United States Patent 8,969,254 (OLIGONUCLEOTIDE ARRAY FOR TISSUE TYPING) - sequence listing, part 11

SEQ ID NO: 241661 - DNA, 27 bp, Artificial Sequence
  Description of Artificial Sequence: Synthetic oligonucleotide
gggctatgcagtgaactcctggtccac

SEQ ID NO: 241662 - DNA, 29 bp, Artificial Sequence
  Description of Artificial Sequence: Synthetic oligonucleotide
ggctatgcagtgaactcctggtccactag

SEQ ID NO: 241663 - DNA, 34 bp, Artificial Sequence
  Description of Artificial Sequence: Synthetic oligonucleotide
gctatgcagtgaactcctggtccactagtaattc

SEQ ID NO: 241664 - DNA, 35 bp, Artificial Sequence
  Description of Artificial Sequence: Synthetic oligonucleotide
ctatgcagtgaactcctggtccactagtaattcag

SEQ ID NO: 241665 - DNA, 35 bp, Artificial Sequence
  Description of Artificial Sequence: Synthetic oligonucleotide
tatgcagtgaactcctggtccactagtaattcagg

SEQ ID NO: 241666 - DNA, 34 bp, Artificial Sequence
  Description of Artificial Sequence: Synthetic oligonucleotide
atgcagtgaactcctggtccactagtaattcagg

SEQ ID NO: 241667 - DNA, 33 bp, Artificial Sequence
  Description of Artificial Sequence: Synthetic oligonucleotide
tgcagtgaactcctggtccactagtaattcagg

SEQ ID NO: 241668 - DNA, 32 bp, Artificial Sequence
  Description of Artificial Sequence: Synthetic oligonucleotide
gcagtgaactcctggtccactagtaattcagg

SEQ ID NO: 241669 - DNA, 35 bp, Artificial Sequence
  Description of Artificial Sequence: Synthetic oligonucleotide
cagtgaactcctggtccactagtaattcaggtatc

SEQ ID NO: 241670 - DNA, 35 bp, Artificial Sequence
  Description of Artificial Sequence: Synthetic oligonucleotide
agtgaactcctggtccactagtaattcaggtatcc

SEQ ID NO: 241671 - DNA, 34 bp, Artificial Sequence
  Description of Artificial Sequence: Synthetic oligonucleotide
gtgaactcctggtccactagtaattcaggtatcc

SEQ ID NO: 241672 - DNA, 35 bp, Artificial Sequence
  Description of Artificial Sequence: Synthetic oligonucleotide
tgaactcctggtccactagtaattcaggtatcctg

SEQ ID NO: 241673 - DNA, 34 bp, Artificial Sequence
  Description of Artificial Sequence: Synthetic oligonucleotide
gaactcctggtccactagtaattcaggtatcctg

SEQ ID NO: 241674 - DNA, 34 bp, Artificial Sequence
  Description of Artificial Sequence: Synthetic oligonucleotide
aactcctggtccactagtaattcaggtatcctgc

SEQ ID NO: 241675 - DNA, 33 bp, Artificial Sequence
  Description of Artificial Sequence: Synthetic oligonucleotide
actcctggtccactagtaattcaggtatcctgc

SEQ ID NO: 241676 - DNA, 32 bp, Artificial Sequence
  Description of Artificial Sequence: Synthetic oligonucleotide
ctcctggtccactagtaattcaggtatcctgc

SEQ ID NO: 241677 - DNA, 33 bp, Artificial Sequence
  Description of Artificial Sequence: Synthetic oligonucleotide
tcctggtccactagtaattcaggtatcctgctg

SEQ ID NO: 241678 - DNA, 32 bp, Artificial Sequence
  Description of Artificial Sequence: Synthetic oligonucleotide
cctggtccactagtaattcaggtatcctgctg

SEQ ID NO: 241679 - DNA, 35 bp, Artificial Sequence
  Description of Artificial Sequence: Synthetic oligonucleotide
ctggtccactagtaattcaggtatcctgctgaaac

SEQ ID NO: 241680 - DNA, 36 bp, Artificial Sequence
  Description of Artificial Sequence: Synthetic oligonucleotide
tggtccactagtaattcaggtatcctgctgaaactg

SEQ ID NO: 241681 - DNA, 35 bp, Artificial Sequence
  Description of Artificial Sequence: Synthetic oligonucleotide
ggtccactagtaattcaggtatcctgctgaaactg

SEQ ID NO: 241682 - DNA, 35 bp, Artificial Sequence
  Description of Artificial Sequence: Synthetic oligonucleotide
gtccactagtaattcaggtatcctgctgaaactgg

SEQ ID NO: 241683 - DNA, 35 bp, Artificial Sequence
  Description of Artificial Sequence: Synthetic oligonucleotide
tccactagtaattcaggtatcctgctgaaactggg

SEQ ID NO: 241684 - DNA, 34 bp, Artificial Sequence
  Description of Artificial Sequence: Synthetic oligonucleotide
ccactagtaattcaggtatcctgctgaaactggg

SEQ ID NO: 241685 - DNA, 37 bp, Artificial Sequence
  Description of Artificial Sequence: Synthetic oligonucleotide
cactagtaattcaggtatcctgctgaaactgggaatc

SEQ ID NO: 241686 - DNA, 37 bp, Artificial Sequence
  Description of Artificial Sequence: Synthetic oligonucleotide
actagtaattcaggtatcctgctgaaactgggaatcc

SEQ ID NO: 241687 - DNA, 36 bp, Artificial Sequence
  Description of Artificial Sequence: Synthetic oligonucleotide
ctagtaattcaggtatcctgctgaaactgggaatcc

SEQ ID NO: 241688 - DNA, 37 bp, Artificial Sequence
  Description of Artificial Sequence: Synthetic oligonucleotide
tagtaattcaggtatcctgctgaaactgggaatccac

SEQ ID NO: 241689 - DNA, 36 bp, Artificial Sequence
  Description of Artificial Sequence: Synthetic oligonucleotide
agtaattcaggtatcctgctgaaactgggaatccac

SEQ ID NO: 241690 - DNA, 35 bp, Artificial Sequence
  Description of Artificial Sequence: Synthetic oligonucleotide
gtaattcaggtatcctgctgaaactgggaatccac

SEQ ID NO: 241691 - DNA, 37 bp, Artificial Sequence
  Description of Artificial Sequence: Synthetic oligonucleotide
taattcaggtatcctgctgaaactgggaatccactac

SEQ ID NO: 241692 - DNA, 36 bp, Artificial Sequence
  Description of Artificial Sequence: Synthetic oligonucleotide
aattcaggtatcctgctgaaactgggaatccactac

SEQ ID NO: 241693 - DNA, 35 bp, Artificial Sequence
  Description of Artificial Sequence: Synthetic oligonucleotide
attcaggtatcctgctgaaactgggaatccactac

SEQ ID NO: 241694 - DNA, 34 bp, Artificial Sequence
  Description of Artificial Sequence: Synthetic oligonucleotide
ttcaggtatcctgctgaaactgggaatccactac

SEQ ID NO: 241695 - DNA, 33 bp, Artificial Sequence
  Description of Artificial Sequence: Synthetic oligonucleotide
tcaggtatcctgctgaaactgggaatccactac

SEQ ID NO: 241696 - DNA, 32 bp, Artificial Sequence
  Description of Artificial Sequence: Synthetic oligonucleotide
caggtatcctgctgaaactgggaatccactac

SEQ ID NO: 241697 - DNA, 35 bp, Artificial Sequence
  Description of Artificial Sequence: Synthetic oligonucleotide
aggtatcctgctgaaactgggaatccactacattg

SEQ ID NO: 241698 - DNA, 34 bp, Artificial Sequence
  Description of Artificial Sequence: Synthetic oligonucleotide
ggtatcctgctgaaactgggaatccactacattg

SEQ ID NO: 241699 - DNA, 34 bp, Artificial Sequence
  Description of Artificial Sequence: Synthetic oligonucleotide
gtatcctgctgaaactgggaatccactacattgg

SEQ ID NO: 241700 - DNA, 35 bp, Artificial Sequence
  Description of Artificial Sequence: Synthetic oligonucleotide
tatcctgctgaaactgggaatccactacattggag

SEQ ID NO: 241701 - DNA, 34 bp, Artificial Sequence
  Description of Artificial Sequence: Synthetic oligonucleotide
atcctgctgaaactgggaatccactacattggag

SEQ ID NO: 241702 - DNA, 33 bp, Artificial Sequence
  Description of Artificial Sequence: Synthetic oligonucleotide
tcctgctgaaactgggaatccactacattggag

SEQ ID NO: 241703 - DNA, 32 bp, Artificial Sequence
  Description of Artificial Sequence: Synthetic oligonucleotide
cctgctgaaactgggaatccactacattggag

SEQ ID NO: 241704 - DNA, 32 bp, Artificial Sequence
  Description of Artificial Sequence: Synthetic oligonucleotide
ctgctgaaactgggaatccactacattggagg

SEQ ID NO: 241705 - DNA, 32 bp, Artificial Sequence
  Description of Artificial Sequence: Synthetic oligonucleotide
tgctgaaactgggaatccactacattggaggg

SEQ ID NO: 241706 - DNA, 31 bp, Artificial Sequence
  Description of Artificial Sequence: Synthetic oligonucleotide
gctgaaactgggaatccactacattggaggg

SEQ ID NO: 241707 - DNA, 31 bp, Artificial Sequence
  Description of Artificial Sequence: Synthetic oligonucleotide
ctgaaactgggaatccactacattggagggc

SEQ ID NO: 241708 - DNA, 32 bp, Artificial Sequence
  Description of Artificial Sequence: Synthetic oligonucleotide
tgaaactgggaatccactacattggagggcag

SEQ ID NO: 241709 - DNA, 31 bp, Artificial Sequence
  Description of Artificial Sequence: Synthetic oligonucleotide
gaaactgggaatccactacattggagggcag

SEQ ID NO: 241710 - DNA, 31 bp, Artificial Sequence
  Description of Artificial Sequence: Synthetic oligonucleotide
aaactgggaatccactacattggagggcagc

SEQ ID NO: 241711 - DNA, 30 bp, Artificial Sequence
  Description of Artificial Sequence: Synthetic oligonucleotide
aactgggaatccactacattggagggcagc

SEQ ID NO: 241712 - DNA, 29 bp, Artificial Sequence
  Description of Artificial Sequence: Synthetic oligonucleotide
actgggaatccactacattggagggcagc

SEQ ID NO: 241713 - DNA, 28 bp, Artificial Sequence
  Description of Artificial Sequence: Synthetic oligonucleotide
ctgggaatccactacattggagggcagc

SEQ ID NO: 241714 - DNA, 29 bp, Artificial Sequence
  Description of Artificial Sequence: Synthetic oligonucleotide
tgggaatccactacattggagggcagctg

SEQ ID NO: 241715 - DNA, 28 bp, Artificial Sequence
  Description of Artificial Sequence: Synthetic oligonucleotide
gggaatccactacattggagggcagctg

SEQ ID NO: 241716 - DNA, 28 bp, Artificial Sequence
  Description of Artificial Sequence: Synthetic oligonucleotide
ggaatccactacattggagggcagctgc

SEQ ID NO: 241717 - DNA, 29 bp, Artificial Sequence
  Description of Artificial Sequence: Synthetic oligonucleotide
gaatccactacattggagggcagctgctg

SEQ ID NO: 241718 - DNA, 30 bp, Artificial Sequence
  Description of Artificial Sequence: Synthetic oligonucleotide
aatccactacattggagggcagctgctgac

SEQ ID NO: 241719 - DNA, 29 bp, Artificial Sequence
  Description of Artificial Sequence: Synthetic oligonucleotide
atccactacattggagggcagctgctgac

SEQ ID NO: 241720 - DNA, 28 bp, Artificial Sequence
  Description of Artificial Sequence: Synthetic oligonucleotide
tccactacattggagggcagctgctgac

SEQ ID NO: 241721 - DNA, 27 bp, Artificial Sequence
  Description of Artificial Sequence: Synthetic oligonucleotide
ccactacattggagggcagctgctgac

SEQ ID NO: 241722 - DNA, 27 bp, Artificial Sequence
  Description of Artificial Sequence: Synthetic oligonucleotide
cactacattggagggcagctgctgacc

SEQ ID NO: 241723 - DNA, 28 bp, Artificial Sequence
  Description of Artificial Sequence: Synthetic oligonucleotide
actacattggagggcagctgctgaccag

SEQ ID NO: 241724 - DNA, 27 bp, Artificial Sequence
  Description of Artificial Sequence: Synthetic oligonucleotide
ctacattggagggcagctgctgaccag

SEQ ID NO: 241725 - DNA, 28 bp, Artificial Sequence
  Description of Artificial Sequence: Synthetic oligonucleotide
tacattggagggcagctgctgaccagtg

SEQ ID NO: 241726 - DNA, 27 bp, Artificial Sequence
  Description of Artificial Sequence: Synthetic oligonucleotide
acattggagggcagctgctgaccagtg

SEQ ID NO: 241727 - DNA, 26 bp, Artificial Sequence
  Description of Artificial Sequence: Synthetic oligonucleotide
cattggagggcagctgctgaccagtg

SEQ ID NO: 241728 - DNA, 26 bp, Artificial Sequence
  Description of Artificial Sequence: Synthetic oligonucleotide
attggagggcagctgctgaccagtgc

SEQ ID NO: 241729 - DNA, 25 bp, Artificial Sequence
  Description of Artificial Sequence: Synthetic oligonucleotide
ttggagggcagctgctgaccagtgc

SEQ ID NO: 241730 - DNA, 24 bp, Artificial Sequence
  Description of Artificial Sequence: Synthetic oligonucleotide
tggagggcagctgctgaccagtgc

SEQ ID NO: 241731 - DNA, 23 bp, Artificial Sequence
  Description of Artificial Sequence: Synthetic oligonucleotide
ggagggcagctgctgaccagtgc

SEQ ID NO: 241732 - DNA, 23 bp, Artificial Sequence
  Description of Artificial Sequence: Synthetic oligonucleotide
gagggcagctgctgaccagtgcg

SEQ ID NO: 241733 - DNA, 23 bp, Artificial Sequence
  Description of Artificial Sequence: Synthetic oligonucleotide
agggcagctgctgaccagtgcgg

SEQ ID NO: 241734 - DNA, 22 bp, Artificial Sequence
  Description of Artificial Sequence: Synthetic oligonucleotide
gggcagctgctgaccagtgcgg

SEQ ID NO: 241735 - DNA, 23 bp, Artificial Sequence
  Description of Artificial Sequence: Synthetic oligonucleotide
ggcagctgctgaccagtgcggct

SEQ ID NO: 241736 - DNA, 26 bp, Artificial Sequence
  Description of Artificial Sequence: Synthetic oligonucleotide
gcagctgctgaccagtgcggctgtaa

SEQ ID NO: 241737 - DNA, 26 bp, Artificial Sequence
  Description of Artificial Sequence: Synthetic oligonucleotide
cagctgctgaccagtgcggctgtaag

SEQ ID NO: 241738 - DNA, 27 bp, Artificial Sequence
  Description of Artificial Sequence: Synthetic oligonucleotide
agctgctgaccagtgcggctgtaagga

SEQ ID NO: 241739 - DNA, 26 bp, Artificial Sequence
  Description of Artificial Sequence: Synthetic oligonucleotide
gctgctgaccagtgcggctgtaagga

SEQ ID NO: 241740 - DNA, 27 bp, Artificial Sequence
  Description of Artificial Sequence: Synthetic oligonucleotide
ctgctgaccagtgcggctgtaaggagt

SEQ ID NO: 241741 - DNA, 27 bp, Artificial Sequence
  Description of Artificial Sequence: Synthetic oligonucleotide
tgctgaccagtgcggctgtaaggagtg

SEQ ID NO: 241742 - DNA, 26 bp, Artificial Sequence
  Description of Artificial Sequence: Synthetic oligonucleotide
gctgaccagtgcggctgtaaggagtg

SEQ ID NO: 241743 - DNA, 26 bp, Artificial Sequence
  Description of Artificial Sequence: Synthetic oligonucleotide
ctgaccagtgcggctgtaaggagtgg

SEQ ID NO: 241744 - DNA, 27 bp, Artificial Sequence
  Description of Artificial Sequence: Synthetic oligonucleotide
tgaccagtgcggctgtaaggagtggga

SEQ ID NO: 241745 - DNA, 27 bp, Artificial Sequence
  Description of Artificial Sequence: Synthetic oligonucleotide
gaccagtgcggctgtaaggagtgggaa

SEQ ID NO: 241746 - DNA, 27 bp, Artificial Sequence
  Description of Artificial Sequence: Synthetic oligonucleotide
accagtgcggctgtaaggagtgggaac

SEQ ID NO: 241747 - DNA, 26 bp, Artificial Sequence
  Description of Artificial Sequence: Synthetic oligonucleotide
ccagtgcggctgtaaggagtgggaac

SEQ ID NO: 241748 - DNA, 27 bp, Artificial Sequence
  Description of Artificial Sequence: Synthetic oligonucleotide
cagtgcggctgtaaggagtgggaacgt

SEQ ID NO: 241749 - DNA, 28 bp, Artificial Sequence
  Description of Artificial Sequence: Synthetic oligonucleotide
agtgcggctgtaaggagtgggaacgttg

SEQ ID NO: 241750 - DNA, 27 bp, Artificial Sequence
  Description of Artificial Sequence: Synthetic oligonucleotide
gtgcggctgtaaggagtgggaacgttg

SEQ ID NO: 241751 - DNA, 28 bp, Artificial Sequence
  Description of Artificial Sequence: Synthetic oligonucleotide
tgcggctgtaaggagtgggaacgttgtc

SEQ ID NO: 241752 - DNA, 27 bp, Artificial Sequence
  Description of Artificial Sequence: Synthetic oligonucleotide
gcggctgtaaggagtgggaacgttgtc

SEQ ID NO: 241753 - DNA, 28 bp, Artificial Sequence
  Description of Artificial Sequence: Synthetic oligonucleotide
cggctgtaaggagtgggaacgttgtcac

SEQ ID NO: 241754 - DNA, 32 bp, Artificial Sequence
  Description of Artificial Sequence: Synthetic oligonucleotide
ggctgtaaggagtgggaacgttgtcacatatg

SEQ ID NO: 241755 - DNA, 34 bp, Artificial Sequence
  Description of Artificial Sequence: Synthetic oligonucleotide
gctgtaaggagtgggaacgttgtcacatatgttc

SEQ ID NO: 241756 - DNA, 35 bp, Artificial Sequence
  Description of Artificial Sequence: Synthetic oligonucleotide
ctgtaaggagtgggaacgttgtcacatatgttctc

SEQ ID NO: 241757 - DNA, 37 bp, Artificial Sequence
  Description of Artificial Sequence: Synthetic oligonucleotide
tgtaaggagtgggaacgttgtcacatatgttctctag

SEQ ID NO: 241758 - DNA, 36 bp, Artificial Sequence
  Description of Artificial Sequence: Synthetic oligonucleotide
gtaaggagtgggaacgttgtcacatatgttctctag

SEQ ID NO: 241759 - DNA, 36 bp, Artificial Sequence
  Description of Artificial Sequence: Synthetic oligonucleotide
taaggagtgggaacgttgtcacatatgttctctagc

SEQ ID NO: 241760 - DNA, 35 bp, Artificial Sequence
  Description of Artificial Sequence: Synthetic oligonucleotide
aaggagtgggaacgttgtcacatatgttctctagc

SEQ ID NO: 241761 - DNA, 34 bp, Artificial Sequence
  Description of Artificial Sequence: Synthetic oligonucleotide
aggagtgggaacgttgtcacatatgttctctagc

SEQ ID NO: 241762 - DNA, 33 bp, Artificial Sequence
  Description of Artificial Sequence: Synthetic oligonucleotide
ggagtgggaacgttgtcacatatgttctctagc

SEQ ID NO: 241763 - DNA, 34 bp, Artificial Sequence
  Description of Artificial Sequence: Synthetic oligonucleotide
gagtgggaacgttgtcacatatgttctctagcag

SEQ ID NO: 241764 - DNA, 36 bp, Artificial Sequence
  Description of Artificial Sequence: Synthetic oligonucleotide
agtgggaacgttgtcacatatgttctctagcagatg

SEQ ID NO: 241765 - DNA, 35 bp, Artificial Sequence
  Description of Artificial Sequence: Synthetic oligonucleotide
gtgggaacgttgtcacatatgttctctagcagatg

SEQ ID NO: 241766 - DNA, 35 bp, Artificial Sequence
  Description of Artificial Sequence: Synthetic oligonucleotide
tgggaacgttgtcacatatgttctctagcagatgc

SEQ ID NO: 241767 - DNA, 34 bp, Artificial Sequence
  Description of Artificial Sequence: Synthetic oligonucleotide
gggaacgttgtcacatatgttctctagcagatgc

SEQ ID NO: 241768 - DNA, 35 bp, Artificial Sequence
  Description of Artificial Sequence: Synthetic oligonucleotide
ggaacgttgtcacatatgttctctagcagatgcag

SEQ ID NO: 241769 - DNA, 37 bp, Artificial Sequence
  Description of Artificial Sequence: Synthetic oligonucleotide
gaacgttgtcacatatgttctctagcagatgcagatc

SEQ ID NO: 241770 - DNA, 38 bp, Artificial Sequence
  Description of Artificial Sequence: Synthetic oligonucleotide
aacgttgtcacatatgttctctagcagatgcagatcac

SEQ ID NO: 241771 - DNA, 37 bp, Artificial Sequence
  Description of Artificial Sequence: Synthetic oligonucleotide
acgttgtcacatatgttctctagcagatgcagatcac

SEQ ID NO: 241772 - DNA, 36 bp, Artificial Sequence
  Description of Artificial Sequence: Synthetic oligonucleotide
cgttgtcacatatgttctctagcagatgcagatcac

SEQ ID NO: 241773 - DNA, 36 bp, Artificial Sequence
  Description of Artificial Sequence: Synthetic oligonucleotide
gttgtcacatatgttctctagcagatgcagatcacc

SEQ ID NO: 241774 - DNA, 36 bp, Artificial Sequence
  Description of Artificial Sequence: Synthetic oligonucleotide
ttgtcacatatgttctctagcagatgcagatcaccc

SEQ ID NO: 241775 - DNA, 35 bp, Artificial Sequence
  Description of Artificial Sequence: Synthetic oligonucleotide
tgtcacatatgttctctagcagatgcagatcaccc

SEQ ID NO: 241776 - DNA, 34 bp, Artificial Sequence
  Description of Artificial Sequence: Synthetic oligonucleotide
gtcacatatgttctctagcagatgcagatcaccc

SEQ ID NO: 241777 - DNA, 35 bp, Artificial Sequence
  Description of Artificial Sequence: Synthetic oligonucleotide
tcacatatgttctctagcagatgcagatcacccag

SEQ ID NO: 241778 - DNA, 34 bp, Artificial Sequence
  Description of Artificial Sequence: Synthetic oligonucleotide
cacatatgttctctagcagatgcagatcacccag

SEQ ID NO: 241779 - DNA, 34 bp, Artificial Sequence
  Description of Artificial Sequence: Synthetic oligonucleotide
acatatgttctctagcagatgcagatcacccagg

SEQ ID NO: 241780 - DNA, 33 bp, Artificial Sequence
  Description of Artificial Sequence: Synthetic oligonucleotide
catatgttctctagcagatgcagatcacccagg

SEQ ID NO: 241781 - DNA, 33 bp, Artificial Sequence
  Description of Artificial Sequence: Synthetic oligonucleotide
atatgttctctagcagatgcagatcacccaggg

SEQ ID NO: 241782 - DNA, 32 bp, Artificial Sequence
  Description of Artificial Sequence: Synthetic oligonucleotide
tatgttctctagcagatgcagatcacccaggg

SEQ ID NO: 241783 - DNA, 31 bp, Artificial Sequence
  Description of Artificial Sequence: Synthetic oligonucleotide
atgttctctagcagatgcagatcacccaggg

SEQ ID NO: 241784 - DNA, 30 bp, Artificial Sequence
  Description of Artificial Sequence: Synthetic oligonucleotide
tgttctctagcagatgcagatcacccaggg

SEQ ID NO: 241785 - DNA, 29 bp, Artificial Sequence
  Description of Artificial Sequence: Synthetic oligonucleotide
gttctctagcagatgcagatcacccaggg

SEQ ID NO: 241786 - DNA, 30 bp, Artificial Sequence
  Description of Artificial Sequence: Synthetic oligonucleotide
ttctctagcagatgcagatcacccagggtg

SEQ ID NO: 241787 - DNA, 29 bp, Artificial Sequence
  Description of Artificial Sequence: Synthetic oligonucleotide
tctctagcagatgcagatcacccagggtg

SEQ ID NO: 241788 - DNA, 28 bp, Artificial Sequence
  Description of Artificial Sequence: Synthetic oligonucleotide
ctctagcagatgcagatcacccagggtg

SEQ ID NO: 241789 - DNA, 29 bp, Artificial Sequence
  Description of Artificial Sequence: Synthetic oligonucleotide
tctagcagatgcagatcacccagggtgtg

SEQ ID NO: 241790 - DNA, 28 bp, Artificial Sequence
  Description of Artificial Sequence: Synthetic oligonucleotide
ctagcagatgcagatcacccagggtgtg

SEQ ID NO: 241791 - DNA, 28 bp, Artificial Sequence
  Description of Artificial Sequence: Synthetic oligonucleotide
tagcagatgcagatcacccagggtgtgg

SEQ ID NO: 241792 - DNA, 27 bp, Artificial Sequence
  Description of Artificial Sequence: Synthetic oligonucleotide
agcagatgcagatcacccagggtgtgg

SEQ ID NO: 241793 - DNA, 27 bp, Artificial Sequence
  Description of Artificial Sequence: Synthetic oligonucleotide
gcagatgcagatcacccagggtgtgga

SEQ ID NO: 241794 - DNA, 27 bp, Artificial Sequence
  Description of Artificial Sequence: Synthetic oligonucleotide
cagatgcagatcacccagggtgtggag

SEQ ID NO: 241795 - DNA, 27 bp, Artificial Sequence
  Description of Artificial Sequence: Synthetic oligonucleotide
agatgcagatcacccagggtgtggagg

SEQ ID NO: 241796 - DNA, 27 bp, Artificial Sequence
  Description of Artificial Sequence: Synthetic oligonucleotide
gatgcagatcacccagggtgtggaggt

SEQ ID NO: 241797 - DNA, 28 bp, Artificial Sequence
  Description of Artificial Sequence: Synthetic oligonucleotide
atgcagatcacccagggtgtggaggttc

SEQ ID NO: 241798 - DNA, 27 bp, Artificial Sequence
  Description of Artificial Sequence: Synthetic oligonucleotide
tgcagatcacccagggtgtggaggttc

SEQ ID NO: 241799 - DNA, 27 bp, Artificial Sequence
  Description of Artificial Sequence: Synthetic oligonucleotide
gcagatcacccagggtgtggaggttct

SEQ ID NO: 241800 - DNA, 27 bp, Artificial Sequence
  Description of Artificial Sequence: Synthetic oligonucleotide
cagatcacccagggtgtggaggttctg

SEQ ID NO: 241801 - DNA, 27 bp, Artificial Sequence
  Description of Artificial Sequence: Synthetic oligonucleotide
agatcacccagggtgtggaggttctgc

SEQ ID NO: 241802 - DNA, 27 bp, Artificial Sequence
  Description of Artificial Sequence: Synthetic oligonucleotide
gatcacccagggtgtggaggttctgct

SEQ ID NO: 241803 - DNA, 27 bp, Artificial Sequence
  Description of Artificial Sequence: Synthetic oligonucleotide
atcacccagggtgtggaggttctgctc

SEQ ID NO: 241804 - DNA, 27 bp, Artificial Sequence
  Description of Artificial Sequence: Synthetic oligonucleotide
tcacccagggtgtggaggttctgctct

SEQ ID NO: 241805 - DNA, 26 bp, Artificial Sequence
  Description of Artificial Sequence: Synthetic oligonucleotide
cacccagggtgtggaggttctgctct

SEQ ID NO: 241806 - DNA, 26 bp, Artificial Sequence
  Description of Artificial Sequence: Synthetic oligonucleotide
acccagggtgtggaggttctgctctc

SEQ ID NO: 241807 - DNA, 25 bp, Artificial Sequence
  Description of Artificial Sequence: Synthetic oligonucleotide
cccagggtgtggaggttctgctctc

SEQ ID NO: 241808 - DNA, 27 bp, Artificial Sequence
  Description of Artificial Sequence: Synthetic oligonucleotide
ccagggtgtggaggttctgctctcctt

SEQ ID NO: 241809 - DNA, 27 bp, Artificial Sequence
  Description of Artificial Sequence: Synthetic oligonucleotide
cagggtgtggaggttctgctctccttc

SEQ ID NO: 241810 - DNA, 29 bp, Artificial Sequence
  Description of Artificial Sequence: Synthetic oligonucleotide
agggtgtggaggttctgctctccttctac

SEQ ID NO: 241811 - DNA, 28 bp, Artificial Sequence
  Description of Artificial Sequence: Synthetic oligonucleotide
gggtgtggaggttctgctctccttctac

SEQ ID NO: 241812 - DNA, 28 bp, Artificial Sequence
  Description of Artificial Sequence: Synthetic oligonucleotide
ggtgtggaggttctgctctccttctacc

SEQ ID NO: 241813 - DNA, 28 bp, Artificial Sequence
  Description of Artificial Sequence: Synthetic oligonucleotide
gtgtggaggttctgctctccttctaccc

SEQ ID NO: 241814 - DNA, 28 bp, Artificial Sequence
  Description of Artificial Sequence: Synthetic oligonucleotide
tgtggaggttctgctctccttctacccc

SEQ ID NO: 241815 - DNA, 27 bp, Artificial Sequence
  Description of Artificial Sequence: Synthetic oligonucleotide
gtggaggttctgctctccttctacccc

SEQ ID NO: 241816 - DNA, 28 bp, Artificial Sequence
  Description of Artificial Sequence: Synthetic oligonucleotide
tggaggttctgctctccttctaccccac

SEQ ID NO: 241817 - DNA, 27 bp, Artificial Sequence
  Description of Artificial Sequence: Synthetic oligonucleotide
ggaggttctgctctccttctaccccac

SEQ ID NO: 241818 - DNA, 28 bp, Artificial Sequence
  Description of Artificial Sequence: Synthetic oligonucleotide
gaggttctgctctccttctaccccacag

SEQ ID NO: 241819 - DNA, 30 bp, Artificial Sequence
  Description of Artificial Sequence: Synthetic oligonucleotide
aggttctgctctccttctaccccacagtac

SEQ ID NO: 241820 - DNA, 29 bp, Artificial Sequence
  Description of Artificial Sequence: Synthetic oligonucleotide
ggttctgctctccttctaccccacagtac

SEQ ID NO: 241821 - DNA, 30 bp, Artificial Sequence
  Description of Artificial Sequence: Synthetic oligonucleotide
gttctgctctccttctaccccacagtacag

SEQ ID NO: 241822 - DNA, 32 bp, Artificial Sequence
  Description of Artificial Sequence: Synthetic oligonucleotide
ttctgctctccttctaccccacagtacagaac

SEQ ID NO: 241823 - DNA, 31 bp, Artificial Sequence
  Description of Artificial Sequence: Synthetic oligonucleotide
tctgctctccttctaccccacagtacagaac

SEQ ID NO: 241824 - DNA, 30 bp, Artificial Sequence
  Description of Artificial Sequence: Synthetic oligonucleotide
ctgctctccttctaccccacagtacagaac

SEQ ID NO: 241825 - DNA, 30 bp, Artificial Sequence
  Description of Artificial Sequence: Synthetic oligonucleotide
tgctctccttctaccccacagtacagaacg

SEQ ID NO: 241826 - DNA, 29 bp, Artificial Sequence
  Description of Artificial Sequence: Synthetic oligonucleotide
gctctccttctaccccacagtacagaacg

SEQ ID NO: 241827 - DNA, 29 bp, Artificial Sequence
  Description of Artificial Sequence: Synthetic oligonucleotide
ctctccttctaccccacagtacagaacgc

SEQ ID NO: 241828 - DNA, 30 bp, Artificial Sequence
  Description of Artificial Sequence: Synthetic oligonucleotide
tctccttctaccccacagtacagaacgctg

SEQ ID NO: 241829 - DNA, 29 bp, Artificial Sequence
  Description of Artificial Sequence: Synthetic oligonucleotide
ctccttctaccccacagtacagaacgctg

SEQ ID NO: 241830 - DNA, 30 bp, Artificial Sequence
  Description of Artificial Sequence: Synthetic oligonucleotide
tccttctaccccacagtacagaacgctgtg

SEQ ID NO: 241831 - DNA, 29 bp, Artificial Sequence
  Description of Artificial Sequence: Synthetic oligonucleotide
ccttctaccccacagtacagaacgctgtg

SEQ ID NO: 241832 - DNA, 29 bp, Artificial Sequence
  Description of Artificial Sequence: Synthetic oligonucleotide
cttctaccccacagtacagaacgctgtgg

SEQ ID NO: 241833 - DNA, 29 bp, Artificial Sequence
  Description of Artificial Sequence: Synthetic oligonucleotide
ttctaccccacagtacagaacgctgtggg

SEQ ID NO: 241834 - DNA, 28 bp, Artificial Sequence
  Description of Artificial Sequence: Synthetic oligonucleotide
tctaccccacagtacagaacgctgtggg

SEQ ID NO: 241835 - DNA, 27 bp, Artificial Sequence
  Description of Artificial Sequence: Synthetic oligonucleotide
ctaccccacagtacagaacgctgtggg

SEQ ID NO: 241836 - DNA, 27 bp, Artificial Sequence
  Description of Artificial Sequence: Synthetic oligonucleotide
taccccacagtacagaacgctgtgggc

SEQ ID NO: 241837 - DNA, 27 bp, Artificial Sequence
  Description of Artificial Sequence: Synthetic oligonucleotide
accccacagtacagaacgctgtgggca

SEQ ID NO: 241838 - DNA, 26 bp, Artificial Sequence
  Description of Artificial Sequence: Synthetic oligonucleotide
ccccacagtacagaacgctgtgggca

SEQ ID NO: 241839 - DNA, 26 bp, Artificial Sequence
  Description of Artificial Sequence: Synthetic oligonucleotide
cccacagtacagaacgctgtgggcac

SEQ ID NO: 241840 - DNA, 27 bp, Artificial Sequence
  Description of Artificial Sequence: Synthetic oligonucleotide
ccacagtacagaacgctgtgggcacct

SEQ ID NO: 241841 - DNA, 27 bp, Artificial Sequence
  Description of Artificial Sequence: Synthetic oligonucleotide
cacagtacagaacgctgtgggcacctc

SEQ ID NO: 241842 - DNA, 28 bp, Artificial Sequence
  Description of Artificial Sequence: Synthetic oligonucleotide
acagtacagaacgctgtgggcacctcag

SEQ ID NO: 241843 - DNA, 27 bp, Artificial Sequence
  Description of Artificial Sequence: Synthetic oligonucleotide
cagtacagaacgctgtgggcacctcag

SEQ ID NO: 241844 - DNA, 28 bp, Artificial Sequence
  Description of Artificial Sequence: Synthetic oligonucleotide
agtacagaacgctgtgggcacctcagag

SEQ ID NO: 241845 - DNA, 27 bp, Artificial Sequence
  Description of Artificial Sequence: Synthetic oligonucleotide
gtacagaacgctgtgggcacctcagag

SEQ ID NO: 241846 - DNA, 36 bp, Artificial Sequence
  Description of Artificial Sequence: Synthetic oligonucleotide
tacagaacgctgtgggcacctcagagataatatttg

SEQ ID NO: 241847 - DNA, 35 bp, Artificial Sequence
  Description of Artificial Sequence: Synthetic oligonucleotide
acagaacgctgtgggcacctcagagataatatttg

SEQ ID NO: 241848 - DNA, 34 bp, Artificial Sequence
  Description of Artificial Sequence: Synthetic oligonucleotide
cagaacgctgtgggcacctcagagataatatttg

SEQ ID NO: 241849 - DNA, 35 bp, Artificial Sequence
  Description of Artificial Sequence: Synthetic oligonucleotide
agaacgctgtgggcacctcagagataatatttgac

SEQ ID NO: 241850 - DNA, 34 bp, Artificial Sequence
  Description of Artificial Sequence: Synthetic oligonucleotide
gaacgctgtgggcacctcagagataatatttgac

SEQ ID NO: 241851 - DNA, 36 bp, Artificial Sequence
  Description of Artificial Sequence: Synthetic oligonucleotide
aacgctgtgggcacctcagagataatatttgactac

SEQ ID NO: 241852 - DNA, 35 bp, Artificial Sequence
  Description of Artificial Sequence: Synthetic oligonucleotide
acgctgtgggcacctcagagataatatttgactac

SEQ ID NO: 241853 - DNA, 34 bp, Artificial Sequence
  Description of Artificial Sequence: Synthetic oligonucleotide
cgctgtgggcacctcagagataatatttgactac

SEQ ID NO: 241854 - DNA, 34 bp, Artificial Sequence
  Description of Artificial Sequence: Synthetic oligonucleotide
gctgtgggcacctcagagataatatttgactacc

SEQ ID NO: 241855 - DNA, 35 bp, Artificial Sequence
  Description of Artificial Sequence: Synthetic oligonucleotide
ctgtgggcacctcagagataatatttgactacctg

SEQ ID NO: 241856 - DNA, 35 bp, Artificial Sequence
  Description of Artificial Sequence: Synthetic oligonucleotide
tgtgggcacctcagagataatatttgactacctgg

SEQ ID NO: 241857 - DNA, 34 bp, Artificial Sequence
  Description of Artificial Sequence: Synthetic oligonucleotide
gtgggcacctcagagataatatttgactacctgg

SEQ ID NO: 241858 - DNA, 35 bp, Artificial Sequence
  Description of Artificial Sequence: Synthetic oligonucleotide
tgggcacctcagagataatatttgactacctggac

SEQ ID NO: 241859 - DNA, 34 bp, Artificial Sequence
  Description of Artificial Sequence: Synthetic oligonucleotide
gggcacctcagagataatatttgactacctggac

SEQ ID NO: 241860 - DNA, 34 bp, Artificial Sequence
  Description of Artificial Sequence: Synthetic oligonucleotide
ggcacctcagagataatatttgactacctggacg

SEQ ID NO: 241861 - DNA, 34 bp, Artificial Sequence
  Description of Artificial Sequence: Synthetic oligonucleotide
gcacctcagagataatatttgactacctggacgg

SEQ ID NO: 241862 - DNA, 34 bp, Artificial Sequence
  Description of Artificial Sequence: Synthetic oligonucleotide
cacctcagagataatatttgactacctggacggc

SEQ ID NO: 241863 - DNA, 35 bp, Artificial Sequence
  Description of Artificial Sequence: Synthetic oligonucleotide
acctcagagataatatttgactacctggacggcac

SEQ ID NO: 241864 - DNA, 34 bp, Artificial Sequence
  Description of Artificial Sequence: Synthetic oligonucleotide
cctcagagataatatttgactacctggacggcac

SEQ ID NO: 241865 - DNA, 34 bp, Artificial Sequence
  Description of Artificial Sequence: Synthetic oligonucleotide
ctcagagataatatttgactacctggacggcacc

SEQ ID NO: 241866 - DNA, 34 bp, Artificial Sequence
  Description of Artificial Sequence: Synthetic oligonucleotide
tcagagataatatttgactacctggacggcaccc

SEQ ID NO: 241867 - DNA, 33 bp, Artificial Sequence
  Description of Artificial Sequence: Synthetic oligonucleotide
cagagataatatttgactacctggacggcaccc

SEQ ID NO: 241868 - DNA, 33 bp, Artificial Sequence
  Description of Artificial Sequence: Synthetic oligonucleotide
agagataatatttgactacctggacggcacccc

SEQ ID NO: 241869 - DNA, 32 bp, Artificial Sequence
  Description of Artificial Sequence: Synthetic oligonucleotide
gagataatatttgactacctggacggcacccc

SEQ ID NO: 241870 - DNA, 33 bp, Artificial Sequence
  Description of Artificial Sequence: Synthetic oligonucleotide
agataatatttgactacctggacggcacccctc

SEQ ID NO: 241871 - DNA, 32 bp, Artificial Sequence
  Description of Artificial Sequence: Synthetic oligonucleotide
gataatatttgactacctggacggcacccctc

SEQ ID NO: 241872 - DNA, 32 bp, Artificial Sequence
  Description of Artificial Sequence: Synthetic oligonucleotide
ataatatttgactacctggacggcacccctcc

SEQ ID NO: 241873 - DNA, 31 bp, Artificial Sequence
  Description of Artificial Sequence: Synthetic oligonucleotide
taatatttgactacctggacggcacccctcc

SEQ ID NO: 241874 - DNA, 30 bp, Artificial Sequence
  Description of Artificial Sequence: Synthetic oligonucleotide
aatatttgactacctggacggcacccctcc

SEQ ID NO: 241875 - DNA, 29 bp, Artificial Sequence
  Description of Artificial Sequence: Synthetic oligonucleotide
atatttgactacctggacggcacccctcc

SEQ ID NO: 241876 - DNA, 28 bp, Artificial Sequence
  Description of Artificial Sequence: Synthetic oligonucleotide
tatttgactacctggacggcacccctcc

SEQ ID NO: 241877 - DNA, 27 bp, Artificial Sequence
  Description of Artificial Sequence: Synthetic oligonucleotide
atttgactacctggacggcacccctcc

SEQ ID NO: 241878 - DNA, 26 bp, Artificial Sequence
  Description of Artificial Sequence: Synthetic oligonucleotide
tttgactacctggacggcacccctcc

SEQ ID NO: 241879 - DNA, 25 bp, Artificial Sequence
  Description of Artificial Sequence: Synthetic oligonucleotide
ttgactacctggacggcacccctcc

SEQ ID NO: 241880 - DNA, 24 bp, Artificial Sequence
  Description of Artificial Sequence: Synthetic oligonucleotide
tgactacctggacggcacccctcc

SEQ ID NO: 241881 - DNA, 23 bp, Artificial Sequence
  Description of Artificial Sequence: Synthetic oligonucleotide
gactacctggacggcacccctcc

SEQ ID NO: 241882 - DNA, 24 bp, Artificial Sequence
  Description of Artificial Sequence: Synthetic oligonucleotide
actacctggacggcacccctccct

SEQ ID NO: 241883 - DNA, 23 bp, Artificial Sequence
  Description of Artificial Sequence: Synthetic oligonucleotide
ctacctggacggcacccctccct

SEQ ID NO: 241884 - DNA, 23 bp, Artificial Sequence
  Description of Artificial Sequence: Synthetic oligonucleotide
tacctggacggcacccctccctg

SEQ ID NO: 241885 - DNA, 22 bp, Artificial Sequence
  Description of Artificial Sequence: Synthetic oligonucleotide
acctggacggcacccctccctg

SEQ ID NO: 241886 - DNA, 21 bp, Artificial Sequence
  Description of Artificial Sequence: Synthetic oligonucleotide
cctggacggcacccctccctg

SEQ ID NO: 241887 - DNA, 21 bp, Artificial Sequence
  Description of Artificial Sequence: Synthetic oligonucleotide
ctggacggcacccctccctgc

SEQ ID NO: 241888 - DNA, 21 bp, Artificial Sequence
  Description of Artificial Sequence: Synthetic oligonucleotide
tggacggcacccctccctgcc

SEQ ID NO: 241889 - DNA, 20 bp, Artificial Sequence
  Description of Artificial Sequence: Synthetic oligonucleotide
ggacggcacccctccctgcc

SEQ ID NO: 241890 - DNA, 21 bp, Artificial Sequence
  Description of Artificial Sequence: Synthetic oligonucleotide
gacggcacccctccctgccca

SEQ ID NO: 241891 - DNA, 21 bp, Artificial Sequence
  Description of Artificial Sequence: Synthetic oligonucleotide
acggcacccctccctgcccac

SEQ ID NO: 241892 - DNA, 20 bp, Artificial Sequence
  Description of Artificial Sequence: Synthetic oligonucleotide
cggcacccctccctgcccac

SEQ ID NO: 241893 - DNA, 20 bp, Artificial Sequence
  Description of Artificial Sequence: Synthetic oligonucleotide
ggcacccctccctgcccacc

SEQ ID NO: 241894 - DNA, 21 bp, Artificial Sequence
  Description of Artificial Sequence: Synthetic oligonucleotide
gcacccctccctgcccaccga

SEQ ID NO: 241895 - DNA, 22 bp, Artificial Sequence
  Description of Artificial Sequence: Synthetic oligonucleotide
cacccctccctgcccaccgagt

SEQ ID NO: 241896 - DNA, 22 bp, Artificial Sequence
  Description of Artificial Sequence: Synthetic oligonucleotide
acccctccctgcccaccgagtg

SEQ ID NO: 241897 - DNA, 21 bp, Artificial Sequence
  Description of Artificial Sequence: Synthetic oligonucleotide
cccctccctgcccaccgagtg

SEQ ID NO: 241898 - DNA, 22 bp, Artificial Sequence
  Description of Artificial Sequence: Synthetic oligonucleotide
ccctccctgcccaccgagtggt

SEQ ID NO: 241899 - DNA, 23 bp, Artificial Sequence
  Description of Artificial Sequence: Synthetic oligonucleotide
cctccctgcccaccgagtggtct

SEQ ID NO: 241900 - DNA, 25 bp, Artificial Sequence
  Description of Artificial Sequence: Synthetic oligonucleotide
ctccctgcccaccgagtggtctgat

SEQ ID NO: 241901 - DNA, 26 bp, Artificial Sequence
  Description of Artificial Sequence: Synthetic oligonucleotide
tccctgcccaccgagtggtctgatga

SEQ ID NO: 241902 - DNA, 25 bp, Artificial Sequence
  Description of Artificial Sequence: Synthetic oligonucleotide
ccctgcccaccgagtggtctgatga

SEQ ID NO: 241903 - DNA, 26 bp, Artificial Sequence
  Description of Artificial Sequence: Synthetic oligonucleotide
cctgcccaccgagtggtctgatgact

SEQ ID NO: 241904 - DNA, 26 bp, Artificial Sequence
  Description of Artificial Sequence: Synthetic oligonucleotide
ctgcccaccgagtggtctgatgactc

SEQ ID NO: 241905 - DNA, 26 bp, Artificial Sequence
  Description of Artificial Sequence: Synthetic oligonucleotide
tgcccaccgagtggtctgatgactcc

SEQ ID NO: 241906 - DNA, 25 bp, Artificial Sequence
  Description of Artificial Sequence: Synthetic oligonucleotide
gcccaccgagtggtctgatgactcc

SEQ ID NO: 241907 - DNA, 27 bp, Artificial Sequence
  Description of Artificial Sequence: Synthetic oligonucleotide
cccaccgagtggtctgatgactcccta

SEQ ID NO: 241908 - DNA, 28 bp, Artificial Sequence
  Description of Artificial Sequence: Synthetic oligonucleotide
ccaccgagtggtctgatgactccctaac

SEQ ID NO: 241909 - DNA, 29 bp, Artificial Sequence
  Description of Artificial Sequence: Synthetic oligonucleotide
caccgagtggtctgatgactccctaacac

SEQ ID NO: 241910 - DNA, 31 bp, Artificial Sequence
  Description of Artificial Sequence: Synthetic oligonucleotide
accgagtggtctgatgactccctaacacttg

SEQ ID NO: 241911 - DNA, 30 bp, Artificial Sequence
  Description of Artificial Sequence: Synthetic oligonucleotide
ccgagtggtctgatgactccctaacacttg

SEQ ID NO: 241912 - DNA, 30 bp, Artificial Sequence
  Description of Artificial Sequence: Synthetic oligonucleotide
cgagtggtctgatgactccctaacacttgg

SEQ ID NO: 241913 - DNA, 31 bp, Artificial Sequence
  Description of Artificial Sequence: Synthetic oligonucleotide
gagtggtctgatgactccctaacacttggac

SEQ ID NO: 241914 - DNA, 31 bp, Artificial Sequence
  Description of Artificial Sequence: Synthetic oligonucleotide
agtggtctgatgactccctaacacttggacg

SEQ ID NO: 241915 - DNA, 30 bp, Artificial Sequence
  Description of Artificial Sequence: Synthetic oligonucleotide
gtggtctgatgactccctaacacttggacg

SEQ ID NO: 241916 - DNA, 30 bp, Artificial Sequence
  Description of Artificial Sequence: Synthetic oligonucleotide
tggtctgatgactccctaacacttggacgg

SEQ ID NO: 241917 - DNA, 29 bp, Artificial Sequence
  Description of Artificial Sequence: Synthetic oligonucleotide
ggtctgatgactccctaacacttggacgg

SEQ ID NO: 241918 - DNA, 29 bp, Artificial Sequence
  Description of Artificial Sequence: Synthetic oligonucleotide
gtctgatgactccctaacacttggacggc

SEQ ID NO: 241919 - DNA, 29 bp, Artificial Sequence
  Description of Artificial Sequence: Synthetic oligonucleotide
tctgatgactccctaacacttggacggcc

SEQ ID NO: 241920 - DNA, 28 bp, Artificial Sequence
  Description of Artificial Sequence: Synthetic oligonucleotide
ctgatgactccctaacacttggacggcc

SEQ ID NO: 241921 - DNA, 30 bp, Artificial Sequence
  Description of Artificial Sequence: Synthetic oligonucleotide
tgatgactccctaacacttggacggccttg

SEQ ID NO: 241922 - DNA, 29 bp, Artificial Sequence
  Description of Artificial Sequence: Synthetic oligonucleotide
gatgactccctaacacttggacggccttg

SEQ ID NO: 241923 - DNA, 30 bp, Artificial Sequence
  Description of Artificial Sequence: Synthetic oligonucleotide
atgactccctaacacttggacggccttgtc

SEQ ID NO: 241924 - DNA, 29 bp, Artificial Sequence
  Description of Artificial Sequence: Synthetic oligonucleotide
tgactccctaacacttggacggccttgtc

SEQ ID NO: 241925 - DNA, 28 bp, Artificial Sequence
  Description of Artificial Sequence: Synthetic oligonucleotide
gactccctaacacttggacggccttgtc

SEQ ID NO: 241926 - DNA, 28 bp, Artificial Sequence
  Description of Artificial Sequence: Synthetic oligonucleotide
actccctaacacttggacggccttgtcg

SEQ ID NO: 241927 - DNA, 27 bp, Artificial Sequence
  Description of Artificial Sequence: Synthetic oligonucleotide
ctccctaacacttggacggccttgtcg

SEQ ID NO: 241928 - DNA, 28 bp, Artificial Sequence
  Description of Artificial Sequence: Synthetic oligonucleotide
tccctaacacttggacggccttgtcgag

SEQ ID NO: 241929 - DNA, 27 bp, Artificial Sequence
  Description of Artificial Sequence: Synthetic oligonucleotide
ccctaacacttggacggccttgtcgag

SEQ ID NO: 241930 - DNA, 29 bp, Artificial Sequence
  Description of Artificial Sequence: Synthetic oligonucleotide
cctaacacttggacggccttgtcgagttc

SEQ ID NO: 241931 - DNA, 29 bp, Artificial Sequence
  Description of Artificial Sequence: Synthetic oligonucleotide
ctaacacttggacggccttgtcgagttcc

SEQ ID NO: 241932 - DNA, 31 bp, Artificial Sequence
  Description of Artificial Sequence: Synthetic oligonucleotide
taacacttggacggccttgtcgagttccaag

SEQ ID NO: 241933 - DNA, 30 bp, Artificial Sequence
  Description of Artificial Sequence: Synthetic oligonucleotide
aacacttggacggccttgtcgagttccaag

SEQ ID NO: 241934 - DNA, 29 bp, Artificial Sequence
  Description of Artificial Sequence: Synthetic oligonucleotide
acacttggacggccttgtcgagttccaag

SEQ ID NO: 241935 - DNA, 28 bp, Artificial Sequence
  Description of Artificial Sequence: Synthetic oligonucleotide
cacttggacggccttgtcgagttccaag

SEQ ID NO: 241936 - DNA, 30 bp, Artificial Sequence
  Description of Artificial Sequence: Synthetic oligonucleotide
acttggacggccttgtcgagttccaagttg

SEQ ID NO: 241937 - DNA, 29 bp, Artificial Sequence
  Description of Artificial Sequence: Synthetic oligonucleotide
cttggacggccttgtcgagttccaagttg

SEQ ID NO: 241938 - DNA, 30 bp, Artificial Sequence
  Description of Artificial Sequence: Synthetic oligonucleotide
ttggacggccttgtcgagttccaagttgtc

SEQ ID NO: 241939 - DNA, 29 bp, Artificial Sequence
  Description of Artificial Sequence: Synthetic oligonucleotide
tggacggccttgtcgagttccaagttgtc

SEQ ID NO: 241940 - DNA, 28 bp, Artificial Sequence
  Description of Artificial Sequence: Synthetic oligonucleotide
ggacggccttgtcgagttccaagttgtc

SEQ ID NO: 241941 - DNA, 29 bp, Artificial Sequence
  Description of Artificial Sequence: Synthetic oligonucleotide
gacggccttgtcgagttccaagttgtctc

SEQ ID NO: 241942 - DNA, 29 bp, Artificial Sequence
  Description of Artificial Sequence: Synthetic oligonucleotide
acggccttgtcgagttccaagttgtctcc

SEQ ID NO: 241943 - DNA, 28 bp, Artificial Sequence
  Description of Artificial Sequence: Synthetic oligonucleotide
cggccttgtcgagttccaagttgtctcc

SEQ ID NO: 241944 - DNA, 31 bp, Artificial Sequence
  Description of Artificial Sequence: Synthetic oligonucleotide
ggccttgtcgagttccaagttgtctccttag

SEQ ID NO: 241945 - DNA, 31 bp, Artificial Sequence
  Description of Artificial Sequence: Synthetic oligonucleotide
gccttgtcgagttccaagttgtctccttagc

SEQ ID NO: 241946 - DNA, 31 bp, Artificial Sequence
  Description of Artificial Sequence: Synthetic oligonucleotide
ccttgtcgagttccaagttgtctccttagcc

SEQ ID NO: 241947 - DNA, 33 bp, Artificial Sequence
  Description of Artificial Sequence: Synthetic oligonucleotide
cttgtcgagttccaagttgtctccttagcctac

SEQ ID NO: 241948 - DNA, 33 bp, Artificial Sequence
  Description of Artificial Sequence: Synthetic oligonucleotide
ttgtcgagttccaagttgtctccttagcctacc

SEQ ID NO: 241949 - DNA, 32 bp, Artificial Sequence
  Description of Artificial Sequence: Synthetic oligonucleotide
tgtcgagttccaagttgtctccttagcctacc

SEQ ID NO: 241950 - DNA, 31 bp, Artificial Sequence
  Description of Artificial Sequence: Synthetic oligonucleotide
gtcgagttccaagttgtctccttagcctacc

SEQ ID NO: 241951 - DNA, 31 bp, Artificial Sequence
  Description of Artificial Sequence: Synthetic oligonucleotide
tcgagttccaagttgtctccttagcctaccc

SEQ ID NO: 241952 - DNA, 30 bp, Artificial Sequence
  Description of Artificial Sequence: Synthetic oligonucleotide
cgagttccaagttgtctccttagcctaccc

SEQ ID NO: 241953 - DNA, 33 bp, Artificial Sequence
  Description of Artificial Sequence: Synthetic oligonucleotide
gagttccaagttgtctccttagcctacccatac

SEQ ID NO: 241954 - DNA, 33 bp, Artificial Sequence
  Description of Artificial Sequence: Synthetic oligonucleotide
agttccaagttgtctccttagcctacccatacc

SEQ ID NO: 241955 - DNA, 32 bp, Artificial Sequence
  Description of Artificial Sequence: Synthetic oligonucleotide
gttccaagttgtctccttagcctacccatacc

SEQ ID NO: 241956 - DNA, 32 bp, Artificial Sequence
  Description of Artificial Sequence: Synthetic oligonucleotide
ttccaagttgtctccttagcctacccataccg

SEQ ID NO: 241957 - DNA, 31 bp, Artificial Sequence
  Description of Artificial Sequence: Synthetic oligonucleotide
tccaagttgtctccttagcctacccataccg

SEQ ID NO: 241958 - DNA, 30 bp, Artificial Sequence
  Description of Artificial Sequence: Synthetic oligonucleotide
ccaagttgtctccttagcctacccataccg

SEQ ID NO: 241959 - DNA, 30 bp, Artificial Sequence
  Description of Artificial Sequence: Synthetic oligonucleotide
caagttgtctccttagcctacccataccgc

SEQ ID NO: 241960 - DNA, 30 bp, Artificial Sequence
  Description of Artificial Sequence: Synthetic oligonucleotide
aagttgtctccttagcctacccataccgcc

SEQ ID NO: 241961 - DNA, 29 bp, Artificial Sequence
  Description of Artificial Sequence: Synthetic oligonucleotide
agttgtctccttagcctacccataccgcc

SEQ ID NO: 241962 - DNA, 28 bp, Artificial Sequence
  Description of Artificial Sequence: Synthetic oligonucleotide
gttgtctccttagcctacccataccgcc

SEQ ID NO: 241963 - DNA, 28 bp, Artificial Sequence
  Description of Artificial Sequence: Synthetic oligonucleotide
ttgtctccttagcctacccataccgccc

SEQ ID NO: 241964 - DNA, 27 bp, Artificial Sequence
  Description of Artificial Sequence: Synthetic oligonucleotide
tgtctccttagcctacccataccgccc

SEQ ID NO: 241965 - DNA, 27 bp, Artificial Sequence
  Description of Artificial Sequence: Synthetic oligonucleotide
gtctccttagcctacccataccgccca

SEQ ID NO: 241966 - DNA, 27 bp, Artificial Sequence
  Description of Artificial Sequence: Synthetic oligonucleotide
tctccttagcctacccataccgcccag

SEQ ID NO: 241967 - DNA, 27 bp, Artificial Sequence
  Description of Artificial Sequence: Synthetic oligonucleotide
ctccttagcctacccataccgcccagt

SEQ ID NO: 241968 - DNA, 30 bp, Artificial Sequence
  Description of Artificial Sequence: Synthetic oligonucleotide
tccttagcctacccataccgcccagttatc

SEQ ID NO: 241969 - DNA, 29 bp, Artificial Sequence
  Description of Artificial Sequence: Synthetic oligonucleotide
ccttagcctacccataccgcccagttatc

SEQ ID NO: 241970 - DNA, 32 bp, Artificial Sequence
  Description of Artificial Sequence: Synthetic oligonucleotide
cttagcctacccataccgcccagttatcttag

SEQ ID NO: 241971 - DNA, 33 bp, Artificial Sequence
  Description of Artificial Sequence: Synthetic oligonucleotide
ttagcctacccataccgcccagttatcttagtc

SEQ ID NO: 241972 - DNA, 32 bp, Artificial Sequence
  Description of Artificial Sequence: Synthetic oligonucleotide
tagcctacccataccgcccagttatcttagtc

SEQ ID NO: 241973 - DNA, 31 bp, Artificial Sequence
  Description of Artificial Sequence: Synthetic oligonucleotide
agcctacccataccgcccagttatcttagtc

SEQ ID NO: 241974 - DNA, 30 bp, Artificial Sequence
  Description of Artificial Sequence: Synthetic oligonucleotide
gcctacccataccgcccagttatcttagtc

SEQ ID NO: 241975 - DNA, 30 bp, Artificial Sequence
  Description of Artificial Sequence: Synthetic oligonucleotide
cctacccataccgcccagttatcttagtcc

SEQ ID NO: 241976 - DNA, 32 bp, Artificial Sequence
  Description of Artificial Sequence: Synthetic oligonucleotide
ctacccataccgcccagttatcttagtcctac

SEQ ID NO: 241977 - DNA, 33 bp, Artificial Sequence
  Description of Artificial Sequence: Synthetic oligonucleotide
tacccataccgcccagttatcttagtcctacag

SEQ ID NO: 241978 - DNA, 32 bp, Artificial Sequence
  Description of Artificial Sequence: Synthetic oligonucleotide
acccataccgcccagttatcttagtcctacag

SEQ ID NO: 241979 - DNA, 31 bp, Artificial Sequence
  Description of Artificial Sequence: Synthetic oligonucleotide
cccataccgcccagttatcttagtcctacag

SEQ ID NO: 241980 - DNA, 31 bp, Artificial Sequence
  Description of Artificial Sequence: Synthetic oligonucleotide
ccataccgcccagttatcttagtcctacagg

SEQ ID NO: 241981 - DNA, 31 bp, Artificial Sequence
  Description of Artificial Sequence: Synthetic oligonucleotide
cataccgcccagttatcttagtcctacaggg

SEQ ID NO: 241982 - DNA, 31 bp, Artificial Sequence
  Description of Artificial Sequence: Synthetic oligonucleotide
ataccgcccagttatcttagtcctacagggg

SEQ ID NO: 241983 - DNA, 30 bp, Artificial Sequence
  Description of Artificial Sequence: Synthetic oligonucleotide
taccgcccagttatcttagtcctacagggg

SEQ ID NO: 241984 - DNA, 29 bp, Artificial Sequence
  Description of Artificial Sequence: Synthetic oligonucleotide
accgcccagttatcttagtcctacagggg

SEQ ID NO: 241985 - DNA, 28 bp, Artificial Sequence
  Description of Artificial Sequence: Synthetic oligonucleotide
ccgcccagttatcttagtcctacagggg

SEQ ID NO: 241986 - DNA, 28 bp, Artificial Sequence
  Description of Artificial Sequence: Synthetic oligonucleotide
cgcccagttatcttagtcctacaggggg

SEQ ID NO: 241987 - DNA, 29 bp, Artificial Sequence
  Description of Artificial Sequence: Synthetic oligonucleotide
gcccagttatcttagtcctacagggggtg

SEQ ID NO: 241988 - DNA, 30 bp, Artificial Sequence
  Description of Artificial Sequence: Synthetic oligonucleotide
cccagttatcttagtcctacagggggtgac

SEQ ID NO: 241989 - DNA, 33 bp, Artificial Sequence
  Description of Artificial Sequence: Synthetic oligonucleotide
ccagttatcttagtcctacagggggtgacattc

SEQ ID NO: 241990 - DNA, 34 bp, Artificial Sequence
  Description of Artificial Sequence: Synthetic oligonucleotide
cagttatcttagtcctacagggggtgacattcag

SEQ ID NO: 241991 - DNA, 34 bp, Artificial Sequence
  Description of Artificial Sequence: Synthetic oligonucleotide
agttatcttagtcctacagggggtgacattcagc

SEQ ID NO: 241992 - DNA, 33 bp, Artificial Sequence
  Description of Artificial Sequence: Synthetic oligonucleotide
gttatcttagtcctacagggggtgacattcagc

SEQ ID NO: 241993 - DNA, 33 bp, Artificial Sequence
  Description of Artificial Sequence: Synthetic oligonucleotide
ttatcttagtcctacagggggtgacattcagcc

SEQ ID NO: 241994 - DNA, 32 bp, Artificial Sequence
  Description of Artificial Sequence: Synthetic oligonucleotide
tatcttagtcctacagggggtgacattcagcc

SEQ ID NO: 241995 - DNA, 31 bp, Artificial Sequence
  Description of Artificial Sequence: Synthetic oligonucleotide
atcttagtcctacagggggtgacattcagcc

SEQ ID NO: 241996 - DNA, 30 bp, Artificial Sequence
  Description of Artificial Sequence: Synthetic oligonucleotide
tcttagtcctacagggggtgacattcagcc

SEQ ID NO: 241997 - DNA, 29 bp, Artificial Sequence
  Description of Artificial Sequence: Synthetic oligonucleotide
cttagtcctacagggggtgacattcagcc

SEQ ID NO: 241998 - DNA, 31 bp, Artificial Sequence
  Description of Artificial Sequence: Synthetic oligonucleotide
ttagtcctacagggggtgacattcagcctac

SEQ ID NO: 241999 - DNA, 30 bp, Artificial Sequence
  Description of Artificial Sequence: Synthetic oligonucleotide
tagtcctacagggggtgacattcagcctac

SEQ ID NO: 242000 - DNA, 29 bp, Artificial Sequence
  Description of Artificial Sequence: Synthetic oligonucleotide
agtcctacagggggtgacattcagcctac

SEQ ID NO: 242001 - DNA, 28 bp, Artificial Sequence
  Description of Artificial Sequence: Synthetic oligonucleotide
gtcctacagggggtgacattcagcctac

SEQ ID NO: 242002 - DNA, 28 bp, Artificial Sequence
  Description of Artificial Sequence: Synthetic oligonucleotide
tcctacagggggtgacattcagcctacg

SEQ ID NO: 242003 - DNA, 27 bp, Artificial Sequence
  Description of Artificial Sequence: Synthetic oligonucleotide
cctacagggggtgacattcagcctacg

SEQ ID NO: 242004 - DNA, 27 bp, Artificial Sequence
  Description of Artificial Sequence: Synthetic oligonucleotide
ctacagggggtgacattcagcctacgc

SEQ ID NO: 242005 - DNA, 27 bp, Artificial Sequence
  Description of Artificial Sequence: Synthetic oligonucleotide
tacagggggtgacattcagcctacgcc

SEQ ID NO: 242006 - DNA, 26 bp, Artificial Sequence
  Description of Artificial Sequence: Synthetic oligonucleotide
acagggggtgacattcagcctacgcc

SEQ ID NO: 242007 - DNA, 25 bp, Artificial Sequence
  Description of Artificial Sequence: Synthetic oligonucleotide
cagggggtgacattcagcctacgcc

SEQ ID NO: 242008 - DNA, 26 bp, Artificial Sequence
  Description of Artificial Sequence: Synthetic oligonucleotide
agggggtgacattcagcctacgccca

SEQ ID NO: 242009 - DNA, 25 bp, Artificial Sequence
  Description of Artificial Sequence: Synthetic oligonucleotide
gggggtgacattcagcctacgccca

SEQ ID NO: 242010 - DNA, 25 bp, Artificial Sequence
  Description of Artificial Sequence: Synthetic oligonucleotide
ggggtgacattcagcctacgcccag

SEQ ID NO: 242011 - DNA, 25 bp, Artificial Sequence
  Description of Artificial Sequence: Synthetic oligonucleotide
gggtgacattcagcctacgcccagg

SEQ ID NO: 242012 - DNA, 25 bp, Artificial Sequence
  Description of Artificial Sequence: Synthetic oligonucleotide
ggtgacattcagcctacgcccaggc

SEQ ID NO: 242013 - DNA, 26 bp, Artificial Sequence
  Description of Artificial Sequence: Synthetic oligonucleotide
gtgacattcagcctacgcccaggcga

SEQ ID NO: 242014 - DNA, 26 bp, Artificial Sequence
  Description of Artificial Sequence: Synthetic oligonucleotide
tgacattcagcctacgcccaggcgag

SEQ ID NO: 242015 - DNA, 25 bp, Artificial Sequence
  Description of Artificial Sequence: Synthetic oligonucleotide
gacattcagcctacgcccaggcgag

SEQ ID NO: 242016 - DNA, 26 bp, Artificial Sequence
  Description of Artificial Sequence: Synthetic oligonucleotide
acattcagcctacgcccaggcgaggt

SEQ ID NO: 242017 - DNA, 25 bp, Artificial Sequence
  Description of Artificial Sequence: Synthetic oligonucleotide
cattcagcctacgcccaggcgaggt

SEQ ID NO: 242018 - DNA, 26 bp, Artificial Sequence
  Description of Artificial Sequence: Synthetic oligonucleotide
attcagcctacgcccaggcgaggtgt

SEQ ID NO: 242019 - DNA, 25 bp, Artificial Sequence
  Description of Artificial Sequence: Synthetic oligonucleotide
ttcagcctacgcccaggcgaggtgt

SEQ ID NO: 242020 - DNA, 24 bp, Artificial Sequence
  Description of Artificial Sequence: Synthetic oligonucleotide
tcagcctacgcccaggcgaggtgt

SEQ ID NO: 242021 - DNA, 23 bp, Artificial Sequence
  Description of Artificial Sequence: Synthetic oligonucleotide
cagcctacgcccaggcgaggtgt

SEQ ID NO: 242022 - DNA, 23 bp, Artificial Sequence
  Description of Artificial Sequence: Synthetic oligonucleotide
agcctacgcccaggcgaggtgtc

SEQ ID NO: 242023 - DNA, 22 bp, Artificial Sequence
  Description of Artificial Sequence: Synthetic oligonucleotide
gcctacgcccaggcgaggtgtc

SEQ ID NO: 242024 - DNA, 22 bp, Artificial Sequence
  Description of Artificial Sequence: Synthetic oligonucleotide
cctacgcccaggcgaggtgtcg

SEQ ID NO: 242025 - DNA, 22 bp, Artificial Sequence
  Description of Artificial Sequence: Synthetic oligonucleotide
ctacgcccaggcgaggtgtcgg

SEQ ID NO: 242026 - DNA, 22 bp, Artificial Sequence
  Description of Artificial Sequence: Synthetic oligonucleotide
tacgcccaggcgaggtgtcggc

SEQ ID NO: 242027 - DNA, 21 bp, Artificial Sequence
  Description of Artificial Sequence: Synthetic oligonucleotide
acgcccaggcgaggtgtcggc

SEQ ID NO: 242028 - DNA, 20 bp, Artificial Sequence
  Description of Artificial Sequence: Synthetic oligonucleotide
cgcccaggcgaggtgtcggc

SEQ ID NO: 242029 - DNA, 20 bp, Artificial Sequence
  Description of Artificial Sequence: Synthetic oligonucleotide
gcccaggcgaggtgtcggcg

SEQ ID NO: 242030 - DNA, 21 bp, Artificial Sequence
  Description of Artificial Sequence: Synthetic oligonucleotide
cccaggcgaggtgtcggcgct

SEQ ID NO: 242031 - DNA, 21 bp, Artificial Sequence
  Description of Artificial Sequence: Synthetic oligonucleotide
ccaggcgaggtgtcggcgctg

SEQ ID NO: 242032 - DNA, 22 bp, Artificial Sequence
  Description of Artificial Sequence: Synthetic oligonucleotide
caggcgaggtgtcggcgctgga

SEQ ID NO: 242033 - DNA, 22 bp, Artificial Sequence
  Description of Artificial Sequence: Synthetic oligonucleotide
aggcgaggtgtcggcgctggag

SEQ ID NO: 242034 - DNA, 21 bp, Artificial Sequence
  Description of Artificial Sequence: Synthetic oligonucleotide
ggcgaggtgtcggcgctggag

SEQ ID NO: 242035 - DNA, 21 bp, Artificial Sequence
  Description of Artificial Sequence: Synthetic oligonucleotide
gcgaggtgtcggcgctggagg

SEQ ID NO: 242036 - DNA, 22 bp, Artificial Sequence
  Description of Artificial Sequence: Synthetic oligonucleotide
cgaggtgtcggcgctggaggga

SEQ ID NO: 242037 - DNA, 22 bp, Artificial Sequence
  Description of Artificial Sequence: Synthetic oligonucleotide
gaggtgtcggcgctggagggac

SEQ ID NO: 242038 - DNA, 22 bp, Artificial Sequence
  Description of Artificial Sequence: Synthetic oligonucleotide
aggtgtcggcgctggagggacc

SEQ ID NO: 242039 - DNA, 21 bp, Artificial Sequence
  Description of Artificial Sequence: Synthetic oligonucleotide
ggtgtcggcgctggagggacc

SEQ ID NO: 242040 - DNA, 24 bp, Artificial Sequence
  Description of Artificial Sequence: Synthetic oligonucleotide
gtgtcggcgctggagggacccaaa

SEQ ID NO: 242041 - DNA, 24 bp, Artificial Sequence
  Description of Artificial Sequence: Synthetic oligonucleotide
tgtcggcgctggagggacccaaag

SEQ ID NO: 242042 - DNA, 23 bp, Artificial Sequence
  Description of Artificial Sequence: Synthetic oligonucleotide
gtcggcgctggagggacccaaag

SEQ ID NO: 242043 - DNA, 23 bp, Artificial Sequence
  Description of Artificial Sequence: Synthetic oligonucleotide
tcggcgctggagggacccaaagg

SEQ ID NO: 242044 - DNA, 22 bp, Artificial Sequence
  Description of Artificial Sequence: Synthetic oligonucleotide
cggcgctggagggacccaaagg

SEQ ID NO: 242045 - DNA, 23 bp, Artificial Sequence
  Description of Artificial Sequence: Synthetic oligonucleotide
ggcgctggagggacccaaagggt

SEQ ID NO: 242046 - DNA, 24 bp, Artificial Sequence
  Description of Artificial Sequence: Synthetic oligonucleotide
gcgctggagggacccaaagggtct

SEQ ID NO: 242047 - DNA, 24 bp, Artificial Sequence
  Description of Artificial Sequence: Synthetic oligonucleotide
cgctggagggacccaaagggtctg

SEQ ID NO: 242048 - DNA, 24 bp, Artificial Sequence
  Description of Artificial Sequence: Synthetic oligonucleotide
gctggagggacccaaagggtctgg

SEQ ID NO: 242049 - DNA, 26 bp, Artificial Sequence
  Description of Artificial Sequence: Synthetic oligonucleotide
ctggagggacccaaagggtctgggta

SEQ ID NO: 242050 - DNA, 27 bp, Artificial Sequence
  Description of Artificial Sequence: Synthetic oligonucleotide
tggagggacccaaagggtctgggtaga

SEQ ID NO: 242051 - DNA, 26 bp, Artificial Sequence
  Description of Artificial Sequence: Synthetic oligonucleotide
ggagggacccaaagggtctgggtaga

SEQ ID NO: 242052 - DNA, 26 bp, Artificial Sequence
  Description of Artificial Sequence: Synthetic oligonucleotide
gagggacccaaagggtctgggtagag

SEQ ID NO: 242053 - DNA, 27 bp, Artificial Sequence
  Description of Artificial Sequence: Synthetic oligonucleotide
agggacccaaagggtctgggtagagca

SEQ ID NO: 242054 - DNA, 26 bp, Artificial Sequence
  Description of Artificial Sequence: Synthetic oligonucleotide
gggacccaaagggtctgggtagagca

SEQ ID NO: 242055 - DNA, 27 bp, Artificial Sequence
  Description of Artificial Sequence: Synthetic oligonucleotide
ggacccaaagggtctgggtagagcaca

SEQ ID NO: 242056 - DNA, 27 bp, Artificial Sequence
  Description of Artificial Sequence: Synthetic oligonucleotide
gacccaaagggtctgggtagagcacag

SEQ ID NO: 242057 - DNA, 28 bp, Artificial Sequence
  Description of Artificial Sequence: Synthetic oligonucleotide
acccaaagggtctgggtagagcacagag

SEQ ID NO: 242058 - DNA, 27 bp, Artificial Sequence
  Description of Artificial Sequence: Synthetic oligonucleotide
cccaaagggtctgggtagagcacagag

SEQ ID NO: 242059 - DNA, 27 bp, Artificial Sequence
  Description of Artificial Sequence: Synthetic oligonucleotide
ccaaagggtctgggtagagcacagagg

SEQ ID NO: 242060 - DNA, 27 bp, Artificial Sequence
  Description of Artificial Sequence: Synthetic oligonucleotide
caaagggtctgggtagagcacagaggc

SEQ ID NO: 242061 - DNA, 28 bp, Artificial Sequence
  Description of Artificial Sequence: Synthetic oligonucleotide
aaagggtctgggtagagcacagaggctg

SEQ ID NO: 242062 - DNA, 27 bp, Artificial Sequence
  Description of Artificial Sequence: Synthetic oligonucleotide
aagggtctgggtagagcacagaggctg

SEQ ID NO: 242063 - DNA, 26 bp, Artificial Sequence
  Description of Artificial Sequence: Synthetic oligonucleotide
agggtctgggtagagcacagaggctg

SEQ ID NO: 242064 - DNA, 25 bp, Artificial Sequence
  Description of Artificial Sequence: Synthetic oligonucleotide
gggtctgggtagagcacagaggctg

SEQ ID NO: 242065 - DNA, 25 bp, Artificial Sequence
  Description of Artificial Sequence: Synthetic oligonucleotide
ggtctgggtagagcacagaggctgc

SEQ ID NO: 242066 - DNA, 25 bp, Artificial Sequence
  Description of Artificial Sequence: Synthetic oligonucleotide
gtctgggtagagcacagaggctgcc

SEQ ID NO: 242067 - DNA, 26 bp, Artificial Sequence
  Description of Artificial Sequence: Synthetic oligonucleotide
tctgggtagagcacagaggctgccct

SEQ ID NO: 242068 - DNA, 25 bp, Artificial Sequence
  Description of Artificial Sequence: Synthetic oligonucleotide
ctgggtagagcacagaggctgccct

SEQ ID NO: 242069 - DNA, 25 bp, Artificial Sequence
  Description of Artificial Sequence: Synthetic oligonucleotide
tgggtagagcacagaggctgccctc

SEQ ID NO: 242070 - DNA, 24 bp, Artificial Sequence
  Description of Artificial Sequence: Synthetic oligonucleotide
gggtagagcacagaggctgccctc

SEQ ID NO: 242071 - DNA, 25 bp, Artificial Sequence
  Description of Artificial Sequence: Synthetic oligonucleotide
ggtagagcacagaggctgccctcct

SEQ ID NO: 242072 - DNA, 25 bp, Artificial Sequence
  Description of Artificial Sequence: Synthetic oligonucleotide
gtagagcacagaggctgccctcctg

SEQ ID NO: 242073 - DNA, 26 bp, Artificial Sequence
  Description of Artificial Sequence: Synthetic oligonucleotide
tagagcacagaggctgccctcctgca

SEQ ID NO: 242074 - DNA, 25 bp, Artificial Sequence
  Description of Artificial Sequence: Synthetic oligonucleotide
agagcacagaggctgccctcctgca

SEQ ID NO: 242075 - DNA, 24 bp, Artificial Sequence
  Description of Artificial Sequence: Synthetic oligonucleotide
gagcacagaggctgccctcctgca

SEQ ID NO: 242076 - DNA, 27 bp, Artificial Sequence
  Description of Artificial Sequence: Synthetic oligonucleotide
agcacagaggctgccctcctgcagaat

SEQ ID NO: 242077 - DNA, 26 bp, Artificial Sequence
  Description of Artificial Sequence: Synthetic oligonucleotide
gcacagaggctgccctcctgcagaat

SEQ ID NO: 242078 - DNA, 27 bp, Artificial Sequence
  Description of Artificial Sequence: Synthetic oligonucleotide
cacagaggctgccctcctgcagaatgt

SEQ ID NO: 242079 - DNA, 27 bp, Artificial Sequence
  Description of Artificial Sequence: Synthetic oligonucleotide
acagaggctgccctcctgcagaatgtg

SEQ ID NO: 242080 - DNA, 27 bp, Artificial Sequence
  Description of Artificial Sequence: Synthetic oligonucleotide
cagaggctgccctcctgcagaatgtgt

SEQ ID NO: 242081 - DNA, 28 bp, Artificial Sequence
  Description of Artificial Sequence: Synthetic oligonucleotide
agaggctgccctcctgcagaatgtgtac

SEQ ID NO: 242082 - DNA, 27 bp, Artificial Sequence
  Description of Artificial Sequence: Synthetic oligonucleotide
gaggctgccctcctgcagaatgtgtac

SEQ ID NO: 242083 - DNA, 27 bp, Artificial Sequence
  Description of Artificial Sequence: Synthetic oligonucleotide
aggctgccctcctgcagaatgtgtacc

SEQ ID NO: 242084 - DNA, 27 bp, Artificial Sequence
  Description of Artificial Sequence: Synthetic oligonucleotide
ggctgccctcctgcagaatgtgtacca

SEQ ID NO: 242085 - DNA, 27 bp, Artificial Sequence
  Description of Artificial Sequence: Synthetic oligonucleotide
gctgccctcctgcagaatgtgtaccag

SEQ ID NO: 242086 - DNA, 27 bp, Artificial Sequence
  Description of Artificial Sequence: Synthetic oligonucleotide
ctgccctcctgcagaatgtgtaccagc

SEQ ID NO: 242087 - DNA, 27 bp, Artificial Sequence
  Description of Artificial Sequence: Synthetic oligonucleotide
tgccctcctgcagaatgtgtaccagcg

SEQ ID NO: 242088 - DNA, 26 bp, Artificial Sequence
  Description of Artificial Sequence: Synthetic oligonucleotide
gccctcctgcagaatgtgtaccagcg

SEQ ID NO: 242089 - DNA, 27 bp, Artificial Sequence
  Description of Artificial Sequence: Synthetic oligonucleotide
ccctcctgcagaatgtgtaccagcgca

SEQ ID NO: 242090 - DNA, 27 bp, Artificial Sequence
  Description of Artificial Sequence: Synthetic oligonucleotide
cctcctgcagaatgtgtaccagcgcac

SEQ ID NO: 242091 - DNA, 27 bp, Artificial Sequence
  Description of Artificial Sequence: Synthetic oligonucleotide
ctcctgcagaatgtgtaccagcgcacc

SEQ ID NO: 242092 - DNA, 27 bp, Artificial Sequence
  Description of Artificial Sequence: Synthetic oligonucleotide
tcctgcagaatgtgtaccagcgcaccg

SEQ ID NO: 242093 - DNA, 26 bp, Artificial Sequence
  Description of Artificial Sequence: Synthetic oligonucleotide
cctgcagaatgtgtaccagcgcaccg

SEQ ID NO: 242094 - DNA, 26 bp, Artificial Sequence
  Description of Artificial Sequence: Synthetic oligonucleotide
ctgcagaatgtgtaccagcgcaccgg

SEQ ID NO: 242095 - DNA, 26 bp, Artificial Sequence
  Description of Artificial Sequence: Synthetic oligonucleotide
tgcagaatgtgtaccagcgcaccggg

SEQ ID NO: 242096 - DNA, 25 bp, Artificial Sequence
  Description of Artificial Sequence: Synthetic oligonucleotide
gcagaatgtgtaccagcgcaccggg

SEQ ID NO: 242097 - DNA, 25 bp, Artificial Sequence
  Description of Artificial Sequence: Synthetic oligonucleotide
cagaatgtgtaccagcgcaccgggg

SEQ ID NO: 242098 - DNA, 26 bp, Artificial Sequence
  Description of Artificial Sequence: Synthetic oligonucleotide
agaatgtgtaccagcgcaccgggggt

SEQ ID NO: 242099 - DNA, 25 bp, Artificial Sequence
  Description of Artificial Sequence: Synthetic oligonucleotide
gaatgtgtaccagcgcaccgggggt

SEQ ID NO: 242100 - DNA, 26 bp, Artificial Sequence
  Description of Artificial Sequence: Synthetic oligonucleotide
aatgtgtaccagcgcaccgggggtca

SEQ ID NO: 242101 - DNA, 25 bp, Artificial Sequence
  Description of Artificial Sequence: Synthetic oligonucleotide
atgtgtaccagcgcaccgggggtca

SEQ ID NO: 242102 - DNA, 24 bp, Artificial Sequence
  Description of Artificial Sequence: Synthetic oligonucleotide
tgtgtaccagcgcaccgggggtca

SEQ ID NO: 242103 - DNA, 23 bp, Artificial Sequence
  Description of Artificial Sequence: Synthetic oligonucleotide
gtgtaccagcgcaccgggggtca

SEQ ID NO: 242104 - DNA, 23 bp, Artificial Sequence
  Description of Artificial Sequence: Synthetic oligonucleotide
tgtaccagcgcaccgggggtcag

SEQ ID NO: 242105 - DNA, 22 bp, Artificial Sequence
  Description of Artificial Sequence: Synthetic oligonucleotide
gtaccagcgcaccgggggtcag

SEQ ID NO: 242106 - DNA, 23 bp, Artificial Sequence
  Description of Artificial Sequence: Synthetic oligonucleotide
taccagcgcaccgggggtcagct

SEQ ID NO: 242107 - DNA, 22 bp, Artificial Sequence
  Description of Artificial Sequence: Synthetic oligonucleotide
accagcgcaccgggggtcagct

SEQ ID NO: 242108 - DNA, 21 bp, Artificial Sequence
  Description of Artificial Sequence: Synthetic oligonucleotide
ccagcgcaccgggggtcagct

SEQ ID NO: 242109 - DNA, 21 bp, Artificial Sequence
  Description of Artificial Sequence: Synthetic oligonucleotide
cagcgcaccgggggtcagctg

SEQ ID NO: 242110 - DNA, 22 bp, Artificial Sequence
  Description of Artificial Sequence: Synthetic oligonucleotide
agcgcaccgggggtcagctgct

SEQ ID NO: 242111 - DNA, 21 bp, Artificial Sequence
  Description of Artificial Sequence: Synthetic oligonucleotide
gcgcaccgggggtcagctgct

SEQ ID NO: 242112 - DNA, 23 bp, Artificial Sequence
  Description of Artificial Sequence: Synthetic oligonucleotide
cgcaccgggggtcagctgctgat

SEQ ID NO: 242113 - DNA, 23 bp, Artificial Sequence
  Description of Artificial Sequence: Synthetic oligonucleotide
gcaccgggggtcagctgctgatg

SEQ ID NO: 242114 - DNA, 25 bp, Artificial Sequence
  Description of Artificial Sequence: Synthetic oligonucleotide
caccgggggtcagctgctgatggat

SEQ ID NO: 242115 - DNA, 25 bp, Artificial Sequence
  Description of Artificial Sequence: Synthetic oligonucleotide
accgggggtcagctgctgatggatg

SEQ ID NO: 242116 - DNA, 24 bp, Artificial Sequence
  Description of Artificial Sequence: Synthetic oligonucleotide
ccgggggtcagctgctgatggatg

SEQ ID NO: 242117 - DNA, 24 bp, Artificial Sequence
  Description of Artificial Sequence: Synthetic oligonucleotide
cgggggtcagctgctgatggatgg

SEQ ID NO: 242118 - DNA, 26 bp, Artificial Sequence
  Description of Artificial Sequence: Synthetic oligonucleotide
gggggtcagctgctgatggatgggat

SEQ ID NO: 242119 - DNA, 26 bp, Artificial Sequence
  Description of Artificial Sequence: Synthetic oligonucleotide
ggggtcagctgctgatggatgggatg

SEQ ID NO: 242120 - DNA, 26 bp, Artificial Sequence
  Description of Artificial Sequence: Synthetic oligonucleotide
gggtcagctgctgatggatgggatgc

SEQ ID NO: 242121 - DNA, 26 bp, Artificial Sequence
  Description of Artificial Sequence: Synthetic oligonucleotide
ggtcagctgctgatggatgggatgcc

SEQ ID NO: 242122 - DNA, 26 bp, Artificial Sequence
  Description of Artificial Sequence: Synthetic oligonucleotide
gtcagctgctgatggatgggatgccc

SEQ ID NO: 242123 - DNA, 27 bp, Artificial Sequence
  Description of Artificial Sequence: Synthetic oligonucleotide
tcagctgctgatggatgggatgcccct

SEQ ID NO: 242124 - DNA, 27 bp, Artificial Sequence
  Description of Artificial Sequence: Synthetic oligonucleotide
cagctgctgatggatgggatgcccctt

SEQ ID NO: 242125 - DNA, 27 bp, Artificial Sequence
  Description of Artificial Sequence: Synthetic oligonucleotide
agctgctgatggatgggatgccccttc

SEQ ID NO: 242126 - DNA, 26 bp, Artificial Sequence
  Description of Artificial Sequence: Synthetic oligonucleotide
gctgctgatggatgggatgccccttc

SEQ ID NO: 242127 - DNA, 26 bp, Artificial Sequence
  Description of Artificial Sequence: Synthetic oligonucleotide
ctgctgatggatgggatgccccttcc

SEQ ID NO: 242128 - DNA, 26 bp, Artificial Sequence
  Description of Artificial Sequence: Synthetic oligonucleotide
tgctgatggatgggatgccccttccg

SEQ ID NO: 242129 - DNA, 25 bp, Artificial Sequence
  Description of Artificial Sequence: Synthetic oligonucleotide
gctgatggatgggatgccccttccg

SEQ ID NO: 242130 - DNA, 27 bp, Artificial Sequence
  Description of Artificial Sequence: Synthetic oligonucleotide
ctgatggatgggatgccccttccgcaa

SEQ ID NO: 242131 - DNA, 30 bp, Artificial Sequence
  Description of Artificial Sequence: Synthetic oligonucleotide
tgatggatgggatgccccttccgcaatatg

SEQ ID NO: 242132 - DNA, 29 bp, Artificial Sequence
  Description of Artificial Sequence: Synthetic oligonucleotide
gatggatgggatgccccttccgcaatatg

SEQ ID NO: 242133 - DNA, 30 bp, Artificial Sequence
  Description of Artificial Sequence: Synthetic oligonucleotide
atggatgggatgccccttccgcaatatgag

SEQ ID NO: 242134 - DNA, 29 bp, Artificial Sequence
  Description of Artificial Sequence: Synthetic oligonucleotide
tggatgggatgccccttccgcaatatgag

SEQ ID NO: 242135 - DNA, 28 bp, Artificial Sequence
  Description of Artificial Sequence: Synthetic oligonucleotide
ggatgggatgccccttccgcaatatgag

SEQ ID NO: 242136 - DNA, 28 bp, Artificial Sequence
  Description of Artificial Sequence: Synthetic oligonucleotide
gatgggatgccccttccgcaatatgagg

SEQ ID NO: 242137 - DNA, 29 bp, Artificial Sequence
  Description of Artificial Sequence: Synthetic oligonucleotide
atgggatgccccttccgcaatatgaggac

SEQ ID NO: 242138 - DNA, 28 bp, Artificial Sequence
  Description of Artificial Sequence: Synthetic oligonucleotide
tgggatgccccttccgcaatatgaggac

SEQ ID NO: 242139 - DNA, 27 bp, Artificial Sequence
  Description of Artificial Sequence: Synthetic oligonucleotide
gggatgccccttccgcaatatgaggac

SEQ ID NO: 242140 - DNA, 27 bp, Artificial Sequence
  Description of Artificial Sequence: Synthetic oligonucleotide
ggatgccccttccgcaatatgaggacc

SEQ ID NO: 242141 - DNA, 27 bp, Artificial Sequence
  Description of Artificial Sequence: Synthetic oligonucleotide
gatgccccttccgcaatatgaggaccg

SEQ ID NO: 242142 - DNA, 27 bp, Artificial Sequence
  Description of Artificial Sequence: Synthetic oligonucleotide
atgccccttccgcaatatgaggaccgc

SEQ ID NO: 242143 - DNA, 27 bp, Artificial Sequence
  Description of Artificial Sequence: Synthetic oligonucleotide
tgccccttccgcaatatgaggaccgct

SEQ ID NO: 242144 - DNA, 27 bp, Artificial Sequence
  Description of Artificial Sequence: Synthetic oligonucleotide
gccccttccgcaatatgaggaccgcta

SEQ ID NO: 242145 - DNA, 27 bp, Artificial Sequence
  Description of Artificial Sequence: Synthetic oligonucleotide
ccccttccgcaatatgaggaccgctac

SEQ ID NO: 242146 - DNA, 27 bp, Artificial Sequence
  Description of Artificial Sequence: Synthetic oligonucleotide
cccttccgcaatatgaggaccgctacc

SEQ ID NO: 242147 - DNA, 28 bp, Artificial Sequence
  Description of Artificial Sequence: Synthetic oligonucleotide
ccttccgcaatatgaggaccgctaccag

SEQ ID NO: 242148 - DNA, 28 bp, Artificial Sequence
  Description of Artificial Sequence: Synthetic oligonucleotide
cttccgcaatatgaggaccgctaccagc

SEQ ID NO: 242149 - DNA, 29 bp, Artificial Sequence
  Description of Artificial Sequence: Synthetic oligonucleotide
ttccgcaatatgaggaccgctaccagcac

SEQ ID NO: 242150 - DNA, 28 bp, Artificial Sequence
  Description of Artificial Sequence: Synthetic oligonucleotide
tccgcaatatgaggaccgctaccagcac

SEQ ID NO: 242151 - DNA, 27 bp, Artificial Sequence
  Description of Artificial Sequence: Synthetic oligonucleotide
ccgcaatatgaggaccgctaccagcac

SEQ ID NO: 242152 - DNA, 28 bp, Artificial Sequence
  Description of Artificial Sequence: Synthetic oligonucleotide
cgcaatatgaggaccgctaccagcacag

SEQ ID NO: 242153 - DNA, 28 bp, Artificial Sequence
  Description of Artificial Sequence: Synthetic oligonucleotide
gcaatatgaggaccgctaccagcacagg

SEQ ID NO: 242154 - DNA, 28 bp, Artificial Sequence
  Description of Artificial Sequence: Synthetic oligonucleotide
caatatgaggaccgctaccagcacaggc

SEQ ID NO: 242155 - DNA, 29 bp, Artificial Sequence
  Description of Artificial Sequence: Synthetic oligonucleotide
aatatgaggaccgctaccagcacaggcac

SEQ ID NO: 242156 - DNA, 28 bp, Artificial Sequence
  Description of Artificial Sequence: Synthetic oligonucleotide
atatgaggaccgctaccagcacaggcac

SEQ ID NO: 242157 - DNA, 27 bp, Artificial Sequence
  Description of Artificial Sequence: Synthetic oligonucleotide
tatgaggaccgctaccagcacaggcac

SEQ ID NO: 242158 - DNA, 26 bp, Artificial Sequence
  Description of Artificial Sequence: Synthetic oligonucleotide
atgaggaccgctaccagcacaggcac

SEQ ID NO: 242159 - DNA, 25 bp, Artificial Sequence
  Description of Artificial Sequence: Synthetic oligonucleotide
tgaggaccgctaccagcacaggcac

SEQ ID NO: 242160 - DNA, 24 bp, Artificial Sequence
  Description of Artificial Sequence: Synthetic oligonucleotide
gaggaccgctaccagcacaggcac

SEQ ID NO: 242161 - DNA, 25 bp, Artificial Sequence
  Description of Artificial Sequence: Synthetic oligonucleotide
aggaccgctaccagcacaggcacgt

SEQ ID NO: 242162 - DNA, 24 bp, Artificial Sequence
  Description of Artificial Sequence: Synthetic oligonucleotide
ggaccgctaccagcacaggcacgt

SEQ ID NO: 242163 - DNA, 24 bp, Artificial Sequence
  Description of Artificial Sequence: Synthetic oligonucleotide
gaccgctaccagcacaggcacgtg

SEQ ID NO: 242164 - DNA, 24 bp, Artificial Sequence
  Description of Artificial Sequence: Synthetic oligonucleotide
accgctaccagcacaggcacgtgg

SEQ ID NO: 242165 - DNA, 23 bp, Artificial Sequence
  Description of Artificial Sequence: Synthetic oligonucleotide
ccgctaccagcacaggcacgtgg

SEQ ID NO: 242166 - DNA, 24 bp, Artificial Sequence
  Description of Artificial Sequence: Synthetic oligonucleotide
cgctaccagcacaggcacgtggct

SEQ ID NO: 242167 - DNA, 24 bp, Artificial Sequence
  Description of Artificial Sequence: Synthetic oligonucleotide
gctaccagcacaggcacgtggctg

SEQ ID NO: 242168 - DNA, 25 bp, Artificial Sequence
  Description of Artificial Sequence: Synthetic oligonucleotide
ctaccagcacaggcacgtggctgca

SEQ ID NO: 242169 - DNA, 26 bp, Artificial Sequence
  Description of Artificial Sequence: Synthetic oligonucleotide
taccagcacaggcacgtggctgcact

SEQ ID NO: 242170 - DNA, 25 bp, Artificial Sequence
  Description of Artificial Sequence: Synthetic oligonucleotide
accagcacaggcacgtggctgcact

SEQ ID NO: 242171 - DNA, 24 bp, Artificial Sequence
  Description of Artificial Sequence: Synthetic oligonucleotide
ccagcacaggcacgtggctgcact

SEQ ID NO: 242172 - DNA, 24 bp, Artificial Sequence
  Description of Artificial Sequence: Synthetic oligonucleotide
cagcacaggcacgtggctgcactg

SEQ ID NO: 242173 - DNA, 24 bp, Artificial Sequence
  Description of Artificial Sequence: Synthetic oligonucleotide
agcacaggcacgtggctgcactgg

SEQ ID NO: 242174 - DNA, 23 bp, Artificial Sequence
  Description of Artificial Sequence: Synthetic oligonucleotide
gcacaggcacgtggctgcactgg

SEQ ID NO: 242175 - DNA, 24 bp, Artificial Sequence
  Description of Artificial Sequence: Synthetic oligonucleotide
cacaggcacgtggctgcactggga

SEQ ID NO: 242176 - DNA, 26 bp, Artificial Sequence
  Description of Artificial Sequence: Synthetic oligonucleotide
acaggcacgtggctgcactgggacaa

SEQ ID NO: 242177 - DNA, 25 bp, Artificial Sequence
  Description of Artificial Sequence: Synthetic oligonucleotide
caggcacgtggctgcactgggacaa

SEQ ID NO: 242178 - DNA, 26 bp, Artificial Sequence
  Description of Artificial Sequence: Synthetic oligonucleotide
aggcacgtggctgcactgggacaagt

SEQ ID NO: 242179 - DNA, 25 bp, Artificial Sequence
  Description of Artificial Sequence: Synthetic oligonucleotide
ggcacgtggctgcactgggacaagt

SEQ ID NO: 242180 - DNA, 25 bp, Artificial Sequence
  Description of Artificial Sequence: Synthetic oligonucleotide
gcacgtggctgcactgggacaagtg

SEQ ID NO: 242181 - DNA, 25 bp, Artificial Sequence
  Description of Artificial Sequence: Synthetic oligonucleotide
cacgtggctgcactgggacaagtgc

SEQ ID NO: 242182 - DNA, 26 bp, Artificial Sequence
  Description of Artificial Sequence: Synthetic oligonucleotide
acgtggctgcactgggacaagtgcca

SEQ ID NO: 242183 - DNA, 25 bp, Artificial Sequence
  Description of Artificial Sequence: Synthetic oligonucleotide
cgtggctgcactgggacaagtgcca

SEQ ID NO: 242184 - DNA, 26 bp, Artificial Sequence
  Description of Artificial Sequence: Synthetic oligonucleotide
gtggctgcactgggacaagtgccaca

SEQ ID NO: 242185 - DNA, 26 bp, Artificial Sequence
  Description of Artificial Sequence: Synthetic oligonucleotide
tggctgcactgggacaagtgccacag

SEQ ID NO: 242186 - DNA, 25 bp, Artificial Sequence
  Description of Artificial Sequence: Synthetic oligonucleotide
ggctgcactgggacaagtgccacag

SEQ ID NO: 242187 - DNA, 27 bp, Artificial Sequence
  Description of Artificial Sequence: Synthetic oligonucleotide
gctgcactgggacaagtgccacaggtt

SEQ ID NO: 242188 - DNA, 30 bp, Artificial Sequence
  Description of Artificial Sequence: Synthetic oligonucleotide
ctgcactgggacaagtgccacaggtttttg

SEQ ID NO: 242189 - DNA, 30 bp, Artificial Sequence
  Description of Artificial Sequence: Synthetic oligonucleotide
tgcactgggacaagtgccacaggtttttgg

SEQ ID NO: 242190 - DNA, 29 bp, Artificial Sequence
  Description of Artificial Sequence: Synthetic oligonucleotide
gcactgggacaagtgccacaggtttttgg

SEQ ID NO: 242191 - DNA, 31 bp, Artificial Sequence
  Description of Artificial Sequence: Synthetic oligonucleotide
cactgggacaagtgccacaggtttttggaag

SEQ ID NO: 242192 - DNA, 33 bp, Artificial Sequence
  Description of Artificial Sequence: Synthetic oligonucleotide
actgggacaagtgccacaggtttttggaagatg

SEQ ID NO: 242193 - DNA, 32 bp, Artificial Sequence
  Description of Artificial Sequence: Synthetic oligonucleotide
ctgggacaagtgccacaggtttttggaagatg

SEQ ID NO: 242194 - DNA, 33 bp, Artificial Sequence
  Description of Artificial Sequence: Synthetic oligonucleotide
tgggacaagtgccacaggtttttggaagatgtc

SEQ ID NO: 242195 - DNA, 32 bp, Artificial Sequence
  Description of Artificial Sequence: Synthetic oligonucleotide
gggacaagtgccacaggtttttggaagatgtc

SEQ ID NO: 242196 - DNA, 34 bp, Artificial Sequence
  Description of Artificial Sequence: Synthetic oligonucleotide
ggacaagtgccacaggtttttggaagatgtcttc

SEQ ID NO: 242197 - DNA, 36 bp, Artificial Sequence
  Description of Artificial Sequence: Synthetic oligonucleotide
gacaagtgccacaggtttttggaagatgtcttcaag

SEQ ID NO: 242198 - DNA, 44 bp, Artificial Sequence
  Description of Artificial Sequence: Synthetic oligonucleotide
acaagtgccacaggtttttggaagatgtcttcaagtaaatattg

SEQ ID NO: 242199 - DNA, 43 bp, Artificial Sequence
  Description of Artificial Sequence: Synthetic oligonucleotide
caagtgccacaggtttttggaagatgtcttcaagtaaatattg

SEQ ID NO: 242200 - DNA, 43 bp, Artificial Sequence
  Description of Artificial Sequence: Synthetic oligonucleotide
aagtgccacaggtttttggaagatgtcttcaagtaaatattgc

SEQ ID NO: 242201 - DNA, 42 bp, Artificial Sequence
  Description of Artificial Sequence: Synthetic oligonucleotide
agtgccacaggtttttggaagatgtcttcaagtaaatattgc

SEQ ID NO: 242202 - DNA, 41 bp, Artificial Sequence
  Description of Artificial Sequence: Synthetic oligonucleotide
gtgccacaggtttttggaagatgtcttcaagtaaatattgc

SEQ ID NO: 242203 - DNA, 41 bp, Artificial Sequence
  Description of Artificial Sequence: Synthetic oligonucleotide
tgccacaggtttttggaagatgtcttcaagtaaatattgcg

SEQ ID NO: 242204 - DNA, 40 bp, Artificial Sequence
  Description of Artificial Sequence: Synthetic oligonucleotide
gccacaggtttttggaagatgtcttcaagtaaatattgcg

SEQ ID NO: 242205 - DNA, 43 bp, Artificial Sequence
  Description of Artificial Sequence: Synthetic oligonucleotide
ccacaggtttttggaagatgtcttcaagtaaatattgcgtatg

SEQ ID NO: 242206 - DNA, 43 bp, Artificial Sequence
  Description of Artificial Sequence: Synthetic oligonucleotide
cacaggtttttggaagatgtcttcaagtaaatattgcgtatgg

SEQ ID NO: 242207 - DNA, 43 bp, Artificial Sequence
  Description of Artificial Sequence: Synthetic oligonucleotide
acaggtttttggaagatgtcttcaagtaaatattgcgtatggc

SEQ ID NO: 242208 - DNA, 42 bp, Artificial Sequence
  Description of Artificial Sequence: Synthetic oligonucleotide
caggtttttggaagatgtcttcaagtaaatattgcgtatggc

SEQ ID NO: 242209 - DNA, 42 bp, Artificial Sequence
  Description of Artificial Sequence: Synthetic oligonucleotide
aggtttttggaagatgtcttcaagtaaatattgcgtatggcc

SEQ ID NO: 242210 - DNA, 41 bp, Artificial Sequence
  Description of Artificial Sequence: Synthetic oligonucleotide
ggtttttggaagatgtcttcaagtaaatattgcgtatggcc

SEQ ID NO: 242211 - DNA, 42 bp, Artificial Sequence
  Description of Artificial Sequence: Synthetic oligonucleotide
gtttttggaagatgtcttcaagtaaatattgcgtatggcctg

SEQ ID NO: 242212 - DNA, 43 bp, Artificial Sequence
  Description of Artificial Sequence: Synthetic oligonucleotide
tttttggaagatgtcttcaagtaaatattgcgtatggcctgtc

SEQ ID NO: 242213 - DNA, 42 bp, Artificial Sequence
  Description of Artificial Sequence: Synthetic oligonucleotide
ttttggaagatgtcttcaagtaaatattgcgtatggcctgtc

SEQ ID NO: 242214 - DNA, 41 bp, Artificial Sequence
  Description of Artificial Sequence: Synthetic oligonucleotide
tttggaagatgtcttcaagtaaatattgcgtatggcctgtc

SEQ ID NO: 242215 - DNA, 40 bp, Artificial Sequence
  Description of Artificial Sequence: Synthetic oligonucleotide
ttggaagatgtcttcaagtaaatattgcgtatggcctgtc

SEQ ID NO: 242216 - DNA, 39 bp, Artificial Sequence
  Description of Artificial Sequence: Synthetic oligonucleotide
tggaagatgtcttcaagtaaatattgcgtatggcctgtc

SEQ ID NO: 242217 - DNA, 38 bp, Artificial Sequence
  Description of Artificial Sequence: Synthetic oligonucleotide
ggaagatgtcttcaagtaaatattgcgtatggcctgtc

SEQ ID NO: 242218 - DNA, 38 bp, Artificial Sequence
  Description of Artificial Sequence: Synthetic oligonucleotide
gaagatgtcttcaagtaaatattgcgtatggcctgtcc

SEQ ID NO: 242219 - DNA, 38 bp, Artificial Sequence
  Description of Artificial Sequence: Synthetic oligonucleotide
aagatgtcttcaagtaaatattgcgtatggcctgtccc

SEQ ID NO: 242220 - DNA, 37 bp, Artificial Sequence
  Description of Artificial Sequence: Synthetic oligonucleotide
agatgtcttcaagtaaatattgcgtatggcctgtccc

SEQ ID NO: 242221 - DNA, 36 bp, Artificial Sequence
  Description of Artificial Sequence: Synthetic oligonucleotide
gatgtcttcaagtaaatattgcgtatggcctgtccc

SEQ ID NO: 242222 - DNA, 37 bp, Artificial Sequence
  Description of Artificial Sequence: Synthetic oligonucleotide
atgtcttcaagtaaatattgcgtatggcctgtcccag

SEQ ID NO: 242223 - DNA, 36 bp, Artificial Sequence
  Description of Artificial Sequence: Synthetic oligonucleotide
tgtcttcaagtaaatattgcgtatggcctgtcccag

SEQ ID NO: 242224 - DNA, 35 bp, Artificial Sequence
  Description of Artificial Sequence: Synthetic oligonucleotide
gtcttcaagtaaatattgcgtatggcctgtcccag

SEQ ID NO: 242225 - DNA, 37 bp, Artificial Sequence
  Description of Artificial Sequence: Synthetic oligonucleotide
tcttcaagtaaatattgcgtatggcctgtcccagaag

SEQ ID NO: 242226 - DNA, 36 bp, Artificial Sequence
  Description of Artificial Sequence: Synthetic oligonucleotide
cttcaagtaaatattgcgtatggcctgtcccagaag

SEQ ID NO: 242227 - DNA, 36 bp, Artificial Sequence
  Description of Artificial Sequence: Synthetic oligonucleotide
ttcaagtaaatattgcgtatggcctgtcccagaagc

SEQ ID NO: 242228 - DNA, 35 bp, Artificial Sequence
  Description of Artificial Sequence: Synthetic oligonucleotide
tcaagtaaatattgcgtatggcctgtcccagaagc

SEQ ID NO: 242229 - DNA, 34 bp, Artificial Sequence
  Description of Artificial Sequence: Synthetic oligonucleotide
caagtaaatattgcgtatggcctgtcccagaagc

SEQ ID NO: 242230 - DNA, 34 bp, Artificial Sequence
  Description of Artificial Sequence: Synthetic oligonucleotide
aagtaaatattgcgtatggcctgtcccagaagcg

SEQ ID NO: 242231 - DNA, 33 bp, Artificial Sequence
  Description of Artificial Sequence: Synthetic oligonucleotide
agtaaatattgcgtatggcctgtcccagaagcg

SEQ ID NO: 242232 - DNA, 32 bp, Artificial Sequence
  Description of Artificial Sequence: Synthetic oligonucleotide
gtaaatattgcgtatggcctgtcccagaagcg

SEQ ID NO: 242233 - DNA, 34 bp, Artificial Sequence
  Description of Artificial Sequence: Synthetic oligonucleotide
taaatattgcgtatggcctgtcccagaagcgaac

SEQ ID NO: 242234 - DNA, 33 bp, Artificial Sequence
  Description of Artificial Sequence: Synthetic oligonucleotide
aaatattgcgtatggcctgtcccagaagcgaac

SEQ ID NO: 242235 - DNA, 32 bp, Artificial Sequence
  Description of Artificial Sequence: Synthetic oligonucleotide
aatattgcgtatggcctgtcccagaagcgaac

SEQ ID NO: 242236 - DNA, 31 bp, Artificial Sequence
  Description of Artificial Sequence: Synthetic oligonucleotide
atattgcgtatggcctgtcccagaagcgaac

SEQ ID NO: 242237 - DNA, 30 bp, Artificial Sequence
  Description of Artificial Sequence: Synthetic oligonucleotide
tattgcgtatggcctgtcccagaagcgaac

SEQ ID NO: 242238 - DNA, 29 bp, Artificial Sequence
  Description of Artificial Sequence: Synthetic oligonucleotide
attgcgtatggcctgtcccagaagcgaac

SEQ ID NO: 242239 - DNA, 28 bp, Artificial Sequence
  Description of Artificial Sequence: Synthetic oligonucleotide
ttgcgtatggcctgtcccagaagcgaac

SEQ ID NO: 242240 - DNA, 27 bp, Artificial Sequence
  Description of Artificial Sequence: Synthetic oligonucleotide
tgcgtatggcctgtcccagaagcgaac

SEQ ID NO: 242241 - DNA, 27 bp, Artificial Sequence
  Description of Artificial Sequence: Synthetic oligonucleotide
gcgtatggcctgtcccagaagcgaact

SEQ ID NO: 242242 - DNA, 29 bp, Artificial Sequence
  Description of Artificial Sequence: Synthetic oligonucleotide
cgtatggcctgtcccagaagcgaactatg

SEQ ID NO: 242243 - DNA, 29 bp, Artificial Sequence
  Description of Artificial Sequence: Synthetic oligonucleotide
gtatggcctgtcccagaagcgaactatgg

SEQ ID NO: 242244 - DNA, 30 bp, Artificial Sequence
  Description of Artificial Sequence: Synthetic oligonucleotide
tatggcctgtcccagaagcgaactatggac

SEQ ID NO: 242245 - DNA, 29 bp, Artificial Sequence
  Description of Artificial Sequence: Synthetic oligonucleotide
atggcctgtcccagaagcgaactatggac

SEQ ID NO: 242246 - DNA, 28 bp, Artificial Sequence
  Description of Artificial Sequence: Synthetic oligonucleotide
tggcctgtcccagaagcgaactatggac

SEQ ID NO: 242247 - DNA, 27 bp, Artificial Sequence
  Description of Artificial Sequence: Synthetic oligonucleotide
ggcctgtcccagaagcgaactatggac

SEQ ID NO: 242248 - DNA, 27 bp, Artificial Sequence
  Description of Artificial Sequence: Synthetic oligonucleotide
gcctgtcccagaagcgaactatggacg

SEQ ID NO: 242249 - DNA, 31 bp, Artificial Sequence
  Description of Artificial Sequence: Synthetic oligonucleotide
cctgtcccagaagcgaactatggacgaaatc

SEQ ID NO: 242250 - DNA, 32 bp, Artificial Sequence
  Description of Artificial Sequence: Synthetic oligonucleotide
ctgtcccagaagcgaactatggacgaaatcac

SEQ ID NO: 242251 - DNA, 33 bp, Artificial Sequence
  Description of Artificial Sequence: Synthetic oligonucleotide
tgtcccagaagcgaactatggacgaaatcacac

SEQ ID NO: 242252 - DNA, 32 bp, Artificial Sequence
  Description of Artificial Sequence: Synthetic oligonucleotide
gtcccagaagcgaactatggacgaaatcacac

SEQ ID NO: 242253 - DNA, 32 bp, Artificial Sequence
  Description of Artificial Sequence: Synthetic oligonucleotide
tcccagaagcgaactatggacgaaatcacacc

SEQ ID NO: 242254 - DNA, 31 bp, Artificial Sequence
  Description of Artificial Sequence: Synthetic oligonucleotide
cccagaagcgaactatggacgaaatcacacc

SEQ ID NO: 242255 - DNA, 32 bp, Artificial Sequence
  Description of Artificial Sequence: Synthetic oligonucleotide
ccagaagcgaactatggacgaaatcacacctg

SEQ ID NO: 242256 - DNA, 32 bp, Artificial Sequence
  Description of Artificial Sequence: Synthetic oligonucleotide
cagaagcgaactatggacgaaatcacacctgc

SEQ ID NO: 242257 - DNA, 33 bp, Artificial Sequence
  Description of Artificial Sequence: Synthetic oligonucleotide
agaagcgaactatggacgaaatcacacctgctg

SEQ ID NO: 242258 - DNA, 32 bp, Artificial Sequence
  Description of Artificial Sequence: Synthetic oligonucleotide
gaagcgaactatggacgaaatcacacctgctg

SEQ ID NO: 242259 - DNA, 32 bp, Artificial Sequence
  Description of Artificial Sequence: Synthetic oligonucleotide
aagcgaactatggacgaaatcacacctgctgc

SEQ ID NO: 242260 - DNA, 31 bp, Artificial Sequence
  Description of Artificial Sequence: Synthetic oligonucleotide
agcgaactatggacgaaatcacacctgctgc

SEQ ID NO: 242261 - DNA, 30 bp, Artificial Sequence
  Description of Artificial Sequence: Synthetic oligonucleotide
gcgaactatggacgaaatcacacctgctgc

SEQ ID NO: 242262 - DNA, 31 bp, Artificial Sequence
  Description of Artificial Sequence: Synthetic oligonucleotide
cgaactatggacgaaatcacacctgctgcag

SEQ ID NO: 242263 - DNA, 35 bp, Artificial Sequence
  Description of Artificial Sequence: Synthetic oligonucleotide
gaactatggacgaaatcacacctgctgcagaaaag

SEQ ID NO: 242264 - DNA, 36 bp, Artificial Sequence
  Description of Artificial Sequence: Synthetic oligonucleotide
aactatggacgaaatcacacctgctgcagaaaagtc

SEQ ID NO: 242265 - DNA, 35 bp, Artificial Sequence
  Description of Artificial Sequence: Synthetic oligonucleotide
actatggacgaaatcacacctgctgcagaaaagtc

SEQ ID NO: 242266 - DNA, 34 bp, Artificial Sequence
  Description of Artificial Sequence: Synthetic oligonucleotide
ctatggacgaaatcacacctgctgcagaaaagtc

SEQ ID NO: 242267 - DNA, 35 bp, Artificial Sequence
  Description of Artificial Sequence: Synthetic oligonucleotide
tatggacgaaatcacacctgctgcagaaaagtctg

SEQ ID NO: 242268 - DNA, 34 bp, Artificial Sequence
  Description of Artificial Sequence: Synthetic oligonucleotide
atggacgaaatcacacctgctgcagaaaagtctg

SEQ ID NO: 242269 - DNA, 33 bp, Artificial Sequence
  Description of Artificial Sequence: Synthetic oligonucleotide
tggacgaaatcacacctgctgcagaaaagtctg

SEQ ID NO: 242270 - DNA, 32 bp, Artificial Sequence
  Description of Artificial Sequence: Synthetic oligonucleotide
ggacgaaatcacacctgctgcagaaaagtctg

SEQ ID NO: 242271 - DNA, 32 bp, Artificial Sequence
  Description of Artificial Sequence: Synthetic oligonucleotide
gacgaaatcacacctgctgcagaaaagtctgg

SEQ ID NO: 242272 - DNA, 32 bp, Artificial Sequence
  Description of Artificial Sequence: Synthetic oligonucleotide
acgaaatcacacctgctgcagaaaagtctggc

SEQ ID NO: 242273 - DNA, 31 bp, Artificial Sequence
  Description of Artificial Sequence: Synthetic oligonucleotide
cgaaatcacacctgctgcagaaaagtctggc

SEQ ID NO: 242274 - DNA, 31 bp, Artificial Sequence
  Description of Artificial Sequence: Synthetic oligonucleotide
gaaatcacacctgctgcagaaaagtctggcg

SEQ ID NO: 242275 - DNA, 31 bp, Artificial Sequence
  Description of Artificial Sequence: Synthetic oligonucleotide
aaatcacacctgctgcagaaaagtctggcgc

SEQ ID NO: 242276 - DNA, 30 bp, Artificial Sequence
  Description of Artificial Sequence: Synthetic oligonucleotide
aatcacacctgctgcagaaaagtctggcgc

SEQ ID NO: 242277 - DNA, 29 bp, Artificial Sequence
  Description of Artificial Sequence: Synthetic oligonucleotide
atcacacctgctgcagaaaagtctggcgc

SEQ ID NO: 242278 - DNA, 28 bp, Artificial Sequence
  Description of Artificial Sequence: Synthetic oligonucleotide
tcacacctgctgcagaaaagtctggcgc

SEQ ID NO: 242279 - DNA, 27 bp, Artificial Sequence
  Description of Artificial Sequence: Synthetic oligonucleotide
cacacctgctgcagaaaagtctggcgc

SEQ ID NO: 242280 - DNA, 27 bp, Artificial Sequence
  Description of Artificial Sequence: Synthetic oligonucleotide
acacctgctgcagaaaagtctggcgcc

SEQ ID NO: 242281 - DNA, 26 bp, Artificial Sequence
  Description of Artificial Sequence: Synthetic oligonucleotide
cacctgctgcagaaaagtctggcgcc

SEQ ID NO: 242282 - DNA, 27 bp, Artificial Sequence
  Description of Artificial Sequence: Synthetic oligonucleotide
acctgctgcagaaaagtctggcgccca

SEQ ID NO: 242283 - DNA, 27 bp, Artificial Sequence
  Description of Artificial Sequence: Synthetic oligonucleotide
cctgctgcagaaaagtctggcgcccat

SEQ ID NO: 242284 - DNA, 28 bp, Artificial Sequence
  Description of Artificial Sequence: Synthetic oligonucleotide
ctgctgcagaaaagtctggcgcccatag

SEQ ID NO: 242285 - DNA, 31 bp, Artificial Sequence
  Description of Artificial Sequence: Synthetic oligonucleotide
tgctgcagaaaagtctggcgcccatagtatc

SEQ ID NO: 242286 - DNA, 30 bp, Artificial Sequence
  Description of Artificial Sequence: Synthetic oligonucleotide
gctgcagaaaagtctggcgcccatagtatc

SEQ ID NO: 242287 - DNA, 32 bp, Artificial Sequence
  Description of Artificial Sequence: Synthetic oligonucleotide
ctgcagaaaagtctggcgcccatagtatcatc

SEQ ID NO: 242288 - DNA, 33 bp, Artificial Sequence
  Description of Artificial Sequence: Synthetic oligonucleotide
tgcagaaaagtctggcgcccatagtatcatctc

SEQ ID NO: 242289 - DNA, 32 bp, Artificial Sequence
  Description of Artificial Sequence: Synthetic oligonucleotide
gcagaaaagtctggcgcccatagtatcatctc

SEQ ID NO: 242290 - DNA, 33 bp, Artificial Sequence
  Description of Artificial Sequence: Synthetic oligonucleotide
cagaaaagtctggcgcccatagtatcatctctg

SEQ ID NO: 242291 - DNA, 33 bp, Artificial Sequence
  Description of Artificial Sequence: Synthetic oligonucleotide
agaaaagtctggcgcccatagtatcatctctgc

SEQ ID NO: 242292 - DNA, 32 bp, Artificial Sequence
  Description of Artificial Sequence: Synthetic oligonucleotide
gaaaagtctggcgcccatagtatcatctctgc

SEQ ID NO: 242293 - DNA, 33 bp, Artificial Sequence
  Description of Artificial Sequence: Synthetic oligonucleotide
aaaagtctggcgcccatagtatcatctctgcac

SEQ ID NO: 242294 - DNA, 32 bp, Artificial Sequence
  Description of Artificial Sequence: Synthetic oligonucleotide
aaagtctggcgcccatagtatcatctctgcac

SEQ ID NO: 242295 - DNA, 31 bp, Artificial Sequence
  Description of Artificial Sequence: Synthetic oligonucleotide
aagtctggcgcccatagtatcatctctgcac

SEQ ID NO: 242296 - DNA, 30 bp, Artificial Sequence
  Description of Artificial Sequence: Synthetic oligonucleotide
agtctggcgcccatagtatcatctctgcac

SEQ ID NO: 242297 - DNA, 29 bp, Artificial Sequence
  Description of Artificial Sequence: Synthetic oligonucleotide
gtctggcgcccatagtatcatctctgcac

SEQ ID NO: 242298 - DNA, 30 bp, Artificial Sequence
  Description of Artificial Sequence: Synthetic oligonucleotide
tctggcgcccatagtatcatctctgcactc

SEQ ID NO: 242299 - DNA, 29 bp, Artificial Sequence
  Description of Artificial Sequence: Synthetic oligonucleotide
ctggcgcccatagtatcatctctgcactc

SEQ ID NO: 242300 - DNA, 29 bp, Artificial Sequence
  Description of Artificial Sequence: Synthetic oligonucleotide
tggcgcccatagtatcatctctgcactcc

SEQ ID NO: 242301 - DNA, 28 bp, Artificial Sequence
  Description of Artificial Sequence: Synthetic oligonucleotide
ggcgcccatagtatcatctctgcactcc

SEQ ID NO: 242302 - DNA, 28 bp, Artificial Sequence
  Description of Artificial Sequence: Synthetic oligonucleotide
gcgcccatagtatcatctctgcactccc

SEQ ID NO: 242303 - DNA, 29 bp, Artificial Sequence
  Description of Artificial Sequence: Synthetic oligonucleotide
cgcccatagtatcatctctgcactccctc

SEQ ID NO: 242304 - DNA, 30 bp, Artificial Sequence
  Description of Artificial Sequence: Synthetic oligonucleotide
gcccatagtatcatctctgcactccctcac

SEQ ID NO: 242305 - DNA, 30 bp, Artificial Sequence
  Description of Artificial Sequence: Synthetic oligonucleotide
cccatagtatcatctctgcactccctcacg

SEQ ID NO: 242306 - DNA, 30 bp, Artificial Sequence
  Description of Artificial Sequence: Synthetic oligonucleotide
ccatagtatcatctctgcactccctcacgg

SEQ ID NO: 242307 - DNA, 30 bp, Artificial Sequence
  Description of Artificial Sequence: Synthetic oligonucleotide
catagtatcatctctgcactccctcacggc

SEQ ID NO: 242308 - DNA, 33 bp, Artificial Sequence
  Description of Artificial Sequence: Synthetic oligonucleotide
atagtatcatctctgcactccctcacggctatg

SEQ ID NO: 242309 - DNA, 32 bp, Artificial Sequence
  Description of Artificial Sequence: Synthetic oligonucleotide
tagtatcatctctgcactccctcacggctatg

SEQ ID NO: 242310 - DNA, 31 bp, Artificial Sequence
  Description of Artificial Sequence: Synthetic oligonucleotide
agtatcatctctgcactccctcacggctatg

SEQ ID NO: 242311 - DNA, 30 bp, Artificial Sequence
  Description of Artificial Sequence: Synthetic oligonucleotide
gtatcatctctgcactccctcacggctatg

SEQ ID NO: 242312 - DNA, 31 bp, Artificial Sequence
  Description of Artificial Sequence: Synthetic oligonucleotide
tatcatctctgcactccctcacggctatgac

SEQ ID NO: 242313 - DNA, 30 bp, Artificial Sequence
  Description of Artificial Sequence: Synthetic oligonucleotide
atcatctctgcactccctcacggctatgac

SEQ ID NO: 242314 - DNA, 29 bp, Artificial Sequence
  Description of Artificial Sequence: Synthetic oligonucleotide
tcatctctgcactccctcacggctatgac

SEQ ID NO: 242315 - DNA, 28 bp, Artificial Sequence
  Description of Artificial Sequence: Synthetic oligonucleotide
catctctgcactccctcacggctatgac

SEQ ID NO: 242316 - DNA, 29 bp, Artificial Sequence
  Description of Artificial Sequence: Synthetic oligonucleotide
atctctgcactccctcacggctatgactc

SEQ ID NO: 242317 - DNA, 28 bp, Artificial Sequence
  Description of Artificial Sequence: Synthetic oligonucleotide
tctctgcactccctcacggctatgactc

SEQ ID NO: 242318 - DNA, 27 bp, Artificial Sequence
  Description of Artificial Sequence: Synthetic oligonucleotide
ctctgcactccctcacggctatgactc

SEQ ID NO: 242319 - DNA, 28 bp, Artificial Sequence
  Description of Artificial Sequence: Synthetic oligonucleotide
tctgcactccctcacggctatgactcag

SEQ ID NO: 242320 - DNA, 27 bp, Artificial Sequence
  Description of Artificial Sequence: Synthetic oligonucleotide
ctgcactccctcacggctatgactcag

SEQ ID NO: 242321 - DNA, 28 bp, Artificial Sequence
  Description of Artificial Sequence: Synthetic oligonucleotide
tgcactccctcacggctatgactcagag

SEQ ID NO: 242322 - DNA, 27 bp, Artificial Sequence
  Description of Artificial Sequence: Synthetic oligonucleotide
gcactccctcacggctatgactcagag

SEQ ID NO: 242323 - DNA, 27 bp, Artificial Sequence
  Description of Artificial Sequence: Synthetic oligonucleotide
cactccctcacggctatgactcagagg

SEQ ID NO: 242324 - DNA, 29 bp, Artificial Sequence
  Description of Artificial Sequence: Synthetic oligonucleotide
actccctcacggctatgactcagaggtag

SEQ ID NO: 242325 - DNA, 28 bp, Artificial Sequence
  Description of Artificial Sequence: Synthetic oligonucleotide
ctccctcacggctatgactcagaggtag

SEQ ID NO: 242326 - DNA, 28 bp, Artificial Sequence
  Description of Artificial Sequence: Synthetic oligonucleotide
tccctcacggctatgactcagaggtagc

SEQ ID NO: 242327 - DNA, 27 bp, Artificial Sequence
  Description of Artificial Sequence: Synthetic oligonucleotide
ccctcacggctatgactcagaggtagc

SEQ ID NO: 242328 - DNA, 27 bp, Artificial Sequence
  Description of Artificial Sequence: Synthetic oligonucleotide
cctcacggctatgactcagaggtagcc

SEQ ID NO: 242329 - DNA, 27 bp, Artificial Sequence
  Description of Artificial Sequence: Synthetic oligonucleotide
ctcacggctatgactcagaggtagccg

SEQ ID NO: 242330 - DNA, 28 bp, Artificial Sequence
  Description of Artificial Sequence: Synthetic oligonucleotide
tcacggctatgactcagaggtagccgag

SEQ ID NO: 242331 - DNA, 27 bp, Artificial Sequence
  Description of Artificial Sequence: Synthetic oligonucleotide
cacggctatgactcagaggtagccgag

SEQ ID NO: 242332 - DNA, 27 bp, Artificial Sequence
  Description of Artificial Sequence: Synthetic oligonucleotide
acggctatgactcagaggtagccgagg

SEQ ID NO: 242333 - DNA, 26 bp, Artificial Sequence
  Description of Artificial Sequence: Synthetic oligonucleotide
cggctatgactcagaggtagccgagg

SEQ ID NO: 242334 - DNA, 27 bp, Artificial Sequence
  Description of Artificial Sequence: Synthetic oligonucleotide
ggctatgactcagaggtagccgaggct

SEQ ID NO: 242335 - DNA, 27 bp, Artificial Sequence
  Description of Artificial Sequence: Synthetic oligonucleotide
gctatgactcagaggtagccgaggctg

SEQ ID NO: 242336 - DNA, 27 bp, Artificial Sequence
  Description of Artificial Sequence: Synthetic oligonucleotide
ctatgactcagaggtagccgaggctgg

SEQ ID NO: 242337 - DNA, 27 bp, Artificial Sequence
  Description of Artificial Sequence: Synthetic oligonucleotide
tatgactcagaggtagccgaggctggc

SEQ ID NO: 242338 - DNA, 27 bp, Artificial Sequence
  Description of Artificial Sequence: Synthetic oligonucleotide
atgactcagaggtagccgaggctggca

SEQ ID NO: 242339 - DNA, 26 bp, Artificial Sequence
  Description of Artificial Sequence: Synthetic oligonucleotide
tgactcagaggtagccgaggctggca

SEQ ID NO: 242340 - DNA, 25 bp, Artificial Sequence
  Description of Artificial Sequence: Synthetic oligonucleotide
gactcagaggtagccgaggctggca

SEQ ID NO: 242341 - DNA, 25 bp, Artificial Sequence
  Description of Artificial Sequence: Synthetic oligonucleotide
actcagaggtagccgaggctggcag

SEQ ID NO: 242342 - DNA, 24 bp, Artificial Sequence
  Description of Artificial Sequence: Synthetic oligonucleotide
ctcagaggtagccgaggctggcag

SEQ ID NO: 242343 - DNA, 24 bp, Artificial Sequence
  Description of Artificial Sequence: Synthetic oligonucleotide
tcagaggtagccgaggctggcagc

SEQ ID NO: 242344 - DNA, 23 bp, Artificial Sequence
  Description of Artificial Sequence: Synthetic oligonucleotide
cagaggtagccgaggctggcagc

SEQ ID NO: 242345 - DNA, 24 bp, Artificial Sequence
  Description of Artificial Sequence: Synthetic oligonucleotide
agaggtagccgaggctggcagcca

SEQ ID NO: 242346 - DNA, 23 bp, Artificial Sequence
  Description of Artificial Sequence: Synthetic oligonucleotide
gaggtagccgaggctggcagcca

SEQ ID NO: 242347 - DNA, 25 bp, Artificial Sequence
  Description of Artificial Sequence: Synthetic oligonucleotide
aggtagccgaggctggcagccagtt

SEQ ID NO: 242348 - DNA, 24 bp, Artificial Sequence
  Description of Artificial Sequence: Synthetic oligonucleotide
ggtagccgaggctggcagccagtt

SEQ ID NO: 242349 - DNA, 25 bp, Artificial Sequence
  Description of Artificial Sequence: Synthetic oligonucleotide
gtagccgaggctggcagccagttga

SEQ ID NO: 242350 - DNA, 26 bp, Artificial Sequence
  Description of Artificial Sequence: Synthetic oligonucleotide
tagccgaggctggcagccagttgaca

SEQ ID NO: 242351 - DNA, 25 bp, Artificial Sequence
  Description of Artificial Sequence: Synthetic oligonucleotide
agccgaggctggcagccagttgaca

SEQ ID NO: 242352 - DNA, 24 bp, Artificial Sequence
  Description of Artificial Sequence: Synthetic oligonucleotide
gccgaggctggcagccagttgaca

SEQ ID NO: 242353 - DNA, 24 bp, Artificial Sequence
  Description of Artificial Sequence: Synthetic oligonucleotide
ccgaggctggcagccagttgacag

SEQ ID NO: 242354 - DNA, 24 bp, Artificial Sequence
  Description of Artificial Sequence: Synthetic oligonucleotide
cgaggctggcagccagttgacagg

SEQ ID NO: 242355 - DNA, 24 bp, Artificial Sequence
  Description of Artificial Sequence: Synthetic oligonucleotide
gaggctggcagccagttgacaggg

SEQ ID NO: 242356 - DNA, 24 bp, Artificial Sequence
  Description of Artificial Sequence: Synthetic oligonucleotide
aggctggcagccagttgacagggg

SEQ ID NO: 242357 - DNA, 23 bp, Artificial Sequence
  Description of Artificial Sequence: Synthetic oligonucleotide
ggctggcagccagttgacagggg

SEQ ID NO: 242358 - DNA, 24 bp, Artificial Sequence
  Description of Artificial Sequence: Synthetic oligonucleotide
gctggcagccagttgacagggggt

SEQ ID NO: 242359 - DNA, 25 bp, Artificial Sequence
  Description of Artificial Sequence: Synthetic oligonucleotide
ctggcagccagttgacagggggtct

SEQ ID NO: 242360 - DNA, 25 bp, Artificial Sequence
  Description of Artificial Sequence: Synthetic oligonucleotide
tggcagccagttgacagggggtctg

SEQ ID NO: 242361 - DNA, 24 bp, Artificial Sequence
  Description of Artificial Sequence: Synthetic oligonucleotide
ggcagccagttgacagggggtctg

SEQ ID NO: 242362 - DNA, 24 bp, Artificial Sequence
  Description of Artificial Sequence: Synthetic oligonucleotide
gcagccagttgacagggggtctgc

SEQ ID NO: 242363 - DNA, 25 bp, Artificial Sequence
  Description of Artificial Sequence: Synthetic oligonucleotide
cagccagttgacagggggtctgcga

SEQ ID NO: 242364 - DNA, 26 bp, Artificial Sequence
  Description of Artificial Sequence: Synthetic oligonucleotide
agccagttgacagggggtctgcgaca

SEQ ID NO: 242365 - DNA, 25 bp, Artificial Sequence
  Description of Artificial Sequence: Synthetic oligonucleotide
gccagttgacagggggtctgcgaca

SEQ ID NO: 242366 - DNA, 25 bp, Artificial Sequence
  Description of Artificial Sequence: Synthetic oligonucleotide
ccagttgacagggggtctgcgacag

SEQ ID NO: 242367 - DNA, 25 bp, Artificial Sequence
  Description of Artificial Sequence: Synthetic oligonucleotide
cagttgacagggggtctgcgacagg

SEQ ID NO: 242368 - DNA, 26 bp, Artificial Sequence
  Description of Artificial Sequence: Synthetic oligonucleotide
agttgacagggggtctgcgacaggct

SEQ ID NO: 242369 - DNA, 25 bp, Artificial Sequence
  Description of Artificial Sequence: Synthetic oligonucleotide
gttgacagggggtctgcgacaggct

SEQ ID NO: 242370 - DNA, 26 bp, Artificial Sequence
  Description of Artificial Sequence: Synthetic oligonucleotide
ttgacagggggtctgcgacaggctgt

SEQ ID NO: 242371 - DNA, 25 bp, Artificial Sequence
  Description of Artificial Sequence: Synthetic oligonucleotide
tgacagggggtctgcgacaggctgt

SEQ ID NO: 242372 - DNA, 24 bp, Artificial Sequence
  Description of Artificial Sequence: Synthetic oligonucleotide
gacagggggtctgcgacaggctgt

SEQ ID NO: 242373 - DNA, 24 bp, Artificial Sequence
  Description of Artificial Sequence: Synthetic oligonucleotide
acagggggtctgcgacaggctgtg

SEQ ID NO: 242374 - DNA, 23 bp, Artificial Sequence
  Description of Artificial Sequence: Synthetic oligonucleotide
cagggggtctgcgacaggctgtg

SEQ ID NO: 242375 - DNA, 23 bp, Artificial Sequence
  Description of Artificial Sequence: Synthetic oligonucleotide
agggggtctgcgacaggctgtgg

SEQ ID NO: 242376 - DNA, 22 bp, Artificial Sequence
  Description of Artificial Sequence: Synthetic oligonucleotide
gggggtctgcgacaggctgtgg

SEQ ID NO: 242377 - DNA, 22 bp, Artificial Sequence
  Description of Artificial Sequence: Synthetic oligonucleotide
ggggtctgcgacaggctgtggc

SEQ ID NO: 242378 - DNA, 24 bp, Artificial Sequence
  Description of Artificial Sequence: Synthetic oligonucleotide
gggtctgcgacaggctgtggcgtt

SEQ ID NO: 242379 - DNA, 24 bp, Artificial Sequence
  Description of Artificial Sequence: Synthetic oligonucleotide
ggtctgcgacaggctgtggcgttg

SEQ ID NO: 242380 - DNA, 24 bp, Artificial Sequence
  Description of Artificial Sequence: Synthetic oligonucleotide
gtctgcgacaggctgtggcgttgc

SEQ ID NO: 242381 - DNA, 24 bp, Artificial Sequence
  Description of Artificial Sequence: Synthetic oligonucleotide
tctgcgacaggctgtggcgttgcc

SEQ ID NO: 242382 - DNA, 23 bp, Artificial Sequence
  Description of Artificial Sequence: Synthetic oligonucleotide
ctgcgacaggctgtggcgttgcc

SEQ ID NO: 242383 - DNA, 23 bp, Artificial Sequence
  Description of Artificial Sequence: Synthetic oligonucleotide
tgcgacaggctgtggcgttgccc

SEQ ID NO: 242384 - DNA, 22 bp, Artificial Sequence
  Description of Artificial Sequence: Synthetic oligonucleotide
gcgacaggctgtggcgttgccc

SEQ ID NO: 242385 - DNA, 22 bp, Artificial Sequence
  Description of Artificial Sequence: Synthetic oligonucleotide
cgacaggctgtggcgttgcccc

SEQ ID NO: 242386 - DNA, 23 bp, Artificial Sequence
  Description of Artificial Sequence: Synthetic oligonucleotide
gacaggctgtggcgttgccccga

SEQ ID NO: 242387 - DNA, 23 bp, Artificial Sequence
  Description of Artificial Sequence: Synthetic oligonucleotide
acaggctgtggcgttgccccgag

SEQ ID NO: 242388 - DNA, 22 bp, Artificial Sequence
  Description of Artificial Sequence: Synthetic oligonucleotide
caggctgtggcgttgccccgag

SEQ ID NO: 242389 - DNA, 25 bp, Artificial Sequence
  Description of Artificial Sequence: Synthetic oligonucleotide
aggctgtggcgttgccccgagcata

SEQ ID NO: 242390 - DNA, 24 bp, Artificial Sequence
  Description of Artificial Sequence: Synthetic oligonucleotide
ggctgtggcgttgccccgagcata

SEQ ID NO: 242391 - DNA, 26 bp, Artificial Sequence
  Description of Artificial Sequence: Synthetic oligonucleotide
gctgtggcgttgccccgagcatagat

SEQ ID NO: 242392 - DNA, 26 bp, Artificial Sequence
  Description of Artificial Sequence: Synthetic oligonucleotide
ctgtggcgttgccccgagcatagatc

SEQ ID NO: 242393 - DNA, 26 bp, Artificial Sequence
  Description of Artificial Sequence: Synthetic oligonucleotide
tgtggcgttgccccgagcatagatcc

SEQ ID NO: 242394 - DNA, 25 bp, Artificial Sequence
  Description of Artificial Sequence: Synthetic oligonucleotide
gtggcgttgccccgagcatagatcc

SEQ ID NO: 242395 - DNA, 25 bp, Artificial Sequence
  Description of Artificial Sequence: Synthetic oligonucleotide
tggcgttgccccgagcatagatccg

SEQ ID NO: 242396 - DNA, 24 bp, Artificial Sequence
  Description of Artificial Sequence: Synthetic oligonucleotide
ggcgttgccccgagcatagatccg

SEQ ID NO: 242397 - DNA, 27 bp, Artificial Sequence
  Description of Artificial Sequence: Synthetic oligonucleotide
gcgttgccccgagcatagatccggaat

SEQ ID NO: 242398 - DNA, 27 bp, Artificial Sequence
  Description of Artificial Sequence: Synthetic oligonucleotide
cgttgccccgagcatagatccggaatc

SEQ ID NO: 242399 - DNA, 27 bp, Artificial Sequence
  Description of Artificial Sequence: Synthetic oligonucleotide
gttgccccgagcatagatccggaatcc

SEQ ID NO: 242400 - DNA, 29 bp, Artificial Sequence
  Description of Artificial Sequence: Synthetic oligonucleotide
ttgccccgagcatagatccggaatccatg

SEQ ID NO: 242401 - DNA, 28 bp, Artificial Sequence
  Description of Artificial Sequence: Synthetic oligonucleotide
tgccccgagcatagatccggaatccatg

SEQ ID NO: 242402 - DNA, 27 bp, Artificial Sequence
  Description of Artificial Sequence: Synthetic oligonucleotide
gccccgagcatagatccggaatccatg

SEQ ID NO: 242403 - DNA, 28 bp, Artificial Sequence
  Description of Artificial Sequence: Synthetic oligonucleotide
ccccgagcatagatccggaatccatgtg

SEQ ID NO: 242404 - DNA, 30 bp, Artificial Sequence
  Description of Artificial Sequence: Synthetic oligonucleotide
cccgagcatagatccggaatccatgtgtag

SEQ ID NO: 242405 - DNA, 34 bp, Artificial Sequence
  Description of Artificial Sequence: Synthetic oligonucleotide
ccgagcatagatccggaatccatgtgtagttatc

SEQ ID NO: 242406 - DNA, 34 bp, Artificial Sequence
  Description of Artificial Sequence: Synthetic oligonucleotide
cgagcatagatccggaatccatgtgtagttatcc

SEQ ID NO: 242407 - DNA, 35 bp, Artificial Sequence
  Description of Artificial Sequence: Synthetic oligonucleotide
gagcatagatccggaatccatgtgtagttatcctg

SEQ ID NO: 242408 - DNA, 35 bp, Artificial Sequence
  Description of Artificial Sequence: Synthetic oligonucleotide
agcatagatccggaatccatgtgtagttatcctgg

SEQ ID NO: 242409 - DNA, 34 bp, Artificial Sequence
  Description of Artificial Sequence: Synthetic oligonucleotide
gcatagatccggaatccatgtgtagttatcctgg

SEQ ID NO: 242410 - DNA, 36 bp, Artificial Sequence
  Description of Artificial Sequence: Synthetic oligonucleotide
catagatccggaatccatgtgtagttatcctggttg

SEQ ID NO: 242411 - DNA, 38 bp, Artificial Sequence
  Description of Artificial Sequence: Synthetic oligonucleotide
atagatccggaatccatgtgtagttatcctggttgatg

SEQ ID NO: 242412 - DNA, 37 bp, Artificial Sequence
  Description of Artificial Sequence: Synthetic oligonucleotide
tagatccggaatccatgtgtagttatcctggttgatg

SEQ ID NO: 242413 - DNA, 36 bp, Artificial Sequence
  Description of Artificial Sequence: Synthetic oligonucleotide
agatccggaatccatgtgtagttatcctggttgatg

SEQ ID NO: 242414 - DNA, 35 bp, Artificial Sequence
  Description of Artificial Sequence: Synthetic oligonucleotide
gatccggaatccatgtgtagttatcctggttgatg

SEQ ID NO: 242415 - DNA, 35 bp, Artificial Sequence
  Description of Artificial Sequence: Synthetic oligonucleotide
atccggaatccatgtgtagttatcctggttgatgc

SEQ ID NO: 242416 - DNA, 34 bp, Artificial Sequence
  Description of Artificial Sequence: Synthetic oligonucleotide
tccggaatccatgtgtagttatcctggttgatgc

SEQ ID NO: 242417 - DNA, 33 bp, Artificial Sequence
  Description of Artificial Sequence: Synthetic oligonucleotide
ccggaatccatgtgtagttatcctggttgatgc

SEQ ID NO: 242418 - DNA, 33 bp, Artificial Sequence
  Description of Artificial Sequence: Synthetic oligonucleotide
cggaatccatgtgtagttatcctggttgatgcc

SEQ ID NO: 242419 - DNA, 34 bp, Artificial Sequence
  Description of Artificial Sequence: Synthetic oligonucleotide
ggaatccatgtgtagttatcctggttgatgccac

SEQ ID NO: 242420 - DNA, 34 bp, Artificial Sequence
  Description of Artificial Sequence: Synthetic oligonucleotide
gaatccatgtgtagttatcctggttgatgccacg

SEQ ID NO: 242421 - DNA, 35 bp, Artificial Sequence
  Description of Artificial Sequence: Synthetic oligonucleotide
aatccatgtgtagttatcctggttgatgccacgag

SEQ ID NO: 242422 - DNA, 34 bp, Artificial Sequence
  Description of Artificial Sequence: Synthetic oligonucleotide
atccatgtgtagttatcctggttgatgccacgag

SEQ ID NO: 242423 - DNA, 33 bp, Artificial Sequence
  Description of Artificial Sequence: Synthetic oligonucleotide
tccatgtgtagttatcctggttgatgccacgag

SEQ ID NO: 242424 - DNA, 32 bp, Artificial Sequence
  Description of Artificial Sequence: Synthetic oligonucleotide
ccatgtgtagttatcctggttgatgccacgag

SEQ ID NO: 242425 - DNA, 33 bp, Artificial Sequence
  Description of Artificial Sequence: Synthetic oligonucleotide
catgtgtagttatcctggttgatgccacgagtg

SEQ ID NO: 242426 - DNA, 33 bp, Artificial Sequence
  Description of Artificial Sequence: Synthetic oligonucleotide
atgtgtagttatcctggttgatgccacgagtgc

SEQ ID NO: 242427 - DNA, 32 bp, Artificial Sequence
  Description of Artificial Sequence: Synthetic oligonucleotide
tgtgtagttatcctggttgatgccacgagtgc

SEQ ID NO: 242428 - DNA, 31 bp, Artificial Sequence
  Description of Artificial Sequence: Synthetic oligonucleotide
gtgtagttatcctggttgatgccacgagtgc

SEQ ID NO: 242429 - DNA, 31 bp, Artificial Sequence
  Description of Artificial Sequence: Synthetic oligonucleotide
tgtagttatcctggttgatgccacgagtgcc

SEQ ID NO: 242430 - DNA, 30 bp, Artificial Sequence
  Description of Artificial Sequence: Synthetic oligonucleotide
gtagttatcctggttgatgccacgagtgcc

SEQ ID NO: 242431 - DNA, 30 bp, Artificial Sequence
  Description of Artificial Sequence: Synthetic oligonucleotide
tagttatcctggttgatgccacgagtgccc

SEQ ID NO: 242432 - DNA, 29 bp, Artificial Sequence
  Description of Artificial Sequence: Synthetic oligonucleotide
agttatcctggttgatgccacgagtgccc

SEQ ID NO: 242433 - DNA, 28 bp, Artificial Sequence
  Description of Artificial Sequence: Synthetic oligonucleotide
gttatcctggttgatgccacgagtgccc

SEQ ID NO: 242434 - DNA, 29 bp, Artificial Sequence
  Description of Artificial Sequence: Synthetic oligonucleotide
ttatcctggttgatgccacgagtgccctg

SEQ ID NO: 242435 - DNA, 28 bp, Artificial Sequence
  Description of Artificial Sequence: Synthetic oligonucleotide
tatcctggttgatgccacgagtgccctg

SEQ ID NO: 242436 - DNA, 27 bp, Artificial Sequence
  Description of Artificial Sequence: Synthetic oligonucleotide
atcctggttgatgccacgagtgccctg

SEQ ID NO: 242437 - DNA, 26 bp, Artificial Sequence
  Description of Artificial Sequence: Synthetic oligonucleotide
tcctggttgatgccacgagtgccctg

SEQ ID NO: 242438 - DNA, 25 bp, Artificial Sequence
  Description of Artificial Sequence: Synthetic oligonucleotide
cctggttgatgccacgagtgccctg

SEQ ID NO: 242439 - DNA, 27 bp, Artificial Sequence
  Description of Artificial Sequence: Synthetic oligonucleotide
ctggttgatgccacgagtgccctgcat

SEQ ID NO: 242440 - DNA, 27 bp, Artificial Sequence
  Description of Artificial Sequence: Synthetic oligonucleotide
tggttgatgccacgagtgccctgcatg

SEQ ID NO: 242441 - DNA, 26 bp, Artificial Sequence
  Description of Artificial Sequence: Synthetic oligonucleotide
ggttgatgccacgagtgccctgcatg

SEQ ID NO: 242442 - DNA, 27 bp, Artificial Sequence
  Description of Artificial Sequence: Synthetic oligonucleotide
gttgatgccacgagtgccctgcatgca

SEQ ID NO: 242443 - DNA, 29 bp, Artificial Sequence
  Description of Artificial Sequence: Synthetic oligonucleotide
ttgatgccacgagtgccctgcatgcaaac

SEQ ID NO: 242444 - DNA, 28 bp, Artificial Sequence
  Description of Artificial Sequence: Synthetic oligonucleotide
tgatgccacgagtgccctgcatgcaaac

SEQ ID NO: 242445 - DNA, 27 bp, Artificial Sequence
  Description of Artificial Sequence: Synthetic oligonucleotide
gatgccacgagtgccctgcatgcaaac

SEQ ID NO: 242446 - DNA, 28 bp, Artificial Sequence
  Description of Artificial Sequence: Synthetic oligonucleotide
atgccacgagtgccctgcatgcaaacac

SEQ ID NO: 242447 - DNA, 27 bp, Artificial Sequence
  Description of Artificial Sequence: Synthetic oligonucleotide
tgccacgagtgccctgcatgcaaacac

SEQ ID NO: 242448 - DNA, 26 bp, Artificial Sequence
  Description of Artificial Sequence: Synthetic oligonucleotide
gccacgagtgccctgcatgcaaacac

SEQ ID NO: 242449 - DNA, 26 bp, Artificial Sequence
  Description of Artificial Sequence: Synthetic oligonucleotide
ccacgagtgccctgcatgcaaacacc

SEQ ID NO: 242450 - DNA, 27 bp, Artificial Sequence
  Description of Artificial Sequence: Synthetic oligonucleotide
cacgagtgccctgcatgcaaacaccca

SEQ ID NO: 242451 - DNA, 27 bp, Artificial Sequence
  Description of Artificial Sequence: Synthetic oligonucleotide
acgagtgccctgcatgcaaacacccag

SEQ ID NO: 242452 - DNA, 27 bp, Artificial Sequence
  Description of Artificial Sequence: Synthetic oligonucleotide
cgagtgccctgcatgcaaacacccagt

SEQ ID NO: 242453 - DNA, 29 bp, Artificial Sequence
  Description of Artificial Sequence: Synthetic oligonucleotide
gagtgccctgcatgcaaacacccagttac

SEQ ID NO: 242454 - DNA, 30 bp, Artificial Sequence
  Description of Artificial Sequence: Synthetic oligonucleotide
agtgccctgcatgcaaacacccagttacac

SEQ ID NO: 242455 - DNA, 29 bp, Artificial Sequence
  Description of Artificial Sequence: Synthetic oligonucleotide
gtgccctgcatgcaaacacccagttacac

SEQ ID NO: 242456 - DNA, 29 bp, Artificial Sequence
  Description of Artificial Sequence: Synthetic oligonucleotide
tgccctgcatgcaaacacccagttacacg

SEQ ID NO: 242457 - DNA, 28 bp, Artificial Sequence
  Description of Artificial Sequence: Synthetic oligonucleotide
gccctgcatgcaaacacccagttacacg

SEQ ID NO: 242458 - DNA, 29 bp, Artificial Sequence
  Description of Artificial Sequence: Synthetic oligonucleotide
ccctgcatgcaaacacccagttacacgtg

SEQ ID NO: 242459 - DNA, 29 bp, Artificial Sequence
  Description of Artificial Sequence: Synthetic oligonucleotide
cctgcatgcaaacacccagttacacgtgg

SEQ ID NO: 242460 - DNA, 30 bp, Artificial Sequence
  Description of Artificial Sequence: Synthetic oligonucleotide
ctgcatgcaaacacccagttacacgtggag

SEQ ID NO: 242461 - DNA, 30 bp, Artificial Sequence
  Description of Artificial Sequence: Synthetic oligonucleotide
tgcatgcaaacacccagttacacgtggagc

SEQ ID NO: 242462 - DNA, 29 bp, Artificial Sequence
  Description of Artificial Sequence: Synthetic oligonucleotide
gcatgcaaacacccagttacacgtggagc

SEQ ID NO: 242463 - DNA, 30 bp, Artificial Sequence
  Description of Artificial Sequence: Synthetic oligonucleotide
catgcaaacacccagttacacgtggagcag

SEQ ID NO: 242464 - DNA, 30 bp, Artificial Sequence
  Description of Artificial Sequence: Synthetic oligonucleotide
atgcaaacacccagttacacgtggagcagg

SEQ ID NO: 242465 - DNA, 29 bp, Artificial Sequence
  Description of Artificial Sequence: Synthetic oligonucleotide
tgcaaacacccagttacacgtggagcagg

SEQ ID NO: 242466 - DNA, 28 bp, Artificial Sequence
  Description of Artificial Sequence: Synthetic oligonucleotide
gcaaacacccagttacacgtggagcagg

SEQ ID NO: 242467 - DNA, 29 bp, Artificial Sequence
  Description of Artificial Sequence: Synthetic oligonucleotide
caaacacccagttacacgtggagcaggtc

SEQ ID NO: 242468 - DNA, 29 bp, Artificial Sequence
  Description of Artificial Sequence: Synthetic oligonucleotide
aaacacccagttacacgtggagcaggtcc

SEQ ID NO: 242469 - DNA, 28 bp, Artificial Sequence
  Description of Artificial Sequence: Synthetic oligonucleotide
aacacccagttacacgtggagcaggtcc

SEQ ID NO: 242470 - DNA, 27 bp, Artificial Sequence
  Description of Artificial Sequence: Synthetic oligonucleotide
acacccagttacacgtggagcaggtcc

SEQ ID NO: 242471 - DNA, 27 bp, Artificial Sequence
  Description of Artificial Sequence: Synthetic oligonucleotide
cacccagttacacgtggagcaggtcct

SEQ ID NO: 242472 - DNA, 27 bp, Artificial Sequence
  Description of Artificial Sequence: Synthetic oligonucleotide
acccagttacacgtggagcaggtcctg

SEQ ID NO: 242473 - DNA, 27 bp, Artificial Sequence
  Description of Artificial Sequence: Synthetic oligonucleotide
cccagttacacgtggagcaggtcctgt

SEQ ID NO: 242474 - DNA, 28 bp, Artificial Sequence
  Description of Artificial Sequence: Synthetic oligonucleotide
ccagttacacgtggagcaggtcctgtac

SEQ ID NO: 242475 - DNA, 28 bp, Artificial Sequence
  Description of Artificial Sequence: Synthetic oligonucleotide
cagttacacgtggagcaggtcctgtacg

SEQ ID NO: 242476 - DNA, 31 bp, Artificial Sequence
  Description of Artificial Sequence: Synthetic oligonucleotide
agttacacgtggagcaggtcctgtacgtaag

SEQ ID NO: 242477 - DNA, 30 bp, Artificial Sequence
  Description of Artificial Sequence: Synthetic oligonucleotide
gttacacgtggagcaggtcctgtacgtaag

SEQ ID NO: 242478 - DNA, 30 bp, Artificial Sequence
  Description of Artificial Sequence: Synthetic oligonucleotide
ttacacgtggagcaggtcctgtacgtaagc

SEQ ID NO: 242479 - DNA, 29 bp, Artificial Sequence
  Description of Artificial Sequence: Synthetic oligonucleotide
tacacgtggagcaggtcctgtacgtaagc

SEQ ID NO: 242480 - DNA, 28 bp, Artificial Sequence
  Description of Artificial Sequence: Synthetic oligonucleotide
acacgtggagcaggtcctgtacgtaagc

SEQ ID NO: 242481 - DNA, 27 bp, Artificial Sequence
  Description of Artificial Sequence: Synthetic oligonucleotide
cacgtggagcaggtcctgtacgtaagc

SEQ ID NO: 242482 - DNA, 27 bp, Artificial Sequence
  Description of Artificial Sequence: Synthetic oligonucleotide
acgtggagcaggtcctgtacgtaagcc

SEQ ID NO: 242483 - DNA, 26 bp, Artificial Sequence
  Description of Artificial Sequence: Synthetic oligonucleotide
cgtggagcaggtcctgtacgtaagcc

SEQ ID NO: 242484 - DNA, 27 bp, Artificial Sequence
  Description of Artificial Sequence: Synthetic oligonucleotide
gtggagcaggtcctgtacgtaagccct

SEQ ID NO: 242485 - DNA, 27 bp, Artificial Sequence
  Description of Artificial Sequence: Synthetic oligonucleotide
tggagcaggtcctgtacgtaagccctg

SEQ ID NO: 242486 - DNA, 27 bp, Artificial Sequence
  Description of Artificial Sequence: Synthetic oligonucleotide
ggagcaggtcctgtacgtaagccctga

SEQ ID NO: 242487 - DNA, 27 bp, Artificial Sequence
  Description of Artificial Sequence: Synthetic oligonucleotide
gagcaggtcctgtacgtaagccctgac

SEQ ID NO: 242488 - DNA, 27 bp, Artificial Sequence
  Description of Artificial Sequence: Synthetic oligonucleotide
agcaggtcctgtacgtaagccctgacc

SEQ ID NO: 242489 - DNA, 26 bp, Artificial Sequence
  Description of Artificial Sequence: Synthetic oligonucleotide
gcaggtcctgtacgtaagccctgacc

SEQ ID NO: 242490 - DNA, 26 bp, Artificial Sequence
  Description of Artificial Sequence: Synthetic oligonucleotide
caggtcctgtacgtaagccctgaccg

SEQ ID NO: 242491 - DNA, 27 bp, Artificial Sequence
  Description of Artificial Sequence: Synthetic oligonucleotide
aggtcctgtacgtaagccctgaccggt

SEQ ID NO: 242492 - DNA, 27 bp, Artificial Sequence
  Description of Artificial Sequence: Synthetic oligonucleotide
ggtcctgtacgtaagccctgaccggta

SEQ ID NO: 242493 - DNA, 27 bp, Artificial Sequence
  Description of Artificial Sequence: Synthetic oligonucleotide
gtcctgtacgtaagccctgaccggtac

SEQ ID NO: 242494 - DNA, 28 bp, Artificial Sequence
  Description of Artificial Sequence: Synthetic oligonucleotide
tcctgtacgtaagccctgaccggtactc

SEQ ID NO: 242495 - DNA, 27 bp, Artificial Sequence
  Description of Artificial Sequence: Synthetic oligonucleotide
cctgtacgtaagccctgaccggtactc

SEQ ID NO: 242496 - DNA, 27 bp, Artificial Sequence
  Description of Artificial Sequence: Synthetic oligonucleotide
ctgtacgtaagccctgaccggtactcc

SEQ ID NO: 242497 - DNA, 27 bp, Artificial Sequence
  Description of Artificial Sequence: Synthetic oligonucleotide
tgtacgtaagccctgaccggtactccg

SEQ ID NO: 242498 - DNA, 26 bp, Artificial Sequence
  Description of Artificial Sequence: Synthetic oligonucleotide
gtacgtaagccctgaccggtactccg

SEQ ID NO: 242499 - DNA, 26 bp, Artificial Sequence
  Description of Artificial Sequence: Synthetic oligonucleotide
tacgtaagccctgaccggtactccgg

SEQ ID NO: 242500 - DNA, 25 bp, Artificial Sequence
  Description of Artificial Sequence: Synthetic oligonucleotide
acgtaagccctgaccggtactccgg

SEQ ID NO: 242501 - DNA, 24 bp, Artificial Sequence
  Description of Artificial Sequence: Synthetic oligonucleotide
cgtaagccctgaccggtactccgg

SEQ ID NO: 242502 - DNA, 25 bp, Artificial Sequence
  Description of Artificial Sequence: Synthetic oligonucleotide
gtaagccctgaccggtactccggct

SEQ ID NO: 242503 - DNA, 26 bp, Artificial Sequence
  Description of Artificial Sequence: Synthetic oligonucleotide
taagccctgaccggtactccggctca

SEQ ID NO: 242504 - DNA, 25 bp, Artificial Sequence
  Description of Artificial Sequence: Synthetic oligonucleotide
aagccctgaccggtactccggctca

SEQ ID NO: 242505 - DNA, 24 bp, Artificial Sequence
  Description of Artificial Sequence: Synthetic oligonucleotide
agccctgaccggtactccggctca

SEQ ID NO: 242506 - DNA, 23 bp, Artificial Sequence
  Description of Artificial Sequence: Synthetic oligonucleotide
gccctgaccggtactccggctca

SEQ ID NO: 242507 - DNA, 24 bp, Artificial Sequence
  Description of Artificial Sequence: Synthetic oligonucleotide
ccctgaccggtactccggctcagt

SEQ ID NO: 242508 - DNA, 24 bp, Artificial Sequence
  Description of Artificial Sequence: Synthetic oligonucleotide
cctgaccggtactccggctcagtg

SEQ ID NO: 242509 - DNA, 26 bp, Artificial Sequence
  Description of Artificial Sequence: Synthetic oligonucleotide
ctgaccggtactccggctcagtgcat

SEQ ID NO: 242510 - DNA, 27 bp, Artificial Sequence
  Description of Artificial Sequence: Synthetic oligonucleotide
tgaccggtactccggctcagtgcatct

SEQ ID NO: 242511 - DNA, 26 bp, Artificial Sequence
  Description of Artificial Sequence: Synthetic oligonucleotide
gaccggtactccggctcagtgcatct

SEQ ID NO: 242512 - DNA, 27 bp, Artificial Sequence
  Description of Artificial Sequence: Synthetic oligonucleotide
accggtactccggctcagtgcatctca

SEQ ID NO: 242513 - DNA, 27 bp, Artificial Sequence
  Description of Artificial Sequence: Synthetic oligonucleotide
ccggtactccggctcagtgcatctcat

SEQ ID NO: 242514 - DNA, 27 bp, Artificial Sequence
  Description of Artificial Sequence: Synthetic oligonucleotide
cggtactccggctcagtgcatctcatc

SEQ ID NO: 242515 - DNA, 28 bp, Artificial Sequence
  Description of Artificial Sequence: Synthetic oligonucleotide
ggtactccggctcagtgcatctcatcac

SEQ ID NO: 242516 - DNA, 28 bp, Artificial Sequence
  Description of Artificial Sequence: Synthetic oligonucleotide
gtactccggctcagtgcatctcatcacg

SEQ ID NO: 242517 - DNA, 28 bp, Artificial Sequence
  Description of Artificial Sequence: Synthetic oligonucleotide
tactccggctcagtgcatctcatcacgc

SEQ ID NO: 242518 - DNA, 27 bp, Artificial Sequence
  Description of Artificial Sequence: Synthetic oligonucleotide
actccggctcagtgcatctcatcacgc

SEQ ID NO: 242519 - DNA, 27 bp, Artificial Sequence
  Description of Artificial Sequence: Synthetic oligonucleotide
ctccggctcagtgcatctcatcacgca

SEQ ID NO: 242520 - DNA, 27 bp, Artificial Sequence
  Description of Artificial Sequence: Synthetic oligonucleotide
tccggctcagtgcatctcatcacgcag

SEQ ID NO: 242521 - DNA, 26 bp, Artificial Sequence
  Description of Artificial Sequence: Synthetic oligonucleotide
ccggctcagtgcatctcatcacgcag

SEQ ID NO: 242522 - DNA, 27 bp, Artificial Sequence
  Description of Artificial Sequence: Synthetic oligonucleotide
cggctcagtgcatctcatcacgcagca

SEQ ID NO: 242523 - DNA, 27 bp, Artificial Sequence
  Description of Artificial Sequence: Synthetic oligonucleotide
ggctcagtgcatctcatcacgcagcac

SEQ ID NO: 242524 - DNA, 27 bp, Artificial Sequence
  Description of Artificial Sequence: Synthetic oligonucleotide
gctcagtgcatctcatcacgcagcacc

SEQ ID NO: 242525 - DNA, 28 bp, Artificial Sequence
  Description of Artificial Sequence: Synthetic oligonucleotide
ctcagtgcatctcatcacgcagcacctc

SEQ ID NO: 242526 - DNA, 29 bp, Artificial Sequence
  Description of Artificial Sequence: Synthetic oligonucleotide
tcagtgcatctcatcacgcagcacctctg

SEQ ID NO: 242527 - DNA, 28 bp, Artificial Sequence
  Description of Artificial Sequence: Synthetic oligonucleotide
cagtgcatctcatcacgcagcacctctg

SEQ ID NO: 242528 - DNA, 28 bp, Artificial Sequence
  Description of Artificial Sequence: Synthetic oligonucleotide
agtgcatctcatcacgcagcacctctgc

SEQ ID NO: 242529 - DNA, 27 bp, Artificial Sequence
  Description of Artificial Sequence: Synthetic oligonucleotide
gtgcatctcatcacgcagcacctctgc

SEQ ID NO: 242530 - DNA, 27 bp, Artificial Sequence
  Description of Artificial Sequence: Synthetic oligonucleotide
tgcatctcatcacgcagcacctctgcc

SEQ ID NO: 242531 - DNA, 27 bp, Artificial Sequence
  Description of Artificial Sequence: Synthetic oligonucleotide
gcatctcatcacgcagcacctctgcct

SEQ ID NO: 242532 - DNA, 27 bp, Artificial Sequence
  Description of Artificial Sequence: Synthetic oligonucleotide
catctcatcacgcagcacctctgcctg

SEQ ID NO: 242533 - DNA, 27 bp, Artificial Sequence
  Description of Artificial Sequence: Synthetic oligonucleotide
atctcatcacgcagcacctctgcctgg

SEQ ID NO: 242534 - DNA, 27 bp, Artificial Sequence
  Description of Artificial Sequence: Synthetic oligonucleotide
tctcatcacgcagcacctctgcctggt

SEQ ID NO: 242535 - DNA, 26 bp, Artificial Sequence
  Description of Artificial Sequence: Synthetic oligonucleotide
ctcatcacgcagcacctctgcctggt

SEQ ID NO: 242536 - DNA, 26 bp, Artificial Sequence
  Description of Artificial Sequence: Synthetic oligonucleotide
tcatcacgcagcacctctgcctggtg

SEQ ID NO: 242537 - DNA, 25 bp, Artificial Sequence
  Description of Artificial Sequence: Synthetic oligonucleotide
catcacgcagcacctctgcctggtg

SEQ ID NO: 242538 - DNA, 26 bp, Artificial Sequence
  Description of Artificial Sequence: Synthetic oligonucleotide
atcacgcagcacctctgcctggtggt

SEQ ID NO: 242539 - DNA, 25 bp, Artificial Sequence
  Description of Artificial Sequence: Synthetic oligonucleotide
tcacgcagcacctctgcctggtggt

SEQ ID NO: 242540 - DNA, 24 bp, Artificial Sequence
  Description of Artificial Sequence: Synthetic oligonucleotide
cacgcagcacctctgcctggtggt

SEQ ID NO: 242541 - DNA, 24 bp, Artificial Sequence
  Description of Artificial Sequence: Synthetic oligonucleotide
acgcagcacctctgcctggtggtg

SEQ ID NO: 242542 - DNA, 23 bp, Artificial Sequence
  Description of Artificial Sequence: Synthetic oligonucleotide
cgcagcacctctgcctggtggtg

SEQ ID NO: 242543 - DNA, 24 bp, Artificial Sequence
  Description of Artificial Sequence: Synthetic oligonucleotide
gcagcacctctgcctggtggtgca

SEQ ID NO: 242544 - DNA, 24 bp, Artificial Sequence
  Description of Artificial Sequence: Synthetic oligonucleotide
cagcacctctgcctggtggtgcag

SEQ ID NO: 242545 - DNA, 24 bp, Artificial Sequence
  Description of Artificial Sequence: Synthetic oligonucleotide
agcacctctgcctggtggtgcagg

SEQ ID NO: 242546 - DNA, 23 bp, Artificial Sequence
  Description of Artificial Sequence: Synthetic oligonucleotide
gcacctctgcctggtggtgcagg

SEQ ID NO: 242547 - DNA, 24 bp, Artificial Sequence
  Description of Artificial Sequence: Synthetic oligonucleotide
cacctctgcctggtggtgcaggct

SEQ ID NO: 242548 - DNA, 25 bp, Artificial Sequence
  Description of Artificial Sequence: Synthetic oligonucleotide
acctctgcctggtggtgcaggctga

SEQ ID NO: 242549 - DNA, 24 bp, Artificial Sequence
  Description of Artificial Sequence: Synthetic oligonucleotide
cctctgcctggtggtgcaggctga

SEQ ID NO: 242550 - DNA, 24 bp, Artificial Sequence
  Description of Artificial Sequence: Synthetic oligonucleotide
ctctgcctggtggtgcaggctgag

SEQ ID NO: 242551 - DNA, 25 bp, Artificial Sequence
  Description of Artificial Sequence: Synthetic oligonucleotide
tctgcctggtggtgcaggctgagca

SEQ ID NO: 242552 - DNA, 24 bp, Artificial Sequence
  Description of Artificial Sequence: Synthetic oligonucleotide
ctgcctggtggtgcaggctgagca

SEQ ID NO: 242553 - DNA, 26 bp, Artificial Sequence
  Description of Artificial Sequence: Synthetic oligonucleotide
tgcctggtggtgcaggctgagcacat

SEQ ID NO: 242554 - DNA, 25 bp, Artificial Sequence
  Description of Artificial Sequence: Synthetic oligonucleotide
gcctggtggtgcaggctgagcacat

SEQ ID NO: 242555 - DNA, 25 bp, Artificial Sequence
  Description of Artificial Sequence: Synthetic oligonucleotide
cctggtggtgcaggctgagcacatc

SEQ ID NO: 242556 - DNA, 26 bp, Artificial Sequence
  Description of Artificial Sequence: Synthetic oligonucleotide
ctggtggtgcaggctgagcacatcct

SEQ ID NO: 242557 - DNA, 27 bp, Artificial Sequence
  Description of Artificial Sequence: Synthetic oligonucleotide
tggtggtgcaggctgagcacatcctca

SEQ ID NO: 242558 - DNA, 27 bp, Artificial Sequence
  Description of Artificial Sequence: Synthetic oligonucleotide
ggtggtgcaggctgagcacatcctcat

SEQ ID NO: 242559 - DNA, 28 bp, Artificial Sequence
  Description of Artificial Sequence: Synthetic oligonucleotide
gtggtgcaggctgagcacatcctcattc

SEQ ID NO: 242560 - DNA, 29 bp, Artificial Sequence
  Description of Artificial Sequence: Synthetic oligonucleotide
tggtgcaggctgagcacatcctcattctg

SEQ ID NO: 242561 - DNA, 28 bp, Artificial Sequence
  Description of Artificial Sequence: Synthetic oligonucleotide
ggtgcaggctgagcacatcctcattctg

SEQ ID NO: 242562 - DNA, 28 bp, Artificial Sequence
  Description of Artificial Sequence: Synthetic oligonucleotide
gtgcaggctgagcacatcctcattctgg

SEQ ID NO: 242563 - DNA, 30 bp, Artificial Sequence
  Description of Artificial Sequence: Synthetic oligonucleotide
tgcaggctgagcacatcctcattctggaag

SEQ ID NO: 242564 - DNA, 29 bp, Artificial Sequence
  Description of Artificial Sequence: Synthetic oligonucleotide
gcaggctgagcacatcctcattctggaag

SEQ ID NO: 242565 - DNA, 29 bp, Artificial Sequence
  Description of Artificial Sequence: Synthetic oligonucleotide
caggctgagcacatcctcattctggaagc

SEQ ID NO: 242566 - DNA, 30 bp, Artificial Sequence
  Description of Artificial Sequence: Synthetic oligonucleotide
aggctgagcacatcctcattctggaagcag

SEQ ID NO: 242567 - DNA, 29 bp, Artificial Sequence
  Description of Artificial Sequence: Synthetic oligonucleotide
ggctgagcacatcctcattctggaagcag

SEQ ID NO: 242568 - DNA, 29 bp, Artificial Sequence
  Description of Artificial Sequence: Synthetic oligonucleotide
gctgagcacatcctcattctggaagcagg

SEQ ID NO: 242569 - DNA, 29 bp, Artificial Sequence
  Description of Artificial Sequence: Synthetic oligonucleotide
ctgagcacatcctcattctggaagcaggc

SEQ ID NO: 242570 - DNA, 29 bp, Artificial Sequence
  Description of Artificial Sequence: Synthetic oligonucleotide
tgagcacatcctcattctggaagcaggcg

SEQ ID NO: 242571 - DNA, 28 bp, Artificial Sequence
  Description of Artificial Sequence: Synthetic oligonucleotide
gagcacatcctcattctggaagcaggcg

SEQ ID NO: 242572 - DNA, 28 bp, Artificial Sequence
  Description of Artificial Sequence: Synthetic oligonucleotide
agcacatcctcattctggaagcaggcgc

SEQ ID NO: 242573 - DNA, 27 bp, Artificial Sequence
  Description of Artificial Sequence: Synthetic oligonucleotide
gcacatcctcattctggaagcaggcgc

SEQ ID NO: 242574 - DNA, 30 bp, Artificial Sequence
  Description of Artificial Sequence: Synthetic oligonucleotide
cacatcctcattctggaagcaggcgctatg

SEQ ID NO: 242575 - DNA, 30 bp, Artificial Sequence
  Description of Artificial Sequence: Synthetic oligonucleotide
acatcctcattctggaagcaggcgctatgc

SEQ ID NO: 242576 - DNA, 29 bp, Artificial Sequence
  Description of Artificial Sequence: Synthetic oligonucleotide
catcctcattctggaagcaggcgctatgc

SEQ ID NO: 242577 - DNA, 29 bp, Artificial Sequence
  Description of Artificial Sequence: Synthetic oligonucleotide
atcctcattctggaagcaggcgctatgcg

SEQ ID NO: 242578 - DNA, 28 bp, Artificial Sequence
  Description of Artificial Sequence: Synthetic oligonucleotide
tcctcattctggaagcaggcgctatgcg

SEQ ID NO: 242579 - DNA, 27 bp, Artificial Sequence
  Description of Artificial Sequence: Synthetic oligonucleotide
cctcattctggaagcaggcgctatgcg

SEQ ID NO: 242580 - DNA, 27 bp, Artificial Sequence
  Description of Artificial Sequence: Synthetic oligonucleotide
ctcattctggaagcaggcgctatgcgg

SEQ ID NO: 242581 - DNA, 27 bp, Artificial Sequence
  Description of Artificial Sequence: Synthetic oligonucleotide
tcattctggaagcaggcgctatgcggg

SEQ ID NO: 242582 - DNA, 27 bp, Artificial Sequence
  Description of Artificial Sequence: Synthetic oligonucleotide
cattctggaagcaggcgctatgcggga

SEQ ID NO: 242583 - DNA, 27 bp, Artificial Sequence
  Description of Artificial Sequence: Synthetic oligonucleotide
attctggaagcaggcgctatgcgggag

SEQ ID NO: 242584 - DNA, 26 bp, Artificial Sequence
  Description of Artificial Sequence: Synthetic oligonucleotide
ttctggaagcaggcgctatgcgggag

SEQ ID NO: 242585 - DNA, 25 bp, Artificial Sequence
  Description of Artificial Sequence: Synthetic oligonucleotide
tctggaagcaggcgctatgcgggag

SEQ ID NO: 242586 - DNA, 24 bp, Artificial Sequence
  Description of Artificial Sequence: Synthetic oligonucleotide
ctggaagcaggcgctatgcgggag

SEQ ID NO: 242587 - DNA, 24 bp, Artificial Sequence
  Description of Artificial Sequence: Synthetic oligonucleotide
tggaagcaggcgctatgcgggagg

SEQ ID NO: 242588 - DNA, 23 bp, Artificial Sequence
  Description of Artificial Sequence: Synthetic oligonucleotide
ggaagcaggcgctatgcgggagg

SEQ ID NO: 242589 - DNA, 23 bp, Artificial Sequence
  Description of Artificial Sequence: Synthetic oligonucleotide
gaagcaggcgctatgcgggaggg

SEQ ID NO: 242590 - DNA, 23 bp, Artificial Sequence
  Description of Artificial Sequence: Synthetic oligonucleotide
aagcaggcgctatgcgggagggg

SEQ ID NO: 242591 - DNA, 22 bp, Artificial Sequence
  Description of Artificial Sequence: Synthetic oligonucleotide
agcaggcgctatgcgggagggg

SEQ ID NO: 242592 - DNA, 21 bp, Artificial Sequence
  Description of Artificial Sequence: Synthetic oligonucleotide
gcaggcgctatgcgggagggg

SEQ ID NO: 242593 - DNA, 21 bp, Artificial Sequence
  Description of Artificial Sequence: Synthetic oligonucleotide
caggcgctatgcgggaggggc

SEQ ID NO: 242594 - DNA, 23 bp, Artificial Sequence
  Description of Artificial Sequence: Synthetic oligonucleotide
aggcgctatgcgggaggggcgaa

SEQ ID NO: 242595 - DNA, 22 bp, Artificial Sequence
  Description of Artificial Sequence: Synthetic oligonucleotide
ggcgctatgcgggaggggcgaa

SEQ ID NO: 242596 - DNA, 22 bp, Artificial Sequence
  Description of Artificial Sequence: Synthetic oligonucleotide
gcgctatgcgggaggggcgaac

SEQ ID NO: 242597 - DNA, 22 bp, Artificial Sequence
  Description of Artificial Sequence: Synthetic oligonucleotide
cgctatgcgggaggggcgaacc

SEQ ID NO: 242598 - DNA, 23 bp, Artificial Sequence
  Description of Artificial Sequence: Synthetic oligonucleotide
gctatgcgggaggggcgaaccca

SEQ ID NO: 242599 - DNA, 23 bp, Artificial Sequence
  Description of Artificial Sequence: Synthetic oligonucleotide
ctatgcgggaggggcgaacccac

SEQ ID NO: 242600 - DNA, 24 bp, Artificial Sequence
  Description of Artificial Sequence: Synthetic oligonucleotide
tatgcgggaggggcgaacccacct

SEQ ID NO: 242601 - DNA, 23 bp, Artificial Sequence
  Description of Artificial Sequence: Synthetic oligonucleotide
atgcgggaggggcgaacccacct

SEQ ID NO: 242602 - DNA, 22 bp, Artificial Sequence
  Description of Artificial Sequence: Synthetic oligonucleotide
tgcgggaggggcgaacccacct

SEQ ID NO: 242603 - DNA, 21 bp, Artificial Sequence
  Description of Artificial Sequence: Synthetic oligonucleotide
gcgggaggggcgaacccacct

SEQ ID NO: 242604 - DNA, 21 bp, Artificial Sequence
  Description of Artificial Sequence: Synthetic oligonucleotide
cgggaggggcgaacccacctg

SEQ ID NO: 242605 - DNA, 22 bp, Artificial Sequence
  Description of Artificial Sequence: Synthetic oligonucleotide
gggaggggcgaacccacctgca

SEQ ID NO: 242606 - DNA, 22 bp, Artificial Sequence
  Description of Artificial Sequence: Synthetic oligonucleotide
ggaggggcgaacccacctgcag

SEQ ID NO: 242607 - DNA, 23 bp, Artificial Sequence
  Description of Artificial Sequence: Synthetic oligonucleotide
gaggggcgaacccacctgcagct

SEQ ID NO: 242608 - DNA, 25 bp, Artificial Sequence
  Description of Artificial Sequence: Synthetic oligonucleotide
aggggcgaacccacctgcagctcat

SEQ ID NO: 242609 - DNA, 24 bp, Artificial Sequence
  Description of Artificial Sequence: Synthetic oligonucleotide
ggggcgaacccacctgcagctcat

SEQ ID NO: 242610 - DNA, 24 bp, Artificial Sequence
  Description of Artificial Sequence: Synthetic oligonucleotide
gggcgaacccacctgcagctcatc

SEQ ID NO: 242611 - DNA, 25 bp, Artificial Sequence
  Description of Artificial Sequence: Synthetic oligonucleotide
ggcgaacccacctgcagctcatcga

SEQ ID NO: 242612 - DNA, 27 bp, Artificial Sequence
  Description of Artificial Sequence: Synthetic oligonucleotide
gcgaacccacctgcagctcatcgagaa

SEQ ID NO: 242613 - DNA, 30 bp, Artificial Sequence
  Description of Artificial Sequence: Synthetic oligonucleotide
cgaacccacctgcagctcatcgagaaaaag

SEQ ID NO: 242614 - DNA, 30 bp, Artificial Sequence
  Description of Artificial Sequence: Synthetic oligonucleotide
gaacccacctgcagctcatcgagaaaaagc

SEQ ID NO: 242615 - DNA, 30 bp, Artificial Sequence
  Description of Artificial Sequence: Synthetic oligonucleotide
aacccacctgcagctcatcgagaaaaagcg

SEQ ID NO: 242616 - DNA, 29 bp, Artificial Sequence
  Description of Artificial Sequence: Synthetic oligonucleotide
acccacctgcagctcatcgagaaaaagcg

SEQ ID NO: 242617 - DNA, 28 bp, Artificial Sequence
  Description of Artificial Sequence: Synthetic oligonucleotide
cccacctgcagctcatcgagaaaaagcg

SEQ ID NO: 242618 - DNA, 28 bp, Artificial Sequence
  Description of Artificial Sequence: Synthetic oligonucleotide
ccacctgcagctcatcgagaaaaagcgg

SEQ ID NO: 242619 - DNA, 29 bp, Artificial Sequence
  Description of Artificial Sequence: Synthetic oligonucleotide
cacctgcagctcatcgagaaaaagcggtg

SEQ ID NO: 242620 - DNA, 29 bp, Artificial Sequence
  Description of Artificial Sequence: Synthetic oligonucleotide
acctgcagctcatcgagaaaaagcggtgc

SEQ ID NO: 242621 - DNA, 28 bp, Artificial Sequence
  Description of Artificial Sequence: Synthetic oligonucleotide
cctgcagctcatcgagaaaaagcggtgc

SEQ ID NO: 242622 - DNA, 30 bp, Artificial Sequence
  Description of Artificial Sequence: Synthetic oligonucleotide
ctgcagctcatcgagaaaaagcggtgctac

SEQ ID NO: 242623 - DNA, 31 bp, Artificial Sequence
  Description of Artificial Sequence: Synthetic oligonucleotide
tgcagctcatcgagaaaaagcggtgctactc

SEQ ID NO: 242624 - DNA, 30 bp, Artificial Sequence
  Description of Artificial Sequence: Synthetic oligonucleotide
gcagctcatcgagaaaaagcggtgctactc

SEQ ID NO: 242625 - DNA, 30 bp, Artificial Sequence
  Description of Artificial Sequence: Synthetic oligonucleotide
cagctcatcgagaaaaagcggtgctactcg

SEQ ID NO: 242626 - DNA, 30 bp, Artificial Sequence
  Description of Artificial Sequence: Synthetic oligonucleotide
agctcatcgagaaaaagcggtgctactcgg

SEQ ID NO: 242627 - DNA, 29 bp, Artificial Sequence
  Description of Artificial Sequence: Synthetic oligonucleotide
gctcatcgagaaaaagcggtgctactcgg

SEQ ID NO: 242628 - DNA, 29 bp, Artificial Sequence
  Description of Artificial Sequence: Synthetic oligonucleotide
ctcatcgagaaaaagcggtgctactcggc

SEQ ID NO: 242629 - DNA, 29 bp, Artificial Sequence
  Description of Artificial Sequence: Synthetic oligonucleotide
tcatcgagaaaaagcggtgctactcggcc

SEQ ID NO: 242630 - DNA, 28 bp, Artificial Sequence
  Description of Artificial Sequence: Synthetic oligonucleotide
catcgagaaaaagcggtgctactcggcc

SEQ ID NO: 242631 - DNA, 30 bp, Artificial Sequence
  Description of Artificial Sequence: Synthetic oligonucleotide
atcgagaaaaagcggtgctactcggccatg

SEQ ID NO: 242632 - DNA, 29 bp, Artificial Sequence
  Description of Artificial Sequence: Synthetic oligonucleotide
tcgagaaaaagcggtgctactcggccatg

SEQ ID NO: 242633 - DNA, 28 bp, Artificial Sequence
  Description of Artificial Sequence: Synthetic oligonucleotide
cgagaaaaagcggtgctactcggccatg

SEQ ID NO: 242634 - DNA, 28 bp, Artificial Sequence
  Description of Artificial Sequence: Synthetic oligonucleotide
gagaaaaagcggtgctactcggccatgg

SEQ ID NO: 242635 - DNA, 29 bp, Artificial Sequence
  Description of Artificial Sequence: Synthetic oligonucleotide
agaaaaagcggtgctactcggccatggtc

SEQ ID NO: 242636 - DNA, 28 bp, Artificial Sequence
  Description of Artificial Sequence: Synthetic oligonucleotide
gaaaaagcggtgctactcggccatggtc

SEQ ID NO: 242637 - DNA, 28 bp, Artificial Sequence
  Description of Artificial Sequence: Synthetic oligonucleotide
aaaaagcggtgctactcggccatggtcc

SEQ ID NO: 242638 - DNA, 27 bp, Artificial Sequence
  Description of Artificial Sequence: Synthetic oligonucleotide
aaaagcggtgctactcggccatggtcc

SEQ ID NO: 242639 - DNA, 27 bp, Artificial Sequence
  Description of Artificial Sequence: Synthetic oligonucleotide
aaagcggtgctactcggccatggtcca

SEQ ID NO: 242640 - DNA, 26 bp, Artificial Sequence
  Description of Artificial Sequence: Synthetic oligonucleotide
aagcggtgctactcggccatggtcca

SEQ ID NO: 242641 - DNA, 25 bp, Artificial Sequence
  Description of Artificial Sequence: Synthetic oligonucleotide
agcggtgctactcggccatggtcca

SEQ ID NO: 242642 - DNA, 24 bp, Artificial Sequence
  Description of Artificial Sequence: Synthetic oligonucleotide
gcggtgctactcggccatggtcca

SEQ ID NO: 242643 - DNA, 24 bp, Artificial Sequence
  Description of Artificial Sequence: Synthetic oligonucleotide
cggtgctactcggccatggtccag

SEQ ID NO: 242644 - DNA, 24 bp, Artificial Sequence
  Description of Artificial Sequence: Synthetic oligonucleotide
ggtgctactcggccatggtccagg

SEQ ID NO: 242645 - DNA, 25 bp, Artificial Sequence
  Description of Artificial Sequence: Synthetic oligonucleotide
gtgctactcggccatggtccaggct

SEQ ID NO: 242646 - DNA, 25 bp, Artificial Sequence
  Description of Artificial Sequence: Synthetic oligonucleotide
tgctactcggccatggtccaggctc

SEQ ID NO: 242647 - DNA, 24 bp, Artificial Sequence
  Description of Artificial Sequence: Synthetic oligonucleotide
gctactcggccatggtccaggctc

SEQ ID NO: 242648 - DNA, 25 bp, Artificial Sequence
  Description of Artificial Sequence: Synthetic oligonucleotide
ctactcggccatggtccaggctcct

SEQ ID NO: 242649 - DNA, 25 bp, Artificial Sequence
  Description of Artificial Sequence: Synthetic oligonucleotide
tactcggccatggtccaggctcctc

SEQ ID NO: 242650 - DNA, 24 bp, Artificial Sequence
  Description of Artificial Sequence: Synthetic oligonucleotide
actcggccatggtccaggctcctc

SEQ ID NO: 242651 - DNA, 23 bp, Artificial Sequence
  Description of Artificial Sequence: Synthetic oligonucleotide
ctcggccatggtccaggctcctc

SEQ ID NO: 242652 - DNA, 24 bp, Artificial Sequence
  Description of Artificial Sequence: Synthetic oligonucleotide
tcggccatggtccaggctcctcca

SEQ ID NO: 242653 - DNA, 23 bp, Artificial Sequence
  Description of Artificial Sequence: Synthetic oligonucleotide
cggccatggtccaggctcctcca

SEQ ID NO: 242654 - DNA, 25 bp, Artificial Sequence
  Description of Artificial Sequence: Synthetic oligonucleotide
ggccatggtccaggctcctccagat

SEQ ID NO: 242655 - DNA, 25 bp, Artificial Sequence
  Description of Artificial Sequence: Synthetic oligonucleotide
gccatggtccaggctcctccagatg

SEQ ID NO: 242656 - DNA, 26 bp, Artificial Sequence
  Description of Artificial Sequence: Synthetic oligonucleotide
ccatggtccaggctcctccagatgct

SEQ ID NO: 242657 - DNA, 26 bp, Artificial Sequence
  Description of Artificial Sequence: Synthetic oligonucleotide
catggtccaggctcctccagatgctc

SEQ ID NO: 242658 - DNA, 27 bp, Artificial Sequence
  Description of Artificial Sequence: Synthetic oligonucleotide
atggtccaggctcctccagatgctcga

SEQ ID NO: 242659 - DNA, 26 bp, Artificial Sequence
  Description of Artificial Sequence: Synthetic oligonucleotide
tggtccaggctcctccagatgctcga

SEQ ID NO: 242660 - DNA, 25 bp, Artificial Sequence
  Description of Artificial Sequence: Synthetic oligonucleotide
ggtccaggctcctccagatgctcga

SEQ ID NO: 242661 - DNA, 27 bp, Artificial Sequence
  Description of Artificial Sequence: Synthetic oligonucleotide
gtccaggctcctccagatgctcgagaa

SEQ ID NO: 242662 - DNA, 28 bp, Artificial Sequence
  Description of Artificial Sequence: Synthetic oligonucleotide
tccaggctcctccagatgctcgagaatg

SEQ ID NO: 242663 - DNA, 27 bp, Artificial Sequence
  Description of Artificial Sequence: Synthetic oligonucleotide
ccaggctcctccagatgctcgagaatg

SEQ ID NO: 242664 - DNA, 25 bp, Artificial Sequence
  Description of Artificial Sequence: Synthetic oligonucleotide
atgcggctcgctgacctgacaccct

SEQ ID NO: 242665 - DNA, 24 bp, Artificial Sequence
  Description of Artificial Sequence: Synthetic oligonucleotide
tgcggctcgctgacctgacaccct

SEQ ID NO: 242666 - DNA, 23 bp, Artificial Sequence
  Description of Artificial Sequence: Synthetic oligonucleotide
gcggctcgctgacctgacaccct

SEQ ID NO: 242667 - DNA, 23 bp, Artificial Sequence
  Description of Artificial Sequence: Synthetic oligonucleotide
cggctcgctgacctgacaccctg

SEQ ID NO: 242668 - DNA, 24 bp, Artificial Sequence
  Description of Artificial Sequence: Synthetic oligonucleotide
ggctcgctgacctgacaccctgga

SEQ ID NO: 242669 - DNA, 24 bp, Artificial Sequence
  Description of Artificial Sequence: Synthetic oligonucleotide
gctcgctgacctgacaccctggac

SEQ ID NO: 242670 - DNA, 25 bp, Artificial Sequence
  Description of Artificial Sequence: Synthetic oligonucleotide
ctcgctgacctgacaccctggacgt

SEQ ID NO: 242671 - DNA, 25 bp, Artificial Sequence
  Description of Artificial Sequence: Synthetic oligonucleotide
tcgctgacctgacaccctggacgtc

SEQ ID NO: 242672 - DNA, 24 bp, Artificial Sequence
  Description of Artificial Sequence: Synthetic oligonucleotide
cgctgacctgacaccctggacgtc

SEQ ID NO: 242673 - DNA, 24 bp, Artificial Sequence
  Description of Artificial Sequence: Synthetic oligonucleotide
gctgacctgacaccctggacgtcc

SEQ ID NO: 242674 - DNA, 25 bp, Artificial Sequence
  Description of Artificial Sequence: Synthetic oligonucleotide
ctgacctgacaccctggacgtccct

SEQ ID NO: 242675 - DNA, 25 bp, Artificial Sequence
  Description of Artificial Sequence: Synthetic oligonucleotide
tgacctgacaccctggacgtccctg

SEQ ID NO: 242676 - DNA, 24 bp, Artificial Sequence
  Description of Artificial Sequence: Synthetic oligonucleotide
gacctgacaccctggacgtccctg

SEQ ID NO: 242677 - DNA, 25 bp, Artificial Sequence
  Description of Artificial Sequence: Synthetic oligonucleotide
acctgacaccctggacgtccctgct

SEQ ID NO: 242678 - DNA, 24 bp, Artificial Sequence
  Description of Artificial Sequence: Synthetic oligonucleotide
cctgacaccctggacgtccctgct

SEQ ID NO: 242679 - DNA, 24 bp, Artificial Sequence
  Description of Artificial Sequence: Synthetic oligonucleotide
ctgacaccctggacgtccctgctg

SEQ ID NO: 242680 - DNA, 25 bp, Artificial Sequence
  Description of Artificial Sequence: Synthetic oligonucleotide
tgacaccctggacgtccctgctggt

SEQ ID NO: 242681 - DNA, 24 bp, Artificial Sequence
  Description of Artificial Sequence: Synthetic oligonucleotide
gacaccctggacgtccctgctggt

SEQ ID NO: 242682 - DNA, 24 bp, Artificial Sequence
  Description of Artificial Sequence: Synthetic oligonucleotide
acaccctggacgtccctgctggtg

SEQ ID NO: 242683 - DNA, 23 bp, Artificial Sequence
  Description of Artificial Sequence: Synthetic oligonucleotide
caccctggacgtccctgctggtg

SEQ ID NO: 242684 - DNA, 24 bp, Artificial Sequence
  Description of Artificial Sequence: Synthetic oligonucleotide
accctggacgtccctgctggtggt

SEQ ID NO: 242685 - DNA, 23 bp, Artificial Sequence
  Description of Artificial Sequence: Synthetic oligonucleotide
ccctggacgtccctgctggtggt

SEQ ID NO: 242686 - DNA, 23 bp, Artificial Sequence
  Description of Artificial Sequence: Synthetic oligonucleotide
cctggacgtccctgctggtggtg

SEQ ID NO: 242687 - DNA, 24 bp, Artificial Sequence
  Description of Artificial Sequence: Synthetic oligonucleotide
ctggacgtccctgctggtggtgga

SEQ ID NO: 242688 - DNA, 24 bp, Artificial Sequence
  Description of Artificial Sequence: Synthetic oligonucleotide
tggacgtccctgctggtggtggac

SEQ ID NO: 242689 - DNA, 23 bp, Artificial Sequence
  Description of Artificial Sequence: Synthetic oligonucleotide
ggacgtccctgctggtggtggac

SEQ ID NO: 242690 - DNA, 23 bp, Artificial Sequence
  Description of Artificial Sequence: Synthetic oligonucleotide
gacgtccctgctggtggtggacg

SEQ ID NO: 242691 - DNA, 23 bp, Artificial Sequence
  Description of Artificial Sequence: Synthetic oligonucleotide
acgtccctgctggtggtggacgg

SEQ ID NO: 242692 - DNA, 22 bp, Artificial Sequence
  Description of Artificial Sequence: Synthetic oligonucleotide
cgtccctgctggtggtggacgg

SEQ ID NO: 242693 - DNA, 22 bp, Artificial Sequence
  Description of Artificial Sequence: Synthetic oligonucleotide
gtccctgctggtggtggacggg

SEQ ID NO: 242694 - DNA, 22 bp, Artificial Sequence
  Description of Artificial Sequence: Synthetic oligonucleotide
tccctgctggtggtggacgggg

SEQ ID NO: 242695 - DNA, 21 bp, Artificial Sequence
  Description of Artificial Sequence: Synthetic oligonucleotide
ccctgctggtggtggacgggg

SEQ ID NO: 242696 - DNA, 25 bp, Artificial Sequence
  Description of Artificial Sequence: Synthetic oligonucleotide
cctgctggtggtggacggggcttta

SEQ ID NO: 242697 - DNA, 26 bp, Artificial Sequence
  Description of Artificial Sequence: Synthetic oligonucleotide
ctgctggtggtggacggggctttact

SEQ ID NO: 242698 - DNA, 27 bp, Artificial Sequence
  Description of Artificial Sequence: Synthetic oligonucleotide
tgctggtggtggacggggctttactct

SEQ ID NO: 242699 - DNA, 26 bp, Artificial Sequence
  Description of Artificial Sequence: Synthetic oligonucleotide
gctggtggtggacggggctttactct

SEQ ID NO: 242700 - DNA, 26 bp, Artificial Sequence
  Description of Artificial Sequence: Synthetic oligonucleotide
ctggtggtggacggggctttactctg

SEQ ID NO: 242701 - DNA, 26 bp, Artificial Sequence
  Description of Artificial Sequence: Synthetic oligonucleotide
tggtggtggacggggctttactctgg

SEQ ID NO: 242702 - DNA, 25 bp, Artificial Sequence
  Description of Artificial Sequence: Synthetic oligonucleotide
ggtggtggacggggctttactctgg

SEQ ID NO: 242703 - DNA, 26 bp, Artificial Sequence
  Description of Artificial Sequence: Synthetic oligonucleotide
gtggtggacggggctttactctggct

SEQ ID NO: 242704 - DNA, 26 bp, Artificial Sequence
  Description of Artificial Sequence: Synthetic oligonucleotide
tggtggacggggctttactctggctg

SEQ ID NO: 242705 - DNA, 25 bp, Artificial Sequence
  Description of Artificial Sequence: Synthetic oligonucleotide
ggtggacggggctttactctggctg

SEQ ID NO: 242706 - DNA, 27 bp, Artificial Sequence
  Description of Artificial Sequence: Synthetic oligonucleotide
gtggacggggctttactctggctgctt

SEQ ID NO: 242707 - DNA, 27 bp, Artificial Sequence
  Description of Artificial Sequence: Synthetic oligonucleotide
tggacggggctttactctggctgcttg

SEQ ID NO: 242708 - DNA, 27 bp, Artificial Sequence
  Description of Artificial Sequence: Synthetic oligonucleotide
ggacggggctttactctggctgcttga

SEQ ID NO: 242709 - DNA, 27 bp, Artificial Sequence
  Description of Artificial Sequence: Synthetic oligonucleotide
gacggggctttactctggctgcttgag

SEQ ID NO: 242710 - DNA, 27 bp, Artificial Sequence
  Description of Artificial Sequence: Synthetic oligonucleotide
acggggctttactctggctgcttgagg

SEQ ID NO: 242711 - DNA, 26 bp, Artificial Sequence
  Description of Artificial Sequence: Synthetic oligonucleotide
cggggctttactctggctgcttgagg

SEQ ID NO: 242712 - DNA, 26 bp, Artificial Sequence
  Description of Artificial Sequence: Synthetic oligonucleotide
ggggctttactctggctgcttgaggg

SEQ ID NO: 242713 - DNA, 26 bp, Artificial Sequence
  Description of Artificial Sequence: Synthetic oligonucleotide
gggctttactctggctgcttgagggc

SEQ ID NO: 242714 - DNA, 26 bp, Artificial Sequence
  Description of Artificial Sequence: Synthetic oligonucleotide
ggctttactctggctgcttgagggcc

SEQ ID NO: 242715 - DNA, 27 bp, Artificial Sequence
  Description of Artificial Sequence: Synthetic oligonucleotide
gctttactctggctgcttgagggccct

SEQ ID NO: 242716 - DNA, 27 bp, Artificial Sequence
  Description of Artificial Sequence: Synthetic oligonucleotide
ctttactctggctgcttgagggccctc

SEQ ID NO: 242717 - DNA, 28 bp, Artificial Sequence
  Description of Artificial Sequence: Synthetic oligonucleotide
tttactctggctgcttgagggccctcag

SEQ ID NO: 242718 - DNA, 27 bp, Artificial Sequence
  Description of Artificial Sequence: Synthetic oligonucleotide
ttactctggctgcttgagggccctcag

SEQ ID NO: 242719 - DNA, 26 bp, Artificial Sequence
  Description of Artificial Sequence: Synthetic oligonucleotide
tactctggctgcttgagggccctcag

SEQ ID NO: 242720 - DNA, 25 bp, Artificial Sequence
  Description of Artificial Sequence: Synthetic oligonucleotide
actctggctgcttgagggccctcag

SEQ ID NO: 242721 - DNA, 24 bp, Artificial Sequence
  Description of Artificial Sequence: Synthetic oligonucleotide
ctctggctgcttgagggccctcag

SEQ ID NO: 242722 - DNA, 24 bp, Artificial Sequence
  Description of Artificial Sequence: Synthetic oligonucleotide
tctggctgcttgagggccctcagg

SEQ ID NO: 242723 - DNA, 23 bp, Artificial Sequence
  Description of Artificial Sequence: Synthetic oligonucleotide
ctggctgcttgagggccctcagg

SEQ ID NO: 242724 - DNA, 23 bp, Artificial Sequence
  Description of Artificial Sequence: Synthetic oligonucleotide
tggctgcttgagggccctcaggg

SEQ ID NO: 242725 - DNA, 22 bp, Artificial Sequence
  Description of Artificial Sequence: Synthetic oligonucleotide
ggctgcttgagggccctcaggg

SEQ ID NO: 242726 - DNA, 23 bp, Artificial Sequence
  Description of Artificial Sequence: Synthetic oligonucleotide
gctgcttgagggccctcagggga

SEQ ID NO: 242727 - DNA, 26 bp, Artificial Sequence
  Description of Artificial Sequence: Synthetic oligonucleotide
ctgcttgagggccctcaggggacttt

SEQ ID NO: 242728 - DNA, 26 bp, Artificial Sequence
  Description of Artificial Sequence: Synthetic oligonucleotide
tgcttgagggccctcaggggactttc

SEQ ID NO: 242729 - DNA, 25 bp, Artificial Sequence
  Description of Artificial Sequence: Synthetic oligonucleotide
gcttgagggccctcaggggactttc

SEQ ID NO: 242730 - DNA, 27 bp, Artificial Sequence
  Description of Artificial Sequence: Synthetic oligonucleotide
cttgagggccctcaggggactttcctt

SEQ ID NO: 242731 - DNA, 27 bp, Artificial Sequence
  Description of Artificial Sequence: Synthetic oligonucleotide
ttgagggccctcaggggactttccttc

SEQ ID NO: 242732 - DNA, 26 bp, Artificial Sequence
  Description of Artificial Sequence: Synthetic oligonucleotide
tgagggccctcaggggactttccttc

SEQ ID NO: 242733 - DNA, 25 bp, Artificial Sequence
  Description of Artificial Sequence: Synthetic oligonucleotide
gagggccctcaggggactttccttc

SEQ ID NO: 242734 - DNA, 26 bp, Artificial Sequence
  Description of Artificial Sequence: Synthetic oligonucleotide
agggccctcaggggactttccttcct

SEQ ID NO: 242735 - DNA, 25 bp, Artificial Sequence
  Description of Artificial Sequence: Synthetic oligonucleotide
gggccctcaggggactttccttcct

SEQ ID NO: 242736 - DNA, 27 bp, Artificial Sequence
  Description of Artificial Sequence: Synthetic oligonucleotide
ggccctcaggggactttccttcctcaa

SEQ ID NO: 242737 - DNA, 27 bp, Artificial Sequence
  Description of Artificial Sequence: Synthetic oligonucleotide
gccctcaggggactttccttcctcaac

SEQ ID NO: 242738 - DNA, 27 bp, Artificial Sequence
  Description of Artificial Sequence: Synthetic oligonucleotide
ccctcaggggactttccttcctcaacg

SEQ ID NO: 242739 - DNA, 27 bp, Artificial Sequence
  Description of Artificial Sequence: Synthetic oligonucleotide
cctcaggggactttccttcctcaacgg

SEQ ID NO: 242740 - DNA, 27 bp, Artificial Sequence
  Description of Artificial Sequence: Synthetic oligonucleotide
ctcaggggactttccttcctcaacggc

SEQ ID NO: 242741 - DNA, 28 bp, Artificial Sequence
  Description of Artificial Sequence: Synthetic oligonucleotide
tcaggggactttccttcctcaacggctg

SEQ ID NO: 242742 - DNA, 27 bp, Artificial Sequence
  Description of Artificial Sequence: Synthetic oligonucleotide
caggggactttccttcctcaacggctg

SEQ ID NO: 242743 - DNA, 27 bp, Artificial Sequence
  Description of Artificial Sequence: Synthetic oligonucleotide
aggggactttccttcctcaacggctgc

SEQ ID NO: 242744 - DNA, 26 bp, Artificial Sequence
  Description of Artificial Sequence: Synthetic oligonucleotide
ggggactttccttcctcaacggctgc

SEQ ID NO: 242745 - DNA, 27 bp, Artificial Sequence
  Description of Artificial Sequence: Synthetic oligonucleotide
gggactttccttcctcaacggctgcca

SEQ ID NO: 242746 - DNA, 27 bp, Artificial Sequence
  Description of Artificial Sequence: Synthetic oligonucleotide
ggactttccttcctcaacggctgccag

SEQ ID NO: 242747 - DNA, 27 bp, Artificial Sequence
  Description of Artificial Sequence: Synthetic oligonucleotide
gactttccttcctcaacggctgccagc

SEQ ID NO: 242748 - DNA, 28 bp, Artificial Sequence
  Description of Artificial Sequence: Synthetic oligonucleotide
actttccttcctcaacggctgccagcac

SEQ ID NO: 242749 - DNA, 27 bp, Artificial Sequence
  Description of Artificial Sequence: Synthetic oligonucleotide
ctttccttcctcaacggctgccagcac

SEQ ID NO: 242750 - DNA, 30 bp, Artificial Sequence
  Description of Artificial Sequence: Synthetic oligonucleotide
tttccttcctcaacggctgccagcactatg

SEQ ID NO: 242751 - DNA, 29 bp, Artificial Sequence
  Description of Artificial Sequence: Synthetic oligonucleotide
ttccttcctcaacggctgccagcactatg

SEQ ID NO: 242752 - DNA, 28 bp, Artificial Sequence
  Description of Artificial Sequence: Synthetic oligonucleotide
tccttcctcaacggctgccagcactatg

SEQ ID NO: 242753 - DNA, 27 bp, Artificial Sequence
  Description of Artificial Sequence: Synthetic oligonucleotide
ccttcctcaacggctgccagcactatg

SEQ ID NO: 242754 - DNA, 27 bp, Artificial Sequence
  Description of Artificial Sequence: Synthetic oligonucleotide
cttcctcaacggctgccagcactatgg

SEQ ID NO: 242755 - DNA, 27 bp, Artificial Sequence
  Description of Artificial Sequence: Synthetic oligonucleotide
ttcctcaacggctgccagcactatggc

SEQ ID NO: 242756 - DNA, 27 bp, Artificial Sequence
  Description of Artificial Sequence: Synthetic oligonucleotide
tcctcaacggctgccagcactatggct

SEQ ID NO: 242757 - DNA, 26 bp, Artificial Sequence
  Description of Artificial Sequence: Synthetic oligonucleotide
cctcaacggctgccagcactatggct

SEQ ID NO: 242758 - DNA, 26 bp, Artificial Sequence
  Description of Artificial Sequence: Synthetic oligonucleotide
ctcaacggctgccagcactatggctc

SEQ ID NO: 242759 - DNA, 27 bp, Artificial Sequence
  Description of Artificial Sequence: Synthetic oligonucleotide
tcaacggctgccagcactatggctcga

SEQ ID NO: 242760 - DNA, 26 bp, Artificial Sequence
  Description of Artificial Sequence: Synthetic oligonucleotide
caacggctgccagcactatggctcga

SEQ ID NO: 242761 - DNA, 26 bp, Artificial Sequence
  Description of Artificial Sequence: Synthetic oligonucleotide
aacggctgccagcactatggctcgag

SEQ ID NO: 242762 - DNA, 25 bp, Artificial Sequence
  Description of Artificial Sequence: Synthetic oligonucleotide
acggctgccagcactatggctcgag

SEQ ID NO: 242763 - DNA, 24 bp, Artificial Sequence
  Description of Artificial Sequence: Synthetic oligonucleotide
cggctgccagcactatggctcgag

SEQ ID NO: 242764 - DNA, 24 bp, Artificial Sequence
  Description of Artificial Sequence: Synthetic oligonucleotide
ggctgccagcactatggctcgagg

SEQ ID NO: 242765 - DNA, 24 bp, Artificial Sequence
  Description of Artificial Sequence: Synthetic oligonucleotide
gctgccagcactatggctcgaggg

SEQ ID NO: 242766 - DNA, 25 bp, Artificial Sequence
  Description of Artificial Sequence: Synthetic oligonucleotide
ctgccagcactatggctcgagggga

SEQ ID NO: 242767 - DNA, 25 bp, Artificial Sequence
  Description of Artificial Sequence: Synthetic oligonucleotide
tgccagcactatggctcgaggggac

SEQ ID NO: 242768 - DNA, 24 bp, Artificial Sequence
  Description of Artificial Sequence: Synthetic oligonucleotide
gccagcactatggctcgaggggac

SEQ ID NO: 242769 - DNA, 24 bp, Artificial Sequence
  Description of Artificial Sequence: Synthetic oligonucleotide
ccagcactatggctcgaggggacc

SEQ ID NO: 242770 - DNA, 25 bp, Artificial Sequence
  Description of Artificial Sequence: Synthetic oligonucleotide
cagcactatggctcgaggggaccgt

SEQ ID NO: 242771 - DNA, 25 bp, Artificial Sequence
  Description of Artificial Sequence: Synthetic oligonucleotide
agcactatggctcgaggggaccgtg

SEQ ID NO: 242772 - DNA, 24 bp, Artificial Sequence
  Description of Artificial Sequence: Synthetic oligonucleotide
gcactatggctcgaggggaccgtg

SEQ ID NO: 242773 - DNA, 24 bp, Artificial Sequence
  Description of Artificial Sequence: Synthetic oligonucleotide
cactatggctcgaggggaccgtgc

SEQ ID NO: 242774 - DNA, 24 bp, Artificial Sequence
  Description of Artificial Sequence: Synthetic oligonucleotide
actatggctcgaggggaccgtgcg

SEQ ID NO: 242775 - DNA, 23 bp, Artificial Sequence
  Description of Artificial Sequence: Synthetic oligonucleotide
ctatggctcgaggggaccgtgcg

SEQ ID NO: 242776 - DNA, 23 bp, Artificial Sequence
  Description of Artificial Sequence: Synthetic oligonucleotide
tatggctcgaggggaccgtgcgg

SEQ ID NO: 242777 - DNA, 22 bp, Artificial Sequence
  Description of Artificial Sequence: Synthetic oligonucleotide
atggctcgaggggaccgtgcgg

SEQ ID NO: 242778 - DNA, 21 bp, Artificial Sequence
  Description of Artificial Sequence: Synthetic oligonucleotide
tggctcgaggggaccgtgcgg

SEQ ID NO: 242779 - DNA, 20 bp, Artificial Sequence
  Description of Artificial Sequence: Synthetic oligonucleotide
ggctcgaggggaccgtgcgg

SEQ ID NO: 242780 - DNA, 21 bp, Artificial Sequence
  Description of Artificial Sequence: Synthetic oligonucleotide
gctcgaggggaccgtgcggct

SEQ ID NO: 242781 - DNA, 21 bp, Artificial Sequence
  Description of Artificial Sequence: Synthetic oligonucleotide
ctcgaggggaccgtgcggctg

SEQ ID NO: 242782 - DNA, 21 bp, Artificial Sequence
  Description of Artificial Sequence: Synthetic oligonucleotide
tcgaggggaccgtgcggctgg

SEQ ID NO: 242783 - DNA, 20 bp, Artificial Sequence
  Description of Artificial Sequence: Synthetic oligonucleotide
cgaggggaccgtgcggctgg

SEQ ID NO: 242784 - DNA, 21 bp, Artificial Sequence
  Description of Artificial Sequence: Synthetic oligonucleotide
gaggggaccgtgcggctggca

SEQ ID NO: 242785 - DNA, 21 bp, Artificial Sequence
  Description of Artificial Sequence: Synthetic oligonucleotide
aggggaccgtgcggctggcag

SEQ ID NO: 242786 - DNA, 20 bp, Artificial Sequence
  Description of Artificial Sequence: Synthetic oligonucleotide
ggggaccgtgcggctggcag

SEQ ID NO: 242787 - DNA, 20 bp, Artificial Sequence
  Description of Artificial Sequence: Synthetic oligonucleotide
gggaccgtgcggctggcagg

SEQ ID NO: 242788 - DNA, 20 bp, Artificial Sequence
  Description of Artificial Sequence: Synthetic oligonucleotide
ggaccgtgcggctggcaggg

SEQ ID NO: 242789 - DNA, 21 bp, Artificial Sequence
  Description of Artificial Sequence: Synthetic oligonucleotide
gaccgtgcggctggcagggct

SEQ ID NO: 242790 - DNA, 22 bp, Artificial Sequence
  Description of Artificial Sequence: Synthetic oligonucleotide
accgtgcggctggcagggctgt

SEQ ID NO: 242791 - DNA, 21 bp, Artificial Sequence
  Description of Artificial Sequence: Synthetic oligonucleotide
ccgtgcggctggcagggctgt

SEQ ID NO: 242792 - DNA, 21 bp, Artificial Sequence
  Description of Artificial Sequence: Synthetic oligonucleotide
cgtgcggctggcagggctgtg

SEQ ID NO: 242793 - DNA, 21 bp, Artificial Sequence
  Description of Artificial Sequence: Synthetic oligonucleotide
gtgcggctggcagggctgtgc

SEQ ID NO: 242794 - DNA, 21 bp, Artificial Sequence
  Description of Artificial Sequence: Synthetic oligonucleotide
tgcggctggcagggctgtgcg

SEQ ID NO: 242795 - DNA, 20 bp, Artificial Sequence
  Description of Artificial Sequence: Synthetic oligonucleotide
gcggctggcagggctgtgcg

SEQ ID NO: 242796 - DNA, 20 bp, Artificial Sequence
  Description of Artificial Sequence: Synthetic oligonucleotide
cggctggcagggctgtgcgg

SEQ ID NO: 242797 - DNA, 20 bp, Artificial Sequence
  Description of Artificial Sequence: Synthetic oligonucleotide
ggctggcagggctgtgcggg

SEQ ID NO: 242798 - DNA, 21 bp, Artificial Sequence
  Description of Artificial Sequence: Synthetic oligonucleotide
gctggcagggctgtgcgggct

SEQ ID NO: 242799 - DNA, 21 bp, Artificial Sequence
  Description of Artificial Sequence: Synthetic oligonucleotide
ctggcagggctgtgcgggctg

SEQ ID NO: 242800 - DNA, 25 bp, Artificial Sequence
  Description of Artificial Sequence: Synthetic oligonucleotide
tggcagggctgtgcgggctgctata

SEQ ID NO: 242801 - DNA, 24 bp, Artificial Sequence
  Description of Artificial Sequence: Synthetic oligonucleotide
ggcagggctgtgcgggctgctata

SEQ ID NO: 242802 - DNA, 24 bp, Artificial Sequence
  Description of Artificial Sequence: Synthetic oligonucleotide
gcagggctgtgcgggctgctatag

SEQ ID NO: 242803 - DNA, 27 bp, Artificial Sequence
  Description of Artificial Sequence: Synthetic oligonucleotide
cagggctgtgcgggctgctatagctaa

SEQ ID NO: 242804 - DNA, 27 bp, Artificial Sequence
  Description of Artificial Sequence: Synthetic oligonucleotide
agggctgtgcgggctgctatagctaag

SEQ ID NO: 242805 - DNA, 27 bp, Artificial Sequence
  Description of Artificial Sequence: Synthetic oligonucleotide
gggctgtgcgggctgctatagctaaga

SEQ ID NO: 242806 - DNA, 27 bp, Artificial Sequence
  Description of Artificial Sequence: Synthetic oligonucleotide
ggctgtgcgggctgctatagctaagag

SEQ ID NO: 242807 - DNA, 27 bp, Artificial Sequence
  Description of Artificial Sequence: Synthetic oligonucleotide
gctgtgcgggctgctatagctaagagc

SEQ ID NO: 242808 - DNA, 27 bp, Artificial Sequence
  Description of Artificial Sequence: Synthetic oligonucleotide
ctgtgcgggctgctatagctaagagcg

SEQ ID NO: 242809 - DNA, 27 bp, Artificial Sequence
  Description of Artificial Sequence: Synthetic oligonucleotide
tgtgcgggctgctatagctaagagcgc

SEQ ID NO: 242810 - DNA, 27 bp, Artificial Sequence
  Description of Artificial Sequence: Synthetic oligonucleotide
gtgcgggctgctatagctaagagcgct

SEQ ID NO: 242811 - DNA, 27 bp, Artificial Sequence
  Description of Artificial Sequence: Synthetic oligonucleotide
tgcgggctgctatagctaagagcgctg

SEQ ID NO: 242812 - DNA, 26 bp, Artificial Sequence
  Description of Artificial Sequence: Synthetic oligonucleotide
gcgggctgctatagctaagagcgctg

SEQ ID NO: 242813 - DNA, 27 bp, Artificial Sequence
  Description of Artificial Sequence: Synthetic oligonucleotide
cgggctgctatagctaagagcgctgct

SEQ ID NO: 242814 - DNA, 27 bp, Artificial Sequence
  Description of Artificial Sequence: Synthetic oligonucleotide
gggctgctatagctaagagcgctgctg

SEQ ID NO: 242815 - DNA, 27 bp, Artificial Sequence
  Description of Artificial Sequence: Synthetic oligonucleotide
ggctgctatagctaagagcgctgctgg

SEQ ID NO: 242816 - DNA, 27 bp, Artificial Sequence
  Description of Artificial Sequence: Synthetic oligonucleotide
gctgctatagctaagagcgctgctggg

SEQ ID NO: 242817 - DNA, 31 bp, Artificial Sequence
  Description of Artificial Sequence: Synthetic oligonucleotide
ctgctatagctaagagcgctgctgggttttg

SEQ ID NO: 242818 - DNA, 32 bp, Artificial Sequence
  Description of Artificial Sequence: Synthetic oligonucleotide
tgctatagctaagagcgctgctgggttttgtg

SEQ ID NO: 242819 - DNA, 31 bp, Artificial Sequence
  Description of Artificial Sequence: Synthetic oligonucleotide
gctatagctaagagcgctgctgggttttgtg

SEQ ID NO: 242820 - DNA, 31 bp, Artificial Sequence
  Description of Artificial Sequence: Synthetic oligonucleotide
ctatagctaagagcgctgctgggttttgtgg

SEQ ID NO: 242821 - DNA, 31 bp, Artificial Sequence
  Description of Artificial Sequence: Synthetic oligonucleotide
tatagctaagagcgctgctgggttttgtggg

SEQ ID NO: 242822 - DNA, 30 bp, Artificial Sequence
  Description of Artificial Sequence: Synthetic oligonucleotide
atagctaagagcgctgctgggttttgtggg

SEQ ID NO: 242823 - DNA, 29 bp, Artificial Sequence
  Description of Artificial Sequence: Synthetic oligonucleotide
tagctaagagcgctgctgggttttgtggg

SEQ ID NO: 242824 - DNA, 28 bp, Artificial Sequence
  Description of Artificial Sequence: Synthetic oligonucleotide
agctaagagcgctgctgggttttgtggg

SEQ ID NO: 242825 - DNA, 27 bp, Artificial Sequence
  Description of Artificial Sequence: Synthetic oligonucleotide
gctaagagcgctgctgggttttgtggg

SEQ ID NO: 242826 - DNA, 27 bp, Artificial Sequence
  Description of Artificial Sequence: Synthetic oligonucleotide
ctaagagcgctgctgggttttgtgggg

SEQ ID NO: 242827 - DNA, 28 bp, Artificial Sequence
  Description of Artificial Sequence: Synthetic oligonucleotide
taagagcgctgctgggttttgtggggtc

SEQ ID NO: 242828 - DNA, 27 bp, Artificial Sequence
  Description of Artificial Sequence: Synthetic oligonucleotide
aagagcgctgctgggttttgtggggtc

SEQ ID NO: 242829 - DNA, 27 bp, Artificial Sequence
  Description of Artificial Sequence: Synthetic oligonucleotide
agagcgctgctgggttttgtggggtca

SEQ ID NO: 242830 - DNA, 26 bp, Artificial Sequence
  Description of Artificial Sequence: Synthetic oligonucleotide
gagcgctgctgggttttgtggggtca

SEQ ID NO: 242831 - DNA, 27 bp, Artificial Sequence
  Description of Artificial Sequence: Synthetic oligonucleotide
agcgctgctgggttttgtggggtcact

SEQ ID NO: 242832 - DNA, 26 bp, Artificial Sequence
  Description of Artificial Sequence: Synthetic oligonucleotide
gcgctgctgggttttgtggggtcact

SEQ ID NO: 242833 - DNA, 26 bp, Artificial Sequence
  Description of Artificial Sequence: Synthetic oligonucleotide
cgctgctgggttttgtggggtcactg

SEQ ID NO: 242834 - DNA, 27 bp, Artificial Sequence
  Description of Artificial Sequence: Synthetic oligonucleotide
gctgctgggttttgtggggtcactgct

SEQ ID NO: 242835 - DNA, 27 bp, Artificial Sequence
  Description of Artificial Sequence: Synthetic oligonucleotide
ctgctgggttttgtggggtcactgctg

SEQ ID NO: 242836 - DNA, 27 bp, Artificial Sequence
  Description of Artificial Sequence: Synthetic oligonucleotide
tgctgggttttgtggggtcactgctgc

SEQ ID NO: 242837 - DNA, 27 bp, Artificial Sequence
  Description of Artificial Sequence: Synthetic oligonucleotide
gctgggttttgtggggtcactgctgca

SEQ ID NO: 242838 - DNA, 27 bp, Artificial Sequence
  Description of Artificial Sequence: Synthetic oligonucleotide
ctgggttttgtggggtcactgctgcac

SEQ ID NO: 242839 - DNA, 27 bp, Artificial Sequence
  Description of Artificial Sequence: Synthetic oligonucleotide
tgggttttgtggggtcactgctgcacc

SEQ ID NO: 242840 - DNA, 26 bp, Artificial Sequence
  Description of Artificial Sequence: Synthetic oligonucleotide
gggttttgtggggtcactgctgcacc

SEQ ID NO: 242841 - DNA, 26 bp, Artificial Sequence
  Description of Artificial Sequence: Synthetic oligonucleotide
ggttttgtggggtcactgctgcaccc

SEQ ID NO: 242842 - DNA, 26 bp, Artificial Sequence
  Description of Artificial Sequence: Synthetic oligonucleotide
gttttgtggggtcactgctgcacccg

SEQ ID NO: 242843 - DNA, 27 bp, Artificial Sequence
  Description of Artificial Sequence: Synthetic oligonucleotide
ttttgtggggtcactgctgcacccgct

SEQ ID NO: 242844 - DNA, 26 bp, Artificial Sequence
  Description of Artificial Sequence: Synthetic oligonucleotide
tttgtggggtcactgctgcacccgct

SEQ ID NO: 242845 - DNA, 25 bp, Artificial Sequence
  Description of Artificial Sequence: Synthetic oligonucleotide
ttgtggggtcactgctgcacccgct

SEQ ID NO: 242846 - DNA, 24 bp, Artificial Sequence
  Description of Artificial Sequence: Synthetic oligonucleotide
tgtggggtcactgctgcacccgct

SEQ ID NO: 242847 - DNA, 23 bp, Artificial Sequence
  Description of Artificial Sequence: Synthetic oligonucleotide
gtggggtcactgctgcacccgct

SEQ ID NO: 242848 - DNA, 24 bp, Artificial Sequence
  Description of Artificial Sequence: Synthetic oligonucleotide
tggggtcactgctgcacccgctct

SEQ ID NO: 242849 - DNA, 23 bp, Artificial Sequence
  Description of Artificial Sequence: Synthetic oligonucleotide
ggggtcactgctgcacccgctct

SEQ ID NO: 242850 - DNA, 24 bp, Artificial Sequence
  Description of Artificial Sequence: Synthetic oligonucleotide
gggtcactgctgcacccgctctga

SEQ ID NO: 242851 - DNA, 25 bp, Artificial Sequence
  Description of Artificial Sequence: Synthetic oligonucleotide
ggtcactgctgcacccgctctgact

SEQ ID NO: 242852 - DNA, 25 bp, Artificial Sequence
  Description of Artificial Sequence: Synthetic oligonucleotide
gtcactgctgcacccgctctgactg

SEQ ID NO: 242853 - DNA, 25 bp, Artificial Sequence
  Description of Artificial Sequence: Synthetic oligonucleotide
tcactgctgcacccgctctgactgg

SEQ ID NO: 242854 - DNA, 24 bp, Artificial Sequence
  Description of Artificial Sequence: Synthetic oligonucleotide
cactgctgcacccgctctgactgg

SEQ ID NO: 242855 - DNA, 24 bp, Artificial Sequence
  Description of Artificial Sequence: Synthetic oligonucleotide
actgctgcacccgctctgactggc

SEQ ID NO: 242856 - DNA, 23 bp, Artificial Sequence
  Description of Artificial Sequence: Synthetic oligonucleotide
ctgctgcacccgctctgactggc

SEQ ID NO: 242857 - DNA, 24 bp, Artificial Sequence
  Description of Artificial Sequence: Synthetic oligonucleotide
tgctgcacccgctctgactggcca

SEQ ID NO: 242858 - DNA, 23 bp, Artificial Sequence
  Description of Artificial Sequence: Synthetic oligonucleotide
gctgcacccgctctgactggcca

SEQ ID NO: 242859 - DNA, 23 bp, Artificial Sequence
  Description of Artificial Sequence: Synthetic oligonucleotide
ctgcacccgctctgactggccac

SEQ ID NO: 242860 - DNA, 23 bp, Artificial Sequence
  Description of Artificial Sequence: Synthetic oligonucleotide
tgcacccgctctgactggccacc

SEQ ID NO: 242861 - DNA, 22 bp, Artificial Sequence
  Description of Artificial Sequence: Synthetic oligonucleotide
gcacccgctctgactggccacc

SEQ ID NO: 242862 - DNA, 22 bp, Artificial Sequence
  Description of Artificial Sequence: Synthetic oligonucleotide
cacccgctctgactggccaccg

SEQ ID NO: 242863 - DNA, 22 bp, Artificial Sequence
  Description of Artificial Sequence: Synthetic oligonucleotide
acccgctctgactggccaccgc

SEQ ID NO: 242864 - DNA, 21 bp, Artificial Sequence
  Description of Artificial Sequence: Synthetic oligonucleotide
cccgctctgactggccaccgc

SEQ ID NO: 242865 - DNA, 21 bp, Artificial Sequence
  Description of Artificial Sequence: Synthetic oligonucleotide
ccgctctgactggccaccgcc

SEQ ID NO: 242866 - DNA, 22 bp, Artificial Sequence
  Description of Artificial Sequence: Synthetic oligonucleotide
cgctctgactggccaccgccct

SEQ ID NO: 242867 - DNA, 23 bp, Artificial Sequence
  Description of Artificial Sequence: Synthetic oligonucleotide
gctctgactggccaccgccctga

SEQ ID NO: 242868 - DNA, 24 bp, Artificial Sequence
  Description of Artificial Sequence: Synthetic oligonucleotide
ctctgactggccaccgccctgact

SEQ ID NO: 242869 - DNA, 25 bp, Artificial Sequence
  Description of Artificial Sequence: Synthetic oligonucleotide
tctgactggccaccgccctgactga

SEQ ID NO: 242870 - DNA, 24 bp, Artificial Sequence
  Description of Artificial Sequence: Synthetic oligonucleotide
ctgactggccaccgccctgactga

SEQ ID NO: 242871 - DNA, 25 bp, Artificial Sequence
  Description of Artificial Sequence: Synthetic oligonucleotide
tgactggccaccgccctgactgact

SEQ ID NO: 242872 - DNA, 24 bp, Artificial Sequence
  Description of Artificial Sequence: Synthetic oligonucleotide
gactggccaccgccctgactgact

SEQ ID NO: 242873 - DNA, 24 bp, Artificial Sequence
  Description of Artificial Sequence: Synthetic oligonucleotide
actggccaccgccctgactgactc

SEQ ID NO: 242874 - DNA, 23 bp, Artificial Sequence
  Description of Artificial Sequence: Synthetic oligonucleotide
ctggccaccgccctgactgactc

SEQ ID NO: 242875 - DNA, 23 bp, Artificial Sequence
  Description of Artificial Sequence: Synthetic oligonucleotide
tggccaccgccctgactgactcc

SEQ ID NO: 242876 - DNA, 22 bp, Artificial Sequence
  Description of Artificial Sequence: Synthetic oligonucleotide
ggccaccgccctgactgactcc

SEQ ID NO: 242877 - DNA, 23 bp, Artificial Sequence
  Description of Artificial Sequence: Synthetic oligonucleotide
gccaccgccctgactgactccct

SEQ ID NO: 242878 - DNA, 24 bp, Artificial Sequence
  Description of Artificial Sequence: Synthetic oligonucleotide
ccaccgccctgactgactccctga

SEQ ID NO: 242879 - DNA, 25 bp, Artificial Sequence
  Description of Artificial Sequence: Synthetic oligonucleotide
caccgccctgactgactccctgagt

SEQ ID NO: 242880 - DNA, 25 bp, Artificial Sequence
  Description of Artificial Sequence: Synthetic oligonucleotide
accgccctgactgactccctgagtg

SEQ ID NO: 242881 - DNA, 24 bp, Artificial Sequence
  Description of Artificial Sequence: Synthetic oligonucleotide
ccgccctgactgactccctgagtg

SEQ ID NO: 242882 - DNA, 24 bp, Artificial Sequence
  Description of Artificial Sequence: Synthetic oligonucleotide
cgccctgactgactccctgagtgc

SEQ ID NO: 242883 - DNA, 24 bp, Artificial Sequence
  Description of Artificial Sequence: Synthetic oligonucleotide
gccctgactgactccctgagtgcc

SEQ ID NO: 242884 - DNA, 25 bp, Artificial Sequence
  Description of Artificial Sequence: Synthetic oligonucleotide
ccctgactgactccctgagtgccct

SEQ ID NO: 242885 - DNA, 25 bp, Artificial Sequence
  Description of Artificial Sequence: Synthetic oligonucleotide
cctgactgactccctgagtgccctg

SEQ ID NO: 242886 - DNA, 26 bp, Artificial Sequence
  Description of Artificial Sequence: Synthetic oligonucleotide
ctgactgactccctgagtgccctggt

SEQ ID NO: 242887 - DNA, 26 bp, Artificial Sequence
  Description of Artificial Sequence: Synthetic oligonucleotide
tgactgactccctgagtgccctggtc

SEQ ID NO: 242888 - DNA, 25 bp, Artificial Sequence
  Description of Artificial Sequence: Synthetic oligonucleotide
gactgactccctgagtgccctggtc

SEQ ID NO: 242889 - DNA, 25 bp, Artificial Sequence
  Description of Artificial Sequence: Synthetic oligonucleotide
actgactccctgagtgccctggtcc

SEQ ID NO: 242890 - DNA, 24 bp, Artificial Sequence
  Description of Artificial Sequence: Synthetic oligonucleotide
ctgactccctgagtgccctggtcc

SEQ ID NO: 242891 - DNA, 24 bp, Artificial Sequence
  Description of Artificial Sequence: Synthetic oligonucleotide
tgactccctgagtgccctggtccc

SEQ ID NO: 242892 - DNA, 23 bp, Artificial Sequence
  Description of Artificial Sequence: Synthetic oligonucleotide
gactccctgagtgccctggtccc

SEQ ID NO: 242893 - DNA, 23 bp, Artificial Sequence
  Description of Artificial Sequence: Synthetic oligonucleotide
actccctgagtgccctggtcccg

SEQ ID NO: 242894 - DNA, 22 bp, Artificial Sequence
  Description of Artificial Sequence: Synthetic oligonucleotide
ctccctgagtgccctggtcccg

SEQ ID NO: 242895 - DNA, 22 bp, Artificial Sequence
  Description of Artificial Sequence: Synthetic oligonucleotide
tccctgagtgccctggtcccgg

SEQ ID NO: 242896 - DNA, 21 bp, Artificial Sequence
  Description of Artificial Sequence: Synthetic oligonucleotide
ccctgagtgccctggtcccgg

SEQ ID NO: 242897 - DNA, 21 bp, Artificial Sequence
  Description of Artificial Sequence: Synthetic oligonucleotide
cctgagtgccctggtcccggg

SEQ ID NO: 242898 - DNA, 21 bp, Artificial Sequence
  Description of Artificial Sequence: Synthetic oligonucleotide
ctgagtgccctggtcccgggg

SEQ ID NO: 242899 - DNA, 21 bp, Artificial Sequence
  Description of Artificial Sequence: Synthetic oligonucleotide
tgagtgccctggtcccggggg

SEQ ID NO: 242900 - DNA, 20 bp, Artificial Sequence
  Description of Artificial Sequence: Synthetic oligonucleotide
gagtgccctggtcccggggg

SEQ ID NO: 242901 - DNA, 20 bp, Artificial Sequence
  Description of Artificial Sequence: Synthetic oligonucleotide
agtgccctggtcccgggggc

SEQ ID NO: 242902 - DNA, 20 bp, Artificial Sequence
  Description of Artificial Sequence: Synthetic oligonucleotide
gtgccctggtcccgggggct

SEQ ID NO: 242903 - DNA, 20 bp, Artificial Sequence
  Description of Artificial Sequence: Synthetic oligonucleotide
tgccctggtcccgggggcct

SEQ ID NO: 242904 - DNA, 20 bp, Artificial Sequence
  Description of Artificial Sequence: Synthetic oligonucleotide
gccctggtcccgggggcctt

SEQ ID NO: 242905 - DNA, 20 bp, Artificial Sequence
  Description of Artificial Sequence: Synthetic oligonucleotide
ccctggtcccgggggcctga

SEQ ID NO: 242906 - DNA, 20 bp, Artificial Sequence
  Description of Artificial Sequence: Synthetic oligonucleotide
cctggtcccgggggcctgac

SEQ ID NO: 242907 - DNA, 21 bp, Artificial Sequence
  Description of Artificial Sequence: Synthetic oligonucleotide
ctggtcccgggggcctgacgt

SEQ ID NO: 242908 - DNA, 21 bp, Artificial Sequence
  Description of Artificial Sequence: Synthetic oligonucleotide
tggtcccgggggcctgacgtg

SEQ ID NO: 242909 - DNA, 20 bp, Artificial Sequence
  Description of Artificial Sequence: Synthetic oligonucleotide
ggtcccgggggcctgacgtg

SEQ ID NO: 242910 - DNA, 21 bp, Artificial Sequence
  Description of Artificial Sequence: Synthetic oligonucleotide
gtcccgggggcctgacgtgct

SEQ ID NO: 242911 - DNA, 21 bp, Artificial Sequence
  Description of Artificial Sequence: Synthetic oligonucleotide
tcccgggggcctgacgtgctc

SEQ ID NO: 242912 - DNA, 20 bp, Artificial Sequence
  Description of Artificial Sequence: Synthetic oligonucleotide
cccgggggcctgacgtgctc

SEQ ID NO: 242913 - DNA, 20 bp, Artificial Sequence
  Description of Artificial Sequence: Synthetic oligonucleotide
ccgggggcctgacgtgctcc

SEQ ID NO: 242914 - DNA, 20 bp, Artificial Sequence
  Description of Artificial Sequence: Synthetic oligonucleotide
cgggggcctgacgtgctccg

SEQ ID NO: 242915 - DNA, 20 bp, Artificial Sequence
  Description of Artificial Sequence: Synthetic oligonucleotide
gggggcctgacgtgctccgc

SEQ ID NO: 242916 - DNA, 21 bp, Artificial Sequence
  Description of Artificial Sequence: Synthetic oligonucleotide
ggggcctgacgtgctccgcca

SEQ ID NO: 242917 - DNA, 21 bp, Artificial Sequence
  Description of Artificial Sequence: Synthetic oligonucleotide
gggcctgacgtgctccgccag

SEQ ID NO: 242918 - DNA, 21 bp, Artificial Sequence
  Description of Artificial Sequence: Synthetic oligonucleotide
ggcctgacgtgctccgccagc

SEQ ID NO: 242919 - DNA, 22 bp, Artificial Sequence
  Description of Artificial Sequence: Synthetic oligonucleotide
gcctgacgtgctccgccagcca

SEQ ID NO: 242920 - DNA, 23 bp, Artificial Sequence
  Description of Artificial Sequence: Synthetic oligonucleotide
cctgacgtgctccgccagccaga

SEQ ID NO: 242921 - DNA, 24 bp, Artificial Sequence
  Description of Artificial Sequence: Synthetic oligonucleotide
ctgacgtgctccgccagccagact

SEQ ID NO: 242922 - DNA, 24 bp, Artificial Sequence
  Description of Artificial Sequence: Synthetic oligonucleotide
tgacgtgctccgccagccagactc

SEQ ID NO: 242923 - DNA, 23 bp, Artificial Sequence
  Description of Artificial Sequence: Synthetic oligonucleotide
gacgtgctccgccagccagactc

SEQ ID NO: 242924 - DNA, 23 bp, Artificial Sequence
  Description of Artificial Sequence: Synthetic oligonucleotide
acgtgctccgccagccagactcg

SEQ ID NO: 242925 - DNA, 22 bp, Artificial Sequence
  Description of Artificial Sequence: Synthetic oligonucleotide
cgtgctccgccagccagactcg

SEQ ID NO: 242926 - DNA, 24 bp, Artificial Sequence
  Description of Artificial Sequence: Synthetic oligonucleotide
gtgctccgccagccagactcgctt

SEQ ID NO: 242927 - DNA, 25 bp, Artificial Sequence
  Description of Artificial Sequence: Synthetic oligonucleotide
tgctccgccagccagactcgcttca

SEQ ID NO: 242928 - DNA, 24 bp, Artificial Sequence
  Description of Artificial Sequence: Synthetic oligonucleotide
gctccgccagccagactcgcttca

SEQ ID NO: 242929 - DNA, 24 bp, Artificial Sequence
  Description of Artificial Sequence: Synthetic oligonucleotide
ctccgccagccagactcgcttcag

SEQ ID NO: 242930 - DNA, 24 bp, Artificial Sequence
  Description of Artificial Sequence: Synthetic oligonucleotide
tccgccagccagactcgcttcagg

SEQ ID NO: 242931 - DNA, 23 bp, Artificial Sequence
  Description of Artificial Sequence: Synthetic oligonucleotide
ccgccagccagactcgcttcagg

SEQ ID NO: 242932 - DNA, 23 bp, Artificial Sequence
  Description of Artificial Sequence: Synthetic oligonucleotide
cgccagccagactcgcttcaggc

SEQ ID NO: 242933 - DNA, 23 bp, Artificial Sequence
  Description of Artificial Sequence: Synthetic oligonucleotide
gccagccagactcgcttcaggcc

SEQ ID NO: 242934 - DNA, 25 bp, Artificial Sequence
  Description of Artificial Sequence: Synthetic oligonucleotide
ccagccagactcgcttcaggccctt

SEQ ID NO: 242935 - DNA, 25 bp, Artificial Sequence
  Description of Artificial Sequence: Synthetic oligonucleotide
cagccagactcgcttcaggcccttg

SEQ ID NO: 242936 - DNA, 26 bp, Artificial Sequence
  Description of Artificial Sequence: Synthetic oligonucleotide
agccagactcgcttcaggcccttgga

SEQ ID NO: 242937 - DNA, 25 bp, Artificial Sequence
  Description of Artificial Sequence: Synthetic oligonucleotide
gccagactcgcttcaggcccttgga

SEQ ID NO: 242938 - DNA, 25 bp, Artificial Sequence
  Description of Artificial Sequence: Synthetic oligonucleotide
ccagactcgcttcaggcccttggag

SEQ ID NO: 242939 - DNA, 26 bp, Artificial Sequence
  Description of Artificial Sequence: Synthetic oligonucleotide
cagactcgcttcaggcccttggaggt

SEQ ID NO: 242940 - DNA, 26 bp, Artificial Sequence
  Description of Artificial Sequence: Synthetic oligonucleotide
agactcgcttcaggcccttggaggtg

SEQ ID NO: 242941 - DNA, 25 bp, Artificial Sequence
  Description of Artificial Sequence: Synthetic oligonucleotide
gactcgcttcaggcccttggaggtg

SEQ ID NO: 242942 - DNA, 25 bp, Artificial Sequence
  Description of Artificial Sequence: Synthetic oligonucleotide
actcgcttcaggcccttggaggtgg

SEQ ID NO: 242943 - DNA, 24 bp, Artificial Sequence
  Description of Artificial Sequence: Synthetic oligonucleotide
ctcgcttcaggcccttggaggtgg

SEQ ID NO: 242944 - DNA, 25 bp, Artificial Sequence
  Description of Artificial Sequence: Synthetic oligonucleotide
tcgcttcaggcccttggaggtggct

SEQ ID NO: 242945 - DNA, 24 bp, Artificial Sequence
  Description of Artificial Sequence: Synthetic oligonucleotide
cgcttcaggcccttggaggtggct

SEQ ID NO: 242946 - DNA, 24 bp, Artificial Sequence
  Description of Artificial Sequence: Synthetic oligonucleotide
gcttcaggcccttggaggtggctg

SEQ ID NO: 242947 - DNA, 25 bp, Artificial Sequence
  Description of Artificial Sequence: Synthetic oligonucleotide
cttcaggcccttggaggtggctgct

SEQ ID NO: 242948 - DNA, 25 bp, Artificial Sequence
  Description of Artificial Sequence: Synthetic oligonucleotide
ttcaggcccttggaggtggctgctg

SEQ ID NO: 242949 - DNA, 24 bp, Artificial Sequence
  Description of Artificial Sequence: Synthetic oligonucleotide
tcaggcccttggaggtggctgctg

SEQ ID NO: 242950 - DNA, 23 bp, Artificial Sequence
  Description of Artificial Sequence: Synthetic oligonucleotide
caggcccttggaggtggctgctg

SEQ ID NO: 242951 - DNA, 24 bp, Artificial Sequence
  Description of Artificial Sequence: Synthetic oligonucleotide
aggcccttggaggtggctgctgct

SEQ ID NO: 242952 - DNA, 23 bp, Artificial Sequence
  Description of Artificial Sequence: Synthetic oligonucleotide
ggcccttggaggtggctgctgct

SEQ ID NO: 242953 - DNA, 23 bp, Artificial Sequence
  Description of Artificial Sequence: Synthetic oligonucleotide
gcccttggaggtggctgctgctg

SEQ ID NO: 242954 - DNA, 23 bp, Artificial Sequence
  Description of Artificial Sequence: Synthetic oligonucleotide
cccttggaggtggctgctgctgg

SEQ ID NO: 242955 - DNA, 23 bp, Artificial Sequence
  Description of Artificial Sequence: Synthetic oligonucleotide
ccttggaggtggctgctgctggg

SEQ ID NO: 242956 - DNA, 25 bp, Artificial Sequence
  Description of Artificial Sequence: Synthetic oligonucleotide
cttggaggtggctgctgctggggta

SEQ ID NO: 242957 - DNA, 25 bp, Artificial Sequence
  Description of Artificial Sequence: Synthetic oligonucleotide
ttggaggtggctgctgctggggtac

SEQ ID NO: 242958 - DNA, 24 bp, Artificial Sequence
  Description of Artificial Sequence: Synthetic oligonucleotide
tggaggtggctgctgctggggtac

SEQ ID NO: 242959 - DNA, 23 bp, Artificial Sequence
  Description of Artificial Sequence: Synthetic oligonucleotide
ggaggtggctgctgctggggtac

SEQ ID NO: 242960 - DNA, 23 bp, Artificial Sequence
  Description of Artificial Sequence: Synthetic oligonucleotide
gaggtggctgctgctggggtacg

SEQ ID NO: 242961 - DNA, 23 bp, Artificial Sequence
  Description of Artificial Sequence: Synthetic oligonucleotide
aggtggctgctgctggggtacgc

SEQ ID NO: 242962 - DNA, 22 bp, Artificial Sequence
  Description of Artificial Sequence: Synthetic oligonucleotide
ggtggctgctgctggggtacgc

SEQ ID NO: 242963 - DNA, 22 bp, Artificial Sequence
  Description of Artificial Sequence: Synthetic oligonucleotide
gtggctgctgctggggtacgcg

SEQ ID NO: 242964 - DNA, 22 bp, Artificial Sequence
  Description of Artificial Sequence: Synthetic oligonucleotide
tggctgctgctggggtacgcgg

SEQ ID NO: 242965 - DNA, 21 bp, Artificial Sequence
  Description of Artificial Sequence: Synthetic oligonucleotide
ggctgctgctggggtacgcgg

SEQ ID NO: 242966 - DNA, 22 bp, Artificial Sequence
  Description of Artificial Sequence: Synthetic oligonucleotide
gctgctgctggggtacgcggct

SEQ ID NO: 242967 - DNA, 22 bp, Artificial Sequence
  Description of Artificial Sequence: Synthetic oligonucleotide
ctgctgctggggtacgcggctg

SEQ ID NO: 242968 - DNA, 22 bp, Artificial Sequence
  Description of Artificial Sequence: Synthetic oligonucleotide
tgctgctggggtacgcggctgc

SEQ ID NO: 242969 - DNA, 21 bp, Artificial Sequence
  Description of Artificial Sequence: Synthetic oligonucleotide
gctgctggggtacgcggctgc

SEQ ID NO: 242970 - DNA, 21 bp, Artificial Sequence
  Description of Artificial Sequence: Synthetic oligonucleotide
ctgctggggtacgcggctgcg

SEQ ID NO: 242971 - DNA, 21 bp, Artificial Sequence
  Description of Artificial Sequence: Synthetic oligonucleotide
tgctggggtacgcggctgcgg

SEQ ID NO: 242972 - DNA, 20 bp, Artificial Sequence
  Description of Artificial Sequence: Synthetic oligonucleotide
gctggggtacgcggctgcgg

SEQ ID NO: 242973 - DNA, 20 bp, Artificial Sequence
  Description of Artificial Sequence: Synthetic oligonucleotide
ctggggtacgcggctgcggg

SEQ ID NO: 242974 - DNA, 20 bp, Artificial Sequence
  Description of Artificial Sequence: Synthetic oligonucleotide
tggggtacgcggctgcgggc

SEQ ID NO: 242975 - DNA, 20 bp, Artificial Sequence
  Description of Artificial Sequence: Synthetic oligonucleotide
ggggtacgcggctgcgggct

SEQ ID NO: 242976 - DNA, 20 bp, Artificial Sequence
  Description of Artificial Sequence: Synthetic oligonucleotide
gggtacgcggctgcgggcct

SEQ ID NO: 242977 - DNA, 21 bp, Artificial Sequence
  Description of Artificial Sequence: Synthetic oligonucleotide
ggtacgcggctgcgggcctca

SEQ ID NO: 242978 - DNA, 21 bp, Artificial Sequence
  Description of Artificial Sequence: Synthetic oligonucleotide
gtacgcggctgcgggcctcag

SEQ ID NO: 242979 - DNA, 22 bp, Artificial Sequence
  Description of Artificial Sequence: Synthetic oligonucleotide
tacgcggctgcgggcctcagct

SEQ ID NO: 242980 - DNA, 21 bp, Artificial Sequence
  Description of Artificial Sequence: Synthetic oligonucleotide
acgcggctgcgggcctcagct

SEQ ID NO: 242981 - DNA, 20 bp, Artificial Sequence
  Description of Artificial Sequence: Synthetic oligonucleotide
cgcggctgcgggcctcagct

SEQ ID NO: 242982 - DNA, 20 bp, Artificial Sequence
  Description of Artificial Sequence: Synthetic oligonucleotide
gcggctgcgggcctcagctg

SEQ ID NO: 242983 - DNA, 21 bp, Artificial Sequence
  Description of Artificial Sequence: Synthetic oligonucleotide
cggctgcgggcctcagctgga

SEQ ID NO: 242984 - DNA, 22 bp, Artificial Sequence
  Description of Artificial Sequence: Synthetic oligonucleotide
ggctgcgggcctcagctggaca

SEQ ID NO: 242985 - DNA, 23 bp, Artificial Sequence
  Description of Artificial Sequence: Synthetic oligonucleotide
gctgcgggcctcagctggacact

SEQ ID NO: 242986 - DNA, 24 bp, Artificial Sequence
  Description of Artificial Sequence: Synthetic oligonucleotide
ctgcgggcctcagctggacactgt

SEQ ID NO: 242987 - DNA, 24 bp, Artificial Sequence
  Description of Artificial Sequence: Synthetic oligonucleotide
tgcgggcctcagctggacactgtg

SEQ ID NO: 242988 - DNA, 23 bp, Artificial Sequence
  Description of Artificial Sequence: Synthetic oligonucleotide
gcgggcctcagctggacactgtg

SEQ ID NO: 242989 - DNA, 23 bp, Artificial Sequence
  Description of Artificial Sequence: Synthetic oligonucleotide
cgggcctcagctggacactgtgg

SEQ ID NO: 242990 - DNA, 23 bp, Artificial Sequence
  Description of Artificial Sequence: Synthetic oligonucleotide
gggcctcagctggacactgtggg

SEQ ID NO: 242991 - DNA, 24 bp, Artificial Sequence
  Description of Artificial Sequence: Synthetic oligonucleotide
ggcctcagctggacactgtggggt

SEQ ID NO: 242992 - DNA, 26 bp, Artificial Sequence
  Description of Artificial Sequence: Synthetic oligonucleotide
gcctcagctggacactgtggggtgtt

SEQ ID NO: 242993 - DNA, 27 bp, Artificial Sequence
  Description of Artificial Sequence: Synthetic oligonucleotide
cctcagctggacactgtggggtgttct

SEQ ID NO: 242994 - DNA, 27 bp, Artificial Sequence
  Description of Artificial Sequence: Synthetic oligonucleotide
ctcagctggacactgtggggtgttctg

SEQ ID NO: 242995 - DNA, 28 bp, Artificial Sequence
  Description of Artificial Sequence: Synthetic oligonucleotide
tcagctggacactgtggggtgttctgag

SEQ ID NO: 242996 - DNA, 27 bp, Artificial Sequence
  Description of Artificial Sequence: Synthetic oligonucleotide
cagctggacactgtggggtgttctgag

SEQ ID NO: 242997 - DNA, 27 bp, Artificial Sequence
  Description of Artificial Sequence: Synthetic oligonucleotide
agctggacactgtggggtgttctgagg

SEQ ID NO: 242998 - DNA, 26 bp, Artificial Sequence
  Description of Artificial Sequence: Synthetic oligonucleotide
gctggacactgtggggtgttctgagg

SEQ ID NO: 242999 - DNA, 26 bp, Artificial Sequence
  Description of Artificial Sequence: Synthetic oligonucleotide
ctggacactgtggggtgttctgaggc

SEQ ID NO: 243000 - DNA, 27 bp, Artificial Sequence
  Description of Artificial Sequence: Synthetic oligonucleotide
tggacactgtggggtgttctgaggcct

SEQ ID NO: 243001 - DNA, 26 bp, Artificial Sequence
  Description of Artificial Sequence: Synthetic oligonucleotide
ggacactgtggggtgttctgaggcct

SEQ ID NO: 243002 - DNA, 26 bp, Artificial Sequence
  Description of Artificial Sequence: Synthetic oligonucleotide
gacactgtggggtgttctgaggcctc

SEQ ID NO: 243003 - DNA, 27 bp, Artificial Sequence
  Description of Artificial Sequence: Synthetic oligonucleotide
acactgtggggtgttctgaggcctcct

SEQ ID NO: 243004 - DNA, 26 bp, Artificial Sequence
  Description of Artificial Sequence: Synthetic oligonucleotide
cactgtggggtgttctgaggcctcct

SEQ ID NO: 243005 - DNA, 26 bp, Artificial Sequence
  Description of Artificial Sequence: Synthetic oligonucleotide
actgtggggtgttctgaggcctcctg

SEQ ID NO: 243006 - DNA, 25 bp, Artificial Sequence
  Description of Artificial Sequence: Synthetic oligonucleotide
ctgtggggtgttctgaggcctcctg

SEQ ID NO: 243007 - DNA, 26 bp, Artificial Sequence
  Description of Artificial Sequence: Synthetic oligonucleotide
tgtggggtgttctgaggcctcctgga

SEQ ID NO: 243008 - DNA, 25 bp, Artificial Sequence
  Description of Artificial Sequence: Synthetic oligonucleotide
gtggggtgttctgaggcctcctgga

SEQ ID NO: 243009 - DNA, 25 bp, Artificial Sequence
  Description of Artificial Sequence: Synthetic oligonucleotide
tggggtgttctgaggcctcctggac

SEQ ID NO: 243010 - DNA, 24 bp, Artificial Sequence
  Description of Artificial Sequence: Synthetic oligonucleotide
ggggtgttctgaggcctcctggac

SEQ ID NO: 243011 - DNA, 24 bp, Artificial Sequence
  Description of Artificial Sequence: Synthetic oligonucleotide
gggtgttctgaggcctcctggacc

SEQ ID NO: 243012 - DNA, 24 bp, Artificial Sequence
  Description of Artificial Sequence: Synthetic oligonucleotide
ggtgttctgaggcctcctggaccc

SEQ ID NO: 243013 - DNA, 25 bp, Artificial Sequence
  Description of Artificial Sequence: Synthetic oligonucleotide
gtgttctgaggcctcctggacccca

SEQ ID NO: 243014 - DNA, 25 bp, Artificial Sequence
  Description of Artificial Sequence: Synthetic oligonucleotide
tgttctgaggcctcctggaccccag

SEQ ID NO: 243015 - DNA, 24 bp, Artificial Sequence
  Description of Artificial Sequence: Synthetic oligonucleotide
gttctgaggcctcctggaccccag

SEQ ID NO: 243016 - DNA, 25 bp, Artificial Sequence
  Description of Artificial Sequence: Synthetic oligonucleotide
ttctgaggcctcctggaccccagga

SEQ ID NO: 243017 - DNA, 24 bp, Artificial Sequence
  Description of Artificial Sequence: Synthetic oligonucleotide
tctgaggcctcctggaccccagga

SEQ ID NO: 243018 - DNA, 23 bp, Artificial Sequence
  Description of Artificial Sequence: Synthetic oligonucleotide
ctgaggcctcctggaccccagga

SEQ ID NO: 243019 - DNA, 25 bp, Artificial Sequence
  Description of Artificial Sequence: Synthetic oligonucleotide
tgaggcctcctggaccccaggagat

SEQ ID NO: 243020 - DNA, 24 bp, Artificial Sequence
  Description of Artificial Sequence: Synthetic oligonucleotide
gaggcctcctggaccccaggagat

SEQ ID NO: 243021 - DNA, 24 bp, Artificial Sequence
  Description of Artificial Sequence: Synthetic oligonucleotide
aggcctcctggaccccaggagatg

SEQ ID NO: 243022 - DNA, 23 bp, Artificial Sequence
  Description of Artificial Sequence: Synthetic oligonucleotide
ggcctcctggaccccaggagatg

SEQ ID NO: 243023 - DNA, 24 bp, Artificial Sequence
  Description of Artificial Sequence: Synthetic oligonucleotide
gcctcctggaccccaggagatgga

SEQ ID NO: 243024 - DNA, 24 bp, Artificial Sequence
  Description of Artificial Sequence: Synthetic oligonucleotide
cctcctggaccccaggagatggag

SEQ ID NO: 243025 - DNA, 25 bp, Artificial Sequence
  Description of Artificial Sequence: Synthetic oligonucleotide
ctcctggaccccaggagatggagca

SEQ ID NO: 243026 - DNA, 25 bp, Artificial Sequence
  Description of Artificial Sequence: Synthetic oligonucleotide
tcctggaccccaggagatggagcag

SEQ ID NO: 243027 - DNA, 24 bp, Artificial Sequence
  Description of Artificial Sequence: Synthetic oligonucleotide
cctggaccccaggagatggagcag

SEQ ID NO: 243028 - DNA, 25 bp, Artificial Sequence
  Description of Artificial Sequence: Synthetic oligonucleotide
ctggaccccaggagatggagcagga

SEQ ID NO: 243029 - DNA, 25 bp, Artificial Sequence
  Description of Artificial Sequence: Synthetic oligonucleotide
tggaccccaggagatggagcaggag

SEQ ID NO: 243030 - DNA, 24 bp, Artificial Sequence
  Description of Artificial Sequence: Synthetic oligonucleotide
ggaccccaggagatggagcaggag

SEQ ID NO: 243031 - DNA, 25 bp, Artificial Sequence
  Description of Artificial Sequence: Synthetic oligonucleotide
gaccccaggagatggagcaggagca

SEQ ID NO: 243032 - DNA, 25 bp, Artificial Sequence
  Description of Artificial Sequence: Synthetic oligonucleotide
accccaggagatggagcaggagcag

SEQ ID NO: 243033 - DNA, 24 bp, Artificial Sequence
  Description of Artificial Sequence: Synthetic oligonucleotide
ccccaggagatggagcaggagcag

SEQ ID NO: 243034 - DNA, 25 bp, Artificial Sequence
  Description of Artificial Sequence: Synthetic oligonucleotide
cccaggagatggagcaggagcaggt

SEQ ID NO: 243035 - DNA, 27 bp, Artificial Sequence
  Description of Artificial Sequence: Synthetic oligonucleotide
ccaggagatggagcaggagcaggtgaa

SEQ ID NO: 243036 - DNA, 27 bp, Artificial Sequence
  Description of Artificial Sequence: Synthetic oligonucleotide
caggagatggagcaggagcaggtgaac

SEQ ID NO: 243037 - DNA, 29 bp, Artificial Sequence
  Description of Artificial Sequence: Synthetic oligonucleotide
aggagatggagcaggagcaggtgaactac

SEQ ID NO: 243038 - DNA, 28 bp, Artificial Sequence
  Description of Artificial Sequence: Synthetic oligonucleotide
ggagatggagcaggagcaggtgaactac

SEQ ID NO: 243039 - DNA, 31 bp, Artificial Sequence
  Description of Artificial Sequence: Synthetic oligonucleotide
gagatggagcaggagcaggtgaactacaaag

SEQ ID NO: 243040 - DNA, 32 bp, Artificial Sequence
  Description of Artificial Sequence: Synthetic oligonucleotide
agatggagcaggagcaggtgaactacaaagtc

SEQ ID NO: 243041 - DNA, 31 bp, Artificial Sequence
  Description of Artificial Sequence: Synthetic oligonucleotide
gatggagcaggagcaggtgaactacaaagtc

SEQ ID NO: 243042 - DNA, 33 bp, Artificial Sequence
  Description of Artificial Sequence: Synthetic oligonucleotide
atggagcaggagcaggtgaactacaaagtctag

SEQ ID NO: 243043 - DNA, 32 bp, Artificial Sequence
  Description of Artificial Sequence: Synthetic oligonucleotide
tggagcaggagcaggtgaactacaaagtctag

SEQ ID NO: 243044 - DNA, 31 bp, Artificial Sequence
  Description of Artificial Sequence: Synthetic oligonucleotide
ggagcaggagcaggtgaactacaaagtctag

SEQ ID NO: 243045 - DNA, 33 bp, Artificial Sequence
  Description of Artificial Sequence: Synthetic oligonucleotide
gagcaggagcaggtgaactacaaagtctagatg

SEQ ID NO: 243046 - DNA, 34 bp, Artificial Sequence
  Description of Artificial Sequence: Synthetic oligonucleotide
agcaggagcaggtgaactacaaagtctagatgtg

SEQ ID NO: 243047 - DNA, 33 bp, Artificial Sequence
  Description of Artificial Sequence: Synthetic oligonucleotide
gcaggagcaggtgaactacaaagtctagatgtg

SEQ ID NO: 243048 - DNA, 33 bp, Artificial Sequence
  Description of Artificial Sequence: Synthetic oligonucleotide
caggagcaggtgaactacaaagtctagatgtgg

SEQ ID NO: 243049 - DNA, 34 bp, Artificial Sequence
  Description of Artificial Sequence: Synthetic oligonucleotide
aggagcaggtgaactacaaagtctagatgtggag

SEQ ID NO: 243050 - DNA, 33 bp, Artificial Sequence
  Description of Artificial Sequence: Synthetic oligonucleotide
ggagcaggtgaactacaaagtctagatgtggag

SEQ ID NO: 243051 - DNA, 33 bp, Artificial Sequence
  Description of Artificial Sequence: Synthetic oligonucleotide
gagcaggtgaactacaaagtctagatgtggagc

SEQ ID NO: 243052 - DNA, 33 bp, Artificial Sequence
  Description of Artificial Sequence: Synthetic oligonucleotide
agcaggtgaactacaaagtctagatgtggagcc

SEQ ID NO: 243053 - DNA, 32 bp, Artificial Sequence
  Description of Artificial Sequence: Synthetic oligonucleotide
gcaggtgaactacaaagtctagatgtggagcc

SEQ ID NO: 243054 - DNA, 33 bp, Artificial Sequence
  Description of Artificial Sequence: Synthetic oligonucleotide
caggtgaactacaaagtctagatgtggagcctg

SEQ ID NO: 243055 - DNA, 33 bp, Artificial Sequence
  Description of Artificial Sequence: Synthetic oligonucleotide
aggtgaactacaaagtctagatgtggagcctgc

SEQ ID NO: 243056 - DNA, 32 bp, Artificial Sequence
  Description of Artificial Sequence: Synthetic oligonucleotide
ggtgaactacaaagtctagatgtggagcctgc

SEQ ID NO: 243057 - DNA, 33 bp, Artificial Sequence
  Description of Artificial Sequence: Synthetic oligonucleotide
gtgaactacaaagtctagatgtggagcctgctg

SEQ ID NO: 243058 - DNA, 35 bp, Artificial Sequence
  Description of Artificial Sequence: Synthetic oligonucleotide
tgaactacaaagtctagatgtggagcctgctgaag

SEQ ID NO: 243059 - DNA, 34 bp, Artificial Sequence
  Description of Artificial Sequence: Synthetic oligonucleotide
gaactacaaagtctagatgtggagcctgctgaag

SEQ ID NO: 243060 - DNA, 34 bp, Artificial Sequence
  Description of Artificial Sequence: Synthetic oligonucleotide
aactacaaagtctagatgtggagcctgctgaagg

SEQ ID NO: 243061 - DNA, 33 bp, Artificial Sequence
  Description of Artificial Sequence: Synthetic oligonucleotide
actacaaagtctagatgtggagcctgctgaagg

SEQ ID NO: 243062 - DNA, 32 bp, Artificial Sequence
  Description of Artificial Sequence: Synthetic oligonucleotide
ctacaaagtctagatgtggagcctgctgaagg

SEQ ID NO: 243063 - DNA, 33 bp, Artificial Sequence
  Description of Artificial Sequence: Synthetic oligonucleotide
tacaaagtctagatgtggagcctgctgaaggtc

SEQ ID NO: 243064 - DNA, 32 bp, Artificial Sequence
  Description of Artificial Sequence: Synthetic oligonucleotide
acaaagtctagatgtggagcctgctgaaggtc

SEQ ID NO: 243065 - DNA, 31 bp, Artificial Sequence
  Description of Artificial Sequence: Synthetic oligonucleotide
caaagtctagatgtggagcctgctgaaggtc

SEQ ID NO: 243066 - DNA, 32 bp, Artificial Sequence
  Description of Artificial Sequence: Synthetic oligonucleotide
aaagtctagatgtggagcctgctgaaggtctc

SEQ ID NO: 243067 - DNA, 31 bp, Artificial Sequence
  Description of Artificial Sequence: Synthetic oligonucleotide
aagtctagatgtggagcctgctgaaggtctc

SEQ ID NO: 243068 - DNA, 30 bp, Artificial Sequence
  Description of Artificial Sequence: Synthetic oligonucleotide
agtctagatgtggagcctgctgaaggtctc

SEQ ID NO: 243069 - DNA, 29 bp, Artificial Sequence
  Description of Artificial Sequence: Synthetic oligonucleotide
gtctagatgtggagcctgctgaaggtctc

SEQ ID NO: 243070 - DNA, 29 bp, Artificial Sequence
  Description of Artificial Sequence: Synthetic oligonucleotide
tctagatgtggagcctgctgaaggtctcc

SEQ ID NO: 243071 - DNA, 28 bp, Artificial Sequence
  Description of Artificial Sequence: Synthetic oligonucleotide
ctagatgtggagcctgctgaaggtctcc

SEQ ID NO: 243072 - DNA, 29 bp, Artificial Sequence
  Description of Artificial Sequence: Synthetic oligonucleotide
tagatgtggagcctgctgaaggtctccag

SEQ ID NO: 243073 - DNA, 28 bp, Artificial Sequence
  Description of Artificial Sequence: Synthetic oligonucleotide
agatgtggagcctgctgaaggtctccag

SEQ ID NO: 243074 - DNA, 27 bp, Artificial Sequence
  Description of Artificial Sequence: Synthetic oligonucleotide
gatgtggagcctgctgaaggtctccag

SEQ ID NO: 243075 - DNA, 27 bp, Artificial Sequence
  Description of Artificial Sequence: Synthetic oligonucleotide
atgtggagcctgctgaaggtctccagg

SEQ ID NO: 243076 - DNA, 26 bp, Artificial Sequence
  Description of Artificial Sequence: Synthetic oligonucleotide
tgtggagcctgctgaaggtctccagg

SEQ ID NO: 243077 - DNA, 25 bp, Artificial Sequence
  Description of Artificial Sequence: Synthetic oligonucleotide
gtggagcctgctgaaggtctccagg

SEQ ID NO: 243078 - DNA, 25 bp, Artificial Sequence
  Description of Artificial Sequence: Synthetic oligonucleotide
tggagcctgctgaaggtctccaggc

SEQ ID NO: 243079 - DNA, 24 bp, Artificial Sequence
  Description of Artificial Sequence: Synthetic oligonucleotide
ggagcctgctgaaggtctccaggc

SEQ ID NO: 243080 - DNA, 24 bp, Artificial Sequence
  Description of Artificial Sequence: Synthetic oligonucleotide
gagcctgctgaaggtctccaggcg

SEQ ID NO: 243081 - DNA, 24 bp, Artificial Sequence
  Description of Artificial Sequence: Synthetic oligonucleotide
agcctgctgaaggtctccaggcgg

SEQ ID NO: 243082 - DNA, 23 bp, Artificial Sequence
  Description of Artificial Sequence: Synthetic oligonucleotide
gcctgctgaaggtctccaggcgg

SEQ ID NO: 243083 - DNA, 24 bp, Artificial Sequence
  Description of Artificial Sequence: Synthetic oligonucleotide
cctgctgaaggtctccaggcggga

SEQ ID NO: 243084 - DNA, 24 bp, Artificial Sequence
  Description of Artificial Sequence: Synthetic oligonucleotide
ctgctgaaggtctccaggcgggac

SEQ ID NO: 243085 - DNA, 25 bp, Artificial Sequence
  Description of Artificial Sequence: Synthetic oligonucleotide
tgctgaaggtctccaggcgggacct

SEQ ID NO: 243086 - DNA, 24 bp, Artificial Sequence
  Description of Artificial Sequence: Synthetic oligonucleotide
gctgaaggtctccaggcgggacct

SEQ ID NO: 243087 - DNA, 24 bp, Artificial Sequence
  Description of Artificial Sequence: Synthetic oligonucleotide
ctgaaggtctccaggcgggacctg

SEQ ID NO: 243088 - DNA, 24 bp, Artificial Sequence
  Description of Artificial Sequence: Synthetic oligonucleotide
tgaaggtctccaggcgggacctgc

SEQ ID NO: 243089 - DNA, 23 bp, Artificial Sequence
  Description of Artificial Sequence: Synthetic oligonucleotide
gaaggtctccaggcgggacctgc

SEQ ID NO: 243090 - DNA, 24 bp, Artificial Sequence
  Description of Artificial Sequence: Synthetic oligonucleotide
aaggtctccaggcgggacctgcca

SEQ ID NO: 243091 - DNA, 23 bp, Artificial Sequence
  Description of Artificial Sequence: Synthetic oligonucleotide
aggtctccaggcgggacctgcca

SEQ ID NO: 243092 - DNA, 22 bp, Artificial Sequence
  Description of Artificial Sequence: Synthetic oligonucleotide
ggtctccaggcgggacctgcca

SEQ ID NO: 243093 - DNA, 23 bp, Artificial Sequence
  Description of Artificial Sequence: Synthetic oligonucleotide
gtctccaggcgggacctgccact

SEQ ID NO: 243094 - DNA, 23 bp, Artificial Sequence
  Description of Artificial Sequence: Synthetic oligonucleotide
tctccaggcgggacctgccactc

SEQ ID NO: 243095 - DNA, 22 bp, Artificial Sequence
  Description of Artificial Sequence: Synthetic oligonucleotide
ctccaggcgggacctgccactc

SEQ ID NO: 243096 - DNA, 23 bp, Artificial Sequence
  Description of Artificial Sequence: Synthetic oligonucleotide
tccaggcgggacctgccactcct

SEQ ID NO: 243097 - DNA, 22 bp, Artificial Sequence
  Description of Artificial Sequence: Synthetic oligonucleotide
ccaggcgggacctgccactcct

SEQ ID NO: 243098 - DNA, 22 bp, Artificial Sequence
  Description of Artificial Sequence: Synthetic oligonucleotide
caggcgggacctgccactcctc

SEQ ID NO: 243099 - DNA, 24 bp, Artificial Sequence
  Description of Artificial Sequence: Synthetic oligonucleotide
aggcgggacctgccactcctcgtt

SEQ ID NO: 243100 - DNA, 23 bp, Artificial Sequence
  Description of Artificial Sequence: Synthetic oligonucleotide
ggcgggacctgccactcctcgtt

SEQ ID NO: 243101 - DNA, 23 bp, Artificial Sequence
  Description of Artificial Sequence: Synthetic oligonucleotide
gcgggacctgccactcctcgttc

SEQ ID NO: 243102 - DNA, 23 bp, Artificial Sequence
  Description of Artificial Sequence: Synthetic oligonucleotide
cgggacctgccactcctcgttcc

SEQ ID NO: 243103 - DNA, 23 bp, Artificial Sequence
  Description of Artificial Sequence: Synthetic oligonucleotide
gggacctgccactcctcgttccc

SEQ ID NO: 243104 - DNA, 23 bp, Artificial Sequence
  Description of Artificial Sequence: Synthetic oligonucleotide
ggacctgccactcctcgttcccg

SEQ ID NO: 243105 - DNA, 23 bp, Artificial Sequence
  Description of Artificial Sequence: Synthetic oligonucleotide
gacctgccactcctcgttcccgc

SEQ ID NO: 243106 - DNA, 25 bp, Artificial Sequence
  Description of Artificial Sequence: Synthetic oligonucleotide
acctgccactcctcgttcccgcctt

SEQ ID NO: 243107 - DNA, 24 bp, Artificial Sequence
  Description of Artificial Sequence: Synthetic oligonucleotide
cctgccactcctcgttcccgcctt

SEQ ID NO: 243108 - DNA, 26 bp, Artificial Sequence
  Description of Artificial Sequence: Synthetic oligonucleotide
ctgccactcctcgttcccgccttcta

SEQ ID NO: 243109 - DNA, 27 bp, Artificial Sequence
  Description of Artificial Sequence: Synthetic oligonucleotide
tgccactcctcgttcccgccttctact

SEQ ID NO: 243110 - DNA, 27 bp, Artificial Sequence
  Description of Artificial Sequence: Synthetic oligonucleotide
gccactcctcgttcccgccttctactt

SEQ ID NO: 243111 - DNA, 27 bp, Artificial Sequence
  Description of Artificial Sequence: Synthetic oligonucleotide
ccactcctcgttcccgccttctacttc

SEQ ID NO: 243112 - DNA, 27 bp, Artificial Sequence
  Description of Artificial Sequence: Synthetic oligonucleotide
cactcctcgttcccgccttctacttcc

SEQ ID NO: 243113 - DNA, 29 bp, Artificial Sequence
  Description of Artificial Sequence: Synthetic oligonucleotide
actcctcgttcccgccttctacttccttg

SEQ ID NO: 243114 - DNA, 28 bp, Artificial Sequence
  Description of Artificial Sequence: Synthetic oligonucleotide
ctcctcgttcccgccttctacttccttg

SEQ ID NO: 243115 - DNA, 29 bp, Artificial Sequence
  Description of Artificial Sequence: Synthetic oligonucleotide
tcctcgttcccgccttctacttccttgtg

SEQ ID NO: 243116 - DNA, 28 bp, Artificial Sequence
  Description of Artificial Sequence: Synthetic oligonucleotide
cctcgttcccgccttctacttccttgtg

SEQ ID NO: 243117 - DNA, 28 bp, Artificial Sequence
  Description of Artificial Sequence: Synthetic oligonucleotide
ctcgttcccgccttctacttccttgtgc

SEQ ID NO: 243118 - DNA, 30 bp, Artificial Sequence
  Description of Artificial Sequence: Synthetic oligonucleotide
tcgttcccgccttctacttccttgtgcttg

SEQ ID NO: 243119 - DNA, 29 bp, Artificial Sequence
  Description of Artificial Sequence: Synthetic oligonucleotide
cgttcccgccttctacttccttgtgcttg

SEQ ID NO: 243120 - DNA, 29 bp, Artificial Sequence
  Description of Artificial Sequence: Synthetic oligonucleotide
gttcccgccttctacttccttgtgcttgc

SEQ ID NO: 243121 - DNA, 30 bp, Artificial Sequence
  Description of Artificial Sequence: Synthetic oligonucleotide
ttcccgccttctacttccttgtgcttgctg

SEQ ID NO: 243122 - DNA, 29 bp, Artificial Sequence
  Description of Artificial Sequence: Synthetic oligonucleotide
tcccgccttctacttccttgtgcttgctg

SEQ ID NO: 243123 - DNA, 28 bp, Artificial Sequence
  Description of Artificial Sequence: Synthetic oligonucleotide
cccgccttctacttccttgtgcttgctg

SEQ ID NO: 243124 - DNA, 32 bp, Artificial Sequence
  Description of Artificial Sequence: Synthetic oligonucleotide
ccgccttctacttccttgtgcttgctgttatg

SEQ ID NO: 243125 - DNA, 32 bp, Artificial Sequence
  Description of Artificial Sequence: Synthetic oligonucleotide
cgccttctacttccttgtgcttgctgttatgg

SEQ ID NO: 243126 - DNA, 32 bp, Artificial Sequence
  Description of Artificial Sequence: Synthetic oligonucleotide
gccttctacttccttgtgcttgctgttatggg

SEQ ID NO: 243127 - DNA, 33 bp, Artificial Sequence
  Description of Artificial Sequence: Synthetic oligonucleotide
ccttctacttccttgtgcttgctgttatgggtg

SEQ ID NO: 243128 - DNA, 34 bp, Artificial Sequence
  Description of Artificial Sequence: Synthetic oligonucleotide
cttctacttccttgtgcttgctgttatgggtgag

SEQ ID NO: 243129 - DNA, 35 bp, Artificial Sequence
  Description of Artificial Sequence: Synthetic oligonucleotide
ttctacttccttgtgcttgctgttatgggtgagag

SEQ ID NO: 243130 - DNA, 34 bp, Artificial Sequence
  Description of Artificial Sequence: Synthetic oligonucleotide
tctacttccttgtgcttgctgttatgggtgagag

SEQ ID NO: 243131 - DNA, 33 bp, Artificial Sequence
  Description of Artificial Sequence: Synthetic oligonucleotide
ctacttccttgtgcttgctgttatgggtgagag

SEQ ID NO: 243132 - DNA, 39 bp, Artificial Sequence
  Description of Artificial Sequence: Synthetic oligonucleotide
tacttccttgtgcttgctgttatgggtgagagattaatc

SEQ ID NO: 243133 - DNA, 38 bp, Artificial Sequence
  Description of Artificial Sequence: Synthetic oligonucleotide
acttccttgtgcttgctgttatgggtgagagattaatc

SEQ ID NO: 243134 - DNA, 37 bp, Artificial Sequence
  Description of Artificial Sequence: Synthetic oligonucleotide
cttccttgtgcttgctgttatgggtgagagattaatc

SEQ ID NO: 243135 - DNA, 37 bp, Artificial Sequence
  Description of Artificial Sequence: Synthetic oligonucleotide
ttccttgtgcttgctgttatgggtgagagattaatcc

SEQ ID NO: 243136 - DNA, 36 bp, Artificial Sequence
  Description of Artificial Sequence: Synthetic oligonucleotide
tccttgtgcttgctgttatgggtgagagattaatcc

SEQ ID NO: 243137 - DNA, 35 bp, Artificial Sequence
  Description of Artificial Sequence: Synthetic oligonucleotide
ccttgtgcttgctgttatgggtgagagattaatcc

SEQ ID NO: 243138 - DNA, 35 bp, Artificial Sequence
  Description of Artificial Sequence: Synthetic oligonucleotide
cttgtgcttgctgttatgggtgagagattaatccc

SEQ ID NO: 243139 - DNA, 36 bp, Artificial Sequence
  Description of Artificial Sequence: Synthetic oligonucleotide
ttgtgcttgctgttatgggtgagagattaatcccac

SEQ ID NO: 243140 - DNA, 35 bp, Artificial Sequence
  Description of Artificial Sequence: Synthetic oligonucleotide
tgtgcttgctgttatgggtgagagattaatcccac

SEQ ID NO: 243141 - DNA, 34 bp, Artificial Sequence
  Description of Artificial Sequence: Synthetic oligonucleotide
gtgcttgctgttatgggtgagagattaatcccac

SEQ ID NO: 243142 - DNA, 35 bp, Artificial Sequence
  Description of Artificial Sequence: Synthetic oligonucleotide
tgcttgctgttatgggtgagagattaatcccacac

SEQ ID NO: 243143 - DNA, 34 bp, Artificial Sequence
  Description of Artificial Sequence: Synthetic oligonucleotide
gcttgctgttatgggtgagagattaatcccacac

SEQ ID NO: 243144 - DNA, 38 bp, Artificial Sequence
  Description of Artificial Sequence: Synthetic oligonucleotide
cttgctgttatgggtgagagattaatcccacactattc

SEQ ID NO: 243145 - DNA, 39 bp, Artificial Sequence
  Description of Artificial Sequence: Synthetic oligonucleotide
ttgctgttatgggtgagagattaatcccacactattctc

SEQ ID NO: 243146 - DNA, 38 bp, Artificial Sequence
  Description of Artificial Sequence: Synthetic oligonucleotide
tgctgttatgggtgagagattaatcccacactattctc

SEQ ID NO: 243147 - DNA, 37 bp, Artificial Sequence
  Description of Artificial Sequence: Synthetic oligonucleotide
gctgttatgggtgagagattaatcccacactattctc

SEQ ID NO: 243148 - DNA, 37 bp, Artificial Sequence
  Description of Artificial Sequence: Synthetic oligonucleotide
ctgttatgggtgagagattaatcccacactattctcg

SEQ ID NO: 243149 - DNA, 38 bp, Artificial Sequence
  Description of Artificial Sequence: Synthetic oligonucleotide
tgttatgggtgagagattaatcccacactattctcgtc

SEQ ID NO: 243150 - DNA, 37 bp, Artificial Sequence
  Description of Artificial Sequence: Synthetic oligonucleotide
gttatgggtgagagattaatcccacactattctcgtc

SEQ ID NO: 243151 - DNA, 37 bp, Artificial Sequence
  Description of Artificial Sequence: Synthetic oligonucleotide
ttatgggtgagagattaatcccacactattctcgtcg

SEQ ID NO: 243152 - DNA, 36 bp, Artificial Sequence
  Description of Artificial Sequence: Synthetic oligonucleotide
tatgggtgagagattaatcccacactattctcgtcg

SEQ ID NO: 243153 - DNA, 35 bp, Artificial Sequence
  Description of Artificial Sequence: Synthetic oligonucleotide
atgggtgagagattaatcccacactattctcgtcg

SEQ ID NO: 243154 - DNA, 34 bp, Artificial Sequence
  Description of Artificial Sequence: Synthetic oligonucleotide
tgggtgagagattaatcccacactattctcgtcg

SEQ ID NO: 243155 - DNA, 33 bp, Artificial Sequence
  Description of Artificial Sequence: Synthetic oligonucleotide
gggtgagagattaatcccacactattctcgtcg

SEQ ID NO: 243156 - DNA, 34 bp, Artificial Sequence
  Description of Artificial Sequence: Synthetic oligonucleotide
ggtgagagattaatcccacactattctcgtcgtg

SEQ ID NO: 243157 - DNA, 35 bp, Artificial Sequence
  Description of Artificial Sequence: Synthetic oligonucleotide
gtgagagattaatcccacactattctcgtcgtgtg

SEQ ID NO: 243158 - DNA, 38 bp, Artificial Sequence
  Description of Artificial Sequence: Synthetic oligonucleotide
tgagagattaatcccacactattctcgtcgtgtgaatg

SEQ ID NO: 243159 - DNA, 37 bp, Artificial Sequence
  Description of Artificial Sequence: Synthetic oligonucleotide
gagagattaatcccacactattctcgtcgtgtgaatg

SEQ ID NO: 243160 - DNA, 38 bp, Artificial Sequence
  Description of Artificial Sequence: Synthetic oligonucleotide
agagattaatcccacactattctcgtcgtgtgaatgac

SEQ ID NO: 243161 - DNA, 37 bp, Artificial Sequence
  Description of Artificial Sequence: Synthetic oligonucleotide
gagattaatcccacactattctcgtcgtgtgaatgac

SEQ ID NO: 243162 - DNA, 39 bp, Artificial Sequence
  Description of Artificial Sequence: Synthetic oligonucleotide
agattaatcccacactattctcgtcgtgtgaatgacatc

SEQ ID NO: 243163 - DNA, 38 bp, Artificial Sequence
  Description of Artificial Sequence: Synthetic oligonucleotide
gattaatcccacactattctcgtcgtgtgaatgacatc

SEQ ID NO: 243164 - DNA, 38 bp, Artificial Sequence
  Description of Artificial Sequence: Synthetic oligonucleotide
attaatcccacactattctcgtcgtgtgaatgacatcc

SEQ ID NO: 243165 - DNA, 37 bp, Artificial Sequence
  Description of Artificial Sequence: Synthetic oligonucleotide
ttaatcccacactattctcgtcgtgtgaatgacatcc

SEQ ID NO: 243166 - DNA, 36 bp, Artificial Sequence
  Description of Artificial Sequence: Synthetic oligonucleotide
taatcccacactattctcgtcgtgtgaatgacatcc

SEQ ID NO: 243167 - DNA, 35 bp, Artificial Sequence
  Description of Artificial Sequence: Synthetic oligonucleotide
aatcccacactattctcgtcgtgtgaatgacatcc

SEQ ID NO: 243168 - DNA, 34 bp, Artificial Sequence
  Description of Artificial Sequence: Synthetic oligonucleotide
atcccacactattctcgtcgtgtgaatgacatcc

SEQ ID NO: 243169 - DNA, 33 bp, Artificial Sequence
  Description of Artificial Sequence: Synthetic oligonucleotide
tcccacactattctcgtcgtgtgaatgacatcc

SEQ ID NO: 243170 - DNA, 32 bp, Artificial Sequence
  Description of Artificial Sequence: Synthetic oligonucleotide
cccacactattctcgtcgtgtgaatgacatcc

SEQ ID NO: 243171 - DNA, 33 bp, Artificial Sequence
  Description of Artificial Sequence: Synthetic oligonucleotide
ccacactattctcgtcgtgtgaatgacatcctc

SEQ ID NO: 243172 - DNA, 33 bp, Artificial Sequence
  Description of Artificial Sequence: Synthetic oligonucleotide
cacactattctcgtcgtgtgaatgacatcctcg

SEQ ID NO: 243173 - DNA, 33 bp, Artificial Sequence
  Description of Artificial Sequence: Synthetic oligonucleotide
acactattctcgtcgtgtgaatgacatcctcgg

SEQ ID NO: 243174 - DNA, 32 bp, Artificial Sequence
  Description of Artificial Sequence: Synthetic oligonucleotide
cactattctcgtcgtgtgaatgacatcctcgg

SEQ ID NO: 243175 - DNA, 33 bp, Artificial Sequence
  Description of Artificial Sequence: Synthetic oligonucleotide
actattctcgtcgtgtgaatgacatcctcggag

SEQ ID NO: 243176 - DNA, 32 bp, Artificial Sequence
  Description of Artificial Sequence: Synthetic oligonucleotide
ctattctcgtcgtgtgaatgacatcctcggag

SEQ ID NO: 243177 - DNA, 32 bp, Artificial Sequence
  Description of Artificial Sequence: Synthetic oligonucleotide
tattctcgtcgtgtgaatgacatcctcggagg

SEQ ID NO: 243178 - DNA, 31 bp, Artificial Sequence
  Description of Artificial Sequence: Synthetic oligonucleotide
attctcgtcgtgtgaatgacatcctcggagg

SEQ ID NO: 243179 - DNA, 30 bp, Artificial Sequence
  Description of Artificial Sequence: Synthetic oligonucleotide
ttctcgtcgtgtgaatgacatcctcggagg

SEQ ID NO: 243180 - DNA, 29 bp, Artificial Sequence
  Description of Artificial Sequence: Synthetic oligonucleotide
tctcgtcgtgtgaatgacatcctcggagg

SEQ ID NO: 243181 - DNA, 28 bp, Artificial Sequence
  Description of Artificial Sequence: Synthetic oligonucleotide
ctcgtcgtgtgaatgacatcctcggagg

SEQ ID NO: 243182 - DNA, 29 bp, Artificial Sequence
  Description of Artificial Sequence: Synthetic oligonucleotide
tcgtcgtgtgaatgacatcctcggaggtg

SEQ ID NO: 243183 - DNA, 28 bp, Artificial Sequence
  Description of Artificial Sequence: Synthetic oligonucleotide
cgtcgtgtgaatgacatcctcggaggtg

SEQ ID NO: 243184 - DNA, 33 bp, Artificial Sequence
  Description of Artificial Sequence: Synthetic oligonucleotide
gtcgtgtgaatgacatcctcggaggtgatattg

SEQ ID NO: 243185 - DNA, 34 bp, Artificial Sequence
  Description of Artificial Sequence: Synthetic oligonucleotide
tcgtgtgaatgacatcctcggaggtgatattgac

SEQ ID NO: 243186 - DNA, 33 bp, Artificial Sequence
  Description of Artificial Sequence: Synthetic oligonucleotide
cgtgtgaatgacatcctcggaggtgatattgac

SEQ ID NO: 243187 - DNA, 33 bp, Artificial Sequence
  Description of Artificial Sequence: Synthetic oligonucleotide
gtgtgaatgacatcctcggaggtgatattgacc

SEQ ID NO: 243188 - DNA, 33 bp, Artificial Sequence
  Description of Artificial Sequence: Synthetic oligonucleotide
tgtgaatgacatcctcggaggtgatattgaccc

SEQ ID NO: 243189 - DNA, 32 bp, Artificial Sequence
  Description of Artificial Sequence: Synthetic oligonucleotide
gtgaatgacatcctcggaggtgatattgaccc

SEQ ID NO: 243190 - DNA, 32 bp, Artificial Sequence
  Description of Artificial Sequence: Synthetic oligonucleotide
tgaatgacatcctcggaggtgatattgacccc

SEQ ID NO: 243191 - DNA, 31 bp, Artificial Sequence
  Description of Artificial Sequence: Synthetic oligonucleotide
gaatgacatcctcggaggtgatattgacccc

SEQ ID NO: 243192 - DNA, 31 bp, Artificial Sequence
  Description of Artificial Sequence: Synthetic oligonucleotide
aatgacatcctcggaggtgatattgaccccc

SEQ ID NO: 243193 - DNA, 30 bp, Artificial Sequence
  Description of Artificial Sequence: Synthetic oligonucleotide
atgacatcctcggaggtgatattgaccccc

SEQ ID NO: 243194 - DNA, 29 bp, Artificial Sequence
  Description of Artificial Sequence: Synthetic oligonucleotide
tgacatcctcggaggtgatattgaccccc

SEQ ID NO: 243195 - DNA, 28 bp, Artificial Sequence
  Description of Artificial Sequence: Synthetic oligonucleotide
gacatcctcggaggtgatattgaccccc

SEQ ID NO: 243196 - DNA, 30 bp, Artificial Sequence
  Description of Artificial Sequence: Synthetic oligonucleotide
acatcctcggaggtgatattgacccccttg

SEQ ID NO: 243197 - DNA, 29 bp, Artificial Sequence
  Description of Artificial Sequence: Synthetic oligonucleotide
catcctcggaggtgatattgacccccttg

SEQ ID NO: 243198 - DNA, 29 bp, Artificial Sequence
  Description of Artificial Sequence: Synthetic oligonucleotide
atcctcggaggtgatattgacccccttgc

SEQ ID NO: 243199 - DNA, 28 bp, Artificial Sequence
  Description of Artificial Sequence: Synthetic oligonucleotide
tcctcggaggtgatattgacccccttgc

SEQ ID NO: 243200 - DNA, 27 bp, Artificial Sequence
  Description of Artificial Sequence: Synthetic oligonucleotide
cctcggaggtgatattgacccccttgc

SEQ ID NO: 243201 - DNA, 27 bp, Artificial Sequence
  Description of Artificial Sequence: Synthetic oligonucleotide
ctcggaggtgatattgacccccttgcc

SEQ ID NO: 243202 - DNA, 30 bp, Artificial Sequence
  Description of Artificial Sequence: Synthetic oligonucleotide
tcggaggtgatattgacccccttgcctttg

SEQ ID NO: 243203 - DNA, 29 bp, Artificial Sequence
  Description of Artificial Sequence: Synthetic oligonucleotide
cggaggtgatattgacccccttgcctttg

SEQ ID NO: 243204 - DNA, 29 bp, Artificial Sequence
  Description of Artificial Sequence: Synthetic oligonucleotide
ggaggtgatattgacccccttgcctttgc

SEQ ID NO: 243205 - DNA, 29 bp, Artificial Sequence
  Description of Artificial Sequence: Synthetic oligonucleotide
gaggtgatattgacccccttgcctttgcg

SEQ ID NO: 243206 - DNA, 30 bp, Artificial Sequence
  Description of Artificial Sequence: Synthetic oligonucleotide
aggtgatattgacccccttgcctttgcgag

SEQ ID NO: 243207 - DNA, 29 bp, Artificial Sequence
  Description of Artificial Sequence: Synthetic oligonucleotide
ggtgatattgacccccttgcctttgcgag

SEQ ID NO: 243208 - DNA, 30 bp, Artificial Sequence
  Description of Artificial Sequence: Synthetic oligonucleotide
gtgatattgacccccttgcctttgcgagtg

SEQ ID NO: 243209 - DNA, 30 bp, Artificial Sequence
  Description of Artificial Sequence: Synthetic oligonucleotide
tgatattgacccccttgcctttgcgagtgc

SEQ ID NO: 243210 - DNA, 29 bp, Artificial Sequence
  Description of Artificial Sequence: Synthetic oligonucleotide
gatattgacccccttgcctttgcgagtgc

SEQ ID NO: 243211 - DNA, 29 bp, Artificial Sequence
  Description of Artificial Sequence: Synthetic oligonucleotide
atattgacccccttgcctttgcgagtgcc

SEQ ID NO: 243212 - DNA, 28 bp, Artificial Sequence
  Description of Artificial Sequence: Synthetic oligonucleotide
tattgacccccttgcctttgcgagtgcc

SEQ ID NO: 243213 - DNA, 27 bp, Artificial Sequence
  Description of Artificial Sequence: Synthetic oligonucleotide
attgacccccttgcctttgcgagtgcc

SEQ ID NO: 243214 - DNA, 27 bp, Artificial Sequence
  Description of Artificial Sequence: Synthetic oligonucleotide
ttgacccccttgcctttgcgagtgcca

SEQ ID NO: 243215 - DNA, 27 bp, Artificial Sequence
  Description of Artificial Sequence: Synthetic oligonucleotide
tgacccccttgcctttgcgagtgccat

SEQ ID NO: 243216 - DNA, 26 bp, Artificial Sequence
  Description of Artificial Sequence: Synthetic oligonucleotide
gacccccttgcctttgcgagtgccat

SEQ ID NO: 243217 - DNA, 27 bp, Artificial Sequence
  Description of Artificial Sequence: Synthetic oligonucleotide
acccccttgcctttgcgagtgccatca

SEQ ID NO: 243218 - DNA, 27 bp, Artificial Sequence
  Description of Artificial Sequence: Synthetic oligonucleotide
cccccttgcctttgcgagtgccatcat

SEQ ID NO: 243219 - DNA, 27 bp, Artificial Sequence
  Description of Artificial Sequence: Synthetic oligonucleotide
ccccttgcctttgcgagtgccatcatc

SEQ ID NO: 243220 - DNA, 29 bp, Artificial Sequence
  Description of Artificial Sequence: Synthetic oligonucleotide
cccttgcctttgcgagtgccatcatcttc

SEQ ID NO: 243221 - DNA, 31 bp, Artificial Sequence
  Description of Artificial Sequence: Synthetic oligonucleotide
ccttgcctttgcgagtgccatcatcttcatg

SEQ ID NO: 243222 - DNA, 32 bp, Artificial Sequence
  Description of Artificial Sequence: Synthetic oligonucleotide
cttgcctttgcgagtgccatcatcttcatgtc

SEQ ID NO: 243223 - DNA, 32 bp, Artificial Sequence
  Description of Artificial Sequence: Synthetic oligonucleotide
ttgcctttgcgagtgccatcatcttcatgtcc

SEQ ID NO: 243224 - DNA, 31 bp, Artificial Sequence
  Description of Artificial Sequence: Synthetic oligonucleotide
tgcctttgcgagtgccatcatcttcatgtcc

SEQ ID NO: 243225 - DNA, 30 bp, Artificial Sequence
  Description of Artificial Sequence: Synthetic oligonucleotide
gcctttgcgagtgccatcatcttcatgtcc

SEQ ID NO: 243226 - DNA, 30 bp, Artificial Sequence
  Description of Artificial Sequence: Synthetic oligonucleotide
cctttgcgagtgccatcatcttcatgtccc

SEQ ID NO: 243227 - DNA, 31 bp, Artificial Sequence
  Description of Artificial Sequence: Synthetic oligonucleotide
ctttgcgagtgccatcatcttcatgtccctc

SEQ ID NO: 243228 - DNA, 33 bp, Artificial Sequence
  Description of Artificial Sequence: Synthetic oligonucleotide
tttgcgagtgccatcatcttcatgtccctcttc

SEQ ID NO: 243229 - DNA, 32 bp, Artificial Sequence
  Description of Artificial Sequence: Synthetic oligonucleotide
ttgcgagtgccatcatcttcatgtccctcttc

SEQ ID NO: 243230 - DNA, 31 bp, Artificial Sequence
  Description of Artificial Sequence: Synthetic oligonucleotide
tgcgagtgccatcatcttcatgtccctcttc

SEQ ID NO: 243231 - DNA, 30 bp, Artificial Sequence
  Description of Artificial Sequence: Synthetic oligonucleotide
gcgagtgccatcatcttcatgtccctcttc

SEQ ID NO: 243232 - DNA, 31 bp, Artificial Sequence
  Description of Artificial Sequence: Synthetic oligonucleotide
cgagtgccatcatcttcatgtccctcttctc

SEQ ID NO: 243233 - DNA, 31 bp, Artificial Sequence
  Description of Artificial Sequence: Synthetic oligonucleotide
gagtgccatcatcttcatgtccctcttctcg

SEQ ID NO: 243234 - DNA, 34 bp, Artificial Sequence
  Description of Artificial Sequence: Synthetic oligonucleotide
agtgccatcatcttcatgtccctcttctcgtttg

SEQ ID NO: 243235 - DNA, 33 bp, Artificial Sequence
  Description of Artificial Sequence: Synthetic oligonucleotide
gtgccatcatcttcatgtccctcttctcgtttg

SEQ ID NO: 243236 - DNA, 33 bp, Artificial Sequence
  Description of Artificial Sequence: Synthetic oligonucleotide
tgccatcatcttcatgtccctcttctcgtttgg

SEQ ID NO: 243237 - DNA, 32 bp, Artificial Sequence
  Description of Artificial Sequence: Synthetic oligonucleotide
gccatcatcttcatgtccctcttctcgtttgg

SEQ ID NO: 243238 - DNA, 32 bp, Artificial Sequence
  Description of Artificial Sequence: Synthetic oligonucleotide
ccatcatcttcatgtccctcttctcgtttggc

SEQ ID NO: 243239 - DNA, 33 bp, Artificial Sequence
  Description of Artificial Sequence: Synthetic oligonucleotide
catcatcttcatgtccctcttctcgtttggcag

SEQ ID NO: 243240 - DNA, 33 bp, Artificial Sequence
  Description of Artificial Sequence: Synthetic oligonucleotide
atcatcttcatgtccctcttctcgtttggcagc

SEQ ID NO: 243241 - DNA, 32 bp, Artificial Sequence
  Description of Artificial Sequence: Synthetic oligonucleotide
tcatcttcatgtccctcttctcgtttggcagc

SEQ ID NO: 243242 - DNA, 31 bp, Artificial Sequence
  Description of Artificial Sequence: Synthetic oligonucleotide
catcttcatgtccctcttctcgtttggcagc

SEQ ID NO: 243243 - DNA, 32 bp, Artificial Sequence
  Description of Artificial Sequence: Synthetic oligonucleotide
atcttcatgtccctcttctcgtttggcagcac

SEQ ID NO: 243244 - DNA, 31 bp, Artificial Sequence
  Description of Artificial Sequence: Synthetic oligonucleotide
tcttcatgtccctcttctcgtttggcagcac

SEQ ID NO: 243245 - DNA, 30 bp, Artificial Sequence
  Description of Artificial Sequence: Synthetic oligonucleotide
cttcatgtccctcttctcgtttggcagcac

SEQ ID NO: 243246 - DNA, 31 bp, Artificial Sequence
  Description of Artificial Sequence: Synthetic oligonucleotide
ttcatgtccctcttctcgtttggcagcacac

SEQ ID NO: 243247 - DNA, 30 bp, Artificial Sequence
  Description of Artificial Sequence: Synthetic oligonucleotide
tcatgtccctcttctcgtttggcagcacac

SEQ ID NO: 243248 - DNA, 29 bp, Artificial Sequence
  Description of Artificial Sequence: Synthetic oligonucleotide
catgtccctcttctcgtttggcagcacac

SEQ ID NO: 243249 - DNA, 30 bp, Artificial Sequence
  Description of Artificial Sequence: Synthetic oligonucleotide
atgtccctcttctcgtttggcagcacactg

SEQ ID NO: 243250 - DNA, 29 bp, Artificial Sequence
  Description of Artificial Sequence: Synthetic oligonucleotide
tgtccctcttctcgtttggcagcacactg

SEQ ID NO: 243251 - DNA, 28 bp, Artificial Sequence
  Description of Artificial Sequence: Synthetic oligonucleotide
gtccctcttctcgtttggcagcacactg

SEQ ID NO: 243252 - DNA, 29 bp, Artificial Sequence
  Description of Artificial Sequence: Synthetic oligonucleotide
tccctcttctcgtttggcagcacactgtc

SEQ ID NO: 243253 - DNA, 28 bp, Artificial Sequence
  Description of Artificial Sequence: Synthetic oligonucleotide
ccctcttctcgtttggcagcacactgtc

SEQ ID NO: 243254 - DNA, 29 bp, Artificial Sequence
  Description of Artificial Sequence: Synthetic oligonucleotide
cctcttctcgtttggcagcacactgtctg

SEQ ID NO: 243255 - DNA, 29 bp, Artificial Sequence
  Description of Artificial Sequence: Synthetic oligonucleotide
ctcttctcgtttggcagcacactgtctgg

SEQ ID NO: 243256 - DNA, 30 bp, Artificial Sequence
  Description of Artificial Sequence: Synthetic oligonucleotide
tcttctcgtttggcagcacactgtctggag

SEQ ID NO: 243257 - DNA, 29 bp, Artificial Sequence
  Description of Artificial Sequence: Synthetic oligonucleotide
cttctcgtttggcagcacactgtctggag

SEQ ID NO: 243258 - DNA, 29 bp, Artificial Sequence
  Description of Artificial Sequence: Synthetic oligonucleotide
ttctcgtttggcagcacactgtctggagg

SEQ ID NO: 243259 - DNA, 28 bp, Artificial Sequence
  Description of Artificial Sequence: Synthetic oligonucleotide
tctcgtttggcagcacactgtctggagg

SEQ ID NO: 243260 - DNA, 27 bp, Artificial Sequence
  Description of Artificial Sequence: Synthetic oligonucleotide
ctcgtttggcagcacactgtctggagg

SEQ ID NO: 243261 - DNA, 27 bp, Artificial Sequence
  Description of Artificial Sequence: Synthetic oligonucleotide
tcgtttggcagcacactgtctggaggc

SEQ ID NO: 243262 - DNA, 27 bp, Artificial Sequence
  Description of Artificial Sequence: Synthetic oligonucleotide
cgtttggcagcacactgtctggaggct

SEQ ID NO: 243263 - DNA, 27 bp, Artificial Sequence
  Description of Artificial Sequence: Synthetic oligonucleotide
gtttggcagcacactgtctggaggctg

SEQ ID NO: 243264 - DNA, 27 bp, Artificial Sequence
  Description of Artificial Sequence: Synthetic oligonucleotide
tttggcagcacactgtctggaggctgc

SEQ ID NO: 243265 - DNA, 26 bp, Artificial Sequence
  Description of Artificial Sequence: Synthetic oligonucleotide
ttggcagcacactgtctggaggctgc

SEQ ID NO: 243266 - DNA, 25 bp, Artificial Sequence
  Description of Artificial Sequence: Synthetic oligonucleotide
tggcagcacactgtctggaggctgc

SEQ ID NO: 243267 - DNA, 24 bp, Artificial Sequence
  Description of Artificial Sequence: Synthetic oligonucleotide
ggcagcacactgtctggaggctgc

SEQ ID NO: 243268 - DNA, 24 bp, Artificial Sequence
  Description of Artificial Sequence: Synthetic oligonucleotide
gcagcacactgtctggaggctgcc

SEQ ID NO: 243269 - DNA, 25 bp, Artificial Sequence
  Description of Artificial Sequence: Synthetic oligonucleotide
cagcacactgtctggaggctgccgt

SEQ ID NO: 243270 - DNA, 25 bp, Artificial Sequence
  Description of Artificial Sequence: Synthetic oligonucleotide
agcacactgtctggaggctgccgtg

SEQ ID NO: 243271 - DNA, 24 bp, Artificial Sequence
  Description of Artificial Sequence: Synthetic oligonucleotide
gcacactgtctggaggctgccgtg

SEQ ID NO: 243272 - DNA, 25 bp, Artificial Sequence
  Description of Artificial Sequence: Synthetic oligonucleotide
cacactgtctggaggctgccgtgga

SEQ ID NO: 243273 - DNA, 25 bp, Artificial Sequence
  Description of Artificial Sequence: Synthetic oligonucleotide
acactgtctggaggctgccgtggag

SEQ ID NO: 243274 - DNA, 24 bp, Artificial Sequence
  Description of Artificial Sequence: Synthetic oligonucleotide
cactgtctggaggctgccgtggag

SEQ ID NO: 243275 - DNA, 24 bp, Artificial Sequence
  Description of Artificial Sequence: Synthetic oligonucleotide
actgtctggaggctgccgtggagg

SEQ ID NO: 243276 - DNA, 23 bp, Artificial Sequence
  Description of Artificial Sequence: Synthetic oligonucleotide
ctgtctggaggctgccgtggagg

SEQ ID NO: 243277 - DNA, 24 bp, Artificial Sequence
  Description of Artificial Sequence: Synthetic oligonucleotide
tgtctggaggctgccgtggaggct

SEQ ID NO: 243278 - DNA, 23 bp, Artificial Sequence
  Description of Artificial Sequence: Synthetic oligonucleotide
gtctggaggctgccgtggaggct

SEQ ID NO: 243279 - DNA, 23 bp, Artificial Sequence
  Description of Artificial Sequence: Synthetic oligonucleotide
tctggaggctgccgtggaggctg

SEQ ID NO: 243280 - DNA, 22 bp, Artificial Sequence
  Description of Artificial Sequence: Synthetic oligonucleotide
ctggaggctgccgtggaggctg

SEQ ID NO: 243281 - DNA, 24 bp, Artificial Sequence
  Description of Artificial Sequence: Synthetic oligonucleotide
tggaggctgccgtggaggctgcat

SEQ ID NO: 243282 - DNA, 23 bp, Artificial Sequence
  Description of Artificial Sequence: Synthetic oligonucleotide
ggaggctgccgtggaggctgcat

SEQ ID NO: 243283 - DNA, 24 bp, Artificial Sequence
  Description of Artificial Sequence: Synthetic oligonucleotide
gaggctgccgtggaggctgcatca

SEQ ID NO: 243284 - DNA, 24 bp, Artificial Sequence
  Description of Artificial Sequence: Synthetic oligonucleotide
aggctgccgtggaggctgcatcac

SEQ ID NO: 243285 - DNA, 23 bp, Artificial Sequence
  Description of Artificial Sequence: Synthetic oligonucleotide
ggctgccgtggaggctgcatcac

SEQ ID NO: 243286 - DNA, 25 bp, Artificial Sequence
  Description of Artificial Sequence: Synthetic oligonucleotide
gctgccgtggaggctgcatcaccta

SEQ ID NO: 243287 - DNA, 26 bp, Artificial Sequence
  Description of Artificial Sequence: Synthetic oligonucleotide
ctgccgtggaggctgcatcacctaca

SEQ ID NO: 243288 - DNA, 26 bp, Artificial Sequence
  Description of Artificial Sequence: Synthetic oligonucleotide
tgccgtggaggctgcatcacctacag

SEQ ID NO: 243289 - DNA, 25 bp, Artificial Sequence
  Description of Artificial Sequence: Synthetic oligonucleotide
gccgtggaggctgcatcacctacag

SEQ ID NO: 243290 - DNA, 27 bp, Artificial Sequence
  Description of Artificial Sequence: Synthetic oligonucleotide
ccgtggaggctgcatcacctacagcat

SEQ ID NO: 243291 - DNA, 27 bp, Artificial Sequence
  Description of Artificial Sequence: Synthetic oligonucleotide
cgtggaggctgcatcacctacagcatg

SEQ ID NO: 243292 - DNA, 28 bp, Artificial Sequence
  Description of Artificial Sequence: Synthetic oligonucleotide
gtggaggctgcatcacctacagcatgtc

SEQ ID NO: 243293 - DNA, 29 bp, Artificial Sequence
  Description of Artificial Sequence: Synthetic oligonucleotide
tggaggctgcatcacctacagcatgtctc

SEQ ID NO: 243294 - DNA, 28 bp, Artificial Sequence
  Description of Artificial Sequence: Synthetic oligonucleotide
ggaggctgcatcacctacagcatgtctc

SEQ ID NO: 243295 - DNA, 28 bp, Artificial Sequence
  Description of Artificial Sequence: Synthetic oligonucleotide
gaggctgcatcacctacagcatgtctcg

SEQ ID NO: 243296 - DNA, 31 bp, Artificial Sequence
  Description of Artificial Sequence: Synthetic oligonucleotide
aggctgcatcacctacagcatgtctcgtatc

SEQ ID NO: 243297 - DNA, 30 bp, Artificial Sequence
  Description of Artificial Sequence: Synthetic oligonucleotide
ggctgcatcacctacagcatgtctcgtatc

SEQ ID NO: 243298 - DNA, 32 bp, Artificial Sequence
  Description of Artificial Sequence: Synthetic oligonucleotide
gctgcatcacctacagcatgtctcgtatcaac

SEQ ID NO: 243299 - DNA, 34 bp, Artificial Sequence
  Description of Artificial Sequence: Synthetic oligonucleotide
ctgcatcacctacagcatgtctcgtatcaacttg

SEQ ID NO: 243300 - DNA, 34 bp, Artificial Sequence
  Description of Artificial Sequence: Synthetic oligonucleotide
tgcatcacctacagcatgtctcgtatcaacttgg

SEQ ID NO: 243301 - DNA, 33 bp, Artificial Sequence
  Description of Artificial Sequence: Synthetic oligonucleotide
gcatcacctacagcatgtctcgtatcaacttgg

SEQ ID NO: 243302 - DNA, 33 bp, Artificial Sequence
  Description of Artificial Sequence: Synthetic oligonucleotide
catcacctacagcatgtctcgtatcaacttggg

SEQ ID NO: 243303 - DNA, 33 bp, Artificial Sequence
  Description of Artificial Sequence: Synthetic oligonucleotide
atcacctacagcatgtctcgtatcaacttgggg

SEQ ID NO: 243304 - DNA, 32 bp, Artificial Sequence
  Description of Artificial Sequence: Synthetic oligonucleotide
tcacctacagcatgtctcgtatcaacttgggg

SEQ ID NO: 243305 - DNA, 31 bp, Artificial Sequence
  Description of Artificial Sequence: Synthetic oligonucleotide
cacctacagcatgtctcgtatcaacttgggg

SEQ ID NO: 243306 - DNA, 33 bp, Artificial Sequence
  Description of Artificial Sequence: Synthetic oligonucleotide
acctacagcatgtctcgtatcaacttggggatc

SEQ ID NO: 243307 - DNA, 32 bp, Artificial Sequence
  Description of Artificial Sequence: Synthetic oligonucleotide
cctacagcatgtctcgtatcaacttggggatc

SEQ ID NO: 243308 - DNA, 32 bp, Artificial Sequence
  Description of Artificial Sequence: Synthetic oligonucleotide
ctacagcatgtctcgtatcaacttggggatcc

SEQ ID NO: 243309 - DNA, 32 bp, Artificial Sequence
  Description of Artificial Sequence: Synthetic oligonucleotide
tacagcatgtctcgtatcaacttggggatccg

SEQ ID NO: 243310 - DNA, 31 bp, Artificial Sequence
  Description of Artificial Sequence: Synthetic oligonucleotide
acagcatgtctcgtatcaacttggggatccg

SEQ ID NO: 243311 - DNA, 30 bp, Artificial Sequence
  Description of Artificial Sequence: Synthetic oligonucleotide
cagcatgtctcgtatcaacttggggatccg

SEQ ID NO: 243312 - DNA, 30 bp, Artificial Sequence
  Description of Artificial Sequence: Synthetic oligonucleotide
agcatgtctcgtatcaacttggggatccgg

SEQ ID NO: 243313 - DNA, 29 bp, Artificial Sequence
  Description of Artificial Sequence: Synthetic oligonucleotide
gcatgtctcgtatcaacttggggatccgg

SEQ ID NO: 243314 - DNA, 29 bp, Artificial Sequence
  Description of Artificial Sequence: Synthetic oligonucleotide
catgtctcgtatcaacttggggatccggg

SEQ ID NO: 243315 - DNA, 30 bp, Artificial Sequence
  Description of Artificial Sequence: Synthetic oligonucleotide
atgtctcgtatcaacttggggatccgggtg

SEQ ID NO: 243316 - DNA, 29 bp, Artificial Sequence
  Description of Artificial Sequence: Synthetic oligonucleotide
tgtctcgtatcaacttggggatccgggtg

SEQ ID NO: 243317 - DNA, 28 bp, Artificial Sequence
  Description of Artificial Sequence: Synthetic oligonucleotide
gtctcgtatcaacttggggatccgggtg

SEQ ID NO: 243318 - DNA, 28 bp, Artificial Sequence
  Description of Artificial Sequence: Synthetic oligonucleotide
tctcgtatcaacttggggatccgggtgc

SEQ ID NO: 243319 - DNA, 27 bp, Artificial Sequence
  Description of Artificial Sequence: Synthetic oligonucleotide
ctcgtatcaacttggggatccgggtgc

SEQ ID NO: 243320 - DNA, 28 bp, Artificial Sequence
  Description of Artificial Sequence: Synthetic oligonucleotide
tcgtatcaacttggggatccgggtgcag

SEQ ID NO: 243321 - DNA, 27 bp, Artificial Sequence
  Description of Artificial Sequence: Synthetic oligonucleotide
cgtatcaacttggggatccgggtgcag

SEQ ID NO: 243322 - DNA, 27 bp, Artificial Sequence
  Description of Artificial Sequence: Synthetic oligonucleotide
gtatcaacttggggatccgggtgcagc

SEQ ID NO: 243323 - DNA, 31 bp, Artificial Sequence
  Description of Artificial Sequence: Synthetic oligonucleotide
tatcaacttggggatccgggtgcagcttttg

SEQ ID NO: 243324 - DNA, 30 bp, Artificial Sequence
  Description of Artificial Sequence: Synthetic oligonucleotide
atcaacttggggatccgggtgcagcttttg

SEQ ID NO: 243325 - DNA, 29 bp, Artificial Sequence
  Description of Artificial Sequence: Synthetic oligonucleotide
tcaacttggggatccgggtgcagcttttg

SEQ ID NO: 243326 - DNA, 28 bp, Artificial Sequence
  Description of Artificial Sequence: Synthetic oligonucleotide
caacttggggatccgggtgcagcttttg

SEQ ID NO: 243327 - DNA, 29 bp, Artificial Sequence
  Description of Artificial Sequence: Synthetic oligonucleotide
aacttggggatccgggtgcagcttttgtc

SEQ ID NO: 243328 - DNA, 28 bp, Artificial Sequence
  Description of Artificial Sequence: Synthetic oligonucleotide
acttggggatccgggtgcagcttttgtc

SEQ ID NO: 243329 - DNA, 27 bp, Artificial Sequence
  Description of Artificial Sequence: Synthetic oligonucleotide
cttggggatccgggtgcagcttttgtc

SEQ ID NO: 243330 - DNA, 27 bp, Artificial Sequence
  Description of Artificial Sequence: Synthetic oligonucleotide
ttggggatccgggtgcagcttttgtcc

SEQ ID NO: 243331 - DNA, 27 bp, Artificial Sequence
  Description of Artificial Sequence: Synthetic oligonucleotide
tggggatccgggtgcagcttttgtcct

SEQ ID NO: 243332 - DNA, 26 bp, Artificial Sequence
  Description of Artificial Sequence: Synthetic oligonucleotide
ggggatccgggtgcagcttttgtcct

SEQ ID NO: 243333 - DNA, 26 bp, Artificial Sequence
  Description of Artificial Sequence: Synthetic oligonucleotide
gggatccgggtgcagcttttgtcctc

SEQ ID NO: 243334 - DNA, 26 bp, Artificial Sequence
  Description of Artificial Sequence: Synthetic oligonucleotide
ggatccgggtgcagcttttgtcctcc

SEQ ID NO: 243335 - DNA, 27 bp, Artificial Sequence
  Description of Artificial Sequence: Synthetic oligonucleotide
gatccgggtgcagcttttgtcctccct

SEQ ID NO: 243336 - DNA, 27 bp, Artificial Sequence
  Description of Artificial Sequence: Synthetic oligonucleotide
atccgggtgcagcttttgtcctccctg

SEQ ID NO: 243337 - DNA, 26 bp, Artificial Sequence
  Description of Artificial Sequence: Synthetic oligonucleotide
tccgggtgcagcttttgtcctccctg

SEQ ID NO: 243338 - DNA, 25 bp, Artificial Sequence
  Description of Artificial Sequence: Synthetic oligonucleotide
ccgggtgcagcttttgtcctccctg

SEQ ID NO: 243339 - DNA, 26 bp, Artificial Sequence
  Description of Artificial Sequence: Synthetic oligonucleotide
cgggtgcagcttttgtcctccctggt

SEQ ID NO: 243340 - DNA, 26 bp, Artificial Sequence
  Description of Artificial Sequence: Synthetic oligonucleotide
gggtgcagcttttgtcctccctggtg

SEQ ID NO: 243341 - DNA, 26 bp, Artificial Sequence
  Description of Artificial Sequence: Synthetic oligonucleotide
ggtgcagcttttgtcctccctggtgc

SEQ ID NO: 243342 - DNA, 26 bp, Artificial Sequence
  Description of Artificial Sequence: Synthetic oligonucleotide
gtgcagcttttgtcctccctggtgcg

SEQ ID NO: 243343 - DNA, 26 bp, Artificial Sequence
  Description of Artificial Sequence: Synthetic oligonucleotide
tgcagcttttgtcctccctggtgcgc

SEQ ID NO: 243344 - DNA, 25 bp, Artificial Sequence
  Description of Artificial Sequence: Synthetic oligonucleotide
gcagcttttgtcctccctggtgcgc

SEQ ID NO: 243345 - DNA, 26 bp, Artificial Sequence
  Description of Artificial Sequence: Synthetic oligonucleotide
cagcttttgtcctccctggtgcgcca

SEQ ID NO: 243346 - DNA, 26 bp, Artificial Sequence
  Description of Artificial Sequence: Synthetic oligonucleotide
agcttttgtcctccctggtgcgccag

SEQ ID NO: 243347 - DNA, 25 bp, Artificial Sequence
  Description of Artificial Sequence: Synthetic oligonucleotide
gcttttgtcctccctggtgcgccag

SEQ ID NO: 243348 - DNA, 26 bp, Artificial Sequence
  Description of Artificial Sequence: Synthetic oligonucleotide
cttttgtcctccctggtgcgccaggt

SEQ ID NO: 243349 - DNA, 26 bp, Artificial Sequence
  Description of Artificial Sequence: Synthetic oligonucleotide
ttttgtcctccctggtgcgccaggtc

SEQ ID NO: 243350 - DNA, 25 bp, Artificial Sequence
  Description of Artificial Sequence: Synthetic oligonucleotide
tttgtcctccctggtgcgccaggtc

SEQ ID NO: 243351 - DNA, 24 bp, Artificial Sequence
  Description of Artificial Sequence: Synthetic oligonucleotide
ttgtcctccctggtgcgccaggtc

SEQ ID NO: 243352 - DNA, 23 bp, Artificial Sequence
  Description of Artificial Sequence: Synthetic oligonucleotide
tgtcctccctggtgcgccaggtc

SEQ ID NO: 243353 - DNA, 22 bp, Artificial Sequence
  Description of Artificial Sequence: Synthetic oligonucleotide
gtcctccctggtgcgccaggtc

SEQ ID NO: 243354 - DNA, 23 bp, Artificial Sequence
  Description of Artificial Sequence: Synthetic oligonucleotide
tcctccctggtgcgccaggtcct

SEQ ID NO: 243355 - DNA, 22 bp, Artificial Sequence
  Description of Artificial Sequence: Synthetic oligonucleotide
cctccctggtgcgccaggtcct

SEQ ID NO: 243356 - DNA, 22 bp, Artificial Sequence
  Description of Artificial Sequence: Synthetic oligonucleotide
ctccctggtgcgccaggtcctc

SEQ ID NO: 243357 - DNA, 22 bp, Artificial Sequence
  Description of Artificial Sequence: Synthetic oligonucleotide
tccctggtgcgccaggtcctcg

SEQ ID NO: 243358 - DNA, 21 bp, Artificial Sequence
  Description of Artificial Sequence: Synthetic oligonucleotide
ccctggtgcgccaggtcctcg

SEQ ID NO: 243359 - DNA, 24 bp, Artificial Sequence
  Description of Artificial Sequence: Synthetic oligonucleotide
cctggtgcgccaggtcctcggttt

SEQ ID NO: 243360 - DNA, 26 bp, Artificial Sequence
  Description of Artificial Sequence: Synthetic oligonucleotide
ctggtgcgccaggtcctcggtttgtt

SEQ ID NO: 243361 - DNA, 26 bp, Artificial Sequence
  Description of Artificial Sequence: Synthetic oligonucleotide
tggtgcgccaggtcctcggtttgttc

SEQ ID NO: 243362 - DNA, 25 bp, Artificial Sequence
  Description of Artificial Sequence: Synthetic oligonucleotide
ggtgcgccaggtcctcggtttgttc

SEQ ID NO: 243363 - DNA, 26 bp, Artificial Sequence
  Description of Artificial Sequence: Synthetic oligonucleotide
gtgcgccaggtcctcggtttgttcca

SEQ ID NO: 243364 - DNA, 26 bp, Artificial Sequence
  Description of Artificial Sequence: Synthetic oligonucleotide
tgcgccaggtcctcggtttgttccag

SEQ ID NO: 243365 - DNA, 25 bp, Artificial Sequence
  Description of Artificial Sequence: Synthetic oligonucleotide
gcgccaggtcctcggtttgttccag

SEQ ID NO: 243366 - DNA, 26 bp, Artificial Sequence
  Description of Artificial Sequence: Synthetic oligonucleotide
cgccaggtcctcggtttgttccagga

SEQ ID NO: 243367 - DNA, 27 bp, Artificial Sequence
  Description of Artificial Sequence: Synthetic oligonucleotide
gccaggtcctcggtttgttccaggagt

SEQ ID NO: 243368 - DNA, 27 bp, Artificial Sequence
  Description of Artificial Sequence: Synthetic oligonucleotide
ccaggtcctcggtttgttccaggagtc

SEQ ID NO: 243369 - DNA, 30 bp, Artificial Sequence
  Description of Artificial Sequence: Synthetic oligonucleotide
caggtcctcggtttgttccaggagtctaag

SEQ ID NO: 243370 - DNA, 31 bp, Artificial Sequence
  Description of Artificial Sequence: Synthetic oligonucleotide
aggtcctcggtttgttccaggagtctaagac

SEQ ID NO: 243371 - DNA, 30 bp, Artificial Sequence
  Description of Artificial Sequence: Synthetic oligonucleotide
ggtcctcggtttgttccaggagtctaagac

SEQ ID NO: 243372 - DNA, 31 bp, Artificial Sequence
  Description of Artificial Sequence: Synthetic oligonucleotide
gtcctcggtttgttccaggagtctaagacag

SEQ ID NO: 243373 - DNA, 31 bp, Artificial Sequence
  Description of Artificial Sequence: Synthetic oligonucleotide
tcctcggtttgttccaggagtctaagacagc

SEQ ID NO: 243374 - DNA, 30 bp, Artificial Sequence
  Description of Artificial Sequence: Synthetic oligonucleotide
cctcggtttgttccaggagtctaagacagc

SEQ ID NO: 243375 - DNA, 30 bp, Artificial Sequence
  Description of Artificial Sequence: Synthetic oligonucleotide
ctcggtttgttccaggagtctaagacagcg

SEQ ID NO: 243376 - DNA, 30 bp, Artificial Sequence
  Description of Artificial Sequence: Synthetic oligonucleotide
tcggtttgttccaggagtctaagacagcgg

SEQ ID NO: 243377 - DNA, 29 bp, Artificial Sequence
  Description of Artificial Sequence: Synthetic oligonucleotide
cggtttgttccaggagtctaagacagcgg

SEQ ID NO: 243378 - DNA, 30 bp, Artificial Sequence
  Description of Artificial Sequence: Synthetic oligonucleotide
ggtttgttccaggagtctaagacagcggag

SEQ ID NO: 243379 - DNA, 30 bp, Artificial Sequence
  Description of Artificial Sequence: Synthetic oligonucleotide
gtttgttccaggagtctaagacagcggagc

SEQ ID NO: 243380 - DNA, 31 bp, Artificial Sequence
  Description of Artificial Sequence: Synthetic oligonucleotide
tttgttccaggagtctaagacagcggagctg

SEQ ID NO: 243381 - DNA, 30 bp, Artificial Sequence
  Description of Artificial Sequence: Synthetic oligonucleotide
ttgttccaggagtctaagacagcggagctg

SEQ ID NO: 243382 - DNA, 29 bp, Artificial Sequence
  Description of Artificial Sequence: Synthetic oligonucleotide
tgttccaggagtctaagacagcggagctg

SEQ ID NO: 243383 - DNA, 28 bp, Artificial Sequence
  Description of Artificial Sequence: Synthetic oligonucleotide
gttccaggagtctaagacagcggagctg

SEQ ID NO: 243384 - DNA, 30 bp, Artificial Sequence
  Description of Artificial Sequence: Synthetic oligonucleotide
ttccaggagtctaagacagcggagctgaag

SEQ ID NO: 243385 - DNA, 29 bp, Artificial Sequence
  Description of Artificial Sequence: Synthetic oligonucleotide
tccaggagtctaagacagcggagctgaag

SEQ ID NO: 243386 - DNA, 28 bp, Artificial Sequence
  Description of Artificial Sequence: Synthetic oligonucleotide
ccaggagtctaagacagcggagctgaag

SEQ ID NO: 243387 - DNA, 29 bp, Artificial Sequence
  Description of Artificial Sequence: Synthetic oligonucleotide
caggagtctaagacagcggagctgaagtc

SEQ ID NO: 243388 - DNA, 30 bp, Artificial Sequence
  Description of Artificial Sequence: Synthetic oligonucleotide
aggagtctaagacagcggagctgaagtcac

SEQ ID NO: 243389 - DNA, 29 bp, Artificial Sequence
  Description of Artificial Sequence: Synthetic oligonucleotide
ggagtctaagacagcggagctgaagtcac

SEQ ID NO: 243390 - DNA, 29 bp, Artificial Sequence
  Description of Artificial Sequence: Synthetic oligonucleotide
gagtctaagacagcggagctgaagtcacg

SEQ ID NO: 243391 - DNA, 29 bp, Artificial Sequence
  Description of Artificial Sequence: Synthetic oligonucleotide
agtctaagacagcggagctgaagtcacgg

SEQ ID NO: 243392 - DNA, 28 bp, Artificial Sequence
  Description of Artificial Sequence: Synthetic oligonucleotide
gtctaagacagcggagctgaagtcacgg

SEQ ID NO: 243393 - DNA, 28 bp, Artificial Sequence
  Description of Artificial Sequence: Synthetic oligonucleotide
tctaagacagcggagctgaagtcacggc

SEQ ID NO: 243394 - DNA, 27 bp, Artificial Sequence
  Description of Artificial Sequence: Synthetic oligonucleotide
ctaagacagcggagctgaagtcacggc

SEQ ID NO: 243395 - DNA, 28 bp, Artificial Sequence
  Description of Artificial Sequence: Synthetic oligonucleotide
taagacagcggagctgaagtcacggctg

SEQ ID NO: 243396 - DNA, 27 bp, Artificial Sequence
  Description of Artificial Sequence: Synthetic oligonucleotide
aagacagcggagctgaagtcacggctg

SEQ ID NO: 243397 - DNA, 27 bp, Artificial Sequence
  Description of Artificial Sequence: Synthetic oligonucleotide
agacagcggagctgaagtcacggctgt

SEQ ID NO: 243398 - DNA, 26 bp, Artificial Sequence
  Description of Artificial Sequence: Synthetic oligonucleotide
gacagcggagctgaagtcacggctgt

SEQ ID NO: 243399 - DNA, 26 bp, Artificial Sequence
  Description of Artificial Sequence: Synthetic oligonucleotide
acagcggagctgaagtcacggctgtg

SEQ ID NO: 243400 - DNA, 25 bp, Artificial Sequence
  Description of Artificial Sequence: Synthetic oligonucleotide
cagcggagctgaagtcacggctgtg

SEQ ID NO: 243401 - DNA, 26 bp, Artificial Sequence
  Description of Artificial Sequence: Synthetic oligonucleotide
agcggagctgaagtcacggctgtgct

SEQ ID NO: 243402 - DNA, 25 bp, Artificial Sequence
  Description of Artificial Sequence: Synthetic oligonucleotide
gcggagctgaagtcacggctgtgct

SEQ ID NO: 243403 - DNA, 25 bp, Artificial Sequence
  Description of Artificial Sequence: Synthetic oligonucleotide
cggagctgaagtcacggctgtgctc

SEQ ID NO: 243404 - DNA, 25 bp, Artificial Sequence
  Description of Artificial Sequence: Synthetic oligonucleotide
ggagctgaagtcacggctgtgctcg

SEQ ID NO: 243405 - DNA, 27 bp, Artificial Sequence
  Description of Artificial Sequence: Synthetic oligonucleotide
gagctgaagtcacggctgtgctcggat

SEQ ID NO: 243406 - DNA, 28 bp, Artificial Sequence
  Description of Artificial Sequence: Synthetic oligonucleotide
agctgaagtcacggctgtgctcggatag

SEQ ID NO: 243407 - DNA, 27 bp, Artificial Sequence
  Description of Artificial Sequence: Synthetic oligonucleotide
gctgaagtcacggctgtgctcggatag

SEQ ID NO: 243408 - DNA, 27 bp, Artificial Sequence
  Description of Artificial Sequence: Synthetic oligonucleotide
ctgaagtcacggctgtgctcggatagc

SEQ ID NO: 243409 - DNA, 28 bp, Artificial Sequence
  Description of Artificial Sequence: Synthetic oligonucleotide
tgaagtcacggctgtgctcggatagcac

SEQ ID NO: 243410 - DNA, 27 bp, Artificial Sequence
  Description of Artificial Sequence: Synthetic oligonucleotide
gaagtcacggctgtgctcggatagcac

SEQ ID NO: 243411 - DNA, 27 bp, Artificial Sequence
  Description of Artificial Sequence: Synthetic oligonucleotide
aagtcacggctgtgctcggatagcacc

SEQ ID NO: 243412 - DNA, 26 bp, Artificial Sequence
  Description of Artificial Sequence: Synthetic oligonucleotide
agtcacggctgtgctcggatagcacc

SEQ ID NO: 243413 - DNA, 25 bp, Artificial Sequence
  Description of Artificial Sequence: Synthetic oligonucleotide
gtcacggctgtgctcggatagcacc

SEQ ID NO: 243414 - DNA, 26 bp, Artificial Sequence
  Description of Artificial Sequence: Synthetic oligonucleotide
tcacggctgtgctcggatagcaccct

SEQ ID NO: 243415 - DNA, 25 bp, Artificial Sequence
  Description of Artificial Sequence: Synthetic oligonucleotide
cacggctgtgctcggatagcaccct

SEQ ID NO: 243416 - DNA, 27 bp, Artificial Sequence
  Description of Artificial Sequence: Synthetic oligonucleotide
acggctgtgctcggatagcaccctgat

SEQ ID NO: 243417 - DNA, 26 bp, Artificial Sequence
  Description of Artificial Sequence: Synthetic oligonucleotide
cggctgtgctcggatagcaccctgat

SEQ ID NO: 243418 - DNA, 27 bp, Artificial Sequence
  Description of Artificial Sequence: Synthetic oligonucleotide
ggctgtgctcggatagcaccctgatca

SEQ ID NO: 243419 - DNA, 27 bp, Artificial Sequence
  Description of Artificial Sequence: Synthetic oligonucleotide
gctgtgctcggatagcaccctgatcag

SEQ ID NO: 243420 - DNA, 30 bp, Artificial Sequence
  Description of Artificial Sequence: Synthetic oligonucleotide
ctgtgctcggatagcaccctgatcagtaac

SEQ ID NO: 243421 - DNA, 31 bp, Artificial Sequence
  Description of Artificial Sequence: Synthetic oligonucleotide
tgtgctcggatagcaccctgatcagtaactg

SEQ ID NO: 243422 - DNA, 30 bp, Artificial Sequence
  Description of Artificial Sequence: Synthetic oligonucleotide
gtgctcggatagcaccctgatcagtaactg

SEQ ID NO: 243423 - DNA, 30 bp, Artificial Sequence
  Description of Artificial Sequence: Synthetic oligonucleotide
tgctcggatagcaccctgatcagtaactgg

SEQ ID NO: 243424 - DNA, 29 bp, Artificial Sequence
  Description of Artificial Sequence: Synthetic oligonucleotide
gctcggatagcaccctgatcagtaactgg

SEQ ID NO: 243425 - DNA, 29 bp, Artificial Sequence
  Description of Artificial Sequence: Synthetic oligonucleotide
ctcggatagcaccctgatcagtaactggg

SEQ ID NO: 243426 - DNA, 31 bp, Artificial Sequence
  Description of Artificial Sequence: Synthetic oligonucleotide
tcggatagcaccctgatcagtaactgggttc

SEQ ID NO: 243427 - DNA, 30 bp, Artificial Sequence
  Description of Artificial Sequence: Synthetic oligonucleotide
cggatagcaccctgatcagtaactgggttc

SEQ ID NO: 243428 - DNA, 30 bp, Artificial Sequence
  Description of Artificial Sequence: Synthetic oligonucleotide
ggatagcaccctgatcagtaactgggttcc

SEQ ID NO: 243429 - DNA, 37 bp, Artificial Sequence
  Description of Artificial Sequence: Synthetic oligonucleotide
gatagcaccctgatcagtaactgggttcctttaattg

SEQ ID NO: 243430 - DNA, 37 bp, Artificial Sequence
  Description of Artificial Sequence: Synthetic oligonucleotide
atagcaccctgatcagtaactgggttcctttaattgc

SEQ ID NO: 243431 - DNA, 36 bp, Artificial Sequence
  Description of Artificial Sequence: Synthetic oligonucleotide
tagcaccctgatcagtaactgggttcctttaattgc

SEQ ID NO: 243432 - DNA, 35 bp, Artificial Sequence
  Description of Artificial Sequence: Synthetic oligonucleotide
agcaccctgatcagtaactgggttcctttaattgc

SEQ ID NO: 243433 - DNA, 34 bp, Artificial Sequence
  Description of Artificial Sequence: Synthetic oligonucleotide
gcaccctgatcagtaactgggttcctttaattgc

SEQ ID NO: 243434 - DNA, 34 bp, Artificial Sequence
  Description of Artificial Sequence: Synthetic oligonucleotide
caccctgatcagtaactgggttcctttaattgcc

SEQ ID NO: 243435 - DNA, 37 bp, Artificial Sequence
  Description of Artificial Sequence: Synthetic oligonucleotide
accctgatcagtaactgggttcctttaattgccaatg

SEQ ID NO: 243436 - DNA, 36 bp, Artificial Sequence
  Description of Artificial Sequence: Synthetic oligonucleotide
ccctgatcagtaactgggttcctttaattgccaatg

SEQ ID NO: 243437 - DNA, 37 bp, Artificial Sequence
  Description of Artificial Sequence: Synthetic oligonucleotide
cctgatcagtaactgggttcctttaattgccaatgtc

SEQ ID NO: 243438 - DNA, 37 bp, Artificial Sequence
  Description of Artificial Sequence: Synthetic oligonucleotide
ctgatcagtaactgggttcctttaattgccaatgtcc

SEQ ID NO: 243439 - DNA, 38 bp, Artificial Sequence
  Description of Artificial Sequence: Synthetic oligonucleotide
tgatcagtaactgggttcctttaattgccaatgtcctc

SEQ ID NO: 243440 - DNA, 37 bp, Artificial Sequence
  Description of Artificial Sequence: Synthetic oligonucleotide
gatcagtaactgggttcctttaattgccaatgtcctc

SEQ ID NO: 243441 - DNA, 39 bp, Artificial Sequence
  Description of Artificial Sequence: Synthetic oligonucleotide
atcagtaactgggttcctttaattgccaatgtcctcttg

SEQ ID NO: 243442 - DNA, 38 bp, Artificial Sequence
  Description of Artificial Sequence: Synthetic oligonucleotide
tcagtaactgggttcctttaattgccaatgtcctcttg

SEQ ID NO: 243443 - DNA, 37 bp, Artificial Sequence
  Description of Artificial Sequence: Synthetic oligonucleotide
cagtaactgggttcctttaattgccaatgtcctcttg

SEQ ID NO: 243444 - DNA, 37 bp, Artificial Sequence
  Description of Artificial Sequence: Synthetic oligonucleotide
agtaactgggttcctttaattgccaatgtcctcttgc

SEQ ID NO: 243445 - DNA, 36 bp, Artificial Sequence
  Description of Artificial Sequence: Synthetic oligonucleotide
gtaactgggttcctttaattgccaatgtcctcttgc

SEQ ID NO: 243446 - DNA, 36 bp, Artificial Sequence
  Description of Artificial Sequence: Synthetic oligonucleotide
taactgggttcctttaattgccaatgtcctcttgcg

SEQ ID NO: 243447 - DNA, 35 bp, Artificial Sequence
  Description of Artificial Sequence: Synthetic oligonucleotide
aactgggttcctttaattgccaatgtcctcttgcg

SEQ ID NO: 243448 - DNA, 34 bp, Artificial Sequence
  Description of Artificial Sequence: Synthetic oligonucleotide
actgggttcctttaattgccaatgtcctcttgcg

SEQ ID NO: 243449 - DNA, 33 bp, Artificial Sequence
  Description of Artificial Sequence: Synthetic oligonucleotide
ctgggttcctttaattgccaatgtcctcttgcg

SEQ ID NO: 243450 - DNA, 35 bp, Artificial Sequence
  Description of Artificial Sequence: Synthetic oligonucleotide
tgggttcctttaattgccaatgtcctcttgcgatg

SEQ ID NO: 243451 - DNA, 34 bp, Artificial Sequence
  Description of Artificial Sequence: Synthetic oligonucleotide
gggttcctttaattgccaatgtcctcttgcgatg

SEQ ID NO: 243452 - DNA, 34 bp, Artificial Sequence
  Description of Artificial Sequence: Synthetic oligonucleotide
ggttcctttaattgccaatgtcctcttgcgatgc

SEQ ID NO: 243453 - DNA, 34 bp, Artificial Sequence
  Description of Artificial Sequence: Synthetic oligonucleotide
gttcctttaattgccaatgtcctcttgcgatgcc

SEQ ID NO: 243454 - DNA, 35 bp, Artificial Sequence
  Description of Artificial Sequence: Synthetic oligonucleotide
ttcctttaattgccaatgtcctcttgcgatgcctg

SEQ ID NO: 243455 - DNA, 34 bp, Artificial Sequence
  Description of Artificial Sequence: Synthetic oligonucleotide
tcctttaattgccaatgtcctcttgcgatgcctg

SEQ ID NO: 243456 - DNA, 33 bp, Artificial Sequence
  Description of Artificial Sequence: Synthetic oligonucleotide
cctttaattgccaatgtcctcttgcgatgcctg

SEQ ID NO: 243457 - DNA, 33 bp, Artificial Sequence
  Description of Artificial Sequence: Synthetic oligonucleotide
ctttaattgccaatgtcctcttgcgatgcctgg

SEQ ID NO: 243458 - DNA, 34 bp, Artificial Sequence
  Description of Artificial Sequence: Synthetic oligonucleotide
tttaattgccaatgtcctcttgcgatgcctggtg

SEQ ID NO: 243459 - DNA, 33 bp, Artificial Sequence
  Description of Artificial Sequence: Synthetic oligonucleotide
ttaattgccaatgtcctcttgcgatgcctggtg

SEQ ID NO: 243460 - DNA, 32 bp, Artificial Sequence
  Description of Artificial Sequence: Synthetic oligonucleotide
taattgccaatgtcctcttgcgatgcctggtg

SEQ ID NO: 243461 - DNA, 31 bp, Artificial Sequence
  Description of Artificial Sequence: Synthetic oligonucleotide
aattgccaatgtcctcttgcgatgcctggtg

SEQ ID NO: 243462 - DNA, 30 bp, Artificial Sequence
  Description of Artificial Sequence: Synthetic oligonucleotide
attgccaatgtcctcttgcgatgcctggtg

SEQ ID NO: 243463 - DNA, 29 bp, Artificial Sequence
  Description of Artificial Sequence: Synthetic oligonucleotide
ttgccaatgtcctcttgcgatgcctggtg

SEQ ID NO: 243464 - DNA, 28 bp, Artificial Sequence
  Description of Artificial Sequence: Synthetic oligonucleotide
tgccaatgtcctcttgcgatgcctggtg

SEQ ID NO: 243465 - DNA, 27 bp, Artificial Sequence
  Description of Artificial Sequence: Synthetic oligonucleotide
gccaatgtcctcttgcgatgcctggtg

SEQ ID NO: 243466 - DNA, 30 bp, Artificial Sequence
  Description of Artificial Sequence: Synthetic oligonucleotide
ccaatgtcctcttgcgatgcctggtgatag

SEQ ID NO: 243467 - DNA, 31 bp, Artificial Sequence
  Description of Artificial Sequence: Synthetic oligonucleotide
caatgtcctcttgcgatgcctggtgatagtg

SEQ ID NO: 243468 - DNA, 31 bp, Artificial Sequence
  Description of Artificial Sequence: Synthetic oligonucleotide
aatgtcctcttgcgatgcctggtgatagtgg

SEQ ID NO: 243469 - DNA, 30 bp, Artificial Sequence
  Description of Artificial Sequence: Synthetic oligonucleotide
atgtcctcttgcgatgcctggtgatagtgg

SEQ ID NO: 243470 - DNA, 29 bp, Artificial Sequence
  Description of Artificial Sequence: Synthetic oligonucleotide
tgtcctcttgcgatgcctggtgatagtgg

SEQ ID NO: 243471 - DNA, 28 bp, Artificial Sequence
  Description of Artificial Sequence: Synthetic oligonucleotide
gtcctcttgcgatgcctggtgatagtgg

SEQ ID NO: 243472 - DNA, 29 bp, Artificial Sequence
  Description of Artificial Sequence: Synthetic oligonucleotide
tcctcttgcgatgcctggtgatagtggtg

SEQ ID NO: 243473 - DNA, 28 bp, Artificial Sequence
  Description of Artificial Sequence: Synthetic oligonucleotide
cctcttgcgatgcctggtgatagtggtg

SEQ ID NO: 243474 - DNA, 28 bp, Artificial Sequence
  Description of Artificial Sequence: Synthetic oligonucleotide
ctcttgcgatgcctggtgatagtggtgg

SEQ ID NO: 243475 - DNA, 28 bp, Artificial Sequence
  Description of Artificial Sequence: Synthetic oligonucleotide
tcttgcgatgcctggtgatagtggtggg

SEQ ID NO: 243476 - DNA, 27 bp, Artificial Sequence
  Description of Artificial Sequence: Synthetic oligonucleotide
cttgcgatgcctggtgatagtggtggg

SEQ ID NO: 243477 - DNA, 27 bp, Artificial Sequence
  Description of Artificial Sequence: Synthetic oligonucleotide
ttgcgatgcctggtgatagtggtgggc

SEQ ID NO: 243478 - DNA, 26 bp, Artificial Sequence
  Description of Artificial Sequence: Synthetic oligonucleotide
tgcgatgcctggtgatagtggtgggc

SEQ ID NO: 243479 - DNA, 25 bp, Artificial Sequence
  Description of Artificial Sequence: Synthetic oligonucleotide
gcgatgcctggtgatagtggtgggc

SEQ ID NO: 243480 - DNA, 26 bp, Artificial Sequence
  Description of Artificial Sequence: Synthetic oligonucleotide
cgatgcctggtgatagtggtgggcct

SEQ ID NO: 243481 - DNA, 27 bp, Artificial Sequence
  Description of Artificial Sequence: Synthetic oligonucleotide
gatgcctggtgatagtggtgggcctgt

SEQ ID NO: 243482 - DNA, 29 bp, Artificial Sequence
  Description of Artificial Sequence: Synthetic oligonucleotide
atgcctggtgatagtggtgggcctgtatg

SEQ ID NO: 243483 - DNA, 28 bp, Artificial Sequence
  Description of Artificial Sequence: Synthetic oligonucleotide
tgcctggtgatagtggtgggcctgtatg

SEQ ID NO: 243484 - DNA, 27 bp, Artificial Sequence
  Description of Artificial Sequence: Synthetic oligonucleotide
gcctggtgatagtggtgggcctgtatg

SEQ ID NO: 243485 - DNA, 27 bp, Artificial Sequence
  Description of Artificial Sequence: Synthetic oligonucleotide
cctggtgatagtggtgggcctgtatgg

SEQ ID NO: 243486 - DNA, 27 bp, Artificial Sequence
  Description of Artificial Sequence: Synthetic oligonucleotide
ctggtgatagtggtgggcctgtatggc

SEQ ID NO: 243487 - DNA, 29 bp, Artificial Sequence
  Description of Artificial Sequence: Synthetic oligonucleotide
tggtgatagtggtgggcctgtatggcatc

SEQ ID NO: 243488 - DNA, 28 bp, Artificial Sequence
  Description of Artificial Sequence: Synthetic oligonucleotide
ggtgatagtggtgggcctgtatggcatc

SEQ ID NO: 243489 - DNA, 30 bp, Artificial Sequence
  Description of Artificial Sequence: Synthetic oligonucleotide
gtgatagtggtgggcctgtatggcatcatg

SEQ ID NO: 243490 - DNA, 30 bp, Artificial Sequence
  Description of Artificial Sequence: Synthetic oligonucleotide
tgatagtggtgggcctgtatggcatcatgc

SEQ ID NO: 243491 - DNA, 29 bp, Artificial Sequence
  Description of Artificial Sequence: Synthetic oligonucleotide
gatagtggtgggcctgtatggcatcatgc

SEQ ID NO: 243492 - DNA, 30 bp, Artificial Sequence
  Description of Artificial Sequence: Synthetic oligonucleotide
atagtggtgggcctgtatggcatcatgctc

SEQ ID NO: 243493 - DNA, 29 bp, Artificial Sequence
  Description of Artificial Sequence: Synthetic oligonucleotide
tagtggtgggcctgtatggcatcatgctc

SEQ ID NO: 243494 - DNA, 28 bp, Artificial Sequence
  Description of Artificial Sequence: Synthetic oligonucleotide
agtggtgggcctgtatggcatcatgctc

SEQ ID NO: 243495 - DNA, 27 bp, Artificial Sequence
  Description of Artificial Sequence: Synthetic oligonucleotide
gtggtgggcctgtatggcatcatgctc

SEQ ID NO: 243496 - DNA, 28 bp, Artificial Sequence
  Description of Artificial Sequence: Synthetic oligonucleotide
tggtgggcctgtatggcatcatgctcac

SEQ ID NO: 243497 - DNA, 27 bp, Artificial Sequence
  Description of Artificial Sequence: Synthetic oligonucleotide
ggtgggcctgtatggcatcatgctcac

SEQ ID NO: 243498 - DNA, 27 bp, Artificial Sequence
  Description of Artificial Sequence: Synthetic oligonucleotide
gtgggcctgtatggcatcatgctcacc

SEQ ID NO: 243499 - DNA, 31 bp, Artificial Sequence
  Description of Artificial Sequence: Synthetic oligonucleotide
tgggcctgtatggcatcatgctcaccatatc

SEQ ID NO: 243500 - DNA, 30 bp, Artificial Sequence
  Description of Artificial Sequence: Synthetic oligonucleotide
gggcctgtatggcatcatgctcaccatatc

SEQ ID NO: 243501 - DNA, 30 bp, Artificial Sequence
  Description of Artificial Sequence: Synthetic oligonucleotide
ggcctgtatggcatcatgctcaccatatcg

SEQ ID NO: 243502 - DNA, 30 bp, Artificial Sequence
  Description of Artificial Sequence: Synthetic oligonucleotide
gcctgtatggcatcatgctcaccatatcgc

SEQ ID NO: 243503 - DNA, 30 bp, Artificial Sequence
  Description of Artificial Sequence: Synthetic oligonucleotide
cctgtatggcatcatgctcaccatatcgcc

SEQ ID NO: 243504 - DNA, 31 bp, Artificial Sequence
  Description of Artificial Sequence: Synthetic oligonucleotide
ctgtatggcatcatgctcaccatatcgccac

SEQ ID NO: 243505 - DNA, 31 bp, Artificial Sequence
  Description of Artificial Sequence: Synthetic oligonucleotide
tgtatggcatcatgctcaccatatcgccacg

SEQ ID NO: 243506 - DNA, 30 bp, Artificial Sequence
  Description of Artificial Sequence: Synthetic oligonucleotide
gtatggcatcatgctcaccatatcgccacg

SEQ ID NO: 243507 - DNA, 31 bp, Artificial Sequence
  Description of Artificial Sequence: Synthetic oligonucleotide
tatggcatcatgctcaccatatcgccacgac

SEQ ID NO: 243508 - DNA, 30 bp, Artificial Sequence
  Description of Artificial Sequence: Synthetic oligonucleotide
atggcatcatgctcaccatatcgccacgac

SEQ ID NO: 243509 - DNA, 29 bp, Artificial Sequence
  Description of Artificial Sequence: Synthetic oligonucleotide
tggcatcatgctcaccatatcgccacgac

SEQ ID NO: 243510 - DNA, 28 bp, Artificial Sequence
  Description of Artificial Sequence: Synthetic oligonucleotide
ggcatcatgctcaccatatcgccacgac

SEQ ID NO: 243511 - DNA, 29 bp, Artificial Sequence
  Description of Artificial Sequence: Synthetic oligonucleotide
gcatcatgctcaccatatcgccacgactc

SEQ ID NO: 243512 - DNA, 30 bp, Artificial Sequence
  Description of Artificial Sequence: Synthetic oligonucleotide
catcatgctcaccatatcgccacgactcac

SEQ ID NO: 243513 - DNA, 30 bp, Artificial Sequence
  Description of Artificial Sequence: Synthetic oligonucleotide
atcatgctcaccatatcgccacgactcacc

SEQ ID NO: 243514 - DNA, 29 bp, Artificial Sequence
  Description of Artificial Sequence: Synthetic oligonucleotide
tcatgctcaccatatcgccacgactcacc

SEQ ID NO: 243515 - DNA, 28 bp, Artificial Sequence
  Description of Artificial Sequence: Synthetic oligonucleotide
catgctcaccatatcgccacgactcacc

SEQ ID NO: 243516 - DNA, 28 bp, Artificial Sequence
  Description of Artificial Sequence: Synthetic oligonucleotide
atgctcaccatatcgccacgactcaccg

SEQ ID NO: 243517 - DNA, 27 bp, Artificial Sequence
  Description of Artificial Sequence: Synthetic oligonucleotide
tgctcaccatatcgccacgactcaccg

SEQ ID NO: 243518 - DNA, 27 bp, Artificial Sequence
  Description of Artificial Sequence: Synthetic oligonucleotide
gctcaccatatcgccacgactcaccgt

SEQ ID NO: 243519 - DNA, 27 bp, Artificial Sequence
  Description of Artificial Sequence: Synthetic oligonucleotide
ctcaccatatcgccacgactcaccgtc

SEQ ID NO: 243520 - DNA, 27 bp, Artificial Sequence
  Description of Artificial Sequence: Synthetic oligonucleotide
tcaccatatcgccacgactcaccgtcc

SEQ ID NO: 243521 - DNA, 27 bp, Artificial Sequence
  Description of Artificial Sequence: Synthetic oligonucleotide
caccatatcgccacgactcaccgtcct

SEQ ID NO: 243522 - DNA, 29 bp, Artificial Sequence
  Description of Artificial Sequence: Synthetic oligonucleotide
accatatcgccacgactcaccgtcctttc

SEQ ID NO: 243523 - DNA, 28 bp, Artificial Sequence
  Description of Artificial Sequence: Synthetic oligonucleotide
ccatatcgccacgactcaccgtcctttc

SEQ ID NO: 243524 - DNA, 29 bp, Artificial Sequence
  Description of Artificial Sequence: Synthetic oligonucleotide
catatcgccacgactcaccgtcctttctc

SEQ ID NO: 243525 - DNA, 30 bp, Artificial Sequence
  Description of Artificial Sequence: Synthetic oligonucleotide
atatcgccacgactcaccgtcctttctcag

SEQ ID NO: 243526 - DNA, 29 bp, Artificial Sequence
  Description of Artificial Sequence: Synthetic oligonucleotide
tatcgccacgactcaccgtcctttctcag

SEQ ID NO: 243527 - DNA, 28 bp, Artificial Sequence
  Description of Artificial Sequence: Synthetic oligonucleotide
atcgccacgactcaccgtcctttctcag

SEQ ID NO: 243528 - DNA, 27 bp, Artificial Sequence
  Description of Artificial Sequence: Synthetic oligonucleotide
tcgccacgactcaccgtcctttctcag

SEQ ID NO: 243529 - DNA, 26 bp, Artificial Sequence
  Description of Artificial Sequence: Synthetic oligonucleotide
cgccacgactcaccgtcctttctcag

SEQ ID NO: 243530 - DNA, 27 bp, Artificial Sequence
  Description of Artificial Sequence: Synthetic oligonucleotide
gccacgactcaccgtcctttctcagct

SEQ ID NO: 243531 - DNA, 27 bp, Artificial Sequence
  Description of Artificial Sequence: Synthetic oligonucleotide
ccacgactcaccgtcctttctcagctg

SEQ ID NO: 243532 - DNA, 27 bp, Artificial Sequence
  Description of Artificial Sequence: Synthetic oligonucleotide
cacgactcaccgtcctttctcagctgc

SEQ ID NO: 243533 - DNA, 28 bp, Artificial Sequence
  Description of Artificial Sequence: Synthetic oligonucleotide
acgactcaccgtcctttctcagctgcac

SEQ ID NO: 243534 - DNA, 27 bp, Artificial Sequence
  Description of Artificial Sequence: Synthetic oligonucleotide
cgactcaccgtcctttctcagctgcac

SEQ ID NO: 243535 - DNA, 29 bp, Artificial Sequence
  Description of Artificial Sequence: Synthetic oligonucleotide
gactcaccgtcctttctcagctgcacatc

SEQ ID NO: 243536 - DNA, 29 bp, Artificial Sequence
  Description of Artificial Sequence: Synthetic oligonucleotide
actcaccgtcctttctcagctgcacatcc

SEQ ID NO: 243537 - DNA, 28 bp, Artificial Sequence
  Description of Artificial Sequence: Synthetic oligonucleotide
ctcaccgtcctttctcagctgcacatcc

SEQ ID NO: 243538 - DNA, 28 bp, Artificial Sequence
  Description of Artificial Sequence: Synthetic oligonucleotide
tcaccgtcctttctcagctgcacatccc

SEQ ID NO: 243539 - DNA, 27 bp, Artificial Sequence
  Description of Artificial Sequence: Synthetic oligonucleotide
caccgtcctttctcagctgcacatccc

SEQ ID NO: 243540 - DNA, 27 bp, Artificial Sequence
  Description of Artificial Sequence: Synthetic oligonucleotide
accgtcctttctcagctgcacatcccc

SEQ ID NO: 243541 - DNA, 27 bp, Artificial Sequence
  Description of Artificial Sequence: Synthetic oligonucleotide
ccgtcctttctcagctgcacatcccct

SEQ ID NO: 243542 - DNA, 28 bp, Artificial Sequence
  Description of Artificial Sequence: Synthetic oligonucleotide
cgtcctttctcagctgcacatccccttc

SEQ ID NO: 243543 - DNA, 29 bp, Artificial Sequence
  Description of Artificial Sequence: Synthetic oligonucleotide
gtcctttctcagctgcacatccccttcac

SEQ ID NO: 243544 - DNA, 33 bp, Artificial Sequence
  Description of Artificial Sequence: Synthetic oligonucleotide
tcctttctcagctgcacatccccttcacattag

SEQ ID NO: 243545 - DNA, 32 bp, Artificial Sequence
  Description of Artificial Sequence: Synthetic oligonucleotide
cctttctcagctgcacatccccttcacattag

SEQ ID NO: 243546 - DNA, 32 bp, Artificial Sequence
  Description of Artificial Sequence: Synthetic oligonucleotide
ctttctcagctgcacatccccttcacattagc

SEQ ID NO: 243547 - DNA, 33 bp, Artificial Sequence
  Description of Artificial Sequence: Synthetic oligonucleotide
tttctcagctgcacatccccttcacattagcag

SEQ ID NO: 243548 - DNA, 32 bp, Artificial Sequence
  Description of Artificial Sequence: Synthetic oligonucleotide
ttctcagctgcacatccccttcacattagcag

SEQ ID NO: 243549 - DNA, 31 bp, Artificial Sequence
  Description of Artificial Sequence: Synthetic oligonucleotide
tctcagctgcacatccccttcacattagcag

SEQ ID NO: 243550 - DNA, 30 bp, Artificial Sequence
  Description of Artificial Sequence: Synthetic oligonucleotide
ctcagctgcacatccccttcacattagcag

SEQ ID NO: 243551 - DNA, 30 bp, Artificial Sequence
  Description of Artificial Sequence: Synthetic oligonucleotide
tcagctgcacatccccttcacattagcagc

SEQ ID NO: 243552 - DNA, 29 bp, Artificial Sequence
  Description of Artificial Sequence: Synthetic oligonucleotide
cagctgcacatccccttcacattagcagc

SEQ ID NO: 243553 - DNA, 29 bp, Artificial Sequence
  Description of Artificial Sequence: Synthetic oligonucleotide
agctgcacatccccttcacattagcagcg

SEQ ID NO: 243554 - DNA, 28 bp, Artificial Sequence
  Description of Artificial Sequence: Synthetic oligonucleotide
gctgcacatccccttcacattagcagcg

SEQ ID NO: 243555 - DNA, 28 bp, Artificial Sequence
  Description of Artificial Sequence: Synthetic oligonucleotide
ctgcacatccccttcacattagcagcgg

SEQ ID NO: 243556 - DNA, 29 bp, Artificial Sequence
  Description of Artificial Sequence: Synthetic oligonucleotide
tgcacatccccttcacattagcagcggtg

SEQ ID NO: 243557 - DNA, 28 bp, Artificial Sequence
  Description of Artificial Sequence: Synthetic oligonucleotide
gcacatccccttcacattagcagcggtg

SEQ ID NO: 243558 - DNA, 30 bp, Artificial Sequence
  Description of Artificial Sequence: Synthetic oligonucleotide
cacatccccttcacattagcagcggtgaag

SEQ ID NO: 243559 - DNA, 30 bp, Artificial Sequence
  Description of Artificial Sequence: Synthetic oligonucleotide
acatccccttcacattagcagcggtgaagg

SEQ ID NO: 243560 - DNA, 29 bp, Artificial Sequence
  Description of Artificial Sequence: Synthetic oligonucleotide
catccccttcacattagcagcggtgaagg

SEQ ID NO: 243561 - DNA, 30 bp, Artificial Sequence
  Description of Artificial Sequence: Synthetic oligonucleotide
atccccttcacattagcagcggtgaaggtg

SEQ ID NO: 243562 - DNA, 29 bp, Artificial Sequence
  Description of Artificial Sequence: Synthetic oligonucleotide
tccccttcacattagcagcggtgaaggtg

SEQ ID NO: 243563 - DNA, 28 bp, Artificial Sequence
  Description of Artificial Sequence: Synthetic oligonucleotide
ccccttcacattagcagcggtgaaggtg

SEQ ID NO: 243564 - DNA, 30 bp, Artificial Sequence
  Description of Artificial Sequence: Synthetic oligonucleotide
cccttcacattagcagcggtgaaggtgtag

SEQ ID NO: 243565 - DNA, 32 bp, Artificial Sequence
  Description of Artificial Sequence: Synthetic oligonucleotide
ccttcacattagcagcggtgaaggtgtagaac

SEQ ID NO: 243566 - DNA, 33 bp, Artificial Sequence
  Description of Artificial Sequence: Synthetic oligonucleotide
cttcacattagcagcggtgaaggtgtagaacac

SEQ ID NO: 243567 - DNA, 33 bp, Artificial Sequence
  Description of Artificial Sequence: Synthetic oligonucleotide
ttcacattagcagcggtgaaggtgtagaacacc

SEQ ID NO: 243568 - DNA, 32 bp, Artificial Sequence
  Description of Artificial Sequence: Synthetic oligonucleotide
tcacattagcagcggtgaaggtgtagaacacc

SEQ ID NO: 243569 - DNA, 31 bp, Artificial Sequence
  Description of Artificial Sequence: Synthetic oligonucleotide
cacattagcagcggtgaaggtgtagaacacc

SEQ ID NO: 243570 - DNA, 31 bp, Artificial Sequence
  Description of Artificial Sequence: Synthetic oligonucleotide
acattagcagcggtgaaggtgtagaacaccc

SEQ ID NO: 243571 - DNA, 30 bp, Artificial Sequence
  Description of Artificial Sequence: Synthetic oligonucleotide
cattagcagcggtgaaggtgtagaacaccc

SEQ ID NO: 243572 - DNA, 30 bp, Artificial Sequence
  Description of Artificial Sequence: Synthetic oligonucleotide
attagcagcggtgaaggtgtagaacacccg

SEQ ID NO: 243573 - DNA, 29 bp, Artificial Sequence
  Description of Artificial Sequence: Synthetic oligonucleotide
ttagcagcggtgaaggtgtagaacacccg

SEQ ID NO: 243574 - DNA, 28 bp, Artificial Sequence
  Description of Artificial Sequence: Synthetic oligonucleotide
tagcagcggtgaaggtgtagaacacccg

SEQ ID NO: 243575 - DNA, 27 bp, Artificial Sequence
  Description of Artificial Sequence: Synthetic oligonucleotide
agcagcggtgaaggtgtagaacacccg

SEQ ID NO: 243576 - DNA, 26 bp, Artificial Sequence
  Description of Artificial Sequence: Synthetic oligonucleotide
gcagcggtgaaggtgtagaacacccg

SEQ ID NO: 243577 - DNA, 26 bp, Artificial Sequence
  Description of Artificial Sequence: Synthetic oligonucleotide
cagcggtgaaggtgtagaacacccgc

SEQ ID NO: 243578 - DNA, 27 bp, Artificial Sequence
  Description of Artificial Sequence: Synthetic oligonucleotide
agcggtgaaggtgtagaacacccgcga

SEQ ID NO: 243579 - DNA, 27 bp, Artificial Sequence
  Description of Artificial Sequence: Synthetic oligonucleotide
gcggtgaaggtgtagaacacccgcgat

SEQ ID NO: 243580 - DNA, 27 bp, Artificial Sequence
  Description of Artificial Sequence: Synthetic oligonucleotide
cggtgaaggtgtagaacacccgcgatc

SEQ ID NO: 243581 - DNA, 28 bp, Artificial Sequence
  Description of Artificial Sequence: Synthetic oligonucleotide
ggtgaaggtgtagaacacccgcgatcag

SEQ ID NO: 243582 - DNA, 28 bp, Artificial Sequence
  Description of Artificial Sequence: Synthetic oligonucleotide
gtgaaggtgtagaacacccgcgatcagg

SEQ ID NO: 243583 - DNA, 30 bp, Artificial Sequence
  Description of Artificial Sequence: Synthetic oligonucleotide
tgaaggtgtagaacacccgcgatcaggaag

SEQ ID NO: 243584 - DNA, 29 bp, Artificial Sequence
  Description of Artificial Sequence: Synthetic oligonucleotide
gaaggtgtagaacacccgcgatcaggaag

SEQ ID NO: 243585 - DNA, 30 bp, Artificial Sequence
  Description of Artificial Sequence: Synthetic oligonucleotide
aaggtgtagaacacccgcgatcaggaagag

SEQ ID NO: 243586 - DNA, 29 bp, Artificial Sequence
  Description of Artificial Sequence: Synthetic oligonucleotide
aggtgtagaacacccgcgatcaggaagag

SEQ ID NO: 243587 - DNA, 28 bp, Artificial Sequence
  Description of Artificial Sequence: Synthetic oligonucleotide
ggtgtagaacacccgcgatcaggaagag

SEQ ID NO: 243588 - DNA, 28 bp, Artificial Sequence
  Description of Artificial Sequence: Synthetic oligonucleotide
gtgtagaacacccgcgatcaggaagagc

SEQ ID NO: 243589 - DNA, 30 bp, Artificial Sequence
  Description of Artificial Sequence: Synthetic oligonucleotide
tgtagaacacccgcgatcaggaagagcttc

SEQ ID NO: 243590 - DNA, 29 bp, Artificial Sequence
  Description of Artificial Sequence: Synthetic oligonucleotide
gtagaacacccgcgatcaggaagagcttc

SEQ ID NO: 243591 - DNA, 29 bp, Artificial Sequence
  Description of Artificial Sequence: Synthetic oligonucleotide
tagaacacccgcgatcaggaagagcttcg

SEQ ID NO: 243592 - DNA, 28 bp, Artificial Sequence
  Description of Artificial Sequence: Synthetic oligonucleotide
agaacacccgcgatcaggaagagcttcg

SEQ ID NO: 243593 - DNA, 27 bp, Artificial Sequence
  Description of Artificial Sequence: Synthetic oligonucleotide
gaacacccgcgatcaggaagagcttcg

SEQ ID NO: 243594 - DNA, 27 bp, Artificial Sequence
  Description of Artificial Sequence: Synthetic oligonucleotide
aacacccgcgatcaggaagagcttcgg

SEQ ID NO: 243595 - DNA, 26 bp, Artificial Sequence
  Description of Artificial Sequence: Synthetic oligonucleotide
acacccgcgatcaggaagagcttcgg

SEQ ID NO: 243596 - DNA, 25 bp, Artificial Sequence
  Description of Artificial Sequence: Synthetic oligonucleotide
cacccgcgatcaggaagagcttcgg

SEQ ID NO: 243597 - DNA, 26 bp, Artificial Sequence
  Description of Artificial Sequence: Synthetic oligonucleotide
acccgcgatcaggaagagcttcggga

SEQ ID NO: 243598 - DNA, 25 bp, Artificial Sequence
  Description of Artificial Sequence: Synthetic oligonucleotide
cccgcgatcaggaagagcttcggga

SEQ ID NO: 243599 - DNA, 27 bp, Artificial Sequence
  Description of Artificial Sequence: Synthetic oligonucleotide
ccgcgatcaggaagagcttcgggacat

SEQ ID NO: 243600 - DNA, 27 bp, Artificial Sequence
  Description of Artificial Sequence: Synthetic oligonucleotide
cgcgatcaggaagagcttcgggacatc

SEQ ID NO: 243601 - DNA, 27 bp, Artificial Sequence
  Description of Artificial Sequence: Synthetic oligonucleotide
gcgatcaggaagagcttcgggacatcc

SEQ ID NO: 243602 - DNA, 28 bp, Artificial Sequence
  Description of Artificial Sequence: Synthetic oligonucleotide
cgatcaggaagagcttcgggacatccag

SEQ ID NO: 243603 - DNA, 28 bp, Artificial Sequence
  Description of Artificial Sequence: Synthetic oligonucleotide
gatcaggaagagcttcgggacatccagg

SEQ ID NO: 243604 - DNA, 30 bp, Artificial Sequence
  Description of Artificial Sequence: Synthetic oligonucleotide
atcaggaagagcttcgggacatccaggatc

SEQ ID NO: 243605 - DNA, 29 bp, Artificial Sequence
  Description of Artificial Sequence: Synthetic oligonucleotide
tcaggaagagcttcgggacatccaggatc

SEQ ID NO: 243606 - DNA, 28 bp, Artificial Sequence
  Description of Artificial Sequence: Synthetic oligonucleotide
caggaagagcttcgggacatccaggatc

SEQ ID NO: 243607 - DNA, 28 bp, Artificial Sequence
  Description of Artificial Sequence: Synthetic oligonucleotide
aggaagagcttcgggacatccaggatcc

SEQ ID NO: 243608 - DNA, 27 bp, Artificial Sequence
  Description of Artificial Sequence: Synthetic oligonucleotide
ggaagagcttcgggacatccaggatcc

SEQ ID NO: 243609 - DNA, 28 bp, Artificial Sequence
  Description of Artificial Sequence: Synthetic oligonucleotide
gaagagcttcgggacatccaggatccag

SEQ ID NO: 243610 - DNA, 29 bp, Artificial Sequence
  Description of Artificial Sequence: Synthetic oligonucleotide
aagagcttcgggacatccaggatccagtg

SEQ ID NO: 243611 - DNA, 28 bp, Artificial Sequence
  Description of Artificial Sequence: Synthetic oligonucleotide
agagcttcgggacatccaggatccagtg

SEQ ID NO: 243612 - DNA, 27 bp, Artificial Sequence
  Description of Artificial Sequence: Synthetic oligonucleotide
gagcttcgggacatccaggatccagtg

SEQ ID NO: 243613 - DNA, 27 bp, Artificial Sequence
  Description of Artificial Sequence: Synthetic oligonucleotide
agcttcgggacatccaggatccagtgg

SEQ ID NO: 243614 - DNA, 26 bp, Artificial Sequence
  Description of Artificial Sequence: Synthetic oligonucleotide
gcttcgggacatccaggatccagtgg

SEQ ID NO: 243615 - DNA, 26 bp, Artificial Sequence
  Description of Artificial Sequence: Synthetic oligonucleotide
cttcgggacatccaggatccagtggc

SEQ ID NO: 243616 - DNA, 27 bp, Artificial Sequence
  Description of Artificial Sequence: Synthetic oligonucleotide
ttcgggacatccaggatccagtggcca

SEQ ID NO: 243617 - DNA, 26 bp, Artificial Sequence
  Description of Artificial Sequence: Synthetic oligonucleotide
tcgggacatccaggatccagtggcca

SEQ ID NO: 243618 - DNA, 25 bp, Artificial Sequence
  Description of Artificial Sequence: Synthetic oligonucleotide
cgggacatccaggatccagtggcca

SEQ ID NO: 243619 - DNA, 25 bp, Artificial Sequence
  Description of Artificial Sequence: Synthetic oligonucleotide
gggacatccaggatccagtggccac

SEQ ID NO: 243620 - DNA, 25 bp, Artificial Sequence
  Description of Artificial Sequence: Synthetic oligonucleotide
ggacatccaggatccagtggccacg

SEQ ID NO: 243621 - DNA, 25 bp, Artificial Sequence
  Description of Artificial Sequence: Synthetic oligonucleotide
gacatccaggatccagtggccacgg

SEQ ID NO: 243622 - DNA, 25 bp, Artificial Sequence
  Description of Artificial Sequence: Synthetic oligonucleotide
acatccaggatccagtggccacggc

SEQ ID NO: 243623 - DNA, 24 bp, Artificial Sequence
  Description of Artificial Sequence: Synthetic oligonucleotide
catccaggatccagtggccacggc

SEQ ID NO: 243624 - DNA, 24 bp, Artificial Sequence
  Description of Artificial Sequence: Synthetic oligonucleotide
atccaggatccagtggccacggcg

SEQ ID NO: 243625 - DNA, 23 bp, Artificial Sequence
  Description of Artificial Sequence: Synthetic oligonucleotide
tccaggatccagtggccacggcg

SEQ ID NO: 243626 - DNA, 22 bp, Artificial Sequence
  Description of Artificial Sequence: Synthetic oligonucleotide
ccaggatccagtggccacggcg

SEQ ID NO: 243627 - DNA, 22 bp, Artificial Sequence
  Description of Artificial Sequence: Synthetic oligonucleotide
caggatccagtggccacggcgg

SEQ ID NO: 243628 - DNA, 22 bp, Artificial Sequence
  Description of Artificial Sequence: Synthetic oligonucleotide
aggatccagtggccacggcggg

SEQ ID NO: 243629 - DNA, 21 bp, Artificial Sequence
  Description of Artificial Sequence: Synthetic oligonucleotide
ggatccagtggccacggcggg

SEQ ID NO: 243630 - DNA, 21 bp, Artificial Sequence
  Description of Artificial Sequence: Synthetic oligonucleotide
gatccagtggccacggcgggg

SEQ ID NO: 243631 - DNA, 22 bp, Artificial Sequence
  Description of Artificial Sequence: Synthetic oligonucleotide
atccagtggccacggcggggca

SEQ ID NO: 243632 - DNA, 21 bp, Artificial Sequence
  Description of Artificial Sequence: Synthetic oligonucleotide
tccagtggccacggcggggca

SEQ ID NO: 243633 - DNA, 20 bp, Artificial Sequence
  Description of Artificial Sequence: Synthetic oligonucleotide
ccagtggccacggcggggca

SEQ ID NO: 243634 - DNA, 20 bp, Artificial Sequence
  Description of Artificial Sequence: Synthetic oligonucleotide
cagtggccacggcggggcac

SEQ ID NO: 243635 - DNA, 21 bp, Artificial Sequence
  Description of Artificial Sequence: Synthetic oligonucleotide
agtggccacggcggggcacgt

SEQ ID NO: 243636 - DNA, 20 bp, Artificial Sequence
  Description of Artificial Sequence: Synthetic oligonucleotide
gtggccacggcggggcacgt

SEQ ID NO: 243637 - DNA, 20 bp, Artificial Sequence
  Description of Artificial Sequence: Synthetic oligonucleotide
tggccacggcggggcacgtg

SEQ ID NO: 243638 - DNA, 20 bp, Artificial Sequence
  Description of Artificial Sequence: Synthetic oligonucleotide
ggccacggcggggcacgtgt

SEQ ID NO: 243639 - DNA, 20 bp, Artificial Sequence
  Description of Artificial Sequence: Synthetic oligonucleotide
gccacggcggggcacgtggt

SEQ ID NO: 243640 - DNA, 20 bp, Artificial Sequence
  Description of Artificial Sequence: Synthetic oligonucleotide
ccacggcggggcacgtggtg

SEQ ID NO: 243641 - DNA, 20 bp, Artificial Sequence
  Description of Artificial Sequence: Synthetic oligonucleotide
cacggcggggcacgtggtgc

SEQ ID NO: 243642 - DNA, 20 bp, Artificial Sequence
  Description of Artificial Sequence: Synthetic oligonucleotide
acggcggggcacgtggtgcg

SEQ ID NO: 243643 - DNA, 20 bp, Artificial Sequence
  Description of Artificial Sequence: Synthetic oligonucleotide
cggcggggcacgtggtgcgt

SEQ ID NO: 243644 - DNA, 20 bp, Artificial Sequence
  Description of Artificial Sequence: Synthetic oligonucleotide
ggcggggcacgtggtgcggt

SEQ ID NO: 243645 - DNA, 21 bp, Artificial Sequence
  Description of Artificial Sequence: Synthetic oligonucleotide
gcggggcacgtggtgcggcaa

SEQ ID NO: 243646 - DNA, 21 bp, Artificial Sequence
  Description of Artificial Sequence: Synthetic oligonucleotide
cggggcacgtggtgcggcaag

SEQ ID NO: 243647 - DNA, 21 bp, Artificial Sequence
  Description of Artificial Sequence: Synthetic oligonucleotide
ggggcacgtggtgcggcaagc

SEQ ID NO: 243648 - DNA, 21 bp, Artificial Sequence
  Description of Artificial Sequence: Synthetic oligonucleotide
gggcacgtggtgcggcaagcc

SEQ ID NO: 243649 - DNA, 23 bp, Artificial Sequence
  Description of Artificial Sequence: Synthetic oligonucleotide
ggcacgtggtgcggcaagccgtt

SEQ ID NO: 243650 - DNA, 23 bp, Artificial Sequence
  Description of Artificial Sequence: Synthetic oligonucleotide
gcacgtggtgcggcaagccgttg

SEQ ID NO: 243651 - DNA, 24 bp, Artificial Sequence
  Description of Artificial Sequence: Synthetic oligonucleotide
cacgtggtgcggcaagccgttgca

SEQ ID NO: 243652 - DNA, 24 bp, Artificial Sequence
  Description of Artificial Sequence: Synthetic oligonucleotide
acgtggtgcggcaagccgttgcag

SEQ ID NO: 243653 - DNA, 23 bp, Artificial Sequence
  Description of Artificial Sequence: Synthetic oligonucleotide
cgtggtgcggcaagccgttgcag

SEQ ID NO: 243654 - DNA, 23 bp, Artificial Sequence
  Description of Artificial Sequence: Synthetic oligonucleotide
gtggtgcggcaagccgttgcagg

SEQ ID NO: 243655 - DNA, 23 bp, Artificial Sequence
  Description of Artificial Sequence: Synthetic oligonucleotide
tggtgcggcaagccgttgcaggg

SEQ ID NO: 243656 - DNA, 22 bp, Artificial Sequence
  Description of Artificial Sequence: Synthetic oligonucleotide
ggtgcggcaagccgttgcaggg

SEQ ID NO: 243657 - DNA, 23 bp, Artificial Sequence
  Description of Artificial Sequence: Synthetic oligonucleotide
gtgcggcaagccgttgcagggct

SEQ ID NO: 243658 - DNA, 23 bp, Artificial Sequence
  Description of Artificial Sequence: Synthetic oligonucleotide
tgcggcaagccgttgcagggctg

SEQ ID NO: 243659 - DNA, 22 bp, Artificial Sequence
  Description of Artificial Sequence: Synthetic oligonucleotide
gcggcaagccgttgcagggctg

SEQ ID NO: 243660 - DNA, 23 bp, Artificial Sequence
  Description of Artificial Sequence: Synthetic oligonucleotide
cggcaagccgttgcagggctgca

SEQ ID NO: 243661 - DNA, 24 bp, Artificial Sequence
  Description of Artificial Sequence: Synthetic oligonucleotide
ggcaagccgttgcagggctgcaca

SEQ ID NO: 243662 - DNA, 24 bp, Artificial Sequence
  Description of Artificial Sequence: Synthetic oligonucleotide
gcaagccgttgcagggctgcacac

SEQ ID NO: 243663 - DNA, 24 bp, Artificial Sequence
  Description of Artificial Sequence: Synthetic oligonucleotide
caagccgttgcagggctgcacacc

SEQ ID NO: 243664 - DNA, 26 bp, Artificial Sequence
  Description of Artificial Sequence: Synthetic oligonucleotide
aagccgttgcagggctgcacaccgtt

SEQ ID NO: 243665 - DNA, 25 bp, Artificial Sequence
  Description of Artificial Sequence: Synthetic oligonucleotide
agccgttgcagggctgcacaccgtt

SEQ ID NO: 243666 - DNA, 24 bp, Artificial Sequence
  Description of Artificial Sequence: Synthetic oligonucleotide
gccgttgcagggctgcacaccgtt

SEQ ID NO: 243667 - DNA, 24 bp, Artificial Sequence
  Description of Artificial Sequence: Synthetic oligonucleotide
ccgttgcagggctgcacaccgttc

SEQ ID NO: 243668 - DNA, 24 bp, Artificial Sequence
  Description of Artificial Sequence: Synthetic oligonucleotide
cgttgcagggctgcacaccgttcg

SEQ ID NO: 243669 - DNA, 25 bp, Artificial Sequence
  Description of Artificial Sequence: Synthetic oligonucleotide
gttgcagggctgcacaccgttcgct

SEQ ID NO: 243670 - DNA, 27 bp, Artificial Sequence
  Description of Artificial Sequence: Synthetic oligonucleotide
ttgcagggctgcacaccgttcgctgtt

SEQ ID NO: 243671 - DNA, 27 bp, Artificial Sequence
  Description of Artificial Sequence: Synthetic oligonucleotide
tgcagggctgcacaccgttcgctgttt

SEQ ID NO: 243672 - DNA, 27 bp, Artificial Sequence
  Description of Artificial Sequence: Synthetic oligonucleotide
gcagggctgcacaccgttcgctgtttt

SEQ ID NO: 243673 - DNA, 27 bp, Artificial Sequence
  Description of Artificial Sequence: Synthetic oligonucleotide
cagggctgcacaccgttcgctgttttg

SEQ ID NO: 243674 - DNA, 27 bp, Artificial Sequence
  Description of Artificial Sequence: Synthetic oligonucleotide
agggctgcacaccgttcgctgttttgg

SEQ ID NO: 243675 - DNA, 26 bp, Artificial Sequence
  Description of Artificial Sequence: Synthetic oligonucleotide
gggctgcacaccgttcgctgttttgg

SEQ ID NO: 243676 - DNA, 26 bp, Artificial Sequence
  Description of Artificial Sequence: Synthetic oligonucleotide
ggctgcacaccgttcgctgttttggg

SEQ ID NO: 243677 - DNA, 26 bp, Artificial Sequence
  Description of Artificial Sequence: Synthetic oligonucleotide
gctgcacaccgttcgctgttttgggg

SEQ ID NO: 243678 - DNA, 26 bp, Artificial Sequence
  Description of Artificial Sequence: Synthetic oligonucleotide
ctgcacaccgttcgctgttttggggg

SEQ ID NO: 243679 - DNA, 26 bp, Artificial Sequence
  Description of Artificial Sequence: Synthetic oligonucleotide
tgcacaccgttcgctgttttgggggc

SEQ ID NO: 243680 - DNA, 25 bp, Artificial Sequence
  Description of Artificial Sequence: Synthetic oligonucleotide
gcacaccgttcgctgttttgggggc

SEQ ID NO: 243681 - DNA, 26 bp, Artificial Sequence
  Description of Artificial Sequence: Synthetic oligonucleotide
cacaccgttcgctgttttgggggcga

SEQ ID NO: 243682 - DNA, 26 bp, Artificial Sequence
  Description of Artificial Sequence: Synthetic oligonucleotide
acaccgttcgctgttttgggggcgag

SEQ ID NO: 243683 - DNA, 25 bp, Artificial Sequence
  Description of Artificial Sequence: Synthetic oligonucleotide
caccgttcgctgttttgggggcgag

SEQ ID NO: 243684 - DNA, 26 bp, Artificial Sequence
  Description of Artificial Sequence: Synthetic oligonucleotide
accgttcgctgttttgggggcgagga

SEQ ID NO: 243685 - DNA, 25 bp, Artificial Sequence
  Description of Artificial Sequence: Synthetic oligonucleotide
ccgttcgctgttttgggggcgagga

SEQ ID NO: 243686 - DNA, 25 bp, Artificial Sequence
  Description of Artificial Sequence: Synthetic oligonucleotide
cgttcgctgttttgggggcgaggag

SEQ ID NO: 243687 - DNA, 27 bp, Artificial Sequence
  Description of Artificial Sequence: Synthetic oligonucleotide
gttcgctgttttgggggcgaggagcaa

SEQ ID NO: 243688 - DNA, 27 bp, Artificial Sequence
  Description of Artificial Sequence: Synthetic oligonucleotide
ttcgctgttttgggggcgaggagcaag

SEQ ID NO: 243689 - DNA, 27 bp, Artificial Sequence
  Description of Artificial Sequence: Synthetic oligonucleotide
tcgctgttttgggggcgaggagcaaga

SEQ ID NO: 243690 - DNA, 27 bp, Artificial Sequence
  Description of Artificial Sequence: Synthetic oligonucleotide
cgctgttttgggggcgaggagcaagaa

SEQ ID NO: 243691 - DNA, 27 bp, Artificial Sequence
  Description of Artificial Sequence: Synthetic oligonucleotide
gctgttttgggggcgaggagcaagaag

SEQ ID NO: 243692 - DNA, 28 bp, Artificial Sequence
  Description of Artificial Sequence: Synthetic oligonucleotide
ctgttttgggggcgaggagcaagaagtc

SEQ ID NO: 243693 - DNA, 29 bp, Artificial Sequence
  Description of Artificial Sequence: Synthetic oligonucleotide
tgttttgggggcgaggagcaagaagtctg

SEQ ID NO: 243694 - DNA, 28 bp, Artificial Sequence
  Description of Artificial Sequence: Synthetic oligonucleotide
gttttgggggcgaggagcaagaagtctg

SEQ ID NO: 243695 - DNA, 29 bp, Artificial Sequence
  Description of Artificial Sequence: Synthetic oligonucleotide
ttttgggggcgaggagcaagaagtctgtg

SEQ ID NO: 243696 - DNA, 28 bp, Artificial Sequence
  Description of Artificial Sequence: Synthetic oligonucleotide
tttgggggcgaggagcaagaagtctgtg

SEQ ID NO: 243697 - DNA, 27 bp, Artificial Sequence
  Description of Artificial Sequence: Synthetic oligonucleotide
ttgggggcgaggagcaagaagtctgtg

SEQ ID NO: 243698 - DNA, 26 bp, Artificial Sequence
  Description of Artificial Sequence: Synthetic oligonucleotide
tgggggcgaggagcaagaagtctgtg

SEQ ID NO: 243699 - DNA, 25 bp, Artificial Sequence
  Description of Artificial Sequence: Synthetic oligonucleotide
gggggcgaggagcaagaagtctgtg

SEQ ID NO: 243700 - DNA, 25 bp, Artificial Sequence
  Description of Artificial Sequence: Synthetic oligonucleotide
ggggcgaggagcaagaagtctgtgg

SEQ ID NO: 243701 - DNA, 27 bp, Artificial Sequence
  Description of Artificial Sequence: Synthetic oligonucleotide
gggcgaggagcaagaagtctgtggcta

SEQ ID NO: 243702 - DNA, 31 bp, Artificial Sequence
  Description of Artificial Sequence: Synthetic oligonucleotide
ggcgaggagcaagaagtctgtggctataaag

SEQ ID NO: 243703 - DNA, 32 bp, Artificial Sequence
  Description of Artificial Sequence: Synthetic oligonucleotide
gcgaggagcaagaagtctgtggctataaagtg

SEQ ID NO: 243704 - DNA, 32 bp, Artificial Sequence
  Description of Artificial Sequence: Synthetic oligonucleotide
cgaggagcaagaagtctgtggctataaagtgg

SEQ ID NO: 243705 - DNA, 32 bp, Artificial Sequence
  Description of Artificial Sequence: Synthetic oligonucleotide
gaggagcaagaagtctgtggctataaagtggc

SEQ ID NO: 243706 - DNA, 32 bp, Artificial Sequence
  Description of Artificial Sequence: Synthetic oligonucleotide
aggagcaagaagtctgtggctataaagtggcc

SEQ ID NO: 243707 - DNA, 31 bp, Artificial Sequence
  Description of Artificial Sequence: Synthetic oligonucleotide
ggagcaagaagtctgtggctataaagtggcc

SEQ ID NO: 243708 - DNA, 31 bp, Artificial Sequence
  Description of Artificial Sequence: Synthetic oligonucleotide
gagcaagaagtctgtggctataaagtggccc

SEQ ID NO: 243709 - DNA, 33 bp, Artificial Sequence
  Description of Artificial Sequence: Synthetic oligonucleotide
agcaagaagtctgtggctataaagtggcccttg

SEQ ID NO: 243710 - DNA, 32 bp, Artificial Sequence
  Description of Artificial Sequence: Synthetic oligonucleotide
gcaagaagtctgtggctataaagtggcccttg

SEQ ID NO: 243711 - DNA, 34 bp, Artificial Sequence
  Description of Artificial Sequence: Synthetic oligonucleotide
caagaagtctgtggctataaagtggcccttgatc

SEQ ID NO: 243712 - DNA, 37 bp, Artificial Sequence
  Description of Artificial Sequence: Synthetic oligonucleotide
aagaagtctgtggctataaagtggcccttgatcaatg

SEQ ID NO: 243713 - DNA, 36 bp, Artificial Sequence
  Description of Artificial Sequence: Synthetic oligonucleotide
agaagtctgtggctataaagtggcccttgatcaatg

SEQ ID NO: 243714 - DNA, 35 bp, Artificial Sequence
  Description of Artificial Sequence: Synthetic oligonucleotide
gaagtctgtggctataaagtggcccttgatcaatg

SEQ ID NO: 243715 - DNA, 36 bp, Artificial Sequence
  Description of Artificial Sequence: Synthetic oligonucleotide
aagtctgtggctataaagtggcccttgatcaatgtc

SEQ ID NO: 243716 - DNA, 35 bp, Artificial Sequence
  Description of Artificial Sequence: Synthetic oligonucleotide
agtctgtggctataaagtggcccttgatcaatgtc

SEQ ID NO: 243717 - DNA, 34 bp, Artificial Sequence
  Description of Artificial Sequence: Synthetic oligonucleotide
gtctgtggctataaagtggcccttgatcaatgtc

SEQ ID NO: 243718 - DNA, 34 bp, Artificial Sequence
  Description of Artificial Sequence: Synthetic oligonucleotide
tctgtggctataaagtggcccttgatcaatgtcg

SEQ ID NO: 243719 - DNA, 33 bp, Artificial Sequence
  Description of Artificial Sequence: Synthetic oligonucleotide
ctgtggctataaagtggcccttgatcaatgtcg

SEQ ID NO: 243720 - DNA, 33 bp, Artificial Sequence
  Description of Artificial Sequence: Synthetic oligonucleotide
tgtggctataaagtggcccttgatcaatgtcgg

SEQ ID NO: 243721 - DNA, 32 bp, Artificial Sequence
  Description of Artificial Sequence: Synthetic oligonucleotide
gtggctataaagtggcccttgatcaatgtcgg

SEQ ID NO: 243722 - DNA, 32 bp, Artificial Sequence
  Description of Artificial Sequence: Synthetic oligonucleotide
tggctataaagtggcccttgatcaatgtcggg

SEQ ID NO: 243723 - DNA, 31 bp, Artificial Sequence
  Description of Artificial Sequence: Synthetic oligonucleotide
ggctataaagtggcccttgatcaatgtcggg

SEQ ID NO: 243724 - DNA, 32 bp, Artificial Sequence
  Description of Artificial Sequence: Synthetic oligonucleotide
gctataaagtggcccttgatcaatgtcgggag

SEQ ID NO: 243725 - DNA, 32 bp, Artificial Sequence
  Description of Artificial Sequence: Synthetic oligonucleotide
ctataaagtggcccttgatcaatgtcgggagc

SEQ ID NO: 243726 - DNA, 33 bp, Artificial Sequence
  Description of Artificial Sequence: Synthetic oligonucleotide
tataaagtggcccttgatcaatgtcgggagctg

SEQ ID NO: 243727 - DNA, 32 bp, Artificial Sequence
  Description of Artificial Sequence: Synthetic oligonucleotide
ataaagtggcccttgatcaatgtcgggagctg

SEQ ID NO: 243728 - DNA, 31 bp, Artificial Sequence
  Description of Artificial Sequence: Synthetic oligonucleotide
taaagtggcccttgatcaatgtcgggagctg

SEQ ID NO: 243729 - DNA, 30 bp, Artificial Sequence
  Description of Artificial Sequence: Synthetic oligonucleotide
aaagtggcccttgatcaatgtcgggagctg

SEQ ID NO: 243730 - DNA, 29 bp, Artificial Sequence
  Description of Artificial Sequence: Synthetic oligonucleotide
aagtggcccttgatcaatgtcgggagctg

SEQ ID NO: 243731 - DNA, 28 bp, Artificial Sequence
  Description of Artificial Sequence: Synthetic oligonucleotide
agtggcccttgatcaatgtcgggagctg

SEQ ID NO: 243732 - DNA, 27 bp, Artificial Sequence
  Description of Artificial Sequence: Synthetic oligonucleotide
gtggcccttgatcaatgtcgggagctg

SEQ ID NO: 243733 - DNA, 31 bp, Artificial Sequence
  Description of Artificial Sequence: Synthetic oligonucleotide
tggcccttgatcaatgtcgggagctgtattc

SEQ ID NO: 243734 - DNA, 30 bp, Artificial Sequence
  Description of Artificial Sequence: Synthetic oligonucleotide
ggcccttgatcaatgtcgggagctgtattc

SEQ ID NO: 243735 - DNA, 30 bp, Artificial Sequence
  Description of Artificial Sequence: Synthetic oligonucleotide
gcccttgatcaatgtcgggagctgtattcg

SEQ ID NO: 243736 - DNA, 30 bp, Artificial Sequence
  Description of Artificial Sequence: Synthetic oligonucleotide
cccttgatcaatgtcgggagctgtattcgc

SEQ ID NO: 243737 - DNA, 30 bp, Artificial Sequence
  Description of Artificial Sequence: Synthetic oligonucleotide
ccttgatcaatgtcgggagctgtattcgcg

SEQ ID NO: 243738 - DNA, 30 bp, Artificial Sequence
  Description of Artificial Sequence: Synthetic oligonucleotide
cttgatcaatgtcgggagctgtattcgcgg

SEQ ID NO: 243739 - DNA, 31 bp, Artificial Sequence
  Description of Artificial Sequence: Synthetic oligonucleotide
ttgatcaatgtcgggagctgtattcgcggag

SEQ ID NO: 243740 - DNA, 30 bp, Artificial Sequence
  Description of Artificial Sequence: Synthetic oligonucleotide
tgatcaatgtcgggagctgtattcgcggag

SEQ ID NO: 243741 - DNA, 29 bp, Artificial Sequence
  Description of Artificial Sequence: Synthetic oligonucleotide
gatcaatgtcgggagctgtattcgcggag

SEQ ID NO: 243742 - DNA, 30 bp, Artificial Sequence
  Description of Artificial Sequence: Synthetic oligonucleotide
atcaatgtcgggagctgtattcgcggagag

SEQ ID NO: 243743 - DNA, 29 bp, Artificial Sequence
  Description of Artificial Sequence: Synthetic oligonucleotide
tcaatgtcgggagctgtattcgcggagag

SEQ ID NO: 243744 - DNA, 28 bp, Artificial Sequence
  Description of Artificial Sequence: Synthetic oligonucleotide
caatgtcgggagctgtattcgcggagag

SEQ ID NO: 243745 - DNA, 29 bp, Artificial Sequence
  Description of Artificial Sequence: Synthetic oligonucleotide
aatgtcgggagctgtattcgcggagagag

SEQ ID NO: 243746 - DNA, 28 bp, Artificial Sequence
  Description of Artificial Sequence: Synthetic oligonucleotide
atgtcgggagctgtattcgcggagagag

SEQ ID NO: 243747 - DNA, 27 bp, Artificial Sequence
  Description of Artificial Sequence: Synthetic oligonucleotide
tgtcgggagctgtattcgcggagagag

SEQ ID NO: 243748 - DNA, 26 bp, Artificial Sequence
  Description of Artificial Sequence: Synthetic oligonucleotide
gtcgggagctgtattcgcggagagag

SEQ ID NO: 243749 - DNA, 27 bp, Artificial Sequence
  Description of Artificial Sequence: Synthetic oligonucleotide
tcgggagctgtattcgcggagagagct

SEQ ID NO: 243750 - DNA, 26 bp, Artificial Sequence
  Description of Artificial Sequence: Synthetic oligonucleotide
cgggagctgtattcgcggagagagct

SEQ ID NO: 243751 - DNA, 26 bp, Artificial Sequence
  Description of Artificial Sequence: Synthetic oligonucleotide
gggagctgtattcgcggagagagctg

SEQ ID NO: 243752 - DNA, 27 bp, Artificial Sequence
  Description of Artificial Sequence: Synthetic oligonucleotide
ggagctgtattcgcggagagagctgga

SEQ ID NO: 243753 - DNA, 28 bp, Artificial Sequence
  Description of Artificial Sequence: Synthetic oligonucleotide
gagctgtattcgcggagagagctggaac

SEQ ID NO: 243754 - DNA, 28 bp, Artificial Sequence
  Description of Artificial Sequence: Synthetic oligonucleotide
agctgtattcgcggagagagctggaacg

SEQ ID NO: 243755 - DNA, 27 bp, Artificial Sequence
  Description of Artificial Sequence: Synthetic oligonucleotide
gctgtattcgcggagagagctggaacg

SEQ ID NO: 243756 - DNA, 27 bp, Artificial Sequence
  Description of Artificial Sequence: Synthetic oligonucleotide
ctgtattcgcggagagagctggaacgc

SEQ ID NO: 243757 - DNA, 27 bp, Artificial Sequence
  Description of Artificial Sequence: Synthetic oligonucleotide
tgtattcgcggagagagctggaacgcc

SEQ ID NO: 243758 - DNA, 26 bp, Artificial Sequence
  Description of Artificial Sequence: Synthetic oligonucleotide
gtattcgcggagagagctggaacgcc

SEQ ID NO: 243759 - DNA, 26 bp, Artificial Sequence
  Description of Artificial Sequence: Synthetic oligonucleotide
tattcgcggagagagctggaacgccc

SEQ ID NO: 243760 - DNA, 25 bp, Artificial Sequence
  Description of Artificial Sequence: Synthetic oligonucleotide
attcgcggagagagctggaacgccc

SEQ ID NO: 243761 - DNA, 24 bp, Artificial Sequence
  Description of Artificial Sequence: Synthetic oligonucleotide
ttcgcggagagagctggaacgccc

SEQ ID NO: 243762 - DNA, 23 bp, Artificial Sequence
  Description of Artificial Sequence: Synthetic oligonucleotide
tcgcggagagagctggaacgccc

SEQ ID NO: 243763 - DNA, 22 bp, Artificial Sequence
  Description of Artificial Sequence: Synthetic oligonucleotide
cgcggagagagctggaacgccc

SEQ ID NO: 243764 - DNA, 24 bp, Artificial Sequence
  Description of Artificial Sequence: Synthetic oligonucleotide
gcggagagagctggaacgcccctt

SEQ ID NO: 243765 - DNA, 26 bp, Artificial Sequence
  Description of Artificial Sequence: Synthetic oligonucleotide
cggagagagctggaacgccccttgta

SEQ ID NO: 243766 - DNA, 26 bp, Artificial Sequence
  Description of Artificial Sequence: Synthetic oligonucleotide
ggagagagctggaacgccccttgtac

SEQ ID NO: 243767 - DNA, 27 bp, Artificial Sequence
  Description of Artificial Sequence: Synthetic oligonucleotide
gagagagctggaacgccccttgtacca

SEQ ID NO: 243768 - DNA, 27 bp, Artificial Sequence
  Description of Artificial Sequence: Synthetic oligonucleotide
agagagctggaacgccccttgtaccag

SEQ ID NO: 243769 - DNA, 26 bp, Artificial Sequence
  Description of Artificial Sequence: Synthetic oligonucleotide
gagagctggaacgccccttgtaccag

SEQ ID NO: 243770 - DNA, 27 bp, Artificial Sequence
  Description of Artificial Sequence: Synthetic oligonucleotide
agagctggaacgccccttgtaccagct

SEQ ID NO: 243771 - DNA, 26 bp, Artificial Sequence
  Description of Artificial Sequence: Synthetic oligonucleotide
gagctggaacgccccttgtaccagct

SEQ ID NO: 243772 - DNA, 26 bp, Artificial Sequence
  Description of Artificial Sequence: Synthetic oligonucleotide
agctggaacgccccttgtaccagctc

SEQ ID NO: 243773 - DNA, 25 bp, Artificial Sequence
  Description of Artificial Sequence: Synthetic oligonucleotide
gctggaacgccccttgtaccagctc

SEQ ID NO: 243774 - DNA, 27 bp, Artificial Sequence
  Description of Artificial Sequence: Synthetic oligonucleotide
ctggaacgccccttgtaccagctcgta

SEQ ID NO: 243775 - DNA, 28 bp, Artificial Sequence
  Description of Artificial Sequence: Synthetic oligonucleotide
tggaacgccccttgtaccagctcgtaag

SEQ ID NO: 243776 - DNA, 27 bp, Artificial Sequence
  Description of Artificial Sequence: Synthetic oligonucleotide
ggaacgccccttgtaccagctcgtaag

SEQ ID NO: 243777 - DNA, 27 bp, Artificial Sequence
  Description of Artificial Sequence: Synthetic oligonucleotide
gaacgccccttgtaccagctcgtaagc

SEQ ID NO: 243778 - DNA, 28 bp, Artificial Sequence
  Description of Artificial Sequence: Synthetic oligonucleotide
aacgccccttgtaccagctcgtaagcag

SEQ ID NO: 243779 - DNA, 27 bp, Artificial Sequence
  Description of Artificial Sequence: Synthetic oligonucleotide
acgccccttgtaccagctcgtaagcag

SEQ ID NO: 243780 - DNA, 26 bp, Artificial Sequence
  Description of Artificial Sequence: Synthetic oligonucleotide
cgccccttgtaccagctcgtaagcag

SEQ ID NO: 243781 - DNA, 26 bp, Artificial Sequence
  Description of Artificial Sequence: Synthetic oligonucleotide
gccccttgtaccagctcgtaagcagg

SEQ ID NO: 243782 - DNA, 27 bp, Artificial Sequence
  Description of Artificial Sequence: Synthetic oligonucleotide
ccccttgtaccagctcgtaagcagggt

SEQ ID NO: 243783 - DNA, 27 bp, Artificial Sequence
  Description of Artificial Sequence: Synthetic oligonucleotide
cccttgtaccagctcgtaagcagggtg

SEQ ID NO: 243784 - DNA, 27 bp, Artificial Sequence
  Description of Artificial Sequence: Synthetic oligonucleotide
ccttgtaccagctcgtaagcagggtgc

SEQ ID NO: 243785 - DNA, 28 bp, Artificial Sequence
  Description of Artificial Sequence: Synthetic oligonucleotide
cttgtaccagctcgtaagcagggtgctg

SEQ ID NO: 243786 - DNA, 28 bp, Artificial Sequence
  Description of Artificial Sequence: Synthetic oligonucleotide
ttgtaccagctcgtaagcagggtgctgg

SEQ ID NO: 243787 - DNA, 27 bp, Artificial Sequence
  Description of Artificial Sequence: Synthetic oligonucleotide
tgtaccagctcgtaagcagggtgctgg

SEQ ID NO: 243788 - DNA, 27 bp, Artificial Sequence
  Description of Artificial Sequence: Synthetic oligonucleotide
gtaccagctcgtaagcagggtgctgga

SEQ ID NO: 243789 - DNA, 27 bp, Artificial Sequence
  Description of Artificial Sequence: Synthetic oligonucleotide
taccagctcgtaagcagggtgctggac

SEQ ID NO: 243790 - DNA, 27 bp, Artificial Sequence
  Description of Artificial Sequence: Synthetic oligonucleotide
accagctcgtaagcagggtgctggact

SEQ ID NO: 243791 - DNA, 27 bp, Artificial Sequence
  Description of Artificial Sequence: Synthetic oligonucleotide
ccagctcgtaagcagggtgctggactt

SEQ ID NO: 243792 - DNA, 27 bp, Artificial Sequence
  Description of Artificial Sequence: Synthetic oligonucleotide
cagctcgtaagcagggtgctggacttg

SEQ ID NO: 243793 - DNA, 27 bp, Artificial Sequence
  Description of Artificial Sequence: Synthetic oligonucleotide
agctcgtaagcagggtgctggacttgg

SEQ ID NO: 243794 - DNA, 26 bp, Artificial Sequence
  Description of Artificial Sequence: Synthetic oligonucleotide
gctcgtaagcagggtgctggacttgg

SEQ ID NO: 243795 - DNA, 26 bp, Artificial Sequence
  Description of Artificial Sequence: Synthetic oligonucleotide
ctcgtaagcagggtgctggacttggg

SEQ ID NO: 243796 - DNA, 26 bp, Artificial Sequence
  Description of Artificial Sequence: Synthetic oligonucleotide
tcgtaagcagggtgctggacttgggg

SEQ ID NO: 243797 - DNA, 25 bp, Artificial Sequence
  Description of Artificial Sequence: Synthetic oligonucleotide
cgtaagcagggtgctggacttgggg

SEQ ID NO: 243798 - DNA, 26 bp, Artificial Sequence
  Description of Artificial Sequence: Synthetic oligonucleotide
gtaagcagggtgctggacttggggga

SEQ ID NO: 243799 - DNA, 26 bp, Artificial Sequence
  Description of Artificial Sequence: Synthetic oligonucleotide
taagcagggtgctggacttgggggag

SEQ ID NO: 243800 - DNA, 25 bp, Artificial Sequence
  Description of Artificial Sequence: Synthetic oligonucleotide
aagcagggtgctggacttgggggag

SEQ ID NO: 243801 - DNA, 24 bp, Artificial Sequence
  Description of Artificial Sequence: Synthetic oligonucleotide
agcagggtgctggacttgggggag

SEQ ID NO: 243802 - DNA, 23 bp, Artificial Sequence
  Description of Artificial Sequence: Synthetic oligonucleotide
gcagggtgctggacttgggggag

SEQ ID NO: 243803 - DNA, 24 bp, Artificial Sequence
  Description of Artificial Sequence: Synthetic oligonucleotide
cagggtgctggacttgggggagca

SEQ ID NO: 243804 - DNA, 26 bp, Artificial Sequence
  Description of Artificial Sequence: Synthetic oligonucleotide
agggtgctggacttgggggagcagat

SEQ ID NO: 243805 - DNA, 25 bp, Artificial Sequence
  Description of Artificial Sequence: Synthetic oligonucleotide
gggtgctggacttgggggagcagat

SEQ ID NO: 243806 - DNA, 25 bp, Artificial Sequence
  Description of Artificial Sequence: Synthetic oligonucleotide
ggtgctggacttgggggagcagatg

SEQ ID NO: 243807 - DNA, 26 bp, Artificial Sequence
  Description of Artificial Sequence: Synthetic oligonucleotide
gtgctggacttgggggagcagatgct

SEQ ID NO: 243808 - DNA, 27 bp, Artificial Sequence
  Description of Artificial Sequence: Synthetic oligonucleotide
tgctggacttgggggagcagatgctca

SEQ ID NO: 243809 - DNA, 27 bp, Artificial Sequence
  Description of Artificial Sequence: Synthetic oligonucleotide
gctggacttgggggagcagatgctcat

SEQ ID NO: 243810 - DNA, 27 bp, Artificial Sequence
  Description of Artificial Sequence: Synthetic oligonucleotide
ctggacttgggggagcagatgctcatg

SEQ ID NO: 243811 - DNA, 27 bp, Artificial Sequence
  Description of Artificial Sequence: Synthetic oligonucleotide
tggacttgggggagcagatgctcatgc

SEQ ID NO: 243812 - DNA, 27 bp, Artificial Sequence
  Description of Artificial Sequence: Synthetic oligonucleotide
ggacttgggggagcagatgctcatgct

SEQ ID NO: 243813 - DNA, 27 bp, Artificial Sequence
  Description of Artificial Sequence: Synthetic oligonucleotide
gacttgggggagcagatgctcatgctg

SEQ ID NO: 243814 - DNA, 28 bp, Artificial Sequence
  Description of Artificial Sequence: Synthetic oligonucleotide
acttgggggagcagatgctcatgctgag

SEQ ID NO: 243815 - DNA, 27 bp, Artificial Sequence
  Description of Artificial Sequence: Synthetic oligonucleotide
cttgggggagcagatgctcatgctgag

SEQ ID NO: 243816 - DNA, 27 bp, Artificial Sequence
  Description of Artificial Sequence: Synthetic oligonucleotide
ttgggggagcagatgctcatgctgagc

SEQ ID NO: 243817 - DNA, 27 bp, Artificial Sequence
  Description of Artificial Sequence: Synthetic oligonucleotide
tgggggagcagatgctcatgctgagca

SEQ ID NO: 243818 - DNA, 26 bp, Artificial Sequence
  Description of Artificial Sequence: Synthetic oligonucleotide
gggggagcagatgctcatgctgagca

SEQ ID NO: 243819 - DNA, 27 bp, Artificial Sequence
  Description of Artificial Sequence: Synthetic oligonucleotide
ggggagcagatgctcatgctgagcagt

SEQ ID NO: 243820 - DNA, 27 bp, Artificial Sequence
  Description of Artificial Sequence: Synthetic oligonucleotide
gggagcagatgctcatgctgagcagtg

SEQ ID NO: 243821 - DNA, 27 bp, Artificial Sequence
  Description of Artificial Sequence: Synthetic oligonucleotide
ggagcagatgctcatgctgagcagtgg

SEQ ID NO: 243822 - DNA, 27 bp, Artificial Sequence
  Description of Artificial Sequence: Synthetic oligonucleotide
gagcagatgctcatgctgagcagtggg

SEQ ID NO: 243823 - DNA, 27 bp, Artificial Sequence
  Description of Artificial Sequence: Synthetic oligonucleotide
agcagatgctcatgctgagcagtgggc

SEQ ID NO: 243824 - DNA, 27 bp, Artificial Sequence
  Description of Artificial Sequence: Synthetic oligonucleotide
gcagatgctcatgctgagcagtgggct

SEQ ID NO: 243825 - DNA, 27 bp, Artificial Sequence
  Description of Artificial Sequence: Synthetic oligonucleotide
cagatgctcatgctgagcagtgggctg

SEQ ID NO: 243826 - DNA, 27 bp, Artificial Sequence
  Description of Artificial Sequence: Synthetic oligonucleotide
agatgctcatgctgagcagtgggctgc

SEQ ID NO: 243827 - DNA, 27 bp, Artificial Sequence
  Description of Artificial Sequence: Synthetic oligonucleotide
gatgctcatgctgagcagtgggctgct

SEQ ID NO: 243828 - DNA, 27 bp, Artificial Sequence
  Description of Artificial Sequence: Synthetic oligonucleotide
atgctcatgctgagcagtgggctgctg

SEQ ID NO: 243829 - DNA, 26 bp, Artificial Sequence
  Description of Artificial Sequence: Synthetic oligonucleotide
tgctcatgctgagcagtgggctgctg

SEQ ID NO: 243830 - DNA, 25 bp, Artificial Sequence
  Description of Artificial Sequence: Synthetic oligonucleotide
gctcatgctgagcagtgggctgctg

SEQ ID NO: 243831 - DNA, 26 bp, Artificial Sequence
  Description of Artificial Sequence: Synthetic oligonucleotide
ctcatgctgagcagtgggctgctgca

SEQ ID NO: 243832 - DNA, 27 bp, Artificial Sequence
  Description of Artificial Sequence: Synthetic oligonucleotide
tcatgctgagcagtgggctgctgcaga

SEQ ID NO: 243833 - DNA, 27 bp, Artificial Sequence
  Description of Artificial Sequence: Synthetic oligonucleotide
catgctgagcagtgggctgctgcagat

SEQ ID NO: 243834 - DNA, 27 bp, Artificial Sequence
  Description of Artificial Sequence: Synthetic oligonucleotide
atgctgagcagtgggctgctgcagatg

SEQ ID NO: 243835 - DNA, 26 bp, Artificial Sequence
  Description of Artificial Sequence: Synthetic oligonucleotide
tgctgagcagtgggctgctgcagatg

SEQ ID NO: 243836 - DNA, 25 bp, Artificial Sequence
  Description of Artificial Sequence: Synthetic oligonucleotide
gctgagcagtgggctgctgcagatg

SEQ ID NO: 243837 - DNA, 26 bp, Artificial Sequence
  Description of Artificial Sequence: Synthetic oligonucleotide
ctgagcagtgggctgctgcagatgca

SEQ ID NO: 243838 - DNA, 26 bp, Artificial Sequence
  Description of Artificial Sequence: Synthetic oligonucleotide
tgagcagtgggctgctgcagatgcac

SEQ ID NO: 243839 - DNA, 25 bp, Artificial Sequence
  Description of Artificial Sequence: Synthetic oligonucleotide
gagcagtgggctgctgcagatgcac

SEQ ID NO: 243840 - DNA, 27 bp, Artificial Sequence
  Description of Artificial Sequence: Synthetic oligonucleotide
agcagtgggctgctgcagatgcacgat

SEQ ID NO: 243841 - DNA, 26 bp, Artificial Sequence
  Description of Artificial Sequence: Synthetic oligonucleotide
gcagtgggctgctgcagatgcacgat

SEQ ID NO: 243842 - DNA, 26 bp, Artificial Sequence
  Description of Artificial Sequence: Synthetic oligonucleotide
cagtgggctgctgcagatgcacgatg

SEQ ID NO: 243843 - DNA, 26 bp, Artificial Sequence
  Description of Artificial Sequence: Synthetic oligonucleotide
agtgggctgctgcagatgcacgatgg

SEQ ID NO: 243844 - DNA, 25 bp, Artificial Sequence
  Description of Artificial Sequence: Synthetic oligonucleotide
gtgggctgctgcagatgcacgatgg

SEQ ID NO: 243845 - DNA, 25 bp, Artificial Sequence
  Description of Artificial Sequence: Synthetic oligonucleotide
tgggctgctgcagatgcacgatggg

SEQ ID NO: 243846 - DNA, 24 bp, Artificial Sequence
  Description of Artificial Sequence: Synthetic oligonucleotide
gggctgctgcagatgcacgatggg

SEQ ID NO: 243847 - DNA, 25 bp, Artificial Sequence
  Description of Artificial Sequence: Synthetic oligonucleotide
ggctgctgcagatgcacgatgggga

SEQ ID NO: 243848 - DNA, 25 bp, Artificial Sequence
  Description of Artificial Sequence: Synthetic oligonucleotide
gctgctgcagatgcacgatggggag

SEQ ID NO: 243849 - DNA, 26 bp, Artificial Sequence
  Description of Artificial Sequence: Synthetic oligonucleotide
ctgctgcagatgcacgatggggaggt

SEQ ID NO: 243850 - DNA, 27 bp, Artificial Sequence
  Description of Artificial Sequence: Synthetic oligonucleotide
tgctgcagatgcacgatggggaggtca

SEQ ID NO: 243851 - DNA, 26 bp, Artificial Sequence
  Description of Artificial Sequence: Synthetic oligonucleotide
gctgcagatgcacgatggggaggtca

SEQ ID NO: 243852 - DNA, 26 bp, Artificial Sequence
  Description of Artificial Sequence: Synthetic oligonucleotide
ctgcagatgcacgatggggaggtcac

SEQ ID NO: 243853 - DNA, 26 bp, Artificial Sequence
  Description of Artificial Sequence: Synthetic oligonucleotide
tgcagatgcacgatggggaggtcacc

SEQ ID NO: 243854 - DNA, 25 bp, Artificial Sequence
  Description of Artificial Sequence: Synthetic oligonucleotide
gcagatgcacgatggggaggtcacc

SEQ ID NO: 243855 - DNA, 26 bp, Artificial Sequence
  Description of Artificial Sequence: Synthetic oligonucleotide
cagatgcacgatggggaggtcaccca

SEQ ID NO: 243856 - DNA, 26 bp, Artificial Sequence
  Description of Artificial Sequence: Synthetic oligonucleotide
agatgcacgatggggaggtcacccag

SEQ ID NO: 243857 - DNA, 25 bp, Artificial Sequence
  Description of Artificial Sequence: Synthetic oligonucleotide
gatgcacgatggggaggtcacccag

SEQ ID NO: 243858 - DNA, 25 bp, Artificial Sequence
  Description of Artificial Sequence: Synthetic oligonucleotide
atgcacgatggggaggtcacccagg

SEQ ID NO: 243859 - DNA, 24 bp, Artificial Sequence
  Description of Artificial Sequence: Synthetic oligonucleotide
tgcacgatggggaggtcacccagg

SEQ ID NO: 243860 - DNA, 23 bp, Artificial Sequence
  Description of Artificial Sequence: Synthetic oligonucleotide
gcacgatggggaggtcacccagg

SEQ ID NO: 243861 - DNA, 23 bp, Artificial Sequence
  Description of Artificial Sequence: Synthetic oligonucleotide
cacgatggggaggtcacccaggc

SEQ ID NO: 243862 - DNA, 24 bp, Artificial Sequence
  Description of Artificial Sequence: Synthetic oligonucleotide
acgatggggaggtcacccaggcca

SEQ ID NO: 243863 - DNA, 23 bp, Artificial Sequence
  Description of Artificial Sequence: Synthetic oligonucleotide
cgatggggaggtcacccaggcca

SEQ ID NO: 243864 - DNA, 23 bp, Artificial Sequence
  Description of Artificial Sequence: Synthetic oligonucleotide
gatggggaggtcacccaggccag

SEQ ID NO: 243865 - DNA, 23 bp, Artificial Sequence
  Description of Artificial Sequence: Synthetic oligonucleotide
atggggaggtcacccaggccagc

SEQ ID NO: 243866 - DNA, 22 bp, Artificial Sequence
  Description of Artificial Sequence: Synthetic oligonucleotide
tggggaggtcacccaggccagc

SEQ ID NO: 243867 - DNA, 21 bp, Artificial Sequence
  Description of Artificial Sequence: Synthetic oligonucleotide
ggggaggtcacccaggccagc

SEQ ID NO: 243868 - DNA, 22 bp, Artificial Sequence
  Description of Artificial Sequence: Synthetic oligonucleotide
gggaggtcacccaggccagcct

SEQ ID NO: 243869 - DNA, 22 bp, Artificial Sequence
  Description of Artificial Sequence: Synthetic oligonucleotide
ggaggtcacccaggccagcctg

SEQ ID NO: 243870 - DNA, 25 bp, Artificial Sequence
  Description of Artificial Sequence: Synthetic oligonucleotide
gaggtcacccaggccagcctgctat

SEQ ID NO: 243871 - DNA, 25 bp, Artificial Sequence
  Description of Artificial Sequence: Synthetic oligonucleotide
aggtcacccaggccagcctgctatc

SEQ ID NO: 243872 - DNA, 24 bp, Artificial Sequence
  Description of Artificial Sequence: Synthetic oligonucleotide
ggtcacccaggccagcctgctatc

SEQ ID NO: 243873 - DNA, 27 bp, Artificial Sequence
  Description of Artificial Sequence: Synthetic oligonucleotide
gtcacccaggccagcctgctatccttt

SEQ ID NO: 243874 - DNA, 29 bp, Artificial Sequence
  Description of Artificial Sequence: Synthetic oligonucleotide
tcacccaggccagcctgctatcctttatg

SEQ ID NO: 243875 - DNA, 28 bp, Artificial Sequence
  Description of Artificial Sequence: Synthetic oligonucleotide
cacccaggccagcctgctatcctttatg

SEQ ID NO: 243876 - DNA, 30 bp, Artificial Sequence
  Description of Artificial Sequence: Synthetic oligonucleotide
acccaggccagcctgctatcctttatgttc

SEQ ID NO: 243877 - DNA, 29 bp, Artificial Sequence
  Description of Artificial Sequence: Synthetic oligonucleotide
cccaggccagcctgctatcctttatgttc

SEQ ID NO: 243878 - DNA, 31 bp, Artificial Sequence
  Description of Artificial Sequence: Synthetic oligonucleotide
ccaggccagcctgctatcctttatgttctac

SEQ ID NO: 243879 - DNA, 31 bp, Artificial Sequence
  Description of Artificial Sequence: Synthetic oligonucleotide
caggccagcctgctatcctttatgttctacc

SEQ ID NO: 243880 - DNA, 32 bp, Artificial Sequence
  Description of Artificial Sequence: Synthetic oligonucleotide
aggccagcctgctatcctttatgttctaccag

SEQ ID NO: 243881 - DNA, 31 bp, Artificial Sequence
  Description of Artificial Sequence: Synthetic oligonucleotide
ggccagcctgctatcctttatgttctaccag

SEQ ID NO: 243882 - DNA, 31 bp, Artificial Sequence
  Description of Artificial Sequence: Synthetic oligonucleotide
gccagcctgctatcctttatgttctaccagg

SEQ ID NO: 243883 - DNA, 32 bp, Artificial Sequence
  Description of Artificial Sequence: Synthetic oligonucleotide
ccagcctgctatcctttatgttctaccaggtg

SEQ ID NO: 243884 - DNA, 33 bp, Artificial Sequence
  Description of Artificial Sequence: Synthetic oligonucleotide
cagcctgctatcctttatgttctaccaggtgag

SEQ ID NO: 243885 - DNA, 33 bp, Artificial Sequence
  Description of Artificial Sequence: Synthetic oligonucleotide
agcctgctatcctttatgttctaccaggtgagc

SEQ ID NO: 243886 - DNA, 32 bp, Artificial Sequence
  Description of Artificial Sequence: Synthetic oligonucleotide
gcctgctatcctttatgttctaccaggtgagc

SEQ ID NO: 243887 - DNA, 32 bp, Artificial Sequence
  Description of Artificial Sequence: Synthetic oligonucleotide
cctgctatcctttatgttctaccaggtgagcg

SEQ ID NO: 243888 - DNA, 33 bp, Artificial Sequence
  Description of Artificial Sequence: Synthetic oligonucleotide
ctgctatcctttatgttctaccaggtgagcgtg

SEQ ID NO: 243889 - DNA, 33 bp, Artificial Sequence
  Description of Artificial Sequence: Synthetic oligonucleotide
tgctatcctttatgttctaccaggtgagcgtgg

SEQ ID NO: 243890 - DNA, 32 bp, Artificial Sequence
  Description of Artificial Sequence: Synthetic oligonucleotide
gctatcctttatgttctaccaggtgagcgtgg

SEQ ID NO: 243891 - DNA, 32 bp, Artificial Sequence
  Description of Artificial Sequence: Synthetic oligonucleotide
ctatcctttatgttctaccaggtgagcgtggg

SEQ ID NO: 243892 - DNA, 32 bp, Artificial Sequence
  Description of Artificial Sequence: Synthetic oligonucleotide
tatcctttatgttctaccaggtgagcgtgggc

SEQ ID NO: 243893 - DNA, 31 bp, Artificial Sequence
  Description of Artificial Sequence: Synthetic oligonucleotide
atcctttatgttctaccaggtgagcgtgggc

SEQ ID NO: 243894 - DNA, 30 bp, Artificial Sequence
  Description of Artificial Sequence: Synthetic oligonucleotide
tcctttatgttctaccaggtgagcgtgggc

SEQ ID NO: 243895 - DNA, 29 bp, Artificial Sequence
  Description of Artificial Sequence: Synthetic oligonucleotide
cctttatgttctaccaggtgagcgtgggc

SEQ ID NO: 243896 - DNA, 30 bp, Artificial Sequence
  Description of Artificial Sequence: Synthetic oligonucleotide
ctttatgttctaccaggtgagcgtgggcag

SEQ ID NO: 243897 - DNA, 30 bp, Artificial Sequence
  Description of Artificial Sequence: Synthetic oligonucleotide
tttatgttctaccaggtgagcgtgggcagc

SEQ ID NO: 243898 - DNA, 29 bp, Artificial Sequence
  Description of Artificial Sequence: Synthetic oligonucleotide
ttatgttctaccaggtgagcgtgggcagc

SEQ ID NO: 243899 - DNA, 28 bp, Artificial Sequence
  Description of Artificial Sequence: Synthetic oligonucleotide
tatgttctaccaggtgagcgtgggcagc

SEQ ID NO: 243900 - DNA, 27 bp, Artificial Sequence
  Description of Artificial Sequence: Synthetic oligonucleotide
atgttctaccaggtgagcgtgggcagc

SEQ ID NO: 243901 - DNA, 27 bp, Artificial Sequence
  Description of Artificial Sequence: Synthetic oligonucleotide
tgttctaccaggtgagcgtgggcagct

SEQ ID NO: 243902 - DNA, 27 bp, Artificial Sequence
  Description of Artificial Sequence: Synthetic oligonucleotide
gttctaccaggtgagcgtgggcagcta

SEQ ID NO: 243903 - DNA, 28 bp, Artificial Sequence
  Description of Artificial Sequence: Synthetic oligonucleotide
ttctaccaggtgagcgtgggcagctatg

SEQ ID NO: 243904 - DNA, 27 bp, Artificial Sequence
  Description of Artificial Sequence: Synthetic oligonucleotide
tctaccaggtgagcgtgggcagctatg

SEQ ID NO: 243905 - DNA, 27 bp, Artificial Sequence
  Description of Artificial Sequence: Synthetic oligonucleotide
ctaccaggtgagcgtgggcagctatgt

SEQ ID NO: 243906 - DNA, 27 bp, Artificial Sequence
  Description of Artificial Sequence: Synthetic oligonucleotide
taccaggtgagcgtgggcagctatgtg

SEQ ID NO: 243907 - DNA, 26 bp, Artificial Sequence
  Description of Artificial Sequence: Synthetic oligonucleotide
accaggtgagcgtgggcagctatgtg

SEQ ID NO: 243908 - DNA, 25 bp, Artificial Sequence
  Description of Artificial Sequence: Synthetic oligonucleotide
ccaggtgagcgtgggcagctatgtg

SEQ ID NO: 243909 - DNA, 26 bp, Artificial Sequence
  Description of Artificial Sequence: Synthetic oligonucleotide
caggtgagcgtgggcagctatgtgga

SEQ ID NO: 243910 - DNA, 27 bp, Artificial Sequence
  Description of Artificial Sequence: Synthetic oligonucleotide
aggtgagcgtgggcagctatgtggaga

SEQ ID NO: 243911 - DNA, 26 bp, Artificial Sequence
  Description of Artificial Sequence: Synthetic oligonucleotide
ggtgagcgtgggcagctatgtggaga

SEQ ID NO: 243912 - DNA, 26 bp, Artificial Sequence
  Description of Artificial Sequence: Synthetic oligonucleotide
gtgagcgtgggcagctatgtggagac

SEQ ID NO: 243913 - DNA, 26 bp, Artificial Sequence
  Description of Artificial Sequence: Synthetic oligonucleotide
tgagcgtgggcagctatgtggagacc

SEQ ID NO: 243914 - DNA, 25 bp, Artificial Sequence
  Description of Artificial Sequence: Synthetic oligonucleotide
gagcgtgggcagctatgtggagacc

SEQ ID NO: 243915 - DNA, 26 bp, Artificial Sequence
  Description of Artificial Sequence: Synthetic oligonucleotide
agcgtgggcagctatgtggagaccct

SEQ ID NO: 243916 - DNA, 25 bp, Artificial Sequence
  Description of Artificial Sequence: Synthetic oligonucleotide
gcgtgggcagctatgtggagaccct

SEQ ID NO: 243917 - DNA, 25 bp, Artificial Sequence
  Description of Artificial Sequence: Synthetic oligonucleotide
cgtgggcagctatgtggagaccctg

SEQ ID NO: 243918 - DNA, 27 bp, Artificial Sequence
  Description of Artificial Sequence: Synthetic oligonucleotide
gtgggcagctatgtggagaccctggaa

SEQ ID NO: 243919 - DNA, 29 bp, Artificial Sequence
  Description of Artificial Sequence: Synthetic oligonucleotide
tgggcagctatgtggagaccctggaatac

SEQ ID NO: 243920 - DNA, 28 bp, Artificial Sequence
  Description of Artificial Sequence: Synthetic oligonucleotide
gggcagctatgtggagaccctggaatac

SEQ ID NO: 243921 - DNA, 34 bp, Artificial Sequence
  Description of Artificial Sequence: Synthetic oligonucleotide
ggcagctatgtggagaccctggaatacatataag

SEQ ID NO: 243922 - DNA, 34 bp, Artificial Sequence
  Description of Artificial Sequence: Synthetic oligonucleotide
gcagctatgtggagaccctggaatacatataagg

SEQ ID NO: 243923 - DNA, 34 bp, Artificial Sequence
  Description of Artificial Sequence: Synthetic oligonucleotide
cagctatgtggagaccctggaatacatataaggg

SEQ ID NO: 243924 - DNA, 34 bp, Artificial Sequence
  Description of Artificial Sequence: Synthetic oligonucleotide
agctatgtggagaccctggaatacatataagggg

SEQ ID NO: 243925 - DNA, 33 bp, Artificial Sequence
  Description of Artificial Sequence: Synthetic oligonucleotide
gctatgtggagaccctggaatacatataagggg

SEQ ID NO: 243926 - DNA, 37 bp, Artificial Sequence
  Description of Artificial Sequence: Synthetic oligonucleotide
ctatgtggagaccctggaatacatataaggggatatg

SEQ ID NO: 243927 - DNA, 37 bp, Artificial Sequence
  Description of Artificial Sequence: Synthetic oligonucleotide
tatgtggagaccctggaatacatataaggggatatgg

SEQ ID NO: 243928 - DNA, 36 bp, Artificial Sequence
  Description of Artificial Sequence: Synthetic oligonucleotide
atgtggagaccctggaatacatataaggggatatgg

SEQ ID NO: 243929 - DNA, 35 bp, Artificial Sequence
  Description of Artificial Sequence: Synthetic oligonucleotide
tgtggagaccctggaatacatataaggggatatgg

SEQ ID NO: 243930 - DNA, 34 bp, Artificial Sequence
  Description of Artificial Sequence: Synthetic oligonucleotide
gtggagaccctggaatacatataaggggatatgg

SEQ ID NO: 243931 - DNA, 35 bp, Artificial Sequence
  Description of Artificial Sequence: Synthetic oligonucleotide
tggagaccctggaatacatataaggggatatggtc

SEQ ID NO: 243932 - DNA, 34 bp, Artificial Sequence
  Description of Artificial Sequence: Synthetic oligonucleotide
ggagaccctggaatacatataaggggatatggtc

SEQ ID NO: 243933 - DNA, 35 bp, Artificial Sequence
  Description of Artificial Sequence: Synthetic oligonucleotide
gagaccctggaatacatataaggggatatggtcag

SEQ ID NO: 243934 - DNA, 35 bp, Artificial Sequence
  Description of Artificial Sequence: Synthetic oligonucleotide
agaccctggaatacatataaggggatatggtcagc

SEQ ID NO: 243935 - DNA, 34 bp, Artificial Sequence
  Description of Artificial Sequence: Synthetic oligonucleotide
gaccctggaatacatataaggggatatggtcagc

SEQ ID NO: 243936 - DNA, 37 bp, Artificial Sequence
  Description of Artificial Sequence: Synthetic oligonucleotide
accctggaatacatataaggggatatggtcagcaatg

SEQ ID NO: 243937 - DNA, 36 bp, Artificial Sequence
  Description of Artificial Sequence: Synthetic oligonucleotide
ccctggaatacatataaggggatatggtcagcaatg

SEQ ID NO: 243938 - DNA, 37 bp, Artificial Sequence
  Description of Artificial Sequence: Synthetic oligonucleotide
cctggaatacatataaggggatatggtcagcaatgag

SEQ ID NO: 243939 - DNA, 37 bp, Artificial Sequence
  Description of Artificial Sequence: Synthetic oligonucleotide
ctggaatacatataaggggatatggtcagcaatgagg

SEQ ID NO: 243940 - DNA, 37 bp, Artificial Sequence
  Description of Artificial Sequence: Synthetic oligonucleotide
tggaatacatataaggggatatggtcagcaatgaggg

SEQ ID NO: 243941 - DNA, 36 bp, Artificial Sequence
  Description of Artificial Sequence: Synthetic oligonucleotide
ggaatacatataaggggatatggtcagcaatgaggg

SEQ ID NO: 243942 - DNA, 37 bp, Artificial Sequence
  Description of Artificial Sequence: Synthetic oligonucleotide
gaatacatataaggggatatggtcagcaatgagggag

SEQ ID NO: 243943 - DNA, 37 bp, Artificial Sequence
  Description of Artificial Sequence: Synthetic oligonucleotide
aatacatataaggggatatggtcagcaatgagggagc

SEQ ID NO: 243944 - DNA, 36 bp, Artificial Sequence
  Description of Artificial Sequence: Synthetic oligonucleotide
atacatataaggggatatggtcagcaatgagggagc

SEQ ID NO: 243945 - DNA, 35 bp, Artificial Sequence
  Description of Artificial Sequence: Synthetic oligonucleotide
tacatataaggggatatggtcagcaatgagggagc

SEQ ID NO: 243946 - DNA, 34 bp, Artificial Sequence
  Description of Artificial Sequence: Synthetic oligonucleotide
acatataaggggatatggtcagcaatgagggagc

SEQ ID NO: 243947 - DNA, 33 bp, Artificial Sequence
  Description of Artificial Sequence: Synthetic oligonucleotide
catataaggggatatggtcagcaatgagggagc

SEQ ID NO: 243948 - DNA, 34 bp, Artificial Sequence
  Description of Artificial Sequence: Synthetic oligonucleotide
atataaggggatatggtcagcaatgagggagctg

SEQ ID NO: 243949 - DNA, 33 bp, Artificial Sequence
  Description of Artificial Sequence: Synthetic oligonucleotide
tataaggggatatggtcagcaatgagggagctg

SEQ ID NO: 243950 - DNA, 32 bp, Artificial Sequence
  Description of Artificial Sequence: Synthetic oligonucleotide
ataaggggatatggtcagcaatgagggagctg

SEQ ID NO: 243951 - DNA, 31 bp, Artificial Sequence
  Description of Artificial Sequence: Synthetic oligonucleotide
taaggggatatggtcagcaatgagggagctg

SEQ ID NO: 243952 - DNA, 30 bp, Artificial Sequence
  Description of Artificial Sequence: Synthetic oligonucleotide
aaggggatatggtcagcaatgagggagctg

SEQ ID NO: 243953 - DNA, 29 bp, Artificial Sequence
  Description of Artificial Sequence: Synthetic oligonucleotide
aggggatatggtcagcaatgagggagctg

SEQ ID NO: 243954 - DNA, 28 bp, Artificial Sequence
  Description of Artificial Sequence: Synthetic oligonucleotide
ggggatatggtcagcaatgagggagctg

SEQ ID NO: 243955 - DNA, 28 bp, Artificial Sequence
  Description of Artificial Sequence: Synthetic oligonucleotide
gggatatggtcagcaatgagggagctgc

SEQ ID NO: 243956 - DNA, 29 bp, Artificial Sequence
  Description of Artificial Sequence: Synthetic oligonucleotide
ggatatggtcagcaatgagggagctgctg

SEQ ID NO: 243957 - DNA, 30 bp, Artificial Sequence
  Description of Artificial Sequence: Synthetic oligonucleotide
gatatggtcagcaatgagggagctgctgag

SEQ ID NO: 243958 - DNA, 32 bp, Artificial Sequence
  Description of Artificial Sequence: Synthetic oligonucleotide
atatggtcagcaatgagggagctgctgagaag

SEQ ID NO: 243959 - DNA, 31 bp, Artificial Sequence
  Description of Artificial Sequence: Synthetic oligonucleotide
tatggtcagcaatgagggagctgctgagaag

SEQ ID NO: 243960 - DNA, 30 bp, Artificial Sequence
  Description of Artificial Sequence: Synthetic oligonucleotide
atggtcagcaatgagggagctgctgagaag

SEQ ID NO: 243961 - DNA, 29 bp, Artificial Sequence
  Description of Artificial Sequence: Synthetic oligonucleotide
tggtcagcaatgagggagctgctgagaag

SEQ ID NO: 243962 - DNA, 28 bp, Artificial Sequence
  Description of Artificial Sequence: Synthetic oligonucleotide
ggtcagcaatgagggagctgctgagaag

SEQ ID NO: 243963 - DNA, 28 bp, Artificial Sequence
  Description of Artificial Sequence: Synthetic oligonucleotide
gtcagcaatgagggagctgctgagaagg

SEQ ID NO: 243964 - DNA, 32 bp, Artificial Sequence
  Description of Artificial Sequence: Synthetic oligonucleotide
tcagcaatgagggagctgctgagaaggttatc

SEQ ID NO: 243965 - DNA, 31 bp, Artificial Sequence
  Description of Artificial Sequence: Synthetic oligonucleotide
cagcaatgagggagctgctgagaaggttatc

SEQ ID NO: 243966 - DNA, 32 bp, Artificial Sequence
  Description of Artificial Sequence: Synthetic oligonucleotide
agcaatgagggagctgctgagaaggttatctc

SEQ ID NO: 243967 - DNA, 31 bp, Artificial Sequence
  Description of Artificial Sequence: Synthetic oligonucleotide
gcaatgagggagctgctgagaaggttatctc

SEQ ID NO: 243968 - DNA, 31 bp, Artificial Sequence
  Description of Artificial Sequence: Synthetic oligonucleotide
caatgagggagctgctgagaaggttatctcc

SEQ ID NO: 243969 - DNA, 33 bp, Artificial Sequence
  Description of Artificial Sequence: Synthetic oligonucleotide
aatgagggagctgctgagaaggttatctcctac

SEQ ID NO: 243970 - DNA, 32 bp, Artificial Sequence
  Description of Artificial Sequence: Synthetic oligonucleotide
atgagggagctgctgagaaggttatctcctac

SEQ ID NO: 243971 - DNA, 31 bp, Artificial Sequence
  Description of Artificial Sequence: Synthetic oligonucleotide
tgagggagctgctgagaaggttatctcctac

SEQ ID NO: 243972 - DNA, 30 bp, Artificial Sequence
  Description of Artificial Sequence: Synthetic oligonucleotide
gagggagctgctgagaaggttatctcctac

SEQ ID NO: 243973 - DNA, 32 bp, Artificial Sequence
  Description of Artificial Sequence: Synthetic oligonucleotide
agggagctgctgagaaggttatctcctacaag

SEQ ID NO: 243974 - DNA, 31 bp, Artificial Sequence
  Description of Artificial Sequence: Synthetic oligonucleotide
gggagctgctgagaaggttatctcctacaag

SEQ ID NO: 243975 - DNA, 31 bp, Artificial Sequence
  Description of Artificial Sequence: Synthetic oligonucleotide
ggagctgctgagaaggttatctcctacaagg

SEQ ID NO: 243976 - DNA, 32 bp, Artificial Sequence
  Description of Artificial Sequence: Synthetic oligonucleotide
gagctgctgagaaggttatctcctacaaggac

SEQ ID NO: 243977 - DNA, 32 bp, Artificial Sequence
  Description of Artificial Sequence: Synthetic oligonucleotide
agctgctgagaaggttatctcctacaaggacc

SEQ ID NO: 243978 - DNA, 31 bp, Artificial Sequence
  Description of Artificial Sequence: Synthetic oligonucleotide
gctgctgagaaggttatctcctacaaggacc

SEQ ID NO: 243979 - DNA, 31 bp, Artificial Sequence
  Description of Artificial Sequence: Synthetic oligonucleotide
ctgctgagaaggttatctcctacaaggaccg

SEQ ID NO: 243980 - DNA, 32 bp, Artificial Sequence
  Description of Artificial Sequence: Synthetic oligonucleotide
tgctgagaaggttatctcctacaaggaccgac

SEQ ID NO: 243981 - DNA, 31 bp, Artificial Sequence
  Description of Artificial Sequence: Synthetic oligonucleotide
gctgagaaggttatctcctacaaggaccgac

SEQ ID NO: 243982 - DNA, 32 bp, Artificial Sequence
  Description of Artificial Sequence: Synthetic oligonucleotide
ctgagaaggttatctcctacaaggaccgacac

SEQ ID NO: 243983 - DNA, 32 bp, Artificial Sequence
  Description of Artificial Sequence: Synthetic oligonucleotide
tgagaaggttatctcctacaaggaccgacacc

SEQ ID NO: 243984 - DNA, 31 bp, Artificial Sequence
  Description of Artificial Sequence: Synthetic oligonucleotide
gagaaggttatctcctacaaggaccgacacc

SEQ ID NO: 243985 - DNA, 31 bp, Artificial Sequence
  Description of Artificial Sequence: Synthetic oligonucleotide
agaaggttatctcctacaaggaccgacaccc

SEQ ID NO: 243986 - DNA, 30 bp, Artificial Sequence
  Description of Artificial Sequence: Synthetic oligonucleotide
gaaggttatctcctacaaggaccgacaccc

SEQ ID NO: 243987 - DNA, 34 bp, Artificial Sequence
  Description of Artificial Sequence: Synthetic oligonucleotide
aaggttatctcctacaaggaccgacacccaaatc

SEQ ID NO: 243988 - DNA, 33 bp, Artificial Sequence
  Description of Artificial Sequence: Synthetic oligonucleotide
aggttatctcctacaaggaccgacacccaaatc

SEQ ID NO: 243989 - DNA, 32 bp, Artificial Sequence
  Description of Artificial Sequence: Synthetic oligonucleotide
ggttatctcctacaaggaccgacacccaaatc

SEQ ID NO: 243990 - DNA, 33 bp, Artificial Sequence
  Description of Artificial Sequence: Synthetic oligonucleotide
gttatctcctacaaggaccgacacccaaatctg

SEQ ID NO: 243991 - DNA, 33 bp, Artificial Sequence
  Description of Artificial Sequence: Synthetic oligonucleotide
ttatctcctacaaggaccgacacccaaatctgg

SEQ ID NO: 243992 - DNA, 32 bp, Artificial Sequence
  Description of Artificial Sequence: Synthetic oligonucleotide
tatctcctacaaggaccgacacccaaatctgg

SEQ ID NO: 243993 - DNA, 31 bp, Artificial Sequence
  Description of Artificial Sequence: Synthetic oligonucleotide
atctcctacaaggaccgacacccaaatctgg

SEQ ID NO: 243994 - DNA, 30 bp, Artificial Sequence
  Description of Artificial Sequence: Synthetic oligonucleotide
tctcctacaaggaccgacacccaaatctgg

SEQ ID NO: 243995 - DNA, 29 bp, Artificial Sequence
  Description of Artificial Sequence: Synthetic oligonucleotide
ctcctacaaggaccgacacccaaatctgg

SEQ ID NO: 243996 - DNA, 29 bp, Artificial Sequence
  Description of Artificial Sequence: Synthetic oligonucleotide
tcctacaaggaccgacacccaaatctggc

SEQ ID NO: 243997 - DNA, 28 bp, Artificial Sequence
  Description of Artificial Sequence: Synthetic oligonucleotide
cctacaaggaccgacacccaaatctggc

SEQ ID NO: 243998 - DNA, 30 bp, Artificial Sequence
  Description of Artificial Sequence: Synthetic oligonucleotide
ctacaaggaccgacacccaaatctggcttc

SEQ ID NO: 243999 - DNA, 31 bp, Artificial Sequence
  Description of Artificial Sequence: Synthetic oligonucleotide
tacaaggaccgacacccaaatctggcttcac

SEQ ID NO: 244000 - DNA, 30 bp, Artificial Sequence
  Description of Artificial Sequence: Synthetic oligonucleotide
acaaggaccgacacccaaatctggcttcac

SEQ ID NO: 244001 - DNA, 29 bp, Artificial Sequence
  Description of Artificial Sequence: Synthetic oligonucleotide
caaggaccgacacccaaatctggcttcac

SEQ ID NO: 244002 - DNA, 29 bp, Artificial Sequence
  Description of Artificial Sequence: Synthetic oligonucleotide
aaggaccgacacccaaatctggcttcacc

SEQ ID NO: 244003 - DNA, 28 bp, Artificial Sequence
  Description of Artificial Sequence: Synthetic oligonucleotide
aggaccgacacccaaatctggcttcacc

SEQ ID NO: 244004 - DNA, 27 bp, Artificial Sequence
  Description of Artificial Sequence: Synthetic oligonucleotide
ggaccgacacccaaatctggcttcacc

SEQ ID NO: 244005 - DNA, 28 bp, Artificial Sequence
  Description of Artificial Sequence: Synthetic oligonucleotide
gaccgacacccaaatctggcttcacctg

SEQ ID NO: 244006 - DNA, 28 bp, Artificial Sequence
  Description of Artificial Sequence: Synthetic oligonucleotide
accgacacccaaatctggcttcacctgc

SEQ ID NO: 244007 - DNA, 27 bp, Artificial Sequence
  Description of Artificial Sequence: Synthetic oligonucleotide
ccgacacccaaatctggcttcacctgc

SEQ ID NO: 244008 - DNA, 27 bp, Artificial Sequence
  Description of Artificial Sequence: Synthetic oligonucleotide
cgacacccaaatctggcttcacctgcc

SEQ ID NO: 244009 - DNA, 28 bp, Artificial Sequence
  Description of Artificial Sequence: Synthetic oligonucleotide
gacacccaaatctggcttcacctgccac

SEQ ID NO: 244010 - DNA, 28 bp, Artificial Sequence
  Description of Artificial Sequence: Synthetic oligonucleotide
acacccaaatctggcttcacctgccacg

SEQ ID NO: 244011 - DNA, 27 bp, Artificial Sequence
  Description of Artificial Sequence: Synthetic oligonucleotide
cacccaaatctggcttcacctgccacg

SEQ ID NO: 244012 - DNA, 27 bp, Artificial Sequence
  Description of Artificial Sequence: Synthetic oligonucleotide
acccaaatctggcttcacctgccacgc

SEQ ID NO: 244013 - DNA, 27 bp, Artificial Sequence
  Description of Artificial Sequence: Synthetic oligonucleotide
cccaaatctggcttcacctgccacgct

SEQ ID NO: 244014 - DNA, 28 bp, Artificial Sequence
  Description of Artificial Sequence: Synthetic oligonucleotide
ccaaatctggcttcacctgccacgcttg

SEQ ID NO: 244015 - DNA, 28 bp, Artificial Sequence
  Description of Artificial Sequence: Synthetic oligonucleotide
caaatctggcttcacctgccacgcttgc

SEQ ID NO: 244016 - DNA, 28 bp, Artificial Sequence
  Description of Artificial Sequence: Synthetic oligonucleotide
aaatctggcttcacctgccacgcttgcg

SEQ ID NO: 244017 - DNA, 27 bp, Artificial Sequence
  Description of Artificial Sequence: Synthetic oligonucleotide
aatctggcttcacctgccacgcttgcg

SEQ ID NO: 244018 - DNA, 26 bp, Artificial Sequence
  Description of Artificial Sequence: Synthetic oligonucleotide
atctggcttcacctgccacgcttgcg

SEQ ID NO: 244019 - DNA, 25 bp, Artificial Sequence
  Description of Artificial Sequence: Synthetic oligonucleotide
tctggcttcacctgccacgcttgcg

SEQ ID NO: 244020 - DNA, 24 bp, Artificial Sequence
  Description of Artificial Sequence: Synthetic oligonucleotide
ctggcttcacctgccacgcttgcg

SEQ ID NO: 244021 - DNA, 24 bp, Artificial Sequence
  Description of Artificial Sequence: Synthetic oligonucleotide
tggcttcacctgccacgcttgcgc

SEQ ID NO: 244022 - DNA, 23 bp, Artificial Sequence
  Description of Artificial Sequence: Synthetic oligonucleotide
ggcttcacctgccacgcttgcgc

SEQ ID NO: 244023 - DNA, 23 bp, Artificial Sequence
  Description of Artificial Sequence: Synthetic oligonucleotide
gcttcacctgccacgcttgcgcc

SEQ ID NO: 244024 - DNA, 24 bp, Artificial Sequence
  Description of Artificial Sequence: Synthetic oligonucleotide
cttcacctgccacgcttgcgccca

SEQ ID NO: 244025 - DNA, 24 bp, Artificial Sequence
  Description of Artificial Sequence: Synthetic oligonucleotide
ttcacctgccacgcttgcgcccac

SEQ ID NO: 244026 - DNA, 23 bp, Artificial Sequence
  Description of Artificial Sequence: Synthetic oligonucleotide
tcacctgccacgcttgcgcccac

SEQ ID NO: 244027 - DNA, 22 bp, Artificial Sequence
  Description of Artificial Sequence: Synthetic oligonucleotide
cacctgccacgcttgcgcccac

SEQ ID NO: 244028 - DNA, 23 bp, Artificial Sequence
  Description of Artificial Sequence: Synthetic oligonucleotide
acctgccacgcttgcgcccacca

SEQ ID NO: 244029 - DNA, 22 bp, Artificial Sequence
  Description of Artificial Sequence: Synthetic oligonucleotide
cctgccacgcttgcgcccacca

SEQ ID NO: 244030 - DNA, 23 bp, Artificial Sequence
  Description of Artificial Sequence: Synthetic oligonucleotide
ctgccacgcttgcgcccaccact

SEQ ID NO: 244031 - DNA, 24 bp, Artificial Sequence
  Description of Artificial Sequence: Synthetic oligonucleotide
tgccacgcttgcgcccaccactgt

SEQ ID NO: 244032 - DNA, 23 bp, Artificial Sequence
  Description of Artificial Sequence: Synthetic oligonucleotide
gccacgcttgcgcccaccactgt

SEQ ID NO: 244033 - DNA, 23 bp, Artificial Sequence
  Description of Artificial Sequence: Synthetic oligonucleotide
ccacgcttgcgcccaccactgtg

SEQ ID NO: 244034 - DNA, 24 bp, Artificial Sequence
  Description of Artificial Sequence: Synthetic oligonucleotide
cacgcttgcgcccaccactgtgca

SEQ ID NO: 244035 - DNA, 24 bp, Artificial Sequence
  Description of Artificial Sequence: Synthetic oligonucleotide
acgcttgcgcccaccactgtgcag

SEQ ID NO: 244036 - DNA, 23 bp, Artificial Sequence
  Description of Artificial Sequence: Synthetic oligonucleotide
cgcttgcgcccaccactgtgcag

SEQ ID NO: 244037 - DNA, 23 bp, Artificial Sequence
  Description of Artificial Sequence: Synthetic oligonucleotide
gcttgcgcccaccactgtgcagg

SEQ ID NO: 244038 - DNA, 23 bp, Artificial Sequence
  Description of Artificial Sequence: Synthetic oligonucleotide
cttgcgcccaccactgtgcaggg

SEQ ID NO: 244039 - DNA, 23 bp, Artificial Sequence
  Description of Artificial Sequence: Synthetic oligonucleotide
ttgcgcccaccactgtgcagggg

SEQ ID NO: 244040 - DNA, 22 bp, Artificial Sequence
  Description of Artificial Sequence: Synthetic oligonucleotide
tgcgcccaccactgtgcagggg

SEQ ID NO: 244041 - DNA, 21 bp, Artificial Sequence
  Description of Artificial Sequence: Synthetic oligonucleotide
gcgcccaccactgtgcagggg

SEQ ID NO: 244042 - DNA, 23 bp, Artificial Sequence
  Description of Artificial Sequence: Synthetic oligonucleotide
cgcccaccactgtgcagggggat

SEQ ID NO: 244043 - DNA, 24 bp, Artificial Sequence
  Description of Artificial Sequence: Synthetic oligonucleotide
gcccaccactgtgcagggggatgt

SEQ ID NO: 244044 - DNA, 27 bp, Artificial Sequence
  Description of Artificial Sequence: Synthetic oligonucleotide
cccaccactgtgcagggggatgtgaaa

SEQ ID NO: 244045 - DNA, 29 bp, Artificial Sequence
  Description of Artificial Sequence: Synthetic oligonucleotide
ccaccactgtgcagggggatgtgaaattg

SEQ ID NO: 244046 - DNA, 29 bp, Artificial Sequence
  Description of Artificial Sequence: Synthetic oligonucleotide
caccactgtgcagggggatgtgaaattgc

SEQ ID NO: 244047 - DNA, 31 bp, Artificial Sequence
  Description of Artificial Sequence: Synthetic oligonucleotide
accactgtgcagggggatgtgaaattgcaag

SEQ ID NO: 244048 - DNA, 30 bp, Artificial Sequence
  Description of Artificial Sequence: Synthetic oligonucleotide
ccactgtgcagggggatgtgaaattgcaag

SEQ ID NO: 244049 - DNA, 31 bp, Artificial Sequence
  Description of Artificial Sequence: Synthetic oligonucleotide
cactgtgcagggggatgtgaaattgcaagac

SEQ ID NO: 244050 - DNA, 31 bp, Artificial Sequence
  Description of Artificial Sequence: Synthetic oligonucleotide
actgtgcagggggatgtgaaattgcaagacg

SEQ ID NO: 244051 - DNA, 30 bp, Artificial Sequence
  Description of Artificial Sequence: Synthetic oligonucleotide
ctgtgcagggggatgtgaaattgcaagacg

SEQ ID NO: 244052 - DNA, 31 bp, Artificial Sequence
  Description of Artificial Sequence: Synthetic oligonucleotide
tgtgcagggggatgtgaaattgcaagacgtc

SEQ ID NO: 244053 - DNA, 30 bp, Artificial Sequence
  Description of Artificial Sequence: Synthetic oligonucleotide
gtgcagggggatgtgaaattgcaagacgtc

SEQ ID NO: 244054 - DNA, 31 bp, Artificial Sequence
  Description of Artificial Sequence: Synthetic oligonucleotide
tgcagggggatgtgaaattgcaagacgtcac

SEQ ID NO: 244055 - DNA, 30 bp, Artificial Sequence
  Description of Artificial Sequence: Synthetic oligonucleotide
gcagggggatgtgaaattgcaagacgtcac

SEQ ID NO: 244056 - DNA, 30 bp, Artificial Sequence
  Description of Artificial Sequence: Synthetic oligonucleotide
cagggggatgtgaaattgcaagacgtcacc

SEQ ID NO: 244057 - DNA, 33 bp, Artificial Sequence
  Description of Artificial Sequence: Synthetic oligonucleotide
agggggatgtgaaattgcaagacgtcacctttg

SEQ ID NO: 244058 - DNA, 32 bp, Artificial Sequence
  Description of Artificial Sequence: Synthetic oligonucleotide
gggggatgtgaaattgcaagacgtcacctttg

SEQ ID NO: 244059 - DNA, 32 bp, Artificial Sequence
  Description of Artificial Sequence: Synthetic oligonucleotide
ggggatgtgaaattgcaagacgtcacctttgc

SEQ ID NO: 244060 - DNA, 36 bp, Artificial Sequence
  Description of Artificial Sequence: Synthetic oligonucleotide
gggatgtgaaattgcaagacgtcacctttgcatttc

SEQ ID NO: 244061 - DNA, 36 bp, Artificial Sequence
  Description of Artificial Sequence: Synthetic oligonucleotide
ggatgtgaaattgcaagacgtcacctttgcatttcc

SEQ ID NO: 244062 - DNA, 36 bp, Artificial Sequence
  Description of Artificial Sequence: Synthetic oligonucleotide
gatgtgaaattgcaagacgtcacctttgcatttccc

SEQ ID NO: 244063 - DNA, 39 bp, Artificial Sequence
  Description of Artificial Sequence: Synthetic oligonucleotide
atgtgaaattgcaagacgtcacctttgcatttcccaatc

SEQ ID NO: 244064 - DNA, 38 bp, Artificial Sequence
  Description of Artificial Sequence: Synthetic oligonucleotide
tgtgaaattgcaagacgtcacctttgcatttcccaatc

SEQ ID NO: 244065 - DNA, 37 bp, Artificial Sequence
  Description of Artificial Sequence: Synthetic oligonucleotide
gtgaaattgcaagacgtcacctttgcatttcccaatc

SEQ ID NO: 244066 - DNA, 37 bp, Artificial Sequence
  Description of Artificial Sequence: Synthetic oligonucleotide
tgaaattgcaagacgtcacctttgcatttcccaatcg

SEQ ID NO: 244067 - DNA, 36 bp, Artificial Sequence
  Description of Artificial Sequence: Synthetic oligonucleotide
gaaattgcaagacgtcacctttgcatttcccaatcg

SEQ ID NO: 244068 - DNA, 36 bp, Artificial Sequence
  Description of Artificial Sequence: Synthetic oligonucleotide
aaattgcaagacgtcacctttgcatttcccaatcgg

SEQ ID NO: 244069 - DNA, 35 bp, Artificial Sequence
  Description of Artificial Sequence: Synthetic oligonucleotide
aattgcaagacgtcacctttgcatttcccaatcgg

SEQ ID NO: 244070 - DNA, 34 bp, Artificial Sequence
  Description of Artificial Sequence: Synthetic oligonucleotide
attgcaagacgtcacctttgcatttcccaatcgg

SEQ ID NO: 244071 - DNA, 33 bp, Artificial Sequence
  Description of Artificial Sequence: Synthetic oligonucleotide
ttgcaagacgtcacctttgcatttcccaatcgg

SEQ ID NO: 244072 - DNA, 32 bp, Artificial Sequence
  Description of Artificial Sequence: Synthetic oligonucleotide
tgcaagacgtcacctttgcatttcccaatcgg

SEQ ID NO: 244073 - DNA, 31 bp, Artificial Sequence
  Description of Artificial Sequence: Synthetic oligonucleotide
gcaagacgtcacctttgcatttcccaatcgg

SEQ ID NO: 244074 - DNA, 31 bp, Artificial Sequence
  Description of Artificial Sequence: Synthetic oligonucleotide
caagacgtcacctttgcatttcccaatcggc

SEQ ID NO: 244075 - DNA, 31 bp, Artificial Sequence
  Description of Artificial Sequence: Synthetic oligonucleotide
aagacgtcacctttgcatttcccaatcggcc

SEQ ID NO: 244076 - DNA, 30 bp, Artificial Sequence
  Description of Artificial Sequence: Synthetic oligonucleotide
agacgtcacctttgcatttcccaatcggcc

SEQ ID NO: 244077 - DNA, 29 bp, Artificial Sequence
  Description of Artificial Sequence: Synthetic oligonucleotide
gacgtcacctttgcatttcccaatcggcc

SEQ ID NO: 244078 - DNA, 30 bp, Artificial Sequence
  Description of Artificial Sequence: Synthetic oligonucleotide
acgtcacctttgcatttcccaatcggcctg

SEQ ID NO: 244079 - DNA, 29 bp, Artificial Sequence
  Description of Artificial Sequence: Synthetic oligonucleotide
cgtcacctttgcatttcccaatcggcctg

SEQ ID NO: 244080 - DNA, 30 bp, Artificial Sequence
  Description of Artificial Sequence: Synthetic oligonucleotide
gtcacctttgcatttcccaatcggcctgac

SEQ ID NO: 244081 - DNA, 31 bp, Artificial Sequence
  Description of Artificial Sequence: Synthetic oligonucleotide
tcacctttgcatttcccaatcggcctgacag

SEQ ID NO: 244082 - DNA, 30 bp, Artificial Sequence
  Description of Artificial Sequence: Synthetic oligonucleotide
cacctttgcatttcccaatcggcctgacag

SEQ ID NO: 244083 - DNA, 30 bp, Artificial Sequence
  Description of Artificial Sequence: Synthetic oligonucleotide
acctttgcatttcccaatcggcctgacagg

SEQ ID NO: 244084 - DNA, 29 bp, Artificial Sequence
  Description of Artificial Sequence: Synthetic oligonucleotide
cctttgcatttcccaatcggcctgacagg

SEQ ID NO: 244085 - DNA, 29 bp, Artificial Sequence
  Description of Artificial Sequence: Synthetic oligonucleotide
ctttgcatttcccaatcggcctgacaggg

SEQ ID NO: 244086 - DNA, 29 bp, Artificial Sequence
  Description of Artificial Sequence: Synthetic oligonucleotide
tttgcatttcccaatcggcctgacagggc

SEQ ID NO: 244087 - DNA, 28 bp, Artificial Sequence
  Description of Artificial Sequence: Synthetic oligonucleotide
ttgcatttcccaatcggcctgacagggc

SEQ ID NO: 244088 - DNA, 27 bp, Artificial Sequence
  Description of Artificial Sequence: Synthetic oligonucleotide
tgcatttcccaatcggcctgacagggc

SEQ ID NO: 244089 - DNA, 27 bp, Artificial Sequence
  Description of Artificial Sequence: Synthetic oligonucleotide
gcatttcccaatcggcctgacagggct

SEQ ID NO: 244090 - DNA, 27 bp, Artificial Sequence
  Description of Artificial Sequence: Synthetic oligonucleotide
catttcccaatcggcctgacagggctg

SEQ ID NO: 244091 - DNA, 28 bp, Artificial Sequence
  Description of Artificial Sequence: Synthetic oligonucleotide
atttcccaatcggcctgacagggctgtg

SEQ ID NO: 244092 - DNA, 27 bp, Artificial Sequence
  Description of Artificial Sequence: Synthetic oligonucleotide
tttcccaatcggcctgacagggctgtg

SEQ ID NO: 244093 - DNA, 26 bp, Artificial Sequence
  Description of Artificial Sequence: Synthetic oligonucleotide
ttcccaatcggcctgacagggctgtg

SEQ ID NO: 244094 - DNA, 25 bp, Artificial Sequence
  Description of Artificial Sequence: Synthetic oligonucleotide
tcccaatcggcctgacagggctgtg

SEQ ID NO: 244095 - DNA, 24 bp, Artificial Sequence
  Description of Artificial Sequence: Synthetic oligonucleotide
cccaatcggcctgacagggctgtg

SEQ ID NO: 244096 - DNA, 25 bp, Artificial Sequence
  Description of Artificial Sequence: Synthetic oligonucleotide
ccaatcggcctgacagggctgtgct

SEQ ID NO: 244097 - DNA, 27 bp, Artificial Sequence
  Description of Artificial Sequence: Synthetic oligonucleotide
caatcggcctgacagggctgtgctcat

SEQ ID NO: 244098 - DNA, 27 bp, Artificial Sequence
  Description of Artificial Sequence: Synthetic oligonucleotide
aatcggcctgacagggctgtgctcatg

SEQ ID NO: 244099 - DNA, 26 bp, Artificial Sequence
  Description of Artificial Sequence: Synthetic oligonucleotide
atcggcctgacagggctgtgctcatg

SEQ ID NO: 244100 - DNA, 25 bp, Artificial Sequence
  Description of Artificial Sequence: Synthetic oligonucleotide
tcggcctgacagggctgtgctcatg

SEQ ID NO: 244101 - DNA, 24 bp, Artificial Sequence
  Description of Artificial Sequence: Synthetic oligonucleotide
cggcctgacagggctgtgctcatg

SEQ ID NO: 244102 - DNA, 24 bp, Artificial Sequence
  Description of Artificial Sequence: Synthetic oligonucleotide
ggcctgacagggctgtgctcatgg

SEQ ID NO: 244103 - DNA, 24 bp, Artificial Sequence
  Description of Artificial Sequence: Synthetic oligonucleotide
gcctgacagggctgtgctcatggg

SEQ ID NO: 244104 - DNA, 24 bp, Artificial Sequence
  Description of Artificial Sequence: Synthetic oligonucleotide
cctgacagggctgtgctcatgggg

SEQ ID NO: 244105 - DNA, 25 bp, Artificial Sequence
  Description of Artificial Sequence: Synthetic oligonucleotide
ctgacagggctgtgctcatggggct

SEQ ID NO: 244106 - DNA, 26 bp, Artificial Sequence
  Description of Artificial Sequence: Synthetic oligonucleotide
tgacagggctgtgctcatggggctga

SEQ ID NO: 244107 - DNA, 25 bp, Artificial Sequence
  Description of Artificial Sequence: Synthetic oligonucleotide
gacagggctgtgctcatggggctga

SEQ ID NO: 244108 - DNA, 25 bp, Artificial Sequence
  Description of Artificial Sequence: Synthetic oligonucleotide
acagggctgtgctcatggggctgac

SEQ ID NO: 244109 - DNA, 24 bp, Artificial Sequence
  Description of Artificial Sequence: Synthetic oligonucleotide
cagggctgtgctcatggggctgac

SEQ ID NO: 244110 - DNA, 27 bp, Artificial Sequence
  Description of Artificial Sequence: Synthetic oligonucleotide
agggctgtgctcatggggctgaccttt

SEQ ID NO: 244111 - DNA, 27 bp, Artificial Sequence
  Description of Artificial Sequence: Synthetic oligonucleotide
gggctgtgctcatggggctgaccttta

SEQ ID NO: 244112 - DNA, 27 bp, Artificial Sequence
  Description of Artificial Sequence: Synthetic oligonucleotide
ggctgtgctcatggggctgacctttac

SEQ ID NO: 244113 - DNA, 27 bp, Artificial Sequence
  Description of Artificial Sequence: Synthetic oligonucleotide
gctgtgctcatggggctgacctttacc

SEQ ID NO: 244114 - DNA, 27 bp, Artificial Sequence
  Description of Artificial Sequence: Synthetic oligonucleotide
ctgtgctcatggggctgacctttaccc

SEQ ID NO: 244115 - DNA, 29 bp, Artificial Sequence
  Description of Artificial Sequence: Synthetic oligonucleotide
tgtgctcatggggctgacctttaccctag

SEQ ID NO: 244116 - DNA, 28 bp, Artificial Sequence
  Description of Artificial Sequence: Synthetic oligonucleotide
gtgctcatggggctgacctttaccctag

SEQ ID NO: 244117 - DNA, 28 bp, Artificial Sequence
  Description of Artificial Sequence: Synthetic oligonucleotide
tgctcatggggctgacctttaccctagg

SEQ ID NO: 244118 - DNA, 27 bp, Artificial Sequence
  Description of Artificial Sequence: Synthetic oligonucleotide
gctcatggggctgacctttaccctagg

SEQ ID NO: 244119 - DNA, 28 bp, Artificial Sequence
  Description of Artificial Sequence: Synthetic oligonucleotide
ctcatggggctgacctttaccctaggtc

SEQ ID NO: 244120 - DNA, 28 bp, Artificial Sequence
  Description of Artificial Sequence: Synthetic oligonucleotide
tcatggggctgacctttaccctaggtcc

SEQ ID NO: 244121 - DNA, 27 bp, Artificial Sequence
  Description of Artificial Sequence: Synthetic oligonucleotide
catggggctgacctttaccctaggtcc

SEQ ID NO: 244122 - DNA, 28 bp, Artificial Sequence
  Description of Artificial Sequence: Synthetic oligonucleotide
atggggctgacctttaccctaggtcctg

SEQ ID NO: 244123 - DNA, 27 bp, Artificial Sequence
  Description of Artificial Sequence: Synthetic oligonucleotide
tggggctgacctttaccctaggtcctg

SEQ ID NO: 244124 - DNA, 26 bp, Artificial Sequence
  Description of Artificial Sequence: Synthetic oligonucleotide
ggggctgacctttaccctaggtcctg

SEQ ID NO: 244125 - DNA, 27 bp, Artificial Sequence
  Description of Artificial Sequence: Synthetic oligonucleotide
gggctgacctttaccctaggtcctggt

SEQ ID NO: 244126 - DNA, 27 bp, Artificial Sequence
  Description of Artificial Sequence: Synthetic oligonucleotide
ggctgacctttaccctaggtcctggtg

SEQ ID NO: 244127 - DNA, 28 bp, Artificial Sequence
  Description of Artificial Sequence: Synthetic oligonucleotide
gctgacctttaccctaggtcctggtgtg

SEQ ID NO: 244128 - DNA, 28 bp, Artificial Sequence
  Description of Artificial Sequence: Synthetic oligonucleotide
ctgacctttaccctaggtcctggtgtgg

SEQ ID NO: 244129 - DNA, 29 bp, Artificial Sequence
  Description of Artificial Sequence: Synthetic oligonucleotide
tgacctttaccctaggtcctggtgtggtg

SEQ ID NO: 244130 - DNA, 28 bp, Artificial Sequence
  Description of Artificial Sequence: Synthetic oligonucleotide
gacctttaccctaggtcctggtgtggtg

SEQ ID NO: 244131 - DNA, 29 bp, Artificial Sequence
  Description of Artificial Sequence: Synthetic oligonucleotide
acctttaccctaggtcctggtgtggtgac

SEQ ID NO: 244132 - DNA, 28 bp, Artificial Sequence
  Description of Artificial Sequence: Synthetic oligonucleotide
cctttaccctaggtcctggtgtggtgac

SEQ ID NO: 244133 - DNA, 28 bp, Artificial Sequence
  Description of Artificial Sequence: Synthetic oligonucleotide
ctttaccctaggtcctggtgtggtgacg

SEQ ID NO: 244134 - DNA, 28 bp, Artificial Sequence
  Description of Artificial Sequence: Synthetic oligonucleotide
tttaccctaggtcctggtgtggtgacgg

SEQ ID NO: 244135 - DNA, 27 bp, Artificial Sequence
  Description of Artificial Sequence: Synthetic oligonucleotide
ttaccctaggtcctggtgtggtgacgg

SEQ ID NO: 244136 - DNA, 26 bp, Artificial Sequence
  Description of Artificial Sequence: Synthetic oligonucleotide
taccctaggtcctggtgtggtgacgg

SEQ ID NO: 244137 - DNA, 25 bp, Artificial Sequence
  Description of Artificial Sequence: Synthetic oligonucleotide
accctaggtcctggtgtggtgacgg

SEQ ID NO: 244138 - DNA, 24 bp, Artificial Sequence
  Description of Artificial Sequence: Synthetic oligonucleotide
ccctaggtcctggtgtggtgacgg

SEQ ID NO: 244139 - DNA, 24 bp, Artificial Sequence
  Description of Artificial Sequence: Synthetic oligonucleotide
cctaggtcctggtgtggtgacggc

SEQ ID NO: 244140 - DNA, 24 bp, Artificial Sequence
  Description of Artificial Sequence: Synthetic oligonucleotide
ctaggtcctggtgtggtgacggcc

SEQ ID NO: 244141 - DNA, 25 bp, Artificial Sequence
  Description of Artificial Sequence: Synthetic oligonucleotide
taggtcctggtgtggtgacggccct

SEQ ID NO: 244142 - DNA, 24 bp, Artificial Sequence
  Description of Artificial Sequence: Synthetic oligonucleotide
aggtcctggtgtggtgacggccct

SEQ ID NO: 244143 - DNA, 23 bp, Artificial Sequence
  Description of Artificial Sequence: Synthetic oligonucleotide
ggtcctggtgtggtgacggccct

SEQ ID NO: 244144 - DNA, 23 bp, Artificial Sequence
  Description of Artificial Sequence: Synthetic oligonucleotide
gtcctggtgtggtgacggccctg

SEQ ID NO: 244145 - DNA, 24 bp, Artificial Sequence
  Description of Artificial Sequence: Synthetic oligonucleotide
tcctggtgtggtgacggccctggt

SEQ ID NO: 244146 - DNA, 23 bp, Artificial Sequence
  Description of Artificial Sequence: Synthetic oligonucleotide
cctggtgtggtgacggccctggt

SEQ ID NO: 244147 - DNA, 23 bp, Artificial Sequence
  Description of Artificial Sequence: Synthetic oligonucleotide
ctggtgtggtgacggccctggtg

SEQ ID NO: 244148 - DNA, 23 bp, Artificial Sequence
  Description of Artificial Sequence: Synthetic oligonucleotide
tggtgtggtgacggccctggtgg

SEQ ID NO: 244149 - DNA, 22 bp, Artificial Sequence
  Description of Artificial Sequence: Synthetic oligonucleotide
ggtgtggtgacggccctggtgg

SEQ ID NO: 244150 - DNA, 23 bp, Artificial Sequence
  Description of Artificial Sequence: Synthetic oligonucleotide
gtgtggtgacggccctggtggga

SEQ ID NO: 244151 - DNA, 23 bp, Artificial Sequence
  Description of Artificial Sequence: Synthetic oligonucleotide
tgtggtgacggccctggtgggag

SEQ ID NO: 244152 - DNA, 22 bp, Artificial Sequence
  Description of Artificial Sequence: Synthetic oligonucleotide
gtggtgacggccctggtgggag

SEQ ID NO: 244153 - DNA, 22 bp, Artificial Sequence
  Description of Artificial Sequence: Synthetic oligonucleotide
tggtgacggccctggtgggagc

SEQ ID NO: 244154 - DNA, 21 bp, Artificial Sequence
  Description of Artificial Sequence: Synthetic oligonucleotide
ggtgacggccctggtgggagc

SEQ ID NO: 244155 - DNA, 24 bp, Artificial Sequence
  Description of Artificial Sequence: Synthetic oligonucleotide
gtgacggccctggtgggagccaat

SEQ ID NO: 244156 - DNA, 24 bp, Artificial Sequence
  Description of Artificial Sequence: Synthetic oligonucleotide
tgacggccctggtgggagccaatg

SEQ ID NO: 244157 - DNA, 23 bp, Artificial Sequence
  Description of Artificial Sequence: Synthetic oligonucleotide
gacggccctggtgggagccaatg

SEQ ID NO: 244158 - DNA, 23 bp, Artificial Sequence
  Description of Artificial Sequence: Synthetic oligonucleotide
acggccctggtgggagccaatgg

SEQ ID NO: 244159 - DNA, 22 bp, Artificial Sequence
  Description of Artificial Sequence: Synthetic oligonucleotide
cggccctggtgggagccaatgg

SEQ ID NO: 244160 - DNA, 23 bp, Artificial Sequence
  Description of Artificial Sequence: Synthetic oligonucleotide
ggccctggtgggagccaatgggt

SEQ ID NO: 244161 - DNA, 24 bp, Artificial Sequence
  Description of Artificial Sequence: Synthetic oligonucleotide
gccctggtgggagccaatgggtgt

SEQ ID NO: 244162 - DNA, 24 bp, Artificial Sequence
  Description of Artificial Sequence: Synthetic oligonucleotide
ccctggtgggagccaatgggtgtg

SEQ ID NO: 244163 - DNA, 24 bp, Artificial Sequence
  Description of Artificial Sequence: Synthetic oligonucleotide
cctggtgggagccaatgggtgtgg

SEQ ID NO: 244164 - DNA, 26 bp, Artificial Sequence
  Description of Artificial Sequence: Synthetic oligonucleotide
ctggtgggagccaatgggtgtgggaa

SEQ ID NO: 244165 - DNA, 27 bp, Artificial Sequence
  Description of Artificial Sequence: Synthetic oligonucleotide
tggtgggagccaatgggtgtgggaaga

SEQ ID NO: 244166 - DNA, 26 bp, Artificial Sequence
  Description of Artificial Sequence: Synthetic oligonucleotide
ggtgggagccaatgggtgtgggaaga

SEQ ID NO: 244167 - DNA, 26 bp, Artificial Sequence
  Description of Artificial Sequence: Synthetic oligonucleotide
gtgggagccaatgggtgtgggaagag

SEQ ID NO: 244168 - DNA, 27 bp, Artificial Sequence
  Description of Artificial Sequence: Synthetic oligonucleotide
tgggagccaatgggtgtgggaagagga

SEQ ID NO: 244169 - DNA, 26 bp, Artificial Sequence
  Description of Artificial Sequence: Synthetic oligonucleotide
gggagccaatgggtgtgggaagagga

SEQ ID NO: 244170 - DNA, 27 bp, Artificial Sequence
  Description of Artificial Sequence: Synthetic oligonucleotide
ggagccaatgggtgtgggaagaggaca

SEQ ID NO: 244171 - DNA, 27 bp, Artificial Sequence
  Description of Artificial Sequence: Synthetic oligonucleotide
gagccaatgggtgtgggaagaggacag

SEQ ID NO: 244172 - DNA, 28 bp, Artificial Sequence
  Description of Artificial Sequence: Synthetic oligonucleotide
agccaatgggtgtgggaagaggacagtg

SEQ ID NO: 244173 - DNA, 27 bp, Artificial Sequence
  Description of Artificial Sequence: Synthetic oligonucleotide
gccaatgggtgtgggaagaggacagtg

SEQ ID NO: 244174 - DNA, 27 bp, Artificial Sequence
  Description of Artificial Sequence: Synthetic oligonucleotide
ccaatgggtgtgggaagaggacagtgg

SEQ ID NO: 244175 - DNA, 27 bp, Artificial Sequence
  Description of Artificial Sequence: Synthetic oligonucleotide
caatgggtgtgggaagaggacagtggc

SEQ ID NO: 244176 - DNA, 28 bp, Artificial Sequence
  Description of Artificial Sequence: Synthetic oligonucleotide
aatgggtgtgggaagaggacagtggctc

SEQ ID NO: 244177 - DNA, 27 bp, Artificial Sequence
  Description of Artificial Sequence: Synthetic oligonucleotide
atgggtgtgggaagaggacagtggctc

SEQ ID NO: 244178 - DNA, 26 bp, Artificial Sequence
  Description of Artificial Sequence: Synthetic oligonucleotide
tgggtgtgggaagaggacagtggctc

SEQ ID NO: 244179 - DNA, 25 bp, Artificial Sequence
  Description of Artificial Sequence: Synthetic oligonucleotide
gggtgtgggaagaggacagtggctc

SEQ ID NO: 244180 - DNA, 25 bp, Artificial Sequence
  Description of Artificial Sequence: Synthetic oligonucleotide
ggtgtgggaagaggacagtggctcc

SEQ ID NO: 244181 - DNA, 25 bp, Artificial Sequence
  Description of Artificial Sequence: Synthetic oligonucleotide
gtgtgggaagaggacagtggctccc

SEQ ID NO: 244182 - DNA, 26 bp, Artificial Sequence
  Description of Artificial Sequence: Synthetic oligonucleotide
tgtgggaagaggacagtggctcccct

SEQ ID NO: 244183 - DNA, 25 bp, Artificial Sequence
  Description of Artificial Sequence: Synthetic oligonucleotide
gtgggaagaggacagtggctcccct

SEQ ID NO: 244184 - DNA, 25 bp, Artificial Sequence
  Description of Artificial Sequence: Synthetic oligonucleotide
tgggaagaggacagtggctcccctg

SEQ ID NO: 244185 - DNA, 24 bp, Artificial Sequence
  Description of Artificial Sequence: Synthetic oligonucleotide
gggaagaggacagtggctcccctg

SEQ ID NO: 244186 - DNA, 25 bp, Artificial Sequence
  Description of Artificial Sequence: Synthetic oligonucleotide
ggaagaggacagtggctcccctgct

SEQ ID NO: 244187 - DNA, 25 bp, Artificial Sequence
  Description of Artificial Sequence: Synthetic oligonucleotide
gaagaggacagtggctcccctgctg

SEQ ID NO: 244188 - DNA, 26 bp, Artificial Sequence
  Description of Artificial Sequence: Synthetic oligonucleotide
aagaggacagtggctcccctgctgct

SEQ ID NO: 244189 - DNA, 25 bp, Artificial Sequence
  Description of Artificial Sequence: Synthetic oligonucleotide
agaggacagtggctcccctgctgct

SEQ ID NO: 244190 - DNA, 24 bp, Artificial Sequence
  Description of Artificial Sequence: Synthetic oligonucleotide
gaggacagtggctcccctgctgct

SEQ ID NO: 244191 - DNA, 27 bp, Artificial Sequence
  Description of Artificial Sequence: Synthetic oligonucleotide
aggacagtggctcccctgctgctgaat

SEQ ID NO: 244192 - DNA, 26 bp, Artificial Sequence
  Description of Artificial Sequence: Synthetic oligonucleotide
ggacagtggctcccctgctgctgaat

SEQ ID NO: 244193 - DNA, 27 bp, Artificial Sequence
  Description of Artificial Sequence: Synthetic oligonucleotide
gacagtggctcccctgctgctgaatct

SEQ ID NO: 244194 - DNA, 27 bp, Artificial Sequence
  Description of Artificial Sequence: Synthetic oligonucleotide
acagtggctcccctgctgctgaatctg

SEQ ID NO: 244195 - DNA, 27 bp, Artificial Sequence
  Description of Artificial Sequence: Synthetic oligonucleotide
cagtggctcccctgctgctgaatctgt

SEQ ID NO: 244196 - DNA, 28 bp, Artificial Sequence
  Description of Artificial Sequence: Synthetic oligonucleotide
agtggctcccctgctgctgaatctgtag

SEQ ID NO: 244197 - DNA, 27 bp, Artificial Sequence
  Description of Artificial Sequence: Synthetic oligonucleotide
gtggctcccctgctgctgaatctgtag

SEQ ID NO: 244198 - DNA, 27 bp, Artificial Sequence
  Description of Artificial Sequence: Synthetic oligonucleotide
tggctcccctgctgctgaatctgtagc

SEQ ID NO: 244199 - DNA, 27 bp, Artificial Sequence
  Description of Artificial Sequence: Synthetic oligonucleotide
ggctcccctgctgctgaatctgtagca

SEQ ID NO: 244200 - DNA, 27 bp, Artificial Sequence
  Description of Artificial Sequence: Synthetic oligonucleotide
gctcccctgctgctgaatctgtagcag

SEQ ID NO: 244201 - DNA, 27 bp, Artificial Sequence
  Description of Artificial Sequence: Synthetic oligonucleotide
ctcccctgctgctgaatctgtagcagc

SEQ ID NO: 244202 - DNA, 27 bp, Artificial Sequence
  Description of Artificial Sequence: Synthetic oligonucleotide
tcccctgctgctgaatctgtagcagcc

SEQ ID NO: 244203 - DNA, 26 bp, Artificial Sequence
  Description of Artificial Sequence: Synthetic oligonucleotide
cccctgctgctgaatctgtagcagcc

SEQ ID NO: 244204 - DNA, 27 bp, Artificial Sequence
  Description of Artificial Sequence: Synthetic oligonucleotide
ccctgctgctgaatctgtagcagccca

SEQ ID NO: 244205 - DNA, 27 bp, Artificial Sequence
  Description of Artificial Sequence: Synthetic oligonucleotide
cctgctgctgaatctgtagcagcccac

SEQ ID NO: 244206 - DNA, 28 bp, Artificial Sequence
  Description of Artificial Sequence: Synthetic oligonucleotide
ctgctgctgaatctgtagcagcccacac

SEQ ID NO: 244207 - DNA, 28 bp, Artificial Sequence
  Description of Artificial Sequence: Synthetic oligonucleotide
tgctgctgaatctgtagcagcccacacg

SEQ ID NO: 244208 - DNA, 27 bp, Artificial Sequence
  Description of Artificial Sequence: Synthetic oligonucleotide
gctgctgaatctgtagcagcccacacg

SEQ ID NO: 244209 - DNA, 27 bp, Artificial Sequence
  Description of Artificial Sequence: Synthetic oligonucleotide
ctgctgaatctgtagcagcccacacgg

SEQ ID NO: 244210 - DNA, 27 bp, Artificial Sequence
  Description of Artificial Sequence: Synthetic oligonucleotide
tgctgaatctgtagcagcccacacggg

SEQ ID NO: 244211 - DNA, 26 bp, Artificial Sequence
  Description of Artificial Sequence: Synthetic oligonucleotide
gctgaatctgtagcagcccacacggg

SEQ ID NO: 244212 - DNA, 27 bp, Artificial Sequence
  Description of Artificial Sequence: Synthetic oligonucleotide
ctgaatctgtagcagcccacacgggga

SEQ ID NO: 244213 - DNA, 27 bp, Artificial Sequence
  Description of Artificial Sequence: Synthetic oligonucleotide
tgaatctgtagcagcccacacggggac

SEQ ID NO: 244214 - DNA, 27 bp, Artificial Sequence
  Description of Artificial Sequence: Synthetic oligonucleotide
gaatctgtagcagcccacacggggaca

SEQ ID NO: 244215 - DNA, 27 bp, Artificial Sequence
  Description of Artificial Sequence: Synthetic oligonucleotide
aatctgtagcagcccacacggggacag

SEQ ID NO: 244216 - DNA, 26 bp, Artificial Sequence
  Description of Artificial Sequence: Synthetic oligonucleotide
atctgtagcagcccacacggggacag

SEQ ID NO: 244217 - DNA, 25 bp, Artificial Sequence
  Description of Artificial Sequence: Synthetic oligonucleotide
tctgtagcagcccacacggggacag

SEQ ID NO: 244218 - DNA, 24 bp, Artificial Sequence
  Description of Artificial Sequence: Synthetic oligonucleotide
ctgtagcagcccacacggggacag

SEQ ID NO: 244219 - DNA, 25 bp, Artificial Sequence
  Description of Artificial Sequence: Synthetic oligonucleotide
tgtagcagcccacacggggacagga

SEQ ID NO: 244220 - DNA, 24 bp, Artificial Sequence
  Description of Artificial Sequence: Synthetic oligonucleotide
gtagcagcccacacggggacagga

SEQ ID NO: 244221 - DNA, 24 bp, Artificial Sequence
  Description of Artificial Sequence: Synthetic oligonucleotide
tagcagcccacacggggacaggag

SEQ ID NO: 244222 - DNA, 23 bp, Artificial Sequence
  Description of Artificial Sequence: Synthetic oligonucleotide
agcagcccacacggggacaggag

SEQ ID NO: 244223 - DNA, 22 bp, Artificial Sequence
  Description of Artificial Sequence: Synthetic oligonucleotide
gcagcccacacggggacaggag

SEQ ID NO: 244224 - DNA, 23 bp, Artificial Sequence
  Description of Artificial Sequence: Synthetic oligonucleotide
cagcccacacggggacaggagct

SEQ ID NO: 244225 - DNA, 23 bp, Artificial Sequence
  Description of Artificial Sequence: Synthetic oligonucleotide
agcccacacggggacaggagctg

SEQ ID NO: 244226 - DNA, 22 bp, Artificial Sequence
  Description of Artificial Sequence: Synthetic oligonucleotide
gcccacacggggacaggagctg

SEQ ID NO: 244227 - DNA, 23 bp, Artificial Sequence
  Description of Artificial Sequence: Synthetic oligonucleotide
cccacacggggacaggagctgct

SEQ ID NO: 244228 - DNA, 23 bp, Artificial Sequence
  Description of Artificial Sequence: Synthetic oligonucleotide
ccacacggggacaggagctgctg

SEQ ID NO: 244229 - DNA, 25 bp, Artificial Sequence
  Description of Artificial Sequence: Synthetic oligonucleotide
cacacggggacaggagctgctggaa

SEQ ID NO: 244230 - DNA, 27 bp, Artificial Sequence
  Description of Artificial Sequence: Synthetic oligonucleotide
acacggggacaggagctgctggaagaa

SEQ ID NO: 244231 - DNA, 27 bp, Artificial Sequence
  Description of Artificial Sequence: Synthetic oligonucleotide
cacggggacaggagctgctggaagaaa

SEQ ID NO: 244232 - DNA, 28 bp, Artificial Sequence
  Description of Artificial Sequence: Synthetic oligonucleotide
acggggacaggagctgctggaagaaaag

SEQ ID NO: 244233 - DNA, 27 bp, Artificial Sequence
  Description of Artificial Sequence: Synthetic oligonucleotide
cggggacaggagctgctggaagaaaag

SEQ ID NO: 244234 - DNA, 27 bp, Artificial Sequence
  Description of Artificial Sequence: Synthetic oligonucleotide
ggggacaggagctgctggaagaaaagc

SEQ ID NO: 244235 - DNA, 27 bp, Artificial Sequence
  Description of Artificial Sequence: Synthetic oligonucleotide
gggacaggagctgctggaagaaaagcc

SEQ ID NO: 244236 - DNA, 27 bp, Artificial Sequence
  Description of Artificial Sequence: Synthetic oligonucleotide
ggacaggagctgctggaagaaaagccc

SEQ ID NO: 244237 - DNA, 29 bp, Artificial Sequence
  Description of Artificial Sequence: Synthetic oligonucleotide
gacaggagctgctggaagaaaagcccttc

SEQ ID NO: 244238 - DNA, 30 bp, Artificial Sequence
  Description of Artificial Sequence: Synthetic oligonucleotide
acaggagctgctggaagaaaagcccttctc

SEQ ID NO: 244239 - DNA, 29 bp, Artificial Sequence
  Description of Artificial Sequence: Synthetic oligonucleotide
caggagctgctggaagaaaagcccttctc

SEQ ID NO: 244240 - DNA, 30 bp, Artificial Sequence
  Description of Artificial Sequence: Synthetic oligonucleotide
aggagctgctggaagaaaagcccttctcac

SEQ ID NO: 244241 - DNA, 29 bp, Artificial Sequence
  Description of Artificial Sequence: Synthetic oligonucleotide
ggagctgctggaagaaaagcccttctcac

SEQ ID NO: 244242 - DNA, 30 bp, Artificial Sequence
  Description of Artificial Sequence: Synthetic oligonucleotide
gagctgctggaagaaaagcccttctcacag

SEQ ID NO: 244243 - DNA, 33 bp, Artificial Sequence
  Description of Artificial Sequence: Synthetic oligonucleotide
agctgctggaagaaaagcccttctcacagtttg

SEQ ID NO: 244244 - DNA, 32 bp, Artificial Sequence
  Description of Artificial Sequence: Synthetic oligonucleotide
gctgctggaagaaaagcccttctcacagtttg

SEQ ID NO: 244245 - DNA, 34 bp, Artificial Sequence
  Description of Artificial Sequence: Synthetic oligonucleotide
ctgctggaagaaaagcccttctcacagtttgaac

SEQ ID NO: 244246 - DNA, 35 bp, Artificial Sequence
  Description of Artificial Sequence: Synthetic oligonucleotide
tgctggaagaaaagcccttctcacagtttgaacac

SEQ ID NO: 244247 - DNA, 34 bp, Artificial Sequence
  Description of Artificial Sequence: Synthetic oligonucleotide
gctggaagaaaagcccttctcacagtttgaacac

SEQ ID NO: 244248 - DNA, 35 bp, Artificial Sequence
  Description of Artificial Sequence: Synthetic oligonucleotide
ctggaagaaaagcccttctcacagtttgaacactg

SEQ ID NO: 244249 - DNA, 35 bp, Artificial Sequence
  Description of Artificial Sequence: Synthetic oligonucleotide
tggaagaaaagcccttctcacagtttgaacactgg

SEQ ID NO: 244250 - DNA, 34 bp, Artificial Sequence
  Description of Artificial Sequence: Synthetic oligonucleotide
ggaagaaaagcccttctcacagtttgaacactgg

SEQ ID NO: 244251 - DNA, 36 bp, Artificial Sequence
  Description of Artificial Sequence: Synthetic oligonucleotide
gaagaaaagcccttctcacagtttgaacactggtac

SEQ ID NO: 244252 - DNA, 36 bp, Artificial Sequence
  Description of Artificial Sequence: Synthetic oligonucleotide
aagaaaagcccttctcacagtttgaacactggtacc

SEQ ID NO: 244253 - DNA, 35 bp, Artificial Sequence
  Description of Artificial Sequence: Synthetic oligonucleotide
agaaaagcccttctcacagtttgaacactggtacc

SEQ ID NO: 244254 - DNA, 34 bp, Artificial Sequence
  Description of Artificial Sequence: Synthetic oligonucleotide
gaaaagcccttctcacagtttgaacactggtacc

SEQ ID NO: 244255 - DNA, 35 bp, Artificial Sequence
  Description of Artificial Sequence: Synthetic oligonucleotide
aaaagcccttctcacagtttgaacactggtacctg

SEQ ID NO: 244256 - DNA, 34 bp, Artificial Sequence
  Description of Artificial Sequence: Synthetic oligonucleotide
aaagcccttctcacagtttgaacactggtacctg

SEQ ID NO: 244257 - DNA, 33 bp, Artificial Sequence
  Description of Artificial Sequence: Synthetic oligonucleotide
aagcccttctcacagtttgaacactggtacctg

SEQ ID NO: 244258 - DNA, 32 bp, Artificial Sequence
  Description of Artificial Sequence: Synthetic oligonucleotide
agcccttctcacagtttgaacactggtacctg

SEQ ID NO: 244259 - DNA, 31 bp, Artificial Sequence
  Description of Artificial Sequence: Synthetic oligonucleotide
gcccttctcacagtttgaacactggtacctg

SEQ ID NO: 244260 - DNA, 31 bp, Artificial Sequence
  Description of Artificial Sequence: Synthetic oligonucleotide
cccttctcacagtttgaacactggtacctgc

SEQ ID NO: 244261 - DNA, 32 bp, Artificial Sequence
  Description of Artificial Sequence: Synthetic oligonucleotide
ccttctcacagtttgaacactggtacctgcac

SEQ ID NO: 244262 - DNA, 33 bp, Artificial Sequence
  Description of Artificial Sequence: Synthetic oligonucleotide
cttctcacagtttgaacactggtacctgcactg

SEQ ID NO: 244263 - DNA, 33 bp, Artificial Sequence
  Description of Artificial Sequence: Synthetic oligonucleotide
ttctcacagtttgaacactggtacctgcactgc

SEQ ID NO: 244264 - DNA, 32 bp, Artificial Sequence
  Description of Artificial Sequence: Synthetic oligonucleotide
tctcacagtttgaacactggtacctgcactgc

SEQ ID NO: 244265 - DNA, 31 bp, Artificial Sequence
  Description of Artificial Sequence: Synthetic oligonucleotide
ctcacagtttgaacactggtacctgcactgc

SEQ ID NO: 244266 - DNA, 31 bp, Artificial Sequence
  Description of Artificial Sequence: Synthetic oligonucleotide
tcacagtttgaacactggtacctgcactgcc

SEQ ID NO: 244267 - DNA, 30 bp, Artificial Sequence
  Description of Artificial Sequence: Synthetic oligonucleotide
cacagtttgaacactggtacctgcactgcc

SEQ ID NO: 244268 - DNA, 31 bp, Artificial Sequence
  Description of Artificial Sequence: Synthetic oligonucleotide
acagtttgaacactggtacctgcactgccag

SEQ ID NO: 244269 - DNA, 30 bp, Artificial Sequence
  Description of Artificial Sequence: Synthetic oligonucleotide
cagtttgaacactggtacctgcactgccag

SEQ ID NO: 244270 - DNA, 30 bp, Artificial Sequence
  Description of Artificial Sequence: Synthetic oligonucleotide
agtttgaacactggtacctgcactgccagg

SEQ ID NO: 244271 - DNA, 29 bp, Artificial Sequence
  Description of Artificial Sequence: Synthetic oligonucleotide
gtttgaacactggtacctgcactgccagg

SEQ ID NO: 244272 - DNA, 30 bp, Artificial Sequence
  Description of Artificial Sequence: Synthetic oligonucleotide
tttgaacactggtacctgcactgccaggtg

SEQ ID NO: 244273 - DNA, 29 bp, Artificial Sequence
  Description of Artificial Sequence: Synthetic oligonucleotide
ttgaacactggtacctgcactgccaggtg

SEQ ID NO: 244274 - DNA, 28 bp, Artificial Sequence
  Description of Artificial Sequence: Synthetic oligonucleotide
tgaacactggtacctgcactgccaggtg

SEQ ID NO: 244275 - DNA, 27 bp, Artificial Sequence
  Description of Artificial Sequence: Synthetic oligonucleotide
gaacactggtacctgcactgccaggtg

SEQ ID NO: 244276 - DNA, 27 bp, Artificial Sequence
  Description of Artificial Sequence: Synthetic oligonucleotide
aacactggtacctgcactgccaggtgg

SEQ ID NO: 244277 - DNA, 27 bp, Artificial Sequence
  Description of Artificial Sequence: Synthetic oligonucleotide
acactggtacctgcactgccaggtgga

SEQ ID NO: 244278 - DNA, 27 bp, Artificial Sequence
  Description of Artificial Sequence: Synthetic oligonucleotide
cactggtacctgcactgccaggtggat

SEQ ID NO: 244279 - DNA, 28 bp, Artificial Sequence
  Description of Artificial Sequence: Synthetic oligonucleotide
actggtacctgcactgccaggtggattc

SEQ ID NO: 244280 - DNA, 27 bp, Artificial Sequence
  Description of Artificial Sequence: Synthetic oligonucleotide
ctggtacctgcactgccaggtggattc

SEQ ID NO: 244281 - DNA, 28 bp, Artificial Sequence
  Description of Artificial Sequence: Synthetic oligonucleotide
tggtacctgcactgccaggtggattcag

SEQ ID NO: 244282 - DNA, 27 bp, Artificial Sequence
  Description of Artificial Sequence: Synthetic oligonucleotide
ggtacctgcactgccaggtggattcag

SEQ ID NO: 244283 - DNA, 29 bp, Artificial Sequence
  Description of Artificial Sequence: Synthetic oligonucleotide
gtacctgcactgccaggtggattcagttg

SEQ ID NO: 244284 - DNA, 29 bp, Artificial Sequence
  Description of Artificial Sequence: Synthetic oligonucleotide
tacctgcactgccaggtggattcagttgg

SEQ ID NO: 244285 - DNA, 28 bp, Artificial Sequence
  Description of Artificial Sequence: Synthetic oligonucleotide
acctgcactgccaggtggattcagttgg

SEQ ID NO: 244286 - DNA, 27 bp, Artificial Sequence
  Description of Artificial Sequence: Synthetic oligonucleotide
cctgcactgccaggtggattcagttgg

SEQ ID NO: 244287 - DNA, 27 bp, Artificial Sequence
  Description of Artificial Sequence: Synthetic oligonucleotide
ctgcactgccaggtggattcagttggc

SEQ ID NO: 244288 - DNA, 27 bp, Artificial Sequence
  Description of Artificial Sequence: Synthetic oligonucleotide
tgcactgccaggtggattcagttggcc

SEQ ID NO: 244289 - DNA, 27 bp, Artificial Sequence
  Description of Artificial Sequence: Synthetic oligonucleotide
gcactgccaggtggattcagttggcca

SEQ ID NO: 244290 - DNA, 27 bp, Artificial Sequence
  Description of Artificial Sequence: Synthetic oligonucleotide
cactgccaggtggattcagttggccag

SEQ ID NO: 244291 - DNA, 27 bp, Artificial Sequence
  Description of Artificial Sequence: Synthetic oligonucleotide
actgccaggtggattcagttggccagg

SEQ ID NO: 244292 - DNA, 27 bp, Artificial Sequence
  Description of Artificial Sequence: Synthetic oligonucleotide
ctgccaggtggattcagttggccagga

SEQ ID NO: 244293 - DNA, 27 bp, Artificial Sequence
  Description of Artificial Sequence: Synthetic oligonucleotide
tgccaggtggattcagttggccaggag

SEQ ID NO: 244294 - DNA, 26 bp, Artificial Sequence
  Description of Artificial Sequence: Synthetic oligonucleotide
gccaggtggattcagttggccaggag

SEQ ID NO: 244295 - DNA, 26 bp, Artificial Sequence
  Description of Artificial Sequence: Synthetic oligonucleotide
ccaggtggattcagttggccaggagc

SEQ ID NO: 244296 - DNA, 27 bp, Artificial Sequence
  Description of Artificial Sequence: Synthetic oligonucleotide
caggtggattcagttggccaggagcct

SEQ ID NO: 244297 - DNA, 27 bp, Artificial Sequence
  Description of Artificial Sequence: Synthetic oligonucleotide
aggtggattcagttggccaggagcctc

SEQ ID NO: 244298 - DNA, 27 bp, Artificial Sequence
  Description of Artificial Sequence: Synthetic oligonucleotide
ggtggattcagttggccaggagcctct

SEQ ID NO: 244299 - DNA, 27 bp, Artificial Sequence
  Description of Artificial Sequence: Synthetic oligonucleotide
gtggattcagttggccaggagcctctg

SEQ ID NO: 244300 - DNA, 27 bp, Artificial Sequence
  Description of Artificial Sequence: Synthetic oligonucleotide
tggattcagttggccaggagcctctgc

SEQ ID NO: 244301 - DNA, 27 bp, Artificial Sequence
  Description of Artificial Sequence: Synthetic oligonucleotide
ggattcagttggccaggagcctctgct

SEQ ID NO: 244302 - DNA, 27 bp, Artificial Sequence
  Description of Artificial Sequence: Synthetic oligonucleotide
gattcagttggccaggagcctctgctg

SEQ ID NO: 244303 - DNA, 29 bp, Artificial Sequence
  Description of Artificial Sequence: Synthetic oligonucleotide
attcagttggccaggagcctctgctgttc

SEQ ID NO: 244304 - DNA, 28 bp, Artificial Sequence
  Description of Artificial Sequence: Synthetic oligonucleotide
ttcagttggccaggagcctctgctgttc

SEQ ID NO: 244305 - DNA, 27 bp, Artificial Sequence
  Description of Artificial Sequence: Synthetic oligonucleotide
tcagttggccaggagcctctgctgttc

SEQ ID NO: 244306 - DNA, 27 bp, Artificial Sequence
  Description of Artificial Sequence: Synthetic oligonucleotide
cagttggccaggagcctctgctgttct

SEQ ID NO: 244307 - DNA, 27 bp, Artificial Sequence
  Description of Artificial Sequence: Synthetic oligonucleotide
agttggccaggagcctctgctgttctg

SEQ ID NO: 244308 - DNA, 26 bp, Artificial Sequence
  Description of Artificial Sequence: Synthetic oligonucleotide
gttggccaggagcctctgctgttctg

SEQ ID NO: 244309 - DNA, 26 bp, Artificial Sequence
  Description of Artificial Sequence: Synthetic oligonucleotide
ttggccaggagcctctgctgttctgc

SEQ ID NO: 244310 - DNA, 25 bp, Artificial Sequence
  Description of Artificial Sequence: Synthetic oligonucleotide
tggccaggagcctctgctgttctgc

SEQ ID NO: 244311 - DNA, 24 bp, Artificial Sequence
  Description of Artificial Sequence: Synthetic oligonucleotide
ggccaggagcctctgctgttctgc

SEQ ID NO: 244312 - DNA, 24 bp, Artificial Sequence
  Description of Artificial Sequence: Synthetic oligonucleotide
gccaggagcctctgctgttctgcg

SEQ ID NO: 244313 - DNA, 26 bp, Artificial Sequence
  Description of Artificial Sequence: Synthetic oligonucleotide
ccaggagcctctgctgttctgcggtt

SEQ ID NO: 244314 - DNA, 27 bp, Artificial Sequence
  Description of Artificial Sequence: Synthetic oligonucleotide
caggagcctctgctgttctgcggttct

SEQ ID NO: 244315 - DNA, 27 bp, Artificial Sequence
  Description of Artificial Sequence: Synthetic oligonucleotide
aggagcctctgctgttctgcggttctg

SEQ ID NO: 244316 - DNA, 27 bp, Artificial Sequence
  Description of Artificial Sequence: Synthetic oligonucleotide
ggagcctctgctgttctgcggttctgt

SEQ ID NO: 244317 - DNA, 27 bp, Artificial Sequence
  Description of Artificial Sequence: Synthetic oligonucleotide
gagcctctgctgttctgcggttctgtc

SEQ ID NO: 244318 - DNA, 28 bp, Artificial Sequence
  Description of Artificial Sequence: Synthetic oligonucleotide
agcctctgctgttctgcggttctgtcag

SEQ ID NO: 244319 - DNA, 27 bp, Artificial Sequence
  Description of Artificial Sequence: Synthetic oligonucleotide
gcctctgctgttctgcggttctgtcag

SEQ ID NO: 244320 - DNA, 27 bp, Artificial Sequence
  Description of Artificial Sequence: Synthetic oligonucleotide
cctctgctgttctgcggttctgtcagg

SEQ ID NO: 244321 - DNA, 29 bp, Artificial Sequence
  Description of Artificial Sequence: Synthetic oligonucleotide
ctctgctgttctgcggttctgtcaggaac

SEQ ID NO: 244322 - DNA, 31 bp, Artificial Sequence
  Description of Artificial Sequence: Synthetic oligonucleotide
tctgctgttctgcggttctgtcaggaacaac

SEQ ID NO: 244323 - DNA, 30 bp, Artificial Sequence
  Description of Artificial Sequence: Synthetic oligonucleotide
ctgctgttctgcggttctgtcaggaacaac

SEQ ID NO: 244324 - DNA, 33 bp, Artificial Sequence
  Description of Artificial Sequence: Synthetic oligonucleotide
tgctgttctgcggttctgtcaggaacaactttg

SEQ ID NO: 244325 - DNA, 32 bp, Artificial Sequence
  Description of Artificial Sequence: Synthetic oligonucleotide
gctgttctgcggttctgtcaggaacaactttg

SEQ ID NO: 244326 - DNA, 32 bp, Artificial Sequence
  Description of Artificial Sequence: Synthetic oligonucleotide
ctgttctgcggttctgtcaggaacaactttgc

SEQ ID NO: 244327 - DNA, 36 bp, Artificial Sequence
  Description of Artificial Sequence: Synthetic oligonucleotide
tgttctgcggttctgtcaggaacaactttgcttatg

SEQ ID NO: 244328 - DNA, 35 bp, Artificial Sequence
  Description of Artificial Sequence: Synthetic oligonucleotide
gttctgcggttctgtcaggaacaactttgcttatg

SEQ ID NO: 244329 - DNA, 35 bp, Artificial Sequence
  Description of Artificial Sequence: Synthetic oligonucleotide
ttctgcggttctgtcaggaacaactttgcttatgc

SEQ ID NO: 244330 - DNA, 34 bp, Artificial Sequence
  Description of Artificial Sequence: Synthetic oligonucleotide
tctgcggttctgtcaggaacaactttgcttatgc

SEQ ID NO: 244331 - DNA, 33 bp, Artificial Sequence
  Description of Artificial Sequence: Synthetic oligonucleotide
ctgcggttctgtcaggaacaactttgcttatgc

SEQ ID NO: 244332 - DNA, 33 bp, Artificial Sequence
  Description of Artificial Sequence: Synthetic oligonucleotide
tgcggttctgtcaggaacaactttgcttatgcg

SEQ ID NO: 244333 - DNA, 32 bp, Artificial Sequence
  Description of Artificial Sequence: Synthetic oligonucleotide
gcggttctgtcaggaacaactttgcttatgcg

SEQ ID NO: 244334 - DNA, 32 bp, Artificial Sequence
  Description of Artificial Sequence: Synthetic oligonucleotide
cggttctgtcaggaacaactttgcttatgcgc

SEQ ID NO: 244335 - DNA, 33 bp, Artificial Sequence
  Description of Artificial Sequence: Synthetic oligonucleotide
ggttctgtcaggaacaactttgcttatgcgctg

SEQ ID NO: 244336 - DNA, 33 bp, Artificial Sequence
  Description of Artificial Sequence: Synthetic oligonucleotide
gttctgtcaggaacaactttgcttatgcgctgc

SEQ ID NO: 244337 - DNA, 34 bp, Artificial Sequence
  Description of Artificial Sequence: Synthetic oligonucleotide
ttctgtcaggaacaactttgcttatgcgctgcag

SEQ ID NO: 244338 - DNA, 33 bp, Artificial Sequence
  Description of Artificial Sequence: Synthetic oligonucleotide
tctgtcaggaacaactttgcttatgcgctgcag

SEQ ID NO: 244339 - DNA, 32 bp, Artificial Sequence
  Description of Artificial Sequence: Synthetic oligonucleotide
ctgtcaggaacaactttgcttatgcgctgcag

SEQ ID NO: 244340 - DNA, 33 bp, Artificial Sequence
  Description of Artificial Sequence: Synthetic oligonucleotide
tgtcaggaacaactttgcttatgcgctgcagag

SEQ ID NO: 244341 - DNA, 32 bp, Artificial Sequence
  Description of Artificial Sequence: Synthetic oligonucleotide
gtcaggaacaactttgcttatgcgctgcagag

SEQ ID NO: 244342 - DNA, 32 bp, Artificial Sequence
  Description of Artificial Sequence: Synthetic oligonucleotide
tcaggaacaactttgcttatgcgctgcagagg

SEQ ID NO: 244343 - DNA, 31 bp, Artificial Sequence
  Description of Artificial Sequence: Synthetic oligonucleotide
caggaacaactttgcttatgcgctgcagagg

SEQ ID NO: 244344 - DNA, 32 bp, Artificial Sequence
  Description of Artificial Sequence: Synthetic oligonucleotide
aggaacaactttgcttatgcgctgcagaggtg

SEQ ID NO: 244345 - DNA, 31 bp, Artificial Sequence
  Description of Artificial Sequence: Synthetic oligonucleotide
ggaacaactttgcttatgcgctgcagaggtg

SEQ ID NO: 244346 - DNA, 31 bp, Artificial Sequence
  Description of Artificial Sequence: Synthetic oligonucleotide
gaacaactttgcttatgcgctgcagaggtgc

SEQ ID NO: 244347 - DNA, 31 bp, Artificial Sequence
  Description of Artificial Sequence: Synthetic oligonucleotide
aacaactttgcttatgcgctgcagaggtgcg

SEQ ID NO: 244348 - DNA, 30 bp, Artificial Sequence
  Description of Artificial Sequence: Synthetic oligonucleotide
acaactttgcttatgcgctgcagaggtgcg

SEQ ID NO: 244349 - DNA, 29 bp, Artificial Sequence
  Description of Artificial Sequence: Synthetic oligonucleotide
caactttgcttatgcgctgcagaggtgcg

SEQ ID NO: 244350 - DNA, 31 bp, Artificial Sequence
  Description of Artificial Sequence: Synthetic oligonucleotide
aactttgcttatgcgctgcagaggtgcgaag

SEQ ID NO: 244351 - DNA, 30 bp, Artificial Sequence
  Description of Artificial Sequence: Synthetic oligonucleotide
actttgcttatgcgctgcagaggtgcgaag

SEQ ID NO: 244352 - DNA, 29 bp, Artificial Sequence
  Description of Artificial Sequence: Synthetic oligonucleotide
ctttgcttatgcgctgcagaggtgcgaag

SEQ ID NO: 244353 - DNA, 31 bp, Artificial Sequence
  Description of Artificial Sequence: Synthetic oligonucleotide
tttgcttatgcgctgcagaggtgcgaagatc

SEQ ID NO: 244354 - DNA, 30 bp, Artificial Sequence
  Description of Artificial Sequence: Synthetic oligonucleotide
ttgcttatgcgctgcagaggtgcgaagatc

SEQ ID NO: 244355 - DNA, 29 bp, Artificial Sequence
  Description of Artificial Sequence: Synthetic oligonucleotide
tgcttatgcgctgcagaggtgcgaagatc

SEQ ID NO: 244356 - DNA, 28 bp, Artificial Sequence
  Description of Artificial Sequence: Synthetic oligonucleotide
gcttatgcgctgcagaggtgcgaagatc

SEQ ID NO: 244357 - DNA, 32 bp, Artificial Sequence
  Description of Artificial Sequence: Synthetic oligonucleotide
cttatgcgctgcagaggtgcgaagatcataag

SEQ ID NO: 244358 - DNA, 32 bp, Artificial Sequence
  Description of Artificial Sequence: Synthetic oligonucleotide
ttatgcgctgcagaggtgcgaagatcataagg

SEQ ID NO: 244359 - DNA, 31 bp, Artificial Sequence
  Description of Artificial Sequence: Synthetic oligonucleotide
tatgcgctgcagaggtgcgaagatcataagg

SEQ ID NO: 244360 - DNA, 30 bp, Artificial Sequence
  Description of Artificial Sequence: Synthetic oligonucleotide
atgcgctgcagaggtgcgaagatcataagg

SEQ ID NO: 244361 - DNA, 29 bp, Artificial Sequence
  Description of Artificial Sequence: Synthetic oligonucleotide
tgcgctgcagaggtgcgaagatcataagg

SEQ ID NO: 244362 - DNA, 28 bp, Artificial Sequence
  Description of Artificial Sequence: Synthetic oligonucleotide
gcgctgcagaggtgcgaagatcataagg

SEQ ID NO: 244363 - DNA, 29 bp, Artificial Sequence
  Description of Artificial Sequence: Synthetic oligonucleotide
cgctgcagaggtgcgaagatcataaggtg

SEQ ID NO: 244364 - DNA, 31 bp, Artificial Sequence
  Description of Artificial Sequence: Synthetic oligonucleotide
gctgcagaggtgcgaagatcataaggtgaag

SEQ ID NO: 244365 - DNA, 31 bp, Artificial Sequence
  Description of Artificial Sequence: Synthetic oligonucleotide
ctgcagaggtgcgaagatcataaggtgaagg

SEQ ID NO: 244366 - DNA, 31 bp, Artificial Sequence
  Description of Artificial Sequence: Synthetic oligonucleotide
tgcagaggtgcgaagatcataaggtgaaggc

SEQ ID NO: 244367 - DNA, 30 bp, Artificial Sequence
  Description of Artificial Sequence: Synthetic oligonucleotide
gcagaggtgcgaagatcataaggtgaaggc

SEQ ID NO: 244368 - DNA, 30 bp, Artificial Sequence
  Description of Artificial Sequence: Synthetic oligonucleotide
cagaggtgcgaagatcataaggtgaaggcg

SEQ ID NO: 244369 - DNA, 30 bp, Artificial Sequence
  Description of Artificial Sequence: Synthetic oligonucleotide
agaggtgcgaagatcataaggtgaaggcgg

SEQ ID NO: 244370 - DNA, 29 bp, Artificial Sequence
  Description of Artificial Sequence: Synthetic oligonucleotide
gaggtgcgaagatcataaggtgaaggcgg

SEQ ID NO: 244371 - DNA, 29 bp, Artificial Sequence
  Description of Artificial Sequence: Synthetic oligonucleotide
aggtgcgaagatcataaggtgaaggcggc

SEQ ID NO: 244372 - DNA, 28 bp, Artificial Sequence
  Description of Artificial Sequence: Synthetic oligonucleotide
ggtgcgaagatcataaggtgaaggcggc

SEQ ID NO: 244373 - DNA, 29 bp, Artificial Sequence
  Description of Artificial Sequence: Synthetic oligonucleotide
gtgcgaagatcataaggtgaaggcggctg

SEQ ID NO: 244374 - DNA, 29 bp, Artificial Sequence
  Description of Artificial Sequence: Synthetic oligonucleotide
tgcgaagatcataaggtgaaggcggctgc

SEQ ID NO: 244375 - DNA, 28 bp, Artificial Sequence
  Description of Artificial Sequence: Synthetic oligonucleotide
gcgaagatcataaggtgaaggcggctgc

SEQ ID NO: 244376 - DNA, 28 bp, Artificial Sequence
  Description of Artificial Sequence: Synthetic oligonucleotide
cgaagatcataaggtgaaggcggctgcg

SEQ ID NO: 244377 - DNA, 28 bp, Artificial Sequence
  Description of Artificial Sequence: Synthetic oligonucleotide
gaagatcataaggtgaaggcggctgcgc

SEQ ID NO: 244378 - DNA, 29 bp, Artificial Sequence
  Description of Artificial Sequence: Synthetic oligonucleotide
aagatcataaggtgaaggcggctgcgcag

SEQ ID NO: 244379 - DNA, 28 bp, Artificial Sequence
  Description of Artificial Sequence: Synthetic oligonucleotide
agatcataaggtgaaggcggctgcgcag

SEQ ID NO: 244380 - DNA, 27 bp, Artificial Sequence
  Description of Artificial Sequence: Synthetic oligonucleotide
gatcataaggtgaaggcggctgcgcag

SEQ ID NO: 244381 - DNA, 27 bp, Artificial Sequence
  Description of Artificial Sequence: Synthetic oligonucleotide
atcataaggtgaaggcggctgcgcagg

SEQ ID NO: 244382 - DNA, 26 bp, Artificial Sequence
  Description of Artificial Sequence: Synthetic oligonucleotide
tcataaggtgaaggcggctgcgcagg

SEQ ID NO: 244383 - DNA, 25 bp, Artificial Sequence
  Description of Artificial Sequence: Synthetic oligonucleotide
cataaggtgaaggcggctgcgcagg

SEQ ID NO: 244384 - DNA, 26 bp, Artificial Sequence
  Description of Artificial Sequence: Synthetic oligonucleotide
ataaggtgaaggcggctgcgcaggct

SEQ ID NO: 244385 - DNA, 25 bp, Artificial Sequence
  Description of Artificial Sequence: Synthetic oligonucleotide
taaggtgaaggcggctgcgcaggct

SEQ ID NO: 244386 - DNA, 24 bp, Artificial Sequence
  Description of Artificial Sequence: Synthetic oligonucleotide
aaggtgaaggcggctgcgcaggct

SEQ ID NO: 244387 - DNA, 23 bp, Artificial Sequence
  Description of Artificial Sequence: Synthetic oligonucleotide
aggtgaaggcggctgcgcaggct

SEQ ID NO: 244388 - DNA, 22 bp, Artificial Sequence
  Description of Artificial Sequence: Synthetic oligonucleotide
ggtgaaggcggctgcgcaggct

SEQ ID NO: 244389 - DNA, 22 bp, Artificial Sequence
  Description of Artificial Sequence: Synthetic oligonucleotide
gtgaaggcggctgcgcaggctg

SEQ ID NO: 244390 - DNA, 22 bp, Artificial Sequence
  Description of Artificial Sequence: Synthetic oligonucleotide
tgaaggcggctgcgcaggctgc

SEQ ID NO: 244391 - DNA, 21 bp, Artificial Sequence
  Description of Artificial Sequence: Synthetic oligonucleotide
gaaggcggctgcgcaggctgc

SEQ ID NO: 244392 - DNA, 21 bp, Artificial Sequence
  Description of Artificial Sequence: Synthetic oligonucleotide
aaggcggctgcgcaggctgcc

SEQ ID NO: 244393 - DNA, 20 bp, Artificial Sequence
  Description of Artificial Sequence: Synthetic oligonucleotide
aggcggctgcgcaggctgcc

SEQ ID NO: 244394 - DNA, 20 bp, Artificial Sequence
  Description of Artificial Sequence: Synthetic oligonucleotide
ggcggctgcgcaggctgcct

SEQ ID NO: 244395 - DNA, 20 bp, Artificial Sequence
  Description of Artificial Sequence: Synthetic oligonucleotide
gcggctgcgcaggctgccga

SEQ ID NO: 244396 - DNA, 20 bp, Artificial Sequence
  Description of Artificial Sequence: Synthetic oligonucleotide
cggctgcgcaggctgccgac

SEQ ID NO: 244397 - DNA, 20 bp, Artificial Sequence
  Description of Artificial Sequence: Synthetic oligonucleotide
ggctgcgcaggctgccgacg

SEQ ID NO: 244398 - DNA, 21 bp, Artificial Sequence
  Description of Artificial Sequence: Synthetic oligonucleotide
gctgcgcaggctgccgacgca

SEQ ID NO: 244399 - DNA, 23 bp, Artificial Sequence
  Description of Artificial Sequence: Synthetic oligonucleotide
ctgcgcaggctgccgacgcagat

SEQ ID NO: 244400 - DNA, 24 bp, Artificial Sequence
  Description of Artificial Sequence: Synthetic oligonucleotide
tgcgcaggctgccgacgcagatgt

SEQ ID NO: 244401 - DNA, 23 bp, Artificial Sequence
  Description of Artificial Sequence: Synthetic oligonucleotide
gcgcaggctgccgacgcagatgt

SEQ ID NO: 244402 - DNA, 25 bp, Artificial Sequence
  Description of Artificial Sequence: Synthetic oligonucleotide
cgcaggctgccgacgcagatgtctt

SEQ ID NO: 244403 - DNA, 27 bp, Artificial Sequence
  Description of Artificial Sequence: Synthetic oligonucleotide
gcaggctgccgacgcagatgtcttcat

SEQ ID NO: 244404 - DNA, 27 bp, Artificial Sequence
  Description of Artificial Sequence: Synthetic oligonucleotide
caggctgccgacgcagatgtcttcatc

SEQ ID NO: 244405 - DNA, 27 bp, Artificial Sequence
  Description of Artificial Sequence: Synthetic oligonucleotide
aggctgccgacgcagatgtcttcatcc

SEQ ID NO: 244406 - DNA, 27 bp, Artificial Sequence
  Description of Artificial Sequence: Synthetic oligonucleotide
ggctgccgacgcagatgtcttcatcca

SEQ ID NO: 244407 - DNA, 27 bp, Artificial Sequence
  Description of Artificial Sequence: Synthetic oligonucleotide
gctgccgacgcagatgtcttcatccac

SEQ ID NO: 244408 - DNA, 27 bp, Artificial Sequence
  Description of Artificial Sequence: Synthetic oligonucleotide
ctgccgacgcagatgtcttcatccacg

SEQ ID NO: 244409 - DNA, 31 bp, Artificial Sequence
  Description of Artificial Sequence: Synthetic oligonucleotide
tgccgacgcagatgtcttcatccacgaaatg

SEQ ID NO: 244410 - DNA, 30 bp, Artificial Sequence
  Description of Artificial Sequence: Synthetic oligonucleotide
gccgacgcagatgtcttcatccacgaaatg

SEQ ID NO: 244411 - DNA, 30 bp, Artificial Sequence
  Description of Artificial Sequence: Synthetic oligonucleotide
ccgacgcagatgtcttcatccacgaaatgg

SEQ ID NO: 244412 - DNA, 31 bp, Artificial Sequence
  Description of Artificial Sequence: Synthetic oligonucleotide
cgacgcagatgtcttcatccacgaaatggag

SEQ ID NO: 244413 - DNA, 31 bp, Artificial Sequence
  Description of Artificial Sequence: Synthetic oligonucleotide
gacgcagatgtcttcatccacgaaatggagg

SEQ ID NO: 244414 - DNA, 33 bp, Artificial Sequence
  Description of Artificial Sequence: Synthetic oligonucleotide
acgcagatgtcttcatccacgaaatggaggatg

SEQ ID NO: 244415 - DNA, 32 bp, Artificial Sequence
  Description of Artificial Sequence: Synthetic oligonucleotide
cgcagatgtcttcatccacgaaatggaggatg

SEQ ID NO: 244416 - DNA, 32 bp, Artificial Sequence
  Description of Artificial Sequence: Synthetic oligonucleotide
gcagatgtcttcatccacgaaatggaggatgg

SEQ ID NO: 244417 - DNA, 38 bp, Artificial Sequence
  Description of Artificial Sequence: Synthetic oligonucleotide
cagatgtcttcatccacgaaatggaggatggaatattc

SEQ ID NO: 244418 - DNA, 39 bp, Artificial Sequence
  Description of Artificial Sequence: Synthetic oligonucleotide
agatgtcttcatccacgaaatggaggatggaatattcac

SEQ ID NO: 244419 - DNA, 38 bp, Artificial Sequence
  Description of Artificial Sequence: Synthetic oligonucleotide
gatgtcttcatccacgaaatggaggatggaatattcac

SEQ ID NO: 244420 - DNA, 39 bp, Artificial Sequence
  Description of Artificial Sequence: Synthetic oligonucleotide
atgtcttcatccacgaaatggaggatggaatattcacag

SEQ ID NO: 244421 - DNA, 38 bp, Artificial Sequence
  Description of Artificial Sequence: Synthetic oligonucleotide
tgtcttcatccacgaaatggaggatggaatattcacag

SEQ ID NO: 244422 - DNA, 37 bp, Artificial Sequence
  Description of Artificial Sequence: Synthetic oligonucleotide
gtcttcatccacgaaatggaggatggaatattcacag

SEQ ID NO: 244423 - DNA, 39 bp, Artificial Sequence
  Description of Artificial Sequence: Synthetic oligonucleotide
tcttcatccacgaaatggaggatggaatattcacagatg

SEQ ID NO: 244424 - DNA, 38 bp, Artificial Sequence
  Description of Artificial Sequence: Synthetic oligonucleotide
cttcatccacgaaatggaggatggaatattcacagatg

SEQ ID NO: 244425 - DNA, 40 bp, Artificial Sequence
  Description of Artificial Sequence: Synthetic oligonucleotide
ttcatccacgaaatggaggatggaatattcacagatgttg

SEQ ID NO: 244426 - DNA, 39 bp, Artificial Sequence
  Description of Artificial Sequence: Synthetic oligonucleotide
tcatccacgaaatggaggatggaatattcacagatgttg

SEQ ID NO: 244427 - DNA, 38 bp, Artificial Sequence
  Description of Artificial Sequence: Synthetic oligonucleotide
catccacgaaatggaggatggaatattcacagatgttg

SEQ ID NO: 244428 - DNA, 38 bp, Artificial Sequence
  Description of Artificial Sequence: Synthetic oligonucleotide
atccacgaaatggaggatggaatattcacagatgttgg

SEQ ID NO: 244429 - DNA, 37 bp, Artificial Sequence
  Description of Artificial Sequence: Synthetic oligonucleotide
tccacgaaatggaggatggaatattcacagatgttgg

SEQ ID NO: 244430 - DNA, 36 bp, Artificial Sequence
  Description of Artificial Sequence: Synthetic oligonucleotide
ccacgaaatggaggatggaatattcacagatgttgg

SEQ ID NO: 244431 - DNA, 36 bp, Artificial Sequence
  Description of Artificial Sequence: Synthetic oligonucleotide
cacgaaatggaggatggaatattcacagatgttggg

SEQ ID NO: 244432 - DNA, 36 bp, Artificial Sequence
  Description of Artificial Sequence: Synthetic oligonucleotide
acgaaatggaggatggaatattcacagatgttgggg

SEQ ID NO: 244433 - DNA, 35 bp, Artificial Sequence
  Description of Artificial Sequence: Synthetic oligonucleotide
cgaaatggaggatggaatattcacagatgttgggg

SEQ ID NO: 244434 - DNA, 36 bp, Artificial Sequence
  Description of Artificial Sequence: Synthetic oligonucleotide
gaaatggaggatggaatattcacagatgttggggag

SEQ ID NO: 244435 - DNA, 38 bp, Artificial Sequence
  Description of Artificial Sequence: Synthetic oligonucleotide
aaatggaggatggaatattcacagatgttggggagaag

SEQ ID NO: 244436 - DNA, 37 bp, Artificial Sequence
  Description of Artificial Sequence: Synthetic oligonucleotide
aatggaggatggaatattcacagatgttggggagaag

SEQ ID NO: 244437 - DNA, 36 bp, Artificial Sequence
  Description of Artificial Sequence: Synthetic oligonucleotide
atggaggatggaatattcacagatgttggggagaag

SEQ ID NO: 244438 - DNA, 35 bp, Artificial Sequence
  Description of Artificial Sequence: Synthetic oligonucleotide
tggaggatggaatattcacagatgttggggagaag

SEQ ID NO: 244439 - DNA, 34 bp, Artificial Sequence
  Description of Artificial Sequence: Synthetic oligonucleotide
ggaggatggaatattcacagatgttggggagaag

SEQ ID NO: 244440 - DNA, 34 bp, Artificial Sequence
  Description of Artificial Sequence: Synthetic oligonucleotide
gaggatggaatattcacagatgttggggagaagc

SEQ ID NO: 244441 - DNA, 34 bp, Artificial Sequence
  Description of Artificial Sequence: Synthetic oligonucleotide
aggatggaatattcacagatgttggggagaagcg

SEQ ID NO: 244442 - DNA, 33 bp, Artificial Sequence
  Description of Artificial Sequence: Synthetic oligonucleotide
ggatggaatattcacagatgttggggagaagcg

SEQ ID NO: 244443 - DNA, 33 bp, Artificial Sequence
  Description of Artificial Sequence: Synthetic oligonucleotide
gatggaatattcacagatgttggggagaagcgg

SEQ ID NO: 244444 - DNA, 34 bp, Artificial Sequence
  Description of Artificial Sequence: Synthetic oligonucleotide
atggaatattcacagatgttggggagaagcggag

SEQ ID NO: 244445 - DNA, 33 bp, Artificial Sequence
  Description of Artificial Sequence: Synthetic oligonucleotide
tggaatattcacagatgttggggagaagcggag

SEQ ID NO: 244446 - DNA, 32 bp, Artificial Sequence
  Description of Artificial Sequence: Synthetic oligonucleotide
ggaatattcacagatgttggggagaagcggag

SEQ ID NO: 244447 - DNA, 32 bp, Artificial Sequence
  Description of Artificial Sequence: Synthetic oligonucleotide
gaatattcacagatgttggggagaagcggagc

SEQ ID NO: 244448 - DNA, 32 bp, Artificial Sequence
  Description of Artificial Sequence: Synthetic oligonucleotide
aatattcacagatgttggggagaagcggagcc

SEQ ID NO: 244449 - DNA, 31 bp, Artificial Sequence
  Description of Artificial Sequence: Synthetic oligonucleotide
atattcacagatgttggggagaagcggagcc

SEQ ID NO: 244450 - DNA, 30 bp, Artificial Sequence
  Description of Artificial Sequence: Synthetic oligonucleotide
tattcacagatgttggggagaagcggagcc

SEQ ID NO: 244451 - DNA, 29 bp, Artificial Sequence
  Description of Artificial Sequence: Synthetic oligonucleotide
attcacagatgttggggagaagcggagcc

SEQ ID NO: 244452 - DNA, 28 bp, Artificial Sequence
  Description of Artificial Sequence: Synthetic oligonucleotide
ttcacagatgttggggagaagcggagcc

SEQ ID NO: 244453 - DNA, 27 bp, Artificial Sequence
  Description of Artificial Sequence: Synthetic oligonucleotide
tcacagatgttggggagaagcggagcc

SEQ ID NO: 244454 - DNA, 27 bp, Artificial Sequence
  Description of Artificial Sequence: Synthetic oligonucleotide
cacagatgttggggagaagcggagcca

SEQ ID NO: 244455 - DNA, 27 bp, Artificial Sequence
  Description of Artificial Sequence: Synthetic oligonucleotide
acagatgttggggagaagcggagccag

SEQ ID NO: 244456 - DNA, 26 bp, Artificial Sequence
  Description of Artificial Sequence: Synthetic oligonucleotide
cagatgttggggagaagcggagccag

SEQ ID NO: 244457 - DNA, 27 bp, Artificial Sequence
  Description of Artificial Sequence: Synthetic oligonucleotide
agatgttggggagaagcggagccagca

SEQ ID NO: 244458 - DNA, 26 bp, Artificial Sequence
  Description of Artificial Sequence: Synthetic oligonucleotide
gatgttggggagaagcggagccagca

SEQ ID NO: 244459 - DNA, 26 bp, Artificial Sequence
  Description of Artificial Sequence: Synthetic oligonucleotide
atgttggggagaagcggagccagcag

SEQ ID NO: 244460 - DNA, 25 bp, Artificial Sequence
  Description of Artificial Sequence: Synthetic oligonucleotide
tgttggggagaagcggagccagcag

SEQ ID NO: 244461 - DNA, 24 bp, Artificial Sequence
  Description of Artificial Sequence: Synthetic oligonucleotide
gttggggagaagcggagccagcag

SEQ ID NO: 244462 - DNA, 24 bp, Artificial Sequence
  Description of Artificial Sequence: Synthetic oligonucleotide
ttggggagaagcggagccagcagg

SEQ ID NO: 244463 - DNA, 23 bp, Artificial Sequence
  Description of Artificial Sequence: Synthetic oligonucleotide
tggggagaagcggagccagcagg

SEQ ID NO: 244464 - DNA, 22 bp, Artificial Sequence
  Description of Artificial Sequence: Synthetic oligonucleotide
ggggagaagcggagccagcagg

SEQ ID NO: 244465 - DNA, 23 bp, Artificial Sequence
  Description of Artificial Sequence: Synthetic oligonucleotide
gggagaagcggagccagcaggct

SEQ ID NO: 244466 - DNA, 23 bp, Artificial Sequence
  Description of Artificial Sequence: Synthetic oligonucleotide
ggagaagcggagccagcaggctg

SEQ ID NO: 244467 - DNA, 23 bp, Artificial Sequence
  Description of Artificial Sequence: Synthetic oligonucleotide
gagaagcggagccagcaggctgc

SEQ ID NO: 244468 - DNA, 23 bp, Artificial Sequence
  Description of Artificial Sequence: Synthetic oligonucleotide
agaagcggagccagcaggctgcg

SEQ ID NO: 244469 - DNA, 22 bp, Artificial Sequence
  Description of Artificial Sequence: Synthetic oligonucleotide
gaagcggagccagcaggctgcg

SEQ ID NO: 244470 - DNA, 22 bp, Artificial Sequence
  Description of Artificial Sequence: Synthetic oligonucleotide
aagcggagccagcaggctgcgg

SEQ ID NO: 244471 - DNA, 21 bp, Artificial Sequence
  Description of Artificial Sequence: Synthetic oligonucleotide
agcggagccagcaggctgcgg

SEQ ID NO: 244472 - DNA, 20 bp, Artificial Sequence
  Description of Artificial Sequence: Synthetic oligonucleotide
gcggagccagcaggctgcgg

SEQ ID NO: 244473 - DNA, 21 bp, Artificial Sequence
  Description of Artificial Sequence: Synthetic oligonucleotide
cggagccagcaggctgcgggt

SEQ ID NO: 244474 - DNA, 22 bp, Artificial Sequence
  Description of Artificial Sequence: Synthetic oligonucleotide
ggagccagcaggctgcgggtca

SEQ ID NO: 244475 - DNA, 25 bp, Artificial Sequence
  Description of Artificial Sequence: Synthetic oligonucleotide
gagccagcaggctgcgggtcagaaa

SEQ ID NO: 244476 - DNA, 27 bp, Artificial Sequence
  Description of Artificial Sequence: Synthetic oligonucleotide
agccagcaggctgcgggtcagaaacaa

SEQ ID NO: 244477 - DNA, 26 bp, Artificial Sequence
  Description of Artificial Sequence: Synthetic oligonucleotide
gccagcaggctgcgggtcagaaacaa

SEQ ID NO: 244478 - DNA, 26 bp, Artificial Sequence
  Description of Artificial Sequence: Synthetic oligonucleotide
ccagcaggctgcgggtcagaaacaag

SEQ ID NO: 244479 - DNA, 27 bp, Artificial Sequence
  Description of Artificial Sequence: Synthetic oligonucleotide
cagcaggctgcgggtcagaaacaaggt

SEQ ID NO: 244480 - DNA, 27 bp, Artificial Sequence
  Description of Artificial Sequence: Synthetic oligonucleotide
agcaggctgcgggtcagaaacaaggtc

SEQ ID NO: 244481 - DNA, 27 bp, Artificial Sequence
  Description of Artificial Sequence: Synthetic oligonucleotide
gcaggctgcgggtcagaaacaaggtct

SEQ ID NO: 244482 - DNA, 27 bp, Artificial Sequence
  Description of Artificial Sequence: Synthetic oligonucleotide
caggctgcgggtcagaaacaaggtctg

SEQ ID NO: 244483 - DNA, 27 bp, Artificial Sequence
  Description of Artificial Sequence: Synthetic oligonucleotide
aggctgcgggtcagaaacaaggtctgg

SEQ ID NO: 244484 - DNA, 26 bp, Artificial Sequence
  Description of Artificial Sequence: Synthetic oligonucleotide
ggctgcgggtcagaaacaaggtctgg

SEQ ID NO: 244485 - DNA, 26 bp, Artificial Sequence
  Description of Artificial Sequence: Synthetic oligonucleotide
gctgcgggtcagaaacaaggtctggc

SEQ ID NO: 244486 - DNA, 27 bp, Artificial Sequence
  Description of Artificial Sequence: Synthetic oligonucleotide
ctgcgggtcagaaacaaggtctggcca

SEQ ID NO: 244487 - DNA, 29 bp, Artificial Sequence
  Description of Artificial Sequence: Synthetic oligonucleotide
tgcgggtcagaaacaaggtctggccaatg

SEQ ID NO: 244488 - DNA, 28 bp, Artificial Sequence
  Description of Artificial Sequence: Synthetic oligonucleotide
gcgggtcagaaacaaggtctggccaatg

SEQ ID NO: 244489 - DNA, 28 bp, Artificial Sequence
  Description of Artificial Sequence: Synthetic oligonucleotide
cgggtcagaaacaaggtctggccaatgc

SEQ ID NO: 244490 - DNA, 28 bp, Artificial Sequence
  Description of Artificial Sequence: Synthetic oligonucleotide
gggtcagaaacaaggtctggccaatgcc

SEQ ID NO: 244491 - DNA, 28 bp, Artificial Sequence
  Description of Artificial Sequence: Synthetic oligonucleotide
ggtcagaaacaaggtctggccaatgccc

SEQ ID NO: 244492 - DNA, 28 bp, Artificial Sequence
  Description of Artificial Sequence: Synthetic oligonucleotide
gtcagaaacaaggtctggccaatgcccg

SEQ ID NO: 244493 - DNA, 28 bp, Artificial Sequence
  Description of Artificial Sequence: Synthetic oligonucleotide
tcagaaacaaggtctggccaatgcccgg

SEQ ID NO: 244494 - DNA, 27 bp, Artificial Sequence
  Description of Artificial Sequence: Synthetic oligonucleotide
cagaaacaaggtctggccaatgcccgg

SEQ ID NO: 244495 - DNA, 27 bp, Artificial Sequence
  Description of Artificial Sequence: Synthetic oligonucleotide
agaaacaaggtctggccaatgcccggg

SEQ ID NO: 244496 - DNA, 26 bp, Artificial Sequence
  Description of Artificial Sequence: Synthetic oligonucleotide
gaaacaaggtctggccaatgcccggg

SEQ ID NO: 244497 - DNA, 26 bp, Artificial Sequence
  Description of Artificial Sequence: Synthetic oligonucleotide
aaacaaggtctggccaatgcccgggc

SEQ ID NO: 244498 - DNA, 25 bp, Artificial Sequence
  Description of Artificial Sequence: Synthetic oligonucleotide
aacaaggtctggccaatgcccgggc

SEQ ID NO: 244499 - DNA, 24 bp, Artificial Sequence
  Description of Artificial Sequence: Synthetic oligonucleotide
acaaggtctggccaatgcccgggc

SEQ ID NO: 244500 - DNA, 23 bp, Artificial Sequence
  Description of Artificial Sequence: Synthetic oligonucleotide
caaggtctggccaatgcccgggc

SEQ ID NO: 244501 - DNA, 23 bp, Artificial Sequence
  Description of Artificial Sequence: Synthetic oligonucleotide
aaggtctggccaatgcccgggcg

SEQ ID NO: 244502 - DNA, 22 bp, Artificial Sequence
  Description of Artificial Sequence: Synthetic oligonucleotide
aggtctggccaatgcccgggcg

SEQ ID NO: 244503 - DNA, 21 bp, Artificial Sequence
  Description of Artificial Sequence: Synthetic oligonucleotide
ggtctggccaatgcccgggcg

SEQ ID NO: 244504 - DNA, 23 bp, Artificial Sequence
  Description of Artificial Sequence: Synthetic oligonucleotide
gtctggccaatgcccgggcgctt

SEQ ID NO: 244505 - DNA, 25 bp, Artificial Sequence
  Description of Artificial Sequence: Synthetic oligonucleotide
tctggccaatgcccgggcgcttgta

SEQ ID NO: 244506 - DNA, 24 bp, Artificial Sequence
  Description of Artificial Sequence: Synthetic oligonucleotide
ctggccaatgcccgggcgcttgta

SEQ ID NO: 244507 - DNA, 24 bp, Artificial Sequence
  Description of Artificial Sequence: Synthetic oligonucleotide
tggccaatgcccgggcgcttgtac

SEQ ID NO: 244508 - DNA, 23 bp, Artificial Sequence
  Description of Artificial Sequence: Synthetic oligonucleotide
ggccaatgcccgggcgcttgtac

SEQ ID NO: 244509 - DNA, 24 bp, Artificial Sequence
  Description of Artificial Sequence: Synthetic oligonucleotide
gccaatgcccgggcgcttgtacga

SEQ ID NO: 244510 - DNA, 25 bp, Artificial Sequence
  Description of Artificial Sequence: Synthetic oligonucleotide
ccaatgcccgggcgcttgtacgaca

SEQ ID NO: 244511 - DNA, 25 bp, Artificial Sequence
  Description of Artificial Sequence: Synthetic oligonucleotide
caatgcccgggcgcttgtacgacac

SEQ ID NO: 244512 - DNA, 25 bp, Artificial Sequence
  Description of Artificial Sequence: Synthetic oligonucleotide
aatgcccgggcgcttgtacgacacc

SEQ ID NO: 244513 - DNA, 24 bp, Artificial Sequence
  Description of Artificial Sequence: Synthetic oligonucleotide
atgcccgggcgcttgtacgacacc

SEQ ID NO: 244514 - DNA, 23 bp, Artificial Sequence
  Description of Artificial Sequence: Synthetic oligonucleotide
tgcccgggcgcttgtacgacacc

SEQ ID NO: 244515 - DNA, 22 bp, Artificial Sequence
  Description of Artificial Sequence: Synthetic oligonucleotide
gcccgggcgcttgtacgacacc

SEQ ID NO: 244516 - DNA, 22 bp, Artificial Sequence
  Description of Artificial Sequence: Synthetic oligonucleotide
cccgggcgcttgtacgacaccc

SEQ ID NO: 244517 - DNA, 22 bp, Artificial Sequence
  Description of Artificial Sequence: Synthetic oligonucleotide
ccgggcgcttgtacgacacccg

SEQ ID NO: 244518 - DNA, 22 bp, Artificial Sequence
  Description of Artificial Sequence: Synthetic oligonucleotide
cgggcgcttgtacgacacccgc

SEQ ID NO: 244519 - DNA, 22 bp, Artificial Sequence
  Description of Artificial Sequence: Synthetic oligonucleotide
gggcgcttgtacgacacccgcg

SEQ ID NO: 244520 - DNA, 22 bp, Artificial Sequence
  Description of Artificial Sequence: Synthetic oligonucleotide
ggcgcttgtacgacacccgcgg

SEQ ID NO: 244521 - DNA, 23 bp, Artificial Sequence
  Description of Artificial Sequence: Synthetic oligonucleotide
gcgcttgtacgacacccgcggga

SEQ ID NO: 244522 - DNA, 23 bp, Artificial Sequence
  Description of Artificial Sequence: Synthetic oligonucleotide
cgcttgtacgacacccgcgggac

SEQ ID NO: 244523 - DNA, 24 bp, Artificial Sequence
  Description of Artificial Sequence: Synthetic oligonucleotide
gcttgtacgacacccgcgggacct

SEQ ID NO: 244524 - DNA, 26 bp, Artificial Sequence
  Description of Artificial Sequence: Synthetic oligonucleotide
cttgtacgacacccgcgggacctcat

SEQ ID NO: 244525 - DNA, 26 bp, Artificial Sequence
  Description of Artificial Sequence: Synthetic oligonucleotide
ttgtacgacacccgcgggacctcatc

SEQ ID NO: 244526 - DNA, 25 bp, Artificial Sequence
  Description of Artificial Sequence: Synthetic oligonucleotide
tgtacgacacccgcgggacctcatc

SEQ ID NO: 244527 - DNA, 24 bp, Artificial Sequence
  Description of Artificial Sequence: Synthetic oligonucleotide
gtacgacacccgcgggacctcatc

SEQ ID NO: 244528 - DNA, 25 bp, Artificial Sequence
  Description of Artificial Sequence: Synthetic oligonucleotide
tacgacacccgcgggacctcatcct

SEQ ID NO: 244529 - DNA, 24 bp, Artificial Sequence
  Description of Artificial Sequence: Synthetic oligonucleotide
acgacacccgcgggacctcatcct

SEQ ID NO: 244530 - DNA, 23 bp, Artificial Sequence
  Description of Artificial Sequence: Synthetic oligonucleotide
cgacacccgcgggacctcatcct

SEQ ID NO: 244531 - DNA, 23 bp, Artificial Sequence
  Description of Artificial Sequence: Synthetic oligonucleotide
gacacccgcgggacctcatcctc

SEQ ID NO: 244532 - DNA, 25 bp, Artificial Sequence
  Description of Artificial Sequence: Synthetic oligonucleotide
acacccgcgggacctcatcctcgat

SEQ ID NO: 244533 - DNA, 24 bp, Artificial Sequence
  Description of Artificial Sequence: Synthetic oligonucleotide
cacccgcgggacctcatcctcgat

SEQ ID NO: 244534 - DNA, 25 bp, Artificial Sequence
  Description of Artificial Sequence: Synthetic oligonucleotide
acccgcgggacctcatcctcgatga

SEQ ID NO: 244535 - DNA, 24 bp, Artificial Sequence
  Description of Artificial Sequence: Synthetic oligonucleotide
cccgcgggacctcatcctcgatga

SEQ ID NO: 244536 - DNA, 24 bp, Artificial Sequence
  Description of Artificial Sequence: Synthetic oligonucleotide
ccgcgggacctcatcctcgatgag

SEQ ID NO: 244537 - DNA, 24 bp, Artificial Sequence
  Description of Artificial Sequence: Synthetic oligonucleotide
cgcgggacctcatcctcgatgagg

SEQ ID NO: 244538 - DNA, 26 bp, Artificial Sequence
  Description of Artificial Sequence: Synthetic oligonucleotide
gcgggacctcatcctcgatgaggctt

SEQ ID NO: 244539 - DNA, 27 bp, Artificial Sequence
  Description of Artificial Sequence: Synthetic oligonucleotide
cgggacctcatcctcgatgaggcttct

SEQ ID NO: 244540 - DNA, 28 bp, Artificial Sequence
  Description of Artificial Sequence: Synthetic oligonucleotide
gggacctcatcctcgatgaggcttctag

SEQ ID NO: 244541 - DNA, 29 bp, Artificial Sequence
  Description of Artificial Sequence: Synthetic oligonucleotide
ggacctcatcctcgatgaggcttctagtg

SEQ ID NO: 244542 - DNA, 29 bp, Artificial Sequence
  Description of Artificial Sequence: Synthetic oligonucleotide
gacctcatcctcgatgaggcttctagtgc

SEQ ID NO: 244543 - DNA, 29 bp, Artificial Sequence
  Description of Artificial Sequence: Synthetic oligonucleotide
acctcatcctcgatgaggcttctagtgcc

SEQ ID NO: 244544 - DNA, 28 bp, Artificial Sequence
  Description of Artificial Sequence: Synthetic oligonucleotide
cctcatcctcgatgaggcttctagtgcc

SEQ ID NO: 244545 - DNA, 28 bp, Artificial Sequence
  Description of Artificial Sequence: Synthetic oligonucleotide
ctcatcctcgatgaggcttctagtgccc

SEQ ID NO: 244546 - DNA, 30 bp, Artificial Sequence
  Description of Artificial Sequence: Synthetic oligonucleotide
tcatcctcgatgaggcttctagtgcccaag

SEQ ID NO: 244547 - DNA, 29 bp, Artificial Sequence
  Description of Artificial Sequence: Synthetic oligonucleotide
catcctcgatgaggcttctagtgcccaag

SEQ ID NO: 244548 - DNA, 31 bp, Artificial Sequence
  Description of Artificial Sequence: Synthetic oligonucleotide
atcctcgatgaggcttctagtgcccaagatg

SEQ ID NO: 244549 - DNA, 30 bp, Artificial Sequence
  Description of Artificial Sequence: Synthetic oligonucleotide
tcctcgatgaggcttctagtgcccaagatg

SEQ ID NO: 244550 - DNA, 29 bp, Artificial Sequence
  Description of Artificial Sequence: Synthetic oligonucleotide
cctcgatgaggcttctagtgcccaagatg

SEQ ID NO: 244551 - DNA, 30 bp, Artificial Sequence
  Description of Artificial Sequence: Synthetic oligonucleotide
ctcgatgaggcttctagtgcccaagatgtg

SEQ ID NO: 244552 - DNA, 30 bp, Artificial Sequence
  Description of Artificial Sequence: Synthetic oligonucleotide
tcgatgaggcttctagtgcccaagatgtgc

SEQ ID NO: 244553 - DNA, 29 bp, Artificial Sequence
  Description of Artificial Sequence: Synthetic oligonucleotide
cgatgaggcttctagtgcccaagatgtgc

SEQ ID NO: 244554 - DNA, 30 bp, Artificial Sequence
  Description of Artificial Sequence: Synthetic oligonucleotide
gatgaggcttctagtgcccaagatgtgcac

SEQ ID NO: 244555 - DNA, 31 bp, Artificial Sequence
  Description of Artificial Sequence: Synthetic oligonucleotide
atgaggcttctagtgcccaagatgtgcactg

SEQ ID NO: 244556 - DNA, 30 bp, Artificial Sequence
  Description of Artificial Sequence: Synthetic oligonucleotide
tgaggcttctagtgcccaagatgtgcactg

SEQ ID NO: 244557 - DNA, 29 bp, Artificial Sequence
  Description of Artificial Sequence: Synthetic oligonucleotide
gaggcttctagtgcccaagatgtgcactg

SEQ ID NO: 244558 - DNA, 29 bp, Artificial Sequence
  Description of Artificial Sequence: Synthetic oligonucleotide
aggcttctagtgcccaagatgtgcactgc

SEQ ID NO: 244559 - DNA, 28 bp, Artificial Sequence
  Description of Artificial Sequence: Synthetic oligonucleotide
ggcttctagtgcccaagatgtgcactgc

SEQ ID NO: 244560 - DNA, 28 bp, Artificial Sequence
  Description of Artificial Sequence: Synthetic oligonucleotide
gcttctagtgcccaagatgtgcactgcg

SEQ ID NO: 244561 - DNA, 29 bp, Artificial Sequence
  Description of Artificial Sequence: Synthetic oligonucleotide
cttctagtgcccaagatgtgcactgcgag

SEQ ID NO: 244562 - DNA, 29 bp, Artificial Sequence
  Description of Artificial Sequence: Synthetic oligonucleotide
ttctagtgcccaagatgtgcactgcgagc

SEQ ID NO: 244563 - DNA, 28 bp, Artificial Sequence
  Description of Artificial Sequence: Synthetic oligonucleotide
tctagtgcccaagatgtgcactgcgagc

SEQ ID NO: 244564 - DNA, 27 bp, Artificial Sequence
  Description of Artificial Sequence: Synthetic oligonucleotide
ctagtgcccaagatgtgcactgcgagc

SEQ ID NO: 244565 - DNA, 28 bp, Artificial Sequence
  Description of Artificial Sequence: Synthetic oligonucleotide
tagtgcccaagatgtgcactgcgagcag

SEQ ID NO: 244566 - DNA, 27 bp, Artificial Sequence
  Description of Artificial Sequence: Synthetic oligonucleotide
agtgcccaagatgtgcactgcgagcag

SEQ ID NO: 244567 - DNA, 26 bp, Artificial Sequence
  Description of Artificial Sequence: Synthetic oligonucleotide
gtgcccaagatgtgcactgcgagcag

SEQ ID NO: 244568 - DNA, 26 bp, Artificial Sequence
  Description of Artificial Sequence: Synthetic oligonucleotide
tgcccaagatgtgcactgcgagcagc

SEQ ID NO: 244569 - DNA, 25 bp, Artificial Sequence
  Description of Artificial Sequence: Synthetic oligonucleotide
gcccaagatgtgcactgcgagcagc

SEQ ID NO: 244570 - DNA, 25 bp, Artificial Sequence
  Description of Artificial Sequence: Synthetic oligonucleotide
cccaagatgtgcactgcgagcagcc

SEQ ID NO: 244571 - DNA, 25 bp, Artificial Sequence
  Description of Artificial Sequence: Synthetic oligonucleotide
ccaagatgtgcactgcgagcagccc

SEQ ID NO: 244572 - DNA, 26 bp, Artificial Sequence
  Description of Artificial Sequence: Synthetic oligonucleotide
caagatgtgcactgcgagcagcccct

SEQ ID NO: 244573 - DNA, 26 bp, Artificial Sequence
  Description of Artificial Sequence: Synthetic oligonucleotide
aagatgtgcactgcgagcagcccctg

SEQ ID NO: 244574 - DNA, 25 bp, Artificial Sequence
  Description of Artificial Sequence: Synthetic oligonucleotide
agatgtgcactgcgagcagcccctg

SEQ ID NO: 244575 - DNA, 24 bp, Artificial Sequence
  Description of Artificial Sequence: Synthetic oligonucleotide
gatgtgcactgcgagcagcccctg

SEQ ID NO: 244576 - DNA, 25 bp, Artificial Sequence
  Description of Artificial Sequence: Synthetic oligonucleotide
atgtgcactgcgagcagcccctgca

SEQ ID NO: 244577 - DNA, 24 bp, Artificial Sequence
  Description of Artificial Sequence: Synthetic oligonucleotide
tgtgcactgcgagcagcccctgca

SEQ ID NO: 244578 - DNA, 23 bp, Artificial Sequence
  Description of Artificial Sequence: Synthetic oligonucleotide
gtgcactgcgagcagcccctgca

SEQ ID NO: 244579 - DNA, 23 bp, Artificial Sequence
  Description of Artificial Sequence: Synthetic oligonucleotide
tgcactgcgagcagcccctgcag

SEQ ID NO: 244580 - DNA, 22 bp, Artificial Sequence
  Description of Artificial Sequence: Synthetic oligonucleotide
gcactgcgagcagcccctgcag

SEQ ID NO: 244581 - DNA, 23 bp, Artificial Sequence
  Description of Artificial Sequence: Synthetic oligonucleotide
cactgcgagcagcccctgcaggt

SEQ ID NO: 244582 - DNA, 24 bp, Artificial Sequence
  Description of Artificial Sequence: Synthetic oligonucleotide
actgcgagcagcccctgcaggtct

SEQ ID NO: 244583 - DNA, 23 bp, Artificial Sequence
  Description of Artificial Sequence: Synthetic oligonucleotide
ctgcgagcagcccctgcaggtct

SEQ ID NO: 244584 - DNA, 23 bp, Artificial Sequence
  Description of Artificial Sequence: Synthetic oligonucleotide
tgcgagcagcccctgcaggtctg

SEQ ID NO: 244585 - DNA, 22 bp, Artificial Sequence
  Description of Artificial Sequence: Synthetic oligonucleotide
gcgagcagcccctgcaggtctg

SEQ ID NO: 244586 - DNA, 26 bp, Artificial Sequence
  Description of Artificial Sequence: Synthetic oligonucleotide
cgagcagcccctgcaggtctggaatt

SEQ ID NO: 244587 - DNA, 26 bp, Artificial Sequence
  Description of Artificial Sequence: Synthetic oligonucleotide
gagcagcccctgcaggtctggaattc

SEQ ID NO: 244588 - DNA, 26 bp, Artificial Sequence
  Description of Artificial Sequence: Synthetic oligonucleotide
agcagcccctgcaggtctggaattcg

SEQ ID NO: 244589 - DNA, 25 bp, Artificial Sequence
  Description of Artificial Sequence: Synthetic oligonucleotide
gcagcccctgcaggtctggaattcg

SEQ ID NO: 244590 - DNA, 25 bp, Artificial Sequence
  Description of Artificial Sequence: Synthetic oligonucleotide
cagcccctgcaggtctggaattcgc

SEQ ID NO: 244591 - DNA, 26 bp, Artificial Sequence
  Description of Artificial Sequence: Synthetic oligonucleotide
agcccctgcaggtctggaattcgcgt

SEQ ID NO: 244592 - DNA, 25 bp, Artificial Sequence
  Description of Artificial Sequence: Synthetic oligonucleotide
gcccctgcaggtctggaattcgcgt

SEQ ID NO: 244593 - DNA, 25 bp, Artificial Sequence
  Description of Artificial Sequence: Synthetic oligonucleotide
cccctgcaggtctggaattcgcgtg

SEQ ID NO: 244594 - DNA, 25 bp, Artificial Sequence
  Description of Artificial Sequence: Synthetic oligonucleotide
ccctgcaggtctggaattcgcgtgg

SEQ ID NO: 244595 - DNA, 25 bp, Artificial Sequence
  Description of Artificial Sequence: Synthetic oligonucleotide
cctgcaggtctggaattcgcgtggg

SEQ ID NO: 244596 - DNA, 27 bp, Artificial Sequence
  Description of Artificial Sequence: Synthetic oligonucleotide
ctgcaggtctggaattcgcgtggggat

SEQ ID NO: 244597 - DNA, 27 bp, Artificial Sequence
  Description of Artificial Sequence: Synthetic oligonucleotide
tgcaggtctggaattcgcgtggggatg

SEQ ID NO: 244598 - DNA, 26 bp, Artificial Sequence
  Description of Artificial Sequence: Synthetic oligonucleotide
gcaggtctggaattcgcgtggggatg

SEQ ID NO: 244599 - DNA, 26 bp, Artificial Sequence
  Description of Artificial Sequence: Synthetic oligonucleotide
caggtctggaattcgcgtggggatgg

SEQ ID NO: 244600 - DNA, 27 bp, Artificial Sequence
  Description of Artificial Sequence: Synthetic oligonucleotide
aggtctggaattcgcgtggggatggca

SEQ ID NO: 244601 - DNA, 26 bp, Artificial Sequence
  Description of Artificial Sequence: Synthetic oligonucleotide
ggtctggaattcgcgtggggatggca

SEQ ID NO: 244602 - DNA, 27 bp, Artificial Sequence
  Description of Artificial Sequence: Synthetic oligonucleotide
gtctggaattcgcgtggggatggcaca

SEQ ID NO: 244603 - DNA, 27 bp, Artificial Sequence
  Description of Artificial Sequence: Synthetic oligonucleotide
tctggaattcgcgtggggatggcacag

SEQ ID NO: 244604 - DNA, 27 bp, Artificial Sequence
  Description of Artificial Sequence: Synthetic oligonucleotide
ctggaattcgcgtggggatggcacagt

SEQ ID NO: 244605 - DNA, 27 bp, Artificial Sequence
  Description of Artificial Sequence: Synthetic oligonucleotide
tggaattcgcgtggggatggcacagtg

SEQ ID NO: 244606 - DNA, 26 bp, Artificial Sequence
  Description of Artificial Sequence: Synthetic oligonucleotide
ggaattcgcgtggggatggcacagtg

SEQ ID NO: 244607 - DNA, 27 bp, Artificial Sequence
  Description of Artificial Sequence: Synthetic oligonucleotide
gaattcgcgtggggatggcacagtgca

SEQ ID NO: 244608 - DNA, 27 bp, Artificial Sequence
  Description of Artificial Sequence: Synthetic oligonucleotide
aattcgcgtggggatggcacagtgcag

SEQ ID NO: 244609 - DNA, 26 bp, Artificial Sequence
  Description of Artificial Sequence: Synthetic oligonucleotide
attcgcgtggggatggcacagtgcag

SEQ ID NO: 244610 - DNA, 25 bp, Artificial Sequence
  Description of Artificial Sequence: Synthetic oligonucleotide
ttcgcgtggggatggcacagtgcag

SEQ ID NO: 244611 - DNA, 24 bp, Artificial Sequence
  Description of Artificial Sequence: Synthetic oligonucleotide
tcgcgtggggatggcacagtgcag

SEQ ID NO: 244612 - DNA, 23 bp, Artificial Sequence
  Description of Artificial Sequence: Synthetic oligonucleotide
cgcgtggggatggcacagtgcag

SEQ ID NO: 244613 - DNA, 24 bp, Artificial Sequence
  Description of Artificial Sequence: Synthetic oligonucleotide
gcgtggggatggcacagtgcaggt

SEQ ID NO: 244614 - DNA, 27 bp, Artificial Sequence
  Description of Artificial Sequence: Synthetic oligonucleotide
cgtggggatggcacagtgcaggtgatt

SEQ ID NO: 244615 - DNA, 27 bp, Artificial Sequence
  Description of Artificial Sequence: Synthetic oligonucleotide
gtggggatggcacagtgcaggtgattg

SEQ ID NO: 244616 - DNA, 27 bp, Artificial Sequence
  Description of Artificial Sequence: Synthetic oligonucleotide
tggggatggcacagtgcaggtgattgc

SEQ ID NO: 244617 - DNA, 27 bp, Artificial Sequence
  Description of Artificial Sequence: Synthetic oligonucleotide
ggggatggcacagtgcaggtgattgca

SEQ ID NO: 244618 - DNA, 27 bp, Artificial Sequence
  Description of Artificial Sequence: Synthetic oligonucleotide
gggatggcacagtgcaggtgattgcac

SEQ ID NO: 244619 - DNA, 28 bp, Artificial Sequence
  Description of Artificial Sequence: Synthetic oligonucleotide
ggatggcacagtgcaggtgattgcacac

SEQ ID NO: 244620 - DNA, 29 bp, Artificial Sequence
  Description of Artificial Sequence: Synthetic oligonucleotide
gatggcacagtgcaggtgattgcacacag

SEQ ID NO: 244621 - DNA, 29 bp, Artificial Sequence
  Description of Artificial Sequence: Synthetic oligonucleotide
atggcacagtgcaggtgattgcacacagg

SEQ ID NO: 244622 - DNA, 28 bp, Artificial Sequence
  Description of Artificial Sequence: Synthetic oligonucleotide
tggcacagtgcaggtgattgcacacagg

SEQ ID NO: 244623 - DNA, 27 bp, Artificial Sequence
  Description of Artificial Sequence: Synthetic oligonucleotide
ggcacagtgcaggtgattgcacacagg

SEQ ID NO: 244624 - DNA, 27 bp, Artificial Sequence
  Description of Artificial Sequence: Synthetic oligonucleotide
gcacagtgcaggtgattgcacacaggc

SEQ ID NO: 244625 - DNA, 28 bp, Artificial Sequence
  Description of Artificial Sequence: Synthetic oligonucleotide
cacagtgcaggtgattgcacacaggctg

SEQ ID NO: 244626 - DNA, 28 bp, Artificial Sequence
  Description of Artificial Sequence: Synthetic oligonucleotide
acagtgcaggtgattgcacacaggctgg

SEQ ID NO: 244627 - DNA, 27 bp, Artificial Sequence
  Description of Artificial Sequence: Synthetic oligonucleotide
cagtgcaggtgattgcacacaggctgg

SEQ ID NO: 244628 - DNA, 28 bp, Artificial Sequence
  Description of Artificial Sequence: Synthetic oligonucleotide
agtgcaggtgattgcacacaggctggag

SEQ ID NO: 244629 - DNA, 27 bp, Artificial Sequence
  Description of Artificial Sequence: Synthetic oligonucleotide
gtgcaggtgattgcacacaggctggag

SEQ ID NO: 244630 - DNA, 27 bp, Artificial Sequence
  Description of Artificial Sequence: Synthetic oligonucleotide
tgcaggtgattgcacacaggctggagg

SEQ ID NO: 244631 - DNA, 26 bp, Artificial Sequence
  Description of Artificial Sequence: Synthetic oligonucleotide
gcaggtgattgcacacaggctggagg

SEQ ID NO: 244632 - DNA, 27 bp, Artificial Sequence
  Description of Artificial Sequence: Synthetic oligonucleotide
caggtgattgcacacaggctggaggca

SEQ ID NO: 244633 - DNA, 27 bp, Artificial Sequence
  Description of Artificial Sequence: Synthetic oligonucleotide
aggtgattgcacacaggctggaggcag

SEQ ID NO: 244634 - DNA, 27 bp, Artificial Sequence
  Description of Artificial Sequence: Synthetic oligonucleotide
ggtgattgcacacaggctggaggcagt

SEQ ID NO: 244635 - DNA, 28 bp, Artificial Sequence
  Description of Artificial Sequence: Synthetic oligonucleotide
gtgattgcacacaggctggaggcagttc

SEQ ID NO: 244636 - DNA, 29 bp, Artificial Sequence
  Description of Artificial Sequence: Synthetic oligonucleotide
tgattgcacacaggctggaggcagttctg

SEQ ID NO: 244637 - DNA, 28 bp, Artificial Sequence
  Description of Artificial Sequence: Synthetic oligonucleotide
gattgcacacaggctggaggcagttctg

SEQ ID NO: 244638 - DNA, 28 bp, Artificial Sequence
  Description of Artificial Sequence: Synthetic oligonucleotide
attgcacacaggctggaggcagttctgc

SEQ ID NO: 244639 - DNA, 27 bp, Artificial Sequence
  Description of Artificial Sequence: Synthetic oligonucleotide
ttgcacacaggctggaggcagttctgc

SEQ ID NO: 244640 - DNA, 26 bp, Artificial Sequence
  Description of Artificial Sequence: Synthetic oligonucleotide
tgcacacaggctggaggcagttctgc

SEQ ID NO: 244641 - DNA, 25 bp, Artificial Sequence
  Description of Artificial Sequence: Synthetic oligonucleotide
gcacacaggctggaggcagttctgc

SEQ ID NO: 244642 - DNA, 25 bp, Artificial Sequence
  Description of Artificial Sequence: Synthetic oligonucleotide
cacacaggctggaggcagttctgcg

SEQ ID NO: 244643 - DNA, 25 bp, Artificial Sequence
  Description of Artificial Sequence: Synthetic oligonucleotide
acacaggctggaggcagttctgcgc

SEQ ID NO: 244644 - DNA, 24 bp, Artificial Sequence
  Description of Artificial Sequence: Synthetic oligonucleotide
cacaggctggaggcagttctgcgc

SEQ ID NO: 244645 - DNA, 24 bp, Artificial Sequence
  Description of Artificial Sequence: Synthetic oligonucleotide
acaggctggaggcagttctgcgcg

SEQ ID NO: 244646 - DNA, 23 bp, Artificial Sequence
  Description of Artificial Sequence: Synthetic oligonucleotide
caggctggaggcagttctgcgcg

SEQ ID NO: 244647 - DNA, 23 bp, Artificial Sequence
  Description of Artificial Sequence: Synthetic oligonucleotide
aggctggaggcagttctgcgcgc

SEQ ID NO: 244648 - DNA, 22 bp, Artificial Sequence
  Description of Artificial Sequence: Synthetic oligonucleotide
ggctggaggcagttctgcgcgc

SEQ ID NO: 244649 - DNA, 22 bp, Artificial Sequence
  Description of Artificial Sequence: Synthetic oligonucleotide
gctggaggcagttctgcgcgcc

SEQ ID NO: 244650 - DNA, 23 bp, Artificial Sequence
  Description of Artificial Sequence: Synthetic oligonucleotide
ctggaggcagttctgcgcgccca

SEQ ID NO: 244651 - DNA, 23 bp, Artificial Sequence
  Description of Artificial Sequence: Synthetic oligonucleotide
tggaggcagttctgcgcgcccag

SEQ ID NO: 244652 - DNA, 22 bp, Artificial Sequence
  Description of Artificial Sequence: Synthetic oligonucleotide
ggaggcagttctgcgcgcccag

SEQ ID NO: 244653 - DNA, 23 bp, Artificial Sequence
  Description of Artificial Sequence: Synthetic oligonucleotide
gaggcagttctgcgcgcccagca

SEQ ID NO: 244654 - DNA, 25 bp, Artificial Sequence
  Description of Artificial Sequence: Synthetic oligonucleotide
aggcagttctgcgcgcccagcagat

SEQ ID NO: 244655 - DNA, 24 bp, Artificial Sequence
  Description of Artificial Sequence: Synthetic oligonucleotide
ggcagttctgcgcgcccagcagat

SEQ ID NO: 244656 - DNA, 24 bp, Artificial Sequence
  Description of Artificial Sequence: Synthetic oligonucleotide
gcagttctgcgcgcccagcagatc

SEQ ID NO: 244657 - DNA, 25 bp, Artificial Sequence
  Description of Artificial Sequence: Synthetic oligonucleotide
cagttctgcgcgcccagcagatcct

SEQ ID NO: 244658 - DNA, 25 bp, Artificial Sequence
  Description of Artificial Sequence: Synthetic oligonucleotide
agttctgcgcgcccagcagatcctg

SEQ ID NO: 244659 - DNA, 24 bp, Artificial Sequence
  Description of Artificial Sequence: Synthetic oligonucleotide
gttctgcgcgcccagcagatcctg

SEQ ID NO: 244660 - DNA, 25 bp, Artificial Sequence
  Description of Artificial Sequence: Synthetic oligonucleotide
ttctgcgcgcccagcagatcctgct

SEQ ID NO: 244661 - DNA, 24 bp, Artificial Sequence
  Description of Artificial Sequence: Synthetic oligonucleotide
tctgcgcgcccagcagatcctgct

SEQ ID NO: 244662 - DNA, 23 bp, Artificial Sequence
  Description of Artificial Sequence: Synthetic oligonucleotide
ctgcgcgcccagcagatcctgct

SEQ ID NO: 244663 - DNA, 23 bp, Artificial Sequence
  Description of Artificial Sequence: Synthetic oligonucleotide
tgcgcgcccagcagatcctgctg

SEQ ID NO: 244664 - DNA, 22 bp, Artificial Sequence
  Description of Artificial Sequence: Synthetic oligonucleotide
gcgcgcccagcagatcctgctg

SEQ ID NO: 244665 - DNA, 23 bp, Artificial Sequence
  Description of Artificial Sequence: Synthetic oligonucleotide
cgcgcccagcagatcctgctgct

SEQ ID NO: 244666 - DNA, 23 bp, Artificial Sequence
  Description of Artificial Sequence: Synthetic oligonucleotide
gcgcccagcagatcctgctgctc

SEQ ID NO: 244667 - DNA, 24 bp, Artificial Sequence
  Description of Artificial Sequence: Synthetic oligonucleotide
cgcccagcagatcctgctgctcca

SEQ ID NO: 244668 - DNA, 24 bp, Artificial Sequence
  Description of Artificial Sequence: Synthetic oligonucleotide
gcccagcagatcctgctgctccag

SEQ ID NO: 244669 - DNA, 25 bp, Artificial Sequence
  Description of Artificial Sequence: Synthetic oligonucleotide
cccagcagatcctgctgctccaggt

SEQ ID NO: 244670 - DNA, 25 bp, Artificial Sequence
  Description of Artificial Sequence: Synthetic oligonucleotide
ccagcagatcctgctgctccaggtg

SEQ ID NO: 244671 - DNA, 25 bp, Artificial Sequence
  Description of Artificial Sequence: Synthetic oligonucleotide
cagcagatcctgctgctccaggtgg

SEQ ID NO: 244672 - DNA, 25 bp, Artificial Sequence
  Description of Artificial Sequence: Synthetic oligonucleotide
agcagatcctgctgctccaggtggg

SEQ ID NO: 244673 - DNA, 24 bp, Artificial Sequence
  Description of Artificial Sequence: Synthetic oligonucleotide
gcagatcctgctgctccaggtggg

SEQ ID NO: 244674 - DNA, 26 bp, Artificial Sequence
  Description of Artificial Sequence: Synthetic oligonucleotide
cagatcctgctgctccaggtgggcaa

SEQ ID NO: 244675 - DNA, 26 bp, Artificial Sequence
  Description of Artificial Sequence: Synthetic oligonucleotide
agatcctgctgctccaggtgggcaag

SEQ ID NO: 244676 - DNA, 25 bp, Artificial Sequence
  Description of Artificial Sequence: Synthetic oligonucleotide
gatcctgctgctccaggtgggcaag

SEQ ID NO: 244677 - DNA, 26 bp, Artificial Sequence
  Description of Artificial Sequence: Synthetic oligonucleotide
atcctgctgctccaggtgggcaagct

SEQ ID NO: 244678 - DNA, 25 bp, Artificial Sequence
  Description of Artificial Sequence: Synthetic oligonucleotide
tcctgctgctccaggtgggcaagct

SEQ ID NO: 244679 - DNA, 24 bp, Artificial Sequence
  Description of Artificial Sequence: Synthetic oligonucleotide
cctgctgctccaggtgggcaagct

SEQ ID NO: 244680 - DNA, 24 bp, Artificial Sequence
  Description of Artificial Sequence: Synthetic oligonucleotide
ctgctgctccaggtgggcaagctc

SEQ ID NO: 244681 - DNA, 25 bp, Artificial Sequence
  Description of Artificial Sequence: Synthetic oligonucleotide
tgctgctccaggtgggcaagctcca

SEQ ID NO: 244682 - DNA, 24 bp, Artificial Sequence
  Description of Artificial Sequence: Synthetic oligonucleotide
gctgctccaggtgggcaagctcca

SEQ ID NO: 244683 - DNA, 26 bp, Artificial Sequence
  Description of Artificial Sequence: Synthetic oligonucleotide
ctgctccaggtgggcaagctccagaa

SEQ ID NO: 244684 - DNA, 26 bp, Artificial Sequence
  Description of Artificial Sequence: Synthetic oligonucleotide
tgctccaggtgggcaagctccagaag

SEQ ID NO: 244685 - DNA, 25 bp, Artificial Sequence
  Description of Artificial Sequence: Synthetic oligonucleotide
gctccaggtgggcaagctccagaag

SEQ ID NO: 244686 - DNA, 27 bp, Artificial Sequence
  Description of Artificial Sequence: Synthetic oligonucleotide
ctccaggtgggcaagctccagaagctt

SEQ ID NO: 244687 - DNA, 27 bp, Artificial Sequence
  Description of Artificial Sequence: Synthetic oligonucleotide
tccaggtgggcaagctccagaagcttc

SEQ ID NO: 244688 - DNA, 26 bp, Artificial Sequence
  Description of Artificial Sequence: Synthetic oligonucleotide
ccaggtgggcaagctccagaagcttc

SEQ ID NO: 244689 - DNA, 26 bp, Artificial Sequence
  Description of Artificial Sequence: Synthetic oligonucleotide
caggtgggcaagctccagaagcttcc

SEQ ID NO: 244690 - DNA, 26 bp, Artificial Sequence
  Description of Artificial Sequence: Synthetic oligonucleotide
aggtgggcaagctccagaagcttccc

SEQ ID NO: 244691 - DNA, 25 bp, Artificial Sequence
  Description of Artificial Sequence: Synthetic oligonucleotide
ggtgggcaagctccagaagcttccc

SEQ ID NO: 244692 - DNA, 26 bp, Artificial Sequence
  Description of Artificial Sequence: Synthetic oligonucleotide
gtgggcaagctccagaagcttcccca

SEQ ID NO: 244693 - DNA, 26 bp, Artificial Sequence
  Description of Artificial Sequence: Synthetic oligonucleotide
tgggcaagctccagaagcttccccag

SEQ ID NO: 244694 - DNA, 25 bp, Artificial Sequence
  Description of Artificial Sequence: Synthetic oligonucleotide
gggcaagctccagaagcttccccag

SEQ ID NO: 244695 - DNA, 26 bp, Artificial Sequence
  Description of Artificial Sequence: Synthetic oligonucleotide
ggcaagctccagaagcttccccagct

SEQ ID NO: 244696 - DNA, 26 bp, Artificial Sequence
  Description of Artificial Sequence: Synthetic oligonucleotide
gcaagctccagaagcttccccagctc

SEQ ID NO: 244697 - DNA, 27 bp, Artificial Sequence
  Description of Artificial Sequence: Synthetic oligonucleotide
caagctccagaagcttccccagctcct

SEQ ID NO: 244698 - DNA, 27 bp, Artificial Sequence
  Description of Artificial Sequence: Synthetic oligonucleotide
aagctccagaagcttccccagctcctg

SEQ ID NO: 244699 - DNA, 26 bp, Artificial Sequence
  Description of Artificial Sequence: Synthetic oligonucleotide
agctccagaagcttccccagctcctg

SEQ ID NO: 244700 - DNA, 25 bp, Artificial Sequence
  Description of Artificial Sequence: Synthetic oligonucleotide
gctccagaagcttccccagctcctg

SEQ ID NO: 244701 - DNA, 26 bp, Artificial Sequence
  Description of Artificial Sequence: Synthetic oligonucleotide
ctccagaagcttccccagctcctgga

SEQ ID NO: 244702 - DNA, 26 bp, Artificial Sequence
  Description of Artificial Sequence: Synthetic oligonucleotide
tccagaagcttccccagctcctggag

SEQ ID NO: 244703 - DNA, 25 bp, Artificial Sequence
  Description of Artificial Sequence: Synthetic oligonucleotide
ccagaagcttccccagctcctggag

SEQ ID NO: 244704 - DNA, 25 bp, Artificial Sequence
  Description of Artificial Sequence: Synthetic oligonucleotide
cagaagcttccccagctcctggagg

SEQ ID NO: 244705 - DNA, 26 bp, Artificial Sequence
  Description of Artificial Sequence: Synthetic oligonucleotide
agaagcttccccagctcctggaggga

SEQ ID NO: 244706 - DNA, 25 bp, Artificial Sequence
  Description of Artificial Sequence: Synthetic oligonucleotide
gaagcttccccagctcctggaggga

SEQ ID NO: 244707 - DNA, 26 bp, Artificial Sequence
  Description of Artificial Sequence: Synthetic oligonucleotide
aagcttccccagctcctggagggaca

SEQ ID NO: 244708 - DNA, 25 bp, Artificial Sequence
  Description of Artificial Sequence: Synthetic oligonucleotide
agcttccccagctcctggagggaca

SEQ ID NO: 244709 - DNA, 24 bp, Artificial Sequence
  Description of Artificial Sequence: Synthetic oligonucleotide
gcttccccagctcctggagggaca

SEQ ID NO: 244710 - DNA, 24 bp, Artificial Sequence
  Description of Artificial Sequence: Synthetic oligonucleotide
cttccccagctcctggagggacac

SEQ ID NO: 244711 - DNA, 25 bp, Artificial Sequence
  Description of Artificial Sequence: Synthetic oligonucleotide
ttccccagctcctggagggacacga

SEQ ID NO: 244712 - DNA, 24 bp, Artificial Sequence
  Description of Artificial Sequence: Synthetic oligonucleotide
tccccagctcctggagggacacga

SEQ ID NO: 244713 - DNA, 23 bp, Artificial Sequence
  Description of Artificial Sequence: Synthetic oligonucleotide
ccccagctcctggagggacacga

SEQ ID NO: 244714 - DNA, 23 bp, Artificial Sequence
  Description of Artificial Sequence: Synthetic oligonucleotide
cccagctcctggagggacacgac

SEQ ID NO: 244715 - DNA, 24 bp, Artificial Sequence
  Description of Artificial Sequence: Synthetic oligonucleotide
ccagctcctggagggacacgacct

SEQ ID NO: 244716 - DNA, 27 bp, Artificial Sequence
  Description of Artificial Sequence: Synthetic oligonucleotide
cagctcctggagggacacgacctctat

SEQ ID NO: 244717 - DNA, 28 bp, Artificial Sequence
  Description of Artificial Sequence: Synthetic oligonucleotide
agctcctggagggacacgacctctatac

SEQ ID NO: 244718 - DNA, 27 bp, Artificial Sequence
  Description of Artificial Sequence: Synthetic oligonucleotide
gctcctggagggacacgacctctatac

SEQ ID NO: 244719 - DNA, 27 bp, Artificial Sequence
  Description of Artificial Sequence: Synthetic oligonucleotide
ctcctggagggacacgacctctatacc

SEQ ID NO: 244720 - DNA, 27 bp, Artificial Sequence
  Description of Artificial Sequence: Synthetic oligonucleotide
tcctggagggacacgacctctataccc

SEQ ID NO: 244721 - DNA, 26 bp, Artificial Sequence
  Description of Artificial Sequence: Synthetic oligonucleotide
cctggagggacacgacctctataccc

SEQ ID NO: 244722 - DNA, 26 bp, Artificial Sequence
  Description of Artificial Sequence: Synthetic oligonucleotide
ctggagggacacgacctctatacccg

SEQ ID NO: 244723 - DNA, 26 bp, Artificial Sequence
  Description of Artificial Sequence: Synthetic oligonucleotide
tggagggacacgacctctatacccgc

SEQ ID NO: 244724 - DNA, 25 bp, Artificial Sequence
  Description of Artificial Sequence: Synthetic oligonucleotide
ggagggacacgacctctatacccgc

SEQ ID NO: 244725 - DNA, 26 bp, Artificial Sequence
  Description of Artificial Sequence: Synthetic oligonucleotide
gagggacacgacctctatacccgcct

SEQ ID NO: 244726 - DNA, 26 bp, Artificial Sequence
  Description of Artificial Sequence: Synthetic oligonucleotide
agggacacgacctctatacccgcctg

SEQ ID NO: 244727 - DNA, 25 bp, Artificial Sequence
  Description of Artificial Sequence: Synthetic oligonucleotide
gggacacgacctctatacccgcctg

SEQ ID NO: 244728 - DNA, 27 bp, Artificial Sequence
  Description of Artificial Sequence: Synthetic oligonucleotide
ggacacgacctctatacccgcctggat

SEQ ID NO: 244729 - DNA, 27 bp, Artificial Sequence
  Description of Artificial Sequence: Synthetic oligonucleotide
gacacgacctctatacccgcctggatc

SEQ ID NO: 244730 - DNA, 28 bp, Artificial Sequence
  Description of Artificial Sequence: Synthetic oligonucleotide
acacgacctctatacccgcctggatcag

SEQ ID NO: 244731 - DNA, 27 bp, Artificial Sequence
  Description of Artificial Sequence: Synthetic oligonucleotide
cacgacctctatacccgcctggatcag

SEQ ID NO: 244732 - DNA, 27 bp, Artificial Sequence
  Description of Artificial Sequence: Synthetic oligonucleotide
acgacctctatacccgcctggatcagc

SEQ ID NO: 244733 - DNA, 27 bp, Artificial Sequence
  Description of Artificial Sequence: Synthetic oligonucleotide
cgacctctatacccgcctggatcagca

SEQ ID NO: 244734 - DNA, 27 bp, Artificial Sequence
  Description of Artificial Sequence: Synthetic oligonucleotide
gacctctatacccgcctggatcagcag

SEQ ID NO: 244735 - DNA, 27 bp, Artificial Sequence
  Description of Artificial Sequence: Synthetic oligonucleotide
acctctatacccgcctggatcagcagc

SEQ ID NO: 244736 - DNA, 26 bp, Artificial Sequence
  Description of Artificial Sequence: Synthetic oligonucleotide
cctctatacccgcctggatcagcagc

SEQ ID NO: 244737 - DNA, 26 bp, Artificial Sequence
  Description of Artificial Sequence: Synthetic oligonucleotide
ctctatacccgcctggatcagcagcg

SEQ ID NO: 244738 - DNA, 26 bp, Artificial Sequence
  Description of Artificial Sequence: Synthetic oligonucleotide
tctatacccgcctggatcagcagcgc

SEQ ID NO: 244739 - DNA, 25 bp, Artificial Sequence
  Description of Artificial Sequence: Synthetic oligonucleotide
ctatacccgcctggatcagcagcgc

SEQ ID NO: 244740 - DNA, 26 bp, Artificial Sequence
  Description of Artificial Sequence: Synthetic oligonucleotide
tatacccgcctggatcagcagcgcct

SEQ ID NO: 244741 - DNA, 25 bp, Artificial Sequence
  Description of Artificial Sequence: Synthetic oligonucleotide
atacccgcctggatcagcagcgcct

SEQ ID NO: 244742 - DNA, 24 bp, Artificial Sequence
  Description of Artificial Sequence: Synthetic oligonucleotide
tacccgcctggatcagcagcgcct

SEQ ID NO: 244743 - DNA, 23 bp, Artificial Sequence
  Description of Artificial Sequence: Synthetic oligonucleotide
acccgcctggatcagcagcgcct

SEQ ID NO: 244744 - DNA, 22 bp, Artificial Sequence
  Description of Artificial Sequence: Synthetic oligonucleotide
cccgcctggatcagcagcgcct

SEQ ID NO: 244745 - DNA, 24 bp, Artificial Sequence
  Description of Artificial Sequence: Synthetic oligonucleotide
ccgcctggatcagcagcgcctgat

SEQ ID NO: 244746 - DNA, 24 bp, Artificial Sequence
  Description of Artificial Sequence: Synthetic oligonucleotide
cgcctggatcagcagcgcctgatg

SEQ ID NO: 244747 - DNA, 25 bp, Artificial Sequence
  Description of Artificial Sequence: Synthetic oligonucleotide
gcctggatcagcagcgcctgatgga

SEQ ID NO: 244748 - DNA, 26 bp, Artificial Sequence
  Description of Artificial Sequence: Synthetic oligonucleotide
cctggatcagcagcgcctgatggaca

SEQ ID NO: 244749 - DNA, 27 bp, Artificial Sequence
  Description of Artificial Sequence: Synthetic oligonucleotide
ctggatcagcagcgcctgatggacaga

SEQ ID NO: 244750 - DNA, 27 bp, Artificial Sequence
  Description of Artificial Sequence: Synthetic oligonucleotide
atgtctcgcaccgtggcctaagctgtg

SEQ ID NO: 244751 - DNA, 26 bp, Artificial Sequence
  Description of Artificial Sequence: Synthetic oligonucleotide
tgtctcgcaccgtggcctaagctgtg

SEQ ID NO: 244752 - DNA, 25 bp, Artificial Sequence
  Description of Artificial Sequence: Synthetic oligonucleotide
gtctcgcaccgtggcctaagctgtg

SEQ ID NO: 244753 - DNA, 26 bp, Artificial Sequence
  Description of Artificial Sequence: Synthetic oligonucleotide
tctcgcaccgtggcctaagctgtgct

SEQ ID NO: 244754 - DNA, 25 bp, Artificial Sequence
  Description of Artificial Sequence: Synthetic oligonucleotide
ctcgcaccgtggcctaagctgtgct

SEQ ID NO: 244755 - DNA, 25 bp, Artificial Sequence
  Description of Artificial Sequence: Synthetic oligonucleotide
tcgcaccgtggcctaagctgtgctg

SEQ ID NO: 244756 - DNA, 24 bp, Artificial Sequence
  Description of Artificial Sequence: Synthetic oligonucleotide
cgcaccgtggcctaagctgtgctg

SEQ ID NO: 244757 - DNA, 24 bp, Artificial Sequence
  Description of Artificial Sequence: Synthetic oligonucleotide
gcaccgtggcctaagctgtgctgg

SEQ ID NO: 244758 - DNA, 24 bp, Artificial Sequence
  Description of Artificial Sequence: Synthetic oligonucleotide
caccgtggcctaagctgtgctggc

SEQ ID NO: 244759 - DNA, 24 bp, Artificial Sequence
  Description of Artificial Sequence: Synthetic oligonucleotide
accgtggcctaagctgtgctggcg

SEQ ID NO: 244760 - DNA, 23 bp, Artificial Sequence
  Description of Artificial Sequence: Synthetic oligonucleotide
ccgtggcctaagctgtgctggcg

SEQ ID NO: 244761 - DNA, 25 bp, Artificial Sequence
  Description of Artificial Sequence: Synthetic oligonucleotide
cgtggcctaagctgtgctggcgcta

SEQ ID NO: 244762 - DNA, 26 bp, Artificial Sequence
  Description of Artificial Sequence: Synthetic oligonucleotide
gtggcctaagctgtgctggcgctact

SEQ ID NO: 244763 - DNA, 27 bp, Artificial Sequence
  Description of Artificial Sequence: Synthetic oligonucleotide
tggcctaagctgtgctggcgctactca

SEQ ID NO: 244764 - DNA, 26 bp, Artificial Sequence
  Description of Artificial Sequence: Synthetic oligonucleotide
ggcctaagctgtgctggcgctactca

SEQ ID NO: 244765 - DNA, 27 bp, Artificial Sequence
  Description of Artificial Sequence: Synthetic oligonucleotide
gcctaagctgtgctggcgctactcact

SEQ ID NO: 244766 - DNA, 27 bp, Artificial Sequence
  Description of Artificial Sequence: Synthetic oligonucleotide
cctaagctgtgctggcgctactcactc

SEQ ID NO: 244767 - DNA, 30 bp, Artificial Sequence
  Description of Artificial Sequence: Synthetic oligonucleotide
ctaagctgtgctggcgctactcactctttc

SEQ ID NO: 244768 - DNA, 31 bp, Artificial Sequence
  Description of Artificial Sequence: Synthetic oligonucleotide
taagctgtgctggcgctactcactctttctg

SEQ ID NO: 244769 - DNA, 30 bp, Artificial Sequence
  Description of Artificial Sequence: Synthetic oligonucleotide
aagctgtgctggcgctactcactctttctg

SEQ ID NO: 244770 - DNA, 29 bp, Artificial Sequence
  Description of Artificial Sequence: Synthetic oligonucleotide
agctgtgctggcgctactcactctttctg

SEQ ID NO: 244771 - DNA, 28 bp, Artificial Sequence
  Description of Artificial Sequence: Synthetic oligonucleotide
gctgtgctggcgctactcactctttctg

SEQ ID NO: 244772 - DNA, 28 bp, Artificial Sequence
  Description of Artificial Sequence: Synthetic oligonucleotide
ctgtgctggcgctactcactctttctgc

SEQ ID NO: 244773 - DNA, 28 bp, Artificial Sequence
  Description of Artificial Sequence: Synthetic oligonucleotide
tgtgctggcgctactcactctttctgcc

SEQ ID NO: 244774 - DNA, 27 bp, Artificial Sequence
  Description of Artificial Sequence: Synthetic oligonucleotide
gtgctggcgctactcactctttctgcc

SEQ ID NO: 244775 - DNA, 27 bp, Artificial Sequence
  Description of Artificial Sequence: Synthetic oligonucleotide
tgctggcgctactcactctttctgccc

SEQ ID NO: 244776 - DNA, 27 bp, Artificial Sequence
  Description of Artificial Sequence: Synthetic oligonucleotide
gctggcgctactcactctttctgccct

SEQ ID NO: 244777 - DNA, 27 bp, Artificial Sequence
  Description of Artificial Sequence: Synthetic oligonucleotide
ctggcgctactcactctttctgccctg

SEQ ID NO: 244778 - DNA, 27 bp, Artificial Sequence
  Description of Artificial Sequence: Synthetic oligonucleotide
tggcgctactcactctttctgccctgg

SEQ ID NO: 244779 - DNA, 27 bp, Artificial Sequence
  Description of Artificial Sequence: Synthetic oligonucleotide
ggcgctactcactctttctgccctgga

SEQ ID NO: 244780 - DNA, 27 bp, Artificial Sequence
  Description of Artificial Sequence: Synthetic oligonucleotide
gcgctactcactctttctgccctggag

SEQ ID NO: 244781 - DNA, 27 bp, Artificial Sequence
  Description of Artificial Sequence: Synthetic oligonucleotide
cgctactcactctttctgccctggagg

SEQ ID NO: 244782 - DNA, 27 bp, Artificial Sequence
  Description of Artificial Sequence: Synthetic oligonucleotide
gctactcactctttctgccctggaggc

SEQ ID NO: 244783 - DNA, 30 bp, Artificial Sequence
  Description of Artificial Sequence: Synthetic oligonucleotide
ctactcactctttctgccctggaggcaatc

SEQ ID NO: 244784 - DNA, 30 bp, Artificial Sequence
  Description of Artificial Sequence: Synthetic oligonucleotide
tactcactctttctgccctggaggcaatcc

SEQ ID NO: 244785 - DNA, 29 bp, Artificial Sequence
  Description of Artificial Sequence: Synthetic oligonucleotide
actcactctttctgccctggaggcaatcc

SEQ ID NO: 244786 - DNA, 28 bp, Artificial Sequence
  Description of Artificial Sequence: Synthetic oligonucleotide
ctcactctttctgccctggaggcaatcc

SEQ ID NO: 244787 - DNA, 29 bp, Artificial Sequence
  Description of Artificial Sequence: Synthetic oligonucleotide
tcactctttctgccctggaggcaatccag

SEQ ID NO: 244788 - DNA, 28 bp, Artificial Sequence
  Description of Artificial Sequence: Synthetic oligonucleotide
cactctttctgccctggaggcaatccag

SEQ ID NO: 244789 - DNA, 28 bp, Artificial Sequence
  Description of Artificial Sequence: Synthetic oligonucleotide
actctttctgccctggaggcaatccagc

SEQ ID NO: 244790 - DNA, 27 bp, Artificial Sequence
  Description of Artificial Sequence: Synthetic oligonucleotide
ctctttctgccctggaggcaatccagc

SEQ ID NO: 244791 - DNA, 27 bp, Artificial Sequence
  Description of Artificial Sequence: Synthetic oligonucleotide
tctttctgccctggaggcaatccagcg

SEQ ID NO: 244792 - DNA, 27 bp, Artificial Sequence
  Description of Artificial Sequence: Synthetic oligonucleotide
ctttctgccctggaggcaatccagcgt

SEQ ID NO: 244793 - DNA, 28 bp, Artificial Sequence
  Description of Artificial Sequence: Synthetic oligonucleotide
tttctgccctggaggcaatccagcgttc

SEQ ID NO: 244794 - DNA, 27 bp, Artificial Sequence
  Description of Artificial Sequence: Synthetic oligonucleotide
ttctgccctggaggcaatccagcgttc

SEQ ID NO: 244795 - DNA, 27 bp, Artificial Sequence
  Description of Artificial Sequence: Synthetic oligonucleotide
tctgccctggaggcaatccagcgttct

SEQ ID NO: 244796 - DNA, 26 bp, Artificial Sequence
  Description of Artificial Sequence: Synthetic oligonucleotide
ctgccctggaggcaatccagcgttct

SEQ ID NO: 244797 - DNA, 26 bp, Artificial Sequence
  Description of Artificial Sequence: Synthetic oligonucleotide
tgccctggaggcaatccagcgttctc

SEQ ID NO: 244798 - DNA, 25 bp, Artificial Sequence
  Description of Artificial Sequence: Synthetic oligonucleotide
gccctggaggcaatccagcgttctc

SEQ ID NO: 244799 - DNA, 27 bp, Artificial Sequence
  Description of Artificial Sequence: Synthetic oligonucleotide
ccctggaggcaatccagcgttctccaa

SEQ ID NO: 244800 - DNA, 28 bp, Artificial Sequence
  Description of Artificial Sequence: Synthetic oligonucleotide
cctggaggcaatccagcgttctccaaag

SEQ ID NO: 244801 - DNA, 31 bp, Artificial Sequence
  Description of Artificial Sequence: Synthetic oligonucleotide
ctggaggcaatccagcgttctccaaagaatc

SEQ ID NO: 244802 - DNA, 32 bp, Artificial Sequence
  Description of Artificial Sequence: Synthetic oligonucleotide
tggaggcaatccagcgttctccaaagaatcag

SEQ ID NO: 244803 - DNA, 31 bp, Artificial Sequence
  Description of Artificial Sequence: Synthetic oligonucleotide
ggaggcaatccagcgttctccaaagaatcag

SEQ ID NO: 244804 - DNA, 31 bp, Artificial Sequence
  Description of Artificial Sequence: Synthetic oligonucleotide
gaggcaatccagcgttctccaaagaatcagg

SEQ ID NO: 244805 - DNA, 35 bp, Artificial Sequence
  Description of Artificial Sequence: Synthetic oligonucleotide
aggcaatccagcgttctccaaagaatcaggtttag

SEQ ID NO: 244806 - DNA, 34 bp, Artificial Sequence
  Description of Artificial Sequence: Synthetic oligonucleotide
ggcaatccagcgttctccaaagaatcaggtttag

SEQ ID NO: 244807 - DNA, 35 bp, Artificial Sequence
  Description of Artificial Sequence: Synthetic oligonucleotide
gcaatccagcgttctccaaagaatcaggtttagtc

SEQ ID NO: 244808 - DNA, 36 bp, Artificial Sequence
  Description of Artificial Sequence: Synthetic oligonucleotide
caatccagcgttctccaaagaatcaggtttagtcac

SEQ ID NO: 244809 - DNA, 36 bp, Artificial Sequence
  Description of Artificial Sequence: Synthetic oligonucleotide
aatccagcgttctccaaagaatcaggtttagtcacg

SEQ ID NO: 244810 - DNA, 35 bp, Artificial Sequence
  Description of Artificial Sequence: Synthetic oligonucleotide
atccagcgttctccaaagaatcaggtttagtcacg

SEQ ID NO: 244811 - DNA, 34 bp, Artificial Sequence
  Description of Artificial Sequence: Synthetic oligonucleotide
tccagcgttctccaaagaatcaggtttagtcacg

SEQ ID NO: 244812 - DNA, 33 bp, Artificial Sequence
  Description of Artificial Sequence: Synthetic oligonucleotide
ccagcgttctccaaagaatcaggtttagtcacg

SEQ ID NO: 244813 - DNA, 34 bp, Artificial Sequence
  Description of Artificial Sequence: Synthetic oligonucleotide
cagcgttctccaaagaatcaggtttagtcacgtc

SEQ ID NO: 244814 - DNA, 36 bp, Artificial Sequence
  Description of Artificial Sequence: Synthetic oligonucleotide
agcgttctccaaagaatcaggtttagtcacgtcatg

SEQ ID NO: 244815 - DNA, 35 bp, Artificial Sequence
  Description of Artificial Sequence: Synthetic oligonucleotide
gcgttctccaaagaatcaggtttagtcacgtcatg

SEQ ID NO: 244816 - DNA, 35 bp, Artificial Sequence
  Description of Artificial Sequence: Synthetic oligonucleotide
cgttctccaaagaatcaggtttagtcacgtcatgc

SEQ ID NO: 244817 - DNA, 36 bp, Artificial Sequence
  Description of Artificial Sequence: Synthetic oligonucleotide
gttctccaaagaatcaggtttagtcacgtcatgcag

SEQ ID NO: 244818 - DNA, 36 bp, Artificial Sequence
  Description of Artificial Sequence: Synthetic oligonucleotide
ttctccaaagaatcaggtttagtcacgtcatgcagc

SEQ ID NO: 244819 - DNA, 35 bp, Artificial Sequence
  Description of Artificial Sequence: Synthetic oligonucleotide
tctccaaagaatcaggtttagtcacgtcatgcagc

SEQ ID NO: 244820 - DNA, 34 bp, Artificial Sequence
  Description of Artificial Sequence: Synthetic oligonucleotide
ctccaaagaatcaggtttagtcacgtcatgcagc

SEQ ID NO: 244821 - DNA, 35 bp, Artificial Sequence
  Description of Artificial Sequence: Synthetic oligonucleotide
tccaaagaatcaggtttagtcacgtcatgcagcag

SEQ ID NO: 244822 - DNA, 34 bp, Artificial Sequence
  Description of Artificial Sequence: Synthetic oligonucleotide
ccaaagaatcaggtttagtcacgtcatgcagcag

SEQ ID NO: 244823 - DNA, 35 bp, Artificial Sequence
  Description of Artificial Sequence: Synthetic oligonucleotide
caaagaatcaggtttagtcacgtcatgcagcagag

SEQ ID NO: 244824 - DNA, 38 bp, Artificial Sequence
  Description of Artificial Sequence: Synthetic oligonucleotide
aaagaatcaggtttagtcacgtcatgcagcagagattg

SEQ ID NO: 244825 - DNA, 37 bp, Artificial Sequence
  Description of Artificial Sequence: Synthetic oligonucleotide
aagaatcaggtttagtcacgtcatgcagcagagattg

SEQ ID NO: 244826 - DNA, 36 bp, Artificial Sequence
  Description of Artificial Sequence: Synthetic oligonucleotide
agaatcaggtttagtcacgtcatgcagcagagattg

SEQ ID NO: 244827 - DNA, 35 bp, Artificial Sequence
  Description of Artificial Sequence: Synthetic oligonucleotide
gaatcaggtttagtcacgtcatgcagcagagattg

SEQ ID NO: 244828 - DNA, 35 bp, Artificial Sequence
  Description of Artificial Sequence: Synthetic oligonucleotide
aatcaggtttagtcacgtcatgcagcagagattgg

SEQ ID NO: 244829 - DNA, 34 bp, Artificial Sequence
  Description of Artificial Sequence: Synthetic oligonucleotide
atcaggtttagtcacgtcatgcagcagagattgg

SEQ ID NO: 244830 - DNA, 33 bp, Artificial Sequence
  Description of Artificial Sequence: Synthetic oligonucleotide
tcaggtttagtcacgtcatgcagcagagattgg

SEQ ID NO: 244831 - DNA, 32 bp, Artificial Sequence
  Description of Artificial Sequence: Synthetic oligonucleotide
caggtttagtcacgtcatgcagcagagattgg

SEQ ID NO: 244832 - DNA, 35 bp, Artificial Sequence
  Description of Artificial Sequence: Synthetic oligonucleotide
aggtttagtcacgtcatgcagcagagattggaaag

SEQ ID NO: 244833 - DNA, 34 bp, Artificial Sequence
  Description of Artificial Sequence: Synthetic oligonucleotide
ggtttagtcacgtcatgcagcagagattggaaag

SEQ ID NO: 244834 - DNA, 35 bp, Artificial Sequence
  Description of Artificial Sequence: Synthetic oligonucleotide
gtttagtcacgtcatgcagcagagattggaaagtc

SEQ ID NO: 244835 - DNA, 41 bp, Artificial Sequence
  Description of Artificial Sequence: Synthetic oligonucleotide
tttagtcacgtcatgcagcagagattggaaagtctaatttc

SEQ ID NO: 244836 - DNA, 40 bp, Artificial Sequence
  Description of Artificial Sequence: Synthetic oligonucleotide
ttagtcacgtcatgcagcagagattggaaagtctaatttc

SEQ ID NO: 244837 - DNA, 39 bp, Artificial Sequence
  Description of Artificial Sequence: Synthetic oligonucleotide
tagtcacgtcatgcagcagagattggaaagtctaatttc

SEQ ID NO: 244838 - DNA, 38 bp, Artificial Sequence
  Description of Artificial Sequence: Synthetic oligonucleotide
agtcacgtcatgcagcagagattggaaagtctaatttc

SEQ ID NO: 244839 - DNA, 37 bp, Artificial Sequence
  Description of Artificial Sequence: Synthetic oligonucleotide
gtcacgtcatgcagcagagattggaaagtctaatttc

SEQ ID NO: 244840 - DNA, 37 bp, Artificial Sequence
  Description of Artificial Sequence: Synthetic oligonucleotide
tcacgtcatgcagcagagattggaaagtctaatttcc

SEQ ID NO: 244841 - DNA, 36 bp, Artificial Sequence
  Description of Artificial Sequence: Synthetic oligonucleotide
cacgtcatgcagcagagattggaaagtctaatttcc

SEQ ID NO: 244842 - DNA, 37 bp, Artificial Sequence
  Description of Artificial Sequence: Synthetic oligonucleotide
acgtcatgcagcagagattggaaagtctaatttcctg

SEQ ID NO: 244843 - DNA, 36 bp, Artificial Sequence
  Description of Artificial Sequence: Synthetic oligonucleotide
cgtcatgcagcagagattggaaagtctaatttcctg

SEQ ID NO: 244844 - DNA, 40 bp, Artificial Sequence
  Description of Artificial Sequence: Synthetic oligonucleotide
gtcatgcagcagagattggaaagtctaatttcctgtattg

SEQ ID NO: 244845 - DNA, 40 bp, Artificial Sequence
  Description of Artificial Sequence: Synthetic oligonucleotide
tcatgcagcagagattggaaagtctaatttcctgtattgc

SEQ ID NO: 244846 - DNA, 39 bp, Artificial Sequence
  Description of Artificial Sequence: Synthetic oligonucleotide
catgcagcagagattggaaagtctaatttcctgtattgc

SEQ ID NO: 244847 - DNA, 42 bp, Artificial Sequence
  Description of Artificial Sequence: Synthetic oligonucleotide
atgcagcagagattggaaagtctaatttcctgtattgctatg

SEQ ID NO: 244848 - DNA, 41 bp, Artificial Sequence
  Description of Artificial Sequence: Synthetic oligonucleotide
tgcagcagagattggaaagtctaatttcctgtattgctatg

SEQ ID NO: 244849 - DNA, 40 bp, Artificial Sequence
  Description of Artificial Sequence: Synthetic oligonucleotide
gcagcagagattggaaagtctaatttcctgtattgctatg

SEQ ID NO: 244850 - DNA, 41 bp, Artificial Sequence
  Description of Artificial Sequence: Synthetic oligonucleotide
cagcagagattggaaagtctaatttcctgtattgctatgag

SEQ ID NO: 244851 - DNA, 42 bp, Artificial Sequence
  Description of Artificial Sequence: Synthetic oligonucleotide
agcagagattggaaagtctaatttcctgtattgctatgagtc

SEQ ID NO: 244852 - DNA, 41 bp, Artificial Sequence
  Description of Artificial Sequence: Synthetic oligonucleotide
gcagagattggaaagtctaatttcctgtattgctatgagtc

SEQ ID NO: 244853 - DNA, 42 bp, Artificial Sequence
  Description of Artificial Sequence: Synthetic oligonucleotide
cagagattggaaagtctaatttcctgtattgctatgagtctg

SEQ ID NO: 244854 - DNA, 42 bp, Artificial Sequence
  Description of Artificial Sequence: Synthetic oligonucleotide
agagattggaaagtctaatttcctgtattgctatgagtctgg

SEQ ID NO: 244855 - DNA, 41 bp, Artificial Sequence
  Description of Artificial Sequence: Synthetic oligonucleotide
gagattggaaagtctaatttcctgtattgctatgagtctgg

SEQ ID NO: 244856 - DNA, 41 bp, Artificial Sequence
  Description of Artificial Sequence: Synthetic oligonucleotide
agattggaaagtctaatttcctgtattgctatgagtctggg

SEQ ID NO: 244857 - DNA, 40 bp, Artificial Sequence
  Description of Artificial Sequence: Synthetic oligonucleotide
gattggaaagtctaatttcctgtattgctatgagtctggg

SEQ ID NO: 244858 - DNA, 43 bp, Artificial Sequence
  Description of Artificial Sequence: Synthetic oligonucleotide
attggaaagtctaatttcctgtattgctatgagtctgggttac

SEQ ID NO: 244859 - DNA, 42 bp, Artificial Sequence
  Description of Artificial Sequence: Synthetic oligonucleotide
ttggaaagtctaatttcctgtattgctatgagtctgggttac

SEQ ID NO: 244860 - DNA, 41 bp, Artificial Sequence
  Description of Artificial Sequence: Synthetic oligonucleotide
tggaaagtctaatttcctgtattgctatgagtctgggttac

SEQ ID NO: 244861 - DNA, 40 bp, Artificial Sequence
  Description of Artificial Sequence: Synthetic oligonucleotide
ggaaagtctaatttcctgtattgctatgagtctgggttac

SEQ ID NO: 244862 - DNA, 42 bp, Artificial Sequence
  Description of Artificial Sequence: Synthetic oligonucleotide
gaaagtctaatttcctgtattgctatgagtctgggttacatc

SEQ ID NO: 244863 - DNA, 42 bp, Artificial Sequence
  Description of Artificial Sequence: Synthetic oligonucleotide
aaagtctaatttcctgtattgctatgagtctgggttacatcc

SEQ ID NO: 244864 - DNA, 41 bp, Artificial Sequence
  Description of Artificial Sequence: Synthetic oligonucleotide
aagtctaatttcctgtattgctatgagtctgggttacatcc

SEQ ID NO: 244865 - DNA, 40 bp, Artificial Sequence
  Description of Artificial Sequence: Synthetic oligonucleotide
agtctaatttcctgtattgctatgagtctgggttacatcc

SEQ ID NO: 244866 - DNA, 39 bp, Artificial Sequence
  Description of Artificial Sequence: Synthetic oligonucleotide
gtctaatttcctgtattgctatgagtctgggttacatcc

SEQ ID NO: 244867 - DNA, 41 bp, Artificial Sequence
  Description of Artificial Sequence: Synthetic oligonucleotide
tctaatttcctgtattgctatgagtctgggttacatccatc

SEQ ID NO: 244868 - DNA, 40 bp, Artificial Sequence
  Description of Artificial Sequence: Synthetic oligonucleotide
ctaatttcctgtattgctatgagtctgggttacatccatc

SEQ ID NO: 244869 - DNA, 40 bp, Artificial Sequence
  Description of Artificial Sequence: Synthetic oligonucleotide
taatttcctgtattgctatgagtctgggttacatccatcc

SEQ ID NO: 244870 - DNA, 39 bp, Artificial Sequence
  Description of Artificial Sequence: Synthetic oligonucleotide
aatttcctgtattgctatgagtctgggttacatccatcc

SEQ ID NO: 244871 - DNA, 38 bp, Artificial Sequence
  Description of Artificial Sequence: Synthetic oligonucleotide
atttcctgtattgctatgagtctgggttacatccatcc

SEQ ID NO: 244872 - DNA, 37 bp, Artificial Sequence
  Description of Artificial Sequence: Synthetic oligonucleotide
tttcctgtattgctatgagtctgggttacatccatcc

SEQ ID NO: 244873 - DNA, 36 bp, Artificial Sequence
  Description of Artificial Sequence: Synthetic oligonucleotide
ttcctgtattgctatgagtctgggttacatccatcc

SEQ ID NO: 244874 - DNA, 35 bp, Artificial Sequence
  Description of Artificial Sequence: Synthetic oligonucleotide
tcctgtattgctatgagtctgggttacatccatcc

SEQ ID NO: 244875 - DNA, 34 bp, Artificial Sequence
  Description of Artificial Sequence: Synthetic oligonucleotide
cctgtattgctatgagtctgggttacatccatcc

SEQ ID NO: 244876 - DNA, 34 bp, Artificial Sequence
  Description of Artificial Sequence: Synthetic oligonucleotide
ctgtattgctatgagtctgggttacatccatccc

SEQ ID NO: 244877 - DNA, 35 bp, Artificial Sequence
  Description of Artificial Sequence: Synthetic oligonucleotide
tgtattgctatgagtctgggttacatccatcccac

SEQ ID NO: 244878 - DNA, 34 bp, Artificial Sequence
  Description of Artificial Sequence: Synthetic oligonucleotide
gtattgctatgagtctgggttacatccatcccac

SEQ ID NO: 244879 - DNA, 37 bp, Artificial Sequence
  Description of Artificial Sequence: Synthetic oligonucleotide
tattgctatgagtctgggttacatccatcccacattg

SEQ ID NO: 244880 - DNA, 36 bp, Artificial Sequence
  Description of Artificial Sequence: Synthetic oligonucleotide
attgctatgagtctgggttacatccatcccacattg

SEQ ID NO: 244881 - DNA, 35 bp, Artificial Sequence
  Description of Artificial Sequence: Synthetic oligonucleotide
ttgctatgagtctgggttacatccatcccacattg

SEQ ID NO: 244882 - DNA, 34 bp, Artificial Sequence
  Description of Artificial Sequence: Synthetic oligonucleotide
tgctatgagtctgggttacatccatcccacattg

SEQ ID NO: 244883 - DNA, 33 bp, Artificial Sequence
  Description of Artificial Sequence: Synthetic oligonucleotide
gctatgagtctgggttacatccatcccacattg

SEQ ID NO: 244884 - DNA, 35 bp, Artificial Sequence
  Description of Artificial Sequence: Synthetic oligonucleotide
ctatgagtctgggttacatccatcccacattgaag

SEQ ID NO: 244885 - DNA, 37 bp, Artificial Sequence
  Description of Artificial Sequence: Synthetic oligonucleotide
tatgagtctgggttacatccatcccacattgaagatg

SEQ ID NO: 244886 - DNA, 36 bp, Artificial Sequence
  Description of Artificial Sequence: Synthetic oligonucleotide
atgagtctgggttacatccatcccacattgaagatg

SEQ ID NO: 244887 - DNA, 35 bp, Artificial Sequence
  Description of Artificial Sequence: Synthetic oligonucleotide
tgagtctgggttacatccatcccacattgaagatg

SEQ ID NO: 244888 - DNA, 34 bp, Artificial Sequence
  Description of Artificial Sequence: Synthetic oligonucleotide
gagtctgggttacatccatcccacattgaagatg

SEQ ID NO: 244889 - DNA, 35 bp, Artificial Sequence
  Description of Artificial Sequence: Synthetic oligonucleotide
agtctgggttacatccatcccacattgaagatgac

SEQ ID NO: 244890 - DNA, 34 bp, Artificial Sequence
  Description of Artificial Sequence: Synthetic oligonucleotide
gtctgggttacatccatcccacattgaagatgac

SEQ ID NO: 244891 - DNA, 37 bp, Artificial Sequence
  Description of Artificial Sequence: Synthetic oligonucleotide
tctgggttacatccatcccacattgaagatgacttac

SEQ ID NO: 244892 - DNA, 36 bp, Artificial Sequence
  Description of Artificial Sequence: Synthetic oligonucleotide
ctgggttacatccatcccacattgaagatgacttac

SEQ ID NO: 244893 - DNA, 37 bp, Artificial Sequence
  Description of Artificial Sequence: Synthetic oligonucleotide
tgggttacatccatcccacattgaagatgacttactc

SEQ ID NO: 244894 - DNA, 36 bp, Artificial Sequence
  Description of Artificial Sequence: Synthetic oligonucleotide
gggttacatccatcccacattgaagatgacttactc

SEQ ID NO: 244895 - DNA, 38 bp, Artificial Sequence
  Description of Artificial Sequence: Synthetic oligonucleotide
ggttacatccatcccacattgaagatgacttactcaag

SEQ ID NO: 244896 - DNA, 41 bp, Artificial Sequence
  Description of Artificial Sequence: Synthetic oligonucleotide
gttacatccatcccacattgaagatgacttactcaagaatg

SEQ ID NO: 244897 - DNA, 41 bp, Artificial Sequence
  Description of Artificial Sequence: Synthetic oligonucleotide
ttacatccatcccacattgaagatgacttactcaagaatgg

SEQ ID NO: 244898 - DNA, 40 bp, Artificial Sequence
  Description of Artificial Sequence: Synthetic oligonucleotide
tacatccatcccacattgaagatgacttactcaagaatgg

SEQ ID NO: 244899 - DNA, 39 bp, Artificial Sequence
  Description of Artificial Sequence: Synthetic oligonucleotide
acatccatcccacattgaagatgacttactcaagaatgg

SEQ ID NO: 244900 - DNA, 38 bp, Artificial Sequence
  Description of Artificial Sequence: Synthetic oligonucleotide
catccatcccacattgaagatgacttactcaagaatgg

SEQ ID NO: 244901 - DNA, 39 bp, Artificial Sequence
  Description of Artificial Sequence: Synthetic oligonucleotide
atccatcccacattgaagatgacttactcaagaatggac

SEQ ID NO: 244902 - DNA, 38 bp, Artificial Sequence
  Description of Artificial Sequence: Synthetic oligonucleotide
tccatcccacattgaagatgacttactcaagaatggac

SEQ ID NO: 244903 - DNA, 37 bp, Artificial Sequence
  Description of Artificial Sequence: Synthetic oligonucleotide
ccatcccacattgaagatgacttactcaagaatggac

SEQ ID NO: 244904 - DNA, 38 bp, Artificial Sequence
  Description of Artificial Sequence: Synthetic oligonucleotide
catcccacattgaagatgacttactcaagaatggacag

SEQ ID NO: 244905 - DNA, 39 bp, Artificial Sequence
  Description of Artificial Sequence: Synthetic oligonucleotide
atcccacattgaagatgacttactcaagaatggacagag

SEQ ID NO: 244906 - DNA, 38 bp, Artificial Sequence
  Description of Artificial Sequence: Synthetic oligonucleotide
tcccacattgaagatgacttactcaagaatggacagag

SEQ ID NO: 244907 - DNA, 37 bp, Artificial Sequence
  Description of Artificial Sequence: Synthetic oligonucleotide
cccacattgaagatgacttactcaagaatggacagag

SEQ ID NO: 244908 - DNA, 41 bp, Artificial Sequence
  Description of Artificial Sequence: Synthetic oligonucleotide
ccacattgaagatgacttactcaagaatggacagagaattg

SEQ ID NO: 244909 - DNA, 46 bp, Artificial Sequence
  Description of Artificial Sequence: Synthetic oligonucleotide
cacattgaagatgacttactcaagaatggacagagaattgtaaaag

SEQ ID NO: 244910 - DNA, 47 bp, Artificial Sequence
  Description of Artificial Sequence: Synthetic oligonucleotide
acattgaagatgacttactcaagaatggacagagaattgtaaaagtg

SEQ ID NO: 244911 - DNA, 46 bp, Artificial Sequence
  Description of Artificial Sequence: Synthetic oligonucleotide
cattgaagatgacttactcaagaatggacagagaattgtaaaagtg

SEQ ID NO: 244912 - DNA, 46 bp, Artificial Sequence
  Description of Artificial Sequence: Synthetic oligonucleotide
attgaagatgacttactcaagaatggacagagaattgtaaaagtgg

SEQ ID NO: 244913 - DNA, 45 bp, Artificial Sequence
  Description of Artificial Sequence: Synthetic oligonucleotide
ttgaagatgacttactcaagaatggacagagaattgtaaaagtgg

SEQ ID NO: 244914 - DNA, 44 bp, Artificial Sequence
  Description of Artificial Sequence: Synthetic oligonucleotide
tgaagatgacttactcaagaatggacagagaattgtaaaagtgg

SEQ ID NO: 244915 - DNA, 43 bp, Artificial Sequence
  Description of Artificial Sequence: Synthetic oligonucleotide
gaagatgacttactcaagaatggacagagaattgtaaaagtgg

SEQ ID NO: 244916 - DNA, 44 bp, Artificial Sequence
  Description of Artificial Sequence: Synthetic oligonucleotide
aagatgacttactcaagaatggacagagaattgtaaaagtggac

SEQ ID NO: 244917 - DNA, 43 bp, Artificial Sequence
  Description of Artificial Sequence: Synthetic oligonucleotide
agatgacttactcaagaatggacagagaattgtaaaagtggac

SEQ ID NO: 244918 - DNA, 42 bp, Artificial Sequence
  Description of Artificial Sequence: Synthetic oligonucleotide
gatgacttactcaagaatggacagagaattgtaaaagtggac

SEQ ID NO: 244919 - DNA, 42 bp, Artificial Sequence
  Description of Artificial Sequence: Synthetic oligonucleotide
atgacttactcaagaatggacagagaattgtaaaagtggacc

SEQ ID NO: 244920 - DNA, 41 bp, Artificial Sequence
  Description of Artificial Sequence: Synthetic oligonucleotide
tgacttactcaagaatggacagagaattgtaaaagtggacc

SEQ ID NO: 244921 - DNA, 40 bp, Artificial Sequence
  Description of Artificial Sequence: Synthetic oligonucleotide
gacttactcaagaatggacagagaattgtaaaagtggacc

SEQ ID NO: 244922 - DNA, 43 bp, Artificial Sequence
  Description of Artificial Sequence: Synthetic oligonucleotide
acttactcaagaatggacagagaattgtaaaagtggaccattc

SEQ ID NO: 244923 - DNA, 42 bp, Artificial Sequence
  Description of Artificial Sequence: Synthetic oligonucleotide
cttactcaagaatggacagagaattgtaaaagtggaccattc

SEQ ID NO: 244924 - DNA, 43 bp, Artificial Sequence
  Description of Artificial Sequence: Synthetic oligonucleotide
ttactcaagaatggacagagaattgtaaaagtggaccattcag

SEQ ID NO: 244925 - DNA, 42 bp, Artificial Sequence
  Description of Artificial Sequence: Synthetic oligonucleotide
tactcaagaatggacagagaattgtaaaagtggaccattcag

SEQ ID NO: 244926 - DNA, 41 bp, Artificial Sequence
  Description of Artificial Sequence: Synthetic oligonucleotide
actcaagaatggacagagaattgtaaaagtggaccattcag

SEQ ID NO: 244927 - DNA, 40 bp, Artificial Sequence
  Description of Artificial Sequence: Synthetic oligonucleotide
ctcaagaatggacagagaattgtaaaagtggaccattcag

SEQ ID NO: 244928 - DNA, 41 bp, Artificial Sequence
  Description of Artificial Sequence: Synthetic oligonucleotide
tcaagaatggacagagaattgtaaaagtggaccattcagac

SEQ ID NO: 244929 - DNA, 40 bp, Artificial Sequence
  Description of Artificial Sequence: Synthetic oligonucleotide
caagaatggacagagaattgtaaaagtggaccattcagac

SEQ ID NO: 244930 - DNA, 42 bp, Artificial Sequence
  Description of Artificial Sequence: Synthetic oligonucleotide
aagaatggacagagaattgtaaaagtggaccattcagacatg

SEQ ID NO: 244931 - DNA, 41 bp, Artificial Sequence
  Description of Artificial Sequence: Synthetic oligonucleotide
agaatggacagagaattgtaaaagtggaccattcagacatg

SEQ ID NO: 244932 - DNA, 40 bp, Artificial Sequence
  Description of Artificial Sequence: Synthetic oligonucleotide
gaatggacagagaattgtaaaagtggaccattcagacatg

SEQ ID NO: 244933 - DNA, 41 bp, Artificial Sequence
  Description of Artificial Sequence: Synthetic oligonucleotide
aatggacagagaattgtaaaagtggaccattcagacatgtc

SEQ ID NO: 244934 - DNA, 40 bp, Artificial Sequence
  Description of Artificial Sequence: Synthetic oligonucleotide
atggacagagaattgtaaaagtggaccattcagacatgtc

SEQ ID NO: 244935 - DNA, 39 bp, Artificial Sequence
  Description of Artificial Sequence: Synthetic oligonucleotide
tggacagagaattgtaaaagtggaccattcagacatgtc

SEQ ID NO: 244936 - DNA, 38 bp, Artificial Sequence
  Description of Artificial Sequence: Synthetic oligonucleotide
ggacagagaattgtaaaagtggaccattcagacatgtc

SEQ ID NO: 244937 - DNA, 41 bp, Artificial Sequence
  Description of Artificial Sequence: Synthetic oligonucleotide
gacagagaattgtaaaagtggaccattcagacatgtctttc

SEQ ID NO: 244938 - DNA, 42 bp, Artificial Sequence
  Description of Artificial Sequence: Synthetic oligonucleotide
acagagaattgtaaaagtggaccattcagacatgtctttcac

SEQ ID NO: 244939 - DNA, 41 bp, Artificial Sequence
  Description of Artificial Sequence: Synthetic oligonucleotide
cagagaattgtaaaagtggaccattcagacatgtctttcac

SEQ ID NO: 244940 - DNA, 41 bp, Artificial Sequence
  Description of Artificial Sequence: Synthetic oligonucleotide
agagaattgtaaaagtggaccattcagacatgtctttcacc

SEQ ID NO: 244941 - DNA, 40 bp, Artificial Sequence
  Description of Artificial Sequence: Synthetic oligonucleotide
gagaattgtaaaagtggaccattcagacatgtctttcacc

SEQ ID NO: 244942 - DNA, 42 bp, Artificial Sequence
  Description of Artificial Sequence: Synthetic oligonucleotide
agaattgtaaaagtggaccattcagacatgtctttcaccaag

SEQ ID NO: 244943 - DNA, 41 bp, Artificial Sequence
  Description of Artificial Sequence: Synthetic oligonucleotide
gaattgtaaaagtggaccattcagacatgtctttcaccaag

SEQ ID NO: 244944 - DNA, 41 bp, Artificial Sequence
  Description of Artificial Sequence: Synthetic oligonucleotide
aattgtaaaagtggaccattcagacatgtctttcaccaagg

SEQ ID NO: 244945 - DNA, 40 bp, Artificial Sequence
  Description of Artificial Sequence: Synthetic oligonucleotide
attgtaaaagtggaccattcagacatgtctttcaccaagg

SEQ ID NO: 244946 - DNA, 39 bp, Artificial Sequence
  Description of Artificial Sequence: Synthetic oligonucleotide
ttgtaaaagtggaccattcagacatgtctttcaccaagg

SEQ ID NO: 244947 - DNA, 38 bp, Artificial Sequence
  Description of Artificial Sequence: Synthetic oligonucleotide
tgtaaaagtggaccattcagacatgtctttcaccaagg

SEQ ID NO: 244948 - DNA, 37 bp, Artificial Sequence
  Description of Artificial Sequence: Synthetic oligonucleotide
gtaaaagtggaccattcagacatgtctttcaccaagg

SEQ ID NO: 244949 - DNA, 38 bp, Artificial Sequence
  Description of Artificial Sequence: Synthetic oligonucleotide
taaaagtggaccattcagacatgtctttcaccaaggac

SEQ ID NO: 244950 - DNA, 37 bp, Artificial Sequence
  Description of Artificial Sequence: Synthetic oligonucleotide
aaaagtggaccattcagacatgtctttcaccaaggac

SEQ ID NO: 244951 - DNA, 36 bp, Artificial Sequence
  Description of Artificial Sequence: Synthetic oligonucleotide
aaagtggaccattcagacatgtctttcaccaaggac

SEQ ID NO: 244952 - DNA, 35 bp, Artificial Sequence
  Description of Artificial Sequence: Synthetic oligonucleotide
aagtggaccattcagacatgtctttcaccaaggac

SEQ ID NO: 244953 - DNA, 34 bp, Artificial Sequence
  Description of Artificial Sequence: Synthetic oligonucleotide
agtggaccattcagacatgtctttcaccaaggac

SEQ ID NO: 244954 - DNA, 33 bp, Artificial Sequence
  Description of Artificial Sequence: Synthetic oligonucleotide
gtggaccattcagacatgtctttcaccaaggac

SEQ ID NO: 244955 - DNA, 34 bp, Artificial Sequence
  Description of Artificial Sequence: Synthetic oligonucleotide
tggaccattcagacatgtctttcaccaaggactg

SEQ ID NO: 244956 - DNA, 33 bp, Artificial Sequence
  Description of Artificial Sequence: Synthetic oligonucleotide
ggaccattcagacatgtctttcaccaaggactg

SEQ ID NO: 244957 - DNA, 33 bp, Artificial Sequence
  Description of Artificial Sequence: Synthetic oligonucleotide
gaccattcagacatgtctttcaccaaggactgc

SEQ ID NO: 244958 - DNA, 34 bp, Artificial Sequence
  Description of Artificial Sequence: Synthetic oligonucleotide
accattcagacatgtctttcaccaaggactgctc

SEQ ID NO: 244959 - DNA, 33 bp, Artificial Sequence
  Description of Artificial Sequence: Synthetic oligonucleotide
ccattcagacatgtctttcaccaaggactgctc

SEQ ID NO: 244960 - DNA, 36 bp, Artificial Sequence
  Description of Artificial Sequence: Synthetic oligonucleotide
cattcagacatgtctttcaccaaggactgctctttc

SEQ ID NO: 244961 - DNA, 39 bp, Artificial Sequence
  Description of Artificial Sequence: Synthetic oligonucleotide
attcagacatgtctttcaccaaggactgctctttctatg

SEQ ID NO: 244962 - DNA, 38 bp, Artificial Sequence
  Description of Artificial Sequence: Synthetic oligonucleotide
ttcagacatgtctttcaccaaggactgctctttctatg

SEQ ID NO: 244963 - DNA, 37 bp, Artificial Sequence
  Description of Artificial Sequence: Synthetic oligonucleotide
tcagacatgtctttcaccaaggactgctctttctatg

SEQ ID NO: 244964 - DNA, 36 bp, Artificial Sequence
  Description of Artificial Sequence: Synthetic oligonucleotide
cagacatgtctttcaccaaggactgctctttctatg

SEQ ID NO: 244965 - DNA, 37 bp, Artificial Sequence
  Description of Artificial Sequence: Synthetic oligonucleotide
agacatgtctttcaccaaggactgctctttctatgtc

SEQ ID NO: 244966 - DNA, 36 bp, Artificial Sequence
  Description of Artificial Sequence: Synthetic oligonucleotide
gacatgtctttcaccaaggactgctctttctatgtc

SEQ ID NO: 244967 - DNA, 38 bp, Artificial Sequence
  Description of Artificial Sequence: Synthetic oligonucleotide
acatgtctttcaccaaggactgctctttctatgtcttg

SEQ ID NO: 244968 - DNA, 37 bp, Artificial Sequence
  Description of Artificial Sequence: Synthetic oligonucleotide
catgtctttcaccaaggactgctctttctatgtcttg

SEQ ID NO: 244969 - DNA, 39 bp, Artificial Sequence
  Description of Artificial Sequence: Synthetic oligonucleotide
atgtctttcaccaaggactgctctttctatgtcttgtac

SEQ ID NO: 244970 - DNA, 38 bp, Artificial Sequence
  Description of Artificial Sequence: Synthetic oligonucleotide
tgtctttcaccaaggactgctctttctatgtcttgtac

SEQ ID NO: 244971 - DNA, 37 bp, Artificial Sequence
  Description of Artificial Sequence: Synthetic oligonucleotide
gtctttcaccaaggactgctctttctatgtcttgtac

SEQ ID NO: 244972 - DNA, 39 bp, Artificial Sequence
  Description of Artificial Sequence: Synthetic oligonucleotide
tctttcaccaaggactgctctttctatgtcttgtacttc

SEQ ID NO: 244973 - DNA, 38 bp, Artificial Sequence
  Description of Artificial Sequence: Synthetic oligonucleotide
ctttcaccaaggactgctctttctatgtcttgtacttc

SEQ ID NO: 244974 - DNA, 39 bp, Artificial Sequence
  Description of Artificial Sequence: Synthetic oligonucleotide
tttcaccaaggactgctctttctatgtcttgtacttcac

SEQ ID NO: 244975 - DNA, 38 bp, Artificial Sequence
  Description of Artificial Sequence: Synthetic oligonucleotide
ttcaccaaggactgctctttctatgtcttgtacttcac

SEQ ID NO: 244976 - DNA, 37 bp, Artificial Sequence
  Description of Artificial Sequence: Synthetic oligonucleotide
tcaccaaggactgctctttctatgtcttgtacttcac

SEQ ID NO: 244977 - DNA, 36 bp, Artificial Sequence
  Description of Artificial Sequence: Synthetic oligonucleotide
caccaaggactgctctttctatgtcttgtacttcac

SEQ ID NO: 244978 - DNA, 37 bp, Artificial Sequence
  Description of Artificial Sequence: Synthetic oligonucleotide
accaaggactgctctttctatgtcttgtacttcactg

SEQ ID NO: 244979 - DNA, 36 bp, Artificial Sequence
  Description of Artificial Sequence: Synthetic oligonucleotide
ccaaggactgctctttctatgtcttgtacttcactg

SEQ ID NO: 244980 - DNA, 40 bp, Artificial Sequence
  Description of Artificial Sequence: Synthetic oligonucleotide
caaggactgctctttctatgtcttgtacttcactgaattg

SEQ ID NO: 244981 - DNA, 41 bp, Artificial Sequence
  Description of Artificial Sequence: Synthetic oligonucleotide
aaggactgctctttctatgtcttgtacttcactgaattgac

SEQ ID NO: 244982 - DNA, 40 bp, Artificial Sequence
  Description of Artificial Sequence: Synthetic oligonucleotide
aggactgctctttctatgtcttgtacttcactgaattgac

SEQ ID NO: 244983 - DNA, 39 bp, Artificial Sequence
  Description of Artificial Sequence: Synthetic oligonucleotide
ggactgctctttctatgtcttgtacttcactgaattgac

SEQ ID NO: 244984 - DNA, 39 bp, Artificial Sequence
  Description of Artificial Sequence: Synthetic oligonucleotide
gactgctctttctatgtcttgtacttcactgaattgacc

SEQ ID NO: 244985 - DNA, 39 bp, Artificial Sequence
  Description of Artificial Sequence: Synthetic oligonucleotide
actgctctttctatgtcttgtacttcactgaattgaccc

SEQ ID NO: 244986 - DNA, 38 bp, Artificial Sequence
  Description of Artificial Sequence: Synthetic oligonucleotide
ctgctctttctatgtcttgtacttcactgaattgaccc

SEQ ID NO: 244987 - DNA, 38 bp, Artificial Sequence
  Description of Artificial Sequence: Synthetic oligonucleotide
tgctctttctatgtcttgtacttcactgaattgacccc

SEQ ID NO: 244988 - DNA, 37 bp, Artificial Sequence
  Description of Artificial Sequence: Synthetic oligonucleotide
gctctttctatgtcttgtacttcactgaattgacccc

SEQ ID NO: 244989 - DNA, 37 bp, Artificial Sequence
  Description of Artificial Sequence: Synthetic oligonucleotide
ctctttctatgtcttgtacttcactgaattgaccccc

SEQ ID NO: 244990 - DNA, 38 bp, Artificial Sequence
  Description of Artificial Sequence: Synthetic oligonucleotide
tctttctatgtcttgtacttcactgaattgacccccac

SEQ ID NO: 244991 - DNA, 37 bp, Artificial Sequence
  Description of Artificial Sequence: Synthetic oligonucleotide
ctttctatgtcttgtacttcactgaattgacccccac

SEQ ID NO: 244992 - DNA, 38 bp, Artificial Sequence
  Description of Artificial Sequence: Synthetic oligonucleotide
tttctatgtcttgtacttcactgaattgacccccactc

SEQ ID NO: 244993 - DNA, 37 bp, Artificial Sequence
  Description of Artificial Sequence: Synthetic oligonucleotide
ttctatgtcttgtacttcactgaattgacccccactc

SEQ ID NO: 244994 - DNA, 36 bp, Artificial Sequence
  Description of Artificial Sequence: Synthetic oligonucleotide
tctatgtcttgtacttcactgaattgacccccactc

SEQ ID NO: 244995 - DNA, 35 bp, Artificial Sequence
  Description of Artificial Sequence: Synthetic oligonucleotide
ctatgtcttgtacttcactgaattgacccccactc

SEQ ID NO: 244996 - DNA, 40 bp, Artificial Sequence
  Description of Artificial Sequence: Synthetic oligonucleotide
tatgtcttgtacttcactgaattgacccccactcaaaaag

SEQ ID NO: 244997 - DNA, 39 bp, Artificial Sequence
  Description of Artificial Sequence: Synthetic oligonucleotide
atgtcttgtacttcactgaattgacccccactcaaaaag

SEQ ID NO: 244998 - DNA, 38 bp, Artificial Sequence
  Description of Artificial Sequence: Synthetic oligonucleotide
tgtcttgtacttcactgaattgacccccactcaaaaag

SEQ ID NO: 244999 - DNA, 37 bp, Artificial Sequence
  Description of Artificial Sequence: Synthetic oligonucleotide
gtcttgtacttcactgaattgacccccactcaaaaag

SEQ ID NO: 245000 - DNA, 39 bp, Artificial Sequence
  Description of Artificial Sequence: Synthetic oligonucleotide
tcttgtacttcactgaattgacccccactcaaaaagatg

SEQ ID NO: 245001 - DNA, 38 bp, Artificial Sequence
  Description of Artificial Sequence: Synthetic oligonucleotide
cttgtacttcactgaattgacccccactcaaaaagatg

SEQ ID NO: 245002 - DNA, 39 bp, Artificial Sequence
  Description of Artificial Sequence: Synthetic oligonucleotide
ttgtacttcactgaattgacccccactcaaaaagatgtg

SEQ ID NO: 245003 - DNA, 38 bp, Artificial Sequence
  Description of Artificial Sequence: Synthetic oligonucleotide
tgtacttcactgaattgacccccactcaaaaagatgtg

SEQ ID NO: 245004 - DNA, 37 bp, Artificial Sequence
  Description of Artificial Sequence: Synthetic oligonucleotide
gtacttcactgaattgacccccactcaaaaagatgtg

SEQ ID NO: 245005 - DNA, 40 bp, Artificial Sequence
  Description of Artificial Sequence: Synthetic oligonucleotide
tacttcactgaattgacccccactcaaaaagatgtgtatg

SEQ ID NO: 245006 - DNA, 39 bp, Artificial Sequence
  Description of Artificial Sequence: Synthetic oligonucleotide
acttcactgaattgacccccactcaaaaagatgtgtatg

SEQ ID NO: 245007 - DNA, 38 bp, Artificial Sequence
  Description of Artificial Sequence: Synthetic oligonucleotide
cttcactgaattgacccccactcaaaaagatgtgtatg

SEQ ID NO: 245008 - DNA, 38 bp, Artificial Sequence
  Description of Artificial Sequence: Synthetic oligonucleotide
ttcactgaattgacccccactcaaaaagatgtgtatgc

SEQ ID NO: 245009 - DNA, 37 bp, Artificial Sequence
  Description of Artificial Sequence: Synthetic oligonucleotide
tcactgaattgacccccactcaaaaagatgtgtatgc

SEQ ID NO: 245010 - DNA, 36 bp, Artificial Sequence
  Description of Artificial Sequence: Synthetic oligonucleotide
cactgaattgacccccactcaaaaagatgtgtatgc

SEQ ID NO: 245011 - DNA, 36 bp, Artificial Sequence
  Description of Artificial Sequence: Synthetic oligonucleotide
actgaattgacccccactcaaaaagatgtgtatgcc

SEQ ID NO: 245012 - DNA, 35 bp, Artificial Sequence
  Description of Artificial Sequence: Synthetic oligonucleotide
ctgaattgacccccactcaaaaagatgtgtatgcc

SEQ ID NO: 245013 - DNA, 36 bp, Artificial Sequence
  Description of Artificial Sequence: Synthetic oligonucleotide
tgaattgacccccactcaaaaagatgtgtatgcctg

SEQ ID NO: 245014 - DNA, 35 bp, Artificial Sequence
  Description of Artificial Sequence: Synthetic oligonucleotide
gaattgacccccactcaaaaagatgtgtatgcctg

SEQ ID NO: 245015 - DNA, 35 bp, Artificial Sequence
  Description of Artificial Sequence: Synthetic oligonucleotide
aattgacccccactcaaaaagatgtgtatgcctgg

SEQ ID NO: 245016 - DNA, 34 bp, Artificial Sequence
  Description of Artificial Sequence: Synthetic oligonucleotide
attgacccccactcaaaaagatgtgtatgcctgg

SEQ ID NO: 245017 - DNA, 33 bp, Artificial Sequence
  Description of Artificial Sequence: Synthetic oligonucleotide
ttgacccccactcaaaaagatgtgtatgcctgg

SEQ ID NO: 245018 - DNA, 32 bp, Artificial Sequence
  Description of Artificial Sequence: Synthetic oligonucleotide
tgacccccactcaaaaagatgtgtatgcctgg

SEQ ID NO: 245019 - DNA, 31 bp, Artificial Sequence
  Description of Artificial Sequence: Synthetic oligonucleotide
gacccccactcaaaaagatgtgtatgcctgg

SEQ ID NO: 245020 - DNA, 31 bp, Artificial Sequence
  Description of Artificial Sequence: Synthetic oligonucleotide
acccccactcaaaaagatgtgtatgcctggc

SEQ ID NO: 245021 - DNA, 30 bp, Artificial Sequence
  Description of Artificial Sequence: Synthetic oligonucleotide
cccccactcaaaaagatgtgtatgcctggc

SEQ ID NO: 245022 - DNA, 30 bp, Artificial Sequence
  Description of Artificial Sequence: Synthetic oligonucleotide
ccccactcaaaaagatgtgtatgcctggcg

SEQ ID NO: 245023 - DNA, 31 bp, Artificial Sequence
  Description of Artificial Sequence: Synthetic oligonucleotide
cccactcaaaaagatgtgtatgcctggcgtg

SEQ ID NO: 245024 - DNA, 32 bp, Artificial Sequence
  Description of Artificial Sequence: Synthetic oligonucleotide
ccactcaaaaagatgtgtatgcctggcgtgtg

SEQ ID NO: 245025 - DNA, 34 bp, Artificial Sequence
  Description of Artificial Sequence: Synthetic oligonucleotide
cactcaaaaagatgtgtatgcctggcgtgtgaac

SEQ ID NO: 245026 - DNA, 34 bp, Artificial Sequence
  Description of Artificial Sequence: Synthetic oligonucleotide
actcaaaaagatgtgtatgcctggcgtgtgaacg

SEQ ID NO: 245027 - DNA, 33 bp, Artificial Sequence
  Description of Artificial Sequence: Synthetic oligonucleotide
ctcaaaaagatgtgtatgcctggcgtgtgaacg

SEQ ID NO: 245028 - DNA, 35 bp, Artificial Sequence
  Description of Artificial Sequence: Synthetic oligonucleotide
tcaaaaagatgtgtatgcctggcgtgtgaacgatg

SEQ ID NO: 245029 - DNA, 34 bp, Artificial Sequence
  Description of Artificial Sequence: Synthetic oligonucleotide
caaaaagatgtgtatgcctggcgtgtgaacgatg

SEQ ID NO: 245030 - DNA, 35 bp, Artificial Sequence
  Description of Artificial Sequence: Synthetic oligonucleotide
aaaaagatgtgtatgcctggcgtgtgaacgatgtg

SEQ ID NO: 245031 - DNA, 34 bp, Artificial Sequence
  Description of Artificial Sequence: Synthetic oligonucleotide
aaaagatgtgtatgcctggcgtgtgaacgatgtg

SEQ ID NO: 245032 - DNA, 33 bp, Artificial Sequence
  Description of Artificial Sequence: Synthetic oligonucleotide
aaagatgtgtatgcctggcgtgtgaacgatgtg

SEQ ID NO: 245033 - DNA, 32 bp, Artificial Sequence
  Description of Artificial Sequence: Synthetic oligonucleotide
aagatgtgtatgcctggcgtgtgaacgatgtg

SEQ ID NO: 245034 - DNA, 31 bp, Artificial Sequence
  Description of Artificial Sequence: Synthetic oligonucleotide
agatgtgtatgcctggcgtgtgaacgatgtg

SEQ ID NO: 245035 - DNA, 30 bp, Artificial Sequence
  Description of Artificial Sequence: Synthetic oligonucleotide
gatgtgtatgcctggcgtgtgaacgatgtg

SEQ ID NO: 245036 - DNA, 31 bp, Artificial Sequence
  Description of Artificial Sequence: Synthetic oligonucleotide
atgtgtatgcctggcgtgtgaacgatgtgac

SEQ ID NO: 245037 - DNA, 30 bp, Artificial Sequence
  Description of Artificial Sequence: Synthetic oligonucleotide
tgtgtatgcctggcgtgtgaacgatgtgac

SEQ ID NO: 245038 - DNA, 29 bp, Artificial Sequence
  Description of Artificial Sequence: Synthetic oligonucleotide
gtgtatgcctggcgtgtgaacgatgtgac

SEQ ID NO: 245039 - DNA, 32 bp, Artificial Sequence
  Description of Artificial Sequence: Synthetic oligonucleotide
tgtatgcctggcgtgtgaacgatgtgacttag

SEQ ID NO: 245040 - DNA, 31 bp, Artificial Sequence
  Description of Artificial Sequence: Synthetic oligonucleotide
gtatgcctggcgtgtgaacgatgtgacttag

SEQ ID NO: 245041 - DNA, 32 bp, Artificial Sequence
  Description of Artificial Sequence: Synthetic oligonucleotide
tatgcctggcgtgtgaacgatgtgacttagtc

SEQ ID NO: 245042 - DNA, 31 bp, Artificial Sequence
  Description of Artificial Sequence: Synthetic oligonucleotide
atgcctggcgtgtgaacgatgtgacttagtc

SEQ ID NO: 245043 - DNA, 30 bp, Artificial Sequence
  Description of Artificial Sequence: Synthetic oligonucleotide
tgcctggcgtgtgaacgatgtgacttagtc

SEQ ID NO: 245044 - DNA, 29 bp, Artificial Sequence
  Description of Artificial Sequence: Synthetic oligonucleotide
gcctggcgtgtgaacgatgtgacttagtc

SEQ ID NO: 245045 - DNA, 30 bp, Artificial Sequence
  Description of Artificial Sequence: Synthetic oligonucleotide
cctggcgtgtgaacgatgtgacttagtcac

SEQ ID NO: 245046 - DNA, 31 bp, Artificial Sequence
  Description of Artificial Sequence: Synthetic oligonucleotide
ctggcgtgtgaacgatgtgacttagtcacag

SEQ ID NO: 245047 - DNA, 31 bp, Artificial Sequence
  Description of Artificial Sequence: Synthetic oligonucleotide
tggcgtgtgaacgatgtgacttagtcacagc

SEQ ID NO: 245048 - DNA, 30 bp, Artificial Sequence
  Description of Artificial Sequence: Synthetic oligonucleotide
ggcgtgtgaacgatgtgacttagtcacagc

SEQ ID NO: 245049 - DNA, 30 bp, Artificial Sequence
  Description of Artificial Sequence: Synthetic oligonucleotide
gcgtgtgaacgatgtgacttagtcacagcc

SEQ ID NO: 245050 - DNA, 30 bp, Artificial Sequence
  Description of Artificial Sequence: Synthetic oligonucleotide
cgtgtgaacgatgtgacttagtcacagccg

SEQ ID NO: 245051 - DNA, 32 bp, Artificial Sequence
  Description of Artificial Sequence: Synthetic oligonucleotide
gtgtgaacgatgtgacttagtcacagccgaag

SEQ ID NO: 245052 - DNA, 35 bp, Artificial Sequence
  Description of Artificial Sequence: Synthetic oligonucleotide
tgtgaacgatgtgacttagtcacagccgaagatag

SEQ ID NO: 245053 - DNA, 34 bp, Artificial Sequence
  Description of Artificial Sequence: Synthetic oligonucleotide
gtgaacgatgtgacttagtcacagccgaagatag

SEQ ID NO: 245054 - DNA, 38 bp, Artificial Sequence
  Description of Artificial Sequence: Synthetic oligonucleotide
tgaacgatgtgacttagtcacagccgaagatagtttag

SEQ ID NO: 245055 - DNA, 37 bp, Artificial Sequence
  Description of Artificial Sequence: Synthetic oligonucleotide
gaacgatgtgacttagtcacagccgaagatagtttag

SEQ ID NO: 245056 - DNA, 38 bp, Artificial Sequence
  Description of Artificial Sequence: Synthetic oligonucleotide
aacgatgtgacttagtcacagccgaagatagtttagtg

SEQ ID NO: 245057 - DNA, 37 bp, Artificial Sequence
  Description of Artificial Sequence: Synthetic oligonucleotide
acgatgtgacttagtcacagccgaagatagtttagtg

SEQ ID NO: 245058 - DNA, 36 bp, Artificial Sequence
  Description of Artificial Sequence: Synthetic oligonucleotide
cgatgtgacttagtcacagccgaagatagtttagtg

SEQ ID NO: 245059 - DNA, 36 bp, Artificial Sequence
  Description of Artificial Sequence: Synthetic oligonucleotide
gatgtgacttagtcacagccgaagatagtttagtgg

SEQ ID NO: 245060 - DNA, 36 bp, Artificial Sequence
  Description of Artificial Sequence: Synthetic oligonucleotide
atgtgacttagtcacagccgaagatagtttagtggg

SEQ ID NO: 245061 - DNA, 35 bp, Artificial Sequence
  Description of Artificial Sequence: Synthetic oligonucleotide
tgtgacttagtcacagccgaagatagtttagtggg

SEQ ID NO: 245062 - DNA, 34 bp, Artificial Sequence
  Description of Artificial Sequence: Synthetic oligonucleotide
gtgacttagtcacagccgaagatagtttagtggg

SEQ ID NO: 245063 - DNA, 36 bp, Artificial Sequence
  Description of Artificial Sequence: Synthetic oligonucleotide
tgacttagtcacagccgaagatagtttagtgggatc

SEQ ID NO: 245064 - DNA, 35 bp, Artificial Sequence
  Description of Artificial Sequence: Synthetic oligonucleotide
gacttagtcacagccgaagatagtttagtgggatc

SEQ ID NO: 245065 - DNA, 35 bp, Artificial Sequence
  Description of Artificial Sequence: Synthetic oligonucleotide
acttagtcacagccgaagatagtttagtgggatcc

SEQ ID NO: 245066 - DNA, 34 bp, Artificial Sequence
  Description of Artificial Sequence: Synthetic oligonucleotide
cttagtcacagccgaagatagtttagtgggatcc

SEQ ID NO: 245067 - DNA, 35 bp, Artificial Sequence
  Description of Artificial Sequence: Synthetic oligonucleotide
ttagtcacagccgaagatagtttagtgggatccag

SEQ ID NO: 245068 - DNA, 34 bp, Artificial Sequence
  Description of Artificial Sequence: Synthetic oligonucleotide
tagtcacagccgaagatagtttagtgggatccag

SEQ ID NO: 245069 - DNA, 33 bp, Artificial Sequence
  Description of Artificial Sequence: Synthetic oligonucleotide
agtcacagccgaagatagtttagtgggatccag

SEQ ID NO: 245070 - DNA, 32 bp, Artificial Sequence
  Description of Artificial Sequence: Synthetic oligonucleotide
gtcacagccgaagatagtttagtgggatccag

SEQ ID NO: 245071 - DNA, 33 bp, Artificial Sequence
  Description of Artificial Sequence: Synthetic oligonucleotide
tcacagccgaagatagtttagtgggatccagac

SEQ ID NO: 245072 - DNA, 32 bp, Artificial Sequence
  Description of Artificial Sequence: Synthetic oligonucleotide
cacagccgaagatagtttagtgggatccagac

SEQ ID NO: 245073 - DNA, 34 bp, Artificial Sequence
  Description of Artificial Sequence: Synthetic oligonucleotide
acagccgaagatagtttagtgggatccagacatg

SEQ ID NO: 245074 - DNA, 33 bp, Artificial Sequence
  Description of Artificial Sequence: Synthetic oligonucleotide
cagccgaagatagtttagtgggatccagacatg

SEQ ID NO: 245075 - DNA, 28 bp, Artificial Sequence
  Description of Artificial Sequence: Synthetic oligonucleotide
atgtagtccctgtgtctgctcctggctg

SEQ ID NO: 245076 - DNA, 27 bp, Artificial Sequence
  Description of Artificial Sequence: Synthetic oligonucleotide
tgtagtccctgtgtctgctcctggctg

SEQ ID NO: 245077 - DNA, 27 bp, Artificial Sequence
  Description of Artificial Sequence: Synthetic oligonucleotide
gtagtccctgtgtctgctcctggctgt

SEQ ID NO: 245078 - DNA, 27 bp, Artificial Sequence
  Description of Artificial Sequence: Synthetic oligonucleotide
tagtccctgtgtctgctcctggctgtg

SEQ ID NO: 245079 - DNA, 26 bp, Artificial Sequence
  Description of Artificial Sequence: Synthetic oligonucleotide
agtccctgtgtctgctcctggctgtg

SEQ ID NO: 245080 - DNA, 25 bp, Artificial Sequence
  Description of Artificial Sequence: Synthetic oligonucleotide
gtccctgtgtctgctcctggctgtg

SEQ ID NO: 245081 - DNA, 25 bp, Artificial Sequence
  Description of Artificial Sequence: Synthetic oligonucleotide
tccctgtgtctgctcctggctgtgg

SEQ ID NO: 245082 - DNA, 24 bp, Artificial Sequence
  Description of Artificial Sequence: Synthetic oligonucleotide
ccctgtgtctgctcctggctgtgg

SEQ ID NO: 245083 - DNA, 27 bp, Artificial Sequence
  Description of Artificial Sequence: Synthetic oligonucleotide
cctgtgtctgctcctggctgtggctat

SEQ ID NO: 245084 - DNA, 27 bp, Artificial Sequence
  Description of Artificial Sequence: Synthetic oligonucleotide
ctgtgtctgctcctggctgtggctatg

SEQ ID NO: 245085 - DNA, 27 bp, Artificial Sequence
  Description of Artificial Sequence: Synthetic oligonucleotide
tgtgtctgctcctggctgtggctatgg

SEQ ID NO: 245086 - DNA, 26 bp, Artificial Sequence
  Description of Artificial Sequence: Synthetic oligonucleotide
gtgtctgctcctggctgtggctatgg

SEQ ID NO: 245087 - DNA, 26 bp, Artificial Sequence
  Description of Artificial Sequence: Synthetic oligonucleotide
tgtctgctcctggctgtggctatggg

SEQ ID NO: 245088 - DNA, 25 bp, Artificial Sequence
  Description of Artificial Sequence: Synthetic oligonucleotide
gtctgctcctggctgtggctatggg

SEQ ID NO: 245089 - DNA, 25 bp, Artificial Sequence
  Description of Artificial Sequence: Synthetic oligonucleotide
tctgctcctggctgtggctatgggc

SEQ ID NO: 245090 - DNA, 24 bp, Artificial Sequence
  Description of Artificial Sequence: Synthetic oligonucleotide
ctgctcctggctgtggctatgggc

SEQ ID NO: 245091 - DNA, 25 bp, Artificial Sequence
  Description of Artificial Sequence: Synthetic oligonucleotide
tgctcctggctgtggctatgggcct

SEQ ID NO: 245092 - DNA, 24 bp, Artificial Sequence
  Description of Artificial Sequence: Synthetic oligonucleotide
gctcctggctgtggctatgggcct

SEQ ID NO: 245093 - DNA, 24 bp, Artificial Sequence
  Description of Artificial Sequence: Synthetic oligonucleotide
ctcctggctgtggctatgggcctg

SEQ ID NO: 245094 - DNA, 24 bp, Artificial Sequence
  Description of Artificial Sequence: Synthetic oligonucleotide
tcctggctgtggctatgggcctgg

SEQ ID NO: 245095 - DNA, 23 bp, Artificial Sequence
  Description of Artificial Sequence: Synthetic oligonucleotide
cctggctgtggctatgggcctgg

SEQ ID NO: 245096 - DNA, 23 bp, Artificial Sequence
  Description of Artificial Sequence: Synthetic oligonucleotide
ctggctgtggctatgggcctggg

SEQ ID NO: 245097 - DNA, 24 bp, Artificial Sequence
  Description of Artificial Sequence: Synthetic oligonucleotide
tggctgtggctatgggcctgggga

SEQ ID NO: 245098 - DNA, 23 bp, Artificial Sequence
  Description of Artificial Sequence: Synthetic oligonucleotide
ggctgtggctatgggcctgggga

SEQ ID NO: 245099 - DNA, 23 bp, Artificial Sequence
  Description of Artificial Sequence: Synthetic oligonucleotide
gctgtggctatgggcctggggac

SEQ ID NO: 245100 - DNA, 23 bp, Artificial Sequence
  Description of Artificial Sequence: Synthetic oligonucleotide
ctgtggctatgggcctggggacc

SEQ ID NO: 245101 - DNA, 23 bp, Artificial Sequence
  Description of Artificial Sequence: Synthetic oligonucleotide
tgtggctatgggcctggggaccg

SEQ ID NO: 245102 - DNA, 22 bp, Artificial Sequence
  Description of Artificial Sequence: Synthetic oligonucleotide
gtggctatgggcctggggaccg

SEQ ID NO: 245103 - DNA, 22 bp, Artificial Sequence
  Description of Artificial Sequence: Synthetic oligonucleotide
tggctatgggcctggggaccgc

SEQ ID NO: 245104 - DNA, 21 bp, Artificial Sequence
  Description of Artificial Sequence: Synthetic oligonucleotide
ggctatgggcctggggaccgc

SEQ ID NO: 245105 - DNA, 21 bp, Artificial Sequence
  Description of Artificial Sequence: Synthetic oligonucleotide
gctatgggcctggggaccgcc

SEQ ID NO: 245106 - DNA, 22 bp, Artificial Sequence
  Description of Artificial Sequence: Synthetic oligonucleotide
ctatgggcctggggaccgccgt

SEQ ID NO: 245107 - DNA, 23 bp, Artificial Sequence
  Description of Artificial Sequence: Synthetic oligonucleotide
tatgggcctggggaccgccgtgt

SEQ ID NO: 245108 - DNA, 22 bp, Artificial Sequence
  Description of Artificial Sequence: Synthetic oligonucleotide
atgggcctggggaccgccgtgt

SEQ ID NO: 245109 - DNA, 21 bp, Artificial Sequence
  Description of Artificial Sequence: Synthetic oligonucleotide
tgggcctggggaccgccgtgt

SEQ ID NO: 245110 - DNA, 20 bp, Artificial Sequence
  Description of Artificial Sequence: Synthetic oligonucleotide
gggcctggggaccgccgtgt

SEQ ID NO: 245111 - DNA, 21 bp, Artificial Sequence
  Description of Artificial Sequence: Synthetic oligonucleotide
ggcctggggaccgccgtgtca

SEQ ID NO: 245112 - DNA, 21 bp, Artificial Sequence
  Description of Artificial Sequence: Synthetic oligonucleotide
gcctggggaccgccgtgtcag

SEQ ID NO: 245113 - DNA, 22 bp, Artificial Sequence
  Description of Artificial Sequence: Synthetic oligonucleotide
cctggggaccgccgtgtcagca

SEQ ID NO: 245114 - DNA, 22 bp, Artificial Sequence
  Description of Artificial Sequence: Synthetic oligonucleotide
ctggggaccgccgtgtcagcag

SEQ ID NO: 245115 - DNA, 23 bp, Artificial Sequence
  Description of Artificial Sequence: Synthetic oligonucleotide
tggggaccgccgtgtcagcagga

SEQ ID NO: 245116 - DNA, 22 bp, Artificial Sequence
  Description of Artificial Sequence: Synthetic oligonucleotide
ggggaccgccgtgtcagcagga

SEQ ID NO: 245117 - DNA, 22 bp, Artificial Sequence
  Description of Artificial Sequence: Synthetic oligonucleotide
gggaccgccgtgtcagcaggag

SEQ ID NO: 245118 - DNA, 22 bp, Artificial Sequence
  Description of Artificial Sequence: Synthetic oligonucleotide
ggaccgccgtgtcagcaggagc

SEQ ID NO: 245119 - DNA, 22 bp, Artificial Sequence
  Description of Artificial Sequence: Synthetic oligonucleotide
gaccgccgtgtcagcaggagcc

SEQ ID NO: 245120 - DNA, 22 bp, Artificial Sequence
  Description of Artificial Sequence: Synthetic oligonucleotide
accgccgtgtcagcaggagccg

SEQ ID NO: 245121 - DNA, 21 bp, Artificial Sequence
  Description of Artificial Sequence: Synthetic oligonucleotide
ccgccgtgtcagcaggagccg

SEQ ID NO: 245122 - DNA, 21 bp, Artificial Sequence
  Description of Artificial Sequence: Synthetic oligonucleotide
cgccgtgtcagcaggagccgc

SEQ ID NO: 245123 - DNA, 21 bp, Artificial Sequence
  Description of Artificial Sequence: Synthetic oligonucleotide
gccgtgtcagcaggagccgcg

SEQ ID NO: 245124 - DNA, 22 bp, Artificial Sequence
  Description of Artificial Sequence: Synthetic oligonucleotide
ccgtgtcagcaggagccgcggt

SEQ ID NO: 245125 - DNA, 24 bp, Artificial Sequence
  Description of Artificial Sequence: Synthetic oligonucleotide
cgtgtcagcaggagccgcggtgaa

SEQ ID NO: 245126 - DNA, 24 bp, Artificial Sequence
  Description of Artificial Sequence: Synthetic oligonucleotide
gtgtcagcaggagccgcggtgaac

SEQ ID NO: 245127 - DNA, 25 bp, Artificial Sequence
  Description of Artificial Sequence: Synthetic oligonucleotide
tgtcagcaggagccgcggtgaacga

SEQ ID NO: 245128 - DNA, 24 bp, Artificial Sequence
  Description of Artificial Sequence: Synthetic oligonucleotide
gtcagcaggagccgcggtgaacga

SEQ ID NO: 245129 - DNA, 25 bp, Artificial Sequence
  Description of Artificial Sequence: Synthetic oligonucleotide
tcagcaggagccgcggtgaacgagt

SEQ ID NO: 245130 - DNA, 24 bp, Artificial Sequence
  Description of Artificial Sequence: Synthetic oligonucleotide
cagcaggagccgcggtgaacgagt

SEQ ID NO: 245131 - DNA, 26 bp, Artificial Sequence
  Description of Artificial Sequence: Synthetic oligonucleotide
agcaggagccgcggtgaacgagtgtt

SEQ ID NO: 245132 - DNA, 25 bp, Artificial Sequence
  Description of Artificial Sequence: Synthetic oligonucleotide
gcaggagccgcggtgaacgagtgtt

SEQ ID NO: 245133 - DNA, 25 bp, Artificial Sequence
  Description of Artificial Sequence: Synthetic oligonucleotide
caggagccgcggtgaacgagtgttg

SEQ ID NO: 245134 - DNA, 27 bp, Artificial Sequence
  Description of Artificial Sequence: Synthetic oligonucleotide
aggagccgcggtgaacgagtgttgctt

SEQ ID NO: 245135 - DNA, 26 bp, Artificial Sequence
  Description of Artificial Sequence: Synthetic oligonucleotide
ggagccgcggtgaacgagtgttgctt

SEQ ID NO: 245136 - DNA, 26 bp, Artificial Sequence
  Description of Artificial Sequence: Synthetic oligonucleotide
gagccgcggtgaacgagtgttgcttc

SEQ ID NO: 245137 - DNA, 27 bp, Artificial Sequence
  Description of Artificial Sequence: Synthetic oligonucleotide
agccgcggtgaacgagtgttgcttcgt

SEQ ID NO: 245138 - DNA, 26 bp, Artificial Sequence
  Description of Artificial Sequence: Synthetic oligonucleotide
gccgcggtgaacgagtgttgcttcgt

SEQ ID NO: 245139 - DNA, 26 bp, Artificial Sequence
  Description of Artificial Sequence: Synthetic oligonucleotide
ccgcggtgaacgagtgttgcttcgtg

SEQ ID NO: 245140 - DNA, 27 bp, Artificial Sequence
  Description of Artificial Sequence: Synthetic oligonucleotide
cgcggtgaacgagtgttgcttcgtgga

SEQ ID NO: 245141 - DNA, 27 bp, Artificial Sequence
  Description of Artificial Sequence: Synthetic oligonucleotide
gcggtgaacgagtgttgcttcgtggag

SEQ ID NO: 245142 - DNA, 27 bp, Artificial Sequence
  Description of Artificial Sequence: Synthetic oligonucleotide
cggtgaacgagtgttgcttcgtggagc

SEQ ID NO: 245143 - DNA, 29 bp, Artificial Sequence
  Description of Artificial Sequence: Synthetic oligonucleotide
ggtgaacgagtgttgcttcgtggagcatg

SEQ ID NO: 245144 - DNA, 29 bp, Artificial Sequence
  Description of Artificial Sequence: Synthetic oligonucleotide
gtgaacgagtgttgcttcgtggagcatgc

SEQ ID NO: 245145 - DNA, 29 bp, Artificial Sequence
  Description of Artificial Sequence: Synthetic oligonucleotide
tgaacgagtgttgcttcgtggagcatgcg

SEQ ID NO: 245146 - DNA, 28 bp, Artificial Sequence
  Description of Artificial Sequence: Synthetic oligonucleotide
gaacgagtgttgcttcgtggagcatgcg

SEQ ID NO: 245147 - DNA, 29 bp, Artificial Sequence
  Description of Artificial Sequence: Synthetic oligonucleotide
aacgagtgttgcttcgtggagcatgcgag

SEQ ID NO: 245148 - DNA, 28 bp, Artificial Sequence
  Description of Artificial Sequence: Synthetic oligonucleotide
acgagtgttgcttcgtggagcatgcgag

SEQ ID NO: 245149 - DNA, 27 bp, Artificial Sequence
  Description of Artificial Sequence: Synthetic oligonucleotide
cgagtgttgcttcgtggagcatgcgag

SEQ ID NO: 245150 - DNA, 27 bp, Artificial Sequence
  Description of Artificial Sequence: Synthetic oligonucleotide
gagtgttgcttcgtggagcatgcgagc

SEQ ID NO: 245151 - DNA, 27 bp, Artificial Sequence
  Description of Artificial Sequence: Synthetic oligonucleotide
agtgttgcttcgtggagcatgcgagcg

SEQ ID NO: 245152 - DNA, 26 bp, Artificial Sequence
  Description of Artificial Sequence: Synthetic oligonucleotide
gtgttgcttcgtggagcatgcgagcg

SEQ ID NO: 245153 - DNA, 27 bp, Artificial Sequence
  Description of Artificial Sequence: Synthetic oligonucleotide
tgttgcttcgtggagcatgcgagcgca

SEQ ID NO: 245154 - DNA, 27 bp, Artificial Sequence
  Description of Artificial Sequence: Synthetic oligonucleotide
gttgcttcgtggagcatgcgagcgcaa

SEQ ID NO: 245155 - DNA, 28 bp, Artificial Sequence
  Description of Artificial Sequence: Synthetic oligonucleotide
ttgcttcgtggagcatgcgagcgcaaag

SEQ ID NO: 245156 - DNA, 27 bp, Artificial Sequence
  Description of Artificial Sequence: Synthetic oligonucleotide
tgcttcgtggagcatgcgagcgcaaag

SEQ ID NO: 245157 - DNA, 26 bp, Artificial Sequence
  Description of Artificial Sequence: Synthetic oligonucleotide
gcttcgtggagcatgcgagcgcaaag

SEQ ID NO: 245158 - DNA, 26 bp, Artificial Sequence
  Description of Artificial Sequence: Synthetic oligonucleotide
cttcgtggagcatgcgagcgcaaagg

SEQ ID NO: 245159 - DNA, 26 bp, Artificial Sequence
  Description of Artificial Sequence: Synthetic oligonucleotide
ttcgtggagcatgcgagcgcaaaggg

SEQ ID NO: 245160 - DNA, 25 bp, Artificial Sequence
  Description of Artificial Sequence: Synthetic oligonucleotide
tcgtggagcatgcgagcgcaaaggg

SEQ ID NO: 245161 - DNA, 24 bp, Artificial Sequence
  Description of Artificial Sequence: Synthetic oligonucleotide
cgtggagcatgcgagcgcaaaggg

SEQ ID NO: 245162 - DNA, 24 bp, Artificial Sequence
  Description of Artificial Sequence: Synthetic oligonucleotide
gtggagcatgcgagcgcaaagggc

SEQ ID NO: 245163 - DNA, 25 bp, Artificial Sequence
  Description of Artificial Sequence: Synthetic oligonucleotide
tggagcatgcgagcgcaaagggcct

SEQ ID NO: 245164 - DNA, 24 bp, Artificial Sequence
  Description of Artificial Sequence: Synthetic oligonucleotide
ggagcatgcgagcgcaaagggcct

SEQ ID NO: 245165 - DNA, 24 bp, Artificial Sequence
  Description of Artificial Sequence: Synthetic oligonucleotide
gagcatgcgagcgcaaagggcctc

SEQ ID NO: 245166 - DNA, 24 bp, Artificial Sequence
  Description of Artificial Sequence: Synthetic oligonucleotide
agcatgcgagcgcaaagggcctcg

SEQ ID NO: 245167 - DNA, 23 bp, Artificial Sequence
  Description of Artificial Sequence: Synthetic oligonucleotide
gcatgcgagcgcaaagggcctcg

SEQ ID NO: 245168 - DNA, 23 bp, Artificial Sequence
  Description of Artificial Sequence: Synthetic oligonucleotide
catgcgagcgcaaagggcctcgc

SEQ ID NO: 245169 - DNA, 25 bp, Artificial Sequence
  Description of Artificial Sequence: Synthetic oligonucleotide
atgcgagcgcaaagggcctcgccaa

SEQ ID NO: 245170 - DNA, 24 bp, Artificial Sequence
  Description of Artificial Sequence: Synthetic oligonucleotide
tgcgagcgcaaagggcctcgccaa

SEQ ID NO: 245171 - DNA, 23 bp, Artificial Sequence
  Description of Artificial Sequence: Synthetic oligonucleotide
gcgagcgcaaagggcctcgccaa

SEQ ID NO: 245172 - DNA, 24 bp, Artificial Sequence
  Description of Artificial Sequence: Synthetic oligonucleotide
cgagcgcaaagggcctcgccaaga

SEQ ID NO: 245173 - DNA, 25 bp, Artificial Sequence
  Description of Artificial Sequence: Synthetic oligonucleotide
gagcgcaaagggcctcgccaagaga

SEQ ID NO: 245174 - DNA, 25 bp, Artificial Sequence
  Description of Artificial Sequence: Synthetic oligonucleotide
agcgcaaagggcctcgccaagagag

SEQ ID NO: 245175 - DNA, 24 bp, Artificial Sequence
  Description of Artificial Sequence: Synthetic oligonucleotide
gcgcaaagggcctcgccaagagag

SEQ ID NO: 245176 - DNA, 24 bp, Artificial Sequence
  Description of Artificial Sequence: Synthetic oligonucleotide
cgcaaagggcctcgccaagagagc

SEQ ID NO: 245177 - DNA, 24 bp, Artificial Sequence
  Description of Artificial Sequence: Synthetic oligonucleotide
gcaaagggcctcgccaagagagcc

SEQ ID NO: 245178 - DNA, 24 bp, Artificial Sequence
  Description of Artificial Sequence: Synthetic oligonucleotide
caaagggcctcgccaagagagccg

SEQ ID NO: 245179 - DNA, 25 bp, Artificial Sequence
  Description of Artificial Sequence: Synthetic oligonucleotide
aaagggcctcgccaagagagccggt

SEQ ID NO: 245180 - DNA, 24 bp, Artificial Sequence
  Description of Artificial Sequence: Synthetic oligonucleotide
aagggcctcgccaagagagccggt

SEQ ID NO: 245181 - DNA, 23 bp, Artificial Sequence
  Description of Artificial Sequence: Synthetic oligonucleotide
agggcctcgccaagagagccggt

SEQ ID NO: 245182 - DNA, 22 bp, Artificial Sequence
  Description of Artificial Sequence: Synthetic oligonucleotide
gggcctcgccaagagagccggt

SEQ ID NO: 245183 - DNA, 22 bp, Artificial Sequence
  Description of Artificial Sequence: Synthetic oligonucleotide
ggcctcgccaagagagccggtg

SEQ ID NO: 245184 - DNA, 23 bp, Artificial Sequence
  Description of Artificial Sequence: Synthetic oligonucleotide
gcctcgccaagagagccggtgca

SEQ ID NO: 245185 - DNA, 24 bp, Artificial Sequence
  Description of Artificial Sequence: Synthetic oligonucleotide
cctcgccaagagagccggtgcaca

SEQ ID NO: 245186 - DNA, 24 bp, Artificial Sequence
  Description of Artificial Sequence: Synthetic oligonucleotide
ctcgccaagagagccggtgcacag

SEQ ID NO: 245187 - DNA, 25 bp, Artificial Sequence
  Description of Artificial Sequence: Synthetic oligonucleotide
tcgccaagagagccggtgcacagct

SEQ ID NO: 245188 - DNA, 24 bp, Artificial Sequence
  Description of Artificial Sequence: Synthetic oligonucleotide
cgccaagagagccggtgcacagct

SEQ ID NO: 245189 - DNA, 26 bp, Artificial Sequence
  Description of Artificial Sequence: Synthetic oligonucleotide
gccaagagagccggtgcacagctgtt

SEQ ID NO: 245190 - DNA, 26 bp, Artificial Sequence
  Description of Artificial Sequence: Synthetic oligonucleotide
ccaagagagccggtgcacagctgttg

SEQ ID NO: 245191 - DNA, 26 bp, Artificial Sequence
  Description of Artificial Sequence: Synthetic oligonucleotide
caagagagccggtgcacagctgttgc

SEQ ID NO: 245192 - DNA, 26 bp, Artificial Sequence
  Description of Artificial Sequence: Synthetic oligonucleotide
aagagagccggtgcacagctgttgcg

SEQ ID NO: 245193 - DNA, 25 bp, Artificial Sequence
  Description of Artificial Sequence: Synthetic oligonucleotide
agagagccggtgcacagctgttgcg

SEQ ID NO: 245194 - DNA, 24 bp, Artificial Sequence
  Description of Artificial Sequence: Synthetic oligonucleotide
gagagccggtgcacagctgttgcg

SEQ ID NO: 245195 - DNA, 24 bp, Artificial Sequence
  Description of Artificial Sequence: Synthetic oligonucleotide
agagccggtgcacagctgttgcgg

SEQ ID NO: 245196 - DNA, 23 bp, Artificial Sequence
  Description of Artificial Sequence: Synthetic oligonucleotide
gagccggtgcacagctgttgcgg

SEQ ID NO: 245197 - DNA, 24 bp, Artificial Sequence
  Description of Artificial Sequence: Synthetic oligonucleotide
agccggtgcacagctgttgcggca

SEQ ID NO: 245198 - DNA, 23 bp, Artificial Sequence
  Description of Artificial Sequence: Synthetic oligonucleotide
gccggtgcacagctgttgcggca

SEQ ID NO: 245199 - DNA, 23 bp, Artificial Sequence
  Description of Artificial Sequence: Synthetic oligonucleotide
ccggtgcacagctgttgcggcag

SEQ ID NO: 245200 - DNA, 23 bp, Artificial Sequence
  Description of Artificial Sequence: Synthetic oligonucleotide
cggtgcacagctgttgcggcagg

SEQ ID NO: 245201 - DNA, 24 bp, Artificial Sequence
  Description of Artificial Sequence: Synthetic oligonucleotide
ggtgcacagctgttgcggcaggga

SEQ ID NO: 245202 - DNA, 24 bp, Artificial Sequence
  Description of Artificial Sequence: Synthetic oligonucleotide
gtgcacagctgttgcggcagggac

SEQ ID NO: 245203 - DNA, 24 bp, Artificial Sequence
  Description of Artificial Sequence: Synthetic oligonucleotide
tgcacagctgttgcggcagggacc

SEQ ID NO: 245204 - DNA, 23 bp, Artificial Sequence
  Description of Artificial Sequence: Synthetic oligonucleotide
gcacagctgttgcggcagggacc

SEQ ID NO: 245205 - DNA, 23 bp, Artificial Sequence
  Description of Artificial Sequence: Synthetic oligonucleotide
cacagctgttgcggcagggaccg

SEQ ID NO: 245206 - DNA, 23 bp, Artificial Sequence
  Description of Artificial Sequence: Synthetic oligonucleotide
acagctgttgcggcagggaccgg

SEQ ID NO: 245207 - DNA, 22 bp, Artificial Sequence
  Description of Artificial Sequence: Synthetic oligonucleotide
cagctgttgcggcagggaccgg

SEQ ID NO: 245208 - DNA, 22 bp, Artificial Sequence
  Description of Artificial Sequence: Synthetic oligonucleotide
agctgttgcggcagggaccggg

SEQ ID NO: 245209 - DNA, 21 bp, Artificial Sequence
  Description of Artificial Sequence: Synthetic oligonucleotide
gctgttgcggcagggaccggg

SEQ ID NO: 245210 - DNA, 23 bp, Artificial Sequence
  Description of Artificial Sequence: Synthetic oligonucleotide
ctgttgcggcagggaccggggaa

SEQ ID NO: 245211 - DNA, 23 bp, Artificial Sequence
  Description of Artificial Sequence: Synthetic oligonucleotide
tgttgcggcagggaccggggaac

SEQ ID NO: 245212 - DNA, 22 bp, Artificial Sequence
  Description of Artificial Sequence: Synthetic oligonucleotide
gttgcggcagggaccggggaac

SEQ ID NO: 245213 - DNA, 22 bp, Artificial Sequence
  Description of Artificial Sequence: Synthetic oligonucleotide
ttgcggcagggaccggggaacc

SEQ ID NO: 245214 - DNA, 21 bp, Artificial Sequence
  Description of Artificial Sequence: Synthetic oligonucleotide
tgcggcagggaccggggaacc

SEQ ID NO: 245215 - DNA, 20 bp, Artificial Sequence
  Description of Artificial Sequence: Synthetic oligonucleotide
gcggcagggaccggggaacc

SEQ ID NO: 245216 - DNA, 20 bp, Artificial Sequence
  Description of Artificial Sequence: Synthetic oligonucleotide
cggcagggaccggggaaccg

SEQ ID NO: 245217 - DNA, 20 bp, Artificial Sequence
  Description of Artificial Sequence: Synthetic oligonucleotide
ggcagggaccggggaaccgc

SEQ ID NO: 245218 - DNA, 20 bp, Artificial Sequence
  Description of Artificial Sequence: Synthetic oligonucleotide
gcagggaccggggaaccgcg

SEQ ID NO: 245219 - DNA, 20 bp, Artificial Sequence
  Description of Artificial Sequence: Synthetic oligonucleotide
cagggaccggggaaccgcgg

SEQ ID NO: 245220 - DNA, 20 bp, Artificial Sequence
  Description of Artificial Sequence: Synthetic oligonucleotide
agggaccggggaaccgcggc

SEQ ID NO: 245221 - DNA, 20 bp, Artificial Sequence
  Description of Artificial Sequence: Synthetic oligonucleotide
gggaccggggaaccgcggct

SEQ ID NO: 245222 - DNA, 20 bp, Artificial Sequence
  Description of Artificial Sequence: Synthetic oligonucleotide
ggaccggggaaccgcggcct

SEQ ID NO: 245223 - DNA, 20 bp, Artificial Sequence
  Description of Artificial Sequence: Synthetic oligonucleotide
gaccggggaaccgcggccct

SEQ ID NO: 245224 - DNA, 20 bp, Artificial Sequence
  Description of Artificial Sequence: Synthetic oligonucleotide
accggggaaccgcggcccct

SEQ ID NO: 245225 - DNA, 20 bp, Artificial Sequence
  Description of Artificial Sequence: Synthetic oligonucleotide
ccggggaaccgcggcccctt

SEQ ID NO: 245226 - DNA, 20 bp, Artificial Sequence
  Description of Artificial Sequence: Synthetic oligonucleotide
cggggaaccgcggccccgtt

SEQ ID NO: 245227 - DNA, 20 bp, Artificial Sequence
  Description of Artificial Sequence: Synthetic oligonucleotide
ggggaaccgcggccccggtt

SEQ ID NO: 245228 - DNA, 20 bp, Artificial Sequence
  Description of Artificial Sequence: Synthetic oligonucleotide
gggaaccgcggccccggctt

SEQ ID NO: 245229 - DNA, 20 bp, Artificial Sequence
  Description of Artificial Sequence: Synthetic oligonucleotide
ggaaccgcggccccggcctt

SEQ ID NO: 245230 - DNA, 20 bp, Artificial Sequence
  Description of Artificial Sequence: Synthetic oligonucleotide
gaaccgcggccccggccctt

SEQ ID NO: 245231 - DNA, 20 bp, Artificial Sequence
  Description of Artificial Sequence: Synthetic oligonucleotide
aaccgcggccccggcccgat

SEQ ID NO: 245232 - DNA, 20 bp, Artificial Sequence
  Description of Artificial Sequence: Synthetic oligonucleotide
accgcggccccggcccgatt

SEQ ID NO: 245233 - DNA, 20 bp, Artificial Sequence
  Description of Artificial Sequence: Synthetic oligonucleotide
ccgcggccccggcccgattt

SEQ ID NO: 245234 - DNA, 20 bp, Artificial Sequence
  Description of Artificial Sequence: Synthetic oligonucleotide
cgcggccccggcccgacttt

SEQ ID NO: 245235 - DNA, 20 bp, Artificial Sequence
  Description of Artificial Sequence: Synthetic oligonucleotide
gcggccccggcccgaccttt

SEQ ID NO: 245236 - DNA, 20 bp, Artificial Sequence
  Description of Artificial Sequence: Synthetic oligonucleotide
cggccccggcccgacctctt

SEQ ID NO: 245237 - DNA, 20 bp, Artificial Sequence
  Description of Artificial Sequence: Synthetic oligonucleotide
ggccccggcccgacctcgat

SEQ ID NO: 245238 - DNA, 20 bp, Artificial Sequence
  Description of Artificial Sequence: Synthetic oligonucleotide
gccccggcccgacctcgact

SEQ ID NO: 245239 - DNA, 20 bp, Artificial Sequence
  Description of Artificial Sequence: Synthetic oligonucleotide
ccccggcccgacctcgacgt

SEQ ID NO: 245240 - DNA, 20 bp, Artificial Sequence
  Description of Artificial Sequence: Synthetic oligonucleotide
cccggcccgacctcgacgct

SEQ ID NO: 245241 - DNA, 21 bp, Artificial Sequence
  Description of Artificial Sequence: Synthetic oligonucleotide
ccggcccgacctcgacgctga

SEQ ID NO: 245242 - DNA, 21 bp, Artificial Sequence
  Description of Artificial Sequence: Synthetic oligonucleotide
cggcccgacctcgacgctgag

SEQ ID NO: 245243 - DNA, 22 bp, Artificial Sequence
  Description of Artificial Sequence: Synthetic oligonucleotide
ggcccgacctcgacgctgagct

SEQ ID NO: 245244 - DNA, 25 bp, Artificial Sequence
  Description of Artificial Sequence: Synthetic oligonucleotide
gcccgacctcgacgctgagctcttt

SEQ ID NO: 245245 - DNA, 26 bp, Artificial Sequence
  Description of Artificial Sequence: Synthetic oligonucleotide
cccgacctcgacgctgagctctttct

SEQ ID NO: 245246 - DNA, 27 bp, Artificial Sequence
  Description of Artificial Sequence: Synthetic oligonucleotide
ccgacctcgacgctgagctctttctca

SEQ ID NO: 245247 - DNA, 27 bp, Artificial Sequence
  Description of Artificial Sequence: Synthetic oligonucleotide
cgacctcgacgctgagctctttctcag

SEQ ID NO: 245248 - DNA, 28 bp, Artificial Sequence
  Description of Artificial Sequence: Synthetic oligonucleotide
gacctcgacgctgagctctttctcagtg

SEQ ID NO: 245249 - DNA, 30 bp, Artificial Sequence
  Description of Artificial Sequence: Synthetic oligonucleotide
acctcgacgctgagctctttctcagtgttc

SEQ ID NO: 245250 - DNA, 29 bp, Artificial Sequence
  Description of Artificial Sequence: Synthetic oligonucleotide
cctcgacgctgagctctttctcagtgttc

SEQ ID NO: 245251 - DNA, 30 bp, Artificial Sequence
  Description of Artificial Sequence: Synthetic oligonucleotide
ctcgacgctgagctctttctcagtgttcac

SEQ ID NO: 245252 - DNA, 30 bp, Artificial Sequence
  Description of Artificial Sequence: Synthetic oligonucleotide
tcgacgctgagctctttctcagtgttcacg

SEQ ID NO: 245253 - DNA, 29 bp, Artificial Sequence
  Description of Artificial Sequence: Synthetic oligonucleotide
cgacgctgagctctttctcagtgttcacg

SEQ ID NO: 245254 - DNA, 30 bp, Artificial Sequence
  Description of Artificial Sequence: Synthetic oligonucleotide
gacgctgagctctttctcagtgttcacgac

SEQ ID NO: 245255 - DNA, 30 bp, Artificial Sequence
  Description of Artificial Sequence: Synthetic oligonucleotide
acgctgagctctttctcagtgttcacgacc

SEQ ID NO: 245256 - DNA, 29 bp, Artificial Sequence
  Description of Artificial Sequence: Synthetic oligonucleotide
cgctgagctctttctcagtgttcacgacc

SEQ ID NO: 245257 - DNA, 29 bp, Artificial Sequence
  Description of Artificial Sequence: Synthetic oligonucleotide
gctgagctctttctcagtgttcacgaccc

SEQ ID NO: 245258 - DNA, 29 bp, Artificial Sequence
  Description of Artificial Sequence: Synthetic oligonucleotide
ctgagctctttctcagtgttcacgacccc

SEQ ID NO: 245259 - DNA, 29 bp, Artificial Sequence
  Description of Artificial Sequence: Synthetic oligonucleotide
tgagctctttctcagtgttcacgaccccc

SEQ ID NO: 245260 - DNA, 28 bp, Artificial Sequence
  Description of Artificial Sequence: Synthetic oligonucleotide
gagctctttctcagtgttcacgaccccc

SEQ ID NO: 245261 - DNA, 28 bp, Artificial Sequence
  Description of Artificial Sequence: Synthetic oligonucleotide
agctctttctcagtgttcacgacccccc

SEQ ID NO: 245262 - DNA, 27 bp, Artificial Sequence
  Description of Artificial Sequence: Synthetic oligonucleotide
gctctttctcagtgttcacgacccccc

SEQ ID NO: 245263 - DNA, 27 bp, Artificial Sequence
  Description of Artificial Sequence: Synthetic oligonucleotide
ctctttctcagtgttcacgaccccccg

SEQ ID NO: 245264 - DNA, 27 bp, Artificial Sequence
  Description of Artificial Sequence: Synthetic oligonucleotide
tctttctcagtgttcacgaccccccgg

SEQ ID NO: 245265 - DNA, 26 bp, Artificial Sequence
  Description of Artificial Sequence: Synthetic oligonucleotide
ctttctcagtgttcacgaccccccgg

SEQ ID NO: 245266 - DNA, 26 bp, Artificial Sequence
  Description of Artificial Sequence: Synthetic oligonucleotide
tttctcagtgttcacgaccccccggg

SEQ ID NO: 245267 - DNA, 25 bp, Artificial Sequence
  Description of Artificial Sequence: Synthetic oligonucleotide
ttctcagtgttcacgaccccccggg

SEQ ID NO: 245268 - DNA, 24 bp, Artificial Sequence
  Description of Artificial Sequence: Synthetic oligonucleotide
tctcagtgttcacgaccccccggg

SEQ ID NO: 245269 - DNA, 23 bp, Artificial Sequence
  Description of Artificial Sequence: Synthetic oligonucleotide
ctcagtgttcacgaccccccggg

SEQ ID NO: 245270 - DNA, 23 bp, Artificial Sequence
  Description of Artificial Sequence: Synthetic oligonucleotide
tcagtgttcacgaccccccgggc

SEQ ID NO: 245271 - DNA, 22 bp, Artificial Sequence
  Description of Artificial Sequence: Synthetic oligonucleotide
cagtgttcacgaccccccgggc

SEQ ID NO: 245272 - DNA, 22 bp, Artificial Sequence
  Description of Artificial Sequence: Synthetic oligonucleotide
agtgttcacgaccccccgggcg

SEQ ID NO: 245273 - DNA, 21 bp, Artificial Sequence
  Description of Artificial Sequence: Synthetic oligonucleotide
gtgttcacgaccccccgggcg

SEQ ID NO: 245274 - DNA, 21 bp, Artificial Sequence
  Description of Artificial Sequence: Synthetic oligonucleotide
tgttcacgaccccccgggcgc

SEQ ID NO: 245275 - DNA, 20 bp, Artificial Sequence
  Description of Artificial Sequence: Synthetic oligonucleotide
gttcacgaccccccgggcgc

SEQ ID NO: 245276 - DNA, 20 bp, Artificial Sequence
  Description of Artificial Sequence: Synthetic oligonucleotide
ttcacgaccccccgggcgcc

SEQ ID NO: 245277 - DNA, 20 bp, Artificial Sequence
  Description of Artificial Sequence: Synthetic oligonucleotide
tcacgaccccccgggcgcct

SEQ ID NO: 245278 - DNA, 20 bp, Artificial Sequence
  Description of Artificial Sequence: Synthetic oligonucleotide
cacgaccccccgggcgcctt

SEQ ID NO: 245279 - DNA, 20 bp, Artificial Sequence
  Description of Artificial Sequence: Synthetic oligonucleotide
acgaccccccgggcgcccat

SEQ ID NO: 245280 - DNA, 20 bp, Artificial Sequence
  Description of Artificial Sequence: Synthetic oligonucleotide
cgaccccccgggcgcccatt

SEQ ID NO: 245281 - DNA, 20 bp, Artificial Sequence
  Description of Artificial Sequence: Synthetic oligonucleotide
gaccccccgggcgcccactt

SEQ ID NO: 245282 - DNA, 20 bp, Artificial Sequence
  Description of Artificial Sequence: Synthetic oligonucleotide
accccccgggcgcccaccat

SEQ ID NO: 245283 - DNA, 20 bp, Artificial Sequence
  Description of Artificial Sequence: Synthetic oligonucleotide
ccccccgggcgcccaccatt

SEQ ID NO: 245284 - DNA, 20 bp, Artificial Sequence
  Description of Artificial Sequence: Synthetic oligonucleotide
cccccgggcgcccaccagtt

SEQ ID NO: 245285 - DNA, 20 bp, Artificial Sequence
  Description of Artificial Sequence: Synthetic oligonucleotide
ccccgggcgcccaccaggtt

SEQ ID NO: 245286 - DNA, 20 bp, Artificial Sequence
  Description of Artificial Sequence: Synthetic oligonucleotide
cccgggcgcccaccaggctt

SEQ ID NO: 245287 - DNA, 20 bp, Artificial Sequence
  Description of Artificial Sequence: Synthetic oligonucleotide
ccgggcgcccaccaggctgt

SEQ ID NO: 245288 - DNA, 20 bp, Artificial Sequence
  Description of Artificial Sequence: Synthetic oligonucleotide
cgggcgcccaccaggctgct

SEQ ID NO: 245289 - DNA, 21 bp, Artificial Sequence
  Description of Artificial Sequence: Synthetic oligonucleotide
gggcgcccaccaggctgcgtt

SEQ ID NO: 245290 - DNA, 22 bp, Artificial Sequence
  Description of Artificial Sequence: Synthetic oligonucleotide
ggcgcccaccaggctgcgttca

SEQ ID NO: 245291 - DNA, 22 bp, Artificial Sequence
  Description of Artificial Sequence: Synthetic oligonucleotide
gcgcccaccaggctgcgttcag

SEQ ID NO: 245292 - DNA, 22 bp, Artificial Sequence
  Description of Artificial Sequence: Synthetic oligonucleotide
cgcccaccaggctgcgttcagg

SEQ ID NO: 245293 - DNA, 22 bp, Artificial Sequence
  Description of Artificial Sequence: Synthetic oligonucleotide
gcccaccaggctgcgttcaggc

SEQ ID NO: 245294 - DNA, 22 bp, Artificial Sequence
  Description of Artificial Sequence: Synthetic oligonucleotide
cccaccaggctgcgttcaggcg

SEQ ID NO: 245295 - DNA, 25 bp, Artificial Sequence
  Description of Artificial Sequence: Synthetic oligonucleotide
ccaccaggctgcgttcaggcggaat

SEQ ID NO: 245296 - DNA, 25 bp, Artificial Sequence
  Description of Artificial Sequence: Synthetic oligonucleotide
caccaggctgcgttcaggcggaatc

SEQ ID NO: 245297 - DNA, 25 bp, Artificial Sequence
  Description of Artificial Sequence: Synthetic oligonucleotide
accaggctgcgttcaggcggaatcc

SEQ ID NO: 245298 - DNA, 24 bp, Artificial Sequence
  Description of Artificial Sequence: Synthetic oligonucleotide
ccaggctgcgttcaggcggaatcc

SEQ ID NO: 245299 - DNA, 24 bp, Artificial Sequence
  Description of Artificial Sequence: Synthetic oligonucleotide
caggctgcgttcaggcggaatccc

SEQ ID NO: 245300 - DNA, 24 bp, Artificial Sequence
  Description of Artificial Sequence: Synthetic oligonucleotide
aggctgcgttcaggcggaatcccc

SEQ ID NO: 245301 - DNA, 23 bp, Artificial Sequence
  Description of Artificial Sequence: Synthetic oligonucleotide
ggctgcgttcaggcggaatcccc

SEQ ID NO: 245302 - DNA, 23 bp, Artificial Sequence
  Description of Artificial Sequence: Synthetic oligonucleotide
gctgcgttcaggcggaatccccg

SEQ ID NO: 245303 - DNA, 23 bp, Artificial Sequence
  Description of Artificial Sequence: Synthetic oligonucleotide
ctgcgttcaggcggaatccccgg

SEQ ID NO: 245304 - DNA, 23 bp, Artificial Sequence
  Description of Artificial Sequence: Synthetic oligonucleotide
tgcgttcaggcggaatccccggg

SEQ ID NO: 245305 - DNA, 22 bp, Artificial Sequence
  Description of Artificial Sequence: Synthetic oligonucleotide
gcgttcaggcggaatccccggg

SEQ ID NO: 245306 - DNA, 22 bp, Artificial Sequence
  Description of Artificial Sequence: Synthetic oligonucleotide
cgttcaggcggaatccccgggc

SEQ ID NO: 245307 - DNA, 22 bp, Artificial Sequence
  Description of Artificial Sequence: Synthetic oligonucleotide
gttcaggcggaatccccgggcc

SEQ ID NO: 245308 - DNA, 22 bp, Artificial Sequence
  Description of Artificial Sequence: Synthetic oligonucleotide
ttcaggcggaatccccgggccg

SEQ ID NO: 245309 - DNA, 21 bp, Artificial Sequence
  Description of Artificial Sequence: Synthetic oligonucleotide
tcaggcggaatccccgggccg

SEQ ID NO: 245310 - DNA, 20 bp, Artificial Sequence
  Description of Artificial Sequence: Synthetic oligonucleotide
caggcggaatccccgggccg

SEQ ID NO: 245311 - DNA, 20 bp, Artificial Sequence
  Description of Artificial Sequence: Synthetic oligonucleotide
aggcggaatccccgggccgc

SEQ ID NO: 245312 - DNA, 20 bp, Artificial Sequence
  Description of Artificial Sequence: Synthetic oligonucleotide
ggcggaatccccgggccgct

SEQ ID NO: 245313 - DNA, 20 bp, Artificial Sequence
  Description of Artificial Sequence: Synthetic oligonucleotide
gcggaatccccgggccgcct

SEQ ID NO: 245314 - DNA, 20 bp, Artificial Sequence
  Description of Artificial Sequence: Synthetic oligonucleotide
cggaatccccgggccgccct

SEQ ID NO: 245315 - DNA, 20 bp, Artificial Sequence
  Description of Artificial Sequence: Synthetic oligonucleotide
ggaatccccgggccgcccct

SEQ ID NO: 245316 - DNA, 20 bp, Artificial Sequence
  Description of Artificial Sequence: Synthetic oligonucleotide
gaatccccgggccgccccct

SEQ ID NO: 245317 - DNA, 20 bp, Artificial Sequence
  Description of Artificial Sequence: Synthetic oligonucleotide
aatccccgggccgcccccgt

SEQ ID NO: 245318 - DNA, 20 bp, Artificial Sequence
  Description of Artificial Sequence: Synthetic oligonucleotide
atccccgggccgcccccgtt

SEQ ID NO: 245319 - DNA, 20 bp, Artificial Sequence
  Description of Artificial Sequence: Synthetic oligonucleotide
tccccgggccgcccccgttt

SEQ ID NO: 245320 - DNA, 20 bp, Artificial Sequence
  Description of Artificial Sequence: Synthetic oligonucleotide
ccccgggccgcccccgtttt

SEQ ID NO: 245321 - DNA, 20 bp, Artificial Sequence
  Description of Artificial Sequence: Synthetic oligonucleotide
cccgggccgcccccgctttt

SEQ ID NO: 245322 - DNA, 20 bp, Artificial Sequence
  Description of Artificial Sequence: Synthetic oligonucleotide
ccgggccgcccccgctcttt

SEQ ID NO: 245323 - DNA, 20 bp, Artificial Sequence
  Description of Artificial Sequence: Synthetic oligonucleotide
cgggccgcccccgctccatt

SEQ ID NO: 245324 - DNA, 20 bp, Artificial Sequence
  Description of Artificial Sequence: Synthetic oligonucleotide
gggccgcccccgctccacat

SEQ ID NO: 245325 - DNA, 20 bp, Artificial Sequence
  Description of Artificial Sequence: Synthetic oligonucleotide
ggccgcccccgctccacact

SEQ ID NO: 245326 - DNA, 20 bp, Artificial Sequence
  Description of Artificial Sequence: Synthetic oligonucleotide
gccgcccccgctccacactg

SEQ ID NO: 245327 - DNA, 20 bp, Artificial Sequence
  Description of Artificial Sequence: Synthetic oligonucleotide
ccgcccccgctccacactgc

SEQ ID NO: 245328 - DNA, 21 bp, Artificial Sequence
  Description of Artificial Sequence: Synthetic oligonucleotide
cgcccccgctccacactgcca

SEQ ID NO: 245329 - DNA, 23 bp, Artificial Sequence
  Description of Artificial Sequence: Synthetic oligonucleotide
gcccccgctccacactgccagat

SEQ ID NO: 245330 - DNA, 24 bp, Artificial Sequence
  Description of Artificial Sequence: Synthetic oligonucleotide
cccccgctccacactgccagatga

SEQ ID NO: 245331 - DNA, 24 bp, Artificial Sequence
  Description of Artificial Sequence: Synthetic oligonucleotide
ccccgctccacactgccagatgag

SEQ ID NO: 245332 - DNA, 24 bp, Artificial Sequence
  Description of Artificial Sequence: Synthetic oligonucleotide
cccgctccacactgccagatgagc

SEQ ID NO: 245333 - DNA, 24 bp, Artificial Sequence
  Description of Artificial Sequence: Synthetic oligonucleotide
ccgctccacactgccagatgagcc

SEQ ID NO: 245334 - DNA, 24 bp, Artificial Sequence
  Description of Artificial Sequence: Synthetic oligonucleotide
cgctccacactgccagatgagccc

SEQ ID NO: 245335 - DNA, 26 bp, Artificial Sequence
  Description of Artificial Sequence: Synthetic oligonucleotide
gctccacactgccagatgagcccctt

SEQ ID NO: 245336 - DNA, 26 bp, Artificial Sequence
  Description of Artificial Sequence: Synthetic oligonucleotide
ctccacactgccagatgagccccttc

SEQ ID NO: 245337 - DNA, 27 bp, Artificial Sequence
  Description of Artificial Sequence: Synthetic oligonucleotide
tccacactgccagatgagccccttcgt

SEQ ID NO: 245338 - DNA, 26 bp, Artificial Sequence
  Description of Artificial Sequence: Synthetic oligonucleotide
ccacactgccagatgagccccttcgt

SEQ ID NO: 245339 - DNA, 26 bp, Artificial Sequence
  Description of Artificial Sequence: Synthetic oligonucleotide
cacactgccagatgagccccttcgtg

SEQ ID NO: 245340 - DNA, 26 bp, Artificial Sequence
  Description of Artificial Sequence: Synthetic oligonucleotide
acactgccagatgagccccttcgtgc

SEQ ID NO: 245341 - DNA, 25 bp, Artificial Sequence
  Description of Artificial Sequence: Synthetic oligonucleotide
cactgccagatgagccccttcgtgc

SEQ ID NO: 245342 - DNA, 26 bp, Artificial Sequence
  Description of Artificial Sequence: Synthetic oligonucleotide
actgccagatgagccccttcgtgcca

SEQ ID NO: 245343 - DNA, 25 bp, Artificial Sequence
  Description of Artificial Sequence: Synthetic oligonucleotide
ctgccagatgagccccttcgtgcca

SEQ ID NO: 245344 - DNA, 26 bp, Artificial Sequence
  Description of Artificial Sequence: Synthetic oligonucleotide
tgccagatgagccccttcgtgccact

SEQ ID NO: 245345 - DNA, 25 bp, Artificial Sequence
  Description of Artificial Sequence: Synthetic oligonucleotide
gccagatgagccccttcgtgccact

SEQ ID NO: 245346 - DNA, 25 bp, Artificial Sequence
  Description of Artificial Sequence: Synthetic oligonucleotide
ccagatgagccccttcgtgccactc

SEQ ID NO: 245347 - DNA, 25 bp, Artificial Sequence
  Description of Artificial Sequence: Synthetic oligonucleotide
cagatgagccccttcgtgccactcc

SEQ ID NO: 245348 - DNA, 25 bp, Artificial Sequence
  Description of Artificial Sequence: Synthetic oligonucleotide
agatgagccccttcgtgccactccc

SEQ ID NO: 245349 - DNA, 24 bp, Artificial Sequence
  Description of Artificial Sequence: Synthetic oligonucleotide
gatgagccccttcgtgccactccc

SEQ ID NO: 245350 - DNA, 24 bp, Artificial Sequence
  Description of Artificial Sequence: Synthetic oligonucleotide
atgagccccttcgtgccactcccc

SEQ ID NO: 245351 - DNA, 23 bp, Artificial Sequence
  Description of Artificial Sequence: Synthetic oligonucleotide
tgagccccttcgtgccactcccc

SEQ ID NO: 245352 - DNA, 22 bp, Artificial Sequence
  Description of Artificial Sequence: Synthetic oligonucleotide
gagccccttcgtgccactcccc

SEQ ID NO: 245353 - DNA, 22 bp, Artificial Sequence
  Description of Artificial Sequence: Synthetic oligonucleotide
agccccttcgtgccactccccg

SEQ ID NO: 245354 - DNA, 21 bp, Artificial Sequence
  Description of Artificial Sequence: Synthetic oligonucleotide
gccccttcgtgccactccccg

SEQ ID NO: 245355 - DNA, 21 bp, Artificial Sequence
  Description of Artificial Sequence: Synthetic oligonucleotide
ccccttcgtgccactccccgc

SEQ ID NO: 245356 - DNA, 22 bp, Artificial Sequence
  Description of Artificial Sequence: Synthetic oligonucleotide
cccttcgtgccactccccgcca

SEQ ID NO: 245357 - DNA, 23 bp, Artificial Sequence
  Description of Artificial Sequence: Synthetic oligonucleotide
ccttcgtgccactccccgccact

SEQ ID NO: 245358 - DNA, 23 bp, Artificial Sequence
  Description of Artificial Sequence: Synthetic oligonucleotide
cttcgtgccactccccgccactg

SEQ ID NO: 245359 - DNA, 23 bp, Artificial Sequence
  Description of Artificial Sequence: Synthetic oligonucleotide
ttcgtgccactccccgccactgc

SEQ ID NO: 245360 - DNA, 22 bp, Artificial Sequence
  Description of Artificial Sequence: Synthetic oligonucleotide
tcgtgccactccccgccactgc

SEQ ID NO: 245361 - DNA, 21 bp, Artificial Sequence
  Description of Artificial Sequence: Synthetic oligonucleotide
cgtgccactccccgccactgc

SEQ ID NO: 245362 - DNA, 25 bp, Artificial Sequence
  Description of Artificial Sequence: Synthetic oligonucleotide
gtgccactccccgccactgcgaaat

SEQ ID NO: 245363 - DNA, 25 bp, Artificial Sequence
  Description of Artificial Sequence: Synthetic oligonucleotide
tgccactccccgccactgcgaaatc

SEQ ID NO: 245364 - DNA, 24 bp, Artificial Sequence
  Description of Artificial Sequence: Synthetic oligonucleotide
gccactccccgccactgcgaaatc

SEQ ID NO: 245365 - DNA, 24 bp, Artificial Sequence
  Description of Artificial Sequence: Synthetic oligonucleotide
ccactccccgccactgcgaaatcg

SEQ ID NO: 245366 - DNA, 24 bp, Artificial Sequence
  Description of Artificial Sequence: Synthetic oligonucleotide
cactccccgccactgcgaaatcgg

SEQ ID NO: 245367 - DNA, 24 bp, Artificial Sequence
  Description of Artificial Sequence: Synthetic oligonucleotide
actccccgccactgcgaaatcggc

SEQ ID NO: 245368 - DNA, 23 bp, Artificial Sequence
  Description of Artificial Sequence: Synthetic oligonucleotide
ctccccgccactgcgaaatcggc

SEQ ID NO: 245369 - DNA, 24 bp, Artificial Sequence
  Description of Artificial Sequence: Synthetic oligonucleotide
tccccgccactgcgaaatcggcca

SEQ ID NO: 245370 - DNA, 23 bp, Artificial Sequence
  Description of Artificial Sequence: Synthetic oligonucleotide
ccccgccactgcgaaatcggcca

SEQ ID NO: 245371 - DNA, 23 bp, Artificial Sequence
  Description of Artificial Sequence: Synthetic oligonucleotide
cccgccactgcgaaatcggccag

SEQ ID NO: 245372 - DNA, 23 bp, Artificial Sequence
  Description of Artificial Sequence: Synthetic oligonucleotide
ccgccactgcgaaatcggccagc

SEQ ID NO: 245373 - DNA, 23 bp, Artificial Sequence
  Description of Artificial Sequence: Synthetic oligonucleotide
cgccactgcgaaatcggccagcg

SEQ ID NO: 245374 - DNA, 23 bp, Artificial Sequence
  Description of Artificial Sequence: Synthetic oligonucleotide
gccactgcgaaatcggccagcgg

SEQ ID NO: 245375 - DNA, 23 bp, Artificial Sequence
  Description of Artificial Sequence: Synthetic oligonucleotide
ccactgcgaaatcggccagcggg

SEQ ID NO: 245376 - DNA, 24 bp, Artificial Sequence
  Description of Artificial Sequence: Synthetic oligonucleotide
cactgcgaaatcggccagcgggct

SEQ ID NO: 245377 - DNA, 25 bp, Artificial Sequence
  Description of Artificial Sequence: Synthetic oligonucleotide
actgcgaaatcggccagcgggctga

SEQ ID NO: 245378 - DNA, 24 bp, Artificial Sequence
  Description of Artificial Sequence: Synthetic oligonucleotide
ctgcgaaatcggccagcgggctga

SEQ ID NO: 245379 - DNA, 24 bp, Artificial Sequence
  Description of Artificial Sequence: Synthetic oligonucleotide
tgcgaaatcggccagcgggctgac

SEQ ID NO: 245380 - DNA, 23 bp, Artificial Sequence
  Description of Artificial Sequence: Synthetic oligonucleotide
gcgaaatcggccagcgggctgac

SEQ ID NO: 245381 - DNA, 23 bp, Artificial Sequence
  Description of Artificial Sequence: Synthetic oligonucleotide
cgaaatcggccagcgggctgacc

SEQ ID NO: 245382 - DNA, 23 bp, Artificial Sequence
  Description of Artificial Sequence: Synthetic oligonucleotide
gaaatcggccagcgggctgaccc

SEQ ID NO: 245383 - DNA, 23 bp, Artificial Sequence
  Description of Artificial Sequence: Synthetic oligonucleotide
aaatcggccagcgggctgacccc

SEQ ID NO: 245384 - DNA, 22 bp, Artificial Sequence
  Description of Artificial Sequence: Synthetic oligonucleotide
aatcggccagcgggctgacccc

SEQ ID NO: 245385 - DNA, 21 bp, Artificial Sequence
  Description of Artificial Sequence: Synthetic oligonucleotide
atcggccagcgggctgacccc

SEQ ID NO: 245386 - DNA, 20 bp, Artificial Sequence
  Description of Artificial Sequence: Synthetic oligonucleotide
tcggccagcgggctgacccc

SEQ ID NO: 245387 - DNA, 20 bp, Artificial Sequence
  Description of Artificial Sequence: Synthetic oligonucleotide
cggccagcgggctgacccct

SEQ ID NO: 245388 - DNA, 20 bp, Artificial Sequence
  Description of Artificial Sequence: Synthetic oligonucleotide
ggccagcgggctgaccccct

SEQ ID NO: 245389 - DNA, 20 bp, Artificial Sequence
  Description of Artificial Sequence: Synthetic oligonucleotide
gccagcgggctgacccccct

SEQ ID NO: 245390 - DNA, 20 bp, Artificial Sequence
  Description of Artificial Sequence: Synthetic oligonucleotide
ccagcgggctgaccccccct

SEQ ID NO: 245391 - DNA, 20 bp, Artificial Sequence
  Description of Artificial Sequence: Synthetic oligonucleotide
cagcgggctgacccccccgt

SEQ ID NO: 245392 - DNA, 20 bp, Artificial Sequence
  Description of Artificial Sequence: Synthetic oligonucleotide
agcgggctgacccccccgca

SEQ ID NO: 245393 - DNA, 20 bp, Artificial Sequence
  Description of Artificial Sequence: Synthetic oligonucleotide
gcgggctgacccccccgcat

SEQ ID NO: 245394 - DNA, 21 bp, Artificial Sequence
  Description of Artificial Sequence: Synthetic oligonucleotide
cgggctgacccccccgcagaa

SEQ ID NO: 245395 - DNA, 22 bp, Artificial Sequence
  Description of Artificial Sequence: Synthetic oligonucleotide
gggctgacccccccgcagaact

SEQ ID NO: 245396 - DNA, 22 bp, Artificial Sequence
  Description of Artificial Sequence: Synthetic oligonucleotide
ggctgacccccccgcagaactc

SEQ ID NO: 245397 - DNA, 22 bp, Artificial Sequence
  Description of Artificial Sequence: Synthetic oligonucleotide
gctgacccccccgcagaactcc

SEQ ID NO: 245398 - DNA, 22 bp, Artificial Sequence
  Description of Artificial Sequence: Synthetic oligonucleotide
ctgacccccccgcagaactccc

SEQ ID NO: 245399 - DNA, 22 bp, Artificial Sequence
  Description of Artificial Sequence: Synthetic oligonucleotide
tgacccccccgcagaactcccc

SEQ ID NO: 245400 - DNA, 21 bp, Artificial Sequence
  Description of Artificial Sequence: Synthetic oligonucleotide
gacccccccgcagaactcccc

SEQ ID NO: 245401 - DNA, 21 bp, Artificial Sequence
  Description of Artificial Sequence: Synthetic oligonucleotide
acccccccgcagaactccccg

SEQ ID NO: 245402 - DNA, 20 bp, Artificial Sequence
  Description of Artificial Sequence: Synthetic oligonucleotide
cccccccgcagaactccccg

SEQ ID NO: 245403 - DNA, 20 bp, Artificial Sequence
  Description of Artificial Sequence: Synthetic oligonucleotide
ccccccgcagaactccccgc

SEQ ID NO: 245404 - DNA, 20 bp, Artificial Sequence
  Description of Artificial Sequence: Synthetic oligonucleotide
cccccgcagaactccccgcg

SEQ ID NO: 245405 - DNA, 20 bp, Artificial Sequence
  Description of Artificial Sequence: Synthetic oligonucleotide
ccccgcagaactccccgcgg

SEQ ID NO: 245406 - DNA, 20 bp, Artificial Sequence
  Description of Artificial Sequence: Synthetic oligonucleotide
cccgcagaactccccgcggg

SEQ ID NO: 245407 - DNA, 20 bp, Artificial Sequence
  Description of Artificial Sequence: Synthetic oligonucleotide
ccgcagaactccccgcgggc

SEQ ID NO: 245408 - DNA, 20 bp, Artificial Sequence
  Description of Artificial Sequence: Synthetic oligonucleotide
cgcagaactccccgcgggcg

SEQ ID NO: 245409 - DNA, 21 bp, Artificial Sequence
  Description of Artificial Sequence: Synthetic oligonucleotide
gcagaactccccgcgggcgct

SEQ ID NO: 245410 - DNA, 21 bp, Artificial Sequence
  Description of Artificial Sequence: Synthetic oligonucleotide
cagaactccccgcgggcgctg

SEQ ID NO: 245411 - DNA, 23 bp, Artificial Sequence
  Description of Artificial Sequence: Synthetic oligonucleotide
agaactccccgcgggcgctggat

SEQ ID NO: 245412 - DNA, 22 bp, Artificial Sequence
  Description of Artificial Sequence: Synthetic oligonucleotide
gaactccccgcgggcgctggat

SEQ ID NO: 245413 - DNA, 22 bp, Artificial Sequence
  Description of Artificial Sequence: Synthetic oligonucleotide
aactccccgcgggcgctggatg

SEQ ID NO: 245414 - DNA, 21 bp, Artificial Sequence
  Description of Artificial Sequence: Synthetic oligonucleotide
actccccgcgggcgctggatg

SEQ ID NO: 245415 - DNA, 20 bp, Artificial Sequence
  Description of Artificial Sequence: Synthetic oligonucleotide
ctccccgcgggcgctggatg

SEQ ID NO: 245416 - DNA, 20 bp, Artificial Sequence
  Description of Artificial Sequence: Synthetic oligonucleotide
tccccgcgggcgctggatgg

SEQ ID NO: 245417 - DNA, 20 bp, Artificial Sequence
  Description of Artificial Sequence: Synthetic oligonucleotide
ccccgcgggcgctggatggt

SEQ ID NO: 245418 - DNA, 20 bp, Artificial Sequence
  Description of Artificial Sequence: Synthetic oligonucleotide
cccgcgggcgctggatgggt

SEQ ID NO: 245419 - DNA, 20 bp, Artificial Sequence
  Description of Artificial Sequence: Synthetic oligonucleotide
ccgcgggcgctggatgggct

SEQ ID NO: 245420 - DNA, 21 bp, Artificial Sequence
  Description of Artificial Sequence: Synthetic oligonucleotide
cgcgggcgctggatgggcctt

SEQ ID NO: 245421 - DNA, 21 bp, Artificial Sequence
  Description of Artificial Sequence: Synthetic oligonucleotide
gcgggcgctggatgggccttg

SEQ ID NO: 245422 - DNA, 21 bp, Artificial Sequence
  Description of Artificial Sequence: Synthetic oligonucleotide
cgggcgctggatgggccttgg

SEQ ID NO: 245423 - DNA, 22 bp, Artificial Sequence
  Description of Artificial Sequence: Synthetic oligonucleotide
gggcgctggatgggccttggct

SEQ ID NO: 245424 - DNA, 24 bp, Artificial Sequence
  Description of Artificial Sequence: Synthetic oligonucleotide
ggcgctggatgggccttggctgaa

SEQ ID NO: 245425 - DNA, 24 bp, Artificial Sequence
  Description of Artificial Sequence: Synthetic oligonucleotide
gcgctggatgggccttggctgaag

SEQ ID NO: 245426 - DNA, 25 bp, Artificial Sequence
  Description of Artificial Sequence: Synthetic oligonucleotide
cgctggatgggccttggctgaaggt

SEQ ID NO: 245427 - DNA, 26 bp, Artificial Sequence
  Description of Artificial Sequence: Synthetic oligonucleotide
gctggatgggccttggctgaaggtca

SEQ ID NO: 245428 - DNA, 26 bp, Artificial Sequence
  Description of Artificial Sequence: Synthetic oligonucleotide
ctggatgggccttggctgaaggtcag

SEQ ID NO: 245429 - DNA, 27 bp, Artificial Sequence
  Description of Artificial Sequence: Synthetic oligonucleotide
tggatgggccttggctgaaggtcagca

SEQ ID NO: 245430 - DNA, 27 bp, Artificial Sequence
  Description of Artificial Sequence: Synthetic oligonucleotide
ggatgggccttggctgaaggtcagcat

SEQ ID NO: 245431 - DNA, 29 bp, Artificial Sequence
  Description of Artificial Sequence: Synthetic oligonucleotide
gatgggccttggctgaaggtcagcatttc

SEQ ID NO: 245432 - DNA, 29 bp, Artificial Sequence
  Description of Artificial Sequence: Synthetic oligonucleotide
atgggccttggctgaaggtcagcatttcc

SEQ ID NO: 245433 - DNA, 28 bp, Artificial Sequence
  Description of Artificial Sequence: Synthetic oligonucleotide
tgggccttggctgaaggtcagcatttcc

SEQ ID NO: 245434 - DNA, 27 bp, Artificial Sequence
  Description of Artificial Sequence: Synthetic oligonucleotide
gggccttggctgaaggtcagcatttcc

SEQ ID NO: 245435 - DNA, 28 bp, Artificial Sequence
  Description of Artificial Sequence: Synthetic oligonucleotide
ggccttggctgaaggtcagcatttccag

SEQ ID NO: 245436 - DNA, 28 bp, Artificial Sequence
  Description of Artificial Sequence: Synthetic oligonucleotide
gccttggctgaaggtcagcatttccagc

SEQ ID NO: 245437 - DNA, 28 bp, Artificial Sequence
  Description of Artificial Sequence: Synthetic oligonucleotide
ccttggctgaaggtcagcatttccagcc

SEQ ID NO: 245438 - DNA, 28 bp, Artificial Sequence
  Description of Artificial Sequence: Synthetic oligonucleotide
cttggctgaaggtcagcatttccagccc

SEQ ID NO: 245439 - DNA, 29 bp, Artificial Sequence
  Description of Artificial Sequence: Synthetic oligonucleotide
ttggctgaaggtcagcatttccagcccac

SEQ ID NO: 245440 - DNA, 28 bp, Artificial Sequence
  Description of Artificial Sequence: Synthetic oligonucleotide
tggctgaaggtcagcatttccagcccac

SEQ ID NO: 245441 - DNA, 27 bp, Artificial Sequence
  Description of Artificial Sequence: Synthetic oligonucleotide
ggctgaaggtcagcatttccagcccac

SEQ ID NO: 245442 - DNA, 28 bp, Artificial Sequence
  Description of Artificial Sequence: Synthetic oligonucleotide
gctgaaggtcagcatttccagcccactc

SEQ ID NO: 245443 - DNA, 28 bp, Artificial Sequence
  Description of Artificial Sequence: Synthetic oligonucleotide
ctgaaggtcagcatttccagcccactcc

SEQ ID NO: 245444 - DNA, 29 bp, Artificial Sequence
  Description of Artificial Sequence: Synthetic oligonucleotide
tgaaggtcagcatttccagcccactcctc

SEQ ID NO: 245445 - DNA, 28 bp, Artificial Sequence
  Description of Artificial Sequence: Synthetic oligonucleotide
gaaggtcagcatttccagcccactcctc

SEQ ID NO: 245446 - DNA, 29 bp, Artificial Sequence
  Description of Artificial Sequence: Synthetic oligonucleotide
aaggtcagcatttccagcccactcctcag

SEQ ID NO: 245447 - DNA, 28 bp, Artificial Sequence
  Description of Artificial Sequence: Synthetic oligonucleotide
aggtcagcatttccagcccactcctcag

SEQ ID NO: 245448 - DNA, 27 bp, Artificial Sequence
  Description of Artificial Sequence: Synthetic oligonucleotide
ggtcagcatttccagcccactcctcag

SEQ ID NO: 245449 - DNA, 27 bp, Artificial Sequence
  Description of Artificial Sequence: Synthetic oligonucleotide
gtcagcatttccagcccactcctcagc

SEQ ID NO: 245450 - DNA, 27 bp, Artificial Sequence
  Description of Artificial Sequence: Synthetic oligonucleotide
tcagcatttccagcccactcctcagcc

SEQ ID NO: 245451 - DNA, 27 bp, Artificial Sequence
  Description of Artificial Sequence: Synthetic oligonucleotide
cagcatttccagcccactcctcagcca

SEQ ID NO: 245452 - DNA, 27 bp, Artificial Sequence
  Description of Artificial Sequence: Synthetic oligonucleotide
agcatttccagcccactcctcagccac

SEQ ID NO: 245453 - DNA, 27 bp, Artificial Sequence
  Description of Artificial Sequence: Synthetic oligonucleotide
gcatttccagcccactcctcagccact

SEQ ID NO: 245454 - DNA, 27 bp, Artificial Sequence
  Description of Artificial Sequence: Synthetic oligonucleotide
catttccagcccactcctcagccactc

SEQ ID NO: 245455 - DNA, 27 bp, Artificial Sequence
  Description of Artificial Sequence: Synthetic oligonucleotide
atttccagcccactcctcagccactcc

SEQ ID NO: 245456 - DNA, 27 bp, Artificial Sequence
  Description of Artificial Sequence: Synthetic oligonucleotide
tttccagcccactcctcagccactcca

SEQ ID NO: 245457 - DNA, 26 bp, Artificial Sequence
  Description of Artificial Sequence: Synthetic oligonucleotide
ttccagcccactcctcagccactcca

SEQ ID NO: 245458 - DNA, 25 bp, Artificial Sequence
  Description of Artificial Sequence: Synthetic oligonucleotide
tccagcccactcctcagccactcca

SEQ ID NO: 245459 - DNA, 24 bp, Artificial Sequence
  Description of Artificial Sequence: Synthetic oligonucleotide
ccagcccactcctcagccactcca

SEQ ID NO: 245460 - DNA, 24 bp, Artificial Sequence
  Description of Artificial Sequence: Synthetic oligonucleotide
cagcccactcctcagccactccag

SEQ ID NO: 245461 - DNA, 24 bp, Artificial Sequence
  Description of Artificial Sequence: Synthetic oligonucleotide
agcccactcctcagccactccagc

SEQ ID NO: 245462 - DNA, 23 bp, Artificial Sequence
  Description of Artificial Sequence: Synthetic oligonucleotide
gcccactcctcagccactccagc

SEQ ID NO: 245463 - DNA, 24 bp, Artificial Sequence
  Description of Artificial Sequence: Synthetic oligonucleotide
cccactcctcagccactccagcct

SEQ ID NO: 245464 - DNA, 26 bp, Artificial Sequence
  Description of Artificial Sequence: Synthetic oligonucleotide
ccactcctcagccactccagcctgtt

SEQ ID NO: 245465 - DNA, 26 bp, Artificial Sequence
  Description of Artificial Sequence: Synthetic oligonucleotide
cactcctcagccactccagcctgttg

SEQ ID NO: 245466 - DNA, 26 bp, Artificial Sequence
  Description of Artificial Sequence: Synthetic oligonucleotide
actcctcagccactccagcctgttgc

SEQ ID NO: 245467 - DNA, 25 bp, Artificial Sequence
  Description of Artificial Sequence: Synthetic oligonucleotide
ctcctcagccactccagcctgttgc

SEQ ID NO: 245468 - DNA, 26 bp, Artificial Sequence
  Description of Artificial Sequence: Synthetic oligonucleotide
tcctcagccactccagcctgttgcga

SEQ ID NO: 245469 - DNA, 25 bp, Artificial Sequence
  Description of Artificial Sequence: Synthetic oligonucleotide
cctcagccactccagcctgttgcga

SEQ ID NO: 245470 - DNA, 25 bp, Artificial Sequence
  Description of Artificial Sequence: Synthetic oligonucleotide
ctcagccactccagcctgttgcgac

SEQ ID NO: 245471 - DNA, 26 bp, Artificial Sequence
  Description of Artificial Sequence: Synthetic oligonucleotide
tcagccactccagcctgttgcgacca

SEQ ID NO: 245472 - DNA, 25 bp, Artificial Sequence
  Description of Artificial Sequence: Synthetic oligonucleotide
cagccactccagcctgttgcgacca

SEQ ID NO: 245473 - DNA, 26 bp, Artificial Sequence
  Description of Artificial Sequence: Synthetic oligonucleotide
agccactccagcctgttgcgaccaga

SEQ ID NO: 245474 - DNA, 25 bp, Artificial Sequence
  Description of Artificial Sequence: Synthetic oligonucleotide
gccactccagcctgttgcgaccaga

SEQ ID NO: 245475 - DNA, 25 bp, Artificial Sequence
  Description of Artificial Sequence: Synthetic oligonucleotide
ccactccagcctgttgcgaccagag

SEQ ID NO: 245476 - DNA, 25 bp, Artificial Sequence
  Description of Artificial Sequence: Synthetic oligonucleotide
cactccagcctgttgcgaccagagc

SEQ ID NO: 245477 - DNA, 26 bp, Artificial Sequence
  Description of Artificial Sequence: Synthetic oligonucleotide
actccagcctgttgcgaccagagcca

SEQ ID NO: 245478 - DNA, 25 bp, Artificial Sequence
  Description of Artificial Sequence: Synthetic oligonucleotide
ctccagcctgttgcgaccagagcca

SEQ ID NO: 245479 - DNA, 26 bp, Artificial Sequence
  Description of Artificial Sequence: Synthetic oligonucleotide
tccagcctgttgcgaccagagccaga

SEQ ID NO: 245480 - DNA, 25 bp, Artificial Sequence
  Description of Artificial Sequence: Synthetic oligonucleotide
ccagcctgttgcgaccagagccaga

SEQ ID NO: 245481 - DNA, 25 bp, Artificial Sequence
  Description of Artificial Sequence: Synthetic oligonucleotide
cagcctgttgcgaccagagccagag

SEQ ID NO: 245482 - DNA, 25 bp, Artificial Sequence
  Description of Artificial Sequence: Synthetic oligonucleotide
agcctgttgcgaccagagccagagc

SEQ ID NO: 245483 - DNA, 24 bp, Artificial Sequence
  Description of Artificial Sequence: Synthetic oligonucleotide
gcctgttgcgaccagagccagagc

SEQ ID NO: 245484 - DNA, 25 bp, Artificial Sequence
  Description of Artificial Sequence: Synthetic oligonucleotide
cctgttgcgaccagagccagagcgt

SEQ ID NO: 245485 - DNA, 26 bp, Artificial Sequence
  Description of Artificial Sequence: Synthetic oligonucleotide
ctgttgcgaccagagccagagcgtca

SEQ ID NO: 245486 - DNA, 26 bp, Artificial Sequence
  Description of Artificial Sequence: Synthetic oligonucleotide
tgttgcgaccagagccagagcgtcag

SEQ ID NO: 245487 - DNA, 25 bp, Artificial Sequence
  Description of Artificial Sequence: Synthetic oligonucleotide
gttgcgaccagagccagagcgtcag

SEQ ID NO: 245488 - DNA, 26 bp, Artificial Sequence
  Description of Artificial Sequence: Synthetic oligonucleotide
ttgcgaccagagccagagcgtcagca

SEQ ID NO: 245489 - DNA, 25 bp, Artificial Sequence
  Description of Artificial Sequence: Synthetic oligonucleotide
tgcgaccagagccagagcgtcagca

SEQ ID NO: 245490 - DNA, 24 bp, Artificial Sequence
  Description of Artificial Sequence: Synthetic oligonucleotide
gcgaccagagccagagcgtcagca

SEQ ID NO: 245491 - DNA, 24 bp, Artificial Sequence
  Description of Artificial Sequence: Synthetic oligonucleotide
cgaccagagccagagcgtcagcag

SEQ ID NO: 245492 - DNA, 25 bp, Artificial Sequence
  Description of Artificial Sequence: Synthetic oligonucleotide
gaccagagccagagcgtcagcagga

SEQ ID NO: 245493 - DNA, 25 bp, Artificial Sequence
  Description of Artificial Sequence: Synthetic oligonucleotide
accagagccagagcgtcagcaggac

SEQ ID NO: 245494 - DNA, 24 bp, Artificial Sequence
  Description of Artificial Sequence: Synthetic oligonucleotide
ccagagccagagcgtcagcaggac

SEQ ID NO: 245495 - DNA, 24 bp, Artificial Sequence
  Description of Artificial Sequence: Synthetic oligonucleotide
cagagccagagcgtcagcaggacc

SEQ ID NO: 245496 - DNA, 25 bp, Artificial Sequence
  Description of Artificial Sequence: Synthetic oligonucleotide
agagccagagcgtcagcaggaccct

SEQ ID NO: 245497 - DNA, 24 bp, Artificial Sequence
  Description of Artificial Sequence: Synthetic oligonucleotide
gagccagagcgtcagcaggaccct

SEQ ID NO: 245498 - DNA, 26 bp, Artificial Sequence
  Description of Artificial Sequence: Synthetic oligonucleotide
agccagagcgtcagcaggaccctgtt

SEQ ID NO: 245499 - DNA, 25 bp, Artificial Sequence
  Description of Artificial Sequence: Synthetic oligonucleotide
gccagagcgtcagcaggaccctgtt

SEQ ID NO: 245500 - DNA, 26 bp, Artificial Sequence
  Description of Artificial Sequence: Synthetic oligonucleotide
ccagagcgtcagcaggaccctgttct

SEQ ID NO: 245501 - DNA, 27 bp, Artificial Sequence
  Description of Artificial Sequence: Synthetic oligonucleotide
cagagcgtcagcaggaccctgttctct

SEQ ID NO: 245502 - DNA, 28 bp, Artificial Sequence
  Description of Artificial Sequence: Synthetic oligonucleotide
agagcgtcagcaggaccctgttctcttc

SEQ ID NO: 245503 - DNA, 27 bp, Artificial Sequence
  Description of Artificial Sequence: Synthetic oligonucleotide
gagcgtcagcaggaccctgttctcttc

SEQ ID NO: 245504 - DNA, 28 bp, Artificial Sequence
  Description of Artificial Sequence: Synthetic oligonucleotide
agcgtcagcaggaccctgttctcttcac

SEQ ID NO: 245505 - DNA, 27 bp, Artificial Sequence
  Description of Artificial Sequence: Synthetic oligonucleotide
gcgtcagcaggaccctgttctcttcac

SEQ ID NO: 245506 - DNA, 27 bp, Artificial Sequence
  Description of Artificial Sequence: Synthetic oligonucleotide
cgtcagcaggaccctgttctcttcacc

SEQ ID NO: 245507 - DNA, 29 bp, Artificial Sequence
  Description of Artificial Sequence: Synthetic oligonucleotide
gtcagcaggaccctgttctcttcaccatg

SEQ ID NO: 245508 - DNA, 29 bp, Artificial Sequence
  Description of Artificial Sequence: Synthetic oligonucleotide
tcagcaggaccctgttctcttcaccatgg

SEQ ID NO: 245509 - DNA, 28 bp, Artificial Sequence
  Description of Artificial Sequence: Synthetic oligonucleotide
cagcaggaccctgttctcttcaccatgg

SEQ ID NO: 245510 - DNA, 28 bp, Artificial Sequence
  Description of Artificial Sequence: Synthetic oligonucleotide
agcaggaccctgttctcttcaccatggg

SEQ ID NO: 245511 - DNA, 27 bp, Artificial Sequence
  Description of Artificial Sequence: Synthetic oligonucleotide
gcaggaccctgttctcttcaccatggg

SEQ ID NO: 245512 - DNA, 29 bp, Artificial Sequence
  Description of Artificial Sequence: Synthetic oligonucleotide
caggaccctgttctcttcaccatgggaac

SEQ ID NO: 245513 - DNA, 30 bp, Artificial Sequence
  Description of Artificial Sequence: Synthetic oligonucleotide
aggaccctgttctcttcaccatgggaacag

SEQ ID NO: 245514 - DNA, 29 bp, Artificial Sequence
  Description of Artificial Sequence: Synthetic oligonucleotide
ggaccctgttctcttcaccatgggaacag

SEQ ID NO: 245515 - DNA, 30 bp, Artificial Sequence
  Description of Artificial Sequence: Synthetic oligonucleotide
gaccctgttctcttcaccatgggaacagtg

SEQ ID NO: 245516 - DNA, 30 bp, Artificial Sequence
  Description of Artificial Sequence: Synthetic oligonucleotide
accctgttctcttcaccatgggaacagtgg

SEQ ID NO: 245517 - DNA, 29 bp, Artificial Sequence
  Description of Artificial Sequence: Synthetic oligonucleotide
ccctgttctcttcaccatgggaacagtgg

SEQ ID NO: 245518 - DNA, 31 bp, Artificial Sequence
  Description of Artificial Sequence: Synthetic oligonucleotide
cctgttctcttcaccatgggaacagtggttc

SEQ ID NO: 245519 - DNA, 32 bp, Artificial Sequence
  Description of Artificial Sequence: Synthetic oligonucleotide
ctgttctcttcaccatgggaacagtggttctg

SEQ ID NO: 245520 - DNA, 33 bp, Artificial Sequence
  Description of Artificial Sequence: Synthetic oligonucleotide
tgttctcttcaccatgggaacagtggttctgac

SEQ ID NO: 245521 - DNA, 32 bp, Artificial Sequence
  Description of Artificial Sequence: Synthetic oligonucleotide
gttctcttcaccatgggaacagtggttctgac

SEQ ID NO: 245522 - DNA, 33 bp, Artificial Sequence
  Description of Artificial Sequence: Synthetic oligonucleotide
ttctcttcaccatgggaacagtggttctgactg

SEQ ID NO: 245523 - DNA, 32 bp, Artificial Sequence
  Description of Artificial Sequence: Synthetic oligonucleotide
tctcttcaccatgggaacagtggttctgactg

SEQ ID NO: 245524 - DNA, 31 bp, Artificial Sequence
  Description of Artificial Sequence: Synthetic oligonucleotide
ctcttcaccatgggaacagtggttctgactg

SEQ ID NO: 245525 - DNA, 32 bp, Artificial Sequence
  Description of Artificial Sequence: Synthetic oligonucleotide
tcttcaccatgggaacagtggttctgactgtc

SEQ ID NO: 245526 - DNA, 31 bp, Artificial Sequence
  Description of Artificial Sequence: Synthetic oligonucleotide
cttcaccatgggaacagtggttctgactgtc

SEQ ID NO: 245527 - DNA, 31 bp, Artificial Sequence
  Description of Artificial Sequence: Synthetic oligonucleotide
ttcaccatgggaacagtggttctgactgtcg

SEQ ID NO: 245528 - DNA, 30 bp, Artificial Sequence
  Description of Artificial Sequence: Synthetic oligonucleotide
tcaccatgggaacagtggttctgactgtcg

SEQ ID NO: 245529 - DNA, 29 bp, Artificial Sequence
  Description of Artificial Sequence: Synthetic oligonucleotide
caccatgggaacagtggttctgactgtcg

SEQ ID NO: 245530 - DNA, 30 bp, Artificial Sequence
  Description of Artificial Sequence: Synthetic oligonucleotide
accatgggaacagtggttctgactgtcgtc

SEQ ID NO: 245531 - DNA, 29 bp, Artificial Sequence
  Description of Artificial Sequence: Synthetic oligonucleotide
ccatgggaacagtggttctgactgtcgtc

SEQ ID NO: 245532 - DNA, 30 bp, Artificial Sequence
  Description of Artificial Sequence: Synthetic oligonucleotide
catgggaacagtggttctgactgtcgtcac

SEQ ID NO: 245533 - DNA, 30 bp, Artificial Sequence
  Description of Artificial Sequence: Synthetic oligonucleotide
atgggaacagtggttctgactgtcgtcacc

SEQ ID NO: 245534 - DNA, 29 bp, Artificial Sequence
  Description of Artificial Sequence: Synthetic oligonucleotide
tgggaacagtggttctgactgtcgtcacc

SEQ ID NO: 245535 - DNA, 28 bp, Artificial Sequence
  Description of Artificial Sequence: Synthetic oligonucleotide
gggaacagtggttctgactgtcgtcacc

SEQ ID NO: 245536 - DNA, 28 bp, Artificial Sequence
  Description of Artificial Sequence: Synthetic oligonucleotide
ggaacagtggttctgactgtcgtcaccc

SEQ ID NO: 245537 - DNA, 29 bp, Artificial Sequence
  Description of Artificial Sequence: Synthetic oligonucleotide
gaacagtggttctgactgtcgtcacccac

SEQ ID NO: 245538 - DNA, 30 bp, Artificial Sequence
  Description of Artificial Sequence: Synthetic oligonucleotide
aacagtggttctgactgtcgtcacccacag

SEQ ID NO: 245539 - DNA, 29 bp, Artificial Sequence
  Description of Artificial Sequence: Synthetic oligonucleotide
acagtggttctgactgtcgtcacccacag

SEQ ID NO: 245540 - DNA, 28 bp, Artificial Sequence
  Description of Artificial Sequence: Synthetic oligonucleotide
cagtggttctgactgtcgtcacccacag

SEQ ID NO: 245541 - DNA, 28 bp, Artificial Sequence
  Description of Artificial Sequence: Synthetic oligonucleotide
agtggttctgactgtcgtcacccacagc

SEQ ID NO: 245542 - DNA, 27 bp, Artificial Sequence
  Description of Artificial Sequence: Synthetic oligonucleotide
gtggttctgactgtcgtcacccacagc

SEQ ID NO: 245543 - DNA, 27 bp, Artificial Sequence
  Description of Artificial Sequence: Synthetic oligonucleotide
tggttctgactgtcgtcacccacagcc

SEQ ID NO: 245544 - DNA, 26 bp, Artificial Sequence
  Description of Artificial Sequence: Synthetic oligonucleotide
ggttctgactgtcgtcacccacagcc

SEQ ID NO: 245545 - DNA, 27 bp, Artificial Sequence
  Description of Artificial Sequence: Synthetic oligonucleotide
gttctgactgtcgtcacccacagccct

SEQ ID NO: 245546 - DNA, 27 bp, Artificial Sequence
  Description of Artificial Sequence: Synthetic oligonucleotide
ttctgactgtcgtcacccacagccctg

SEQ ID NO: 245547 - DNA, 26 bp, Artificial Sequence
  Description of Artificial Sequence: Synthetic oligonucleotide
tctgactgtcgtcacccacagccctg

SEQ ID NO: 245548 - DNA, 25 bp, Artificial Sequence
  Description of Artificial Sequence: Synthetic oligonucleotide
ctgactgtcgtcacccacagccctg

SEQ ID NO: 245549 - DNA, 25 bp, Artificial Sequence
  Description of Artificial Sequence: Synthetic oligonucleotide
tgactgtcgtcacccacagccctgc

SEQ ID NO: 245550 - DNA, 24 bp, Artificial Sequence
  Description of Artificial Sequence: Synthetic oligonucleotide
gactgtcgtcacccacagccctgc

SEQ ID NO: 245551 - DNA, 24 bp, Artificial Sequence
  Description of Artificial Sequence: Synthetic oligonucleotide
actgtcgtcacccacagccctgcc

SEQ ID NO: 245552 - DNA, 23 bp, Artificial Sequence
  Description of Artificial Sequence: Synthetic oligonucleotide
ctgtcgtcacccacagccctgcc

SEQ ID NO: 245553 - DNA, 23 bp, Artificial Sequence
  Description of Artificial Sequence: Synthetic oligonucleotide
tgtcgtcacccacagccctgccc

SEQ ID NO: 245554 - DNA, 22 bp, Artificial Sequence
  Description of Artificial Sequence: Synthetic oligonucleotide
gtcgtcacccacagccctgccc

SEQ ID NO: 245555 - DNA, 23 bp, Artificial Sequence
  Description of Artificial Sequence: Synthetic oligonucleotide
tcgtcacccacagccctgcccca

SEQ ID NO: 245556 - DNA, 22 bp, Artificial Sequence
  Description of Artificial Sequence: Synthetic oligonucleotide
cgtcacccacagccctgcccca

SEQ ID NO: 245557 - DNA, 22 bp, Artificial Sequence
  Description of Artificial Sequence: Synthetic oligonucleotide
gtcacccacagccctgccccac

SEQ ID NO: 245558 - DNA, 23 bp, Artificial Sequence
  Description of Artificial Sequence: Synthetic oligonucleotide
tcacccacagccctgccccacga

SEQ ID NO: 245559 - DNA, 22 bp, Artificial Sequence
  Description of Artificial Sequence: Synthetic oligonucleotide
cacccacagccctgccccacga

SEQ ID NO: 245560 - DNA, 23 bp, Artificial Sequence
  Description of Artificial Sequence: Synthetic oligonucleotide
acccacagccctgccccacgagt

SEQ ID NO: 245561 - DNA, 22 bp, Artificial Sequence
  Description of Artificial Sequence: Synthetic oligonucleotide
cccacagccctgccccacgagt

SEQ ID NO: 245562 - DNA, 23 bp, Artificial Sequence
  Description of Artificial Sequence: Synthetic oligonucleotide
ccacagccctgccccacgagtga

SEQ ID NO: 245563 - DNA, 24 bp, Artificial Sequence
  Description of Artificial Sequence: Synthetic oligonucleotide
cacagccctgccccacgagtgaga

SEQ ID NO: 245564 - DNA, 25 bp, Artificial Sequence
  Description of Artificial Sequence: Synthetic oligonucleotide
acagccctgccccacgagtgagagt

SEQ ID NO: 245565 - DNA, 24 bp, Artificial Sequence
  Description of Artificial Sequence: Synthetic oligonucleotide
cagccctgccccacgagtgagagt

SEQ ID NO: 245566 - DNA, 24 bp, Artificial Sequence
  Description of Artificial Sequence: Synthetic oligonucleotide
agccctgccccacgagtgagagtg

SEQ ID NO: 245567 - DNA, 23 bp, Artificial Sequence
  Description of Artificial Sequence: Synthetic oligonucleotide
gccctgccccacgagtgagagtg

SEQ ID NO: 245568 - DNA, 23 bp, Artificial Sequence
  Description of Artificial Sequence: Synthetic oligonucleotide
ccctgccccacgagtgagagtgg

SEQ ID NO: 245569 - DNA, 24 bp, Artificial Sequence
  Description of Artificial Sequence: Synthetic oligonucleotide
cctgccccacgagtgagagtggga

SEQ ID NO: 245570 - DNA, 26 bp, Artificial Sequence
  Description of Artificial Sequence: Synthetic oligonucleotide
ctgccccacgagtgagagtgggacaa

SEQ ID NO: 245571 - DNA, 27 bp, Artificial Sequence
  Description of Artificial Sequence: Synthetic oligonucleotide
tgccccacgagtgagagtgggacaagt

SEQ ID NO: 245572 - DNA, 27 bp, Artificial Sequence
  Description of Artificial Sequence: Synthetic oligonucleotide
gccccacgagtgagagtgggacaagtt

SEQ ID NO: 245573 - DNA, 27 bp, Artificial Sequence
  Description of Artificial Sequence: Synthetic oligonucleotide
ccccacgagtgagagtgggacaagttg

SEQ ID NO: 245574 - DNA, 27 bp, Artificial Sequence
  Description of Artificial Sequence: Synthetic oligonucleotide
cccacgagtgagagtgggacaagttgc

SEQ ID NO: 245575 - DNA, 28 bp, Artificial Sequence
  Description of Artificial Sequence: Synthetic oligonucleotide
ccacgagtgagagtgggacaagttgctc

SEQ ID NO: 245576 - DNA, 29 bp, Artificial Sequence
  Description of Artificial Sequence: Synthetic oligonucleotide
cacgagtgagagtgggacaagttgctctg

SEQ ID NO: 245577 - DNA, 29 bp, Artificial Sequence
  Description of Artificial Sequence: Synthetic oligonucleotide
acgagtgagagtgggacaagttgctctgc

SEQ ID NO: 245578 - DNA, 28 bp, Artificial Sequence
  Description of Artificial Sequence: Synthetic oligonucleotide
cgagtgagagtgggacaagttgctctgc

SEQ ID NO: 245579 - DNA, 29 bp, Artificial Sequence
  Description of Artificial Sequence: Synthetic oligonucleotide
gagtgagagtgggacaagttgctctgctc

SEQ ID NO: 245580 - DNA, 29 bp, Artificial Sequence
  Description of Artificial Sequence: Synthetic oligonucleotide
agtgagagtgggacaagttgctctgctcg

SEQ ID NO: 245581 - DNA, 28 bp, Artificial Sequence
  Description of Artificial Sequence: Synthetic oligonucleotide
gtgagagtgggacaagttgctctgctcg

SEQ ID NO: 245582 - DNA, 29 bp, Artificial Sequence
  Description of Artificial Sequence: Synthetic oligonucleotide
tgagagtgggacaagttgctctgctcgac

SEQ ID NO: 245583 - DNA, 28 bp, Artificial Sequence
  Description of Artificial Sequence: Synthetic oligonucleotide
gagagtgggacaagttgctctgctcgac

SEQ ID NO: 245584 - DNA, 30 bp, Artificial Sequence
  Description of Artificial Sequence: Synthetic oligonucleotide
agagtgggacaagttgctctgctcgacttg

SEQ ID NO: 245585 - DNA, 29 bp, Artificial Sequence
  Description of Artificial Sequence: Synthetic oligonucleotide
gagtgggacaagttgctctgctcgacttg

SEQ ID NO: 245586 - DNA, 30 bp, Artificial Sequence
  Description of Artificial Sequence: Synthetic oligonucleotide
agtgggacaagttgctctgctcgacttgag

SEQ ID NO: 245587 - DNA, 29 bp, Artificial Sequence
  Description of Artificial Sequence: Synthetic oligonucleotide
gtgggacaagttgctctgctcgacttgag

SEQ ID NO: 245588 - DNA, 29 bp, Artificial Sequence
  Description of Artificial Sequence: Synthetic oligonucleotide
tgggacaagttgctctgctcgacttgagc

SEQ ID NO: 245589 - DNA, 28 bp, Artificial Sequence
  Description of Artificial Sequence: Synthetic oligonucleotide
gggacaagttgctctgctcgacttgagc

SEQ ID NO: 245590 - DNA, 31 bp, Artificial Sequence
  Description of Artificial Sequence: Synthetic oligonucleotide
ggacaagttgctctgctcgacttgagcattg

SEQ ID NO: 245591 - DNA, 31 bp, Artificial Sequence
  Description of Artificial Sequence: Synthetic oligonucleotide
gacaagttgctctgctcgacttgagcattgc

SEQ ID NO: 245592 - DNA, 31 bp, Artificial Sequence
  Description of Artificial Sequence: Synthetic oligonucleotide
acaagttgctctgctcgacttgagcattgcc

SEQ ID NO: 245593 - DNA, 30 bp, Artificial Sequence
  Description of Artificial Sequence: Synthetic oligonucleotide
caagttgctctgctcgacttgagcattgcc

SEQ ID NO: 245594 - DNA, 32 bp, Artificial Sequence
  Description of Artificial Sequence: Synthetic oligonucleotide
aagttgctctgctcgacttgagcattgcctac

SEQ ID NO: 245595 - DNA, 31 bp, Artificial Sequence
  Description of Artificial Sequence: Synthetic oligonucleotide
agttgctctgctcgacttgagcattgcctac

SEQ ID NO: 245596 - DNA, 30 bp, Artificial Sequence
  Description of Artificial Sequence: Synthetic oligonucleotide
gttgctctgctcgacttgagcattgcctac

SEQ ID NO: 245597 - DNA, 32 bp, Artificial Sequence
  Description of Artificial Sequence: Synthetic oligonucleotide
ttgctctgctcgacttgagcattgcctacaag

SEQ ID NO: 245598 - DNA, 31 bp, Artificial Sequence
  Description of Artificial Sequence: Synthetic oligonucleotide
tgctctgctcgacttgagcattgcctacaag

SEQ ID NO: 245599 - DNA, 30 bp, Artificial Sequence
  Description of Artificial Sequence: Synthetic oligonucleotide
gctctgctcgacttgagcattgcctacaag

SEQ ID NO: 245600 - DNA, 30 bp, Artificial Sequence
  Description of Artificial Sequence: Synthetic oligonucleotide
ctctgctcgacttgagcattgcctacaagc

SEQ ID NO: 245601 - DNA, 30 bp, Artificial Sequence
  Description of Artificial Sequence: Synthetic oligonucleotide
tctgctcgacttgagcattgcctacaagcc

SEQ ID NO: 245602 - DNA, 29 bp, Artificial Sequence
  Description of Artificial Sequence: Synthetic oligonucleotide
ctgctcgacttgagcattgcctacaagcc

SEQ ID NO: 245603 - DNA, 29 bp, Artificial Sequence
  Description of Artificial Sequence: Synthetic oligonucleotide
tgctcgacttgagcattgcctacaagccc

SEQ ID NO: 245604 - DNA, 28 bp, Artificial Sequence
  Description of Artificial Sequence: Synthetic oligonucleotide
gctcgacttgagcattgcctacaagccc

SEQ ID NO: 245605 - DNA, 28 bp, Artificial Sequence
  Description of Artificial Sequence: Synthetic oligonucleotide
ctcgacttgagcattgcctacaagcccc

SEQ ID NO: 245606 - DNA, 28 bp, Artificial Sequence
  Description of Artificial Sequence: Synthetic oligonucleotide
tcgacttgagcattgcctacaagccccc

SEQ ID NO: 245607 - DNA, 27 bp, Artificial Sequence
  Description of Artificial Sequence: Synthetic oligonucleotide
cgacttgagcattgcctacaagccccc

SEQ ID NO: 245608 - DNA, 27 bp, Artificial Sequence
  Description of Artificial Sequence: Synthetic oligonucleotide
gacttgagcattgcctacaagcccccc

SEQ ID NO: 245609 - DNA, 28 bp, Artificial Sequence
  Description of Artificial Sequence: Synthetic oligonucleotide
acttgagcattgcctacaagccccccac

SEQ ID NO: 245610 - DNA, 27 bp, Artificial Sequence
  Description of Artificial Sequence: Synthetic oligonucleotide
cttgagcattgcctacaagccccccac

SEQ ID NO: 245611 - DNA, 27 bp, Artificial Sequence
  Description of Artificial Sequence: Synthetic oligonucleotide
ttgagcattgcctacaagccccccacg

SEQ ID NO: 245612 - DNA, 27 bp, Artificial Sequence
  Description of Artificial Sequence: Synthetic oligonucleotide
tgagcattgcctacaagccccccacgt

SEQ ID NO: 245613 - DNA, 26 bp, Artificial Sequence
  Description of Artificial Sequence: Synthetic oligonucleotide
gagcattgcctacaagccccccacgt

SEQ ID NO: 245614 - DNA, 26 bp, Artificial Sequence
  Description of Artificial Sequence: Synthetic oligonucleotide
agcattgcctacaagccccccacgtc

SEQ ID NO: 245615 - DNA, 25 bp, Artificial Sequence
  Description of Artificial Sequence: Synthetic oligonucleotide
gcattgcctacaagccccccacgtc

SEQ ID NO: 245616 - DNA, 25 bp, Artificial Sequence
  Description of Artificial Sequence: Synthetic oligonucleotide
cattgcctacaagccccccacgtcc

SEQ ID NO: 245617 - DNA, 26 bp, Artificial Sequence
  Description of Artificial Sequence: Synthetic oligonucleotide
attgcctacaagccccccacgtccga

SEQ ID NO: 245618 - DNA, 25 bp, Artificial Sequence
  Description of Artificial Sequence: Synthetic oligonucleotide
ttgcctacaagccccccacgtccga

SEQ ID NO: 245619 - DNA, 24 bp, Artificial Sequence
  Description of Artificial Sequence: Synthetic oligonucleotide
tgcctacaagccccccacgtccga

SEQ ID NO: 245620 - DNA, 23 bp, Artificial Sequence
  Description of Artificial Sequence: Synthetic oligonucleotide
gcctacaagccccccacgtccga

SEQ ID NO: 245621 - DNA, 23 bp, Artificial Sequence
  Description of Artificial Sequence: Synthetic oligonucleotide
cctacaagccccccacgtccgag

SEQ ID NO: 245622 - DNA, 23 bp, Artificial Sequence
  Description of Artificial Sequence: Synthetic oligonucleotide
ctacaagccccccacgtccgagg

SEQ ID NO: 245623 - DNA, 23 bp, Artificial Sequence
  Description of Artificial Sequence: Synthetic oligonucleotide
tacaagccccccacgtccgaggc

SEQ ID NO: 245624 - DNA, 22 bp, Artificial Sequence
  Description of Artificial Sequence: Synthetic oligonucleotide
acaagccccccacgtccgaggc

SEQ ID NO: 245625 - DNA, 21 bp, Artificial Sequence
  Description of Artificial Sequence: Synthetic oligonucleotide
caagccccccacgtccgaggc

SEQ ID NO: 245626 - DNA, 21 bp, Artificial Sequence
  Description of Artificial Sequence: Synthetic oligonucleotide
aagccccccacgtccgaggcc

SEQ ID NO: 245627 - DNA, 20 bp, Artificial Sequence
  Description of Artificial Sequence: Synthetic oligonucleotide
agccccccacgtccgaggcc

SEQ ID NO: 245628 - DNA, 20 bp, Artificial Sequence
  Description of Artificial Sequence: Synthetic oligonucleotide
gccccccacgtccgaggcct

SEQ ID NO: 245629 - DNA, 20 bp, Artificial Sequence
  Description of Artificial Sequence: Synthetic oligonucleotide
ccccccacgtccgaggccct

SEQ ID NO: 245630 - DNA, 20 bp, Artificial Sequence
  Description of Artificial Sequence: Synthetic oligonucleotide
cccccacgtccgaggcccct

SEQ ID NO: 245631 - DNA, 20 bp, Artificial Sequence
  Description of Artificial Sequence: Synthetic oligonucleotide
ccccacgtccgaggccccct

SEQ ID NO: 245632 - DNA, 22 bp, Artificial Sequence
  Description of Artificial Sequence: Synthetic oligonucleotide
cccacgtccgaggccccctcat

SEQ ID NO: 245633 - DNA, 23 bp, Artificial Sequence
  Description of Artificial Sequence: Synthetic oligonucleotide
ccacgtccgaggccccctcatct

SEQ ID NO: 245634 - DNA, 24 bp, Artificial Sequence
  Description of Artificial Sequence: Synthetic oligonucleotide
cacgtccgaggccccctcatctca

SEQ ID NO: 245635 - DNA, 24 bp, Artificial Sequence
  Description of Artificial Sequence: Synthetic oligonucleotide
acgtccgaggccccctcatctcag

SEQ ID NO: 245636 - DNA, 23 bp, Artificial Sequence
  Description of Artificial Sequence: Synthetic oligonucleotide
cgtccgaggccccctcatctcag

SEQ ID NO: 245637 - DNA, 23 bp, Artificial Sequence
  Description of Artificial Sequence: Synthetic oligonucleotide
gtccgaggccccctcatctcagg

SEQ ID NO: 245638 - DNA, 24 bp, Artificial Sequence
  Description of Artificial Sequence: Synthetic oligonucleotide
tccgaggccccctcatctcaggct

SEQ ID NO: 245639 - DNA, 23 bp, Artificial Sequence
  Description of Artificial Sequence: Synthetic oligonucleotide
ccgaggccccctcatctcaggct

SEQ ID NO: 245640 - DNA, 23 bp, Artificial Sequence
  Description of Artificial Sequence: Synthetic oligonucleotide
cgaggccccctcatctcaggctc

SEQ ID NO: 245641 - DNA, 23 bp, Artificial Sequence
  Description of Artificial Sequence: Synthetic oligonucleotide
gaggccccctcatctcaggctcc

SEQ ID NO: 245642 - DNA, 23 bp, Artificial Sequence
  Description of Artificial Sequence: Synthetic oligonucleotide
aggccccctcatctcaggctccg

SEQ ID NO: 245643 - DNA, 22 bp, Artificial Sequence
  Description of Artificial Sequence: Synthetic oligonucleotide
ggccccctcatctcaggctccg

SEQ ID NO: 245644 - DNA, 22 bp, Artificial Sequence
  Description of Artificial Sequence: Synthetic oligonucleotide
gccccctcatctcaggctccgg

SEQ ID NO: 245645 - DNA, 23 bp, Artificial Sequence
  Description of Artificial Sequence: Synthetic oligonucleotide
ccccctcatctcaggctccggga

SEQ ID NO: 245646 - DNA, 23 bp, Artificial Sequence
  Description of Artificial Sequence: Synthetic oligonucleotide
cccctcatctcaggctccgggac

SEQ ID NO: 245647 - DNA, 23 bp, Artificial Sequence
  Description of Artificial Sequence: Synthetic oligonucleotide
ccctcatctcaggctccgggacc

SEQ ID NO: 245648 - DNA, 23 bp, Artificial Sequence
  Description of Artificial Sequence: Synthetic oligonucleotide
cctcatctcaggctccgggaccc

SEQ ID NO: 245649 - DNA, 23 bp, Artificial Sequence
  Description of Artificial Sequence: Synthetic oligonucleotide
ctcatctcaggctccgggacccc

SEQ ID NO: 245650 - DNA, 24 bp, Artificial Sequence
  Description of Artificial Sequence: Synthetic oligonucleotide
tcatctcaggctccgggaccccct

SEQ ID NO: 245651 - DNA, 23 bp, Artificial Sequence
  Description of Artificial Sequence: Synthetic oligonucleotide
catctcaggctccgggaccccct

SEQ ID NO: 245652 - DNA, 23 bp, Artificial Sequence
  Description of Artificial Sequence: Synthetic oligonucleotide
atctcaggctccgggaccccctc

SEQ ID NO: 245653 - DNA, 22 bp, Artificial Sequence
  Description of Artificial Sequence: Synthetic oligonucleotide
tctcaggctccgggaccccctc

SEQ ID NO: 245654 - DNA, 21 bp, Artificial Sequence
  Description of Artificial Sequence: Synthetic oligonucleotide
ctcaggctccgggaccccctc

SEQ ID NO: 245655 - DNA, 21 bp, Artificial Sequence
  Description of Artificial Sequence: Synthetic oligonucleotide
tcaggctccgggaccccctcc

SEQ ID NO: 245656 - DNA, 20 bp, Artificial Sequence
  Description of Artificial Sequence: Synthetic oligonucleotide
caggctccgggaccccctcc

SEQ ID NO: 245657 - DNA, 23 bp, Artificial Sequence
  Description of Artificial Sequence: Synthetic oligonucleotide
aggctccgggaccccctcccatt

SEQ ID NO: 245658 - DNA, 22 bp, Artificial Sequence
  Description of Artificial Sequence: Synthetic oligonucleotide
ggctccgggaccccctcccatt

SEQ ID NO: 245659 - DNA, 22 bp, Artificial Sequence
  Description of Artificial Sequence: Synthetic oligonucleotide
gctccgggaccccctcccattg

SEQ ID NO: 245660 - DNA, 22 bp, Artificial Sequence
  Description of Artificial Sequence: Synthetic oligonucleotide
ctccgggaccccctcccattgg

SEQ ID NO: 245661 - DNA, 22 bp, Artificial Sequence
  Description of Artificial Sequence: Synthetic oligonucleotide
tccgggaccccctcccattggg

SEQ ID NO: 245662 - DNA, 21 bp, Artificial Sequence
  Description of Artificial Sequence: Synthetic oligonucleotide
ccgggaccccctcccattggg

SEQ ID NO: 245663 - DNA, 23 bp, Artificial Sequence
  Description of Artificial Sequence: Synthetic oligonucleotide
cgggaccccctcccattgggcta

SEQ ID NO: 245664 - DNA, 24 bp, Artificial Sequence
  Description of Artificial Sequence: Synthetic oligonucleotide
gggaccccctcccattgggctagt

SEQ ID NO: 245665 - DNA, 25 bp, Artificial Sequence
  Description of Artificial Sequence: Synthetic oligonucleotide
ggaccccctcccattgggctagtgt

SEQ ID NO: 245666 - DNA, 25 bp, Artificial Sequence
  Description of Artificial Sequence: Synthetic oligonucleotide
gaccccctcccattgggctagtgtg

SEQ ID NO: 245667 - DNA, 25 bp, Artificial Sequence
  Description of Artificial Sequence: Synthetic oligonucleotide
accccctcccattgggctagtgtgg

SEQ ID NO: 245668 - DNA, 24 bp, Artificial Sequence
  Description of Artificial Sequence: Synthetic oligonucleotide
ccccctcccattgggctagtgtgg

SEQ ID NO: 245669 - DNA, 24 bp, Artificial Sequence
  Description of Artificial Sequence: Synthetic oligonucleotide
cccctcccattgggctagtgtggc

SEQ ID NO: 245670 - DNA, 25 bp, Artificial Sequence
  Description of Artificial Sequence: Synthetic oligonucleotide
ccctcccattgggctagtgtggcga

SEQ ID NO: 245671 - DNA, 25 bp, Artificial Sequence
  Description of Artificial Sequence: Synthetic oligonucleotide
cctcccattgggctagtgtggcgac

SEQ ID NO: 245672 - DNA, 25 bp, Artificial Sequence
  Description of Artificial Sequence: Synthetic oligonucleotide
ctcccattgggctagtgtggcgacg

SEQ ID NO: 245673 - DNA, 25 bp, Artificial Sequence
  Description of Artificial Sequence: Synthetic oligonucleotide
tcccattgggctagtgtggcgacgg

SEQ ID NO: 245674 - DNA, 24 bp, Artificial Sequence
  Description of Artificial Sequence: Synthetic oligonucleotide
cccattgggctagtgtggcgacgg

SEQ ID NO: 245675 - DNA, 25 bp, Artificial Sequence
  Description of Artificial Sequence: Synthetic oligonucleotide
ccattgggctagtgtggcgacggca

SEQ ID NO: 245676 - DNA, 25 bp, Artificial Sequence
  Description of Artificial Sequence: Synthetic oligonucleotide
cattgggctagtgtggcgacggcag

SEQ ID NO: 245677 - DNA, 26 bp, Artificial Sequence
  Description of Artificial Sequence: Synthetic oligonucleotide
attgggctagtgtggcgacggcagca

SEQ ID NO: 245678 - DNA, 25 bp, Artificial Sequence
  Description of Artificial Sequence: Synthetic oligonucleotide
ttgggctagtgtggcgacggcagca

SEQ ID NO: 245679 - DNA, 24 bp, Artificial Sequence
  Description of Artificial Sequence: Synthetic oligonucleotide
tgggctagtgtggcgacggcagca

SEQ ID NO: 245680 - DNA, 23 bp, Artificial Sequence
  Description of Artificial Sequence: Synthetic oligonucleotide
gggctagtgtggcgacggcagca

SEQ ID NO: 245681 - DNA, 23 bp, Artificial Sequence
  Description of Artificial Sequence: Synthetic oligonucleotide
ggctagtgtggcgacggcagcac

SEQ ID NO: 245682 - DNA, 24 bp, Artificial Sequence
  Description of Artificial Sequence: Synthetic oligonucleotide
gctagtgtggcgacggcagcacct

SEQ ID NO: 245683 - DNA, 24 bp, Artificial Sequence
  Description of Artificial Sequence: Synthetic oligonucleotide
ctagtgtggcgacggcagcacctg

SEQ ID NO: 245684 - DNA, 24 bp, Artificial Sequence
  Description of Artificial Sequence: Synthetic oligonucleotide
tagtgtggcgacggcagcacctgc

SEQ ID NO: 245685 - DNA, 23 bp, Artificial Sequence
  Description of Artificial Sequence: Synthetic oligonucleotide
agtgtggcgacggcagcacctgc

SEQ ID NO: 245686 - DNA, 22 bp, Artificial Sequence
  Description of Artificial Sequence: Synthetic oligonucleotide
gtgtggcgacggcagcacctgc

SEQ ID NO: 245687 - DNA, 25 bp, Artificial Sequence
  Description of Artificial Sequence: Synthetic oligonucleotide
tgtggcgacggcagcacctgcgtaa

SEQ ID NO: 245688 - DNA, 24 bp, Artificial Sequence
  Description of Artificial Sequence: Synthetic oligonucleotide
gtggcgacggcagcacctgcgtaa

SEQ ID NO: 245689 - DNA, 24 bp, Artificial Sequence
  Description of Artificial Sequence: Synthetic oligonucleotide
tggcgacggcagcacctgcgtaag

SEQ ID NO: 245690 - DNA, 23 bp, Artificial Sequence
  Description of Artificial Sequence: Synthetic oligonucleotide
ggcgacggcagcacctgcgtaag

SEQ ID NO: 245691 - DNA, 23 bp, Artificial Sequence
  Description of Artificial Sequence: Synthetic oligonucleotide
gcgacggcagcacctgcgtaagg

SEQ ID NO: 245692 - DNA, 24 bp, Artificial Sequence
  Description of Artificial Sequence: Synthetic oligonucleotide
cgacggcagcacctgcgtaaggga

SEQ ID NO: 245693 - DNA, 26 bp, Artificial Sequence
  Description of Artificial Sequence: Synthetic oligonucleotide
gacggcagcacctgcgtaagggactt

SEQ ID NO: 245694 - DNA, 27 bp, Artificial Sequence
  Description of Artificial Sequence: Synthetic oligonucleotide
acggcagcacctgcgtaagggacttct

SEQ ID NO: 245695 - DNA, 26 bp, Artificial Sequence
  Description of Artificial Sequence: Synthetic oligonucleotide
cggcagcacctgcgtaagggacttct

SEQ ID NO: 245696 - DNA, 26 bp, Artificial Sequence
  Description of Artificial Sequence: Synthetic oligonucleotide
ggcagcacctgcgtaagggacttctg

SEQ ID NO: 245697 - DNA, 27 bp, Artificial Sequence
  Description of Artificial Sequence: Synthetic oligonucleotide
gcagcacctgcgtaagggacttctgct

SEQ ID NO: 245698 - DNA, 27 bp, Artificial Sequence
  Description of Artificial Sequence: Synthetic oligonucleotide
cagcacctgcgtaagggacttctgctc

SEQ ID NO: 245699 - DNA, 27 bp, Artificial Sequence
  Description of Artificial Sequence: Synthetic oligonucleotide
agcacctgcgtaagggacttctgctcc

SEQ ID NO: 245700 - DNA, 27 bp, Artificial Sequence
  Description of Artificial Sequence: Synthetic oligonucleotide
gcacctgcgtaagggacttctgctcct

SEQ ID NO: 245701 - DNA, 27 bp, Artificial Sequence
  Description of Artificial Sequence: Synthetic oligonucleotide
cacctgcgtaagggacttctgctcctc

SEQ ID NO: 245702 - DNA, 27 bp, Artificial Sequence
  Description of Artificial Sequence: Synthetic oligonucleotide
acctgcgtaagggacttctgctcctcg

SEQ ID NO: 245703 - DNA, 26 bp, Artificial Sequence
  Description of Artificial Sequence: Synthetic oligonucleotide
cctgcgtaagggacttctgctcctcg

SEQ ID NO: 245704 - DNA, 27 bp, Artificial Sequence
  Description of Artificial Sequence: Synthetic oligonucleotide
ctgcgtaagggacttctgctcctcgct

SEQ ID NO: 245705 - DNA, 27 bp, Artificial Sequence
  Description of Artificial Sequence: Synthetic oligonucleotide
tgcgtaagggacttctgctcctcgctg

SEQ ID NO: 245706 - DNA, 26 bp, Artificial Sequence
  Description of Artificial Sequence: Synthetic oligonucleotide
gcgtaagggacttctgctcctcgctg

SEQ ID NO: 245707 - DNA, 27 bp, Artificial Sequence
  Description of Artificial Sequence: Synthetic oligonucleotide
cgtaagggacttctgctcctcgctgca

SEQ ID NO: 245708 - DNA, 28 bp, Artificial Sequence
  Description of Artificial Sequence: Synthetic oligonucleotide
gtaagggacttctgctcctcgctgcaac

SEQ ID NO: 245709 - DNA, 29 bp, Artificial Sequence
  Description of Artificial Sequence: Synthetic oligonucleotide
taagggacttctgctcctcgctgcaactg

SEQ ID NO: 245710 - DNA, 28 bp, Artificial Sequence
  Description of Artificial Sequence: Synthetic oligonucleotide
aagggacttctgctcctcgctgcaactg

SEQ ID NO: 245711 - DNA, 27 bp, Artificial Sequence
  Description of Artificial Sequence: Synthetic oligonucleotide
agggacttctgctcctcgctgcaactg

SEQ ID NO: 245712 - DNA, 26 bp, Artificial Sequence
  Description of Artificial Sequence: Synthetic oligonucleotide
gggacttctgctcctcgctgcaactg

SEQ ID NO: 245713 - DNA, 27 bp, Artificial Sequence
  Description of Artificial Sequence: Synthetic oligonucleotide
ggacttctgctcctcgctgcaactgct

SEQ ID NO: 245714 - DNA, 27 bp, Artificial Sequence
  Description of Artificial Sequence: Synthetic oligonucleotide
gacttctgctcctcgctgcaactgctg

SEQ ID NO: 245715 - DNA, 27 bp, Artificial Sequence
  Description of Artificial Sequence: Synthetic oligonucleotide
acttctgctcctcgctgcaactgctgg

SEQ ID NO: 245716 - DNA, 26 bp, Artificial Sequence
  Description of Artificial Sequence: Synthetic oligonucleotide
cttctgctcctcgctgcaactgctgg

SEQ ID NO: 245717 - DNA, 26 bp, Artificial Sequence
  Description of Artificial Sequence: Synthetic oligonucleotide
ttctgctcctcgctgcaactgctggg

SEQ ID NO: 245718 - DNA, 25 bp, Artificial Sequence
  Description of Artificial Sequence: Synthetic oligonucleotide
tctgctcctcgctgcaactgctggg

SEQ ID NO: 245719 - DNA, 24 bp, Artificial Sequence
  Description of Artificial Sequence: Synthetic oligonucleotide
ctgctcctcgctgcaactgctggg

SEQ ID NO: 245720 - DNA, 25 bp, Artificial Sequence
  Description of Artificial Sequence: Synthetic oligonucleotide
tgctcctcgctgcaactgctgggct

SEQ ID NO: 245721 - DNA, 24 bp, Artificial Sequence
  Description of Artificial Sequence: Synthetic oligonucleotide
gctcctcgctgcaactgctgggct

SEQ ID NO: 245722 - DNA, 27 bp, Artificial Sequence
  Description of Artificial Sequence: Synthetic oligonucleotide
ctcctcgctgcaactgctgggctgatt

SEQ ID NO: 245723 - DNA, 27 bp, Artificial Sequence
  Description of Artificial Sequence: Synthetic oligonucleotide
tcctcgctgcaactgctgggctgattg

SEQ ID NO: 245724 - DNA, 26 bp, Artificial Sequence
  Description of Artificial Sequence: Synthetic oligonucleotide
cctcgctgcaactgctgggctgattg

SEQ ID NO: 245725 - DNA, 26 bp, Artificial Sequence
  Description of Artificial Sequence: Synthetic oligonucleotide
ctcgctgcaactgctgggctgattgg

SEQ ID NO: 245726 - DNA, 26 bp, Artificial Sequence
  Description of Artificial Sequence: Synthetic oligonucleotide
tcgctgcaactgctgggctgattggc

SEQ ID NO: 245727 - DNA, 25 bp, Artificial Sequence
  Description of Artificial Sequence: Synthetic oligonucleotide
cgctgcaactgctgggctgattggc

SEQ ID NO: 245728 - DNA, 26 bp, Artificial Sequence
  Description of Artificial Sequence: Synthetic oligonucleotide
gctgcaactgctgggctgattggcca

SEQ ID NO: 245729 - DNA, 27 bp, Artificial Sequence
  Description of Artificial Sequence: Synthetic oligonucleotide
ctgcaactgctgggctgattggccaga

SEQ ID NO: 245730 - DNA, 28 bp, Artificial Sequence
  Description of Artificial Sequence: Synthetic oligonucleotide
tgcaactgctgggctgattggccagatc

SEQ ID NO: 245731 - DNA, 27 bp, Artificial Sequence
  Description of Artificial Sequence: Synthetic oligonucleotide
gcaactgctgggctgattggccagatc

SEQ ID NO: 245732 - DNA, 27 bp, Artificial Sequence
  Description of Artificial Sequence: Synthetic oligonucleotide
caactgctgggctgattggccagatcc

SEQ ID NO: 245733 - DNA, 27 bp, Artificial Sequence
  Description of Artificial Sequence: Synthetic oligonucleotide
aactgctgggctgattggccagatccc

SEQ ID NO: 245734 - DNA, 27 bp, Artificial Sequence
  Description of Artificial Sequence: Synthetic oligonucleotide
actgctgggctgattggccagatccca

SEQ ID NO: 245735 - DNA, 26 bp, Artificial Sequence
  Description of Artificial Sequence: Synthetic oligonucleotide
ctgctgggctgattggccagatccca

SEQ ID NO: 245736 - DNA, 26 bp, Artificial Sequence
  Description of Artificial Sequence: Synthetic oligonucleotide
tgctgggctgattggccagatcccag

SEQ ID NO: 245737 - DNA, 25 bp, Artificial Sequence
  Description of Artificial Sequence: Synthetic oligonucleotide
gctgggctgattggccagatcccag

SEQ ID NO: 245738 - DNA, 26 bp, Artificial Sequence
  Description of Artificial Sequence: Synthetic oligonucleotide
ctgggctgattggccagatcccagca

SEQ ID NO: 245739 - DNA, 26 bp, Artificial Sequence
  Description of Artificial Sequence: Synthetic oligonucleotide
tgggctgattggccagatcccagcag

SEQ ID NO: 245740 - DNA, 25 bp, Artificial Sequence
  Description of Artificial Sequence: Synthetic oligonucleotide
gggctgattggccagatcccagcag

SEQ ID NO: 245741 - DNA, 25 bp, Artificial Sequence
  Description of Artificial Sequence: Synthetic oligonucleotide
ggctgattggccagatcccagcagc

SEQ ID NO: 245742 - DNA, 25 bp, Artificial Sequence
  Description of Artificial Sequence: Synthetic oligonucleotide
gctgattggccagatcccagcagcc

SEQ ID NO: 245743 - DNA, 27 bp, Artificial Sequence
  Description of Artificial Sequence: Synthetic oligonucleotide
ctgattggccagatcccagcagccgaa

SEQ ID NO: 245744 - DNA, 27 bp, Artificial Sequence
  Description of Artificial Sequence: Synthetic oligonucleotide
tgattggccagatcccagcagccgaag

SEQ ID NO: 245745 - DNA, 27 bp, Artificial Sequence
  Description of Artificial Sequence: Synthetic oligonucleotide
gattggccagatcccagcagccgaaga

SEQ ID NO: 245746 - DNA, 28 bp, Artificial Sequence
  Description of Artificial Sequence: Synthetic oligonucleotide
attggccagatcccagcagccgaagaag

SEQ ID NO: 245747 - DNA, 27 bp, Artificial Sequence
  Description of Artificial Sequence: Synthetic oligonucleotide
ttggccagatcccagcagccgaagaag

SEQ ID NO: 245748 - DNA, 26 bp, Artificial Sequence
  Description of Artificial Sequence: Synthetic oligonucleotide
tggccagatcccagcagccgaagaag

SEQ ID NO: 245749 - DNA, 25 bp, Artificial Sequence
  Description of Artificial Sequence: Synthetic oligonucleotide
ggccagatcccagcagccgaagaag

SEQ ID NO: 245750 - DNA, 25 bp, Artificial Sequence
  Description of Artificial Sequence: Synthetic oligonucleotide
gccagatcccagcagccgaagaagg

SEQ ID NO: 245751 - DNA, 25 bp, Artificial Sequence
  Description of Artificial Sequence: Synthetic oligonucleotide
ccagatcccagcagccgaagaaggg

SEQ ID NO: 245752 - DNA, 25 bp, Artificial Sequence
  Description of Artificial Sequence: Synthetic oligonucleotide
cagatcccagcagccgaagaagggg

SEQ ID NO: 245753 - DNA, 25 bp, Artificial Sequence
  Description of Artificial Sequence: Synthetic oligonucleotide
agatcccagcagccgaagaaggggg

SEQ ID NO: 245754 - DNA, 24 bp, Artificial Sequence
  Description of Artificial Sequence: Synthetic oligonucleotide
gatcccagcagccgaagaaggggg

SEQ ID NO: 245755 - DNA, 24 bp, Artificial Sequence
  Description of Artificial Sequence: Synthetic oligonucleotide
atcccagcagccgaagaagggggc

SEQ ID NO: 245756 - DNA, 23 bp, Artificial Sequence
  Description of Artificial Sequence: Synthetic oligonucleotide
tcccagcagccgaagaagggggc

SEQ ID NO: 245757 - DNA, 22 bp, Artificial Sequence
  Description of Artificial Sequence: Synthetic oligonucleotide
cccagcagccgaagaagggggc

SEQ ID NO: 245758 - DNA, 23 bp, Artificial Sequence
  Description of Artificial Sequence: Synthetic oligonucleotide
ccagcagccgaagaagggggcgt

SEQ ID NO: 245759 - DNA, 23 bp, Artificial Sequence
  Description of Artificial Sequence: Synthetic oligonucleotide
cagcagccgaagaagggggcgtg

SEQ ID NO: 245760 - DNA, 23 bp, Artificial Sequence
  Description of Artificial Sequence: Synthetic oligonucleotide
agcagccgaagaagggggcgtgg

SEQ ID NO: 245761 - DNA, 22 bp, Artificial Sequence
  Description of Artificial Sequence: Synthetic oligonucleotide
gcagccgaagaagggggcgtgg

SEQ ID NO: 245762 - DNA, 26 bp, Artificial Sequence
  Description of Artificial Sequence: Synthetic oligonucleotide
cagccgaagaagggggcgtggcatta

SEQ ID NO: 245763 - DNA, 26 bp, Artificial Sequence
  Description of Artificial Sequence: Synthetic oligonucleotide
agccgaagaagggggcgtggcattag

SEQ ID NO: 245764 - DNA, 25 bp, Artificial Sequence
  Description of Artificial Sequence: Synthetic oligonucleotide
gccgaagaagggggcgtggcattag

SEQ ID NO: 245765 - DNA, 26 bp, Artificial Sequence
  Description of Artificial Sequence: Synthetic oligonucleotide
ccgaagaagggggcgtggcattagct

SEQ ID NO: 245766 - DNA, 26 bp, Artificial Sequence
  Description of Artificial Sequence: Synthetic oligonucleotide
cgaagaagggggcgtggcattagctg

SEQ ID NO: 245767 - DNA, 27 bp, Artificial Sequence
  Description of Artificial Sequence: Synthetic oligonucleotide
gaagaagggggcgtggcattagctgct

SEQ ID NO: 245768 - DNA, 28 bp, Artificial Sequence
  Description of Artificial Sequence: Synthetic oligonucleotide
aagaagggggcgtggcattagctgcttg

SEQ ID NO: 245769 - DNA, 27 bp, Artificial Sequence
  Description of Artificial Sequence: Synthetic oligonucleotide
agaagggggcgtggcattagctgcttg

SEQ ID NO: 245770 - DNA, 26 bp, Artificial Sequence
  Description of Artificial Sequence: Synthetic oligonucleotide
gaagggggcgtggcattagctgcttg

SEQ ID NO: 245771 - DNA, 26 bp, Artificial Sequence
  Description of Artificial Sequence: Synthetic oligonucleotide
aagggggcgtggcattagctgcttgg

SEQ ID NO: 245772 - DNA, 25 bp, Artificial Sequence
  Description of Artificial Sequence: Synthetic oligonucleotide
agggggcgtggcattagctgcttgg

SEQ ID NO: 245773 - DNA, 24 bp, Artificial Sequence
  Description of Artificial Sequence: Synthetic oligonucleotide
gggggcgtggcattagctgcttgg

SEQ ID NO: 245774 - DNA, 26 bp, Artificial Sequence
  Description of Artificial Sequence: Synthetic oligonucleotide
ggggcgtggcattagctgcttggcat

SEQ ID NO: 245775 - DNA, 27 bp, Artificial Sequence
  Description of Artificial Sequence: Synthetic oligonucleotide
gggcgtggcattagctgcttggcatga

SEQ ID NO: 245776 - DNA, 28 bp, Artificial Sequence
  Description of Artificial Sequence: Synthetic oligonucleotide
ggcgtggcattagctgcttggcatgatg

SEQ ID NO: 245777 - DNA, 30 bp, Artificial Sequence
  Description of Artificial Sequence: Synthetic oligonucleotide
gcgtggcattagctgcttggcatgatgatg

SEQ ID NO: 245778 - DNA, 31 bp, Artificial Sequence
  Description of Artificial Sequence: Synthetic oligonucleotide
cgtggcattagctgcttggcatgatgatgtg

SEQ ID NO: 245779 - DNA, 31 bp, Artificial Sequence
  Description of Artificial Sequence: Synthetic oligonucleotide
gtggcattagctgcttggcatgatgatgtgc

SEQ ID NO: 245780 - DNA, 31 bp, Artificial Sequence
  Description of Artificial Sequence: Synthetic oligonucleotide
tggcattagctgcttggcatgatgatgtgcc

SEQ ID NO: 245781 - DNA, 30 bp, Artificial Sequence
  Description of Artificial Sequence: Synthetic oligonucleotide
ggcattagctgcttggcatgatgatgtgcc

SEQ ID NO: 245782 - DNA, 32 bp, Artificial Sequence
  Description of Artificial Sequence: Synthetic oligonucleotide
gcattagctgcttggcatgatgatgtgccatg

SEQ ID NO: 245783 - DNA, 32 bp, Artificial Sequence
  Description of Artificial Sequence: Synthetic oligonucleotide
cattagctgcttggcatgatgatgtgccatgg

SEQ ID NO: 245784 - DNA, 32 bp, Artificial Sequence
  Description of Artificial Sequence: Synthetic oligonucleotide
attagctgcttggcatgatgatgtgccatggg

SEQ ID NO: 245785 - DNA, 31 bp, Artificial Sequence
  Description of Artificial Sequence: Synthetic oligonucleotide
ttagctgcttggcatgatgatgtgccatggg

SEQ ID NO: 245786 - DNA, 30 bp, Artificial Sequence
  Description of Artificial Sequence: Synthetic oligonucleotide
tagctgcttggcatgatgatgtgccatggg

SEQ ID NO: 245787 - DNA, 29 bp, Artificial Sequence
  Description of Artificial Sequence: Synthetic oligonucleotide
agctgcttggcatgatgatgtgccatggg

SEQ ID NO: 245788 - DNA, 28 bp, Artificial Sequence
  Description of Artificial Sequence: Synthetic oligonucleotide
gctgcttggcatgatgatgtgccatggg

SEQ ID NO: 245789 - DNA, 28 bp, Artificial Sequence
  Description of Artificial Sequence: Synthetic oligonucleotide
ctgcttggcatgatgatgtgccatgggg

SEQ ID NO: 245790 - DNA, 28 bp, Artificial Sequence
  Description of Artificial Sequence: Synthetic oligonucleotide
tgcttggcatgatgatgtgccatggggg

SEQ ID NO: 245791 - DNA, 27 bp, Artificial Sequence
  Description of Artificial Sequence: Synthetic oligonucleotide
gcttggcatgatgatgtgccatggggg

SEQ ID NO: 245792 - DNA, 27 bp, Artificial Sequence
  Description of Artificial Sequence: Synthetic oligonucleotide
cttggcatgatgatgtgccatgggggc

SEQ ID NO: 245793 - DNA, 27 bp, Artificial Sequence
  Description of Artificial Sequence: Synthetic oligonucleotide
ttggcatgatgatgtgccatgggggcc

SEQ ID NO: 245794 - DNA, 27 bp, Artificial Sequence
  Description of Artificial Sequence: Synthetic oligonucleotide
tggcatgatgatgtgccatgggggcca

SEQ ID NO: 245795 - DNA, 27 bp, Artificial Sequence
  Description of Artificial Sequence: Synthetic oligonucleotide
ggcatgatgatgtgccatgggggccat

SEQ ID NO: 245796 - DNA, 27 bp, Artificial Sequence
  Description of Artificial Sequence: Synthetic oligonucleotide
gcatgatgatgtgccatgggggccatg

SEQ ID NO: 245797 - DNA, 27 bp, Artificial Sequence
  Description of Artificial Sequence: Synthetic oligonucleotide
catgatgatgtgccatgggggccatgg

SEQ ID NO: 245798 - DNA, 28 bp, Artificial Sequence
  Description of Artificial Sequence: Synthetic oligonucleotide
atgatgatgtgccatgggggccatggac

SEQ ID NO: 245799 - DNA, 27 bp, Artificial Sequence
  Description of Artificial Sequence: Synthetic oligonucleotide
tgatgatgtgccatgggggccatggac

SEQ ID NO: 245800 - DNA, 26 bp, Artificial Sequence
  Description of Artificial Sequence: Synthetic oligonucleotide
gatgatgtgccatgggggccatggac

SEQ ID NO: 245801 - DNA, 26 bp, Artificial Sequence
  Description of Artificial Sequence: Synthetic oligonucleotide
atgatgtgccatgggggccatggacc

SEQ ID NO: 245802 - DNA, 25 bp, Artificial Sequence
  Description of Artificial Sequence: Synthetic oligonucleotide
tgatgtgccatgggggccatggacc

SEQ ID NO: 245803 - DNA, 24 bp, Artificial Sequence
  Description of Artificial Sequence: Synthetic oligonucleotide
gatgtgccatgggggccatggacc

SEQ ID NO: 245804 - DNA, 24 bp, Artificial Sequence
  Description of Artificial Sequence: Synthetic oligonucleotide
atgtgccatgggggccatggaccc

SEQ ID NO: 245805 - DNA, 23 bp, Artificial Sequence
  Description of Artificial Sequence: Synthetic oligonucleotide
tgtgccatgggggccatggaccc

SEQ ID NO: 245806 - DNA, 22 bp, Artificial Sequence
  Description of Artificial Sequence: Synthetic oligonucleotide
gtgccatgggggccatggaccc

SEQ ID NO: 245807 - DNA, 26 bp, Artificial Sequence
  Description of Artificial Sequence: Synthetic oligonucleotide
tgccatgggggccatggacccgaaat

SEQ ID NO: 245808 - DNA, 25 bp, Artificial Sequence
  Description of Artificial Sequence: Synthetic oligonucleotide
gccatgggggccatggacccgaaat

SEQ ID NO: 245809 - DNA, 25 bp, Artificial Sequence
  Description of Artificial Sequence: Synthetic oligonucleotide
ccatgggggccatggacccgaaatg

SEQ ID NO: 245810 - DNA, 25 bp, Artificial Sequence
  Description of Artificial Sequence: Synthetic oligonucleotide
catgggggccatggacccgaaatgg

SEQ ID NO: 245811 - DNA, 26 bp, Artificial Sequence
  Description of Artificial Sequence: Synthetic oligonucleotide
atgggggccatggacccgaaatggga

SEQ ID NO: 245812 - DNA, 25 bp, Artificial Sequence
  Description of Artificial Sequence: Synthetic oligonucleotide
tgggggccatggacccgaaatggga

SEQ ID NO: 245813 - DNA, 24 bp, Artificial Sequence
  Description of Artificial Sequence: Synthetic oligonucleotide
gggggccatggacccgaaatggga

SEQ ID NO: 245814 - DNA, 24 bp, Artificial Sequence
  Description of Artificial Sequence: Synthetic oligonucleotide
ggggccatggacccgaaatgggag

SEQ ID NO: 245815 - DNA, 26 bp, Artificial Sequence
  Description of Artificial Sequence: Synthetic oligonucleotide
gggccatggacccgaaatgggagctt

SEQ ID NO: 245816 - DNA, 27 bp, Artificial Sequence
  Description of Artificial Sequence: Synthetic oligonucleotide
ggccatggacccgaaatgggagcttct

SEQ ID NO: 245817 - DNA, 27 bp, Artificial Sequence
  Description of Artificial Sequence: Synthetic oligonucleotide
gccatggacccgaaatgggagcttctg

SEQ ID NO: 245818 - DNA, 27 bp, Artificial Sequence
  Description of Artificial Sequence: Synthetic oligonucleotide
ccatggacccgaaatgggagcttctgg

SEQ ID NO: 245819 - DNA, 27 bp, Artificial Sequence
  Description of Artificial Sequence: Synthetic oligonucleotide
catggacccgaaatgggagcttctggc

SEQ ID NO: 245820 - DNA, 28 bp, Artificial Sequence
  Description of Artificial Sequence: Synthetic oligonucleotide
atggacccgaaatgggagcttctggctc

SEQ ID NO: 245821 - DNA, 27 bp, Artificial Sequence
  Description of Artificial Sequence: Synthetic oligonucleotide
tggacccgaaatgggagcttctggctc

SEQ ID NO: 245822 - DNA, 26 bp, Artificial Sequence
  Description of Artificial Sequence: Synthetic oligonucleotide
ggacccgaaatgggagcttctggctc

SEQ ID NO: 245823 - DNA, 26 bp, Artificial Sequence
  Description of Artificial Sequence: Synthetic oligonucleotide
gacccgaaatgggagcttctggctcc

SEQ ID NO: 245824 - DNA, 27 bp, Artificial Sequence
  Description of Artificial Sequence: Synthetic oligonucleotide
acccgaaatgggagcttctggctccct

SEQ ID NO: 245825 - DNA, 27 bp, Artificial Sequence
  Description of Artificial Sequence: Synthetic oligonucleotide
cccgaaatgggagcttctggctcccta

SEQ ID NO: 245826 - DNA, 27 bp, Artificial Sequence
  Description of Artificial Sequence: Synthetic oligonucleotide
ccgaaatgggagcttctggctccctac

SEQ ID NO: 245827 - DNA, 28 bp, Artificial Sequence
  Description of Artificial Sequence: Synthetic oligonucleotide
cgaaatgggagcttctggctccctacag

SEQ ID NO: 245828 - DNA, 30 bp, Artificial Sequence
  Description of Artificial Sequence: Synthetic oligonucleotide
gaaatgggagcttctggctccctacagttg

SEQ ID NO: 245829 - DNA, 32 bp, Artificial Sequence
  Description of Artificial Sequence: Synthetic oligonucleotide
aaatgggagcttctggctccctacagttgaac

SEQ ID NO: 245830 - DNA, 31 bp, Artificial Sequence
  Description of Artificial Sequence: Synthetic oligonucleotide
aatgggagcttctggctccctacagttgaac

SEQ ID NO: 245831 - DNA, 30 bp, Artificial Sequence
  Description of Artificial Sequence: Synthetic oligonucleotide
atgggagcttctggctccctacagttgaac

SEQ ID NO: 245832 - DNA, 29 bp, Artificial Sequence
  Description of Artificial Sequence: Synthetic oligonucleotide
tgggagcttctggctccctacagttgaac

SEQ ID NO: 245833 - DNA, 28 bp, Artificial Sequence
  Description of Artificial Sequence: Synthetic oligonucleotide
gggagcttctggctccctacagttgaac

SEQ ID NO: 245834 - DNA, 28 bp, Artificial Sequence
  Description of Artificial Sequence: Synthetic oligonucleotide
ggagcttctggctccctacagttgaacc

SEQ ID NO: 245835 - DNA, 28 bp, Artificial Sequence
  Description of Artificial Sequence: Synthetic oligonucleotide
gagcttctggctccctacagttgaaccc

SEQ ID NO: 245836 - DNA, 31 bp, Artificial Sequence
  Description of Artificial Sequence: Synthetic oligonucleotide
agcttctggctccctacagttgaaccctttc

SEQ ID NO: 245837 - DNA, 30 bp, Artificial Sequence
  Description of Artificial Sequence: Synthetic oligonucleotide
gcttctggctccctacagttgaaccctttc

SEQ ID NO: 245838 - DNA, 31 bp, Artificial Sequence
  Description of Artificial Sequence: Synthetic oligonucleotide
cttctggctccctacagttgaaccctttctg

SEQ ID NO: 245839 - DNA, 31 bp, Artificial Sequence
  Description of Artificial Sequence: Synthetic oligonucleotide
ttctggctccctacagttgaaccctttctgg

SEQ ID NO: 245840 - DNA, 30 bp, Artificial Sequence
  Description of Artificial Sequence: Synthetic oligonucleotide
tctggctccctacagttgaaccctttctgg

SEQ ID NO: 245841 - DNA, 29 bp, Artificial Sequence
  Description of Artificial Sequence: Synthetic oligonucleotide
ctggctccctacagttgaaccctttctgg

SEQ ID NO: 245842 - DNA, 30 bp, Artificial Sequence
  Description of Artificial Sequence: Synthetic oligonucleotide
tggctccctacagttgaaccctttctggag

SEQ ID NO: 245843 - DNA, 29 bp, Artificial Sequence
  Description of Artificial Sequence: Synthetic oligonucleotide
ggctccctacagttgaaccctttctggag

SEQ ID NO: 245844 - DNA, 29 bp, Artificial Sequence
  Description of Artificial Sequence: Synthetic oligonucleotide
gctccctacagttgaaccctttctggagg

SEQ ID NO: 245845 - DNA, 29 bp, Artificial Sequence
  Description of Artificial Sequence: Synthetic oligonucleotide
ctccctacagttgaaccctttctggaggg

SEQ ID NO: 245846 - DNA, 29 bp, Artificial Sequence
  Description of Artificial Sequence: Synthetic oligonucleotide
tccctacagttgaaccctttctggagggc

SEQ ID NO: 245847 - DNA, 28 bp, Artificial Sequence
  Description of Artificial Sequence: Synthetic oligonucleotide
ccctacagttgaaccctttctggagggc

SEQ ID NO: 245848 - DNA, 29 bp, Artificial Sequence
  Description of Artificial Sequence: Synthetic oligonucleotide
cctacagttgaaccctttctggagggcac

SEQ ID NO: 245849 - DNA, 29 bp, Artificial Sequence
  Description of Artificial Sequence: Synthetic oligonucleotide
ctacagttgaaccctttctggagggcacg

SEQ ID NO: 245850 - DNA, 32 bp, Artificial Sequence
  Description of Artificial Sequence: Synthetic oligonucleotide
tacagttgaaccctttctggagggcacgtatc

SEQ ID NO: 245851 - DNA, 31 bp, Artificial Sequence
  Description of Artificial Sequence: Synthetic oligonucleotide
acagttgaaccctttctggagggcacgtatc

SEQ ID NO: 245852 - DNA, 30 bp, Artificial Sequence
  Description of Artificial Sequence: Synthetic oligonucleotide
cagttgaaccctttctggagggcacgtatc

SEQ ID NO: 245853 - DNA, 31 bp, Artificial Sequence
  Description of Artificial Sequence: Synthetic oligonucleotide
agttgaaccctttctggagggcacgtatctg

SEQ ID NO: 245854 - DNA, 30 bp, Artificial Sequence
  Description of Artificial Sequence: Synthetic oligonucleotide
gttgaaccctttctggagggcacgtatctg

SEQ ID NO: 245855 - DNA, 30 bp, Artificial Sequence
  Description of Artificial Sequence: Synthetic oligonucleotide
ttgaaccctttctggagggcacgtatctgg

SEQ ID NO: 245856 - DNA, 29 bp, Artificial Sequence
  Description of Artificial Sequence: Synthetic oligonucleotide
tgaaccctttctggagggcacgtatctgg

SEQ ID NO: 245857 - DNA, 28 bp, Artificial Sequence
  Description of Artificial Sequence: Synthetic oligonucleotide
gaaccctttctggagggcacgtatctgg

SEQ ID NO: 245858 - DNA, 28 bp, Artificial Sequence
  Description of Artificial Sequence: Synthetic oligonucleotide
aaccctttctggagggcacgtatctggc

SEQ ID NO: 245859 - DNA, 27 bp, Artificial Sequence
  Description of Artificial Sequence: Synthetic oligonucleotide
accctttctggagggcacgtatctggc

SEQ ID NO: 245860 - DNA, 26 bp, Artificial Sequence
  Description of Artificial Sequence: Synthetic oligonucleotide
ccctttctggagggcacgtatctggc

SEQ ID NO: 245861 - DNA, 27 bp, Artificial Sequence
  Description of Artificial Sequence: Synthetic oligonucleotide
cctttctggagggcacgtatctggcct

SEQ ID NO: 245862 - DNA, 27 bp, Artificial Sequence
  Description of Artificial Sequence: Synthetic oligonucleotide
ctttctggagggcacgtatctggcctc

SEQ ID NO: 245863 - DNA, 27 bp, Artificial Sequence
  Description of Artificial Sequence: Synthetic oligonucleotide
tttctggagggcacgtatctggcctcc

SEQ ID NO: 245864 - DNA, 27 bp, Artificial Sequence
  Description of Artificial Sequence: Synthetic oligonucleotide
ttctggagggcacgtatctggcctcca

SEQ ID NO: 245865 - DNA, 27 bp, Artificial Sequence
  Description of Artificial Sequence: Synthetic oligonucleotide
tctggagggcacgtatctggcctccat

SEQ ID NO: 245866 - DNA, 27 bp, Artificial Sequence
  Description of Artificial Sequence: Synthetic oligonucleotide
ctggagggcacgtatctggcctccata

SEQ ID NO: 245867 - DNA, 27 bp, Artificial Sequence
  Description of Artificial Sequence: Synthetic oligonucleotide
tggagggcacgtatctggcctccatac

SEQ ID NO: 245868 - DNA, 27 bp, Artificial Sequence
  Description of Artificial Sequence: Synthetic oligonucleotide
ggagggcacgtatctggcctccataca

SEQ ID NO: 245869 - DNA, 27 bp, Artificial Sequence
  Description of Artificial Sequence: Synthetic oligonucleotide
gagggcacgtatctggcctccatacac

SEQ ID NO: 245870 - DNA, 27 bp, Artificial Sequence
  Description of Artificial Sequence: Synthetic oligonucleotide
agggcacgtatctggcctccatacacc

SEQ ID NO: 245871 - DNA, 27 bp, Artificial Sequence
  Description of Artificial Sequence: Synthetic oligonucleotide
gggcacgtatctggcctccatacacca

SEQ ID NO: 245872 - DNA, 27 bp, Artificial Sequence
  Description of Artificial Sequence: Synthetic oligonucleotide
ggcacgtatctggcctccatacaccag

SEQ ID NO: 245873 - DNA, 27 bp, Artificial Sequence
  Description of Artificial Sequence: Synthetic oligonucleotide
gcacgtatctggcctccatacaccagc

SEQ ID NO: 245874 - DNA, 27 bp, Artificial Sequence
  Description of Artificial Sequence: Synthetic oligonucleotide
cacgtatctggcctccatacaccagcc

SEQ ID NO: 245875 - DNA, 30 bp, Artificial Sequence
  Description of Artificial Sequence: Synthetic oligonucleotide
acgtatctggcctccatacaccagccatac

SEQ ID NO: 245876 - DNA, 29 bp, Artificial Sequence
  Description of Artificial Sequence: Synthetic oligonucleotide
cgtatctggcctccatacaccagccatac

SEQ ID NO: 245877 - DNA, 29 bp, Artificial Sequence
  Description of Artificial Sequence: Synthetic oligonucleotide
gtatctggcctccatacaccagccatacc

SEQ ID NO: 245878 - DNA, 30 bp, Artificial Sequence
  Description of Artificial Sequence: Synthetic oligonucleotide
tatctggcctccatacaccagccatacctc

SEQ ID NO: 245879 - DNA, 29 bp, Artificial Sequence
  Description of Artificial Sequence: Synthetic oligonucleotide
atctggcctccatacaccagccatacctc

SEQ ID NO: 245880 - DNA, 28 bp, Artificial Sequence
  Description of Artificial Sequence: Synthetic oligonucleotide
tctggcctccatacaccagccatacctc

SEQ ID NO: 245881 - DNA, 27 bp, Artificial Sequence
  Description of Artificial Sequence: Synthetic oligonucleotide
ctggcctccatacaccagccatacctc

SEQ ID NO: 245882 - DNA, 27 bp, Artificial Sequence
  Description of Artificial Sequence: Synthetic oligonucleotide
tggcctccatacaccagccatacctcc

SEQ ID NO: 245883 - DNA, 27 bp, Artificial Sequence
  Description of Artificial Sequence: Synthetic oligonucleotide
ggcctccatacaccagccatacctcca

SEQ ID NO: 245884 - DNA, 28 bp, Artificial Sequence
  Description of Artificial Sequence: Synthetic oligonucleotide
gcctccatacaccagccatacctccaag

SEQ ID NO: 245885 - DNA, 28 bp, Artificial Sequence
  Description of Artificial Sequence: Synthetic oligonucleotide
cctccatacaccagccatacctccaagg

SEQ ID NO: 245886 - DNA, 29 bp, Artificial Sequence
  Description of Artificial Sequence: Synthetic oligonucleotide
ctccatacaccagccatacctccaaggac

SEQ ID NO: 245887 - DNA, 30 bp, Artificial Sequence
  Description of Artificial Sequence: Synthetic oligonucleotide
tccatacaccagccatacctccaaggacag

SEQ ID NO: 245888 - DNA, 29 bp, Artificial Sequence
  Description of Artificial Sequence: Synthetic oligonucleotide
ccatacaccagccatacctccaaggacag

SEQ ID NO: 245889 - DNA, 29 bp, Artificial Sequence
  Description of Artificial Sequence: Synthetic oligonucleotide
catacaccagccatacctccaaggacagc

SEQ ID NO: 245890 - DNA, 30 bp, Artificial Sequence
  Description of Artificial Sequence: Synthetic oligonucleotide
atacaccagccatacctccaaggacagctc

SEQ ID NO: 245891 - DNA, 29 bp, Artificial Sequence
  Description of Artificial Sequence: Synthetic oligonucleotide
tacaccagccatacctccaaggacagctc

SEQ ID NO: 245892 - DNA, 28 bp, Artificial Sequence
  Description of Artificial Sequence: Synthetic oligonucleotide
acaccagccatacctccaaggacagctc

SEQ ID NO: 245893 - DNA, 27 bp, Artificial Sequence
  Description of Artificial Sequence: Synthetic oligonucleotide
caccagccatacctccaaggacagctc

SEQ ID NO: 245894 - DNA, 28 bp, Artificial Sequence
  Description of Artificial Sequence: Synthetic oligonucleotide
accagccatacctccaaggacagctcac

SEQ ID NO: 245895 - DNA, 27 bp, Artificial Sequence
  Description of Artificial Sequence: Synthetic oligonucleotide
ccagccatacctccaaggacagctcac

SEQ ID NO: 245896 - DNA, 27 bp, Artificial Sequence
  Description of Artificial Sequence: Synthetic oligonucleotide
cagccatacctccaaggacagctcacc

SEQ ID NO: 245897 - DNA, 27 bp, Artificial Sequence
  Description of Artificial Sequence: Synthetic oligonucleotide
agccatacctccaaggacagctcaccc

SEQ ID NO: 245898 - DNA, 27 bp, Artificial Sequence
  Description of Artificial Sequence: Synthetic oligonucleotide
gccatacctccaaggacagctcaccct

SEQ ID NO: 245899 - DNA, 27 bp, Artificial Sequence
  Description of Artificial Sequence: Synthetic oligonucleotide
ccatacctccaaggacagctcaccctg

SEQ ID NO: 245900 - DNA, 27 bp, Artificial Sequence
  Description of Artificial Sequence: Synthetic oligonucleotide
catacctccaaggacagctcaccctgg

SEQ ID NO: 245901 - DNA, 28 bp, Artificial Sequence
  Description of Artificial Sequence: Synthetic oligonucleotide
atacctccaaggacagctcaccctggtg

SEQ ID NO: 245902 - DNA, 27 bp, Artificial Sequence
  Description of Artificial Sequence: Synthetic oligonucleotide
tacctccaaggacagctcaccctggtg

SEQ ID NO: 245903 - DNA, 26 bp, Artificial Sequence
  Description of Artificial Sequence: Synthetic oligonucleotide
acctccaaggacagctcaccctggtg

SEQ ID NO: 245904 - DNA, 25 bp, Artificial Sequence
  Description of Artificial Sequence: Synthetic oligonucleotide
cctccaaggacagctcaccctggtg

SEQ ID NO: 245905 - DNA, 27 bp, Artificial Sequence
  Description of Artificial Sequence: Synthetic oligonucleotide
ctccaaggacagctcaccctggtgctt

SEQ ID NO: 245906 - DNA, 27 bp, Artificial Sequence
  Description of Artificial Sequence: Synthetic oligonucleotide
tccaaggacagctcaccctggtgcttg

SEQ ID NO: 245907 - DNA, 26 bp, Artificial Sequence
  Description of Artificial Sequence: Synthetic oligonucleotide
ccaaggacagctcaccctggtgcttg

SEQ ID NO: 245908 - DNA, 27 bp, Artificial Sequence
  Description of Artificial Sequence: Synthetic oligonucleotide
caaggacagctcaccctggtgcttgct

SEQ ID NO: 245909 - DNA, 27 bp, Artificial Sequence
  Description of Artificial Sequence: Synthetic oligonucleotide
aaggacagctcaccctggtgcttgctg

SEQ ID NO: 245910 - DNA, 27 bp, Artificial Sequence
  Description of Artificial Sequence: Synthetic oligonucleotide
aggacagctcaccctggtgcttgctgt

SEQ ID NO: 245911 - DNA, 26 bp, Artificial Sequence
  Description of Artificial Sequence: Synthetic oligonucleotide
ggacagctcaccctggtgcttgctgt

SEQ ID NO: 245912 - DNA, 27 bp, Artificial Sequence
  Description of Artificial Sequence: Synthetic oligonucleotide
gacagctcaccctggtgcttgctgtct

SEQ ID NO: 245913 - DNA, 28 bp, Artificial Sequence
  Description of Artificial Sequence: Synthetic oligonucleotide
acagctcaccctggtgcttgctgtctac

SEQ ID NO: 245914 - DNA, 27 bp, Artificial Sequence
  Description of Artificial Sequence: Synthetic oligonucleotide
cagctcaccctggtgcttgctgtctac

SEQ ID NO: 245915 - DNA, 30 bp, Artificial Sequence
  Description of Artificial Sequence: Synthetic oligonucleotide
agctcaccctggtgcttgctgtctacaaac

SEQ ID NO: 245916 - DNA, 29 bp, Artificial Sequence
  Description of Artificial Sequence: Synthetic oligonucleotide
gctcaccctggtgcttgctgtctacaaac

SEQ ID NO: 245917 - DNA, 29 bp, Artificial Sequence
  Description of Artificial Sequence: Synthetic oligonucleotide
ctcaccctggtgcttgctgtctacaaacc

SEQ ID NO: 245918 - DNA, 29 bp, Artificial Sequence
  Description of Artificial Sequence: Synthetic oligonucleotide
tcaccctggtgcttgctgtctacaaaccc

SEQ ID NO: 245919 - DNA, 28 bp, Artificial Sequence
  Description of Artificial Sequence: Synthetic oligonucleotide
caccctggtgcttgctgtctacaaaccc

SEQ ID NO: 245920 - DNA, 28 bp, Artificial Sequence
  Description of Artificial Sequence: Synthetic oligonucleotide
accctggtgcttgctgtctacaaacccg

SEQ ID NO: 245921 - DNA, 27 bp, Artificial Sequence
  Description of Artificial Sequence: Synthetic oligonucleotide
ccctggtgcttgctgtctacaaacccg

SEQ ID NO: 245922 - DNA, 27 bp, Artificial Sequence
  Description of Artificial Sequence: Synthetic oligonucleotide
cctggtgcttgctgtctacaaacccgc

SEQ ID NO: 245923 - DNA, 27 bp, Artificial Sequence
  Description of Artificial Sequence: Synthetic oligonucleotide
ctggtgcttgctgtctacaaacccgcc

SEQ ID NO: 245924 - DNA, 30 bp, Artificial Sequence
  Description of Artificial Sequence: Synthetic oligonucleotide
tggtgcttgctgtctacaaacccgccaaag

SEQ ID NO: 245925 - DNA, 29 bp, Artificial Sequence
  Description of Artificial Sequence: Synthetic oligonucleotide
ggtgcttgctgtctacaaacccgccaaag

SEQ ID NO: 245926 - DNA, 30 bp, Artificial Sequence
  Description of Artificial Sequence: Synthetic oligonucleotide
gtgcttgctgtctacaaacccgccaaagtg

SEQ ID NO: 245927 - DNA, 31 bp, Artificial Sequence
  Description of Artificial Sequence: Synthetic oligonucleotide
tgcttgctgtctacaaacccgccaaagtgtg

SEQ ID NO: 245928 - DNA, 30 bp, Artificial Sequence
  Description of Artificial Sequence: Synthetic oligonucleotide
gcttgctgtctacaaacccgccaaagtgtg

SEQ ID NO: 245929 - DNA, 30 bp, Artificial Sequence
  Description of Artificial Sequence: Synthetic oligonucleotide
cttgctgtctacaaacccgccaaagtgtgc

SEQ ID NO: 245930 - DNA, 30 bp, Artificial Sequence
  Description of Artificial Sequence: Synthetic oligonucleotide
ttgctgtctacaaacccgccaaagtgtgcc

SEQ ID NO: 245931 - DNA, 29 bp, Artificial Sequence
  Description of Artificial Sequence: Synthetic oligonucleotide
tgctgtctacaaacccgccaaagtgtgcc

SEQ ID NO: 245932 - DNA, 28 bp, Artificial Sequence
  Description of Artificial Sequence: Synthetic oligonucleotide
gctgtctacaaacccgccaaagtgtgcc

SEQ ID NO: 245933 - DNA, 29 bp, Artificial Sequence
  Description of Artificial Sequence: Synthetic oligonucleotide
ctgtctacaaacccgccaaagtgtgcctg

SEQ ID NO: 245934 - DNA, 31 bp, Artificial Sequence
  Description of Artificial Sequence: Synthetic oligonucleotide
tgtctacaaacccgccaaagtgtgcctgatg

SEQ ID NO: 245935 - DNA, 30 bp, Artificial Sequence
  Description of Artificial Sequence: Synthetic oligonucleotide
gtctacaaacccgccaaagtgtgcctgatg

SEQ ID NO: 245936 - DNA, 30 bp, Artificial Sequence
  Description of Artificial Sequence: Synthetic oligonucleotide
tctacaaacccgccaaagtgtgcctgatgc

SEQ ID NO: 245937 - DNA, 29 bp, Artificial Sequence
  Description of Artificial Sequence: Synthetic oligonucleotide
ctacaaacccgccaaagtgtgcctgatgc

SEQ ID NO: 245938 - DNA, 29 bp, Artificial Sequence
  Description of Artificial Sequence: Synthetic oligonucleotide
tacaaacccgccaaagtgtgcctgatgcc

SEQ ID NO: 245939 - DNA, 28 bp, Artificial Sequence
  Description of Artificial Sequence: Synthetic oligonucleotide
acaaacccgccaaagtgtgcctgatgcc

SEQ ID NO: 245940 - DNA, 27 bp, Artificial Sequence
  Description of Artificial Sequence: Synthetic oligonucleotide
caaacccgccaaagtgtgcctgatgcc

SEQ ID NO: 245941 - DNA, 28 bp, Artificial Sequence
  Description of Artificial Sequence: Synthetic oligonucleotide
aaacccgccaaagtgtgcctgatgcctg

SEQ ID NO: 245942 - DNA, 27 bp, Artificial Sequence
  Description of Artificial Sequence: Synthetic oligonucleotide
aacccgccaaagtgtgcctgatgcctg

SEQ ID NO: 245943 - DNA, 26 bp, Artificial Sequence
  Description of Artificial Sequence: Synthetic oligonucleotide
acccgccaaagtgtgcctgatgcctg

SEQ ID NO: 245944 - DNA, 25 bp, Artificial Sequence
  Description of Artificial Sequence: Synthetic oligonucleotide
cccgccaaagtgtgcctgatgcctg

SEQ ID NO: 245945 - DNA, 27 bp, Artificial Sequence
  Description of Artificial Sequence: Synthetic oligonucleotide
ccgccaaagtgtgcctgatgcctgcaa

SEQ ID NO: 245946 - DNA, 27 bp, Artificial Sequence
  Description of Artificial Sequence: Synthetic oligonucleotide
cgccaaagtgtgcctgatgcctgcaac

SEQ ID NO: 245947 - DNA, 27 bp, Artificial Sequence
  Description of Artificial Sequence: Synthetic oligonucleotide
gccaaagtgtgcctgatgcctgcaacc

SEQ ID NO: 245948 - DNA, 27 bp, Artificial Sequence
  Description of Artificial Sequence: Synthetic oligonucleotide
ccaaagtgtgcctgatgcctgcaaccc

SEQ ID NO: 245949 - DNA, 29 bp, Artificial Sequence
  Description of Artificial Sequence: Synthetic oligonucleotide
caaagtgtgcctgatgcctgcaacccttc

SEQ ID NO: 245950 - DNA, 29 bp, Artificial Sequence
  Description of Artificial Sequence: Synthetic oligonucleotide
aaagtgtgcctgatgcctgcaacccttcc

SEQ ID NO: 245951 - DNA, 28 bp, Artificial Sequence
  Description of Artificial Sequence: Synthetic oligonucleotide
aagtgtgcctgatgcctgcaacccttcc

SEQ ID NO: 245952 - DNA, 27 bp, Artificial Sequence
  Description of Artificial Sequence: Synthetic oligonucleotide
agtgtgcctgatgcctgcaacccttcc

SEQ ID NO: 245953 - DNA, 27 bp, Artificial Sequence
  Description of Artificial Sequence: Synthetic oligonucleotide
gtgtgcctgatgcctgcaacccttcca

SEQ ID NO: 245954 - DNA, 27 bp, Artificial Sequence
  Description of Artificial Sequence: Synthetic oligonucleotide
tgtgcctgatgcctgcaacccttccac

SEQ ID NO: 245955 - DNA, 26 bp, Artificial Sequence
  Description of Artificial Sequence: Synthetic oligonucleotide
gtgcctgatgcctgcaacccttccac

SEQ ID NO: 245956 - DNA, 26 bp, Artificial Sequence
  Description of Artificial Sequence: Synthetic oligonucleotide
tgcctgatgcctgcaacccttccacg

SEQ ID NO: 245957 - DNA, 25 bp, Artificial Sequence
  Description of Artificial Sequence: Synthetic oligonucleotide
gcctgatgcctgcaacccttccacg

SEQ ID NO: 245958 - DNA, 25 bp, Artificial Sequence
  Description of Artificial Sequence: Synthetic oligonucleotide
cctgatgcctgcaacccttccacgg

SEQ ID NO: 245959 - DNA, 25 bp, Artificial Sequence
  Description of Artificial Sequence: Synthetic oligonucleotide
ctgatgcctgcaacccttccacggg

SEQ ID NO: 245960 - DNA, 25 bp, Artificial Sequence
  Description of Artificial Sequence: Synthetic oligonucleotide
tgatgcctgcaacccttccacgggc

SEQ ID NO: 245961 - DNA, 24 bp, Artificial Sequence
  Description of Artificial Sequence: Synthetic oligonucleotide
gatgcctgcaacccttccacgggc

SEQ ID NO: 245962 - DNA, 24 bp, Artificial Sequence
  Description of Artificial Sequence: Synthetic oligonucleotide
atgcctgcaacccttccacgggcc

SEQ ID NO: 245963 - DNA, 23 bp, Artificial Sequence
  Description of Artificial Sequence: Synthetic oligonucleotide
tgcctgcaacccttccacgggcc

SEQ ID NO: 245964 - DNA, 22 bp, Artificial Sequence
  Description of Artificial Sequence: Synthetic oligonucleotide
gcctgcaacccttccacgggcc

SEQ ID NO: 245965 - DNA, 22 bp, Artificial Sequence
  Description of Artificial Sequence: Synthetic oligonucleotide
cctgcaacccttccacgggccg

SEQ ID NO: 245966 - DNA, 22 bp, Artificial Sequence
  Description of Artificial Sequence: Synthetic oligonucleotide
ctgcaacccttccacgggccgg

SEQ ID NO: 245967 - DNA, 22 bp, Artificial Sequence
  Description of Artificial Sequence: Synthetic oligonucleotide
tgcaacccttccacgggccggc

SEQ ID NO: 245968 - DNA, 21 bp, Artificial Sequence
  Description of Artificial Sequence: Synthetic oligonucleotide
gcaacccttccacgggccggc

SEQ ID NO: 245969 - DNA, 21 bp, Artificial Sequence
  Description of Artificial Sequence: Synthetic oligonucleotide
caacccttccacgggccggcc

SEQ ID NO: 245970 - DNA, 22 bp, Artificial Sequence
  Description of Artificial Sequence: Synthetic oligonucleotide
aacccttccacgggccggccca

SEQ ID NO: 245971 - DNA, 21 bp, Artificial Sequence
  Description of Artificial Sequence: Synthetic oligonucleotide
acccttccacgggccggccca

SEQ ID NO: 245972 - DNA, 20 bp, Artificial Sequence
  Description of Artificial Sequence: Synthetic oligonucleotide
cccttccacgggccggccca

SEQ ID NO: 245973 - DNA, 20 bp, Artificial Sequence
  Description of Artificial Sequence: Synthetic oligonucleotide
ccttccacgggccggcccag

SEQ ID NO: 245974 - DNA, 20 bp, Artificial Sequence
  Description of Artificial Sequence: Synthetic oligonucleotide
cttccacgggccggcccagg

SEQ ID NO: 245975 - DNA, 20 bp, Artificial Sequence
  Description of Artificial Sequence: Synthetic oligonucleotide
ttccacgggccggcccaggg

SEQ ID NO: 245976 - DNA, 20 bp, Artificial Sequence
  Description of Artificial Sequence: Synthetic oligonucleotide
tccacgggccggcccagggt

SEQ ID NO: 245977 - DNA, 20 bp, Artificial Sequence
  Description of Artificial Sequence: Synthetic oligonucleotide
ccacgggccggcccagggtt

SEQ ID NO: 245978 - DNA, 20 bp, Artificial Sequence
  Description of Artificial Sequence: Synthetic oligonucleotide
cacgggccggcccaggggat

SEQ ID NO: 245979 - DNA, 20 bp, Artificial Sequence
  Description of Artificial Sequence: Synthetic oligonucleotide
acgggccggcccaggggact

SEQ ID NO: 245980 - DNA, 20 bp, Artificial Sequence
  Description of Artificial Sequence: Synthetic oligonucleotide
cgggccggcccaggggactt

SEQ ID NO: 245981 - DNA, 20 bp, Artificial Sequence
  Description of Artificial Sequence: Synthetic oligonucleotide
gggccggcccaggggacgtt

SEQ ID NO: 245982 - DNA, 20 bp, Artificial Sequence
  Description of Artificial Sequence: Synthetic oligonucleotide
ggccggcccaggggacgcat

SEQ ID NO: 245983 - DNA, 20 bp, Artificial Sequence
  Description of Artificial Sequence: Synthetic oligonucleotide
gccggcccaggggacgcact

SEQ ID NO: 245984 - DNA, 20 bp, Artificial Sequence
  Description of Artificial Sequence: Synthetic oligonucleotide
ccggcccaggggacgcacct

SEQ ID NO: 245985 - DNA, 20 bp, Artificial Sequence
  Description of Artificial Sequence: Synthetic oligonucleotide
cggcccaggggacgcaccct

SEQ ID NO: 245986 - DNA, 20 bp, Artificial Sequence
  Description of Artificial Sequence: Synthetic oligonucleotide
ggcccaggggacgcacccct

SEQ ID NO: 245987 - DNA, 20 bp, Artificial Sequence
  Description of Artificial Sequence: Synthetic oligonucleotide
gcccaggggacgcaccccct

SEQ ID NO: 245988 - DNA, 20 bp, Artificial Sequence
  Description of Artificial Sequence: Synthetic oligonucleotide
cccaggggacgcacccccgt

SEQ ID NO: 245989 - DNA, 23 bp, Artificial Sequence
  Description of Artificial Sequence: Synthetic oligonucleotide
ccaggggacgcacccccgcaatt

SEQ ID NO: 245990 - DNA, 23 bp, Artificial Sequence
  Description of Artificial Sequence: Synthetic oligonucleotide
caggggacgcacccccgcaattg

SEQ ID NO: 245991 - DNA, 24 bp, Artificial Sequence
  Description of Artificial Sequence: Synthetic oligonucleotide
aggggacgcacccccgcaattgct

SEQ ID NO: 245992 - DNA, 23 bp, Artificial Sequence
  Description of Artificial Sequence: Synthetic oligonucleotide
ggggacgcacccccgcaattgct

SEQ ID NO: 245993 - DNA, 24 bp, Artificial Sequence
  Description of Artificial Sequence: Synthetic oligonucleotide
gggacgcacccccgcaattgctct

SEQ ID NO: 245994 - DNA, 24 bp, Artificial Sequence
  Description of Artificial Sequence: Synthetic oligonucleotide
ggacgcacccccgcaattgctctc

SEQ ID NO: 245995 - DNA, 24 bp, Artificial Sequence
  Description of Artificial Sequence: Synthetic oligonucleotide
gacgcacccccgcaattgctctcc

SEQ ID NO: 245996 - DNA, 26 bp, Artificial Sequence
  Description of Artificial Sequence: Synthetic oligonucleotide
acgcacccccgcaattgctctccctt

SEQ ID NO: 245997 - DNA, 25 bp, Artificial Sequence
  Description of Artificial Sequence: Synthetic oligonucleotide
cgcacccccgcaattgctctccctt

SEQ ID NO: 245998 - DNA, 26 bp, Artificial Sequence
  Description of Artificial Sequence: Synthetic oligonucleotide
gcacccccgcaattgctctcccttgt

SEQ ID NO: 245999 - DNA, 27 bp, Artificial Sequence
  Description of Artificial Sequence: Synthetic oligonucleotide
cacccccgcaattgctctcccttgtgt

SEQ ID NO: 246000 - DNA, 27 bp, Artificial Sequence
  Description of Artificial Sequence: Synthetic oligonucleotide
acccccgcaattgctctcccttgtgtc

SEQ ID NO: 246001 - DNA, 26 bp, Artificial Sequence
  Description of Artificial Sequence: Synthetic oligonucleotide
cccccgcaattgctctcccttgtgtc

SEQ ID NO: 246002 - DNA, 26 bp, Artificial Sequence
  Description of Artificial Sequence: Synthetic oligonucleotide
ccccgcaattgctctcccttgtgtcg

SEQ ID NO: 246003 - DNA, 27 bp, Artificial Sequence
  Description of Artificial Sequence: Synthetic oligonucleotide
cccgcaattgctctcccttgtgtcgca

SEQ ID NO: 246004 - DNA, 27 bp, Artificial Sequence
  Description of Artificial Sequence: Synthetic oligonucleotide
ccgcaattgctctcccttgtgtcgcac

SEQ ID NO: 246005 - DNA, 29 bp, Artificial Sequence
  Description of Artificial Sequence: Synthetic oligonucleotide
cgcaattgctctcccttgtgtcgcacttc

SEQ ID NO: 246006 - DNA, 31 bp, Artificial Sequence
  Description of Artificial Sequence: Synthetic oligonucleotide
gcaattgctctcccttgtgtcgcacttctac

SEQ ID NO: 246007 - DNA, 31 bp, Artificial Sequence
  Description of Artificial Sequence: Synthetic oligonucleotide
caattgctctcccttgtgtcgcacttctacg

SEQ ID NO: 246008 - DNA, 31 bp, Artificial Sequence
  Description of Artificial Sequence: Synthetic oligonucleotide
aattgctctcccttgtgtcgcacttctacgc

SEQ ID NO: 246009 - DNA, 30 bp, Artificial Sequence
  Description of Artificial Sequence: Synthetic oligonucleotide
attgctctcccttgtgtcgcacttctacgc

SEQ ID NO: 246010 - DNA, 29 bp, Artificial Sequence
  Description of Artificial Sequence: Synthetic oligonucleotide
ttgctctcccttgtgtcgcacttctacgc

SEQ ID NO: 246011 - DNA, 28 bp, Artificial Sequence
  Description of Artificial Sequence: Synthetic oligonucleotide
tgctctcccttgtgtcgcacttctacgc

SEQ ID NO: 246012 - DNA, 27 bp, Artificial Sequence
  Description of Artificial Sequence: Synthetic oligonucleotide
gctctcccttgtgtcgcacttctacgc

SEQ ID NO: 246013 - DNA, 29 bp, Artificial Sequence
  Description of Artificial Sequence: Synthetic oligonucleotide
ctctcccttgtgtcgcacttctacgcttc

SEQ ID NO: 246014 - DNA, 30 bp, Artificial Sequence
  Description of Artificial Sequence: Synthetic oligonucleotide
tctcccttgtgtcgcacttctacgcttctg

SEQ ID NO: 246015 - DNA, 29 bp, Artificial Sequence
  Description of Artificial Sequence: Synthetic oligonucleotide
ctcccttgtgtcgcacttctacgcttctg

SEQ ID NO: 246016 - DNA, 29 bp, Artificial Sequence
  Description of Artificial Sequence: Synthetic oligonucleotide
tcccttgtgtcgcacttctacgcttctgg

SEQ ID NO: 246017 - DNA, 28 bp, Artificial Sequence
  Description of Artificial Sequence: Synthetic oligonucleotide
cccttgtgtcgcacttctacgcttctgg

SEQ ID NO: 246018 - DNA, 28 bp, Artificial Sequence
  Description of Artificial Sequence: Synthetic oligonucleotide
ccttgtgtcgcacttctacgcttctggg

SEQ ID NO: 246019 - DNA, 28 bp, Artificial Sequence
  Description of Artificial Sequence: Synthetic oligonucleotide
cttgtgtcgcacttctacgcttctgggg

SEQ ID NO: 246020 - DNA, 28 bp, Artificial Sequence
  Description of Artificial Sequence: Synthetic oligonucleotide
ttgtgtcgcacttctacgcttctggggc

SEQ ID NO: 246021 - DNA, 27 bp, Artificial Sequence
  Description of Artificial Sequence: Synthetic oligonucleotide
tgtgtcgcacttctacgcttctggggc

SEQ ID NO: 246022 - DNA, 26 bp, Artificial Sequence
  Description of Artificial Sequence: Synthetic oligonucleotide
gtgtcgcacttctacgcttctggggc

SEQ ID NO: 246023 - DNA, 26 bp, Artificial Sequence
  Description of Artificial Sequence: Synthetic oligonucleotide
tgtcgcacttctacgcttctggggcc

SEQ ID NO: 246024 - DNA, 25 bp, Artificial Sequence
  Description of Artificial Sequence: Synthetic oligonucleotide
gtcgcacttctacgcttctggggcc

SEQ ID NO: 246025 - DNA, 26 bp, Artificial Sequence
  Description of Artificial Sequence: Synthetic oligonucleotide
tcgcacttctacgcttctggggccct

SEQ ID NO: 246026 - DNA, 25 bp, Artificial Sequence
  Description of Artificial Sequence: Synthetic oligonucleotide
cgcacttctacgcttctggggccct

SEQ ID NO: 246027 - DNA, 25 bp, Artificial Sequence
  Description of Artificial Sequence: Synthetic oligonucleotide
gcacttctacgcttctggggccctg

SEQ ID NO: 246028 - DNA, 26 bp, Artificial Sequence
  Description of Artificial Sequence: Synthetic oligonucleotide
cacttctacgcttctggggccctgga

SEQ ID NO: 246029 - DNA, 26 bp, Artificial Sequence
  Description of Artificial Sequence: Synthetic oligonucleotide
acttctacgcttctggggccctggag

SEQ ID NO: 246030 - DNA, 25 bp, Artificial Sequence
  Description of Artificial Sequence: Synthetic oligonucleotide
cttctacgcttctggggccctggag

SEQ ID NO: 246031 - DNA, 26 bp, Artificial Sequence
  Description of Artificial Sequence: Synthetic oligonucleotide
ttctacgcttctggggccctggaggt

SEQ ID NO: 246032 - DNA, 25 bp, Artificial Sequence
  Description of Artificial Sequence: Synthetic oligonucleotide
tctacgcttctggggccctggaggt

SEQ ID NO: 246033 - DNA, 24 bp, Artificial Sequence
  Description of Artificial Sequence: Synthetic oligonucleotide
ctacgcttctggggccctggaggt

SEQ ID NO: 246034 - DNA, 24 bp, Artificial Sequence
  Description of Artificial Sequence: Synthetic oligonucleotide
tacgcttctggggccctggaggtc

SEQ ID NO: 246035 - DNA, 23 bp, Artificial Sequence
  Description of Artificial Sequence: Synthetic oligonucleotide
acgcttctggggccctggaggtc

SEQ ID NO: 246036 - DNA, 22 bp, Artificial Sequence
  Description of Artificial Sequence: Synthetic oligonucleotide
cgcttctggggccctggaggtc

SEQ ID NO: 246037 - DNA, 23 bp, Artificial Sequence
  Description of Artificial Sequence: Synthetic oligonucleotide
gcttctggggccctggaggtcga

SEQ ID NO: 246038 - DNA, 24 bp, Artificial Sequence
  Description of Artificial Sequence: Synthetic oligonucleotide
cttctggggccctggaggtcgagt

SEQ ID NO: 246039 - DNA, 24 bp, Artificial Sequence
  Description of Artificial Sequence: Synthetic oligonucleotide
ttctggggccctggaggtcgagtg

SEQ ID NO: 246040 - DNA, 23 bp, Artificial Sequence
  Description of Artificial Sequence: Synthetic oligonucleotide
tctggggccctggaggtcgagtg

SEQ ID NO: 246041 - DNA, 22 bp, Artificial Sequence
  Description of Artificial Sequence: Synthetic oligonucleotide
ctggggccctggaggtcgagtg

SEQ ID NO: 246042 - DNA, 22 bp, Artificial Sequence
  Description of Artificial Sequence: Synthetic oligonucleotide
tggggccctggaggtcgagtgg

SEQ ID NO: 246043 - DNA, 21 bp, Artificial Sequence
  Description of Artificial Sequence: Synthetic oligonucleotide
ggggccctggaggtcgagtgg

SEQ ID NO: 246044 - DNA, 23 bp, Artificial Sequence
  Description of Artificial Sequence: Synthetic oligonucleotide
gggccctggaggtcgagtgggaa

SEQ ID NO: 246045 - DNA, 24 bp, Artificial Sequence
  Description of Artificial Sequence: Synthetic oligonucleotide
ggccctggaggtcgagtgggaagt

SEQ ID NO: 246046 - DNA, 24 bp, Artificial Sequence
  Description of Artificial Sequence: Synthetic oligonucleotide
gccctggaggtcgagtgggaagtc

SEQ ID NO: 246047 - DNA, 24 bp, Artificial Sequence
  Description of Artificial Sequence: Synthetic oligonucleotide
ccctggaggtcgagtgggaagtcc

SEQ ID NO: 246048 - DNA, 24 bp, Artificial Sequence
  Description of Artificial Sequence: Synthetic oligonucleotide
cctggaggtcgagtgggaagtccg

SEQ ID NO: 246049 - DNA, 24 bp, Artificial Sequence
  Description of Artificial Sequence: Synthetic oligonucleotide
ctggaggtcgagtgggaagtccgg

SEQ ID NO: 246050 - DNA, 24 bp, Artificial Sequence
  Description of Artificial Sequence: Synthetic oligonucleotide
tggaggtcgagtgggaagtccggg

SEQ ID NO: 246051 - DNA, 23 bp, Artificial Sequence
  Description of Artificial Sequence: Synthetic oligonucleotide
ggaggtcgagtgggaagtccggg

SEQ ID NO: 246052 - DNA, 24 bp, Artificial Sequence
  Description of Artificial Sequence: Synthetic oligonucleotide
gaggtcgagtgggaagtccggggt

SEQ ID NO: 246053 - DNA, 24 bp, Artificial Sequence
  Description of Artificial Sequence: Synthetic oligonucleotide
aggtcgagtgggaagtccggggtg

SEQ ID NO: 246054 - DNA, 23 bp, Artificial Sequence
  Description of Artificial Sequence: Synthetic oligonucleotide
ggtcgagtgggaagtccggggtg

SEQ ID NO: 246055 - DNA, 23 bp, Artificial Sequence
  Description of Artificial Sequence: Synthetic oligonucleotide
gtcgagtgggaagtccggggtgc

SEQ ID NO: 246056 - DNA, 23 bp, Artificial Sequence
  Description of Artificial Sequence: Synthetic oligonucleotide
tcgagtgggaagtccggggtgcc

SEQ ID NO: 246057 - DNA, 22 bp, Artificial Sequence
  Description of Artificial Sequence: Synthetic oligonucleotide
cgagtgggaagtccggggtgcc

SEQ ID NO: 246058 - DNA, 22 bp, Artificial Sequence
  Description of Artificial Sequence: Synthetic oligonucleotide
gagtgggaagtccggggtgccc

SEQ ID NO: 246059 - DNA, 23 bp, Artificial Sequence
  Description of Artificial Sequence: Synthetic oligonucleotide
agtgggaagtccggggtgcccca

SEQ ID NO: 246060 - DNA, 22 bp, Artificial Sequence
  Description of Artificial Sequence: Synthetic oligonucleotide
gtgggaagtccggggtgcccca

SEQ ID NO: 246061 - DNA, 22 bp, Artificial Sequence
  Description of Artificial Sequence: Synthetic oligonucleotide
tgggaagtccggggtgccccag

SEQ ID NO: 246062 - DNA, 21 bp, Artificial Sequence
  Description of Artificial Sequence: Synthetic oligonucleotide
gggaagtccggggtgccccag

SEQ ID NO: 246063 - DNA, 21 bp, Artificial Sequence
  Description of Artificial Sequence: Synthetic oligonucleotide
ggaagtccggggtgccccagg

SEQ ID NO: 246064 - DNA, 21 bp, Artificial Sequence
  Description of Artificial Sequence: Synthetic oligonucleotide
gaagtccggggtgccccaggg

SEQ ID NO: 246065 - DNA, 21 bp, Artificial Sequence
  Description of Artificial Sequence: Synthetic oligonucleotide
aagtccggggtgccccagggg

SEQ ID NO: 246066 - DNA, 20 bp, Artificial Sequence
  Description of Artificial Sequence: Synthetic oligonucleotide
agtccggggtgccccagggg

SEQ ID NO: 246067 - DNA, 20 bp, Artificial Sequence
  Description of Artificial Sequence: Synthetic oligonucleotide
gtccggggtgccccaggggt

SEQ ID NO: 246068 - DNA, 20 bp, Artificial Sequence
  Description of Artificial Sequence: Synthetic oligonucleotide
tccggggtgccccagggggt

SEQ ID NO: 246069 - DNA, 20 bp, Artificial Sequence
  Description of Artificial Sequence: Synthetic oligonucleotide
ccggggtgccccagggggtt

SEQ ID NO: 246070 - DNA, 20 bp, Artificial Sequence
  Description of Artificial Sequence: Synthetic oligonucleotide
cggggtgccccaggggggtt

SEQ ID NO: 246071 - DNA, 20 bp, Artificial Sequence
  Description of Artificial Sequence: Synthetic oligonucleotide
ggggtgccccaggggggctt

SEQ ID NO: 246072 - DNA, 20 bp, Artificial Sequence
  Description of Artificial Sequence: Synthetic oligonucleotide
gggtgccccaggggggcgtt

SEQ ID NO: 246073 - DNA, 20 bp, Artificial Sequence
  Description of Artificial Sequence: Synthetic oligonucleotide
ggtgccccaggggggcgctt

SEQ ID NO: 246074 - DNA, 20 bp, Artificial Sequence
  Description of Artificial Sequence: Synthetic oligonucleotide
gtgccccaggggggcgctct

SEQ ID NO: 246075 - DNA, 21 bp, Artificial Sequence
  Description of Artificial Sequence: Synthetic oligonucleotide
tgccccaggggggcgctctca

SEQ ID NO: 246076 - DNA, 20 bp, Artificial Sequence
  Description of Artificial Sequence: Synthetic oligonucleotide
gccccaggggggcgctctca

SEQ ID NO: 246077 - DNA, 22 bp, Artificial Sequence
  Description of Artificial Sequence: Synthetic oligonucleotide
ccccaggggggcgctctcagta

SEQ ID NO: 246078 - DNA, 22 bp, Artificial Sequence
  Description of Artificial Sequence: Synthetic oligonucleotide
cccaggggggcgctctcagtag

SEQ ID NO: 246079 - DNA, 22 bp, Artificial Sequence
  Description of Artificial Sequence: Synthetic oligonucleotide
ccaggggggcgctctcagtagg

SEQ ID NO: 246080 - DNA, 22 bp, Artificial Sequence
  Description of Artificial Sequence: Synthetic oligonucleotide
caggggggcgctctcagtaggc

SEQ ID NO: 246081 - DNA, 22 bp, Artificial Sequence
  Description of Artificial Sequence: Synthetic oligonucleotide
aggggggcgctctcagtaggcc

SEQ ID NO: 246082 - DNA, 21 bp, Artificial Sequence
  Description of Artificial Sequence: Synthetic oligonucleotide
ggggggcgctctcagtaggcc

SEQ ID NO: 246083 - DNA, 22 bp, Artificial Sequence
  Description of Artificial Sequence: Synthetic oligonucleotide
gggggcgctctcagtaggccga

SEQ ID NO: 246084 - DNA, 22 bp, Artificial Sequence
  Description of Artificial Sequence: Synthetic oligonucleotide
ggggcgctctcagtaggccgag

SEQ ID NO: 246085 - DNA, 22 bp, Artificial Sequence
  Description of Artificial Sequence: Synthetic oligonucleotide
gggcgctctcagtaggccgagg

SEQ ID NO: 246086 - DNA, 22 bp, Artificial Sequence
  Description of Artificial Sequence: Synthetic oligonucleotide
ggcgctctcagtaggccgaggc

SEQ ID NO: 246087 - DNA, 22 bp, Artificial Sequence
  Description of Artificial Sequence: Synthetic oligonucleotide
gcgctctcagtaggccgaggcg

SEQ ID NO: 246088 - DNA, 23 bp, Artificial Sequence
  Description of Artificial Sequence: Synthetic oligonucleotide
cgctctcagtaggccgaggcgca

SEQ ID NO: 246089 - DNA, 24 bp, Artificial Sequence
  Description of Artificial Sequence: Synthetic oligonucleotide
gctctcagtaggccgaggcgcaga

SEQ ID NO: 246090 - DNA, 24 bp, Artificial Sequence
  Description of Artificial Sequence: Synthetic oligonucleotide
ctctcagtaggccgaggcgcagag

SEQ ID NO: 246091 - DNA, 25 bp, Artificial Sequence
  Description of Artificial Sequence: Synthetic oligonucleotide
tctcagtaggccgaggcgcagaggt

SEQ ID NO: 246092 - DNA, 24 bp, Artificial Sequence
  Description of Artificial Sequence: Synthetic oligonucleotide
ctcagtaggccgaggcgcagaggt

SEQ ID NO: 246093 - DNA, 24 bp, Artificial Sequence
  Description of Artificial Sequence: Synthetic oligonucleotide
tcagtaggccgaggcgcagaggtg

SEQ ID NO: 246094 - DNA, 23 bp, Artificial Sequence
  Description of Artificial Sequence: Synthetic oligonucleotide
cagtaggccgaggcgcagaggtg

SEQ ID NO: 246095 - DNA, 23 bp, Artificial Sequence
  Description of Artificial Sequence: Synthetic oligonucleotide
agtaggccgaggcgcagaggtgc

SEQ ID NO: 246096 - DNA, 22 bp, Artificial Sequence
  Description of Artificial Sequence: Synthetic oligonucleotide
gtaggccgaggcgcagaggtgc

SEQ ID NO: 246097 - DNA, 23 bp, Artificial Sequence
  Description of Artificial Sequence: Synthetic oligonucleotide
taggccgaggcgcagaggtgcct

SEQ ID NO: 246098 - DNA, 22 bp, Artificial Sequence
  Description of Artificial Sequence: Synthetic oligonucleotide
aggccgaggcgcagaggtgcct

SEQ ID NO: 246099 - DNA, 21 bp, Artificial Sequence
  Description of Artificial Sequence: Synthetic oligonucleotide
ggccgaggcgcagaggtgcct

SEQ ID NO: 246100 - DNA, 22 bp, Artificial Sequence
  Description of Artificial Sequence: Synthetic oligonucleotide
gccgaggcgcagaggtgcctct

SEQ ID NO: 246101 - DNA, 22 bp, Artificial Sequence
  Description of Artificial Sequence: Synthetic oligonucleotide
ccgaggcgcagaggtgcctctc

SEQ ID NO: 246102 - DNA, 22 bp, Artificial Sequence
  Description of Artificial Sequence: Synthetic oligonucleotide
cgaggcgcagaggtgcctctcg

SEQ ID NO: 246103 - DNA, 22 bp, Artificial Sequence
  Description of Artificial Sequence: Synthetic oligonucleotide
gaggcgcagaggtgcctctcgg

SEQ ID NO: 246104 - DNA, 22 bp, Artificial Sequence
  Description of Artificial Sequence: Synthetic oligonucleotide
aggcgcagaggtgcctctcggc

SEQ ID NO: 246105 - DNA, 21 bp, Artificial Sequence
  Description of Artificial Sequence: Synthetic oligonucleotide
ggcgcagaggtgcctctcggc

SEQ ID NO: 246106 - DNA, 21 bp, Artificial Sequence
  Description of Artificial Sequence: Synthetic oligonucleotide
gcgcagaggtgcctctcggcc

SEQ ID NO: 246107 - DNA, 22 bp, Artificial Sequence
  Description of Artificial Sequence: Synthetic oligonucleotide
cgcagaggtgcctctcggccgt

SEQ ID NO: 246108 - DNA, 22 bp, Artificial Sequence
  Description of Artificial Sequence: Synthetic oligonucleotide
gcagaggtgcctctcggccgtg

SEQ ID NO: 246109 - DNA, 22 bp, Artificial Sequence
  Description of Artificial Sequence: Synthetic oligonucleotide
cagaggtgcctctcggccgtgc

SEQ ID NO: 246110 - DNA, 22 bp, Artificial Sequence
  Description of Artificial Sequence: Synthetic oligonucleotide
agaggtgcctctcggccgtgcg

SEQ ID NO: 246111 - DNA, 21 bp, Artificial Sequence
  Description of Artificial Sequence: Synthetic oligonucleotide
gaggtgcctctcggccgtgcg

SEQ ID NO: 246112 - DNA, 21 bp, Artificial Sequence
  Description of Artificial Sequence: Synthetic oligonucleotide
aggtgcctctcggccgtgcgc

SEQ ID NO: 246113 - DNA, 20 bp, Artificial Sequence
  Description of Artificial Sequence: Synthetic oligonucleotide
ggtgcctctcggccgtgcgc

SEQ ID NO: 246114 - DNA, 21 bp, Artificial Sequence
  Description of Artificial Sequence: Synthetic oligonucleotide
gtgcctctcggccgtgcgcca

SEQ ID NO: 246115 - DNA, 21 bp, Artificial Sequence
  Description of Artificial Sequence: Synthetic oligonucleotide
tgcctctcggccgtgcgccac

SEQ ID NO: 246116 - DNA, 20 bp, Artificial Sequence
  Description of Artificial Sequence: Synthetic oligonucleotide
gcctctcggccgtgcgccac

SEQ ID NO: 246117 - DNA, 23 bp, Artificial Sequence
  Description of Artificial Sequence: Synthetic oligonucleotide
cctctcggccgtgcgccaccttt

SEQ ID NO: 246118 - DNA, 23 bp, Artificial Sequence
  Description of Artificial Sequence: Synthetic oligonucleotide
ctctcggccgtgcgccacctttc

SEQ ID NO: 246119 - DNA, 23 bp, Artificial Sequence
  Description of Artificial Sequence: Synthetic oligonucleotide
tctcggccgtgcgccacctttcc

SEQ ID NO: 246120 - DNA, 22 bp, Artificial Sequence
  Description of Artificial Sequence: Synthetic oligonucleotide
ctcggccgtgcgccacctttcc

SEQ ID NO: 246121 - DNA, 24 bp, Artificial Sequence
  Description of Artificial Sequence: Synthetic oligonucleotide
tcggccgtgcgccacctttccgat

SEQ ID NO: 246122 - DNA, 23 bp, Artificial Sequence
  Description of Artificial Sequence: Synthetic oligonucleotide
cggccgtgcgccacctttccgat

SEQ ID NO: 246123 - DNA, 23 bp, Artificial Sequence
  Description of Artificial Sequence: Synthetic oligonucleotide
ggccgtgcgccacctttccgatg

SEQ ID NO: 246124 - DNA, 23 bp, Artificial Sequence
  Description of Artificial Sequence: Synthetic oligonucleotide
gccgtgcgccacctttccgatgg

SEQ ID NO: 246125 - DNA, 24 bp, Artificial Sequence
  Description of Artificial Sequence: Synthetic oligonucleotide
ccgtgcgccacctttccgatgggt

SEQ ID NO: 246126 - DNA, 25 bp, Artificial Sequence
  Description of Artificial Sequence: Synthetic oligonucleotide
cgtgcgccacctttccgatgggtct

SEQ ID NO: 246127 - DNA, 26 bp, Artificial Sequence
  Description of Artificial Sequence: Synthetic oligonucleotide
gtgcgccacctttccgatgggtctgt

SEQ ID NO: 246128 - DNA, 27 bp, Artificial Sequence
  Description of Artificial Sequence: Synthetic oligonucleotide
tgcgccacctttccgatgggtctgtca

SEQ ID NO: 246129 - DNA, 26 bp, Artificial Sequence
  Description of Artificial Sequence: Synthetic oligonucleotide
gcgccacctttccgatgggtctgtca

SEQ ID NO: 246130 - DNA, 26 bp, Artificial Sequence
  Description of Artificial Sequence: Synthetic oligonucleotide
cgccacctttccgatgggtctgtcag

SEQ ID NO: 246131 - DNA, 26 bp, Artificial Sequence
  Description of Artificial Sequence: Synthetic oligonucleotide
gccacctttccgatgggtctgtcagc

SEQ ID NO: 246132 - DNA, 27 bp, Artificial Sequence
  Description of Artificial Sequence: Synthetic oligonucleotide
ccacctttccgatgggtctgtcagcgt

SEQ ID NO: 246133 - DNA, 27 bp, Artificial Sequence
  Description of Artificial Sequence: Synthetic oligonucleotide
cacctttccgatgggtctgtcagcgtc

SEQ ID NO: 246134 - DNA, 28 bp, Artificial Sequence
  Description of Artificial Sequence: Synthetic oligonucleotide
acctttccgatgggtctgtcagcgtctc

SEQ ID NO: 246135 - DNA, 27 bp, Artificial Sequence
  Description of Artificial Sequence: Synthetic oligonucleotide
cctttccgatgggtctgtcagcgtctc

SEQ ID NO: 246136 - DNA, 28 bp, Artificial Sequence
  Description of Artificial Sequence: Synthetic oligonucleotide
ctttccgatgggtctgtcagcgtctctg

SEQ ID NO: 246137 - DNA, 28 bp, Artificial Sequence
  Description of Artificial Sequence: Synthetic oligonucleotide
tttccgatgggtctgtcagcgtctctgg

SEQ ID NO: 246138 - DNA, 27 bp, Artificial Sequence
  Description of Artificial Sequence: Synthetic oligonucleotide
ttccgatgggtctgtcagcgtctctgg

SEQ ID NO: 246139 - DNA, 26 bp, Artificial Sequence
  Description of Artificial Sequence: Synthetic oligonucleotide
tccgatgggtctgtcagcgtctctgg

SEQ ID NO: 246140 - DNA, 25 bp, Artificial Sequence
  Description of Artificial Sequence: Synthetic oligonucleotide
ccgatgggtctgtcagcgtctctgg

SEQ ID NO: 246141 - DNA, 25 bp, Artificial Sequence
  Description of Artificial Sequence: Synthetic oligonucleotide
cgatgggtctgtcagcgtctctggg

SEQ ID NO: 246142 - DNA, 26 bp, Artificial Sequence
  Description of Artificial Sequence: Synthetic oligonucleotide
gatgggtctgtcagcgtctctgggct

SEQ ID NO: 246143 - DNA, 27 bp, Artificial Sequence
  Description of Artificial Sequence: Synthetic oligonucleotide
atgggtctgtcagcgtctctgggctct

SEQ ID NO: 246144 - DNA, 27 bp, Artificial Sequence
  Description of Artificial Sequence: Synthetic oligonucleotide
tgggtctgtcagcgtctctgggctctt

SEQ ID NO: 246145 - DNA, 26 bp, Artificial Sequence
  Description of Artificial Sequence: Synthetic oligonucleotide
gggtctgtcagcgtctctgggctctt

SEQ ID NO: 246146 - DNA, 26 bp, Artificial Sequence
  Description of Artificial Sequence: Synthetic oligonucleotide
ggtctgtcagcgtctctgggctcttg

SEQ ID NO: 246147 - DNA, 27 bp, Artificial Sequence
  Description of Artificial Sequence: Synthetic oligonucleotide
gtctgtcagcgtctctgggctcttgca

SEQ ID NO: 246148 - DNA, 27 bp, Artificial Sequence
  Description of Artificial Sequence: Synthetic oligonucleotide
tctgtcagcgtctctgggctcttgcag

SEQ ID NO: 246149 - DNA, 26 bp, Artificial Sequence
  Description of Artificial Sequence: Synthetic oligonucleotide
ctgtcagcgtctctgggctcttgcag

SEQ ID NO: 246150 - DNA, 26 bp, Artificial Sequence
  Description of Artificial Sequence: Synthetic oligonucleotide
tgtcagcgtctctgggctcttgcagc

SEQ ID NO: 246151 - DNA, 25 bp, Artificial Sequence
  Description of Artificial Sequence: Synthetic oligonucleotide
gtcagcgtctctgggctcttgcagc

SEQ ID NO: 246152 - DNA, 25 bp, Artificial Sequence
  Description of Artificial Sequence: Synthetic oligonucleotide
tcagcgtctctgggctcttgcagcc

SEQ ID NO: 246153 - DNA, 24 bp, Artificial Sequence
  Description of Artificial Sequence: Synthetic oligonucleotide
cagcgtctctgggctcttgcagcc

SEQ ID NO: 246154 - DNA, 24 bp, Artificial Sequence
  Description of Artificial Sequence: Synthetic oligonucleotide
agcgtctctgggctcttgcagccc

SEQ ID NO: 246155 - DNA, 23 bp, Artificial Sequence
  Description of Artificial Sequence: Synthetic oligonucleotide
gcgtctctgggctcttgcagccc

SEQ ID NO: 246156 - DNA, 23 bp, Artificial Sequence
  Description of Artificial Sequence: Synthetic oligonucleotide
cgtctctgggctcttgcagcccc

SEQ ID NO: 246157 - DNA, 23 bp, Artificial Sequence
  Description of Artificial Sequence: Synthetic oligonucleotide
gtctctgggctcttgcagccccc

SEQ ID NO: 246158 - DNA, 23 bp, Artificial Sequence
  Description of Artificial Sequence: Synthetic oligonucleotide
tctctgggctcttgcagcccccc

SEQ ID NO: 246159 - DNA, 22 bp, Artificial Sequence
  Description of Artificial Sequence: Synthetic oligonucleotide
ctctgggctcttgcagcccccc

SEQ ID NO: 246160 - DNA, 22 bp, Artificial Sequence
  Description of Artificial Sequence: Synthetic oligonucleotide
tctgggctcttgcagccccccc

SEQ ID NO: 246161 - DNA, 21 bp, Artificial Sequence
  Description of Artificial Sequence: Synthetic oligonucleotide
ctgggctcttgcagccccccc

SEQ ID NO: 246162 - DNA, 22 bp, Artificial Sequence
  Description of Artificial Sequence: Synthetic oligonucleotide
tgggctcttgcagcccccccca

SEQ ID NO: 246163 - DNA, 21 bp, Artificial Sequence
  Description of Artificial Sequence: Synthetic oligonucleotide
gggctcttgcagcccccccca

SEQ ID NO: 246164 - DNA, 22 bp, Artificial Sequence
  Description of Artificial Sequence: Synthetic oligonucleotide
ggctcttgcagccccccccagt

SEQ ID NO: 246165 - DNA, 23 bp, Artificial Sequence
  Description of Artificial Sequence: Synthetic oligonucleotide
gctcttgcagccccccccagtct

SEQ ID NO: 246166 - DNA, 23 bp, Artificial Sequence
  Description of Artificial Sequence: Synthetic oligonucleotide
ctcttgcagccccccccagtctc

SEQ ID NO: 246167 - DNA, 24 bp, Artificial Sequence
  Description of Artificial Sequence: Synthetic oligonucleotide
tcttgcagccccccccagtctcca

SEQ ID NO: 246168 - DNA, 23 bp, Artificial Sequence
  Description of Artificial Sequence: Synthetic oligonucleotide
cttgcagccccccccagtctcca

SEQ ID NO: 246169 - DNA, 24 bp, Artificial Sequence
  Description of Artificial Sequence: Synthetic oligonucleotide
ttgcagccccccccagtctccact

SEQ ID NO: 246170 - DNA, 23 bp, Artificial Sequence
  Description of Artificial Sequence: Synthetic oligonucleotide
tgcagccccccccagtctccact

SEQ ID NO: 246171 - DNA, 22 bp, Artificial Sequence
  Description of Artificial Sequence: Synthetic oligonucleotide
gcagccccccccagtctccact

SEQ ID NO: 246172 - DNA, 23 bp, Artificial Sequence
  Description of Artificial Sequence: Synthetic oligonucleotide
cagccccccccagtctccactga

SEQ ID NO: 246173 - DNA, 23 bp, Artificial Sequence
  Description of Artificial Sequence: Synthetic oligonucleotide
agccccccccagtctccactgag

SEQ ID NO: 246174 - DNA, 22 bp, Artificial Sequence
  Description of Artificial Sequence: Synthetic oligonucleotide
gccccccccagtctccactgag

SEQ ID NO: 246175 - DNA, 23 bp, Artificial Sequence
  Description of Artificial Sequence: Synthetic oligonucleotide
ccccccccagtctccactgagct

SEQ ID NO: 246176 - DNA, 23 bp, Artificial Sequence
  Description of Artificial Sequence: Synthetic oligonucleotide
cccccccagtctccactgagctg

SEQ ID NO: 246177 - DNA, 25 bp, Artificial Sequence
  Description of Artificial Sequence: Synthetic oligonucleotide
ccccccagtctccactgagctgcat

SEQ ID NO: 246178 - DNA, 25 bp, Artificial Sequence
  Description of Artificial Sequence: Synthetic oligonucleotide
cccccagtctccactgagctgcatg

SEQ ID NO: 246179 - DNA, 25 bp, Artificial Sequence
  Description of Artificial Sequence: Synthetic oligonucleotide
ccccagtctccactgagctgcatgg

SEQ ID NO: 246180 - DNA, 25 bp, Artificial Sequence
  Description of Artificial Sequence: Synthetic oligonucleotide
cccagtctccactgagctgcatggg

SEQ ID NO: 246181 - DNA, 25 bp, Artificial Sequence
  Description of Artificial Sequence: Synthetic oligonucleotide
ccagtctccactgagctgcatgggg

SEQ ID NO: 246182 - DNA, 26 bp, Artificial Sequence
  Description of Artificial Sequence: Synthetic oligonucleotide
cagtctccactgagctgcatggggct

SEQ ID NO: 246183 - DNA, 26 bp, Artificial Sequence
  Description of Artificial Sequence: Synthetic oligonucleotide
agtctccactgagctgcatggggctc

SEQ ID NO: 246184 - DNA, 25 bp, Artificial Sequence
  Description of Artificial Sequence: Synthetic oligonucleotide
gtctccactgagctgcatggggctc

SEQ ID NO: 246185 - DNA, 25 bp, Artificial Sequence
  Description of Artificial Sequence: Synthetic oligonucleotide
tctccactgagctgcatggggctcg

SEQ ID NO: 246186 - DNA, 24 bp, Artificial Sequence
  Description of Artificial Sequence: Synthetic oligonucleotide
ctccactgagctgcatggggctcg

SEQ ID NO: 246187 - DNA, 27 bp, Artificial Sequence
  Description of Artificial Sequence: Synthetic oligonucleotide
tccactgagctgcatggggctcgctat

SEQ ID NO: 246188 - DNA, 26 bp, Artificial Sequence
  Description of Artificial Sequence: Synthetic oligonucleotide
ccactgagctgcatggggctcgctat

SEQ ID NO: 246189 - DNA, 26 bp, Artificial Sequence
  Description of Artificial Sequence: Synthetic oligonucleotide
cactgagctgcatggggctcgctatg

SEQ ID NO: 246190 - DNA, 26 bp, Artificial Sequence
  Description of Artificial Sequence: Synthetic oligonucleotide
actgagctgcatggggctcgctatgc

SEQ ID NO: 246191 - DNA, 25 bp, Artificial Sequence
  Description of Artificial Sequence: Synthetic oligonucleotide
ctgagctgcatggggctcgctatgc

SEQ ID NO: 246192 - DNA, 26 bp, Artificial Sequence
  Description of Artificial Sequence: Synthetic oligonucleotide
tgagctgcatggggctcgctatgcca

SEQ ID NO: 246193 - DNA, 25 bp, Artificial Sequence
  Description of Artificial Sequence: Synthetic oligonucleotide
gagctgcatggggctcgctatgcca

SEQ ID NO: 246194 - DNA, 26 bp, Artificial Sequence
  Description of Artificial Sequence: Synthetic oligonucleotide
agctgcatggggctcgctatgccagt

SEQ ID NO: 246195 - DNA, 25 bp, Artificial Sequence
  Description of Artificial Sequence: Synthetic oligonucleotide
gctgcatggggctcgctatgccagt

SEQ ID NO: 246196 - DNA, 25 bp, Artificial Sequence
  Description of Artificial Sequence: Synthetic oligonucleotide
ctgcatggggctcgctatgccagtc

SEQ ID NO: 246197 - DNA, 27 bp, Artificial Sequence
  Description of Artificial Sequence: Synthetic oligonucleotide
tgcatggggctcgctatgccagtcgaa

SEQ ID NO: 246198 - DNA, 27 bp, Artificial Sequence
  Description of Artificial Sequence: Synthetic oligonucleotide
gcatggggctcgctatgccagtcgaat

SEQ ID NO: 246199 - DNA, 28 bp, Artificial Sequence
  Description of Artificial Sequence: Synthetic oligonucleotide
catggggctcgctatgccagtcgaattc

SEQ ID NO: 246200 - DNA, 29 bp, Artificial Sequence
  Description of Artificial Sequence: Synthetic oligonucleotide
atggggctcgctatgccagtcgaattctc

SEQ ID NO: 246201 - DNA, 28 bp, Artificial Sequence
  Description of Artificial Sequence: Synthetic oligonucleotide
tggggctcgctatgccagtcgaattctc

SEQ ID NO: 246202 - DNA, 27 bp, Artificial Sequence
  Description of Artificial Sequence: Synthetic oligonucleotide
ggggctcgctatgccagtcgaattctc

SEQ ID NO: 246203 - DNA, 27 bp, Artificial Sequence
  Description of Artificial Sequence: Synthetic oligonucleotide
gggctcgctatgccagtcgaattctcc

SEQ ID NO: 246204 - DNA, 29 bp, Artificial Sequence
  Description of Artificial Sequence: Synthetic oligonucleotide
ggctcgctatgccagtcgaattctccatc

SEQ ID NO: 246205 - DNA, 29 bp, Artificial Sequence
  Description of Artificial Sequence: Synthetic oligonucleotide
gctcgctatgccagtcgaattctccatcc

SEQ ID NO: 246206 - DNA, 29 bp, Artificial Sequence
  Description of Artificial Sequence: Synthetic oligonucleotide
ctcgctatgccagtcgaattctccatccc

SEQ ID NO: 246207 - DNA, 30 bp, Artificial Sequence
  Description of Artificial Sequence: Synthetic oligonucleotide
tcgctatgccagtcgaattctccatcccag

SEQ ID NO: 246208 - DNA, 29 bp, Artificial Sequence
  Description of Artificial Sequence: Synthetic oligonucleotide
cgctatgccagtcgaattctccatcccag

SEQ ID NO: 246209 - DNA, 29 bp, Artificial Sequence
  Description of Artificial Sequence: Synthetic oligonucleotide
gctatgccagtcgaattctccatcccagg

SEQ ID NO: 246210 - DNA, 29 bp, Artificial Sequence
  Description of Artificial Sequence: Synthetic oligonucleotide
ctatgccagtcgaattctccatcccaggc

SEQ ID NO: 246211 - DNA, 30 bp, Artificial Sequence
  Description of Artificial Sequence: Synthetic oligonucleotide
tatgccagtcgaattctccatcccaggctg

SEQ ID NO: 246212 - DNA, 29 bp, Artificial Sequence
  Description of Artificial Sequence: Synthetic oligonucleotide
atgccagtcgaattctccatcccaggctg

SEQ ID NO: 246213 - DNA, 28 bp, Artificial Sequence
  Description of Artificial Sequence: Synthetic oligonucleotide
tgccagtcgaattctccatcccaggctg

SEQ ID NO: 246214 - DNA, 27 bp, Artificial Sequence
  Description of Artificial Sequence: Synthetic oligonucleotide
gccagtcgaattctccatcccaggctg

SEQ ID NO: 246215 - DNA, 27 bp, Artificial Sequence
  Description of Artificial Sequence: Synthetic oligonucleotide
ccagtcgaattctccatcccaggctgc

SEQ ID NO: 246216 - DNA, 27 bp, Artificial Sequence
  Description of Artificial Sequence: Synthetic oligonucleotide
cagtcgaattctccatcccaggctgcc

SEQ ID NO: 246217 - DNA, 28 bp, Artificial Sequence
  Description of Artificial Sequence: Synthetic oligonucleotide
agtcgaattctccatcccaggctgcctg

SEQ ID NO: 246218 - DNA, 27 bp, Artificial Sequence
  Description of Artificial Sequence: Synthetic oligonucleotide
gtcgaattctccatcccaggctgcctg

SEQ ID NO: 246219 - DNA, 27 bp, Artificial Sequence
  Description of Artificial Sequence: Synthetic oligonucleotide
tcgaattctccatcccaggctgcctgc

SEQ ID NO: 246220 - DNA, 26 bp, Artificial Sequence
  Description of Artificial Sequence: Synthetic oligonucleotide
cgaattctccatcccaggctgcctgc

SEQ ID NO: 246221 - DNA, 27 bp, Artificial Sequence
  Description of Artificial Sequence: Synthetic oligonucleotide
gaattctccatcccaggctgcctgcca

SEQ ID NO: 246222 - DNA, 27 bp, Artificial Sequence
  Description of Artificial Sequence: Synthetic oligonucleotide
aattctccatcccaggctgcctgccac

SEQ ID NO: 246223 - DNA, 26 bp, Artificial Sequence
  Description of Artificial Sequence: Synthetic oligonucleotide
attctccatcccaggctgcctgccac

SEQ ID NO: 246224 - DNA, 25 bp, Artificial Sequence
  Description of Artificial Sequence: Synthetic oligonucleotide
ttctccatcccaggctgcctgccac

SEQ ID NO: 246225 - DNA, 24 bp, Artificial Sequence
  Description of Artificial Sequence: Synthetic oligonucleotide
tctccatcccaggctgcctgccac

SEQ ID NO: 246226 - DNA, 23 bp, Artificial Sequence
  Description of Artificial Sequence: Synthetic oligonucleotide
ctccatcccaggctgcctgccac

SEQ ID NO: 246227 - DNA, 23 bp, Artificial Sequence
  Description of Artificial Sequence: Synthetic oligonucleotide
tccatcccaggctgcctgccacg

SEQ ID NO: 246228 - DNA, 22 bp, Artificial Sequence
  Description of Artificial Sequence: Synthetic oligonucleotide
ccatcccaggctgcctgccacg

SEQ ID NO: 246229 - DNA, 22 bp, Artificial Sequence
  Description of Artificial Sequence: Synthetic oligonucleotide
catcccaggctgcctgccacgg

SEQ ID NO: 246230 - DNA, 22 bp, Artificial Sequence
  Description of Artificial Sequence: Synthetic oligonucleotide
atcccaggctgcctgccacggg

SEQ ID NO: 246231 - DNA, 21 bp, Artificial Sequence
  Description of Artificial Sequence: Synthetic oligonucleotide
tcccaggctgcctgccacggg

SEQ ID NO: 246232 - DNA, 20 bp, Artificial Sequence
  Description of Artificial Sequence: Synthetic oligonucleotide
cccaggctgcctgccacggg

SEQ ID NO: 246233 - DNA, 20 bp, Artificial Sequence
  Description of Artificial Sequence: Synthetic oligonucleotide
ccaggctgcctgccacgggg

SEQ ID NO: 246234 - DNA, 20 bp, Artificial Sequence
  Description of Artificial Sequence: Synthetic oligonucleotide
caggctgcctgccacggggc

SEQ ID NO: 246235 - DNA, 20 bp, Artificial Sequence
  Description of Artificial Sequence: Synthetic oligonucleotide
aggctgcctgccacggggcg

SEQ ID NO: 246236 - DNA, 20 bp, Artificial Sequence
  Description of Artificial Sequence: Synthetic oligonucleotide
ggctgcctgccacggggcgt

SEQ ID NO: 246237 - DNA, 20 bp, Artificial Sequence
  Description of Artificial Sequence: Synthetic oligonucleotide
gctgcctgccacggggcgca

SEQ ID NO: 246238 - DNA, 20 bp, Artificial Sequence
  Description of Artificial Sequence: Synthetic oligonucleotide
ctgcctgccacggggcgcac

SEQ ID NO: 246239 - DNA, 20 bp, Artificial Sequence
  Description of Artificial Sequence: Synthetic oligonucleotide
tgcctgccacggggcgcacc

SEQ ID NO: 246240 - DNA, 20 bp, Artificial Sequence
  Description of Artificial Sequence: Synthetic oligonucleotide
gcctgccacggggcgcacct

SEQ ID NO: 246241 - DNA, 20 bp, Artificial Sequence
  Description of Artificial Sequence: Synthetic oligonucleotide
cctgccacggggcgcaccgt

SEQ ID NO: 246242 - DNA, 20 bp, Artificial Sequence
  Description of Artificial Sequence: Synthetic oligonucleotide
ctgccacggggcgcaccgct

SEQ ID NO: 246243 - DNA, 21 bp, Artificial Sequence
  Description of Artificial Sequence: Synthetic oligonucleotide
tgccacggggcgcaccgctga

SEQ ID NO: 246244 - DNA, 20 bp, Artificial Sequence
  Description of Artificial Sequence: Synthetic oligonucleotide
gccacggggcgcaccgctga

SEQ ID NO: 246245 - DNA, 20 bp, Artificial Sequence
  Description of Artificial Sequence: Synthetic oligonucleotide
ccacggggcgcaccgctgag

SEQ ID NO: 246246 - DNA, 21 bp, Artificial Sequence
  Description of Artificial Sequence: Synthetic oligonucleotide
cacggggcgcaccgctgaggt

SEQ ID NO: 246247 - DNA, 22 bp, Artificial Sequence
  Description of Artificial Sequence: Synthetic oligonucleotide
acggggcgcaccgctgaggtga

SEQ ID NO: 246248 - DNA, 21 bp, Artificial Sequence
  Description of Artificial Sequence: Synthetic oligonucleotide
cggggcgcaccgctgaggtga

SEQ ID NO: 246249 - DNA, 21 bp, Artificial Sequence
  Description of Artificial Sequence: Synthetic oligonucleotide
ggggcgcaccgctgaggtgac

SEQ ID NO: 246250 - DNA, 21 bp, Artificial Sequence
  Description of Artificial Sequence: Synthetic oligonucleotide
gggcgcaccgctgaggtgacc

SEQ ID NO: 246251 - DNA, 22 bp, Artificial Sequence
  Description of Artificial Sequence: Synthetic oligonucleotide
ggcgcaccgctgaggtgaccct

SEQ ID NO: 246252 - DNA, 22 bp, Artificial Sequence
  Description of Artificial Sequence: Synthetic oligonucleotide
gcgcaccgctgaggtgaccctg

SEQ ID NO: 246253 - DNA, 23 bp, Artificial Sequence
  Description of Artificial Sequence: Synthetic oligonucleotide
cgcaccgctgaggtgaccctgga

SEQ ID NO: 246254 - DNA, 23 bp, Artificial Sequence
  Description of Artificial Sequence: Synthetic oligonucleotide
gcaccgctgaggtgaccctggag

SEQ ID NO: 246255 - DNA, 25 bp, Artificial Sequence
  Description of Artificial Sequence: Synthetic oligonucleotide
caccgctgaggtgaccctggagcta

SEQ ID NO: 246256 - DNA, 25 bp, Artificial Sequence
  Description of Artificial Sequence: Synthetic oligonucleotide
accgctgaggtgaccctggagctag

SEQ ID NO: 246257 - DNA, 24 bp, Artificial Sequence
  Description of Artificial Sequence: Synthetic oligonucleotide
ccgctgaggtgaccctggagctag

SEQ ID NO: 246258 - DNA, 25 bp, Artificial Sequence
  Description of Artificial Sequence: Synthetic oligonucleotide
cgctgaggtgaccctggagctagca

SEQ ID NO: 246259 - DNA, 25 bp, Artificial Sequence
  Description of Artificial Sequence: Synthetic oligonucleotide
gctgaggtgaccctggagctagcag

SEQ ID NO: 246260 - DNA, 26 bp, Artificial Sequence
  Description of Artificial Sequence: Synthetic oligonucleotide
ctgaggtgaccctggagctagcaggt

SEQ ID NO: 246261 - DNA, 27 bp, Artificial Sequence
  Description of Artificial Sequence: Synthetic oligonucleotide
tgaggtgaccctggagctagcaggtca

SEQ ID NO: 246262 - DNA, 27 bp, Artificial Sequence
  Description of Artificial Sequence: Synthetic oligonucleotide
gaggtgaccctggagctagcaggtcat

SEQ ID NO: 246263 - DNA, 28 bp, Artificial Sequence
  Description of Artificial Sequence: Synthetic oligonucleotide
aggtgaccctggagctagcaggtcattc

SEQ ID NO: 246264 - DNA, 27 bp, Artificial Sequence
  Description of Artificial Sequence: Synthetic oligonucleotide
ggtgaccctggagctagcaggtcattc

SEQ ID NO: 246265 - DNA, 28 bp, Artificial Sequence
  Description of Artificial Sequence: Synthetic oligonucleotide
gtgaccctggagctagcaggtcattcag

SEQ ID NO: 246266 - DNA, 28 bp, Artificial Sequence
  Description of Artificial Sequence: Synthetic oligonucleotide
tgaccctggagctagcaggtcattcagg

SEQ ID NO: 246267 - DNA, 27 bp, Artificial Sequence
  Description of Artificial Sequence: Synthetic oligonucleotide
gaccctggagctagcaggtcattcagg

SEQ ID NO: 246268 - DNA, 27 bp, Artificial Sequence
  Description of Artificial Sequence: Synthetic oligonucleotide
accctggagctagcaggtcattcaggg

SEQ ID NO: 246269 - DNA, 26 bp, Artificial Sequence
  Description of Artificial Sequence: Synthetic oligonucleotide
ccctggagctagcaggtcattcaggg

SEQ ID NO: 246270 - DNA, 26 bp, Artificial Sequence
  Description of Artificial Sequence: Synthetic oligonucleotide
cctggagctagcaggtcattcagggc

SEQ ID NO: 246271 - DNA, 26 bp, Artificial Sequence
  Description of Artificial Sequence: Synthetic oligonucleotide
ctggagctagcaggtcattcagggcc

SEQ ID NO: 246272 - DNA, 27 bp, Artificial Sequence
  Description of Artificial Sequence: Synthetic oligonucleotide
tggagctagcaggtcattcagggccgt

SEQ ID NO: 246273 - DNA, 26 bp, Artificial Sequence
  Description of Artificial Sequence: Synthetic oligonucleotide
ggagctagcaggtcattcagggccgt

SEQ ID NO: 246274 - DNA, 26 bp, Artificial Sequence
  Description of Artificial Sequence: Synthetic oligonucleotide
gagctagcaggtcattcagggccgtc

SEQ ID NO: 246275 - DNA, 26 bp, Artificial Sequence
  Description of Artificial Sequence: Synthetic oligonucleotide
agctagcaggtcattcagggccgtcc

SEQ ID NO: 246276 - DNA, 25 bp, Artificial Sequence
  Description of Artificial Sequence: Synthetic oligonucleotide
gctagcaggtcattcagggccgtcc

SEQ ID NO: 246277 - DNA, 27 bp, Artificial Sequence
  Description of Artificial Sequence: Synthetic oligonucleotide
ctagcaggtcattcagggccgtccctt

SEQ ID NO: 246278 - DNA, 27 bp, Artificial Sequence
  Description of Artificial Sequence: Synthetic oligonucleotide
tagcaggtcattcagggccgtcccttg

SEQ ID NO: 246279 - DNA, 27 bp, Artificial Sequence
  Description of Artificial Sequence: Synthetic oligonucleotide
agcaggtcattcagggccgtcccttga

SEQ ID NO: 246280 - DNA, 26 bp, Artificial Sequence
  Description of Artificial Sequence: Synthetic oligonucleotide
gcaggtcattcagggccgtcccttga

SEQ ID NO: 246281 - DNA, 26 bp, Artificial Sequence
  Description of Artificial Sequence: Synthetic oligonucleotide
caggtcattcagggccgtcccttgag

SEQ ID NO: 246282 - DNA, 27 bp, Artificial Sequence
  Description of Artificial Sequence: Synthetic oligonucleotide
aggtcattcagggccgtcccttgagca

SEQ ID NO: 246283 - DNA, 26 bp, Artificial Sequence
  Description of Artificial Sequence: Synthetic oligonucleotide
ggtcattcagggccgtcccttgagca

SEQ ID NO: 246284 - DNA, 27 bp, Artificial Sequence
  Description of Artificial Sequence: Synthetic oligonucleotide
gtcattcagggccgtcccttgagcaca

SEQ ID NO: 246285 - DNA, 27 bp, Artificial Sequence
  Description of Artificial Sequence: Synthetic oligonucleotide
tcattcagggccgtcccttgagcacag

SEQ ID NO: 246286 - DNA, 26 bp, Artificial Sequence
  Description of Artificial Sequence: Synthetic oligonucleotide
cattcagggccgtcccttgagcacag

SEQ ID NO: 246287 - DNA, 26 bp, Artificial Sequence
  Description of Artificial Sequence: Synthetic oligonucleotide
attcagggccgtcccttgagcacagc

SEQ ID NO: 246288 - DNA, 25 bp, Artificial Sequence
  Description of Artificial Sequence: Synthetic oligonucleotide
ttcagggccgtcccttgagcacagc

SEQ ID NO: 246289 - DNA, 24 bp, Artificial Sequence
  Description of Artificial Sequence: Synthetic oligonucleotide
tcagggccgtcccttgagcacagc

SEQ ID NO: 246290 - DNA, 23 bp, Artificial Sequence
  Description of Artificial Sequence: Synthetic oligonucleotide
cagggccgtcccttgagcacagc

SEQ ID NO: 246291 - DNA, 25 bp, Artificial Sequence
  Description of Artificial Sequence: Synthetic oligonucleotide
agggccgtcccttgagcacagcgta

SEQ ID NO: 246292 - DNA, 24 bp, Artificial Sequence
  Description of Artificial Sequence: Synthetic oligonucleotide
gggccgtcccttgagcacagcgta

SEQ ID NO: 246293 - DNA, 24 bp, Artificial Sequence
  Description of Artificial Sequence: Synthetic oligonucleotide
ggccgtcccttgagcacagcgtag

SEQ ID NO: 246294 - DNA, 24 bp, Artificial Sequence
  Description of Artificial Sequence: Synthetic oligonucleotide
gccgtcccttgagcacagcgtagc

SEQ ID NO: 246295 - DNA, 24 bp, Artificial Sequence
  Description of Artificial Sequence: Synthetic oligonucleotide
ccgtcccttgagcacagcgtagcc

SEQ ID NO: 246296 - DNA, 27 bp, Artificial Sequence
  Description of Artificial Sequence: Synthetic oligonucleotide
cgtcccttgagcacagcgtagcccttt

SEQ ID NO: 246297 - DNA, 28 bp, Artificial Sequence
  Description of Artificial Sequence: Synthetic oligonucleotide
gtcccttgagcacagcgtagcccttttc

SEQ ID NO: 246298 - DNA, 28 bp, Artificial Sequence
  Description of Artificial Sequence: Synthetic oligonucleotide
tcccttgagcacagcgtagcccttttcc

SEQ ID NO: 246299 - DNA, 27 bp, Artificial Sequence
  Description of Artificial Sequence: Synthetic oligonucleotide
cccttgagcacagcgtagcccttttcc

SEQ ID NO: 246300 - DNA, 28 bp, Artificial Sequence
  Description of Artificial Sequence: Synthetic oligonucleotide
ccttgagcacagcgtagcccttttcctc

SEQ ID NO: 246301 - DNA, 29 bp, Artificial Sequence
  Description of Artificial Sequence: Synthetic oligonucleotide
cttgagcacagcgtagcccttttcctctc

SEQ ID NO: 246302 - DNA, 30 bp, Artificial Sequence
  Description of Artificial Sequence: Synthetic oligonucleotide
ttgagcacagcgtagcccttttcctctctg

SEQ ID NO: 246303 - DNA, 29 bp, Artificial Sequence
  Description of Artificial Sequence: Synthetic oligonucleotide
tgagcacagcgtagcccttttcctctctg

SEQ ID NO: 246304 - DNA, 28 bp, Artificial Sequence
  Description of Artificial Sequence: Synthetic oligonucleotide
gagcacagcgtagcccttttcctctctg

SEQ ID NO: 246305 - DNA, 28 bp, Artificial Sequence
  Description of Artificial Sequence: Synthetic oligonucleotide
agcacagcgtagcccttttcctctctgc

SEQ ID NO: 246306 - DNA, 27 bp, Artificial Sequence
  Description of Artificial Sequence: Synthetic oligonucleotide
gcacagcgtagcccttttcctctctgc

SEQ ID NO: 246307 - DNA, 27 bp, Artificial Sequence
  Description of Artificial Sequence: Synthetic oligonucleotide
cacagcgtagcccttttcctctctgcc

SEQ ID NO: 246308 - DNA, 30 bp, Artificial Sequence
  Description of Artificial Sequence: Synthetic oligonucleotide
acagcgtagcccttttcctctctgcctttg

SEQ ID NO: 246309 - DNA, 29 bp, Artificial Sequence
  Description of Artificial Sequence: Synthetic oligonucleotide
cagcgtagcccttttcctctctgcctttg

SEQ ID NO: 246310 - DNA, 31 bp, Artificial Sequence
  Description of Artificial Sequence: Synthetic oligonucleotide
agcgtagcccttttcctctctgcctttgttc

SEQ ID NO: 246311 - DNA, 30 bp, Artificial Sequence
  Description of Artificial Sequence: Synthetic oligonucleotide
gcgtagcccttttcctctctgcctttgttc

SEQ ID NO: 246312 - DNA, 31 bp, Artificial Sequence
  Description of Artificial Sequence: Synthetic oligonucleotide
cgtagcccttttcctctctgcctttgttctg

SEQ ID NO: 246313 - DNA, 31 bp, Artificial Sequence
  Description of Artificial Sequence: Synthetic oligonucleotide
gtagcccttttcctctctgcctttgttctgc

SEQ ID NO: 246314 - DNA, 33 bp, Artificial Sequence
  Description of Artificial Sequence: Synthetic oligonucleotide
tagcccttttcctctctgcctttgttctgcttg

SEQ ID NO: 246315 - DNA, 32 bp, Artificial Sequence
  Description of Artificial Sequence: Synthetic oligonucleotide
agcccttttcctctctgcctttgttctgcttg

SEQ ID NO: 246316 - DNA, 31 bp, Artificial Sequence
  Description of Artificial Sequence: Synthetic oligonucleotide
gcccttttcctctctgcctttgttctgcttg

SEQ ID NO: 246317 - DNA, 31 bp, Artificial Sequence
  Description of Artificial Sequence: Synthetic oligonucleotide
cccttttcctctctgcctttgttctgcttgc

SEQ ID NO: 246318 - DNA, 31 bp, Artificial Sequence
  Description of Artificial Sequence: Synthetic oligonucleotide
ccttttcctctctgcctttgttctgcttgcg

SEQ ID NO: 246319 - DNA, 31 bp, Artificial Sequence
  Description of Artificial Sequence: Synthetic oligonucleotide
cttttcctctctgcctttgttctgcttgcgc

SEQ ID NO: 246320 - DNA, 32 bp, Artificial Sequence
  Description of Artificial Sequence: Synthetic oligonucleotide
ttttcctctctgcctttgttctgcttgcgctc

SEQ ID NO: 246321 - DNA, 31 bp, Artificial Sequence
  Description of Artificial Sequence: Synthetic oligonucleotide
tttcctctctgcctttgttctgcttgcgctc

SEQ ID NO: 246322 - DNA, 30 bp, Artificial Sequence
  Description of Artificial Sequence: Synthetic oligonucleotide
ttcctctctgcctttgttctgcttgcgctc

SEQ ID NO: 246323 - DNA, 29 bp, Artificial Sequence
  Description of Artificial Sequence: Synthetic oligonucleotide
tcctctctgcctttgttctgcttgcgctc

SEQ ID NO: 246324 - DNA, 28 bp, Artificial Sequence
  Description of Artificial Sequence: Synthetic oligonucleotide
cctctctgcctttgttctgcttgcgctc

SEQ ID NO: 246325 - DNA, 30 bp, Artificial Sequence
  Description of Artificial Sequence: Synthetic oligonucleotide
ctctctgcctttgttctgcttgcgctcttc

SEQ ID NO: 246326 - DNA, 32 bp, Artificial Sequence
  Description of Artificial Sequence: Synthetic oligonucleotide
tctctgcctttgttctgcttgcgctcttcaac

SEQ ID NO: 246327 - DNA, 31 bp, Artificial Sequence
  Description of Artificial Sequence: Synthetic oligonucleotide
ctctgcctttgttctgcttgcgctcttcaac

SEQ ID NO: 246328 - DNA, 31 bp, Artificial Sequence
  Description of Artificial Sequence: Synthetic oligonucleotide
tctgcctttgttctgcttgcgctcttcaacg

SEQ ID NO: 246329 - DNA, 30 bp, Artificial Sequence
  Description of Artificial Sequence: Synthetic oligonucleotide
ctgcctttgttctgcttgcgctcttcaacg

SEQ ID NO: 246330 - DNA, 30 bp, Artificial Sequence
  Description of Artificial Sequence: Synthetic oligonucleotide
tgcctttgttctgcttgcgctcttcaacgc

SEQ ID NO: 246331 - DNA, 29 bp, Artificial Sequence
  Description of Artificial Sequence: Synthetic oligonucleotide
gcctttgttctgcttgcgctcttcaacgc

SEQ ID NO: 246332 - DNA, 30 bp, Artificial Sequence
  Description of Artificial Sequence: Synthetic oligonucleotide
cctttgttctgcttgcgctcttcaacgcac

SEQ ID NO: 246333 - DNA, 31 bp, Artificial Sequence
  Description of Artificial Sequence: Synthetic oligonucleotide
ctttgttctgcttgcgctcttcaacgcactg

SEQ ID NO: 246334 - DNA, 31 bp, Artificial Sequence
  Description of Artificial Sequence: Synthetic oligonucleotide
tttgttctgcttgcgctcttcaacgcactgg

SEQ ID NO: 246335 - DNA, 30 bp, Artificial Sequence
  Description of Artificial Sequence: Synthetic oligonucleotide
ttgttctgcttgcgctcttcaacgcactgg

SEQ ID NO: 246336 - DNA, 29 bp, Artificial Sequence
  Description of Artificial Sequence: Synthetic oligonucleotide
tgttctgcttgcgctcttcaacgcactgg

SEQ ID NO: 246337 - DNA, 28 bp, Artificial Sequence
  Description of Artificial Sequence: Synthetic oligonucleotide
gttctgcttgcgctcttcaacgcactgg

SEQ ID NO: 246338 - DNA, 28 bp, Artificial Sequence
  Description of Artificial Sequence: Synthetic oligonucleotide
ttctgcttgcgctcttcaacgcactggg

SEQ ID NO: 246339 - DNA, 27 bp, Artificial Sequence
  Description of Artificial Sequence: Synthetic oligonucleotide
tctgcttgcgctcttcaacgcactggg

SEQ ID NO: 246340 - DNA, 26 bp, Artificial Sequence
  Description of Artificial Sequence: Synthetic oligonucleotide
ctgcttgcgctcttcaacgcactggg

SEQ ID NO: 246341 - DNA, 27 bp, Artificial Sequence
  Description of Artificial Sequence: Synthetic oligonucleotide
tgcttgcgctcttcaacgcactgggca

SEQ ID NO: 246342 - DNA, 26 bp, Artificial Sequence
  Description of Artificial Sequence: Synthetic oligonucleotide
gcttgcgctcttcaacgcactgggca

SEQ ID NO: 246343 - DNA, 26 bp, Artificial Sequence
  Description of Artificial Sequence: Synthetic oligonucleotide
cttgcgctcttcaacgcactgggcag

SEQ ID NO: 246344 - DNA, 26 bp, Artificial Sequence
  Description of Artificial Sequence: Synthetic oligonucleotide
ttgcgctcttcaacgcactgggcagg

SEQ ID NO: 246345 - DNA, 25 bp, Artificial Sequence
  Description of Artificial Sequence: Synthetic oligonucleotide
tgcgctcttcaacgcactgggcagg

SEQ ID NO: 246346 - DNA, 24 bp, Artificial Sequence
  Description of Artificial Sequence: Synthetic oligonucleotide
gcgctcttcaacgcactgggcagg

SEQ ID NO: 246347 - DNA, 24 bp, Artificial Sequence
  Description of Artificial Sequence: Synthetic oligonucleotide
cgctcttcaacgcactgggcaggg

SEQ ID NO: 246348 - DNA, 25 bp, Artificial Sequence
  Description of Artificial Sequence: Synthetic oligonucleotide
gctcttcaacgcactgggcagggct

SEQ ID NO: 246349 - DNA, 25 bp, Artificial Sequence
  Description of Artificial Sequence: Synthetic oligonucleotide
ctcttcaacgcactgggcagggctg

SEQ ID NO: 246350 - DNA, 26 bp, Artificial Sequence
  Description of Artificial Sequence: Synthetic oligonucleotide
tcttcaacgcactgggcagggctgct

SEQ ID NO: 246351 - DNA, 25 bp, Artificial Sequence
  Description of Artificial Sequence: Synthetic oligonucleotide
cttcaacgcactgggcagggctgct

SEQ ID NO: 246352 - DNA, 26 bp, Artificial Sequence
  Description of Artificial Sequence: Synthetic oligonucleotide
ttcaacgcactgggcagggctgctga

SEQ ID NO: 246353 - DNA, 25 bp, Artificial Sequence
  Description of Artificial Sequence: Synthetic oligonucleotide
tcaacgcactgggcagggctgctga

SEQ ID NO: 246354 - DNA, 24 bp, Artificial Sequence
  Description of Artificial Sequence: Synthetic oligonucleotide
caacgcactgggcagggctgctga

SEQ ID NO: 246355 - DNA, 26 bp, Artificial Sequence
  Description of Artificial Sequence: Synthetic oligonucleotide
aacgcactgggcagggctgctgacta

SEQ ID NO: 246356 - DNA, 25 bp, Artificial Sequence
  Description of Artificial Sequence: Synthetic oligonucleotide
acgcactgggcagggctgctgacta

SEQ ID NO: 246357 - DNA, 24 bp, Artificial Sequence
  Description of Artificial Sequence: Synthetic oligonucleotide
cgcactgggcagggctgctgacta

SEQ ID NO: 246358 - DNA, 24 bp, Artificial Sequence
  Description of Artificial Sequence: Synthetic oligonucleotide
gcactgggcagggctgctgactac

SEQ ID NO: 246359 - DNA, 25 bp, Artificial Sequence
  Description of Artificial Sequence: Synthetic oligonucleotide
cactgggcagggctgctgactacct

SEQ ID NO: 246360 - DNA, 26 bp, Artificial Sequence
  Description of Artificial Sequence: Synthetic oligonucleotide
actgggcagggctgctgactacctgt

SEQ ID NO: 246361 - DNA, 25 bp, Artificial Sequence
  Description of Artificial Sequence: Synthetic oligonucleotide
ctgggcagggctgctgactacctgt

SEQ ID NO: 246362 - DNA, 25 bp, Artificial Sequence
  Description of Artificial Sequence: Synthetic oligonucleotide
tgggcagggctgctgactacctgtc

SEQ ID NO: 246363 - DNA, 24 bp, Artificial Sequence
  Description of Artificial Sequence: Synthetic oligonucleotide
gggcagggctgctgactacctgtc

SEQ ID NO: 246364 - DNA, 25 bp, Artificial Sequence
  Description of Artificial Sequence: Synthetic oligonucleotide
ggcagggctgctgactacctgtcga

SEQ ID NO: 246365 - DNA, 25 bp, Artificial Sequence
  Description of Artificial Sequence: Synthetic oligonucleotide
gcagggctgctgactacctgtcgac

SEQ ID NO: 246366 - DNA, 26 bp, Artificial Sequence
  Description of Artificial Sequence: Synthetic oligonucleotide
cagggctgctgactacctgtcgacct

SEQ ID NO: 246367 - DNA, 26 bp, Artificial Sequence
  Description of Artificial Sequence: Synthetic oligonucleotide
agggctgctgactacctgtcgacctg

SEQ ID NO: 246368 - DNA, 25 bp, Artificial Sequence
  Description of Artificial Sequence: Synthetic oligonucleotide
gggctgctgactacctgtcgacctg

SEQ ID NO: 246369 - DNA, 27 bp, Artificial Sequence
  Description of Artificial Sequence: Synthetic oligonucleotide
ggctgctgactacctgtcgacctgcaa

SEQ ID NO: 246370 - DNA, 27 bp, Artificial Sequence
  Description of Artificial Sequence: Synthetic oligonucleotide
gctgctgactacctgtcgacctgcaag

SEQ ID NO: 246371 - DNA, 27 bp, Artificial Sequence
  Description of Artificial Sequence: Synthetic oligonucleotide
ctgctgactacctgtcgacctgcaagc

SEQ ID NO: 246372 - DNA, 30 bp, Artificial Sequence
  Description of Artificial Sequence: Synthetic oligonucleotide
tgctgactacctgtcgacctgcaagcattc

SEQ ID NO: 246373 - DNA, 29 bp, Artificial Sequence
  Description of Artificial Sequence: Synthetic oligonucleotide
gctgactacctgtcgacctgcaagcattc

SEQ ID NO: 246374 - DNA, 32 bp, Artificial Sequence
  Description of Artificial Sequence: Synthetic oligonucleotide
ctgactacctgtcgacctgcaagcattcaaag

SEQ ID NO: 246375 - DNA, 34 bp, Artificial Sequence
  Description of Artificial Sequence: Synthetic oligonucleotide
tgactacctgtcgacctgcaagcattcaaagatg

SEQ ID NO: 246376 - DNA, 33 bp, Artificial Sequence
  Description of Artificial Sequence: Synthetic oligonucleotide
gactacctgtcgacctgcaagcattcaaagatg

SEQ ID NO: 246377 - DNA, 36 bp, Artificial Sequence
  Description of Artificial Sequence: Synthetic oligonucleotide
actacctgtcgacctgcaagcattcaaagatgaaag

SEQ ID NO: 246378 - DNA, 35 bp, Artificial Sequence
  Description of Artificial Sequence: Synthetic oligonucleotide
ctacctgtcgacctgcaagcattcaaagatgaaag

SEQ ID NO: 246379 - DNA, 35 bp, Artificial Sequence
  Description of Artificial Sequence: Synthetic oligonucleotide
tacctgtcgacctgcaagcattcaaagatgaaagc

SEQ ID NO: 246380 - DNA, 34 bp, Artificial Sequence
  Description of Artificial Sequence: Synthetic oligonucleotide
acctgtcgacctgcaagcattcaaagatgaaagc

SEQ ID NO: 246381 - DNA, 33 bp, Artificial Sequence
  Description of Artificial Sequence: Synthetic oligonucleotide
cctgtcgacctgcaagcattcaaagatgaaagc

SEQ ID NO: 246382 - DNA, 34 bp, Artificial Sequence
  Description of Artificial Sequence: Synthetic oligonucleotide
ctgtcgacctgcaagcattcaaagatgaaagcag

SEQ ID NO: 246383 - DNA, 35 bp, Artificial Sequence
  Description of Artificial Sequence: Synthetic oligonucleotide
tgtcgacctgcaagcattcaaagatgaaagcagac

SEQ ID NO: 246384 - DNA, 34 bp, Artificial Sequence
  Description of Artificial Sequence: Synthetic oligonucleotide
gtcgacctgcaagcattcaaagatgaaagcagac

SEQ ID NO: 246385 - DNA, 35 bp, Artificial Sequence
  Description of Artificial Sequence: Synthetic oligonucleotide
tcgacctgcaagcattcaaagatgaaagcagactg

SEQ ID NO: 246386 - DNA, 34 bp, Artificial Sequence
  Description of Artificial Sequence: Synthetic oligonucleotide
cgacctgcaagcattcaaagatgaaagcagactg

SEQ ID NO: 246387 - DNA, 34 bp, Artificial Sequence
  Description of Artificial Sequence: Synthetic oligonucleotide
atcgaagggaagaggttgctgtctatgttactcg

SEQ ID NO: 246388 - DNA, 33 bp, Artificial Sequence
  Description of Artificial Sequence: Synthetic oligonucleotide
tcgaagggaagaggttgctgtctatgttactcg

SEQ ID NO: 246389 - DNA, 32 bp, Artificial Sequence
  Description of Artificial Sequence: Synthetic oligonucleotide
cgaagggaagaggttgctgtctatgttactcg

SEQ ID NO: 246390 - DNA, 33 bp, Artificial Sequence
  Description of Artificial Sequence: Synthetic oligonucleotide
gaagggaagaggttgctgtctatgttactcgtg

SEQ ID NO: 246391 - DNA, 33 bp, Artificial Sequence
  Description of Artificial Sequence: Synthetic oligonucleotide
aagggaagaggttgctgtctatgttactcgtgc

SEQ ID NO: 246392 - DNA, 32 bp, Artificial Sequence
  Description of Artificial Sequence: Synthetic oligonucleotide
agggaagaggttgctgtctatgttactcgtgc

SEQ ID NO: 246393 - DNA, 31 bp, Artificial Sequence
  Description of Artificial Sequence: Synthetic oligonucleotide
gggaagaggttgctgtctatgttactcgtgc

SEQ ID NO: 246394 - DNA, 33 bp, Artificial Sequence
  Description of Artificial Sequence: Synthetic oligonucleotide
ggaagaggttgctgtctatgttactcgtgcttg

SEQ ID NO: 246395 - DNA, 33 bp, Artificial Sequence
  Description of Artificial Sequence: Synthetic oligonucleotide
gaagaggttgctgtctatgttactcgtgcttgg

SEQ ID NO: 246396 - DNA, 35 bp, Artificial Sequence
  Description of Artificial Sequence: Synthetic oligonucleotide
aagaggttgctgtctatgttactcgtgcttggatc

SEQ ID NO: 246397 - DNA, 34 bp, Artificial Sequence
  Description of Artificial Sequence: Synthetic oligonucleotide
agaggttgctgtctatgttactcgtgcttggatc

SEQ ID NO: 246398 - DNA, 33 bp, Artificial Sequence
  Description of Artificial Sequence: Synthetic oligonucleotide
gaggttgctgtctatgttactcgtgcttggatc

SEQ ID NO: 246399 - DNA, 34 bp, Artificial Sequence
  Description of Artificial Sequence: Synthetic oligonucleotide
aggttgctgtctatgttactcgtgcttggatctg

SEQ ID NO: 246400 - DNA, 33 bp, Artificial Sequence
  Description of Artificial Sequence: Synthetic oligonucleotide
ggttgctgtctatgttactcgtgcttggatctg

SEQ ID NO: 246401 - DNA, 33 bp, Artificial Sequence
  Description of Artificial Sequence: Synthetic oligonucleotide
gttgctgtctatgttactcgtgcttggatctgc

SEQ ID NO: 246402 - DNA, 37 bp, Artificial Sequence
  Description of Artificial Sequence: Synthetic oligonucleotide
ttgctgtctatgttactcgtgcttggatctgctattg

SEQ ID NO: 246403 - DNA, 36 bp, Artificial Sequence
  Description of Artificial Sequence: Synthetic oligonucleotide
tgctgtctatgttactcgtgcttggatctgctattg

SEQ ID NO: 246404 - DNA, 35 bp, Artificial Sequence
  Description of Artificial Sequence: Synthetic oligonucleotide
gctgtctatgttactcgtgcttggatctgctattg

SEQ ID NO: 246405 - DNA, 37 bp, Artificial Sequence
  Description of Artificial Sequence: Synthetic oligonucleotide
ctgtctatgttactcgtgcttggatctgctattgatg

SEQ ID NO: 246406 - DNA, 38 bp, Artificial Sequence
  Description of Artificial Sequence: Synthetic oligonucleotide
tgtctatgttactcgtgcttggatctgctattgatgag

SEQ ID NO: 246407 - DNA, 37 bp, Artificial Sequence
  Description of Artificial Sequence: Synthetic oligonucleotide
gtctatgttactcgtgcttggatctgctattgatgag

SEQ ID NO: 246408 - DNA, 37 bp, Artificial Sequence
  Description of Artificial Sequence: Synthetic oligonucleotide
tctatgttactcgtgcttggatctgctattgatgagg

SEQ ID NO: 246409 - DNA, 36 bp, Artificial Sequence
  Description of Artificial Sequence: Synthetic oligonucleotide
ctatgttactcgtgcttggatctgctattgatgagg

SEQ ID NO: 246410 - DNA, 36 bp, Artificial Sequence
  Description of Artificial Sequence: Synthetic oligonucleotide
tatgttactcgtgcttggatctgctattgatgaggc

SEQ ID NO: 246411 - DNA, 35 bp, Artificial Sequence
  Description of Artificial Sequence: Synthetic oligonucleotide
atgttactcgtgcttggatctgctattgatgaggc

SEQ ID NO: 246412 - DNA, 34 bp, Artificial Sequence
  Description of Artificial Sequence: Synthetic oligonucleotide
tgttactcgtgcttggatctgctattgatgaggc

SEQ ID NO: 246413 - DNA, 33 bp, Artificial Sequence
  Description of Artificial Sequence: Synthetic oligonucleotide
gttactcgtgcttggatctgctattgatgaggc

SEQ ID NO: 246414 - DNA, 34 bp, Artificial Sequence
  Description of Artificial Sequence: Synthetic oligonucleotide
ttactcgtgcttggatctgctattgatgaggctc

SEQ ID NO: 246415 - DNA, 33 bp, Artificial Sequence
  Description of Artificial Sequence: Synthetic oligonucleotide
tactcgtgcttggatctgctattgatgaggctc

SEQ ID NO: 246416 - DNA, 32 bp, Artificial Sequence
  Description of Artificial Sequence: Synthetic oligonucleotide
actcgtgcttggatctgctattgatgaggctc

SEQ ID NO: 246417 - DNA, 31 bp, Artificial Sequence
  Description of Artificial Sequence: Synthetic oligonucleotide
ctcgtgcttggatctgctattgatgaggctc

SEQ ID NO: 246418 - DNA, 33 bp, Artificial Sequence
  Description of Artificial Sequence: Synthetic oligonucleotide
tcgtgcttggatctgctattgatgaggctcaag

SEQ ID NO: 246419 - DNA, 32 bp, Artificial Sequence
  Description of Artificial Sequence: Synthetic oligonucleotide
cgtgcttggatctgctattgatgaggctcaag

SEQ ID NO: 246420 - DNA, 34 bp, Artificial Sequence
  Description of Artificial Sequence: Synthetic oligonucleotide
gtgcttggatctgctattgatgaggctcaagatg

SEQ ID NO: 246421 - DNA, 34 bp, Artificial Sequence
  Description of Artificial Sequence: Synthetic oligonucleotide
tgcttggatctgctattgatgaggctcaagatgg

SEQ ID NO: 246422 - DNA, 33 bp, Artificial Sequence
  Description of Artificial Sequence: Synthetic oligonucleotide
gcttggatctgctattgatgaggctcaagatgg

SEQ ID NO: 246423 - DNA, 34 bp, Artificial Sequence
  Description of Artificial Sequence: Synthetic oligonucleotide
cttggatctgctattgatgaggctcaagatggac

SEQ ID NO: 246424 - DNA, 36 bp, Artificial Sequence
  Description of Artificial Sequence: Synthetic oligonucleotide
ttggatctgctattgatgaggctcaagatggacatc

SEQ ID NO: 246425 - DNA, 35 bp, Artificial Sequence
  Description of Artificial Sequence: Synthetic oligonucleotide
tggatctgctattgatgaggctcaagatggacatc

SEQ ID NO: 246426 - DNA, 34 bp, Artificial Sequence
  Description of Artificial Sequence: Synthetic oligonucleotide
ggatctgctattgatgaggctcaagatggacatc

SEQ ID NO: 246427 - DNA, 36 bp, Artificial Sequence
  Description of Artificial Sequence: Synthetic oligonucleotide
gatctgctattgatgaggctcaagatggacatcatg

SEQ ID NO: 246428 - DNA, 38 bp, Artificial Sequence
  Description of Artificial Sequence: Synthetic oligonucleotide
atctgctattgatgaggctcaagatggacatcatgatg

SEQ ID NO: 246429 - DNA, 37 bp, Artificial Sequence
  Description of Artificial Sequence: Synthetic oligonucleotide
tctgctattgatgaggctcaagatggacatcatgatg

SEQ ID NO: 246430 - DNA, 36 bp, Artificial Sequence
  Description of Artificial Sequence: Synthetic oligonucleotide
ctgctattgatgaggctcaagatggacatcatgatg

SEQ ID NO: 246431 - DNA, 38 bp, Artificial Sequence
  Description of Artificial Sequence: Synthetic oligonucleotide
tgctattgatgaggctcaagatggacatcatgatgatg

SEQ ID NO: 246432 - DNA, 37 bp, Artificial Sequence
  Description of Artificial Sequence: Synthetic oligonucleotide
gctattgatgaggctcaagatggacatcatgatgatg

SEQ ID NO: 246433 - DNA, 38 bp, Artificial Sequence
  Description of Artificial Sequence: Synthetic oligonucleotide
ctattgatgaggctcaagatggacatcatgatgatgag

SEQ ID NO: 246434 - DNA, 41 bp, Artificial Sequence
  Description of Artificial Sequence: Synthetic oligonucleotide
tattgatgaggctcaagatggacatcatgatgatgagattg

SEQ ID NO: 246435 - DNA, 40 bp, Artificial Sequence
  Description of Artificial Sequence: Synthetic oligonucleotide
attgatgaggctcaagatggacatcatgatgatgagattg

SEQ ID NO: 246436 - DNA, 39 bp, Artificial Sequence
  Description of Artificial Sequence: Synthetic oligonucleotide
ttgatgaggctcaagatggacatcatgatgatgagattg

SEQ ID NO: 246437 - DNA, 38 bp, Artificial Sequence
  Description of Artificial Sequence: Synthetic oligonucleotide
tgatgaggctcaagatggacatcatgatgatgagattg

SEQ ID NO: 246438 - DNA, 37 bp, Artificial Sequence
  Description of Artificial Sequence: Synthetic oligonucleotide
gatgaggctcaagatggacatcatgatgatgagattg

SEQ ID NO: 246439 - DNA, 42 bp, Artificial Sequence
  Description of Artificial Sequence: Synthetic oligonucleotide
atgaggctcaagatggacatcatgatgatgagattgatatag

SEQ ID NO: 246440 - DNA, 41 bp, Artificial Sequence
  Description of Artificial Sequence: Synthetic oligonucleotide
tgaggctcaagatggacatcatgatgatgagattgatatag

SEQ ID NO: 246441 - DNA, 40 bp, Artificial Sequence
  Description of Artificial Sequence: Synthetic oligonucleotide
gaggctcaagatggacatcatgatgatgagattgatatag

SEQ ID NO: 246442 - DNA, 41 bp, Artificial Sequence
  Description of Artificial Sequence: Synthetic oligonucleotide
aggctcaagatggacatcatgatgatgagattgatatagag

SEQ ID NO: 246443 - DNA, 40 bp, Artificial Sequence
  Description of Artificial Sequence: Synthetic oligonucleotide
ggctcaagatggacatcatgatgatgagattgatatagag

SEQ ID NO: 246444 - DNA, 40 bp, Artificial Sequence
  Description of Artificial Sequence: Synthetic oligonucleotide
gctcaagatggacatcatgatgatgagattgatatagagg

SEQ ID NO: 246445 - DNA, 42 bp, Artificial Sequence
  Description of Artificial Sequence: Synthetic oligonucleotide
ctcaagatggacatcatgatgatgagattgatatagaggatg

SEQ ID NO: 246446 - DNA, 43 bp, Artificial Sequence
  Description of Artificial Sequence: Synthetic oligonucleotide
tcaagatggacatcatgatgatgagattgatatagaggatgac

SEQ ID NO: 246447 - DNA, 42 bp, Artificial Sequence
  Description of Artificial Sequence: Synthetic oligonucleotide
caagatggacatcatgatgatgagattgatatagaggatgac

SEQ ID NO: 246448 - DNA, 42 bp, Artificial Sequence
  Description of Artificial Sequence: Synthetic oligonucleotide
aagatggacatcatgatgatgagattgatatagaggatgacg

SEQ ID NO: 246449 - DNA, 41 bp, Artificial Sequence
  Description of Artificial Sequence: Synthetic oligonucleotide
agatggacatcatgatgatgagattgatatagaggatgacg

SEQ ID NO: 246450 - DNA, 40 bp, Artificial Sequence
  Description of Artificial Sequence: Synthetic oligonucleotide
gatggacatcatgatgatgagattgatatagaggatgacg

SEQ ID NO: 246451 - DNA, 42 bp, Artificial Sequence
  Description of Artificial Sequence: Synthetic oligonucleotide
atggacatcatgatgatgagattgatatagaggatgacgttg

SEQ ID NO: 246452 - DNA, 41 bp, Artificial Sequence
  Description of Artificial Sequence: Synthetic oligonucleotide
tggacatcatgatgatgagattgatatagaggatgacgttg

SEQ ID NO: 246453 - DNA, 40 bp, Artificial Sequence
  Description of Artificial Sequence: Synthetic oligonucleotide
ggacatcatgatgatgagattgatatagaggatgacgttg

SEQ ID NO: 246454 - DNA, 41 bp, Artificial Sequence
  Description of Artificial Sequence: Synthetic oligonucleotide
gacatcatgatgatgagattgatatagaggatgacgttgac

SEQ ID NO: 246455 - DNA, 41 bp, Artificial Sequence
  Description of Artificial Sequence: Synthetic oligonucleotide
acatcatgatgatgagattgatatagaggatgacgttgacg

SEQ ID NO: 246456 - DNA, 40 bp, Artificial Sequence
  Description of Artificial Sequence: Synthetic oligonucleotide
catcatgatgatgagattgatatagaggatgacgttgacg

SEQ ID NO: 246457 - DNA, 42 bp, Artificial Sequence
  Description of Artificial Sequence: Synthetic oligonucleotide
atcatgatgatgagattgatatagaggatgacgttgacgatg

SEQ ID NO: 246458 - DNA, 41 bp, Artificial Sequence
  Description of Artificial Sequence: Synthetic oligonucleotide
tcatgatgatgagattgatatagaggatgacgttgacgatg

SEQ ID NO: 246459 - DNA, 40 bp, Artificial Sequence
  Description of Artificial Sequence: Synthetic oligonucleotide
catgatgatgagattgatatagaggatgacgttgacgatg

SEQ ID NO: 246460 - DNA, 41 bp, Artificial Sequence
  Description of Artificial Sequence: Synthetic oligonucleotide
atgatgatgagattgatatagaggatgacgttgacgatgac

SEQ ID NO: 246461 - DNA, 40 bp, Artificial Sequence
  Description of Artificial Sequence: Synthetic oligonucleotide
tgatgatgagattgatatagaggatgacgttgacgatgac

SEQ ID NO: 246462 - DNA, 39 bp, Artificial Sequence
  Description of Artificial Sequence: Synthetic oligonucleotide
gatgatgagattgatatagaggatgacgttgacgatgac

SEQ ID NO: 246463 - DNA, 42 bp, Artificial Sequence
  Description of Artificial Sequence: Synthetic oligonucleotide
atgatgagattgatatagaggatgacgttgacgatgacattg

SEQ ID NO: 246464 - DNA, 41 bp, Artificial Sequence
  Description of Artificial Sequence: Synthetic oligonucleotide
tgatgagattgatatagaggatgacgttgacgatgacattg

SEQ ID NO: 246465 - DNA, 40 bp, Artificial Sequence
  Description of Artificial Sequence: Synthetic oligonucleotide
gatgagattgatatagaggatgacgttgacgatgacattg

SEQ ID NO: 246466 - DNA, 42 bp, Artificial Sequence
  Description of Artificial Sequence: Synthetic oligonucleotide
atgagattgatatagaggatgacgttgacgatgacattgaag

SEQ ID NO: 246467 - DNA, 41 bp, Artificial Sequence
  Description of Artificial Sequence: Synthetic oligonucleotide
tgagattgatatagaggatgacgttgacgatgacattgaag

SEQ ID NO: 246468 - DNA, 40 bp, Artificial Sequence
  Description of Artificial Sequence: Synthetic oligonucleotide
gagattgatatagaggatgacgttgacgatgacattgaag

SEQ ID NO: 246469 - DNA, 41 bp, Artificial Sequence
  Description of Artificial Sequence: Synthetic oligonucleotide
agattgatatagaggatgacgttgacgatgacattgaagac

SEQ ID NO: 246470 - DNA, 40 bp, Artificial Sequence
  Description of Artificial Sequence: Synthetic oligonucleotide
gattgatatagaggatgacgttgacgatgacattgaagac

SEQ ID NO: 246471 - DNA, 40 bp, Artificial Sequence
  Description of Artificial Sequence: Synthetic oligonucleotide
attgatatagaggatgacgttgacgatgacattgaagacg

SEQ ID NO: 246472 - DNA, 39 bp, Artificial Sequence
  Description of Artificial Sequence: Synthetic oligonucleotide
ttgatatagaggatgacgttgacgatgacattgaagacg

SEQ ID NO: 246473 - DNA, 38 bp, Artificial Sequence
  Description of Artificial Sequence: Synthetic oligonucleotide
tgatatagaggatgacgttgacgatgacattgaagacg

SEQ ID NO: 246474 - DNA, 37 bp, Artificial Sequence
  Description of Artificial Sequence: Synthetic oligonucleotide
gatatagaggatgacgttgacgatgacattgaagacg

SEQ ID NO: 246475 - DNA, 39 bp, Artificial Sequence
  Description of Artificial Sequence: Synthetic oligonucleotide
atatagaggatgacgttgacgatgacattgaagacgtag

SEQ ID NO: 246476 - DNA, 38 bp, Artificial Sequence
  Description of Artificial Sequence: Synthetic oligonucleotide
tatagaggatgacgttgacgatgacattgaagacgtag

SEQ ID NO: 246477 - DNA, 37 bp, Artificial Sequence
  Description of Artificial Sequence: Synthetic oligonucleotide
atagaggatgacgttgacgatgacattgaagacgtag

SEQ ID NO: 246478 - DNA, 36 bp, Artificial Sequence
  Description of Artificial Sequence: Synthetic oligonucleotide
tagaggatgacgttgacgatgacattgaagacgtag

SEQ ID NO: 246479 - DNA, 35 bp, Artificial Sequence
  Description of Artificial Sequence: Synthetic oligonucleotide
agaggatgacgttgacgatgacattgaagacgtag

SEQ ID NO: 246480 - DNA, 34 bp, Artificial Sequence
  Description of Artificial Sequence: Synthetic oligonucleotide
gaggatgacgttgacgatgacattgaagacgtag

SEQ ID NO: 246481 - DNA, 36 bp, Artificial Sequence
  Description of Artificial Sequence: Synthetic oligonucleotide
aggatgacgttgacgatgacattgaagacgtagaag

SEQ ID NO: 246482 - DNA, 35 bp, Artificial Sequence
  Description of Artificial Sequence: Synthetic oligonucleotide
ggatgacgttgacgatgacattgaagacgtagaag

SEQ ID NO: 246483 - DNA, 36 bp, Artificial Sequence
  Description of Artificial Sequence: Synthetic oligonucleotide
gatgacgttgacgatgacattgaagacgtagaagac

SEQ ID NO: 246484 - DNA, 37 bp, Artificial Sequence
  Description of Artificial Sequence: Synthetic oligonucleotide
atgacgttgacgatgacattgaagacgtagaagacac

SEQ ID NO: 246485 - DNA, 36 bp, Artificial Sequence
  Description of Artificial Sequence: Synthetic oligonucleotide
tgacgttgacgatgacattgaagacgtagaagacac

SEQ ID NO: 246486 - DNA, 35 bp, Artificial Sequence
  Description of Artificial Sequence: Synthetic oligonucleotide
gacgttgacgatgacattgaagacgtagaagacac

SEQ ID NO: 246487 - DNA, 39 bp, Artificial Sequence
  Description of Artificial Sequence: Synthetic oligonucleotide
acgttgacgatgacattgaagacgtagaagacacaaaac

SEQ ID NO: 246488 - DNA, 38 bp, Artificial Sequence
  Description of Artificial Sequence: Synthetic oligonucleotide
cgttgacgatgacattgaagacgtagaagacacaaaac

SEQ ID NO: 246489 - DNA, 38 bp, Artificial Sequence
  Description of Artificial Sequence: Synthetic oligonucleotide
gttgacgatgacattgaagacgtagaagacacaaaacc

SEQ ID NO: 246490 - DNA, 39 bp, Artificial Sequence
  Description of Artificial Sequence: Synthetic oligonucleotide
ttgacgatgacattgaagacgtagaagacacaaaaccag

SEQ ID NO: 246491 - DNA, 38 bp, Artificial Sequence
  Description of Artificial Sequence: Synthetic oligonucleotide
tgacgatgacattgaagacgtagaagacacaaaaccag

SEQ ID NO: 246492 - DNA, 37 bp, Artificial Sequence
  Description of Artificial Sequence: Synthetic oligonucleotide
gacgatgacattgaagacgtagaagacacaaaaccag

SEQ ID NO: 246493 - DNA, 40 bp, Artificial Sequence
  Description of Artificial Sequence: Synthetic oligonucleotide
acgatgacattgaagacgtagaagacacaaaaccagttac

SEQ ID NO: 246494 - DNA, 39 bp, Artificial Sequence
  Description of Artificial Sequence: Synthetic oligonucleotide
cgatgacattgaagacgtagaagacacaaaaccagttac

SEQ ID NO: 246495 - DNA, 39 bp, Artificial Sequence
  Description of Artificial Sequence: Synthetic oligonucleotide
gatgacattgaagacgtagaagacacaaaaccagttacc

SEQ ID NO: 246496 - DNA, 40 bp, Artificial Sequence
  Description of Artificial Sequence: Synthetic oligonucleotide
atgacattgaagacgtagaagacacaaaaccagttaccac

SEQ ID NO: 246497 - DNA, 39 bp, Artificial Sequence
  Description of Artificial Sequence: Synthetic oligonucleotide
tgacattgaagacgtagaagacacaaaaccagttaccac

SEQ ID NO: 246498 - DNA, 38 bp, Artificial Sequence
  Description of Artificial Sequence: Synthetic oligonucleotide
gacattgaagacgtagaagacacaaaaccagttaccac

SEQ ID NO: 246499 - DNA, 39 bp, Artificial Sequence
  Description of Artificial Sequence: Synthetic oligonucleotide
acattgaagacgtagaagacacaaaaccagttaccactg

SEQ ID NO: 246500 - DNA, 38 bp, Artificial Sequence
  Description of Artificial Sequence: Synthetic oligonucleotide
cattgaagacgtagaagacacaaaaccagttaccactg

SEQ ID NO: 246501 - DNA, 38 bp, Artificial Sequence
  Description of Artificial Sequence: Synthetic oligonucleotide
attgaagacgtagaagacacaaaaccagttaccactgc

SEQ ID NO: 246502 - DNA, 37 bp, Artificial Sequence
  Description of Artificial Sequence: Synthetic oligonucleotide
ttgaagacgtagaagacacaaaaccagttaccactgc

SEQ ID NO: 246503 - DNA, 36 bp, Artificial Sequence
  Description of Artificial Sequence: Synthetic oligonucleotide
tgaagacgtagaagacacaaaaccagttaccactgc

SEQ ID NO: 246504 - DNA, 35 bp, Artificial Sequence
  Description of Artificial Sequence: Synthetic oligonucleotide
gaagacgtagaagacacaaaaccagttaccactgc

SEQ ID NO: 246505 - DNA, 36 bp, Artificial Sequence
  Description of Artificial Sequence: Synthetic oligonucleotide
aagacgtagaagacacaaaaccagttaccactgcac

SEQ ID NO: 246506 - DNA, 35 bp, Artificial Sequence
  Description of Artificial Sequence: Synthetic oligonucleotide
agacgtagaagacacaaaaccagttaccactgcac

SEQ ID NO: 246507 - DNA, 34 bp, Artificial Sequence
  Description of Artificial Sequence: Synthetic oligonucleotide
gacgtagaagacacaaaaccagttaccactgcac

SEQ ID NO: 246508 - DNA, 34 bp, Artificial Sequence
  Description of Artificial Sequence: Synthetic oligonucleotide
acgtagaagacacaaaaccagttaccactgcacc

SEQ ID NO: 246509 - DNA, 33 bp, Artificial Sequence
  Description of Artificial Sequence: Synthetic oligonucleotide
cgtagaagacacaaaaccagttaccactgcacc

SEQ ID NO: 246510 - DNA, 34 bp, Artificial Sequence
  Description of Artificial Sequence: Synthetic oligonucleotide
gtagaagacacaaaaccagttaccactgcacctc

SEQ ID NO: 246511 - DNA, 34 bp, Artificial Sequence
  Description of Artificial Sequence: Synthetic oligonucleotide
tagaagacacaaaaccagttaccactgcacctcc

SEQ ID NO: 246512 - DNA, 33 bp, Artificial Sequence
  Description of Artificial Sequence: Synthetic oligonucleotide
agaagacacaaaaccagttaccactgcacctcc

SEQ ID NO: 246513 - DNA, 32 bp, Artificial Sequence
  Description of Artificial Sequence: Synthetic oligonucleotide
gaagacacaaaaccagttaccactgcacctcc

SEQ ID NO: 246514 - DNA, 34 bp, Artificial Sequence
  Description of Artificial Sequence: Synthetic oligonucleotide
aagacacaaaaccagttaccactgcacctccttc

SEQ ID NO: 246515 - DNA, 33 bp, Artificial Sequence
  Description of Artificial Sequence: Synthetic oligonucleotide
agacacaaaaccagttaccactgcacctccttc

SEQ ID NO: 246516 - DNA, 32 bp, Artificial Sequence
  Description of Artificial Sequence: Synthetic oligonucleotide
gacacaaaaccagttaccactgcacctccttc

SEQ ID NO: 246517 - DNA, 34 bp, Artificial Sequence
  Description of Artificial Sequence: Synthetic oligonucleotide
acacaaaaccagttaccactgcacctccttcaac

SEQ ID NO: 246518 - DNA, 33 bp, Artificial Sequence
  Description of Artificial Sequence: Synthetic oligonucleotide
cacaaaaccagttaccactgcacctccttcaac

SEQ ID NO: 246519 - DNA, 34 bp, Artificial Sequence
  Description of Artificial Sequence: Synthetic oligonucleotide
acaaaaccagttaccactgcacctccttcaactc

SEQ ID NO: 246520 - DNA, 33 bp, Artificial Sequence
  Description of Artificial Sequence: Synthetic oligonucleotide
caaaaccagttaccactgcacctccttcaactc

SEQ ID NO: 246521 - DNA, 33 bp, Artificial Sequence
  Description of Artificial Sequence: Synthetic oligonucleotide
aaaaccagttaccactgcacctccttcaactcc

SEQ ID NO: 246522 - DNA, 32 bp, Artificial Sequence
  Description of Artificial Sequence: Synthetic oligonucleotide
aaaccagttaccactgcacctccttcaactcc

SEQ ID NO: 246523 - DNA, 31 bp, Artificial Sequence
  Description of Artificial Sequence: Synthetic oligonucleotide
aaccagttaccactgcacctccttcaactcc

SEQ ID NO: 246524 - DNA, 30 bp, Artificial Sequence
  Description of Artificial Sequence: Synthetic oligonucleotide
accagttaccactgcacctccttcaactcc

SEQ ID NO: 246525 - DNA, 29 bp, Artificial Sequence
  Description of Artificial Sequence: Synthetic oligonucleotide
ccagttaccactgcacctccttcaactcc

SEQ ID NO: 246526 - DNA, 29 bp, Artificial Sequence
  Description of Artificial Sequence: Synthetic oligonucleotide
cagttaccactgcacctccttcaactccc

SEQ ID NO: 246527 - DNA, 31 bp, Artificial Sequence
  Description of Artificial Sequence: Synthetic oligonucleotide
agttaccactgcacctccttcaactcccaag

SEQ ID NO: 246528 - DNA, 30 bp, Artificial Sequence
  Description of Artificial Sequence: Synthetic oligonucleotide
gttaccactgcacctccttcaactcccaag

SEQ ID NO: 246529 - DNA, 30 bp, Artificial Sequence
  Description of Artificial Sequence: Synthetic oligonucleotide
ttaccactgcacctccttcaactcccaagg

SEQ ID NO: 246530 - DNA, 29 bp, Artificial Sequence
  Description of Artificial Sequence: Synthetic oligonucleotide
taccactgcacctccttcaactcccaagg

SEQ ID NO: 246531 - DNA, 28 bp, Artificial Sequence
  Description of Artificial Sequence: Synthetic oligonucleotide
accactgcacctccttcaactcccaagg

SEQ ID NO: 246532 - DNA, 27 bp, Artificial Sequence
  Description of Artificial Sequence: Synthetic oligonucleotide
ccactgcacctccttcaactcccaagg

SEQ ID NO: 246533 - DNA, 30 bp, Artificial Sequence
  Description of Artificial Sequence: Synthetic oligonucleotide
cactgcacctccttcaactcccaaggatac

SEQ ID NO: 246534 - DNA, 33 bp, Artificial Sequence
  Description of Artificial Sequence: Synthetic oligonucleotide
actgcacctccttcaactcccaaggatacttac

SEQ ID NO: 246535 - DNA, 32 bp, Artificial Sequence
  Description of Artificial Sequence: Synthetic oligonucleotide
ctgcacctccttcaactcccaaggatacttac

SEQ ID NO: 246536 - DNA, 35 bp, Artificial Sequence
  Description of Artificial Sequence: Synthetic oligonucleotide
tgcacctccttcaactcccaaggatacttacaatg

SEQ ID NO: 246537 - DNA, 34 bp, Artificial Sequence
  Description of Artificial Sequence: Synthetic oligonucleotide
gcacctccttcaactcccaaggatacttacaatg

SEQ ID NO: 246538 - DNA, 34 bp, Artificial Sequence
  Description of Artificial Sequence: Synthetic oligonucleotide
cacctccttcaactcccaaggatacttacaatgc

SEQ ID NO: 246539 - DNA, 35 bp, Artificial Sequence
  Description of Artificial Sequence: Synthetic oligonucleotide
acctccttcaactcccaaggatacttacaatgctc

SEQ ID NO: 246540 - DNA, 34 bp, Artificial Sequence
  Description of Artificial Sequence: Synthetic oligonucleotide
cctccttcaactcccaaggatacttacaatgctc

SEQ ID NO: 246541 - DNA, 34 bp, Artificial Sequence
  Description of Artificial Sequence: Synthetic oligonucleotide
ctccttcaactcccaaggatacttacaatgctcc

SEQ ID NO: 246542 - DNA, 35 bp, Artificial Sequence
  Description of Artificial Sequence: Synthetic oligonucleotide
tccttcaactcccaaggatacttacaatgctccag

SEQ ID NO: 246543 - DNA, 34 bp, Artificial Sequence
  Description of Artificial Sequence: Synthetic oligonucleotide
ccttcaactcccaaggatacttacaatgctccag

SEQ ID NO: 246544 - DNA, 36 bp, Artificial Sequence
  Description of Artificial Sequence: Synthetic oligonucleotide
cttcaactcccaaggatacttacaatgctccagttg

SEQ ID NO: 246545 - DNA, 36 bp, Artificial Sequence
  Description of Artificial Sequence: Synthetic oligonucleotide
ttcaactcccaaggatacttacaatgctccagttgc

SEQ ID NO: 246546 - DNA, 35 bp, Artificial Sequence
  Description of Artificial Sequence: Synthetic oligonucleotide
tcaactcccaaggatacttacaatgctccagttgc

SEQ ID NO: 246547 - DNA, 34 bp, Artificial Sequence
  Description of Artificial Sequence: Synthetic oligonucleotide
caactcccaaggatacttacaatgctccagttgc

SEQ ID NO: 246548 - DNA, 36 bp, Artificial Sequence
  Description of Artificial Sequence: Synthetic oligonucleotide
aactcccaaggatacttacaatgctccagttgcaac

SEQ ID NO: 246549 - DNA, 35 bp, Artificial Sequence
  Description of Artificial Sequence: Synthetic oligonucleotide
actcccaaggatacttacaatgctccagttgcaac

SEQ ID NO: 246550 - DNA, 34 bp, Artificial Sequence
  Description of Artificial Sequence: Synthetic oligonucleotide
ctcccaaggatacttacaatgctccagttgcaac

SEQ ID NO: 246551 - DNA, 35 bp, Artificial Sequence
  Description of Artificial Sequence: Synthetic oligonucleotide
tcccaaggatacttacaatgctccagttgcaacag

SEQ ID NO: 246552 - DNA, 34 bp, Artificial Sequence
  Description of Artificial Sequence: Synthetic oligonucleotide
cccaaggatacttacaatgctccagttgcaacag

SEQ ID NO: 246553 - DNA, 34 bp, Artificial Sequence
  Description of Artificial Sequence: Synthetic oligonucleotide
ccaaggatacttacaatgctccagttgcaacagg

SEQ ID NO: 246554 - DNA, 34 bp, Artificial Sequence
  Description of Artificial Sequence: Synthetic oligonucleotide
caaggatacttacaatgctccagttgcaacaggg

SEQ ID NO: 246555 - DNA, 34 bp, Artificial Sequence
  Description of Artificial Sequence: Synthetic oligonucleotide
aaggatacttacaatgctccagttgcaacagggg

SEQ ID NO: 246556 - DNA, 33 bp, Artificial Sequence
  Description of Artificial Sequence: Synthetic oligonucleotide
aggatacttacaatgctccagttgcaacagggg

SEQ ID NO: 246557 - DNA, 32 bp, Artificial Sequence
  Description of Artificial Sequence: Synthetic oligonucleotide
ggatacttacaatgctccagttgcaacagggg

SEQ ID NO: 246558 - DNA, 34 bp, Artificial Sequence
  Description of Artificial Sequence: Synthetic oligonucleotide
gatacttacaatgctccagttgcaacaggggtag

SEQ ID NO: 246559 - DNA, 42 bp, Artificial Sequence
  Description of Artificial Sequence: Synthetic oligonucleotide
atacttacaatgctccagttgcaacaggggtagtatatttag

SEQ ID NO: 246560 - DNA, 41 bp, Artificial Sequence
  Description of Artificial Sequence: Synthetic oligonucleotide
tacttacaatgctccagttgcaacaggggtagtatatttag

SEQ ID NO: 246561 - DNA, 40 bp, Artificial Sequence
  Description of Artificial Sequence: Synthetic oligonucleotide
acttacaatgctccagttgcaacaggggtagtatatttag

SEQ ID NO: 246562 - DNA, 39 bp, Artificial Sequence
  Description of Artificial Sequence: Synthetic oligonucleotide
cttacaatgctccagttgcaacaggggtagtatatttag

SEQ ID NO: 246563 - DNA, 39 bp, Artificial Sequence
  Description of Artificial Sequence: Synthetic oligonucleotide
ttacaatgctccagttgcaacaggggtagtatatttagc

SEQ ID NO: 246564 - DNA, 38 bp, Artificial Sequence
  Description of Artificial Sequence: Synthetic oligonucleotide
tacaatgctccagttgcaacaggggtagtatatttagc

SEQ ID NO: 246565 - DNA, 37 bp, Artificial Sequence
  Description of Artificial Sequence: Synthetic oligonucleotide
acaatgctccagttgcaacaggggtagtatatttagc

SEQ ID NO: 246566 - DNA, 36 bp, Artificial Sequence
  Description of Artificial Sequence: Synthetic oligonucleotide
caatgctccagttgcaacaggggtagtatatttagc

SEQ ID NO: 246567 - DNA, 37 bp, Artificial Sequence
  Description of Artificial Sequence: Synthetic oligonucleotide
aatgctccagttgcaacaggggtagtatatttagctg

SEQ ID NO: 246568 - DNA, 36 bp, Artificial Sequence
  Description of Artificial Sequence: Synthetic oligonucleotide
atgctccagttgcaacaggggtagtatatttagctg

SEQ ID NO: 246569 - DNA, 35 bp, Artificial Sequence
  Description of Artificial Sequence: Synthetic oligonucleotide
tgctccagttgcaacaggggtagtatatttagctg

SEQ ID NO: 246570 - DNA, 34 bp, Artificial Sequence
  Description of Artificial Sequence: Synthetic oligonucleotide
gctccagttgcaacaggggtagtatatttagctg

SEQ ID NO: 246571 - DNA, 37 bp, Artificial Sequence
  Description of Artificial Sequence: Synthetic oligonucleotide
ctccagttgcaacaggggtagtatatttagctgattc

SEQ ID NO: 246572 - DNA, 41 bp, Artificial Sequence
  Description of Artificial Sequence: Synthetic oligonucleotide
tccagttgcaacaggggtagtatatttagctgattctattg

SEQ ID NO: 246573 - DNA, 40 bp, Artificial Sequence
  Description of Artificial Sequence: Synthetic oligonucleotide
ccagttgcaacaggggtagtatatttagctgattctattg

SEQ ID NO: 246574 - DNA, 41 bp, Artificial Sequence
  Description of Artificial Sequence: Synthetic oligonucleotide
cagttgcaacaggggtagtatatttagctgattctattgac

SEQ ID NO: 246575 - DNA, 42 bp, Artificial Sequence
  Description of Artificial Sequence: Synthetic oligonucleotide
agttgcaacaggggtagtatatttagctgattctattgacag

SEQ ID NO: 246576 - DNA, 41 bp, Artificial Sequence
  Description of Artificial Sequence: Synthetic oligonucleotide
gttgcaacaggggtagtatatttagctgattctattgacag

SEQ ID NO: 246577 - DNA, 42 bp, Artificial Sequence
  Description of Artificial Sequence: Synthetic oligonucleotide
ttgcaacaggggtagtatatttagctgattctattgacagag

SEQ ID NO: 246578 - DNA, 41 bp, Artificial Sequence
  Description of Artificial Sequence: Synthetic oligonucleotide
tgcaacaggggtagtatatttagctgattctattgacagag

SEQ ID NO: 246579 - DNA, 40 bp, Artificial Sequence
  Description of Artificial Sequence: Synthetic oligonucleotide
gcaacaggggtagtatatttagctgattctattgacagag

SEQ ID NO: 246580 - DNA, 40 bp, Artificial Sequence
  Description of Artificial Sequence: Synthetic oligonucleotide
caacaggggtagtatatttagctgattctattgacagagc

SEQ ID NO: 246581 - DNA, 42 bp, Artificial Sequence
  Description of Artificial Sequence: Synthetic oligonucleotide
aacaggggtagtatatttagctgattctattgacagagcaac

SEQ ID NO: 246582 - DNA, 41 bp, Artificial Sequence
  Description of Artificial Sequence: Synthetic oligonucleotide
acaggggtagtatatttagctgattctattgacagagcaac

SEQ ID NO: 246583 - DNA, 40 bp, Artificial Sequence
  Description of Artificial Sequence: Synthetic oligonucleotide
caggggtagtatatttagctgattctattgacagagcaac

SEQ ID NO: 246584 - DNA, 41 bp, Artificial Sequence
  Description of Artificial Sequence: Synthetic oligonucleotide
aggggtagtatatttagctgattctattgacagagcaactc

SEQ ID NO: 246585 - DNA, 40 bp, Artificial Sequence
  Description of Artificial Sequence: Synthetic oligonucleotide
ggggtagtatatttagctgattctattgacagagcaactc

SEQ ID NO: 246586 - DNA, 41 bp, Artificial Sequence
  Description of Artificial Sequence: Synthetic oligonucleotide
gggtagtatatttagctgattctattgacagagcaactctg

SEQ ID NO: 246587 - DNA, 42 bp, Artificial Sequence
  Description of Artificial Sequence: Synthetic oligonucleotide
ggtagtatatttagctgattctattgacagagcaactctgtc

SEQ ID NO: 246588 - DNA, 43 bp, Artificial Sequence
  Description of Artificial Sequence: Synthetic oligonucleotide
gtagtatatttagctgattctattgacagagcaactctgtctg

SEQ ID NO: 246589 - DNA, 43 bp, Artificial Sequence
  Description of Artificial Sequence: Synthetic oligonucleotide
tagtatatttagctgattctattgacagagcaactctgtctgg

SEQ ID NO: 246590 - DNA, 42 bp, Artificial Sequence
  Description of Artificial Sequence: Synthetic oligonucleotide
agtatatttagctgattctattgacagagcaactctgtctgg

SEQ ID NO: 246591 - DNA, 41 bp, Artificial Sequence
  Description of Artificial Sequence: Synthetic oligonucleotide
gtatatttagctgattctattgacagagcaactctgtctgg

SEQ ID NO: 246592 - DNA, 41 bp, Artificial Sequence
  Description of Artificial Sequence: Synthetic oligonucleotide
tatatttagctgattctattgacagagcaactctgtctggg

SEQ ID NO: 246593 - DNA, 40 bp, Artificial Sequence
  Description of Artificial Sequence: Synthetic oligonucleotide
atatttagctgattctattgacagagcaactctgtctggg

SEQ ID NO: 246594 - DNA, 39 bp, Artificial Sequence
  Description of Artificial Sequence: Synthetic oligonucleotide
tatttagctgattctattgacagagcaactctgtctggg

SEQ ID NO: 246595 - DNA, 38 bp, Artificial Sequence
  Description of Artificial Sequence: Synthetic oligonucleotide
atttagctgattctattgacagagcaactctgtctggg

SEQ ID NO: 246596 - DNA, 37 bp, Artificial Sequence
  Description of Artificial Sequence: Synthetic oligonucleotide
tttagctgattctattgacagagcaactctgtctggg

SEQ ID NO: 246597 - DNA, 36 bp, Artificial Sequence
  Description of Artificial Sequence: Synthetic oligonucleotide
ttagctgattctattgacagagcaactctgtctggg

SEQ ID NO: 246598 - DNA, 35 bp, Artificial Sequence
  Description of Artificial Sequence: Synthetic oligonucleotide
tagctgattctattgacagagcaactctgtctggg

SEQ ID NO: 246599 - DNA, 34 bp, Artificial Sequence
  Description of Artificial Sequence: Synthetic oligonucleotide
agctgattctattgacagagcaactctgtctggg

SEQ ID NO: 246600 - DNA, 33 bp, Artificial Sequence
  Description of Artificial Sequence: Synthetic oligonucleotide
gctgattctattgacagagcaactctgtctggg

SEQ ID NO: 246601 - DNA, 34 bp, Artificial Sequence
  Description of Artificial Sequence: Synthetic oligonucleotide
ctgattctattgacagagcaactctgtctgggtg

SEQ ID NO: 246602 - DNA, 34 bp, Artificial Sequence
  Description of Artificial Sequence: Synthetic oligonucleotide
tgattctattgacagagcaactctgtctgggtgg

SEQ ID NO: 246603 - DNA, 33 bp, Artificial Sequence
  Description of Artificial Sequence: Synthetic oligonucleotide
gattctattgacagagcaactctgtctgggtgg

SEQ ID NO: 246604 - DNA, 40 bp, Artificial Sequence
  Description of Artificial Sequence: Synthetic oligonucleotide
attctattgacagagcaactctgtctgggtggattatatc

SEQ ID NO: 246605 - DNA, 39 bp, Artificial Sequence
  Description of Artificial Sequence: Synthetic oligonucleotide
ttctattgacagagcaactctgtctgggtggattatatc

SEQ ID NO: 246606 - DNA, 38 bp, Artificial Sequence
  Description of Artificial Sequence: Synthetic oligonucleotide
tctattgacagagcaactctgtctgggtggattatatc

SEQ ID NO: 246607 - DNA, 37 bp, Artificial Sequence
  Description of Artificial Sequence: Synthetic oligonucleotide
ctattgacagagcaactctgtctgggtggattatatc

SEQ ID NO: 246608 - DNA, 37 bp, Artificial Sequence
  Description of Artificial Sequence: Synthetic oligonucleotide
tattgacagagcaactctgtctgggtggattatatcc

SEQ ID NO: 246609 - DNA, 36 bp, Artificial Sequence
  Description of Artificial Sequence: Synthetic oligonucleotide
attgacagagcaactctgtctgggtggattatatcc

SEQ ID NO: 246610 - DNA, 35 bp, Artificial Sequence
  Description of Artificial Sequence: Synthetic oligonucleotide
ttgacagagcaactctgtctgggtggattatatcc

SEQ ID NO: 246611 - DNA, 34 bp, Artificial Sequence
  Description of Artificial Sequence: Synthetic oligonucleotide
tgacagagcaactctgtctgggtggattatatcc

SEQ ID NO: 246612 - DNA, 33 bp, Artificial Sequence
  Description of Artificial Sequence: Synthetic oligonucleotide
gacagagcaactctgtctgggtggattatatcc

SEQ ID NO: 246613 - DNA, 36 bp, Artificial Sequence
  Description of Artificial Sequence: Synthetic oligonucleotide
acagagcaactctgtctgggtggattatatccaaag

SEQ ID NO: 246614 - DNA, 35 bp, Artificial Sequence
  Description of Artificial Sequence: Synthetic oligonucleotide
cagagcaactctgtctgggtggattatatccaaag

SEQ ID NO: 246615 - DNA, 35 bp, Artificial Sequence
  Description of Artificial Sequence: Synthetic oligonucleotide
agagcaactctgtctgggtggattatatccaaagg

SEQ ID NO: 246616 - DNA, 34 bp, Artificial Sequence
  Description of Artificial Sequence: Synthetic oligonucleotide
gagcaactctgtctgggtggattatatccaaagg

SEQ ID NO: 246617 - DNA, 34 bp, Artificial Sequence
  Description of Artificial Sequence: Synthetic oligonucleotide
agcaactctgtctgggtggattatatccaaaggc

SEQ ID NO: 246618 - DNA, 33 bp, Artificial Sequence
  Description of Artificial Sequence: Synthetic oligonucleotide
gcaactctgtctgggtggattatatccaaaggc

SEQ ID NO: 246619 - DNA, 35 bp, Artificial Sequence
  Description of Artificial Sequence: Synthetic oligonucleotide
caactctgtctgggtggattatatccaaaggcaag

SEQ ID NO: 246620 - DNA, 38 bp, Artificial Sequence
  Description of Artificial Sequence: Synthetic oligonucleotide
aactctgtctgggtggattatatccaaaggcaagaaag

SEQ ID NO: 246621 - DNA, 37 bp, Artificial Sequence
  Description of Artificial Sequence: Synthetic oligonucleotide
actctgtctgggtggattatatccaaaggcaagaaag

SEQ ID NO: 246622 - DNA, 36 bp, Artificial Sequence
  Description of Artificial Sequence: Synthetic oligonucleotide
ctctgtctgggtggattatatccaaaggcaagaaag

SEQ ID NO: 246623 - DNA, 37 bp, Artificial Sequence
  Description of Artificial Sequence: Synthetic oligonucleotide
tctgtctgggtggattatatccaaaggcaagaaagag

SEQ ID NO: 246624 - DNA, 36 bp, Artificial Sequence
  Description of Artificial Sequence: Synthetic oligonucleotide
ctgtctgggtggattatatccaaaggcaagaaagag

SEQ ID NO: 246625 - DNA, 36 bp, Artificial Sequence
  Description of Artificial Sequence: Synthetic oligonucleotide
tgtctgggtggattatatccaaaggcaagaaagagg

SEQ ID NO: 246626 - DNA, 35 bp, Artificial Sequence
  Description of Artificial Sequence: Synthetic oligonucleotide
gtctgggtggattatatccaaaggcaagaaagagg

SEQ ID NO: 246627 - DNA, 38 bp, Artificial Sequence
  Description of Artificial Sequence: Synthetic oligonucleotide
tctgggtggattatatccaaaggcaagaaagaggatac

SEQ ID NO: 246628 - DNA, 37 bp, Artificial Sequence
  Description of Artificial Sequence: Synthetic oligonucleotide
ctgggtggattatatccaaaggcaagaaagaggatac

SEQ ID NO: 246629 - DNA, 37 bp, Artificial Sequence
  Description of Artificial Sequence: Synthetic oligonucleotide
tgggtggattatatccaaaggcaagaaagaggatacc

SEQ ID NO: 246630 - DNA, 36 bp, Artificial Sequence
  Description of Artificial Sequence: Synthetic oligonucleotide
gggtggattatatccaaaggcaagaaagaggatacc

SEQ ID NO: 246631 - DNA, 36 bp, Artificial Sequence
  Description of Artificial Sequence: Synthetic oligonucleotide
ggtggattatatccaaaggcaagaaagaggataccg

SEQ ID NO: 246632 - DNA, 38 bp, Artificial Sequence
  Description of Artificial Sequence: Synthetic oligonucleotide
gtggattatatccaaaggcaagaaagaggataccgatc

SEQ ID NO: 246633 - DNA, 40 bp, Artificial Sequence
  Description of Artificial Sequence: Synthetic oligonucleotide
tggattatatccaaaggcaagaaagaggataccgatcatg

SEQ ID NO: 246634 - DNA, 39 bp, Artificial Sequence
  Description of Artificial Sequence: Synthetic oligonucleotide
ggattatatccaaaggcaagaaagaggataccgatcatg

SEQ ID NO: 246635 - DNA, 44 bp, Artificial Sequence
  Description of Artificial Sequence: Synthetic oligonucleotide
gattatatccaaaggcaagaaagaggataccgatcatgaaattg

SEQ ID NO: 246636 - DNA, 44 bp, Artificial Sequence
  Description of Artificial Sequence: Synthetic oligonucleotide
attatatccaaaggcaagaaagaggataccgatcatgaaattgg

SEQ ID NO: 246637 - DNA, 43 bp, Artificial Sequence
  Description of Artificial Sequence: Synthetic oligonucleotide
ttatatccaaaggcaagaaagaggataccgatcatgaaattgg

SEQ ID NO: 246638 - DNA, 42 bp, Artificial Sequence
  Description of Artificial Sequence: Synthetic oligonucleotide
tatatccaaaggcaagaaagaggataccgatcatgaaattgg

SEQ ID NO: 246639 - DNA, 41 bp, Artificial Sequence
  Description of Artificial Sequence: Synthetic oligonucleotide
atatccaaaggcaagaaagaggataccgatcatgaaattgg

SEQ ID NO: 246640 - DNA, 40 bp, Artificial Sequence
  Description of Artificial Sequence: Synthetic oligonucleotide
tatccaaaggcaagaaagaggataccgatcatgaaattgg

SEQ ID NO: 246641 - DNA, 39 bp, Artificial Sequence
  Description of Artificial Sequence: Synthetic oligonucleotide
atccaaaggcaagaaagaggataccgatcatgaaattgg

SEQ ID NO: 246642 - DNA, 38 bp, Artificial Sequence
  Description of Artificial Sequence: Synthetic oligonucleotide
tccaaaggcaagaaagaggataccgatcatgaaattgg

SEQ ID NO: 246643 - DNA, 37 bp, Artificial Sequence
  Description of Artificial Sequence: Synthetic oligonucleotide
ccaaaggcaagaaagaggataccgatcatgaaattgg

SEQ ID NO: 246644 - DNA, 37 bp, Artificial Sequence
  Description of Artificial Sequence: Synthetic oligonucleotide
caaaggcaagaaagaggataccgatcatgaaattggc

SEQ ID NO: 246645 - DNA, 43 bp, Artificial Sequence
  Description of Artificial Sequence: Synthetic oligonucleotide
aaaggcaagaaagaggataccgatcatgaaattggcaaatatg

SEQ ID NO: 246646 - DNA, 42 bp, Artificial Sequence
  Description of Artificial Sequence: Synthetic oligonucleotide
aaggcaagaaagaggataccgatcatgaaattggcaaatatg

SEQ ID NO: 246647 - DNA, 41 bp, Artificial Sequence
  Description of Artificial Sequence: Synthetic oligonucleotide
aggcaagaaagaggataccgatcatgaaattggcaaatatg

SEQ ID NO: 246648 - DNA, 40 bp, Artificial Sequence
  Description of Artificial Sequence: Synthetic oligonucleotide
ggcaagaaagaggataccgatcatgaaattggcaaatatg

SEQ ID NO: 246649 - DNA, 42 bp, Artificial Sequence
  Description of Artificial Sequence: Synthetic oligonucleotide
gcaagaaagaggataccgatcatgaaattggcaaatatgaag

SEQ ID NO: 246650 - DNA, 42 bp, Artificial Sequence
  Description of Artificial Sequence: Synthetic oligonucleotide
caagaaagaggataccgatcatgaaattggcaaatatgaagg

SEQ ID NO: 246651 - DNA, 45 bp, Artificial Sequence
  Description of Artificial Sequence: Synthetic oligonucleotide
aagaaagaggataccgatcatgaaattggcaaatatgaaggaaag

SEQ ID NO: 246652 - DNA, 44 bp, Artificial Sequence
  Description of Artificial Sequence: Synthetic oligonucleotide
agaaagaggataccgatcatgaaattggcaaatatgaaggaaag

SEQ ID NO: 246653 - DNA, 43 bp, Artificial Sequence
  Description of Artificial Sequence: Synthetic oligonucleotide
gaaagaggataccgatcatgaaattggcaaatatgaaggaaag

SEQ ID NO: 246654 - DNA, 44 bp, Artificial Sequence
  Description of Artificial Sequence: Synthetic oligonucleotide
aaagaggataccgatcatgaaattggcaaatatgaaggaaagtg

SEQ ID NO: 246655 - DNA, 43 bp, Artificial Sequence
  Description of Artificial Sequence: Synthetic oligonucleotide
aagaggataccgatcatgaaattggcaaatatgaaggaaagtg

SEQ ID NO: 246656 - DNA, 42 bp, Artificial Sequence
  Description of Artificial Sequence: Synthetic oligonucleotide
agaggataccgatcatgaaattggcaaatatgaaggaaagtg

SEQ ID NO: 246657 - DNA, 41 bp, Artificial Sequence
  Description of Artificial Sequence: Synthetic oligonucleotide
gaggataccgatcatgaaattggcaaatatgaaggaaagtg

SEQ ID NO: 246658 - DNA, 41 bp, Artificial Sequence
  Description of Artificial Sequence: Synthetic oligonucleotide
aggataccgatcatgaaattggcaaatatgaaggaaagtgg

SEQ ID NO: 246659 - DNA, 40 bp, Artificial Sequence
  Description of Artificial Sequence: Synthetic oligonucleotide
ggataccgatcatgaaattggcaaatatgaaggaaagtgg

SEQ ID NO: 246660 - DNA, 40 bp, Artificial Sequence
  Description of Artificial Sequence: Synthetic oligonucleotide
gataccgatcatgaaattggcaaatatgaaggaaagtggc

SEQ ID NO: 246661 - DNA, 41 bp, Artificial Sequence
  Description of Artificial Sequence: Synthetic oligonucleotide
ataccgatcatgaaattggcaaatatgaaggaaagtggcag

SEQ ID NO: 246662 - DNA, 40 bp, Artificial Sequence
  Description of Artificial Sequence: Synthetic oligonucleotide
taccgatcatgaaattggcaaatatgaaggaaagtggcag

SEQ ID NO: 246663 - DNA, 39 bp, Artificial Sequence
  Description of Artificial Sequence: Synthetic oligonucleotide
accgatcatgaaattggcaaatatgaaggaaagtggcag

SEQ ID NO: 246664 - DNA, 38 bp, Artificial Sequence
  Description of Artificial Sequence: Synthetic oligonucleotide
ccgatcatgaaattggcaaatatgaaggaaagtggcag

SEQ ID NO: 246665 - DNA, 38 bp, Artificial Sequence
  Description of Artificial Sequence: Synthetic oligonucleotide
cgatcatgaaattggcaaatatgaaggaaagtggcagg

SEQ ID NO: 246666 - DNA, 40 bp, Artificial Sequence
  Description of Artificial Sequence: Synthetic oligonucleotide
gatcatgaaattggcaaatatgaaggaaagtggcaggtag

SEQ ID NO: 246667 - DNA, 41 bp, Artificial Sequence
  Description of Artificial Sequence: Synthetic oligonucleotide
atcatgaaattggcaaatatgaaggaaagtggcaggtagag

SEQ ID NO: 246668 - DNA, 40 bp, Artificial Sequence
  Description of Artificial Sequence: Synthetic oligonucleotide
tcatgaaattggcaaatatgaaggaaagtggcaggtagag

SEQ ID NO: 246669 - DNA, 39 bp, Artificial Sequence
  Description of Artificial Sequence: Synthetic oligonucleotide
catgaaattggcaaatatgaaggaaagtggcaggtagag

SEQ ID NO: 246670 - DNA, 39 bp, Artificial Sequence
  Description of Artificial Sequence: Synthetic oligonucleotide
atgaaattggcaaatatgaaggaaagtggcaggtagagg

SEQ ID NO: 246671 - DNA, 38 bp, Artificial Sequence
  Description of Artificial Sequence: Synthetic oligonucleotide
tgaaattggcaaatatgaaggaaagtggcaggtagagg

SEQ ID NO: 246672 - DNA, 37 bp, Artificial Sequence
  Description of Artificial Sequence: Synthetic oligonucleotide
gaaattggcaaatatgaaggaaagtggcaggtagagg

SEQ ID NO: 246673 - DNA, 41 bp, Artificial Sequence
  Description of Artificial Sequence: Synthetic oligonucleotide
aaattggcaaatatgaaggaaagtggcaggtagaggtaatg

SEQ ID NO: 246674 - DNA, 40 bp, Artificial Sequence
  Description of Artificial Sequence: Synthetic oligonucleotide
aattggcaaatatgaaggaaagtggcaggtagaggtaatg

SEQ ID NO: 246675 - DNA, 39 bp, Artificial Sequence
  Description of Artificial Sequence: Synthetic oligonucleotide
attggcaaatatgaaggaaagtggcaggtagaggtaatg

SEQ ID NO: 246676 - DNA, 38 bp, Artificial Sequence
  Description of Artificial Sequence: Synthetic oligonucleotide
ttggcaaatatgaaggaaagtggcaggtagaggtaatg

SEQ ID NO: 246677 - DNA, 37 bp, Artificial Sequence
  Description of Artificial Sequence: Synthetic oligonucleotide
tggcaaatatgaaggaaagtggcaggtagaggtaatg

SEQ ID NO: 246678 - DNA, 36 bp, Artificial Sequence
  Description of Artificial Sequence: Synthetic oligonucleotide
ggcaaatatgaaggaaagtggcaggtagaggtaatg

SEQ ID NO: 246679 - DNA, 38 bp, Artificial Sequence
  Description of Artificial Sequence: Synthetic oligonucleotide
gcaaatatgaaggaaagtggcaggtagaggtaatgaag

SEQ ID NO: 246680 - DNA, 38 bp, Artificial Sequence
  Description of Artificial Sequence: Synthetic oligonucleotide
caaatatgaaggaaagtggcaggtagaggtaatgaagg

SEQ ID NO: 246681 - DNA, 39 bp, Artificial Sequence
  Description of Artificial Sequence: Synthetic oligonucleotide
aaatatgaaggaaagtggcaggtagaggtaatgaaggac

SEQ ID NO: 246682 - DNA, 38 bp, Artificial Sequence
  Description of Artificial Sequence: Synthetic oligonucleotide
aatatgaaggaaagtggcaggtagaggtaatgaaggac

SEQ ID NO: 246683 - DNA, 37 bp, Artificial Sequence
  Description of Artificial Sequence: Synthetic oligonucleotide
atatgaaggaaagtggcaggtagaggtaatgaaggac

SEQ ID NO: 246684 - DNA, 36 bp, Artificial Sequence
  Description of Artificial Sequence: Synthetic oligonucleotide
tatgaaggaaagtggcaggtagaggtaatgaaggac

SEQ ID NO: 246685 - DNA, 35 bp, Artificial Sequence
  Description of Artificial Sequence: Synthetic oligonucleotide
atgaaggaaagtggcaggtagaggtaatgaaggac

SEQ ID NO: 246686 - DNA, 34 bp, Artificial Sequence
  Description of Artificial Sequence: Synthetic oligonucleotide
tgaaggaaagtggcaggtagaggtaatgaaggac

SEQ ID NO: 246687 - DNA, 33 bp, Artificial Sequence
  Description of Artificial Sequence: Synthetic oligonucleotide
gaaggaaagtggcaggtagaggtaatgaaggac

SEQ ID NO: 246688 - DNA, 34 bp, Artificial Sequence
  Description of Artificial Sequence: Synthetic oligonucleotide
aaggaaagtggcaggtagaggtaatgaaggactc

SEQ ID NO: 246689 - DNA, 33 bp, Artificial Sequence
  Description of Artificial Sequence: Synthetic oligonucleotide
aggaaagtggcaggtagaggtaatgaaggactc

SEQ ID NO: 246690 - DNA, 32 bp, Artificial Sequence
  Description of Artificial Sequence: Synthetic oligonucleotide
ggaaagtggcaggtagaggtaatgaaggactc

SEQ ID NO: 246691 - DNA, 35 bp, Artificial Sequence
  Description of Artificial Sequence: Synthetic oligonucleotide
gaaagtggcaggtagaggtaatgaaggactcaaag

SEQ ID NO: 246692 - DNA, 35 bp, Artificial Sequence
  Description of Artificial Sequence: Synthetic oligonucleotide
aaagtggcaggtagaggtaatgaaggactcaaagc

SEQ ID NO: 246693 - DNA, 34 bp, Artificial Sequence
  Description of Artificial Sequence: Synthetic oligonucleotide
aagtggcaggtagaggtaatgaaggactcaaagc

SEQ ID NO: 246694 - DNA, 33 bp, Artificial Sequence
  Description of Artificial Sequence: Synthetic oligonucleotide
agtggcaggtagaggtaatgaaggactcaaagc

SEQ ID NO: 246695 - DNA, 32 bp, Artificial Sequence
  Description of Artificial Sequence: Synthetic oligonucleotide
gtggcaggtagaggtaatgaaggactcaaagc

SEQ ID NO: 246696 - DNA, 34 bp, Artificial Sequence
  Description of Artificial Sequence: Synthetic oligonucleotide
tggcaggtagaggtaatgaaggactcaaagcttg

SEQ ID NO: 246697 - DNA, 33 bp, Artificial Sequence
  Description of Artificial Sequence: Synthetic oligonucleotide
ggcaggtagaggtaatgaaggactcaaagcttg

SEQ ID NO: 246698 - DNA, 33 bp, Artificial Sequence
  Description of Artificial Sequence: Synthetic oligonucleotide
gcaggtagaggtaatgaaggactcaaagcttgc

SEQ ID NO: 246699 - DNA, 34 bp, Artificial Sequence
  Description of Artificial Sequence: Synthetic oligonucleotide
caggtagaggtaatgaaggactcaaagcttgcag

SEQ ID NO: 246700 - DNA, 34 bp, Artificial Sequence
  Description of Artificial Sequence: Synthetic oligonucleotide
aggtagaggtaatgaaggactcaaagcttgcagg

SEQ ID NO: 246701 - DNA, 33 bp, Artificial Sequence
  Description of Artificial Sequence: Synthetic oligonucleotide
ggtagaggtaatgaaggactcaaagcttgcagg

SEQ ID NO: 246702 - DNA, 34 bp, Artificial Sequence
  Description of Artificial Sequence: Synthetic oligonucleotide
gtagaggtaatgaaggactcaaagcttgcaggtg

SEQ ID NO: 246703 - DNA, 39 bp, Artificial Sequence
  Description of Artificial Sequence: Synthetic oligonucleotide
tagaggtaatgaaggactcaaagcttgcaggtgatatag

SEQ ID NO: 246704 - DNA, 38 bp, Artificial Sequence
  Description of Artificial Sequence: Synthetic oligonucleotide
agaggtaatgaaggactcaaagcttgcaggtgatatag

SEQ ID NO: 246705 - DNA, 37 bp, Artificial Sequence
  Description of Artificial Sequence: Synthetic oligonucleotide
gaggtaatgaaggactcaaagcttgcaggtgatatag

SEQ ID NO: 246706 - DNA, 37 bp, Artificial Sequence
  Description of Artificial Sequence: Synthetic oligonucleotide
aggtaatgaaggactcaaagcttgcaggtgatatagg

SEQ ID NO: 246707 - DNA, 36 bp, Artificial Sequence
  Description of Artificial Sequence: Synthetic oligonucleotide
ggtaatgaaggactcaaagcttgcaggtgatatagg

SEQ ID NO: 246708 - DNA, 37 bp, Artificial Sequence
  Description of Artificial Sequence: Synthetic oligonucleotide
gtaatgaaggactcaaagcttgcaggtgatataggac

SEQ ID NO: 246709 - DNA, 39 bp, Artificial Sequence
  Description of Artificial Sequence: Synthetic oligonucleotide
taatgaaggactcaaagcttgcaggtgatataggacttg

SEQ ID NO: 246710 - DNA, 38 bp, Artificial Sequence
  Description of Artificial Sequence: Synthetic oligonucleotide
aatgaaggactcaaagcttgcaggtgatataggacttg

SEQ ID NO: 246711 - DNA, 37 bp, Artificial Sequence
  Description of Artificial Sequence: Synthetic oligonucleotide
atgaaggactcaaagcttgcaggtgatataggacttg

SEQ ID NO: 246712 - DNA, 36 bp, Artificial Sequence
  Description of Artificial Sequence: Synthetic oligonucleotide
tgaaggactcaaagcttgcaggtgatataggacttg

SEQ ID NO: 246713 - DNA, 35 bp, Artificial Sequence
  Description of Artificial Sequence: Synthetic oligonucleotide
gaaggactcaaagcttgcaggtgatataggacttg

SEQ ID NO: 246714 - DNA, 36 bp, Artificial Sequence
  Description of Artificial Sequence: Synthetic oligonucleotide
aaggactcaaagcttgcaggtgatataggacttgtc

SEQ ID NO: 246715 - DNA, 35 bp, Artificial Sequence
  Description of Artificial Sequence: Synthetic oligonucleotide
aggactcaaagcttgcaggtgatataggacttgtc

SEQ ID NO: 246716 - DNA, 34 bp, Artificial Sequence
  Description of Artificial Sequence: Synthetic oligonucleotide
ggactcaaagcttgcaggtgatataggacttgtc

SEQ ID NO: 246717 - DNA, 36 bp, Artificial Sequence
  Description of Artificial Sequence: Synthetic oligonucleotide
gactcaaagcttgcaggtgatataggacttgtcttg

SEQ ID NO: 246718 - DNA, 38 bp, Artificial Sequence
  Description of Artificial Sequence: Synthetic oligonucleotide
actcaaagcttgcaggtgatataggacttgtcttgatg

SEQ ID NO: 246719 - DNA, 37 bp, Artificial Sequence
  Description of Artificial Sequence: Synthetic oligonucleotide
ctcaaagcttgcaggtgatataggacttgtcttgatg

SEQ ID NO: 246720 - DNA, 38 bp, Artificial Sequence
  Description of Artificial Sequence: Synthetic oligonucleotide
tcaaagcttgcaggtgatataggacttgtcttgatgtc

SEQ ID NO: 246721 - DNA, 37 bp, Artificial Sequence
  Description of Artificial Sequence: Synthetic oligonucleotide
caaagcttgcaggtgatataggacttgtcttgatgtc

SEQ ID NO: 246722 - DNA, 38 bp, Artificial Sequence
  Description of Artificial Sequence: Synthetic oligonucleotide
aaagcttgcaggtgatataggacttgtcttgatgtctg

SEQ ID NO: 246723 - DNA, 37 bp, Artificial Sequence
  Description of Artificial Sequence: Synthetic oligonucleotide
aagcttgcaggtgatataggacttgtcttgatgtctg

SEQ ID NO: 246724 - DNA, 36 bp, Artificial Sequence
  Description of Artificial Sequence: Synthetic oligonucleotide
agcttgcaggtgatataggacttgtcttgatgtctg

SEQ ID NO: 246725 - DNA, 35 bp, Artificial Sequence
  Description of Artificial Sequence: Synthetic oligonucleotide
gcttgcaggtgatataggacttgtcttgatgtctg

SEQ ID NO: 246726 - DNA, 35 bp, Artificial Sequence
  Description of Artificial Sequence: Synthetic oligonucleotide
cttgcaggtgatataggacttgtcttgatgtctgg

SEQ ID NO: 246727 - DNA, 35 bp, Artificial Sequence
  Description of Artificial Sequence: Synthetic oligonucleotide
ttgcaggtgatataggacttgtcttgatgtctggg

SEQ ID NO: 246728 - DNA, 34 bp, Artificial Sequence
  Description of Artificial Sequence: Synthetic oligonucleotide
tgcaggtgatataggacttgtcttgatgtctggg

SEQ ID NO: 246729 - DNA, 33 bp, Artificial Sequence
  Description of Artificial Sequence: Synthetic oligonucleotide
gcaggtgatataggacttgtcttgatgtctggg

SEQ ID NO: 246730 - DNA, 33 bp, Artificial Sequence
  Description of Artificial Sequence: Synthetic oligonucleotide
caggtgatataggacttgtcttgatgtctgggg

SEQ ID NO: 246731 - DNA, 33 bp, Artificial Sequence
  Description of Artificial Sequence: Synthetic oligonucleotide
aggtgatataggacttgtcttgatgtctggggc

SEQ ID NO: 246732 - DNA, 32 bp, Artificial Sequence
  Description of Artificial Sequence: Synthetic oligonucleotide
ggtgatataggacttgtcttgatgtctggggc

SEQ ID NO: 246733 - DNA, 32 bp, Artificial Sequence
  Description of Artificial Sequence: Synthetic oligonucleotide
gtgatataggacttgtcttgatgtctggggcc

SEQ ID NO: 246734 - DNA, 34 bp, Artificial Sequence
  Description of Artificial Sequence: Synthetic oligonucleotide
tgatataggacttgtcttgatgtctggggccaag

SEQ ID NO: 246735 - DNA, 33 bp, Artificial Sequence
  Description of Artificial Sequence: Synthetic oligonucleotide
gatataggacttgtcttgatgtctggggccaag

SEQ ID NO: 246736 - DNA, 33 bp, Artificial Sequence
  Description of Artificial Sequence: Synthetic oligonucleotide
atataggacttgtcttgatgtctggggccaagc

SEQ ID NO: 246737 - DNA, 32 bp, Artificial Sequence
  Description of Artificial Sequence: Synthetic oligonucleotide
tataggacttgtcttgatgtctggggccaagc

SEQ ID NO: 246738 - DNA, 31 bp, Artificial Sequence
  Description of Artificial Sequence: Synthetic oligonucleotide
ataggacttgtcttgatgtctggggccaagc

SEQ ID NO: 246739 - DNA, 30 bp, Artificial Sequence
  Description of Artificial Sequence: Synthetic oligonucleotide
taggacttgtcttgatgtctggggccaagc

SEQ ID NO: 246740 - DNA, 29 bp, Artificial Sequence
  Description of Artificial Sequence: Synthetic oligonucleotide
aggacttgtcttgatgtctggggccaagc

SEQ ID NO: 246741 - DNA, 28 bp, Artificial Sequence
  Description of Artificial Sequence: Synthetic oligonucleotide
ggacttgtcttgatgtctggggccaagc

SEQ ID NO: 246742 - DNA, 30 bp, Artificial Sequence
  Description of Artificial Sequence: Synthetic oligonucleotide
gacttgtcttgatgtctggggccaagcttc

SEQ ID NO: 246743 - DNA, 32 bp, Artificial Sequence
  Description of Artificial Sequence: Synthetic oligonucleotide
acttgtcttgatgtctggggccaagcttcatg

SEQ ID NO: 246744 - DNA, 31 bp, Artificial Sequence
  Description of Artificial Sequence: Synthetic oligonucleotide
cttgtcttgatgtctggggccaagcttcatg

SEQ ID NO: 246745 - DNA, 31 bp, Artificial Sequence
  Description of Artificial Sequence: Synthetic oligonucleotide
ttgtcttgatgtctggggccaagcttcatgc

SEQ ID NO: 246746 - DNA, 30 bp, Artificial Sequence
  Description of Artificial Sequence: Synthetic oligonucleotide
tgtcttgatgtctggggccaagcttcatgc

SEQ ID NO: 246747 - DNA, 29 bp, Artificial Sequence
  Description of Artificial Sequence: Synthetic oligonucleotide
gtcttgatgtctggggccaagcttcatgc

SEQ ID NO: 246748 - DNA, 29 bp, Artificial Sequence
  Description of Artificial Sequence: Synthetic oligonucleotide
tcttgatgtctggggccaagcttcatgcc

SEQ ID NO: 246749 - DNA, 28 bp, Artificial Sequence
  Description of Artificial Sequence: Synthetic oligonucleotide
cttgatgtctggggccaagcttcatgcc

SEQ ID NO: 246750 - DNA, 30 bp, Artificial Sequence
  Description of Artificial Sequence: Synthetic oligonucleotide
ttgatgtctggggccaagcttcatgccatg

SEQ ID NO: 246751 - DNA, 29 bp, Artificial Sequence
  Description of Artificial Sequence: Synthetic oligonucleotide
tgatgtctggggccaagcttcatgccatg

SEQ ID NO: 246752 - DNA, 28 bp, Artificial Sequence
  Description of Artificial Sequence: Synthetic oligonucleotide
gatgtctggggccaagcttcatgccatg

SEQ ID NO: 246753 - DNA, 29 bp, Artificial Sequence
  Description of Artificial Sequence: Synthetic oligonucleotide
atgtctggggccaagcttcatgccatgtc

SEQ ID NO: 246754 - DNA, 28 bp, Artificial Sequence
  Description of Artificial Sequence: Synthetic oligonucleotide
tgtctggggccaagcttcatgccatgtc

SEQ ID NO: 246755 - DNA, 27 bp, Artificial Sequence
  Description of Artificial Sequence: Synthetic oligonucleotide
gtctggggccaagcttcatgccatgtc

SEQ ID NO: 246756 - DNA, 28 bp, Artificial Sequence
  Description of Artificial Sequence: Synthetic oligonucleotide
tctggggccaagcttcatgccatgtctg

SEQ ID NO: 246757 - DNA, 27 bp, Artificial Sequence
  Description of Artificial Sequence: Synthetic oligonucleotide
ctggggccaagcttcatgccatgtctg

SEQ ID NO: 246758 - DNA, 27 bp, Artificial Sequence
  Description of Artificial Sequence: Synthetic oligonucleotide
tggggccaagcttcatgccatgtctgc

SEQ ID NO: 246759 - DNA, 27 bp, Artificial Sequence
  Description of Artificial Sequence: Synthetic oligonucleotide
ggggccaagcttcatgccatgtctgct

SEQ ID NO: 246760 - DNA, 30 bp, Artificial Sequence
  Description of Artificial Sequence: Synthetic oligonucleotide
gggccaagcttcatgccatgtctgctaaag

SEQ ID NO: 246761 - DNA, 31 bp, Artificial Sequence
  Description of Artificial Sequence: Synthetic oligonucleotide
ggccaagcttcatgccatgtctgctaaagtg

SEQ ID NO: 246762 - DNA, 33 bp, Artificial Sequence
  Description of Artificial Sequence: Synthetic oligonucleotide
gccaagcttcatgccatgtctgctaaagtgaac

SEQ ID NO: 246763 - DNA, 35 bp, Artificial Sequence
  Description of Artificial Sequence: Synthetic oligonucleotide
ccaagcttcatgccatgtctgctaaagtgaacaag

SEQ ID NO: 246764 - DNA, 35 bp, Artificial Sequence
  Description of Artificial Sequence: Synthetic oligonucleotide
caagcttcatgccatgtctgctaaagtgaacaagc

SEQ ID NO: 246765 - DNA, 35 bp, Artificial Sequence
  Description of Artificial Sequence: Synthetic oligonucleotide
aagcttcatgccatgtctgctaaagtgaacaagcg

SEQ ID NO: 246766 - DNA, 34 bp, Artificial Sequence
  Description of Artificial Sequence: Synthetic oligonucleotide
agcttcatgccatgtctgctaaagtgaacaagcg

SEQ ID NO: 246767 - DNA, 33 bp, Artificial Sequence
  Description of Artificial Sequence: Synthetic oligonucleotide
gcttcatgccatgtctgctaaagtgaacaagcg

SEQ ID NO: 246768 - DNA, 33 bp, Artificial Sequence
  Description of Artificial Sequence: Synthetic oligonucleotide
cttcatgccatgtctgctaaagtgaacaagcgc

SEQ ID NO: 246769 - DNA, 35 bp, Artificial Sequence
  Description of Artificial Sequence: Synthetic oligonucleotide
ttcatgccatgtctgctaaagtgaacaagcgcttc

SEQ ID NO: 246770 - DNA, 34 bp, Artificial Sequence
  Description of Artificial Sequence: Synthetic oligonucleotide
tcatgccatgtctgctaaagtgaacaagcgcttc

SEQ ID NO: 246771 - DNA, 33 bp, Artificial Sequence
  Description of Artificial Sequence: Synthetic oligonucleotide
catgccatgtctgctaaagtgaacaagcgcttc

SEQ ID NO: 246772 - DNA, 33 bp, Artificial Sequence
  Description of Artificial Sequence: Synthetic oligonucleotide
atgccatgtctgctaaagtgaacaagcgcttcc

SEQ ID NO: 246773 - DNA, 32 bp, Artificial Sequence
  Description of Artificial Sequence: Synthetic oligonucleotide
tgccatgtctgctaaagtgaacaagcgcttcc

SEQ ID NO: 246774 - DNA, 31 bp, Artificial Sequence
  Description of Artificial Sequence: Synthetic oligonucleotide
gccatgtctgctaaagtgaacaagcgcttcc

SEQ ID NO: 246775 - DNA, 32 bp, Artificial Sequence
  Description of Artificial Sequence: Synthetic oligonucleotide
ccatgtctgctaaagtgaacaagcgcttcctg

SEQ ID NO: 246776 - DNA, 35 bp, Artificial Sequence
  Description of Artificial Sequence: Synthetic oligonucleotide
catgtctgctaaagtgaacaagcgcttcctgttag

SEQ ID NO: 246777 - DNA, 36 bp, Artificial Sequence
  Description of Artificial Sequence: Synthetic oligonucleotide
atgtctgctaaagtgaacaagcgcttcctgttagac

SEQ ID NO: 246778 - DNA, 35 bp, Artificial Sequence
  Description of Artificial Sequence: Synthetic oligonucleotide
tgtctgctaaagtgaacaagcgcttcctgttagac

SEQ ID NO: 246779 - DNA, 34 bp, Artificial Sequence
  Description of Artificial Sequence: Synthetic oligonucleotide
gtctgctaaagtgaacaagcgcttcctgttagac

SEQ ID NO: 246780 - DNA, 35 bp, Artificial Sequence
  Description of Artificial Sequence: Synthetic oligonucleotide
tctgctaaagtgaacaagcgcttcctgttagacac

SEQ ID NO: 246781 - DNA, 34 bp, Artificial Sequence
  Description of Artificial Sequence: Synthetic oligonucleotide
ctgctaaagtgaacaagcgcttcctgttagacac

SEQ ID NO: 246782 - DNA, 34 bp, Artificial Sequence
  Description of Artificial Sequence: Synthetic oligonucleotide
tgctaaagtgaacaagcgcttcctgttagacacc

SEQ ID NO: 246783 - DNA, 33 bp, Artificial Sequence
  Description of Artificial Sequence: Synthetic oligonucleotide
gctaaagtgaacaagcgcttcctgttagacacc

SEQ ID NO: 246784 - DNA, 35 bp, Artificial Sequence
  Description of Artificial Sequence: Synthetic oligonucleotide
ctaaagtgaacaagcgcttcctgttagacaccaag

SEQ ID NO: 246785 - DNA, 35 bp, Artificial Sequence
  Description of Artificial Sequence: Synthetic oligonucleotide
taaagtgaacaagcgcttcctgttagacaccaagg

SEQ ID NO: 246786 - DNA, 34 bp, Artificial Sequence
  Description of Artificial Sequence: Synthetic oligonucleotide
aaagtgaacaagcgcttcctgttagacaccaagg

SEQ ID NO: 246787 - DNA, 33 bp, Artificial Sequence
  Description of Artificial Sequence: Synthetic oligonucleotide
aagtgaacaagcgcttcctgttagacaccaagg

SEQ ID NO: 246788 - DNA, 32 bp, Artificial Sequence
  Description of Artificial Sequence: Synthetic oligonucleotide
agtgaacaagcgcttcctgttagacaccaagg

SEQ ID NO: 246789 - DNA, 31 bp, Artificial Sequence
  Description of Artificial Sequence: Synthetic oligonucleotide
gtgaacaagcgcttcctgttagacaccaagg

SEQ ID NO: 246790 - DNA, 31 bp, Artificial Sequence
  Description of Artificial Sequence: Synthetic oligonucleotide
tgaacaagcgcttcctgttagacaccaaggc

SEQ ID NO: 246791 - DNA, 30 bp, Artificial Sequence
  Description of Artificial Sequence: Synthetic oligonucleotide
gaacaagcgcttcctgttagacaccaaggc

SEQ ID NO: 246792 - DNA, 31 bp, Artificial Sequence
  Description of Artificial Sequence: Synthetic oligonucleotide
aacaagcgcttcctgttagacaccaaggctc

SEQ ID NO: 246793 - DNA, 30 bp, Artificial Sequence
  Description of Artificial Sequence: Synthetic oligonucleotide
acaagcgcttcctgttagacaccaaggctc

SEQ ID NO: 246794 - DNA, 29 bp, Artificial Sequence
  Description of Artificial Sequence: Synthetic oligonucleotide
caagcgcttcctgttagacaccaaggctc

SEQ ID NO: 246795 - DNA, 30 bp, Artificial Sequence
  Description of Artificial Sequence: Synthetic oligonucleotide
aagcgcttcctgttagacaccaaggctctc

SEQ ID NO: 246796 - DNA, 29 bp, Artificial Sequence
  Description of Artificial Sequence: Synthetic oligonucleotide
agcgcttcctgttagacaccaaggctctc

SEQ ID NO: 246797 - DNA, 28 bp, Artificial Sequence
  Description of Artificial Sequence: Synthetic oligonucleotide
gcgcttcctgttagacaccaaggctctc

SEQ ID NO: 246798 - DNA, 31 bp, Artificial Sequence
  Description of Artificial Sequence: Synthetic oligonucleotide
cgcttcctgttagacaccaaggctctcattg

SEQ ID NO: 246799 - DNA, 33 bp, Artificial Sequence
  Description of Artificial Sequence: Synthetic oligonucleotide
gcttcctgttagacaccaaggctctcattgatc

SEQ ID NO: 246800 - DNA, 34 bp, Artificial Sequence
  Description of Artificial Sequence: Synthetic oligonucleotide
cttcctgttagacaccaaggctctcattgatcag

SEQ ID NO: 246801 - DNA, 37 bp, Artificial Sequence
  Description of Artificial Sequence: Synthetic oligonucleotide
ttcctgttagacaccaaggctctcattgatcagtatg

SEQ ID NO: 246802 - DNA, 36 bp, Artificial Sequence
  Description of Artificial Sequence: Synthetic oligonucleotide
tcctgttagacaccaaggctctcattgatcagtatg

SEQ ID NO: 246803 - DNA, 35 bp, Artificial Sequence
  Description of Artificial Sequence: Synthetic oligonucleotide
cctgttagacaccaaggctctcattgatcagtatg

SEQ ID NO: 246804 - DNA, 36 bp, Artificial Sequence
  Description of Artificial Sequence: Synthetic oligonucleotide
ctgttagacaccaaggctctcattgatcagtatgac

SEQ ID NO: 246805 - DNA, 36 bp, Artificial Sequence
  Description of Artificial Sequence: Synthetic oligonucleotide
tgttagacaccaaggctctcattgatcagtatgacg

SEQ ID NO: 246806 - DNA, 35 bp, Artificial Sequence
  Description of Artificial Sequence: Synthetic oligonucleotide
gttagacaccaaggctctcattgatcagtatgacg

SEQ ID NO: 246807 - DNA, 42 bp, Artificial Sequence
  Description of Artificial Sequence: Synthetic oligonucleotide
ttagacaccaaggctctcattgatcagtatgacgttaatttc

SEQ ID NO: 246808 - DNA, 41 bp, Artificial Sequence
  Description of Artificial Sequence: Synthetic oligonucleotide
tagacaccaaggctctcattgatcagtatgacgttaatttc

SEQ ID NO: 246809 - DNA, 40 bp, Artificial Sequence
  Description of Artificial Sequence: Synthetic oligonucleotide
agacaccaaggctctcattgatcagtatgacgttaatttc

SEQ ID NO: 246810 - DNA, 39 bp, Artificial Sequence
  Description of Artificial Sequence: Synthetic oligonucleotide
gacaccaaggctctcattgatcagtatgacgttaatttc

SEQ ID NO: 246811 - DNA, 39 bp, Artificial Sequence
  Description of Artificial Sequence: Synthetic oligonucleotide
acaccaaggctctcattgatcagtatgacgttaatttcg

SEQ ID NO: 246812 - DNA, 38 bp, Artificial Sequence
  Description of Artificial Sequence: Synthetic oligonucleotide
caccaaggctctcattgatcagtatgacgttaatttcg

SEQ ID NO: 246813 - DNA, 43 bp, Artificial Sequence
  Description of Artificial Sequence: Synthetic oligonucleotide
accaaggctctcattgatcagtatgacgttaatttcgaaaatg

SEQ ID NO: 246814 - DNA, 42 bp, Artificial Sequence
  Description of Artificial Sequence: Synthetic oligonucleotide
ccaaggctctcattgatcagtatgacgttaatttcgaaaatg

SEQ ID NO: 246815 - DNA, 42 bp, Artificial Sequence
  Description of Artificial Sequence: Synthetic oligonucleotide
caaggctctcattgatcagtatgacgttaatttcgaaaatgg

SEQ ID NO: 246816 - DNA, 46 bp, Artificial Sequence
  Description of Artificial Sequence: Synthetic oligonucleotide
aaggctctcattgatcagtatgacgttaatttcgaaaatggaaaag

SEQ ID NO: 246817 - DNA, 45 bp, Artificial Sequence
  Description of Artificial Sequence: Synthetic oligonucleotide
aggctctcattgatcagtatgacgttaatttcgaaaatggaaaag

SEQ ID NO: 246818 - DNA, 44 bp, Artificial Sequence
  Description of Artificial Sequence: Synthetic oligonucleotide
ggctctcattgatcagtatgacgttaatttcgaaaatggaaaag

SEQ ID NO: 246819 - DNA, 47 bp, Artificial Sequence
  Description of Artificial Sequence: Synthetic oligonucleotide
gctctcattgatcagtatgacgttaatttcgaaaatggaaaagaatg

SEQ ID NO: 246820 - DNA, 48 bp, Artificial Sequence
  Description of Artificial Sequence: Synthetic oligonucleotide
ctctcattgatcagtatgacgttaatttcgaaaatggaaaagaatgtg

SEQ ID NO: 246821 - DNA, 48 bp, Artificial Sequence
  Description of Artificial Sequence: Synthetic oligonucleotide
tctcattgatcagtatgacgttaatttcgaaaatggaaaagaatgtgg

SEQ ID NO: 246822 - DNA, 47 bp, Artificial Sequence
  Description of Artificial Sequence: Synthetic oligonucleotide
ctcattgatcagtatgacgttaatttcgaaaatggaaaagaatgtgg

SEQ ID NO: 246823 - DNA, 48 bp, Artificial Sequence
  Description of Artificial Sequence: Synthetic oligonucleotide
tcattgatcagtatgacgttaatttcgaaaatggaaaagaatgtggag

SEQ ID NO: 246824 - DNA, 47 bp, Artificial Sequence
  Description of Artificial Sequence: Synthetic oligonucleotide
cattgatcagtatgacgttaatttcgaaaatggaaaagaatgtggag

SEQ ID NO: 246825 - DNA, 47 bp, Artificial Sequence
  Description of Artificial Sequence: Synthetic oligonucleotide
attgatcagtatgacgttaatttcgaaaatggaaaagaatgtggagg

SEQ ID NO: 246826 - DNA, 46 bp, Artificial Sequence
  Description of Artificial Sequence: Synthetic oligonucleotide
ttgatcagtatgacgttaatttcgaaaatggaaaagaatgtggagg

SEQ ID NO: 246827 - DNA, 45 bp, Artificial Sequence
  Description of Artificial Sequence: Synthetic oligonucleotide
tgatcagtatgacgttaatttcgaaaatggaaaagaatgtggagg

SEQ ID NO: 246828 - DNA, 44 bp, Artificial Sequence
  Description of Artificial Sequence: Synthetic oligonucleotide
gatcagtatgacgttaatttcgaaaatggaaaagaatgtggagg

SEQ ID NO: 246829 - DNA, 45 bp, Artificial Sequence
  Description of Artificial Sequence: Synthetic oligonucleotide
atcagtatgacgttaatttcgaaaatggaaaagaatgtggaggtg

SEQ ID NO: 246830 - DNA, 44 bp, Artificial Sequence
  Description of Artificial Sequence: Synthetic oligonucleotide
tcagtatgacgttaatttcgaaaatggaaaagaatgtggaggtg

SEQ ID NO: 246831 - DNA, 43 bp, Artificial Sequence
  Description of Artificial Sequence: Synthetic oligonucleotide
cagtatgacgttaatttcgaaaatggaaaagaatgtggaggtg

SEQ ID NO: 246832 - DNA, 43 bp, Artificial Sequence
  Description of Artificial Sequence: Synthetic oligonucleotide
agtatgacgttaatttcgaaaatggaaaagaatgtggaggtgc

SEQ ID NO: 246833 - DNA, 42 bp, Artificial Sequence
  Description of Artificial Sequence: Synthetic oligonucleotide
gtatgacgttaatttcgaaaatggaaaagaatgtggaggtgc

SEQ ID NO: 246834 - DNA, 42 bp, Artificial Sequence
  Description of Artificial Sequence: Synthetic oligonucleotide
tatgacgttaatttcgaaaatggaaaagaatgtggaggtgcc

SEQ ID NO: 246835 - DNA, 41 bp, Artificial Sequence
  Description of Artificial Sequence: Synthetic oligonucleotide
atgacgttaatttcgaaaatggaaaagaatgtggaggtgcc

SEQ ID NO: 246836 - DNA, 40 bp, Artificial Sequence
  Description of Artificial Sequence: Synthetic oligonucleotide
tgacgttaatttcgaaaatggaaaagaatgtggaggtgcc

SEQ ID NO: 246837 - DNA, 39 bp, Artificial Sequence
  Description of Artificial Sequence: Synthetic oligonucleotide
gacgttaatttcgaaaatggaaaagaatgtggaggtgcc

SEQ ID NO: 246838 - DNA, 42 bp, Artificial Sequence
  Description of Artificial Sequence: Synthetic oligonucleotide
acgttaatttcgaaaatggaaaagaatgtggaggtgcctatc

SEQ ID NO: 246839 - DNA, 41 bp, Artificial Sequence
  Description of Artificial Sequence: Synthetic oligonucleotide
cgttaatttcgaaaatggaaaagaatgtggaggtgcctatc

SEQ ID NO: 246840 - DNA, 42 bp, Artificial Sequence
  Description of Artificial Sequence: Synthetic oligonucleotide
gttaatttcgaaaatggaaaagaatgtggaggtgcctatctg

SEQ ID NO: 246841 - DNA, 45 bp, Artificial Sequence
  Description of Artificial Sequence: Synthetic oligonucleotide
ttaatttcgaaaatggaaaagaatgtggaggtgcctatctgaaac

SEQ ID NO: 246842 - DNA, 44 bp, Artificial Sequence
  Description of Artificial Sequence: Synthetic oligonucleotide
taatttcgaaaatggaaaagaatgtggaggtgcctatctgaaac

SEQ ID NO: 246843 - DNA, 43 bp, Artificial Sequence
  Description of Artificial Sequence: Synthetic oligonucleotide
aatttcgaaaatggaaaagaatgtggaggtgcctatctgaaac

SEQ ID NO: 246844 - DNA, 42 bp, Artificial Sequence
  Description of Artificial Sequence: Synthetic oligonucleotide
atttcgaaaatggaaaagaatgtggaggtgcctatctgaaac

SEQ ID NO: 246845 - DNA, 41 bp, Artificial Sequence
  Description of Artificial Sequence: Synthetic oligonucleotide
tttcgaaaatggaaaagaatgtggaggtgcctatctgaaac

SEQ ID NO: 246846 - DNA, 40 bp, Artificial Sequence
  Description of Artificial Sequence: Synthetic oligonucleotide
ttcgaaaatggaaaagaatgtggaggtgcctatctgaaac

SEQ ID NO: 246847 - DNA, 39 bp, Artificial Sequence
  Description of Artificial Sequence: Synthetic oligonucleotide
tcgaaaatggaaaagaatgtggaggtgcctatctgaaac

SEQ ID NO: 246848 - DNA, 38 bp, Artificial Sequence
  Description of Artificial Sequence: Synthetic oligonucleotide
cgaaaatggaaaagaatgtggaggtgcctatctgaaac

SEQ ID NO: 246849 - DNA, 39 bp, Artificial Sequence
  Description of Artificial Sequence: Synthetic oligonucleotide
gaaaatggaaaagaatgtggaggtgcctatctgaaactg

SEQ ID NO: 246850 - DNA, 39 bp, Artificial Sequence
  Description of Artificial Sequence: Synthetic oligonucleotide
aaaatggaaaagaatgtggaggtgcctatctgaaactgc

SEQ ID NO: 246851 - DNA, 38 bp, Artificial Sequence
  Description of Artificial Sequence: Synthetic oligonucleotide
aaatggaaaagaatgtggaggtgcctatctgaaactgc

SEQ ID NO: 246852 - DNA, 37 bp, Artificial Sequence
  Description of Artificial Sequence: Synthetic oligonucleotide
aatggaaaagaatgtggaggtgcctatctgaaactgc

SEQ ID NO: 246853 - DNA, 36 bp, Artificial Sequence
  Description of Artificial Sequence: Synthetic oligonucleotide
atggaaaagaatgtggaggtgcctatctgaaactgc

SEQ ID NO: 246854 - DNA, 35 bp, Artificial Sequence
  Description of Artificial Sequence: Synthetic oligonucleotide
tggaaaagaatgtggaggtgcctatctgaaactgc

SEQ ID NO: 246855 - DNA, 34 bp, Artificial Sequence
  Description of Artificial Sequence: Synthetic oligonucleotide
ggaaaagaatgtggaggtgcctatctgaaactgc

SEQ ID NO: 246856 - DNA, 37 bp, Artificial Sequence
  Description of Artificial Sequence: Synthetic oligonucleotide
gaaaagaatgtggaggtgcctatctgaaactgcattc

SEQ ID NO: 246857 - DNA, 42 bp, Artificial Sequence
  Description of Artificial Sequence: Synthetic oligonucleotide
aaaagaatgtggaggtgcctatctgaaactgcattctaaaac

SEQ ID NO: 246858 - DNA, 41 bp, Artificial Sequence
  Description of Artificial Sequence: Synthetic oligonucleotide
aaagaatgtggaggtgcctatctgaaactgcattctaaaac

SEQ ID NO: 246859 - DNA, 40 bp, Artificial Sequence
  Description of Artificial Sequence: Synthetic oligonucleotide
aagaatgtggaggtgcctatctgaaactgcattctaaaac

SEQ ID NO: 246860 - DNA, 39 bp, Artificial Sequence
  Description of Artificial Sequence: Synthetic oligonucleotide
agaatgtggaggtgcctatctgaaactgcattctaaaac

SEQ ID NO: 246861 - DNA, 38 bp, Artificial Sequence
  Description of Artificial Sequence: Synthetic oligonucleotide
gaatgtggaggtgcctatctgaaactgcattctaaaac

SEQ ID NO: 246862 - DNA, 39 bp, Artificial Sequence
  Description of Artificial Sequence: Synthetic oligonucleotide
aatgtggaggtgcctatctgaaactgcattctaaaactc

SEQ ID NO: 246863 - DNA, 38 bp, Artificial Sequence
  Description of Artificial Sequence: Synthetic oligonucleotide
atgtggaggtgcctatctgaaactgcattctaaaactc

SEQ ID NO: 246864 - DNA, 37 bp, Artificial Sequence
  Description of Artificial Sequence: Synthetic oligonucleotide
tgtggaggtgcctatctgaaactgcattctaaaactc

SEQ ID NO: 246865 - DNA, 36 bp, Artificial Sequence
  Description of Artificial Sequence: Synthetic oligonucleotide
gtggaggtgcctatctgaaactgcattctaaaactc

SEQ ID NO: 246866 - DNA, 36 bp, Artificial Sequence
  Description of Artificial Sequence: Synthetic oligonucleotide
tggaggtgcctatctgaaactgcattctaaaactcc

SEQ ID NO: 246867 - DNA, 35 bp, Artificial Sequence
  Description of Artificial Sequence: Synthetic oligonucleotide
ggaggtgcctatctgaaactgcattctaaaactcc

SEQ ID NO: 246868 - DNA, 36 bp, Artificial Sequence
  Description of Artificial Sequence: Synthetic oligonucleotide
gaggtgcctatctgaaactgcattctaaaactccag

SEQ ID NO: 246869 - DNA, 38 bp, Artificial Sequence
  Description of Artificial Sequence: Synthetic oligonucleotide
aggtgcctatctgaaactgcattctaaaactccagaac

SEQ ID NO: 246870 - DNA, 37 bp, Artificial Sequence
  Description of Artificial Sequence: Synthetic oligonucleotide
ggtgcctatctgaaactgcattctaaaactccagaac

SEQ ID NO: 246871 - DNA, 38 bp, Artificial Sequence
  Description of Artificial Sequence: Synthetic oligonucleotide
gtgcctatctgaaactgcattctaaaactccagaactc

SEQ ID NO: 246872 - DNA, 40 bp, Artificial Sequence
  Description of Artificial Sequence: Synthetic oligonucleotide
tgcctatctgaaactgcattctaaaactccagaactctac

SEQ ID NO: 246873 - DNA, 39 bp, Artificial Sequence
  Description of Artificial Sequence: Synthetic oligonucleotide
gcctatctgaaactgcattctaaaactccagaactctac

SEQ ID NO: 246874 - DNA, 39 bp, Artificial Sequence
  Description of Artificial Sequence: Synthetic oligonucleotide
cctatctgaaactgcattctaaaactccagaactctacc

SEQ ID NO: 246875 - DNA, 40 bp, Artificial Sequence
  Description of Artificial Sequence: Synthetic oligonucleotide
ctatctgaaactgcattctaaaactccagaactctacctg

SEQ ID NO: 246876 - DNA, 40 bp, Artificial Sequence
  Description of Artificial Sequence: Synthetic oligonucleotide
tatctgaaactgcattctaaaactccagaactctacctgg

SEQ ID NO: 246877 - DNA, 39 bp, Artificial Sequence
  Description of Artificial Sequence: Synthetic oligonucleotide
atctgaaactgcattctaaaactccagaactctacctgg

SEQ ID NO: 246878 - DNA, 38 bp, Artificial Sequence
  Description of Artificial Sequence: Synthetic oligonucleotide
tctgaaactgcattctaaaactccagaactctacctgg

SEQ ID NO: 246879 - DNA, 37 bp, Artificial Sequence
  Description of Artificial Sequence: Synthetic oligonucleotide
ctgaaactgcattctaaaactccagaactctacctgg

SEQ ID NO: 246880 - DNA, 39 bp, Artificial Sequence
  Description of Artificial Sequence: Synthetic oligonucleotide
tgaaactgcattctaaaactccagaactctacctggatc

SEQ ID NO: 246881 - DNA, 38 bp, Artificial Sequence
  Description of Artificial Sequence: Synthetic oligonucleotide
gaaactgcattctaaaactccagaactctacctggatc

SEQ ID NO: 246882 - DNA, 39 bp, Artificial Sequence
  Description of Artificial Sequence: Synthetic oligonucleotide
aaactgcattctaaaactccagaactctacctggatctg

SEQ ID NO: 246883 - DNA, 38 bp, Artificial Sequence
  Description of Artificial Sequence: Synthetic oligonucleotide
aactgcattctaaaactccagaactctacctggatctg

SEQ ID NO: 246884 - DNA, 37 bp, Artificial Sequence
  Description of Artificial Sequence: Synthetic oligonucleotide
actgcattctaaaactccagaactctacctggatctg

SEQ ID NO: 246885 - DNA, 36 bp, Artificial Sequence
  Description of Artificial Sequence: Synthetic oligonucleotide
ctgcattctaaaactccagaactctacctggatctg

SEQ ID NO: 246886 - DNA, 38 bp, Artificial Sequence
  Description of Artificial Sequence: Synthetic oligonucleotide
tgcattctaaaactccagaactctacctggatctgttc

SEQ ID NO: 246887 - DNA, 37 bp, Artificial Sequence
  Description of Artificial Sequence: Synthetic oligonucleotide
gcattctaaaactccagaactctacctggatctgttc

SEQ ID NO: 246888 - DNA, 37 bp, Artificial Sequence
  Description of Artificial Sequence: Synthetic oligonucleotide
cattctaaaactccagaactctacctggatctgttcc

SEQ ID NO: 246889 - DNA, 39 bp, Artificial Sequence
  Description of Artificial Sequence: Synthetic oligonucleotide
attctaaaactccagaactctacctggatctgttccatg

SEQ ID NO: 246890 - DNA, 38 bp, Artificial Sequence
  Description of Artificial Sequence: Synthetic oligonucleotide
ttctaaaactccagaactctacctggatctgttccatg

SEQ ID NO: 246891 - DNA, 37 bp, Artificial Sequence
  Description of Artificial Sequence: Synthetic oligonucleotide
tctaaaactccagaactctacctggatctgttccatg

SEQ ID NO: 246892 - DNA, 36 bp, Artificial Sequence
  Description of Artificial Sequence: Synthetic oligonucleotide
ctaaaactccagaactctacctggatctgttccatg

SEQ ID NO: 246893 - DNA, 37 bp, Artificial Sequence
  Description of Artificial Sequence: Synthetic oligonucleotide
taaaactccagaactctacctggatctgttccatgag

SEQ ID NO: 246894 - DNA, 36 bp, Artificial Sequence
  Description of Artificial Sequence: Synthetic oligonucleotide
aaaactccagaactctacctggatctgttccatgag

SEQ ID NO: 246895 - DNA, 35 bp, Artificial Sequence
  Description of Artificial Sequence: Synthetic oligonucleotide
aaactccagaactctacctggatctgttccatgag

SEQ ID NO: 246896 - DNA, 34 bp, Artificial Sequence
  Description of Artificial Sequence: Synthetic oligonucleotide
aactccagaactctacctggatctgttccatgag

SEQ ID NO: 246897 - DNA, 33 bp, Artificial Sequence
  Description of Artificial Sequence: Synthetic oligonucleotide
actccagaactctacctggatctgttccatgag

SEQ ID NO: 246898 - DNA, 32 bp, Artificial Sequence
  Description of Artificial Sequence: Synthetic oligonucleotide
ctccagaactctacctggatctgttccatgag

SEQ ID NO: 246899 - DNA, 34 bp, Artificial Sequence
  Description of Artificial Sequence: Synthetic oligonucleotide
tccagaactctacctggatctgttccatgagaag

SEQ ID NO: 246900 - DNA, 33 bp, Artificial Sequence
  Description of Artificial Sequence: Synthetic oligonucleotide
ccagaactctacctggatctgttccatgagaag

SEQ ID NO: 246901 - DNA, 34 bp, Artificial Sequence
  Description of Artificial Sequence: Synthetic oligonucleotide
cagaactctacctggatctgttccatgagaagac

SEQ ID NO: 246902 - DNA, 34 bp, Artificial Sequence
  Description of Artificial Sequence: Synthetic oligonucleotide
agaactctacctggatctgttccatgagaagacc

SEQ ID NO: 246903 - DNA, 33 bp, Artificial Sequence
  Description of Artificial Sequence: Synthetic oligonucleotide
gaactctacctggatctgttccatgagaagacc

SEQ ID NO: 246904 - DNA, 33 bp, Artificial Sequence
  Description of Artificial Sequence: Synthetic oligonucleotide
aactctacctggatctgttccatgagaagaccc

SEQ ID NO: 246905 - DNA, 32 bp, Artificial Sequence
  Description of Artificial Sequence: Synthetic oligonucleotide
actctacctggatctgttccatgagaagaccc

SEQ ID NO: 246906 - DNA, 31 bp, Artificial Sequence
  Description of Artificial Sequence: Synthetic oligonucleotide
ctctacctggatctgttccatgagaagaccc

SEQ ID NO: 246907 - DNA, 31 bp, Artificial Sequence
  Description of Artificial Sequence: Synthetic oligonucleotide
tctacctggatctgttccatgagaagacccc

SEQ ID NO: 246908 - DNA, 30 bp, Artificial Sequence
  Description of Artificial Sequence: Synthetic oligonucleotide
ctacctggatctgttccatgagaagacccc

SEQ ID NO: 246909 - DNA, 35 bp, Artificial Sequence
  Description of Artificial Sequence: Synthetic oligonucleotide
tacctggatctgttccatgagaagacccctaatac

SEQ ID NO: 246910 - DNA, 34 bp, Artificial Sequence
  Description of Artificial Sequence: Synthetic oligonucleotide
acctggatctgttccatgagaagacccctaatac

SEQ ID NO: 246911 - DNA, 33 bp, Artificial Sequence
  Description of Artificial Sequence: Synthetic oligonucleotide
cctggatctgttccatgagaagacccctaatac

SEQ ID NO: 246912 - DNA, 33 bp, Artificial Sequence
  Description of Artificial Sequence: Synthetic oligonucleotide
ctggatctgttccatgagaagacccctaatacg

SEQ ID NO: 246913 - DNA, 38 bp, Artificial Sequence
  Description of Artificial Sequence: Synthetic oligonucleotide
tggatctgttccatgagaagacccctaatacgattaag

SEQ ID NO: 246914 - DNA, 37 bp, Artificial Sequence
  Description of Artificial Sequence: Synthetic oligonucleotide
ggatctgttccatgagaagacccctaatacgattaag

SEQ ID NO: 246915 - DNA, 40 bp, Artificial Sequence
  Description of Artificial Sequence: Synthetic oligonucleotide
gatctgttccatgagaagacccctaatacgattaagtttg

SEQ ID NO: 246916 - DNA, 40 bp, Artificial Sequence
  Description of Artificial Sequence: Synthetic oligonucleotide
atctgttccatgagaagacccctaatacgattaagtttgg

SEQ ID NO: 246917 - DNA, 39 bp, Artificial Sequence
  Description of Artificial Sequence: Synthetic oligonucleotide
tctgttccatgagaagacccctaatacgattaagtttgg

SEQ ID NO: 246918 - DNA, 38 bp, Artificial Sequence
  Description of Artificial Sequence: Synthetic oligonucleotide
ctgttccatgagaagacccctaatacgattaagtttgg

SEQ ID NO: 246919 - DNA, 39 bp, Artificial Sequence
  Description of Artificial Sequence: Synthetic oligonucleotide
tgttccatgagaagacccctaatacgattaagtttggtc

SEQ ID NO: 246920 - DNA, 38 bp, Artificial Sequence
  Description of Artificial Sequence: Synthetic oligonucleotide
gttccatgagaagacccctaatacgattaagtttggtc

SEQ ID NO: 246921 - DNA, 38 bp, Artificial Sequence
  Description of Artificial Sequence: Synthetic oligonucleotide
ttccatgagaagacccctaatacgattaagtttggtcc

SEQ ID NO: 246922 - DNA, 37 bp, Artificial Sequence
  Description of Artificial Sequence: Synthetic oligonucleotide
tccatgagaagacccctaatacgattaagtttggtcc

SEQ ID NO: 246923 - DNA, 36 bp, Artificial Sequence
  Description of Artificial Sequence: Synthetic oligonucleotide
ccatgagaagacccctaatacgattaagtttggtcc

SEQ ID NO: 246924 - DNA, 37 bp, Artificial Sequence
  Description of Artificial Sequence: Synthetic oligonucleotide
catgagaagacccctaatacgattaagtttggtcctg

SEQ ID NO: 246925 - DNA, 43 bp, Artificial Sequence
  Description of Artificial Sequence: Synthetic oligonucleotide
atgagaagacccctaatacgattaagtttggtcctgataaatg

SEQ ID NO: 246926 - DNA, 42 bp, Artificial Sequence
  Description of Artificial Sequence: Synthetic oligonucleotide
tgagaagacccctaatacgattaagtttggtcctgataaatg

SEQ ID NO: 246927 - DNA, 41 bp, Artificial Sequence
  Description of Artificial Sequence: Synthetic oligonucleotide
gagaagacccctaatacgattaagtttggtcctgataaatg

SEQ ID NO: 246928 - DNA, 42 bp, Artificial Sequence
  Description of Artificial Sequence: Synthetic oligonucleotide
agaagacccctaatacgattaagtttggtcctgataaatgtc

SEQ ID NO: 246929 - DNA, 41 bp, Artificial Sequence
  Description of Artificial Sequence: Synthetic oligonucleotide
gaagacccctaatacgattaagtttggtcctgataaatgtc

SEQ ID NO: 246930 - DNA, 41 bp, Artificial Sequence
  Description of Artificial Sequence: Synthetic oligonucleotide
aagacccctaatacgattaagtttggtcctgataaatgtcg

SEQ ID NO: 246931 - DNA, 40 bp, Artificial Sequence
  Description of Artificial Sequence: Synthetic oligonucleotide
agacccctaatacgattaagtttggtcctgataaatgtcg

SEQ ID NO: 246932 - DNA, 39 bp, Artificial Sequence
  Description of Artificial Sequence: Synthetic oligonucleotide
gacccctaatacgattaagtttggtcctgataaatgtcg

SEQ ID NO: 246933 - DNA, 40 bp, Artificial Sequence
  Description of Artificial Sequence: Synthetic oligonucleotide
acccctaatacgattaagtttggtcctgataaatgtcgag

SEQ ID NO: 246934 - DNA, 39 bp, Artificial Sequence
  Description of Artificial Sequence: Synthetic oligonucleotide
cccctaatacgattaagtttggtcctgataaatgtcgag

SEQ ID NO: 246935 - DNA, 40 bp, Artificial Sequence
  Description of Artificial Sequence: Synthetic oligonucleotide
ccctaatacgattaagtttggtcctgataaatgtcgagag

SEQ ID NO: 246936 - DNA, 40 bp, Artificial Sequence
  Description of Artificial Sequence: Synthetic oligonucleotide
cctaatacgattaagtttggtcctgataaatgtcgagagg

SEQ ID NO: 246937 - DNA, 41 bp, Artificial Sequence
  Description of Artificial Sequence: Synthetic oligonucleotide
ctaatacgattaagtttggtcctgataaatgtcgagaggac

SEQ ID NO: 246938 - DNA, 47 bp, Artificial Sequence
  Description of Artificial Sequence: Synthetic oligonucleotide
taatacgattaagtttggtcctgataaatgtcgagaggactttaaac

SEQ ID NO: 246939 - DNA, 46 bp, Artificial Sequence
  Description of Artificial Sequence: Synthetic oligonucleotide
aatacgattaagtttggtcctgataaatgtcgagaggactttaaac

SEQ ID NO: 246940 - DNA, 45 bp, Artificial Sequence
  Description of Artificial Sequence: Synthetic oligonucleotide
atacgattaagtttggtcctgataaatgtcgagaggactttaaac

SEQ ID NO: 246941 - DNA, 44 bp, Artificial Sequence
  Description of Artificial Sequence: Synthetic oligonucleotide
tacgattaagtttggtcctgataaatgtcgagaggactttaaac

SEQ ID NO: 246942 - DNA, 43 bp, Artificial Sequence
  Description of Artificial Sequence: Synthetic oligonucleotide
acgattaagtttggtcctgataaatgtcgagaggactttaaac

SEQ ID NO: 246943 - DNA, 42 bp, Artificial Sequence
  Description of Artificial Sequence: Synthetic oligonucleotide
cgattaagtttggtcctgataaatgtcgagaggactttaaac

SEQ ID NO: 246944 - DNA, 43 bp, Artificial Sequence
  Description of Artificial Sequence: Synthetic oligonucleotide
gattaagtttggtcctgataaatgtcgagaggactttaaactg

SEQ ID NO: 246945 - DNA, 43 bp, Artificial Sequence
  Description of Artificial Sequence: Synthetic oligonucleotide
attaagtttggtcctgataaatgtcgagaggactttaaactgc

SEQ ID NO: 246946 - DNA, 42 bp, Artificial Sequence
  Description of Artificial Sequence: Synthetic oligonucleotide
ttaagtttggtcctgataaatgtcgagaggactttaaactgc

SEQ ID NO: 246947 - DNA, 41 bp, Artificial Sequence
  Description of Artificial Sequence: Synthetic oligonucleotide
taagtttggtcctgataaatgtcgagaggactttaaactgc

SEQ ID NO: 246948 - DNA, 40 bp, Artificial Sequence
  Description of Artificial Sequence: Synthetic oligonucleotide
aagtttggtcctgataaatgtcgagaggactttaaactgc

SEQ ID NO: 246949 - DNA, 39 bp, Artificial Sequence
  Description of Artificial Sequence: Synthetic oligonucleotide
agtttggtcctgataaatgtcgagaggactttaaactgc

SEQ ID NO: 246950 - DNA, 38 bp, Artificial Sequence
  Description of Artificial Sequence: Synthetic oligonucleotide
gtttggtcctgataaatgtcgagaggactttaaactgc

SEQ ID NO: 246951 - DNA, 39 bp, Artificial Sequence
  Description of Artificial Sequence: Synthetic oligonucleotide
tttggtcctgataaatgtcgagaggactttaaactgcag

SEQ ID NO: 246952 - DNA, 38 bp, Artificial Sequence
  Description of Artificial Sequence: Synthetic oligonucleotide
ttggtcctgataaatgtcgagaggactttaaactgcag

SEQ ID NO: 246953 - DNA, 37 bp, Artificial Sequence
  Description of Artificial Sequence: Synthetic oligonucleotide
tggtcctgataaatgtcgagaggactttaaactgcag

SEQ ID NO: 246954 - DNA, 36 bp, Artificial Sequence
  Description of Artificial Sequence: Synthetic oligonucleotide
ggtcctgataaatgtcgagaggactttaaactgcag

SEQ ID NO: 246955 - DNA, 38 bp, Artificial Sequence
  Description of Artificial Sequence: Synthetic oligonucleotide
gtcctgataaatgtcgagaggactttaaactgcagttc

SEQ ID NO: 246956 - DNA, 40 bp, Artificial Sequence
  Description of Artificial Sequence: Synthetic oligonucleotide
tcctgataaatgtcgagaggactttaaactgcagttcatc

SEQ ID NO: 246957 - DNA, 39 bp, Artificial Sequence
  Description of Artificial Sequence: Synthetic oligonucleotide
cctgataaatgtcgagaggactttaaactgcagttcatc

SEQ ID NO: 246958 - DNA, 41 bp, Artificial Sequence
  Description of Artificial Sequence: Synthetic oligonucleotide
ctgataaatgtcgagaggactttaaactgcagttcatcttc

SEQ ID NO: 246959 - DNA, 41 bp, Artificial Sequence
  Description of Artificial Sequence: Synthetic oligonucleotide
tgataaatgtcgagaggactttaaactgcagttcatcttcg

SEQ ID NO: 246960 - DNA, 40 bp, Artificial Sequence
  Description of Artificial Sequence: Synthetic oligonucleotide
gataaatgtcgagaggactttaaactgcagttcatcttcg

SEQ ID NO: 246961 - DNA, 40 bp, Artificial Sequence
  Description of Artificial Sequence: Synthetic oligonucleotide
ataaatgtcgagaggactttaaactgcagttcatcttcgg

SEQ ID NO: 246962 - DNA, 39 bp, Artificial Sequence
  Description of Artificial Sequence: Synthetic oligonucleotide
taaatgtcgagaggactttaaactgcagttcatcttcgg

SEQ ID NO: 246963 - DNA, 38 bp, Artificial Sequence
  Description of Artificial Sequence: Synthetic oligonucleotide
aaatgtcgagaggactttaaactgcagttcatcttcgg

SEQ ID NO: 246964 - DNA, 37 bp, Artificial Sequence
  Description of Artificial Sequence: Synthetic oligonucleotide
aatgtcgagaggactttaaactgcagttcatcttcgg

SEQ ID NO: 246965 - DNA, 36 bp, Artificial Sequence
  Description of Artificial Sequence: Synthetic oligonucleotide
atgtcgagaggactttaaactgcagttcatcttcgg

SEQ ID NO: 246966 - DNA, 35 bp, Artificial Sequence
  Description of Artificial Sequence: Synthetic oligonucleotide
tgtcgagaggactttaaactgcagttcatcttcgg

SEQ ID NO: 246967 - DNA, 34 bp, Artificial Sequence
  Description of Artificial Sequence: Synthetic oligonucleotide
gtcgagaggactttaaactgcagttcatcttcgg

SEQ ID NO: 246968 - DNA, 35 bp, Artificial Sequence
  Description of Artificial Sequence: Synthetic oligonucleotide
tcgagaggactttaaactgcagttcatcttcggac

SEQ ID NO: 246969 - DNA, 34 bp, Artificial Sequence
  Description of Artificial Sequence: Synthetic oligonucleotide
cgagaggactttaaactgcagttcatcttcggac

SEQ ID NO: 246970 - DNA, 35 bp, Artificial Sequence
  Description of Artificial Sequence: Synthetic oligonucleotide
gagaggactttaaactgcagttcatcttcggacac

SEQ ID NO: 246971 - DNA, 40 bp, Artificial Sequence
  Description of Artificial Sequence: Synthetic oligonucleotide
agaggactttaaactgcagttcatcttcggacacaaaatc

SEQ ID NO: 246972 - DNA, 39 bp, Artificial Sequence
  Description of Artificial Sequence: Synthetic oligonucleotide
gaggactttaaactgcagttcatcttcggacacaaaatc

SEQ ID NO: 246973 - DNA, 39 bp, Artificial Sequence
  Description of Artificial Sequence: Synthetic oligonucleotide
aggactttaaactgcagttcatcttcggacacaaaatcc

SEQ ID NO: 246974 - DNA, 38 bp, Artificial Sequence
  Description of Artificial Sequence: Synthetic oligonucleotide
ggactttaaactgcagttcatcttcggacacaaaatcc

SEQ ID NO: 246975 - DNA, 38 bp, Artificial Sequence
  Description of Artificial Sequence: Synthetic oligonucleotide
gactttaaactgcagttcatcttcggacacaaaatccc

SEQ ID NO: 246976 - DNA, 38 bp, Artificial Sequence
  Description of Artificial Sequence: Synthetic oligonucleotide
actttaaactgcagttcatcttcggacacaaaatcccc

SEQ ID NO: 246977 - DNA, 37 bp, Artificial Sequence
  Description of Artificial Sequence: Synthetic oligonucleotide
ctttaaactgcagttcatcttcggacacaaaatcccc

SEQ ID NO: 246978 - DNA, 41 bp, Artificial Sequence
  Description of Artificial Sequence: Synthetic oligonucleotide
tttaaactgcagttcatcttcggacacaaaatccccaaaac

SEQ ID NO: 246979 - DNA, 40 bp, Artificial Sequence
  Description of Artificial Sequence: Synthetic oligonucleotide
ttaaactgcagttcatcttcggacacaaaatccccaaaac

SEQ ID NO: 246980 - DNA, 39 bp, Artificial Sequence
  Description of Artificial Sequence: Synthetic oligonucleotide
taaactgcagttcatcttcggacacaaaatccccaaaac

SEQ ID NO: 246981 - DNA, 38 bp, Artificial Sequence
  Description of Artificial Sequence: Synthetic oligonucleotide
aaactgcagttcatcttcggacacaaaatccccaaaac

SEQ ID NO: 246982 - DNA, 37 bp, Artificial Sequence
  Description of Artificial Sequence: Synthetic oligonucleotide
aactgcagttcatcttcggacacaaaatccccaaaac

SEQ ID NO: 246983 - DNA, 36 bp, Artificial Sequence
  Description of Artificial Sequence: Synthetic oligonucleotide
actgcagttcatcttcggacacaaaatccccaaaac

SEQ ID NO: 246984 - DNA, 35 bp, Artificial Sequence
  Description of Artificial Sequence: Synthetic oligonucleotide
ctgcagttcatcttcggacacaaaatccccaaaac

SEQ ID NO: 246985 - DNA, 35 bp, Artificial Sequence
  Description of Artificial Sequence: Synthetic oligonucleotide
tgcagttcatcttcggacacaaaatccccaaaacc

SEQ ID NO: 246986 - DNA, 34 bp, Artificial Sequence
  Description of Artificial Sequence: Synthetic oligonucleotide
gcagttcatcttcggacacaaaatccccaaaacc

SEQ ID NO: 246987 - DNA, 34 bp, Artificial Sequence
  Description of Artificial Sequence: Synthetic oligonucleotide
cagttcatcttcggacacaaaatccccaaaaccg

SEQ ID NO: 246988 - DNA, 34 bp, Artificial Sequence
  Description of Artificial Sequence: Synthetic oligonucleotide
agttcatcttcggacacaaaatccccaaaaccgg

SEQ ID NO: 246989 - DNA, 33 bp, Artificial Sequence
  Description of Artificial Sequence: Synthetic oligonucleotide
gttcatcttcggacacaaaatccccaaaaccgg

SEQ ID NO: 246990 - DNA, 36 bp, Artificial Sequence
  Description of Artificial Sequence: Synthetic oligonucleotide
ttcatcttcggacacaaaatccccaaaaccggtatc

SEQ ID NO: 246991 - DNA, 35 bp, Artificial Sequence
  Description of Artificial Sequence: Synthetic oligonucleotide
tcatcttcggacacaaaatccccaaaaccggtatc

SEQ ID NO: 246992 - DNA, 34 bp, Artificial Sequence
  Description of Artificial Sequence: Synthetic oligonucleotide
catcttcggacacaaaatccccaaaaccggtatc

SEQ ID NO: 246993 - DNA, 37 bp, Artificial Sequence
  Description of Artificial Sequence: Synthetic oligonucleotide
atcttcggacacaaaatccccaaaaccggtatctatc

SEQ ID NO: 246994 - DNA, 36 bp, Artificial Sequence
  Description of Artificial Sequence: Synthetic oligonucleotide
tcttcggacacaaaatccccaaaaccggtatctatc

SEQ ID NO: 246995 - DNA, 35 bp, Artificial Sequence
  Description of Artificial Sequence: Synthetic oligonucleotide
cttcggacacaaaatccccaaaaccggtatctatc

SEQ ID NO: 246996 - DNA, 37 bp, Artificial Sequence
  Description of Artificial Sequence: Synthetic oligonucleotide
ttcggacacaaaatccccaaaaccggtatctatcaag

SEQ ID NO: 246997 - DNA, 36 bp, Artificial Sequence
  Description of Artificial Sequence: Synthetic oligonucleotide
tcggacacaaaatccccaaaaccggtatctatcaag

SEQ ID NO: 246998 - DNA, 35 bp, Artificial Sequence
  Description of Artificial Sequence: Synthetic oligonucleotide
cggacacaaaatccccaaaaccggtatctatcaag

SEQ ID NO: 246999 - DNA, 40 bp, Artificial Sequence
  Description of Artificial Sequence: Synthetic oligonucleotide
ggacacaaaatccccaaaaccggtatctatcaagaaaaac

SEQ ID NO: 247000 - DNA, 42 bp, Artificial Sequence
  Description of Artificial Sequence: Synthetic oligonucleotide
gacacaaaatccccaaaaccggtatctatcaagaaaaacttg

SEQ ID NO: 247001 - DNA, 42 bp, Artificial Sequence
  Description of Artificial Sequence: Synthetic oligonucleotide
acacaaaatccccaaaaccggtatctatcaagaaaaacttgc

SEQ ID NO: 247002 - DNA, 41 bp, Artificial Sequence
  Description of Artificial Sequence: Synthetic oligonucleotide
cacaaaatccccaaaaccggtatctatcaagaaaaacttgc

SEQ ID NO: 247003 - DNA, 44 bp, Artificial Sequence
  Description of Artificial Sequence: Synthetic oligonucleotide
acaaaatccccaaaaccggtatctatcaagaaaaacttgctaag

SEQ ID NO: 247004 - DNA, 43 bp, Artificial Sequence
  Description of Artificial Sequence: Synthetic oligonucleotide
caaaatccccaaaaccggtatctatcaagaaaaacttgctaag

SEQ ID NO: 247005 - DNA, 44 bp, Artificial Sequence
  Description of Artificial Sequence: Synthetic oligonucleotide
aaaatccccaaaaccggtatctatcaagaaaaacttgctaagag

SEQ ID NO: 247006 - DNA, 43 bp, Artificial Sequence
  Description of Artificial Sequence: Synthetic oligonucleotide
aaatccccaaaaccggtatctatcaagaaaaacttgctaagag

SEQ ID NO: 247007 - DNA, 42 bp, Artificial Sequence
  Description of Artificial Sequence: Synthetic oligonucleotide
aatccccaaaaccggtatctatcaagaaaaacttgctaagag

SEQ ID NO: 247008 - DNA, 41 bp, Artificial Sequence
  Description of Artificial Sequence: Synthetic oligonucleotide
atccccaaaaccggtatctatcaagaaaaacttgctaagag

SEQ ID NO: 247009 - DNA, 40 bp, Artificial Sequence
  Description of Artificial Sequence: Synthetic oligonucleotide
tccccaaaaccggtatctatcaagaaaaacttgctaagag

SEQ ID NO: 247010 - DNA, 39 bp, Artificial Sequence
  Description of Artificial Sequence: Synthetic oligonucleotide
ccccaaaaccggtatctatcaagaaaaacttgctaagag

SEQ ID NO: 247011 - DNA, 39 bp, Artificial Sequence
  Description of Artificial Sequence: Synthetic oligonucleotide
cccaaaaccggtatctatcaagaaaaacttgctaagagc

SEQ ID NO: 247012 - DNA, 39 bp, Artificial Sequence
  Description of Artificial Sequence: Synthetic oligonucleotide
ccaaaaccggtatctatcaagaaaaacttgctaagagcc

SEQ ID NO: 247013 - DNA, 39 bp, Artificial Sequence
  Description of Artificial Sequence: Synthetic oligonucleotide
caaaaccggtatctatcaagaaaaacttgctaagagccc

SEQ ID NO: 247014 - DNA, 40 bp, Artificial Sequence
  Description of Artificial Sequence: Synthetic oligonucleotide
aaaaccggtatctatcaagaaaaacttgctaagagcccag

SEQ ID NO: 247015 - DNA, 39 bp, Artificial Sequence
  Description of Artificial Sequence: Synthetic oligonucleotide
aaaccggtatctatcaagaaaaacttgctaagagcccag

SEQ ID NO: 247016 - DNA, 38 bp, Artificial Sequence
  Description of Artificial Sequence: Synthetic oligonucleotide
aaccggtatctatcaagaaaaacttgctaagagcccag

SEQ ID NO: 247017 - DNA, 37 bp, Artificial Sequence
  Description of Artificial Sequence: Synthetic oligonucleotide
accggtatctatcaagaaaaacttgctaagagcccag

SEQ ID NO: 247018 - DNA, 36 bp, Artificial Sequence
  Description of Artificial Sequence: Synthetic oligonucleotide
ccggtatctatcaagaaaaacttgctaagagcccag

SEQ ID NO: 247019 - DNA, 38 bp, Artificial Sequence
  Description of Artificial Sequence: Synthetic oligonucleotide
cggtatctatcaagaaaaacttgctaagagcccagatg

SEQ ID NO: 247020 - DNA, 38 bp, Artificial Sequence
  Description of Artificial Sequence: Synthetic oligonucleotide
ggtatctatcaagaaaaacttgctaagagcccagatgc

SEQ ID NO: 247021 - DNA, 39 bp, Artificial Sequence
  Description of Artificial Sequence: Synthetic oligonucleotide
gtatctatcaagaaaaacttgctaagagcccagatgcac

SEQ ID NO: 247022 - DNA, 41 bp, Artificial Sequence
  Description of Artificial Sequence: Synthetic oligonucleotide
tatctatcaagaaaaacttgctaagagcccagatgcacatc

SEQ ID NO: 247023 - DNA, 40 bp, Artificial Sequence
  Description of Artificial Sequence: Synthetic oligonucleotide
atctatcaagaaaaacttgctaagagcccagatgcacatc

SEQ ID NO: 247024 - DNA, 39 bp, Artificial Sequence
  Description of Artificial Sequence: Synthetic oligonucleotide
tctatcaagaaaaacttgctaagagcccagatgcacatc

SEQ ID NO: 247025 - DNA, 38 bp, Artificial Sequence
  Description of Artificial Sequence: Synthetic oligonucleotide
ctatcaagaaaaacttgctaagagcccagatgcacatc

SEQ ID NO: 247026 - DNA, 39 bp, Artificial Sequence
  Description of Artificial Sequence: Synthetic oligonucleotide
tatcaagaaaaacttgctaagagcccagatgcacatctg

SEQ ID NO: 247027 - DNA, 38 bp, Artificial Sequence
  Description of Artificial Sequence: Synthetic oligonucleotide
atcaagaaaaacttgctaagagcccagatgcacatctg

SEQ ID NO: 247028 - DNA, 37 bp, Artificial Sequence
  Description of Artificial Sequence: Synthetic oligonucleotide
tcaagaaaaacttgctaagagcccagatgcacatctg

SEQ ID NO: 247029 - DNA, 36 bp, Artificial Sequence
  Description of Artificial Sequence: Synthetic oligonucleotide
caagaaaaacttgctaagagcccagatgcacatctg

SEQ ID NO: 247030 - DNA, 38 bp, Artificial Sequence
  Description of Artificial Sequence: Synthetic oligonucleotide
aagaaaaacttgctaagagcccagatgcacatctgaag

SEQ ID NO: 247031 - DNA, 37 bp, Artificial Sequence
  Description of Artificial Sequence: Synthetic oligonucleotide
agaaaaacttgctaagagcccagatgcacatctgaag

SEQ ID NO: 247032 - DNA, 36 bp, Artificial Sequence
  Description of Artificial Sequence: Synthetic oligonucleotide
gaaaaacttgctaagagcccagatgcacatctgaag

SEQ ID NO: 247033 - DNA, 37 bp, Artificial Sequence
  Description of Artificial Sequence: Synthetic oligonucleotide
aaaaacttgctaagagcccagatgcacatctgaagag

SEQ ID NO: 247034 - DNA, 36 bp, Artificial Sequence
  Description of Artificial Sequence: Synthetic oligonucleotide
aaaacttgctaagagcccagatgcacatctgaagag

SEQ ID NO: 247035 - DNA, 35 bp, Artificial Sequence
  Description of Artificial Sequence: Synthetic oligonucleotide
aaacttgctaagagcccagatgcacatctgaagag

SEQ ID NO: 247036 - DNA, 34 bp, Artificial Sequence
  Description of Artificial Sequence: Synthetic oligonucleotide
aacttgctaagagcccagatgcacatctgaagag

SEQ ID NO: 247037 - DNA, 33 bp, Artificial Sequence
  Description of Artificial Sequence: Synthetic oligonucleotide
acttgctaagagcccagatgcacatctgaagag

SEQ ID NO: 247038 - DNA, 32 bp, Artificial Sequence
  Description of Artificial Sequence: Synthetic oligonucleotide
cttgctaagagcccagatgcacatctgaagag

SEQ ID NO: 247039 - DNA, 32 bp, Artificial Sequence
  Description of Artificial Sequence: Synthetic oligonucleotide
ttgctaagagcccagatgcacatctgaagagc

SEQ ID NO: 247040 - DNA, 31 bp, Artificial Sequence
  Description of Artificial Sequence: Synthetic oligonucleotide
tgctaagagcccagatgcacatctgaagagc

SEQ ID NO: 247041 - DNA, 30 bp, Artificial Sequence
  Description of Artificial Sequence: Synthetic oligonucleotide
gctaagagcccagatgcacatctgaagagc

SEQ ID NO: 247042 - DNA, 37 bp, Artificial Sequence
  Description of Artificial Sequence: Synthetic oligonucleotide
ctaagagcccagatgcacatctgaagagctattttac

SEQ ID NO: 247043 - DNA, 38 bp, Artificial Sequence
  Description of Artificial Sequence: Synthetic oligonucleotide
taagagcccagatgcacatctgaagagctattttacag

SEQ ID NO: 247044 - DNA, 37 bp, Artificial Sequence
  Description of Artificial Sequence: Synthetic oligonucleotide
aagagcccagatgcacatctgaagagctattttacag

SEQ ID NO: 247045 - DNA, 36 bp, Artificial Sequence
  Description of Artificial Sequence: Synthetic oligonucleotide
agagcccagatgcacatctgaagagctattttacag

SEQ ID NO: 247046 - DNA, 35 bp, Artificial Sequence
  Description of Artificial Sequence: Synthetic oligonucleotide
gagcccagatgcacatctgaagagctattttacag

SEQ ID NO: 247047 - DNA, 39 bp, Artificial Sequence
  Description of Artificial Sequence: Synthetic oligonucleotide
agcccagatgcacatctgaagagctattttacagataag

SEQ ID NO: 247048 - DNA, 38 bp, Artificial Sequence
  Description of Artificial Sequence: Synthetic oligonucleotide
gcccagatgcacatctgaagagctattttacagataag

SEQ ID NO: 247049 - DNA, 42 bp, Artificial Sequence
  Description of Artificial Sequence: Synthetic oligonucleotide
cccagatgcacatctgaagagctattttacagataagaaatc

SEQ ID NO: 247050 - DNA, 43 bp, Artificial Sequence
  Description of Artificial Sequence: Synthetic oligonucleotide
ccagatgcacatctgaagagctattttacagataagaaatcac

SEQ ID NO: 247051 - DNA, 45 bp, Artificial Sequence
  Description of Artificial Sequence: Synthetic oligonucleotide
cagatgcacatctgaagagctattttacagataagaaatcacatc

SEQ ID NO: 247052 - DNA, 49 bp, Artificial Sequence
  Description of Artificial Sequence: Synthetic oligonucleotide
agatgcacatctgaagagctattttacagataagaaatcacatcttttc

SEQ ID NO: 247053 - DNA, 48 bp, Artificial Sequence
  Description of Artificial Sequence: Synthetic oligonucleotide
gatgcacatctgaagagctattttacagataagaaatcacatcttttc

SEQ ID NO: 247054 - DNA, 49 bp, Artificial Sequence
  Description of Artificial Sequence: Synthetic oligonucleotide
atgcacatctgaagagctattttacagataagaaatcacatcttttcac

SEQ ID NO: 247055 - DNA, 48 bp, Artificial Sequence
  Description of Artificial Sequence: Synthetic oligonucleotide
tgcacatctgaagagctattttacagataagaaatcacatcttttcac

SEQ ID NO: 247056 - DNA, 47 bp, Artificial Sequence
  Description of Artificial Sequence: Synthetic oligonucleotide
gcacatctgaagagctattttacagataagaaatcacatcttttcac

SEQ ID NO: 247057 - DNA, 48 bp, Artificial Sequence
  Description of Artificial Sequence: Synthetic oligonucleotide
cacatctgaagagctattttacagataagaaatcacatcttttcacac

SEQ ID NO: 247058 - DNA, 52 bp, Artificial Sequence
  Description of Artificial Sequence: Synthetic oligonucleotide
acatctgaagagctattttacagataagaaatcacatcttttcacactaatg

SEQ ID NO: 247059 - DNA, 51 bp, Artificial Sequence
  Description of Artificial Sequence: Synthetic oligonucleotide
catctgaagagctattttacagataagaaatcacatcttttcacactaatg

SEQ ID NO: 247060 - DNA, 53 bp, Artificial Sequence
  Description of Artificial Sequence: Synthetic oligonucleotide
atctgaagagctattttacagataagaaatcacatcttttcacactaatgttg

SEQ ID NO: 247061 - DNA, 52 bp, Artificial Sequence
  Description of Artificial Sequence: Synthetic oligonucleotide
tctgaagagctattttacagataagaaatcacatcttttcacactaatgttg

SEQ ID NO: 247062 - DNA, 51 bp, Artificial Sequence
  Description of Artificial Sequence: Synthetic oligonucleotide
ctgaagagctattttacagataagaaatcacatcttttcacactaatgttg

SEQ ID NO: 247063 - DNA, 54 bp, Artificial Sequence
  Description of Artificial Sequence: Synthetic oligonucleotide
tgaagagctattttacagataagaaatcacatcttttcacactaatgttgaatc

SEQ ID NO: 247064 - DNA, 53 bp, Artificial Sequence
  Description of Artificial Sequence: Synthetic oligonucleotide
gaagagctattttacagataagaaatcacatcttttcacactaatgttgaatc

SEQ ID NO: 247065 - DNA, 53 bp, Artificial Sequence
  Description of Artificial Sequence: Synthetic oligonucleotide
aagagctattttacagataagaaatcacatcttttcacactaatgttgaatcc

SEQ ID NO: 247066 - DNA, 52 bp, Artificial Sequence
  Description of Artificial Sequence: Synthetic oligonucleotide
agagctattttacagataagaaatcacatcttttcacactaatgttgaatcc

SEQ ID NO: 247067 - DNA, 51 bp, Artificial Sequence
  Description of Artificial Sequence: Synthetic oligonucleotide
gagctattttacagataagaaatcacatcttttcacactaatgttgaatcc

SEQ ID NO: 247068 - DNA, 52 bp, Artificial Sequence
  Description of Artificial Sequence: Synthetic oligonucleotide
agctattttacagataagaaatcacatcttttcacactaatgttgaatccac

SEQ ID NO: 247069 - DNA, 51 bp, Artificial Sequence
  Description of Artificial Sequence: Synthetic oligonucleotide
gctattttacagataagaaatcacatcttttcacactaatgttgaatccac

SEQ ID NO: 247070 - DNA, 57 bp, Artificial Sequence
  Description of Artificial Sequence: Synthetic oligonucleotide
ctattttacagataagaaatcacatcttttcacactaatgttgaatccacataatag

SEQ ID NO: 247071 - DNA, 60 bp, Artificial Sequence
  Description of Artificial Sequence: Synthetic oligonucleotide
tattttacagataagaaatcacatcttttcacactaatgttgaatccacataatagttat

SEQ ID NO: 247072 - DNA, 60 bp, Artificial Sequence
  Description of Artificial Sequence: Synthetic oligonucleotide
attttacagataagaaatcacatcttttcacactaatgttgaatccacataatagttatg

SEQ ID NO: 247073 - DNA, 59 bp, Artificial Sequence
  Description of Artificial Sequence: Synthetic oligonucleotide
ttttacagataagaaatcacatcttttcacactaatgttgaatccacataatagttatg

SEQ ID NO: 247074 - DNA, 58 bp, Artificial Sequence
  Description of Artificial Sequence: Synthetic oligonucleotide
tttacagataagaaatcacatcttttcacactaatgttgaatccacataatagttatg

SEQ ID NO: 247075 - DNA, 57 bp, Artificial Sequence
  Description of Artificial Sequence: Synthetic oligonucleotide
ttacagataagaaatcacatcttttcacactaatgttgaatccacataatagttatg

SEQ ID NO: 247076 - DNA, 56 bp, Artificial Sequence
  Description of Artificial Sequence: Synthetic oligonucleotide
tacagataagaaatcacatcttttcacactaatgttgaatccacataatagttatg

SEQ ID NO: 247077 - DNA, 55 bp, Artificial Sequence
  Description of Artificial Sequence: Synthetic oligonucleotide
acagataagaaatcacatcttttcacactaatgttgaatccacataatagttatg

SEQ ID NO: 247078 - DNA, 54 bp, Artificial Sequence
  Description of Artificial Sequence: Synthetic oligonucleotide
cagataagaaatcacatcttttcacactaatgttgaatccacataatagttatg

SEQ ID NO: 247079 - DNA, 59 bp, Artificial Sequence
  Description of Artificial Sequence: Synthetic oligonucleotide
agataagaaatcacatcttttcacactaatgttgaatccacataatagttatgaaatac

SEQ ID NO: 247080 - DNA, 58 bp, Artificial Sequence
  Description of Artificial Sequence: Synthetic oligonucleotide
gataagaaatcacatcttttcacactaatgttgaatccacataatagttatgaaatac

SEQ ID NO: 247081 - DNA, 59 bp, Artificial Sequence
  Description of Artificial Sequence: Synthetic oligonucleotide
ataagaaatcacatcttttcacactaatgttgaatccacataatagttatgaaatactc

SEQ ID NO: 247082 - DNA, 58 bp, Artificial Sequence
  Description of Artificial Sequence: Synthetic oligonucleotide
taagaaatcacatcttttcacactaatgttgaatccacataatagttatgaaatactc

SEQ ID NO: 247083 - DNA, 57 bp, Artificial Sequence
  Description of Artificial Sequence: Synthetic oligonucleotide
aagaaatcacatcttttcacactaatgttgaatccacataatagttatgaaatactc

SEQ ID NO: 247084 - DNA, 56 bp, Artificial Sequence
  Description of Artificial Sequence: Synthetic oligonucleotide
agaaatcacatcttttcacactaatgttgaatccacataatagttatgaaatactc

SEQ ID NO: 247085 - DNA, 55 bp, Artificial Sequence
  Description of Artificial Sequence: Synthetic oligonucleotide
gaaatcacatcttttcacactaatgttgaatccacataatagttatgaaatactc

SEQ ID NO: 247086 - DNA, 55 bp, Artificial Sequence
  Description of Artificial Sequence: Synthetic oligonucleotide
aaatcacatcttttcacactaatgttgaatccacataatagttatgaaatactcg

SEQ ID NO: 247087 - DNA, 54 bp, Artificial Sequence
  Description of Artificial Sequence: Synthetic oligonucleotide
aatcacatcttttcacactaatgttgaatccacataatagttatgaaatactcg

SEQ ID NO: 247088 - DNA, 53 bp, Artificial Sequence
  Description of Artificial Sequence: Synthetic oligonucleotide
atcacatcttttcacactaatgttgaatccacataatagttatgaaatactcg

SEQ ID NO: 247089 - DNA, 52 bp, Artificial Sequence
  Description of Artificial Sequence: Synthetic oligonucleotide
tcacatcttttcacactaatgttgaatccacataatagttatgaaatactcg

SEQ ID NO: 247090 - DNA, 51 bp, Artificial Sequence
  Description of Artificial Sequence: Synthetic oligonucleotide
cacatcttttcacactaatgttgaatccacataatagttatgaaatactcg

SEQ ID NO: 247091 - DNA, 53 bp, Artificial Sequence
  Description of Artificial Sequence: Synthetic oligonucleotide
acatcttttcacactaatgttgaatccacataatagttatgaaatactcgttg

SEQ ID NO: 247092 - DNA, 52 bp, Artificial Sequence
  Description of Artificial Sequence: Synthetic oligonucleotide
catcttttcacactaatgttgaatccacataatagttatgaaatactcgttg

SEQ ID NO: 247093 - DNA, 53 bp, Artificial Sequence
  Description of Artificial Sequence: Synthetic oligonucleotide
atcttttcacactaatgttgaatccacataatagttatgaaatactcgttgac

SEQ ID NO: 247094 - DNA, 52 bp, Artificial Sequence
  Description of Artificial Sequence: Synthetic oligonucleotide
tcttttcacactaatgttgaatccacataatagttatgaaatactcgttgac

SEQ ID NO: 247095 - DNA, 51 bp, Artificial Sequence
  Description of Artificial Sequence: Synthetic oligonucleotide
cttttcacactaatgttgaatccacataatagttatgaaatactcgttgac

SEQ ID NO: 247096 - DNA, 51 bp, Artificial Sequence
  Description of Artificial Sequence: Synthetic oligonucleotide
ttttcacactaatgttgaatccacataatagttatgaaatactcgttgacc

SEQ ID NO: 247097 - DNA, 50 bp, Artificial Sequence
  Description of Artificial Sequence: Synthetic oligonucleotide
tttcacactaatgttgaatccacataatagttatgaaatactcgttgacc

SEQ ID NO: 247098 - DNA, 49 bp, Artificial Sequence
  Description of Artificial Sequence: Synthetic oligonucleotide
ttcacactaatgttgaatccacataatagttatgaaatactcgttgacc

SEQ ID NO: 247099 - DNA, 48 bp, Artificial Sequence
  Description of Artificial Sequence: Synthetic oligonucleotide
tcacactaatgttgaatccacataatagttatgaaatactcgttgacc

SEQ ID NO: 247100 - DNA, 47 bp, Artificial Sequence
  Description of Artificial Sequence: Synthetic oligonucleotide
cacactaatgttgaatccacataatagttatgaaatactcgttgacc

SEQ ID NO: 247101 - DNA, 50 bp, Artificial Sequence
  Description of Artificial Sequence: Synthetic oligonucleotide
acactaatgttgaatccacataatagttatgaaatactcgttgaccaaac

SEQ ID NO: 247102 - DNA, 49 bp, Artificial Sequence
  Description of Artificial Sequence: Synthetic oligonucleotide
cactaatgttgaatccacataatagttatgaaatactcgttgaccaaac

SEQ ID NO: 247103 - DNA, 50 bp, Artificial Sequence
  Description of Artificial Sequence: Synthetic oligonucleotide
actaatgttgaatccacataatagttatgaaatactcgttgaccaaactg

SEQ ID NO: 247104 - DNA, 49 bp, Artificial Sequence
  Description of Artificial Sequence: Synthetic oligonucleotide
ctaatgttgaatccacataatagttatgaaatactcgttgaccaaactg

SEQ ID NO: 247105 - DNA, 50 bp, Artificial Sequence
  Description of Artificial Sequence: Synthetic oligonucleotide
taatgttgaatccacataatagttatgaaatactcgttgaccaaactgtg

SEQ ID NO: 247106 - DNA, 49 bp, Artificial Sequence
  Description of Artificial Sequence: Synthetic oligonucleotide
aatgttgaatccacataatagttatgaaatactcgttgaccaaactgtg

SEQ ID NO: 247107 - DNA, 48 bp, Artificial Sequence
  Description of Artificial Sequence: Synthetic oligonucleotide
atgttgaatccacataatagttatgaaatactcgttgaccaaactgtg

SEQ ID NO: 247108 - DNA, 47 bp, Artificial Sequence
  Description of Artificial Sequence: Synthetic oligonucleotide
tgttgaatccacataatagttatgaaatactcgttgaccaaactgtg

SEQ ID NO: 247109 - DNA, 46 bp, Artificial Sequence
  Description of Artificial Sequence: Synthetic oligonucleotide
gttgaatccacataatagttatgaaatactcgttgaccaaactgtg

SEQ ID NO: 247110 - DNA, 46 bp, Artificial Sequence
  Description of Artificial Sequence: Synthetic oligonucleotide
ttgaatccacataatagttatgaaatactcgttgaccaaactgtgg

SEQ ID NO: 247111 - DNA, 45 bp, Artificial Sequence
  Description of Artificial Sequence: Synthetic oligonucleotide
tgaatccacataatagttatgaaatactcgttgaccaaactgtgg

SEQ ID NO: 247112 - DNA, 44 bp, Artificial Sequence
  Description of Artificial Sequence: Synthetic oligonucleotide
gaatccacataatagttatgaaatactcgttgaccaaactgtgg

SEQ ID NO: 247113 - DNA, 45 bp, Artificial Sequence
  Description of Artificial Sequence: Synthetic oligonucleotide
aatccacataatagttatgaaatactcgttgaccaaactgtggtg

SEQ ID NO: 247114 - DNA, 44 bp, Artificial Sequence
  Description of Artificial Sequence: Synthetic oligonucleotide
atccacataatagttatgaaatactcgttgaccaaactgtggtg

SEQ ID NO: 247115 - DNA, 43 bp, Artificial Sequence
  Description of Artificial Sequence: Synthetic oligonucleotide
tccacataatagttatgaaatactcgttgaccaaactgtggtg

SEQ ID NO: 247116 - DNA, 42 bp, Artificial Sequence
  Description of Artificial Sequence: Synthetic oligonucleotide
ccacataatagttatgaaatactcgttgaccaaactgtggtg

SEQ ID NO: 247117 - DNA, 46 bp, Artificial Sequence
  Description of Artificial Sequence: Synthetic oligonucleotide
cacataatagttatgaaatactcgttgaccaaactgtggtgattag

SEQ ID NO: 247118 - DNA, 47 bp, Artificial Sequence
  Description of Artificial Sequence: Synthetic oligonucleotide
acataatagttatgaaatactcgttgaccaaactgtggtgattagtg

SEQ ID NO: 247119 - DNA, 46 bp, Artificial Sequence
  Description of Artificial Sequence: Synthetic oligonucleotide
cataatagttatgaaatactcgttgaccaaactgtggtgattagtg

SEQ ID NO: 247120 - DNA, 46 bp, Artificial Sequence
  Description of Artificial Sequence: Synthetic oligonucleotide
ataatagttatgaaatactcgttgaccaaactgtggtgattagtgg

SEQ ID NO: 247121 - DNA, 45 bp, Artificial Sequence
  Description of Artificial Sequence: Synthetic oligonucleotide
taatagttatgaaatactcgttgaccaaactgtggtgattagtgg

SEQ ID NO: 247122 - DNA, 44 bp, Artificial Sequence
  Description of Artificial Sequence: Synthetic oligonucleotide
aatagttatgaaatactcgttgaccaaactgtggtgattagtgg

SEQ ID NO: 247123 - DNA, 43 bp, Artificial Sequence
  Description of Artificial Sequence: Synthetic oligonucleotide
atagttatgaaatactcgttgaccaaactgtggtgattagtgg

SEQ ID NO: 247124 - DNA, 42 bp, Artificial Sequence
  Description of Artificial Sequence: Synthetic oligonucleotide
tagttatgaaatactcgttgaccaaactgtggtgattagtgg

SEQ ID NO: 247125 - DNA, 41 bp, Artificial Sequence
  Description of Artificial Sequence: Synthetic oligonucleotide
agttatgaaatactcgttgaccaaactgtggtgattagtgg

SEQ ID NO: 247126 - DNA, 40 bp, Artificial Sequence
  Description of Artificial Sequence: Synthetic oligonucleotide
gttatgaaatactcgttgaccaaactgtggtgattagtgg

SEQ ID NO: 247127 - DNA, 44 bp, Artificial Sequence
  Description of Artificial Sequence: Synthetic oligonucleotide
ttatgaaatactcgttgaccaaactgtggtgattagtggaaaac

SEQ ID NO: 247128 - DNA, 43 bp, Artificial Sequence
  Description of Artificial Sequence: Synthetic oligonucleotide
tatgaaatactcgttgaccaaactgtggtgattagtggaaaac

SEQ ID NO: 247129 - DNA, 42 bp, Artificial Sequence
  Description of Artificial Sequence: Synthetic oligonucleotide
atgaaatactcgttgaccaaactgtggtgattagtggaaaac

SEQ ID NO: 247130 - DNA, 41 bp, Artificial Sequence
  Description of Artificial Sequence: Synthetic oligonucleotide
tgaaatactcgttgaccaaactgtggtgattagtggaaaac

SEQ ID NO: 247131 - DNA, 40 bp, Artificial Sequence
  Description of Artificial Sequence: Synthetic oligonucleotide
gaaatactcgttgaccaaactgtggtgattagtggaaaac

SEQ ID NO: 247132 - DNA, 41 bp, Artificial Sequence
  Description of Artificial Sequence: Synthetic oligonucleotide
aaatactcgttgaccaaactgtggtgattagtggaaaactg

SEQ ID NO: 247133 - DNA, 40 bp, Artificial Sequence
  Description of Artificial Sequence: Synthetic oligonucleotide
aatactcgttgaccaaactgtggtgattagtggaaaactg

SEQ ID NO: 247134 - DNA, 39 bp, Artificial Sequence
  Description of Artificial Sequence: Synthetic oligonucleotide
atactcgttgaccaaactgtggtgattagtggaaaactg

SEQ ID NO: 247135 - DNA, 38 bp, Artificial Sequence
  Description of Artificial Sequence: Synthetic oligonucleotide
tactcgttgaccaaactgtggtgattagtggaaaactg

SEQ ID NO: 247136 - DNA, 37 bp, Artificial Sequence
  Description of Artificial Sequence: Synthetic oligonucleotide
actcgttgaccaaactgtggtgattagtggaaaactg

SEQ ID NO: 247137 - DNA, 36 bp, Artificial Sequence
  Description of Artificial Sequence: Synthetic oligonucleotide
ctcgttgaccaaactgtggtgattagtggaaaactg

SEQ ID NO: 247138 - DNA, 36 bp, Artificial Sequence
  Description of Artificial Sequence: Synthetic oligonucleotide
tcgttgaccaaactgtggtgattagtggaaaactgc

SEQ ID NO: 247139 - DNA, 35 bp, Artificial Sequence
  Description of Artificial Sequence: Synthetic oligonucleotide
cgttgaccaaactgtggtgattagtggaaaactgc

SEQ ID NO: 247140 - DNA, 36 bp, Artificial Sequence
  Description of Artificial Sequence: Synthetic oligonucleotide
gttgaccaaactgtggtgattagtggaaaactgctc

SEQ ID NO: 247141 - DNA, 39 bp, Artificial Sequence
  Description of Artificial Sequence: Synthetic oligonucleotide
ttgaccaaactgtggtgattagtggaaaactgctcaatc

SEQ ID NO: 247142 - DNA, 38 bp, Artificial Sequence
  Description of Artificial Sequence: Synthetic oligonucleotide
tgaccaaactgtggtgattagtggaaaactgctcaatc

SEQ ID NO: 247143 - DNA, 37 bp, Artificial Sequence
  Description of Artificial Sequence: Synthetic oligonucleotide
gaccaaactgtggtgattagtggaaaactgctcaatc

SEQ ID NO: 247144 - DNA, 38 bp, Artificial Sequence
  Description of Artificial Sequence: Synthetic oligonucleotide
accaaactgtggtgattagtggaaaactgctcaatcac

SEQ ID NO: 247145 - DNA, 37 bp, Artificial Sequence
  Description of Artificial Sequence: Synthetic oligonucleotide
ccaaactgtggtgattagtggaaaactgctcaatcac

SEQ ID NO: 247146 - DNA, 39 bp, Artificial Sequence
  Description of Artificial Sequence: Synthetic oligonucleotide
caaactgtggtgattagtggaaaactgctcaatcacatg

SEQ ID NO: 247147 - DNA, 40 bp, Artificial Sequence
  Description of Artificial Sequence: Synthetic oligonucleotide
aaactgtggtgattagtggaaaactgctcaatcacatgac

SEQ ID NO: 247148 - DNA, 39 bp, Artificial Sequence
  Description of Artificial Sequence: Synthetic oligonucleotide
aactgtggtgattagtggaaaactgctcaatcacatgac

SEQ ID NO: 247149 - DNA, 38 bp, Artificial Sequence
  Description of Artificial Sequence: Synthetic oligonucleotide
actgtggtgattagtggaaaactgctcaatcacatgac

SEQ ID NO: 247150 - DNA, 37 bp, Artificial Sequence
  Description of Artificial Sequence: Synthetic oligonucleotide
ctgtggtgattagtggaaaactgctcaatcacatgac

SEQ ID NO: 247151 - DNA, 38 bp, Artificial Sequence
  Description of Artificial Sequence: Synthetic oligonucleotide
tgtggtgattagtggaaaactgctcaatcacatgactc

SEQ ID NO: 247152 - DNA, 37 bp, Artificial Sequence
  Description of Artificial Sequence: Synthetic oligonucleotide
gtggtgattagtggaaaactgctcaatcacatgactc

SEQ ID NO: 247153 - DNA, 37 bp, Artificial Sequence
  Description of Artificial Sequence: Synthetic oligonucleotide
tggtgattagtggaaaactgctcaatcacatgactcg

SEQ ID NO: 247154 - DNA, 36 bp, Artificial Sequence
  Description of Artificial Sequence: Synthetic oligonucleotide
ggtgattagtggaaaactgctcaatcacatgactcg

SEQ ID NO: 247155 - DNA, 37 bp, Artificial Sequence
  Description of Artificial Sequence: Synthetic oligonucleotide
gtgattagtggaaaactgctcaatcacatgactcgtc

SEQ ID NO: 247156 - DNA, 37 bp, Artificial Sequence
  Description of Artificial Sequence: Synthetic oligonucleotide
tgattagtggaaaactgctcaatcacatgactcgtcc

SEQ ID NO: 247157 - DNA, 36 bp, Artificial Sequence
  Description of Artificial Sequence: Synthetic oligonucleotide
gattagtggaaaactgctcaatcacatgactcgtcc

SEQ ID NO: 247158 - DNA, 37 bp, Artificial Sequence
  Description of Artificial Sequence: Synthetic oligonucleotide
attagtggaaaactgctcaatcacatgactcgtcctg

SEQ ID NO: 247159 - DNA, 36 bp, Artificial Sequence
  Description of Artificial Sequence: Synthetic oligonucleotide
ttagtggaaaactgctcaatcacatgactcgtcctg

SEQ ID NO: 247160 - DNA, 35 bp, Artificial Sequence
  Description of Artificial Sequence: Synthetic oligonucleotide
tagtggaaaactgctcaatcacatgactcgtcctg

SEQ ID NO: 247161 - DNA, 34 bp, Artificial Sequence
  Description of Artificial Sequence: Synthetic oligonucleotide
agtggaaaactgctcaatcacatgactcgtcctg

SEQ ID NO: 247162 - DNA, 33 bp, Artificial Sequence
  Description of Artificial Sequence: Synthetic oligonucleotide
gtggaaaactgctcaatcacatgactcgtcctg

SEQ ID NO: 247163 - DNA, 38 bp, Artificial Sequence
  Description of Artificial Sequence: Synthetic oligonucleotide
tggaaaactgctcaatcacatgactcgtcctgtaaaac

SEQ ID NO: 247164 - DNA, 37 bp, Artificial Sequence
  Description of Artificial Sequence: Synthetic oligonucleotide
ggaaaactgctcaatcacatgactcgtcctgtaaaac

SEQ ID NO: 247165 - DNA, 37 bp, Artificial Sequence
  Description of Artificial Sequence: Synthetic oligonucleotide
gaaaactgctcaatcacatgactcgtcctgtaaaacc

SEQ ID NO: 247166 - DNA, 39 bp, Artificial Sequence
  Description of Artificial Sequence: Synthetic oligonucleotide
aaaactgctcaatcacatgactcgtcctgtaaaaccttc

SEQ ID NO: 247167 - DNA, 38 bp, Artificial Sequence
  Description of Artificial Sequence: Synthetic oligonucleotide
aaactgctcaatcacatgactcgtcctgtaaaaccttc

SEQ ID NO: 247168 - DNA, 37 bp, Artificial Sequence
  Description of Artificial Sequence: Synthetic oligonucleotide
aactgctcaatcacatgactcgtcctgtaaaaccttc

SEQ ID NO: 247169 - DNA, 36 bp, Artificial Sequence
  Description of Artificial Sequence: Synthetic oligonucleotide
actgctcaatcacatgactcgtcctgtaaaaccttc

SEQ ID NO: 247170 - DNA, 35 bp, Artificial Sequence
  Description of Artificial Sequence: Synthetic oligonucleotide
ctgctcaatcacatgactcgtcctgtaaaaccttc

SEQ ID NO: 247171 - DNA, 36 bp, Artificial Sequence
  Description of Artificial Sequence: Synthetic oligonucleotide
tgctcaatcacatgactcgtcctgtaaaaccttcac

SEQ ID NO: 247172 - DNA, 35 bp, Artificial Sequence
  Description of Artificial Sequence: Synthetic oligonucleotide
gctcaatcacatgactcgtcctgtaaaaccttcac

SEQ ID NO: 247173 - DNA, 35 bp, Artificial Sequence
  Description of Artificial Sequence: Synthetic oligonucleotide
ctcaatcacatgactcgtcctgtaaaaccttcacg

SEQ ID NO: 247174 - DNA, 36 bp, Artificial Sequence
  Description of Artificial Sequence: Synthetic oligonucleotide
tcaatcacatgactcgtcctgtaaaaccttcacgtc

SEQ ID NO: 247175 - DNA, 35 bp, Artificial Sequence
  Description of Artificial Sequence: Synthetic oligonucleotide
caatcacatgactcgtcctgtaaaaccttcacgtc

SEQ ID NO: 247176 - DNA, 40 bp, Artificial Sequence
  Description of Artificial Sequence: Synthetic oligonucleotide
aatcacatgactcgtcctgtaaaaccttcacgtcaaattg

SEQ ID NO: 247177 - DNA, 39 bp, Artificial Sequence
  Description of Artificial Sequence: Synthetic oligonucleotide
atcacatgactcgtcctgtaaaaccttcacgtcaaattg

SEQ ID NO: 247178 - DNA, 38 bp, Artificial Sequence
  Description of Artificial Sequence: Synthetic oligonucleotide
tcacatgactcgtcctgtaaaaccttcacgtcaaattg

SEQ ID NO: 247179 - DNA, 37 bp, Artificial Sequence
  Description of Artificial Sequence: Synthetic oligonucleotide
cacatgactcgtcctgtaaaaccttcacgtcaaattg

SEQ ID NO: 247180 - DNA, 38 bp, Artificial Sequence
  Description of Artificial Sequence: Synthetic oligonucleotide
acatgactcgtcctgtaaaaccttcacgtcaaattgag

SEQ ID NO: 247181 - DNA, 37 bp, Artificial Sequence
  Description of Artificial Sequence: Synthetic oligonucleotide
catgactcgtcctgtaaaaccttcacgtcaaattgag

SEQ ID NO: 247182 - DNA, 37 bp, Artificial Sequence
  Description of Artificial Sequence: Synthetic oligonucleotide
atgactcgtcctgtaaaaccttcacgtcaaattgagg

SEQ ID NO: 247183 - DNA, 36 bp, Artificial Sequence
  Description of Artificial Sequence: Synthetic oligonucleotide
tgactcgtcctgtaaaaccttcacgtcaaattgagg

SEQ ID NO: 247184 - DNA, 35 bp, Artificial Sequence
  Description of Artificial Sequence: Synthetic oligonucleotide
gactcgtcctgtaaaaccttcacgtcaaattgagg

SEQ ID NO: 247185 - DNA, 36 bp, Artificial Sequence
  Description of Artificial Sequence: Synthetic oligonucleotide
actcgtcctgtaaaaccttcacgtcaaattgaggtc

SEQ ID NO: 247186 - DNA, 35 bp, Artificial Sequence
  Description of Artificial Sequence: Synthetic oligonucleotide
ctcgtcctgtaaaaccttcacgtcaaattgaggtc

SEQ ID NO: 247187 - DNA, 35 bp, Artificial Sequence
  Description of Artificial Sequence: Synthetic oligonucleotide
tcgtcctgtaaaaccttcacgtcaaattgaggtcc

SEQ ID NO: 247188 - DNA, 34 bp, Artificial Sequence
  Description of Artificial Sequence: Synthetic oligonucleotide
cgtcctgtaaaaccttcacgtcaaattgaggtcc

SEQ ID NO: 247189 - DNA, 34 bp, Artificial Sequence
  Description of Artificial Sequence: Synthetic oligonucleotide
gtcctgtaaaaccttcacgtcaaattgaggtccc

SEQ ID NO: 247190 - DNA, 35 bp, Artificial Sequence
  Description of Artificial Sequence: Synthetic oligonucleotide
tcctgtaaaaccttcacgtcaaattgaggtcccag

SEQ ID NO: 247191 - DNA, 34 bp, Artificial Sequence
  Description of Artificial Sequence: Synthetic oligonucleotide
cctgtaaaaccttcacgtcaaattgaggtcccag

SEQ ID NO: 247192 - DNA, 36 bp, Artificial Sequence
  Description of Artificial Sequence: Synthetic oligonucleotide
ctgtaaaaccttcacgtcaaattgaggtcccagaag

SEQ ID NO: 247193 - DNA, 37 bp, Artificial Sequence
  Description of Artificial Sequence: Synthetic oligonucleotide
tgtaaaaccttcacgtcaaattgaggtcccagaagag

SEQ ID NO: 247194 - DNA, 36 bp, Artificial Sequence
  Description of Artificial Sequence: Synthetic oligonucleotide
gtaaaaccttcacgtcaaattgaggtcccagaagag

SEQ ID NO: 247195 - DNA, 36 bp, Artificial Sequence
  Description of Artificial Sequence: Synthetic oligonucleotide
taaaaccttcacgtcaaattgaggtcccagaagagc

SEQ ID NO: 247196 - DNA, 35 bp, Artificial Sequence
  Description of Artificial Sequence: Synthetic oligonucleotide
aaaaccttcacgtcaaattgaggtcccagaagagc

SEQ ID NO: 247197 - DNA, 34 bp, Artificial Sequence
  Description of Artificial Sequence: Synthetic oligonucleotide
aaaccttcacgtcaaattgaggtcccagaagagc

SEQ ID NO: 247198 - DNA, 33 bp, Artificial Sequence
  Description of Artificial Sequence: Synthetic oligonucleotide
aaccttcacgtcaaattgaggtcccagaagagc

SEQ ID NO: 247199 - DNA, 32 bp, Artificial Sequence
  Description of Artificial Sequence: Synthetic oligonucleotide
accttcacgtcaaattgaggtcccagaagagc

SEQ ID NO: 247200 - DNA, 31 bp, Artificial Sequence
  Description of Artificial Sequence: Synthetic oligonucleotide
ccttcacgtcaaattgaggtcccagaagagc

SEQ ID NO: 247201 - DNA, 31 bp, Artificial Sequence
  Description of Artificial Sequence: Synthetic oligonucleotide
cttcacgtcaaattgaggtcccagaagagcg

SEQ ID NO: 247202 - DNA, 31 bp, Artificial Sequence
  Description of Artificial Sequence: Synthetic oligonucleotide
ttcacgtcaaattgaggtcccagaagagcgg

SEQ ID NO: 247203 - DNA, 30 bp, Artificial Sequence
  Description of Artificial Sequence: Synthetic oligonucleotide
tcacgtcaaattgaggtcccagaagagcgg

SEQ ID NO: 247204 - DNA, 29 bp, Artificial Sequence
  Description of Artificial Sequence: Synthetic oligonucleotide
cacgtcaaattgaggtcccagaagagcgg

SEQ ID NO: 247205 - DNA, 31 bp, Artificial Sequence
  Description of Artificial Sequence: Synthetic oligonucleotide
acgtcaaattgaggtcccagaagagcggaag

SEQ ID NO: 247206 - DNA, 30 bp, Artificial Sequence
  Description of Artificial Sequence: Synthetic oligonucleotide
cgtcaaattgaggtcccagaagagcggaag

SEQ ID NO: 247207 - DNA, 30 bp, Artificial Sequence
  Description of Artificial Sequence: Synthetic oligonucleotide
gtcaaattgaggtcccagaagagcggaagc

SEQ ID NO: 247208 - DNA, 30 bp, Artificial Sequence
  Description of Artificial Sequence: Synthetic oligonucleotide
tcaaattgaggtcccagaagagcggaagcc

SEQ ID NO: 247209 - DNA, 29 bp, Artificial Sequence
  Description of Artificial Sequence: Synthetic oligonucleotide
caaattgaggtcccagaagagcggaagcc

SEQ ID NO: 247210 - DNA, 29 bp, Artificial Sequence
  Description of Artificial Sequence: Synthetic oligonucleotide
aaattgaggtcccagaagagcggaagccc

SEQ ID NO: 247211 - DNA, 28 bp, Artificial Sequence
  Description of Artificial Sequence: Synthetic oligonucleotide
aattgaggtcccagaagagcggaagccc

SEQ ID NO: 247212 - DNA, 27 bp, Artificial Sequence
  Description of Artificial Sequence: Synthetic oligonucleotide
attgaggtcccagaagagcggaagccc

SEQ ID NO: 247213 - DNA, 26 bp, Artificial Sequence
  Description of Artificial Sequence: Synthetic oligonucleotide
ttgaggtcccagaagagcggaagccc

SEQ ID NO: 247214 - DNA, 25 bp, Artificial Sequence
  Description of Artificial Sequence: Synthetic oligonucleotide
tgaggtcccagaagagcggaagccc

SEQ ID NO: 247215 - DNA, 24 bp, Artificial Sequence
  Description of Artificial Sequence: Synthetic oligonucleotide
gaggtcccagaagagcggaagccc

SEQ ID NO: 247216 - DNA, 25 bp, Artificial Sequence
  Description of Artificial Sequence: Synthetic oligonucleotide
aggtcccagaagagcggaagcccca

SEQ ID NO: 247217 - DNA, 24 bp, Artificial Sequence
  Description of Artificial Sequence: Synthetic oligonucleotide
ggtcccagaagagcggaagcccca

SEQ ID NO: 247218 - DNA, 24 bp, Artificial Sequence
  Description of Artificial Sequence: Synthetic oligonucleotide
gtcccagaagagcggaagccccag

SEQ ID NO: 247219 - DNA, 27 bp, Artificial Sequence
  Description of Artificial Sequence: Synthetic oligonucleotide
tcccagaagagcggaagccccaggatt

SEQ ID NO: 247220 - DNA, 26 bp, Artificial Sequence
  Description of Artificial Sequence: Synthetic oligonucleotide
cccagaagagcggaagccccaggatt

SEQ ID NO: 247221 - DNA, 26 bp, Artificial Sequence
  Description of Artificial Sequence: Synthetic oligonucleotide
ccagaagagcggaagccccaggattg

SEQ ID NO: 247222 - DNA, 26 bp, Artificial Sequence
  Description of Artificial Sequence: Synthetic oligonucleotide
cagaagagcggaagccccaggattgg

SEQ ID NO: 247223 - DNA, 27 bp, Artificial Sequence
  Description of Artificial Sequence: Synthetic oligonucleotide
agaagagcggaagccccaggattgggt

SEQ ID NO: 247224 - DNA, 27 bp, Artificial Sequence
  Description of Artificial Sequence: Synthetic oligonucleotide
gaagagcggaagccccaggattgggtt

SEQ ID NO: 247225 - DNA, 27 bp, Artificial Sequence
  Description of Artificial Sequence: Synthetic oligonucleotide
aagagcggaagccccaggattgggttg

SEQ ID NO: 247226 - DNA, 27 bp, Artificial Sequence
  Description of Artificial Sequence: Synthetic oligonucleotide
agagcggaagccccaggattgggttga

SEQ ID NO: 247227 - DNA, 27 bp, Artificial Sequence
  Description of Artificial Sequence: Synthetic oligonucleotide
gagcggaagccccaggattgggttgaa

SEQ ID NO: 247228 - DNA, 28 bp, Artificial Sequence
  Description of Artificial Sequence: Synthetic oligonucleotide
agcggaagccccaggattgggttgaaag

SEQ ID NO: 247229 - DNA, 27 bp, Artificial Sequence
  Description of Artificial Sequence: Synthetic oligonucleotide
gcggaagccccaggattgggttgaaag

SEQ ID NO: 247230 - DNA, 28 bp, Artificial Sequence
  Description of Artificial Sequence: Synthetic oligonucleotide
cggaagccccaggattgggttgaaagac

SEQ ID NO: 247231 - DNA, 28 bp, Artificial Sequence
  Description of Artificial Sequence: Synthetic oligonucleotide
ggaagccccaggattgggttgaaagacc

SEQ ID NO: 247232 - DNA, 34 bp, Artificial Sequence
  Description of Artificial Sequence: Synthetic oligonucleotide
gaagccccaggattgggttgaaagacctaaaatc

SEQ ID NO: 247233 - DNA, 34 bp, Artificial Sequence
  Description of Artificial Sequence: Synthetic oligonucleotide
aagccccaggattgggttgaaagacctaaaatcc

SEQ ID NO: 247234 - DNA, 33 bp, Artificial Sequence
  Description of Artificial Sequence: Synthetic oligonucleotide
agccccaggattgggttgaaagacctaaaatcc

SEQ ID NO: 247235 - DNA, 32 bp, Artificial Sequence
  Description of Artificial Sequence: Synthetic oligonucleotide
gccccaggattgggttgaaagacctaaaatcc

SEQ ID NO: 247236 - DNA, 32 bp, Artificial Sequence
  Description of Artificial Sequence: Synthetic oligonucleotide
ccccaggattgggttgaaagacctaaaatccc

SEQ ID NO: 247237 - DNA, 33 bp, Artificial Sequence
  Description of Artificial Sequence: Synthetic oligonucleotide
cccaggattgggttgaaagacctaaaatcccac

SEQ ID NO: 247238 - DNA, 35 bp, Artificial Sequence
  Description of Artificial Sequence: Synthetic oligonucleotide
ccaggattgggttgaaagacctaaaatcccacatc

SEQ ID NO: 247239 - DNA, 35 bp, Artificial Sequence
  Description of Artificial Sequence: Synthetic oligonucleotide
caggattgggttgaaagacctaaaatcccacatcc

SEQ ID NO: 247240 - DNA, 36 bp, Artificial Sequence
  Description of Artificial Sequence: Synthetic oligonucleotide
aggattgggttgaaagacctaaaatcccacatccag

SEQ ID NO: 247241 - DNA, 35 bp, Artificial Sequence
  Description of Artificial Sequence: Synthetic oligonucleotide
ggattgggttgaaagacctaaaatcccacatccag

SEQ ID NO: 247242 - DNA, 37 bp, Artificial Sequence
  Description of Artificial Sequence: Synthetic oligonucleotide
gattgggttgaaagacctaaaatcccacatccagaag

SEQ ID NO: 247243 - DNA, 37 bp, Artificial Sequence
  Description of Artificial Sequence: Synthetic oligonucleotide
attgggttgaaagacctaaaatcccacatccagaagg

SEQ ID NO: 247244 - DNA, 36 bp, Artificial Sequence
  Description of Artificial Sequence: Synthetic oligonucleotide
ttgggttgaaagacctaaaatcccacatccagaagg

SEQ ID NO: 247245 - DNA, 35 bp, Artificial Sequence
  Description of Artificial Sequence: Synthetic oligonucleotide
tgggttgaaagacctaaaatcccacatccagaagg

SEQ ID NO: 247246 - DNA, 34 bp, Artificial Sequence
  Description of Artificial Sequence: Synthetic oligonucleotide
gggttgaaagacctaaaatcccacatccagaagg

SEQ ID NO: 247247 - DNA, 35 bp, Artificial Sequence
  Description of Artificial Sequence: Synthetic oligonucleotide
ggttgaaagacctaaaatcccacatccagaaggtg

SEQ ID NO: 247248 - DNA, 36 bp, Artificial Sequence
  Description of Artificial Sequence: Synthetic oligonucleotide
gttgaaagacctaaaatcccacatccagaaggtgtc

SEQ ID NO: 247249 - DNA, 38 bp, Artificial Sequence
  Description of Artificial Sequence: Synthetic oligonucleotide
ttgaaagacctaaaatcccacatccagaaggtgtcaag

SEQ ID NO: 247250 - DNA, 37 bp, Artificial Sequence
  Description of Artificial Sequence: Synthetic oligonucleotide
tgaaagacctaaaatcccacatccagaaggtgtcaag

SEQ ID NO: 247251 - DNA, 36 bp, Artificial Sequence
  Description of Artificial Sequence: Synthetic oligonucleotide
gaaagacctaaaatcccacatccagaaggtgtcaag

SEQ ID NO: 247252 - DNA, 36 bp, Artificial Sequence
  Description of Artificial Sequence: Synthetic oligonucleotide
aaagacctaaaatcccacatccagaaggtgtcaagc

SEQ ID NO: 247253 - DNA, 35 bp, Artificial Sequence
  Description of Artificial Sequence: Synthetic oligonucleotide
aagacctaaaatcccacatccagaaggtgtcaagc

SEQ ID NO: 247254 - DNA, 34 bp, Artificial Sequence
  Description of Artificial Sequence: Synthetic oligonucleotide
agacctaaaatcccacatccagaaggtgtcaagc

SEQ ID NO: 247255 - DNA, 33 bp, Artificial Sequence
  Description of Artificial Sequence: Synthetic oligonucleotide
gacctaaaatcccacatccagaaggtgtcaagc

SEQ ID NO: 247256 - DNA, 33 bp, Artificial Sequence
  Description of Artificial Sequence: Synthetic oligonucleotide
acctaaaatcccacatccagaaggtgtcaagcc

SEQ ID NO: 247257 - DNA, 32 bp, Artificial Sequence
  Description of Artificial Sequence: Synthetic oligonucleotide
cctaaaatcccacatccagaaggtgtcaagcc

SEQ ID NO: 247258 - DNA, 33 bp, Artificial Sequence
  Description of Artificial Sequence: Synthetic oligonucleotide
ctaaaatcccacatccagaaggtgtcaagcctg

SEQ ID NO: 247259 - DNA, 35 bp, Artificial Sequence
  Description of Artificial Sequence: Synthetic oligonucleotide
taaaatcccacatccagaaggtgtcaagcctgatg

SEQ ID NO: 247260 - DNA, 34 bp, Artificial Sequence
  Description of Artificial Sequence: Synthetic oligonucleotide
aaaatcccacatccagaaggtgtcaagcctgatg

SEQ ID NO: 247261 - DNA, 33 bp, Artificial Sequence
  Description of Artificial Sequence: Synthetic oligonucleotide
aaatcccacatccagaaggtgtcaagcctgatg

SEQ ID NO: 247262 - DNA, 32 bp, Artificial Sequence
  Description of Artificial Sequence: Synthetic oligonucleotide
aatcccacatccagaaggtgtcaagcctgatg

SEQ ID NO: 247263 - DNA, 31 bp, Artificial Sequence
  Description of Artificial Sequence: Synthetic oligonucleotide
atcccacatccagaaggtgtcaagcctgatg

SEQ ID NO: 247264 - DNA, 30 bp, Artificial Sequence
  Description of Artificial Sequence: Synthetic oligonucleotide
tcccacatccagaaggtgtcaagcctgatg

SEQ ID NO: 247265 - DNA, 29 bp, Artificial Sequence
  Description of Artificial Sequence: Synthetic oligonucleotide
cccacatccagaaggtgtcaagcctgatg

SEQ ID NO: 247266 - DNA, 30 bp, Artificial Sequence
  Description of Artificial Sequence: Synthetic oligonucleotide
ccacatccagaaggtgtcaagcctgatgac

SEQ ID NO: 247267 - DNA, 31 bp, Artificial Sequence
  Description of Artificial Sequence: Synthetic oligonucleotide
cacatccagaaggtgtcaagcctgatgactg

SEQ ID NO: 247268 - DNA, 31 bp, Artificial Sequence
  Description of Artificial Sequence: Synthetic oligonucleotide
acatccagaaggtgtcaagcctgatgactgg

SEQ ID NO: 247269 - DNA, 30 bp, Artificial Sequence
  Description of Artificial Sequence: Synthetic oligonucleotide
catccagaaggtgtcaagcctgatgactgg

SEQ ID NO: 247270 - DNA, 30 bp, Artificial Sequence
  Description of Artificial Sequence: Synthetic oligonucleotide
atccagaaggtgtcaagcctgatgactggc

SEQ ID NO: 247271 - DNA, 29 bp, Artificial Sequence
  Description of Artificial Sequence: Synthetic oligonucleotide
tccagaaggtgtcaagcctgatgactggc

SEQ ID NO: 247272 - DNA, 28 bp, Artificial Sequence
  Description of Artificial Sequence: Synthetic oligonucleotide
ccagaaggtgtcaagcctgatgactggc

SEQ ID NO: 247273 - DNA, 30 bp, Artificial Sequence
  Description of Artificial Sequence: Synthetic oligonucleotide
cagaaggtgtcaagcctgatgactggcatg

SEQ ID NO: 247274 - DNA, 32 bp, Artificial Sequence
  Description of Artificial Sequence: Synthetic oligonucleotide
agaaggtgtcaagcctgatgactggcatgaag

SEQ ID NO: 247275 - DNA, 31 bp, Artificial Sequence
  Description of Artificial Sequence: Synthetic oligonucleotide
gaaggtgtcaagcctgatgactggcatgaag

SEQ ID NO: 247276 - DNA, 33 bp, Artificial Sequence
  Description of Artificial Sequence: Synthetic oligonucleotide
aaggtgtcaagcctgatgactggcatgaagatg

SEQ ID NO: 247277 - DNA, 32 bp, Artificial Sequence
  Description of Artificial Sequence: Synthetic oligonucleotide
aggtgtcaagcctgatgactggcatgaagatg

SEQ ID NO: 247278 - DNA, 31 bp, Artificial Sequence
  Description of Artificial Sequence: Synthetic oligonucleotide
ggtgtcaagcctgatgactggcatgaagatg

SEQ ID NO: 247279 - DNA, 31 bp, Artificial Sequence
  Description of Artificial Sequence: Synthetic oligonucleotide
gtgtcaagcctgatgactggcatgaagatgg

SEQ ID NO: 247280 - DNA, 31 bp, Artificial Sequence
  Description of Artificial Sequence: Synthetic oligonucleotide
tgtcaagcctgatgactggcatgaagatggc

SEQ ID NO: 247281 - DNA, 30 bp, Artificial Sequence
  Description of Artificial Sequence: Synthetic oligonucleotide
gtcaagcctgatgactggcatgaagatggc

SEQ ID NO: 247282 - DNA, 30 bp, Artificial Sequence
  Description of Artificial Sequence: Synthetic oligonucleotide
tcaagcctgatgactggcatgaagatggcc

SEQ ID NO: 247283 - DNA, 29 bp, Artificial Sequence
  Description of Artificial Sequence: Synthetic oligonucleotide
caagcctgatgactggcatgaagatggcc

SEQ ID NO: 247284 - DNA, 29 bp, Artificial Sequence
  Description of Artificial Sequence: Synthetic oligonucleotide
aagcctgatgactggcatgaagatggccc

SEQ ID NO: 247285 - DNA, 28 bp, Artificial Sequence
  Description of Artificial Sequence: Synthetic oligonucleotide
agcctgatgactggcatgaagatggccc

SEQ ID NO: 247286 - DNA, 27 bp, Artificial Sequence
  Description of Artificial Sequence: Synthetic oligonucleotide
gcctgatgactggcatgaagatggccc

SEQ ID NO: 247287 - DNA, 28 bp, Artificial Sequence
  Description of Artificial Sequence: Synthetic oligonucleotide
cctgatgactggcatgaagatggccctg

SEQ ID NO: 247288 - DNA, 28 bp, Artificial Sequence
  Description of Artificial Sequence: Synthetic oligonucleotide
ctgatgactggcatgaagatggccctgc

SEQ ID NO: 247289 - DNA, 31 bp, Artificial Sequence
  Description of Artificial Sequence: Synthetic oligonucleotide
tgatgactggcatgaagatggccctgctaac

SEQ ID NO: 247290 - DNA, 30 bp, Artificial Sequence
  Description of Artificial Sequence: Synthetic oligonucleotide
gatgactggcatgaagatggccctgctaac

SEQ ID NO: 247291 - DNA, 33 bp, Artificial Sequence
  Description of Artificial Sequence: Synthetic oligonucleotide
atgactggcatgaagatggccctgctaacattc

SEQ ID NO: 247292 - DNA, 32 bp, Artificial Sequence
  Description of Artificial Sequence: Synthetic oligonucleotide
tgactggcatgaagatggccctgctaacattc

SEQ ID NO: 247293 - DNA, 31 bp, Artificial Sequence
  Description of Artificial Sequence: Synthetic oligonucleotide
gactggcatgaagatggccctgctaacattc

SEQ ID NO: 247294 - DNA, 31 bp, Artificial Sequence
  Description of Artificial Sequence: Synthetic oligonucleotide
actggcatgaagatggccctgctaacattcc

SEQ ID NO: 247295 - DNA, 30 bp, Artificial Sequence
  Description of Artificial Sequence: Synthetic oligonucleotide
ctggcatgaagatggccctgctaacattcc

SEQ ID NO: 247296 - DNA, 31 bp, Artificial Sequence
  Description of Artificial Sequence: Synthetic oligonucleotide
tggcatgaagatggccctgctaacattccag

SEQ ID NO: 247297 - DNA, 30 bp, Artificial Sequence
  Description of Artificial Sequence: Synthetic oligonucleotide
ggcatgaagatggccctgctaacattccag

SEQ ID NO: 247298 - DNA, 32 bp, Artificial Sequence
  Description of Artificial Sequence: Synthetic oligonucleotide
gcatgaagatggccctgctaacattccagatc

SEQ ID NO: 247299 - DNA, 34 bp, Artificial Sequence
  Description of Artificial Sequence: Synthetic oligonucleotide
catgaagatggccctgctaacattccagatcaag

SEQ ID NO: 247300 - DNA, 35 bp, Artificial Sequence
  Description of Artificial Sequence: Synthetic oligonucleotide
atgaagatggccctgctaacattccagatcaagag

SEQ ID NO: 247301 - DNA, 34 bp, Artificial Sequence
  Description of Artificial Sequence: Synthetic oligonucleotide
tgaagatggccctgctaacattccagatcaagag

SEQ ID NO: 247302 - DNA, 33 bp, Artificial Sequence
  Description of Artificial Sequence: Synthetic oligonucleotide
gaagatggccctgctaacattccagatcaagag

SEQ ID NO: 247303 - DNA, 33 bp, Artificial Sequence
  Description of Artificial Sequence: Synthetic oligonucleotide
aagatggccctgctaacattccagatcaagagg

SEQ ID NO: 247304 - DNA, 32 bp, Artificial Sequence
  Description of Artificial Sequence: Synthetic oligonucleotide
agatggccctgctaacattccagatcaagagg

SEQ ID NO: 247305 - DNA, 31 bp, Artificial Sequence
  Description of Artificial Sequence: Synthetic oligonucleotide
gatggccctgctaacattccagatcaagagg

SEQ ID NO: 247306 - DNA, 31 bp, Artificial Sequence
  Description of Artificial Sequence: Synthetic oligonucleotide
atggccctgctaacattccagatcaagaggc

SEQ ID NO: 247307 - DNA, 30 bp, Artificial Sequence
  Description of Artificial Sequence: Synthetic oligonucleotide
tggccctgctaacattccagatcaagaggc

SEQ ID NO: 247308 - DNA, 29 bp, Artificial Sequence
  Description of Artificial Sequence: Synthetic oligonucleotide
ggccctgctaacattccagatcaagaggc

SEQ ID NO: 247309 - DNA, 29 bp, Artificial Sequence
  Description of Artificial Sequence: Synthetic oligonucleotide
gccctgctaacattccagatcaagaggcc

SEQ ID NO: 247310 - DNA, 30 bp, Artificial Sequence
  Description of Artificial Sequence: Synthetic oligonucleotide
ccctgctaacattccagatcaagaggccag

SEQ ID NO: 247311 - DNA, 34 bp, Artificial Sequence
  Description of Artificial Sequence: Synthetic oligonucleotide
cctgctaacattccagatcaagaggccagaaaac

SEQ ID NO: 247312 - DNA, 34 bp, Artificial Sequence
  Description of Artificial Sequence: Synthetic oligonucleotide
ctgctaacattccagatcaagaggccagaaaacc

SEQ ID NO: 247313 - DNA, 34 bp, Artificial Sequence
  Description of Artificial Sequence: Synthetic oligonucleotide
tgctaacattccagatcaagaggccagaaaaccc

SEQ ID NO: 247314 - DNA, 33 bp, Artificial Sequence
  Description of Artificial Sequence: Synthetic oligonucleotide
gctaacattccagatcaagaggccagaaaaccc

SEQ ID NO: 247315 - DNA, 33 bp, Artificial Sequence
  Description of Artificial Sequence: Synthetic oligonucleotide
ctaacattccagatcaagaggccagaaaacccg

SEQ ID NO: 247316 - DNA, 35 bp, Artificial Sequence
  Description of Artificial Sequence: Synthetic oligonucleotide
taacattccagatcaagaggccagaaaacccgatg

SEQ ID NO: 247317 - DNA, 34 bp, Artificial Sequence
  Description of Artificial Sequence: Synthetic oligonucleotide
aacattccagatcaagaggccagaaaacccgatg

SEQ ID NO: 247318 - DNA, 33 bp, Artificial Sequence
  Description of Artificial Sequence: Synthetic oligonucleotide
acattccagatcaagaggccagaaaacccgatg

SEQ ID NO: 247319 - DNA, 32 bp, Artificial Sequence
  Description of Artificial Sequence: Synthetic oligonucleotide
cattccagatcaagaggccagaaaacccgatg

SEQ ID NO: 247320 - DNA, 32 bp, Artificial Sequence
  Description of Artificial Sequence: Synthetic oligonucleotide
attccagatcaagaggccagaaaacccgatgg

SEQ ID NO: 247321 - DNA, 31 bp, Artificial Sequence
  Description of Artificial Sequence: Synthetic oligonucleotide
ttccagatcaagaggccagaaaacccgatgg

SEQ ID NO: 247322 - DNA, 30 bp, Artificial Sequence
  Description of Artificial Sequence: Synthetic oligonucleotide
tccagatcaagaggccagaaaacccgatgg

SEQ ID NO: 247323 - DNA, 29 bp, Artificial Sequence
  Description of Artificial Sequence: Synthetic oligonucleotide
ccagatcaagaggccagaaaacccgatgg

SEQ ID NO: 247324 - DNA, 29 bp, Artificial Sequence
  Description of Artificial Sequence: Synthetic oligonucleotide
cagatcaagaggccagaaaacccgatggc

SEQ ID NO: 247325 - DNA, 30 bp, Artificial Sequence
  Description of Artificial Sequence: Synthetic oligonucleotide
agatcaagaggccagaaaacccgatggctg

SEQ ID NO: 247326 - DNA, 29 bp, Artificial Sequence
  Description of Artificial Sequence: Synthetic oligonucleotide
gatcaagaggccagaaaacccgatggctg

SEQ ID NO: 247327 - DNA, 29 bp, Artificial Sequence
  Description of Artificial Sequence: Synthetic oligonucleotide
atcaagaggccagaaaacccgatggctgg

SEQ ID NO: 247328 - DNA, 28 bp, Artificial Sequence
  Description of Artificial Sequence: Synthetic oligonucleotide
tcaagaggccagaaaacccgatggctgg

SEQ ID NO: 247329 - DNA, 27 bp, Artificial Sequence
  Description of Artificial Sequence: Synthetic oligonucleotide
caagaggccagaaaacccgatggctgg

SEQ ID NO: 247330 - DNA, 30 bp, Artificial Sequence
  Description of Artificial Sequence: Synthetic oligonucleotide
aagaggccagaaaacccgatggctggttac

SEQ ID NO: 247331 - DNA, 29 bp, Artificial Sequence
  Description of Artificial Sequence: Synthetic oligonucleotide
agaggccagaaaacccgatggctggttac

SEQ ID NO: 247332 - DNA, 28 bp, Artificial Sequence
  Description of Artificial Sequence: Synthetic oligonucleotide
gaggccagaaaacccgatggctggttac

SEQ ID NO: 247333 - DNA, 30 bp, Artificial Sequence
  Description of Artificial Sequence: Synthetic oligonucleotide
aggccagaaaacccgatggctggttacatg

SEQ ID NO: 247334 - DNA, 29 bp, Artificial Sequence
  Description of Artificial Sequence: Synthetic oligonucleotide
ggccagaaaacccgatggctggttacatg

SEQ ID NO: 247335 - DNA, 31 bp, Artificial Sequence
  Description of Artificial Sequence: Synthetic oligonucleotide
gccagaaaacccgatggctggttacatgatg

SEQ ID NO: 247336 - DNA, 32 bp, Artificial Sequence
  Description of Artificial Sequence: Synthetic oligonucleotide
ccagaaaacccgatggctggttacatgatgag

SEQ ID NO: 247337 - DNA, 32 bp, Artificial Sequence
  Description of Artificial Sequence: Synthetic oligonucleotide
cagaaaacccgatggctggttacatgatgagc

SEQ ID NO: 247338 - DNA, 32 bp, Artificial Sequence
  Description of Artificial Sequence: Synthetic oligonucleotide
agaaaacccgatggctggttacatgatgagcg

SEQ ID NO: 247339 - DNA, 31 bp, Artificial Sequence
  Description of Artificial Sequence: Synthetic oligonucleotide
gaaaacccgatggctggttacatgatgagcg

SEQ ID NO: 247340 - DNA, 32 bp, Artificial Sequence
  Description of Artificial Sequence: Synthetic oligonucleotide
aaaacccgatggctggttacatgatgagcgtg

SEQ ID NO: 247341 - DNA, 31 bp, Artificial Sequence
  Description of Artificial Sequence: Synthetic oligonucleotide
aaacccgatggctggttacatgatgagcgtg

SEQ ID NO: 247342 - DNA, 30 bp, Artificial Sequence
  Description of Artificial Sequence: Synthetic oligonucleotide
aacccgatggctggttacatgatgagcgtg

SEQ ID NO: 247343 - DNA, 29 bp, Artificial Sequence
  Description of Artificial Sequence: Synthetic oligonucleotide
acccgatggctggttacatgatgagcgtg

SEQ ID NO: 247344 - DNA, 28 bp, Artificial Sequence
  Description of Artificial Sequence: Synthetic oligonucleotide
cccgatggctggttacatgatgagcgtg

SEQ ID NO: 247345 - DNA, 29 bp, Artificial Sequence
  Description of Artificial Sequence: Synthetic oligonucleotide
ccgatggctggttacatgatgagcgtgag

SEQ ID NO: 247346 - DNA, 31 bp, Artificial Sequence
  Description of Artificial Sequence: Synthetic oligonucleotide
cgatggctggttacatgatgagcgtgagtac

SEQ ID NO: 247347 - DNA, 31 bp, Artificial Sequence
  Description of Artificial Sequence: Synthetic oligonucleotide
gatggctggttacatgatgagcgtgagtacg

SEQ ID NO: 247348 - DNA, 33 bp, Artificial Sequence
  Description of Artificial Sequence: Synthetic oligonucleotide
atggctggttacatgatgagcgtgagtacgttc

SEQ ID NO: 247349 - DNA, 32 bp, Artificial Sequence
  Description of Artificial Sequence: Synthetic oligonucleotide
tggctggttacatgatgagcgtgagtacgttc

SEQ ID NO: 247350 - DNA, 31 bp, Artificial Sequence
  Description of Artificial Sequence: Synthetic oligonucleotide
ggctggttacatgatgagcgtgagtacgttc

SEQ ID NO: 247351 - DNA, 31 bp, Artificial Sequence
  Description of Artificial Sequence: Synthetic oligonucleotide
gctggttacatgatgagcgtgagtacgttcc

SEQ ID NO: 247352 - DNA, 32 bp, Artificial Sequence
  Description of Artificial Sequence: Synthetic oligonucleotide
ctggttacatgatgagcgtgagtacgttcctg

SEQ ID NO: 247353 - DNA, 34 bp, Artificial Sequence
  Description of Artificial Sequence: Synthetic oligonucleotide
tggttacatgatgagcgtgagtacgttcctgatc

SEQ ID NO: 247354 - DNA, 33 bp, Artificial Sequence
  Description of Artificial Sequence: Synthetic oligonucleotide
ggttacatgatgagcgtgagtacgttcctgatc

SEQ ID NO: 247355 - DNA, 33 bp, Artificial Sequence
  Description of Artificial Sequence: Synthetic oligonucleotide
gttacatgatgagcgtgagtacgttcctgatcc

SEQ ID NO: 247356 - DNA, 34 bp, Artificial Sequence
  Description of Artificial Sequence: Synthetic oligonucleotide
ttacatgatgagcgtgagtacgttcctgatccac

SEQ ID NO: 247357 - DNA, 33 bp, Artificial Sequence
  Description of Artificial Sequence: Synthetic oligonucleotide
tacatgatgagcgtgagtacgttcctgatccac

SEQ ID NO: 247358 - DNA, 32 bp, Artificial Sequence
  Description of Artificial Sequence: Synthetic oligonucleotide
acatgatgagcgtgagtacgttcctgatccac

SEQ ID NO: 247359 - DNA, 31 bp, Artificial Sequence
  Description of Artificial Sequence: Synthetic oligonucleotide
catgatgagcgtgagtacgttcctgatccac

SEQ ID NO: 247360 - DNA, 32 bp, Artificial Sequence
  Description of Artificial Sequence: Synthetic oligonucleotide
atgatgagcgtgagtacgttcctgatccacac

SEQ ID NO: 247361 - DNA, 31 bp, Artificial Sequence
  Description of Artificial Sequence: Synthetic oligonucleotide
tgatgagcgtgagtacgttcctgatccacac

SEQ ID NO: 247362 - DNA, 30 bp, Artificial Sequence
  Description of Artificial Sequence: Synthetic oligonucleotide
gatgagcgtgagtacgttcctgatccacac

SEQ ID NO: 247363 - DNA, 30 bp, Artificial Sequence
  Description of Artificial Sequence: Synthetic oligonucleotide
atgagcgtgagtacgttcctgatccacacg

SEQ ID NO: 247364 - DNA, 29 bp, Artificial Sequence
  Description of Artificial Sequence: Synthetic oligonucleotide
tgagcgtgagtacgttcctgatccacacg

SEQ ID NO: 247365 - DNA, 28 bp, Artificial Sequence
  Description of Artificial Sequence: Synthetic oligonucleotide
gagcgtgagtacgttcctgatccacacg

SEQ ID NO: 247366 - DNA, 28 bp, Artificial Sequence
  Description of Artificial Sequence: Synthetic oligonucleotide
agcgtgagtacgttcctgatccacacgc

SEQ ID NO: 247367 - DNA, 27 bp, Artificial Sequence
  Description of Artificial Sequence: Synthetic oligonucleotide
gcgtgagtacgttcctgatccacacgc

SEQ ID NO: 247368 - DNA, 28 bp, Artificial Sequence
  Description of Artificial Sequence: Synthetic oligonucleotide
cgtgagtacgttcctgatccacacgcag

SEQ ID NO: 247369 - DNA, 29 bp, Artificial Sequence
  Description of Artificial Sequence: Synthetic oligonucleotide
gtgagtacgttcctgatccacacgcagag

SEQ ID NO: 247370 - DNA, 32 bp, Artificial Sequence
  Description of Artificial Sequence: Synthetic oligonucleotide
tgagtacgttcctgatccacacgcagagatac

SEQ ID NO: 247371 - DNA, 31 bp, Artificial Sequence
  Description of Artificial Sequence: Synthetic oligonucleotide
gagtacgttcctgatccacacgcagagatac

SEQ ID NO: 247372 - DNA, 31 bp, Artificial Sequence
  Description of Artificial Sequence: Synthetic oligonucleotide
agtacgttcctgatccacacgcagagatacc

SEQ ID NO: 247373 - DNA, 30 bp, Artificial Sequence
  Description of Artificial Sequence: Synthetic oligonucleotide
gtacgttcctgatccacacgcagagatacc

SEQ ID NO: 247374 - DNA, 31 bp, Artificial Sequence
  Description of Artificial Sequence: Synthetic oligonucleotide
tacgttcctgatccacacgcagagatacctg

SEQ ID NO: 247375 - DNA, 30 bp, Artificial Sequence
  Description of Artificial Sequence: Synthetic oligonucleotide
acgttcctgatccacacgcagagatacctg

SEQ ID NO: 247376 - DNA, 29 bp, Artificial Sequence
  Description of Artificial Sequence: Synthetic oligonucleotide
cgttcctgatccacacgcagagatacctg

SEQ ID NO: 247377 - DNA, 30 bp, Artificial Sequence
  Description of Artificial Sequence: Synthetic oligonucleotide
gttcctgatccacacgcagagatacctgag

SEQ ID NO: 247378 - DNA, 30 bp, Artificial Sequence
  Description of Artificial Sequence: Synthetic oligonucleotide
ttcctgatccacacgcagagatacctgagg

SEQ ID NO: 247379 - DNA, 29 bp, Artificial Sequence
  Description of Artificial Sequence: Synthetic oligonucleotide
tcctgatccacacgcagagatacctgagg

SEQ ID NO: 247380 - DNA, 28 bp, Artificial Sequence
  Description of Artificial Sequence: Synthetic oligonucleotide
cctgatccacacgcagagatacctgagg

SEQ ID NO: 247381 - DNA, 31 bp, Artificial Sequence
  Description of Artificial Sequence: Synthetic oligonucleotide
ctgatccacacgcagagatacctgaggaatg

SEQ ID NO: 247382 - DNA, 31 bp, Artificial Sequence
  Description of Artificial Sequence: Synthetic oligonucleotide
tgatccacacgcagagatacctgaggaatgg

SEQ ID NO: 247383 - DNA, 30 bp, Artificial Sequence
  Description of Artificial Sequence: Synthetic oligonucleotide
gatccacacgcagagatacctgaggaatgg

SEQ ID NO: 247384 - DNA, 30 bp, Artificial Sequence
  Description of Artificial Sequence: Synthetic oligonucleotide
atccacacgcagagatacctgaggaatggg

SEQ ID NO: 247385 - DNA, 29 bp, Artificial Sequence
  Description of Artificial Sequence: Synthetic oligonucleotide
tccacacgcagagatacctgaggaatggg

SEQ ID NO: 247386 - DNA, 28 bp, Artificial Sequence
  Description of Artificial Sequence: Synthetic oligonucleotide
ccacacgcagagatacctgaggaatggg

SEQ ID NO: 247387 - DNA, 30 bp, Artificial Sequence
  Description of Artificial Sequence: Synthetic oligonucleotide
cacacgcagagatacctgaggaatgggatg

SEQ ID NO: 247388 - DNA, 32 bp, Artificial Sequence
  Description of Artificial Sequence: Synthetic oligonucleotide
acacgcagagatacctgaggaatgggatgaac

SEQ ID NO: 247389 - DNA, 31 bp, Artificial Sequence
  Description of Artificial Sequence: Synthetic oligonucleotide
cacgcagagatacctgaggaatgggatgaac

SEQ ID NO: 247390 - DNA, 32 bp, Artificial Sequence
  Description of Artificial Sequence: Synthetic oligonucleotide
acgcagagatacctgaggaatgggatgaacac

SEQ ID NO: 247391 - DNA, 31 bp, Artificial Sequence
  Description of Artificial Sequence: Synthetic oligonucleotide
cgcagagatacctgaggaatgggatgaacac

SEQ ID NO: 247392 - DNA, 33 bp, Artificial Sequence
  Description of Artificial Sequence: Synthetic oligonucleotide
gcagagatacctgaggaatgggatgaacacatg

SEQ ID NO: 247393 - DNA, 33 bp, Artificial Sequence
  Description of Artificial Sequence: Synthetic oligonucleotide
cagagatacctgaggaatgggatgaacacatgg

SEQ ID NO: 247394 - DNA, 35 bp, Artificial Sequence
  Description of Artificial Sequence: Synthetic oligonucleotide
agagatacctgaggaatgggatgaacacatggatg

SEQ ID NO: 247395 - DNA, 34 bp, Artificial Sequence
  Description of Artificial Sequence: Synthetic oligonucleotide
gagatacctgaggaatgggatgaacacatggatg

SEQ ID NO: 247396 - DNA, 34 bp, Artificial Sequence
  Description of Artificial Sequence: Synthetic oligonucleotide
agatacctgaggaatgggatgaacacatggatgc

SEQ ID NO: 247397 - DNA, 33 bp, Artificial Sequence
  Description of Artificial Sequence: Synthetic oligonucleotide
gatacctgaggaatgggatgaacacatggatgc

SEQ ID NO: 247398 - DNA, 34 bp, Artificial Sequence
  Description of Artificial Sequence: Synthetic oligonucleotide
atacctgaggaatgggatgaacacatggatgcag

SEQ ID NO: 247399 - DNA, 33 bp, Artificial Sequence
  Description of Artificial Sequence: Synthetic oligonucleotide
tacctgaggaatgggatgaacacatggatgcag

SEQ ID NO: 247400 - DNA, 32 bp, Artificial Sequence
  Description of Artificial Sequence: Synthetic oligonucleotide
acctgaggaatgggatgaacacatggatgcag

SEQ ID NO: 247401 - DNA, 31 bp, Artificial Sequence
  Description of Artificial Sequence: Synthetic oligonucleotide
cctgaggaatgggatgaacacatggatgcag

SEQ ID NO: 247402 - DNA, 34 bp, Artificial Sequence
  Description of Artificial Sequence: Synthetic oligonucleotide
ctgaggaatgggatgaacacatggatgcagaatg

SEQ ID NO: 247403 - DNA, 34 bp, Artificial Sequence
  Description of Artificial Sequence: Synthetic oligonucleotide
tgaggaatgggatgaacacatggatgcagaatgg

SEQ ID NO: 247404 - DNA, 33 bp, Artificial Sequence
  Description of Artificial Sequence: Synthetic oligonucleotide
gaggaatgggatgaacacatggatgcagaatgg

SEQ ID NO: 247405 - DNA, 33 bp, Artificial Sequence
  Description of Artificial Sequence: Synthetic oligonucleotide
aggaatgggatgaacacatggatgcagaatggg

SEQ ID NO: 247406 - DNA, 32 bp, Artificial Sequence
  Description of Artificial Sequence: Synthetic oligonucleotide
ggaatgggatgaacacatggatgcagaatggg

SEQ ID NO: 247407 - DNA, 33 bp, Artificial Sequence
  Description of Artificial Sequence: Synthetic oligonucleotide
gaatgggatgaacacatggatgcagaatgggac

SEQ ID NO: 247408 - DNA, 33 bp, Artificial Sequence
  Description of Artificial Sequence: Synthetic oligonucleotide
aatgggatgaacacatggatgcagaatgggacg

SEQ ID NO: 247409 - DNA, 32 bp, Artificial Sequence
  Description of Artificial Sequence: Synthetic oligonucleotide
atgggatgaacacatggatgcagaatgggacg

SEQ ID NO: 247410 - DNA, 31 bp, Artificial Sequence
  Description of Artificial Sequence: Synthetic oligonucleotide
tgggatgaacacatggatgcagaatgggacg

SEQ ID NO: 247411 - DNA, 30 bp, Artificial Sequence
  Description of Artificial Sequence: Synthetic oligonucleotide
gggatgaacacatggatgcagaatgggacg

SEQ ID NO: 247412 - DNA, 30 bp, Artificial Sequence
  Description of Artificial Sequence: Synthetic oligonucleotide
ggatgaacacatggatgcagaatgggacgc

SEQ ID NO: 247413 - DNA, 31 bp, Artificial Sequence
  Description of Artificial Sequence: Synthetic oligonucleotide
gatgaacacatggatgcagaatgggacgctc

SEQ ID NO: 247414 - DNA, 31 bp, Artificial Sequence
  Description of Artificial Sequence: Synthetic oligonucleotide
atgaacacatggatgcagaatgggacgctcc

SEQ ID NO: 247415 - DNA, 30 bp, Artificial Sequence
  Description of Artificial Sequence: Synthetic oligonucleotide
tgaacacatggatgcagaatgggacgctcc

SEQ ID NO: 247416 - DNA, 29 bp, Artificial Sequence
  Description of Artificial Sequence: Synthetic oligonucleotide
gaacacatggatgcagaatgggacgctcc

SEQ ID NO: 247417 - DNA, 30 bp, Artificial Sequence
  Description of Artificial Sequence: Synthetic oligonucleotide
aacacatggatgcagaatgggacgctcctc

SEQ ID NO: 247418 - DNA, 29 bp, Artificial Sequence
  Description of Artificial Sequence: Synthetic oligonucleotide
acacatggatgcagaatgggacgctcctc

SEQ ID NO: 247419 - DNA, 28 bp, Artificial Sequence
  Description of Artificial Sequence: Synthetic oligonucleotide
cacatggatgcagaatgggacgctcctc

SEQ ID NO: 247420 - DNA, 29 bp, Artificial Sequence
  Description of Artificial Sequence: Synthetic oligonucleotide
acatggatgcagaatgggacgctcctcag

SEQ ID NO: 247421 - DNA, 28 bp, Artificial Sequence
  Description of Artificial Sequence: Synthetic oligonucleotide
catggatgcagaatgggacgctcctcag

SEQ ID NO: 247422 - DNA, 31 bp, Artificial Sequence
  Description of Artificial Sequence: Synthetic oligonucleotide
atggatgcagaatgggacgctcctcagtttg

SEQ ID NO: 247423 - DNA, 30 bp, Artificial Sequence
  Description of Artificial Sequence: Synthetic oligonucleotide
tggatgcagaatgggacgctcctcagtttg

SEQ ID NO: 247424 - DNA, 29 bp, Artificial Sequence
  Description of Artificial Sequence: Synthetic oligonucleotide
ggatgcagaatgggacgctcctcagtttg

SEQ ID NO: 247425 - DNA, 29 bp, Artificial Sequence
  Description of Artificial Sequence: Synthetic oligonucleotide
gatgcagaatgggacgctcctcagtttgc

SEQ ID NO: 247426 - DNA, 29 bp, Artificial Sequence
  Description of Artificial Sequence: Synthetic oligonucleotide
atgcagaatgggacgctcctcagtttgcc

SEQ ID NO: 247427 - DNA, 28 bp, Artificial Sequence
  Description of Artificial Sequence: Synthetic oligonucleotide
tgcagaatgggacgctcctcagtttgcc

SEQ ID NO: 247428 - DNA, 27 bp, Artificial Sequence
  Description of Artificial Sequence: Synthetic oligonucleotide
gcagaatgggacgctcctcagtttgcc

SEQ ID NO: 247429 - DNA, 29 bp, Artificial Sequence
  Description of Artificial Sequence: Synthetic oligonucleotide
cagaatgggacgctcctcagtttgccaac

SEQ ID NO: 247430 - DNA, 29 bp, Artificial Sequence
  Description of Artificial Sequence: Synthetic oligonucleotide
agaatgggacgctcctcagtttgccaacc

SEQ ID NO: 247431 - DNA, 28 bp, Artificial Sequence
  Description of Artificial Sequence: Synthetic oligonucleotide
gaatgggacgctcctcagtttgccaacc

SEQ ID NO: 247432 - DNA, 28 bp, Artificial Sequence
  Description of Artificial Sequence: Synthetic oligonucleotide
aatgggacgctcctcagtttgccaaccg

SEQ ID NO: 247433 - DNA, 27 bp, Artificial Sequence
  Description of Artificial Sequence: Synthetic oligonucleotide
atgggacgctcctcagtttgccaaccg

SEQ ID NO: 247434 - DNA, 27 bp, Artificial Sequence
  Description of Artificial Sequence: Synthetic oligonucleotide
tgggacgctcctcagtttgccaaccgt

SEQ ID NO: 247435 - DNA, 27 bp, Artificial Sequence
  Description of Artificial Sequence: Synthetic oligonucleotide
gggacgctcctcagtttgccaaccgta

SEQ ID NO: 247436 - DNA, 27 bp, Artificial Sequence
  Description of Artificial Sequence: Synthetic oligonucleotide
ggacgctcctcagtttgccaaccgtag

SEQ ID NO: 247437 - DNA, 29 bp, Artificial Sequence
  Description of Artificial Sequence: Synthetic oligonucleotide
gacgctcctcagtttgccaaccgtagatg

SEQ ID NO: 247438 - DNA, 30 bp, Artificial Sequence
  Description of Artificial Sequence: Synthetic oligonucleotide
acgctcctcagtttgccaaccgtagatgtg

SEQ ID NO: 247439 - DNA, 29 bp, Artificial Sequence
  Description of Artificial Sequence: Synthetic oligonucleotide
cgctcctcagtttgccaaccgtagatgtg

SEQ ID NO: 247440 - DNA, 30 bp, Artificial Sequence
  Description of Artificial Sequence: Synthetic oligonucleotide
gctcctcagtttgccaaccgtagatgtgac

SEQ ID NO: 247441 - DNA, 31 bp, Artificial Sequence
  Description of Artificial Sequence: Synthetic oligonucleotide
ctcctcagtttgccaaccgtagatgtgactc

SEQ ID NO: 247442 - DNA, 32 bp, Artificial Sequence
  Description of Artificial Sequence: Synthetic oligonucleotide
tcctcagtttgccaaccgtagatgtgactcag

SEQ ID NO: 247443 - DNA, 31 bp, Artificial Sequence
  Description of Artificial Sequence: Synthetic oligonucleotide
cctcagtttgccaaccgtagatgtgactcag

SEQ ID NO: 247444 - DNA, 31 bp, Artificial Sequence
  Description of Artificial Sequence: Synthetic oligonucleotide
ctcagtttgccaaccgtagatgtgactcagc

SEQ ID NO: 247445 - DNA, 32 bp, Artificial Sequence
  Description of Artificial Sequence: Synthetic oligonucleotide
tcagtttgccaaccgtagatgtgactcagctc

SEQ ID NO: 247446 - DNA, 31 bp, Artificial Sequence
  Description of Artificial Sequence: Synthetic oligonucleotide
cagtttgccaaccgtagatgtgactcagctc

SEQ ID NO: 247447 - DNA, 31 bp, Artificial Sequence
  Description of Artificial Sequence: Synthetic oligonucleotide
agtttgccaaccgtagatgtgactcagctcc

SEQ ID NO: 247448 - DNA, 30 bp, Artificial Sequence
  Description of Artificial Sequence: Synthetic oligonucleotide
gtttgccaaccgtagatgtgactcagctcc

SEQ ID NO: 247449 - DNA, 31 bp, Artificial Sequence
  Description of Artificial Sequence: Synthetic oligonucleotide
tttgccaaccgtagatgtgactcagctcctc

SEQ ID NO: 247450 - DNA, 30 bp, Artificial Sequence
  Description of Artificial Sequence: Synthetic oligonucleotide
ttgccaaccgtagatgtgactcagctcctc

SEQ ID NO: 247451 - DNA, 29 bp, Artificial Sequence
  Description of Artificial Sequence: Synthetic oligonucleotide
tgccaaccgtagatgtgactcagctcctc

SEQ ID NO: 247452 - DNA, 28 bp, Artificial Sequence
  Description of Artificial Sequence: Synthetic oligonucleotide
gccaaccgtagatgtgactcagctcctc

SEQ ID NO: 247453 - DNA, 28 bp, Artificial Sequence
  Description of Artificial Sequence: Synthetic oligonucleotide
ccaaccgtagatgtgactcagctcctcg

SEQ ID NO: 247454 - DNA, 30 bp, Artificial Sequence
  Description of Artificial Sequence: Synthetic oligonucleotide
caaccgtagatgtgactcagctcctcgatg

SEQ ID NO: 247455 - DNA, 31 bp, Artificial Sequence
  Description of Artificial Sequence: Synthetic oligonucleotide
aaccgtagatgtgactcagctcctcgatgtg

SEQ ID NO: 247456 - DNA, 30 bp, Artificial Sequence
  Description of Artificial Sequence: Synthetic oligonucleotide
accgtagatgtgactcagctcctcgatgtg

SEQ ID NO: 247457 - DNA, 29 bp, Artificial Sequence
  Description of Artificial Sequence: Synthetic oligonucleotide
ccgtagatgtgactcagctcctcgatgtg

SEQ ID NO: 247458 - DNA, 29 bp, Artificial Sequence
  Description of Artificial Sequence: Synthetic oligonucleotide
cgtagatgtgactcagctcctcgatgtgg

SEQ ID NO: 247459 - DNA, 30 bp, Artificial Sequence
  Description of Artificial Sequence: Synthetic oligonucleotide
gtagatgtgactcagctcctcgatgtggtg

SEQ ID NO: 247460 - DNA, 31 bp, Artificial Sequence
  Description of Artificial Sequence: Synthetic oligonucleotide
tagatgtgactcagctcctcgatgtggtgac

SEQ ID NO: 247461 - DNA, 30 bp, Artificial Sequence
  Description of Artificial Sequence: Synthetic oligonucleotide
agatgtgactcagctcctcgatgtggtgac

SEQ ID NO: 247462 - DNA, 29 bp, Artificial Sequence
  Description of Artificial Sequence: Synthetic oligonucleotide
gatgtgactcagctcctcgatgtggtgac

SEQ ID NO: 247463 - DNA, 30 bp, Artificial Sequence
  Description of Artificial Sequence: Synthetic oligonucleotide
atgtgactcagctcctcgatgtggtgactg

SEQ ID NO: 247464 - DNA, 29 bp, Artificial Sequence
  Description of Artificial Sequence: Synthetic oligonucleotide
tgtgactcagctcctcgatgtggtgactg

SEQ ID NO: 247465 - DNA, 28 bp, Artificial Sequence
  Description of Artificial Sequence: Synthetic oligonucleotide
gtgactcagctcctcgatgtggtgactg

SEQ ID NO: 247466 - DNA, 28 bp, Artificial Sequence
  Description of Artificial Sequence: Synthetic oligonucleotide
tgactcagctcctcgatgtggtgactgg

SEQ ID NO: 247467 - DNA, 27 bp, Artificial Sequence
  Description of Artificial Sequence: Synthetic oligonucleotide
gactcagctcctcgatgtggtgactgg

SEQ ID NO: 247468 - DNA, 27 bp, Artificial Sequence
  Description of Artificial Sequence: Synthetic oligonucleotide
actcagctcctcgatgtggtgactggc

SEQ ID NO: 247469 - DNA, 27 bp, Artificial Sequence
  Description of Artificial Sequence: Synthetic oligonucleotide
ctcagctcctcgatgtggtgactggca

SEQ ID NO: 247470 - DNA, 27 bp, Artificial Sequence
  Description of Artificial Sequence: Synthetic oligonucleotide
tcagctcctcgatgtggtgactggcag

SEQ ID NO: 247471 - DNA, 26 bp, Artificial Sequence
  Description of Artificial Sequence: Synthetic oligonucleotide
cagctcctcgatgtggtgactggcag

SEQ ID NO: 247472 - DNA, 26 bp, Artificial Sequence
  Description of Artificial Sequence: Synthetic oligonucleotide
agctcctcgatgtggtgactggcagc

SEQ ID NO: 247473 - DNA, 25 bp, Artificial Sequence
  Description of Artificial Sequence: Synthetic oligonucleotide
gctcctcgatgtggtgactggcagc

SEQ ID NO: 247474 - DNA, 26 bp, Artificial Sequence
  Description of Artificial Sequence: Synthetic oligonucleotide
ctcctcgatgtggtgactggcagcgt

SEQ ID NO: 247475 - DNA, 26 bp, Artificial Sequence
  Description of Artificial Sequence: Synthetic oligonucleotide
tcctcgatgtggtgactggcagcgtc

SEQ ID NO: 247476 - DNA, 25 bp, Artificial Sequence
  Description of Artificial Sequence: Synthetic oligonucleotide
cctcgatgtggtgactggcagcgtc

SEQ ID NO: 247477 - DNA, 26 bp, Artificial Sequence
  Description of Artificial Sequence: Synthetic oligonucleotide
ctcgatgtggtgactggcagcgtcct

SEQ ID NO: 247478 - DNA, 27 bp, Artificial Sequence
  Description of Artificial Sequence: Synthetic oligonucleotide
tcgatgtggtgactggcagcgtcctgt

SEQ ID NO: 247479 - DNA, 26 bp, Artificial Sequence
  Description of Artificial Sequence: Synthetic oligonucleotide
cgatgtggtgactggcagcgtcctgt

SEQ ID NO: 247480 - DNA, 27 bp, Artificial Sequence
  Description of Artificial Sequence: Synthetic oligonucleotide
gatgtggtgactggcagcgtcctgtga

SEQ ID NO: 247481 - DNA, 29 bp, Artificial Sequence
  Description of Artificial Sequence: Synthetic oligonucleotide
atgtggtgactggcagcgtcctgtgattc

SEQ ID NO: 247482 - DNA, 28 bp, Artificial Sequence
  Description of Artificial Sequence: Synthetic oligonucleotide
tgtggtgactggcagcgtcctgtgattc

SEQ ID NO: 247483 - DNA, 27 bp, Artificial Sequence
  Description of Artificial Sequence: Synthetic oligonucleotide
gtggtgactggcagcgtcctgtgattc

SEQ ID NO: 247484 - DNA, 28 bp, Artificial Sequence
  Description of Artificial Sequence: Synthetic oligonucleotide
tggtgactggcagcgtcctgtgattcac

SEQ ID NO: 247485 - DNA, 27 bp, Artificial Sequence
  Description of Artificial Sequence: Synthetic oligonucleotide
ggtgactggcagcgtcctgtgattcac

SEQ ID NO: 247486 - DNA, 29 bp, Artificial Sequence
  Description of Artificial Sequence: Synthetic oligonucleotide
gtgactggcagcgtcctgtgattcacaac

SEQ ID NO: 247487 - DNA, 29 bp, Artificial Sequence
  Description of Artificial Sequence: Synthetic oligonucleotide
tgactggcagcgtcctgtgattcacaacc

SEQ ID NO: 247488 - DNA, 28 bp, Artificial Sequence
  Description of Artificial Sequence: Synthetic oligonucleotide
gactggcagcgtcctgtgattcacaacc

SEQ ID NO: 247489 - DNA, 28 bp, Artificial Sequence
  Description of Artificial Sequence: Synthetic oligonucleotide
actggcagcgtcctgtgattcacaaccc

SEQ ID NO: 247490 - DNA, 27 bp, Artificial Sequence
  Description of Artificial Sequence: Synthetic oligonucleotide
ctggcagcgtcctgtgattcacaaccc

SEQ ID NO: 247491 - DNA, 27 bp, Artificial Sequence
  Description of Artificial Sequence: Synthetic oligonucleotide
tggcagcgtcctgtgattcacaacccc

SEQ ID NO: 247492 - DNA, 27 bp, Artificial Sequence
  Description of Artificial Sequence: Synthetic oligonucleotide
ggcagcgtcctgtgattcacaacccca

SEQ ID NO: 247493 - DNA, 35 bp, Artificial Sequence
  Description of Artificial Sequence: Synthetic oligonucleotide
gcagcgtcctgtgattcacaaccccatttataaag

SEQ ID NO: 247494 - DNA, 35 bp, Artificial Sequence
  Description of Artificial Sequence: Synthetic oligonucleotide
cagcgtcctgtgattcacaaccccatttataaagg

SEQ ID NO: 247495 - DNA, 35 bp, Artificial Sequence
  Description of Artificial Sequence: Synthetic oligonucleotide
agcgtcctgtgattcacaaccccatttataaaggg

SEQ ID NO: 247496 - DNA, 34 bp, Artificial Sequence
  Description of Artificial Sequence: Synthetic oligonucleotide
gcgtcctgtgattcacaaccccatttataaaggg

SEQ ID NO: 247497 - DNA, 38 bp, Artificial Sequence
  Description of Artificial Sequence: Synthetic oligonucleotide
cgtcctgtgattcacaaccccatttataaagggaaatg

SEQ ID NO: 247498 - DNA, 38 bp, Artificial Sequence
  Description of Artificial Sequence: Synthetic oligonucleotide
gtcctgtgattcacaaccccatttataaagggaaatgg

SEQ ID NO: 247499 - DNA, 40 bp, Artificial Sequence
  Description of Artificial Sequence: Synthetic oligonucleotide
tcctgtgattcacaaccccatttataaagggaaatggaag

SEQ ID NO: 247500 - DNA, 39 bp, Artificial Sequence
  Description of Artificial Sequence: Synthetic oligonucleotide
cctgtgattcacaaccccatttataaagggaaatggaag

SEQ ID NO: 247501 - DNA, 39 bp, Artificial Sequence
  Description of Artificial Sequence: Synthetic oligonucleotide
ctgtgattcacaaccccatttataaagggaaatggaagg

SEQ ID NO: 247502 - DNA, 39 bp, Artificial Sequence
  Description of Artificial Sequence: Synthetic oligonucleotide
tgtgattcacaaccccatttataaagggaaatggaaggc

SEQ ID NO: 247503 - DNA, 38 bp, Artificial Sequence
  Description of Artificial Sequence: Synthetic oligonucleotide
gtgattcacaaccccatttataaagggaaatggaaggc

SEQ ID NO: 247504 - DNA, 39 bp, Artificial Sequence
  Description of Artificial Sequence: Synthetic oligonucleotide
tgattcacaaccccatttataaagggaaatggaaggctc

SEQ ID NO: 247505 - DNA, 38 bp, Artificial Sequence
  Description of Artificial Sequence: Synthetic oligonucleotide
gattcacaaccccatttataaagggaaatggaaggctc

SEQ ID NO: 247506 - DNA, 38 bp, Artificial Sequence
  Description of Artificial Sequence: Synthetic oligonucleotide
attcacaaccccatttataaagggaaatggaaggctcc

SEQ ID NO: 247507 - DNA, 37 bp, Artificial Sequence
  Description of Artificial Sequence: Synthetic oligonucleotide
ttcacaaccccatttataaagggaaatggaaggctcc

SEQ ID NO: 247508 - DNA, 36 bp, Artificial Sequence
  Description of Artificial Sequence: Synthetic oligonucleotide
tcacaaccccatttataaagggaaatggaaggctcc

SEQ ID NO: 247509 - DNA, 35 bp, Artificial Sequence
  Description of Artificial Sequence: Synthetic oligonucleotide
cacaaccccatttataaagggaaatggaaggctcc

SEQ ID NO: 247510 - DNA, 38 bp, Artificial Sequence
  Description of Artificial Sequence: Synthetic oligonucleotide
acaaccccatttataaagggaaatggaaggctcctatg

SEQ ID NO: 247511 - DNA, 37 bp, Artificial Sequence
  Description of Artificial Sequence: Synthetic oligonucleotide
caaccccatttataaagggaaatggaaggctcctatg

SEQ ID NO: 247512 - DNA, 40 bp, Artificial Sequence
  Description of Artificial Sequence: Synthetic oligonucleotide
aaccccatttataaagggaaatggaaggctcctatgaatg

SEQ ID NO: 247513 - DNA, 39 bp, Artificial Sequence
  Description of Artificial Sequence: Synthetic oligonucleotide
accccatttataaagggaaatggaaggctcctatgaatg

SEQ ID NO: 247514 - DNA, 38 bp, Artificial Sequence
  Description of Artificial Sequence: Synthetic oligonucleotide
ccccatttataaagggaaatggaaggctcctatgaatg

SEQ ID NO: 247515 - DNA, 39 bp, Artificial Sequence
  Description of Artificial Sequence: Synthetic oligonucleotide
cccatttataaagggaaatggaaggctcctatgaatgac

SEQ ID NO: 247516 - DNA, 42 bp, Artificial Sequence
  Description of Artificial Sequence: Synthetic oligonucleotide
ccatttataaagggaaatggaaggctcctatgaatgacaatc

SEQ ID NO: 247517 - DNA, 42 bp, Artificial Sequence
  Description of Artificial Sequence: Synthetic oligonucleotide
catttataaagggaaatggaaggctcctatgaatgacaatcc

SEQ ID NO: 247518 - DNA, 42 bp, Artificial Sequence
  Description of Artificial Sequence: Synthetic oligonucleotide
atttataaagggaaatggaaggctcctatgaatgacaatccg

SEQ ID NO: 247519 - DNA, 41 bp, Artificial Sequence
  Description of Artificial Sequence: Synthetic oligonucleotide
tttataaagggaaatggaaggctcctatgaatgacaatccg

SEQ ID NO: 247520 - DNA, 40 bp, Artificial Sequence
  Description of Artificial Sequence: Synthetic oligonucleotide
ttataaagggaaatggaaggctcctatgaatgacaatccg

SEQ ID NO: 247521 - DNA, 39 bp, Artificial Sequence
  Description of Artificial Sequence: Synthetic oligonucleotide
tataaagggaaatggaaggctcctatgaatgacaatccg

SEQ ID NO: 247522 - DNA, 38 bp, Artificial Sequence
  Description of Artificial Sequence: Synthetic oligonucleotide
ataaagggaaatggaaggctcctatgaatgacaatccg

SEQ ID NO: 247523 - DNA, 37 bp, Artificial Sequence
  Description of Artificial Sequence: Synthetic oligonucleotide
taaagggaaatggaaggctcctatgaatgacaatccg

SEQ ID NO: 247524 - DNA, 36 bp, Artificial Sequence
  Description of Artificial Sequence: Synthetic oligonucleotide
aaagggaaatggaaggctcctatgaatgacaatccg

SEQ ID NO: 247525 - DNA, 35 bp, Artificial Sequence
  Description of Artificial Sequence: Synthetic oligonucleotide
aagggaaatggaaggctcctatgaatgacaatccg

SEQ ID NO: 247526 - DNA, 34 bp, Artificial Sequence
  Description of Artificial Sequence: Synthetic oligonucleotide
agggaaatggaaggctcctatgaatgacaatccg

SEQ ID NO: 247527 - DNA, 33 bp, Artificial Sequence
  Description of Artificial Sequence: Synthetic oligonucleotide
gggaaatggaaggctcctatgaatgacaatccg

SEQ ID NO: 247528 - DNA, 34 bp, Artificial Sequence
  Description of Artificial Sequence: Synthetic oligonucleotide
ggaaatggaaggctcctatgaatgacaatccgag

SEQ ID NO: 247529 - DNA, 37 bp, Artificial Sequence
  Description of Artificial Sequence: Synthetic oligonucleotide
gaaatggaaggctcctatgaatgacaatccgagttac

SEQ ID NO: 247530 - DNA, 37 bp, Artificial Sequence
  Description of Artificial Sequence: Synthetic oligonucleotide
aaatggaaggctcctatgaatgacaatccgagttacc

SEQ ID NO: 247531 - DNA, 36 bp, Artificial Sequence
  Description of Artificial Sequence: Synthetic oligonucleotide
aatggaaggctcctatgaatgacaatccgagttacc

SEQ ID NO: 247532 - DNA, 35 bp, Artificial Sequence
  Description of Artificial Sequence: Synthetic oligonucleotide
atggaaggctcctatgaatgacaatccgagttacc

SEQ ID NO: 247533 - DNA, 34 bp, Artificial Sequence
  Description of Artificial Sequence: Synthetic oligonucleotide
tggaaggctcctatgaatgacaatccgagttacc

SEQ ID NO: 247534 - DNA, 33 bp, Artificial Sequence
  Description of Artificial Sequence: Synthetic oligonucleotide
ggaaggctcctatgaatgacaatccgagttacc

SEQ ID NO: 247535 - DNA, 34 bp, Artificial Sequence
  Description of Artificial Sequence: Synthetic oligonucleotide
gaaggctcctatgaatgacaatccgagttaccag

SEQ ID NO: 247536 - DNA, 34 bp, Artificial Sequence
  Description of Artificial Sequence: Synthetic oligonucleotide
aaggctcctatgaatgacaatccgagttaccagc

SEQ ID NO: 247537 - DNA, 33 bp, Artificial Sequence
  Description of Artificial Sequence: Synthetic oligonucleotide
aggctcctatgaatgacaatccgagttaccagc

SEQ ID NO: 247538 - DNA, 32 bp, Artificial Sequence
  Description of Artificial Sequence: Synthetic oligonucleotide
ggctcctatgaatgacaatccgagttaccagc

SEQ ID NO: 247539 - DNA, 32 bp, Artificial Sequence
  Description of Artificial Sequence: Synthetic oligonucleotide
gctcctatgaatgacaatccgagttaccagcg

SEQ ID NO: 247540 - DNA, 35 bp, Artificial Sequence
  Description of Artificial Sequence: Synthetic oligonucleotide
ctcctatgaatgacaatccgagttaccagcgaatc

SEQ ID NO: 247541 - DNA, 36 bp, Artificial Sequence
  Description of Artificial Sequence: Synthetic oligonucleotide
tcctatgaatgacaatccgagttaccagcgaatctg

SEQ ID NO: 247542 - DNA, 35 bp, Artificial Sequence
  Description of Artificial Sequence: Synthetic oligonucleotide
cctatgaatgacaatccgagttaccagcgaatctg

SEQ ID NO: 247543 - DNA, 35 bp, Artificial Sequence
  Description of Artificial Sequence: Synthetic oligonucleotide
ctatgaatgacaatccgagttaccagcgaatctgg

SEQ ID NO: 247544 - DNA, 38 bp, Artificial Sequence
  Description of Artificial Sequence: Synthetic oligonucleotide
tatgaatgacaatccgagttaccagcgaatctggatac

SEQ ID NO: 247545 - DNA, 37 bp, Artificial Sequence
  Description of Artificial Sequence: Synthetic oligonucleotide
atgaatgacaatccgagttaccagcgaatctggatac

SEQ ID NO: 247546 - DNA, 36 bp, Artificial Sequence
  Description of Artificial Sequence: Synthetic oligonucleotide
tgaatgacaatccgagttaccagcgaatctggatac

SEQ ID NO: 247547 - DNA, 35 bp, Artificial Sequence
  Description of Artificial Sequence: Synthetic oligonucleotide
gaatgacaatccgagttaccagcgaatctggatac

SEQ ID NO: 247548 - DNA, 35 bp, Artificial Sequence
  Description of Artificial Sequence: Synthetic oligonucleotide
aatgacaatccgagttaccagcgaatctggatacc

SEQ ID NO: 247549 - DNA, 34 bp, Artificial Sequence
  Description of Artificial Sequence: Synthetic oligonucleotide
atgacaatccgagttaccagcgaatctggatacc

SEQ ID NO: 247550 - DNA, 33 bp, Artificial Sequence
  Description of Artificial Sequence: Synthetic oligonucleotide
tgacaatccgagttaccagcgaatctggatacc

SEQ ID NO: 247551 - DNA, 32 bp, Artificial Sequence
  Description of Artificial Sequence: Synthetic oligonucleotide
gacaatccgagttaccagcgaatctggatacc

SEQ ID NO: 247552 - DNA, 32 bp, Artificial Sequence
  Description of Artificial Sequence: Synthetic oligonucleotide
acaatccgagttaccagcgaatctggataccc

SEQ ID NO: 247553 - DNA, 31 bp, Artificial Sequence
  Description of Artificial Sequence: Synthetic oligonucleotide
caatccgagttaccagcgaatctggataccc

SEQ ID NO: 247554 - DNA, 32 bp, Artificial Sequence
  Description of Artificial Sequence: Synthetic oligonucleotide
aatccgagttaccagcgaatctggatacccag

SEQ ID NO: 247555 - DNA, 31 bp, Artificial Sequence
  Description of Artificial Sequence: Synthetic oligonucleotide
atccgagttaccagcgaatctggatacccag

SEQ ID NO: 247556 - DNA, 30 bp, Artificial Sequence
  Description of Artificial Sequence: Synthetic oligonucleotide
tccgagttaccagcgaatctggatacccag

SEQ ID NO: 247557 - DNA, 29 bp, Artificial Sequence
  Description of Artificial Sequence: Synthetic oligonucleotide
ccgagttaccagcgaatctggatacccag

SEQ ID NO: 247558 - DNA, 29 bp, Artificial Sequence
  Description of Artificial Sequence: Synthetic oligonucleotide
cgagttaccagcgaatctggatacccagg

SEQ ID NO: 247559 - DNA, 35 bp, Artificial Sequence
  Description of Artificial Sequence: Synthetic oligonucleotide
gagttaccagcgaatctggatacccaggaatatac

SEQ ID NO: 247560 - DNA, 35 bp, Artificial Sequence
  Description of Artificial Sequence: Synthetic oligonucleotide
agttaccagcgaatctggatacccaggaatatacc

SEQ ID NO: 247561 - DNA, 34 bp, Artificial Sequence
  Description of Artificial Sequence: Synthetic oligonucleotide
gttaccagcgaatctggatacccaggaatatacc

SEQ ID NO: 247562 - DNA, 38 bp, Artificial Sequence
  Description of Artificial Sequence: Synthetic oligonucleotide
ttaccagcgaatctggatacccaggaatataccaaatg

SEQ ID NO: 247563 - DNA, 37 bp, Artificial Sequence
  Description of Artificial Sequence: Synthetic oligonucleotide
taccagcgaatctggatacccaggaatataccaaatg

SEQ ID NO: 247564 - DNA, 36 bp, Artificial Sequence
  Description of Artificial Sequence: Synthetic oligonucleotide
accagcgaatctggatacccaggaatataccaaatg

SEQ ID NO: 247565 - DNA, 35 bp, Artificial Sequence
  Description of Artificial Sequence: Synthetic oligonucleotide
ccagcgaatctggatacccaggaatataccaaatg

SEQ ID NO: 247566 - DNA, 35 bp, Artificial Sequence
  Description of Artificial Sequence: Synthetic oligonucleotide
cagcgaatctggatacccaggaatataccaaatgc

SEQ ID NO: 247567 - DNA, 36 bp, Artificial Sequence
  Description of Artificial Sequence: Synthetic oligonucleotide
agcgaatctggatacccaggaatataccaaatgcag

SEQ ID NO: 247568 - DNA, 35 bp, Artificial Sequence
  Description of Artificial Sequence: Synthetic oligonucleotide
gcgaatctggatacccaggaatataccaaatgcag

SEQ ID NO: 247569 - DNA, 39 bp, Artificial Sequence
  Description of Artificial Sequence: Synthetic oligonucleotide
cgaatctggatacccaggaatataccaaatgcagatttc

SEQ ID NO: 247570 - DNA, 42 bp, Artificial Sequence
  Description of Artificial Sequence: Synthetic oligonucleotide
gaatctggatacccaggaatataccaaatgcagatttctatg

SEQ ID NO: 247571 - DNA, 44 bp, Artificial Sequence
  Description of Artificial Sequence: Synthetic oligonucleotide
aatctggatacccaggaatataccaaatgcagatttctatgaag

SEQ ID NO: 247572 - DNA, 43 bp, Artificial Sequence
  Description of Artificial Sequence: Synthetic oligonucleotide
atctggatacccaggaatataccaaatgcagatttctatgaag

SEQ ID NO: 247573 - DNA, 42 bp, Artificial Sequence
  Description of Artificial Sequence: Synthetic oligonucleotide
tctggatacccaggaatataccaaatgcagatttctatgaag

SEQ ID NO: 247574 - DNA, 41 bp, Artificial Sequence
  Description of Artificial Sequence: Synthetic oligonucleotide
ctggatacccaggaatataccaaatgcagatttctatgaag

SEQ ID NO: 247575 - DNA, 43 bp, Artificial Sequence
  Description of Artificial Sequence: Synthetic oligonucleotide
tggatacccaggaatataccaaatgcagatttctatgaagatc

SEQ ID NO: 247576 - DNA, 42 bp, Artificial Sequence
  Description of Artificial Sequence: Synthetic oligonucleotide
ggatacccaggaatataccaaatgcagatttctatgaagatc

SEQ ID NO: 247577 - DNA, 43 bp, Artificial Sequence
  Description of Artificial Sequence: Synthetic oligonucleotide
gatacccaggaatataccaaatgcagatttctatgaagatctc

SEQ ID NO: 247578 - DNA, 43 bp, Artificial Sequence
  Description of Artificial Sequence: Synthetic oligonucleotide
atacccaggaatataccaaatgcagatttctatgaagatctcg

SEQ ID NO: 247579 - DNA, 42 bp, Artificial Sequence
  Description of Artificial Sequence: Synthetic oligonucleotide
tacccaggaatataccaaatgcagatttctatgaagatctcg

SEQ ID NO: 247580 - DNA, 41 bp, Artificial Sequence
  Description of Artificial Sequence: Synthetic oligonucleotide
acccaggaatataccaaatgcagatttctatgaagatctcg

SEQ ID NO: 247581 - DNA, 40 bp, Artificial Sequence
  Description of Artificial Sequence: Synthetic oligonucleotide
cccaggaatataccaaatgcagatttctatgaagatctcg

SEQ ID NO: 247582 - DNA, 42 bp, Artificial Sequence
  Description of Artificial Sequence: Synthetic oligonucleotide
ccaggaatataccaaatgcagatttctatgaagatctcgaac

SEQ ID NO: 247583 - DNA, 42 bp, Artificial Sequence
  Description of Artificial Sequence: Synthetic oligonucleotide
caggaatataccaaatgcagatttctatgaagatctcgaacc

SEQ ID NO: 247584 - DNA, 45 bp, Artificial Sequence
  Description of Artificial Sequence: Synthetic oligonucleotide
aggaatataccaaatgcagatttctatgaagatctcgaacctttc

SEQ ID NO: 247585 - DNA, 44 bp, Artificial Sequence
  Description of Artificial Sequence: Synthetic oligonucleotide
ggaatataccaaatgcagatttctatgaagatctcgaacctttc

SEQ ID NO: 247586 - DNA, 45 bp, Artificial Sequence
  Description of Artificial Sequence: Synthetic oligonucleotide
gaatataccaaatgcagatttctatgaagatctcgaacctttctg

SEQ ID NO: 247587 - DNA, 48 bp, Artificial Sequence
  Description of Artificial Sequence: Synthetic oligonucleotide
aatataccaaatgcagatttctatgaagatctcgaacctttctgaatg

SEQ ID NO: 247588 - DNA, 47 bp, Artificial Sequence
  Description of Artificial Sequence: Synthetic oligonucleotide
atataccaaatgcagatttctatgaagatctcgaacctttctgaatg

SEQ ID NO: 247589 - DNA, 46 bp, Artificial Sequence
  Description of Artificial Sequence: Synthetic oligonucleotide
tataccaaatgcagatttctatgaagatctcgaacctttctgaatg

SEQ ID NO: 247590 - DNA, 45 bp, Artificial Sequence
  Description of Artificial Sequence: Synthetic oligonucleotide
ataccaaatgcagatttctatgaagatctcgaacctttctgaatg

SEQ ID NO: 247591 - DNA, 44 bp, Artificial Sequence
  Description of Artificial Sequence: Synthetic oligonucleotide
taccaaatgcagatttctatgaagatctcgaacctttctgaatg

SEQ ID NO: 247592 - DNA, 43 bp, Artificial Sequence
  Description of Artificial Sequence: Synthetic oligonucleotide
accaaatgcagatttctatgaagatctcgaacctttctgaatg

SEQ ID NO: 247593 - DNA, 42 bp, Artificial Sequence
  Description of Artificial Sequence: Synthetic oligonucleotide
ccaaatgcagatttctatgaagatctcgaacctttctgaatg

SEQ ID NO: 247594 - DNA, 43 bp, Artificial Sequence
  Description of Artificial Sequence: Synthetic oligonucleotide
caaatgcagatttctatgaagatctcgaacctttctgaatgac

SEQ ID NO: 247595 - DNA, 44 bp, Artificial Sequence
  Description of Artificial Sequence: Synthetic oligonucleotide
aaatgcagatttctatgaagatctcgaacctttctgaatgactc

SEQ ID NO: 247596 - DNA, 43 bp, Artificial Sequence
  Description of Artificial Sequence: Synthetic oligonucleotide
aatgcagatttctatgaagatctcgaacctttctgaatgactc

SEQ ID NO: 247597 - DNA, 42 bp, Artificial Sequence
  Description of Artificial Sequence: Synthetic oligonucleotide
atgcagatttctatgaagatctcgaacctttctgaatgactc

SEQ ID NO: 247598 - DNA, 41 bp, Artificial Sequence
  Description of Artificial Sequence: Synthetic oligonucleotide
tgcagatttctatgaagatctcgaacctttctgaatgactc

SEQ ID NO: 247599 - DNA, 40 bp, Artificial Sequence
  Description of Artificial Sequence: Synthetic oligonucleotide
gcagatttctatgaagatctcgaacctttctgaatgactc

SEQ ID NO: 247600 - DNA, 40 bp, Artificial Sequence
  Description of Artificial Sequence: Synthetic oligonucleotide
cagatttctatgaagatctcgaacctttctgaatgactcg

SEQ ID NO: 247601 - DNA, 45 bp, Artificial Sequence
  Description of Artificial Sequence: Synthetic oligonucleotide
agatttctatgaagatctcgaacctttctgaatgactcgttttag

SEQ ID NO: 247602 - DNA, 44 bp, Artificial Sequence
  Description of Artificial Sequence: Synthetic oligonucleotide
gatttctatgaagatctcgaacctttctgaatgactcgttttag

SEQ ID NO: 247603 - DNA, 45 bp, Artificial Sequence
  Description of Artificial Sequence: Synthetic oligonucleotide
atttctatgaagatctcgaacctttctgaatgactcgttttagtg

SEQ ID NO: 247604 - DNA, 44 bp, Artificial Sequence
  Description of Artificial Sequence: Synthetic oligonucleotide
tttctatgaagatctcgaacctttctgaatgactcgttttagtg

SEQ ID NO: 247605 - DNA, 43 bp, Artificial Sequence
  Description of Artificial Sequence: Synthetic oligonucleotide
ttctatgaagatctcgaacctttctgaatgactcgttttagtg

SEQ ID NO: 247606 - DNA, 42 bp, Artificial Sequence
  Description of Artificial Sequence: Synthetic oligonucleotide
tctatgaagatctcgaacctttctgaatgactcgttttagtg

SEQ ID NO: 247607 - DNA, 41 bp, Artificial Sequence
  Description of Artificial Sequence: Synthetic oligonucleotide
ctatgaagatctcgaacctttctgaatgactcgttttagtg

SEQ ID NO: 247608 - DNA, 41 bp, Artificial Sequence
  Description of Artificial Sequence: Synthetic oligonucleotide
tatgaagatctcgaacctttctgaatgactcgttttagtgc

SEQ ID NO: 247609 - DNA, 40 bp, Artificial Sequence
  Description of Artificial Sequence: Synthetic oligonucleotide
atgaagatctcgaacctttctgaatgactcgttttagtgc

SEQ ID NO: 247610 - DNA, 39 bp, Artificial Sequence
  Description of Artificial Sequence: Synthetic oligonucleotide
tgaagatctcgaacctttctgaatgactcgttttagtgc

SEQ ID NO: 247611 - DNA, 38 bp, Artificial Sequence
  Description of Artificial Sequence: Synthetic oligonucleotide
gaagatctcgaacctttctgaatgactcgttttagtgc

SEQ ID NO: 247612 - DNA, 42 bp, Artificial Sequence
  Description of Artificial Sequence: Synthetic oligonucleotide
aagatctcgaacctttctgaatgactcgttttagtgcaattg

SEQ ID NO: 247613 - DNA, 41 bp, Artificial Sequence
  Description of Artificial Sequence: Synthetic oligonucleotide
agatctcgaacctttctgaatgactcgttttagtgcaattg

SEQ ID NO: 247614 - DNA, 40 bp, Artificial Sequence
  Description of Artificial Sequence: Synthetic oligonucleotide
gatctcgaacctttctgaatgactcgttttagtgcaattg

SEQ ID NO: 247615 - DNA, 40 bp, Artificial Sequence
  Description of Artificial Sequence: Synthetic oligonucleotide
atctcgaacctttctgaatgactcgttttagtgcaattgg

SEQ ID NO: 247616 - DNA, 39 bp, Artificial Sequence
  Description of Artificial Sequence: Synthetic oligonucleotide
tctcgaacctttctgaatgactcgttttagtgcaattgg

SEQ ID NO: 247617 - DNA, 38 bp, Artificial Sequence
  Description of Artificial Sequence: Synthetic oligonucleotide
ctcgaacctttctgaatgactcgttttagtgcaattgg

SEQ ID NO: 247618 - DNA, 41 bp, Artificial Sequence
  Description of Artificial Sequence: Synthetic oligonucleotide
tcgaacctttctgaatgactcgttttagtgcaattggtttg

SEQ ID NO: 247619 - DNA, 40 bp, Artificial Sequence
  Description of Artificial Sequence: Synthetic oligonucleotide
cgaacctttctgaatgactcgttttagtgcaattggtttg

SEQ ID NO: 247620 - DNA, 40 bp, Artificial Sequence
  Description of Artificial Sequence: Synthetic oligonucleotide
gaacctttctgaatgactcgttttagtgcaattggtttgc

SEQ ID NO: 247621 - DNA, 41 bp, Artificial Sequence
  Description of Artificial Sequence: Synthetic oligonucleotide
aacctttctgaatgactcgttttagtgcaattggtttgcag

SEQ ID NO: 247622 - DNA, 40 bp, Artificial Sequence
  Description of Artificial Sequence: Synthetic oligonucleotide
acctttctgaatgactcgttttagtgcaattggtttgcag

SEQ ID NO: 247623 - DNA, 39 bp, Artificial Sequence
  Description of Artificial Sequence: Synthetic oligonucleotide
cctttctgaatgactcgttttagtgcaattggtttgcag

SEQ ID NO: 247624 - DNA, 39 bp, Artificial Sequence
  Description of Artificial Sequence: Synthetic oligonucleotide
ctttctgaatgactcgttttagtgcaattggtttgcagc

SEQ ID NO: 247625 - DNA, 40 bp, Artificial Sequence
  Description of Artificial Sequence: Synthetic oligonucleotide
tttctgaatgactcgttttagtgcaattggtttgcagctg

SEQ ID NO: 247626 - DNA, 39 bp, Artificial Sequence
  Description of Artificial Sequence: Synthetic oligonucleotide
ttctgaatgactcgttttagtgcaattggtttgcagctg

SEQ ID NO: 247627 - DNA, 38 bp, Artificial Sequence
  Description of Artificial Sequence: Synthetic oligonucleotide
tctgaatgactcgttttagtgcaattggtttgcagctg

SEQ ID NO: 247628 - DNA, 37 bp, Artificial Sequence
  Description of Artificial Sequence: Synthetic oligonucleotide
ctgaatgactcgttttagtgcaattggtttgcagctg

SEQ ID NO: 247629 - DNA, 38 bp, Artificial Sequence
  Description of Artificial Sequence: Synthetic oligonucleotide
tgaatgactcgttttagtgcaattggtttgcagctgtg

SEQ ID NO: 247630 - DNA, 37 bp, Artificial Sequence
  Description of Artificial Sequence: Synthetic oligonucleotide
gaatgactcgttttagtgcaattggtttgcagctgtg

SEQ ID NO: 247631 - DNA, 37 bp, Artificial Sequence
  Description of Artificial Sequence: Synthetic oligonucleotide
aatgactcgttttagtgcaattggtttgcagctgtgg

SEQ ID NO: 247632 - DNA, 36 bp, Artificial Sequence
  Description of Artificial Sequence: Synthetic oligonucleotide
atgactcgttttagtgcaattggtttgcagctgtgg

SEQ ID NO: 247633 - DNA, 35 bp, Artificial Sequence
  Description of Artificial Sequence: Synthetic oligonucleotide
tgactcgttttagtgcaattggtttgcagctgtgg

SEQ ID NO: 247634 - DNA, 34 bp, Artificial Sequence
  Description of Artificial Sequence: Synthetic oligonucleotide
gactcgttttagtgcaattggtttgcagctgtgg

SEQ ID NO: 247635 - DNA, 35 bp, Artificial Sequence
  Description of Artificial Sequence: Synthetic oligonucleotide
actcgttttagtgcaattggtttgcagctgtggtg

SEQ ID NO: 247636 - DNA, 34 bp, Artificial Sequence
  Description of Artificial Sequence: Synthetic oligonucleotide
ctcgttttagtgcaattggtttgcagctgtggtg

SEQ ID NO: 247637 - DNA, 34 bp, Artificial Sequence
  Description of Artificial Sequence: Synthetic oligonucleotide
tcgttttagtgcaattggtttgcagctgtggtgc

SEQ ID NO: 247638 - DNA, 33 bp, Artificial Sequence
  Description of Artificial Sequence: Synthetic oligonucleotide
cgttttagtgcaattggtttgcagctgtggtgc

SEQ ID NO: 247639 - DNA, 35 bp, Artificial Sequence
  Description of Artificial Sequence: Synthetic oligonucleotide
gttttagtgcaattggtttgcagctgtggtgcatg

SEQ ID NO: 247640 - DNA, 36 bp, Artificial Sequence
  Description of Artificial Sequence: Synthetic oligonucleotide
ttttagtgcaattggtttgcagctgtggtgcatgac

SEQ ID NO: 247641 - DNA, 35 bp, Artificial Sequence
  Description of Artificial Sequence: Synthetic oligonucleotide
tttagtgcaattggtttgcagctgtggtgcatgac

SEQ ID NO: 247642 - DNA, 34 bp, Artificial Sequence
  Description of Artificial Sequence: Synthetic oligonucleotide
ttagtgcaattggtttgcagctgtggtgcatgac

SEQ ID NO: 247643 - DNA, 33 bp, Artificial Sequence
  Description of Artificial Sequence: Synthetic oligonucleotide
tagtgcaattggtttgcagctgtggtgcatgac

SEQ ID NO: 247644 - DNA, 32 bp, Artificial Sequence
  Description of Artificial Sequence: Synthetic oligonucleotide
agtgcaattggtttgcagctgtggtgcatgac

SEQ ID NO: 247645 - DNA, 31 bp, Artificial Sequence
  Description of Artificial Sequence: Synthetic oligonucleotide
gtgcaattggtttgcagctgtggtgcatgac

SEQ ID NO: 247646 - DNA, 31 bp, Artificial Sequence
  Description of Artificial Sequence: Synthetic oligonucleotide
tgcaattggtttgcagctgtggtgcatgacc

SEQ ID NO: 247647 - DNA, 30 bp, Artificial Sequence
  Description of Artificial Sequence: Synthetic oligonucleotide
gcaattggtttgcagctgtggtgcatgacc

SEQ ID NO: 247648 - DNA, 31 bp, Artificial Sequence
  Description of Artificial Sequence: Synthetic oligonucleotide
caattggtttgcagctgtggtgcatgacctc

SEQ ID NO: 247649 - DNA, 32 bp, Artificial Sequence
  Description of Artificial Sequence: Synthetic oligonucleotide
aattggtttgcagctgtggtgcatgacctcag

SEQ ID NO: 247650 - DNA, 31 bp, Artificial Sequence
  Description of Artificial Sequence: Synthetic oligonucleotide
attggtttgcagctgtggtgcatgacctcag

SEQ ID NO: 247651 - DNA, 30 bp, Artificial Sequence
  Description of Artificial Sequence: Synthetic oligonucleotide
ttggtttgcagctgtggtgcatgacctcag

SEQ ID NO: 247652 - DNA, 29 bp, Artificial Sequence
  Description of Artificial Sequence: Synthetic oligonucleotide
tggtttgcagctgtggtgcatgacctcag

SEQ ID NO: 247653 - DNA, 28 bp, Artificial Sequence
  Description of Artificial Sequence: Synthetic oligonucleotide
ggtttgcagctgtggtgcatgacctcag

SEQ ID NO: 247654 - DNA, 29 bp, Artificial Sequence
  Description of Artificial Sequence: Synthetic oligonucleotide
gtttgcagctgtggtgcatgacctcagac

SEQ ID NO: 247655 - DNA, 38 bp, Artificial Sequence
  Description of Artificial Sequence: Synthetic oligonucleotide
tttgcagctgtggtgcatgacctcagacatttttattg

SEQ ID NO: 247656 - DNA, 37 bp, Artificial Sequence
  Description of Artificial Sequence: Synthetic oligonucleotide
ttgcagctgtggtgcatgacctcagacatttttattg

SEQ ID NO: 247657 - DNA, 36 bp, Artificial Sequence
  Description of Artificial Sequence: Synthetic oligonucleotide
tgcagctgtggtgcatgacctcagacatttttattg

SEQ ID NO: 247658 - DNA, 35 bp, Artificial Sequence
  Description of Artificial Sequence: Synthetic oligonucleotide
gcagctgtggtgcatgacctcagacatttttattg

SEQ ID NO: 247659 - DNA, 36 bp, Artificial Sequence
  Description of Artificial Sequence: Synthetic oligonucleotide
cagctgtggtgcatgacctcagacatttttattgac

SEQ ID NO: 247660 - DNA, 38 bp, Artificial Sequence
  Description of Artificial Sequence: Synthetic oligonucleotide
agctgtggtgcatgacctcagacatttttattgacaac

SEQ ID NO: 247661 - DNA, 37 bp, Artificial Sequence
  Description of Artificial Sequence: Synthetic oligonucleotide
gctgtggtgcatgacctcagacatttttattgacaac

SEQ ID NO: 247662 - DNA, 42 bp, Artificial Sequence
  Description of Artificial Sequence: Synthetic oligonucleotide
ctgtggtgcatgacctcagacatttttattgacaactatatc

SEQ ID NO: 247663 - DNA, 46 bp, Artificial Sequence
  Description of Artificial Sequence: Synthetic oligonucleotide
tgtggtgcatgacctcagacatttttattgacaactatatcatttg

SEQ ID NO: 247664 - DNA, 45 bp, Artificial Sequence
  Description of Artificial Sequence: Synthetic oligonucleotide
gtggtgcatgacctcagacatttttattgacaactatatcatttg

SEQ ID NO: 247665 - DNA, 46 bp, Artificial Sequence
  Description of Artificial Sequence: Synthetic oligonucleotide
tggtgcatgacctcagacatttttattgacaactatatcatttgag

SEQ ID NO: 247666 - DNA, 45 bp, Artificial Sequence
  Description of Artificial Sequence: Synthetic oligonucleotide
ggtgcatgacctcagacatttttattgacaactatatcatttgag

SEQ ID NO: 247667 - DNA, 45 bp, Artificial Sequence
  Description of Artificial Sequence: Synthetic oligonucleotide
gtgcatgacctcagacatttttattgacaactatatcatttgagc

SEQ ID NO: 247668 - DNA, 46 bp, Artificial Sequence
  Description of Artificial Sequence: Synthetic oligonucleotide
tgcatgacctcagacatttttattgacaactatatcatttgagctg

SEQ ID NO: 247669 - DNA, 45 bp, Artificial Sequence
  Description of Artificial Sequence: Synthetic oligonucleotide
gcatgacctcagacatttttattgacaactatatcatttgagctg

SEQ ID NO: 247670 - DNA, 47 bp, Artificial Sequence
  Description of Artificial Sequence: Synthetic oligonucleotide
catgacctcagacatttttattgacaactatatcatttgagctgatc

SEQ ID NO: 247671 - DNA, 47 bp, Artificial Sequence
  Description of Artificial Sequence: Synthetic oligonucleotide
atgacctcagacatttttattgacaactatatcatttgagctgatcg

SEQ ID NO: 247672 - DNA, 46 bp, Artificial Sequence
  Description of Artificial Sequence: Synthetic oligonucleotide
tgacctcagacatttttattgacaactatatcatttgagctgatcg

SEQ ID NO: 247673 - DNA, 45 bp, Artificial Sequence
  Description of Artificial Sequence: Synthetic oligonucleotide
gacctcagacatttttattgacaactatatcatttgagctgatcg

SEQ ID NO: 247674 - DNA, 47 bp, Artificial Sequence
  Description of Artificial Sequence: Synthetic oligonucleotide
acctcagacatttttattgacaactatatcatttgagctgatcgatg

SEQ ID NO: 247675 - DNA, 46 bp, Artificial Sequence
  Description of Artificial Sequence: Synthetic oligonucleotide
cctcagacatttttattgacaactatatcatttgagctgatcgatg

SEQ ID NO: 247676 - DNA, 50 bp, Artificial Sequence
  Description of Artificial Sequence: Synthetic oligonucleotide
ctcagacatttttattgacaactatatcatttgagctgatcgatgaatag

SEQ ID NO: 247677 - DNA, 52 bp, Artificial Sequence
  Description of Artificial Sequence: Synthetic oligonucleotide
tcagacatttttattgacaactatatcatttgagctgatcgatgaatagttg

SEQ ID NO: 247678 - DNA, 51 bp, Artificial Sequence
  Description of Artificial Sequence: Synthetic oligonucleotide
cagacatttttattgacaactatatcatttgagctgatcgatgaatagttg

SEQ ID NO: 247679 - DNA, 53 bp, Artificial Sequence
  Description of Artificial Sequence: Synthetic oligonucleotide
agacatttttattgacaactatatcatttgagctgatcgatgaatagttgttg

SEQ ID NO: 247680 - DNA, 52 bp, Artificial Sequence
  Description of Artificial Sequence: Synthetic oligonucleotide
gacatttttattgacaactatatcatttgagctgatcgatgaatagttgttg

SEQ ID NO: 247681 - DNA, 55 bp, Artificial Sequence
  Description of Artificial Sequence: Synthetic oligonucleotide
acatttttattgacaactatatcatttgagctgatcgatgaatagttgttgattg

SEQ ID NO: 247682 - DNA, 54 bp, Artificial Sequence
  Description of Artificial Sequence: Synthetic oligonucleotide
catttttattgacaactatatcatttgagctgatcgatgaatagttgttgattg

SEQ ID NO: 247683 - DNA, 54 bp, Artificial Sequence
  Description of Artificial Sequence: Synthetic oligonucleotide
atttttattgacaactatatcatttgagctgatcgatgaatagttgttgattgg

SEQ ID NO: 247684 - DNA, 53 bp, Artificial Sequence
  Description of Artificial Sequence: Synthetic oligonucleotide
tttttattgacaactatatcatttgagctgatcgatgaatagttgttgattgg

SEQ ID NO: 247685 - DNA, 52 bp, Artificial Sequence
  Description of Artificial Sequence: Synthetic oligonucleotide
ttttattgacaactatatcatttgagctgatcgatgaatagttgttgattgg

SEQ ID NO: 247686 - DNA, 51 bp, Artificial Sequence
  Description of Artificial Sequence: Synthetic oligonucleotide
tttattgacaactatatcatttgagctgatcgatgaatagttgttgattgg

SEQ ID NO: 247687 - DNA, 50 bp, Artificial Sequence
  Description of Artificial Sequence: Synthetic oligonucleotide
ttattgacaactatatcatttgagctgatcgatgaatagttgttgattgg

SEQ ID NO: 247688 - DNA, 49 bp, Artificial Sequence
  Description of Artificial Sequence: Synthetic oligonucleotide
tattgacaactatatcatttgagctgatcgatgaatagttgttgattgg

SEQ ID NO: 247689 - DNA, 48 bp, Artificial Sequence
  Description of Artificial Sequence: Synthetic oligonucleotide
attgacaactatatcatttgagctgatcgatgaatagttgttgattgg

SEQ ID NO: 247690 - DNA, 47 bp, Artificial Sequence
  Description of Artificial Sequence: Synthetic oligonucleotide
ttgacaactatatcatttgagctgatcgatgaatagttgttgattgg

SEQ ID NO: 247691 - DNA, 46 bp, Artificial Sequence
  Description of Artificial Sequence: Synthetic oligonucleotide
tgacaactatatcatttgagctgatcgatgaatagttgttgattgg

SEQ ID NO: 247692 - DNA, 45 bp, Artificial Sequence
  Description of Artificial Sequence: Synthetic oligonucleotide
gacaactatatcatttgagctgatcgatgaatagttgttgattgg

SEQ ID NO: 247693 - DNA, 45 bp, Artificial Sequence
  Description of Artificial Sequence: Synthetic oligonucleotide
acaactatatcatttgagctgatcgatgaatagttgttgattggg

SEQ ID NO: 247694 - DNA, 44 bp, Artificial Sequence
  Description of Artificial Sequence: Synthetic oligonucleotide
caactatatcatttgagctgatcgatgaatagttgttgattggg

SEQ ID NO: 247695 - DNA, 44 bp, Artificial Sequence
  Description of Artificial Sequence: Synthetic oligonucleotide
aactatatcatttgagctgatcgatgaatagttgttgattgggc

SEQ ID NO: 247696 - DNA, 43 bp, Artificial Sequence
  Description of Artificial Sequence: Synthetic oligonucleotide
actatatcatttgagctgatcgatgaatagttgttgattgggc

SEQ ID NO: 247697 - DNA, 42 bp, Artificial Sequence
  Description of Artificial Sequence: Synthetic oligonucleotide
ctatatcatttgagctgatcgatgaatagttgttgattgggc

SEQ ID NO: 247698 - DNA, 42 bp, Artificial Sequence
  Description of Artificial Sequence: Synthetic oligonucleotide
tatatcatttgagctgatcgatgaatagttgttgattgggcg

SEQ ID NO: 247699 - DNA, 41 bp, Artificial Sequence
  Description of Artificial Sequence: Synthetic oligonucleotide
atatcatttgagctgatcgatgaatagttgttgattgggcg

SEQ ID NO: 247700 - DNA, 40 bp, Artificial Sequence
  Description of Artificial Sequence: Synthetic oligonucleotide
tatcatttgagctgatcgatgaatagttgttgattgggcg

SEQ ID NO: 247701 - DNA, 39 bp, Artificial Sequence
  Description of Artificial Sequence: Synthetic oligonucleotide
atcatttgagctgatcgatgaatagttgttgattgggcg

SEQ ID NO: 247702 - DNA, 38 bp, Artificial Sequence
  Description of Artificial Sequence: Synthetic oligonucleotide
tcatttgagctgatcgatgaatagttgttgattgggcg

SEQ ID NO: 247703 - DNA, 37 bp, Artificial Sequence
  Description of Artificial Sequence: Synthetic oligonucleotide
catttgagctgatcgatgaatagttgttgattgggcg

SEQ ID NO: 247704 - DNA, 40 bp, Artificial Sequence
  Description of Artificial Sequence: Synthetic oligonucleotide
atttgagctgatcgatgaatagttgttgattgggcgaatg

SEQ ID NO: 247705 - DNA, 39 bp, Artificial Sequence
  Description of Artificial Sequence: Synthetic oligonucleotide
tttgagctgatcgatgaatagttgttgattgggcgaatg

SEQ ID NO: 247706 - DNA, 38 bp, Artificial Sequence
  Description of Artificial Sequence: Synthetic oligonucleotide
ttgagctgatcgatgaatagttgttgattgggcgaatg

SEQ ID NO: 247707 - DNA, 37 bp, Artificial Sequence
  Description of Artificial Sequence: Synthetic oligonucleotide
tgagctgatcgatgaatagttgttgattgggcgaatg

SEQ ID NO: 247708 - DNA, 36 bp, Artificial Sequence
  Description of Artificial Sequence: Synthetic oligonucleotide
gagctgatcgatgaatagttgttgattgggcgaatg

SEQ ID NO: 247709 - DNA, 38 bp, Artificial Sequence
  Description of Artificial Sequence: Synthetic oligonucleotide
agctgatcgatgaatagttgttgattgggcgaatgatg

SEQ ID NO: 247710 - DNA, 37 bp, Artificial Sequence
  Description of Artificial Sequence: Synthetic oligonucleotide
gctgatcgatgaatagttgttgattgggcgaatgatg

SEQ ID NO: 247711 - DNA, 37 bp, Artificial Sequence
  Description of Artificial Sequence: Synthetic oligonucleotide
ctgatcgatgaatagttgttgattgggcgaatgatgg

SEQ ID NO: 247712 - DNA, 39 bp, Artificial Sequence
  Description of Artificial Sequence: Synthetic oligonucleotide
tgatcgatgaatagttgttgattgggcgaatgatggaag

SEQ ID NO: 247713 - DNA, 38 bp, Artificial Sequence
  Description of Artificial Sequence: Synthetic oligonucleotide
gatcgatgaatagttgttgattgggcgaatgatggaag

SEQ ID NO: 247714 - DNA, 38 bp, Artificial Sequence
  Description of Artificial Sequence: Synthetic oligonucleotide
atcgatgaatagttgttgattgggcgaatgatggaagg

SEQ ID NO: 247715 - DNA, 37 bp, Artificial Sequence
  Description of Artificial Sequence: Synthetic oligonucleotide
tcgatgaatagttgttgattgggcgaatgatggaagg

SEQ ID NO: 247716 - DNA, 36 bp, Artificial Sequence
  Description of Artificial Sequence: Synthetic oligonucleotide
cgatgaatagttgttgattgggcgaatgatggaagg

SEQ ID NO: 247717 - DNA, 36 bp, Artificial Sequence
  Description of Artificial Sequence: Synthetic oligonucleotide
gatgaatagttgttgattgggcgaatgatggaaggg

SEQ ID NO: 247718 - DNA, 36 bp, Artificial Sequence
  Description of Artificial Sequence: Synthetic oligonucleotide
atgaatagttgttgattgggcgaatgatggaagggg

SEQ ID NO: 247719 - DNA, 35 bp, Artificial Sequence
  Description of Artificial Sequence: Synthetic oligonucleotide
tgaatagttgttgattgggcgaatgatggaagggg

SEQ ID NO: 247720 - DNA, 34 bp, Artificial Sequence
  Description of Artificial Sequence: Synthetic oligonucleotide
gaatagttgttgattgggcgaatgatggaagggg

SEQ ID NO: 247721 - DNA, 34 bp, Artificial Sequence
  Description of Artificial Sequence: Synthetic oligonucleotide
aatagttgttgattgggcgaatgatggaaggggc

SEQ ID NO: 247722 - DNA, 33 bp, Artificial Sequence
  Description of Artificial Sequence: Synthetic oligonucleotide
atagttgttgattgggcgaatgatggaaggggc

SEQ ID NO: 247723 - DNA, 32 bp, Artificial Sequence
  Description of Artificial Sequence: Synthetic oligonucleotide
tagttgttgattgggcgaatgatggaaggggc

SEQ ID NO: 247724 - DNA, 31 bp, Artificial Sequence
  Description of Artificial Sequence: Synthetic oligonucleotide
agttgttgattgggcgaatgatggaaggggc

SEQ ID NO: 247725 - DNA, 30 bp, Artificial Sequence
  Description of Artificial Sequence: Synthetic oligonucleotide
gttgttgattgggcgaatgatggaaggggc

SEQ ID NO: 247726 - DNA, 30 bp, Artificial Sequence
  Description of Artificial Sequence: Synthetic oligonucleotide
ttgttgattgggcgaatgatggaaggggcc

SEQ ID NO: 247727 - DNA, 29 bp, Artificial Sequence
  Description of Artificial Sequence: Synthetic oligonucleotide
tgttgattgggcgaatgatggaaggggcc

SEQ ID NO: 247728 - DNA, 28 bp, Artificial Sequence
  Description of Artificial Sequence: Synthetic oligonucleotide
gttgattgggcgaatgatggaaggggcc

SEQ ID NO: 247729 - DNA, 29 bp, Artificial Sequence
  Description of Artificial Sequence: Synthetic oligonucleotide
ttgattgggcgaatgatggaaggggcctg

SEQ ID NO: 247730 - DNA, 28 bp, Artificial Sequence
  Description of Artificial Sequence: Synthetic oligonucleotide
tgattgggcgaatgatggaaggggcctg

SEQ ID NO: 247731 - DNA, 27 bp, Artificial Sequence
  Description of Artificial Sequence: Synthetic oligonucleotide
gattgggcgaatgatggaaggggcctg

SEQ ID NO: 247732 - DNA, 29 bp, Artificial Sequence
  Description of Artificial Sequence: Synthetic oligonucleotide
attgggcgaatgatggaaggggcctgatg

SEQ ID NO: 247733 - DNA, 28 bp, Artificial Sequence
  Description of Artificial Sequence: Synthetic oligonucleotide
ttgggcgaatgatggaaggggcctgatg

SEQ ID NO: 247734 - DNA, 27 bp, Artificial Sequence
  Description of Artificial Sequence: Synthetic oligonucleotide
tgggcgaatgatggaaggggcctgatg

SEQ ID NO: 247735 - DNA, 27 bp, Artificial Sequence
  Description of Artificial Sequence: Synthetic oligonucleotide
gggcgaatgatggaaggggcctgatga

SEQ ID NO: 247736 - DNA, 29 bp, Artificial Sequence
  Description of Artificial Sequence: Synthetic oligonucleotide
ggcgaatgatggaaggggcctgatgaaag

SEQ ID NO: 247737 - DNA, 29 bp, Artificial Sequence
  Description of Artificial Sequence: Synthetic oligonucleotide
gcgaatgatggaaggggcctgatgaaagc

SEQ ID NO: 247738 - DNA, 30 bp, Artificial Sequence
  Description of Artificial Sequence: Synthetic oligonucleotide
cgaatgatggaaggggcctgatgaaagctg

SEQ ID NO: 247739 - DNA, 30 bp, Artificial Sequence
  Description of Artificial Sequence: Synthetic oligonucleotide
gaatgatggaaggggcctgatgaaagctgc

SEQ ID NO: 247740 - DNA, 31 bp, Artificial Sequence
  Description of Artificial Sequence: Synthetic oligonucleotide
aatgatggaaggggcctgatgaaagctgcag

SEQ ID NO: 247741 - DNA, 30 bp, Artificial Sequence
  Description of Artificial Sequence: Synthetic oligonucleotide
atgatggaaggggcctgatgaaagctgcag

SEQ ID NO: 247742 - DNA, 29 bp, Artificial Sequence
  Description of Artificial Sequence: Synthetic oligonucleotide
tgatggaaggggcctgatgaaagctgcag

SEQ ID NO: 247743 - DNA, 28 bp, Artificial Sequence
  Description of Artificial Sequence: Synthetic oligonucleotide
gatggaaggggcctgatgaaagctgcag

SEQ ID NO: 247744 - DNA, 30 bp, Artificial Sequence
  Description of Artificial Sequence: Synthetic oligonucleotide
atggaaggggcctgatgaaagctgcagatg

SEQ ID NO: 247745 - DNA, 29 bp, Artificial Sequence
  Description of Artificial Sequence: Synthetic oligonucleotide
tggaaggggcctgatgaaagctgcagatg

SEQ ID NO: 247746 - DNA, 28 bp, Artificial Sequence
  Description of Artificial Sequence: Synthetic oligonucleotide
ggaaggggcctgatgaaagctgcagatg

SEQ ID NO: 247747 - DNA, 28 bp, Artificial Sequence
  Description of Artificial Sequence: Synthetic oligonucleotide
gaaggggcctgatgaaagctgcagatgg

SEQ ID NO: 247748 - DNA, 28 bp, Artificial Sequence
  Description of Artificial Sequence: Synthetic oligonucleotide
aaggggcctgatgaaagctgcagatggg

SEQ ID NO: 247749 - DNA, 27 bp, Artificial Sequence
  Description of Artificial Sequence: Synthetic oligonucleotide
aggggcctgatgaaagctgcagatggg

SEQ ID NO: 247750 - DNA, 26 bp, Artificial Sequence
  Description of Artificial Sequence: Synthetic oligonucleotide
ggggcctgatgaaagctgcagatggg

SEQ ID NO: 247751 - DNA, 26 bp, Artificial Sequence
  Description of Artificial Sequence: Synthetic oligonucleotide
gggcctgatgaaagctgcagatgggg

SEQ ID NO: 247752 - DNA, 27 bp, Artificial Sequence
  Description of Artificial Sequence: Synthetic oligonucleotide
ggcctgatgaaagctgcagatggggct

SEQ ID NO: 247753 - DNA, 27 bp, Artificial Sequence
  Description of Artificial Sequence: Synthetic oligonucleotide
gcctgatgaaagctgcagatggggctc

SEQ ID NO: 247754 - DNA, 27 bp, Artificial Sequence
  Description of Artificial Sequence: Synthetic oligonucleotide
cctgatgaaagctgcagatggggctcc

SEQ ID NO: 247755 - DNA, 28 bp, Artificial Sequence
  Description of Artificial Sequence: Synthetic oligonucleotide
ctgatgaaagctgcagatggggctcctg

SEQ ID NO: 247756 - DNA, 29 bp, Artificial Sequence
  Description of Artificial Sequence: Synthetic oligonucleotide
tgatgaaagctgcagatggggctcctgag

SEQ ID NO: 247757 - DNA, 28 bp, Artificial Sequence
  Description of Artificial Sequence: Synthetic oligonucleotide
gatgaaagctgcagatggggctcctgag

SEQ ID NO: 247758 - DNA, 28 bp, Artificial Sequence
  Description of Artificial Sequence: Synthetic oligonucleotide
atgaaagctgcagatggggctcctgagc

SEQ ID NO: 247759 - DNA, 27 bp, Artificial Sequence
  Description of Artificial Sequence: Synthetic oligonucleotide
tgaaagctgcagatggggctcctgagc

SEQ ID NO: 247760 - DNA, 26 bp, Artificial Sequence
  Description of Artificial Sequence: Synthetic oligonucleotide
gaaagctgcagatggggctcctgagc

SEQ ID NO: 247761 - DNA, 27 bp, Artificial Sequence
  Description of Artificial Sequence: Synthetic oligonucleotide
aaagctgcagatggggctcctgagcca

SEQ ID NO: 247762 - DNA, 26 bp, Artificial Sequence
  Description of Artificial Sequence: Synthetic oligonucleotide
aagctgcagatggggctcctgagcca

SEQ ID NO: 247763 - DNA, 25 bp, Artificial Sequence
  Description of Artificial Sequence: Synthetic oligonucleotide
agctgcagatggggctcctgagcca

SEQ ID NO: 247764 - DNA, 24 bp, Artificial Sequence
  Description of Artificial Sequence: Synthetic oligonucleotide
gctgcagatggggctcctgagcca

SEQ ID NO: 247765 - DNA, 24 bp, Artificial Sequence
  Description of Artificial Sequence: Synthetic oligonucleotide
ctgcagatggggctcctgagccag

SEQ ID NO: 247766 - DNA, 24 bp, Artificial Sequence
  Description of Artificial Sequence: Synthetic oligonucleotide
tgcagatggggctcctgagccagc

SEQ ID NO: 247767 - DNA, 23 bp, Artificial Sequence
  Description of Artificial Sequence: Synthetic oligonucleotide
gcagatggggctcctgagccagc

SEQ ID NO: 247768 - DNA, 23 bp, Artificial Sequence
  Description of Artificial Sequence: Synthetic oligonucleotide
cagatggggctcctgagccagcc

SEQ ID NO: 247769 - DNA, 25 bp, Artificial Sequence
  Description of Artificial Sequence: Synthetic oligonucleotide
agatggggctcctgagccagccgtt

SEQ ID NO: 247770 - DNA, 24 bp, Artificial Sequence
  Description of Artificial Sequence: Synthetic oligonucleotide
gatggggctcctgagccagccgtt

SEQ ID NO: 247771 - DNA, 25 bp, Artificial Sequence
  Description of Artificial Sequence: Synthetic oligonucleotide
atggggctcctgagccagccgttgt

SEQ ID NO: 247772 - DNA, 24 bp, Artificial Sequence
  Description of Artificial Sequence: Synthetic oligonucleotide
tggggctcctgagccagccgttgt

SEQ ID NO: 247773 - DNA, 23 bp, Artificial Sequence
  Description of Artificial Sequence: Synthetic oligonucleotide
ggggctcctgagccagccgttgt

SEQ ID NO: 247774 - DNA, 23 bp, Artificial Sequence
  Description of Artificial Sequence: Synthetic oligonucleotide
gggctcctgagccagccgttgtg

SEQ ID NO: 247775 - DNA, 23 bp, Artificial Sequence
  Description of Artificial Sequence: Synthetic oligonucleotide
ggctcctgagccagccgttgtgg

SEQ ID NO: 247776 - DNA, 23 bp, Artificial Sequence
  Description of Artificial Sequence: Synthetic oligonucleotide
gctcctgagccagccgttgtggg

SEQ ID NO: 247777 - DNA, 23 bp, Artificial Sequence
  Description of Artificial Sequence: Synthetic oligonucleotide
ctcctgagccagccgttgtgggc

SEQ ID NO: 247778 - DNA, 24 bp, Artificial Sequence
  Description of Artificial Sequence: Synthetic oligonucleotide
tcctgagccagccgttgtgggcca

SEQ ID NO: 247779 - DNA, 23 bp, Artificial Sequence
  Description of Artificial Sequence: Synthetic oligonucleotide
cctgagccagccgttgtgggcca

SEQ ID NO: 247780 - DNA, 25 bp, Artificial Sequence
  Description of Artificial Sequence: Synthetic oligonucleotide
ctgagccagccgttgtgggccagat

SEQ ID NO: 247781 - DNA, 27 bp, Artificial Sequence
  Description of Artificial Sequence: Synthetic oligonucleotide
tgagccagccgttgtgggccagatgat

SEQ ID NO: 247782 - DNA, 26 bp, Artificial Sequence
  Description of Artificial Sequence: Synthetic oligonucleotide
gagccagccgttgtgggccagatgat

SEQ ID NO: 247783 - DNA, 26 bp, Artificial Sequence
  Description of Artificial Sequence: Synthetic oligonucleotide
agccagccgttgtgggccagatgatc

SEQ ID NO: 247784 - DNA, 25 bp, Artificial Sequence
  Description of Artificial Sequence: Synthetic oligonucleotide
gccagccgttgtgggccagatgatc

SEQ ID NO: 247785 - DNA, 26 bp, Artificial Sequence
  Description of Artificial Sequence: Synthetic oligonucleotide
ccagccgttgtgggccagatgatcca

SEQ ID NO: 247786 - DNA, 26 bp, Artificial Sequence
  Description of Artificial Sequence: Synthetic oligonucleotide
cagccgttgtgggccagatgatccag

SEQ ID NO: 247787 - DNA, 26 bp, Artificial Sequence
  Description of Artificial Sequence: Synthetic oligonucleotide
agccgttgtgggccagatgatccagg

SEQ ID NO: 247788 - DNA, 25 bp, Artificial Sequence
  Description of Artificial Sequence: Synthetic oligonucleotide
gccgttgtgggccagatgatccagg

SEQ ID NO: 247789 - DNA, 26 bp, Artificial Sequence
  Description of Artificial Sequence: Synthetic oligonucleotide
ccgttgtgggccagatgatccaggca

SEQ ID NO: 247790 - DNA, 26 bp, Artificial Sequence
  Description of Artificial Sequence: Synthetic oligonucleotide
cgttgtgggccagatgatccaggcag

SEQ ID NO: 247791 - DNA, 27 bp, Artificial Sequence
  Description of Artificial Sequence: Synthetic oligonucleotide
gttgtgggccagatgatccaggcagct

SEQ ID NO: 247792 - DNA, 27 bp, Artificial Sequence
  Description of Artificial Sequence: Synthetic oligonucleotide
ttgtgggccagatgatccaggcagctg

SEQ ID NO: 247793 - DNA, 27 bp, Artificial Sequence
  Description of Artificial Sequence: Synthetic oligonucleotide
tgtgggccagatgatccaggcagctgt

SEQ ID NO: 247794 - DNA, 27 bp, Artificial Sequence
  Description of Artificial Sequence: Synthetic oligonucleotide
gtgggccagatgatccaggcagctgta

SEQ ID NO: 247795 - DNA, 27 bp, Artificial Sequence
  Description of Artificial Sequence: Synthetic oligonucleotide
tgggccagatgatccaggcagctgtag

SEQ ID NO: 247796 - DNA, 27 bp, Artificial Sequence
  Description of Artificial Sequence: Synthetic oligonucleotide
gggccagatgatccaggcagctgtaga

SEQ ID NO: 247797 - DNA, 27 bp, Artificial Sequence
  Description of Artificial Sequence: Synthetic oligonucleotide
ggccagatgatccaggcagctgtagag

SEQ ID NO: 247798 - DNA, 27 bp, Artificial Sequence
  Description of Artificial Sequence: Synthetic oligonucleotide
gccagatgatccaggcagctgtagagc

SEQ ID NO: 247799 - DNA, 27 bp, Artificial Sequence
  Description of Artificial Sequence: Synthetic oligonucleotide
ccagatgatccaggcagctgtagagcg

SEQ ID NO: 247800 - DNA, 27 bp, Artificial Sequence
  Description of Artificial Sequence: Synthetic oligonucleotide
cagatgatccaggcagctgtagagcgc

SEQ ID NO: 247801 - DNA, 27 bp, Artificial Sequence
  Description of Artificial Sequence: Synthetic oligonucleotide
agatgatccaggcagctgtagagcgcc

SEQ ID NO: 247802 - DNA, 26 bp, Artificial Sequence
  Description of Artificial Sequence: Synthetic oligonucleotide
gatgatccaggcagctgtagagcgcc

SEQ ID NO: 247803 - DNA, 26 bp, Artificial Sequence
  Description of Artificial Sequence: Synthetic oligonucleotide
atgatccaggcagctgtagagcgccc

SEQ ID NO: 247804 - DNA, 25 bp, Artificial Sequence
  Description of Artificial Sequence: Synthetic oligonucleotide
tgatccaggcagctgtagagcgccc

SEQ ID NO: 247805 - DNA, 24 bp, Artificial Sequence
  Description of Artificial Sequence: Synthetic oligonucleotide
gatccaggcagctgtagagcgccc

SEQ ID NO: 247806 - DNA, 25 bp, Artificial Sequence
  Description of Artificial Sequence: Synthetic oligonucleotide
atccaggcagctgtagagcgcccct

SEQ ID NO: 247807 - DNA, 24 bp, Artificial Sequence
  Description of Artificial Sequence: Synthetic oligonucleotide
tccaggcagctgtagagcgcccct

SEQ ID NO: 247808 - DNA, 23 bp, Artificial Sequence
  Description of Artificial Sequence: Synthetic oligonucleotide
ccaggcagctgtagagcgcccct

SEQ ID NO: 247809 - DNA, 23 bp, Artificial Sequence
  Description of Artificial Sequence: Synthetic oligonucleotide
caggcagctgtagagcgcccctg

SEQ ID NO: 247810 - DNA, 23 bp, Artificial Sequence
  Description of Artificial Sequence: Synthetic oligonucleotide
aggcagctgtagagcgcccctgg

SEQ ID NO: 247811 - DNA, 22 bp, Artificial Sequence
  Description of Artificial Sequence: Synthetic oligonucleotide
ggcagctgtagagcgcccctgg

SEQ ID NO: 247812 - DNA, 23 bp, Artificial Sequence
  Description of Artificial Sequence: Synthetic oligonucleotide
gcagctgtagagcgcccctggct

SEQ ID NO: 247813 - DNA, 24 bp, Artificial Sequence
  Description of Artificial Sequence: Synthetic oligonucleotide
cagctgtagagcgcccctggctgt

SEQ ID NO: 247814 - DNA, 24 bp, Artificial Sequence
  Description of Artificial Sequence: Synthetic oligonucleotide
agctgtagagcgcccctggctgtg

SEQ ID NO: 247815 - DNA, 23 bp, Artificial Sequence
  Description of Artificial Sequence: Synthetic oligonucleotide
gctgtagagcgcccctggctgtg

SEQ ID NO: 247816 - DNA, 23 bp, Artificial Sequence
  Description of Artificial Sequence: Synthetic oligonucleotide
ctgtagagcgcccctggctgtgg

SEQ ID NO: 247817 - DNA, 25 bp, Artificial Sequence
  Description of Artificial Sequence: Synthetic oligonucleotide
tgtagagcgcccctggctgtggcta

SEQ ID NO: 247818 - DNA, 24 bp, Artificial Sequence
  Description of Artificial Sequence: Synthetic oligonucleotide
gtagagcgcccctggctgtggcta

SEQ ID NO: 247819 - DNA, 25 bp, Artificial Sequence
  Description of Artificial Sequence: Synthetic oligonucleotide
tagagcgcccctggctgtggctagt

SEQ ID NO: 247820 - DNA, 24 bp, Artificial Sequence
  Description of Artificial Sequence: Synthetic oligonucleotide
agagcgcccctggctgtggctagt

SEQ ID NO: 247821 - DNA, 23 bp, Artificial Sequence
  Description of Artificial Sequence: Synthetic oligonucleotide
gagcgcccctggctgtggctagt

SEQ ID NO: 247822 - DNA, 27 bp, Artificial Sequence
  Description of Artificial Sequence: Synthetic oligonucleotide
agcgcccctggctgtggctagtctata

SEQ ID NO: 247823 - DNA, 27 bp, Artificial Sequence
  Description of Artificial Sequence: Synthetic oligonucleotide
gcgcccctggctgtggctagtctataa

SEQ ID NO: 247824 - DNA, 28 bp, Artificial Sequence
  Description of Artificial Sequence: Synthetic oligonucleotide
cgcccctggctgtggctagtctataatc

SEQ ID NO: 247825 - DNA, 31 bp, Artificial Sequence
  Description of Artificial Sequence: Synthetic oligonucleotide
gcccctggctgtggctagtctataatctaac

SEQ ID NO: 247826 - DNA, 32 bp, Artificial Sequence
  Description of Artificial Sequence: Synthetic oligonucleotide
cccctggctgtggctagtctataatctaactg

SEQ ID NO: 247827 - DNA, 34 bp, Artificial Sequence
  Description of Artificial Sequence: Synthetic oligonucleotide
ccctggctgtggctagtctataatctaactgttg

SEQ ID NO: 247828 - DNA, 34 bp, Artificial Sequence
  Description of Artificial Sequence: Synthetic oligonucleotide
cctggctgtggctagtctataatctaactgttgc

SEQ ID NO: 247829 - DNA, 34 bp, Artificial Sequence
  Description of Artificial Sequence: Synthetic oligonucleotide
ctggctgtggctagtctataatctaactgttgcc

SEQ ID NO: 247830 - DNA, 34 bp, Artificial Sequence
  Description of Artificial Sequence: Synthetic oligonucleotide
tggctgtggctagtctataatctaactgttgccc

SEQ ID NO: 247831 - DNA, 33 bp, Artificial Sequence
  Description of Artificial Sequence: Synthetic oligonucleotide
ggctgtggctagtctataatctaactgttgccc

SEQ ID NO: 247832 - DNA, 35 bp, Artificial Sequence
  Description of Artificial Sequence: Synthetic oligonucleotide
gctgtggctagtctataatctaactgttgcccttc

SEQ ID NO: 247833 - DNA, 35 bp, Artificial Sequence
  Description of Artificial Sequence: Synthetic oligonucleotide
ctgtggctagtctataatctaactgttgcccttcc

SEQ ID NO: 247834 - DNA, 36 bp, Artificial Sequence
  Description of Artificial Sequence: Synthetic oligonucleotide
tgtggctagtctataatctaactgttgcccttcctc

SEQ ID NO: 247835 - DNA, 35 bp, Artificial Sequence
  Description of Artificial Sequence: Synthetic oligonucleotide
gtggctagtctataatctaactgttgcccttcctc

SEQ ID NO: 247836 - DNA, 36 bp, Artificial Sequence
  Description of Artificial Sequence: Synthetic oligonucleotide
tggctagtctataatctaactgttgcccttcctctg

SEQ ID NO: 247837 - DNA, 35 bp, Artificial Sequence
  Description of Artificial Sequence: Synthetic oligonucleotide
ggctagtctataatctaactgttgcccttcctctg

SEQ ID NO: 247838 - DNA, 37 bp, Artificial Sequence
  Description of Artificial Sequence: Synthetic oligonucleotide
gctagtctataatctaactgttgcccttcctctgttc

SEQ ID NO: 247839 - DNA, 37 bp, Artificial Sequence
  Description of Artificial Sequence: Synthetic oligonucleotide
ctagtctataatctaactgttgcccttcctctgttcc

SEQ ID NO: 247840 - DNA, 38 bp, Artificial Sequence
  Description of Artificial Sequence: Synthetic oligonucleotide
tagtctataatctaactgttgcccttcctctgttcctg

SEQ ID NO: 247841 - DNA, 37 bp, Artificial Sequence
  Description of Artificial Sequence: Synthetic oligonucleotide
agtctataatctaactgttgcccttcctctgttcctg

SEQ ID NO: 247842 - DNA, 36 bp, Artificial Sequence
  Description of Artificial Sequence: Synthetic oligonucleotide
gtctataatctaactgttgcccttcctctgttcctg

SEQ ID NO: 247843 - DNA, 36 bp, Artificial Sequence
  Description of Artificial Sequence: Synthetic oligonucleotide
tctataatctaactgttgcccttcctctgttcctgg

SEQ ID NO: 247844 - DNA, 35 bp, Artificial Sequence
  Description of Artificial Sequence: Synthetic oligonucleotide
ctataatctaactgttgcccttcctctgttcctgg

SEQ ID NO: 247845 - DNA, 39 bp, Artificial Sequence
  Description of Artificial Sequence: Synthetic oligonucleotide
tataatctaactgttgcccttcctctgttcctggatatc

SEQ ID NO: 247846 - DNA, 38 bp, Artificial Sequence
  Description of Artificial Sequence: Synthetic oligonucleotide
ataatctaactgttgcccttcctctgttcctggatatc

SEQ ID NO: 247847 - DNA, 37 bp, Artificial Sequence
  Description of Artificial Sequence: Synthetic oligonucleotide
taatctaactgttgcccttcctctgttcctggatatc

SEQ ID NO: 247848 - DNA, 36 bp, Artificial Sequence
  Description of Artificial Sequence: Synthetic oligonucleotide
aatctaactgttgcccttcctctgttcctggatatc

SEQ ID NO: 247849 - DNA, 35 bp, Artificial Sequence
  Description of Artificial Sequence: Synthetic oligonucleotide
atctaactgttgcccttcctctgttcctggatatc

SEQ ID NO: 247850 - DNA, 34 bp, Artificial Sequence
  Description of Artificial Sequence: Synthetic oligonucleotide
tctaactgttgcccttcctctgttcctggatatc

SEQ ID NO: 247851 - DNA, 33 bp, Artificial Sequence
  Description of Artificial Sequence: Synthetic oligonucleotide
ctaactgttgcccttcctctgttcctggatatc

SEQ ID NO: 247852 - DNA, 33 bp, Artificial Sequence
  Description of Artificial Sequence: Synthetic oligonucleotide
taactgttgcccttcctctgttcctggatatcc

SEQ ID NO: 247853 - DNA, 32 bp, Artificial Sequence
  Description of Artificial Sequence: Synthetic oligonucleotide
aactgttgcccttcctctgttcctggatatcc

SEQ ID NO: 247854 - DNA, 31 bp, Artificial Sequence
  Description of Artificial Sequence: Synthetic oligonucleotide
actgttgcccttcctctgttcctggatatcc

SEQ ID NO: 247855 - DNA, 30 bp, Artificial Sequence
  Description of Artificial Sequence: Synthetic oligonucleotide
ctgttgcccttcctctgttcctggatatcc

SEQ ID NO: 247856 - DNA, 31 bp, Artificial Sequence
  Description of Artificial Sequence: Synthetic oligonucleotide
tgttgcccttcctctgttcctggatatcctc

SEQ ID NO: 247857 - DNA, 30 bp, Artificial Sequence
  Description of Artificial Sequence: Synthetic oligonucleotide
gttgcccttcctctgttcctggatatcctc

SEQ ID NO: 247858 - DNA, 32 bp, Artificial Sequence
  Description of Artificial Sequence: Synthetic oligonucleotide
ttgcccttcctctgttcctggatatcctcttg

SEQ ID NO: 247859 - DNA, 31 bp, Artificial Sequence
  Description of Artificial Sequence: Synthetic oligonucleotide
tgcccttcctctgttcctggatatcctcttg

SEQ ID NO: 247860 - DNA, 30 bp, Artificial Sequence
  Description of Artificial Sequence: Synthetic oligonucleotide
gcccttcctctgttcctggatatcctcttg

SEQ ID NO: 247861 - DNA, 31 bp, Artificial Sequence
  Description of Artificial Sequence: Synthetic oligonucleotide
cccttcctctgttcctggatatcctcttgtg

SEQ ID NO: 247862 - DNA, 31 bp, Artificial Sequence
  Description of Artificial Sequence: Synthetic oligonucleotide
ccttcctctgttcctggatatcctcttgtgc

SEQ ID NO: 247863 - DNA, 32 bp, Artificial Sequence
  Description of Artificial Sequence: Synthetic oligonucleotide
cttcctctgttcctggatatcctcttgtgctg

SEQ ID NO: 247864 - DNA, 34 bp, Artificial Sequence
  Description of Artificial Sequence: Synthetic oligonucleotide
ttcctctgttcctggatatcctcttgtgctgttc

SEQ ID NO: 247865 - DNA, 33 bp, Artificial Sequence
  Description of Artificial Sequence: Synthetic oligonucleotide
tcctctgttcctggatatcctcttgtgctgttc

SEQ ID NO: 247866 - DNA, 32 bp, Artificial Sequence
  Description of Artificial Sequence: Synthetic oligonucleotide
cctctgttcctggatatcctcttgtgctgttc

SEQ ID NO: 247867 - DNA, 33 bp, Artificial Sequence
  Description of Artificial Sequence: Synthetic oligonucleotide
ctctgttcctggatatcctcttgtgctgttctc

SEQ ID NO: 247868 - DNA, 33 bp, Artificial Sequence
  Description of Artificial Sequence: Synthetic oligonucleotide
tctgttcctggatatcctcttgtgctgttctcg

SEQ ID NO: 247869 - DNA, 32 bp, Artificial Sequence
  Description of Artificial Sequence: Synthetic oligonucleotide
ctgttcctggatatcctcttgtgctgttctcg

SEQ ID NO: 247870 - DNA, 35 bp, Artificial Sequence
  Description of Artificial Sequence: Synthetic oligonucleotide
tgttcctggatatcctcttgtgctgttctcgaaag

SEQ ID NO: 247871 - DNA, 34 bp, Artificial Sequence
  Description of Artificial Sequence: Synthetic oligonucleotide
gttcctggatatcctcttgtgctgttctcgaaag

SEQ ID NO: 247872 - DNA, 37 bp, Artificial Sequence
  Description of Artificial Sequence: Synthetic oligonucleotide
ttcctggatatcctcttgtgctgttctcgaaagaaac

SEQ ID NO: 247873 - DNA, 36 bp, Artificial Sequence
  Description of Artificial Sequence: Synthetic oligonucleotide
tcctggatatcctcttgtgctgttctcgaaagaaac

SEQ ID NO: 247874 - DNA, 35 bp, Artificial Sequence
  Description of Artificial Sequence: Synthetic oligonucleotide
cctggatatcctcttgtgctgttctcgaaagaaac

SEQ ID NO: 247875 - DNA, 36 bp, Artificial Sequence
  Description of Artificial Sequence: Synthetic oligonucleotide
ctggatatcctcttgtgctgttctcgaaagaaactg

SEQ ID NO: 247876 - DNA, 37 bp, Artificial Sequence
  Description of Artificial Sequence: Synthetic oligonucleotide
tggatatcctcttgtgctgttctcgaaagaaactgac

SEQ ID NO: 247877 - DNA, 36 bp, Artificial Sequence
  Description of Artificial Sequence: Synthetic oligonucleotide
ggatatcctcttgtgctgttctcgaaagaaactgac

SEQ ID NO: 247878 - DNA, 36 bp, Artificial Sequence
  Description of Artificial Sequence: Synthetic oligonucleotide
gatatcctcttgtgctgttctcgaaagaaactgacc

SEQ ID NO: 247879 - DNA, 37 bp, Artificial Sequence
  Description of Artificial Sequence: Synthetic oligonucleotide
atatcctcttgtgctgttctcgaaagaaactgaccag

SEQ ID NO: 247880 - DNA, 36 bp, Artificial Sequence
  Description of Artificial Sequence: Synthetic oligonucleotide
tatcctcttgtgctgttctcgaaagaaactgaccag

SEQ ID NO: 247881 - DNA, 35 bp, Artificial Sequence
  Description of Artificial Sequence: Synthetic oligonucleotide
atcctcttgtgctgttctcgaaagaaactgaccag

SEQ ID NO: 247882 - DNA, 34 bp, Artificial Sequence
  Description of Artificial Sequence: Synthetic oligonucleotide
tcctcttgtgctgttctcgaaagaaactgaccag

SEQ ID NO: 247883 - DNA, 33 bp, Artificial Sequence
  Description of Artificial Sequence: Synthetic oligonucleotide
cctcttgtgctgttctcgaaagaaactgaccag

SEQ ID NO: 247884 - DNA, 34 bp, Artificial Sequence
  Description of Artificial Sequence: Synthetic oligonucleotide
ctcttgtgctgttctcgaaagaaactgaccagtg

SEQ ID NO: 247885 - DNA, 34 bp, Artificial Sequence
  Description of Artificial Sequence: Synthetic oligonucleotide
tcttgtgctgttctcgaaagaaactgaccagtgg

SEQ ID NO: 247886 - DNA, 33 bp, Artificial Sequence
  Description of Artificial Sequence: Synthetic oligonucleotide
cttgtgctgttctcgaaagaaactgaccagtgg

SEQ ID NO: 247887 - DNA, 36 bp, Artificial Sequence
  Description of Artificial Sequence: Synthetic oligonucleotide
ttgtgctgttctcgaaagaaactgaccagtggaatg

SEQ ID NO: 247888 - DNA, 35 bp, Artificial Sequence
  Description of Artificial Sequence: Synthetic oligonucleotide
tgtgctgttctcgaaagaaactgaccagtggaatg

SEQ ID NO: 247889 - DNA, 34 bp, Artificial Sequence
  Description of Artificial Sequence: Synthetic oligonucleotide
gtgctgttctcgaaagaaactgaccagtggaatg

SEQ ID NO: 247890 - DNA, 34 bp, Artificial Sequence
  Description of Artificial Sequence: Synthetic oligonucleotide
tgctgttctcgaaagaaactgaccagtggaatgg

SEQ ID NO: 247891 - DNA, 33 bp, Artificial Sequence
  Description of Artificial Sequence: Synthetic oligonucleotide
gctgttctcgaaagaaactgaccagtggaatgg

SEQ ID NO: 247892 - DNA, 34 bp, Artificial Sequence
  Description of Artificial Sequence: Synthetic oligonucleotide
ctgttctcgaaagaaactgaccagtggaatggag

SEQ ID NO: 247893 - DNA, 39 bp, Artificial Sequence
  Description of Artificial Sequence: Synthetic oligonucleotide
tgttctcgaaagaaactgaccagtggaatggagtattag

SEQ ID NO: 247894 - DNA, 38 bp, Artificial Sequence
  Description of Artificial Sequence: Synthetic oligonucleotide
gttctcgaaagaaactgaccagtggaatggagtattag

SEQ ID NO: 247895 - DNA, 42 bp, Artificial Sequence
  Description of Artificial Sequence: Synthetic oligonucleotide
ttctcgaaagaaactgaccagtggaatggagtattagaaaac

SEQ ID NO: 247896 - DNA, 41 bp, Artificial Sequence
  Description of Artificial Sequence: Synthetic oligonucleotide
tctcgaaagaaactgaccagtggaatggagtattagaaaac

SEQ ID NO: 247897 - DNA, 40 bp, Artificial Sequence
  Description of Artificial Sequence: Synthetic oligonucleotide
ctcgaaagaaactgaccagtggaatggagtattagaaaac

SEQ ID NO: 247898 - DNA, 41 bp, Artificial Sequence
  Description of Artificial Sequence: Synthetic oligonucleotide
tcgaaagaaactgaccagtggaatggagtattagaaaactg

SEQ ID NO: 247899 - DNA, 40 bp, Artificial Sequence
  Description of Artificial Sequence: Synthetic oligonucleotide
cgaaagaaactgaccagtggaatggagtattagaaaactg

SEQ ID NO: 247900 - DNA, 42 bp, Artificial Sequence
  Description of Artificial Sequence: Synthetic oligonucleotide
gaaagaaactgaccagtggaatggagtattagaaaactgttg

SEQ ID NO: 247901 - DNA, 42 bp, Artificial Sequence
  Description of Artificial Sequence: Synthetic oligonucleotide
aaagaaactgaccagtggaatggagtattagaaaactgttgc

SEQ ID NO: 247902 - DNA, 41 bp, Artificial Sequence
  Description of Artificial Sequence: Synthetic oligonucleotide
aagaaactgaccagtggaatggagtattagaaaactgttgc

SEQ ID NO: 247903 - DNA, 40 bp, Artificial Sequence
  Description of Artificial Sequence: Synthetic oligonucleotide
agaaactgaccagtggaatggagtattagaaaactgttgc

SEQ ID NO: 247904 - DNA, 39 bp, Artificial Sequence
  Description of Artificial Sequence: Synthetic oligonucleotide
gaaactgaccagtggaatggagtattagaaaactgttgc

SEQ ID NO: 247905 - DNA, 40 bp, Artificial Sequence
  Description of Artificial Sequence: Synthetic oligonucleotide
aaactgaccagtggaatggagtattagaaaactgttgcac

SEQ ID NO: 247906 - DNA, 39 bp, Artificial Sequence
  Description of Artificial Sequence: Synthetic oligonucleotide
aactgaccagtggaatggagtattagaaaactgttgcac

SEQ ID NO: 247907 - DNA, 38 bp, Artificial Sequence
  Description of Artificial Sequence: Synthetic oligonucleotide
actgaccagtggaatggagtattagaaaactgttgcac

SEQ ID NO: 247908 - DNA, 37 bp, Artificial Sequence
  Description of Artificial Sequence: Synthetic oligonucleotide
ctgaccagtggaatggagtattagaaaactgttgcac

SEQ ID NO: 247909 - DNA, 37 bp, Artificial Sequence
  Description of Artificial Sequence: Synthetic oligonucleotide
tgaccagtggaatggagtattagaaaactgttgcacc

SEQ ID NO: 247910 - DNA, 36 bp, Artificial Sequence
  Description of Artificial Sequence: Synthetic oligonucleotide
gaccagtggaatggagtattagaaaactgttgcacc

SEQ ID NO: 247911 - DNA, 37 bp, Artificial Sequence
  Description of Artificial Sequence: Synthetic oligonucleotide
accagtggaatggagtattagaaaactgttgcacctc

SEQ ID NO: 247912 - DNA, 36 bp, Artificial Sequence
  Description of Artificial Sequence: Synthetic oligonucleotide
ccagtggaatggagtattagaaaactgttgcacctc

SEQ ID NO: 247913 - DNA, 38 bp, Artificial Sequence
  Description of Artificial Sequence: Synthetic oligonucleotide
cagtggaatggagtattagaaaactgttgcacctcatc

SEQ ID NO: 247914 - DNA, 38 bp, Artificial Sequence
  Description of Artificial Sequence: Synthetic oligonucleotide
agtggaatggagtattagaaaactgttgcacctcatcc

SEQ ID NO: 247915 - DNA, 37 bp, Artificial Sequence
  Description of Artificial Sequence: Synthetic oligonucleotide
gtggaatggagtattagaaaactgttgcacctcatcc

SEQ ID NO: 247916 - DNA, 37 bp, Artificial Sequence
  Description of Artificial Sequence: Synthetic oligonucleotide
tggaatggagtattagaaaactgttgcacctcatccg

SEQ ID NO: 247917 - DNA, 36 bp, Artificial Sequence
  Description of Artificial Sequence: Synthetic oligonucleotide
ggaatggagtattagaaaactgttgcacctcatccg

SEQ ID NO: 247918 - DNA, 36 bp, Artificial Sequence
  Description of Artificial Sequence: Synthetic oligonucleotide
gaatggagtattagaaaactgttgcacctcatccgg

SEQ ID NO: 247919 - DNA, 38 bp, Artificial Sequence
  Description of Artificial Sequence: Synthetic oligonucleotide
aatggagtattagaaaactgttgcacctcatccggatg

SEQ ID NO: 247920 - DNA, 37 bp, Artificial Sequence
  Description of Artificial Sequence: Synthetic oligonucleotide
atggagtattagaaaactgttgcacctcatccggatg

SEQ ID NO: 247921 - DNA, 36 bp, Artificial Sequence
  Description of Artificial Sequence: Synthetic oligonucleotide
tggagtattagaaaactgttgcacctcatccggatg

SEQ ID NO: 247922 - DNA, 35 bp, Artificial Sequence
  Description of Artificial Sequence: Synthetic oligonucleotide
ggagtattagaaaactgttgcacctcatccggatg

SEQ ID NO: 247923 - DNA, 36 bp, Artificial Sequence
  Description of Artificial Sequence: Synthetic oligonucleotide
gagtattagaaaactgttgcacctcatccggatgtg

SEQ ID NO: 247924 - DNA, 38 bp, Artificial Sequence
  Description of Artificial Sequence: Synthetic oligonucleotide
agtattagaaaactgttgcacctcatccggatgtgtag

SEQ ID NO: 247925 - DNA, 37 bp, Artificial Sequence
  Description of Artificial Sequence: Synthetic oligonucleotide
gtattagaaaactgttgcacctcatccggatgtgtag

SEQ ID NO: 247926 - DNA, 37 bp, Artificial Sequence
  Description of Artificial Sequence: Synthetic oligonucleotide
tattagaaaactgttgcacctcatccggatgtgtagg

SEQ ID NO: 247927 - DNA, 36 bp, Artificial Sequence
  Description of Artificial Sequence: Synthetic oligonucleotide
attagaaaactgttgcacctcatccggatgtgtagg

SEQ ID NO: 247928 - DNA, 35 bp, Artificial Sequence
  Description of Artificial Sequence: Synthetic oligonucleotide
ttagaaaactgttgcacctcatccggatgtgtagg

SEQ ID NO: 247929 - DNA, 34 bp, Artificial Sequence
  Description of Artificial Sequence: Synthetic oligonucleotide
tagaaaactgttgcacctcatccggatgtgtagg

SEQ ID NO: 247930 - DNA, 33 bp, Artificial Sequence
  Description of Artificial Sequence: Synthetic oligonucleotide
agaaaactgttgcacctcatccggatgtgtagg

SEQ ID NO: 247931 - DNA, 32 bp, Artificial Sequence
  Description of Artificial Sequence: Synthetic oligonucleotide
gaaaactgttgcacctcatccggatgtgtagg

SEQ ID NO: 247932 - DNA, 34 bp, Artificial Sequence
  Description of Artificial Sequence: Synthetic oligonucleotide
aaaactgttgcacctcatccggatgtgtaggaag

SEQ ID NO: 247933 - DNA, 33 bp, Artificial Sequence
  Description of Artificial Sequence: Synthetic oligonucleotide
aaactgttgcacctcatccggatgtgtaggaag

SEQ ID NO: 247934 - DNA, 32 bp, Artificial Sequence
  Description of Artificial Sequence: Synthetic oligonucleotide
aactgttgcacctcatccggatgtgtaggaag

SEQ ID NO: 247935 - DNA, 31 bp, Artificial Sequence
  Description of Artificial Sequence: Synthetic oligonucleotide
actgttgcacctcatccggatgtgtaggaag

SEQ ID NO: 247936 - DNA, 30 bp, Artificial Sequence
  Description of Artificial Sequence: Synthetic oligonucleotide
ctgttgcacctcatccggatgtgtaggaag

SEQ ID NO: 247937 - DNA, 31 bp, Artificial Sequence
  Description of Artificial Sequence: Synthetic oligonucleotide
tgttgcacctcatccggatgtgtaggaagag

SEQ ID NO: 247938 - DNA, 30 bp, Artificial Sequence
  Description of Artificial Sequence: Synthetic oligonucleotide
gttgcacctcatccggatgtgtaggaagag

SEQ ID NO: 247939 - DNA, 30 bp, Artificial Sequence
  Description of Artificial Sequence: Synthetic oligonucleotide
ttgcacctcatccggatgtgtaggaagagg

SEQ ID NO: 247940 - DNA, 29 bp, Artificial Sequence
  Description of Artificial Sequence: Synthetic oligonucleotide
tgcacctcatccggatgtgtaggaagagg

SEQ ID NO: 247941 - DNA, 28 bp, Artificial Sequence
  Description of Artificial Sequence: Synthetic oligonucleotide
gcacctcatccggatgtgtaggaagagg

SEQ ID NO: 247942 - DNA, 30 bp, Artificial Sequence
  Description of Artificial Sequence: Synthetic oligonucleotide
cacctcatccggatgtgtaggaagaggtag

SEQ ID NO: 247943 - DNA, 32 bp, Artificial Sequence
  Description of Artificial Sequence: Synthetic oligonucleotide
acctcatccggatgtgtaggaagaggtagaag

SEQ ID NO: 247944 - DNA, 31 bp, Artificial Sequence
  Description of Artificial Sequence: Synthetic oligonucleotide
cctcatccggatgtgtaggaagaggtagaag

SEQ ID NO: 247945 - DNA, 32 bp, Artificial Sequence
  Description of Artificial Sequence: Synthetic oligonucleotide
ctcatccggatgtgtaggaagaggtagaagag

SEQ ID NO: 247946 - DNA, 34 bp, Artificial Sequence
  Description of Artificial Sequence: Synthetic oligonucleotide
tcatccggatgtgtaggaagaggtagaagagaac

SEQ ID NO: 247947 - DNA, 33 bp, Artificial Sequence
  Description of Artificial Sequence: Synthetic oligonucleotide
catccggatgtgtaggaagaggtagaagagaac

SEQ ID NO: 247948 - DNA, 33 bp, Artificial Sequence
  Description of Artificial Sequence: Synthetic oligonucleotide
atccggatgtgtaggaagaggtagaagagaacg

SEQ ID NO: 247949 - DNA, 32 bp, Artificial Sequence
  Description of Artificial Sequence: Synthetic oligonucleotide
tccggatgtgtaggaagaggtagaagagaacg

SEQ ID NO: 247950 - DNA, 31 bp, Artificial Sequence
  Description of Artificial Sequence: Synthetic oligonucleotide
ccggatgtgtaggaagaggtagaagagaacg

SEQ ID NO: 247951 - DNA, 33 bp, Artificial Sequence
  Description of Artificial Sequence: Synthetic oligonucleotide
cggatgtgtaggaagaggtagaagagaacgaag

SEQ ID NO: 247952 - DNA, 34 bp, Artificial Sequence
  Description of Artificial Sequence: Synthetic oligonucleotide
ggatgtgtaggaagaggtagaagagaacgaagag

SEQ ID NO: 247953 - DNA, 34 bp, Artificial Sequence
  Description of Artificial Sequence: Synthetic oligonucleotide
gatgtgtaggaagaggtagaagagaacgaagagg

SEQ ID NO: 247954 - DNA, 38 bp, Artificial Sequence
  Description of Artificial Sequence: Synthetic oligonucleotide
atgtgtaggaagaggtagaagagaacgaagaggaatag

SEQ ID NO: 247955 - DNA, 37 bp, Artificial Sequence
  Description of Artificial Sequence: Synthetic oligonucleotide
tgtgtaggaagaggtagaagagaacgaagaggaatag

SEQ ID NO: 247956 - DNA, 36 bp, Artificial Sequence
  Description of Artificial Sequence: Synthetic oligonucleotide
gtgtaggaagaggtagaagagaacgaagaggaatag

SEQ ID NO: 247957 - DNA, 36 bp, Artificial Sequence
  Description of Artificial Sequence: Synthetic oligonucleotide
tgtaggaagaggtagaagagaacgaagaggaatagg

SEQ ID NO: 247958 - DNA, 35 bp, Artificial Sequence
  Description of Artificial Sequence: Synthetic oligonucleotide
gtaggaagaggtagaagagaacgaagaggaatagg

SEQ ID NO: 247959 - DNA, 36 bp, Artificial Sequence
  Description of Artificial Sequence: Synthetic oligonucleotide
taggaagaggtagaagagaacgaagaggaataggac

SEQ ID NO: 247960 - DNA, 35 bp, Artificial Sequence
  Description of Artificial Sequence: Synthetic oligonucleotide
aggaagaggtagaagagaacgaagaggaataggac

SEQ ID NO: 247961 - DNA, 34 bp, Artificial Sequence
  Description of Artificial Sequence: Synthetic oligonucleotide
ggaagaggtagaagagaacgaagaggaataggac

SEQ ID NO: 247962 - DNA, 36 bp, Artificial Sequence
  Description of Artificial Sequence: Synthetic oligonucleotide
gaagaggtagaagagaacgaagaggaataggacaag

SEQ ID NO: 247963 - DNA, 36 bp, Artificial Sequence
  Description of Artificial Sequence: Synthetic oligonucleotide
aagaggtagaagagaacgaagaggaataggacaagg

SEQ ID NO: 247964 - DNA, 35 bp, Artificial Sequence
  Description of Artificial Sequence: Synthetic oligonucleotide
agaggtagaagagaacgaagaggaataggacaagg

SEQ ID NO: 247965 - DNA, 34 bp, Artificial Sequence
  Description of Artificial Sequence: Synthetic oligonucleotide
gaggtagaagagaacgaagaggaataggacaagg

SEQ ID NO: 247966 - DNA, 34 bp, Artificial Sequence
  Description of Artificial Sequence: Synthetic oligonucleotide
aggtagaagagaacgaagaggaataggacaaggc

SEQ ID NO: 247967 - DNA, 33 bp, Artificial Sequence
  Description of Artificial Sequence: Synthetic oligonucleotide
ggtagaagagaacgaagaggaataggacaaggc

SEQ ID NO: 247968 - DNA, 34 bp, Artificial Sequence
  Description of Artificial Sequence: Synthetic oligonucleotide
gtagaagagaacgaagaggaataggacaaggcag

SEQ ID NO: 247969 - DNA, 36 bp, Artificial Sequence
  Description of Artificial Sequence: Synthetic oligonucleotide
tagaagagaacgaagaggaataggacaaggcagatg

SEQ ID NO: 247970 - DNA, 35 bp, Artificial Sequence
  Description of Artificial Sequence: Synthetic oligonucleotide
agaagagaacgaagaggaataggacaaggcagatg

SEQ ID NO: 247971 - DNA, 34 bp, Artificial Sequence
  Description of Artificial Sequence: Synthetic oligonucleotide
gaagagaacgaagaggaataggacaaggcagatg

SEQ ID NO: 247972 - DNA, 35 bp, Artificial Sequence
  Description of Artificial Sequence: Synthetic oligonucleotide
aagagaacgaagaggaataggacaaggcagatgag

SEQ ID NO: 247973 - DNA, 34 bp, Artificial Sequence
  Description of Artificial Sequence: Synthetic oligonucleotide
agagaacgaagaggaataggacaaggcagatgag

SEQ ID NO: 247974 - DNA, 33 bp, Artificial Sequence
  Description of Artificial Sequence: Synthetic oligonucleotide
gagaacgaagaggaataggacaaggcagatgag

SEQ ID NO: 247975 - DNA, 33 bp, Artificial Sequence
  Description of Artificial Sequence: Synthetic oligonucleotide
agaacgaagaggaataggacaaggcagatgagg

SEQ ID NO: 247976 - DNA, 32 bp, Artificial Sequence
  Description of Artificial Sequence: Synthetic oligonucleotide
gaacgaagaggaataggacaaggcagatgagg

SEQ ID NO: 247977 - DNA, 33 bp, Artificial Sequence
  Description of Artificial Sequence: Synthetic oligonucleotide
aacgaagaggaataggacaaggcagatgaggac

SEQ ID NO: 247978 - DNA, 32 bp, Artificial Sequence
  Description of Artificial Sequence: Synthetic oligonucleotide
acgaagaggaataggacaaggcagatgaggac

SEQ ID NO: 247979 - DNA, 31 bp, Artificial Sequence
  Description of Artificial Sequence: Synthetic oligonucleotide
cgaagaggaataggacaaggcagatgaggac

SEQ ID NO: 247980 - DNA, 31 bp, Artificial Sequence
  Description of Artificial Sequence: Synthetic oligonucleotide
gaagaggaataggacaaggcagatgaggacg

SEQ ID NO: 247981 - DNA, 32 bp, Artificial Sequence
  Description of Artificial Sequence: Synthetic oligonucleotide
aagaggaataggacaaggcagatgaggacgag

SEQ ID NO: 247982 - DNA, 31 bp, Artificial Sequence
  Description of Artificial Sequence: Synthetic oligonucleotide
agaggaataggacaaggcagatgaggacgag

SEQ ID NO: 247983 - DNA, 30 bp, Artificial Sequence
  Description of Artificial Sequence: Synthetic oligonucleotide
gaggaataggacaaggcagatgaggacgag

SEQ ID NO: 247984 - DNA, 30 bp, Artificial Sequence
  Description of Artificial Sequence: Synthetic oligonucleotide
aggaataggacaaggcagatgaggacgagg

SEQ ID NO: 247985 - DNA, 29 bp, Artificial Sequence
  Description of Artificial Sequence: Synthetic oligonucleotide
ggaataggacaaggcagatgaggacgagg

SEQ ID NO: 247986 - DNA, 31 bp, Artificial Sequence
  Description of Artificial Sequence: Synthetic oligonucleotide
gaataggacaaggcagatgaggacgaggaag

SEQ ID NO: 247987 - DNA, 31 bp, Artificial Sequence
  Description of Artificial Sequence: Synthetic oligonucleotide
aataggacaaggcagatgaggacgaggaagg

SEQ ID NO: 247988 - DNA, 30 bp, Artificial Sequence
  Description of Artificial Sequence: Synthetic oligonucleotide
ataggacaaggcagatgaggacgaggaagg

SEQ ID NO: 247989 - DNA, 29 bp, Artificial Sequence
  Description of Artificial Sequence: Synthetic oligonucleotide
taggacaaggcagatgaggacgaggaagg

SEQ ID NO: 247990 - DNA, 28 bp, Artificial Sequence
  Description of Artificial Sequence: Synthetic oligonucleotide
aggacaaggcagatgaggacgaggaagg

SEQ ID NO: 247991 - DNA, 27 bp, Artificial Sequence
  Description of Artificial Sequence: Synthetic oligonucleotide
ggacaaggcagatgaggacgaggaagg

SEQ ID NO: 247992 - DNA, 28 bp, Artificial Sequence
  Description of Artificial Sequence: Synthetic oligonucleotide
gacaaggcagatgaggacgaggaaggac

SEQ ID NO: 247993 - DNA, 30 bp, Artificial Sequence
  Description of Artificial Sequence: Synthetic oligonucleotide
acaaggcagatgaggacgaggaaggacaag

SEQ ID NO: 247994 - DNA, 29 bp, Artificial Sequence
  Description of Artificial Sequence: Synthetic oligonucleotide
caaggcagatgaggacgaggaaggacaag

SEQ ID NO: 247995 - DNA, 30 bp, Artificial Sequence
  Description of Artificial Sequence: Synthetic oligonucleotide
aaggcagatgaggacgaggaaggacaagag

SEQ ID NO: 247996 - DNA, 29 bp, Artificial Sequence
  Description of Artificial Sequence: Synthetic oligonucleotide
aggcagatgaggacgaggaaggacaagag

SEQ ID NO: 247997 - DNA, 28 bp, Artificial Sequence
  Description of Artificial Sequence: Synthetic oligonucleotide
ggcagatgaggacgaggaaggacaagag

SEQ ID NO: 247998 - DNA, 31 bp, Artificial Sequence
  Description of Artificial Sequence: Synthetic oligonucleotide
gcagatgaggacgaggaaggacaagagaaac

SEQ ID NO: 247999 - DNA, 33 bp, Artificial Sequence
  Description of Artificial Sequence: Synthetic oligonucleotide
cagatgaggacgaggaaggacaagagaaacatg

SEQ ID NO: 248000 - DNA, 35 bp, Artificial Sequence
  Description of Artificial Sequence: Synthetic oligonucleotide
agatgaggacgaggaaggacaagagaaacatgaag

SEQ ID NO: 248001 - DNA, 34 bp, Artificial Sequence
  Description of Artificial Sequence: Synthetic oligonucleotide
gatgaggacgaggaaggacaagagaaacatgaag

SEQ ID NO: 248002 - DNA, 35 bp, Artificial Sequence
  Description of Artificial Sequence: Synthetic oligonucleotide
atgaggacgaggaaggacaagagaaacatgaagag

SEQ ID NO: 248003 - DNA, 34 bp, Artificial Sequence
  Description of Artificial Sequence: Synthetic oligonucleotide
tgaggacgaggaaggacaagagaaacatgaagag

SEQ ID NO: 248004 - DNA, 33 bp, Artificial Sequence
  Description of Artificial Sequence: Synthetic oligonucleotide
gaggacgaggaaggacaagagaaacatgaagag

SEQ ID NO: 248005 - DNA, 36 bp, Artificial Sequence
  Description of Artificial Sequence: Synthetic oligonucleotide
aggacgaggaaggacaagagaaacatgaagagaatc

SEQ ID NO: 248006 - DNA, 35 bp, Artificial Sequence
  Description of Artificial Sequence: Synthetic oligonucleotide
ggacgaggaaggacaagagaaacatgaagagaatc

SEQ ID NO: 248007 - DNA, 36 bp, Artificial Sequence
  Description of Artificial Sequence: Synthetic oligonucleotide
gacgaggaaggacaagagaaacatgaagagaatcag

SEQ ID NO: 248008 - DNA, 40 bp, Artificial Sequence
  Description of Artificial Sequence: Synthetic oligonucleotide
acgaggaaggacaagagaaacatgaagagaatcagaaaag

SEQ ID NO: 248009 - DNA, 39 bp, Artificial Sequence
  Description of Artificial Sequence: Synthetic oligonucleotide
cgaggaaggacaagagaaacatgaagagaatcagaaaag

SEQ ID NO: 248010 - DNA, 40 bp, Artificial Sequence
  Description of Artificial Sequence: Synthetic oligonucleotide
gaggaaggacaagagaaacatgaagagaatcagaaaagtc

SEQ ID NO: 248011 - DNA, 42 bp, Artificial Sequence
  Description of Artificial Sequence: Synthetic oligonucleotide
aggaaggacaagagaaacatgaagagaatcagaaaagtcatg

SEQ ID NO: 248012 - DNA, 41 bp, Artificial Sequence
  Description of Artificial Sequence: Synthetic oligonucleotide
ggaaggacaagagaaacatgaagagaatcagaaaagtcatg

SEQ ID NO: 248013 - DNA, 41 bp, Artificial Sequence
  Description of Artificial Sequence: Synthetic oligonucleotide
gaaggacaagagaaacatgaagagaatcagaaaagtcatgc

SEQ ID NO: 248014 - DNA, 42 bp, Artificial Sequence
  Description of Artificial Sequence: Synthetic oligonucleotide
aaggacaagagaaacatgaagagaatcagaaaagtcatgctg

SEQ ID NO: 248015 - DNA, 41 bp, Artificial Sequence
  Description of Artificial Sequence: Synthetic oligonucleotide
aggacaagagaaacatgaagagaatcagaaaagtcatgctg

SEQ ID NO: 248016 - DNA, 40 bp, Artificial Sequence
  Description of Artificial Sequence: Synthetic oligonucleotide
ggacaagagaaacatgaagagaatcagaaaagtcatgctg

SEQ ID NO: 248017 - DNA, 42 bp, Artificial Sequence
  Description of Artificial Sequence: Synthetic oligonucleotide
gacaagagaaacatgaagagaatcagaaaagtcatgctgaag

SEQ ID NO: 248018 - DNA, 44 bp, Artificial Sequence
  Description of Artificial Sequence: Synthetic oligonucleotide
acaagagaaacatgaagagaatcagaaaagtcatgctgaagtag

SEQ ID NO: 248019 - DNA, 43 bp, Artificial Sequence
  Description of Artificial Sequence: Synthetic oligonucleotide
caagagaaacatgaagagaatcagaaaagtcatgctgaagtag

SEQ ID NO: 248020 - DNA, 45 bp, Artificial Sequence
  Description of Artificial Sequence: Synthetic oligonucleotide
aagagaaacatgaagagaatcagaaaagtcatgctgaagtagatg

SEQ ID NO: 248021 - DNA, 44 bp, Artificial Sequence
  Description of Artificial Sequence: Synthetic oligonucleotide
agagaaacatgaagagaatcagaaaagtcatgctgaagtagatg

SEQ ID NO: 248022 - DNA, 43 bp, Artificial Sequence
  Description of Artificial Sequence: Synthetic oligonucleotide
gagaaacatgaagagaatcagaaaagtcatgctgaagtagatg

SEQ ID NO: 248023 - DNA, 43 bp, Artificial Sequence
  Description of Artificial Sequence: Synthetic oligonucleotide
agaaacatgaagagaatcagaaaagtcatgctgaagtagatgg

SEQ ID NO: 248024 - DNA, 42 bp, Artificial Sequence
  Description of Artificial Sequence: Synthetic oligonucleotide
gaaacatgaagagaatcagaaaagtcatgctgaagtagatgg

SEQ ID NO: 248025 - DNA, 43 bp, Artificial Sequence
  Description of Artificial Sequence: Synthetic oligonucleotide
aaacatgaagagaatcagaaaagtcatgctgaagtagatggtg

SEQ ID NO: 248026 - DNA, 42 bp, Artificial Sequence
  Description of Artificial Sequence: Synthetic oligonucleotide
aacatgaagagaatcagaaaagtcatgctgaagtagatggtg

SEQ ID NO: 248027 - DNA, 41 bp, Artificial Sequence
  Description of Artificial Sequence: Synthetic oligonucleotide
acatgaagagaatcagaaaagtcatgctgaagtagatggtg

SEQ ID NO: 248028 - DNA, 40 bp, Artificial Sequence
  Description of Artificial Sequence: Synthetic oligonucleotide
catgaagagaatcagaaaagtcatgctgaagtagatggtg

SEQ ID NO: 248029 - DNA, 40 bp, Artificial Sequence
  Description of Artificial Sequence: Synthetic oligonucleotide
atgaagagaatcagaaaagtcatgctgaagtagatggtgg

SEQ ID NO: 248030 - DNA, 39 bp, Artificial Sequence
  Description of Artificial Sequence: Synthetic oligonucleotide
tgaagagaatcagaaaagtcatgctgaagtagatggtgg

SEQ ID NO: 248031 - DNA, 38 bp, Artificial Sequence
  Description of Artificial Sequence: Synthetic oligonucleotide
gaagagaatcagaaaagtcatgctgaagtagatggtgg

SEQ ID NO: 248032 - DNA, 38 bp, Artificial Sequence
  Description of Artificial Sequence: Synthetic oligonucleotide
aagagaatcagaaaagtcatgctgaagtagatggtggg

SEQ ID NO: 248033 - DNA, 37 bp, Artificial Sequence
  Description of Artificial Sequence: Synthetic oligonucleotide
agagaatcagaaaagtcatgctgaagtagatggtggg

SEQ ID NO: 248034 - DNA, 36 bp, Artificial Sequence
  Description of Artificial Sequence: Synthetic oligonucleotide
gagaatcagaaaagtcatgctgaagtagatggtggg

SEQ ID NO: 248035 - DNA, 37 bp, Artificial Sequence
  Description of Artificial Sequence: Synthetic oligonucleotide
agaatcagaaaagtcatgctgaagtagatggtgggac

SEQ ID NO: 248036 - DNA, 36 bp, Artificial Sequence
  Description of Artificial Sequence: Synthetic oligonucleotide
gaatcagaaaagtcatgctgaagtagatggtgggac

SEQ ID NO: 248037 - DNA, 37 bp, Artificial Sequence
  Description of Artificial Sequence: Synthetic oligonucleotide
aatcagaaaagtcatgctgaagtagatggtgggactg

SEQ ID NO: 248038 - DNA, 36 bp, Artificial Sequence
  Description of Artificial Sequence: Synthetic oligonucleotide
atcagaaaagtcatgctgaagtagatggtgggactg

SEQ ID NO: 248039 - DNA, 35 bp, Artificial Sequence
  Description of Artificial Sequence: Synthetic oligonucleotide
tcagaaaagtcatgctgaagtagatggtgggactg

SEQ ID NO: 248040 - DNA, 34 bp, Artificial Sequence
  Description of Artificial Sequence: Synthetic oligonucleotide
cagaaaagtcatgctgaagtagatggtgggactg

SEQ ID NO: 248041 - DNA, 35 bp, Artificial Sequence
  Description of Artificial Sequence: Synthetic oligonucleotide
agaaaagtcatgctgaagtagatggtgggactgtc

SEQ ID NO: 248042 - DNA, 34 bp, Artificial Sequence
  Description of Artificial Sequence: Synthetic oligonucleotide
gaaaagtcatgctgaagtagatggtgggactgtc

SEQ ID NO: 248043 - DNA, 35 bp, Artificial Sequence
  Description of Artificial Sequence: Synthetic oligonucleotide
aaaagtcatgctgaagtagatggtgggactgtcag

SEQ ID NO: 248044 - DNA, 34 bp, Artificial Sequence
  Description of Artificial Sequence: Synthetic oligonucleotide
aaagtcatgctgaagtagatggtgggactgtcag

SEQ ID NO: 248045 - DNA, 33 bp, Artificial Sequence
  Description of Artificial Sequence: Synthetic oligonucleotide
aagtcatgctgaagtagatggtgggactgtcag

SEQ ID NO: 248046 - DNA, 32 bp, Artificial Sequence
  Description of Artificial Sequence: Synthetic oligonucleotide
agtcatgctgaagtagatggtgggactgtcag

SEQ ID NO: 248047 - DNA, 31 bp, Artificial Sequence
  Description of Artificial Sequence: Synthetic oligonucleotide
gtcatgctgaagtagatggtgggactgtcag

SEQ ID NO: 248048 - DNA, 32 bp, Artificial Sequence
  Description of Artificial Sequence: Synthetic oligonucleotide
tcatgctgaagtagatggtgggactgtcagtg

SEQ ID NO: 248049 - DNA, 31 bp, Artificial Sequence
  Description of Artificial Sequence: Synthetic oligonucleotide
catgctgaagtagatggtgggactgtcagtg

SEQ ID NO: 248050 - DNA, 33 bp, Artificial Sequence
  Description of Artificial Sequence: Synthetic oligonucleotide
atgctgaagtagatggtgggactgtcagtgaag

SEQ ID NO: 248051 - DNA, 32 bp, Artificial Sequence
  Description of Artificial Sequence: Synthetic oligonucleotide
tgctgaagtagatggtgggactgtcagtgaag

SEQ ID NO: 248052 - DNA, 31 bp, Artificial Sequence
  Description of Artificial Sequence: Synthetic oligonucleotide
gctgaagtagatggtgggactgtcagtgaag

SEQ ID NO: 248053 - DNA, 32 bp, Artificial Sequence
  Description of Artificial Sequence: Synthetic oligonucleotide
ctgaagtagatggtgggactgtcagtgaagag

SEQ ID NO: 248054 - DNA, 32 bp, Artificial Sequence
  Description of Artificial Sequence: Synthetic oligonucleotide
tgaagtagatggtgggactgtcagtgaagagg

SEQ ID NO: 248055 - DNA, 31 bp, Artificial Sequence
  Description of Artificial Sequence: Synthetic oligonucleotide
gaagtagatggtgggactgtcagtgaagagg

SEQ ID NO: 248056 - DNA, 32 bp, Artificial Sequence
  Description of Artificial Sequence: Synthetic oligonucleotide
aagtagatggtgggactgtcagtgaagaggag

SEQ ID NO: 248057 - DNA, 31 bp, Artificial Sequence
  Description of Artificial Sequence: Synthetic oligonucleotide
agtagatggtgggactgtcagtgaagaggag

SEQ ID NO: 248058 - DNA, 30 bp, Artificial Sequence
  Description of Artificial Sequence: Synthetic oligonucleotide
gtagatggtgggactgtcagtgaagaggag

SEQ ID NO: 248059 - DNA, 30 bp, Artificial Sequence
  Description of Artificial Sequence: Synthetic oligonucleotide
tagatggtgggactgtcagtgaagaggagg

SEQ ID NO: 248060 - DNA, 29 bp, Artificial Sequence
  Description of Artificial Sequence: Synthetic oligonucleotide
agatggtgggactgtcagtgaagaggagg

SEQ ID NO: 248061 - DNA, 28 bp, Artificial Sequence
  Description of Artificial Sequence: Synthetic oligonucleotide
gatggtgggactgtcagtgaagaggagg

SEQ ID NO: 248062 - DNA, 30 bp, Artificial Sequence
  Description of Artificial Sequence: Synthetic oligonucleotide
atggtgggactgtcagtgaagaggaggtag

SEQ ID NO: 248063 - DNA, 29 bp, Artificial Sequence
  Description of Artificial Sequence: Synthetic oligonucleotide
tggtgggactgtcagtgaagaggaggtag

SEQ ID NO: 248064 - DNA, 28 bp, Artificial Sequence
  Description of Artificial Sequence: Synthetic oligonucleotide
ggtgggactgtcagtgaagaggaggtag

SEQ ID NO: 248065 - DNA, 29 bp, Artificial Sequence
  Description of Artificial Sequence: Synthetic oligonucleotide
gtgggactgtcagtgaagaggaggtagac

SEQ ID NO: 248066 - DNA, 30 bp, Artificial Sequence
  Description of Artificial Sequence: Synthetic oligonucleotide
tgggactgtcagtgaagaggaggtagacag

SEQ ID NO: 248067 - DNA, 29 bp, Artificial Sequence
  Description of Artificial Sequence: Synthetic oligonucleotide
gggactgtcagtgaagaggaggtagacag

SEQ ID NO: 248068 - DNA, 33 bp, Artificial Sequence
  Description of Artificial Sequence: Synthetic oligonucleotide
ggactgtcagtgaagaggaggtagacagaaatc

SEQ ID NO: 248069 - DNA, 33 bp, Artificial Sequence
  Description of Artificial Sequence: Synthetic oligonucleotide
gactgtcagtgaagaggaggtagacagaaatcc

SEQ ID NO: 248070 - DNA, 37 bp, Artificial Sequence
  Description of Artificial Sequence: Synthetic oligonucleotide
actgtcagtgaagaggaggtagacagaaatcctaaag

SEQ ID NO: 248071 - DNA, 36 bp, Artificial Sequence
  Description of Artificial Sequence: Synthetic oligonucleotide
ctgtcagtgaagaggaggtagacagaaatcctaaag

SEQ ID NO: 248072 - DNA, 36 bp, Artificial Sequence
  Description of Artificial Sequence: Synthetic oligonucleotide
tgtcagtgaagaggaggtagacagaaatcctaaagc

SEQ ID NO: 248073 - DNA, 35 bp, Artificial Sequence
  Description of Artificial Sequence: Synthetic oligonucleotide
gtcagtgaagaggaggtagacagaaatcctaaagc

SEQ ID NO: 248074 - DNA, 36 bp, Artificial Sequence
  Description of Artificial Sequence: Synthetic oligonucleotide
tcagtgaagaggaggtagacagaaatcctaaagcac

SEQ ID NO: 248075 - DNA, 35 bp, Artificial Sequence
  Description of Artificial Sequence: Synthetic oligonucleotide
cagtgaagaggaggtagacagaaatcctaaagcac

SEQ ID NO: 248076 - DNA, 36 bp, Artificial Sequence
  Description of Artificial Sequence: Synthetic oligonucleotide
agtgaagaggaggtagacagaaatcctaaagcacag

SEQ ID NO: 248077 - DNA, 35 bp, Artificial Sequence
  Description of Artificial Sequence: Synthetic oligonucleotide
gtgaagaggaggtagacagaaatcctaaagcacag

SEQ ID NO: 248078 - DNA, 35 bp, Artificial Sequence
  Description of Artificial Sequence: Synthetic oligonucleotide
tgaagaggaggtagacagaaatcctaaagcacagg

SEQ ID NO: 248079 - DNA, 34 bp, Artificial Sequence
  Description of Artificial Sequence: Synthetic oligonucleotide
gaagaggaggtagacagaaatcctaaagcacagg

SEQ ID NO: 248080 - DNA, 35 bp, Artificial Sequence
  Description of Artificial Sequence: Synthetic oligonucleotide
aagaggaggtagacagaaatcctaaagcacaggag

SEQ ID NO: 248081 - DNA, 34 bp, Artificial Sequence
  Description of Artificial Sequence: Synthetic oligonucleotide
agaggaggtagacagaaatcctaaagcacaggag

SEQ ID NO: 248082 - DNA, 33 bp, Artificial Sequence
  Description of Artificial Sequence: Synthetic oligonucleotide
gaggaggtagacagaaatcctaaagcacaggag

SEQ ID NO: 248083 - DNA, 33 bp, Artificial Sequence
  Description of Artificial Sequence: Synthetic oligonucleotide
aggaggtagacagaaatcctaaagcacaggagg

SEQ ID NO: 248084 - DNA, 32 bp, Artificial Sequence
  Description of Artificial Sequence: Synthetic oligonucleotide
ggaggtagacagaaatcctaaagcacaggagg

SEQ ID NO: 248085 - DNA, 34 bp, Artificial Sequence
  Description of Artificial Sequence: Synthetic oligonucleotide
gaggtagacagaaatcctaaagcacaggaggatg

SEQ ID NO: 248086 - DNA, 41 bp, Artificial Sequence
  Description of Artificial Sequence: Synthetic oligonucleotide
aggtagacagaaatcctaaagcacaggaggatgtaattttg

SEQ ID NO: 248087 - DNA, 40 bp, Artificial Sequence
  Description of Artificial Sequence: Synthetic oligonucleotide
ggtagacagaaatcctaaagcacaggaggatgtaattttg

SEQ ID NO: 248088 - DNA, 42 bp, Artificial Sequence
  Description of Artificial Sequence: Synthetic oligonucleotide
gtagacagaaatcctaaagcacaggaggatgtaattttgaag

SEQ ID NO: 248089 - DNA, 43 bp, Artificial Sequence
  Description of Artificial Sequence: Synthetic oligonucleotide
tagacagaaatcctaaagcacaggaggatgtaattttgaagag

SEQ ID NO: 248090 - DNA, 42 bp, Artificial Sequence
  Description of Artificial Sequence: Synthetic oligonucleotide
agacagaaatcctaaagcacaggaggatgtaattttgaagag

SEQ ID NO: 248091 - DNA, 41 bp, Artificial Sequence
  Description of Artificial Sequence: Synthetic oligonucleotide
gacagaaatcctaaagcacaggaggatgtaattttgaagag

SEQ ID NO: 248092 - DNA, 43 bp, Artificial Sequence
  Description of Artificial Sequence: Synthetic oligonucleotide
acagaaatcctaaagcacaggaggatgtaattttgaagagatc

SEQ ID NO: 248093 - DNA, 42 bp, Artificial Sequence
  Description of Artificial Sequence: Synthetic oligonucleotide
cagaaatcctaaagcacaggaggatgtaattttgaagagatc

SEQ ID NO: 248094 - DNA, 43 bp, Artificial Sequence
  Description of Artificial Sequence: Synthetic oligonucleotide
agaaatcctaaagcacaggaggatgtaattttgaagagatcac

SEQ ID NO: 248095 - DNA, 42 bp, Artificial Sequence
  Description of Artificial Sequence: Synthetic oligonucleotide
gaaatcctaaagcacaggaggatgtaattttgaagagatcac

SEQ ID NO: 248096 - DNA, 42 bp, Artificial Sequence
  Description of Artificial Sequence: Synthetic oligonucleotide
aaatcctaaagcacaggaggatgtaattttgaagagatcacc

SEQ ID NO: 248097 - DNA, 41 bp, Artificial Sequence
  Description of Artificial Sequence: Synthetic oligonucleotide
aatcctaaagcacaggaggatgtaattttgaagagatcacc

SEQ ID NO: 248098 - DNA, 40 bp, Artificial Sequence
  Description of Artificial Sequence: Synthetic oligonucleotide
atcctaaagcacaggaggatgtaattttgaagagatcacc

SEQ ID NO: 248099 - DNA, 39 bp, Artificial Sequence
  Description of Artificial Sequence: Synthetic oligonucleotide
tcctaaagcacaggaggatgtaattttgaagagatcacc

SEQ ID NO: 248100 - DNA, 38 bp, Artificial Sequence
  Description of Artificial Sequence: Synthetic oligonucleotide
cctaaagcacaggaggatgtaattttgaagagatcacc

SEQ ID NO: 248101 - DNA, 40 bp, Artificial Sequence
  Description of Artificial Sequence: Synthetic oligonucleotide
ctaaagcacaggaggatgtaattttgaagagatcaccatg

SEQ ID NO: 248102 - DNA, 43 bp, Artificial Sequence
  Description of Artificial Sequence: Synthetic oligonucleotide
taaagcacaggaggatgtaattttgaagagatcaccatgaaac

SEQ ID NO: 248103 - DNA, 42 bp, Artificial Sequence
  Description of Artificial Sequence: Synthetic oligonucleotide
aaagcacaggaggatgtaattttgaagagatcaccatgaaac

SEQ ID NO: 248104 - DNA, 41 bp, Artificial Sequence
  Description of Artificial Sequence: Synthetic oligonucleotide
aagcacaggaggatgtaattttgaagagatcaccatgaaac

SEQ ID NO: 248105 - DNA, 40 bp, Artificial Sequence
  Description of Artificial Sequence: Synthetic oligonucleotide
agcacaggaggatgtaattttgaagagatcaccatgaaac

SEQ ID NO: 248106 - DNA, 39 bp, Artificial Sequence
  Description of Artificial Sequence: Synthetic oligonucleotide
gcacaggaggatgtaattttgaagagatcaccatgaaac

SEQ ID NO: 248107 - DNA, 40 bp, Artificial Sequence
  Description of Artificial Sequence: Synthetic oligonucleotide
cacaggaggatgtaattttgaagagatcaccatgaaacag

SEQ ID NO: 248108 - DNA, 43 bp, Artificial Sequence
  Description of Artificial Sequence: Synthetic oligonucleotide
acaggaggatgtaattttgaagagatcaccatgaaacagaatg

SEQ ID NO: 248109 - DNA, 42 bp, Artificial Sequence
  Description of Artificial Sequence: Synthetic oligonucleotide
caggaggatgtaattttgaagagatcaccatgaaacagaatg

SEQ ID NO: 248110 - DNA, 42 bp, Artificial Sequence
  Description of Artificial Sequence: Synthetic oligonucleotide
aggaggatgtaattttgaagagatcaccatgaaacagaatgc

SEQ ID NO: 248111 - DNA, 41 bp, Artificial Sequence
  Description of Artificial Sequence: Synthetic oligonucleotide
ggaggatgtaattttgaagagatcaccatgaaacagaatgc

SEQ ID NO: 248112 - DNA, 41 bp, Artificial Sequence
  Description of Artificial Sequence: Synthetic oligonucleotide
gaggatgtaattttgaagagatcaccatgaaacagaatgcc

SEQ ID NO: 248113 - DNA, 42 bp, Artificial Sequence
  Description of Artificial Sequence: Synthetic oligonucleotide
aggatgtaattttgaagagatcaccatgaaacagaatgccac

SEQ ID NO: 248114 - DNA, 41 bp, Artificial Sequence
  Description of Artificial Sequence: Synthetic oligonucleotide
ggatgtaattttgaagagatcaccatgaaacagaatgccac

SEQ ID NO: 248115 - DNA, 41 bp, Artificial Sequence
  Description of Artificial Sequence: Synthetic oligonucleotide
gatgtaattttgaagagatcaccatgaaacagaatgccacg

SEQ ID NO: 248116 - DNA, 43 bp, Artificial Sequence
  Description of Artificial Sequence: Synthetic oligonucleotide
atgtaattttgaagagatcaccatgaaacagaatgccacgaag

SEQ ID NO: 248117 - DNA, 42 bp, Artificial Sequence
  Description of Artificial Sequence: Synthetic oligonucleotide
tgtaattttgaagagatcaccatgaaacagaatgccacgaag

SEQ ID NO: 248118 - DNA, 41 bp, Artificial Sequence
  Description of Artificial Sequence: Synthetic oligonucleotide
gtaattttgaagagatcaccatgaaacagaatgccacgaag

SEQ ID NO: 248119 - DNA, 42 bp, Artificial Sequence
  Description of Artificial Sequence: Synthetic oligonucleotide
taattttgaagagatcaccatgaaacagaatgccacgaagtg

SEQ ID NO: 248120 - DNA, 41 bp, Artificial Sequence
  Description of Artificial Sequence: Synthetic oligonucleotide
aattttgaagagatcaccatgaaacagaatgccacgaagtg

SEQ ID NO: 248121 - DNA, 40 bp, Artificial Sequence
  Description of Artificial Sequence: Synthetic oligonucleotide
attttgaagagatcaccatgaaacagaatgccacgaagtg

SEQ ID NO: 248122 - DNA, 39 bp, Artificial Sequence
  Description of Artificial Sequence: Synthetic oligonucleotide
ttttgaagagatcaccatgaaacagaatgccacgaagtg

SEQ ID NO: 248123 - DNA, 38 bp, Artificial Sequence
  Description of Artificial Sequence: Synthetic oligonucleotide
tttgaagagatcaccatgaaacagaatgccacgaagtg

SEQ ID NO: 248124 - DNA, 37 bp, Artificial Sequence
  Description of Artificial Sequence: Synthetic oligonucleotide
ttgaagagatcaccatgaaacagaatgccacgaagtg

SEQ ID NO: 248125 - DNA, 36 bp, Artificial Sequence
  Description of Artificial Sequence: Synthetic oligonucleotide
tgaagagatcaccatgaaacagaatgccacgaagtg

SEQ ID NO: 248126 - DNA, 35 bp, Artificial Sequence
  Description of Artificial Sequence: Synthetic oligonucleotide
gaagagatcaccatgaaacagaatgccacgaagtg

SEQ ID NO: 248127 - DNA, 36 bp, Artificial Sequence
  Description of Artificial Sequence: Synthetic oligonucleotide
aagagatcaccatgaaacagaatgccacgaagtgag

SEQ ID NO: 248128 - DNA, 35 bp, Artificial Sequence
  Description of Artificial Sequence: Synthetic oligonucleotide
agagatcaccatgaaacagaatgccacgaagtgag

SEQ ID NO: 248129 - DNA, 34 bp, Artificial Sequence
  Description of Artificial Sequence: Synthetic oligonucleotide
gagatcaccatgaaacagaatgccacgaagtgag

SEQ ID NO: 248130 - DNA, 35 bp, Artificial Sequence
  Description of Artificial Sequence: Synthetic oligonucleotide
agatcaccatgaaacagaatgccacgaagtgagtg

SEQ ID NO: 248131 - DNA, 34 bp, Artificial Sequence
  Description of Artificial Sequence: Synthetic oligonucleotide
gatcaccatgaaacagaatgccacgaagtgagtg

SEQ ID NO: 248132 - DNA, 26 bp, Artificial Sequence
  Description of Artificial Sequence: Synthetic oligonucleotide
atgctgctaaccgtgccgcagctgct

SEQ ID NO: 248133 - DNA, 25 bp, Artificial Sequence
  Description of Artificial Sequence: Synthetic oligonucleotide
tgctgctaaccgtgccgcagctgct

SEQ ID NO: 248134 - DNA, 24 bp, Artificial Sequence
  Description of Artificial Sequence: Synthetic oligonucleotide
gctgctaaccgtgccgcagctgct

SEQ ID NO: 248135 - DNA, 24 bp, Artificial Sequence
  Description of Artificial Sequence: Synthetic oligonucleotide
ctgctaaccgtgccgcagctgctc

SEQ ID NO: 248136 - DNA, 24 bp, Artificial Sequence
  Description of Artificial Sequence: Synthetic oligonucleotide
tgctaaccgtgccgcagctgctcg

SEQ ID NO: 248137 - DNA, 23 bp, Artificial Sequence
  Description of Artificial Sequence: Synthetic oligonucleotide
gctaaccgtgccgcagctgctcg

SEQ ID NO: 248138 - DNA, 23 bp, Artificial Sequence
  Description of Artificial Sequence: Synthetic oligonucleotide
ctaaccgtgccgcagctgctcgg

SEQ ID NO: 248139 - DNA, 23 bp, Artificial Sequence
  Description of Artificial Sequence: Synthetic oligonucleotide
taaccgtgccgcagctgctcggg

SEQ ID NO: 248140 - DNA, 22 bp, Artificial Sequence
  Description of Artificial Sequence: Synthetic oligonucleotide
aaccgtgccgcagctgctcggg

SEQ ID NO: 248141 - DNA, 21 bp, Artificial Sequence
  Description of Artificial Sequence: Synthetic oligonucleotide
accgtgccgcagctgctcggg

SEQ ID NO: 248142 - DNA, 20 bp, Artificial Sequence
  Description of Artificial Sequence: Synthetic oligonucleotide
ccgtgccgcagctgctcggg

SEQ ID NO: 248143 - DNA, 21 bp, Artificial Sequence
  Description of Artificial Sequence: Synthetic oligonucleotide
cgtgccgcagctgctcgggct

SEQ ID NO: 248144 - DNA, 21 bp, Artificial Sequence
  Description of Artificial Sequence: Synthetic oligonucleotide
gtgccgcagctgctcgggctc

SEQ ID NO: 248145 - DNA, 22 bp, Artificial Sequence
  Description of Artificial Sequence: Synthetic oligonucleotide
tgccgcagctgctcgggctcct

SEQ ID NO: 248146 - DNA, 21 bp, Artificial Sequence
  Description of Artificial Sequence: Synthetic oligonucleotide
gccgcagctgctcgggctcct

SEQ ID NO: 248147 - DNA, 21 bp, Artificial Sequence
  Description of Artificial Sequence: Synthetic oligonucleotide
ccgcagctgctcgggctcctc

SEQ ID NO: 248148 - DNA, 21 bp, Artificial Sequence
  Description of Artificial Sequence: Synthetic oligonucleotide
cgcagctgctcgggctcctcg

SEQ ID NO: 248149 - DNA, 21 bp, Artificial Sequence
  Description of Artificial Sequence: Synthetic oligonucleotide
gcagctgctcgggctcctcgg

SEQ ID NO: 248150 - DNA, 21 bp, Artificial Sequence
  Description of Artificial Sequence: Synthetic oligonucleotide
cagctgctcgggctcctcggc

SEQ ID NO: 248151 - DNA, 22 bp, Artificial Sequence
  Description of Artificial Sequence: Synthetic oligonucleotide
agctgctcgggctcctcggcgt

SEQ ID NO: 248152 - DNA, 21 bp, Artificial Sequence
  Description of Artificial Sequence: Synthetic oligonucleotide
gctgctcgggctcctcggcgt

SEQ ID NO: 248153 - DNA, 21 bp, Artificial Sequence
  Description of Artificial Sequence: Synthetic oligonucleotide
ctgctcgggctcctcggcgtg

SEQ ID NO: 248154 - DNA, 21 bp, Artificial Sequence
  Description of Artificial Sequence: Synthetic oligonucleotide
tgctcgggctcctcggcgtgg

SEQ ID NO: 248155 - DNA, 20 bp, Artificial Sequence
  Description of Artificial Sequence: Synthetic oligonucleotide
gctcgggctcctcggcgtgg

SEQ ID NO: 248156 - DNA, 20 bp, Artificial Sequence
  Description of Artificial Sequence: Synthetic oligonucleotide
ctcgggctcctcggcgtggc

SEQ ID NO: 248157 - DNA, 20 bp, Artificial Sequence
  Description of Artificial Sequence: Synthetic oligonucleotide
tcgggctcctcggcgtggcc

SEQ ID NO: 248158 - DNA, 20 bp, Artificial Sequence
  Description of Artificial Sequence: Synthetic oligonucleotide
cgggctcctcggcgtggcct

SEQ ID NO: 248159 - DNA, 20 bp, Artificial Sequence
  Description of Artificial Sequence: Synthetic oligonucleotide
gggctcctcggcgtggccgt

SEQ ID NO: 248160 - DNA, 20 bp, Artificial Sequence
  Description of Artificial Sequence: Synthetic oligonucleotide
ggctcctcggcgtggccgtc

SEQ ID NO: 248161 - DNA, 20 bp, Artificial Sequence
  Description of Artificial Sequence: Synthetic oligonucleotide
gctcctcggcgtggccgtcg

SEQ ID NO: 248162 - DNA, 20 bp, Artificial Sequence
  Description of Artificial Sequence: Synthetic oligonucleotide
ctcctcggcgtggccgtcgg

SEQ ID NO: 248163 - DNA, 20 bp, Artificial Sequence
  Description of Artificial Sequence: Synthetic oligonucleotide
tcctcggcgtggccgtcggc

SEQ ID NO: 248164 - DNA, 20 bp, Artificial Sequence
  Description of Artificial Sequence: Synthetic oligonucleotide
cctcggcgtggccgtcggct

SEQ ID NO: 248165 - DNA, 20 bp, Artificial Sequence
  Description of Artificial Sequence: Synthetic oligonucleotide
ctcggcgtggccgtcggcga

SEQ ID NO: 248166 - DNA, 20 bp, Artificial Sequence
  Description of Artificial Sequence: Synthetic oligonucleotide
tcggcgtggccgtcggcgag

SEQ ID NO: 248167 - DNA, 20 bp, Artificial Sequence
  Description of Artificial Sequence: Synthetic oligonucleotide
cggcgtggccgtcggcgagt

SEQ ID NO: 248168 - DNA, 20 bp, Artificial Sequence
  Description of Artificial Sequence: Synthetic oligonucleotide
ggcgtggccgtcggcgagct

SEQ ID NO: 248169 - DNA, 20 bp, Artificial Sequence
  Description of Artificial Sequence: Synthetic oligonucleotide
gcgtggccgtcggcgagcct

SEQ ID NO: 248170 - DNA, 20 bp, Artificial Sequence
  Description of Artificial Sequence: Synthetic oligonucleotide
cgtggccgtcggcgagcctg

SEQ ID NO: 248171 - DNA, 20 bp, Artificial Sequence
  Description of Artificial Sequence: Synthetic oligonucleotide
gtggccgtcggcgagcctgc

SEQ ID NO: 248172 - DNA, 20 bp, Artificial Sequence
  Description of Artificial Sequence: Synthetic oligonucleotide
tggccgtcggcgagcctgcg

SEQ ID NO: 248173 - DNA, 20 bp, Artificial Sequence
  Description of Artificial Sequence: Synthetic oligonucleotide
ggccgtcggcgagcctgcgt

SEQ ID NO: 248174 - DNA, 20 bp, Artificial Sequence
  Description of Artificial Sequence: Synthetic oligonucleotide
gccgtcggcgagcctgcggt

SEQ ID NO: 248175 - DNA, 22 bp, Artificial Sequence
  Description of Artificial Sequence: Synthetic oligonucleotide
ccgtcggcgagcctgcggtcta

SEQ ID NO: 248176 - DNA, 24 bp, Artificial Sequence
  Description of Artificial Sequence: Synthetic oligonucleotide
cgtcggcgagcctgcggtctactt

SEQ ID NO: 248177 - DNA, 26 bp, Artificial Sequence
  Description of Artificial Sequence: Synthetic oligonucleotide
gtcggcgagcctgcggtctacttcta

SEQ ID NO: 248178 - DNA, 26 bp, Artificial Sequence
  Description of Artificial Sequence: Synthetic oligonucleotide
tcggcgagcctgcggtctacttctag

SEQ ID NO: 248179 - DNA, 25 bp, Artificial Sequence
  Description of Artificial Sequence: Synthetic oligonucleotide
cggcgagcctgcggtctacttctag

SEQ ID NO: 248180 - DNA, 26 bp, Artificial Sequence
  Description of Artificial Sequence: Synthetic oligonucleotide
ggcgagcctgcggtctacttctagga

SEQ ID NO: 248181 - DNA, 26 bp, Artificial Sequence
  Description of Artificial Sequence: Synthetic oligonucleotide
gcgagcctgcggtctacttctaggag

SEQ ID NO: 248182 - DNA, 27 bp, Artificial Sequence
  Description of Artificial Sequence: Synthetic oligonucleotide
cgagcctgcggtctacttctaggagca

SEQ ID NO: 248183 - DNA, 27 bp, Artificial Sequence
  Description of Artificial Sequence: Synthetic oligonucleotide
gagcctgcggtctacttctaggagcag

SEQ ID NO: 248184 - DNA, 30 bp, Artificial Sequence
  Description of Artificial Sequence: Synthetic oligonucleotide
agcctgcggtctacttctaggagcagtatc

SEQ ID NO: 248185 - DNA, 29 bp, Artificial Sequence
  Description of Artificial Sequence: Synthetic oligonucleotide
gcctgcggtctacttctaggagcagtatc

SEQ ID NO: 248186 - DNA, 30 bp, Artificial Sequence
  Description of Artificial Sequence: Synthetic oligonucleotide
cctgcggtctacttctaggagcagtatctg

SEQ ID NO: 248187 - DNA, 30 bp, Artificial Sequence
  Description of Artificial Sequence: Synthetic oligonucleotide
ctgcggtctacttctaggagcagtatctgg

SEQ ID NO: 248188 - DNA, 31 bp, Artificial Sequence
  Description of Artificial Sequence: Synthetic oligonucleotide
tgcggtctacttctaggagcagtatctggac

SEQ ID NO: 248189 - DNA, 30 bp, Artificial Sequence
  Description of Artificial Sequence: Synthetic oligonucleotide
gcggtctacttctaggagcagtatctggac

SEQ ID NO: 248190 - DNA, 30 bp, Artificial Sequence
  Description of Artificial Sequence: Synthetic oligonucleotide
cggtctacttctaggagcagtatctggacg

SEQ ID NO: 248191 - DNA, 30 bp, Artificial Sequence
  Description of Artificial Sequence: Synthetic oligonucleotide
ggtctacttctaggagcagtatctggacgg

SEQ ID NO: 248192 - DNA, 31 bp, Artificial Sequence
  Description of Artificial Sequence: Synthetic oligonucleotide
gtctacttctaggagcagtatctggacggtg

SEQ ID NO: 248193 - DNA, 32 bp, Artificial Sequence
  Description of Artificial Sequence: Synthetic oligonucleotide
tctacttctaggagcagtatctggacggtgac

SEQ ID NO: 248194 - DNA, 31 bp, Artificial Sequence
  Description of Artificial Sequence: Synthetic oligonucleotide
ctacttctaggagcagtatctggacggtgac

SEQ ID NO: 248195 - DNA, 31 bp, Artificial Sequence
  Description of Artificial Sequence: Synthetic oligonucleotide
tacttctaggagcagtatctggacggtgacg

SEQ ID NO: 248196 - DNA, 30 bp, Artificial Sequence
  Description of Artificial Sequence: Synthetic oligonucleotide
acttctaggagcagtatctggacggtgacg

SEQ ID NO: 248197 - DNA, 29 bp, Artificial Sequence
  Description of Artificial Sequence: Synthetic oligonucleotide
cttctaggagcagtatctggacggtgacg

SEQ ID NO: 248198 - DNA, 29 bp, Artificial Sequence
  Description of Artificial Sequence: Synthetic oligonucleotide
ttctaggagcagtatctggacggtgacgg

SEQ ID NO: 248199 - DNA, 28 bp, Artificial Sequence
  Description of Artificial Sequence: Synthetic oligonucleotide
tctaggagcagtatctggacggtgacgg

SEQ ID NO: 248200 - DNA, 27 bp, Artificial Sequence
  Description of Artificial Sequence: Synthetic oligonucleotide
ctaggagcagtatctggacggtgacgg

SEQ ID NO: 248201 - DNA, 27 bp, Artificial Sequence
  Description of Artificial Sequence: Synthetic oligonucleotide
taggagcagtatctggacggtgacggg

SEQ ID NO: 248202 - DNA, 27 bp, Artificial Sequence
  Description of Artificial Sequence: Synthetic oligonucleotide
aggagcagtatctggacggtgacgggt

SEQ ID NO: 248203 - DNA, 26 bp, Artificial Sequence
  Description of Artificial Sequence: Synthetic oligonucleotide
ggagcagtatctggacggtgacgggt

SEQ ID NO: 248204 - DNA, 26 bp, Artificial Sequence
  Description of Artificial Sequence: Synthetic oligonucleotide
gagcagtatctggacggtgacgggtg

SEQ ID NO: 248205 - DNA, 27 bp, Artificial Sequence
  Description of Artificial Sequence: Synthetic oligonucleotide
agcagtatctggacggtgacgggtggt

SEQ ID NO: 248206 - DNA, 26 bp, Artificial Sequence
  Description of Artificial Sequence: Synthetic oligonucleotide
gcagtatctggacggtgacgggtggt

SEQ ID NO: 248207 - DNA, 27 bp, Artificial Sequence
  Description of Artificial Sequence: Synthetic oligonucleotide
cagtatctggacggtgacgggtggtct

SEQ ID NO: 248208 - DNA, 28 bp, Artificial Sequence
  Description of Artificial Sequence: Synthetic oligonucleotide
agtatctggacggtgacgggtggtcttc

SEQ ID NO: 248209 - DNA, 27 bp, Artificial Sequence
  Description of Artificial Sequence: Synthetic oligonucleotide
gtatctggacggtgacgggtggtcttc

SEQ ID NO: 248210 - DNA, 27 bp, Artificial Sequence
  Description of Artificial Sequence: Synthetic oligonucleotide
tatctggacggtgacgggtggtcttcc

SEQ ID NO: 248211 - DNA, 26 bp, Artificial Sequence
  Description of Artificial Sequence: Synthetic oligonucleotide
atctggacggtgacgggtggtcttcc

SEQ ID NO: 248212 - DNA, 25 bp, Artificial Sequence
  Description of Artificial Sequence: Synthetic oligonucleotide
tctggacggtgacgggtggtcttcc

SEQ ID NO: 248213 - DNA, 24 bp, Artificial Sequence
  Description of Artificial Sequence: Synthetic oligonucleotide
ctggacggtgacgggtggtcttcc

SEQ ID NO: 248214 - DNA, 24 bp, Artificial Sequence
  Description of Artificial Sequence: Synthetic oligonucleotide
tggacggtgacgggtggtcttccc

SEQ ID NO: 248215 - DNA, 23 bp, Artificial Sequence
  Description of Artificial Sequence: Synthetic oligonucleotide
ggacggtgacgggtggtcttccc

SEQ ID NO: 248216 - DNA, 23 bp, Artificial Sequence
  Description of Artificial Sequence: Synthetic oligonucleotide
gacggtgacgggtggtcttcccg

SEQ ID NO: 248217 - DNA, 24 bp, Artificial Sequence
  Description of Artificial Sequence: Synthetic oligonucleotide
acggtgacgggtggtcttcccgct

SEQ ID NO: 248218 - DNA, 23 bp, Artificial Sequence
  Description of Artificial Sequence: Synthetic oligonucleotide
cggtgacgggtggtcttcccgct

SEQ ID NO: 248219 - DNA, 23 bp, Artificial Sequence
  Description of Artificial Sequence: Synthetic oligonucleotide
ggtgacgggtggtcttcccgctc

SEQ ID NO: 248220 - DNA, 25 bp, Artificial Sequence
  Description of Artificial Sequence: Synthetic oligonucleotide
gtgacgggtggtcttcccgctcgat

SEQ ID NO: 248221 - DNA, 25 bp, Artificial Sequence
  Description of Artificial Sequence: Synthetic oligonucleotide
tgacgggtggtcttcccgctcgatc

SEQ ID NO: 248222 - DNA, 24 bp, Artificial Sequence
  Description of Artificial Sequence: Synthetic oligonucleotide
gacgggtggtcttcccgctcgatc

SEQ ID NO: 248223 - DNA, 27 bp, Artificial Sequence
  Description of Artificial Sequence: Synthetic oligonucleotide
acgggtggtcttcccgctcgatcgaat

SEQ ID NO: 248224 - DNA, 26 bp, Artificial Sequence
  Description of Artificial Sequence: Synthetic oligonucleotide
cgggtggtcttcccgctcgatcgaat

SEQ ID NO: 248225 - DNA, 26 bp, Artificial Sequence
  Description of Artificial Sequence: Synthetic oligonucleotide
gggtggtcttcccgctcgatcgaatc

SEQ ID NO: 248226 - DNA, 27 bp, Artificial Sequence
  Description of Artificial Sequence: Synthetic oligonucleotide
ggtggtcttcccgctcgatcgaatcga

SEQ ID NO: 248227 - DNA, 29 bp, Artificial Sequence
  Description of Artificial Sequence: Synthetic oligonucleotide
gtggtcttcccgctcgatcgaatcgaaac

SEQ ID NO: 248228 - DNA, 30 bp, Artificial Sequence
  Description of Artificial Sequence: Synthetic oligonucleotide
tggtcttcccgctcgatcgaatcgaaacac

SEQ ID NO: 248229 - DNA, 29 bp, Artificial Sequence
  Description of Artificial Sequence: Synthetic oligonucleotide
ggtcttcccgctcgatcgaatcgaaacac

SEQ ID NO: 248230 - DNA, 31 bp, Artificial Sequence
  Description of Artificial Sequence: Synthetic oligonucleotide
gtcttcccgctcgatcgaatcgaaacacaag

SEQ ID NO: 248231 - DNA, 32 bp, Artificial Sequence
  Description of Artificial Sequence: Synthetic oligonucleotide
tcttcccgctcgatcgaatcgaaacacaagac

SEQ ID NO: 248232 - DNA, 31 bp, Artificial Sequence
  Description of Artificial Sequence: Synthetic oligonucleotide
cttcccgctcgatcgaatcgaaacacaagac

SEQ ID NO: 248233 - DNA, 32 bp, Artificial Sequence
  Description of Artificial Sequence: Synthetic oligonucleotide
ttcccgctcgatcgaatcgaaacacaagacag

SEQ ID NO: 248234 - DNA, 31 bp, Artificial Sequence
  Description of Artificial Sequence: Synthetic oligonucleotide
tcccgctcgatcgaatcgaaacacaagacag

SEQ ID NO: 248235 - DNA, 30 bp, Artificial Sequence
  Description of Artificial Sequence: Synthetic oligonucleotide
cccgctcgatcgaatcgaaacacaagacag

SEQ ID NO: 248236 - DNA, 35 bp, Artificial Sequence
  Description of Artificial Sequence: Synthetic oligonucleotide
ccgctcgatcgaatcgaaacacaagacagattttg

SEQ ID NO: 248237 - DNA, 35 bp, Artificial Sequence
  Description of Artificial Sequence: Synthetic oligonucleotide
cgctcgatcgaatcgaaacacaagacagattttgc

SEQ ID NO: 248238 - DNA, 35 bp, Artificial Sequence
  Description of Artificial Sequence: Synthetic oligonucleotide
gctcgatcgaatcgaaacacaagacagattttgcc

SEQ ID NO: 248239 - DNA, 40 bp, Artificial Sequence
  Description of Artificial Sequence: Synthetic oligonucleotide
ctcgatcgaatcgaaacacaagacagattttgccaaattc

SEQ ID NO: 248240 - DNA, 40 bp, Artificial Sequence
  Description of Artificial Sequence: Synthetic oligonucleotide
tcgatcgaatcgaaacacaagacagattttgccaaattcg

SEQ ID NO: 248241 - DNA, 39 bp, Artificial Sequence
  Description of Artificial Sequence: Synthetic oligonucleotide
cgatcgaatcgaaacacaagacagattttgccaaattcg

SEQ ID NO: 248242 - DNA, 41 bp, Artificial Sequence
  Description of Artificial Sequence: Synthetic oligonucleotide
gatcgaatcgaaacacaagacagattttgccaaattcgtac

SEQ ID NO: 248243 - DNA, 42 bp, Artificial Sequence
  Description of Artificial Sequence: Synthetic oligonucleotide
atcgaatcgaaacacaagacagattttgccaaattcgtactc

SEQ ID NO: 248244 - DNA, 41 bp, Artificial Sequence
  Description of Artificial Sequence: Synthetic oligonucleotide
tcgaatcgaaacacaagacagattttgccaaattcgtactc

SEQ ID NO: 248245 - DNA, 40 bp, Artificial Sequence
  Description of Artificial Sequence: Synthetic oligonucleotide
cgaatcgaaacacaagacagattttgccaaattcgtactc

SEQ ID NO: 248246 - DNA, 41 bp, Artificial Sequence
  Description of Artificial Sequence: Synthetic oligonucleotide
gaatcgaaacacaagacagattttgccaaattcgtactcag

SEQ ID NO: 248247 - DNA, 43 bp, Artificial Sequence
  Description of Artificial Sequence: Synthetic oligonucleotide
aatcgaaacacaagacagattttgccaaattcgtactcagttc

SEQ ID NO: 248248 - DNA, 42 bp, Artificial Sequence
  Description of Artificial Sequence: Synthetic oligonucleotide
atcgaaacacaagacagattttgccaaattcgtactcagttc

SEQ ID NO: 248249 - DNA, 41 bp, Artificial Sequence
  Description of Artificial Sequence: Synthetic oligonucleotide
tcgaaacacaagacagattttgccaaattcgtactcagttc

SEQ ID NO: 248250 - DNA, 40 bp, Artificial Sequence
  Description of Artificial Sequence: Synthetic oligonucleotide
cgaaacacaagacagattttgccaaattcgtactcagttc

SEQ ID NO: 248251 - DNA, 40 bp, Artificial Sequence
  Description of Artificial Sequence: Synthetic oligonucleotide
gaaacacaagacagattttgccaaattcgtactcagttcc

SEQ ID NO: 248252 - DNA, 40 bp, Artificial Sequence
  Description of Artificial Sequence: Synthetic oligonucleotide
aaacacaagacagattttgccaaattcgtactcagttccc

SEQ ID NO: 248253 - DNA, 39 bp, Artificial Sequence
  Description of Artificial Sequence: Synthetic oligonucleotide
aacacaagacagattttgccaaattcgtactcagttccc

SEQ ID NO: 248254 - DNA, 38 bp, Artificial Sequence
  Description of Artificial Sequence: Synthetic oligonucleotide
acacaagacagattttgccaaattcgtactcagttccc

SEQ ID NO: 248255 - DNA, 37 bp, Artificial Sequence
  Description of Artificial Sequence: Synthetic oligonucleotide
cacaagacagattttgccaaattcgtactcagttccc

SEQ ID NO: 248256 - DNA, 37 bp, Artificial Sequence
  Description of Artificial Sequence: Synthetic oligonucleotide
acaagacagattttgccaaattcgtactcagttcccg

SEQ ID NO: 248257 - DNA, 36 bp, Artificial Sequence
  Description of Artificial Sequence: Synthetic oligonucleotide
caagacagattttgccaaattcgtactcagttcccg

SEQ ID NO: 248258 - DNA, 36 bp, Artificial Sequence
  Description of Artificial Sequence: Synthetic oligonucleotide
aagacagattttgccaaattcgtactcagttcccgc

SEQ ID NO: 248259 - DNA, 35 bp, Artificial Sequence
  Description of Artificial Sequence: Synthetic oligonucleotide
agacagattttgccaaattcgtactcagttcccgc

SEQ ID NO: 248260 - DNA, 34 bp, Artificial Sequence
  Description of Artificial Sequence: Synthetic oligonucleotide
gacagattttgccaaattcgtactcagttcccgc

SEQ ID NO: 248261 - DNA, 36 bp, Artificial Sequence
  Description of Artificial Sequence: Synthetic oligonucleotide
acagattttgccaaattcgtactcagttcccgcaag

SEQ ID NO: 248262 - DNA, 35 bp, Artificial Sequence
  Description of Artificial Sequence: Synthetic oligonucleotide
cagattttgccaaattcgtactcagttcccgcaag

SEQ ID NO: 248263 - DNA, 37 bp, Artificial Sequence
  Description of Artificial Sequence: Synthetic oligonucleotide
agattttgccaaattcgtactcagttcccgcaagttc

SEQ ID NO: 248264 - DNA, 36 bp, Artificial Sequence
  Description of Artificial Sequence: Synthetic oligonucleotide
gattttgccaaattcgtactcagttcccgcaagttc

SEQ ID NO: 248265 - DNA, 38 bp, Artificial Sequence
  Description of Artificial Sequence: Synthetic oligonucleotide
attttgccaaattcgtactcagttcccgcaagttcttc

SEQ ID NO: 248266 - DNA, 37 bp, Artificial Sequence
  Description of Artificial Sequence: Synthetic oligonucleotide
ttttgccaaattcgtactcagttcccgcaagttcttc

SEQ ID NO: 248267 - DNA, 36 bp, Artificial Sequence
  Description of Artificial Sequence: Synthetic oligonucleotide
tttgccaaattcgtactcagttcccgcaagttcttc

SEQ ID NO: 248268 - DNA, 35 bp, Artificial Sequence
  Description of Artificial Sequence: Synthetic oligonucleotide
ttgccaaattcgtactcagttcccgcaagttcttc

SEQ ID NO: 248269 - DNA, 34 bp, Artificial Sequence
  Description of Artificial Sequence: Synthetic oligonucleotide
tgccaaattcgtactcagttcccgcaagttcttc

SEQ ID NO: 248270 - DNA, 33 bp, Artificial Sequence
  Description of Artificial Sequence: Synthetic oligonucleotide
gccaaattcgtactcagttcccgcaagttcttc

SEQ ID NO: 248271 - DNA, 33 bp, Artificial Sequence
  Description of Artificial Sequence: Synthetic oligonucleotide
ccaaattcgtactcagttcccgcaagttcttcg

SEQ ID NO: 248272 - DNA, 33 bp, Artificial Sequence
  Description of Artificial Sequence: Synthetic oligonucleotide
caaattcgtactcagttcccgcaagttcttcgg

SEQ ID NO: 248273 - DNA, 34 bp, Artificial Sequence
  Description of Artificial Sequence: Synthetic oligonucleotide
aaattcgtactcagttcccgcaagttcttcggtg

SEQ ID NO: 248274 - DNA, 33 bp, Artificial Sequence
  Description of Artificial Sequence: Synthetic oligonucleotide
aattcgtactcagttcccgcaagttcttcggtg

SEQ ID NO: 248275 - DNA, 32 bp, Artificial Sequence
  Description of Artificial Sequence: Synthetic oligonucleotide
attcgtactcagttcccgcaagttcttcggtg

SEQ ID NO: 248276 - DNA, 31 bp, Artificial Sequence
  Description of Artificial Sequence: Synthetic oligonucleotide
ttcgtactcagttcccgcaagttcttcggtg

SEQ ID NO: 248277 - DNA, 30 bp, Artificial Sequence
  Description of Artificial Sequence: Synthetic oligonucleotide
tcgtactcagttcccgcaagttcttcggtg

SEQ ID NO: 248278 - DNA, 29 bp, Artificial Sequence
  Description of Artificial Sequence: Synthetic oligonucleotide
cgtactcagttcccgcaagttcttcggtg

SEQ ID NO: 248279 - DNA, 30 bp, Artificial Sequence
  Description of Artificial Sequence: Synthetic oligonucleotide
gtactcagttcccgcaagttcttcggtgac

SEQ ID NO: 248280 - DNA, 30 bp, Artificial Sequence
  Description of Artificial Sequence: Synthetic oligonucleotide
tactcagttcccgcaagttcttcggtgacg

SEQ ID NO: 248281 - DNA, 29 bp, Artificial Sequence
  Description of Artificial Sequence: Synthetic oligonucleotide
actcagttcccgcaagttcttcggtgacg

SEQ ID NO: 248282 - DNA, 28 bp, Artificial Sequence
  Description of Artificial Sequence: Synthetic oligonucleotide
ctcagttcccgcaagttcttcggtgacg

SEQ ID NO: 248283 - DNA, 29 bp, Artificial Sequence
  Description of Artificial Sequence: Synthetic oligonucleotide
tcagttcccgcaagttcttcggtgacgac

SEQ ID NO: 248284 - DNA, 28 bp, Artificial Sequence
  Description of Artificial Sequence: Synthetic oligonucleotide
cagttcccgcaagttcttcggtgacgac

SEQ ID NO: 248285 - DNA, 28 bp, Artificial Sequence
  Description of Artificial Sequence: Synthetic oligonucleotide
agttcccgcaagttcttcggtgacgacg

SEQ ID NO: 248286 - DNA, 27 bp, Artificial Sequence
  Description of Artificial Sequence: Synthetic oligonucleotide
gttcccgcaagttcttcggtgacgacg

SEQ ID NO: 248287 - DNA, 28 bp, Artificial Sequence
  Description of Artificial Sequence: Synthetic oligonucleotide
ttcccgcaagttcttcggtgacgacgag

SEQ ID NO: 248288 - DNA, 27 bp, Artificial Sequence
  Description of Artificial Sequence: Synthetic oligonucleotide
tcccgcaagttcttcggtgacgacgag

SEQ ID NO: 248289 - DNA, 27 bp, Artificial Sequence
  Description of Artificial Sequence: Synthetic oligonucleotide
cccgcaagttcttcggtgacgacgaga

SEQ ID NO: 248290 - DNA, 29 bp, Artificial Sequence
  Description of Artificial Sequence: Synthetic oligonucleotide
ccgcaagttcttcggtgacgacgagaaag

SEQ ID NO: 248291 - DNA, 34 bp, Artificial Sequence
  Description of Artificial Sequence: Synthetic oligonucleotide
cgcaagttcttcggtgacgacgagaaagattaag

SEQ ID NO: 248292 - DNA, 34 bp, Artificial Sequence
  Description of Artificial Sequence: Synthetic oligonucleotide
gcaagttcttcggtgacgacgagaaagattaagg

SEQ ID NO: 248293 - DNA, 37 bp, Artificial Sequence
  Description of Artificial Sequence: Synthetic oligonucleotide
caagttcttcggtgacgacgagaaagattaaggtttg

SEQ ID NO: 248294 - DNA, 37 bp, Artificial Sequence
  Description of Artificial Sequence: Synthetic oligonucleotide
aagttcttcggtgacgacgagaaagattaaggtttgc

SEQ ID NO: 248295 - DNA, 36 bp, Artificial Sequence
  Description of Artificial Sequence: Synthetic oligonucleotide
agttcttcggtgacgacgagaaagattaaggtttgc

SEQ ID NO: 248296 - DNA, 35 bp, Artificial Sequence
  Description of Artificial Sequence: Synthetic oligonucleotide
gttcttcggtgacgacgagaaagattaaggtttgc

SEQ ID NO: 248297 - DNA, 36 bp, Artificial Sequence
  Description of Artificial Sequence: Synthetic oligonucleotide
ttcttcggtgacgacgagaaagattaaggtttgctg

SEQ ID NO: 248298 - DNA, 35 bp, Artificial Sequence
  Description of Artificial Sequence: Synthetic oligonucleotide
tcttcggtgacgacgagaaagattaaggtttgctg

SEQ ID NO: 248299 - DNA, 34 bp, Artificial Sequence
  Description of Artificial Sequence: Synthetic oligonucleotide
cttcggtgacgacgagaaagattaaggtttgctg

SEQ ID NO: 248300 - DNA, 35 bp, Artificial Sequence
  Description of Artificial Sequence: Synthetic oligonucleotide
ttcggtgacgacgagaaagattaaggtttgctgac

SEQ ID NO: 248301 - DNA, 34 bp, Artificial Sequence
  Description of Artificial Sequence: Synthetic oligonucleotide
tcggtgacgacgagaaagattaaggtttgctgac

SEQ ID NO: 248302 - DNA, 33 bp, Artificial Sequence
  Description of Artificial Sequence: Synthetic oligonucleotide
cggtgacgacgagaaagattaaggtttgctgac

SEQ ID NO: 248303 - DNA, 35 bp, Artificial Sequence
  Description of Artificial Sequence: Synthetic oligonucleotide
ggtgacgacgagaaagattaaggtttgctgacaag

SEQ ID NO: 248304 - DNA, 35 bp, Artificial Sequence
  Description of Artificial Sequence: Synthetic oligonucleotide
gtgacgacgagaaagattaaggtttgctgacaagc

SEQ ID NO: 248305 - DNA, 35 bp, Artificial Sequence
  Description of Artificial Sequence: Synthetic oligonucleotide
tgacgacgagaaagattaaggtttgctgacaagcc

SEQ ID NO: 248306 - DNA, 34 bp, Artificial Sequence
  Description of Artificial Sequence: Synthetic oligonucleotide
gacgacgagaaagattaaggtttgctgacaagcc

SEQ ID NO: 248307 - DNA, 35 bp, Artificial Sequence
  Description of Artificial Sequence: Synthetic oligonucleotide
acgacgagaaagattaaggtttgctgacaagccac

SEQ ID NO: 248308 - DNA, 34 bp, Artificial Sequence
  Description of Artificial Sequence: Synthetic oligonucleotide
cgacgagaaagattaaggtttgctgacaagccac

SEQ ID NO: 248309 - DNA, 34 bp, Artificial Sequence
  Description of Artificial Sequence: Synthetic oligonucleotide
gacgagaaagattaaggtttgctgacaagccacg

SEQ ID NO: 248310 - DNA, 36 bp, Artificial Sequence
  Description of Artificial Sequence: Synthetic oligonucleotide
acgagaaagattaaggtttgctgacaagccacgatg

SEQ ID NO: 248311 - DNA, 35 bp, Artificial Sequence
  Description of Artificial Sequence: Synthetic oligonucleotide
cgagaaagattaaggtttgctgacaagccacgatg

SEQ ID NO: 248312 - DNA, 35 bp, Artificial Sequence
  Description of Artificial Sequence: Synthetic oligonucleotide
gagaaagattaaggtttgctgacaagccacgatgc

SEQ ID NO: 248313 - DNA, 36 bp, Artificial Sequence
  Description of Artificial Sequence: Synthetic oligonucleotide
agaaagattaaggtttgctgacaagccacgatgcac

SEQ ID NO: 248314 - DNA, 35 bp, Artificial Sequence
  Description of Artificial Sequence: Synthetic oligonucleotide
gaaagattaaggtttgctgacaagccacgatgcac

SEQ ID NO: 248315 - DNA, 35 bp, Artificial Sequence
  Description of Artificial Sequence: Synthetic oligonucleotide
aaagattaaggtttgctgacaagccacgatgcacg

SEQ ID NO: 248316 - DNA, 34 bp, Artificial Sequence
  Description of Artificial Sequence: Synthetic oligonucleotide
aagattaaggtttgctgacaagccacgatgcacg

SEQ ID NO: 248317 - DNA, 33 bp, Artificial Sequence
  Description of Artificial Sequence: Synthetic oligonucleotide
agattaaggtttgctgacaagccacgatgcacg

SEQ ID NO: 248318 - DNA, 32 bp, Artificial Sequence
  Description of Artificial Sequence: Synthetic oligonucleotide
gattaaggtttgctgacaagccacgatgcacg

SEQ ID NO: 248319 - DNA, 32 bp, Artificial Sequence
  Description of Artificial Sequence: Synthetic oligonucleotide
attaaggtttgctgacaagccacgatgcacgc

SEQ ID NO: 248320 - DNA, 31 bp, Artificial Sequence
  Description of Artificial Sequence: Synthetic oligonucleotide
ttaaggtttgctgacaagccacgatgcacgc

SEQ ID NO: 248321 - DNA, 30 bp, Artificial Sequence
  Description of Artificial Sequence: Synthetic oligonucleotide
taaggtttgctgacaagccacgatgcacgc

SEQ ID NO: 248322 - DNA, 29 bp, Artificial Sequence
  Description of Artificial Sequence: Synthetic oligonucleotide
aaggtttgctgacaagccacgatgcacgc

SEQ ID NO: 248323 - DNA, 28 bp, Artificial Sequence
  Description of Artificial Sequence: Synthetic oligonucleotide
aggtttgctgacaagccacgatgcacgc

SEQ ID NO: 248324 - DNA, 27 bp, Artificial Sequence
  Description of Artificial Sequence: Synthetic oligonucleotide
ggtttgctgacaagccacgatgcacgc

SEQ ID NO: 248325 - DNA, 33 bp, Artificial Sequence
  Description of Artificial Sequence: Synthetic oligonucleotide
gtttgctgacaagccacgatgcacgcatttatg

SEQ ID NO: 248326 - DNA, 33 bp, Artificial Sequence
  Description of Artificial Sequence: Synthetic oligonucleotide
tttgctgacaagccacgatgcacgcatttatgc

SEQ ID NO: 248327 - DNA, 32 bp, Artificial Sequence
  Description of Artificial Sequence: Synthetic oligonucleotide
ttgctgacaagccacgatgcacgcatttatgc

SEQ ID NO: 248328 - DNA, 31 bp, Artificial Sequence
  Description of Artificial Sequence: Synthetic oligonucleotide
tgctgacaagccacgatgcacgcatttatgc

SEQ ID NO: 248329 - DNA, 30 bp, Artificial Sequence
  Description of Artificial Sequence: Synthetic oligonucleotide
gctgacaagccacgatgcacgcatttatgc

SEQ ID NO: 248330 - DNA, 31 bp, Artificial Sequence
  Description of Artificial Sequence: Synthetic oligonucleotide
ctgacaagccacgatgcacgcatttatgctc

SEQ ID NO: 248331 - DNA, 32 bp, Artificial Sequence
  Description of Artificial Sequence: Synthetic oligonucleotide
tgacaagccacgatgcacgcatttatgctcag

SEQ ID NO: 248332 - DNA, 31 bp, Artificial Sequence
  Description of Artificial Sequence: Synthetic oligonucleotide
gacaagccacgatgcacgcatttatgctcag

SEQ ID NO: 248333 - DNA, 32 bp, Artificial Sequence
  Description of Artificial Sequence: Synthetic oligonucleotide
acaagccacgatgcacgcatttatgctcagtc

SEQ ID NO: 248334 - DNA, 31 bp, Artificial Sequence
  Description of Artificial Sequence: Synthetic oligonucleotide
caagccacgatgcacgcatttatgctcagtc

SEQ ID NO: 248335 - DNA, 31 bp, Artificial Sequence
  Description of Artificial Sequence: Synthetic oligonucleotide
aagccacgatgcacgcatttatgctcagtcg

SEQ ID NO: 248336 - DNA, 30 bp, Artificial Sequence
  Description of Artificial Sequence: Synthetic oligonucleotide
agccacgatgcacgcatttatgctcagtcg

SEQ ID NO: 248337 - DNA, 29 bp, Artificial Sequence
  Description of Artificial Sequence: Synthetic oligonucleotide
gccacgatgcacgcatttatgctcagtcg

SEQ ID NO: 248338 - DNA, 29 bp, Artificial Sequence
  Description of Artificial Sequence: Synthetic oligonucleotide
ccacgatgcacgcatttatgctcagtcgg

SEQ ID NO: 248339 - DNA, 29 bp, Artificial Sequence
  Description of Artificial Sequence: Synthetic oligonucleotide
cacgatgcacgcatttatgctcagtcggc

SEQ ID NO: 248340 - DNA, 29 bp, Artificial Sequence
  Description of Artificial Sequence: Synthetic oligonucleotide
acgatgcacgcatttatgctcagtcggcc

SEQ ID NO: 248341 - DNA, 28 bp, Artificial Sequence
  Description of Artificial Sequence: Synthetic oligonucleotide
cgatgcacgcatttatgctcagtcggcc

SEQ ID NO: 248342 - DNA, 29 bp, Artificial Sequence
  Description of Artificial Sequence: Synthetic oligonucleotide
gatgcacgcatttatgctcagtcggccag

SEQ ID NO: 248343 - DNA, 32 bp, Artificial Sequence
  Description of Artificial Sequence: Synthetic oligonucleotide
atgcacgcatttatgctcagtcggccagattc

SEQ ID NO: 248344 - DNA, 31 bp, Artificial Sequence
  Description of Artificial Sequence: Synthetic oligonucleotide
tgcacgcatttatgctcagtcggccagattc

SEQ ID NO: 248345 - DNA, 30 bp, Artificial Sequence
  Description of Artificial Sequence: Synthetic oligonucleotide
gcacgcatttatgctcagtcggccagattc

SEQ ID NO: 248346 - DNA, 30 bp, Artificial Sequence
  Description of Artificial Sequence: Synthetic oligonucleotide
cacgcatttatgctcagtcggccagattcg

SEQ ID NO: 248347 - DNA, 31 bp, Artificial Sequence
  Description of Artificial Sequence: Synthetic oligonucleotide
acgcatttatgctcagtcggccagattcgag

SEQ ID NO: 248348 - DNA, 30 bp, Artificial Sequence
  Description of Artificial Sequence: Synthetic oligonucleotide
cgcatttatgctcagtcggccagattcgag

SEQ ID NO: 248349 - DNA, 30 bp, Artificial Sequence
  Description of Artificial Sequence: Synthetic oligonucleotide
gcatttatgctcagtcggccagattcgagc

SEQ ID NO: 248350 - DNA, 30 bp, Artificial Sequence
  Description of Artificial Sequence: Synthetic oligonucleotide
catttatgctcagtcggccagattcgagcc

SEQ ID NO: 248351 - DNA, 33 bp, Artificial Sequence
  Description of Artificial Sequence: Synthetic oligonucleotide
atttatgctcagtcggccagattcgagcctatc

SEQ ID NO: 248352 - DNA, 32 bp, Artificial Sequence
  Description of Artificial Sequence: Synthetic oligonucleotide
tttatgctcagtcggccagattcgagcctatc

SEQ ID NO: 248353 - DNA, 31 bp, Artificial Sequence
  Description of Artificial Sequence: Synthetic oligonucleotide
ttatgctcagtcggccagattcgagcctatc

SEQ ID NO: 248354 - DNA, 30 bp, Artificial Sequence
  Description of Artificial Sequence: Synthetic oligonucleotide
tatgctcagtcggccagattcgagcctatc

SEQ ID NO: 248355 - DNA, 29 bp, Artificial Sequence
  Description of Artificial Sequence: Synthetic oligonucleotide
atgctcagtcggccagattcgagcctatc

SEQ ID NO: 248356 - DNA, 28 bp, Artificial Sequence
  Description of Artificial Sequence: Synthetic oligonucleotide
tgctcagtcggccagattcgagcctatc

SEQ ID NO: 248357 - DNA, 27 bp, Artificial Sequence
  Description of Artificial Sequence: Synthetic oligonucleotide
gctcagtcggccagattcgagcctatc

SEQ ID NO: 248358 - DNA, 28 bp, Artificial Sequence
  Description of Artificial Sequence: Synthetic oligonucleotide
ctcagtcggccagattcgagcctatcag

SEQ ID NO: 248359 - DNA, 28 bp, Artificial Sequence
  Description of Artificial Sequence: Synthetic oligonucleotide
tcagtcggccagattcgagcctatcagc

SEQ ID NO: 248360 - DNA, 27 bp, Artificial Sequence
  Description of Artificial Sequence: Synthetic oligonucleotide
cagtcggccagattcgagcctatcagc

SEQ ID NO: 248361 - DNA, 29 bp, Artificial Sequence
  Description of Artificial Sequence: Synthetic oligonucleotide
agtcggccagattcgagcctatcagcaac

SEQ ID NO: 248362 - DNA, 28 bp, Artificial Sequence
  Description of Artificial Sequence: Synthetic oligonucleotide
gtcggccagattcgagcctatcagcaac

SEQ ID NO: 248363 - DNA, 31 bp, Artificial Sequence
  Description of Artificial Sequence: Synthetic oligonucleotide
tcggccagattcgagcctatcagcaacatag

SEQ ID NO: 248364 - DNA, 30 bp, Artificial Sequence
  Description of Artificial Sequence: Synthetic oligonucleotide
cggccagattcgagcctatcagcaacatag

SEQ ID NO: 248365 - DNA, 30 bp, Artificial Sequence
  Description of Artificial Sequence: Synthetic oligonucleotide
ggccagattcgagcctatcagcaacatagg

SEQ ID NO: 248366 - DNA, 30 bp, Artificial Sequence
  Description of Artificial Sequence: Synthetic oligonucleotide
gccagattcgagcctatcagcaacataggc

SEQ ID NO: 248367 - DNA, 30 bp, Artificial Sequence
  Description of Artificial Sequence: Synthetic oligonucleotide
ccagattcgagcctatcagcaacataggcc

SEQ ID NO: 248368 - DNA, 31 bp, Artificial Sequence
  Description of Artificial Sequence: Synthetic oligonucleotide
cagattcgagcctatcagcaacataggccag

SEQ ID NO: 248369 - DNA, 32 bp, Artificial Sequence
  Description of Artificial Sequence: Synthetic oligonucleotide
agattcgagcctatcagcaacataggccagac

SEQ ID NO: 248370 - DNA, 31 bp, Artificial Sequence
  Description of Artificial Sequence: Synthetic oligonucleotide
gattcgagcctatcagcaacataggccagac

SEQ ID NO: 248371 - DNA, 31 bp, Artificial Sequence
  Description of Artificial Sequence: Synthetic oligonucleotide
attcgagcctatcagcaacataggccagacc

SEQ ID NO: 248372 - DNA, 30 bp, Artificial Sequence
  Description of Artificial Sequence: Synthetic oligonucleotide
ttcgagcctatcagcaacataggccagacc

SEQ ID NO: 248373 - DNA, 29 bp, Artificial Sequence
  Description of Artificial Sequence: Synthetic oligonucleotide
tcgagcctatcagcaacataggccagacc

SEQ ID NO: 248374 - DNA, 28 bp, Artificial Sequence
  Description of Artificial Sequence: Synthetic oligonucleotide
cgagcctatcagcaacataggccagacc

SEQ ID NO: 248375 - DNA, 28 bp, Artificial Sequence
  Description of Artificial Sequence: Synthetic oligonucleotide
gagcctatcagcaacataggccagaccc

SEQ ID NO: 248376 - DNA, 29 bp, Artificial Sequence
  Description of Artificial Sequence: Synthetic oligonucleotide
agcctatcagcaacataggccagaccctg

SEQ ID NO: 248377 - DNA, 28 bp, Artificial Sequence
  Description of Artificial Sequence: Synthetic oligonucleotide
gcctatcagcaacataggccagaccctg

SEQ ID NO: 248378 - DNA, 28 bp, Artificial Sequence
  Description of Artificial Sequence: Synthetic oligonucleotide
cctatcagcaacataggccagaccctgg

SEQ ID NO: 248379 - DNA, 29 bp, Artificial Sequence
  Description of Artificial Sequence: Synthetic oligonucleotide
ctatcagcaacataggccagaccctggtg

SEQ ID NO: 248380 - DNA, 29 bp, Artificial Sequence
  Description of Artificial Sequence: Synthetic oligonucleotide
tatcagcaacataggccagaccctggtgg

SEQ ID NO: 248381 - DNA, 28 bp, Artificial Sequence
  Description of Artificial Sequence: Synthetic oligonucleotide
atcagcaacataggccagaccctggtgg

SEQ ID NO: 248382 - DNA, 27 bp, Artificial Sequence
  Description of Artificial Sequence: Synthetic oligonucleotide
tcagcaacataggccagaccctggtgg

SEQ ID NO: 248383 - DNA, 27 bp, Artificial Sequence
  Description of Artificial Sequence: Synthetic oligonucleotide
cagcaacataggccagaccctggtggt

SEQ ID NO: 248384 - DNA, 27 bp, Artificial Sequence
  Description of Artificial Sequence: Synthetic oligonucleotide
agcaacataggccagaccctggtggtg

SEQ ID NO: 248385 - DNA, 26 bp, Artificial Sequence
  Description of Artificial Sequence: Synthetic oligonucleotide
gcaacataggccagaccctggtggtg

SEQ ID NO: 248386 - DNA, 27 bp, Artificial Sequence
  Description of Artificial Sequence: Synthetic oligonucleotide
caacataggccagaccctggtggtgga

SEQ ID NO: 248387 - DNA, 27 bp, Artificial Sequence
  Description of Artificial Sequence: Synthetic oligonucleotide
aacataggccagaccctggtggtggag

SEQ ID NO: 248388 - DNA, 27 bp, Artificial Sequence
  Description of Artificial Sequence: Synthetic oligonucleotide
acataggccagaccctggtggtggagt

SEQ ID NO: 248389 - DNA, 27 bp, Artificial Sequence
  Description of Artificial Sequence: Synthetic oligonucleotide
cataggccagaccctggtggtggagtt

SEQ ID NO: 248390 - DNA, 27 bp, Artificial Sequence
  Description of Artificial Sequence: Synthetic oligonucleotide
ataggccagaccctggtggtggagttc

SEQ ID NO: 248391 - DNA, 27 bp, Artificial Sequence
  Description of Artificial Sequence: Synthetic oligonucleotide
taggccagaccctggtggtggagttca

SEQ ID NO: 248392 - DNA, 26 bp, Artificial Sequence
  Description of Artificial Sequence: Synthetic oligonucleotide
aggccagaccctggtggtggagttca

SEQ ID NO: 248393 - DNA, 25 bp, Artificial Sequence
  Description of Artificial Sequence: Synthetic oligonucleotide
ggccagaccctggtggtggagttca

SEQ ID NO: 248394 - DNA, 25 bp, Artificial Sequence
  Description of Artificial Sequence: Synthetic oligonucleotide
gccagaccctggtggtggagttcac

SEQ ID NO: 248395 - DNA, 25 bp, Artificial Sequence
  Description of Artificial Sequence: Synthetic oligonucleotide
ccagaccctggtggtggagttcacg

SEQ ID NO: 248396 - DNA, 26 bp, Artificial Sequence
  Description of Artificial Sequence: Synthetic oligonucleotide
cagaccctggtggtggagttcacgga

SEQ ID NO: 248397 - DNA, 27 bp, Artificial Sequence
  Description of Artificial Sequence: Synthetic oligonucleotide
agaccctggtggtggagttcacggaga

SEQ ID NO: 248398 - DNA, 27 bp, Artificial Sequence
  Description of Artificial Sequence: Synthetic oligonucleotide
gaccctggtggtggagttcacggagaa

SEQ ID NO: 248399 - DNA, 28 bp, Artificial Sequence
  Description of Artificial Sequence: Synthetic oligonucleotide
accctggtggtggagttcacggagaaac

SEQ ID NO: 248400 - DNA, 27 bp, Artificial Sequence
  Description of Artificial Sequence: Synthetic oligonucleotide
ccctggtggtggagttcacggagaaac

SEQ ID NO: 248401 - DNA, 29 bp, Artificial Sequence
  Description of Artificial Sequence: Synthetic oligonucleotide
cctggtggtggagttcacggagaaacatg

SEQ ID NO: 248402 - DNA, 30 bp, Artificial Sequence
  Description of Artificial Sequence: Synthetic oligonucleotide
ctggtggtggagttcacggagaaacatgac

SEQ ID NO: 248403 - DNA, 30 bp, Artificial Sequence
  Description of Artificial Sequence: Synthetic oligonucleotide
tggtggtggagttcacggagaaacatgacc

SEQ ID NO: 248404 - DNA, 29 bp, Artificial Sequence
  Description of Artificial Sequence: Synthetic oligonucleotide
ggtggtggagttcacggagaaacatgacc

SEQ ID NO: 248405 - DNA, 30 bp, Artificial Sequence
  Description of Artificial Sequence: Synthetic oligonucleotide
gtggtggagttcacggagaaacatgaccag

SEQ ID NO: 248406 - DNA, 32 bp, Artificial Sequence
  Description of Artificial Sequence: Synthetic oligonucleotide
tggtggagttcacggagaaacatgaccagaac

SEQ ID NO: 248407 - DNA, 31 bp, Artificial Sequence
  Description of Artificial Sequence: Synthetic oligonucleotide
ggtggagttcacggagaaacatgaccagaac

SEQ ID NO: 248408 - DNA, 33 bp, Artificial Sequence
  Description of Artificial Sequence: Synthetic oligonucleotide
gtggagttcacggagaaacatgaccagaacatc

SEQ ID NO: 248409 - DNA, 33 bp, Artificial Sequence
  Description of Artificial Sequence: Synthetic oligonucleotide
tggagttcacggagaaacatgaccagaacatcc

SEQ ID NO: 248410 - DNA, 32 bp, Artificial Sequence
  Description of Artificial Sequence: Synthetic oligonucleotide
ggagttcacggagaaacatgaccagaacatcc

SEQ ID NO: 248411 - DNA, 33 bp, Artificial Sequence
  Description of Artificial Sequence: Synthetic oligonucleotide
gagttcacggagaaacatgaccagaacatccac

SEQ ID NO: 248412 - DNA, 34 bp, Artificial Sequence
  Description of Artificial Sequence: Synthetic oligonucleotide
agttcacggagaaacatgaccagaacatccactg

SEQ ID NO: 248413 - DNA, 33 bp, Artificial Sequence
  Description of Artificial Sequence: Synthetic oligonucleotide
gttcacggagaaacatgaccagaacatccactg

SEQ ID NO: 248414 - DNA, 34 bp, Artificial Sequence
  Description of Artificial Sequence: Synthetic oligonucleotide
ttcacggagaaacatgaccagaacatccactgtg

SEQ ID NO: 248415 - DNA, 33 bp, Artificial Sequence
  Description of Artificial Sequence: Synthetic oligonucleotide
tcacggagaaacatgaccagaacatccactgtg

SEQ ID NO: 248416 - DNA, 32 bp, Artificial Sequence
  Description of Artificial Sequence: Synthetic oligonucleotide
cacggagaaacatgaccagaacatccactgtg

SEQ ID NO: 248417 - DNA, 32 bp, Artificial Sequence
  Description of Artificial Sequence: Synthetic oligonucleotide
acggagaaacatgaccagaacatccactgtgg

SEQ ID NO: 248418 - DNA, 31 bp, Artificial Sequence
  Description of Artificial Sequence: Synthetic oligonucleotide
cggagaaacatgaccagaacatccactgtgg

SEQ ID NO: 248419 - DNA, 31 bp, Artificial Sequence
  Description of Artificial Sequence: Synthetic oligonucleotide
ggagaaacatgaccagaacatccactgtggg

SEQ ID NO: 248420 - DNA, 31 bp, Artificial Sequence
  Description of Artificial Sequence: Synthetic oligonucleotide
gagaaacatgaccagaacatccactgtgggg

SEQ ID NO: 248421 - DNA, 31 bp, Artificial Sequence
  Description of Artificial Sequence: Synthetic oligonucleotide
agaaacatgaccagaacatccactgtggggc

SEQ ID NO: 248422 - DNA, 30 bp, Artificial Sequence
  Description of Artificial Sequence: Synthetic oligonucleotide
gaaacatgaccagaacatccactgtggggc

SEQ ID NO: 248423 - DNA, 30 bp, Artificial Sequence
  Description of Artificial Sequence: Synthetic oligonucleotide
aaacatgaccagaacatccactgtggggcc

SEQ ID NO: 248424 - DNA, 29 bp, Artificial Sequence
  Description of Artificial Sequence: Synthetic oligonucleotide
aacatgaccagaacatccactgtggggcc

SEQ ID NO: 248425 - DNA, 28 bp, Artificial Sequence
  Description of Artificial Sequence: Synthetic oligonucleotide
acatgaccagaacatccactgtggggcc

SEQ ID NO: 248426 - DNA, 27 bp, Artificial Sequence
  Description of Artificial Sequence: Synthetic oligonucleotide
catgaccagaacatccactgtggggcc

SEQ ID NO: 248427 - DNA, 27 bp, Artificial Sequence
  Description of Artificial Sequence: Synthetic oligonucleotide
atgaccagaacatccactgtggggccg

SEQ ID NO: 248428 - DNA, 26 bp, Artificial Sequence
  Description of Artificial Sequence: Synthetic oligonucleotide
tgaccagaacatccactgtggggccg

SEQ ID NO: 248429 - DNA, 25 bp, Artificial Sequence
  Description of Artificial Sequence: Synthetic oligonucleotide
gaccagaacatccactgtggggccg

SEQ ID NO: 248430 - DNA, 25 bp, Artificial Sequence
  Description of Artificial Sequence: Synthetic oligonucleotide
accagaacatccactgtggggccgg

SEQ ID NO: 248431 - DNA, 24 bp, Artificial Sequence
  Description of Artificial Sequence: Synthetic oligonucleotide
ccagaacatccactgtggggccgg

SEQ ID NO: 248432 - DNA, 27 bp, Artificial Sequence
  Description of Artificial Sequence: Synthetic oligonucleotide
cagaacatccactgtggggccggctat

SEQ ID NO: 248433 - DNA, 27 bp, Artificial Sequence
  Description of Artificial Sequence: Synthetic oligonucleotide
agaacatccactgtggggccggctatg

SEQ ID NO: 248434 - DNA, 27 bp, Artificial Sequence
  Description of Artificial Sequence: Synthetic oligonucleotide
gaacatccactgtggggccggctatgt

SEQ ID NO: 248435 - DNA, 27 bp, Artificial Sequence
  Description of Artificial Sequence: Synthetic oligonucleotide
aacatccactgtggggccggctatgtc

SEQ ID NO: 248436 - DNA, 27 bp, Artificial Sequence
  Description of Artificial Sequence: Synthetic oligonucleotide
acatccactgtggggccggctatgtca

SEQ ID NO: 248437 - DNA, 27 bp, Artificial Sequence
  Description of Artificial Sequence: Synthetic oligonucleotide
catccactgtggggccggctatgtcaa

SEQ ID NO: 248438 - DNA, 27 bp, Artificial Sequence
  Description of Artificial Sequence: Synthetic oligonucleotide
atccactgtggggccggctatgtcaag

SEQ ID NO: 248439 - DNA, 26 bp, Artificial Sequence
  Description of Artificial Sequence: Synthetic oligonucleotide
tccactgtggggccggctatgtcaag

SEQ ID NO: 248440 - DNA, 25 bp, Artificial Sequence
  Description of Artificial Sequence: Synthetic oligonucleotide
ccactgtggggccggctatgtcaag

SEQ ID NO: 248441 - DNA, 26 bp, Artificial Sequence
  Description of Artificial Sequence: Synthetic oligonucleotide
cactgtggggccggctatgtcaagct

SEQ ID NO: 248442 - DNA, 27 bp, Artificial Sequence
  Description of Artificial Sequence: Synthetic oligonucleotide
actgtggggccggctatgtcaagctgt

SEQ ID NO: 248443 - DNA, 27 bp, Artificial Sequence
  Description of Artificial Sequence: Synthetic oligonucleotide
ctgtggggccggctatgtcaagctgtt

SEQ ID NO: 248444 - DNA, 28 bp, Artificial Sequence
  Description of Artificial Sequence: Synthetic oligonucleotide
tgtggggccggctatgtcaagctgtttg

SEQ ID NO: 248445 - DNA, 27 bp, Artificial Sequence
  Description of Artificial Sequence: Synthetic oligonucleotide
gtggggccggctatgtcaagctgtttg

SEQ ID NO: 248446 - DNA, 27 bp, Artificial Sequence
  Description of Artificial Sequence: Synthetic oligonucleotide
tggggccggctatgtcaagctgtttgc

SEQ ID NO: 248447 - DNA, 27 bp, Artificial Sequence
  Description of Artificial Sequence: Synthetic oligonucleotide
ggggccggctatgtcaagctgtttgct

SEQ ID NO: 248448 - DNA, 31 bp, Artificial Sequence
  Description of Artificial Sequence: Synthetic oligonucleotide
gggccggctatgtcaagctgtttgctaatag

SEQ ID NO: 248449 - DNA, 34 bp, Artificial Sequence
  Description of Artificial Sequence: Synthetic oligonucleotide
ggccggctatgtcaagctgtttgctaatagttag

SEQ ID NO: 248450 - DNA, 34 bp, Artificial Sequence
  Description of Artificial Sequence: Synthetic oligonucleotide
gccggctatgtcaagctgtttgctaatagttagg

SEQ ID NO: 248451 - DNA, 35 bp, Artificial Sequence
  Description of Artificial Sequence: Synthetic oligonucleotide
ccggctatgtcaagctgtttgctaatagttaggac

SEQ ID NO: 248452 - DNA, 35 bp, Artificial Sequence
  Description of Artificial Sequence: Synthetic oligonucleotide
cggctatgtcaagctgtttgctaatagttaggacc

SEQ ID NO: 248453 - DNA, 36 bp, Artificial Sequence
  Description of Artificial Sequence: Synthetic oligonucleotide
ggctatgtcaagctgtttgctaatagttaggaccag

SEQ ID NO: 248454 - DNA, 37 bp, Artificial Sequence
  Description of Artificial Sequence: Synthetic oligonucleotide
gctatgtcaagctgtttgctaatagttaggaccagac

SEQ ID NO: 248455 - DNA, 38 bp, Artificial Sequence
  Description of Artificial Sequence: Synthetic oligonucleotide
ctatgtcaagctgtttgctaatagttaggaccagactg

SEQ ID NO: 248456 - DNA, 39 bp, Artificial Sequence
  Description of Artificial Sequence: Synthetic oligonucleotide
tatgtcaagctgtttgctaatagttaggaccagactgac

SEQ ID NO: 248457 - DNA, 38 bp, Artificial Sequence
  Description of Artificial Sequence: Synthetic oligonucleotide
atgtcaagctgtttgctaatagttaggaccagactgac

SEQ ID NO: 248458 - DNA, 37 bp, Artificial Sequence
  Description of Artificial Sequence: Synthetic oligonucleotide
tgtcaagctgtttgctaatagttaggaccagactgac

SEQ ID NO: 248459 - DNA, 36 bp, Artificial Sequence
  Description of Artificial Sequence: Synthetic oligonucleotide
gtcaagctgtttgctaatagttaggaccagactgac

SEQ ID NO: 248460 - DNA, 38 bp, Artificial Sequence
  Description of Artificial Sequence: Synthetic oligonucleotide
tcaagctgtttgctaatagttaggaccagactgacatg

SEQ ID NO: 248461 - DNA, 37 bp, Artificial Sequence
  Description of Artificial Sequence: Synthetic oligonucleotide
caagctgtttgctaatagttaggaccagactgacatg

SEQ ID NO: 248462 - DNA, 37 bp, Artificial Sequence
  Description of Artificial Sequence: Synthetic oligonucleotide
aagctgtttgctaatagttaggaccagactgacatgc

SEQ ID NO: 248463 - DNA, 36 bp, Artificial Sequence
  Description of Artificial Sequence: Synthetic oligonucleotide
agctgtttgctaatagttaggaccagactgacatgc

SEQ ID NO: 248464 - DNA, 35 bp, Artificial Sequence
  Description of Artificial Sequence: Synthetic oligonucleotide
gctgtttgctaatagttaggaccagactgacatgc

SEQ ID NO: 248465 - DNA, 36 bp, Artificial Sequence
  Description of Artificial Sequence: Synthetic oligonucleotide
ctgtttgctaatagttaggaccagactgacatgcac

SEQ ID NO: 248466 - DNA, 36 bp, Artificial Sequence
  Description of Artificial Sequence: Synthetic oligonucleotide
tgtttgctaatagttaggaccagactgacatgcacc

SEQ ID NO: 248467 - DNA, 35 bp, Artificial Sequence
  Description of Artificial Sequence: Synthetic oligonucleotide
gtttgctaatagttaggaccagactgacatgcacc

SEQ ID NO: 248468 - DNA, 35 bp, Artificial Sequence
  Description of Artificial Sequence: Synthetic oligonucleotide
tttgctaatagttaggaccagactgacatgcaccg

SEQ ID NO: 248469 - DNA, 34 bp, Artificial Sequence
  Description of Artificial Sequence: Synthetic oligonucleotide
ttgctaatagttaggaccagactgacatgcaccg

SEQ ID NO: 248470 - DNA, 33 bp, Artificial Sequence
  Description of Artificial Sequence: Synthetic oligonucleotide
tgctaatagttaggaccagactgacatgcaccg

SEQ ID NO: 248471 - DNA, 32 bp, Artificial Sequence
  Description of Artificial Sequence: Synthetic oligonucleotide
gctaatagttaggaccagactgacatgcaccg

SEQ ID NO: 248472 - DNA, 33 bp, Artificial Sequence
  Description of Artificial Sequence: Synthetic oligonucleotide
ctaatagttaggaccagactgacatgcaccgag

SEQ ID NO: 248473 - DNA, 34 bp, Artificial Sequence
  Description of Artificial Sequence: Synthetic oligonucleotide
taatagttaggaccagactgacatgcaccgagac

SEQ ID NO: 248474 - DNA, 33 bp, Artificial Sequence
  Description of Artificial Sequence: Synthetic oligonucleotide
aatagttaggaccagactgacatgcaccgagac

SEQ ID NO: 248475 - DNA, 32 bp, Artificial Sequence
  Description of Artificial Sequence: Synthetic oligonucleotide
atagttaggaccagactgacatgcaccgagac

SEQ ID NO: 248476 - DNA, 31 bp, Artificial Sequence
  Description of Artificial Sequence: Synthetic oligonucleotide
tagttaggaccagactgacatgcaccgagac

SEQ ID NO: 248477 - DNA, 30 bp, Artificial Sequence
  Description of Artificial Sequence: Synthetic oligonucleotide
agttaggaccagactgacatgcaccgagac

SEQ ID NO: 248478 - DNA, 29 bp, Artificial Sequence
  Description of Artificial Sequence: Synthetic oligonucleotide
gttaggaccagactgacatgcaccgagac

SEQ ID NO: 248479 - DNA, 30 bp, Artificial Sequence
  Description of Artificial Sequence: Synthetic oligonucleotide
ttaggaccagactgacatgcaccgagactc

SEQ ID NO: 248480 - DNA, 29 bp, Artificial Sequence
  Description of Artificial Sequence: Synthetic oligonucleotide
taggaccagactgacatgcaccgagactc

SEQ ID NO: 248481 - DNA, 28 bp, Artificial Sequence
  Description of Artificial Sequence: Synthetic oligonucleotide
aggaccagactgacatgcaccgagactc

SEQ ID NO: 248482 - DNA, 27 bp, Artificial Sequence
  Description of Artificial Sequence: Synthetic oligonucleotide
ggaccagactgacatgcaccgagactc

SEQ ID NO: 248483 - DNA, 28 bp, Artificial Sequence
  Description of Artificial Sequence: Synthetic oligonucleotide
gaccagactgacatgcaccgagactcag

SEQ ID NO: 248484 - DNA, 32 bp, Artificial Sequence
  Description of Artificial Sequence: Synthetic oligonucleotide
accagactgacatgcaccgagactcagtatac

SEQ ID NO: 248485 - DNA, 31 bp, Artificial Sequence
  Description of Artificial Sequence: Synthetic oligonucleotide
ccagactgacatgcaccgagactcagtatac

SEQ ID NO: 248486 - DNA, 33 bp, Artificial Sequence
  Description of Artificial Sequence: Synthetic oligonucleotide
cagactgacatgcaccgagactcagtatacaac

SEQ ID NO: 248487 - DNA, 35 bp, Artificial Sequence
  Description of Artificial Sequence: Synthetic oligonucleotide
agactgacatgcaccgagactcagtatacaacatg

SEQ ID NO: 248488 - DNA, 34 bp, Artificial Sequence
  Description of Artificial Sequence: Synthetic oligonucleotide
gactgacatgcaccgagactcagtatacaacatg

SEQ ID NO: 248489 - DNA, 36 bp, Artificial Sequence
  Description of Artificial Sequence: Synthetic oligonucleotide
actgacatgcaccgagactcagtatacaacatgatg

SEQ ID NO: 248490 - DNA, 35 bp, Artificial Sequence
  Description of Artificial Sequence: Synthetic oligonucleotide
ctgacatgcaccgagactcagtatacaacatgatg

SEQ ID NO: 248491 - DNA, 38 bp, Artificial Sequence
  Description of Artificial Sequence: Synthetic oligonucleotide
tgacatgcaccgagactcagtatacaacatgatgtttg

SEQ ID NO: 248492 - DNA, 37 bp, Artificial Sequence
  Description of Artificial Sequence: Synthetic oligonucleotide
gacatgcaccgagactcagtatacaacatgatgtttg

SEQ ID NO: 248493 - DNA, 37 bp, Artificial Sequence
  Description of Artificial Sequence: Synthetic oligonucleotide
acatgcaccgagactcagtatacaacatgatgtttgg

SEQ ID NO: 248494 - DNA, 36 bp, Artificial Sequence
  Description of Artificial Sequence: Synthetic oligonucleotide
catgcaccgagactcagtatacaacatgatgtttgg

SEQ ID NO: 248495 - DNA, 37 bp, Artificial Sequence
  Description of Artificial Sequence: Synthetic oligonucleotide
atgcaccgagactcagtatacaacatgatgtttggtg

SEQ ID NO: 248496 - DNA, 36 bp, Artificial Sequence
  Description of Artificial Sequence: Synthetic oligonucleotide
tgcaccgagactcagtatacaacatgatgtttggtg

SEQ ID NO: 248497 - DNA, 35 bp, Artificial Sequence
  Description of Artificial Sequence: Synthetic oligonucleotide
gcaccgagactcagtatacaacatgatgtttggtg

SEQ ID NO: 248498 - DNA, 35 bp, Artificial Sequence
  Description of Artificial Sequence: Synthetic oligonucleotide
caccgagactcagtatacaacatgatgtttggtgc

SEQ ID NO: 248499 - DNA, 35 bp, Artificial Sequence
  Description of Artificial Sequence: Synthetic oligonucleotide
accgagactcagtatacaacatgatgtttggtgcc

SEQ ID NO: 248500 - DNA, 34 bp, Artificial Sequence
  Description of Artificial Sequence: Synthetic oligonucleotide
ccgagactcagtatacaacatgatgtttggtgcc

SEQ ID NO: 248501 - DNA, 34 bp, Artificial Sequence
  Description of Artificial Sequence: Synthetic oligonucleotide
cgagactcagtatacaacatgatgtttggtgccg

SEQ ID NO: 248502 - DNA, 35 bp, Artificial Sequence
  Description of Artificial Sequence: Synthetic oligonucleotide
gagactcagtatacaacatgatgtttggtgccgac

SEQ ID NO: 248503 - DNA, 37 bp, Artificial Sequence
  Description of Artificial Sequence: Synthetic oligonucleotide
agactcagtatacaacatgatgtttggtgccgacatc

SEQ ID NO: 248504 - DNA, 36 bp, Artificial Sequence
  Description of Artificial Sequence: Synthetic oligonucleotide
gactcagtatacaacatgatgtttggtgccgacatc

SEQ ID NO: 248505 - DNA, 37 bp, Artificial Sequence
  Description of Artificial Sequence: Synthetic oligonucleotide
actcagtatacaacatgatgtttggtgccgacatctc

SEQ ID NO: 248506 - DNA, 36 bp, Artificial Sequence
  Description of Artificial Sequence: Synthetic oligonucleotide
ctcagtatacaacatgatgtttggtgccgacatctc

SEQ ID NO: 248507 - DNA, 37 bp, Artificial Sequence
  Description of Artificial Sequence: Synthetic oligonucleotide
tcagtatacaacatgatgtttggtgccgacatctctg

SEQ ID NO: 248508 - DNA, 36 bp, Artificial Sequence
  Description of Artificial Sequence: Synthetic oligonucleotide
cagtatacaacatgatgtttggtgccgacatctctg

SEQ ID NO: 248509 - DNA, 36 bp, Artificial Sequence
  Description of Artificial Sequence: Synthetic oligonucleotide
agtatacaacatgatgtttggtgccgacatctctgg

SEQ ID NO: 248510 - DNA, 35 bp, Artificial Sequence
  Description of Artificial Sequence: Synthetic oligonucleotide
gtatacaacatgatgtttggtgccgacatctctgg

SEQ ID NO: 248511 - DNA, 35 bp, Artificial Sequence
  Description of Artificial Sequence: Synthetic oligonucleotide
tatacaacatgatgtttggtgccgacatctctggc

SEQ ID NO: 248512 - DNA, 34 bp, Artificial Sequence
  Description of Artificial Sequence: Synthetic oligonucleotide
atacaacatgatgtttggtgccgacatctctggc

SEQ ID NO: 248513 - DNA, 33 bp, Artificial Sequence
  Description of Artificial Sequence: Synthetic oligonucleotide
tacaacatgatgtttggtgccgacatctctggc

SEQ ID NO: 248514 - DNA, 32 bp, Artificial Sequence
  Description of Artificial Sequence: Synthetic oligonucleotide
acaacatgatgtttggtgccgacatctctggc

SEQ ID NO: 248515 - DNA, 31 bp, Artificial Sequence
  Description of Artificial Sequence: Synthetic oligonucleotide
caacatgatgtttggtgccgacatctctggc

SEQ ID NO: 248516 - DNA, 31 bp, Artificial Sequence
  Description of Artificial Sequence: Synthetic oligonucleotide
aacatgatgtttggtgccgacatctctggcc

SEQ ID NO: 248517 - DNA, 30 bp, Artificial Sequence
  Description of Artificial Sequence: Synthetic oligonucleotide
acatgatgtttggtgccgacatctctggcc

SEQ ID NO: 248518 - DNA, 29 bp, Artificial Sequence
  Description of Artificial Sequence: Synthetic oligonucleotide
catgatgtttggtgccgacatctctggcc

SEQ ID NO: 248519 - DNA, 29 bp, Artificial Sequence
  Description of Artificial Sequence: Synthetic oligonucleotide
atgatgtttggtgccgacatctctggccc

SEQ ID NO: 248520 - DNA, 28 bp, Artificial Sequence
  Description of Artificial Sequence: Synthetic oligonucleotide
tgatgtttggtgccgacatctctggccc

SEQ ID NO: 248521 - DNA, 27 bp, Artificial Sequence
  Description of Artificial Sequence: Synthetic oligonucleotide
gatgtttggtgccgacatctctggccc

SEQ ID NO: 248522 - DNA, 28 bp, Artificial Sequence
  Description of Artificial Sequence: Synthetic oligonucleotide
atgtttggtgccgacatctctggccctg

SEQ ID NO: 248523 - DNA, 27 bp, Artificial Sequence
  Description of Artificial Sequence: Synthetic oligonucleotide
tgtttggtgccgacatctctggccctg

SEQ ID NO: 248524 - DNA, 26 bp, Artificial Sequence
  Description of Artificial Sequence: Synthetic oligonucleotide
gtttggtgccgacatctctggccctg

SEQ ID NO: 248525 - DNA, 26 bp, Artificial Sequence
  Description of Artificial Sequence: Synthetic oligonucleotide
tttggtgccgacatctctggccctgg

SEQ ID NO: 248526 - DNA, 25 bp, Artificial Sequence
  Description of Artificial Sequence: Synthetic oligonucleotide
ttggtgccgacatctctggccctgg

SEQ ID NO: 248527 - DNA, 24 bp, Artificial Sequence
  Description of Artificial Sequence: Synthetic oligonucleotide
tggtgccgacatctctggccctgg

SEQ ID NO: 248528 - DNA, 23 bp, Artificial Sequence
  Description of Artificial Sequence: Synthetic oligonucleotide
ggtgccgacatctctggccctgg

SEQ ID NO: 248529 - DNA, 24 bp, Artificial Sequence
  Description of Artificial Sequence: Synthetic oligonucleotide
gtgccgacatctctggccctggga

SEQ ID NO: 248530 - DNA, 24 bp, Artificial Sequence
  Description of Artificial Sequence: Synthetic oligonucleotide
tgccgacatctctggccctgggac

SEQ ID NO: 248531 - DNA, 23 bp, Artificial Sequence
  Description of Artificial Sequence: Synthetic oligonucleotide
gccgacatctctggccctgggac

SEQ ID NO: 248532 - DNA, 25 bp, Artificial Sequence
  Description of Artificial Sequence: Synthetic oligonucleotide
ccgacatctctggccctgggaccaa

SEQ ID NO: 248533 - DNA, 27 bp, Artificial Sequence
  Description of Artificial Sequence: Synthetic oligonucleotide
cgacatctctggccctgggaccaagaa

SEQ ID NO: 248534 - DNA, 27 bp, Artificial Sequence
  Description of Artificial Sequence: Synthetic oligonucleotide
gacatctctggccctgggaccaagaag

SEQ ID NO: 248535 - DNA, 27 bp, Artificial Sequence
  Description of Artificial Sequence: Synthetic oligonucleotide
acatctctggccctgggaccaagaagc

SEQ ID NO: 248536 - DNA, 27 bp, Artificial Sequence
  Description of Artificial Sequence: Synthetic oligonucleotide
catctctggccctgggaccaagaagct

SEQ ID NO: 248537 - DNA, 28 bp, Artificial Sequence
  Description of Artificial Sequence: Synthetic oligonucleotide
atctctggccctgggaccaagaagcttc

SEQ ID NO: 248538 - DNA, 27 bp, Artificial Sequence
  Description of Artificial Sequence: Synthetic oligonucleotide
tctctggccctgggaccaagaagcttc

SEQ ID NO: 248539 - DNA, 27 bp, Artificial Sequence
  Description of Artificial Sequence: Synthetic oligonucleotide
ctctggccctgggaccaagaagcttca

SEQ ID NO: 248540 - DNA, 28 bp, Artificial Sequence
  Description of Artificial Sequence: Synthetic oligonucleotide
tctggccctgggaccaagaagcttcatg

SEQ ID NO: 248541 - DNA, 27 bp, Artificial Sequence
  Description of Artificial Sequence: Synthetic oligonucleotide
ctggccctgggaccaagaagcttcatg

SEQ ID NO: 248542 - DNA, 28 bp, Artificial Sequence
  Description of Artificial Sequence: Synthetic oligonucleotide
tggccctgggaccaagaagcttcatgtc

SEQ ID NO: 248543 - DNA, 27 bp, Artificial Sequence
  Description of Artificial Sequence: Synthetic oligonucleotide
ggccctgggaccaagaagcttcatgtc

SEQ ID NO: 248544 - DNA, 29 bp, Artificial Sequence
  Description of Artificial Sequence: Synthetic oligonucleotide
gccctgggaccaagaagcttcatgtcaac

SEQ ID NO: 248545 - DNA, 31 bp, Artificial Sequence
  Description of Artificial Sequence: Synthetic oligonucleotide
ccctgggaccaagaagcttcatgtcaacttc

SEQ ID NO: 248546 - DNA, 33 bp, Artificial Sequence
  Description of Artificial Sequence: Synthetic oligonucleotide
cctgggaccaagaagcttcatgtcaacttcaac

SEQ ID NO: 248547 - DNA, 35 bp, Artificial Sequence
  Description of Artificial Sequence: Synthetic oligonucleotide
ctgggaccaagaagcttcatgtcaacttcaactag

SEQ ID NO: 248548 - DNA, 37 bp, Artificial Sequence
  Description of Artificial Sequence: Synthetic oligonucleotide
tgggaccaagaagcttcatgtcaacttcaactagaag

SEQ ID NO: 248549 - DNA, 36 bp, Artificial Sequence
  Description of Artificial Sequence: Synthetic oligonucleotide
gggaccaagaagcttcatgtcaacttcaactagaag

SEQ ID NO: 248550 - DNA, 36 bp, Artificial Sequence
  Description of Artificial Sequence: Synthetic oligonucleotide
ggaccaagaagcttcatgtcaacttcaactagaagg

SEQ ID NO: 248551 - DNA, 36 bp, Artificial Sequence
  Description of Artificial Sequence: Synthetic oligonucleotide
gaccaagaagcttcatgtcaacttcaactagaaggg

SEQ ID NO: 248552 - DNA, 36 bp, Artificial Sequence
  Description of Artificial Sequence: Synthetic oligonucleotide
accaagaagcttcatgtcaacttcaactagaagggc

SEQ ID NO: 248553 - DNA, 35 bp, Artificial Sequence
  Description of Artificial Sequence: Synthetic oligonucleotide
ccaagaagcttcatgtcaacttcaactagaagggc

SEQ ID NO: 248554 - DNA, 37 bp, Artificial Sequence
  Description of Artificial Sequence: Synthetic oligonucleotide
caagaagcttcatgtcaacttcaactagaagggcaag

SEQ ID NO: 248555 - DNA, 39 bp, Artificial Sequence
  Description of Artificial Sequence: Synthetic oligonucleotide
aagaagcttcatgtcaacttcaactagaagggcaagtac

SEQ ID NO: 248556 - DNA, 38 bp, Artificial Sequence
  Description of Artificial Sequence: Synthetic oligonucleotide
agaagcttcatgtcaacttcaactagaagggcaagtac

SEQ ID NO: 248557 - DNA, 37 bp, Artificial Sequence
  Description of Artificial Sequence: Synthetic oligonucleotide
gaagcttcatgtcaacttcaactagaagggcaagtac

SEQ ID NO: 248558 - DNA, 37 bp, Artificial Sequence
  Description of Artificial Sequence: Synthetic oligonucleotide
aagcttcatgtcaacttcaactagaagggcaagtacg

SEQ ID NO: 248559 - DNA, 36 bp, Artificial Sequence
  Description of Artificial Sequence: Synthetic oligonucleotide
agcttcatgtcaacttcaactagaagggcaagtacg

SEQ ID NO: 248560 - DNA, 35 bp, Artificial Sequence
  Description of Artificial Sequence: Synthetic oligonucleotide
gcttcatgtcaacttcaactagaagggcaagtacg

SEQ ID NO: 248561 - DNA, 36 bp, Artificial Sequence
  Description of Artificial Sequence: Synthetic oligonucleotide
cttcatgtcaacttcaactagaagggcaagtacgtg

SEQ ID NO: 248562 - DNA, 36 bp, Artificial Sequence
  Description of Artificial Sequence: Synthetic oligonucleotide
ttcatgtcaacttcaactagaagggcaagtacgtgc

SEQ ID NO: 248563 - DNA, 35 bp, Artificial Sequence
  Description of Artificial Sequence: Synthetic oligonucleotide
tcatgtcaacttcaactagaagggcaagtacgtgc

SEQ ID NO: 248564 - DNA, 34 bp, Artificial Sequence
  Description of Artificial Sequence: Synthetic oligonucleotide
catgtcaacttcaactagaagggcaagtacgtgc

SEQ ID NO: 248565 - DNA, 35 bp, Artificial Sequence
  Description of Artificial Sequence: Synthetic oligonucleotide
atgtcaacttcaactagaagggcaagtacgtgctg

SEQ ID NO: 248566 - DNA, 34 bp, Artificial Sequence
  Description of Artificial Sequence: Synthetic oligonucleotide
tgtcaacttcaactagaagggcaagtacgtgctg

SEQ ID NO: 248567 - DNA, 33 bp, Artificial Sequence
  Description of Artificial Sequence: Synthetic oligonucleotide
gtcaacttcaactagaagggcaagtacgtgctg

SEQ ID NO: 248568 - DNA, 35 bp, Artificial Sequence
  Description of Artificial Sequence: Synthetic oligonucleotide
tcaacttcaactagaagggcaagtacgtgctgaac

SEQ ID NO: 248569 - DNA, 34 bp, Artificial Sequence
  Description of Artificial Sequence: Synthetic oligonucleotide
caacttcaactagaagggcaagtacgtgctgaac

SEQ ID NO: 248570 - DNA, 36 bp, Artificial Sequence
  Description of Artificial Sequence: Synthetic oligonucleotide
aacttcaactagaagggcaagtacgtgctgaacaac

SEQ ID NO: 248571 - DNA, 35 bp, Artificial Sequence
  Description of Artificial Sequence: Synthetic oligonucleotide
acttcaactagaagggcaagtacgtgctgaacaac

SEQ ID NO: 248572 - DNA, 34 bp, Artificial Sequence
  Description of Artificial Sequence: Synthetic oligonucleotide
cttcaactagaagggcaagtacgtgctgaacaac

SEQ ID NO: 248573 - DNA, 36 bp, Artificial Sequence
  Description of Artificial Sequence: Synthetic oligonucleotide
ttcaactagaagggcaagtacgtgctgaacaacaag

SEQ ID NO: 248574 - DNA, 35 bp, Artificial Sequence
  Description of Artificial Sequence: Synthetic oligonucleotide
tcaactagaagggcaagtacgtgctgaacaacaag

SEQ ID NO: 248575 - DNA, 34 bp, Artificial Sequence
  Description of Artificial Sequence: Synthetic oligonucleotide
caactagaagggcaagtacgtgctgaacaacaag

SEQ ID NO: 248576 - DNA, 34 bp, Artificial Sequence
  Description of Artificial Sequence: Synthetic oligonucleotide
aactagaagggcaagtacgtgctgaacaacaagg

SEQ ID NO: 248577 - DNA, 33 bp, Artificial Sequence
  Description of Artificial Sequence: Synthetic oligonucleotide
actagaagggcaagtacgtgctgaacaacaagg

SEQ ID NO: 248578 - DNA, 32 bp, Artificial Sequence
  Description of Artificial Sequence: Synthetic oligonucleotide
ctagaagggcaagtacgtgctgaacaacaagg

SEQ ID NO: 248579 - DNA, 33 bp, Artificial Sequence
  Description of Artificial Sequence: Synthetic oligonucleotide
tagaagggcaagtacgtgctgaacaacaaggag

SEQ ID NO: 248580 - DNA, 32 bp, Artificial Sequence
  Description of Artificial Sequence: Synthetic oligonucleotide
agaagggcaagtacgtgctgaacaacaaggag

SEQ ID NO: 248581 - DNA, 31 bp, Artificial Sequence
  Description of Artificial Sequence: Synthetic oligonucleotide
gaagggcaagtacgtgctgaacaacaaggag

SEQ ID NO: 248582 - DNA, 33 bp, Artificial Sequence
  Description of Artificial Sequence: Synthetic oligonucleotide
aagggcaagtacgtgctgaacaacaaggagatc

SEQ ID NO: 248583 - DNA, 32 bp, Artificial Sequence
  Description of Artificial Sequence: Synthetic oligonucleotide
agggcaagtacgtgctgaacaacaaggagatc

SEQ ID NO: 248584 - DNA, 31 bp, Artificial Sequence
  Description of Artificial Sequence: Synthetic oligonucleotide
gggcaagtacgtgctgaacaacaaggagatc

SEQ ID NO: 248585 - DNA, 31 bp, Artificial Sequence
  Description of Artificial Sequence: Synthetic oligonucleotide
ggcaagtacgtgctgaacaacaaggagatcc

SEQ ID NO: 248586 - DNA, 31 bp, Artificial Sequence
  Description of Artificial Sequence: Synthetic oligonucleotide
gcaagtacgtgctgaacaacaaggagatccg

SEQ ID NO: 248587 - DNA, 33 bp, Artificial Sequence
  Description of Artificial Sequence: Synthetic oligonucleotide
caagtacgtgctgaacaacaaggagatccgttg

SEQ ID NO: 248588 - DNA, 33 bp, Artificial Sequence
  Description of Artificial Sequence: Synthetic oligonucleotide
aagtacgtgctgaacaacaaggagatccgttgc

SEQ ID NO: 248589 - DNA, 32 bp, Artificial Sequence
  Description of Artificial Sequence: Synthetic oligonucleotide
agtacgtgctgaacaacaaggagatccgttgc

SEQ ID NO: 248590 - DNA, 31 bp, Artificial Sequence
  Description of Artificial Sequence: Synthetic oligonucleotide
gtacgtgctgaacaacaaggagatccgttgc

SEQ ID NO: 248591 - DNA, 33 bp, Artificial Sequence
  Description of Artificial Sequence: Synthetic oligonucleotide
tacgtgctgaacaacaaggagatccgttgctag

SEQ ID NO: 248592 - DNA, 32 bp, Artificial Sequence
  Description of Artificial Sequence: Synthetic oligonucleotide
acgtgctgaacaacaaggagatccgttgctag

SEQ ID NO: 248593 - DNA, 31 bp, Artificial Sequence
  Description of Artificial Sequence: Synthetic oligonucleotide
cgtgctgaacaacaaggagatccgttgctag

SEQ ID NO: 248594 - DNA, 31 bp, Artificial Sequence
  Description of Artificial Sequence: Synthetic oligonucleotide
gtgctgaacaacaaggagatccgttgctagg

SEQ ID NO: 248595 - DNA, 33 bp, Artificial Sequence
  Description of Artificial Sequence: Synthetic oligonucleotide
tgctgaacaacaaggagatccgttgctaggatg

SEQ ID NO: 248596 - DNA, 32 bp, Artificial Sequence
  Description of Artificial Sequence: Synthetic oligonucleotide
gctgaacaacaaggagatccgttgctaggatg

SEQ ID NO: 248597 - DNA, 34 bp, Artificial Sequence
  Description of Artificial Sequence: Synthetic oligonucleotide
ctgaacaacaaggagatccgttgctaggatgatg

SEQ ID NO: 248598 - DNA, 35 bp, Artificial Sequence
  Description of Artificial Sequence: Synthetic oligonucleotide
tgaacaacaaggagatccgttgctaggatgatgtg

SEQ ID NO: 248599 - DNA, 34 bp, Artificial Sequence
  Description of Artificial Sequence: Synthetic oligonucleotide
gaacaacaaggagatccgttgctaggatgatgtg

SEQ ID NO: 248600 - DNA, 38 bp, Artificial Sequence
  Description of Artificial Sequence: Synthetic oligonucleotide
aacaacaaggagatccgttgctaggatgatgtgtttac

SEQ ID NO: 248601 - DNA, 37 bp, Artificial Sequence
  Description of Artificial Sequence: Synthetic oligonucleotide
acaacaaggagatccgttgctaggatgatgtgtttac

SEQ ID NO: 248602 - DNA, 36 bp, Artificial Sequence
  Description of Artificial Sequence: Synthetic oligonucleotide
caacaaggagatccgttgctaggatgatgtgtttac

SEQ ID NO: 248603 - DNA, 37 bp, Artificial Sequence
  Description of Artificial Sequence: Synthetic oligonucleotide
aacaaggagatccgttgctaggatgatgtgtttacac

SEQ ID NO: 248604 - DNA, 36 bp, Artificial Sequence
  Description of Artificial Sequence: Synthetic oligonucleotide
acaaggagatccgttgctaggatgatgtgtttacac

SEQ ID NO: 248605 - DNA, 35 bp, Artificial Sequence
  Description of Artificial Sequence: Synthetic oligonucleotide
caaggagatccgttgctaggatgatgtgtttacac

SEQ ID NO: 248606 - DNA, 36 bp, Artificial Sequence
  Description of Artificial Sequence: Synthetic oligonucleotide
aaggagatccgttgctaggatgatgtgtttacacag

SEQ ID NO: 248607 - DNA, 35 bp, Artificial Sequence
  Description of Artificial Sequence: Synthetic oligonucleotide
aggagatccgttgctaggatgatgtgtttacacag

SEQ ID NO: 248608 - DNA, 34 bp, Artificial Sequence
  Description of Artificial Sequence: Synthetic oligonucleotide
ggagatccgttgctaggatgatgtgtttacacag

SEQ ID NO: 248609 - DNA, 34 bp, Artificial Sequence
  Description of Artificial Sequence: Synthetic oligonucleotide
gagatccgttgctaggatgatgtgtttacacagc

SEQ ID NO: 248610 - DNA, 35 bp, Artificial Sequence
  Description of Artificial Sequence: Synthetic oligonucleotide
agatccgttgctaggatgatgtgtttacacagctg

SEQ ID NO: 248611 - DNA, 34 bp, Artificial Sequence
  Description of Artificial Sequence: Synthetic oligonucleotide
gatccgttgctaggatgatgtgtttacacagctg

SEQ ID NO: 248612 - DNA, 36 bp, Artificial Sequence
  Description of Artificial Sequence: Synthetic oligonucleotide
atccgttgctaggatgatgtgtttacacagctgtac

SEQ ID NO: 248613 - DNA, 35 bp, Artificial Sequence
  Description of Artificial Sequence: Synthetic oligonucleotide
tccgttgctaggatgatgtgtttacacagctgtac

SEQ ID NO: 248614 - DNA, 34 bp, Artificial Sequence
  Description of Artificial Sequence: Synthetic oligonucleotide
ccgttgctaggatgatgtgtttacacagctgtac

SEQ ID NO: 248615 - DNA, 35 bp, Artificial Sequence
  Description of Artificial Sequence: Synthetic oligonucleotide
cgttgctaggatgatgtgtttacacagctgtacac

SEQ ID NO: 248616 - DNA, 36 bp, Artificial Sequence
  Description of Artificial Sequence: Synthetic oligonucleotide
gttgctaggatgatgtgtttacacagctgtacacag

SEQ ID NO: 248617 - DNA, 37 bp, Artificial Sequence
  Description of Artificial Sequence: Synthetic oligonucleotide
ttgctaggatgatgtgtttacacagctgtacacagtg

SEQ ID NO: 248618 - DNA, 36 bp, Artificial Sequence
  Description of Artificial Sequence: Synthetic oligonucleotide
tgctaggatgatgtgtttacacagctgtacacagtg

SEQ ID NO: 248619 - DNA, 35 bp, Artificial Sequence
  Description of Artificial Sequence: Synthetic oligonucleotide
gctaggatgatgtgtttacacagctgtacacagtg

SEQ ID NO: 248620 - DNA, 38 bp, Artificial Sequence
  Description of Artificial Sequence: Synthetic oligonucleotide
ctaggatgatgtgtttacacagctgtacacagtgattg

SEQ ID NO: 248621 - DNA, 39 bp, Artificial Sequence
  Description of Artificial Sequence: Synthetic oligonucleotide
taggatgatgtgtttacacagctgtacacagtgattgtg

SEQ ID NO: 248622 - DNA, 38 bp, Artificial Sequence
  Description of Artificial Sequence: Synthetic oligonucleotide
aggatgatgtgtttacacagctgtacacagtgattgtg

SEQ ID NO: 248623 - DNA, 37 bp, Artificial Sequence
  Description of Artificial Sequence: Synthetic oligonucleotide
ggatgatgtgtttacacagctgtacacagtgattgtg

SEQ ID NO: 248624 - DNA, 37 bp, Artificial Sequence
  Description of Artificial Sequence: Synthetic oligonucleotide
gatgatgtgtttacacagctgtacacagtgattgtgc

SEQ ID NO: 248625 - DNA, 37 bp, Artificial Sequence
  Description of Artificial Sequence: Synthetic oligonucleotide
atgatgtgtttacacagctgtacacagtgattgtgcc

SEQ ID NO: 248626 - DNA, 36 bp, Artificial Sequence
  Description of Artificial Sequence: Synthetic oligonucleotide
tgatgtgtttacacagctgtacacagtgattgtgcc

SEQ ID NO: 248627 - DNA, 35 bp, Artificial Sequence
  Description of Artificial Sequence: Synthetic oligonucleotide
gatgtgtttacacagctgtacacagtgattgtgcc

SEQ ID NO: 248628 - DNA, 35 bp, Artificial Sequence
  Description of Artificial Sequence: Synthetic oligonucleotide
atgtgtttacacagctgtacacagtgattgtgccg

SEQ ID NO: 248629 - DNA, 34 bp, Artificial Sequence
  Description of Artificial Sequence: Synthetic oligonucleotide
tgtgtttacacagctgtacacagtgattgtgccg

SEQ ID NO: 248630 - DNA, 33 bp, Artificial Sequence
  Description of Artificial Sequence: Synthetic oligonucleotide
gtgtttacacagctgtacacagtgattgtgccg

SEQ ID NO: 248631 - DNA, 33 bp, Artificial Sequence
  Description of Artificial Sequence: Synthetic oligonucleotide
tgtttacacagctgtacacagtgattgtgccgc

SEQ ID NO: 248632 - DNA, 32 bp, Artificial Sequence
  Description of Artificial Sequence: Synthetic oligonucleotide
gtttacacagctgtacacagtgattgtgccgc

SEQ ID NO: 248633 - DNA, 32 bp, Artificial Sequence
  Description of Artificial Sequence: Synthetic oligonucleotide
tttacacagctgtacacagtgattgtgccgcc

SEQ ID NO: 248634 - DNA, 31 bp, Artificial Sequence
  Description of Artificial Sequence: Synthetic oligonucleotide
ttacacagctgtacacagtgattgtgccgcc

SEQ ID NO: 248635 - DNA, 30 bp, Artificial Sequence
  Description of Artificial Sequence: Synthetic oligonucleotide
tacacagctgtacacagtgattgtgccgcc

SEQ ID NO: 248636 - DNA, 29 bp, Artificial Sequence
  Description of Artificial Sequence: Synthetic oligonucleotide
acacagctgtacacagtgattgtgccgcc

SEQ ID NO: 248637 - DNA, 28 bp, Artificial Sequence
  Description of Artificial Sequence: Synthetic oligonucleotide
cacagctgtacacagtgattgtgccgcc

SEQ ID NO: 248638 - DNA, 29 bp, Artificial Sequence
  Description of Artificial Sequence: Synthetic oligonucleotide
acagctgtacacagtgattgtgccgccag

SEQ ID NO: 248639 - DNA, 28 bp, Artificial Sequence
  Description of Artificial Sequence: Synthetic oligonucleotide
cagctgtacacagtgattgtgccgccag

SEQ ID NO: 248640 - DNA, 29 bp, Artificial Sequence
  Description of Artificial Sequence: Synthetic oligonucleotide
agctgtacacagtgattgtgccgccagac

SEQ ID NO: 248641 - DNA, 28 bp, Artificial Sequence
  Description of Artificial Sequence: Synthetic oligonucleotide
gctgtacacagtgattgtgccgccagac

SEQ ID NO: 248642 - DNA, 30 bp, Artificial Sequence
  Description of Artificial Sequence: Synthetic oligonucleotide
ctgtacacagtgattgtgccgccagacaag

SEQ ID NO: 248643 - DNA, 31 bp, Artificial Sequence
  Description of Artificial Sequence: Synthetic oligonucleotide
tgtacacagtgattgtgccgccagacaagac

SEQ ID NO: 248644 - DNA, 30 bp, Artificial Sequence
  Description of Artificial Sequence: Synthetic oligonucleotide
gtacacagtgattgtgccgccagacaagac

SEQ ID NO: 248645 - DNA, 30 bp, Artificial Sequence
  Description of Artificial Sequence: Synthetic oligonucleotide
tacacagtgattgtgccgccagacaagacc

SEQ ID NO: 248646 - DNA, 29 bp, Artificial Sequence
  Description of Artificial Sequence: Synthetic oligonucleotide
acacagtgattgtgccgccagacaagacc

SEQ ID NO: 248647 - DNA, 28 bp, Artificial Sequence
  Description of Artificial Sequence: Synthetic oligonucleotide
cacagtgattgtgccgccagacaagacc

SEQ ID NO: 248648 - DNA, 31 bp, Artificial Sequence
  Description of Artificial Sequence: Synthetic oligonucleotide
acagtgattgtgccgccagacaagacctatg

SEQ ID NO: 248649 - DNA, 30 bp, Artificial Sequence
  Description of Artificial Sequence: Synthetic oligonucleotide
cagtgattgtgccgccagacaagacctatg

SEQ ID NO: 248650 - DNA, 31 bp, Artificial Sequence
  Description of Artificial Sequence: Synthetic oligonucleotide
agtgattgtgccgccagacaagacctatgag

SEQ ID NO: 248651 - DNA, 30 bp, Artificial Sequence
  Description of Artificial Sequence: Synthetic oligonucleotide
gtgattgtgccgccagacaagacctatgag

SEQ ID NO: 248652 - DNA, 30 bp, Artificial Sequence
  Description of Artificial Sequence: Synthetic oligonucleotide
tgattgtgccgccagacaagacctatgagc

SEQ ID NO: 248653 - DNA, 29 bp, Artificial Sequence
  Description of Artificial Sequence: Synthetic oligonucleotide
gattgtgccgccagacaagacctatgagc

SEQ ID NO: 248654 - DNA, 30 bp, Artificial Sequence
  Description of Artificial Sequence: Synthetic oligonucleotide
attgtgccgccagacaagacctatgagctg

SEQ ID NO: 248655 - DNA, 29 bp, Artificial Sequence
  Description of Artificial Sequence: Synthetic oligonucleotide
ttgtgccgccagacaagacctatgagctg

SEQ ID NO: 248656 - DNA, 28 bp, Artificial Sequence
  Description of Artificial Sequence: Synthetic oligonucleotide
tgtgccgccagacaagacctatgagctg

SEQ ID NO: 248657 - DNA, 27 bp, Artificial Sequence
  Description of Artificial Sequence: Synthetic oligonucleotide
gtgccgccagacaagacctatgagctg

SEQ ID NO: 248658 - DNA, 29 bp, Artificial Sequence
  Description of Artificial Sequence: Synthetic oligonucleotide
tgccgccagacaagacctatgagctgaag

SEQ ID NO: 248659 - DNA, 28 bp, Artificial Sequence
  Description of Artificial Sequence: Synthetic oligonucleotide
gccgccagacaagacctatgagctgaag

SEQ ID NO: 248660 - DNA, 31 bp, Artificial Sequence
  Description of Artificial Sequence: Synthetic oligonucleotide
ccgccagacaagacctatgagctgaagattg

SEQ ID NO: 248661 - DNA, 32 bp, Artificial Sequence
  Description of Artificial Sequence: Synthetic oligonucleotide
cgccagacaagacctatgagctgaagattgtc

SEQ ID NO: 248662 - DNA, 34 bp, Artificial Sequence
  Description of Artificial Sequence: Synthetic oligonucleotide
gccagacaagacctatgagctgaagattgtcaac

SEQ ID NO: 248663 - DNA, 35 bp, Artificial Sequence
  Description of Artificial Sequence: Synthetic oligonucleotide
ccagacaagacctatgagctgaagattgtcaacag

SEQ ID NO: 248664 - DNA, 35 bp, Artificial Sequence
  Description of Artificial Sequence: Synthetic oligonucleotide
cagacaagacctatgagctgaagattgtcaacagc

SEQ ID NO: 248665 - DNA, 35 bp, Artificial Sequence
  Description of Artificial Sequence: Synthetic oligonucleotide
agacaagacctatgagctgaagattgtcaacagcc

SEQ ID NO: 248666 - DNA, 34 bp, Artificial Sequence
  Description of Artificial Sequence: Synthetic oligonucleotide
gacaagacctatgagctgaagattgtcaacagcc

SEQ ID NO: 248667 - DNA, 35 bp, Artificial Sequence
  Description of Artificial Sequence: Synthetic oligonucleotide
acaagacctatgagctgaagattgtcaacagccac

SEQ ID NO: 248668 - DNA, 34 bp, Artificial Sequence
  Description of Artificial Sequence: Synthetic oligonucleotide
caagacctatgagctgaagattgtcaacagccac

SEQ ID NO: 248669 - DNA, 34 bp, Artificial Sequence
  Description of Artificial Sequence: Synthetic oligonucleotide
aagacctatgagctgaagattgtcaacagccacg

SEQ ID NO: 248670 - DNA, 33 bp, Artificial Sequence
  Description of Artificial Sequence: Synthetic oligonucleotide
agacctatgagctgaagattgtcaacagccacg

SEQ ID NO: 248671 - DNA, 32 bp, Artificial Sequence
  Description of Artificial Sequence: Synthetic oligonucleotide
gacctatgagctgaagattgtcaacagccacg

SEQ ID NO: 248672 - DNA, 33 bp, Artificial Sequence
  Description of Artificial Sequence: Synthetic oligonucleotide
acctatgagctgaagattgtcaacagccacgtg

SEQ ID NO: 248673 - DNA, 32 bp, Artificial Sequence
  Description of Artificial Sequence: Synthetic oligonucleotide
cctatgagctgaagattgtcaacagccacgtg

SEQ ID NO: 248674 - DNA, 32 bp, Artificial Sequence
  Description of Artificial Sequence: Synthetic oligonucleotide
ctatgagctgaagattgtcaacagccacgtgg

SEQ ID NO: 248675 - DNA, 33 bp, Artificial Sequence
  Description of Artificial Sequence: Synthetic oligonucleotide
tatgagctgaagattgtcaacagccacgtggag

SEQ ID NO: 248676 - DNA, 32 bp, Artificial Sequence
  Description of Artificial Sequence: Synthetic oligonucleotide
atgagctgaagattgtcaacagccacgtggag

SEQ ID NO: 248677 - DNA, 31 bp, Artificial Sequence
  Description of Artificial Sequence: Synthetic oligonucleotide
tgagctgaagattgtcaacagccacgtggag

SEQ ID NO: 248678 - DNA, 30 bp, Artificial Sequence
  Description of Artificial Sequence: Synthetic oligonucleotide
gagctgaagattgtcaacagccacgtggag

SEQ ID NO: 248679 - DNA, 31 bp, Artificial Sequence
  Description of Artificial Sequence: Synthetic oligonucleotide
agctgaagattgtcaacagccacgtggagtc

SEQ ID NO: 248680 - DNA, 30 bp, Artificial Sequence
  Description of Artificial Sequence: Synthetic oligonucleotide
gctgaagattgtcaacagccacgtggagtc

SEQ ID NO: 248681 - DNA, 30 bp, Artificial Sequence
  Description of Artificial Sequence: Synthetic oligonucleotide
ctgaagattgtcaacagccacgtggagtcc

SEQ ID NO: 248682 - DNA, 30 bp, Artificial Sequence
  Description of Artificial Sequence: Synthetic oligonucleotide
tgaagattgtcaacagccacgtggagtccc

SEQ ID NO: 248683 - DNA, 29 bp, Artificial Sequence
  Description of Artificial Sequence: Synthetic oligonucleotide
gaagattgtcaacagccacgtggagtccc

SEQ ID NO: 248684 - DNA, 29 bp, Artificial Sequence
  Description of Artificial Sequence: Synthetic oligonucleotide
aagattgtcaacagccacgtggagtcccg

SEQ ID NO: 248685 - DNA, 28 bp, Artificial Sequence
  Description of Artificial Sequence: Synthetic oligonucleotide
agattgtcaacagccacgtggagtcccg

SEQ ID NO: 248686 - DNA, 27 bp, Artificial Sequence
  Description of Artificial Sequence: Synthetic oligonucleotide
gattgtcaacagccacgtggagtcccg

SEQ ID NO: 248687 - DNA, 27 bp, Artificial Sequence
  Description of Artificial Sequence: Synthetic oligonucleotide
attgtcaacagccacgtggagtcccgc

SEQ ID NO: 248688 - DNA, 27 bp, Artificial Sequence
  Description of Artificial Sequence: Synthetic oligonucleotide
ttgtcaacagccacgtggagtcccgct

SEQ ID NO: 248689 - DNA, 26 bp, Artificial Sequence
  Description of Artificial Sequence: Synthetic oligonucleotide
tgtcaacagccacgtggagtcccgct

SEQ ID NO: 248690 - DNA, 25 bp, Artificial Sequence
  Description of Artificial Sequence: Synthetic oligonucleotide
gtcaacagccacgtggagtcccgct

SEQ ID NO: 248691 - DNA, 25 bp, Artificial Sequence
  Description of Artificial Sequence: Synthetic oligonucleotide
tcaacagccacgtggagtcccgctc

SEQ ID NO: 248692 - DNA, 24 bp, Artificial Sequence
  Description of Artificial Sequence: Synthetic oligonucleotide
caacagccacgtggagtcccgctc

SEQ ID NO: 248693 - DNA, 26 bp, Artificial Sequence
  Description of Artificial Sequence: Synthetic oligonucleotide
aacagccacgtggagtcccgctcctt

SEQ ID NO: 248694 - DNA, 25 bp, Artificial Sequence
  Description of Artificial Sequence: Synthetic oligonucleotide
acagccacgtggagtcccgctcctt

SEQ ID NO: 248695 - DNA, 24 bp, Artificial Sequence
  Description of Artificial Sequence: Synthetic oligonucleotide
cagccacgtggagtcccgctcctt

SEQ ID NO: 248696 - DNA, 24 bp, Artificial Sequence
  Description of Artificial Sequence: Synthetic oligonucleotide
agccacgtggagtcccgctccttg

SEQ ID NO: 248697 - DNA, 23 bp, Artificial Sequence
  Description of Artificial Sequence: Synthetic oligonucleotide
gccacgtggagtcccgctccttg

SEQ ID NO: 248698 - DNA, 25 bp, Artificial Sequence
  Description of Artificial Sequence: Synthetic oligonucleotide
ccacgtggagtcccgctccttggta

SEQ ID NO: 248699 - DNA, 26 bp, Artificial Sequence
  Description of Artificial Sequence: Synthetic oligonucleotide
cacgtggagtcccgctccttggtaga

SEQ ID NO: 248700 - DNA, 26 bp, Artificial Sequence
  Description of Artificial Sequence: Synthetic oligonucleotide
acgtggagtcccgctccttggtagac

SEQ ID NO: 248701 - DNA, 25 bp, Artificial Sequence
  Description of Artificial Sequence: Synthetic oligonucleotide
cgtggagtcccgctccttggtagac

SEQ ID NO: 248702 - DNA, 27 bp, Artificial Sequence
  Description of Artificial Sequence: Synthetic oligonucleotide
gtggagtcccgctccttggtagacgat

SEQ ID NO: 248703 - DNA, 28 bp, Artificial Sequence
  Description of Artificial Sequence: Synthetic oligonucleotide
tggagtcccgctccttggtagacgattg

SEQ ID NO: 248704 - DNA, 27 bp, Artificial Sequence
  Description of Artificial Sequence: Synthetic oligonucleotide
ggagtcccgctccttggtagacgattg

SEQ ID NO: 248705 - DNA, 27 bp, Artificial Sequence
  Description of Artificial Sequence: Synthetic oligonucleotide
gagtcccgctccttggtagacgattgc

SEQ ID NO: 248706 - DNA, 27 bp, Artificial Sequence
  Description of Artificial Sequence: Synthetic oligonucleotide
agtcccgctccttggtagacgattgcg

SEQ ID NO: 248707 - DNA, 27 bp, Artificial Sequence
  Description of Artificial Sequence: Synthetic oligonucleotide
gtcccgctccttggtagacgattgcga

SEQ ID NO: 248708 - DNA, 27 bp, Artificial Sequence
  Description of Artificial Sequence: Synthetic oligonucleotide
tcccgctccttggtagacgattgcgac

SEQ ID NO: 248709 - DNA, 27 bp, Artificial Sequence
  Description of Artificial Sequence: Synthetic oligonucleotide
cccgctccttggtagacgattgcgact

SEQ ID NO: 248710 - DNA, 28 bp, Artificial Sequence
  Description of Artificial Sequence: Synthetic oligonucleotide
ccgctccttggtagacgattgcgacttc

SEQ ID NO: 248711 - DNA, 28 bp, Artificial Sequence
  Description of Artificial Sequence: Synthetic oligonucleotide
cgctccttggtagacgattgcgacttcc

SEQ ID NO: 248712 - DNA, 29 bp, Artificial Sequence
  Description of Artificial Sequence: Synthetic oligonucleotide
gctccttggtagacgattgcgacttcctg

SEQ ID NO: 248713 - DNA, 29 bp, Artificial Sequence
  Description of Artificial Sequence: Synthetic oligonucleotide
ctccttggtagacgattgcgacttcctgg

SEQ ID NO: 248714 - DNA, 29 bp, Artificial Sequence
  Description of Artificial Sequence: Synthetic oligonucleotide
tccttggtagacgattgcgacttcctggc

SEQ ID NO: 248715 - DNA, 28 bp, Artificial Sequence
  Description of Artificial Sequence: Synthetic oligonucleotide
ccttggtagacgattgcgacttcctggc

SEQ ID NO: 248716 - DNA, 29 bp, Artificial Sequence
  Description of Artificial Sequence: Synthetic oligonucleotide
cttggtagacgattgcgacttcctggcac

SEQ ID NO: 248717 - DNA, 29 bp, Artificial Sequence
  Description of Artificial Sequence: Synthetic oligonucleotide
ttggtagacgattgcgacttcctggcacc

SEQ ID NO: 248718 - DNA, 28 bp, Artificial Sequence
  Description of Artificial Sequence: Synthetic oligonucleotide
tggtagacgattgcgacttcctggcacc

SEQ ID NO: 248719 - DNA, 27 bp, Artificial Sequence
  Description of Artificial Sequence: Synthetic oligonucleotide
ggtagacgattgcgacttcctggcacc

SEQ ID NO: 248720 - DNA, 27 bp, Artificial Sequence
  Description of Artificial Sequence: Synthetic oligonucleotide
gtagacgattgcgacttcctggcaccc

SEQ ID NO: 248721 - DNA, 29 bp, Artificial Sequence
  Description of Artificial Sequence: Synthetic oligonucleotide
tagacgattgcgacttcctggcacccaag

SEQ ID NO: 248722 - DNA, 28 bp, Artificial Sequence
  Description of Artificial Sequence: Synthetic oligonucleotide
agacgattgcgacttcctggcacccaag

SEQ ID NO: 248723 - DNA, 27 bp, Artificial Sequence
  Description of Artificial Sequence: Synthetic oligonucleotide
gacgattgcgacttcctggcacccaag

SEQ ID NO: 248724 - DNA, 29 bp, Artificial Sequence
  Description of Artificial Sequence: Synthetic oligonucleotide
acgattgcgacttcctggcacccaagatg

SEQ ID NO: 248725 - DNA, 28 bp, Artificial Sequence
  Description of Artificial Sequence: Synthetic oligonucleotide
cgattgcgacttcctggcacccaagatg

SEQ ID NO: 248726 - DNA, 33 bp, Artificial Sequence
  Description of Artificial Sequence: Synthetic oligonucleotide
gattgcgacttcctggcacccaagatgataaag

SEQ ID NO: 248727 - DNA, 33 bp, Artificial Sequence
  Description of Artificial Sequence: Synthetic oligonucleotide
attgcgacttcctggcacccaagatgataaagg

SEQ ID NO: 248728 - DNA, 32 bp, Artificial Sequence
  Description of Artificial Sequence: Synthetic oligonucleotide
ttgcgacttcctggcacccaagatgataaagg

SEQ ID NO: 248729 - DNA, 31 bp, Artificial Sequence
  Description of Artificial Sequence: Synthetic oligonucleotide
tgcgacttcctggcacccaagatgataaagg

SEQ ID NO: 248730 - DNA, 30 bp, Artificial Sequence
  Description of Artificial Sequence: Synthetic oligonucleotide
gcgacttcctggcacccaagatgataaagg

SEQ ID NO: 248731 - DNA, 32 bp, Artificial Sequence
  Description of Artificial Sequence: Synthetic oligonucleotide
cgacttcctggcacccaagatgataaaggaac

SEQ ID NO: 248732 - DNA, 32 bp, Artificial Sequence
  Description of Artificial Sequence: Synthetic oligonucleotide
gacttcctggcacccaagatgataaaggaacc

SEQ ID NO: 248733 - DNA, 33 bp, Artificial Sequence
  Description of Artificial Sequence: Synthetic oligonucleotide
acttcctggcacccaagatgataaaggaacctg

SEQ ID NO: 248734 - DNA, 32 bp, Artificial Sequence
  Description of Artificial Sequence: Synthetic oligonucleotide
cttcctggcacccaagatgataaaggaacctg

SEQ ID NO: 248735 - DNA, 34 bp, Artificial Sequence
  Description of Artificial Sequence: Synthetic oligonucleotide
ttcctggcacccaagatgataaaggaacctgatg

SEQ ID NO: 248736 - DNA, 33 bp, Artificial Sequence
  Description of Artificial Sequence: Synthetic oligonucleotide
tcctggcacccaagatgataaaggaacctgatg

SEQ ID NO: 248737 - DNA, 32 bp, Artificial Sequence
  Description of Artificial Sequence: Synthetic oligonucleotide
cctggcacccaagatgataaaggaacctgatg

SEQ ID NO: 248738 - DNA, 32 bp, Artificial Sequence
  Description of Artificial Sequence: Synthetic oligonucleotide
ctggcacccaagatgataaaggaacctgatgc

SEQ ID NO: 248739 - DNA, 34 bp, Artificial Sequence
  Description of Artificial Sequence: Synthetic oligonucleotide
tggcacccaagatgataaaggaacctgatgctac

SEQ ID NO: 248740 - DNA, 33 bp, Artificial Sequence
  Description of Artificial Sequence: Synthetic oligonucleotide
ggcacccaagatgataaaggaacctgatgctac

SEQ ID NO: 248741 - DNA, 37 bp, Artificial Sequence
  Description of Artificial Sequence: Synthetic oligonucleotide
gcacccaagatgataaaggaacctgatgctacaaaac

SEQ ID NO: 248742 - DNA, 37 bp, Artificial Sequence
  Description of Artificial Sequence: Synthetic oligonucleotide
cacccaagatgataaaggaacctgatgctacaaaacc

SEQ ID NO: 248743 - DNA, 37 bp, Artificial Sequence
  Description of Artificial Sequence: Synthetic oligonucleotide
acccaagatgataaaggaacctgatgctacaaaaccg

SEQ ID NO: 248744 - DNA, 36 bp, Artificial Sequence
  Description of Artificial Sequence: Synthetic oligonucleotide
cccaagatgataaaggaacctgatgctacaaaaccg

SEQ ID NO: 248745 - DNA, 36 bp, Artificial Sequence
  Description of Artificial Sequence: Synthetic oligonucleotide
ccaagatgataaaggaacctgatgctacaaaaccgg

SEQ ID NO: 248746 - DNA, 38 bp, Artificial Sequence
  Description of Artificial Sequence: Synthetic oligonucleotide
caagatgataaaggaacctgatgctacaaaaccggtag

SEQ ID NO: 248747 - DNA, 39 bp, Artificial Sequence
  Description of Artificial Sequence: Synthetic oligonucleotide
aagatgataaaggaacctgatgctacaaaaccggtagac

SEQ ID NO: 248748 - DNA, 38 bp, Artificial Sequence
  Description of Artificial Sequence: Synthetic oligonucleotide
agatgataaaggaacctgatgctacaaaaccggtagac

SEQ ID NO: 248749 - DNA, 37 bp, Artificial Sequence
  Description of Artificial Sequence: Synthetic oligonucleotide
gatgataaaggaacctgatgctacaaaaccggtagac

SEQ ID NO: 248750 - DNA, 38 bp, Artificial Sequence
  Description of Artificial Sequence: Synthetic oligonucleotide
atgataaaggaacctgatgctacaaaaccggtagactg

SEQ ID NO: 248751 - DNA, 37 bp, Artificial Sequence
  Description of Artificial Sequence: Synthetic oligonucleotide
tgataaaggaacctgatgctacaaaaccggtagactg

SEQ ID NO: 248752 - DNA, 36 bp, Artificial Sequence
  Description of Artificial Sequence: Synthetic oligonucleotide
gataaaggaacctgatgctacaaaaccggtagactg

SEQ ID NO: 248753 - DNA, 36 bp, Artificial Sequence
  Description of Artificial Sequence: Synthetic oligonucleotide
ataaaggaacctgatgctacaaaaccggtagactgg

SEQ ID NO: 248754 - DNA, 35 bp, Artificial Sequence
  Description of Artificial Sequence: Synthetic oligonucleotide
taaaggaacctgatgctacaaaaccggtagactgg

SEQ ID NO: 248755 - DNA, 34 bp, Artificial Sequence
  Description of Artificial Sequence: Synthetic oligonucleotide
aaaggaacctgatgctacaaaaccggtagactgg

SEQ ID NO: 248756 - DNA, 33 bp, Artificial Sequence
  Description of Artificial Sequence: Synthetic oligonucleotide
aaggaacctgatgctacaaaaccggtagactgg

SEQ ID NO: 248757 - DNA, 32 bp, Artificial Sequence
  Description of Artificial Sequence: Synthetic oligonucleotide
aggaacctgatgctacaaaaccggtagactgg

SEQ ID NO: 248758 - DNA, 31 bp, Artificial Sequence
  Description of Artificial Sequence: Synthetic oligonucleotide
ggaacctgatgctacaaaaccggtagactgg

SEQ ID NO: 248759 - DNA, 31 bp, Artificial Sequence
  Description of Artificial Sequence: Synthetic oligonucleotide
gaacctgatgctacaaaaccggtagactggg

SEQ ID NO: 248760 - DNA, 33 bp, Artificial Sequence
  Description of Artificial Sequence: Synthetic oligonucleotide
aacctgatgctacaaaaccggtagactgggaag

SEQ ID NO: 248761 - DNA, 32 bp, Artificial Sequence
  Description of Artificial Sequence: Synthetic oligonucleotide
acctgatgctacaaaaccggtagactgggaag

SEQ ID NO: 248762 - DNA, 31 bp, Artificial Sequence
  Description of Artificial Sequence: Synthetic oligonucleotide
cctgatgctacaaaaccggtagactgggaag

SEQ ID NO: 248763 - DNA, 32 bp, Artificial Sequence
  Description of Artificial Sequence: Synthetic oligonucleotide
ctgatgctacaaaaccggtagactgggaagag

SEQ ID NO: 248764 - DNA, 32 bp, Artificial Sequence
  Description of Artificial Sequence: Synthetic oligonucleotide
tgatgctacaaaaccggtagactgggaagagc

SEQ ID NO: 248765 - DNA, 31 bp, Artificial Sequence
  Description of Artificial Sequence: Synthetic oligonucleotide
gatgctacaaaaccggtagactgggaagagc

SEQ ID NO: 248766 - DNA, 31 bp, Artificial Sequence
  Description of Artificial Sequence: Synthetic oligonucleotide
atgctacaaaaccggtagactgggaagagcg

SEQ ID NO: 248767 - DNA, 30 bp, Artificial Sequence
  Description of Artificial Sequence: Synthetic oligonucleotide
tgctacaaaaccggtagactgggaagagcg

SEQ ID NO: 248768 - DNA, 29 bp, Artificial Sequence
  Description of Artificial Sequence: Synthetic oligonucleotide
gctacaaaaccggtagactgggaagagcg

SEQ ID NO: 248769 - DNA, 29 bp, Artificial Sequence
  Description of Artificial Sequence: Synthetic oligonucleotide
ctacaaaaccggtagactgggaagagcgg

SEQ ID NO: 248770 - DNA, 29 bp, Artificial Sequence
  Description of Artificial Sequence: Synthetic oligonucleotide
tacaaaaccggtagactgggaagagcggg

SEQ ID NO: 248771 - DNA, 28 bp, Artificial Sequence
  Description of Artificial Sequence: Synthetic oligonucleotide
acaaaaccggtagactgggaagagcggg

SEQ ID NO: 248772 - DNA, 27 bp, Artificial Sequence
  Description of Artificial Sequence: Synthetic oligonucleotide
caaaaccggtagactgggaagagcggg

SEQ ID NO: 248773 - DNA, 27 bp, Artificial Sequence
  Description of Artificial Sequence: Synthetic oligonucleotide
aaaaccggtagactgggaagagcgggc

SEQ ID NO: 248774 - DNA, 26 bp, Artificial Sequence
  Description of Artificial Sequence: Synthetic oligonucleotide
aaaccggtagactgggaagagcgggc

SEQ ID NO: 248775 - DNA, 25 bp, Artificial Sequence
  Description of Artificial Sequence: Synthetic oligonucleotide
aaccggtagactgggaagagcgggc

SEQ ID NO: 248776 - DNA, 24 bp, Artificial Sequence
  Description of Artificial Sequence: Synthetic oligonucleotide
accggtagactgggaagagcgggc

SEQ ID NO: 248777 - DNA, 23 bp, Artificial Sequence
  Description of Artificial Sequence: Synthetic oligonucleotide
ccggtagactgggaagagcgggc

SEQ ID NO: 248778 - DNA, 25 bp, Artificial Sequence
  Description of Artificial Sequence: Synthetic oligonucleotide
cggtagactgggaagagcgggccta

SEQ ID NO: 248779 - DNA, 27 bp, Artificial Sequence
  Description of Artificial Sequence: Synthetic oligonucleotide
ggtagactgggaagagcgggcctagat

SEQ ID NO: 248780 - DNA, 27 bp, Artificial Sequence
  Description of Artificial Sequence: Synthetic oligonucleotide
gtagactgggaagagcgggcctagatc

SEQ ID NO: 248781 - DNA, 27 bp, Artificial Sequence
  Description of Artificial Sequence: Synthetic oligonucleotide
tagactgggaagagcgggcctagatcg

SEQ ID NO: 248782 - DNA, 27 bp, Artificial Sequence
  Description of Artificial Sequence: Synthetic oligonucleotide
agactgggaagagcgggcctagatcga

SEQ ID NO: 248783 - DNA, 27 bp, Artificial Sequence
  Description of Artificial Sequence: Synthetic oligonucleotide
gactgggaagagcgggcctagatcgat

SEQ ID NO: 248784 - DNA, 27 bp, Artificial Sequence
  Description of Artificial Sequence: Synthetic oligonucleotide
actgggaagagcgggcctagatcgatg

SEQ ID NO: 248785 - DNA, 27 bp, Artificial Sequence
  Description of Artificial Sequence: Synthetic oligonucleotide
ctgggaagagcgggcctagatcgatgt

SEQ ID NO: 248786 - DNA, 28 bp, Artificial Sequence
  Description of Artificial Sequence: Synthetic oligonucleotide
tgggaagagcgggcctagatcgatgttc

SEQ ID NO: 248787 - DNA, 27 bp, Artificial Sequence
  Description of Artificial Sequence: Synthetic oligonucleotide
gggaagagcgggcctagatcgatgttc

SEQ ID NO: 248788 - DNA, 27 bp, Artificial Sequence
  Description of Artificial Sequence: Synthetic oligonucleotide
ggaagagcgggcctagatcgatgttcc

SEQ ID NO: 248789 - DNA, 27 bp, Artificial Sequence
  Description of Artificial Sequence: Synthetic oligonucleotide
gaagagcgggcctagatcgatgttccc

SEQ ID NO: 248790 - DNA, 28 bp, Artificial Sequence
  Description of Artificial Sequence: Synthetic oligonucleotide
aagagcgggcctagatcgatgttcccac

SEQ ID NO: 248791 - DNA, 27 bp, Artificial Sequence
  Description of Artificial Sequence: Synthetic oligonucleotide
agagcgggcctagatcgatgttcccac

SEQ ID NO: 248792 - DNA, 27 bp, Artificial Sequence
  Description of Artificial Sequence: Synthetic oligonucleotide
gagcgggcctagatcgatgttcccaca

SEQ ID NO: 248793 - DNA, 27 bp, Artificial Sequence
  Description of Artificial Sequence: Synthetic oligonucleotide
agcgggcctagatcgatgttcccacag

SEQ ID NO: 248794 - DNA, 27 bp, Artificial Sequence
  Description of Artificial Sequence: Synthetic oligonucleotide
gcgggcctagatcgatgttcccacaga

SEQ ID NO: 248795 - DNA, 27 bp, Artificial Sequence
  Description of Artificial Sequence: Synthetic oligonucleotide
cgggcctagatcgatgttcccacagag

SEQ ID NO: 248796 - DNA, 28 bp, Artificial Sequence
  Description of Artificial Sequence: Synthetic oligonucleotide
gggcctagatcgatgttcccacagagtc

SEQ ID NO: 248797 - DNA, 28 bp, Artificial Sequence
  Description of Artificial Sequence: Synthetic oligonucleotide
ggcctagatcgatgttcccacagagtcc

SEQ ID NO: 248798 - DNA, 30 bp, Artificial Sequence
  Description of Artificial Sequence: Synthetic oligonucleotide
gcctagatcgatgttcccacagagtccaag

SEQ ID NO: 248799 - DNA, 30 bp, Artificial Sequence
  Description of Artificial Sequence: Synthetic oligonucleotide
cctagatcgatgttcccacagagtccaagc

SEQ ID NO: 248800 - DNA, 30 bp, Artificial Sequence
  Description of Artificial Sequence: Synthetic oligonucleotide
ctagatcgatgttcccacagagtccaagcc

SEQ ID NO: 248801 - DNA, 31 bp, Artificial Sequence
  Description of Artificial Sequence: Synthetic oligonucleotide
tagatcgatgttcccacagagtccaagcctc

SEQ ID NO: 248802 - DNA, 30 bp, Artificial Sequence
  Description of Artificial Sequence: Synthetic oligonucleotide
agatcgatgttcccacagagtccaagcctc

SEQ ID NO: 248803 - DNA, 29 bp, Artificial Sequence
  Description of Artificial Sequence: Synthetic oligonucleotide
gatcgatgttcccacagagtccaagcctc

SEQ ID NO: 248804 - DNA, 30 bp, Artificial Sequence
  Description of Artificial Sequence: Synthetic oligonucleotide
atcgatgttcccacagagtccaagcctcag

SEQ ID NO: 248805 - DNA, 29 bp, Artificial Sequence
  Description of Artificial Sequence: Synthetic oligonucleotide
tcgatgttcccacagagtccaagcctcag

SEQ ID NO: 248806 - DNA, 28 bp, Artificial Sequence
  Description of Artificial Sequence: Synthetic oligonucleotide
cgatgttcccacagagtccaagcctcag

SEQ ID NO: 248807 - DNA, 28 bp, Artificial Sequence
  Description of Artificial Sequence: Synthetic oligonucleotide
gatgttcccacagagtccaagcctcagg

SEQ ID NO: 248808 - DNA, 29 bp, Artificial Sequence
  Description of Artificial Sequence: Synthetic oligonucleotide
atgttcccacagagtccaagcctcaggac

SEQ ID NO: 248809 - DNA, 28 bp, Artificial Sequence
  Description of Artificial Sequence: Synthetic oligonucleotide
tgttcccacagagtccaagcctcaggac

SEQ ID NO: 248810 - DNA, 27 bp, Artificial Sequence
  Description of Artificial Sequence: Synthetic oligonucleotide
gttcccacagagtccaagcctcaggac

SEQ ID NO: 248811 - DNA, 28 bp, Artificial Sequence
  Description of Artificial Sequence: Synthetic oligonucleotide
ttcccacagagtccaagcctcaggactg

SEQ ID NO: 248812 - DNA, 27 bp, Artificial Sequence
  Description of Artificial Sequence: Synthetic oligonucleotide
tcccacagagtccaagcctcaggactg

SEQ ID NO: 248813 - DNA, 26 bp, Artificial Sequence
  Description of Artificial Sequence: Synthetic oligonucleotide
cccacagagtccaagcctcaggactg

SEQ ID NO: 248814 - DNA, 26 bp, Artificial Sequence
  Description of Artificial Sequence: Synthetic oligonucleotide
ccacagagtccaagcctcaggactgg

SEQ ID NO: 248815 - DNA, 27 bp, Artificial Sequence
  Description of Artificial Sequence: Synthetic oligonucleotide
cacagagtccaagcctcaggactgggt

SEQ ID NO: 248816 - DNA, 27 bp, Artificial Sequence
  Description of Artificial Sequence: Synthetic oligonucleotide
acagagtccaagcctcaggactgggtc

SEQ ID NO: 248817 - DNA, 27 bp, Artificial Sequence
  Description of Artificial Sequence: Synthetic oligonucleotide
cagagtccaagcctcaggactgggtca

SEQ ID NO: 248818 - DNA, 28 bp, Artificial Sequence
  Description of Artificial Sequence: Synthetic oligonucleotide
agagtccaagcctcaggactgggtcaag

SEQ ID NO: 248819 - DNA, 27 bp, Artificial Sequence
  Description of Artificial Sequence: Synthetic oligonucleotide
gagtccaagcctcaggactgggtcaag

SEQ ID NO: 248820 - DNA, 27 bp, Artificial Sequence
  Description of Artificial Sequence: Synthetic oligonucleotide
agtccaagcctcaggactgggtcaagc

SEQ ID NO: 248821 - DNA, 26 bp, Artificial Sequence
  Description of Artificial Sequence: Synthetic oligonucleotide
gtccaagcctcaggactgggtcaagc

SEQ ID NO: 248822 - DNA, 26 bp, Artificial Sequence
  Description of Artificial Sequence: Synthetic oligonucleotide
tccaagcctcaggactgggtcaagcc

SEQ ID NO: 248823 - DNA, 25 bp, Artificial Sequence
  Description of Artificial Sequence: Synthetic oligonucleotide
ccaagcctcaggactgggtcaagcc

SEQ ID NO: 248824 - DNA, 25 bp, Artificial Sequence
  Description of Artificial Sequence: Synthetic oligonucleotide
caagcctcaggactgggtcaagccc

SEQ ID NO: 248825 - DNA, 26 bp, Artificial Sequence
  Description of Artificial Sequence: Synthetic oligonucleotide
aagcctcaggactgggtcaagcccga

SEQ ID NO: 248826 - DNA, 25 bp, Artificial Sequence
  Description of Artificial Sequence: Synthetic oligonucleotide
agcctcaggactgggtcaagcccga

SEQ ID NO: 248827 - DNA, 24 bp, Artificial Sequence
  Description of Artificial Sequence: Synthetic oligonucleotide
gcctcaggactgggtcaagcccga

SEQ ID NO: 248828 - DNA, 24 bp, Artificial Sequence
  Description of Artificial Sequence: Synthetic oligonucleotide
cctcaggactgggtcaagcccgac

SEQ ID NO: 248829 - DNA, 27 bp, Artificial Sequence
  Description of Artificial Sequence: Synthetic oligonucleotide
ctcaggactgggtcaagcccgaccata

SEQ ID NO: 248830 - DNA, 28 bp, Artificial Sequence
  Description of Artificial Sequence: Synthetic oligonucleotide
tcaggactgggtcaagcccgaccatatc

SEQ ID NO: 248831 - DNA, 27 bp, Artificial Sequence
  Description of Artificial Sequence: Synthetic oligonucleotide
caggactgggtcaagcccgaccatatc

SEQ ID NO: 248832 - DNA, 27 bp, Artificial Sequence
  Description of Artificial Sequence: Synthetic oligonucleotide
aggactgggtcaagcccgaccatatcc

SEQ ID NO: 248833 - DNA, 26 bp, Artificial Sequence
  Description of Artificial Sequence: Synthetic oligonucleotide
ggactgggtcaagcccgaccatatcc

SEQ ID NO: 248834 - DNA, 27 bp, Artificial Sequence
  Description of Artificial Sequence: Synthetic oligonucleotide
gactgggtcaagcccgaccatatccct

SEQ ID NO: 248835 - DNA, 27 bp, Artificial Sequence
  Description of Artificial Sequence: Synthetic oligonucleotide
actgggtcaagcccgaccatatccctc

SEQ ID NO: 248836 - DNA, 27 bp, Artificial Sequence
  Description of Artificial Sequence: Synthetic oligonucleotide
ctgggtcaagcccgaccatatccctca

SEQ ID NO: 248837 - DNA, 27 bp, Artificial Sequence
  Description of Artificial Sequence: Synthetic oligonucleotide
tgggtcaagcccgaccatatccctcac

SEQ ID NO: 248838 - DNA, 26 bp, Artificial Sequence
  Description of Artificial Sequence: Synthetic oligonucleotide
gggtcaagcccgaccatatccctcac

SEQ ID NO: 248839 - DNA, 26 bp, Artificial Sequence
  Description of Artificial Sequence: Synthetic oligonucleotide
ggtcaagcccgaccatatccctcacc

SEQ ID NO: 248840 - DNA, 27 bp, Artificial Sequence
  Description of Artificial Sequence: Synthetic oligonucleotide
gtcaagcccgaccatatccctcaccct

SEQ ID NO: 248841 - DNA, 27 bp, Artificial Sequence
  Description of Artificial Sequence: Synthetic oligonucleotide
tcaagcccgaccatatccctcaccctg

SEQ ID NO: 248842 - DNA, 27 bp, Artificial Sequence
  Description of Artificial Sequence: Synthetic oligonucleotide
caagcccgaccatatccctcaccctga

SEQ ID NO: 248843 - DNA, 28 bp, Artificial Sequence
  Description of Artificial Sequence: Synthetic oligonucleotide
aagcccgaccatatccctcaccctgatg

SEQ ID NO: 248844 - DNA, 27 bp, Artificial Sequence
  Description of Artificial Sequence: Synthetic oligonucleotide
agcccgaccatatccctcaccctgatg

SEQ ID NO: 248845 - DNA, 26 bp, Artificial Sequence
  Description of Artificial Sequence: Synthetic oligonucleotide
gcccgaccatatccctcaccctgatg

SEQ ID NO: 248846 - DNA, 27 bp, Artificial Sequence
  Description of Artificial Sequence: Synthetic oligonucleotide
cccgaccatatccctcaccctgatggt

SEQ ID NO: 248847 - DNA, 29 bp, Artificial Sequence
  Description of Artificial Sequence: Synthetic oligonucleotide
ccgaccatatccctcaccctgatggtaag

SEQ ID NO: 248848 - DNA, 31 bp, Artificial Sequence
  Description of Artificial Sequence: Synthetic oligonucleotide
cgaccatatccctcaccctgatggtaagaag

SEQ ID NO: 248849 - DNA, 31 bp, Artificial Sequence
  Description of Artificial Sequence: Synthetic oligonucleotide
gaccatatccctcaccctgatggtaagaagc

SEQ ID NO: 248850 - DNA, 31 bp, Artificial Sequence
  Description of Artificial Sequence: Synthetic oligonucleotide
accatatccctcaccctgatggtaagaagcc

SEQ ID NO: 248851 - DNA, 30 bp, Artificial Sequence
  Description of Artificial Sequence: Synthetic oligonucleotide
ccatatccctcaccctgatggtaagaagcc

SEQ ID NO: 248852 - DNA, 30 bp, Artificial Sequence
  Description of Artificial Sequence: Synthetic oligonucleotide
catatccctcaccctgatggtaagaagccg

SEQ ID NO: 248853 - DNA, 30 bp, Artificial Sequence
  Description of Artificial Sequence: Synthetic oligonucleotide
atatccctcaccctgatggtaagaagccgg

SEQ ID NO: 248854 - DNA, 29 bp, Artificial Sequence
  Description of Artificial Sequence: Synthetic oligonucleotide
tatccctcaccctgatggtaagaagccgg

SEQ ID NO: 248855 - DNA, 28 bp, Artificial Sequence
  Description of Artificial Sequence: Synthetic oligonucleotide
atccctcaccctgatggtaagaagccgg

SEQ ID NO: 248856 - DNA, 27 bp, Artificial Sequence
  Description of Artificial Sequence: Synthetic oligonucleotide
tccctcaccctgatggtaagaagccgg

SEQ ID NO: 248857 - DNA, 27 bp, Artificial Sequence
  Description of Artificial Sequence: Synthetic oligonucleotide
ccctcaccctgatggtaagaagccgga

SEQ ID NO: 248858 - DNA, 27 bp, Artificial Sequence
  Description of Artificial Sequence: Synthetic oligonucleotide
cctcaccctgatggtaagaagccggag

SEQ ID NO: 248859 - DNA, 27 bp, Artificial Sequence
  Description of Artificial Sequence: Synthetic oligonucleotide
ctcaccctgatggtaagaagccggagg

SEQ ID NO: 248860 - DNA, 28 bp, Artificial Sequence
  Description of Artificial Sequence: Synthetic oligonucleotide
tcaccctgatggtaagaagccggaggac

SEQ ID NO: 248861 - DNA, 27 bp, Artificial Sequence
  Description of Artificial Sequence: Synthetic oligonucleotide
caccctgatggtaagaagccggaggac

SEQ ID NO: 248862 - DNA, 28 bp, Artificial Sequence
  Description of Artificial Sequence: Synthetic oligonucleotide
accctgatggtaagaagccggaggactg

SEQ ID NO: 248863 - DNA, 27 bp, Artificial Sequence
  Description of Artificial Sequence: Synthetic oligonucleotide
ccctgatggtaagaagccggaggactg

SEQ ID NO: 248864 - DNA, 27 bp, Artificial Sequence
  Description of Artificial Sequence: Synthetic oligonucleotide
cctgatggtaagaagccggaggactgg

SEQ ID NO: 248865 - DNA, 27 bp, Artificial Sequence
  Description of Artificial Sequence: Synthetic oligonucleotide
ctgatggtaagaagccggaggactggc

SEQ ID NO: 248866 - DNA, 29 bp, Artificial Sequence
  Description of Artificial Sequence: Synthetic oligonucleotide
tgatggtaagaagccggaggactggcatg

SEQ ID NO: 248867 - DNA, 28 bp, Artificial Sequence
  Description of Artificial Sequence: Synthetic oligonucleotide
gatggtaagaagccggaggactggcatg

SEQ ID NO: 248868 - DNA, 30 bp, Artificial Sequence
  Description of Artificial Sequence: Synthetic oligonucleotide
atggtaagaagccggaggactggcatgaag

SEQ ID NO: 248869 - DNA, 29 bp, Artificial Sequence
  Description of Artificial Sequence: Synthetic oligonucleotide
tggtaagaagccggaggactggcatgaag

SEQ ID NO: 248870 - DNA, 28 bp, Artificial Sequence
  Description of Artificial Sequence: Synthetic oligonucleotide
ggtaagaagccggaggactggcatgaag

SEQ ID NO: 248871 - DNA, 29 bp, Artificial Sequence
  Description of Artificial Sequence: Synthetic oligonucleotide
gtaagaagccggaggactggcatgaagag

SEQ ID NO: 248872 - DNA, 31 bp, Artificial Sequence
  Description of Artificial Sequence: Synthetic oligonucleotide
taagaagccggaggactggcatgaagagaag

SEQ ID NO: 248873 - DNA, 30 bp, Artificial Sequence
  Description of Artificial Sequence: Synthetic oligonucleotide
aagaagccggaggactggcatgaagagaag

SEQ ID NO: 248874 - DNA, 29 bp, Artificial Sequence
  Description of Artificial Sequence: Synthetic oligonucleotide
agaagccggaggactggcatgaagagaag

SEQ ID NO: 248875 - DNA, 28 bp, Artificial Sequence
  Description of Artificial Sequence: Synthetic oligonucleotide
gaagccggaggactggcatgaagagaag

SEQ ID NO: 248876 - DNA, 28 bp, Artificial Sequence
  Description of Artificial Sequence: Synthetic oligonucleotide
aagccggaggactggcatgaagagaagg

SEQ ID NO: 248877 - DNA, 27 bp, Artificial Sequence
  Description of Artificial Sequence: Synthetic oligonucleotide
agccggaggactggcatgaagagaagg

SEQ ID NO: 248878 - DNA, 27 bp, Artificial Sequence
  Description of Artificial Sequence: Synthetic oligonucleotide
gccggaggactggcatgaagagaagga

SEQ ID NO: 248879 - DNA, 27 bp, Artificial Sequence
  Description of Artificial Sequence: Synthetic oligonucleotide
ccggaggactggcatgaagagaaggac

SEQ ID NO: 248880 - DNA, 27 bp, Artificial Sequence
  Description of Artificial Sequence: Synthetic oligonucleotide
cggaggactggcatgaagagaaggacg

SEQ ID NO: 248881 - DNA, 27 bp, Artificial Sequence
  Description of Artificial Sequence: Synthetic oligonucleotide
ggaggactggcatgaagagaaggacgg

SEQ ID NO: 248882 - DNA, 28 bp, Artificial Sequence
  Description of Artificial Sequence: Synthetic oligonucleotide
gaggactggcatgaagagaaggacggag

SEQ ID NO: 248883 - DNA, 29 bp, Artificial Sequence
  Description of Artificial Sequence: Synthetic oligonucleotide
aggactggcatgaagagaaggacggagac

SEQ ID NO: 248884 - DNA, 28 bp, Artificial Sequence
  Description of Artificial Sequence: Synthetic oligonucleotide
ggactggcatgaagagaaggacggagac

SEQ ID NO: 248885 - DNA, 29 bp, Artificial Sequence
  Description of Artificial Sequence: Synthetic oligonucleotide
gactggcatgaagagaaggacggagactg

SEQ ID NO: 248886 - DNA, 29 bp, Artificial Sequence
  Description of Artificial Sequence: Synthetic oligonucleotide
actggcatgaagagaaggacggagactgg

SEQ ID NO: 248887 - DNA, 28 bp, Artificial Sequence
  Description of Artificial Sequence: Synthetic oligonucleotide
ctggcatgaagagaaggacggagactgg

SEQ ID NO: 248888 - DNA, 28 bp, Artificial Sequence
  Description of Artificial Sequence: Synthetic oligonucleotide
tggcatgaagagaaggacggagactggg

SEQ ID NO: 248889 - DNA, 27 bp, Artificial Sequence
  Description of Artificial Sequence: Synthetic oligonucleotide
ggcatgaagagaaggacggagactggg

SEQ ID NO: 248890 - DNA, 29 bp, Artificial Sequence
  Description of Artificial Sequence: Synthetic oligonucleotide
gcatgaagagaaggacggagactgggaac

SEQ ID NO: 248891 - DNA, 29 bp, Artificial Sequence
  Description of Artificial Sequence: Synthetic oligonucleotide
catgaagagaaggacggagactgggaacc

SEQ ID NO: 248892 - DNA, 29 bp, Artificial Sequence
  Description of Artificial Sequence: Synthetic oligonucleotide
atgaagagaaggacggagactgggaaccc

SEQ ID NO: 248893 - DNA, 28 bp, Artificial Sequence
  Description of Artificial Sequence: Synthetic oligonucleotide
tgaagagaaggacggagactgggaaccc

SEQ ID NO: 248894 - DNA, 27 bp, Artificial Sequence
  Description of Artificial Sequence: Synthetic oligonucleotide
gaagagaaggacggagactgggaaccc

SEQ ID NO: 248895 - DNA, 27 bp, Artificial Sequence
  Description of Artificial Sequence: Synthetic oligonucleotide
aagagaaggacggagactgggaacccg

SEQ ID NO: 248896 - DNA, 26 bp, Artificial Sequence
  Description of Artificial Sequence: Synthetic oligonucleotide
agagaaggacggagactgggaacccg

SEQ ID NO: 248897 - DNA, 25 bp, Artificial Sequence
  Description of Artificial Sequence: Synthetic oligonucleotide
gagaaggacggagactgggaacccg

SEQ ID NO: 248898 - DNA, 26 bp, Artificial Sequence
  Description of Artificial Sequence: Synthetic oligonucleotide
agaaggacggagactgggaacccgca

SEQ ID NO: 248899 - DNA, 25 bp, Artificial Sequence
  Description of Artificial Sequence: Synthetic oligonucleotide
gaaggacggagactgggaacccgca

SEQ ID NO: 248900 - DNA, 26 bp, Artificial Sequence
  Description of Artificial Sequence: Synthetic oligonucleotide
aaggacggagactgggaacccgcagt

SEQ ID NO: 248901 - DNA, 25 bp, Artificial Sequence
  Description of Artificial Sequence: Synthetic oligonucleotide
aggacggagactgggaacccgcagt

SEQ ID NO: 248902 - DNA, 24 bp, Artificial Sequence
  Description of Artificial Sequence: Synthetic oligonucleotide
ggacggagactgggaacccgcagt

SEQ ID NO: 248903 - DNA, 27 bp, Artificial Sequence
  Description of Artificial Sequence: Synthetic oligonucleotide
gacggagactgggaacccgcagtgatt

SEQ ID NO: 248904 - DNA, 27 bp, Artificial Sequence
  Description of Artificial Sequence: Synthetic oligonucleotide
acggagactgggaacccgcagtgattc

SEQ ID NO: 248905 - DNA, 27 bp, Artificial Sequence
  Description of Artificial Sequence: Synthetic oligonucleotide
cggagactgggaacccgcagtgattct

SEQ ID NO: 248906 - DNA, 27 bp, Artificial Sequence
  Description of Artificial Sequence: Synthetic oligonucleotide
ggagactgggaacccgcagtgattctg

SEQ ID NO: 248907 - DNA, 29 bp, Artificial Sequence
  Description of Artificial Sequence: Synthetic oligonucleotide
gagactgggaacccgcagtgattctgaac

SEQ ID NO: 248908 - DNA, 29 bp, Artificial Sequence
  Description of Artificial Sequence: Synthetic oligonucleotide
agactgggaacccgcagtgattctgaacc

SEQ ID NO: 248909 - DNA, 28 bp, Artificial Sequence
  Description of Artificial Sequence: Synthetic oligonucleotide
gactgggaacccgcagtgattctgaacc

SEQ ID NO: 248910 - DNA, 28 bp, Artificial Sequence
  Description of Artificial Sequence: Synthetic oligonucleotide
actgggaacccgcagtgattctgaaccc

SEQ ID NO: 248911 - DNA, 27 bp, Artificial Sequence
  Description of Artificial Sequence: Synthetic oligonucleotide
ctgggaacccgcagtgattctgaaccc

SEQ ID NO: 248912 - DNA, 28 bp, Artificial Sequence
  Description of Artificial Sequence: Synthetic oligonucleotide
tgggaacccgcagtgattctgaaccctg

SEQ ID NO: 248913 - DNA, 27 bp, Artificial Sequence
  Description of Artificial Sequence: Synthetic oligonucleotide
gggaacccgcagtgattctgaaccctg

SEQ ID NO: 248914 - DNA, 28 bp, Artificial Sequence
  Description of Artificial Sequence: Synthetic oligonucleotide
ggaacccgcagtgattctgaaccctgac

SEQ ID NO: 248915 - DNA, 30 bp, Artificial Sequence
  Description of Artificial Sequence: Synthetic oligonucleotide
gaacccgcagtgattctgaaccctgactac

SEQ ID NO: 248916 - DNA, 32 bp, Artificial Sequence
  Description of Artificial Sequence: Synthetic oligonucleotide
aacccgcagtgattctgaaccctgactacaag

SEQ ID NO: 248917 - DNA, 31 bp, Artificial Sequence
  Description of Artificial Sequence: Synthetic oligonucleotide
acccgcagtgattctgaaccctgactacaag

SEQ ID NO: 248918 - DNA, 30 bp, Artificial Sequence
  Description of Artificial Sequence: Synthetic oligonucleotide
cccgcagtgattctgaaccctgactacaag

SEQ ID NO: 248919 - DNA, 30 bp, Artificial Sequence
  Description of Artificial Sequence: Synthetic oligonucleotide
ccgcagtgattctgaaccctgactacaagg

SEQ ID NO: 248920 - DNA, 30 bp, Artificial Sequence
  Description of Artificial Sequence: Synthetic oligonucleotide
cgcagtgattctgaaccctgactacaaggg

SEQ ID NO: 248921 - DNA, 31 bp, Artificial Sequence
  Description of Artificial Sequence: Synthetic oligonucleotide
gcagtgattctgaaccctgactacaagggtc

SEQ ID NO: 248922 - DNA, 32 bp, Artificial Sequence
  Description of Artificial Sequence: Synthetic oligonucleotide
cagtgattctgaaccctgactacaagggtcag

SEQ ID NO: 248923 - DNA, 33 bp, Artificial Sequence
  Description of Artificial Sequence: Synthetic oligonucleotide
agtgattctgaaccctgactacaagggtcagtg

SEQ ID NO: 248924 - DNA, 32 bp, Artificial Sequence
  Description of Artificial Sequence: Synthetic oligonucleotide
gtgattctgaaccctgactacaagggtcagtg

SEQ ID NO: 248925 - DNA, 32 bp, Artificial Sequence
  Description of Artificial Sequence: Synthetic oligonucleotide
tgattctgaaccctgactacaagggtcagtgg

SEQ ID NO: 248926 - DNA, 31 bp, Artificial Sequence
  Description of Artificial Sequence: Synthetic oligonucleotide
gattctgaaccctgactacaagggtcagtgg

SEQ ID NO: 248927 - DNA, 33 bp, Artificial Sequence
  Description of Artificial Sequence: Synthetic oligonucleotide
attctgaaccctgactacaagggtcagtggaag

SEQ ID NO: 248928 - DNA, 32 bp, Artificial Sequence
  Description of Artificial Sequence: Synthetic oligonucleotide
ttctgaaccctgactacaagggtcagtggaag

SEQ ID NO: 248929 - DNA, 31 bp, Artificial Sequence
  Description of Artificial Sequence: Synthetic oligonucleotide
tctgaaccctgactacaagggtcagtggaag

SEQ ID NO: 248930 - DNA, 30 bp, Artificial Sequence
  Description of Artificial Sequence: Synthetic oligonucleotide
ctgaaccctgactacaagggtcagtggaag

SEQ ID NO: 248931 - DNA, 30 bp, Artificial Sequence
  Description of Artificial Sequence: Synthetic oligonucleotide
tgaaccctgactacaagggtcagtggaagc

SEQ ID NO: 248932 - DNA, 29 bp, Artificial Sequence
  Description of Artificial Sequence: Synthetic oligonucleotide
gaaccctgactacaagggtcagtggaagc

SEQ ID NO: 248933 - DNA, 29 bp, Artificial Sequence
  Description of Artificial Sequence: Synthetic oligonucleotide
aaccctgactacaagggtcagtggaagcg

SEQ ID NO: 248934 - DNA, 28 bp, Artificial Sequence
  Description of Artificial Sequence: Synthetic oligonucleotide
accctgactacaagggtcagtggaagcg

SEQ ID NO: 248935 - DNA, 27 bp, Artificial Sequence
  Description of Artificial Sequence: Synthetic oligonucleotide
ccctgactacaagggtcagtggaagcg

SEQ ID NO: 248936 - DNA, 27 bp, Artificial Sequence
  Description of Artificial Sequence: Synthetic oligonucleotide
cctgactacaagggtcagtggaagcgc

SEQ ID NO: 248937 - DNA, 27 bp, Artificial Sequence
  Description of Artificial Sequence: Synthetic oligonucleotide
ctgactacaagggtcagtggaagcgcc

SEQ ID NO: 248938 - DNA, 27 bp, Artificial Sequence
  Description of Artificial Sequence: Synthetic oligonucleotide
tgactacaagggtcagtggaagcgccg

SEQ ID NO: 248939 - DNA, 26 bp, Artificial Sequence
  Description of Artificial Sequence: Synthetic oligonucleotide
gactacaagggtcagtggaagcgccg

SEQ ID NO: 248940 - DNA, 26 bp, Artificial Sequence
  Description of Artificial Sequence: Synthetic oligonucleotide
actacaagggtcagtggaagcgccgg

SEQ ID NO: 248941 - DNA, 25 bp, Artificial Sequence
  Description of Artificial Sequence: Synthetic oligonucleotide
ctacaagggtcagtggaagcgccgg

SEQ ID NO: 248942 - DNA, 26 bp, Artificial Sequence
  Description of Artificial Sequence: Synthetic oligonucleotide
tacaagggtcagtggaagcgccggca

SEQ ID NO: 248943 - DNA, 25 bp, Artificial Sequence
  Description of Artificial Sequence: Synthetic oligonucleotide
acaagggtcagtggaagcgccggca

SEQ ID NO: 248944 - DNA, 24 bp, Artificial Sequence
  Description of Artificial Sequence: Synthetic oligonucleotide
caagggtcagtggaagcgccggca

SEQ ID NO: 248945 - DNA, 26 bp, Artificial Sequence
  Description of Artificial Sequence: Synthetic oligonucleotide
aagggtcagtggaagcgccggcagat

SEQ ID NO: 248946 - DNA, 25 bp, Artificial Sequence
  Description of Artificial Sequence: Synthetic oligonucleotide
agggtcagtggaagcgccggcagat

SEQ ID NO: 248947 - DNA, 24 bp, Artificial Sequence
  Description of Artificial Sequence: Synthetic oligonucleotide
gggtcagtggaagcgccggcagat

SEQ ID NO: 248948 - DNA, 24 bp, Artificial Sequence
  Description of Artificial Sequence: Synthetic oligonucleotide
ggtcagtggaagcgccggcagatg

SEQ ID NO: 248949 - DNA, 25 bp, Artificial Sequence
  Description of Artificial Sequence: Synthetic oligonucleotide
gtcagtggaagcgccggcagatgga

SEQ ID NO: 248950 - DNA, 27 bp, Artificial Sequence
  Description of Artificial Sequence: Synthetic oligonucleotide
tcagtggaagcgccggcagatggacaa

SEQ ID NO: 248951 - DNA, 26 bp, Artificial Sequence
  Description of Artificial Sequence: Synthetic oligonucleotide
cagtggaagcgccggcagatggacaa

SEQ ID NO: 248952 - DNA, 26 bp, Artificial Sequence
  Description of Artificial Sequence: Synthetic oligonucleotide
agtggaagcgccggcagatggacaac

SEQ ID NO: 248953 - DNA, 25 bp, Artificial Sequence
  Description of Artificial Sequence: Synthetic oligonucleotide
gtggaagcgccggcagatggacaac

SEQ ID NO: 248954 - DNA, 25 bp, Artificial Sequence
  Description of Artificial Sequence: Synthetic oligonucleotide
tggaagcgccggcagatggacaacc

SEQ ID NO: 248955 - DNA, 24 bp, Artificial Sequence
  Description of Artificial Sequence: Synthetic oligonucleotide
ggaagcgccggcagatggacaacc

SEQ ID NO: 248956 - DNA, 25 bp, Artificial Sequence
  Description of Artificial Sequence: Synthetic oligonucleotide
gaagcgccggcagatggacaaccca

SEQ ID NO: 248957 - DNA, 27 bp, Artificial Sequence
  Description of Artificial Sequence: Synthetic oligonucleotide
aagcgccggcagatggacaacccacat

SEQ ID NO: 248958 - DNA, 27 bp, Artificial Sequence
  Description of Artificial Sequence: Synthetic oligonucleotide
agcgccggcagatggacaacccacatt

SEQ ID NO: 248959 - DNA, 27 bp, Artificial Sequence
  Description of Artificial Sequence: Synthetic oligonucleotide
gcgccggcagatggacaacccacatta

SEQ ID NO: 248960 - DNA, 27 bp, Artificial Sequence
  Description of Artificial Sequence: Synthetic oligonucleotide
cgccggcagatggacaacccacattac

SEQ ID NO: 248961 - DNA, 29 bp, Artificial Sequence
  Description of Artificial Sequence: Synthetic oligonucleotide
gccggcagatggacaacccacattacaag

SEQ ID NO: 248962 - DNA, 29 bp, Artificial Sequence
  Description of Artificial Sequence: Synthetic oligonucleotide
ccggcagatggacaacccacattacaagg

SEQ ID NO: 248963 - DNA, 29 bp, Artificial Sequence
  Description of Artificial Sequence: Synthetic oligonucleotide
cggcagatggacaacccacattacaaggc

SEQ ID NO: 248964 - DNA, 29 bp, Artificial Sequence
  Description of Artificial Sequence: Synthetic oligonucleotide
ggcagatggacaacccacattacaaggcc

SEQ ID NO: 248965 - DNA, 30 bp, Artificial Sequence
  Description of Artificial Sequence: Synthetic oligonucleotide
gcagatggacaacccacattacaaggccac

SEQ ID NO: 248966 - DNA, 32 bp, Artificial Sequence
  Description of Artificial Sequence: Synthetic oligonucleotide
cagatggacaacccacattacaaggccacttg

SEQ ID NO: 248967 - DNA, 32 bp, Artificial Sequence
  Description of Artificial Sequence: Synthetic oligonucleotide
agatggacaacccacattacaaggccacttgg

SEQ ID NO: 248968 - DNA, 31 bp, Artificial Sequence
  Description of Artificial Sequence: Synthetic oligonucleotide
gatggacaacccacattacaaggccacttgg

SEQ ID NO: 248969 - DNA, 33 bp, Artificial Sequence
  Description of Artificial Sequence: Synthetic oligonucleotide
atggacaacccacattacaaggccacttggatg

SEQ ID NO: 248970 - DNA, 32 bp, Artificial Sequence
  Description of Artificial Sequence: Synthetic oligonucleotide
tggacaacccacattacaaggccacttggatg

SEQ ID NO: 248971 - DNA, 31 bp, Artificial Sequence
  Description of Artificial Sequence: Synthetic oligonucleotide
ggacaacccacattacaaggccacttggatg

SEQ ID NO: 248972 - DNA, 31 bp, Artificial Sequence
  Description of Artificial Sequence: Synthetic oligonucleotide
gacaacccacattacaaggccacttggatgc

SEQ ID NO: 248973 - DNA, 32 bp, Artificial Sequence
  Description of Artificial Sequence: Synthetic oligonucleotide
acaacccacattacaaggccacttggatgcac

SEQ ID NO: 248974 - DNA, 31 bp, Artificial Sequence
  Description of Artificial Sequence: Synthetic oligonucleotide
caacccacattacaaggccacttggatgcac

SEQ ID NO: 248975 - DNA, 31 bp, Artificial Sequence
  Description of Artificial Sequence: Synthetic oligonucleotide
aacccacattacaaggccacttggatgcacc

SEQ ID NO: 248976 - DNA, 30 bp, Artificial Sequence
  Description of Artificial Sequence: Synthetic oligonucleotide
acccacattacaaggccacttggatgcacc

SEQ ID NO: 248977 - DNA, 29 bp, Artificial Sequence
  Description of Artificial Sequence: Synthetic oligonucleotide
cccacattacaaggccacttggatgcacc

SEQ ID NO: 248978 - DNA, 29 bp, Artificial Sequence
  Description of Artificial Sequence: Synthetic oligonucleotide
ccacattacaaggccacttggatgcaccc

SEQ ID NO: 248979 - DNA, 30 bp, Artificial Sequence
  Description of Artificial Sequence: Synthetic oligonucleotide
cacattacaaggccacttggatgcacccag

SEQ ID NO: 248980 - DNA, 35 bp, Artificial Sequence
  Description of Artificial Sequence: Synthetic oligonucleotide
acattacaaggccacttggatgcacccagaatttg

SEQ ID NO: 248981 - DNA, 34 bp, Artificial Sequence
  Description of Artificial Sequence: Synthetic oligonucleotide
cattacaaggccacttggatgcacccagaatttg

SEQ ID NO: 248982 - DNA, 35 bp, Artificial Sequence
  Description of Artificial Sequence: Synthetic oligonucleotide
attacaaggccacttggatgcacccagaatttgac

SEQ ID NO: 248983 - DNA, 34 bp, Artificial Sequence
  Description of Artificial Sequence: Synthetic oligonucleotide
ttacaaggccacttggatgcacccagaatttgac

SEQ ID NO: 248984 - DNA, 33 bp, Artificial Sequence
  Description of Artificial Sequence: Synthetic oligonucleotide
tacaaggccacttggatgcacccagaatttgac

SEQ ID NO: 248985 - DNA, 32 bp, Artificial Sequence
  Description of Artificial Sequence: Synthetic oligonucleotide
acaaggccacttggatgcacccagaatttgac

SEQ ID NO: 248986 - DNA, 31 bp, Artificial Sequence
  Description of Artificial Sequence: Synthetic oligonucleotide
caaggccacttggatgcacccagaatttgac

SEQ ID NO: 248987 - DNA, 33 bp, Artificial Sequence
  Description of Artificial Sequence: Synthetic oligonucleotide
aaggccacttggatgcacccagaatttgacaac

SEQ ID NO: 248988 - DNA, 32 bp, Artificial Sequence
  Description of Artificial Sequence: Synthetic oligonucleotide
aggccacttggatgcacccagaatttgacaac

SEQ ID NO: 248989 - DNA, 31 bp, Artificial Sequence
  Description of Artificial Sequence: Synthetic oligonucleotide
ggccacttggatgcacccagaatttgacaac

SEQ ID NO: 248990 - DNA, 31 bp, Artificial Sequence
  Description of Artificial Sequence: Synthetic oligonucleotide
gccacttggatgcacccagaatttgacaacc

SEQ ID NO: 248991 - DNA, 31 bp, Artificial Sequence
  Description of Artificial Sequence: Synthetic oligonucleotide
ccacttggatgcacccagaatttgacaaccg

SEQ ID NO: 248992 - DNA, 31 bp, Artificial Sequence
  Description of Artificial Sequence: Synthetic oligonucleotide
cacttggatgcacccagaatttgacaaccgc

SEQ ID NO: 248993 - DNA, 31 bp, Artificial Sequence
  Description of Artificial Sequence: Synthetic oligonucleotide
acttggatgcacccagaatttgacaaccgcg

SEQ ID NO: 248994 - DNA, 30 bp, Artificial Sequence
  Description of Artificial Sequence: Synthetic oligonucleotide
cttggatgcacccagaatttgacaaccgcg

SEQ ID NO: 248995 - DNA, 31 bp, Artificial Sequence
  Description of Artificial Sequence: Synthetic oligonucleotide
ttggatgcacccagaatttgacaaccgcgag

SEQ ID NO: 248996 - DNA, 30 bp, Artificial Sequence
  Description of Artificial Sequence: Synthetic oligonucleotide
tggatgcacccagaatttgacaaccgcgag

SEQ ID NO: 248997 - DNA, 29 bp, Artificial Sequence
  Description of Artificial Sequence: Synthetic oligonucleotide
ggatgcacccagaatttgacaaccgcgag

SEQ ID NO: 248998 - DNA, 33 bp, Artificial Sequence
  Description of Artificial Sequence: Synthetic oligonucleotide
gatgcacccagaatttgacaaccgcgagtattc

SEQ ID NO: 248999 - DNA, 34 bp, Artificial Sequence
  Description of Artificial Sequence: Synthetic oligonucleotide
atgcacccagaatttgacaaccgcgagtattcac

SEQ ID NO: 249000 - DNA, 33 bp, Artificial Sequence
  Description of Artificial Sequence: Synthetic oligonucleotide
tgcacccagaatttgacaaccgcgagtattcac

SEQ ID NO: 249001 - DNA, 32 bp, Artificial Sequence
  Description of Artificial Sequence: Synthetic oligonucleotide
gcacccagaatttgacaaccgcgagtattcac

SEQ ID NO: 249002 - DNA, 32 bp, Artificial Sequence
  Description of Artificial Sequence: Synthetic oligonucleotide
cacccagaatttgacaaccgcgagtattcacc

SEQ ID NO: 249003 - DNA, 32 bp, Artificial Sequence
  Description of Artificial Sequence: Synthetic oligonucleotide
acccagaatttgacaaccgcgagtattcaccc

SEQ ID NO: 249004 - DNA, 31 bp, Artificial Sequence
  Description of Artificial Sequence: Synthetic oligonucleotide
cccagaatttgacaaccgcgagtattcaccc

SEQ ID NO: 249005 - DNA, 31 bp, Artificial Sequence
  Description of Artificial Sequence: Synthetic oligonucleotide
ccagaatttgacaaccgcgagtattcacccg

SEQ ID NO: 249006 - DNA, 33 bp, Artificial Sequence
  Description of Artificial Sequence: Synthetic oligonucleotide
cagaatttgacaaccgcgagtattcacccgatc

SEQ ID NO: 249007 - DNA, 33 bp, Artificial Sequence
  Description of Artificial Sequence: Synthetic oligonucleotide
agaatttgacaaccgcgagtattcacccgatcc

SEQ ID NO: 249008 - DNA, 32 bp, Artificial Sequence
  Description of Artificial Sequence: Synthetic oligonucleotide
gaatttgacaaccgcgagtattcacccgatcc

SEQ ID NO: 249009 - DNA, 32 bp, Artificial Sequence
  Description of Artificial Sequence: Synthetic oligonucleotide
aatttgacaaccgcgagtattcacccgatccc

SEQ ID NO: 249010 - DNA, 31 bp, Artificial Sequence
  Description of Artificial Sequence: Synthetic oligonucleotide
atttgacaaccgcgagtattcacccgatccc

SEQ ID NO: 249011 - DNA, 30 bp, Artificial Sequence
  Description of Artificial Sequence: Synthetic oligonucleotide
tttgacaaccgcgagtattcacccgatccc

SEQ ID NO: 249012 - DNA, 29 bp, Artificial Sequence
  Description of Artificial Sequence: Synthetic oligonucleotide
ttgacaaccgcgagtattcacccgatccc

SEQ ID NO: 249013 - DNA, 28 bp, Artificial Sequence
  Description of Artificial Sequence: Synthetic oligonucleotide
tgacaaccgcgagtattcacccgatccc

SEQ ID NO: 249014 - DNA, 27 bp, Artificial Sequence
  Description of Artificial Sequence: Synthetic oligonucleotide
gacaaccgcgagtattcacccgatccc

SEQ ID NO: 249015 - DNA, 28 bp, Artificial Sequence
  Description of Artificial Sequence: Synthetic oligonucleotide
acaaccgcgagtattcacccgatccctg

SEQ ID NO: 249016 - DNA, 27 bp, Artificial Sequence
  Description of Artificial Sequence: Synthetic oligonucleotide
caaccgcgagtattcacccgatccctg

SEQ ID NO: 249017 - DNA, 30 bp, Artificial Sequence
  Description of Artificial Sequence: Synthetic oligonucleotide
aaccgcgagtattcacccgatccctgtatc

SEQ ID NO: 249018 - DNA, 29 bp, Artificial Sequence
  Description of Artificial Sequence: Synthetic oligonucleotide
accgcgagtattcacccgatccctgtatc

SEQ ID NO: 249019 - DNA, 28 bp, Artificial Sequence
  Description of Artificial Sequence: Synthetic oligonucleotide
ccgcgagtattcacccgatccctgtatc

SEQ ID NO: 249020 - DNA, 31 bp, Artificial Sequence
  Description of Artificial Sequence: Synthetic oligonucleotide
cgcgagtattcacccgatccctgtatctatg

SEQ ID NO: 249021 - DNA, 31 bp, Artificial Sequence
  Description of Artificial Sequence: Synthetic oligonucleotide
gcgagtattcacccgatccctgtatctatgg

SEQ ID NO: 249022 - DNA, 31 bp, Artificial Sequence
  Description of Artificial Sequence: Synthetic oligonucleotide
cgagtattcacccgatccctgtatctatggc

SEQ ID NO: 249023 - DNA, 34 bp, Artificial Sequence
  Description of Artificial Sequence: Synthetic oligonucleotide
gagtattcacccgatccctgtatctatggctatg

SEQ ID NO: 249024 - DNA, 38 bp, Artificial Sequence
  Description of Artificial Sequence: Synthetic oligonucleotide
agtattcacccgatccctgtatctatggctatgataag

SEQ ID NO: 249025 - DNA, 37 bp, Artificial Sequence
  Description of Artificial Sequence: Synthetic oligonucleotide
gtattcacccgatccctgtatctatggctatgataag

SEQ ID NO: 249026 - DNA, 40 bp, Artificial Sequence
  Description of Artificial Sequence: Synthetic oligonucleotide
tattcacccgatccctgtatctatggctatgataagtttg

SEQ ID NO: 249027 - DNA, 39 bp, Artificial Sequence
  Description of Artificial Sequence: Synthetic oligonucleotide
attcacccgatccctgtatctatggctatgataagtttg

SEQ ID NO: 249028 - DNA, 38 bp, Artificial Sequence
  Description of Artificial Sequence: Synthetic oligonucleotide
ttcacccgatccctgtatctatggctatgataagtttg

SEQ ID NO: 249029 - DNA, 37 bp, Artificial Sequence
  Description of Artificial Sequence: Synthetic oligonucleotide
tcacccgatccctgtatctatggctatgataagtttg

SEQ ID NO: 249030 - DNA, 36 bp, Artificial Sequence
  Description of Artificial Sequence: Synthetic oligonucleotide
cacccgatccctgtatctatggctatgataagtttg

SEQ ID NO: 249031 - DNA, 36 bp, Artificial Sequence
  Description of Artificial Sequence: Synthetic oligonucleotide
acccgatccctgtatctatggctatgataagtttgg

SEQ ID NO: 249032 - DNA, 35 bp, Artificial Sequence
  Description of Artificial Sequence: Synthetic oligonucleotide
cccgatccctgtatctatggctatgataagtttgg

SEQ ID NO: 249033 - DNA, 35 bp, Artificial Sequence
  Description of Artificial Sequence: Synthetic oligonucleotide
ccgatccctgtatctatggctatgataagtttggc

SEQ ID NO: 249034 - DNA, 35 bp, Artificial Sequence
  Description of Artificial Sequence: Synthetic oligonucleotide
cgatccctgtatctatggctatgataagtttggcg

SEQ ID NO: 249035 - DNA, 36 bp, Artificial Sequence
  Description of Artificial Sequence: Synthetic oligonucleotide
gatccctgtatctatggctatgataagtttggcgtg

SEQ ID NO: 249036 - DNA, 36 bp, Artificial Sequence
  Description of Artificial Sequence: Synthetic oligonucleotide
atccctgtatctatggctatgataagtttggcgtgg

SEQ ID NO: 249037 - DNA, 35 bp, Artificial Sequence
  Description of Artificial Sequence: Synthetic oligonucleotide
tccctgtatctatggctatgataagtttggcgtgg

SEQ ID NO: 249038 - DNA, 34 bp, Artificial Sequence
  Description of Artificial Sequence: Synthetic oligonucleotide
ccctgtatctatggctatgataagtttggcgtgg

SEQ ID NO: 249039 - DNA, 35 bp, Artificial Sequence
  Description of Artificial Sequence: Synthetic oligonucleotide
cctgtatctatggctatgataagtttggcgtggtg

SEQ ID NO: 249040 - DNA, 35 bp, Artificial Sequence
  Description of Artificial Sequence: Synthetic oligonucleotide
ctgtatctatggctatgataagtttggcgtggtgg

SEQ ID NO: 249041 - DNA, 35 bp, Artificial Sequence
  Description of Artificial Sequence: Synthetic oligonucleotide
tgtatctatggctatgataagtttggcgtggtggg

SEQ ID NO: 249042 - DNA, 34 bp, Artificial Sequence
  Description of Artificial Sequence: Synthetic oligonucleotide
gtatctatggctatgataagtttggcgtggtggg

SEQ ID NO: 249043 - DNA, 34 bp, Artificial Sequence
  Description of Artificial Sequence: Synthetic oligonucleotide
tatctatggctatgataagtttggcgtggtgggc

SEQ ID NO: 249044 - DNA, 33 bp, Artificial Sequence
  Description of Artificial Sequence: Synthetic oligonucleotide
atctatggctatgataagtttggcgtggtgggc

SEQ ID NO: 249045 - DNA, 32 bp, Artificial Sequence
  Description of Artificial Sequence: Synthetic oligonucleotide
tctatggctatgataagtttggcgtggtgggc

SEQ ID NO: 249046 - DNA, 31 bp, Artificial Sequence
  Description of Artificial Sequence: Synthetic oligonucleotide
ctatggctatgataagtttggcgtggtgggc

SEQ ID NO: 249047 - DNA, 31 bp, Artificial Sequence
  Description of Artificial Sequence: Synthetic oligonucleotide
tatggctatgataagtttggcgtggtgggcc

SEQ ID NO: 249048 - DNA, 30 bp, Artificial Sequence
  Description of Artificial Sequence: Synthetic oligonucleotide
atggctatgataagtttggcgtggtgggcc

SEQ ID NO: 249049 - DNA, 29 bp, Artificial Sequence
  Description of Artificial Sequence: Synthetic oligonucleotide
tggctatgataagtttggcgtggtgggcc

SEQ ID NO: 249050 - DNA, 28 bp, Artificial Sequence
  Description of Artificial Sequence: Synthetic oligonucleotide
ggctatgataagtttggcgtggtgggcc

SEQ ID NO: 249051 - DNA, 29 bp, Artificial Sequence
  Description of Artificial Sequence: Synthetic oligonucleotide
gctatgataagtttggcgtggtgggcctg

SEQ ID NO: 249052 - DNA, 29 bp, Artificial Sequence
  Description of Artificial Sequence: Synthetic oligonucleotide
ctatgataagtttggcgtggtgggcctgg

SEQ ID NO: 249053 - DNA, 30 bp, Artificial Sequence
  Description of Artificial Sequence: Synthetic oligonucleotide
tatgataagtttggcgtggtgggcctggtc

SEQ ID NO: 249054 - DNA, 29 bp, Artificial Sequence
  Description of Artificial Sequence: Synthetic oligonucleotide
atgataagtttggcgtggtgggcctggtc

SEQ ID NO: 249055 - DNA, 28 bp, Artificial Sequence
  Description of Artificial Sequence: Synthetic oligonucleotide
tgataagtttggcgtggtgggcctggtc

SEQ ID NO: 249056 - DNA, 27 bp, Artificial Sequence
  Description of Artificial Sequence: Synthetic oligonucleotide
gataagtttggcgtggtgggcctggtc

SEQ ID NO: 249057 - DNA, 27 bp, Artificial Sequence
  Description of Artificial Sequence: Synthetic oligonucleotide
ataagtttggcgtggtgggcctggtcc

SEQ ID NO: 249058 - DNA, 27 bp, Artificial Sequence
  Description of Artificial Sequence: Synthetic oligonucleotide
taagtttggcgtggtgggcctggtcct

SEQ ID NO: 249059 - DNA, 26 bp, Artificial Sequence
  Description of Artificial Sequence: Synthetic oligonucleotide
aagtttggcgtggtgggcctggtcct

SEQ ID NO: 249060 - DNA, 25 bp, Artificial Sequence
  Description of Artificial Sequence: Synthetic oligonucleotide
agtttggcgtggtgggcctggtcct

SEQ ID NO: 249061 - DNA, 24 bp, Artificial Sequence
  Description of Artificial Sequence: Synthetic oligonucleotide
gtttggcgtggtgggcctggtcct

SEQ ID NO: 249062 - DNA, 25 bp, Artificial Sequence
  Description of Artificial Sequence: Synthetic oligonucleotide
tttggcgtggtgggcctggtcctct

SEQ ID NO: 249063 - DNA, 24 bp, Artificial Sequence
  Description of Artificial Sequence: Synthetic oligonucleotide
ttggcgtggtgggcctggtcctct

SEQ ID NO: 249064 - DNA, 23 bp, Artificial Sequence
  Description of Artificial Sequence: Synthetic oligonucleotide
tggcgtggtgggcctggtcctct

SEQ ID NO: 249065 - DNA, 22 bp, Artificial Sequence
  Description of Artificial Sequence: Synthetic oligonucleotide
ggcgtggtgggcctggtcctct

SEQ ID NO: 249066 - DNA, 22 bp, Artificial Sequence
  Description of Artificial Sequence: Synthetic oligonucleotide
gcgtggtgggcctggtcctctg

SEQ ID NO: 249067 - DNA, 22 bp, Artificial Sequence
  Description of Artificial Sequence: Synthetic oligonucleotide
cgtggtgggcctggtcctctgg

SEQ ID NO: 249068 - DNA, 23 bp, Artificial Sequence
  Description of Artificial Sequence: Synthetic oligonucleotide
gtggtgggcctggtcctctggca

SEQ ID NO: 249069 - DNA, 23 bp, Artificial Sequence
  Description of Artificial Sequence: Synthetic oligonucleotide
tggtgggcctggtcctctggcac

SEQ ID NO: 249070 - DNA, 22 bp, Artificial Sequence
  Description of Artificial Sequence: Synthetic oligonucleotide
ggtgggcctggtcctctggcac

SEQ ID NO: 249071 - DNA, 23 bp, Artificial Sequence
  Description of Artificial Sequence: Synthetic oligonucleotide
gtgggcctggtcctctggcacgt

SEQ ID NO: 249072 - DNA, 25 bp, Artificial Sequence
  Description of Artificial Sequence: Synthetic oligonucleotide
tgggcctggtcctctggcacgtcaa

SEQ ID NO: 249073 - DNA, 24 bp, Artificial Sequence
  Description of Artificial Sequence: Synthetic oligonucleotide
gggcctggtcctctggcacgtcaa

SEQ ID NO: 249074 - DNA, 25 bp, Artificial Sequence
  Description of Artificial Sequence: Synthetic oligonucleotide
ggcctggtcctctggcacgtcaagt

SEQ ID NO: 249075 - DNA, 26 bp, Artificial Sequence
  Description of Artificial Sequence: Synthetic oligonucleotide
gcctggtcctctggcacgtcaagtct

SEQ ID NO: 249076 - DNA, 26 bp, Artificial Sequence
  Description of Artificial Sequence: Synthetic oligonucleotide
cctggtcctctggcacgtcaagtctc

SEQ ID NO: 249077 - DNA, 26 bp, Artificial Sequence
  Description of Artificial Sequence: Synthetic oligonucleotide
ctggtcctctggcacgtcaagtctcg

SEQ ID NO: 249078 - DNA, 27 bp, Artificial Sequence
  Description of Artificial Sequence: Synthetic oligonucleotide
tggtcctctggcacgtcaagtctcgca

SEQ ID NO: 249079 - DNA, 26 bp, Artificial Sequence
  Description of Artificial Sequence: Synthetic oligonucleotide
ggtcctctggcacgtcaagtctcgca

SEQ ID NO: 249080 - DNA, 26 bp, Artificial Sequence
  Description of Artificial Sequence: Synthetic oligonucleotide
gtcctctggcacgtcaagtctcgcac

SEQ ID NO: 249081 - DNA, 27 bp, Artificial Sequence
  Description of Artificial Sequence: Synthetic oligonucleotide
tcctctggcacgtcaagtctcgcacca

SEQ ID NO: 249082 - DNA, 27 bp, Artificial Sequence
  Description of Artificial Sequence: Synthetic oligonucleotide
cctctggcacgtcaagtctcgcaccat

SEQ ID NO: 249083 - DNA, 27 bp, Artificial Sequence
  Description of Artificial Sequence: Synthetic oligonucleotide
ctctggcacgtcaagtctcgcaccatc

SEQ ID NO: 249084 - DNA, 30 bp, Artificial Sequence
  Description of Artificial Sequence: Synthetic oligonucleotide
tctggcacgtcaagtctcgcaccatctatg

SEQ ID NO: 249085 - DNA, 29 bp, Artificial Sequence
  Description of Artificial Sequence: Synthetic oligonucleotide
ctggcacgtcaagtctcgcaccatctatg

SEQ ID NO: 249086 - DNA, 30 bp, Artificial Sequence
  Description of Artificial Sequence: Synthetic oligonucleotide
tggcacgtcaagtctcgcaccatctatgac

SEQ ID NO: 249087 - DNA, 29 bp, Artificial Sequence
  Description of Artificial Sequence: Synthetic oligonucleotide
ggcacgtcaagtctcgcaccatctatgac

SEQ ID NO: 249088 - DNA, 31 bp, Artificial Sequence
  Description of Artificial Sequence: Synthetic oligonucleotide
gcacgtcaagtctcgcaccatctatgacaac

SEQ ID NO: 249089 - DNA, 33 bp, Artificial Sequence
  Description of Artificial Sequence: Synthetic oligonucleotide
cacgtcaagtctcgcaccatctatgacaacttg

SEQ ID NO: 249090 - DNA, 33 bp, Artificial Sequence
  Description of Artificial Sequence: Synthetic oligonucleotide
acgtcaagtctcgcaccatctatgacaacttgc

SEQ ID NO: 249091 - DNA, 32 bp, Artificial Sequence
  Description of Artificial Sequence: Synthetic oligonucleotide
cgtcaagtctcgcaccatctatgacaacttgc

SEQ ID NO: 249092 - DNA, 33 bp, Artificial Sequence
  Description of Artificial Sequence: Synthetic oligonucleotide
gtcaagtctcgcaccatctatgacaacttgctc

SEQ ID NO: 249093 - DNA, 35 bp, Artificial Sequence
  Description of Artificial Sequence: Synthetic oligonucleotide
tcaagtctcgcaccatctatgacaacttgctcatc

SEQ ID NO: 249094 - DNA, 34 bp, Artificial Sequence
  Description of Artificial Sequence: Synthetic oligonucleotide
caagtctcgcaccatctatgacaacttgctcatc

SEQ ID NO: 249095 - DNA, 35 bp, Artificial Sequence
  Description of Artificial Sequence: Synthetic oligonucleotide
aagtctcgcaccatctatgacaacttgctcatcac

SEQ ID NO: 249096 - DNA, 34 bp, Artificial Sequence
  Description of Artificial Sequence: Synthetic oligonucleotide
agtctcgcaccatctatgacaacttgctcatcac

SEQ ID NO: 249097 - DNA, 33 bp, Artificial Sequence
  Description of Artificial Sequence: Synthetic oligonucleotide
gtctcgcaccatctatgacaacttgctcatcac

SEQ ID NO: 249098 - DNA, 33 bp, Artificial Sequence
  Description of Artificial Sequence: Synthetic oligonucleotide
tctcgcaccatctatgacaacttgctcatcacc

SEQ ID NO: 249099 - DNA, 32 bp, Artificial Sequence
  Description of Artificial Sequence: Synthetic oligonucleotide
ctcgcaccatctatgacaacttgctcatcacc

SEQ ID NO: 249100 - DNA, 34 bp, Artificial Sequence
  Description of Artificial Sequence: Synthetic oligonucleotide
tcgcaccatctatgacaacttgctcatcacctac

SEQ ID NO: 249101 - DNA, 33 bp, Artificial Sequence
  Description of Artificial Sequence: Synthetic oligonucleotide
cgcaccatctatgacaacttgctcatcacctac

SEQ ID NO: 249102 - DNA, 33 bp, Artificial Sequence
  Description of Artificial Sequence: Synthetic oligonucleotide
gcaccatctatgacaacttgctcatcacctacg

SEQ ID NO: 249103 - DNA, 35 bp, Artificial Sequence
  Description of Artificial Sequence: Synthetic oligonucleotide
caccatctatgacaacttgctcatcacctacgatg

SEQ ID NO: 249104 - DNA, 36 bp, Artificial Sequence
  Description of Artificial Sequence: Synthetic oligonucleotide
accatctatgacaacttgctcatcacctacgatgag

SEQ ID NO: 249105 - DNA, 35 bp, Artificial Sequence
  Description of Artificial Sequence: Synthetic oligonucleotide
ccatctatgacaacttgctcatcacctacgatgag

SEQ ID NO: 249106 - DNA, 35 bp, Artificial Sequence
  Description of Artificial Sequence: Synthetic oligonucleotide
catctatgacaacttgctcatcacctacgatgagg

SEQ ID NO: 249107 - DNA, 35 bp, Artificial Sequence
  Description of Artificial Sequence: Synthetic oligonucleotide
atctatgacaacttgctcatcacctacgatgaggg

SEQ ID NO: 249108 - DNA, 34 bp, Artificial Sequence
  Description of Artificial Sequence: Synthetic oligonucleotide
tctatgacaacttgctcatcacctacgatgaggg

SEQ ID NO: 249109 - DNA, 33 bp, Artificial Sequence
  Description of Artificial Sequence: Synthetic oligonucleotide
ctatgacaacttgctcatcacctacgatgaggg

SEQ ID NO: 249110 - DNA, 36 bp, Artificial Sequence
  Description of Artificial Sequence: Synthetic oligonucleotide
tatgacaacttgctcatcacctacgatgagggatac

SEQ ID NO: 249111 - DNA, 35 bp, Artificial Sequence
  Description of Artificial Sequence: Synthetic oligonucleotide
atgacaacttgctcatcacctacgatgagggatac

SEQ ID NO: 249112 - DNA, 34 bp, Artificial Sequence
  Description of Artificial Sequence: Synthetic oligonucleotide
tgacaacttgctcatcacctacgatgagggatac

SEQ ID NO: 249113 - DNA, 33 bp, Artificial Sequence
  Description of Artificial Sequence: Synthetic oligonucleotide
gacaacttgctcatcacctacgatgagggatac

SEQ ID NO: 249114 - DNA, 33 bp, Artificial Sequence
  Description of Artificial Sequence: Synthetic oligonucleotide
acaacttgctcatcacctacgatgagggatacg

SEQ ID NO: 249115 - DNA, 32 bp, Artificial Sequence
  Description of Artificial Sequence: Synthetic oligonucleotide
caacttgctcatcacctacgatgagggatacg

SEQ ID NO: 249116 - DNA, 32 bp, Artificial Sequence
  Description of Artificial Sequence: Synthetic oligonucleotide
aacttgctcatcacctacgatgagggatacgc

SEQ ID NO: 249117 - DNA, 31 bp, Artificial Sequence
  Description of Artificial Sequence: Synthetic oligonucleotide
acttgctcatcacctacgatgagggatacgc

SEQ ID NO: 249118 - DNA, 30 bp, Artificial Sequence
  Description of Artificial Sequence: Synthetic oligonucleotide
cttgctcatcacctacgatgagggatacgc

SEQ ID NO: 249119 - DNA, 31 bp, Artificial Sequence
  Description of Artificial Sequence: Synthetic oligonucleotide
ttgctcatcacctacgatgagggatacgctg

SEQ ID NO: 249120 - DNA, 30 bp, Artificial Sequence
  Description of Artificial Sequence: Synthetic oligonucleotide
tgctcatcacctacgatgagggatacgctg

SEQ ID NO: 249121 - DNA, 29 bp, Artificial Sequence
  Description of Artificial Sequence: Synthetic oligonucleotide
gctcatcacctacgatgagggatacgctg

SEQ ID NO: 249122 - DNA, 30 bp, Artificial Sequence
  Description of Artificial Sequence: Synthetic oligonucleotide
ctcatcacctacgatgagggatacgctgac

SEQ ID NO: 249123 - DNA, 30 bp, Artificial Sequence
  Description of Artificial Sequence: Synthetic oligonucleotide
tcatcacctacgatgagggatacgctgacg

SEQ ID NO: 249124 - DNA, 29 bp, Artificial Sequence
  Description of Artificial Sequence: Synthetic oligonucleotide
catcacctacgatgagggatacgctgacg

SEQ ID NO: 249125 - DNA, 30 bp, Artificial Sequence
  Description of Artificial Sequence: Synthetic oligonucleotide
atcacctacgatgagggatacgctgacgag

SEQ ID NO: 249126 - DNA, 29 bp, Artificial Sequence
  Description of Artificial Sequence: Synthetic oligonucleotide
tcacctacgatgagggatacgctgacgag

SEQ ID NO: 249127 - DNA, 28 bp, Artificial Sequence
  Description of Artificial Sequence: Synthetic oligonucleotide
cacctacgatgagggatacgctgacgag

SEQ ID NO: 249128 - DNA, 31 bp, Artificial Sequence
  Description of Artificial Sequence: Synthetic oligonucleotide
acctacgatgagggatacgctgacgagtttg

SEQ ID NO: 249129 - DNA, 30 bp, Artificial Sequence
  Description of Artificial Sequence: Synthetic oligonucleotide
cctacgatgagggatacgctgacgagtttg

SEQ ID NO: 249130 - DNA, 30 bp, Artificial Sequence
  Description of Artificial Sequence: Synthetic oligonucleotide
ctacgatgagggatacgctgacgagtttgg

SEQ ID NO: 249131 - DNA, 30 bp, Artificial Sequence
  Description of Artificial Sequence: Synthetic oligonucleotide
tacgatgagggatacgctgacgagtttggc

SEQ ID NO: 249132 - DNA, 29 bp, Artificial Sequence
  Description of Artificial Sequence: Synthetic oligonucleotide
acgatgagggatacgctgacgagtttggc

SEQ ID NO: 249133 - DNA, 28 bp, Artificial Sequence
  Description of Artificial Sequence: Synthetic oligonucleotide
cgatgagggatacgctgacgagtttggc

SEQ ID NO: 249134 - DNA, 30 bp, Artificial Sequence
  Description of Artificial Sequence: Synthetic oligonucleotide
gatgagggatacgctgacgagtttggctac

SEQ ID NO: 249135 - DNA, 30 bp, Artificial Sequence
  Description of Artificial Sequence: Synthetic oligonucleotide
atgagggatacgctgacgagtttggctacg

SEQ ID NO: 249136 - DNA, 29 bp, Artificial Sequence
  Description of Artificial Sequence: Synthetic oligonucleotide
tgagggatacgctgacgagtttggctacg

SEQ ID NO: 249137 - DNA, 28 bp, Artificial Sequence
  Description of Artificial Sequence: Synthetic oligonucleotide
gagggatacgctgacgagtttggctacg

SEQ ID NO: 249138 - DNA, 29 bp, Artificial Sequence
  Description of Artificial Sequence: Synthetic oligonucleotide
agggatacgctgacgagtttggctacgag

SEQ ID NO: 249139 - DNA, 28 bp, Artificial Sequence
  Description of Artificial Sequence: Synthetic oligonucleotide
gggatacgctgacgagtttggctacgag

SEQ ID NO: 249140 - DNA, 29 bp, Artificial Sequence
  Description of Artificial Sequence: Synthetic oligonucleotide
ggatacgctgacgagtttggctacgagac

SEQ ID NO: 249141 - DNA, 29 bp, Artificial Sequence
  Description of Artificial Sequence: Synthetic oligonucleotide
gatacgctgacgagtttggctacgagacg

SEQ ID NO: 249142 - DNA, 30 bp, Artificial Sequence
  Description of Artificial Sequence: Synthetic oligonucleotide
atacgctgacgagtttggctacgagacgtc

SEQ ID NO: 249143 - DNA, 29 bp, Artificial Sequence
  Description of Artificial Sequence: Synthetic oligonucleotide
tacgctgacgagtttggctacgagacgtc

SEQ ID NO: 249144 - DNA, 28 bp, Artificial Sequence
  Description of Artificial Sequence: Synthetic oligonucleotide
acgctgacgagtttggctacgagacgtc

SEQ ID NO: 249145 - DNA, 27 bp, Artificial Sequence
  Description of Artificial Sequence: Synthetic oligonucleotide
cgctgacgagtttggctacgagacgtc

SEQ ID NO: 249146 - DNA, 27 bp, Artificial Sequence
  Description of Artificial Sequence: Synthetic oligonucleotide
gctgacgagtttggctacgagacgtcg

SEQ ID NO: 249147 - DNA, 27 bp, Artificial Sequence
  Description of Artificial Sequence: Synthetic oligonucleotide
ctgacgagtttggctacgagacgtcgg

SEQ ID NO: 249148 - DNA, 27 bp, Artificial Sequence
  Description of Artificial Sequence: Synthetic oligonucleotide
tgacgagtttggctacgagacgtcggg

SEQ ID NO: 249149 - DNA, 26 bp, Artificial Sequence
  Description of Artificial Sequence: Synthetic oligonucleotide
gacgagtttggctacgagacgtcggg

SEQ ID NO: 249150 - DNA, 26 bp, Artificial Sequence
  Description of Artificial Sequence: Synthetic oligonucleotide
acgagtttggctacgagacgtcgggc

SEQ ID NO: 249151 - DNA, 25 bp, Artificial Sequence
  Description of Artificial Sequence: Synthetic oligonucleotide
cgagtttggctacgagacgtcgggc

SEQ ID NO: 249152 - DNA, 27 bp, Artificial Sequence
  Description of Artificial Sequence: Synthetic oligonucleotide
gagtttggctacgagacgtcgggcgta

SEQ ID NO: 249153 - DNA, 28 bp, Artificial Sequence
  Description of Artificial Sequence: Synthetic oligonucleotide
agtttggctacgagacgtcgggcgtaac

SEQ ID NO: 249154 - DNA, 27 bp, Artificial Sequence
  Description of Artificial Sequence: Synthetic oligonucleotide
gtttggctacgagacgtcgggcgtaac

SEQ ID NO: 249155 - DNA, 30 bp, Artificial Sequence
  Description of Artificial Sequence: Synthetic oligonucleotide
tttggctacgagacgtcgggcgtaactaag

SEQ ID NO: 249156 - DNA, 29 bp, Artificial Sequence
  Description of Artificial Sequence: Synthetic oligonucleotide
ttggctacgagacgtcgggcgtaactaag

SEQ ID NO: 249157 - DNA, 28 bp, Artificial Sequence
  Description of Artificial Sequence: Synthetic oligonucleotide
tggctacgagacgtcgggcgtaactaag

SEQ ID NO: 249158 - DNA, 27 bp, Artificial Sequence
  Description of Artificial Sequence: Synthetic oligonucleotide
ggctacgagacgtcgggcgtaactaag

SEQ ID NO: 249159 - DNA, 27 bp, Artificial Sequence
  Description of Artificial Sequence: Synthetic oligonucleotide
gctacgagacgtcgggcgtaactaagg

SEQ ID NO: 249160 - DNA, 27 bp, Artificial Sequence
  Description of Artificial Sequence: Synthetic oligonucleotide
ctacgagacgtcgggcgtaactaaggc

SEQ ID NO: 249161 - DNA, 28 bp, Artificial Sequence
  Description of Artificial Sequence: Synthetic oligonucleotide
tacgagacgtcgggcgtaactaaggcag

SEQ ID NO: 249162 - DNA, 27 bp, Artificial Sequence
  Description of Artificial Sequence: Synthetic oligonucleotide
acgagacgtcgggcgtaactaaggcag

SEQ ID NO: 249163 - DNA, 26 bp, Artificial Sequence
  Description of Artificial Sequence: Synthetic oligonucleotide
cgagacgtcgggcgtaactaaggcag

SEQ ID NO: 249164 - DNA, 27 bp, Artificial Sequence
  Description of Artificial Sequence: Synthetic oligonucleotide
gagacgtcgggcgtaactaaggcagca

SEQ ID NO: 249165 - DNA, 27 bp, Artificial Sequence
  Description of Artificial Sequence: Synthetic oligonucleotide
agacgtcgggcgtaactaaggcagcac

SEQ ID NO: 249166 - DNA, 27 bp, Artificial Sequence
  Description of Artificial Sequence: Synthetic oligonucleotide
gacgtcgggcgtaactaaggcagcaca

SEQ ID NO: 249167 - DNA, 27 bp, Artificial Sequence
  Description of Artificial Sequence: Synthetic oligonucleotide
acgtcgggcgtaactaaggcagcacag

SEQ ID NO: 249168 - DNA, 27 bp, Artificial Sequence
  Description of Artificial Sequence: Synthetic oligonucleotide
cgtcgggcgtaactaaggcagcacaga

SEQ ID NO: 249169 - DNA, 29 bp, Artificial Sequence
  Description of Artificial Sequence: Synthetic oligonucleotide
gtcgggcgtaactaaggcagcacagaaac

SEQ ID NO: 249170 - DNA, 33 bp, Artificial Sequence
  Description of Artificial Sequence: Synthetic oligonucleotide
tcgggcgtaactaaggcagcacagaaacaaaag

SEQ ID NO: 249171 - DNA, 32 bp, Artificial Sequence
  Description of Artificial Sequence: Synthetic oligonucleotide
cgggcgtaactaaggcagcacagaaacaaaag

SEQ ID NO: 249172 - DNA, 34 bp, Artificial Sequence
  Description of Artificial Sequence: Synthetic oligonucleotide
gggcgtaactaaggcagcacagaaacaaaagaag

SEQ ID NO: 249173 - DNA, 34 bp, Artificial Sequence
  Description of Artificial Sequence: Synthetic oligonucleotide
ggcgtaactaaggcagcacagaaacaaaagaagg

SEQ ID NO: 249174 - DNA, 35 bp, Artificial Sequence
  Description of Artificial Sequence: Synthetic oligonucleotide
gcgtaactaaggcagcacagaaacaaaagaaggac

SEQ ID NO: 249175 - DNA, 38 bp, Artificial Sequence
  Description of Artificial Sequence: Synthetic oligonucleotide
cgtaactaaggcagcacagaaacaaaagaaggacaatc

SEQ ID NO: 249176 - DNA, 39 bp, Artificial Sequence
  Description of Artificial Sequence: Synthetic oligonucleotide
gtaactaaggcagcacagaaacaaaagaaggacaatcag

SEQ ID NO: 249177 - DNA, 39 bp, Artificial Sequence
  Description of Artificial Sequence: Synthetic oligonucleotide
taactaaggcagcacagaaacaaaagaaggacaatcagg

SEQ ID NO: 249178 - DNA, 38 bp, Artificial Sequence
  Description of Artificial Sequence: Synthetic oligonucleotide
aactaaggcagcacagaaacaaaagaaggacaatcagg

SEQ ID NO: 249179 - DNA, 37 bp, Artificial Sequence
  Description of Artificial Sequence: Synthetic oligonucleotide
actaaggcagcacagaaacaaaagaaggacaatcagg

SEQ ID NO: 249180 - DNA, 36 bp, Artificial Sequence
  Description of Artificial Sequence: Synthetic oligonucleotide
ctaaggcagcacagaaacaaaagaaggacaatcagg

SEQ ID NO: 249181 - DNA, 37 bp, Artificial Sequence
  Description of Artificial Sequence: Synthetic oligonucleotide
taaggcagcacagaaacaaaagaaggacaatcaggac

SEQ ID NO: 249182 - DNA, 36 bp, Artificial Sequence
  Description of Artificial Sequence: Synthetic oligonucleotide
aaggcagcacagaaacaaaagaaggacaatcaggac

SEQ ID NO: 249183 - DNA, 35 bp, Artificial Sequence
  Description of Artificial Sequence: Synthetic oligonucleotide
aggcagcacagaaacaaaagaaggacaatcaggac

SEQ ID NO: 249184 - DNA, 34 bp, Artificial Sequence
  Description of Artificial Sequence: Synthetic oligonucleotide
ggcagcacagaaacaaaagaaggacaatcaggac

SEQ ID NO: 249185 - DNA, 34 bp, Artificial Sequence
  Description of Artificial Sequence: Synthetic oligonucleotide
gcagcacagaaacaaaagaaggacaatcaggacg

SEQ ID NO: 249186 - DNA, 35 bp, Artificial Sequence
  Description of Artificial Sequence: Synthetic oligonucleotide
cagcacagaaacaaaagaaggacaatcaggacgag

SEQ ID NO: 249187 - DNA, 35 bp, Artificial Sequence
  Description of Artificial Sequence: Synthetic oligonucleotide
agcacagaaacaaaagaaggacaatcaggacgagc

SEQ ID NO: 249188 - DNA, 34 bp, Artificial Sequence
  Description of Artificial Sequence: Synthetic oligonucleotide
gcacagaaacaaaagaaggacaatcaggacgagc

SEQ ID NO: 249189 - DNA, 35 bp, Artificial Sequence
  Description of Artificial Sequence: Synthetic oligonucleotide
cacagaaacaaaagaaggacaatcaggacgagcag

SEQ ID NO: 249190 - DNA, 35 bp, Artificial Sequence
  Description of Artificial Sequence: Synthetic oligonucleotide
acagaaacaaaagaaggacaatcaggacgagcagc

SEQ ID NO: 249191 - DNA, 34 bp, Artificial Sequence
  Description of Artificial Sequence: Synthetic oligonucleotide
cagaaacaaaagaaggacaatcaggacgagcagc

SEQ ID NO: 249192 - DNA, 35 bp, Artificial Sequence
  Description of Artificial Sequence: Synthetic oligonucleotide
agaaacaaaagaaggacaatcaggacgagcagcag

SEQ ID NO: 249193 - DNA, 34 bp, Artificial Sequence
  Description of Artificial Sequence: Synthetic oligonucleotide
gaaacaaaagaaggacaatcaggacgagcagcag

SEQ ID NO: 249194 - DNA, 35 bp, Artificial Sequence
  Description of Artificial Sequence: Synthetic oligonucleotide
aaacaaaagaaggacaatcaggacgagcagcagag

SEQ ID NO: 249195 - DNA, 34 bp, Artificial Sequence
  Description of Artificial Sequence: Synthetic oligonucleotide
aacaaaagaaggacaatcaggacgagcagcagag

SEQ ID NO: 249196 - DNA, 33 bp, Artificial Sequence
  Description of Artificial Sequence: Synthetic oligonucleotide
acaaaagaaggacaatcaggacgagcagcagag

SEQ ID NO: 249197 - DNA, 32 bp, Artificial Sequence
  Description of Artificial Sequence: Synthetic oligonucleotide
caaaagaaggacaatcaggacgagcagcagag

SEQ ID NO: 249198 - DNA, 32 bp, Artificial Sequence
  Description of Artificial Sequence: Synthetic oligonucleotide
aaaagaaggacaatcaggacgagcagcagagg

SEQ ID NO: 249199 - DNA, 31 bp, Artificial Sequence
  Description of Artificial Sequence: Synthetic oligonucleotide
aaagaaggacaatcaggacgagcagcagagg

SEQ ID NO: 249200 - DNA, 30 bp, Artificial Sequence
  Description of Artificial Sequence: Synthetic oligonucleotide
aagaaggacaatcaggacgagcagcagagg

SEQ ID NO: 249201 - DNA, 29 bp, Artificial Sequence
  Description of Artificial Sequence: Synthetic oligonucleotide
agaaggacaatcaggacgagcagcagagg

SEQ ID NO: 249202 - DNA, 28 bp, Artificial Sequence
  Description of Artificial Sequence: Synthetic oligonucleotide
gaaggacaatcaggacgagcagcagagg

SEQ ID NO: 249203 - DNA, 28 bp, Artificial Sequence
  Description of Artificial Sequence: Synthetic oligonucleotide
aaggacaatcaggacgagcagcagaggc

SEQ ID NO: 249204 - DNA, 27 bp, Artificial Sequence
  Description of Artificial Sequence: Synthetic oligonucleotide
aggacaatcaggacgagcagcagaggc

SEQ ID NO: 249205 - DNA, 27 bp, Artificial Sequence
  Description of Artificial Sequence: Synthetic oligonucleotide
ggacaatcaggacgagcagcagaggca

SEQ ID NO: 249206 - DNA, 30 bp, Artificial Sequence
  Description of Artificial Sequence: Synthetic oligonucleotide
gacaatcaggacgagcagcagaggcataag

SEQ ID NO: 249207 - DNA, 30 bp, Artificial Sequence
  Description of Artificial Sequence: Synthetic oligonucleotide
acaatcaggacgagcagcagaggcataagg

SEQ ID NO: 249208 - DNA, 29 bp, Artificial Sequence
  Description of Artificial Sequence: Synthetic oligonucleotide
caatcaggacgagcagcagaggcataagg

SEQ ID NO: 249209 - DNA, 30 bp, Artificial Sequence
  Description of Artificial Sequence: Synthetic oligonucleotide
aatcaggacgagcagcagaggcataaggag

SEQ ID NO: 249210 - DNA, 29 bp, Artificial Sequence
  Description of Artificial Sequence: Synthetic oligonucleotide
atcaggacgagcagcagaggcataaggag

SEQ ID NO: 249211 - DNA, 28 bp, Artificial Sequence
  Description of Artificial Sequence: Synthetic oligonucleotide
tcaggacgagcagcagaggcataaggag

SEQ ID NO: 249212 - DNA, 27 bp, Artificial Sequence
  Description of Artificial Sequence: Synthetic oligonucleotide
caggacgagcagcagaggcataaggag

SEQ ID NO: 249213 - DNA, 27 bp, Artificial Sequence
  Description of Artificial Sequence: Synthetic oligonucleotide
aggacgagcagcagaggcataaggagg

SEQ ID NO: 249214 - DNA, 27 bp, Artificial Sequence
  Description of Artificial Sequence: Synthetic oligonucleotide
ggacgagcagcagaggcataaggagga

SEQ ID NO: 249215 - DNA, 27 bp, Artificial Sequence
  Description of Artificial Sequence: Synthetic oligonucleotide
gacgagcagcagaggcataaggaggac

SEQ ID NO: 249216 - DNA, 27 bp, Artificial Sequence
  Description of Artificial Sequence: Synthetic oligonucleotide
acgagcagcagaggcataaggaggacg

SEQ ID NO: 249217 - DNA, 27 bp, Artificial Sequence
  Description of Artificial Sequence: Synthetic oligonucleotide
cgagcagcagaggcataaggaggacga

SEQ ID NO: 249218 - DNA, 28 bp, Artificial Sequence
  Description of Artificial Sequence: Synthetic oligonucleotide
gagcagcagaggcataaggaggacgaag

SEQ ID NO: 249219 - DNA, 30 bp, Artificial Sequence
  Description of Artificial Sequence: Synthetic oligonucleotide
agcagcagaggcataaggaggacgaagaag

SEQ ID NO: 249220 - DNA, 29 bp, Artificial Sequence
  Description of Artificial Sequence: Synthetic oligonucleotide
gcagcagaggcataaggaggacgaagaag

SEQ ID NO: 249221 - DNA, 30 bp, Artificial Sequence
  Description of Artificial Sequence: Synthetic oligonucleotide
cagcagaggcataaggaggacgaagaagac

SEQ ID NO: 249222 - DNA, 32 bp, Artificial Sequence
  Description of Artificial Sequence: Synthetic oligonucleotide
agcagaggcataaggaggacgaagaagactag

SEQ ID NO: 249223 - DNA, 31 bp, Artificial Sequence
  Description of Artificial Sequence: Synthetic oligonucleotide
gcagaggcataaggaggacgaagaagactag

SEQ ID NO: 249224 - DNA, 34 bp, Artificial Sequence
  Description of Artificial Sequence: Synthetic oligonucleotide
cagaggcataaggaggacgaagaagactagaaac

SEQ ID NO: 249225 - DNA, 34 bp, Artificial Sequence
  Description of Artificial Sequence: Synthetic oligonucleotide
agaggcataaggaggacgaagaagactagaaacg

SEQ ID NO: 249226 - DNA, 33 bp, Artificial Sequence
  Description of Artificial Sequence: Synthetic oligonucleotide
gaggcataaggaggacgaagaagactagaaacg

SEQ ID NO: 249227 - DNA, 33 bp, Artificial Sequence
  Description of Artificial Sequence: Synthetic oligonucleotide
aggcataaggaggacgaagaagactagaaacgc

SEQ ID NO: 249228 - DNA, 32 bp, Artificial Sequence
  Description of Artificial Sequence: Synthetic oligonucleotide
ggcataaggaggacgaagaagactagaaacgc

SEQ ID NO: 249229 - DNA, 35 bp, Artificial Sequence
  Description of Artificial Sequence: Synthetic oligonucleotide
gcataaggaggacgaagaagactagaaacgcatag

SEQ ID NO: 249230 - DNA, 36 bp, Artificial Sequence
  Description of Artificial Sequence: Synthetic oligonucleotide
cataaggaggacgaagaagactagaaacgcatagag

SEQ ID NO: 249231 - DNA, 36 bp, Artificial Sequence
  Description of Artificial Sequence: Synthetic oligonucleotide
ataaggaggacgaagaagactagaaacgcatagagg

SEQ ID NO: 249232 - DNA, 35 bp, Artificial Sequence
  Description of Artificial Sequence: Synthetic oligonucleotide
taaggaggacgaagaagactagaaacgcatagagg

SEQ ID NO: 249233 - DNA, 34 bp, Artificial Sequence
  Description of Artificial Sequence: Synthetic oligonucleotide
aaggaggacgaagaagactagaaacgcatagagg

SEQ ID NO: 249234 - DNA, 33 bp, Artificial Sequence
  Description of Artificial Sequence: Synthetic oligonucleotide
aggaggacgaagaagactagaaacgcatagagg

SEQ ID NO: 249235 - DNA, 32 bp, Artificial Sequence
  Description of Artificial Sequence: Synthetic oligonucleotide
ggaggacgaagaagactagaaacgcatagagg

SEQ ID NO: 249236 - DNA, 33 bp, Artificial Sequence
  Description of Artificial Sequence: Synthetic oligonucleotide
gaggacgaagaagactagaaacgcatagaggag

SEQ ID NO: 249237 - DNA, 33 bp, Artificial Sequence
  Description of Artificial Sequence: Synthetic oligonucleotide
aggacgaagaagactagaaacgcatagaggagg

SEQ ID NO: 249238 - DNA, 32 bp, Artificial Sequence
  Description of Artificial Sequence: Synthetic oligonucleotide
ggacgaagaagactagaaacgcatagaggagg

SEQ ID NO: 249239 - DNA, 33 bp, Artificial Sequence
  Description of Artificial Sequence: Synthetic oligonucleotide
gacgaagaagactagaaacgcatagaggaggac

SEQ ID NO: 249240 - DNA, 33 bp, Artificial Sequence
  Description of Artificial Sequence: Synthetic oligonucleotide
acgaagaagactagaaacgcatagaggaggacg

SEQ ID NO: 249241 - DNA, 32 bp, Artificial Sequence
  Description of Artificial Sequence: Synthetic oligonucleotide
cgaagaagactagaaacgcatagaggaggacg

SEQ ID NO: 249242 - DNA, 33 bp, Artificial Sequence
  Description of Artificial Sequence: Synthetic oligonucleotide
gaagaagactagaaacgcatagaggaggacgag

SEQ ID NO: 249243 - DNA, 33 bp, Artificial Sequence
  Description of Artificial Sequence: Synthetic oligonucleotide
aagaagactagaaacgcatagaggaggacgagg

SEQ ID NO: 249244 - DNA, 32 bp, Artificial Sequence
  Description of Artificial Sequence: Synthetic oligonucleotide
agaagactagaaacgcatagaggaggacgagg

SEQ ID NO: 249245 - DNA, 31 bp, Artificial Sequence
  Description of Artificial Sequence: Synthetic oligonucleotide
gaagactagaaacgcatagaggaggacgagg

SEQ ID NO: 249246 - DNA, 31 bp, Artificial Sequence
  Description of Artificial Sequence: Synthetic oligonucleotide
aagactagaaacgcatagaggaggacgaggc

SEQ ID NO: 249247 - DNA, 30 bp, Artificial Sequence
  Description of Artificial Sequence: Synthetic oligonucleotide
agactagaaacgcatagaggaggacgaggc

SEQ ID NO: 249248 - DNA, 29 bp, Artificial Sequence
  Description of Artificial Sequence: Synthetic oligonucleotide
gactagaaacgcatagaggaggacgaggc

SEQ ID NO: 249249 - DNA, 30 bp, Artificial Sequence
  Description of Artificial Sequence: Synthetic oligonucleotide
actagaaacgcatagaggaggacgaggcag

SEQ ID NO: 249250 - DNA, 29 bp, Artificial Sequence
  Description of Artificial Sequence: Synthetic oligonucleotide
ctagaaacgcatagaggaggacgaggcag

SEQ ID NO: 249251 - DNA, 30 bp, Artificial Sequence
  Description of Artificial Sequence: Synthetic oligonucleotide
tagaaacgcatagaggaggacgaggcagag

SEQ ID NO: 249252 - DNA, 29 bp, Artificial Sequence
  Description of Artificial Sequence: Synthetic oligonucleotide
agaaacgcatagaggaggacgaggcagag

SEQ ID NO: 249253 - DNA, 28 bp, Artificial Sequence
  Description of Artificial Sequence: Synthetic oligonucleotide
gaaacgcatagaggaggacgaggcagag

SEQ ID NO: 249254 - DNA, 28 bp, Artificial Sequence
  Description of Artificial Sequence: Synthetic oligonucleotide
aaacgcatagaggaggacgaggcagagc

SEQ ID NO: 249255 - DNA, 27 bp, Artificial Sequence
  Description of Artificial Sequence: Synthetic oligonucleotide
aacgcatagaggaggacgaggcagagc

SEQ ID NO: 249256 - DNA, 27 bp, Artificial Sequence
  Description of Artificial Sequence: Synthetic oligonucleotide
acgcatagaggaggacgaggcagagca

SEQ ID NO: 249257 - DNA, 26 bp, Artificial Sequence
  Description of Artificial Sequence: Synthetic oligonucleotide
cgcatagaggaggacgaggcagagca

SEQ ID NO: 249258 - DNA, 27 bp, Artificial Sequence
  Description of Artificial Sequence: Synthetic oligonucleotide
gcatagaggaggacgaggcagagcaca

SEQ ID NO: 249259 - DNA, 28 bp, Artificial Sequence
  Description of Artificial Sequence: Synthetic oligonucleotide
catagaggaggacgaggcagagcacaag

SEQ ID NO: 249260 - DNA, 28 bp, Artificial Sequence
  Description of Artificial Sequence: Synthetic oligonucleotide
atagaggaggacgaggcagagcacaagg

SEQ ID NO: 249261 - DNA, 27 bp, Artificial Sequence
  Description of Artificial Sequence: Synthetic oligonucleotide
tagaggaggacgaggcagagcacaagg

SEQ ID NO: 249262 - DNA, 27 bp, Artificial Sequence
  Description of Artificial Sequence: Synthetic oligonucleotide
agaggaggacgaggcagagcacaagga

SEQ ID NO: 249263 - DNA, 26 bp, Artificial Sequence
  Description of Artificial Sequence: Synthetic oligonucleotide
gaggaggacgaggcagagcacaagga

SEQ ID NO: 249264 - DNA, 26 bp, Artificial Sequence
  Description of Artificial Sequence: Synthetic oligonucleotide
aggaggacgaggcagagcacaaggag

SEQ ID NO: 249265 - DNA, 25 bp, Artificial Sequence
  Description of Artificial Sequence: Synthetic oligonucleotide
ggaggacgaggcagagcacaaggag

SEQ ID NO: 249266 - DNA, 27 bp, Artificial Sequence
  Description of Artificial Sequence: Synthetic oligonucleotide
gaggacgaggcagagcacaaggaggtt

SEQ ID NO: 249267 - DNA, 27 bp, Artificial Sequence
  Description of Artificial Sequence: Synthetic oligonucleotide
aggacgaggcagagcacaaggaggttg

SEQ ID NO: 249268 - DNA, 27 bp, Artificial Sequence
  Description of Artificial Sequence: Synthetic oligonucleotide
ggacgaggcagagcacaaggaggttga

SEQ ID NO: 249269 - DNA, 28 bp, Artificial Sequence
  Description of Artificial Sequence: Synthetic oligonucleotide
gacgaggcagagcacaaggaggttgatg

SEQ ID NO: 249270 - DNA, 29 bp, Artificial Sequence
  Description of Artificial Sequence: Synthetic oligonucleotide
acgaggcagagcacaaggaggttgatgag

SEQ ID NO: 249271 - DNA, 28 bp, Artificial Sequence
  Description of Artificial Sequence: Synthetic oligonucleotide
cgaggcagagcacaaggaggttgatgag

SEQ ID NO: 249272 - DNA, 28 bp, Artificial Sequence
  Description of Artificial Sequence: Synthetic oligonucleotide
gaggcagagcacaaggaggttgatgagg

SEQ ID NO: 249273 - DNA, 29 bp, Artificial Sequence
  Description of Artificial Sequence: Synthetic oligonucleotide
aggcagagcacaaggaggttgatgaggag

SEQ ID NO: 249274 - DNA, 28 bp, Artificial Sequence
  Description of Artificial Sequence: Synthetic oligonucleotide
ggcagagcacaaggaggttgatgaggag

SEQ ID NO: 249275 - DNA, 31 bp, Artificial Sequence
  Description of Artificial Sequence: Synthetic oligonucleotide
gcagagcacaaggaggttgatgaggagaaag

SEQ ID NO: 249276 - DNA, 33 bp, Artificial Sequence
  Description of Artificial Sequence: Synthetic oligonucleotide
cagagcacaaggaggttgatgaggagaaagatg

SEQ ID NO: 249277 - DNA, 34 bp, Artificial Sequence
  Description of Artificial Sequence: Synthetic oligonucleotide
agagcacaaggaggttgatgaggagaaagatgag

SEQ ID NO: 249278 - DNA, 33 bp, Artificial Sequence
  Description of Artificial Sequence: Synthetic oligonucleotide
gagcacaaggaggttgatgaggagaaagatgag

SEQ ID NO: 249279 - DNA, 33 bp, Artificial Sequence
  Description of Artificial Sequence: Synthetic oligonucleotide
agcacaaggaggttgatgaggagaaagatgagc

SEQ ID NO: 249280 - DNA, 32 bp, Artificial Sequence
  Description of Artificial Sequence: Synthetic oligonucleotide
gcacaaggaggttgatgaggagaaagatgagc

SEQ ID NO: 249281 - DNA, 34 bp, Artificial Sequence
  Description of Artificial Sequence: Synthetic oligonucleotide
cacaaggaggttgatgaggagaaagatgagcatg

SEQ ID NO: 249282 - DNA, 35 bp, Artificial Sequence
  Description of Artificial Sequence: Synthetic oligonucleotide
acaaggaggttgatgaggagaaagatgagcatgag

SEQ ID NO: 249283 - DNA, 34 bp, Artificial Sequence
  Description of Artificial Sequence: Synthetic oligonucleotide
caaggaggttgatgaggagaaagatgagcatgag

SEQ ID NO: 249284 - DNA, 34 bp, Artificial Sequence
  Description of Artificial Sequence: Synthetic oligonucleotide
aaggaggttgatgaggagaaagatgagcatgagg

SEQ ID NO: 249285 - DNA, 33 bp, Artificial Sequence
  Description of Artificial Sequence: Synthetic oligonucleotide
aggaggttgatgaggagaaagatgagcatgagg

SEQ ID NO: 249286 - DNA, 32 bp, Artificial Sequence
  Description of Artificial Sequence: Synthetic oligonucleotide
ggaggttgatgaggagaaagatgagcatgagg

SEQ ID NO: 249287 - DNA, 33 bp, Artificial Sequence
  Description of Artificial Sequence: Synthetic oligonucleotide
gaggttgatgaggagaaagatgagcatgaggag

SEQ ID NO: 249288 - DNA, 33 bp, Artificial Sequence
  Description of Artificial Sequence: Synthetic oligonucleotide
aggttgatgaggagaaagatgagcatgaggagg

SEQ ID NO: 249289 - DNA, 32 bp, Artificial Sequence
  Description of Artificial Sequence: Synthetic oligonucleotide
ggttgatgaggagaaagatgagcatgaggagg

SEQ ID NO: 249290 - DNA, 34 bp, Artificial Sequence
  Description of Artificial Sequence: Synthetic oligonucleotide
gttgatgaggagaaagatgagcatgaggaggttg

SEQ ID NO: 249291 - DNA, 35 bp, Artificial Sequence
  Description of Artificial Sequence: Synthetic oligonucleotide
ttgatgaggagaaagatgagcatgaggaggttgag

SEQ ID NO: 249292 - DNA, 34 bp, Artificial Sequence
  Description of Artificial Sequence: Synthetic oligonucleotide
tgatgaggagaaagatgagcatgaggaggttgag

SEQ ID NO: 249293 - DNA, 33 bp, Artificial Sequence
  Description of Artificial Sequence: Synthetic oligonucleotide
gatgaggagaaagatgagcatgaggaggttgag

SEQ ID NO: 249294 - DNA, 33 bp, Artificial Sequence
  Description of Artificial Sequence: Synthetic oligonucleotide
atgaggagaaagatgagcatgaggaggttgagg

SEQ ID NO: 249295 - DNA, 32 bp, Artificial Sequence
  Description of Artificial Sequence: Synthetic oligonucleotide
tgaggagaaagatgagcatgaggaggttgagg

SEQ ID NO: 249296 - DNA, 31 bp, Artificial Sequence
  Description of Artificial Sequence: Synthetic oligonucleotide
gaggagaaagatgagcatgaggaggttgagg

SEQ ID NO: 249297 - DNA, 32 bp, Artificial Sequence
  Description of Artificial Sequence: Synthetic oligonucleotide
aggagaaagatgagcatgaggaggttgaggag

SEQ ID NO: 249298 - DNA, 31 bp, Artificial Sequence
  Description of Artificial Sequence: Synthetic oligonucleotide
ggagaaagatgagcatgaggaggttgaggag

SEQ ID NO: 249299 - DNA, 31 bp, Artificial Sequence
  Description of Artificial Sequence: Synthetic oligonucleotide
gagaaagatgagcatgaggaggttgaggagg

SEQ ID NO: 249300 - DNA, 32 bp, Artificial Sequence
  Description of Artificial Sequence: Synthetic oligonucleotide
agaaagatgagcatgaggaggttgaggaggag

SEQ ID NO: 249301 - DNA, 31 bp, Artificial Sequence
  Description of Artificial Sequence: Synthetic oligonucleotide
gaaagatgagcatgaggaggttgaggaggag

SEQ ID NO: 249302 - DNA, 33 bp, Artificial Sequence
  Description of Artificial Sequence: Synthetic oligonucleotide
aaagatgagcatgaggaggttgaggaggagaag

SEQ ID NO: 249303 - DNA, 32 bp, Artificial Sequence
  Description of Artificial Sequence: Synthetic oligonucleotide
aagatgagcatgaggaggttgaggaggagaag

SEQ ID NO: 249304 - DNA, 31 bp, Artificial Sequence
  Description of Artificial Sequence: Synthetic oligonucleotide
agatgagcatgaggaggttgaggaggagaag

SEQ ID NO: 249305 - DNA, 30 bp, Artificial Sequence
  Description of Artificial Sequence: Synthetic oligonucleotide
gatgagcatgaggaggttgaggaggagaag

SEQ ID NO: 249306 - DNA, 30 bp, Artificial Sequence
  Description of Artificial Sequence: Synthetic oligonucleotide
atgagcatgaggaggttgaggaggagaagg

SEQ ID NO: 249307 - DNA, 29 bp, Artificial Sequence
  Description of Artificial Sequence: Synthetic oligonucleotide
tgagcatgaggaggttgaggaggagaagg

SEQ ID NO: 249308 - DNA, 28 bp, Artificial Sequence
  Description of Artificial Sequence: Synthetic oligonucleotide
gagcatgaggaggttgaggaggagaagg

SEQ ID NO: 249309 - DNA, 29 bp, Artificial Sequence
  Description of Artificial Sequence: Synthetic oligonucleotide
agcatgaggaggttgaggaggagaaggag

SEQ ID NO: 249310 - DNA, 28 bp, Artificial Sequence
  Description of Artificial Sequence: Synthetic oligonucleotide
gcatgaggaggttgaggaggagaaggag

SEQ ID NO: 249311 - DNA, 28 bp, Artificial Sequence
  Description of Artificial Sequence: Synthetic oligonucleotide
catgaggaggttgaggaggagaaggagg

SEQ ID NO: 249312 - DNA, 30 bp, Artificial Sequence
  Description of Artificial Sequence: Synthetic oligonucleotide
atgaggaggttgaggaggagaaggaggaac

SEQ ID NO: 249313 - DNA, 29 bp, Artificial Sequence
  Description of Artificial Sequence: Synthetic oligonucleotide
tgaggaggttgaggaggagaaggaggaac

SEQ ID NO: 249314 - DNA, 28 bp, Artificial Sequence
  Description of Artificial Sequence: Synthetic oligonucleotide
gaggaggttgaggaggagaaggaggaac

SEQ ID NO: 249315 - DNA, 30 bp, Artificial Sequence
  Description of Artificial Sequence: Synthetic oligonucleotide
aggaggttgaggaggagaaggaggaacatg

SEQ ID NO: 249316 - DNA, 29 bp, Artificial Sequence
  Description of Artificial Sequence: Synthetic oligonucleotide
ggaggttgaggaggagaaggaggaacatg

SEQ ID NO: 249317 - DNA, 30 bp, Artificial Sequence
  Description of Artificial Sequence: Synthetic oligonucleotide
gaggttgaggaggagaaggaggaacatgag

SEQ ID NO: 249318 - DNA, 30 bp, Artificial Sequence
  Description of Artificial Sequence: Synthetic oligonucleotide
aggttgaggaggagaaggaggaacatgagg

SEQ ID NO: 249319 - DNA, 29 bp, Artificial Sequence
  Description of Artificial Sequence: Synthetic oligonucleotide
ggttgaggaggagaaggaggaacatgagg

SEQ ID NO: 249320 - DNA, 30 bp, Artificial Sequence
  Description of Artificial Sequence: Synthetic oligonucleotide
gttgaggaggagaaggaggaacatgaggag

SEQ ID NO: 249321 - DNA, 30 bp, Artificial Sequence
  Description of Artificial Sequence: Synthetic oligonucleotide
ttgaggaggagaaggaggaacatgaggagg

SEQ ID NO: 249322 - DNA, 29 bp, Artificial Sequence
  Description of Artificial Sequence: Synthetic oligonucleotide
tgaggaggagaaggaggaacatgaggagg

SEQ ID NO: 249323 - DNA, 28 bp, Artificial Sequence
  Description of Artificial Sequence: Synthetic oligonucleotide
gaggaggagaaggaggaacatgaggagg

SEQ ID NO: 249324 - DNA, 30 bp, Artificial Sequence
  Description of Artificial Sequence: Synthetic oligonucleotide
aggaggagaaggaggaacatgaggaggtag

SEQ ID NO: 249325 - DNA, 29 bp, Artificial Sequence
  Description of Artificial Sequence: Synthetic oligonucleotide
ggaggagaaggaggaacatgaggaggtag

SEQ ID NO: 249326 - DNA, 31 bp, Artificial Sequence
  Description of Artificial Sequence: Synthetic oligonucleotide
gaggagaaggaggaacatgaggaggtagatg

SEQ ID NO: 249327 - DNA, 32 bp, Artificial Sequence
  Description of Artificial Sequence: Synthetic oligonucleotide
aggagaaggaggaacatgaggaggtagatgtc

SEQ ID NO: 249328 - DNA, 31 bp, Artificial Sequence
  Description of Artificial Sequence: Synthetic oligonucleotide
ggagaaggaggaacatgaggaggtagatgtc

SEQ ID NO: 249329 - DNA, 31 bp, Artificial Sequence
  Description of Artificial Sequence: Synthetic oligonucleotide
gagaaggaggaacatgaggaggtagatgtcc

SEQ ID NO: 249330 - DNA, 31 bp, Artificial Sequence
  Description of Artificial Sequence: Synthetic oligonucleotide
agaaggaggaacatgaggaggtagatgtccc

SEQ ID NO: 249331 - DNA, 30 bp, Artificial Sequence
  Description of Artificial Sequence: Synthetic oligonucleotide
gaaggaggaacatgaggaggtagatgtccc

SEQ ID NO: 249332 - DNA, 30 bp, Artificial Sequence
  Description of Artificial Sequence: Synthetic oligonucleotide
aaggaggaacatgaggaggtagatgtcccg

SEQ ID NO: 249333 - DNA, 29 bp, Artificial Sequence
  Description of Artificial Sequence: Synthetic oligonucleotide
aggaggaacatgaggaggtagatgtcccg

SEQ ID NO: 249334 - DNA, 28 bp, Artificial Sequence
  Description of Artificial Sequence: Synthetic oligonucleotide
ggaggaacatgaggaggtagatgtcccg

SEQ ID NO: 249335 - DNA, 28 bp, Artificial Sequence
  Description of Artificial Sequence: Synthetic oligonucleotide
gaggaacatgaggaggtagatgtcccgg

SEQ ID NO: 249336 - DNA, 28 bp, Artificial Sequence
  Description of Artificial Sequence: Synthetic oligonucleotide
aggaacatgaggaggtagatgtcccggg

SEQ ID NO: 249337 - DNA, 27 bp, Artificial Sequence
  Description of Artificial Sequence: Synthetic oligonucleotide
ggaacatgaggaggtagatgtcccggg

SEQ ID NO: 249338 - DNA, 27 bp, Artificial Sequence
  Description of Artificial Sequence: Synthetic oligonucleotide
gaacatgaggaggtagatgtcccgggc

SEQ ID NO: 249339 - DNA, 27 bp, Artificial Sequence
  Description of Artificial Sequence: Synthetic oligonucleotide
aacatgaggaggtagatgtcccgggcc

SEQ ID NO: 249340 - DNA, 27 bp, Artificial Sequence
  Description of Artificial Sequence: Synthetic oligonucleotide
acatgaggaggtagatgtcccgggcca

SEQ ID NO: 249341 - DNA, 26 bp, Artificial Sequence
  Description of Artificial Sequence: Synthetic oligonucleotide
catgaggaggtagatgtcccgggcca

SEQ ID NO: 249342 - DNA, 26 bp, Artificial Sequence
  Description of Artificial Sequence: Synthetic oligonucleotide
atgaggaggtagatgtcccgggccag

SEQ ID NO: 249343 - DNA, 25 bp, Artificial Sequence
  Description of Artificial Sequence: Synthetic oligonucleotide
tgaggaggtagatgtcccgggccag

SEQ ID NO: 249344 - DNA, 24 bp, Artificial Sequence
  Description of Artificial Sequence: Synthetic oligonucleotide
gaggaggtagatgtcccgggccag

SEQ ID NO: 249345 - DNA, 24 bp, Artificial Sequence
  Description of Artificial Sequence: Synthetic oligonucleotide
aggaggtagatgtcccgggccagg

SEQ ID NO: 249346 - DNA, 23 bp, Artificial Sequence
  Description of Artificial Sequence: Synthetic oligonucleotide
ggaggtagatgtcccgggccagg

SEQ ID NO: 249347 - DNA, 23 bp, Artificial Sequence
  Description of Artificial Sequence: Synthetic oligonucleotide
gaggtagatgtcccgggccaggc

SEQ ID NO: 249348 - DNA, 25 bp, Artificial Sequence
  Description of Artificial Sequence: Synthetic oligonucleotide
aggtagatgtcccgggccaggccta

SEQ ID NO: 249349 - DNA, 24 bp, Artificial Sequence
  Description of Artificial Sequence: Synthetic oligonucleotide
ggtagatgtcccgggccaggccta

SEQ ID NO: 249350 - DNA, 24 bp, Artificial Sequence
  Description of Artificial Sequence: Synthetic oligonucleotide
gtagatgtcccgggccaggcctag

SEQ ID NO: 249351 - DNA, 25 bp, Artificial Sequence
  Description of Artificial Sequence: Synthetic oligonucleotide
tagatgtcccgggccaggcctagga

SEQ ID NO: 249352 - DNA, 24 bp, Artificial Sequence
  Description of Artificial Sequence: Synthetic oligonucleotide
agatgtcccgggccaggcctagga

SEQ ID NO: 249353 - DNA, 23 bp, Artificial Sequence
  Description of Artificial Sequence: Synthetic oligonucleotide
gatgtcccgggccaggcctagga

SEQ ID NO: 249354 - DNA, 23 bp, Artificial Sequence
  Description of Artificial Sequence: Synthetic oligonucleotide
atgtcccgggccaggcctaggac

SEQ ID NO: 249355 - DNA, 22 bp, Artificial Sequence
  Description of Artificial Sequence: Synthetic oligonucleotide
tgtcccgggccaggcctaggac

SEQ ID NO: 249356 - DNA, 21 bp, Artificial Sequence
  Description of Artificial Sequence: Synthetic oligonucleotide
gtcccgggccaggcctaggac

SEQ ID NO: 249357 - DNA, 22 bp, Artificial Sequence
  Description of Artificial Sequence: Synthetic oligonucleotide
tcccgggccaggcctaggacga

SEQ ID NO: 249358 - DNA, 21 bp, Artificial Sequence
  Description of Artificial Sequence: Synthetic oligonucleotide
cccgggccaggcctaggacga

SEQ ID NO: 249359 - DNA, 21 bp, Artificial Sequence
  Description of Artificial Sequence: Synthetic oligonucleotide
ccgggccaggcctaggacgag

SEQ ID NO: 249360 - DNA, 22 bp, Artificial Sequence
  Description of Artificial Sequence: Synthetic oligonucleotide
cgggccaggcctaggacgagca

SEQ ID NO: 249361 - DNA, 24 bp, Artificial Sequence
  Description of Artificial Sequence: Synthetic oligonucleotide
gggccaggcctaggacgagcagta

SEQ ID NO: 249362 - DNA, 24 bp, Artificial Sequence
  Description of Artificial Sequence: Synthetic oligonucleotide
ggccaggcctaggacgagcagtag

SEQ ID NO: 249363 - DNA, 27 bp, Artificial Sequence
  Description of Artificial Sequence: Synthetic oligonucleotide
atgagcccccagcttctccctgtactg

SEQ ID NO: 249364 - DNA, 26 bp, Artificial Sequence
  Description of Artificial Sequence: Synthetic oligonucleotide
tgagcccccagcttctccctgtactg

SEQ ID NO: 249365 - DNA, 25 bp, Artificial Sequence
  Description of Artificial Sequence: Synthetic oligonucleotide
gagcccccagcttctccctgtactg

SEQ ID NO: 249366 - DNA, 26 bp, Artificial Sequence
  Description of Artificial Sequence: Synthetic oligonucleotide
agcccccagcttctccctgtactggt

SEQ ID NO: 249367 - DNA, 25 bp, Artificial Sequence
  Description of Artificial Sequence: Synthetic oligonucleotide
gcccccagcttctccctgtactggt

SEQ ID NO: 249368 - DNA, 25 bp, Artificial Sequence
  Description of Artificial Sequence: Synthetic oligonucleotide
cccccagcttctccctgtactggtg

SEQ ID NO: 249369 - DNA, 26 bp, Artificial Sequence
  Description of Artificial Sequence: Synthetic oligonucleotide
ccccagcttctccctgtactggtgct

SEQ ID NO: 249370 - DNA, 26 bp, Artificial Sequence
  Description of Artificial Sequence: Synthetic oligonucleotide
cccagcttctccctgtactggtgctg

SEQ ID NO: 249371 - DNA, 27 bp, Artificial Sequence
  Description of Artificial Sequence: Synthetic oligonucleotide
ccagcttctccctgtactggtgctgct

SEQ ID NO: 249372 - DNA, 27 bp, Artificial Sequence
  Description of Artificial Sequence: Synthetic oligonucleotide
cagcttctccctgtactggtgctgctg

SEQ ID NO: 249373 - DNA, 27 bp, Artificial Sequence
  Description of Artificial Sequence: Synthetic oligonucleotide
agcttctccctgtactggtgctgctgc

SEQ ID NO: 249374 - DNA, 27 bp, Artificial Sequence
  Description of Artificial Sequence: Synthetic oligonucleotide
gcttctccctgtactggtgctgctgca

SEQ ID NO: 249375 - DNA, 27 bp, Artificial Sequence
  Description of Artificial Sequence: Synthetic oligonucleotide
cttctccctgtactggtgctgctgcag

SEQ ID NO: 249376 - DNA, 27 bp, Artificial Sequence
  Description of Artificial Sequence: Synthetic oligonucleotide
ttctccctgtactggtgctgctgcagc

SEQ ID NO: 249377 - DNA, 27 bp, Artificial Sequence
  Description of Artificial Sequence: Synthetic oligonucleotide
tctccctgtactggtgctgctgcagct

SEQ ID NO: 249378 - DNA, 26 bp, Artificial Sequence
  Description of Artificial Sequence: Synthetic oligonucleotide
ctccctgtactggtgctgctgcagct

SEQ ID NO: 249379 - DNA, 27 bp, Artificial Sequence
  Description of Artificial Sequence: Synthetic oligonucleotide
tccctgtactggtgctgctgcagctca

SEQ ID NO: 249380 - DNA, 26 bp, Artificial Sequence
  Description of Artificial Sequence: Synthetic oligonucleotide
ccctgtactggtgctgctgcagctca

SEQ ID NO: 249381 - DNA, 26 bp, Artificial Sequence
  Description of Artificial Sequence: Synthetic oligonucleotide
cctgtactggtgctgctgcagctcag

SEQ ID NO: 249382 - DNA, 26 bp, Artificial Sequence
  Description of Artificial Sequence: Synthetic oligonucleotide
ctgtactggtgctgctgcagctcagg

SEQ ID NO: 249383 - DNA, 26 bp, Artificial Sequence
  Description of Artificial Sequence: Synthetic oligonucleotide
tgtactggtgctgctgcagctcaggg

SEQ ID NO: 249384 - DNA, 25 bp, Artificial Sequence
  Description of Artificial Sequence: Synthetic oligonucleotide
gtactggtgctgctgcagctcaggg

SEQ ID NO: 249385 - DNA, 27 bp, Artificial Sequence
  Description of Artificial Sequence: Synthetic oligonucleotide
tactggtgctgctgcagctcagggcat

SEQ ID NO: 249386 - DNA, 26 bp, Artificial Sequence
  Description of Artificial Sequence: Synthetic oligonucleotide
actggtgctgctgcagctcagggcat

SEQ ID NO: 249387 - DNA, 25 bp, Artificial Sequence
  Description of Artificial Sequence: Synthetic oligonucleotide
ctggtgctgctgcagctcagggcat

SEQ ID NO: 249388 - DNA, 25 bp, Artificial Sequence
  Description of Artificial Sequence: Synthetic oligonucleotide
tggtgctgctgcagctcagggcatc

SEQ ID NO: 249389 - DNA, 24 bp, Artificial Sequence
  Description of Artificial Sequence: Synthetic oligonucleotide
ggtgctgctgcagctcagggcatc

SEQ ID NO: 249390 - DNA, 25 bp, Artificial Sequence
  Description of Artificial Sequence: Synthetic oligonucleotide
gtgctgctgcagctcagggcatcgt

SEQ ID NO: 249391 - DNA, 25 bp, Artificial Sequence
  Description of Artificial Sequence: Synthetic oligonucleotide
tgctgctgcagctcagggcatcgtg

SEQ ID NO: 249392 - DNA, 24 bp, Artificial Sequence
  Description of Artificial Sequence: Synthetic oligonucleotide
gctgctgcagctcagggcatcgtg

SEQ ID NO: 249393 - DNA, 24 bp, Artificial Sequence
  Description of Artificial Sequence: Synthetic oligonucleotide
ctgctgcagctcagggcatcgtgc

SEQ ID NO: 249394 - DNA, 24 bp, Artificial Sequence
  Description of Artificial Sequence: Synthetic oligonucleotide
tgctgcagctcagggcatcgtgcc

SEQ ID NO: 249395 - DNA, 23 bp, Artificial Sequence
  Description of Artificial Sequence: Synthetic oligonucleotide
gctgcagctcagggcatcgtgcc

SEQ ID NO: 249396 - DNA, 25 bp, Artificial Sequence
  Description of Artificial Sequence: Synthetic oligonucleotide
ctgcagctcagggcatcgtgcccaa

SEQ ID NO: 249397 - DNA, 25 bp, Artificial Sequence
  Description of Artificial Sequence: Synthetic oligonucleotide
tgcagctcagggcatcgtgcccaag

SEQ ID NO: 249398 - DNA, 24 bp, Artificial Sequence
  Description of Artificial Sequence: Synthetic oligonucleotide
gcagctcagggcatcgtgcccaag

SEQ ID NO: 249399 - DNA, 24 bp, Artificial Sequence
  Description of Artificial Sequence: Synthetic oligonucleotide
cagctcagggcatcgtgcccaagg

SEQ ID NO: 249400 - DNA, 24 bp, Artificial Sequence
  Description of Artificial Sequence: Synthetic oligonucleotide
agctcagggcatcgtgcccaaggg

SEQ ID NO: 249401 - DNA, 23 bp, Artificial Sequence
  Description of Artificial Sequence: Synthetic oligonucleotide
gctcagggcatcgtgcccaaggg

SEQ ID NO: 249402 - DNA, 24 bp, Artificial Sequence
  Description of Artificial Sequence: Synthetic oligonucleotide
ctcagggcatcgtgcccaaggggt

SEQ ID NO: 249403 - DNA, 25 bp, Artificial Sequence
  Description of Artificial Sequence: Synthetic oligonucleotide
tcagggcatcgtgcccaaggggtca

SEQ ID NO: 249404 - DNA, 24 bp, Artificial Sequence
  Description of Artificial Sequence: Synthetic oligonucleotide
cagggcatcgtgcccaaggggtca

SEQ ID NO: 249405 - DNA, 24 bp, Artificial Sequence
  Description of Artificial Sequence: Synthetic oligonucleotide
agggcatcgtgcccaaggggtcag

SEQ ID NO: 249406 - DNA, 23 bp, Artificial Sequence
  Description of Artificial Sequence: Synthetic oligonucleotide
gggcatcgtgcccaaggggtcag

SEQ ID NO: 249407 - DNA, 25 bp, Artificial Sequence
  Description of Artificial Sequence: Synthetic oligonucleotide
ggcatcgtgcccaaggggtcaggta

SEQ ID NO: 249408 - DNA, 26 bp, Artificial Sequence
  Description of Artificial Sequence: Synthetic oligonucleotide
gcatcgtgcccaaggggtcaggtaca

SEQ ID NO: 249409 - DNA, 26 bp, Artificial Sequence
  Description of Artificial Sequence: Synthetic oligonucleotide
catcgtgcccaaggggtcaggtacag

SEQ ID NO: 249410 - DNA, 26 bp, Artificial Sequence
  Description of Artificial Sequence: Synthetic oligonucleotide
atcgtgcccaaggggtcaggtacagg

SEQ ID NO: 249411 - DNA, 25 bp, Artificial Sequence
  Description of Artificial Sequence: Synthetic oligonucleotide
tcgtgcccaaggggtcaggtacagg

SEQ ID NO: 249412 - DNA, 24 bp, Artificial Sequence
  Description of Artificial Sequence: Synthetic oligonucleotide
cgtgcccaaggggtcaggtacagg

SEQ ID NO: 249413 - DNA, 25 bp, Artificial Sequence
  Description of Artificial Sequence: Synthetic oligonucleotide
gtgcccaaggggtcaggtacaggga

SEQ ID NO: 249414 - DNA, 25 bp, Artificial Sequence
  Description of Artificial Sequence: Synthetic oligonucleotide
tgcccaaggggtcaggtacagggag

SEQ ID NO: 249415 - DNA, 24 bp, Artificial Sequence
  Description of Artificial Sequence: Synthetic oligonucleotide
gcccaaggggtcaggtacagggag

SEQ ID NO: 249416 - DNA, 24 bp, Artificial Sequence
  Description of Artificial Sequence: Synthetic oligonucleotide
cccaaggggtcaggtacagggagc

SEQ ID NO: 249417 - DNA, 25 bp, Artificial Sequence
  Description of Artificial Sequence: Synthetic oligonucleotide
ccaaggggtcaggtacagggagcca

SEQ ID NO: 249418 - DNA, 25 bp, Artificial Sequence
  Description of Artificial Sequence: Synthetic oligonucleotide
caaggggtcaggtacagggagccag

SEQ ID NO: 249419 - DNA, 26 bp, Artificial Sequence
  Description of Artificial Sequence: Synthetic oligonucleotide
aaggggtcaggtacagggagccagga

SEQ ID NO: 249420 - DNA, 25 bp, Artificial Sequence
  Description of Artificial Sequence: Synthetic oligonucleotide
aggggtcaggtacagggagccagga

SEQ ID NO: 249421 - DNA, 24 bp, Artificial Sequence
  Description of Artificial Sequence: Synthetic oligonucleotide
ggggtcaggtacagggagccagga

SEQ ID NO: 249422 - DNA, 24 bp, Artificial Sequence
  Description of Artificial Sequence: Synthetic oligonucleotide
gggtcaggtacagggagccaggag

SEQ ID NO: 249423 - DNA, 24 bp, Artificial Sequence
  Description of Artificial Sequence: Synthetic oligonucleotide
ggtcaggtacagggagccaggagc

SEQ ID NO: 249424 - DNA, 24 bp, Artificial Sequence
  Description of Artificial Sequence: Synthetic oligonucleotide
gtcaggtacagggagccaggagcc

SEQ ID NO: 249425 - DNA, 24 bp, Artificial Sequence
  Description of Artificial Sequence: Synthetic oligonucleotide
tcaggtacagggagccaggagccc

SEQ ID NO: 249426 - DNA, 23 bp, Artificial Sequence
  Description of Artificial Sequence: Synthetic oligonucleotide
caggtacagggagccaggagccc

SEQ ID NO: 249427 - DNA, 24 bp, Artificial Sequence
  Description of Artificial Sequence: Synthetic oligonucleotide
aggtacagggagccaggagcccca

SEQ ID NO: 249428 - DNA, 23 bp, Artificial Sequence
  Description of Artificial Sequence: Synthetic oligonucleotide
ggtacagggagccaggagcccca

SEQ ID NO: 249429 - DNA, 23 bp, Artificial Sequence
  Description of Artificial Sequence: Synthetic oligonucleotide
gtacagggagccaggagccccac

SEQ ID NO: 249430 - DNA, 23 bp, Artificial Sequence
  Description of Artificial Sequence: Synthetic oligonucleotide
tacagggagccaggagccccacg

SEQ ID NO: 249431 - DNA, 22 bp, Artificial Sequence
  Description of Artificial Sequence: Synthetic oligonucleotide
acagggagccaggagccccacg

SEQ ID NO: 249432 - DNA, 21 bp, Artificial Sequence
  Description of Artificial Sequence: Synthetic oligonucleotide
cagggagccaggagccccacg

SEQ ID NO: 249433 - DNA, 22 bp, Artificial Sequence
  Description of Artificial Sequence: Synthetic oligonucleotide
agggagccaggagccccacgga

SEQ ID NO: 249434 - DNA, 21 bp, Artificial Sequence
  Description of Artificial Sequence: Synthetic oligonucleotide
gggagccaggagccccacgga

SEQ ID NO: 249435 - DNA, 21 bp, Artificial Sequence
  Description of Artificial Sequence: Synthetic oligonucleotide
ggagccaggagccccacggag

SEQ ID NO: 249436 - DNA, 22 bp, Artificial Sequence
  Description of Artificial Sequence: Synthetic oligonucleotide
gagccaggagccccacggagga

SEQ ID NO: 249437 - DNA, 22 bp, Artificial Sequence
  Description of Artificial Sequence: Synthetic oligonucleotide
agccaggagccccacggaggag

SEQ ID NO: 249438 - DNA, 21 bp, Artificial Sequence
  Description of Artificial Sequence: Synthetic oligonucleotide
gccaggagccccacggaggag

SEQ ID NO: 249439 - DNA, 21 bp, Artificial Sequence
  Description of Artificial Sequence: Synthetic oligonucleotide
ccaggagccccacggaggagc

SEQ ID NO: 249440 - DNA, 22 bp, Artificial Sequence
  Description of Artificial Sequence: Synthetic oligonucleotide
caggagccccacggaggagcgt

SEQ ID NO: 249441 - DNA, 22 bp, Artificial Sequence
  Description of Artificial Sequence: Synthetic oligonucleotide
aggagccccacggaggagcgtc

SEQ ID NO: 249442 - DNA, 21 bp, Artificial Sequence
  Description of Artificial Sequence: Synthetic oligonucleotide
ggagccccacggaggagcgtc

SEQ ID NO: 249443 - DNA, 22 bp, Artificial Sequence
  Description of Artificial Sequence: Synthetic oligonucleotide
gagccccacggaggagcgtcca

SEQ ID NO: 249444 - DNA, 23 bp, Artificial Sequence
  Description of Artificial Sequence: Synthetic oligonucleotide
agccccacggaggagcgtccaga

SEQ ID NO: 249445 - DNA, 22 bp, Artificial Sequence
  Description of Artificial Sequence: Synthetic oligonucleotide
gccccacggaggagcgtccaga

SEQ ID NO: 249446 - DNA, 22 bp, Artificial Sequence
  Description of Artificial Sequence: Synthetic oligonucleotide
ccccacggaggagcgtccagag

SEQ ID NO: 249447 - DNA, 23 bp, Artificial Sequence
  Description of Artificial Sequence: Synthetic oligonucleotide
cccacggaggagcgtccagagga

SEQ ID NO: 249448 - DNA, 23 bp, Artificial Sequence
  Description of Artificial Sequence: Synthetic oligonucleotide
ccacggaggagcgtccagaggac

SEQ ID NO: 249449 - DNA, 27 bp, Artificial Sequence
  Description of Artificial Sequence: Synthetic oligonucleotide
cacggaggagcgtccagaggacgaaat

SEQ ID NO: 249450 - DNA, 27 bp, Artificial Sequence
  Description of Artificial Sequence: Synthetic oligonucleotide
acggaggagcgtccagaggacgaaatc

SEQ ID NO: 249451 - DNA, 26 bp, Artificial Sequence
  Description of Artificial Sequence: Synthetic oligonucleotide
cggaggagcgtccagaggacgaaatc

SEQ ID NO: 249452 - DNA, 26 bp, Artificial Sequence
  Description of Artificial Sequence: Synthetic oligonucleotide
ggaggagcgtccagaggacgaaatcc

SEQ ID NO: 249453 - DNA, 26 bp, Artificial Sequence
  Description of Artificial Sequence: Synthetic oligonucleotide
gaggagcgtccagaggacgaaatccc

SEQ ID NO: 249454 - DNA, 27 bp, Artificial Sequence
  Description of Artificial Sequence: Synthetic oligonucleotide
aggagcgtccagaggacgaaatcccct

SEQ ID NO: 249455 - DNA, 27 bp, Artificial Sequence
  Description of Artificial Sequence: Synthetic oligonucleotide
ggagcgtccagaggacgaaatccccta

SEQ ID NO: 249456 - DNA, 27 bp, Artificial Sequence
  Description of Artificial Sequence: Synthetic oligonucleotide
gagcgtccagaggacgaaatcccctag

SEQ ID NO: 249457 - DNA, 27 bp, Artificial Sequence
  Description of Artificial Sequence: Synthetic oligonucleotide
agcgtccagaggacgaaatcccctagg

SEQ ID NO: 249458 - DNA, 27 bp, Artificial Sequence
  Description of Artificial Sequence: Synthetic oligonucleotide
gcgtccagaggacgaaatcccctagga

SEQ ID NO: 249459 - DNA, 27 bp, Artificial Sequence
  Description of Artificial Sequence: Synthetic oligonucleotide
cgtccagaggacgaaatcccctaggag

SEQ ID NO: 249460 - DNA, 27 bp, Artificial Sequence
  Description of Artificial Sequence: Synthetic oligonucleotide
gtccagaggacgaaatcccctaggagg

SEQ ID NO: 249461 - DNA, 29 bp, Artificial Sequence
  Description of Artificial Sequence: Synthetic oligonucleotide
tccagaggacgaaatcccctaggaggatg

SEQ ID NO: 249462 - DNA, 28 bp, Artificial Sequence
  Description of Artificial Sequence: Synthetic oligonucleotide
ccagaggacgaaatcccctaggaggatg

SEQ ID NO: 249463 - DNA, 28 bp, Artificial Sequence
  Description of Artificial Sequence: Synthetic oligonucleotide
cagaggacgaaatcccctaggaggatgc

SEQ ID NO: 249464 - DNA, 28 bp, Artificial Sequence
  Description of Artificial Sequence: Synthetic oligonucleotide
agaggacgaaatcccctaggaggatgcg

SEQ ID NO: 249465 - DNA, 27 bp, Artificial Sequence
  Description of Artificial Sequence: Synthetic oligonucleotide
gaggacgaaatcccctaggaggatgcg

SEQ ID NO: 249466 - DNA, 29 bp, Artificial Sequence
  Description of Artificial Sequence: Synthetic oligonucleotide
aggacgaaatcccctaggaggatgcgatc

SEQ ID NO: 249467 - DNA, 28 bp, Artificial Sequence
  Description of Artificial Sequence: Synthetic oligonucleotide
ggacgaaatcccctaggaggatgcgatc

SEQ ID NO: 249468 - DNA, 30 bp, Artificial Sequence
  Description of Artificial Sequence: Synthetic oligonucleotide
gacgaaatcccctaggaggatgcgatcttg

SEQ ID NO: 249469 - DNA, 30 bp, Artificial Sequence
  Description of Artificial Sequence: Synthetic oligonucleotide
acgaaatcccctaggaggatgcgatcttgg

SEQ ID NO: 249470 - DNA, 29 bp, Artificial Sequence
  Description of Artificial Sequence: Synthetic oligonucleotide
cgaaatcccctaggaggatgcgatcttgg

SEQ ID NO: 249471 - DNA, 30 bp, Artificial Sequence
  Description of Artificial Sequence: Synthetic oligonucleotide
gaaatcccctaggaggatgcgatcttggtc

SEQ ID NO: 249472 - DNA, 30 bp, Artificial Sequence
  Description of Artificial Sequence: Synthetic oligonucleotide
aaatcccctaggaggatgcgatcttggtcc

SEQ ID NO: 249473 - DNA, 29 bp, Artificial Sequence
  Description of Artificial Sequence: Synthetic oligonucleotide
aatcccctaggaggatgcgatcttggtcc

SEQ ID NO: 249474 - DNA, 28 bp, Artificial Sequence
  Description of Artificial Sequence: Synthetic oligonucleotide
atcccctaggaggatgcgatcttggtcc

SEQ ID NO: 249475 - DNA, 27 bp, Artificial Sequence
  Description of Artificial Sequence: Synthetic oligonucleotide
tcccctaggaggatgcgatcttggtcc

SEQ ID NO: 249476 - DNA, 27 bp, Artificial Sequence
  Description of Artificial Sequence: Synthetic oligonucleotide
cccctaggaggatgcgatcttggtcct

SEQ ID NO: 249477 - DNA, 27 bp, Artificial Sequence
  Description of Artificial Sequence: Synthetic oligonucleotide
ccctaggaggatgcgatcttggtcctg

SEQ ID NO: 249478 - DNA, 28 bp, Artificial Sequence
  Description of Artificial Sequence: Synthetic oligonucleotide
cctaggaggatgcgatcttggtcctgag

SEQ ID NO: 249479 - DNA, 28 bp, Artificial Sequence
  Description of Artificial Sequence: Synthetic oligonucleotide
ctaggaggatgcgatcttggtcctgagc

SEQ ID NO: 249480 - DNA, 28 bp, Artificial Sequence
  Description of Artificial Sequence: Synthetic oligonucleotide
taggaggatgcgatcttggtcctgagcc

SEQ ID NO: 249481 - DNA, 27 bp, Artificial Sequence
  Description of Artificial Sequence: Synthetic oligonucleotide
aggaggatgcgatcttggtcctgagcc

SEQ ID NO: 249482 - DNA, 26 bp, Artificial Sequence
  Description of Artificial Sequence: Synthetic oligonucleotide
ggaggatgcgatcttggtcctgagcc

SEQ ID NO: 249483 - DNA, 26 bp, Artificial Sequence
  Description of Artificial Sequence: Synthetic oligonucleotide
gaggatgcgatcttggtcctgagccg

SEQ ID NO: 249484 - DNA, 26 bp, Artificial Sequence
  Description of Artificial Sequence: Synthetic oligonucleotide
aggatgcgatcttggtcctgagccgc

SEQ ID NO: 249485 - DNA, 25 bp, Artificial Sequence
  Description of Artificial Sequence: Synthetic oligonucleotide
ggatgcgatcttggtcctgagccgc

SEQ ID NO: 249486 - DNA, 26 bp, Artificial Sequence
  Description of Artificial Sequence: Synthetic oligonucleotide
gatgcgatcttggtcctgagccgcga

SEQ ID NO: 249487 - DNA, 27 bp, Artificial Sequence
  Description of Artificial Sequence: Synthetic oligonucleotide
atgcgatcttggtcctgagccgcgaca

SEQ ID NO: 249488 - DNA, 26 bp, Artificial Sequence
  Description of Artificial Sequence: Synthetic oligonucleotide
tgcgatcttggtcctgagccgcgaca

SEQ ID NO: 249489 - DNA, 25 bp, Artificial Sequence
  Description of Artificial Sequence: Synthetic oligonucleotide
gcgatcttggtcctgagccgcgaca

SEQ ID NO: 249490 - DNA, 25 bp, Artificial Sequence
  Description of Artificial Sequence: Synthetic oligonucleotide
cgatcttggtcctgagccgcgacac

SEQ ID NO: 249491 - DNA, 25 bp, Artificial Sequence
  Description of Artificial Sequence: Synthetic oligonucleotide
gatcttggtcctgagccgcgacacc

SEQ ID NO: 249492 - DNA, 26 bp, Artificial Sequence
  Description of Artificial Sequence: Synthetic oligonucleotide
atcttggtcctgagccgcgacaccct

SEQ ID NO: 249493 - DNA, 25 bp, Artificial Sequence
  Description of Artificial Sequence: Synthetic oligonucleotide
tcttggtcctgagccgcgacaccct

SEQ ID NO: 249494 - DNA, 24 bp, Artificial Sequence
  Description of Artificial Sequence: Synthetic oligonucleotide
cttggtcctgagccgcgacaccct

SEQ ID NO: 249495 - DNA, 24 bp, Artificial Sequence
  Description of Artificial Sequence: Synthetic oligonucleotide
ttggtcctgagccgcgacaccctg

SEQ ID NO: 249496 - DNA, 23 bp, Artificial Sequence
  Description of Artificial Sequence: Synthetic oligonucleotide
tggtcctgagccgcgacaccctg

SEQ ID NO: 249497 - DNA, 22 bp, Artificial Sequence
  Description of Artificial Sequence: Synthetic oligonucleotide
ggtcctgagccgcgacaccctg

SEQ ID NO: 249498 - DNA, 22 bp, Artificial Sequence
  Description of Artificial Sequence: Synthetic oligonucleotide
gtcctgagccgcgacaccctgg

SEQ ID NO: 249499 - DNA, 22 bp, Artificial Sequence
  Description of Artificial Sequence: Synthetic oligonucleotide
tcctgagccgcgacaccctggc

SEQ ID NO: 249500 - DNA, 21 bp, Artificial Sequence
  Description of Artificial Sequence: Synthetic oligonucleotide
cctgagccgcgacaccctggc

SEQ ID NO: 249501 - DNA, 21 bp, Artificial Sequence
  Description of Artificial Sequence: Synthetic oligonucleotide
ctgagccgcgacaccctggcc

SEQ ID NO: 249502 - DNA, 22 bp, Artificial Sequence
  Description of Artificial Sequence: Synthetic oligonucleotide
tgagccgcgacaccctggccct

SEQ ID NO: 249503 - DNA, 21 bp, Artificial Sequence
  Description of Artificial Sequence: Synthetic oligonucleotide
gagccgcgacaccctggccct

SEQ ID NO: 249504 - DNA, 21 bp, Artificial Sequence
  Description of Artificial Sequence: Synthetic oligonucleotide
agccgcgacaccctggccctg

SEQ ID NO: 249505 - DNA, 20 bp, Artificial Sequence
  Description of Artificial Sequence: Synthetic oligonucleotide
gccgcgacaccctggccctg

SEQ ID NO: 249506 - DNA, 20 bp, Artificial Sequence
  Description of Artificial Sequence: Synthetic oligonucleotide
ccgcgacaccctggccctgg

SEQ ID NO: 249507 - DNA, 20 bp, Artificial Sequence
  Description of Artificial Sequence: Synthetic oligonucleotide
cgcgacaccctggccctggc

SEQ ID NO: 249508 - DNA, 20 bp, Artificial Sequence
  Description of Artificial Sequence: Synthetic oligonucleotide
gcgacaccctggccctggcc

SEQ ID NO: 249509 - DNA, 21 bp, Artificial Sequence
  Description of Artificial Sequence: Synthetic oligonucleotide
cgacaccctggccctggccct

SEQ ID NO: 249510 - DNA, 21 bp, Artificial Sequence
  Description of Artificial Sequence: Synthetic oligonucleotide
gacaccctggccctggccctc

SEQ ID NO: 249511 - DNA, 21 bp, Artificial Sequence
  Description of Artificial Sequence: Synthetic oligonucleotide
acaccctggccctggccctcc

SEQ ID NO: 249512 - DNA, 20 bp, Artificial Sequence
  Description of Artificial Sequence: Synthetic oligonucleotide
caccctggccctggccctcc

SEQ ID NO: 249513 - DNA, 20 bp, Artificial Sequence
  Description of Artificial Sequence: Synthetic oligonucleotide
accctggccctggccctccg

SEQ ID NO: 249514 - DNA, 20 bp, Artificial Sequence
  Description of Artificial Sequence: Synthetic oligonucleotide
ccctggccctggccctccgt

SEQ ID NO: 249515 - DNA, 20 bp, Artificial Sequence
  Description of Artificial Sequence: Synthetic oligonucleotide
cctggccctggccctccggt

SEQ ID NO: 249516 - DNA, 20 bp, Artificial Sequence
  Description of Artificial Sequence: Synthetic oligonucleotide
ctggccctggccctccggga

SEQ ID NO: 249517 - DNA, 20 bp, Artificial Sequence
  Description of Artificial Sequence: Synthetic oligonucleotide
tggccctggccctccgggag

SEQ ID NO: 249518 - DNA, 20 bp, Artificial Sequence
  Description of Artificial Sequence: Synthetic oligonucleotide
ggccctggccctccgggagt

SEQ ID NO: 249519 - DNA, 20 bp, Artificial Sequence
  Description of Artificial Sequence: Synthetic oligonucleotide
gccctggccctccgggagca

SEQ ID NO: 249520 - DNA, 20 bp, Artificial Sequence
  Description of Artificial Sequence: Synthetic oligonucleotide
ccctggccctccgggagcac

SEQ ID NO: 249521 - DNA, 20 bp, Artificial Sequence
  Description of Artificial Sequence: Synthetic oligonucleotide
cctggccctccgggagcacg

SEQ ID NO: 249522 - DNA, 21 bp, Artificial Sequence
  Description of Artificial Sequence: Synthetic oligonucleotide
ctggccctccgggagcacgct

SEQ ID NO: 249523 - DNA, 21 bp, Artificial Sequence
  Description of Artificial Sequence: Synthetic oligonucleotide
tggccctccgggagcacgctg

SEQ ID NO: 249524 - DNA, 20 bp, Artificial Sequence
  Description of Artificial Sequence: Synthetic oligonucleotide
ggccctccgggagcacgctg

SEQ ID NO: 249525 - DNA, 20 bp, Artificial Sequence
  Description of Artificial Sequence: Synthetic oligonucleotide
gccctccgggagcacgctgc

SEQ ID NO: 249526 - DNA, 20 bp, Artificial Sequence
  Description of Artificial Sequence: Synthetic oligonucleotide
ccctccgggagcacgctgcc

SEQ ID NO: 249527 - DNA, 21 bp, Artificial Sequence
  Description of Artificial Sequence: Synthetic oligonucleotide
cctccgggagcacgctgccct

SEQ ID NO: 249528 - DNA, 21 bp, Artificial Sequence
  Description of Artificial Sequence: Synthetic oligonucleotide
ctccgggagcacgctgccctg

SEQ ID NO: 249529 - DNA, 22 bp, Artificial Sequence
  Description of Artificial Sequence: Synthetic oligonucleotide
tccgggagcacgctgccctgca

SEQ ID NO: 249530 - DNA, 21 bp, Artificial Sequence
  Description of Artificial Sequence: Synthetic oligonucleotide
ccgggagcacgctgccctgca

SEQ ID NO: 249531 - DNA, 21 bp, Artificial Sequence
  Description of Artificial Sequence: Synthetic oligonucleotide
cgggagcacgctgccctgcag

SEQ ID NO: 249532 - DNA, 22 bp, Artificial Sequence
  Description of Artificial Sequence: Synthetic oligonucleotide
gggagcacgctgccctgcaggt

SEQ ID NO: 249533 - DNA, 22 bp, Artificial Sequence
  Description of Artificial Sequence: Synthetic oligonucleotide
ggagcacgctgccctgcaggtg

SEQ ID NO: 249534 - DNA, 26 bp, Artificial Sequence
  Description of Artificial Sequence: Synthetic oligonucleotide
gagcacgctgccctgcaggtggaatt

SEQ ID NO: 249535 - DNA, 27 bp, Artificial Sequence
  Description of Artificial Sequence: Synthetic oligonucleotide
agcacgctgccctgcaggtggaattgt

SEQ ID NO: 249536 - DNA, 27 bp, Artificial Sequence
  Description of Artificial Sequence: Synthetic oligonucleotide
gcacgctgccctgcaggtggaattgta

SEQ ID NO: 249537 - DNA, 28 bp, Artificial Sequence
  Description of Artificial Sequence: Synthetic oligonucleotide
cacgctgccctgcaggtggaattgtatg

SEQ ID NO: 249538 - DNA, 28 bp, Artificial Sequence
  Description of Artificial Sequence: Synthetic oligonucleotide
acgctgccctgcaggtggaattgtatgc

SEQ ID NO: 249539 - DNA, 27 bp, Artificial Sequence
  Description of Artificial Sequence: Synthetic oligonucleotide
cgctgccctgcaggtggaattgtatgc

SEQ ID NO: 249540 - DNA, 27 bp, Artificial Sequence
  Description of Artificial Sequence: Synthetic oligonucleotide
gctgccctgcaggtggaattgtatgcc

SEQ ID NO: 249541 - DNA, 27 bp, Artificial Sequence
  Description of Artificial Sequence: Synthetic oligonucleotide
ctgccctgcaggtggaattgtatgccc

SEQ ID NO: 249542 - DNA, 27 bp, Artificial Sequence
  Description of Artificial Sequence: Synthetic oligonucleotide
tgccctgcaggtggaattgtatgcccc

SEQ ID NO: 249543 - DNA, 26 bp, Artificial Sequence
  Description of Artificial Sequence: Synthetic oligonucleotide
gccctgcaggtggaattgtatgcccc

SEQ ID NO: 249544 - DNA, 27 bp, Artificial Sequence
  Description of Artificial Sequence: Synthetic oligonucleotide
ccctgcaggtggaattgtatgccccga

SEQ ID NO: 249545 - DNA, 27 bp, Artificial Sequence
  Description of Artificial Sequence: Synthetic oligonucleotide
cctgcaggtggaattgtatgccccgag

SEQ ID NO: 249546 - DNA, 27 bp, Artificial Sequence
  Description of Artificial Sequence: Synthetic oligonucleotide
ctgcaggtggaattgtatgccccgagg

SEQ ID NO: 249547 - DNA, 28 bp, Artificial Sequence
  Description of Artificial Sequence: Synthetic oligonucleotide
tgcaggtggaattgtatgccccgaggtg

SEQ ID NO: 249548 - DNA, 27 bp, Artificial Sequence
  Description of Artificial Sequence: Synthetic oligonucleotide
gcaggtggaattgtatgccccgaggtg

SEQ ID NO: 249549 - DNA, 28 bp, Artificial Sequence
  Description of Artificial Sequence: Synthetic oligonucleotide
caggtggaattgtatgccccgaggtgtg

SEQ ID NO: 249550 - DNA, 28 bp, Artificial Sequence
  Description of Artificial Sequence: Synthetic oligonucleotide
aggtggaattgtatgccccgaggtgtgg

SEQ ID NO: 249551 - DNA, 27 bp, Artificial Sequence
  Description of Artificial Sequence: Synthetic oligonucleotide
ggtggaattgtatgccccgaggtgtgg

SEQ ID NO: 249552 - DNA, 27 bp, Artificial Sequence
  Description of Artificial Sequence: Synthetic oligonucleotide
gtggaattgtatgccccgaggtgtggg

SEQ ID NO: 249553 - DNA, 27 bp, Artificial Sequence
  Description of Artificial Sequence: Synthetic oligonucleotide
tggaattgtatgccccgaggtgtgggc

SEQ ID NO: 249554 - DNA, 27 bp, Artificial Sequence
  Description of Artificial Sequence: Synthetic oligonucleotide
ggaattgtatgccccgaggtgtgggct

SEQ ID NO: 249555 - DNA, 27 bp, Artificial Sequence
  Description of Artificial Sequence: Synthetic oligonucleotide
gaattgtatgccccgaggtgtgggctc

SEQ ID NO: 249556 - DNA, 28 bp, Artificial Sequence
  Description of Artificial Sequence: Synthetic oligonucleotide
aattgtatgccccgaggtgtgggctctg

SEQ ID NO: 249557 - DNA, 27 bp, Artificial Sequence
  Description of Artificial Sequence: Synthetic oligonucleotide
attgtatgccccgaggtgtgggctctg

SEQ ID NO: 249558 - DNA, 26 bp, Artificial Sequence
  Description of Artificial Sequence: Synthetic oligonucleotide
ttgtatgccccgaggtgtgggctctg

SEQ ID NO: 249559 - DNA, 25 bp, Artificial Sequence
  Description of Artificial Sequence: Synthetic oligonucleotide
tgtatgccccgaggtgtgggctctg

SEQ ID NO: 249560 - DNA, 24 bp, Artificial Sequence
  Description of Artificial Sequence: Synthetic oligonucleotide
gtatgccccgaggtgtgggctctg

SEQ ID NO: 249561 - DNA, 24 bp, Artificial Sequence
  Description of Artificial Sequence: Synthetic oligonucleotide
tatgccccgaggtgtgggctctgc

SEQ ID NO: 249562 - DNA, 23 bp, Artificial Sequence
  Description of Artificial Sequence: Synthetic oligonucleotide
atgccccgaggtgtgggctctgc

SEQ ID NO: 249563 - DNA, 22 bp, Artificial Sequence
  Description of Artificial Sequence: Synthetic oligonucleotide
tgccccgaggtgtgggctctgc

SEQ ID NO: 249564 - DNA, 21 bp, Artificial Sequence
  Description of Artificial Sequence: Synthetic oligonucleotide
gccccgaggtgtgggctctgc

SEQ ID NO: 249565 - DNA, 22 bp, Artificial Sequence
  Description of Artificial Sequence: Synthetic oligonucleotide
ccccgaggtgtgggctctgcca

SEQ ID NO: 249566 - DNA, 22 bp, Artificial Sequence
  Description of Artificial Sequence: Synthetic oligonucleotide
cccgaggtgtgggctctgccag

SEQ ID NO: 249567 - DNA, 22 bp, Artificial Sequence
  Description of Artificial Sequence: Synthetic oligonucleotide
ccgaggtgtgggctctgccagg

SEQ ID NO: 249568 - DNA, 22 bp, Artificial Sequence
  Description of Artificial Sequence: Synthetic oligonucleotide
cgaggtgtgggctctgccaggc

SEQ ID NO: 249569 - DNA, 22 bp, Artificial Sequence
  Description of Artificial Sequence: Synthetic oligonucleotide
gaggtgtgggctctgccaggcg

SEQ ID NO: 249570 - DNA, 23 bp, Artificial Sequence
  Description of Artificial Sequence: Synthetic oligonucleotide
aggtgtgggctctgccaggcgct

SEQ ID NO: 249571 - DNA, 22 bp, Artificial Sequence
  Description of Artificial Sequence: Synthetic oligonucleotide
ggtgtgggctctgccaggcgct

SEQ ID NO: 249572 - DNA, 22 bp, Artificial Sequence
  Description of Artificial Sequence: Synthetic oligonucleotide
gtgtgggctctgccaggcgctg

SEQ ID NO: 249573 - DNA, 22 bp, Artificial Sequence
  Description of Artificial Sequence: Synthetic oligonucleotide
tgtgggctctgccaggcgctgg

SEQ ID NO: 249574 - DNA, 21 bp, Artificial Sequence
  Description of Artificial Sequence: Synthetic oligonucleotide
gtgggctctgccaggcgctgg

SEQ ID NO: 249575 - DNA, 21 bp, Artificial Sequence
  Description of Artificial Sequence: Synthetic oligonucleotide
tgggctctgccaggcgctggc

SEQ ID NO: 249576 - DNA, 20 bp, Artificial Sequence
  Description of Artificial Sequence: Synthetic oligonucleotide
gggctctgccaggcgctggc

SEQ ID NO: 249577 - DNA, 20 bp, Artificial Sequence
  Description of Artificial Sequence: Synthetic oligonucleotide
ggctctgccaggcgctggcc

SEQ ID NO: 249578 - DNA, 20 bp, Artificial Sequence
  Description of Artificial Sequence: Synthetic oligonucleotide
gctctgccaggcgctggccc

SEQ ID NO: 249579 - DNA, 20 bp, Artificial Sequence
  Description of Artificial Sequence: Synthetic oligonucleotide
ctctgccaggcgctggcccc

SEQ ID NO: 249580 - DNA, 20 bp, Artificial Sequence
  Description of Artificial Sequence: Synthetic oligonucleotide
tctgccaggcgctggccccc

SEQ ID NO: 249581 - DNA, 20 bp, Artificial Sequence
  Description of Artificial Sequence: Synthetic oligonucleotide
ctgccaggcgctggccccct

SEQ ID NO: 249582 - DNA, 20 bp, Artificial Sequence
  Description of Artificial Sequence: Synthetic oligonucleotide
tgccaggcgctggcccccca

SEQ ID NO: 249583 - DNA, 20 bp, Artificial Sequence
  Description of Artificial Sequence: Synthetic oligonucleotide
gccaggcgctggccccccat

SEQ ID NO: 249584 - DNA, 21 bp, Artificial Sequence
  Description of Artificial Sequence: Synthetic oligonucleotide
ccaggcgctggccccccagta

SEQ ID NO: 249585 - DNA, 22 bp, Artificial Sequence
  Description of Artificial Sequence: Synthetic oligonucleotide
caggcgctggccccccagtaca

SEQ ID NO: 249586 - DNA, 22 bp, Artificial Sequence
  Description of Artificial Sequence: Synthetic oligonucleotide
aggcgctggccccccagtacag

SEQ ID NO: 249587 - DNA, 21 bp, Artificial Sequence
  Description of Artificial Sequence: Synthetic oligonucleotide
ggcgctggccccccagtacag

SEQ ID NO: 249588 - DNA, 23 bp, Artificial Sequence
  Description of Artificial Sequence: Synthetic oligonucleotide
gcgctggccccccagtacagcat

SEQ ID NO: 249589 - DNA, 23 bp, Artificial Sequence
  Description of Artificial Sequence: Synthetic oligonucleotide
cgctggccccccagtacagcatg

SEQ ID NO: 249590 - DNA, 23 bp, Artificial Sequence
  Description of Artificial Sequence: Synthetic oligonucleotide
gctggccccccagtacagcatgg

SEQ ID NO: 249591 - DNA, 24 bp, Artificial Sequence
  Description of Artificial Sequence: Synthetic oligonucleotide
ctggccccccagtacagcatggca

SEQ ID NO: 249592 - DNA, 24 bp, Artificial Sequence
  Description of Artificial Sequence: Synthetic oligonucleotide
tggccccccagtacagcatggcag

SEQ ID NO: 249593 - DNA, 23 bp, Artificial Sequence
  Description of Artificial Sequence: Synthetic oligonucleotide
ggccccccagtacagcatggcag

SEQ ID NO: 249594 - DNA, 24 bp, Artificial Sequence
  Description of Artificial Sequence: Synthetic oligonucleotide
gccccccagtacagcatggcagct

SEQ ID NO: 249595 - DNA, 24 bp, Artificial Sequence
  Description of Artificial Sequence: Synthetic oligonucleotide
ccccccagtacagcatggcagctg

SEQ ID NO: 249596 - DNA, 24 bp, Artificial Sequence
  Description of Artificial Sequence: Synthetic oligonucleotide
cccccagtacagcatggcagctgc

SEQ ID NO: 249597 - DNA, 24 bp, Artificial Sequence
  Description of Artificial Sequence: Synthetic oligonucleotide
ccccagtacagcatggcagctgcg

SEQ ID NO: 249598 - DNA, 25 bp, Artificial Sequence
  Description of Artificial Sequence: Synthetic oligonucleotide
cccagtacagcatggcagctgcggt

SEQ ID NO: 249599 - DNA, 25 bp, Artificial Sequence
  Description of Artificial Sequence: Synthetic oligonucleotide
ccagtacagcatggcagctgcggtg

SEQ ID NO: 249600 - DNA, 26 bp, Artificial Sequence
  Description of Artificial Sequence: Synthetic oligonucleotide
cagtacagcatggcagctgcggtgct

SEQ ID NO: 249601 - DNA, 26 bp, Artificial Sequence
  Description of Artificial Sequence: Synthetic oligonucleotide
agtacagcatggcagctgcggtgctc

SEQ ID NO: 249602 - DNA, 25 bp, Artificial Sequence
  Description of Artificial Sequence: Synthetic oligonucleotide
gtacagcatggcagctgcggtgctc

SEQ ID NO: 249603 - DNA, 25 bp, Artificial Sequence
  Description of Artificial Sequence: Synthetic oligonucleotide
tacagcatggcagctgcggtgctcg

SEQ ID NO: 249604 - DNA, 24 bp, Artificial Sequence
  Description of Artificial Sequence: Synthetic oligonucleotide
acagcatggcagctgcggtgctcg

SEQ ID NO: 249605 - DNA, 23 bp, Artificial Sequence
  Description of Artificial Sequence: Synthetic oligonucleotide
cagcatggcagctgcggtgctcg

SEQ ID NO: 249606 - DNA, 23 bp, Artificial Sequence
  Description of Artificial Sequence: Synthetic oligonucleotide
agcatggcagctgcggtgctcgc

SEQ ID NO: 249607 - DNA, 22 bp, Artificial Sequence
  Description of Artificial Sequence: Synthetic oligonucleotide
gcatggcagctgcggtgctcgc

SEQ ID NO: 249608 - DNA, 22 bp, Artificial Sequence
  Description of Artificial Sequence: Synthetic oligonucleotide
catggcagctgcggtgctcgcg

SEQ ID NO: 249609 - DNA, 22 bp, Artificial Sequence
  Description of Artificial Sequence: Synthetic oligonucleotide
atggcagctgcggtgctcgcgc

SEQ ID NO: 249610 - DNA, 21 bp, Artificial Sequence
  Description of Artificial Sequence: Synthetic oligonucleotide
tggcagctgcggtgctcgcgc

SEQ ID NO: 249611 - DNA, 20 bp, Artificial Sequence
  Description of Artificial Sequence: Synthetic oligonucleotide
ggcagctgcggtgctcgcgc

SEQ ID NO: 249612 - DNA, 20 bp, Artificial Sequence
  Description of Artificial Sequence: Synthetic oligonucleotide
gcagctgcggtgctcgcgcc

SEQ ID NO: 249613 - DNA, 20 bp, Artificial Sequence
  Description of Artificial Sequence: Synthetic oligonucleotide
cagctgcggtgctcgcgccc

SEQ ID NO: 249614 - DNA, 21 bp, Artificial Sequence
  Description of Artificial Sequence: Synthetic oligonucleotide
agctgcggtgctcgcgcccga

SEQ ID NO: 249615 - DNA, 20 bp, Artificial Sequence
  Description of Artificial Sequence: Synthetic oligonucleotide
gctgcggtgctcgcgcccga

SEQ ID NO: 249616 - DNA, 21 bp, Artificial Sequence
  Description of Artificial Sequence: Synthetic oligonucleotide
ctgcggtgctcgcgcccgagt

SEQ ID NO: 249617 - DNA, 24 bp, Artificial Sequence
  Description of Artificial Sequence: Synthetic oligonucleotide
tgcggtgctcgcgcccgagtcaaa

SEQ ID NO: 249618 - DNA, 23 bp, Artificial Sequence
  Description of Artificial Sequence: Synthetic oligonucleotide
gcggtgctcgcgcccgagtcaaa

SEQ ID NO: 249619 - DNA, 23 bp, Artificial Sequence
  Description of Artificial Sequence: Synthetic oligonucleotide
cggtgctcgcgcccgagtcaaag

SEQ ID NO: 249620 - DNA, 24 bp, Artificial Sequence
  Description of Artificial Sequence: Synthetic oligonucleotide
ggtgctcgcgcccgagtcaaaggt

SEQ ID NO: 249621 - DNA, 24 bp, Artificial Sequence
  Description of Artificial Sequence: Synthetic oligonucleotide
gtgctcgcgcccgagtcaaaggtg

SEQ ID NO: 249622 - DNA, 25 bp, Artificial Sequence
  Description of Artificial Sequence: Synthetic oligonucleotide
tgctcgcgcccgagtcaaaggtggt

SEQ ID NO: 249623 - DNA, 24 bp, Artificial Sequence
  Description of Artificial Sequence: Synthetic oligonucleotide
gctcgcgcccgagtcaaaggtggt

SEQ ID NO: 249624 - DNA, 25 bp, Artificial Sequence
  Description of Artificial Sequence: Synthetic oligonucleotide
ctcgcgcccgagtcaaaggtggtca

SEQ ID NO: 249625 - DNA, 25 bp, Artificial Sequence
  Description of Artificial Sequence: Synthetic oligonucleotide
tcgcgcccgagtcaaaggtggtcac

SEQ ID NO: 249626 - DNA, 24 bp, Artificial Sequence
  Description of Artificial Sequence: Synthetic oligonucleotide
cgcgcccgagtcaaaggtggtcac

SEQ ID NO: 249627 - DNA, 24 bp, Artificial Sequence
  Description of Artificial Sequence: Synthetic oligonucleotide
gcgcccgagtcaaaggtggtcacc

SEQ ID NO: 249628 - DNA, 25 bp, Artificial Sequence
  Description of Artificial Sequence: Synthetic oligonucleotide
cgcccgagtcaaaggtggtcaccct

SEQ ID NO: 249629 - DNA, 25 bp, Artificial Sequence
  Description of Artificial Sequence: Synthetic oligonucleotide
gcccgagtcaaaggtggtcaccctg

SEQ ID NO: 249630 - DNA, 25 bp, Artificial Sequence
  Description of Artificial Sequence: Synthetic oligonucleotide
cccgagtcaaaggtggtcaccctgg

SEQ ID NO: 249631 - DNA, 25 bp, Artificial Sequence
  Description of Artificial Sequence: Synthetic oligonucleotide
ccgagtcaaaggtggtcaccctggc

SEQ ID NO: 249632 - DNA, 27 bp, Artificial Sequence
  Description of Artificial Sequence: Synthetic oligonucleotide
cgagtcaaaggtggtcaccctggccaa

SEQ ID NO: 249633 - DNA, 27 bp, Artificial Sequence
  Description of Artificial Sequence: Synthetic oligonucleotide
gagtcaaaggtggtcaccctggccaag

SEQ ID NO: 249634 - DNA, 27 bp, Artificial Sequence
  Description of Artificial Sequence: Synthetic oligonucleotide
agtcaaaggtggtcaccctggccaagc

SEQ ID NO: 249635 - DNA, 27 bp, Artificial Sequence
  Description of Artificial Sequence: Synthetic oligonucleotide
gtcaaaggtggtcaccctggccaagct

SEQ ID NO: 249636 - DNA, 27 bp, Artificial Sequence
  Description of Artificial Sequence: Synthetic oligonucleotide
tcaaaggtggtcaccctggccaagctg

SEQ ID NO: 249637 - DNA, 26 bp, Artificial Sequence
  Description of Artificial Sequence: Synthetic oligonucleotide
caaaggtggtcaccctggccaagctg

SEQ ID NO: 249638 - DNA, 27 bp, Artificial Sequence
  Description of Artificial Sequence: Synthetic oligonucleotide
aaaggtggtcaccctggccaagctgga

SEQ ID NO: 249639 - DNA, 27 bp, Artificial Sequence
  Description of Artificial Sequence: Synthetic oligonucleotide
aaggtggtcaccctggccaagctggat

SEQ ID NO: 249640 - DNA, 26 bp, Artificial Sequence
  Description of Artificial Sequence: Synthetic oligonucleotide
aggtggtcaccctggccaagctggat

SEQ ID NO: 249641 - DNA, 25 bp, Artificial Sequence
  Description of Artificial Sequence: Synthetic oligonucleotide
ggtggtcaccctggccaagctggat

SEQ ID NO: 249642 - DNA, 25 bp, Artificial Sequence
  Description of Artificial Sequence: Synthetic oligonucleotide
gtggtcaccctggccaagctggatg

SEQ ID NO: 249643 - DNA, 25 bp, Artificial Sequence
  Description of Artificial Sequence: Synthetic oligonucleotide
tggtcaccctggccaagctggatgg

SEQ ID NO: 249644 - DNA, 24 bp, Artificial Sequence
  Description of Artificial Sequence: Synthetic oligonucleotide
ggtcaccctggccaagctggatgg

SEQ ID NO: 249645 - DNA, 24 bp, Artificial Sequence
  Description of Artificial Sequence: Synthetic oligonucleotide
gtcaccctggccaagctggatggg

SEQ ID NO: 249646 - DNA, 24 bp, Artificial Sequence
  Description of Artificial Sequence: Synthetic oligonucleotide
tcaccctggccaagctggatgggc

SEQ ID NO: 249647 - DNA, 23 bp, Artificial Sequence
  Description of Artificial Sequence: Synthetic oligonucleotide
caccctggccaagctggatgggc

SEQ ID NO: 249648 - DNA, 23 bp, Artificial Sequence
  Description of Artificial Sequence: Synthetic oligonucleotide
accctggccaagctggatgggcg

SEQ ID NO: 249649 - DNA, 22 bp, Artificial Sequence
  Description of Artificial Sequence: Synthetic oligonucleotide
ccctggccaagctggatgggcg

SEQ ID NO: 249650 - DNA, 22 bp, Artificial Sequence
  Description of Artificial Sequence: Synthetic oligonucleotide
cctggccaagctggatgggcgc

SEQ ID NO: 249651 - DNA, 22 bp, Artificial Sequence
  Description of Artificial Sequence: Synthetic oligonucleotide
ctggccaagctggatgggcgcg

SEQ ID NO: 249652 - DNA, 22 bp, Artificial Sequence
  Description of Artificial Sequence: Synthetic oligonucleotide
tggccaagctggatgggcgcgc

SEQ ID NO: 249653 - DNA, 21 bp, Artificial Sequence
  Description of Artificial Sequence: Synthetic oligonucleotide
ggccaagctggatgggcgcgc

SEQ ID NO: 249654 - DNA, 21 bp, Artificial Sequence
  Description of Artificial Sequence: Synthetic oligonucleotide
gccaagctggatgggcgcgcg

SEQ ID NO: 249655 - DNA, 22 bp, Artificial Sequence
  Description of Artificial Sequence: Synthetic oligonucleotide
ccaagctggatgggcgcgcgca

SEQ ID NO: 249656 - DNA, 22 bp, Artificial Sequence
  Description of Artificial Sequence: Synthetic oligonucleotide
caagctggatgggcgcgcgcag

SEQ ID NO: 249657 - DNA, 22 bp, Artificial Sequence
  Description of Artificial Sequence: Synthetic oligonucleotide
aagctggatgggcgcgcgcagc

SEQ ID NO: 249658 - DNA, 21 bp, Artificial Sequence
  Description of Artificial Sequence: Synthetic oligonucleotide
agctggatgggcgcgcgcagc

SEQ ID NO: 249659 - DNA, 20 bp, Artificial Sequence
  Description of Artificial Sequence: Synthetic oligonucleotide
gctggatgggcgcgcgcagc

SEQ ID NO: 249660 - DNA, 20 bp, Artificial Sequence
  Description of Artificial Sequence: Synthetic oligonucleotide
ctggatgggcgcgcgcagcg

SEQ ID NO: 249661 - DNA, 20 bp, Artificial Sequence
  Description of Artificial Sequence: Synthetic oligonucleotide
tggatgggcgcgcgcagcgg

SEQ ID NO: 249662 - DNA, 20 bp, Artificial Sequence
  Description of Artificial Sequence: Synthetic oligonucleotide
ggatgggcgcgcgcagcggt

SEQ ID NO: 249663 - DNA, 20 bp, Artificial Sequence
  Description of Artificial Sequence: Synthetic oligonucleotide
gatgggcgcgcgcagcggga

SEQ ID NO: 249664 - DNA, 20 bp, Artificial Sequence
  Description of Artificial Sequence: Synthetic oligonucleotide
atgggcgcgcgcagcgggag

SEQ ID NO: 249665 - DNA, 20 bp, Artificial Sequence
  Description of Artificial Sequence: Synthetic oligonucleotide
tgggcgcgcgcagcgggagt

SEQ ID NO: 249666 - DNA, 20 bp, Artificial Sequence
  Description of Artificial Sequence: Synthetic oligonucleotide
gggcgcgcgcagcgggagtt

SEQ ID NO: 249667 - DNA, 20 bp, Artificial Sequence
  Description of Artificial Sequence: Synthetic oligonucleotide
ggcgcgcgcagcgggagctt

SEQ ID NO: 249668 - DNA, 20 bp, Artificial Sequence
  Description of Artificial Sequence: Synthetic oligonucleotide
gcgcgcgcagcgggagctgt

SEQ ID NO: 249669 - DNA, 20 bp, Artificial Sequence
  Description of Artificial Sequence: Synthetic oligonucleotide
cgcgcgcagcgggagctggt

SEQ ID NO: 249670 - DNA, 20 bp, Artificial Sequence
  Description of Artificial Sequence: Synthetic oligonucleotide
gcgcgcagcgggagctggct

SEQ ID NO: 249671 - DNA, 21 bp, Artificial Sequence
  Description of Artificial Sequence: Synthetic oligonucleotide
cgcgcagcgggagctggctca

SEQ ID NO: 249672 - DNA, 21 bp, Artificial Sequence
  Description of Artificial Sequence: Synthetic oligonucleotide
gcgcagcgggagctggctcag

SEQ ID NO: 249673 - DNA, 22 bp, Artificial Sequence
  Description of Artificial Sequence: Synthetic oligonucleotide
cgcagcgggagctggctcagga

SEQ ID NO: 249674 - DNA, 25 bp, Artificial Sequence
  Description of Artificial Sequence: Synthetic oligonucleotide
gcagcgggagctggctcaggagttt

SEQ ID NO: 249675 - DNA, 25 bp, Artificial Sequence
  Description of Artificial Sequence: Synthetic oligonucleotide
cagcgggagctggctcaggagtttg

SEQ ID NO: 249676 - DNA, 26 bp, Artificial Sequence
  Description of Artificial Sequence: Synthetic oligonucleotide
agcgggagctggctcaggagtttgct

SEQ ID NO: 249677 - DNA, 25 bp, Artificial Sequence
  Description of Artificial Sequence: Synthetic oligonucleotide
gcgggagctggctcaggagtttgct

SEQ ID NO: 249678 - DNA, 26 bp, Artificial Sequence
  Description of Artificial Sequence: Synthetic oligonucleotide
cgggagctggctcaggagtttgctgt

SEQ ID NO: 249679 - DNA, 27 bp, Artificial Sequence
  Description of Artificial Sequence: Synthetic oligonucleotide
gggagctggctcaggagtttgctgtga

SEQ ID NO: 249680 - DNA, 27 bp, Artificial Sequence
  Description of Artificial Sequence: Synthetic oligonucleotide
ggagctggctcaggagtttgctgtgac

SEQ ID NO: 249681 - DNA, 27 bp, Artificial Sequence
  Description of Artificial Sequence: Synthetic oligonucleotide
gagctggctcaggagtttgctgtgacg

SEQ ID NO: 249682 - DNA, 27 bp, Artificial Sequence
  Description of Artificial Sequence: Synthetic oligonucleotide
agctggctcaggagtttgctgtgacgg

SEQ ID NO: 249683 - DNA, 27 bp, Artificial Sequence
  Description of Artificial Sequence: Synthetic oligonucleotide
gctggctcaggagtttgctgtgacgga

SEQ ID NO: 249684 - DNA, 27 bp, Artificial Sequence
  Description of Artificial Sequence: Synthetic oligonucleotide
ctggctcaggagtttgctgtgacggac

SEQ ID NO: 249685 - DNA, 29 bp, Artificial Sequence
  Description of Artificial Sequence: Synthetic oligonucleotide
tggctcaggagtttgctgtgacggactac

SEQ ID NO: 249686 - DNA, 28 bp, Artificial Sequence
  Description of Artificial Sequence: Synthetic oligonucleotide
ggctcaggagtttgctgtgacggactac

SEQ ID NO: 249687 - DNA, 28 bp, Artificial Sequence
  Description of Artificial Sequence: Synthetic oligonucleotide
gctcaggagtttgctgtgacggactacc

SEQ ID NO: 249688 - DNA, 28 bp, Artificial Sequence
  Description of Artificial Sequence: Synthetic oligonucleotide
ctcaggagtttgctgtgacggactaccc

SEQ ID NO: 249689 - DNA, 30 bp, Artificial Sequence
  Description of Artificial Sequence: Synthetic oligonucleotide
tcaggagtttgctgtgacggactaccctac

SEQ ID NO: 249690 - DNA, 29 bp, Artificial Sequence
  Description of Artificial Sequence: Synthetic oligonucleotide
caggagtttgctgtgacggactaccctac

SEQ ID NO: 249691 - DNA, 29 bp, Artificial Sequence
  Description of Artificial Sequence: Synthetic oligonucleotide
aggagtttgctgtgacggactaccctacg

SEQ ID NO: 249692 - DNA, 28 bp, Artificial Sequence
  Description of Artificial Sequence: Synthetic oligonucleotide
ggagtttgctgtgacggactaccctacg

SEQ ID NO: 249693 - DNA, 28 bp, Artificial Sequence
  Description of Artificial Sequence: Synthetic oligonucleotide
gagtttgctgtgacggactaccctacgg

SEQ ID NO: 249694 - DNA, 29 bp, Artificial Sequence
  Description of Artificial Sequence: Synthetic oligonucleotide
agtttgctgtgacggactaccctacggtc

SEQ ID NO: 249695 - DNA, 28 bp, Artificial Sequence
  Description of Artificial Sequence: Synthetic oligonucleotide
gtttgctgtgacggactaccctacggtc

SEQ ID NO: 249696 - DNA, 30 bp, Artificial Sequence
  Description of Artificial Sequence: Synthetic oligonucleotide
tttgctgtgacggactaccctacggtcaag

SEQ ID NO: 249697 - DNA, 29 bp, Artificial Sequence
  Description of Artificial Sequence: Synthetic oligonucleotide
ttgctgtgacggactaccctacggtcaag

SEQ ID NO: 249698 - DNA, 28 bp, Artificial Sequence
  Description of Artificial Sequence: Synthetic oligonucleotide
tgctgtgacggactaccctacggtcaag

SEQ ID NO: 249699 - DNA, 27 bp, Artificial Sequence
  Description of Artificial Sequence: Synthetic oligonucleotide
gctgtgacggactaccctacggtcaag

SEQ ID NO: 249700 - DNA, 29 bp, Artificial Sequence
  Description of Artificial Sequence: Synthetic oligonucleotide
ctgtgacggactaccctacggtcaagttc

SEQ ID NO: 249701 - DNA, 31 bp, Artificial Sequence
  Description of Artificial Sequence: Synthetic oligonucleotide
tgtgacggactaccctacggtcaagttctac

SEQ ID NO: 249702 - DNA, 30 bp, Artificial Sequence
  Description of Artificial Sequence: Synthetic oligonucleotide
gtgacggactaccctacggtcaagttctac

SEQ ID NO: 249703 - DNA, 30 bp, Artificial Sequence
  Description of Artificial Sequence: Synthetic oligonucleotide
tgacggactaccctacggtcaagttctacc

SEQ ID NO: 249704 - DNA, 29 bp, Artificial Sequence
  Description of Artificial Sequence: Synthetic oligonucleotide
gacggactaccctacggtcaagttctacc

SEQ ID NO: 249705 - DNA, 29 bp, Artificial Sequence
  Description of Artificial Sequence: Synthetic oligonucleotide
acggactaccctacggtcaagttctaccg

SEQ ID NO: 249706 - DNA, 28 bp, Artificial Sequence
  Description of Artificial Sequence: Synthetic oligonucleotide
cggactaccctacggtcaagttctaccg

SEQ ID NO: 249707 - DNA, 28 bp, Artificial Sequence
  Description of Artificial Sequence: Synthetic oligonucleotide
ggactaccctacggtcaagttctaccgc

SEQ ID NO: 249708 - DNA, 31 bp, Artificial Sequence
  Description of Artificial Sequence: Synthetic oligonucleotide
gactaccctacggtcaagttctaccgcaatg

SEQ ID NO: 249709 - DNA, 31 bp, Artificial Sequence
  Description of Artificial Sequence: Synthetic oligonucleotide
actaccctacggtcaagttctaccgcaatgg

SEQ ID NO: 249710 - DNA, 30 bp, Artificial Sequence
  Description of Artificial Sequence: Synthetic oligonucleotide
ctaccctacggtcaagttctaccgcaatgg

SEQ ID NO: 249711 - DNA, 30 bp, Artificial Sequence
  Description of Artificial Sequence: Synthetic oligonucleotide
taccctacggtcaagttctaccgcaatggc

SEQ ID NO: 249712 - DNA, 29 bp, Artificial Sequence
  Description of Artificial Sequence: Synthetic oligonucleotide
accctacggtcaagttctaccgcaatggc

SEQ ID NO: 249713 - DNA, 28 bp, Artificial Sequence
  Description of Artificial Sequence: Synthetic oligonucleotide
ccctacggtcaagttctaccgcaatggc

SEQ ID NO: 249714 - DNA, 30 bp, Artificial Sequence
  Description of Artificial Sequence: Synthetic oligonucleotide
cctacggtcaagttctaccgcaatggcaac

SEQ ID NO: 249715 - DNA, 30 bp, Artificial Sequence
  Description of Artificial Sequence: Synthetic oligonucleotide
ctacggtcaagttctaccgcaatggcaacc

SEQ ID NO: 249716 - DNA, 30 bp, Artificial Sequence
  Description of Artificial Sequence: Synthetic oligonucleotide
tacggtcaagttctaccgcaatggcaaccg

SEQ ID NO: 249717 - DNA, 29 bp, Artificial Sequence
  Description of Artificial Sequence: Synthetic oligonucleotide
acggtcaagttctaccgcaatggcaaccg

SEQ ID NO: 249718 - DNA, 28 bp, Artificial Sequence
  Description of Artificial Sequence: Synthetic oligonucleotide
cggtcaagttctaccgcaatggcaaccg

SEQ ID NO: 249719 - DNA, 28 bp, Artificial Sequence
  Description of Artificial Sequence: Synthetic oligonucleotide
ggtcaagttctaccgcaatggcaaccgc

SEQ ID NO: 249720 - DNA, 29 bp, Artificial Sequence
  Description of Artificial Sequence: Synthetic oligonucleotide
gtcaagttctaccgcaatggcaaccgcac

SEQ ID NO: 249721 - DNA, 29 bp, Artificial Sequence
  Description of Artificial Sequence: Synthetic oligonucleotide
tcaagttctaccgcaatggcaaccgcacg

SEQ ID NO: 249722 - DNA, 28 bp, Artificial Sequence
  Description of Artificial Sequence: Synthetic oligonucleotide
caagttctaccgcaatggcaaccgcacg

SEQ ID NO: 249723 - DNA, 28 bp, Artificial Sequence
  Description of Artificial Sequence: Synthetic oligonucleotide
aagttctaccgcaatggcaaccgcacgg

SEQ ID NO: 249724 - DNA, 27 bp, Artificial Sequence
  Description of Artificial Sequence: Synthetic oligonucleotide
agttctaccgcaatggcaaccgcacgg

SEQ ID NO: 249725 - DNA, 27 bp, Artificial Sequence
  Description of Artificial Sequence: Synthetic oligonucleotide
gttctaccgcaatggcaaccgcacgga

SEQ ID NO: 249726 - DNA, 27 bp, Artificial Sequence
  Description of Artificial Sequence: Synthetic oligonucleotide
ttctaccgcaatggcaaccgcacggac

SEQ ID NO: 249727 - DNA, 26 bp, Artificial Sequence
  Description of Artificial Sequence: Synthetic oligonucleotide
tctaccgcaatggcaaccgcacggac

SEQ ID NO: 249728 - DNA, 25 bp, Artificial Sequence
  Description of Artificial Sequence: Synthetic oligonucleotide
ctaccgcaatggcaaccgcacggac

SEQ ID NO: 249729 - DNA, 25 bp, Artificial Sequence
  Description of Artificial Sequence: Synthetic oligonucleotide
taccgcaatggcaaccgcacggacc

SEQ ID NO: 249730 - DNA, 24 bp, Artificial Sequence
  Description of Artificial Sequence: Synthetic oligonucleotide
accgcaatggcaaccgcacggacc

SEQ ID NO: 249731 - DNA, 23 bp, Artificial Sequence
  Description of Artificial Sequence: Synthetic oligonucleotide
ccgcaatggcaaccgcacggacc

SEQ ID NO: 249732 - DNA, 23 bp, Artificial Sequence
  Description of Artificial Sequence: Synthetic oligonucleotide
cgcaatggcaaccgcacggaccc

SEQ ID NO: 249733 - DNA, 23 bp, Artificial Sequence
  Description of Artificial Sequence: Synthetic oligonucleotide
gcaatggcaaccgcacggacccg

SEQ ID NO: 249734 - DNA, 24 bp, Artificial Sequence
  Description of Artificial Sequence: Synthetic oligonucleotide
caatggcaaccgcacggacccgga

SEQ ID NO: 249735 - DNA, 24 bp, Artificial Sequence
  Description of Artificial Sequence: Synthetic oligonucleotide
aatggcaaccgcacggacccggag

SEQ ID NO: 249736 - DNA, 23 bp, Artificial Sequence
  Description of Artificial Sequence: Synthetic oligonucleotide
atggcaaccgcacggacccggag

SEQ ID NO: 249737 - DNA, 22 bp, Artificial Sequence
  Description of Artificial Sequence: Synthetic oligonucleotide
tggcaaccgcacggacccggag

SEQ ID NO: 249738 - DNA, 21 bp, Artificial Sequence
  Description of Artificial Sequence: Synthetic oligonucleotide
ggcaaccgcacggacccggag

SEQ ID NO: 249739 - DNA, 22 bp, Artificial Sequence
  Description of Artificial Sequence: Synthetic oligonucleotide
gcaaccgcacggacccggaggt

SEQ ID NO: 249740 - DNA, 24 bp, Artificial Sequence
  Description of Artificial Sequence: Synthetic oligonucleotide
caaccgcacggacccggaggtgta

SEQ ID NO: 249741 - DNA, 25 bp, Artificial Sequence
  Description of Artificial Sequence: Synthetic oligonucleotide
aaccgcacggacccggaggtgtaca

SEQ ID NO: 249742 - DNA, 24 bp, Artificial Sequence
  Description of Artificial Sequence: Synthetic oligonucleotide
accgcacggacccggaggtgtaca

SEQ ID NO: 249743 - DNA, 23 bp, Artificial Sequence
  Description of Artificial Sequence: Synthetic oligonucleotide
ccgcacggacccggaggtgtaca

SEQ ID NO: 249744 - DNA, 24 bp, Artificial Sequence
  Description of Artificial Sequence: Synthetic oligonucleotide
cgcacggacccggaggtgtacaca

SEQ ID NO: 249745 - DNA, 24 bp, Artificial Sequence
  Description of Artificial Sequence: Synthetic oligonucleotide
gcacggacccggaggtgtacacag

SEQ ID NO: 249746 - DNA, 25 bp, Artificial Sequence
  Description of Artificial Sequence: Synthetic oligonucleotide
cacggacccggaggtgtacacaggt

SEQ ID NO: 249747 - DNA, 25 bp, Artificial Sequence
  Description of Artificial Sequence: Synthetic oligonucleotide
acggacccggaggtgtacacaggtc

SEQ ID NO: 249748 - DNA, 24 bp, Artificial Sequence
  Description of Artificial Sequence: Synthetic oligonucleotide
cggacccggaggtgtacacaggtc

SEQ ID NO: 249749 - DNA, 25 bp, Artificial Sequence
  Description of Artificial Sequence: Synthetic oligonucleotide
ggacccggaggtgtacacaggtcca

SEQ ID NO: 249750 - DNA, 25 bp, Artificial Sequence
  Description of Artificial Sequence: Synthetic oligonucleotide
gacccggaggtgtacacaggtccac

SEQ ID NO: 249751 - DNA, 25 bp, Artificial Sequence
  Description of Artificial Sequence: Synthetic oligonucleotide
acccggaggtgtacacaggtccacg

SEQ ID NO: 249752 - DNA, 24 bp, Artificial Sequence
  Description of Artificial Sequence: Synthetic oligonucleotide
cccggaggtgtacacaggtccacg

SEQ ID NO: 249753 - DNA, 24 bp, Artificial Sequence
  Description of Artificial Sequence: Synthetic oligonucleotide
ccggaggtgtacacaggtccacgg

SEQ ID NO: 249754 - DNA, 25 bp, Artificial Sequence
  Description of Artificial Sequence: Synthetic oligonucleotide
cggaggtgtacacaggtccacggga

SEQ ID NO: 249755 - DNA, 25 bp, Artificial Sequence
  Description of Artificial Sequence: Synthetic oligonucleotide
ggaggtgtacacaggtccacgggac

SEQ ID NO: 249756 - DNA, 25 bp, Artificial Sequence
  Description of Artificial Sequence: Synthetic oligonucleotide
gaggtgtacacaggtccacgggacc

SEQ ID NO: 249757 - DNA, 26 bp, Artificial Sequence
  Description of Artificial Sequence: Synthetic oligonucleotide
aggtgtacacaggtccacgggaccct

SEQ ID NO: 249758 - DNA, 25 bp, Artificial Sequence
  Description of Artificial Sequence: Synthetic oligonucleotide
ggtgtacacaggtccacgggaccct

SEQ ID NO: 249759 - DNA, 26 bp, Artificial Sequence
  Description of Artificial Sequence: Synthetic oligonucleotide
gtgtacacaggtccacgggaccctga

SEQ ID NO: 249760 - DNA, 26 bp, Artificial Sequence
  Description of Artificial Sequence: Synthetic oligonucleotide
tgtacacaggtccacgggaccctgag

SEQ ID NO: 249761 - DNA, 25 bp, Artificial Sequence
  Description of Artificial Sequence: Synthetic oligonucleotide
gtacacaggtccacgggaccctgag

SEQ ID NO: 249762 - DNA, 25 bp, Artificial Sequence
  Description of Artificial Sequence: Synthetic oligonucleotide
tacacaggtccacgggaccctgagg

SEQ ID NO: 249763 - DNA, 24 bp, Artificial Sequence
  Description of Artificial Sequence: Synthetic oligonucleotide
acacaggtccacgggaccctgagg

SEQ ID NO: 249764 - DNA, 23 bp, Artificial Sequence
  Description of Artificial Sequence: Synthetic oligonucleotide
cacaggtccacgggaccctgagg

SEQ ID NO: 249765 - DNA, 23 bp, Artificial Sequence
  Description of Artificial Sequence: Synthetic oligonucleotide
acaggtccacgggaccctgaggg

SEQ ID NO: 249766 - DNA, 22 bp, Artificial Sequence
  Description of Artificial Sequence: Synthetic oligonucleotide
caggtccacgggaccctgaggg

SEQ ID NO: 249767 - DNA, 25 bp, Artificial Sequence
  Description of Artificial Sequence: Synthetic oligonucleotide
aggtccacgggaccctgagggcaat

SEQ ID NO: 249768 - DNA, 24 bp, Artificial Sequence
  Description of Artificial Sequence: Synthetic oligonucleotide
ggtccacgggaccctgagggcaat

SEQ ID NO: 249769 - DNA, 24 bp, Artificial Sequence
  Description of Artificial Sequence: Synthetic oligonucleotide
gtccacgggaccctgagggcaatg

SEQ ID NO: 249770 - DNA, 24 bp, Artificial Sequence
  Description of Artificial Sequence: Synthetic oligonucleotide
tccacgggaccctgagggcaatgc

SEQ ID NO: 249771 - DNA, 23 bp, Artificial Sequence
  Description of Artificial Sequence: Synthetic oligonucleotide
ccacgggaccctgagggcaatgc

SEQ ID NO: 249772 - DNA, 23 bp, Artificial Sequence
  Description of Artificial Sequence: Synthetic oligonucleotide
cacgggaccctgagggcaatgcc

SEQ ID NO: 249773 - DNA, 24 bp, Artificial Sequence
  Description of Artificial Sequence: Synthetic oligonucleotide
acgggaccctgagggcaatgccga

SEQ ID NO: 249774 - DNA, 23 bp, Artificial Sequence
  Description of Artificial Sequence: Synthetic oligonucleotide
cgggaccctgagggcaatgccga

SEQ ID NO: 249775 - DNA, 24 bp, Artificial Sequence
  Description of Artificial Sequence: Synthetic oligonucleotide
gggaccctgagggcaatgccgagt

SEQ ID NO: 249776 - DNA, 24 bp, Artificial Sequence
  Description of Artificial Sequence: Synthetic oligonucleotide
ggaccctgagggcaatgccgagtg

SEQ ID NO: 249777 - DNA, 24 bp, Artificial Sequence
  Description of Artificial Sequence: Synthetic oligonucleotide
gaccctgagggcaatgccgagtgc

SEQ ID NO: 249778 - DNA, 25 bp, Artificial Sequence
  Description of Artificial Sequence: Synthetic oligonucleotide
accctgagggcaatgccgagtgcct

SEQ ID NO: 249779 - DNA, 24 bp, Artificial Sequence
  Description of Artificial Sequence: Synthetic oligonucleotide
ccctgagggcaatgccgagtgcct

SEQ ID NO: 249780 - DNA, 24 bp, Artificial Sequence
  Description of Artificial Sequence: Synthetic oligonucleotide
cctgagggcaatgccgagtgcctg

SEQ ID NO: 249781 - DNA, 24 bp, Artificial Sequence
  Description of Artificial Sequence: Synthetic oligonucleotide
ctgagggcaatgccgagtgcctgc

SEQ ID NO: 249782 - DNA, 25 bp, Artificial Sequence
  Description of Artificial Sequence: Synthetic oligonucleotide
tgagggcaatgccgagtgcctgcga

SEQ ID NO: 249783 - DNA, 24 bp, Artificial Sequence
  Description of Artificial Sequence: Synthetic oligonucleotide
gagggcaatgccgagtgcctgcga

SEQ ID NO: 249784 - DNA, 24 bp, Artificial Sequence
  Description of Artificial Sequence: Synthetic oligonucleotide
agggcaatgccgagtgcctgcgac

SEQ ID NO: 249785 - DNA, 23 bp, Artificial Sequence
  Description of Artificial Sequence: Synthetic oligonucleotide
gggcaatgccgagtgcctgcgac

SEQ ID NO: 249786 - DNA, 23 bp, Artificial Sequence
  Description of Artificial Sequence: Synthetic oligonucleotide
ggcaatgccgagtgcctgcgacg

SEQ ID NO: 249787 - DNA, 23 bp, Artificial Sequence
  Description of Artificial Sequence: Synthetic oligonucleotide
gcaatgccgagtgcctgcgacgg

SEQ ID NO: 249788 - DNA, 23 bp, Artificial Sequence
  Description of Artificial Sequence: Synthetic oligonucleotide
caatgccgagtgcctgcgacggg

SEQ ID NO: 249789 - DNA, 23 bp, Artificial Sequence
  Description of Artificial Sequence: Synthetic oligonucleotide
aatgccgagtgcctgcgacgggg

SEQ ID NO: 249790 - DNA, 22 bp, Artificial Sequence
  Description of Artificial Sequence: Synthetic oligonucleotide
atgccgagtgcctgcgacgggg

SEQ ID NO: 249791 - DNA, 21 bp, Artificial Sequence
  Description of Artificial Sequence: Synthetic oligonucleotide
tgccgagtgcctgcgacgggg

SEQ ID NO: 249792 - DNA, 20 bp, Artificial Sequence
  Description of Artificial Sequence: Synthetic oligonucleotide
gccgagtgcctgcgacgggg

SEQ ID NO: 249793 - DNA, 20 bp, Artificial Sequence
  Description of Artificial Sequence: Synthetic oligonucleotide
ccgagtgcctgcgacggggg

SEQ ID NO: 249794 - DNA, 21 bp, Artificial Sequence
  Description of Artificial Sequence: Synthetic oligonucleotide
cgagtgcctgcgacggggggt

SEQ ID NO: 249795 - DNA, 21 bp, Artificial Sequence
  Description of Artificial Sequence: Synthetic oligonucleotide
gagtgcctgcgacggggggtg

SEQ ID NO: 249796 - DNA, 21 bp, Artificial Sequence
  Description of Artificial Sequence: Synthetic oligonucleotide
agtgcctgcgacggggggtgg

SEQ ID NO: 249797 - DNA, 20 bp, Artificial Sequence
  Description of Artificial Sequence: Synthetic oligonucleotide
gtgcctgcgacggggggtgg

SEQ ID NO: 249798 - DNA, 20 bp, Artificial Sequence
  Description of Artificial Sequence: Synthetic oligonucleotide
tgcctgcgacggggggtggg

SEQ ID NO: 249799 - DNA, 20 bp, Artificial Sequence
  Description of Artificial Sequence: Synthetic oligonucleotide
gcctgcgacggggggtgggt

SEQ ID NO: 249800 - DNA, 20 bp, Artificial Sequence
  Description of Artificial Sequence: Synthetic oligonucleotide
cctgcgacggggggtggggt

SEQ ID NO: 249801 - DNA, 20 bp, Artificial Sequence
  Description of Artificial Sequence: Synthetic oligonucleotide
ctgcgacggggggtggggct

SEQ ID NO: 249802 - DNA, 20 bp, Artificial Sequence
  Description of Artificial Sequence: Synthetic oligonucleotide
tgcgacggggggtggggcgt

SEQ ID NO: 249803 - DNA, 20 bp, Artificial Sequence
  Description of Artificial Sequence: Synthetic oligonucleotide
gcgacggggggtggggcgtt

SEQ ID NO: 249804 - DNA, 20 bp, Artificial Sequence
  Description of Artificial Sequence: Synthetic oligonucleotide
cgacggggggtggggcgcat

SEQ ID NO: 249805 - DNA, 20 bp, Artificial Sequence
  Description of Artificial Sequence: Synthetic oligonucleotide
gacggggggtggggcgcagt

SEQ ID NO: 249806 - DNA, 20 bp, Artificial Sequence
  Description of Artificial Sequence: Synthetic oligonucleotide
acggggggtggggcgcagtg

SEQ ID NO: 249807 - DNA, 20 bp, Artificial Sequence
  Description of Artificial Sequence: Synthetic oligonucleotide
cggggggtggggcgcagtgt

SEQ ID NO: 249808 - DNA, 20 bp, Artificial Sequence
  Description of Artificial Sequence: Synthetic oligonucleotide
ggggggtggggcgcagtgct

SEQ ID NO: 249809 - DNA, 21 bp, Artificial Sequence
  Description of Artificial Sequence: Synthetic oligonucleotide
gggggtggggcgcagtgccat

SEQ ID NO: 249810 - DNA, 21 bp, Artificial Sequence
  Description of Artificial Sequence: Synthetic oligonucleotide
ggggtggggcgcagtgccatc

SEQ ID NO: 249811 - DNA, 21 bp, Artificial Sequence
  Description of Artificial Sequence: Synthetic oligonucleotide
gggtggggcgcagtgccatcc

SEQ ID NO: 249812 - DNA, 21 bp, Artificial Sequence
  Description of Artificial Sequence: Synthetic oligonucleotide
ggtggggcgcagtgccatccg

SEQ ID NO: 249813 - DNA, 21 bp, Artificial Sequence
  Description of Artificial Sequence: Synthetic oligonucleotide
gtggggcgcagtgccatccgg

SEQ ID NO: 249814 - DNA, 22 bp, Artificial Sequence
  Description of Artificial Sequence: Synthetic oligonucleotide
tggggcgcagtgccatccggct

SEQ ID NO: 249815 - DNA, 21 bp, Artificial Sequence
  Description of Artificial Sequence: Synthetic oligonucleotide
ggggcgcagtgccatccggct

SEQ ID NO: 249816 - DNA, 21 bp, Artificial Sequence
  Description of Artificial Sequence: Synthetic oligonucleotide
gggcgcagtgccatccggctg

SEQ ID NO: 249817 - DNA, 22 bp, Artificial Sequence
  Description of Artificial Sequence: Synthetic oligonucleotide
ggcgcagtgccatccggctgga

SEQ ID NO: 249818 - DNA, 22 bp, Artificial Sequence
  Description of Artificial Sequence: Synthetic oligonucleotide
gcgcagtgccatccggctggag

SEQ ID NO: 249819 - DNA, 23 bp, Artificial Sequence
  Description of Artificial Sequence: Synthetic oligonucleotide
cgcagtgccatccggctggagca

SEQ ID NO: 249820 - DNA, 23 bp, Artificial Sequence
  Description of Artificial Sequence: Synthetic oligonucleotide
gcagtgccatccggctggagcac

SEQ ID NO: 249821 - DNA, 24 bp, Artificial Sequence
  Description of Artificial Sequence: Synthetic oligonucleotide
cagtgccatccggctggagcacga

SEQ ID NO: 249822 - DNA, 24 bp, Artificial Sequence
  Description of Artificial Sequence: Synthetic oligonucleotide
agtgccatccggctggagcacgag

SEQ ID NO: 249823 - DNA, 23 bp, Artificial Sequence
  Description of Artificial Sequence: Synthetic oligonucleotide
gtgccatccggctggagcacgag

SEQ ID NO: 249824 - DNA, 23 bp, Artificial Sequence
  Description of Artificial Sequence: Synthetic oligonucleotide
tgccatccggctggagcacgagg

SEQ ID NO: 249825 - DNA, 22 bp, Artificial Sequence
  Description of Artificial Sequence: Synthetic oligonucleotide
gccatccggctggagcacgagg

SEQ ID NO: 249826 - DNA, 22 bp, Artificial Sequence
  Description of Artificial Sequence: Synthetic oligonucleotide
ccatccggctggagcacgaggc

SEQ ID NO: 249827 - DNA, 22 bp, Artificial Sequence
  Description of Artificial Sequence: Synthetic oligonucleotide
catccggctggagcacgaggcg

SEQ ID NO: 249828 - DNA, 22 bp, Artificial Sequence
  Description of Artificial Sequence: Synthetic oligonucleotide
atccggctggagcacgaggcgg

SEQ ID NO: 249829 - DNA, 21 bp, Artificial Sequence
  Description of Artificial Sequence: Synthetic oligonucleotide
tccggctggagcacgaggcgg

SEQ ID NO: 249830 - DNA, 20 bp, Artificial Sequence
  Description of Artificial Sequence: Synthetic oligonucleotide
ccggctggagcacgaggcgg

SEQ ID NO: 249831 - DNA, 20 bp, Artificial Sequence
  Description of Artificial Sequence: Synthetic oligonucleotide
cggctggagcacgaggcggg

SEQ ID NO: 249832 - DNA, 20 bp, Artificial Sequence
  Description of Artificial Sequence: Synthetic oligonucleotide
ggctggagcacgaggcgggc

SEQ ID NO: 249833 - DNA, 20 bp, Artificial Sequence
  Description of Artificial Sequence: Synthetic oligonucleotide
gctggagcacgaggcgggcg

SEQ ID NO: 249834 - DNA, 20 bp, Artificial Sequence
  Description of Artificial Sequence: Synthetic oligonucleotide
ctggagcacgaggcgggcgc

SEQ ID NO: 249835 - DNA, 20 bp, Artificial Sequence
  Description of Artificial Sequence: Synthetic oligonucleotide
tggagcacgaggcgggcgcc

SEQ ID NO: 249836 - DNA, 20 bp, Artificial Sequence
  Description of Artificial Sequence: Synthetic oligonucleotide
ggagcacgaggcgggcgcct

SEQ ID NO: 249837 - DNA, 20 bp, Artificial Sequence
  Description of Artificial Sequence: Synthetic oligonucleotide
gagcacgaggcgggcgccca

SEQ ID NO: 249838 - DNA, 20 bp, Artificial Sequence
  Description of Artificial Sequence: Synthetic oligonucleotide
agcacgaggcgggcgcccag

SEQ ID NO: 249839 - DNA, 20 bp, Artificial Sequence
  Description of Artificial Sequence: Synthetic oligonucleotide
gcacgaggcgggcgcccagt

SEQ ID NO: 249840 - DNA, 20 bp, Artificial Sequence
  Description of Artificial Sequence: Synthetic oligonucleotide
cacgaggcgggcgcccaggt

SEQ ID NO: 249841 - DNA, 20 bp, Artificial Sequence
  Description of Artificial Sequence: Synthetic oligonucleotide
acgaggcgggcgcccaggct

SEQ ID NO: 249842 - DNA, 20 bp, Artificial Sequence
  Description of Artificial Sequence: Synthetic oligonucleotide
cgaggcgggcgcccaggctt

SEQ ID NO: 249843 - DNA, 20 bp, Artificial Sequence
  Description of Artificial Sequence: Synthetic oligonucleotide
gaggcgggcgcccaggcctt

SEQ ID NO: 249844 - DNA, 20 bp, Artificial Sequence
  Description of Artificial Sequence: Synthetic oligonucleotide
aggcgggcgcccaggccctt

SEQ ID NO: 249845 - DNA, 20 bp, Artificial Sequence
  Description of Artificial Sequence: Synthetic oligonucleotide
ggcgggcgcccaggcccttt

SEQ ID NO: 249846 - DNA, 20 bp, Artificial Sequence
  Description of Artificial Sequence: Synthetic oligonucleotide
gcgggcgcccaggccctgat

SEQ ID NO: 249847 - DNA, 20 bp, Artificial Sequence
  Description of Artificial Sequence: Synthetic oligonucleotide
cgggcgcccaggccctgatc

SEQ ID NO: 249848 - DNA, 20 bp, Artificial Sequence
  Description of Artificial Sequence: Synthetic oligonucleotide
gggcgcccaggccctgatcg

SEQ ID NO: 249849 - DNA, 21 bp, Artificial Sequence
  Description of Artificial Sequence: Synthetic oligonucleotide
ggcgcccaggccctgatcggt

SEQ ID NO: 249850 - DNA, 21 bp, Artificial Sequence
  Description of Artificial Sequence: Synthetic oligonucleotide
gcgcccaggccctgatcggtc

SEQ ID NO: 249851 - DNA, 21 bp, Artificial Sequence
  Description of Artificial Sequence: Synthetic oligonucleotide
cgcccaggccctgatcggtcg

SEQ ID NO: 249852 - DNA, 21 bp, Artificial Sequence
  Description of Artificial Sequence: Synthetic oligonucleotide
gcccaggccctgatcggtcgc

SEQ ID NO: 249853 - DNA, 21 bp, Artificial Sequence
  Description of Artificial Sequence: Synthetic oligonucleotide
cccaggccctgatcggtcgcc

SEQ ID NO: 249854 - DNA, 21 bp, Artificial Sequence
  Description of Artificial Sequence: Synthetic oligonucleotide
ccaggccctgatcggtcgccg

SEQ ID NO: 249855 - DNA, 21 bp, Artificial Sequence
  Description of Artificial Sequence: Synthetic oligonucleotide
caggccctgatcggtcgccgg

SEQ ID NO: 249856 - DNA, 22 bp, Artificial Sequence
  Description of Artificial Sequence: Synthetic oligonucleotide
aggccctgatcggtcgccggga

SEQ ID NO: 249857 - DNA, 21 bp, Artificial Sequence
  Description of Artificial Sequence: Synthetic oligonucleotide
ggccctgatcggtcgccggga

SEQ ID NO: 249858 - DNA, 21 bp, Artificial Sequence
  Description of Artificial Sequence: Synthetic oligonucleotide
gccctgatcggtcgccgggac

SEQ ID NO: 249859 - DNA, 23 bp, Artificial Sequence
  Description of Artificial Sequence: Synthetic oligonucleotide
ccctgatcggtcgccgggaccaa

SEQ ID NO: 249860 - DNA, 24 bp, Artificial Sequence
  Description of Artificial Sequence: Synthetic oligonucleotide
cctgatcggtcgccgggaccaagt

SEQ ID NO: 249861 - DNA, 24 bp, Artificial Sequence
  Description of Artificial Sequence: Synthetic oligonucleotide
ctgatcggtcgccgggaccaagtg

SEQ ID NO: 249862 - DNA, 25 bp, Artificial Sequence
  Description of Artificial Sequence: Synthetic oligonucleotide
tgatcggtcgccgggaccaagtggt

SEQ ID NO: 249863 - DNA, 24 bp, Artificial Sequence
  Description of Artificial Sequence: Synthetic oligonucleotide
gatcggtcgccgggaccaagtggt

SEQ ID NO: 249864 - DNA, 27 bp, Artificial Sequence
  Description of Artificial Sequence: Synthetic oligonucleotide
atcggtcgccgggaccaagtggtcata

SEQ ID NO: 249865 - DNA, 26 bp, Artificial Sequence
  Description of Artificial Sequence: Synthetic oligonucleotide
tcggtcgccgggaccaagtggtcata

SEQ ID NO: 249866 - DNA, 25 bp, Artificial Sequence
  Description of Artificial Sequence: Synthetic oligonucleotide
cggtcgccgggaccaagtggtcata

SEQ ID NO: 249867 - DNA, 25 bp, Artificial Sequence
  Description of Artificial Sequence: Synthetic oligonucleotide
ggtcgccgggaccaagtggtcatag

SEQ ID NO: 249868 - DNA, 25 bp, Artificial Sequence
  Description of Artificial Sequence: Synthetic oligonucleotide
gtcgccgggaccaagtggtcatagg

SEQ ID NO: 249869 - DNA, 27 bp, Artificial Sequence
  Description of Artificial Sequence: Synthetic oligonucleotide
tcgccgggaccaagtggtcataggctt

SEQ ID NO: 249870 - DNA, 26 bp, Artificial Sequence
  Description of Artificial Sequence: Synthetic oligonucleotide
cgccgggaccaagtggtcataggctt

SEQ ID NO: 249871 - DNA, 27 bp, Artificial Sequence
  Description of Artificial Sequence: Synthetic oligonucleotide
gccgggaccaagtggtcataggcttct

SEQ ID NO: 249872 - DNA, 28 bp, Artificial Sequence
  Description of Artificial Sequence: Synthetic oligonucleotide
ccgggaccaagtggtcataggcttcttc

SEQ ID NO: 249873 - DNA, 28 bp, Artificial Sequence
  Description of Artificial Sequence: Synthetic oligonucleotide
cgggaccaagtggtcataggcttcttcg

SEQ ID NO: 249874 - DNA, 29 bp, Artificial Sequence
  Description of Artificial Sequence: Synthetic oligonucleotide
gggaccaagtggtcataggcttcttcgag

SEQ ID NO: 249875 - DNA, 29 bp, Artificial Sequence
  Description of Artificial Sequence: Synthetic oligonucleotide
ggaccaagtggtcataggcttcttcgagg

SEQ ID NO: 249876 - DNA, 30 bp, Artificial Sequence
  Description of Artificial Sequence: Synthetic oligonucleotide
gaccaagtggtcataggcttcttcgaggac

SEQ ID NO: 249877 - DNA, 30 bp, Artificial Sequence
  Description of Artificial Sequence: Synthetic oligonucleotide
accaagtggtcataggcttcttcgaggacc

SEQ ID NO: 249878 - DNA, 29 bp, Artificial Sequence
  Description of Artificial Sequence: Synthetic oligonucleotide
ccaagtggtcataggcttcttcgaggacc

SEQ ID NO: 249879 - DNA, 30 bp, Artificial Sequence
  Description of Artificial Sequence: Synthetic oligonucleotide
caagtggtcataggcttcttcgaggacctg

SEQ ID NO: 249880 - DNA, 30 bp, Artificial Sequence
  Description of Artificial Sequence: Synthetic oligonucleotide
aagtggtcataggcttcttcgaggacctgc

SEQ ID NO: 249881 - DNA, 29 bp, Artificial Sequence
  Description of Artificial Sequence: Synthetic oligonucleotide
agtggtcataggcttcttcgaggacctgc

SEQ ID NO: 249882 - DNA, 28 bp, Artificial Sequence
  Description of Artificial Sequence: Synthetic oligonucleotide
gtggtcataggcttcttcgaggacctgc

SEQ ID NO: 249883 - DNA, 29 bp, Artificial Sequence
  Description of Artificial Sequence: Synthetic oligonucleotide
tggtcataggcttcttcgaggacctgctg

SEQ ID NO: 249884 - DNA, 28 bp, Artificial Sequence
  Description of Artificial Sequence: Synthetic oligonucleotide
ggtcataggcttcttcgaggacctgctg

SEQ ID NO: 249885 - DNA, 28 bp, Artificial Sequence
  Description of Artificial Sequence: Synthetic oligonucleotide
gtcataggcttcttcgaggacctgctgg

SEQ ID NO: 249886 - DNA, 29 bp, Artificial Sequence
  Description of Artificial Sequence: Synthetic oligonucleotide
tcataggcttcttcgaggacctgctggac

SEQ ID NO: 249887 - DNA, 28 bp, Artificial Sequence
  Description of Artificial Sequence: Synthetic oligonucleotide
cataggcttcttcgaggacctgctggac

SEQ ID NO: 249888 - DNA, 28 bp, Artificial Sequence
  Description of Artificial Sequence: Synthetic oligonucleotide
ataggcttcttcgaggacctgctggacg

SEQ ID NO: 249889 - DNA, 27 bp, Artificial Sequence
  Description of Artificial Sequence: Synthetic oligonucleotide
taggcttcttcgaggacctgctggacg

SEQ ID NO: 249890 - DNA, 27 bp, Artificial Sequence
  Description of Artificial Sequence: Synthetic oligonucleotide
aggcttcttcgaggacctgctggacga

SEQ ID NO: 249891 - DNA, 26 bp, Artificial Sequence
  Description of Artificial Sequence: Synthetic oligonucleotide
ggcttcttcgaggacctgctggacga

SEQ ID NO: 249892 - DNA, 26 bp, Artificial Sequence
  Description of Artificial Sequence: Synthetic oligonucleotide
gcttcttcgaggacctgctggacgag

SEQ ID NO: 249893 - DNA, 27 bp, Artificial Sequence
  Description of Artificial Sequence: Synthetic oligonucleotide
cttcttcgaggacctgctggacgagga

SEQ ID NO: 249894 - DNA, 27 bp, Artificial Sequence
  Description of Artificial Sequence: Synthetic oligonucleotide
ttcttcgaggacctgctggacgaggag

SEQ ID NO: 249895 - DNA, 26 bp, Artificial Sequence
  Description of Artificial Sequence: Synthetic oligonucleotide
tcttcgaggacctgctggacgaggag

SEQ ID NO: 249896 - DNA, 25 bp, Artificial Sequence
  Description of Artificial Sequence: Synthetic oligonucleotide
cttcgaggacctgctggacgaggag

SEQ ID NO: 249897 - DNA, 26 bp, Artificial Sequence
  Description of Artificial Sequence: Synthetic oligonucleotide
ttcgaggacctgctggacgaggaggt

SEQ ID NO: 249898 - DNA, 25 bp, Artificial Sequence
  Description of Artificial Sequence: Synthetic oligonucleotide
tcgaggacctgctggacgaggaggt

SEQ ID NO: 249899 - DNA, 24 bp, Artificial Sequence
  Description of Artificial Sequence: Synthetic oligonucleotide
cgaggacctgctggacgaggaggt

SEQ ID NO: 249900 - DNA, 24 bp, Artificial Sequence
  Description of Artificial Sequence: Synthetic oligonucleotide
gaggacctgctggacgaggaggtg

SEQ ID NO: 249901 - DNA, 24 bp, Artificial Sequence
  Description of Artificial Sequence: Synthetic oligonucleotide
aggacctgctggacgaggaggtgg

SEQ ID NO: 249902 - DNA, 23 bp, Artificial Sequence
  Description of Artificial Sequence: Synthetic oligonucleotide
ggacctgctggacgaggaggtgg

SEQ ID NO: 249903 - DNA, 23 bp, Artificial Sequence
  Description of Artificial Sequence: Synthetic oligonucleotide
gacctgctggacgaggaggtggc

SEQ ID NO: 249904 - DNA, 24 bp, Artificial Sequence
  Description of Artificial Sequence: Synthetic oligonucleotide
acctgctggacgaggaggtggcca

SEQ ID NO: 249905 - DNA, 23 bp, Artificial Sequence
  Description of Artificial Sequence: Synthetic oligonucleotide
cctgctggacgaggaggtggcca

SEQ ID NO: 249906 - DNA, 23 bp, Artificial Sequence
  Description of Artificial Sequence: Synthetic oligonucleotide
ctgctggacgaggaggtggccac

SEQ ID NO: 249907 - DNA, 25 bp, Artificial Sequence
  Description of Artificial Sequence: Synthetic oligonucleotide
tgctggacgaggaggtggccaccat

SEQ ID NO: 249908 - DNA, 24 bp, Artificial Sequence
  Description of Artificial Sequence: Synthetic oligonucleotide
gctggacgaggaggtggccaccat

SEQ ID NO: 249909 - DNA, 26 bp, Artificial Sequence
  Description of Artificial Sequence: Synthetic oligonucleotide
ctggacgaggaggtggccaccatctt

SEQ ID NO: 249910 - DNA, 26 bp, Artificial Sequence
  Description of Artificial Sequence: Synthetic oligonucleotide
tggacgaggaggtggccaccatcttg

SEQ ID NO: 249911 - DNA, 25 bp, Artificial Sequence
  Description of Artificial Sequence: Synthetic oligonucleotide
ggacgaggaggtggccaccatcttg

SEQ ID NO: 249912 - DNA, 25 bp, Artificial Sequence
  Description of Artificial Sequence: Synthetic oligonucleotide
gacgaggaggtggccaccatcttgg

SEQ ID NO: 249913 - DNA, 25 bp, Artificial Sequence
  Description of Artificial Sequence: Synthetic oligonucleotide
acgaggaggtggccaccatcttggc

SEQ ID NO: 249914 - DNA, 24 bp, Artificial Sequence
  Description of Artificial Sequence: Synthetic oligonucleotide
cgaggaggtggccaccatcttggc

SEQ ID NO: 249915 - DNA, 26 bp, Artificial Sequence
  Description of Artificial Sequence: Synthetic oligonucleotide
gaggaggtggccaccatcttggccta

SEQ ID NO: 249916 - DNA, 26 bp, Artificial Sequence
  Description of Artificial Sequence: Synthetic oligonucleotide
aggaggtggccaccatcttggcctag

SEQ ID NO: 249917 - DNA, 25 bp, Artificial Sequence
  Description of Artificial Sequence: Synthetic oligonucleotide
ggaggtggccaccatcttggcctag

SEQ ID NO: 249918 - DNA, 25 bp, Artificial Sequence
  Description of Artificial Sequence: Synthetic oligonucleotide
gaggtggccaccatcttggcctagg

SEQ ID NO: 249919 - DNA, 25 bp, Artificial Sequence
  Description of Artificial Sequence: Synthetic oligonucleotide
aggtggccaccatcttggcctaggc

SEQ ID NO: 249920 - DNA, 24 bp, Artificial Sequence
  Description of Artificial Sequence: Synthetic oligonucleotide
ggtggccaccatcttggcctaggc

SEQ ID NO: 249921 - DNA, 24 bp, Artificial Sequence
  Description of Artificial Sequence: Synthetic oligonucleotide
gtggccaccatcttggcctaggcc

SEQ ID NO: 249922 - DNA, 25 bp, Artificial Sequence
  Description of Artificial Sequence: Synthetic oligonucleotide
tggccaccatcttggcctaggccca

SEQ ID NO: 249923 - DNA, 24 bp, Artificial Sequence
  Description of Artificial Sequence: Synthetic oligonucleotide
ggccaccatcttggcctaggccca

SEQ ID NO: 249924 - DNA, 24 bp, Artificial Sequence
  Description of Artificial Sequence: Synthetic oligonucleotide
gccaccatcttggcctaggcccag

SEQ ID NO: 249925 - DNA, 25 bp, Artificial Sequence
  Description of Artificial Sequence: Synthetic oligonucleotide
ccaccatcttggcctaggcccagga

SEQ ID NO: 249926 - DNA, 25 bp, Artificial Sequence
  Description of Artificial Sequence: Synthetic oligonucleotide
caccatcttggcctaggcccaggag

SEQ ID NO: 249927 - DNA, 25 bp, Artificial Sequence
  Description of Artificial Sequence: Synthetic oligonucleotide
accatcttggcctaggcccaggagg

SEQ ID NO: 249928 - DNA, 24 bp, Artificial Sequence
  Description of Artificial Sequence: Synthetic oligonucleotide
ccatcttggcctaggcccaggagg

SEQ ID NO: 249929 - DNA, 24 bp, Artificial Sequence
  Description of Artificial Sequence: Synthetic oligonucleotide
catcttggcctaggcccaggaggc

SEQ ID NO: 249930 - DNA, 24 bp, Artificial Sequence
  Description of Artificial Sequence: Synthetic oligonucleotide
atcttggcctaggcccaggaggcc

SEQ ID NO: 249931 - DNA, 23 bp, Artificial Sequence
  Description of Artificial Sequence: Synthetic oligonucleotide
tcttggcctaggcccaggaggcc

SEQ ID NO: 249932 - DNA, 22 bp, Artificial Sequence
  Description of Artificial Sequence: Synthetic oligonucleotide
cttggcctaggcccaggaggcc

SEQ ID NO: 249933 - DNA, 23 bp, Artificial Sequence
  Description of Artificial Sequence: Synthetic oligonucleotide
ttggcctaggcccaggaggccct

SEQ ID NO: 249934 - DNA, 22 bp, Artificial Sequence
  Description of Artificial Sequence: Synthetic oligonucleotide
tggcctaggcccaggaggccct

SEQ ID NO: 249935 - DNA, 21 bp, Artificial Sequence
  Description of Artificial Sequence: Synthetic oligonucleotide
ggcctaggcccaggaggccct

SEQ ID NO: 249936 - DNA, 21 bp, Artificial Sequence
  Description of Artificial Sequence: Synthetic oligonucleotide
gcctaggcccaggaggccctg

SEQ ID NO: 249937 - DNA, 22 bp, Artificial Sequence
  Description of Artificial Sequence: Synthetic oligonucleotide
cctaggcccaggaggccctgga

SEQ ID NO: 249938 - DNA, 24 bp, Artificial Sequence
  Description of Artificial Sequence: Synthetic oligonucleotide
ctaggcccaggaggccctggactt

SEQ ID NO: 249939 - DNA, 25 bp, Artificial Sequence
  Description of Artificial Sequence: Synthetic oligonucleotide
taggcccaggaggccctggacttga

SEQ ID NO: 249940 - DNA, 24 bp, Artificial Sequence
  Description of Artificial Sequence: Synthetic oligonucleotide
aggcccaggaggccctggacttga

SEQ ID NO: 249941 - DNA, 23 bp, Artificial Sequence
  Description of Artificial Sequence: Synthetic oligonucleotide
ggcccaggaggccctggacttga

SEQ ID NO: 249942 - DNA, 23 bp, Artificial Sequence
  Description of Artificial Sequence: Synthetic oligonucleotide
gcccaggaggccctggacttgac

SEQ ID NO: 249943 - DNA, 26 bp, Artificial Sequence
  Description of Artificial Sequence: Synthetic oligonucleotide
cccaggaggccctggacttgaccttt

SEQ ID NO: 249944 - DNA, 26 bp, Artificial Sequence
  Description of Artificial Sequence: Synthetic oligonucleotide
ccaggaggccctggacttgacctttg

SEQ ID NO: 249945 - DNA, 26 bp, Artificial Sequence
  Description of Artificial Sequence: Synthetic oligonucleotide
caggaggccctggacttgacctttgc

SEQ ID NO: 249946 - DNA, 26 bp, Artificial Sequence
  Description of Artificial Sequence: Synthetic oligonucleotide
aggaggccctggacttgacctttgcc

SEQ ID NO: 249947 - DNA, 25 bp, Artificial Sequence
  Description of Artificial Sequence: Synthetic oligonucleotide
ggaggccctggacttgacctttgcc

SEQ ID NO: 249948 - DNA, 26 bp, Artificial Sequence
  Description of Artificial Sequence: Synthetic oligonucleotide
gaggccctggacttgacctttgccct

SEQ ID NO: 249949 - DNA, 27 bp, Artificial Sequence
  Description of Artificial Sequence: Synthetic oligonucleotide
aggccctggacttgacctttgccctca

SEQ ID NO: 249950 - DNA, 26 bp, Artificial Sequence
  Description of Artificial Sequence: Synthetic oligonucleotide
ggccctggacttgacctttgccctca

SEQ ID NO: 249951 - DNA, 27 bp, Artificial Sequence
  Description of Artificial Sequence: Synthetic oligonucleotide
gccctggacttgacctttgccctcaca

SEQ ID NO: 249952 - DNA, 27 bp, Artificial Sequence
  Description of Artificial Sequence: Synthetic oligonucleotide
ccctggacttgacctttgccctcacag

SEQ ID NO: 249953 - DNA, 28 bp, Artificial Sequence
  Description of Artificial Sequence: Synthetic oligonucleotide
cctggacttgacctttgccctcacagag

SEQ ID NO: 249954 - DNA, 28 bp, Artificial Sequence
  Description of Artificial Sequence: Synthetic oligonucleotide
ctggacttgacctttgccctcacagagc

SEQ ID NO: 249955 - DNA, 28 bp, Artificial Sequence
  Description of Artificial Sequence: Synthetic oligonucleotide
tggacttgacctttgccctcacagagcg

SEQ ID NO: 249956 - DNA, 27 bp, Artificial Sequence
  Description of Artificial Sequence: Synthetic oligonucleotide
ggacttgacctttgccctcacagagcg

SEQ ID NO: 249957 - DNA, 27 bp, Artificial Sequence
  Description of Artificial Sequence: Synthetic oligonucleotide
gacttgacctttgccctcacagagcgg

SEQ ID NO: 249958 - DNA, 27 bp, Artificial Sequence
  Description of Artificial Sequence: Synthetic oligonucleotide
acttgacctttgccctcacagagcggc

SEQ ID NO: 249959 - DNA, 26 bp, Artificial Sequence
  Description of Artificial Sequence: Synthetic oligonucleotide
cttgacctttgccctcacagagcggc

SEQ ID NO: 249960 - DNA, 26 bp, Artificial Sequence
  Description of Artificial Sequence: Synthetic oligonucleotide
ttgacctttgccctcacagagcggcc

SEQ ID NO: 249961 - DNA, 25 bp, Artificial Sequence
  Description of Artificial Sequence: Synthetic oligonucleotide
tgacctttgccctcacagagcggcc

SEQ ID NO: 249962 - DNA, 24 bp, Artificial Sequence
  Description of Artificial Sequence: Synthetic oligonucleotide
gacctttgccctcacagagcggcc

SEQ ID NO: 249963 - DNA, 24 bp, Artificial Sequence
  Description of Artificial Sequence: Synthetic oligonucleotide
acctttgccctcacagagcggccg

SEQ ID NO: 249964 - DNA, 23 bp, Artificial Sequence
  Description of Artificial Sequence: Synthetic oligonucleotide
cctttgccctcacagagcggccg

SEQ ID NO: 249965 - DNA, 23 bp, Artificial Sequence
  Description of Artificial Sequence: Synthetic oligonucleotide
ctttgccctcacagagcggccgc

SEQ ID NO: 249966 - DNA, 23 bp, Artificial Sequence
  Description of Artificial Sequence: Synthetic oligonucleotide
tttgccctcacagagcggccgcg

SEQ ID NO: 249967 - DNA, 22 bp, Artificial Sequence
  Description of Artificial Sequence: Synthetic oligonucleotide
ttgccctcacagagcggccgcg

SEQ ID NO: 249968 - DNA, 21 bp, Artificial Sequence
  Description of Artificial Sequence: Synthetic oligonucleotide
tgccctcacagagcggccgcg

SEQ ID NO: 249969 - DNA, 20 bp, Artificial Sequence
  Description of Artificial Sequence: Synthetic oligonucleotide
gccctcacagagcggccgcg

SEQ ID NO: 249970 - DNA, 20 bp, Artificial Sequence
  Description of Artificial Sequence: Synthetic oligonucleotide
ccctcacagagcggccgcgg

SEQ ID NO: 249971 - DNA, 21 bp, Artificial Sequence
  Description of Artificial Sequence: Synthetic oligonucleotide
cctcacagagcggccgcgggt

SEQ ID NO: 249972 - DNA, 24 bp, Artificial Sequence
  Description of Artificial Sequence: Synthetic oligonucleotide
ctcacagagcggccgcgggtcttt

SEQ ID NO: 249973 - DNA, 25 bp, Artificial Sequence
  Description of Artificial Sequence: Synthetic oligonucleotide
tcacagagcggccgcgggtctttca

SEQ ID NO: 249974 - DNA, 24 bp, Artificial Sequence
  Description of Artificial Sequence: Synthetic oligonucleotide
cacagagcggccgcgggtctttca

SEQ ID NO: 249975 - DNA, 24 bp, Artificial Sequence
  Description of Artificial Sequence: Synthetic oligonucleotide
acagagcggccgcgggtctttcag

SEQ ID NO: 249976 - DNA, 23 bp, Artificial Sequence
  Description of Artificial Sequence: Synthetic oligonucleotide
cagagcggccgcgggtctttcag

SEQ ID NO: 249977 - DNA, 24 bp, Artificial Sequence
  Description of Artificial Sequence: Synthetic oligonucleotide
agagcggccgcgggtctttcagct

SEQ ID NO: 249978 - DNA, 23 bp, Artificial Sequence
  Description of Artificial Sequence: Synthetic oligonucleotide
gagcggccgcgggtctttcagct

SEQ ID NO: 249979 - DNA, 26 bp, Artificial Sequence
  Description of Artificial Sequence: Synthetic oligonucleotide
agcggccgcgggtctttcagctgttt

SEQ ID NO: 249980 - DNA, 25 bp, Artificial Sequence
  Description of Artificial Sequence: Synthetic oligonucleotide
gcggccgcgggtctttcagctgttt

SEQ ID NO: 249981 - DNA, 25 bp, Artificial Sequence
  Description of Artificial Sequence: Synthetic oligonucleotide
cggccgcgggtctttcagctgtttg

SEQ ID NO: 249982 - DNA, 25 bp, Artificial Sequence
  Description of Artificial Sequence: Synthetic oligonucleotide
ggccgcgggtctttcagctgtttgg

SEQ ID NO: 249983 - DNA, 25 bp, Artificial Sequence
  Description of Artificial Sequence: Synthetic oligonucleotide
gccgcgggtctttcagctgtttggc

SEQ ID NO: 249984 - DNA, 26 bp, Artificial Sequence
  Description of Artificial Sequence: Synthetic oligonucleotide
ccgcgggtctttcagctgtttggcct

SEQ ID NO: 249985 - DNA, 27 bp, Artificial Sequence
  Description of Artificial Sequence: Synthetic oligonucleotide
cgcgggtctttcagctgtttggcctga

SEQ ID NO: 249986 - DNA, 27 bp, Artificial Sequence
  Description of Artificial Sequence: Synthetic oligonucleotide
gcgggtctttcagctgtttggcctgac

SEQ ID NO: 249987 - DNA, 27 bp, Artificial Sequence
  Description of Artificial Sequence: Synthetic oligonucleotide
cgggtctttcagctgtttggcctgacc

SEQ ID NO: 249988 - DNA, 29 bp, Artificial Sequence
  Description of Artificial Sequence: Synthetic oligonucleotide
gggtctttcagctgtttggcctgaccaag

SEQ ID NO: 249989 - DNA, 29 bp, Artificial Sequence
  Description of Artificial Sequence: Synthetic oligonucleotide
ggtctttcagctgtttggcctgaccaagg

SEQ ID NO: 249990 - DNA, 30 bp, Artificial Sequence
  Description of Artificial Sequence: Synthetic oligonucleotide
gtctttcagctgtttggcctgaccaaggac

SEQ ID NO: 249991 - DNA, 31 bp, Artificial Sequence
  Description of Artificial Sequence: Synthetic oligonucleotide
tctttcagctgtttggcctgaccaaggactc

SEQ ID NO: 249992 - DNA, 30 bp, Artificial Sequence
  Description of Artificial Sequence: Synthetic oligonucleotide
ctttcagctgtttggcctgaccaaggactc

SEQ ID NO: 249993 - DNA, 31 bp, Artificial Sequence
  Description of Artificial Sequence: Synthetic oligonucleotide
tttcagctgtttggcctgaccaaggactctg

SEQ ID NO: 249994 - DNA, 30 bp, Artificial Sequence
  Description of Artificial Sequence: Synthetic oligonucleotide
ttcagctgtttggcctgaccaaggactctg

SEQ ID NO: 249995 - DNA, 29 bp, Artificial Sequence
  Description of Artificial Sequence: Synthetic oligonucleotide
tcagctgtttggcctgaccaaggactctg

SEQ ID NO: 249996 - DNA, 28 bp, Artificial Sequence
  Description of Artificial Sequence: Synthetic oligonucleotide
cagctgtttggcctgaccaaggactctg

SEQ ID NO: 249997 - DNA, 29 bp, Artificial Sequence
  Description of Artificial Sequence: Synthetic oligonucleotide
agctgtttggcctgaccaaggactctgtg

SEQ ID NO: 249998 - DNA, 28 bp, Artificial Sequence
  Description of Artificial Sequence: Synthetic oligonucleotide
gctgtttggcctgaccaaggactctgtg

SEQ ID NO: 249999 - DNA, 28 bp, Artificial Sequence
  Description of Artificial Sequence: Synthetic oligonucleotide
ctgtttggcctgaccaaggactctgtgg

SEQ ID NO: 250000 - DNA, 30 bp, Artificial Sequence
  Description of Artificial Sequence: Synthetic oligonucleotide
tgtttggcctgaccaaggactctgtggttc

SEQ ID NO: 250001 - DNA, 29 bp, Artificial Sequence
  Description of Artificial Sequence: Synthetic oligonucleotide
gtttggcctgaccaaggactctgtggttc

SEQ ID NO: 250002 - DNA, 30 bp, Artificial Sequence
  Description of Artificial Sequence: Synthetic oligonucleotide
tttggcctgaccaaggactctgtggttcac

SEQ ID NO: 250003 - DNA, 29 bp, Artificial Sequence
  Description of Artificial Sequence: Synthetic oligonucleotide
ttggcctgaccaaggactctgtggttcac

SEQ ID NO: 250004 - DNA, 28 bp, Artificial Sequence
  Description of Artificial Sequence: Synthetic oligonucleotide
tggcctgaccaaggactctgtggttcac

SEQ ID NO: 250005 - DNA, 27 bp, Artificial Sequence
  Description of Artificial Sequence: Synthetic oligonucleotide
ggcctgaccaaggactctgtggttcac

SEQ ID NO: 250006 - DNA, 29 bp, Artificial Sequence
  Description of Artificial Sequence: Synthetic oligonucleotide
gcctgaccaaggactctgtggttcacttc

SEQ ID NO: 250007 - DNA, 31 bp, Artificial Sequence
  Description of Artificial Sequence: Synthetic oligonucleotide
cctgaccaaggactctgtggttcacttcaag

SEQ ID NO: 250008 - DNA, 33 bp, Artificial Sequence
  Description of Artificial Sequence: Synthetic oligonucleotide
ctgaccaaggactctgtggttcacttcaagaac

SEQ ID NO: 250009 - DNA, 36 bp, Artificial Sequence
  Description of Artificial Sequence: Synthetic oligonucleotide
tgaccaaggactctgtggttcacttcaagaactttg

SEQ ID NO: 250010 - DNA, 35 bp, Artificial Sequence
  Description of Artificial Sequence: Synthetic oligonucleotide
gaccaaggactctgtggttcacttcaagaactttg

SEQ ID NO: 250011 - DNA, 37 bp, Artificial Sequence
  Description of Artificial Sequence: Synthetic oligonucleotide
accaaggactctgtggttcacttcaagaactttgatg

SEQ ID NO: 250012 - DNA, 36 bp, Artificial Sequence
  Description of Artificial Sequence: Synthetic oligonucleotide
ccaaggactctgtggttcacttcaagaactttgatg

SEQ ID NO: 250013 - DNA, 37 bp, Artificial Sequence
  Description of Artificial Sequence: Synthetic oligonucleotide
caaggactctgtggttcacttcaagaactttgatgag

SEQ ID NO: 250014 - DNA, 37 bp, Artificial Sequence
  Description of Artificial Sequence: Synthetic oligonucleotide
aaggactctgtggttcacttcaagaactttgatgagc

SEQ ID NO: 250015 - DNA, 36 bp, Artificial Sequence
  Description of Artificial Sequence: Synthetic oligonucleotide
aggactctgtggttcacttcaagaactttgatgagc

SEQ ID NO: 250016 - DNA, 35 bp, Artificial Sequence
  Description of Artificial Sequence: Synthetic oligonucleotide
ggactctgtggttcacttcaagaactttgatgagc

SEQ ID NO: 250017 - DNA, 35 bp, Artificial Sequence
  Description of Artificial Sequence: Synthetic oligonucleotide
gactctgtggttcacttcaagaactttgatgagcg

SEQ ID NO: 250018 - DNA, 35 bp, Artificial Sequence
  Description of Artificial Sequence: Synthetic oligonucleotide
actctgtggttcacttcaagaactttgatgagcgg

SEQ ID NO: 250019 - DNA, 34 bp, Artificial Sequence
  Description of Artificial Sequence: Synthetic oligonucleotide
ctctgtggttcacttcaagaactttgatgagcgg

SEQ ID NO: 250020 - DNA, 34 bp, Artificial Sequence
  Description of Artificial Sequence: Synthetic oligonucleotide
tctgtggttcacttcaagaactttgatgagcggc

SEQ ID NO: 250021 - DNA, 33 bp, Artificial Sequence
  Description of Artificial Sequence: Synthetic oligonucleotide
ctgtggttcacttcaagaactttgatgagcggc

SEQ ID NO: 250022 - DNA, 33 bp, Artificial Sequence
  Description of Artificial Sequence: Synthetic oligonucleotide
tgtggttcacttcaagaactttgatgagcggcg

SEQ ID NO: 250023 - DNA, 32 bp, Artificial Sequence
  Description of Artificial Sequence: Synthetic oligonucleotide
gtggttcacttcaagaactttgatgagcggcg

SEQ ID NO: 250024 - DNA, 32 bp, Artificial Sequence
  Description of Artificial Sequence: Synthetic oligonucleotide
tggttcacttcaagaactttgatgagcggcgg

SEQ ID NO: 250025 - DNA, 31 bp, Artificial Sequence
  Description of Artificial Sequence: Synthetic oligonucleotide
ggttcacttcaagaactttgatgagcggcgg

SEQ ID NO: 250026 - DNA, 31 bp, Artificial Sequence
  Description of Artificial Sequence: Synthetic oligonucleotide
gttcacttcaagaactttgatgagcggcggg

SEQ ID NO: 250027 - DNA, 31 bp, Artificial Sequence
  Description of Artificial Sequence: Synthetic oligonucleotide
ttcacttcaagaactttgatgagcggcgggc

SEQ ID NO: 250028 - DNA, 30 bp, Artificial Sequence
  Description of Artificial Sequence: Synthetic oligonucleotide
tcacttcaagaactttgatgagcggcgggc

SEQ ID NO: 250029 - DNA, 29 bp, Artificial Sequence
  Description of Artificial Sequence: Synthetic oligonucleotide
cacttcaagaactttgatgagcggcgggc

SEQ ID NO: 250030 - DNA, 30 bp, Artificial Sequence
  Description of Artificial Sequence: Synthetic oligonucleotide
acttcaagaactttgatgagcggcgggcag

SEQ ID NO: 250031 - DNA, 29 bp, Artificial Sequence
  Description of Artificial Sequence: Synthetic oligonucleotide
cttcaagaactttgatgagcggcgggcag

SEQ ID NO: 250032 - DNA, 30 bp, Artificial Sequence
  Description of Artificial Sequence: Synthetic oligonucleotide
ttcaagaactttgatgagcggcgggcagtc

SEQ ID NO: 250033 - DNA, 29 bp, Artificial Sequence
  Description of Artificial Sequence: Synthetic oligonucleotide
tcaagaactttgatgagcggcgggcagtc

SEQ ID NO: 250034 - DNA, 28 bp, Artificial Sequence
  Description of Artificial Sequence: Synthetic oligonucleotide
caagaactttgatgagcggcgggcagtc

SEQ ID NO: 250035 - DNA, 30 bp, Artificial Sequence
  Description of Artificial Sequence: Synthetic oligonucleotide
aagaactttgatgagcggcgggcagtcttc

SEQ ID NO: 250036 - DNA, 29 bp, Artificial Sequence
  Description of Artificial Sequence: Synthetic oligonucleotide
agaactttgatgagcggcgggcagtcttc

SEQ ID NO: 250037 - DNA, 28 bp, Artificial Sequence
  Description of Artificial Sequence: Synthetic oligonucleotide
gaactttgatgagcggcgggcagtcttc

SEQ ID NO: 250038 - DNA, 28 bp, Artificial Sequence
  Description of Artificial Sequence: Synthetic oligonucleotide
aactttgatgagcggcgggcagtcttcc

SEQ ID NO: 250039 - DNA, 27 bp, Artificial Sequence
  Description of Artificial Sequence: Synthetic oligonucleotide
actttgatgagcggcgggcagtcttcc

SEQ ID NO: 250040 - DNA, 26 bp, Artificial Sequence
  Description of Artificial Sequence: Synthetic oligonucleotide
ctttgatgagcggcgggcagtcttcc

SEQ ID NO: 250041 - DNA, 26 bp, Artificial Sequence
  Description of Artificial Sequence: Synthetic oligonucleotide
tttgatgagcggcgggcagtcttccc

SEQ ID NO: 250042 - DNA, 25 bp, Artificial Sequence
  Description of Artificial Sequence: Synthetic oligonucleotide
ttgatgagcggcgggcagtcttccc

SEQ ID NO: 250043 - DNA, 24 bp, Artificial Sequence
  Description of Artificial Sequence: Synthetic oligonucleotide
tgatgagcggcgggcagtcttccc

SEQ ID NO: 250044 - DNA, 23 bp, Artificial Sequence
  Description of Artificial Sequence: Synthetic oligonucleotide
gatgagcggcgggcagtcttccc

SEQ ID NO: 250045 - DNA, 23 bp, Artificial Sequence
  Description of Artificial Sequence: Synthetic oligonucleotide
atgagcggcgggcagtcttcccc

SEQ ID NO: 250046 - DNA, 22 bp, Artificial Sequence
  Description of Artificial Sequence: Synthetic oligonucleotide
tgagcggcgggcagtcttcccc

SEQ ID NO: 250047 - DNA, 21 bp, Artificial Sequence
  Description of Artificial Sequence: Synthetic oligonucleotide
gagcggcgggcagtcttcccc

SEQ ID NO: 250048 - DNA, 22 bp, Artificial Sequence
  Description of Artificial Sequence: Synthetic oligonucleotide
agcggcgggcagtcttccccgt

SEQ ID NO: 250049 - DNA, 21 bp, Artificial Sequence
  Description of Artificial Sequence: Synthetic oligonucleotide
gcggcgggcagtcttccccgt

SEQ ID NO: 250050 - DNA, 21 bp, Artificial Sequence
  Description of Artificial Sequence: Synthetic oligonucleotide
cggcgggcagtcttccccgtc

SEQ ID NO: 250051 - DNA, 22 bp, Artificial Sequence
  Description of Artificial Sequence: Synthetic oligonucleotide
ggcgggcagtcttccccgtcga

SEQ ID NO: 250052 - DNA, 22 bp, Artificial Sequence
  Description of Artificial Sequence: Synthetic oligonucleotide
gcgggcagtcttccccgtcgac

SEQ ID NO: 250053 - DNA, 23 bp, Artificial Sequence
  Description of Artificial Sequence: Synthetic oligonucleotide
cgggcagtcttccccgtcgacga

SEQ ID NO: 250054 - DNA, 23 bp, Artificial Sequence
  Description of Artificial Sequence: Synthetic oligonucleotide
gggcagtcttccccgtcgacgag

SEQ ID NO: 250055 - DNA, 24 bp, Artificial Sequence
  Description of Artificial Sequence: Synthetic oligonucleotide
ggcagtcttccccgtcgacgagga

SEQ ID NO: 250056 - DNA, 24 bp, Artificial Sequence
  Description of Artificial Sequence: Synthetic oligonucleotide
gcagtcttccccgtcgacgaggag

SEQ ID NO: 250057 - DNA, 26 bp, Artificial Sequence
  Description of Artificial Sequence: Synthetic oligonucleotide
cagtcttccccgtcgacgaggaggtt

SEQ ID NO: 250058 - DNA, 26 bp, Artificial Sequence
  Description of Artificial Sequence: Synthetic oligonucleotide
agtcttccccgtcgacgaggaggttg

SEQ ID NO: 250059 - DNA, 25 bp, Artificial Sequence
  Description of Artificial Sequence: Synthetic oligonucleotide
gtcttccccgtcgacgaggaggttg

SEQ ID NO: 250060 - DNA, 25 bp, Artificial Sequence
  Description of Artificial Sequence: Synthetic oligonucleotide
tcttccccgtcgacgaggaggttgg

SEQ ID NO: 250061 - DNA, 24 bp, Artificial Sequence
  Description of Artificial Sequence: Synthetic oligonucleotide
cttccccgtcgacgaggaggttgg

SEQ ID NO: 250062 - DNA, 24 bp, Artificial Sequence
  Description of Artificial Sequence: Synthetic oligonucleotide
ttccccgtcgacgaggaggttggc

SEQ ID NO: 250063 - DNA, 23 bp, Artificial Sequence
  Description of Artificial Sequence: Synthetic oligonucleotide
tccccgtcgacgaggaggttggc

SEQ ID NO: 250064 - DNA, 22 bp, Artificial Sequence
  Description of Artificial Sequence: Synthetic oligonucleotide
ccccgtcgacgaggaggttggc

SEQ ID NO: 250065 - DNA, 23 bp, Artificial Sequence
  Description of Artificial Sequence: Synthetic oligonucleotide
cccgtcgacgaggaggttggcct

SEQ ID NO: 250066 - DNA, 23 bp, Artificial Sequence
  Description of Artificial Sequence: Synthetic oligonucleotide
ccgtcgacgaggaggttggcctg

SEQ ID NO: 250067 - DNA, 24 bp, Artificial Sequence
  Description of Artificial Sequence: Synthetic oligonucleotide
cgtcgacgaggaggttggcctggt

SEQ ID NO: 250068 - DNA, 24 bp, Artificial Sequence
  Description of Artificial Sequence: Synthetic oligonucleotide
gtcgacgaggaggttggcctggtc

SEQ ID NO: 250069 - DNA, 25 bp, Artificial Sequence
  Description of Artificial Sequence: Synthetic oligonucleotide
tcgacgaggaggttggcctggtcct

SEQ ID NO: 250070 - DNA, 24 bp, Artificial Sequence
  Description of Artificial Sequence: Synthetic oligonucleotide
cgacgaggaggttggcctggtcct

SEQ ID NO: 250071 - DNA, 24 bp, Artificial Sequence
  Description of Artificial Sequence: Synthetic oligonucleotide
gacgaggaggttggcctggtcctg

SEQ ID NO: 250072 - DNA, 24 bp, Artificial Sequence
  Description of Artificial Sequence: Synthetic oligonucleotide
acgaggaggttggcctggtcctgg

SEQ ID NO: 250073 - DNA, 23 bp, Artificial Sequence
  Description of Artificial Sequence: Synthetic oligonucleotide
cgaggaggttggcctggtcctgg

SEQ ID NO: 250074 - DNA, 23 bp, Artificial Sequence
  Description of Artificial Sequence: Synthetic oligonucleotide
gaggaggttggcctggtcctggg

SEQ ID NO: 250075 - DNA, 23 bp, Artificial Sequence
  Description of Artificial Sequence: Synthetic oligonucleotide
aggaggttggcctggtcctgggg

SEQ ID NO: 250076 - DNA, 22 bp, Artificial Sequence
  Description of Artificial Sequence: Synthetic oligonucleotide
ggaggttggcctggtcctgggg

SEQ ID NO: 250077 - DNA, 24 bp, Artificial Sequence
  Description of Artificial Sequence: Synthetic oligonucleotide
gaggttggcctggtcctgggggaa

SEQ ID NO: 250078 - DNA, 25 bp, Artificial Sequence
  Description of Artificial Sequence: Synthetic oligonucleotide
aggttggcctggtcctgggggaact

SEQ ID NO: 250079 - DNA, 24 bp, Artificial Sequence
  Description of Artificial Sequence: Synthetic oligonucleotide
ggttggcctggtcctgggggaact

SEQ ID NO: 250080 - DNA, 25 bp, Artificial Sequence
  Description of Artificial Sequence: Synthetic oligonucleotide
gttggcctggtcctgggggaactgt

SEQ ID NO: 250081 - DNA, 25 bp, Artificial Sequence
  Description of Artificial Sequence: Synthetic oligonucleotide
ttggcctggtcctgggggaactgtc

SEQ ID NO: 250082 - DNA, 24 bp, Artificial Sequence
  Description of Artificial Sequence: Synthetic oligonucleotide
tggcctggtcctgggggaactgtc

SEQ ID NO: 250083 - DNA, 23 bp, Artificial Sequence
  Description of Artificial Sequence: Synthetic oligonucleotide
ggcctggtcctgggggaactgtc

SEQ ID NO: 250084 - DNA, 23 bp, Artificial Sequence
  Description of Artificial Sequence: Synthetic oligonucleotide
gcctggtcctgggggaactgtcg

SEQ ID NO: 250085 - DNA, 23 bp, Artificial Sequence
  Description of Artificial Sequence: Synthetic oligonucleotide
cctggtcctgggggaactgtcgc

SEQ ID NO: 250086 - DNA, 23 bp, Artificial Sequence
  Description of Artificial Sequence: Synthetic oligonucleotide
ctggtcctgggggaactgtcgcg

SEQ ID NO: 250087 - DNA, 25 bp, Artificial Sequence
  Description of Artificial Sequence: Synthetic oligonucleotide
tggtcctgggggaactgtcgcgcat

SEQ ID NO: 250088 - DNA, 24 bp, Artificial Sequence
  Description of Artificial Sequence: Synthetic oligonucleotide
ggtcctgggggaactgtcgcgcat

SEQ ID NO: 250089 - DNA, 24 bp, Artificial Sequence
  Description of Artificial Sequence: Synthetic oligonucleotide
gtcctgggggaactgtcgcgcatc

SEQ ID NO: 250090 - DNA, 25 bp, Artificial Sequence
  Description of Artificial Sequence: Synthetic oligonucleotide
tcctgggggaactgtcgcgcatcct

SEQ ID NO: 250091 - DNA, 24 bp, Artificial Sequence
  Description of Artificial Sequence: Synthetic oligonucleotide
cctgggggaactgtcgcgcatcct

SEQ ID NO: 250092 - DNA, 24 bp, Artificial Sequence
  Description of Artificial Sequence: Synthetic oligonucleotide
ctgggggaactgtcgcgcatcctg

SEQ ID NO: 250093 - DNA, 25 bp, Artificial Sequence
  Description of Artificial Sequence: Synthetic oligonucleotide
tgggggaactgtcgcgcatcctggt

SEQ ID NO: 250094 - DNA, 24 bp, Artificial Sequence
  Description of Artificial Sequence: Synthetic oligonucleotide
gggggaactgtcgcgcatcctggt

SEQ ID NO: 250095 - DNA, 25 bp, Artificial Sequence
  Description of Artificial Sequence: Synthetic oligonucleotide
ggggaactgtcgcgcatcctggtca

SEQ ID NO: 250096 - DNA, 26 bp, Artificial Sequence
  Description of Artificial Sequence: Synthetic oligonucleotide
gggaactgtcgcgcatcctggtcaga

SEQ ID NO: 250097 - DNA, 27 bp, Artificial Sequence
  Description of Artificial Sequence: Synthetic oligonucleotide
ggaactgtcgcgcatcctggtcagaca

SEQ ID NO: 250098 - DNA, 27 bp, Artificial Sequence
  Description of Artificial Sequence: Synthetic oligonucleotide
gaactgtcgcgcatcctggtcagacac

SEQ ID NO: 250099 - DNA, 28 bp, Artificial Sequence
  Description of Artificial Sequence: Synthetic oligonucleotide
aactgtcgcgcatcctggtcagacacag

SEQ ID NO: 250100 - DNA, 27 bp, Artificial Sequence
  Description of Artificial Sequence: Synthetic oligonucleotide
actgtcgcgcatcctggtcagacacag

SEQ ID NO: 250101 - DNA, 26 bp, Artificial Sequence
  Description of Artificial Sequence: Synthetic oligonucleotide
ctgtcgcgcatcctggtcagacacag

SEQ ID NO: 250102 - DNA, 27 bp, Artificial Sequence
  Description of Artificial Sequence: Synthetic oligonucleotide
tgtcgcgcatcctggtcagacacagca

SEQ ID NO: 250103 - DNA, 27 bp, Artificial Sequence
  Description of Artificial Sequence: Synthetic oligonucleotide
gtcgcgcatcctggtcagacacagcat

SEQ ID NO: 250104 - DNA, 27 bp, Artificial Sequence
  Description of Artificial Sequence: Synthetic oligonucleotide
tcgcgcatcctggtcagacacagcatc

SEQ ID NO: 250105 - DNA, 26 bp, Artificial Sequence
  Description of Artificial Sequence: Synthetic oligonucleotide
cgcgcatcctggtcagacacagcatc

SEQ ID NO: 250106 - DNA, 26 bp, Artificial Sequence
  Description of Artificial Sequence: Synthetic oligonucleotide
gcgcatcctggtcagacacagcatcc

SEQ ID NO: 250107 - DNA, 26 bp, Artificial Sequence
  Description of Artificial Sequence: Synthetic oligonucleotide
cgcatcctggtcagacacagcatccg

SEQ ID NO: 250108 - DNA, 26 bp, Artificial Sequence
  Description of Artificial Sequence: Synthetic oligonucleotide
gcatcctggtcagacacagcatccgc

SEQ ID NO: 250109 - DNA, 27 bp, Artificial Sequence
  Description of Artificial Sequence: Synthetic oligonucleotide
catcctggtcagacacagcatccgcct

SEQ ID NO: 250110 - DNA, 27 bp, Artificial Sequence
  Description of Artificial Sequence: Synthetic oligonucleotide
atcctggtcagacacagcatccgcctg

SEQ ID NO: 250111 - DNA, 26 bp, Artificial Sequence
  Description of Artificial Sequence: Synthetic oligonucleotide
tcctggtcagacacagcatccgcctg

SEQ ID NO: 250112 - DNA, 25 bp, Artificial Sequence
  Description of Artificial Sequence: Synthetic oligonucleotide
cctggtcagacacagcatccgcctg

SEQ ID NO: 250113 - DNA, 26 bp, Artificial Sequence
  Description of Artificial Sequence: Synthetic oligonucleotide
ctggtcagacacagcatccgcctggt

SEQ ID NO: 250114 - DNA, 27 bp, Artificial Sequence
  Description of Artificial Sequence: Synthetic oligonucleotide
tggtcagacacagcatccgcctggtct

SEQ ID NO: 250115 - DNA, 26 bp, Artificial Sequence
  Description of Artificial Sequence: Synthetic oligonucleotide
ggtcagacacagcatccgcctggtct

SEQ ID NO: 250116 - DNA, 26 bp, Artificial Sequence
  Description of Artificial Sequence: Synthetic oligonucleotide
gtcagacacagcatccgcctggtctc

SEQ ID NO: 250117 - DNA, 26 bp, Artificial Sequence
  Description of Artificial Sequence: Synthetic oligonucleotide
tcagacacagcatccgcctggtctcg

SEQ ID NO: 250118 - DNA, 25 bp, Artificial Sequence
  Description of Artificial Sequence: Synthetic oligonucleotide
cagacacagcatccgcctggtctcg

SEQ ID NO: 250119 - DNA, 26 bp, Artificial Sequence
  Description of Artificial Sequence: Synthetic oligonucleotide
agacacagcatccgcctggtctcgga

SEQ ID NO: 250120 - DNA, 25 bp, Artificial Sequence
  Description of Artificial Sequence: Synthetic oligonucleotide
gacacagcatccgcctggtctcgga

SEQ ID NO: 250121 - DNA, 27 bp, Artificial Sequence
  Description of Artificial Sequence: Synthetic oligonucleotide
acacagcatccgcctggtctcggagtt

SEQ ID NO: 250122 - DNA, 26 bp, Artificial Sequence
  Description of Artificial Sequence: Synthetic oligonucleotide
cacagcatccgcctggtctcggagtt

SEQ ID NO: 250123 - DNA, 27 bp, Artificial Sequence
  Description of Artificial Sequence: Synthetic oligonucleotide
acagcatccgcctggtctcggagttca

SEQ ID NO: 250124 - DNA, 27 bp, Artificial Sequence
  Description of Artificial Sequence: Synthetic oligonucleotide
cagcatccgcctggtctcggagttcat

SEQ ID NO: 250125 - DNA, 27 bp, Artificial Sequence
  Description of Artificial Sequence: Synthetic oligonucleotide
agcatccgcctggtctcggagttcatc

SEQ ID NO: 250126 - DNA, 27 bp, Artificial Sequence
  Description of Artificial Sequence: Synthetic oligonucleotide
gcatccgcctggtctcggagttcatca

SEQ ID NO: 250127 - DNA, 27 bp, Artificial Sequence
  Description of Artificial Sequence: Synthetic oligonucleotide
catccgcctggtctcggagttcatcag

SEQ ID NO: 250128 - DNA, 27 bp, Artificial Sequence
  Description of Artificial Sequence: Synthetic oligonucleotide
atccgcctggtctcggagttcatcagc

SEQ ID NO: 250129 - DNA, 26 bp, Artificial Sequence
  Description of Artificial Sequence: Synthetic oligonucleotide
tccgcctggtctcggagttcatcagc

SEQ ID NO: 250130 - DNA, 25 bp, Artificial Sequence
  Description of Artificial Sequence: Synthetic oligonucleotide
ccgcctggtctcggagttcatcagc

SEQ ID NO: 250131 - DNA, 26 bp, Artificial Sequence
  Description of Artificial Sequence: Synthetic oligonucleotide
cgcctggtctcggagttcatcagcca

SEQ ID NO: 250132 - DNA, 27 bp, Artificial Sequence
  Description of Artificial Sequence: Synthetic oligonucleotide
gcctggtctcggagttcatcagccaga

SEQ ID NO: 250133 - DNA, 27 bp, Artificial Sequence
  Description of Artificial Sequence: Synthetic oligonucleotide
cctggtctcggagttcatcagccagac

SEQ ID NO: 250134 - DNA, 27 bp, Artificial Sequence
  Description of Artificial Sequence: Synthetic oligonucleotide
ctggtctcggagttcatcagccagacc

SEQ ID NO: 250135 - DNA, 28 bp, Artificial Sequence
  Description of Artificial Sequence: Synthetic oligonucleotide
tggtctcggagttcatcagccagacctc

SEQ ID NO: 250136 - DNA, 27 bp, Artificial Sequence
  Description of Artificial Sequence: Synthetic oligonucleotide
ggtctcggagttcatcagccagacctc

SEQ ID NO: 250137 - DNA, 28 bp, Artificial Sequence
  Description of Artificial Sequence: Synthetic oligonucleotide
gtctcggagttcatcagccagacctctg

SEQ ID NO: 250138 - DNA, 28 bp, Artificial Sequence
  Description of Artificial Sequence: Synthetic oligonucleotide
tctcggagttcatcagccagacctctgc

SEQ ID NO: 250139 - DNA, 27 bp, Artificial Sequence
  Description of Artificial Sequence: Synthetic oligonucleotide
ctcggagttcatcagccagacctctgc

SEQ ID NO: 250140 - DNA, 27 bp, Artificial Sequence
  Description of Artificial Sequence: Synthetic oligonucleotide
tcggagttcatcagccagacctctgcc

SEQ ID NO: 250141 - DNA, 27 bp, Artificial Sequence
  Description of Artificial Sequence: Synthetic oligonucleotide
cggagttcatcagccagacctctgcca

SEQ ID NO: 250142 - DNA, 28 bp, Artificial Sequence
  Description of Artificial Sequence: Synthetic oligonucleotide
ggagttcatcagccagacctctgccaag

SEQ ID NO: 250143 - DNA, 30 bp, Artificial Sequence
  Description of Artificial Sequence: Synthetic oligonucleotide
gagttcatcagccagacctctgccaagttc

SEQ ID NO: 250144 - DNA, 32 bp, Artificial Sequence
  Description of Artificial Sequence: Synthetic oligonucleotide
agttcatcagccagacctctgccaagttcttc

SEQ ID NO: 250145 - DNA, 31 bp, Artificial Sequence
  Description of Artificial Sequence: Synthetic oligonucleotide
gttcatcagccagacctctgccaagttcttc

SEQ ID NO: 250146 - DNA, 31 bp, Artificial Sequence
  Description of Artificial Sequence: Synthetic oligonucleotide
ttcatcagccagacctctgccaagttcttcg

SEQ ID NO: 250147 - DNA, 30 bp, Artificial Sequence
  Description of Artificial Sequence: Synthetic oligonucleotide
tcatcagccagacctctgccaagttcttcg

SEQ ID NO: 250148 - DNA, 29 bp, Artificial Sequence
  Description of Artificial Sequence: Synthetic oligonucleotide
catcagccagacctctgccaagttcttcg

SEQ ID NO: 250149 - DNA, 29 bp, Artificial Sequence
  Description of Artificial Sequence: Synthetic oligonucleotide
atcagccagacctctgccaagttcttcgc

SEQ ID NO: 250150 - DNA, 28 bp, Artificial Sequence
  Description of Artificial Sequence: Synthetic oligonucleotide
tcagccagacctctgccaagttcttcgc

SEQ ID NO: 250151 - DNA, 27 bp, Artificial Sequence
  Description of Artificial Sequence: Synthetic oligonucleotide
cagccagacctctgccaagttcttcgc

SEQ ID NO: 250152 - DNA, 27 bp, Artificial Sequence
  Description of Artificial Sequence: Synthetic oligonucleotide
agccagacctctgccaagttcttcgcg

SEQ ID NO: 250153 - DNA, 26 bp, Artificial Sequence
  Description of Artificial Sequence: Synthetic oligonucleotide
gccagacctctgccaagttcttcgcg

SEQ ID NO: 250154 - DNA, 26 bp, Artificial Sequence
  Description of Artificial Sequence: Synthetic oligonucleotide
ccagacctctgccaagttcttcgcgg

SEQ ID NO: 250155 - DNA, 26 bp, Artificial Sequence
  Description of Artificial Sequence: Synthetic oligonucleotide
cagacctctgccaagttcttcgcggg

SEQ ID NO: 250156 - DNA, 27 bp, Artificial Sequence
  Description of Artificial Sequence: Synthetic oligonucleotide
agacctctgccaagttcttcgcgggca

SEQ ID NO: 250157 - DNA, 26 bp, Artificial Sequence
  Description of Artificial Sequence: Synthetic oligonucleotide
gacctctgccaagttcttcgcgggca

SEQ ID NO: 250158 - DNA, 26 bp, Artificial Sequence
  Description of Artificial Sequence: Synthetic oligonucleotide
acctctgccaagttcttcgcgggcag

SEQ ID NO: 250159 - DNA, 25 bp, Artificial Sequence
  Description of Artificial Sequence: Synthetic oligonucleotide
cctctgccaagttcttcgcgggcag

SEQ ID NO: 250160 - DNA, 27 bp, Artificial Sequence
  Description of Artificial Sequence: Synthetic oligonucleotide
ctctgccaagttcttcgcgggcaggat

SEQ ID NO: 250161 - DNA, 27 bp, Artificial Sequence
  Description of Artificial Sequence: Synthetic oligonucleotide
tctgccaagttcttcgcgggcaggatc

SEQ ID NO: 250162 - DNA, 26 bp, Artificial Sequence
  Description of Artificial Sequence: Synthetic oligonucleotide
ctgccaagttcttcgcgggcaggatc

SEQ ID NO: 250163 - DNA, 27 bp, Artificial Sequence
  Description of Artificial Sequence: Synthetic oligonucleotide
tgccaagttcttcgcgggcaggatcct

SEQ ID NO: 250164 - DNA, 26 bp, Artificial Sequence
  Description of Artificial Sequence: Synthetic oligonucleotide
gccaagttcttcgcgggcaggatcct

SEQ ID NO: 250165 - DNA, 27 bp, Artificial Sequence
  Description of Artificial Sequence: Synthetic oligonucleotide
ccaagttcttcgcgggcaggatcctga

SEQ ID NO: 250166 - DNA, 28 bp, Artificial Sequence
  Description of Artificial Sequence: Synthetic oligonucleotide
caagttcttcgcgggcaggatcctgaac

SEQ ID NO: 250167 - DNA, 28 bp, Artificial Sequence
  Description of Artificial Sequence: Synthetic oligonucleotide
aagttcttcgcgggcaggatcctgaacc

SEQ ID NO: 250168 - DNA, 27 bp, Artificial Sequence
  Description of Artificial Sequence: Synthetic oligonucleotide
agttcttcgcgggcaggatcctgaacc

SEQ ID NO: 250169 - DNA, 27 bp, Artificial Sequence
  Description of Artificial Sequence: Synthetic oligonucleotide
gttcttcgcgggcaggatcctgaacca

SEQ ID NO: 250170 - DNA, 27 bp, Artificial Sequence
  Description of Artificial Sequence: Synthetic oligonucleotide
ttcttcgcgggcaggatcctgaaccac

SEQ ID NO: 250171 - DNA, 26 bp, Artificial Sequence
  Description of Artificial Sequence: Synthetic oligonucleotide
tcttcgcgggcaggatcctgaaccac

SEQ ID NO: 250172 - DNA, 25 bp, Artificial Sequence
  Description of Artificial Sequence: Synthetic oligonucleotide
cttcgcgggcaggatcctgaaccac

SEQ ID NO: 250173 - DNA, 26 bp, Artificial Sequence
  Description of Artificial Sequence: Synthetic oligonucleotide
ttcgcgggcaggatcctgaaccacct

SEQ ID NO: 250174 - DNA, 25 bp, Artificial Sequence
  Description of Artificial Sequence: Synthetic oligonucleotide
tcgcgggcaggatcctgaaccacct

SEQ ID NO: 250175 - DNA, 24 bp, Artificial Sequence
  Description of Artificial Sequence: Synthetic oligonucleotide
cgcgggcaggatcctgaaccacct

SEQ ID NO: 250176 - DNA, 24 bp, Artificial Sequence
  Description of Artificial Sequence: Synthetic oligonucleotide
gcgggcaggatcctgaaccacctg

SEQ ID NO: 250177 - DNA, 25 bp, Artificial Sequence
  Description of Artificial Sequence: Synthetic oligonucleotide
cgggcaggatcctgaaccacctggt

SEQ ID NO: 250178 - DNA, 25 bp, Artificial Sequence
  Description of Artificial Sequence: Synthetic oligonucleotide
gggcaggatcctgaaccacctggtg

SEQ ID NO: 250179 - DNA, 26 bp, Artificial Sequence
  Description of Artificial Sequence: Synthetic oligonucleotide
ggcaggatcctgaaccacctggtgct

SEQ ID NO: 250180 - DNA, 27 bp, Artificial Sequence
  Description of Artificial Sequence: Synthetic oligonucleotide
gcaggatcctgaaccacctggtgctgt

SEQ ID NO: 250181 - DNA, 29 bp, Artificial Sequence
  Description of Artificial Sequence: Synthetic oligonucleotide
caggatcctgaaccacctggtgctgtttg

SEQ ID NO: 250182 - DNA, 30 bp, Artificial Sequence
  Description of Artificial Sequence: Synthetic oligonucleotide
aggatcctgaaccacctggtgctgtttgac

SEQ ID NO: 250183 - DNA, 29 bp, Artificial Sequence
  Description of Artificial Sequence: Synthetic oligonucleotide
ggatcctgaaccacctggtgctgtttgac

SEQ ID NO: 250184 - DNA, 31 bp, Artificial Sequence
  Description of Artificial Sequence: Synthetic oligonucleotide
gatcctgaaccacctggtgctgtttgacaac

SEQ ID NO: 250185 - DNA, 31 bp, Artificial Sequence
  Description of Artificial Sequence: Synthetic oligonucleotide
atcctgaaccacctggtgctgtttgacaacc

SEQ ID NO: 250186 - DNA, 30 bp, Artificial Sequence
  Description of Artificial Sequence: Synthetic oligonucleotide
tcctgaaccacctggtgctgtttgacaacc

SEQ ID NO: 250187 - DNA, 29 bp, Artificial Sequence
  Description of Artificial Sequence: Synthetic oligonucleotide
cctgaaccacctggtgctgtttgacaacc

SEQ ID NO: 250188 - DNA, 30 bp, Artificial Sequence
  Description of Artificial Sequence: Synthetic oligonucleotide
ctgaaccacctggtgctgtttgacaaccag

SEQ ID NO: 250189 - DNA, 31 bp, Artificial Sequence
  Description of Artificial Sequence: Synthetic oligonucleotide
tgaaccacctggtgctgtttgacaaccagac

SEQ ID NO: 250190 - DNA, 30 bp, Artificial Sequence
  Description of Artificial Sequence: Synthetic oligonucleotide
gaaccacctggtgctgtttgacaaccagac

SEQ ID NO: 250191 - DNA, 30 bp, Artificial Sequence
  Description of Artificial Sequence: Synthetic oligonucleotide
aaccacctggtgctgtttgacaaccagacc

SEQ ID NO: 250192 - DNA, 29 bp, Artificial Sequence
  Description of Artificial Sequence: Synthetic oligonucleotide
accacctggtgctgtttgacaaccagacc

SEQ ID NO: 250193 - DNA, 28 bp, Artificial Sequence
  Description of Artificial Sequence: Synthetic oligonucleotide
ccacctggtgctgtttgacaaccagacc

SEQ ID NO: 250194 - DNA, 28 bp, Artificial Sequence
  Description of Artificial Sequence: Synthetic oligonucleotide
cacctggtgctgtttgacaaccagaccc

SEQ ID NO: 250195 - DNA, 29 bp, Artificial Sequence
  Description of Artificial Sequence: Synthetic oligonucleotide
acctggtgctgtttgacaaccagaccctg

SEQ ID NO: 250196 - DNA, 28 bp, Artificial Sequence
  Description of Artificial Sequence: Synthetic oligonucleotide
cctggtgctgtttgacaaccagaccctg

SEQ ID NO: 250197 - DNA, 28 bp, Artificial Sequence
  Description of Artificial Sequence: Synthetic oligonucleotide
ctggtgctgtttgacaaccagaccctgg

SEQ ID NO: 250198 - DNA, 28 bp, Artificial Sequence
  Description of Artificial Sequence: Synthetic oligonucleotide
tggtgctgtttgacaaccagaccctggc

SEQ ID NO: 250199 - DNA, 27 bp, Artificial Sequence
  Description of Artificial Sequence: Synthetic oligonucleotide
ggtgctgtttgacaaccagaccctggc

SEQ ID NO: 250200 - DNA, 28 bp, Artificial Sequence
  Description of Artificial Sequence: Synthetic oligonucleotide
gtgctgtttgacaaccagaccctggctg

SEQ ID NO: 250201 - DNA, 28 bp, Artificial Sequence
  Description of Artificial Sequence: Synthetic oligonucleotide
tgctgtttgacaaccagaccctggctgc

SEQ ID NO: 250202 - DNA, 27 bp, Artificial Sequence
  Description of Artificial Sequence: Synthetic oligonucleotide
gctgtttgacaaccagaccctggctgc

SEQ ID NO: 250203 - DNA, 27 bp, Artificial Sequence
  Description of Artificial Sequence: Synthetic oligonucleotide
ctgtttgacaaccagaccctggctgcg

SEQ ID NO: 250204 - DNA, 27 bp, Artificial Sequence
  Description of Artificial Sequence: Synthetic oligonucleotide
tgtttgacaaccagaccctggctgcgg

SEQ ID NO: 250205 - DNA, 27 bp, Artificial Sequence
  Description of Artificial Sequence: Synthetic oligonucleotide
gtttgacaaccagaccctggctgcgga

SEQ ID NO: 250206 - DNA, 27 bp, Artificial Sequence
  Description of Artificial Sequence: Synthetic oligonucleotide
tttgacaaccagaccctggctgcggac

SEQ ID NO: 250207 - DNA, 26 bp, Artificial Sequence
  Description of Artificial Sequence: Synthetic oligonucleotide
ttgacaaccagaccctggctgcggac

SEQ ID NO: 250208 - DNA, 25 bp, Artificial Sequence
  Description of Artificial Sequence: Synthetic oligonucleotide
tgacaaccagaccctggctgcggac

SEQ ID NO: 250209 - DNA, 24 bp, Artificial Sequence
  Description of Artificial Sequence: Synthetic oligonucleotide
gacaaccagaccctggctgcggac

SEQ ID NO: 250210 - DNA, 24 bp, Artificial Sequence
  Description of Artificial Sequence: Synthetic oligonucleotide
acaaccagaccctggctgcggacc

SEQ ID NO: 250211 - DNA, 23 bp, Artificial Sequence
  Description of Artificial Sequence: Synthetic oligonucleotide
caaccagaccctggctgcggacc

SEQ ID NO: 250212 - DNA, 23 bp, Artificial Sequence
  Description of Artificial Sequence: Synthetic oligonucleotide
aaccagaccctggctgcggaccg

SEQ ID NO: 250213 - DNA, 22 bp, Artificial Sequence
  Description of Artificial Sequence: Synthetic oligonucleotide
accagaccctggctgcggaccg

SEQ ID NO: 250214 - DNA, 21 bp, Artificial Sequence
  Description of Artificial Sequence: Synthetic oligonucleotide
ccagaccctggctgcggaccg

SEQ ID NO: 250215 - DNA, 21 bp, Artificial Sequence
  Description of Artificial Sequence: Synthetic oligonucleotide
cagaccctggctgcggaccgg

SEQ ID NO: 250216 - DNA, 22 bp, Artificial Sequence
  Description of Artificial Sequence: Synthetic oligonucleotide
agaccctggctgcggaccggga

SEQ ID NO: 250217 - DNA, 21 bp, Artificial Sequence
  Description of Artificial Sequence: Synthetic oligonucleotide
gaccctggctgcggaccggga

SEQ ID NO: 250218 - DNA, 21 bp, Artificial Sequence
  Description of Artificial Sequence: Synthetic oligonucleotide
accctggctgcggaccgggag

SEQ ID NO: 250219 - DNA, 20 bp, Artificial Sequence
  Description of Artificial Sequence: Synthetic oligonucleotide
ccctggctgcggaccgggag

SEQ ID NO: 250220 - DNA, 21 bp, Artificial Sequence
  Description of Artificial Sequence: Synthetic oligonucleotide
cctggctgcggaccgggagca

SEQ ID NO: 250221 - DNA, 21 bp, Artificial Sequence
  Description of Artificial Sequence: Synthetic oligonucleotide
ctggctgcggaccgggagcac

SEQ ID NO: 250222 - DNA, 23 bp, Artificial Sequence
  Description of Artificial Sequence: Synthetic oligonucleotide
tggctgcggaccgggagcaccta

SEQ ID NO: 250223 - DNA, 22 bp, Artificial Sequence
  Description of Artificial Sequence: Synthetic oligonucleotide
ggctgcggaccgggagcaccta

SEQ ID NO: 250224 - DNA, 22 bp, Artificial Sequence
  Description of Artificial Sequence: Synthetic oligonucleotide
gctgcggaccgggagcacctag

SEQ ID NO: 250225 - DNA, 22 bp, Artificial Sequence
  Description of Artificial Sequence: Synthetic oligonucleotide
ctgcggaccgggagcacctagc

SEQ ID NO: 250226 - DNA, 22 bp, Artificial Sequence
  Description of Artificial Sequence: Synthetic oligonucleotide
tgcggaccgggagcacctagcg

SEQ ID NO: 250227 - DNA, 21 bp, Artificial Sequence
  Description of Artificial Sequence: Synthetic oligonucleotide
gcggaccgggagcacctagcg

SEQ ID NO: 250228 - DNA, 21 bp, Artificial Sequence
  Description of Artificial Sequence: Synthetic oligonucleotide
cggaccgggagcacctagcgg

SEQ ID NO: 250229 - DNA, 21 bp, Artificial Sequence
  Description of Artificial Sequence: Synthetic oligonucleotide
ggaccgggagcacctagcggg

SEQ ID NO: 250230 - DNA, 24 bp, Artificial Sequence
  Description of Artificial Sequence: Synthetic oligonucleotide
gaccgggagcacctagcggggttt

SEQ ID NO: 250231 - DNA, 24 bp, Artificial Sequence
  Description of Artificial Sequence: Synthetic oligonucleotide
accgggagcacctagcggggtttg

SEQ ID NO: 250232 - DNA, 23 bp, Artificial Sequence
  Description of Artificial Sequence: Synthetic oligonucleotide
ccgggagcacctagcggggtttg

SEQ ID NO: 250233 - DNA, 23 bp, Artificial Sequence
  Description of Artificial Sequence: Synthetic oligonucleotide
cgggagcacctagcggggtttgg

SEQ ID NO: 250234 - DNA, 23 bp, Artificial Sequence
  Description of Artificial Sequence: Synthetic oligonucleotide
gggagcacctagcggggtttggg

SEQ ID NO: 250235 - DNA, 24 bp, Artificial Sequence
  Description of Artificial Sequence: Synthetic oligonucleotide
ggagcacctagcggggtttgggga

SEQ ID NO: 250236 - DNA, 24 bp, Artificial Sequence
  Description of Artificial Sequence: Synthetic oligonucleotide
gagcacctagcggggtttggggag

SEQ ID NO: 250237 - DNA, 24 bp, Artificial Sequence
  Description of Artificial Sequence: Synthetic oligonucleotide
agcacctagcggggtttggggagc

SEQ ID NO: 250238 - DNA, 23 bp, Artificial Sequence
  Description of Artificial Sequence: Synthetic oligonucleotide
gcacctagcggggtttggggagc

SEQ ID NO: 250239 - DNA, 24 bp, Artificial Sequence
  Description of Artificial Sequence: Synthetic oligonucleotide
cacctagcggggtttggggagcca

SEQ ID NO: 250240 - DNA, 24 bp, Artificial Sequence
  Description of Artificial Sequence: Synthetic oligonucleotide
acctagcggggtttggggagccag

SEQ ID NO: 250241 - DNA, 23 bp, Artificial Sequence
  Description of Artificial Sequence: Synthetic oligonucleotide
cctagcggggtttggggagccag

SEQ ID NO: 250242 - DNA, 24 bp, Artificial Sequence
  Description of Artificial Sequence: Synthetic oligonucleotide
ctagcggggtttggggagccagct

SEQ ID NO: 250243 - DNA, 24 bp, Artificial Sequence
  Description of Artificial Sequence: Synthetic oligonucleotide
tagcggggtttggggagccagctc

SEQ ID NO: 250244 - DNA, 23 bp, Artificial Sequence
  Description of Artificial Sequence: Synthetic oligonucleotide
agcggggtttggggagccagctc

SEQ ID NO: 250245 - DNA, 22 bp, Artificial Sequence
  Description of Artificial Sequence: Synthetic oligonucleotide
gcggggtttggggagccagctc

SEQ ID NO: 250246 - DNA, 22 bp, Artificial Sequence
  Description of Artificial Sequence: Synthetic oligonucleotide
cggggtttggggagccagctcc

SEQ ID NO: 250247 - DNA, 22 bp, Artificial Sequence
  Description of Artificial Sequence: Synthetic oligonucleotide
ggggtttggggagccagctccc

SEQ ID NO: 250248 - DNA, 22 bp, Artificial Sequence
  Description of Artificial Sequence: Synthetic oligonucleotide
gggtttggggagccagctcccc

SEQ ID NO: 250249 - DNA, 22 bp, Artificial Sequence
  Description of Artificial Sequence: Synthetic oligonucleotide
ggtttggggagccagctccccc

SEQ ID NO: 250250 - DNA, 24 bp, Artificial Sequence
  Description of Artificial Sequence: Synthetic oligonucleotide
gtttggggagccagctcccccctt

SEQ ID NO: 250251 - DNA, 24 bp, Artificial Sequence
  Description of Artificial Sequence: Synthetic oligonucleotide
tttggggagccagctccccccttc

SEQ ID NO: 250252 - DNA, 23 bp, Artificial Sequence
  Description of Artificial Sequence: Synthetic oligonucleotide
ttggggagccagctccccccttc

SEQ ID NO: 250253 - DNA, 22 bp, Artificial Sequence
  Description of Artificial Sequence: Synthetic oligonucleotide
tggggagccagctccccccttc

SEQ ID NO: 250254 - DNA, 21 bp, Artificial Sequence
  Description of Artificial Sequence: Synthetic oligonucleotide
ggggagccagctccccccttc

SEQ ID NO: 250255 - DNA, 21 bp, Artificial Sequence
  Description of Artificial Sequence: Synthetic oligonucleotide
gggagccagctccccccttcc

SEQ ID NO: 250256 - DNA, 21 bp, Artificial Sequence
  Description of Artificial Sequence: Synthetic oligonucleotide
ggagccagctccccccttccg

SEQ ID NO: 250257 - DNA, 21 bp, Artificial Sequence
  Description of Artificial Sequence: Synthetic oligonucleotide
gagccagctccccccttccgg

SEQ ID NO: 250258 - DNA, 21 bp, Artificial Sequence
  Description of Artificial Sequence: Synthetic oligonucleotide
agccagctccccccttccggg

SEQ ID NO: 250259 - DNA, 20 bp, Artificial Sequence
  Description of Artificial Sequence: Synthetic oligonucleotide
gccagctccccccttccggg

SEQ ID NO: 250260 - DNA, 20 bp, Artificial Sequence
  Description of Artificial Sequence: Synthetic oligonucleotide
ccagctccccccttccgggg

SEQ ID NO: 250261 - DNA, 20 bp, Artificial Sequence
  Description of Artificial Sequence: Synthetic oligonucleotide
cagctccccccttccggggc

SEQ ID NO: 250262 - DNA, 21 bp, Artificial Sequence
  Description of Artificial Sequence: Synthetic oligonucleotide
agctccccccttccggggcca

SEQ ID NO: 250263 - DNA, 20 bp, Artificial Sequence
  Description of Artificial Sequence: Synthetic oligonucleotide
gctccccccttccggggcca

SEQ ID NO: 250264 - DNA, 20 bp, Artificial Sequence
  Description of Artificial Sequence: Synthetic oligonucleotide
ctccccccttccggggccag

SEQ ID NO: 250265 - DNA, 21 bp, Artificial Sequence
  Description of Artificial Sequence: Synthetic oligonucleotide
tccccccttccggggccaggt

SEQ ID NO: 250266 - DNA, 20 bp, Artificial Sequence
  Description of Artificial Sequence: Synthetic oligonucleotide
ccccccttccggggccaggt

SEQ ID NO: 250267 - DNA, 20 bp, Artificial Sequence
  Description of Artificial Sequence: Synthetic oligonucleotide
cccccttccggggccaggtg

SEQ ID NO: 250268 - DNA, 21 bp, Artificial Sequence
  Description of Artificial Sequence: Synthetic oligonucleotide
ccccttccggggccaggtgct

SEQ ID NO: 250269 - DNA, 23 bp, Artificial Sequence
  Description of Artificial Sequence: Synthetic oligonucleotide
cccttccggggccaggtgctgat

SEQ ID NO: 250270 - DNA, 23 bp, Artificial Sequence
  Description of Artificial Sequence: Synthetic oligonucleotide
ccttccggggccaggtgctgatc

SEQ ID NO: 250271 - DNA, 24 bp, Artificial Sequence
  Description of Artificial Sequence: Synthetic oligonucleotide
cttccggggccaggtgctgatcgt

SEQ ID NO: 250272 - DNA, 24 bp, Artificial Sequence
  Description of Artificial Sequence: Synthetic oligonucleotide
ttccggggccaggtgctgatcgtg

SEQ ID NO: 250273 - DNA, 23 bp, Artificial Sequence
  Description of Artificial Sequence: Synthetic oligonucleotide
tccggggccaggtgctgatcgtg

SEQ ID NO: 250274 - DNA, 22 bp, Artificial Sequence
  Description of Artificial Sequence: Synthetic oligonucleotide
ccggggccaggtgctgatcgtg

SEQ ID NO: 250275 - DNA, 23 bp, Artificial Sequence
  Description of Artificial Sequence: Synthetic oligonucleotide
cggggccaggtgctgatcgtggt

SEQ ID NO: 250276 - DNA, 23 bp, Artificial Sequence
  Description of Artificial Sequence: Synthetic oligonucleotide
ggggccaggtgctgatcgtggtg

SEQ ID NO: 250277 - DNA, 24 bp, Artificial Sequence
  Description of Artificial Sequence: Synthetic oligonucleotide
gggccaggtgctgatcgtggtgga

SEQ ID NO: 250278 - DNA, 24 bp, Artificial Sequence
  Description of Artificial Sequence: Synthetic oligonucleotide
ggccaggtgctgatcgtggtggag

SEQ ID NO: 250279 - DNA, 25 bp, Artificial Sequence
  Description of Artificial Sequence: Synthetic oligonucleotide
gccaggtgctgatcgtggtggagga

SEQ ID NO: 250280 - DNA, 25 bp, Artificial Sequence
  Description of Artificial Sequence: Synthetic oligonucleotide
ccaggtgctgatcgtggtggaggac

SEQ ID NO: 250281 - DNA, 26 bp, Artificial Sequence
  Description of Artificial Sequence: Synthetic oligonucleotide
caggtgctgatcgtggtggaggacgt

SEQ ID NO: 250282 - DNA, 26 bp, Artificial Sequence
  Description of Artificial Sequence: Synthetic oligonucleotide
aggtgctgatcgtggtggaggacgtg

SEQ ID NO: 250283 - DNA, 25 bp, Artificial Sequence
  Description of Artificial Sequence: Synthetic oligonucleotide
ggtgctgatcgtggtggaggacgtg

SEQ ID NO: 250284 - DNA, 25 bp, Artificial Sequence
  Description of Artificial Sequence: Synthetic oligonucleotide
gtgctgatcgtggtggaggacgtgg

SEQ ID NO: 250285 - DNA, 25 bp, Artificial Sequence
  Description of Artificial Sequence: Synthetic oligonucleotide
tgctgatcgtggtggaggacgtggc

SEQ ID NO: 250286 - DNA, 24 bp, Artificial Sequence
  Description of Artificial Sequence: Synthetic oligonucleotide
gctgatcgtggtggaggacgtggc

SEQ ID NO: 250287 - DNA, 24 bp, Artificial Sequence
  Description of Artificial Sequence: Synthetic oligonucleotide
ctgatcgtggtggaggacgtggcc

SEQ ID NO: 250288 - DNA, 24 bp, Artificial Sequence
  Description of Artificial Sequence: Synthetic oligonucleotide
tgatcgtggtggaggacgtggccg

SEQ ID NO: 250289 - DNA, 23 bp, Artificial Sequence
  Description of Artificial Sequence: Synthetic oligonucleotide
gatcgtggtggaggacgtggccg

SEQ ID NO: 250290 - DNA, 23 bp, Artificial Sequence
  Description of Artificial Sequence: Synthetic oligonucleotide
atcgtggtggaggacgtggccgc

SEQ ID NO: 250291 - DNA, 22 bp, Artificial Sequence
  Description of Artificial Sequence: Synthetic oligonucleotide
tcgtggtggaggacgtggccgc

SEQ ID NO: 250292 - DNA, 21 bp, Artificial Sequence
  Description of Artificial Sequence: Synthetic oligonucleotide
cgtggtggaggacgtggccgc

SEQ ID NO: 250293 - DNA, 21 bp, Artificial Sequence
  Description of Artificial Sequence: Synthetic oligonucleotide
gtggtggaggacgtggccgcc

SEQ ID NO: 250294 - DNA, 22 bp, Artificial Sequence
  Description of Artificial Sequence: Synthetic oligonucleotide
tggtggaggacgtggccgccga

SEQ ID NO: 250295 - DNA, 21 bp, Artificial Sequence
  Description of Artificial Sequence: Synthetic oligonucleotide
ggtggaggacgtggccgccga

SEQ ID NO: 250296 - DNA, 24 bp, Artificial Sequence
  Description of Artificial Sequence: Synthetic oligonucleotide
gtggaggacgtggccgccgacaat

SEQ ID NO: 250297 - DNA, 25 bp, Artificial Sequence
  Description of Artificial Sequence: Synthetic oligonucleotide
tggaggacgtggccgccgacaatca

SEQ ID NO: 250298 - DNA, 24 bp, Artificial Sequence
  Description of Artificial Sequence: Synthetic oligonucleotide
ggaggacgtggccgccgacaatca

SEQ ID NO: 250299 - DNA, 24 bp, Artificial Sequence
  Description of Artificial Sequence: Synthetic oligonucleotide
gaggacgtggccgccgacaatcag

SEQ ID NO: 250300 - DNA, 25 bp, Artificial Sequence
  Description of Artificial Sequence: Synthetic oligonucleotide
aggacgtggccgccgacaatcagca

SEQ ID NO: 250301 - DNA, 24 bp, Artificial Sequence
  Description of Artificial Sequence: Synthetic oligonucleotide
ggacgtggccgccgacaatcagca

SEQ ID NO: 250302 - DNA, 24 bp, Artificial Sequence
  Description of Artificial Sequence: Synthetic oligonucleotide
gacgtggccgccgacaatcagcac

SEQ ID NO: 250303 - DNA, 25 bp, Artificial Sequence
  Description of Artificial Sequence: Synthetic oligonucleotide
acgtggccgccgacaatcagcacgt

SEQ ID NO: 250304 - DNA, 24 bp, Artificial Sequence
  Description of Artificial Sequence: Synthetic oligonucleotide
cgtggccgccgacaatcagcacgt

SEQ ID NO: 250305 - DNA, 24 bp, Artificial Sequence
  Description of Artificial Sequence: Synthetic oligonucleotide
gtggccgccgacaatcagcacgtg

SEQ ID NO: 250306 - DNA, 25 bp, Artificial Sequence
  Description of Artificial Sequence: Synthetic oligonucleotide
tggccgccgacaatcagcacgtgca

SEQ ID NO: 250307 - DNA, 24 bp, Artificial Sequence
  Description of Artificial Sequence: Synthetic oligonucleotide
ggccgccgacaatcagcacgtgca

SEQ ID NO: 250308 - DNA, 24 bp, Artificial Sequence
  Description of Artificial Sequence: Synthetic oligonucleotide
gccgccgacaatcagcacgtgcag

SEQ ID NO: 250309 - DNA, 25 bp, Artificial Sequence
  Description of Artificial Sequence: Synthetic oligonucleotide
ccgccgacaatcagcacgtgcagca

SEQ ID NO: 250310 - DNA, 27 bp, Artificial Sequence
  Description of Artificial Sequence: Synthetic oligonucleotide
cgccgacaatcagcacgtgcagcagta

SEQ ID NO: 250311 - DNA, 27 bp, Artificial Sequence
  Description of Artificial Sequence: Synthetic oligonucleotide
gccgacaatcagcacgtgcagcagtac

SEQ ID NO: 250312 - DNA, 30 bp, Artificial Sequence
  Description of Artificial Sequence: Synthetic oligonucleotide
ccgacaatcagcacgtgcagcagtacttag

SEQ ID NO: 250313 - DNA, 30 bp, Artificial Sequence
  Description of Artificial Sequence: Synthetic oligonucleotide
cgacaatcagcacgtgcagcagtacttagg

SEQ ID NO: 250314 - DNA, 31 bp, Artificial Sequence
  Description of Artificial Sequence: Synthetic oligonucleotide
gacaatcagcacgtgcagcagtacttaggac

SEQ ID NO: 250315 - DNA, 32 bp, Artificial Sequence
  Description of Artificial Sequence: Synthetic oligonucleotide
acaatcagcacgtgcagcagtacttaggactc

SEQ ID NO: 250316 - DNA, 31 bp, Artificial Sequence
  Description of Artificial Sequence: Synthetic oligonucleotide
caatcagcacgtgcagcagtacttaggactc

SEQ ID NO: 250317 - DNA, 33 bp, Artificial Sequence
  Description of Artificial Sequence: Synthetic oligonucleotide
aatcagcacgtgcagcagtacttaggactcaag

SEQ ID NO: 250318 - DNA, 32 bp, Artificial Sequence
  Description of Artificial Sequence: Synthetic oligonucleotide
atcagcacgtgcagcagtacttaggactcaag

SEQ ID NO: 250319 - DNA, 31 bp, Artificial Sequence
  Description of Artificial Sequence: Synthetic oligonucleotide
tcagcacgtgcagcagtacttaggactcaag

SEQ ID NO: 250320 - DNA, 30 bp, Artificial Sequence
  Description of Artificial Sequence: Synthetic oligonucleotide
cagcacgtgcagcagtacttaggactcaag

SEQ ID NO: 250321 - DNA, 30 bp, Artificial Sequence
  Description of Artificial Sequence: Synthetic oligonucleotide
agcacgtgcagcagtacttaggactcaagc

SEQ ID NO: 250322 - DNA, 29 bp, Artificial Sequence
  Description of Artificial Sequence: Synthetic oligonucleotide
gcacgtgcagcagtacttaggactcaagc

SEQ ID NO: 250323 - DNA, 29 bp, Artificial Sequence
  Description of Artificial Sequence: Synthetic oligonucleotide
cacgtgcagcagtacttaggactcaagcc

SEQ ID NO: 250324 - DNA, 30 bp, Artificial Sequence
  Description of Artificial Sequence: Synthetic oligonucleotide
acgtgcagcagtacttaggactcaagcctg

SEQ ID NO: 250325 - DNA, 29 bp, Artificial Sequence
  Description of Artificial Sequence: Synthetic oligonucleotide
cgtgcagcagtacttaggactcaagcctg

SEQ ID NO: 250326 - DNA, 30 bp, Artificial Sequence
  Description of Artificial Sequence: Synthetic oligonucleotide
gtgcagcagtacttaggactcaagcctgag

SEQ ID NO: 250327 - DNA, 30 bp, Artificial Sequence
  Description of Artificial Sequence: Synthetic oligonucleotide
tgcagcagtacttaggactcaagcctgagg

SEQ ID NO: 250328 - DNA, 29 bp, Artificial Sequence
  Description of Artificial Sequence: Synthetic oligonucleotide
gcagcagtacttaggactcaagcctgagg

SEQ ID NO: 250329 - DNA, 29 bp, Artificial Sequence
  Description of Artificial Sequence: Synthetic oligonucleotide
cagcagtacttaggactcaagcctgaggc

SEQ ID NO: 250330 - DNA, 30 bp, Artificial Sequence
  Description of Artificial Sequence: Synthetic oligonucleotide
agcagtacttaggactcaagcctgaggcag

SEQ ID NO: 250331 - DNA, 29 bp, Artificial Sequence
  Description of Artificial Sequence: Synthetic oligonucleotide
gcagtacttaggactcaagcctgaggcag

SEQ ID NO: 250332 - DNA, 29 bp, Artificial Sequence
  Description of Artificial Sequence: Synthetic oligonucleotide
cagtacttaggactcaagcctgaggcagg

SEQ ID NO: 250333 - DNA, 29 bp, Artificial Sequence
  Description of Artificial Sequence: Synthetic oligonucleotide
agtacttaggactcaagcctgaggcaggc

SEQ ID NO: 250334 - DNA, 28 bp, Artificial Sequence
  Description of Artificial Sequence: Synthetic oligonucleotide
gtacttaggactcaagcctgaggcaggc

SEQ ID NO: 250335 - DNA, 28 bp, Artificial Sequence
  Description of Artificial Sequence: Synthetic oligonucleotide
tacttaggactcaagcctgaggcaggcc

SEQ ID NO: 250336 - DNA, 27 bp, Artificial Sequence
  Description of Artificial Sequence: Synthetic oligonucleotide
acttaggactcaagcctgaggcaggcc

SEQ ID NO: 250337 - DNA, 26 bp, Artificial Sequence
  Description of Artificial Sequence: Synthetic oligonucleotide
cttaggactcaagcctgaggcaggcc

SEQ ID NO: 250338 - DNA, 26 bp, Artificial Sequence
  Description of Artificial Sequence: Synthetic oligonucleotide
ttaggactcaagcctgaggcaggccc

SEQ ID NO: 250339 - DNA, 25 bp, Artificial Sequence
  Description of Artificial Sequence: Synthetic oligonucleotide
taggactcaagcctgaggcaggccc

SEQ ID NO: 250340 - DNA, 24 bp, Artificial Sequence
  Description of Artificial Sequence: Synthetic oligonucleotide
aggactcaagcctgaggcaggccc

SEQ ID NO: 250341 - DNA, 23 bp, Artificial Sequence
  Description of Artificial Sequence: Synthetic oligonucleotide
ggactcaagcctgaggcaggccc

SEQ ID NO: 250342 - DNA, 24 bp, Artificial Sequence
  Description of Artificial Sequence: Synthetic oligonucleotide
gactcaagcctgaggcaggcccca

SEQ ID NO: 250343 - DNA, 25 bp, Artificial Sequence
  Description of Artificial Sequence: Synthetic oligonucleotide
actcaagcctgaggcaggccccact

SEQ ID NO: 250344 - DNA, 24 bp, Artificial Sequence
  Description of Artificial Sequence: Synthetic oligonucleotide
ctcaagcctgaggcaggccccact

SEQ ID NO: 250345 - DNA, 25 bp, Artificial Sequence
  Description of Artificial Sequence: Synthetic oligonucleotide
tcaagcctgaggcaggccccactct

SEQ ID NO: 250346 - DNA, 24 bp, Artificial Sequence
  Description of Artificial Sequence: Synthetic oligonucleotide
caagcctgaggcaggccccactct

SEQ ID NO: 250347 - DNA, 24 bp, Artificial Sequence
  Description of Artificial Sequence: Synthetic oligonucleotide
aagcctgaggcaggccccactctc

SEQ ID NO: 250348 - DNA, 23 bp, Artificial Sequence
  Description of Artificial Sequence: Synthetic oligonucleotide
agcctgaggcaggccccactctc

SEQ ID NO: 250349 - DNA, 22 bp, Artificial Sequence
  Description of Artificial Sequence: Synthetic oligonucleotide
gcctgaggcaggccccactctc

SEQ ID NO: 250350 - DNA, 22 bp, Artificial Sequence
  Description of Artificial Sequence: Synthetic oligonucleotide
cctgaggcaggccccactctcc

SEQ ID NO: 250351 - DNA, 22 bp, Artificial Sequence
  Description of Artificial Sequence: Synthetic oligonucleotide
ctgaggcaggccccactctccg

SEQ ID NO: 250352 - DNA, 24 bp, Artificial Sequence
  Description of Artificial Sequence: Synthetic oligonucleotide
tgaggcaggccccactctccgctt

SEQ ID NO: 250353 - DNA, 23 bp, Artificial Sequence
  Description of Artificial Sequence: Synthetic oligonucleotide
gaggcaggccccactctccgctt

SEQ ID NO: 250354 - DNA, 23 bp, Artificial Sequence
  Description of Artificial Sequence: Synthetic oligonucleotide
aggcaggccccactctccgcttg

SEQ ID NO: 250355 - DNA, 22 bp, Artificial Sequence
  Description of Artificial Sequence: Synthetic oligonucleotide
ggcaggccccactctccgcttg

SEQ ID NO: 250356 - DNA, 23 bp, Artificial Sequence
  Description of Artificial Sequence: Synthetic oligonucleotide
gcaggccccactctccgcttggt

SEQ ID NO: 250357 - DNA, 25 bp, Artificial Sequence
  Description of Artificial Sequence: Synthetic oligonucleotide
caggccccactctccgcttggtcta

SEQ ID NO: 250358 - DNA, 25 bp, Artificial Sequence
  Description of Artificial Sequence: Synthetic oligonucleotide
aggccccactctccgcttggtctac

SEQ ID NO: 250359 - DNA, 24 bp, Artificial Sequence
  Description of Artificial Sequence: Synthetic oligonucleotide
ggccccactctccgcttggtctac

SEQ ID NO: 250360 - DNA, 26 bp, Artificial Sequence
  Description of Artificial Sequence: Synthetic oligonucleotide
gccccactctccgcttggtctacctt

SEQ ID NO: 250361 - DNA, 27 bp, Artificial Sequence
  Description of Artificial Sequence: Synthetic oligonucleotide
ccccactctccgcttggtctaccttga

SEQ ID NO: 250362 - DNA, 29 bp, Artificial Sequence
  Description of Artificial Sequence: Synthetic oligonucleotide
cccactctccgcttggtctaccttgaaag

SEQ ID NO: 250363 - DNA, 29 bp, Artificial Sequence
  Description of Artificial Sequence: Synthetic oligonucleotide
ccactctccgcttggtctaccttgaaagc

SEQ ID NO: 250364 - DNA, 30 bp, Artificial Sequence
  Description of Artificial Sequence: Synthetic oligonucleotide
cactctccgcttggtctaccttgaaagcac

SEQ ID NO: 250365 - DNA, 33 bp, Artificial Sequence
  Description of Artificial Sequence: Synthetic oligonucleotide
actctccgcttggtctaccttgaaagcactaag

SEQ ID NO: 250366 - DNA, 32 bp, Artificial Sequence
  Description of Artificial Sequence: Synthetic oligonucleotide
ctctccgcttggtctaccttgaaagcactaag

SEQ ID NO: 250367 - DNA, 34 bp, Artificial Sequence
  Description of Artificial Sequence: Synthetic oligonucleotide
tctccgcttggtctaccttgaaagcactaagaac

SEQ ID NO: 250368 - DNA, 33 bp, Artificial Sequence
  Description of Artificial Sequence: Synthetic oligonucleotide
ctccgcttggtctaccttgaaagcactaagaac

SEQ ID NO: 250369 - DNA, 36 bp, Artificial Sequence
  Description of Artificial Sequence: Synthetic oligonucleotide
tccgcttggtctaccttgaaagcactaagaactatg

SEQ ID NO: 250370 - DNA, 35 bp, Artificial Sequence
  Description of Artificial Sequence: Synthetic oligonucleotide
ccgcttggtctaccttgaaagcactaagaactatg

SEQ ID NO: 250371 - DNA, 35 bp, Artificial Sequence
  Description of Artificial Sequence: Synthetic oligonucleotide
cgcttggtctaccttgaaagcactaagaactatgc

SEQ ID NO: 250372 - DNA, 35 bp, Artificial Sequence
  Description of Artificial Sequence: Synthetic oligonucleotide
gcttggtctaccttgaaagcactaagaactatgcg

SEQ ID NO: 250373 - DNA, 35 bp, Artificial Sequence
  Description of Artificial Sequence: Synthetic oligonucleotide
cttggtctaccttgaaagcactaagaactatgcgc

SEQ ID NO: 250374 - DNA, 35 bp, Artificial Sequence
  Description of Artificial Sequence: Synthetic oligonucleotide
ttggtctaccttgaaagcactaagaactatgcgcc

SEQ ID NO: 250375 - DNA, 34 bp, Artificial Sequence
  Description of Artificial Sequence: Synthetic oligonucleotide
tggtctaccttgaaagcactaagaactatgcgcc

SEQ ID NO: 250376 - DNA, 33 bp, Artificial Sequence
  Description of Artificial Sequence: Synthetic oligonucleotide
ggtctaccttgaaagcactaagaactatgcgcc

SEQ ID NO: 250377 - DNA, 34 bp, Artificial Sequence
  Description of Artificial Sequence: Synthetic oligonucleotide
gtctaccttgaaagcactaagaactatgcgcctc

SEQ ID NO: 250378 - DNA, 35 bp, Artificial Sequence
  Description of Artificial Sequence: Synthetic oligonucleotide
tctaccttgaaagcactaagaactatgcgcctctg

SEQ ID NO: 250379 - DNA, 34 bp, Artificial Sequence
  Description of Artificial Sequence: Synthetic oligonucleotide
ctaccttgaaagcactaagaactatgcgcctctg

SEQ ID NO: 250380 - DNA, 34 bp, Artificial Sequence
  Description of Artificial Sequence: Synthetic oligonucleotide
taccttgaaagcactaagaactatgcgcctctgg

SEQ ID NO: 250381 - DNA, 33 bp, Artificial Sequence
  Description of Artificial Sequence: Synthetic oligonucleotide
accttgaaagcactaagaactatgcgcctctgg

SEQ ID NO: 250382 - DNA, 32 bp, Artificial Sequence
  Description of Artificial Sequence: Synthetic oligonucleotide
ccttgaaagcactaagaactatgcgcctctgg

SEQ ID NO: 250383 - DNA, 34 bp, Artificial Sequence
  Description of Artificial Sequence: Synthetic oligonucleotide
cttgaaagcactaagaactatgcgcctctggatg

SEQ ID NO: 250384 - DNA, 34 bp, Artificial Sequence
  Description of Artificial Sequence: Synthetic oligonucleotide
ttgaaagcactaagaactatgcgcctctggatgg

SEQ ID NO: 250385 - DNA, 33 bp, Artificial Sequence
  Description of Artificial Sequence: Synthetic oligonucleotide
tgaaagcactaagaactatgcgcctctggatgg

SEQ ID NO: 250386 - DNA, 32 bp, Artificial Sequence
  Description of Artificial Sequence: Synthetic oligonucleotide
gaaagcactaagaactatgcgcctctggatgg

SEQ ID NO: 250387 - DNA, 32 bp, Artificial Sequence
  Description of Artificial Sequence: Synthetic oligonucleotide
aaagcactaagaactatgcgcctctggatggg

SEQ ID NO: 250388 - DNA, 31 bp, Artificial Sequence
  Description of Artificial Sequence: Synthetic oligonucleotide
aagcactaagaactatgcgcctctggatggg

SEQ ID NO: 250389 - DNA, 30 bp, Artificial Sequence
  Description of Artificial Sequence: Synthetic oligonucleotide
agcactaagaactatgcgcctctggatggg

SEQ ID NO: 250390 - DNA, 29 bp, Artificial Sequence
  Description of Artificial Sequence: Synthetic oligonucleotide
gcactaagaactatgcgcctctggatggg

SEQ ID NO: 250391 - DNA, 29 bp, Artificial Sequence
  Description of Artificial Sequence: Synthetic oligonucleotide
cactaagaactatgcgcctctggatgggg

SEQ ID NO: 250392 - DNA, 29 bp, Artificial Sequence
  Description of Artificial Sequence: Synthetic oligonucleotide
actaagaactatgcgcctctggatggggc

SEQ ID NO: 250393 - DNA, 28 bp, Artificial Sequence
  Description of Artificial Sequence: Synthetic oligonucleotide
ctaagaactatgcgcctctggatggggc

SEQ ID NO: 250394 - DNA, 28 bp, Artificial Sequence
  Description of Artificial Sequence: Synthetic oligonucleotide
taagaactatgcgcctctggatggggcc

SEQ ID NO: 250395 - DNA, 27 bp, Artificial Sequence
  Description of Artificial Sequence: Synthetic oligonucleotide
aagaactatgcgcctctggatggggcc

SEQ ID NO: 250396 - DNA, 26 bp, Artificial Sequence
  Description of Artificial Sequence: Synthetic oligonucleotide
agaactatgcgcctctggatggggcc

SEQ ID NO: 250397 - DNA, 25 bp, Artificial Sequence
  Description of Artificial Sequence: Synthetic oligonucleotide
gaactatgcgcctctggatggggcc

SEQ ID NO: 250398 - DNA, 25 bp, Artificial Sequence
  Description of Artificial Sequence: Synthetic oligonucleotide
aactatgcgcctctggatggggccc

SEQ ID NO: 250399 - DNA, 24 bp, Artificial Sequence
  Description of Artificial Sequence: Synthetic oligonucleotide
actatgcgcctctggatggggccc

SEQ ID NO: 250400 - DNA, 23 bp, Artificial Sequence
  Description of Artificial Sequence: Synthetic oligonucleotide
ctatgcgcctctggatggggccc

SEQ ID NO: 250401 - DNA, 24 bp, Artificial Sequence
  Description of Artificial Sequence: Synthetic oligonucleotide
tatgcgcctctggatggggcccct

SEQ ID NO: 250402 - DNA, 23 bp, Artificial Sequence
  Description of Artificial Sequence: Synthetic oligonucleotide
atgcgcctctggatggggcccct

SEQ ID NO: 250403 - DNA, 22 bp, Artificial Sequence
  Description of Artificial Sequence: Synthetic oligonucleotide
tgcgcctctggatggggcccct

SEQ ID NO: 250404 - DNA, 21 bp, Artificial Sequence
  Description of Artificial Sequence: Synthetic oligonucleotide
gcgcctctggatggggcccct

SEQ ID NO: 250405 - DNA, 22 bp, Artificial Sequence
  Description of Artificial Sequence: Synthetic oligonucleotide
cgcctctggatggggcccctgt

SEQ ID NO: 250406 - DNA, 23 bp, Artificial Sequence
  Description of Artificial Sequence: Synthetic oligonucleotide
gcctctggatggggcccctgtca

SEQ ID NO: 250407 - DNA, 23 bp, Artificial Sequence
  Description of Artificial Sequence: Synthetic oligonucleotide
cctctggatggggcccctgtcac

SEQ ID NO: 250408 - DNA, 23 bp, Artificial Sequence
  Description of Artificial Sequence: Synthetic oligonucleotide
ctctggatggggcccctgtcacg

SEQ ID NO: 250409 - DNA, 23 bp, Artificial Sequence
  Description of Artificial Sequence: Synthetic oligonucleotide
tctggatggggcccctgtcacgg

SEQ ID NO: 250410 - DNA, 22 bp, Artificial Sequence
  Description of Artificial Sequence: Synthetic oligonucleotide
ctggatggggcccctgtcacgg

SEQ ID NO: 250411 - DNA, 23 bp, Artificial Sequence
  Description of Artificial Sequence: Synthetic oligonucleotide
tggatggggcccctgtcacggca

SEQ ID NO: 250412 - DNA, 22 bp, Artificial Sequence
  Description of Artificial Sequence: Synthetic oligonucleotide
ggatggggcccctgtcacggca

SEQ ID NO: 250413 - DNA, 22 bp, Artificial Sequence
  Description of Artificial Sequence: Synthetic oligonucleotide
gatggggcccctgtcacggcag

SEQ ID NO: 250414 - DNA, 22 bp, Artificial Sequence
  Description of Artificial Sequence: Synthetic oligonucleotide
atggggcccctgtcacggcagc

SEQ ID NO: 250415 - DNA, 21 bp, Artificial Sequence
  Description of Artificial Sequence: Synthetic oligonucleotide
tggggcccctgtcacggcagc

SEQ ID NO: 250416 - DNA, 20 bp, Artificial Sequence
  Description of Artificial Sequence: Synthetic oligonucleotide
ggggcccctgtcacggcagc

SEQ ID NO: 250417 - DNA, 21 bp, Artificial Sequence
  Description of Artificial Sequence: Synthetic oligonucleotide
gggcccctgtcacggcagcgt

SEQ ID NO: 250418 - DNA, 21 bp, Artificial Sequence
  Description of Artificial Sequence: Synthetic oligonucleotide
ggcccctgtcacggcagcgtc

SEQ ID NO: 250419 - DNA, 23 bp, Artificial Sequence
  Description of Artificial Sequence: Synthetic oligonucleotide
gcccctgtcacggcagcgtcctt

SEQ ID NO: 250420 - DNA, 24 bp, Artificial Sequence
  Description of Artificial Sequence: Synthetic oligonucleotide
cccctgtcacggcagcgtccttca

SEQ ID NO: 250421 - DNA, 25 bp, Artificial Sequence
  Description of Artificial Sequence: Synthetic oligonucleotide
ccctgtcacggcagcgtccttcact

SEQ ID NO: 250422 - DNA, 25 bp, Artificial Sequence
  Description of Artificial Sequence: Synthetic oligonucleotide
cctgtcacggcagcgtccttcactg

SEQ ID NO: 250423 - DNA, 27 bp, Artificial Sequence
  Description of Artificial Sequence: Synthetic oligonucleotide
ctgtcacggcagcgtccttcactgctt

SEQ ID NO: 250424 - DNA, 28 bp, Artificial Sequence
  Description of Artificial Sequence: Synthetic oligonucleotide
tgtcacggcagcgtccttcactgcttac

SEQ ID NO: 250425 - DNA, 27 bp, Artificial Sequence
  Description of Artificial Sequence: Synthetic oligonucleotide
gtcacggcagcgtccttcactgcttac

SEQ ID NO: 250426 - DNA, 28 bp, Artificial Sequence
  Description of Artificial Sequence: Synthetic oligonucleotide
tcacggcagcgtccttcactgcttactg

SEQ ID NO: 250427 - DNA, 27 bp, Artificial Sequence
  Description of Artificial Sequence: Synthetic oligonucleotide
cacggcagcgtccttcactgcttactg

SEQ ID NO: 250428 - DNA, 27 bp, Artificial Sequence
  Description of Artificial Sequence: Synthetic oligonucleotide
acggcagcgtccttcactgcttactgc

SEQ ID NO: 250429 - DNA, 26 bp, Artificial Sequence
  Description of Artificial Sequence: Synthetic oligonucleotide
cggcagcgtccttcactgcttactgc

SEQ ID NO: 250430 - DNA, 27 bp, Artificial Sequence
  Description of Artificial Sequence: Synthetic oligonucleotide
ggcagcgtccttcactgcttactgcca

SEQ ID NO: 250431 - DNA, 28 bp, Artificial Sequence
  Description of Artificial Sequence: Synthetic oligonucleotide
gcagcgtccttcactgcttactgccatg

SEQ ID NO: 250432 - DNA, 28 bp, Artificial Sequence
  Description of Artificial Sequence: Synthetic oligonucleotide
cagcgtccttcactgcttactgccatgc

SEQ ID NO: 250433 - DNA, 29 bp, Artificial Sequence
  Description of Artificial Sequence: Synthetic oligonucleotide
agcgtccttcactgcttactgccatgctg

SEQ ID NO: 250434 - DNA, 28 bp, Artificial Sequence
  Description of Artificial Sequence: Synthetic oligonucleotide
gcgtccttcactgcttactgccatgctg

SEQ ID NO: 250435 - DNA, 29 bp, Artificial Sequence
  Description of Artificial Sequence: Synthetic oligonucleotide
cgtccttcactgcttactgccatgctgtc

SEQ ID NO: 250436 - DNA, 29 bp, Artificial Sequence
  Description of Artificial Sequence: Synthetic oligonucleotide
gtccttcactgcttactgccatgctgtcc

SEQ ID NO: 250437 - DNA, 30 bp, Artificial Sequence
  Description of Artificial Sequence: Synthetic oligonucleotide
tccttcactgcttactgccatgctgtcctc

SEQ ID NO: 250438 - DNA, 29 bp, Artificial Sequence
  Description of Artificial Sequence: Synthetic oligonucleotide
ccttcactgcttactgccatgctgtcctc

SEQ ID NO: 250439 - DNA, 31 bp, Artificial Sequence
  Description of Artificial Sequence: Synthetic oligonucleotide
cttcactgcttactgccatgctgtcctcaac

SEQ ID NO: 250440 - DNA, 31 bp, Artificial Sequence
  Description of Artificial Sequence: Synthetic oligonucleotide
ttcactgcttactgccatgctgtcctcaacc

SEQ ID NO: 250441 - DNA, 30 bp, Artificial Sequence
  Description of Artificial Sequence: Synthetic oligonucleotide
tcactgcttactgccatgctgtcctcaacc

SEQ ID NO: 250442 - DNA, 29 bp, Artificial Sequence
  Description of Artificial Sequence: Synthetic oligonucleotide
cactgcttactgccatgctgtcctcaacc

SEQ ID NO: 250443 - DNA, 29 bp, Artificial Sequence
  Description of Artificial Sequence: Synthetic oligonucleotide
actgcttactgccatgctgtcctcaaccg

SEQ ID NO: 250444 - DNA, 28 bp, Artificial Sequence
  Description of Artificial Sequence: Synthetic oligonucleotide
ctgcttactgccatgctgtcctcaaccg

SEQ ID NO: 250445 - DNA, 28 bp, Artificial Sequence
  Description of Artificial Sequence: Synthetic oligonucleotide
tgcttactgccatgctgtcctcaaccgc

SEQ ID NO: 250446 - DNA, 27 bp, Artificial Sequence
  Description of Artificial Sequence: Synthetic oligonucleotide
gcttactgccatgctgtcctcaaccgc

SEQ ID NO: 250447 - DNA, 27 bp, Artificial Sequence
  Description of Artificial Sequence: Synthetic oligonucleotide
cttactgccatgctgtcctcaaccgcc

SEQ ID NO: 250448 - DNA, 29 bp, Artificial Sequence
  Description of Artificial Sequence: Synthetic oligonucleotide
ttactgccatgctgtcctcaaccgccaag

SEQ ID NO: 250449 - DNA, 28 bp, Artificial Sequence
  Description of Artificial Sequence: Synthetic oligonucleotide
tactgccatgctgtcctcaaccgccaag

SEQ ID NO: 250450 - DNA, 27 bp, Artificial Sequence
  Description of Artificial Sequence: Synthetic oligonucleotide
actgccatgctgtcctcaaccgccaag

SEQ ID NO: 250451 - DNA, 27 bp, Artificial Sequence
  Description of Artificial Sequence: Synthetic oligonucleotide
ctgccatgctgtcctcaaccgccaagt

SEQ ID NO: 250452 - DNA, 27 bp, Artificial Sequence
  Description of Artificial Sequence: Synthetic oligonucleotide
tgccatgctgtcctcaaccgccaagtc

SEQ ID NO: 250453 - DNA, 27 bp, Artificial Sequence
  Description of Artificial Sequence: Synthetic oligonucleotide
gccatgctgtcctcaaccgccaagtca

SEQ ID NO: 250454 - DNA, 28 bp, Artificial Sequence
  Description of Artificial Sequence: Synthetic oligonucleotide
ccatgctgtcctcaaccgccaagtcatg

SEQ ID NO: 250455 - DNA, 28 bp, Artificial Sequence
  Description of Artificial Sequence: Synthetic oligonucleotide
catgctgtcctcaaccgccaagtcatgc

SEQ ID NO: 250456 - DNA, 28 bp, Artificial Sequence
  Description of Artificial Sequence: Synthetic oligonucleotide
atgctgtcctcaaccgccaagtcatgcc

SEQ ID NO: 250457 - DNA, 27 bp, Artificial Sequence
  Description of Artificial Sequence: Synthetic oligonucleotide
tgctgtcctcaaccgccaagtcatgcc

SEQ ID NO: 250458 - DNA, 26 bp, Artificial Sequence
  Description of Artificial Sequence: Synthetic oligonucleotide
gctgtcctcaaccgccaagtcatgcc

SEQ ID NO: 250459 - DNA, 27 bp, Artificial Sequence
  Description of Artificial Sequence: Synthetic oligonucleotide
ctgtcctcaaccgccaagtcatgccct

SEQ ID NO: 250460 - DNA, 29 bp, Artificial Sequence
  Description of Artificial Sequence: Synthetic oligonucleotide
tgtcctcaaccgccaagtcatgccctatc

SEQ ID NO: 250461 - DNA, 28 bp, Artificial Sequence
  Description of Artificial Sequence: Synthetic oligonucleotide
gtcctcaaccgccaagtcatgccctatc

SEQ ID NO: 250462 - DNA, 29 bp, Artificial Sequence
  Description of Artificial Sequence: Synthetic oligonucleotide
tcctcaaccgccaagtcatgccctatctg

SEQ ID NO: 250463 - DNA, 28 bp, Artificial Sequence
  Description of Artificial Sequence: Synthetic oligonucleotide
cctcaaccgccaagtcatgccctatctg

SEQ ID NO: 250464 - DNA, 28 bp, Artificial Sequence
  Description of Artificial Sequence: Synthetic oligonucleotide
ctcaaccgccaagtcatgccctatctgc

SEQ ID NO: 250465 - DNA, 29 bp, Artificial Sequence
  Description of Artificial Sequence: Synthetic oligonucleotide
tcaaccgccaagtcatgccctatctgctg

SEQ ID NO: 250466 - DNA, 28 bp, Artificial Sequence
  Description of Artificial Sequence: Synthetic oligonucleotide
caaccgccaagtcatgccctatctgctg

SEQ ID NO: 250467 - DNA, 29 bp, Artificial Sequence
  Description of Artificial Sequence: Synthetic oligonucleotide
aaccgccaagtcatgccctatctgctgag

SEQ ID NO: 250468 - DNA, 28 bp, Artificial Sequence
  Description of Artificial Sequence: Synthetic oligonucleotide
accgccaagtcatgccctatctgctgag

SEQ ID NO: 250469 - DNA, 27 bp, Artificial Sequence
  Description of Artificial Sequence: Synthetic oligonucleotide
ccgccaagtcatgccctatctgctgag

SEQ ID NO: 250470 - DNA, 27 bp, Artificial Sequence
  Description of Artificial Sequence: Synthetic oligonucleotide
cgccaagtcatgccctatctgctgagc

SEQ ID NO: 250471 - DNA, 27 bp, Artificial Sequence
  Description of Artificial Sequence: Synthetic oligonucleotide
gccaagtcatgccctatctgctgagcc

SEQ ID NO: 250472 - DNA, 28 bp, Artificial Sequence
  Description of Artificial Sequence: Synthetic oligonucleotide
ccaagtcatgccctatctgctgagccag

SEQ ID NO: 250473 - DNA, 28 bp, Artificial Sequence
  Description of Artificial Sequence: Synthetic oligonucleotide
caagtcatgccctatctgctgagccagc

SEQ ID NO: 250474 - DNA, 29 bp, Artificial Sequence
  Description of Artificial Sequence: Synthetic oligonucleotide
aagtcatgccctatctgctgagccagcag

SEQ ID NO: 250475 - DNA, 28 bp, Artificial Sequence
  Description of Artificial Sequence: Synthetic oligonucleotide
agtcatgccctatctgctgagccagcag

SEQ ID NO: 250476 - DNA, 27 bp, Artificial Sequence
  Description of Artificial Sequence: Synthetic oligonucleotide
gtcatgccctatctgctgagccagcag

SEQ ID NO: 250477 - DNA, 30 bp, Artificial Sequence
  Description of Artificial Sequence: Synthetic oligonucleotide
tcatgccctatctgctgagccagcagatac

SEQ ID NO: 250478 - DNA, 29 bp, Artificial Sequence
  Description of Artificial Sequence: Synthetic oligonucleotide
catgccctatctgctgagccagcagatac

SEQ ID NO: 250479 - DNA, 29 bp, Artificial Sequence
  Description of Artificial Sequence: Synthetic oligonucleotide
atgccctatctgctgagccagcagatacc

SEQ ID NO: 250480 - DNA, 28 bp, Artificial Sequence
  Description of Artificial Sequence: Synthetic oligonucleotide
tgccctatctgctgagccagcagatacc

SEQ ID NO: 250481 - DNA, 27 bp, Artificial Sequence
  Description of Artificial Sequence: Synthetic oligonucleotide
gccctatctgctgagccagcagatacc

SEQ ID NO: 250482 - DNA, 27 bp, Artificial Sequence
  Description of Artificial Sequence: Synthetic oligonucleotide
ccctatctgctgagccagcagataccc

SEQ ID NO: 250483 - DNA, 27 bp, Artificial Sequence
  Description of Artificial Sequence: Synthetic oligonucleotide
cctatctgctgagccagcagatacccc

SEQ ID NO: 250484 - DNA, 27 bp, Artificial Sequence
  Description of Artificial Sequence: Synthetic oligonucleotide
ctatctgctgagccagcagataccccg

SEQ ID NO: 250485 - DNA, 28 bp, Artificial Sequence
  Description of Artificial Sequence: Synthetic oligonucleotide
tatctgctgagccagcagataccccgtg

SEQ ID NO: 250486 - DNA, 27 bp, Artificial Sequence
  Description of Artificial Sequence: Synthetic oligonucleotide
atctgctgagccagcagataccccgtg

SEQ ID NO: 250487 - DNA, 27 bp, Artificial Sequence
  Description of Artificial Sequence: Synthetic oligonucleotide
tctgctgagccagcagataccccgtga

SEQ ID NO: 250488 - DNA, 27 bp, Artificial Sequence
  Description of Artificial Sequence: Synthetic oligonucleotide
ctgctgagccagcagataccccgtgat

SEQ ID NO: 250489 - DNA, 28 bp, Artificial Sequence
  Description of Artificial Sequence: Synthetic oligonucleotide
tgctgagccagcagataccccgtgattg

SEQ ID NO: 250490 - DNA, 27 bp, Artificial Sequence
  Description of Artificial Sequence: Synthetic oligonucleotide
gctgagccagcagataccccgtgattg

SEQ ID NO: 250491 - DNA, 27 bp, Artificial Sequence
  Description of Artificial Sequence: Synthetic oligonucleotide
ctgagccagcagataccccgtgattgg

SEQ ID NO: 250492 - DNA, 27 bp, Artificial Sequence
  Description of Artificial Sequence: Synthetic oligonucleotide
tgagccagcagataccccgtgattggg

SEQ ID NO: 250493 - DNA, 27 bp, Artificial Sequence
  Description of Artificial Sequence: Synthetic oligonucleotide
gagccagcagataccccgtgattggga

SEQ ID NO: 250494 - DNA, 28 bp, Artificial Sequence
  Description of Artificial Sequence: Synthetic oligonucleotide
agccagcagataccccgtgattgggaac

SEQ ID NO: 250495 - DNA, 27 bp, Artificial Sequence
  Description of Artificial Sequence: Synthetic oligonucleotide
gccagcagataccccgtgattgggaac

SEQ ID NO: 250496 - DNA, 28 bp, Artificial Sequence
  Description of Artificial Sequence: Synthetic oligonucleotide
ccagcagataccccgtgattgggaacag

SEQ ID NO: 250497 - DNA, 28 bp, Artificial Sequence
  Description of Artificial Sequence: Synthetic oligonucleotide
cagcagataccccgtgattgggaacagc

SEQ ID NO: 250498 - DNA, 28 bp, Artificial Sequence
  Description of Artificial Sequence: Synthetic oligonucleotide
agcagataccccgtgattgggaacagcg

SEQ ID NO: 250499 - DNA, 27 bp, Artificial Sequence
  Description of Artificial Sequence: Synthetic oligonucleotide
gcagataccccgtgattgggaacagcg

SEQ ID NO: 250500 - DNA, 27 bp, Artificial Sequence
  Description of Artificial Sequence: Synthetic oligonucleotide
cagataccccgtgattgggaacagcgg

SEQ ID NO: 250501 - DNA, 27 bp, Artificial Sequence
  Description of Artificial Sequence: Synthetic oligonucleotide
agataccccgtgattgggaacagcggc

SEQ ID NO: 250502 - DNA, 26 bp, Artificial Sequence
  Description of Artificial Sequence: Synthetic oligonucleotide
gataccccgtgattgggaacagcggc

SEQ ID NO: 250503 - DNA, 27 bp, Artificial Sequence
  Description of Artificial Sequence: Synthetic oligonucleotide
ataccccgtgattgggaacagcggcca

SEQ ID NO: 250504 - DNA, 26 bp, Artificial Sequence
  Description of Artificial Sequence: Synthetic oligonucleotide
taccccgtgattgggaacagcggcca

SEQ ID NO: 250505 - DNA, 25 bp, Artificial Sequence
  Description of Artificial Sequence: Synthetic oligonucleotide
accccgtgattgggaacagcggcca

SEQ ID NO: 250506 - DNA, 24 bp, Artificial Sequence
  Description of Artificial Sequence: Synthetic oligonucleotide
ccccgtgattgggaacagcggcca

SEQ ID NO: 250507 - DNA, 27 bp, Artificial Sequence
  Description of Artificial Sequence: Synthetic oligonucleotide
cccgtgattgggaacagcggccactta

SEQ ID NO: 250508 - DNA, 28 bp, Artificial Sequence
  Description of Artificial Sequence: Synthetic oligonucleotide
ccgtgattgggaacagcggccacttaag

SEQ ID NO: 250509 - DNA, 29 bp, Artificial Sequence
  Description of Artificial Sequence: Synthetic oligonucleotide
cgtgattgggaacagcggccacttaagac

SEQ ID NO: 250510 - DNA, 29 bp, Artificial Sequence
  Description of Artificial Sequence: Synthetic oligonucleotide
gtgattgggaacagcggccacttaagacc

SEQ ID NO: 250511 - DNA, 29 bp, Artificial Sequence
  Description of Artificial Sequence: Synthetic oligonucleotide
tgattgggaacagcggccacttaagaccc

SEQ ID NO: 250512 - DNA, 28 bp, Artificial Sequence
  Description of Artificial Sequence: Synthetic oligonucleotide
gattgggaacagcggccacttaagaccc

SEQ ID NO: 250513 - DNA, 29 bp, Artificial Sequence
  Description of Artificial Sequence: Synthetic oligonucleotide
attgggaacagcggccacttaagacccac

SEQ ID NO: 250514 - DNA, 28 bp, Artificial Sequence
  Description of Artificial Sequence: Synthetic oligonucleotide
ttgggaacagcggccacttaagacccac

SEQ ID NO: 250515 - DNA, 27 bp, Artificial Sequence
  Description of Artificial Sequence: Synthetic oligonucleotide
tgggaacagcggccacttaagacccac

SEQ ID NO: 250516 - DNA, 26 bp, Artificial Sequence
  Description of Artificial Sequence: Synthetic oligonucleotide
gggaacagcggccacttaagacccac

SEQ ID NO: 250517 - DNA, 27 bp, Artificial Sequence
  Description of Artificial Sequence: Synthetic oligonucleotide
ggaacagcggccacttaagacccacgt

SEQ ID NO: 250518 - DNA, 27 bp, Artificial Sequence
  Description of Artificial Sequence: Synthetic oligonucleotide
gaacagcggccacttaagacccacgtg

SEQ ID NO: 250519 - DNA, 27 bp, Artificial Sequence
  Description of Artificial Sequence: Synthetic oligonucleotide
aacagcggccacttaagacccacgtgg

SEQ ID NO: 250520 - DNA, 26 bp, Artificial Sequence
  Description of Artificial Sequence: Synthetic oligonucleotide
acagcggccacttaagacccacgtgg

SEQ ID NO: 250521 - DNA, 25 bp, Artificial Sequence
  Description of Artificial Sequence: Synthetic oligonucleotide
cagcggccacttaagacccacgtgg

SEQ ID NO: 250522 - DNA, 25 bp, Artificial Sequence
  Description of Artificial Sequence: Synthetic oligonucleotide
agcggccacttaagacccacgtggg

SEQ ID NO: 250523 - DNA, 24 bp, Artificial Sequence
  Description of Artificial Sequence: Synthetic oligonucleotide
gcggccacttaagacccacgtggg

SEQ ID NO: 250524 - DNA, 26 bp, Artificial Sequence
  Description of Artificial Sequence: Synthetic oligonucleotide
cggccacttaagacccacgtgggcaa

SEQ ID NO: 250525 - DNA, 27 bp, Artificial Sequence
  Description of Artificial Sequence: Synthetic oligonucleotide
ggccacttaagacccacgtgggcaaca

SEQ ID NO: 250526 - DNA, 32 bp, Artificial Sequence
  Description of Artificial Sequence: Synthetic oligonucleotide
gccacttaagacccacgtgggcaacaattttg

SEQ ID NO: 250527 - DNA, 33 bp, Artificial Sequence
  Description of Artificial Sequence: Synthetic oligonucleotide
ccacttaagacccacgtgggcaacaattttgag

SEQ ID NO: 250528 - DNA, 33 bp, Artificial Sequence
  Description of Artificial Sequence: Synthetic oligonucleotide
cacttaagacccacgtgggcaacaattttgagg

SEQ ID NO: 250529 - DNA, 34 bp, Artificial Sequence
  Description of Artificial Sequence: Synthetic oligonucleotide
acttaagacccacgtgggcaacaattttgaggag

SEQ ID NO: 250530 - DNA, 33 bp, Artificial Sequence
  Description of Artificial Sequence: Synthetic oligonucleotide
cttaagacccacgtgggcaacaattttgaggag

SEQ ID NO: 250531 - DNA, 33 bp, Artificial Sequence
  Description of Artificial Sequence: Synthetic oligonucleotide
ttaagacccacgtgggcaacaattttgaggagg

SEQ ID NO: 250532 - DNA, 32 bp, Artificial Sequence
  Description of Artificial Sequence: Synthetic oligonucleotide
taagacccacgtgggcaacaattttgaggagg

SEQ ID NO: 250533 - DNA, 31 bp, Artificial Sequence
  Description of Artificial Sequence: Synthetic oligonucleotide
aagacccacgtgggcaacaattttgaggagg

SEQ ID NO: 250534 - DNA, 30 bp, Artificial Sequence
  Description of Artificial Sequence: Synthetic oligonucleotide
agacccacgtgggcaacaattttgaggagg

SEQ ID NO: 250535 - DNA, 29 bp, Artificial Sequence
  Description of Artificial Sequence: Synthetic oligonucleotide
gacccacgtgggcaacaattttgaggagg

SEQ ID NO: 250536 - DNA, 30 bp, Artificial Sequence
  Description of Artificial Sequence: Synthetic oligonucleotide
acccacgtgggcaacaattttgaggaggtg

SEQ ID NO: 250537 - DNA, 29 bp, Artificial Sequence
  Description of Artificial Sequence: Synthetic oligonucleotide
cccacgtgggcaacaattttgaggaggtg

SEQ ID NO: 250538 - DNA, 29 bp, Artificial Sequence
  Description of Artificial Sequence: Synthetic oligonucleotide
ccacgtgggcaacaattttgaggaggtgg

SEQ ID NO: 250539 - DNA, 29 bp, Artificial Sequence
  Description of Artificial Sequence: Synthetic oligonucleotide
cacgtgggcaacaattttgaggaggtggc

SEQ ID NO: 250540 - DNA, 33 bp, Artificial Sequence
  Description of Artificial Sequence: Synthetic oligonucleotide
acgtgggcaacaattttgaggaggtggcttatg

SEQ ID NO: 250541 - DNA, 32 bp, Artificial Sequence
  Description of Artificial Sequence: Synthetic oligonucleotide
cgtgggcaacaattttgaggaggtggcttatg

SEQ ID NO: 250542 - DNA, 33 bp, Artificial Sequence
  Description of Artificial Sequence: Synthetic oligonucleotide
gtgggcaacaattttgaggaggtggcttatgac

SEQ ID NO: 250543 - DNA, 33 bp, Artificial Sequence
  Description of Artificial Sequence: Synthetic oligonucleotide
tgggcaacaattttgaggaggtggcttatgacg

SEQ ID NO: 250544 - DNA, 32 bp, Artificial Sequence
  Description of Artificial Sequence: Synthetic oligonucleotide
gggcaacaattttgaggaggtggcttatgacg

SEQ ID NO: 250545 - DNA, 35 bp, Artificial Sequence
  Description of Artificial Sequence: Synthetic oligonucleotide
ggcaacaattttgaggaggtggcttatgacgaaac

SEQ ID NO: 250546 - DNA, 35 bp, Artificial Sequence
  Description of Artificial Sequence: Synthetic oligonucleotide
gcaacaattttgaggaggtggcttatgacgaaacg

SEQ ID NO: 250547 - DNA, 37 bp, Artificial Sequence
  Description of Artificial Sequence: Synthetic oligonucleotide
caacaattttgaggaggtggcttatgacgaaacgaag

SEQ ID NO: 250548 - DNA, 40 bp, Artificial Sequence
  Description of Artificial Sequence: Synthetic oligonucleotide
aacaattttgaggaggtggcttatgacgaaacgaagaatg

SEQ ID NO: 250549 - DNA, 39 bp, Artificial Sequence
  Description of Artificial Sequence: Synthetic oligonucleotide
acaattttgaggaggtggcttatgacgaaacgaagaatg

SEQ ID NO: 250550 - DNA, 38 bp, Artificial Sequence
  Description of Artificial Sequence: Synthetic oligonucleotide
caattttgaggaggtggcttatgacgaaacgaagaatg

SEQ ID NO: 250551 - DNA, 39 bp, Artificial Sequence
  Description of Artificial Sequence: Synthetic oligonucleotide
aattttgaggaggtggcttatgacgaaacgaagaatgtg

SEQ ID NO: 250552 - DNA, 38 bp, Artificial Sequence
  Description of Artificial Sequence: Synthetic oligonucleotide
attttgaggaggtggcttatgacgaaacgaagaatgtg

SEQ ID NO: 250553 - DNA, 37 bp, Artificial Sequence
  Description of Artificial Sequence: Synthetic oligonucleotide
ttttgaggaggtggcttatgacgaaacgaagaatgtg

SEQ ID NO: 250554 - DNA, 36 bp, Artificial Sequence
  Description of Artificial Sequence: Synthetic oligonucleotide
tttgaggaggtggcttatgacgaaacgaagaatgtg

SEQ ID NO: 250555 - DNA, 35 bp, Artificial Sequence
  Description of Artificial Sequence: Synthetic oligonucleotide
ttgaggaggtggcttatgacgaaacgaagaatgtg

SEQ ID NO: 250556 - DNA, 34 bp, Artificial Sequence
  Description of Artificial Sequence: Synthetic oligonucleotide
tgaggaggtggcttatgacgaaacgaagaatgtg

SEQ ID NO: 250557 - DNA, 33 bp, Artificial Sequence
  Description of Artificial Sequence: Synthetic oligonucleotide
gaggaggtggcttatgacgaaacgaagaatgtg

SEQ ID NO: 250558 - DNA, 36 bp, Artificial Sequence
  Description of Artificial Sequence: Synthetic oligonucleotide
aggaggtggcttatgacgaaacgaagaatgtgattg

SEQ ID NO: 250559 - DNA, 35 bp, Artificial Sequence
  Description of Artificial Sequence: Synthetic oligonucleotide
ggaggtggcttatgacgaaacgaagaatgtgattg

SEQ ID NO: 250560 - DNA, 36 bp, Artificial Sequence
  Description of Artificial Sequence: Synthetic oligonucleotide
gaggtggcttatgacgaaacgaagaatgtgattgtc

SEQ ID NO: 250561 - DNA, 38 bp, Artificial Sequence
  Description of Artificial Sequence: Synthetic oligonucleotide
aggtggcttatgacgaaacgaagaatgtgattgtcaag

SEQ ID NO: 250562 - DNA, 37 bp, Artificial Sequence
  Description of Artificial Sequence: Synthetic oligonucleotide
ggtggcttatgacgaaacgaagaatgtgattgtcaag

SEQ ID NO: 250563 - DNA, 39 bp, Artificial Sequence
  Description of Artificial Sequence: Synthetic oligonucleotide
gtggcttatgacgaaacgaagaatgtgattgtcaagtac

SEQ ID NO: 250564 - DNA, 42 bp, Artificial Sequence
  Description of Artificial Sequence: Synthetic oligonucleotide
tggcttatgacgaaacgaagaatgtgattgtcaagtactatg

SEQ ID NO: 250565 - DNA, 41 bp, Artificial Sequence
  Description of Artificial Sequence: Synthetic oligonucleotide
ggcttatgacgaaacgaagaatgtgattgtcaagtactatg

SEQ ID NO: 250566 - DNA, 41 bp, Artificial Sequence
  Description of Artificial Sequence: Synthetic oligonucleotide
gcttatgacgaaacgaagaatgtgattgtcaagtactatgc

SEQ ID NO: 250567 - DNA, 41 bp, Artificial Sequence
  Description of Artificial Sequence: Synthetic oligonucleotide
cttatgacgaaacgaagaatgtgattgtcaagtactatgcc

SEQ ID NO: 250568 - DNA, 41 bp, Artificial Sequence
  Description of Artificial Sequence: Synthetic oligonucleotide
ttatgacgaaacgaagaatgtgattgtcaagtactatgccc

SEQ ID NO: 250569 - DNA, 40 bp, Artificial Sequence
  Description of Artificial Sequence: Synthetic oligonucleotide
tatgacgaaacgaagaatgtgattgtcaagtactatgccc

SEQ ID NO: 250570 - DNA, 39 bp, Artificial Sequence
  Description of Artificial Sequence: Synthetic oligonucleotide
atgacgaaacgaagaatgtgattgtcaagtactatgccc

SEQ ID NO: 250571 - DNA, 38 bp, Artificial Sequence
  Description of Artificial Sequence: Synthetic oligonucleotide
tgacgaaacgaagaatgtgattgtcaagtactatgccc

SEQ ID NO: 250572 - DNA, 37 bp, Artificial Sequence
  Description of Artificial Sequence: Synthetic oligonucleotide
gacgaaacgaagaatgtgattgtcaagtactatgccc

SEQ ID NO: 250573 - DNA, 37 bp, Artificial Sequence
  Description of Artificial Sequence: Synthetic oligonucleotide
acgaaacgaagaatgtgattgtcaagtactatgcccc

SEQ ID NO: 250574 - DNA, 36 bp, Artificial Sequence
  Description of Artificial Sequence: Synthetic oligonucleotide
cgaaacgaagaatgtgattgtcaagtactatgcccc

SEQ ID NO: 250575 - DNA, 36 bp, Artificial Sequence
  Description of Artificial Sequence: Synthetic oligonucleotide
gaaacgaagaatgtgattgtcaagtactatgccccc

SEQ ID NO: 250576 - DNA, 37 bp, Artificial Sequence
  Description of Artificial Sequence: Synthetic oligonucleotide
aaacgaagaatgtgattgtcaagtactatgccccctg

SEQ ID NO: 250577 - DNA, 36 bp, Artificial Sequence
  Description of Artificial Sequence: Synthetic oligonucleotide
aacgaagaatgtgattgtcaagtactatgccccctg

SEQ ID NO: 250578 - DNA, 35 bp, Artificial Sequence
  Description of Artificial Sequence: Synthetic oligonucleotide
acgaagaatgtgattgtcaagtactatgccccctg

SEQ ID NO: 250579 - DNA, 34 bp, Artificial Sequence
  Description of Artificial Sequence: Synthetic oligonucleotide
cgaagaatgtgattgtcaagtactatgccccctg

SEQ ID NO: 250580 - DNA, 34 bp, Artificial Sequence
  Description of Artificial Sequence: Synthetic oligonucleotide
gaagaatgtgattgtcaagtactatgccccctgg

SEQ ID NO: 250581 - DNA, 35 bp, Artificial Sequence
  Description of Artificial Sequence: Synthetic oligonucleotide
aagaatgtgattgtcaagtactatgccccctggtg

SEQ ID NO: 250582 - DNA, 34 bp, Artificial Sequence
  Description of Artificial Sequence: Synthetic oligonucleotide
agaatgtgattgtcaagtactatgccccctggtg

SEQ ID NO: 250583 - DNA, 33 bp, Artificial Sequence
  Description of Artificial Sequence: Synthetic oligonucleotide
gaatgtgattgtcaagtactatgccccctggtg

SEQ ID NO: 250584 - DNA, 33 bp, Artificial Sequence
  Description of Artificial Sequence: Synthetic oligonucleotide
aatgtgattgtcaagtactatgccccctggtgc

SEQ ID NO: 250585 - DNA, 32 bp, Artificial Sequence
  Description of Artificial Sequence: Synthetic oligonucleotide
atgtgattgtcaagtactatgccccctggtgc

SEQ ID NO: 250586 - DNA, 31 bp, Artificial Sequence
  Description of Artificial Sequence: Synthetic oligonucleotide
tgtgattgtcaagtactatgccccctggtgc

SEQ ID NO: 250587 - DNA, 30 bp, Artificial Sequence
  Description of Artificial Sequence: Synthetic oligonucleotide
gtgattgtcaagtactatgccccctggtgc

SEQ ID NO: 250588 - DNA, 31 bp, Artificial Sequence
  Description of Artificial Sequence: Synthetic oligonucleotide
tgattgtcaagtactatgccccctggtgcac

SEQ ID NO: 250589 - DNA, 30 bp, Artificial Sequence
  Description of Artificial Sequence: Synthetic oligonucleotide
gattgtcaagtactatgccccctggtgcac

SEQ ID NO: 250590 - DNA, 30 bp, Artificial Sequence
  Description of Artificial Sequence: Synthetic oligonucleotide
attgtcaagtactatgccccctggtgcacc

SEQ ID NO: 250591 - DNA, 29 bp, Artificial Sequence
  Description of Artificial Sequence: Synthetic oligonucleotide
ttgtcaagtactatgccccctggtgcacc

SEQ ID NO: 250592 - DNA, 28 bp, Artificial Sequence
  Description of Artificial Sequence: Synthetic oligonucleotide
tgtcaagtactatgccccctggtgcacc

SEQ ID NO: 250593 - DNA, 27 bp, Artificial Sequence
  Description of Artificial Sequence: Synthetic oligonucleotide
gtcaagtactatgccccctggtgcacc

SEQ ID NO: 250594 - DNA, 27 bp, Artificial Sequence
  Description of Artificial Sequence: Synthetic oligonucleotide
tcaagtactatgccccctggtgcaccg

SEQ ID NO: 250595 - DNA, 27 bp, Artificial Sequence
  Description of Artificial Sequence: Synthetic oligonucleotide
caagtactatgccccctggtgcaccga

SEQ ID NO: 250596 - DNA, 27 bp, Artificial Sequence
  Description of Artificial Sequence: Synthetic oligonucleotide
aagtactatgccccctggtgcaccgac

SEQ ID NO: 250597 - DNA, 27 bp, Artificial Sequence
  Description of Artificial Sequence: Synthetic oligonucleotide
agtactatgccccctggtgcaccgact

SEQ ID NO: 250598 - DNA, 26 bp, Artificial Sequence
  Description of Artificial Sequence: Synthetic oligonucleotide
gtactatgccccctggtgcaccgact

SEQ ID NO: 250599 - DNA, 26 bp, Artificial Sequence
  Description of Artificial Sequence: Synthetic oligonucleotide
tactatgccccctggtgcaccgactg

SEQ ID NO: 250600 - DNA, 25 bp, Artificial Sequence
  Description of Artificial Sequence: Synthetic oligonucleotide
actatgccccctggtgcaccgactg

SEQ ID NO: 250601 - DNA, 24 bp, Artificial Sequence
  Description of Artificial Sequence: Synthetic oligonucleotide
ctatgccccctggtgcaccgactg

SEQ ID NO: 250602 - DNA, 26 bp, Artificial Sequence
  Description of Artificial Sequence: Synthetic oligonucleotide
tatgccccctggtgcaccgactgcaa

SEQ ID NO: 250603 - DNA, 25 bp, Artificial Sequence
  Description of Artificial Sequence: Synthetic oligonucleotide
atgccccctggtgcaccgactgcaa

SEQ ID NO: 250604 - DNA, 24 bp, Artificial Sequence
  Description of Artificial Sequence: Synthetic oligonucleotide
tgccccctggtgcaccgactgcaa

SEQ ID NO: 250605 - DNA, 23 bp, Artificial Sequence
  Description of Artificial Sequence: Synthetic oligonucleotide
gccccctggtgcaccgactgcaa

SEQ ID NO: 250606 - DNA, 23 bp, Artificial Sequence
  Description of Artificial Sequence: Synthetic oligonucleotide
ccccctggtgcaccgactgcaag

SEQ ID NO: 250607 - DNA, 24 bp, Artificial Sequence
  Description of Artificial Sequence: Synthetic oligonucleotide
cccctggtgcaccgactgcaaggt

SEQ ID NO: 250608 - DNA, 26 bp, Artificial Sequence
  Description of Artificial Sequence: Synthetic oligonucleotide
ccctggtgcaccgactgcaaggtgat

SEQ ID NO: 250609 - DNA, 26 bp, Artificial Sequence
  Description of Artificial Sequence: Synthetic oligonucleotide
cctggtgcaccgactgcaaggtgatg

SEQ ID NO: 250610 - DNA, 26 bp, Artificial Sequence
  Description of Artificial Sequence: Synthetic oligonucleotide
ctggtgcaccgactgcaaggtgatgg

SEQ ID NO: 250611 - DNA, 26 bp, Artificial Sequence
  Description of Artificial Sequence: Synthetic oligonucleotide
tggtgcaccgactgcaaggtgatggc

SEQ ID NO: 250612 - DNA, 25 bp, Artificial Sequence
  Description of Artificial Sequence: Synthetic oligonucleotide
ggtgcaccgactgcaaggtgatggc

SEQ ID NO: 250613 - DNA, 25 bp, Artificial Sequence
  Description of Artificial Sequence: Synthetic oligonucleotide
gtgcaccgactgcaaggtgatggcc

SEQ ID NO: 250614 - DNA, 25 bp, Artificial Sequence
  Description of Artificial Sequence: Synthetic oligonucleotide
tgcaccgactgcaaggtgatggccc

SEQ ID NO: 250615 - DNA, 24 bp, Artificial Sequence
  Description of Artificial Sequence: Synthetic oligonucleotide
gcaccgactgcaaggtgatggccc

SEQ ID NO: 250616 - DNA, 25 bp, Artificial Sequence
  Description of Artificial Sequence: Synthetic oligonucleotide
caccgactgcaaggtgatggcccca

SEQ ID NO: 250617 - DNA, 25 bp, Artificial Sequence
  Description of Artificial Sequence: Synthetic oligonucleotide
accgactgcaaggtgatggccccag

SEQ ID NO: 250618 - DNA, 24 bp, Artificial Sequence
  Description of Artificial Sequence: Synthetic oligonucleotide
ccgactgcaaggtgatggccccag

SEQ ID NO: 250619 - DNA, 24 bp, Artificial Sequence
  Description of Artificial Sequence: Synthetic oligonucleotide
cgactgcaaggtgatggccccagc

SEQ ID NO: 250620 - DNA, 25 bp, Artificial Sequence
  Description of Artificial Sequence: Synthetic oligonucleotide
gactgcaaggtgatggccccagcct

SEQ ID NO: 250621 - DNA, 25 bp, Artificial Sequence
  Description of Artificial Sequence: Synthetic oligonucleotide
actgcaaggtgatggccccagcctg

SEQ ID NO: 250622 - DNA, 24 bp, Artificial Sequence
  Description of Artificial Sequence: Synthetic oligonucleotide
ctgcaaggtgatggccccagcctg

SEQ ID NO: 250623 - DNA, 24 bp, Artificial Sequence
  Description of Artificial Sequence: Synthetic oligonucleotide
tgcaaggtgatggccccagcctgg

SEQ ID NO: 250624 - DNA, 23 bp, Artificial Sequence
  Description of Artificial Sequence: Synthetic oligonucleotide
gcaaggtgatggccccagcctgg

SEQ ID NO: 250625 - DNA, 24 bp, Artificial Sequence
  Description of Artificial Sequence: Synthetic oligonucleotide
caaggtgatggccccagcctggga

SEQ ID NO: 250626 - DNA, 24 bp, Artificial Sequence
  Description of Artificial Sequence: Synthetic oligonucleotide
aaggtgatggccccagcctgggag

SEQ ID NO: 250627 - DNA, 23 bp, Artificial Sequence
  Description of Artificial Sequence: Synthetic oligonucleotide
aggtgatggccccagcctgggag

SEQ ID NO: 250628 - DNA, 22 bp, Artificial Sequence
  Description of Artificial Sequence: Synthetic oligonucleotide
ggtgatggccccagcctgggag

SEQ ID NO: 250629 - DNA, 22 bp, Artificial Sequence
  Description of Artificial Sequence: Synthetic oligonucleotide
gtgatggccccagcctgggagc

SEQ ID NO: 250630 - DNA, 25 bp, Artificial Sequence
  Description of Artificial Sequence: Synthetic oligonucleotide
tgatggccccagcctgggagccatt

SEQ ID NO: 250631 - DNA, 24 bp, Artificial Sequence
  Description of Artificial Sequence: Synthetic oligonucleotide
gatggccccagcctgggagccatt

SEQ ID NO: 250632 - DNA, 24 bp, Artificial Sequence
  Description of Artificial Sequence: Synthetic oligonucleotide
atggccccagcctgggagccattg

SEQ ID NO: 250633 - DNA, 23 bp, Artificial Sequence
  Description of Artificial Sequence: Synthetic oligonucleotide
tggccccagcctgggagccattg

SEQ ID NO: 250634 - DNA, 22 bp, Artificial Sequence
  Description of Artificial Sequence: Synthetic oligonucleotide
ggccccagcctgggagccattg

SEQ ID NO: 250635 - DNA, 22 bp, Artificial Sequence
  Description of Artificial Sequence: Synthetic oligonucleotide
gccccagcctgggagccattgg

SEQ ID NO: 250636 - DNA, 23 bp, Artificial Sequence
  Description of Artificial Sequence: Synthetic oligonucleotide
ccccagcctgggagccattggct

SEQ ID NO: 250637 - DNA, 24 bp, Artificial Sequence
  Description of Artificial Sequence: Synthetic oligonucleotide
cccagcctgggagccattggctgt

SEQ ID NO: 250638 - DNA, 26 bp, Artificial Sequence
  Description of Artificial Sequence: Synthetic oligonucleotide
ccagcctgggagccattggctgtgaa

SEQ ID NO: 250639 - DNA, 27 bp, Artificial Sequence
  Description of Artificial Sequence: Synthetic oligonucleotide
cagcctgggagccattggctgtgaagt

SEQ ID NO: 250640 - DNA, 28 bp, Artificial Sequence
  Description of Artificial Sequence: Synthetic oligonucleotide
agcctgggagccattggctgtgaagtac

SEQ ID NO: 250641 - DNA, 27 bp, Artificial Sequence
  Description of Artificial Sequence: Synthetic oligonucleotide
gcctgggagccattggctgtgaagtac

SEQ ID NO: 250642 - DNA, 27 bp, Artificial Sequence
  Description of Artificial Sequence: Synthetic oligonucleotide
cctgggagccattggctgtgaagtacc

SEQ ID NO: 250643 - DNA, 29 bp, Artificial Sequence
  Description of Artificial Sequence: Synthetic oligonucleotide
ctgggagccattggctgtgaagtaccatg

SEQ ID NO: 250644 - DNA, 30 bp, Artificial Sequence
  Description of Artificial Sequence: Synthetic oligonucleotide
tgggagccattggctgtgaagtaccatgac

SEQ ID NO: 250645 - DNA, 29 bp, Artificial Sequence
  Description of Artificial Sequence: Synthetic oligonucleotide
gggagccattggctgtgaagtaccatgac

SEQ ID NO: 250646 - DNA, 29 bp, Artificial Sequence
  Description of Artificial Sequence: Synthetic oligonucleotide
ggagccattggctgtgaagtaccatgacc

SEQ ID NO: 250647 - DNA, 30 bp, Artificial Sequence
  Description of Artificial Sequence: Synthetic oligonucleotide
gagccattggctgtgaagtaccatgaccac

SEQ ID NO: 250648 - DNA, 30 bp, Artificial Sequence
  Description of Artificial Sequence: Synthetic oligonucleotide
agccattggctgtgaagtaccatgaccacg

SEQ ID NO: 250649 - DNA, 29 bp, Artificial Sequence
  Description of Artificial Sequence: Synthetic oligonucleotide
gccattggctgtgaagtaccatgaccacg

SEQ ID NO: 250650 - DNA, 30 bp, Artificial Sequence
  Description of Artificial Sequence: Synthetic oligonucleotide
ccattggctgtgaagtaccatgaccacgag

SEQ ID NO: 250651 - DNA, 30 bp, Artificial Sequence
  Description of Artificial Sequence: Synthetic oligonucleotide
cattggctgtgaagtaccatgaccacgagc

SEQ ID NO: 250652 - DNA, 31 bp, Artificial Sequence
  Description of Artificial Sequence: Synthetic oligonucleotide
attggctgtgaagtaccatgaccacgagcac

SEQ ID NO: 250653 - DNA, 30 bp, Artificial Sequence
  Description of Artificial Sequence: Synthetic oligonucleotide
ttggctgtgaagtaccatgaccacgagcac

SEQ ID NO: 250654 - DNA, 29 bp, Artificial Sequence
  Description of Artificial Sequence: Synthetic oligonucleotide
tggctgtgaagtaccatgaccacgagcac

SEQ ID NO: 250655 - DNA, 28 bp, Artificial Sequence
  Description of Artificial Sequence: Synthetic oligonucleotide
ggctgtgaagtaccatgaccacgagcac

SEQ ID NO: 250656 - DNA, 30 bp, Artificial Sequence
  Description of Artificial Sequence: Synthetic oligonucleotide
gctgtgaagtaccatgaccacgagcacatc

SEQ ID NO: 250657 - DNA, 32 bp, Artificial Sequence
  Description of Artificial Sequence: Synthetic oligonucleotide
ctgtgaagtaccatgaccacgagcacatcatc

SEQ ID NO: 250658 - DNA, 35 bp, Artificial Sequence
  Description of Artificial Sequence: Synthetic oligonucleotide
tgtgaagtaccatgaccacgagcacatcatcaatg

SEQ ID NO: 250659 - DNA, 34 bp, Artificial Sequence
  Description of Artificial Sequence: Synthetic oligonucleotide
gtgaagtaccatgaccacgagcacatcatcaatg

SEQ ID NO: 250660 - DNA, 34 bp, Artificial Sequence
  Description of Artificial Sequence: Synthetic oligonucleotide
tgaagtaccatgaccacgagcacatcatcaatgc

SEQ ID NO: 250661 - DNA, 33 bp, Artificial Sequence
  Description of Artificial Sequence: Synthetic oligonucleotide
gaagtaccatgaccacgagcacatcatcaatgc

SEQ ID NO: 250662 - DNA, 34 bp, Artificial Sequence
  Description of Artificial Sequence: Synthetic oligonucleotide
aagtaccatgaccacgagcacatcatcaatgctg

SEQ ID NO: 250663 - DNA, 33 bp, Artificial Sequence
  Description of Artificial Sequence: Synthetic oligonucleotide
agtaccatgaccacgagcacatcatcaatgctg

SEQ ID NO: 250664 - DNA, 32 bp, Artificial Sequence
  Description of Artificial Sequence: Synthetic oligonucleotide
gtaccatgaccacgagcacatcatcaatgctg

SEQ ID NO: 250665 - DNA, 33 bp, Artificial Sequence
  Description of Artificial Sequence: Synthetic oligonucleotide
taccatgaccacgagcacatcatcaatgctgag

SEQ ID NO: 250666 - DNA, 32 bp, Artificial Sequence
  Description of Artificial Sequence: Synthetic oligonucleotide
accatgaccacgagcacatcatcaatgctgag

SEQ ID NO: 250667 - DNA, 31 bp, Artificial Sequence
  Description of Artificial Sequence: Synthetic oligonucleotide
ccatgaccacgagcacatcatcaatgctgag

SEQ ID NO: 250668 - DNA, 31 bp, Artificial Sequence
  Description of Artificial Sequence: Synthetic oligonucleotide
catgaccacgagcacatcatcaatgctgagc

SEQ ID NO: 250669 - DNA, 32 bp, Artificial Sequence
  Description of Artificial Sequence: Synthetic oligonucleotide
atgaccacgagcacatcatcaatgctgagctc

SEQ ID NO: 250670 - DNA, 31 bp, Artificial Sequence
  Description of Artificial Sequence: Synthetic oligonucleotide
tgaccacgagcacatcatcaatgctgagctc

SEQ ID NO: 250671 - DNA, 30 bp, Artificial Sequence
  Description of Artificial Sequence: Synthetic oligonucleotide
gaccacgagcacatcatcaatgctgagctc

SEQ ID NO: 250672 - DNA, 30 bp, Artificial Sequence
  Description of Artificial Sequence: Synthetic oligonucleotide
accacgagcacatcatcaatgctgagctcg

SEQ ID NO: 250673 - DNA, 29 bp, Artificial Sequence
  Description of Artificial Sequence: Synthetic oligonucleotide
ccacgagcacatcatcaatgctgagctcg

SEQ ID NO: 250674 - DNA, 31 bp, Artificial Sequence
  Description of Artificial Sequence: Synthetic oligonucleotide
cacgagcacatcatcaatgctgagctcgatg

SEQ ID NO: 250675 - DNA, 31 bp, Artificial Sequence
  Description of Artificial Sequence: Synthetic oligonucleotide
acgagcacatcatcaatgctgagctcgatgc

SEQ ID NO: 250676 - DNA, 30 bp, Artificial Sequence
  Description of Artificial Sequence: Synthetic oligonucleotide
cgagcacatcatcaatgctgagctcgatgc

SEQ ID NO: 250677 - DNA, 30 bp, Artificial Sequence
  Description of Artificial Sequence: Synthetic oligonucleotide
gagcacatcatcaatgctgagctcgatgcc

SEQ ID NO: 250678 - DNA, 31 bp, Artificial Sequence
  Description of Artificial Sequence: Synthetic oligonucleotide
agcacatcatcaatgctgagctcgatgccac

SEQ ID NO: 250679 - DNA, 30 bp, Artificial Sequence
  Description of Artificial Sequence: Synthetic oligonucleotide
gcacatcatcaatgctgagctcgatgccac

SEQ ID NO: 250680 - DNA, 30 bp, Artificial Sequence
  Description of Artificial Sequence: Synthetic oligonucleotide
cacatcatcaatgctgagctcgatgccacg

SEQ ID NO: 250681 - DNA, 30 bp, Artificial Sequence
  Description of Artificial Sequence: Synthetic oligonucleotide
acatcatcaatgctgagctcgatgccacgc

SEQ ID NO: 250682 - DNA, 29 bp, Artificial Sequence
  Description of Artificial Sequence: Synthetic oligonucleotide
catcatcaatgctgagctcgatgccacgc

SEQ ID NO: 250683 - DNA, 29 bp, Artificial Sequence
  Description of Artificial Sequence: Synthetic oligonucleotide
atcatcaatgctgagctcgatgccacgcc

SEQ ID NO: 250684 - DNA, 28 bp, Artificial Sequence
  Description of Artificial Sequence: Synthetic oligonucleotide
tcatcaatgctgagctcgatgccacgcc

SEQ ID NO: 250685 - DNA, 27 bp, Artificial Sequence
  Description of Artificial Sequence: Synthetic oligonucleotide
catcaatgctgagctcgatgccacgcc

SEQ ID NO: 250686 - DNA, 27 bp, Artificial Sequence
  Description of Artificial Sequence: Synthetic oligonucleotide
atcaatgctgagctcgatgccacgccc

SEQ ID NO: 250687 - DNA, 27 bp, Artificial Sequence
  Description of Artificial Sequence: Synthetic oligonucleotide
tcaatgctgagctcgatgccacgccca

SEQ ID NO: 250688 - DNA, 27 bp, Artificial Sequence
  Description of Artificial Sequence: Synthetic oligonucleotide
caatgctgagctcgatgccacgcccaa

SEQ ID NO: 250689 - DNA, 27 bp, Artificial Sequence
  Description of Artificial Sequence: Synthetic oligonucleotide
aatgctgagctcgatgccacgcccaac

SEQ ID NO: 250690 - DNA, 26 bp, Artificial Sequence
  Description of Artificial Sequence: Synthetic oligonucleotide
atgctgagctcgatgccacgcccaac

SEQ ID NO: 250691 - DNA, 25 bp, Artificial Sequence
  Description of Artificial Sequence: Synthetic oligonucleotide
tgctgagctcgatgccacgcccaac

SEQ ID NO: 250692 - DNA, 24 bp, Artificial Sequence
  Description of Artificial Sequence: Synthetic oligonucleotide
gctgagctcgatgccacgcccaac

SEQ ID NO: 250693 - DNA, 25 bp, Artificial Sequence
  Description of Artificial Sequence: Synthetic oligonucleotide
ctgagctcgatgccacgcccaacga

SEQ ID NO: 250694 - DNA, 25 bp, Artificial Sequence
  Description of Artificial Sequence: Synthetic oligonucleotide
tgagctcgatgccacgcccaacgag

SEQ ID NO: 250695 - DNA, 24 bp, Artificial Sequence
  Description of Artificial Sequence: Synthetic oligonucleotide
gagctcgatgccacgcccaacgag

SEQ ID NO: 250696 - DNA, 25 bp, Artificial Sequence
  Description of Artificial Sequence: Synthetic oligonucleotide
agctcgatgccacgcccaacgagca

SEQ ID NO: 250697 - DNA, 24 bp, Artificial Sequence
  Description of Artificial Sequence: Synthetic oligonucleotide
gctcgatgccacgcccaacgagca

SEQ ID NO: 250698 - DNA, 24 bp, Artificial Sequence
  Description of Artificial Sequence: Synthetic oligonucleotide
ctcgatgccacgcccaacgagcag

SEQ ID NO: 250699 - DNA, 26 bp, Artificial Sequence
  Description of Artificial Sequence: Synthetic oligonucleotide
tcgatgccacgcccaacgagcaggat

SEQ ID NO: 250700 - DNA, 25 bp, Artificial Sequence
  Description of Artificial Sequence: Synthetic oligonucleotide
cgatgccacgcccaacgagcaggat

SEQ ID NO: 250701 - DNA, 25 bp, Artificial Sequence
  Description of Artificial Sequence: Synthetic oligonucleotide
gatgccacgcccaacgagcaggatg

SEQ ID NO: 250702 - DNA, 25 bp, Artificial Sequence
  Description of Artificial Sequence: Synthetic oligonucleotide
atgccacgcccaacgagcaggatgc

SEQ ID NO: 250703 - DNA, 24 bp, Artificial Sequence
  Description of Artificial Sequence: Synthetic oligonucleotide
tgccacgcccaacgagcaggatgc

SEQ ID NO: 250704 - DNA, 23 bp, Artificial Sequence
  Description of Artificial Sequence: Synthetic oligonucleotide
gccacgcccaacgagcaggatgc

SEQ ID NO: 250705 - DNA, 25 bp, Artificial Sequence
  Description of Artificial Sequence: Synthetic oligonucleotide
ccacgcccaacgagcaggatgcctt

SEQ ID NO: 250706 - DNA, 25 bp, Artificial Sequence
  Description of Artificial Sequence: Synthetic oligonucleotide
cacgcccaacgagcaggatgccttg

SEQ ID NO: 250707 - DNA, 25 bp, Artificial Sequence
  Description of Artificial Sequence: Synthetic oligonucleotide
acgcccaacgagcaggatgccttgg

SEQ ID NO: 250708 - DNA, 24 bp, Artificial Sequence
  Description of Artificial Sequence: Synthetic oligonucleotide
cgcccaacgagcaggatgccttgg

SEQ ID NO: 250709 - DNA, 25 bp, Artificial Sequence
  Description of Artificial Sequence: Synthetic oligonucleotide
gcccaacgagcaggatgccttggct

SEQ ID NO: 250710 - DNA, 26 bp, Artificial Sequence
  Description of Artificial Sequence: Synthetic oligonucleotide
cccaacgagcaggatgccttggctgt

SEQ ID NO: 250711 - DNA, 26 bp, Artificial Sequence
  Description of Artificial Sequence: Synthetic oligonucleotide
ccaacgagcaggatgccttggctgtg

SEQ ID NO: 250712 - DNA, 27 bp, Artificial Sequence
  Description of Artificial Sequence: Synthetic oligonucleotide
caacgagcaggatgccttggctgtgca

SEQ ID NO: 250713 - DNA, 27 bp, Artificial Sequence
  Description of Artificial Sequence: Synthetic oligonucleotide
aacgagcaggatgccttggctgtgcac

SEQ ID NO: 250714 - DNA, 26 bp, Artificial Sequence
  Description of Artificial Sequence: Synthetic oligonucleotide
acgagcaggatgccttggctgtgcac

SEQ ID NO: 250715 - DNA, 25 bp, Artificial Sequence
  Description of Artificial Sequence: Synthetic oligonucleotide
cgagcaggatgccttggctgtgcac

SEQ ID NO: 250716 - DNA, 25 bp, Artificial Sequence
  Description of Artificial Sequence: Synthetic oligonucleotide
gagcaggatgccttggctgtgcacc

SEQ ID NO: 250717 - DNA, 25 bp, Artificial Sequence
  Description of Artificial Sequence: Synthetic oligonucleotide
agcaggatgccttggctgtgcaccg

SEQ ID NO: 250718 - DNA, 24 bp, Artificial Sequence
  Description of Artificial Sequence: Synthetic oligonucleotide
gcaggatgccttggctgtgcaccg

SEQ ID NO: 250719 - DNA, 26 bp, Artificial Sequence
  Description of Artificial Sequence: Synthetic oligonucleotide
caggatgccttggctgtgcaccgctt

SEQ ID NO: 250720 - DNA, 26 bp, Artificial Sequence
  Description of Artificial Sequence: Synthetic oligonucleotide
aggatgccttggctgtgcaccgcttc

SEQ ID NO: 250721 - DNA, 25 bp, Artificial Sequence
  Description of Artificial Sequence: Synthetic oligonucleotide
ggatgccttggctgtgcaccgcttc

SEQ ID NO: 250722 - DNA, 25 bp, Artificial Sequence
  Description of Artificial Sequence: Synthetic oligonucleotide
gatgccttggctgtgcaccgcttcc

SEQ ID NO: 250723 - DNA, 27 bp, Artificial Sequence
  Description of Artificial Sequence: Synthetic oligonucleotide
atgccttggctgtgcaccgcttcccta

SEQ ID NO: 250724 - DNA, 26 bp, Artificial Sequence
  Description of Artificial Sequence: Synthetic oligonucleotide
tgccttggctgtgcaccgcttcccta

SEQ ID NO: 250725 - DNA, 25 bp, Artificial Sequence
  Description of Artificial Sequence: Synthetic oligonucleotide
gccttggctgtgcaccgcttcccta

SEQ ID NO: 250726 - DNA, 26 bp, Artificial Sequence
  Description of Artificial Sequence: Synthetic oligonucleotide
ccttggctgtgcaccgcttccctagt

SEQ ID NO: 250727 - DNA, 27 bp, Artificial Sequence
  Description of Artificial Sequence: Synthetic oligonucleotide
cttggctgtgcaccgcttccctagtct

SEQ ID NO: 250728 - DNA, 27 bp, Artificial Sequence
  Description of Artificial Sequence: Synthetic oligonucleotide
ttggctgtgcaccgcttccctagtctc

SEQ ID NO: 250729 - DNA, 27 bp, Artificial Sequence
  Description of Artificial Sequence: Synthetic oligonucleotide
tggctgtgcaccgcttccctagtctca

SEQ ID NO: 250730 - DNA, 27 bp, Artificial Sequence
  Description of Artificial Sequence: Synthetic oligonucleotide
ggctgtgcaccgcttccctagtctcaa

SEQ ID NO: 250731 - DNA, 27 bp, Artificial Sequence
  Description of Artificial Sequence: Synthetic oligonucleotide
gctgtgcaccgcttccctagtctcaag

SEQ ID NO: 250732 - DNA, 29 bp, Artificial Sequence
  Description of Artificial Sequence: Synthetic oligonucleotide
ctgtgcaccgcttccctagtctcaagtag

SEQ ID NO: 250733 - DNA, 31 bp, Artificial Sequence
  Description of Artificial Sequence: Synthetic oligonucleotide
tgtgcaccgcttccctagtctcaagtagttc

SEQ ID NO: 250734 - DNA, 30 bp, Artificial Sequence
  Description of Artificial Sequence: Synthetic oligonucleotide
gtgcaccgcttccctagtctcaagtagttc

SEQ ID NO: 250735 - DNA, 30 bp, Artificial Sequence
  Description of Artificial Sequence: Synthetic oligonucleotide
tgcaccgcttccctagtctcaagtagttcc

SEQ ID NO: 250736 - DNA, 29 bp, Artificial Sequence
  Description of Artificial Sequence: Synthetic oligonucleotide
gcaccgcttccctagtctcaagtagttcc

SEQ ID NO: 250737 - DNA, 29 bp, Artificial Sequence
  Description of Artificial Sequence: Synthetic oligonucleotide
caccgcttccctagtctcaagtagttccc

SEQ ID NO: 250738 - DNA, 30 bp, Artificial Sequence
  Description of Artificial Sequence: Synthetic oligonucleotide
accgcttccctagtctcaagtagttcccag

SEQ ID NO: 250739 - DNA, 29 bp, Artificial Sequence
  Description of Artificial Sequence: Synthetic oligonucleotide
ccgcttccctagtctcaagtagttcccag

SEQ ID NO: 250740 - DNA, 29 bp, Artificial Sequence
  Description of Artificial Sequence: Synthetic oligonucleotide
cgcttccctagtctcaagtagttcccagc

SEQ ID NO: 250741 - DNA, 30 bp, Artificial Sequence
  Description of Artificial Sequence: Synthetic oligonucleotide
gcttccctagtctcaagtagttcccagcac

SEQ ID NO: 250742 - DNA, 30 bp, Artificial Sequence
  Description of Artificial Sequence: Synthetic oligonucleotide
cttccctagtctcaagtagttcccagcacg

SEQ ID NO: 250743 - DNA, 30 bp, Artificial Sequence
  Description of Artificial Sequence: Synthetic oligonucleotide
ttccctagtctcaagtagttcccagcacgg

SEQ ID NO: 250744 - DNA, 29 bp, Artificial Sequence
  Description of Artificial Sequence: Synthetic oligonucleotide
tccctagtctcaagtagttcccagcacgg

SEQ ID NO: 250745 - DNA, 28 bp, Artificial Sequence
  Description of Artificial Sequence: Synthetic oligonucleotide
ccctagtctcaagtagttcccagcacgg

SEQ ID NO: 250746 - DNA, 28 bp, Artificial Sequence
  Description of Artificial Sequence: Synthetic oligonucleotide
cctagtctcaagtagttcccagcacggc

SEQ ID NO: 250747 - DNA, 28 bp, Artificial Sequence
  Description of Artificial Sequence: Synthetic oligonucleotide
ctagtctcaagtagttcccagcacggcc

SEQ ID NO: 250748 - DNA, 29 bp, Artificial Sequence
  Description of Artificial Sequence: Synthetic oligonucleotide
tagtctcaagtagttcccagcacggccag

SEQ ID NO: 250749 - DNA, 28 bp, Artificial Sequence
  Description of Artificial Sequence: Synthetic oligonucleotide
agtctcaagtagttcccagcacggccag

SEQ ID NO: 250750 - DNA, 27 bp, Artificial Sequence
  Description of Artificial Sequence: Synthetic oligonucleotide
gtctcaagtagttcccagcacggccag

SEQ ID NO: 250751 - DNA, 27 bp, Artificial Sequence
  Description of Artificial Sequence: Synthetic oligonucleotide
tctcaagtagttcccagcacggccagg

SEQ ID NO: 250752 - DNA, 27 bp, Artificial Sequence
  Description of Artificial Sequence: Synthetic oligonucleotide
ctcaagtagttcccagcacggccaggt

SEQ ID NO: 250753 - DNA, 27 bp, Artificial Sequence
  Description of Artificial Sequence: Synthetic oligonucleotide
tcaagtagttcccagcacggccaggtc

SEQ ID NO: 250754 - DNA, 26 bp, Artificial Sequence
  Description of Artificial Sequence: Synthetic oligonucleotide
caagtagttcccagcacggccaggtc

SEQ ID NO: 250755 - DNA, 26 bp, Artificial Sequence
  Description of Artificial Sequence: Synthetic oligonucleotide
aagtagttcccagcacggccaggtcc

SEQ ID NO: 250756 - DNA, 25 bp, Artificial Sequence
  Description of Artificial Sequence: Synthetic oligonucleotide
agtagttcccagcacggccaggtcc

SEQ ID NO: 250757 - DNA, 24 bp, Artificial Sequence
  Description of Artificial Sequence: Synthetic oligonucleotide
gtagttcccagcacggccaggtcc

SEQ ID NO: 250758 - DNA, 26 bp, Artificial Sequence
  Description of Artificial Sequence: Synthetic oligonucleotide
tagttcccagcacggccaggtccgaa

SEQ ID NO: 250759 - DNA, 25 bp, Artificial Sequence
  Description of Artificial Sequence: Synthetic oligonucleotide
agttcccagcacggccaggtccgaa

SEQ ID NO: 250760 - DNA, 24 bp, Artificial Sequence
  Description of Artificial Sequence: Synthetic oligonucleotide
gttcccagcacggccaggtccgaa

SEQ ID NO: 250761 - DNA, 24 bp, Artificial Sequence
  Description of Artificial Sequence: Synthetic oligonucleotide
ttcccagcacggccaggtccgaag

SEQ ID NO: 250762 - DNA, 23 bp, Artificial Sequence
  Description of Artificial Sequence: Synthetic oligonucleotide
tcccagcacggccaggtccgaag

SEQ ID NO: 250763 - DNA, 22 bp, Artificial Sequence
  Description of Artificial Sequence: Synthetic oligonucleotide
cccagcacggccaggtccgaag

SEQ ID NO: 250764 - DNA, 23 bp, Artificial Sequence
  Description of Artificial Sequence: Synthetic oligonucleotide
ccagcacggccaggtccgaaggt

SEQ ID NO: 250765 - DNA, 26 bp, Artificial Sequence
  Description of Artificial Sequence: Synthetic oligonucleotide
cagcacggccaggtccgaaggtgata

SEQ ID NO: 250766 - DNA, 27 bp, Artificial Sequence
  Description of Artificial Sequence: Synthetic oligonucleotide
agcacggccaggtccgaaggtgataga

SEQ ID NO: 250767 - DNA, 27 bp, Artificial Sequence
  Description of Artificial Sequence: Synthetic oligonucleotide
gcacggccaggtccgaaggtgatagaa

SEQ ID NO: 250768 - DNA, 29 bp, Artificial Sequence
  Description of Artificial Sequence: Synthetic oligonucleotide
cacggccaggtccgaaggtgatagaatac

SEQ ID NO: 250769 - DNA, 33 bp, Artificial Sequence
  Description of Artificial Sequence: Synthetic oligonucleotide
acggccaggtccgaaggtgatagaatacaaatg

SEQ ID NO: 250770 - DNA, 32 bp, Artificial Sequence
  Description of Artificial Sequence: Synthetic oligonucleotide
cggccaggtccgaaggtgatagaatacaaatg

SEQ ID NO: 250771 - DNA, 32 bp, Artificial Sequence
  Description of Artificial Sequence: Synthetic oligonucleotide
ggccaggtccgaaggtgatagaatacaaatgc

SEQ ID NO: 250772 - DNA, 33 bp, Artificial Sequence
  Description of Artificial Sequence: Synthetic oligonucleotide
gccaggtccgaaggtgatagaatacaaatgcac

SEQ ID NO: 250773 - DNA, 33 bp, Artificial Sequence
  Description of Artificial Sequence: Synthetic oligonucleotide
ccaggtccgaaggtgatagaatacaaatgcacc

SEQ ID NO: 250774 - DNA, 34 bp, Artificial Sequence
  Description of Artificial Sequence: Synthetic oligonucleotide
caggtccgaaggtgatagaatacaaatgcaccag

SEQ ID NO: 250775 - DNA, 34 bp, Artificial Sequence
  Description of Artificial Sequence: Synthetic oligonucleotide
aggtccgaaggtgatagaatacaaatgcaccagg

SEQ ID NO: 250776 - DNA, 33 bp, Artificial Sequence
  Description of Artificial Sequence: Synthetic oligonucleotide
ggtccgaaggtgatagaatacaaatgcaccagg

SEQ ID NO: 250777 - DNA, 33 bp, Artificial Sequence
  Description of Artificial Sequence: Synthetic oligonucleotide
gtccgaaggtgatagaatacaaatgcaccaggg

SEQ ID NO: 250778 - DNA, 34 bp, Artificial Sequence
  Description of Artificial Sequence: Synthetic oligonucleotide
tccgaaggtgatagaatacaaatgcaccagggtc

SEQ ID NO: 250779 - DNA, 33 bp, Artificial Sequence
  Description of Artificial Sequence: Synthetic oligonucleotide
ccgaaggtgatagaatacaaatgcaccagggtc

SEQ ID NO: 250780 - DNA, 33 bp, Artificial Sequence
  Description of Artificial Sequence: Synthetic oligonucleotide
cgaaggtgatagaatacaaatgcaccagggtcc

SEQ ID NO: 250781 - DNA, 34 bp, Artificial Sequence
  Description of Artificial Sequence: Synthetic oligonucleotide
gaaggtgatagaatacaaatgcaccagggtcctg

SEQ ID NO: 250782 - DNA, 34 bp, Artificial Sequence
  Description of Artificial Sequence: Synthetic oligonucleotide
aaggtgatagaatacaaatgcaccagggtcctgg

SEQ ID NO: 250783 - DNA, 33 bp, Artificial Sequence
  Description of Artificial Sequence: Synthetic oligonucleotide
aggtgatagaatacaaatgcaccagggtcctgg

SEQ ID NO: 250784 - DNA, 32 bp, Artificial Sequence
  Description of Artificial Sequence: Synthetic oligonucleotide
ggtgatagaatacaaatgcaccagggtcctgg

SEQ ID NO: 250785 - DNA, 33 bp, Artificial Sequence
  Description of Artificial Sequence: Synthetic oligonucleotide
gtgatagaatacaaatgcaccagggtcctggag

SEQ ID NO: 250786 - DNA, 34 bp, Artificial Sequence
  Description of Artificial Sequence: Synthetic oligonucleotide
tgatagaatacaaatgcaccagggtcctggagac

SEQ ID NO: 250787 - DNA, 33 bp, Artificial Sequence
  Description of Artificial Sequence: Synthetic oligonucleotide
gatagaatacaaatgcaccagggtcctggagac

SEQ ID NO: 250788 - DNA, 36 bp, Artificial Sequence
  Description of Artificial Sequence: Synthetic oligonucleotide
atagaatacaaatgcaccagggtcctggagacattc

SEQ ID NO: 250789 - DNA, 35 bp, Artificial Sequence
  Description of Artificial Sequence: Synthetic oligonucleotide
tagaatacaaatgcaccagggtcctggagacattc

SEQ ID NO: 250790 - DNA, 34 bp, Artificial Sequence
  Description of Artificial Sequence: Synthetic oligonucleotide
agaatacaaatgcaccagggtcctggagacattc

SEQ ID NO: 250791 - DNA, 33 bp, Artificial Sequence
  Description of Artificial Sequence: Synthetic oligonucleotide
gaatacaaatgcaccagggtcctggagacattc

SEQ ID NO: 250792 - DNA, 34 bp, Artificial Sequence
  Description of Artificial Sequence: Synthetic oligonucleotide
aatacaaatgcaccagggtcctggagacattctc

SEQ ID NO: 250793 - DNA, 33 bp, Artificial Sequence
  Description of Artificial Sequence: Synthetic oligonucleotide
atacaaatgcaccagggtcctggagacattctc

SEQ ID NO: 250794 - DNA, 32 bp, Artificial Sequence
  Description of Artificial Sequence: Synthetic oligonucleotide
tacaaatgcaccagggtcctggagacattctc

SEQ ID NO: 250795 - DNA, 31 bp, Artificial Sequence
  Description of Artificial Sequence: Synthetic oligonucleotide
acaaatgcaccagggtcctggagacattctc

SEQ ID NO: 250796 - DNA, 30 bp, Artificial Sequence
  Description of Artificial Sequence: Synthetic oligonucleotide
caaatgcaccagggtcctggagacattctc

SEQ ID NO: 250797 - DNA, 30 bp, Artificial Sequence
  Description of Artificial Sequence: Synthetic oligonucleotide
aaatgcaccagggtcctggagacattctcc

SEQ ID NO: 250798 - DNA, 29 bp, Artificial Sequence
  Description of Artificial Sequence: Synthetic oligonucleotide
aatgcaccagggtcctggagacattctcc

SEQ ID NO: 250799 - DNA, 28 bp, Artificial Sequence
  Description of Artificial Sequence: Synthetic oligonucleotide
atgcaccagggtcctggagacattctcc

SEQ ID NO: 250800 - DNA, 27 bp, Artificial Sequence
  Description of Artificial Sequence: Synthetic oligonucleotide
tgcaccagggtcctggagacattctcc

SEQ ID NO: 250801 - DNA, 27 bp, Artificial Sequence
  Description of Artificial Sequence: Synthetic oligonucleotide
gcaccagggtcctggagacattctcca

SEQ ID NO: 250802 - DNA, 28 bp, Artificial Sequence
  Description of Artificial Sequence: Synthetic oligonucleotide
caccagggtcctggagacattctccaag

SEQ ID NO: 250803 - DNA, 30 bp, Artificial Sequence
  Description of Artificial Sequence: Synthetic oligonucleotide
accagggtcctggagacattctccaagatc

SEQ ID NO: 250804 - DNA, 29 bp, Artificial Sequence
  Description of Artificial Sequence: Synthetic oligonucleotide
ccagggtcctggagacattctccaagatc

SEQ ID NO: 250805 - DNA, 29 bp, Artificial Sequence
  Description of Artificial Sequence: Synthetic oligonucleotide
cagggtcctggagacattctccaagatcc

SEQ ID NO: 250806 - DNA, 30 bp, Artificial Sequence
  Description of Artificial Sequence: Synthetic oligonucleotide
agggtcctggagacattctccaagatcctg

SEQ ID NO: 250807 - DNA, 29 bp, Artificial Sequence
  Description of Artificial Sequence: Synthetic oligonucleotide
gggtcctggagacattctccaagatcctg

SEQ ID NO: 250808 - DNA, 29 bp, Artificial Sequence
  Description of Artificial Sequence: Synthetic oligonucleotide
ggtcctggagacattctccaagatcctgg

SEQ ID NO: 250809 - DNA, 30 bp, Artificial Sequence
  Description of Artificial Sequence: Synthetic oligonucleotide
gtcctggagacattctccaagatcctggac

SEQ ID NO: 250810 - DNA, 32 bp, Artificial Sequence
  Description of Artificial Sequence: Synthetic oligonucleotide
tcctggagacattctccaagatcctggacatc

SEQ ID NO: 250811 - DNA, 31 bp, Artificial Sequence
  Description of Artificial Sequence: Synthetic oligonucleotide
cctggagacattctccaagatcctggacatc

SEQ ID NO: 250812 - DNA, 31 bp, Artificial Sequence
  Description of Artificial Sequence: Synthetic oligonucleotide
ctggagacattctccaagatcctggacatcg

SEQ ID NO: 250813 - DNA, 31 bp, Artificial Sequence
  Description of Artificial Sequence: Synthetic oligonucleotide
tggagacattctccaagatcctggacatcgg

SEQ ID NO: 250814 - DNA, 30 bp, Artificial Sequence
  Description of Artificial Sequence: Synthetic oligonucleotide
ggagacattctccaagatcctggacatcgg

SEQ ID NO: 250815 - DNA, 30 bp, Artificial Sequence
  Description of Artificial Sequence: Synthetic oligonucleotide
gagacattctccaagatcctggacatcggg

SEQ ID NO: 250816 - DNA, 30 bp, Artificial Sequence
  Description of Artificial Sequence: Synthetic oligonucleotide
agacattctccaagatcctggacatcgggg

SEQ ID NO: 250817 - DNA, 29 bp, Artificial Sequence
  Description of Artificial Sequence: Synthetic oligonucleotide
gacattctccaagatcctggacatcgggg

SEQ ID NO: 250818 - DNA, 29 bp, Artificial Sequence
  Description of Artificial Sequence: Synthetic oligonucleotide
acattctccaagatcctggacatcggggg

SEQ ID NO: 250819 - DNA, 28 bp, Artificial Sequence
  Description of Artificial Sequence: Synthetic oligonucleotide
cattctccaagatcctggacatcggggg

SEQ ID NO: 250820 - DNA, 28 bp, Artificial Sequence
  Description of Artificial Sequence: Synthetic oligonucleotide
attctccaagatcctggacatcgggggc

SEQ ID NO: 250821 - DNA, 27 bp, Artificial Sequence
  Description of Artificial Sequence: Synthetic oligonucleotide
ttctccaagatcctggacatcgggggc

SEQ ID NO: 250822 - DNA, 26 bp, Artificial Sequence
  Description of Artificial Sequence: Synthetic oligonucleotide
tctccaagatcctggacatcgggggc

SEQ ID NO: 250823 - DNA, 25 bp, Artificial Sequence
  Description of Artificial Sequence: Synthetic oligonucleotide
ctccaagatcctggacatcgggggc

SEQ ID NO: 250824 - DNA, 26 bp, Artificial Sequence
  Description of Artificial Sequence: Synthetic oligonucleotide
tccaagatcctggacatcgggggcgt

SEQ ID NO: 250825 - DNA, 25 bp, Artificial Sequence
  Description of Artificial Sequence: Synthetic oligonucleotide
ccaagatcctggacatcgggggcgt

SEQ ID NO: 250826 - DNA, 25 bp, Artificial Sequence
  Description of Artificial Sequence: Synthetic oligonucleotide
caagatcctggacatcgggggcgtc

SEQ ID NO: 250827 - DNA, 26 bp, Artificial Sequence
  Description of Artificial Sequence: Synthetic oligonucleotide
aagatcctggacatcgggggcgtcct

SEQ ID NO: 250828 - DNA, 25 bp, Artificial Sequence
  Description of Artificial Sequence: Synthetic oligonucleotide
agatcctggacatcgggggcgtcct

SEQ ID NO: 250829 - DNA, 24 bp, Artificial Sequence
  Description of Artificial Sequence: Synthetic oligonucleotide
gatcctggacatcgggggcgtcct

SEQ ID NO: 250830 - DNA, 24 bp, Artificial Sequence
  Description of Artificial Sequence: Synthetic oligonucleotide
atcctggacatcgggggcgtcctg

SEQ ID NO: 250831 - DNA, 23 bp, Artificial Sequence
  Description of Artificial Sequence: Synthetic oligonucleotide
tcctggacatcgggggcgtcctg

SEQ ID NO: 250832 - DNA, 22 bp, Artificial Sequence
  Description of Artificial Sequence: Synthetic oligonucleotide
cctggacatcgggggcgtcctg

SEQ ID NO: 250833 - DNA, 22 bp, Artificial Sequence
  Description of Artificial Sequence: Synthetic oligonucleotide
ctggacatcgggggcgtcctgc

SEQ ID NO: 250834 - DNA, 22 bp, Artificial Sequence
  Description of Artificial Sequence: Synthetic oligonucleotide
tggacatcgggggcgtcctgcc

SEQ ID NO: 250835 - DNA, 21 bp, Artificial Sequence
  Description of Artificial Sequence: Synthetic oligonucleotide
ggacatcgggggcgtcctgcc

SEQ ID NO: 250836 - DNA, 22 bp, Artificial Sequence
  Description of Artificial Sequence: Synthetic oligonucleotide
gacatcgggggcgtcctgccca

SEQ ID NO: 250837 - DNA, 22 bp, Artificial Sequence
  Description of Artificial Sequence: Synthetic oligonucleotide
acatcgggggcgtcctgcccac

SEQ ID NO: 250838 - DNA, 21 bp, Artificial Sequence
  Description of Artificial Sequence: Synthetic oligonucleotide
catcgggggcgtcctgcccac

SEQ ID NO: 250839 - DNA, 21 bp, Artificial Sequence
  Description of Artificial Sequence: Synthetic oligonucleotide
atcgggggcgtcctgcccacg

SEQ ID NO: 250840 - DNA, 20 bp, Artificial Sequence
  Description of Artificial Sequence: Synthetic oligonucleotide
tcgggggcgtcctgcccacg

SEQ ID NO: 250841 - DNA, 20 bp, Artificial Sequence
  Description of Artificial Sequence: Synthetic oligonucleotide
cgggggcgtcctgcccacgt

SEQ ID NO: 250842 - DNA, 20 bp, Artificial Sequence
  Description of Artificial Sequence: Synthetic oligonucleotide
gggggcgtcctgcccacgca

SEQ ID NO: 250843 - DNA, 20 bp, Artificial Sequence
  Description of Artificial Sequence: Synthetic oligonucleotide
ggggcgtcctgcccacgcag

SEQ ID NO: 250844 - DNA, 21 bp, Artificial Sequence
  Description of Artificial Sequence: Synthetic oligonucleotide
gggcgtcctgcccacgcagga

SEQ ID NO: 250845 - DNA, 21 bp, Artificial Sequence
  Description of Artificial Sequence: Synthetic oligonucleotide
ggcgtcctgcccacgcaggag

SEQ ID NO: 250846 - DNA, 21 bp, Artificial Sequence
  Description of Artificial Sequence: Synthetic oligonucleotide
gcgtcctgcccacgcaggagc

SEQ ID NO: 250847 - DNA, 21 bp, Artificial Sequence
  Description of Artificial Sequence: Synthetic oligonucleotide
cgtcctgcccacgcaggagcc

SEQ ID NO: 250848 - DNA, 21 bp, Artificial Sequence
  Description of Artificial Sequence: Synthetic oligonucleotide
gtcctgcccacgcaggagccc

SEQ ID NO: 250849 - DNA, 21 bp, Artificial Sequence
  Description of Artificial Sequence: Synthetic oligonucleotide
tcctgcccacgcaggagcccc

SEQ ID NO: 250850 - DNA, 20 bp, Artificial Sequence
  Description of Artificial Sequence: Synthetic oligonucleotide
cctgcccacgcaggagcccc

SEQ ID NO: 250851 - DNA, 20 bp, Artificial Sequence
  Description of Artificial Sequence: Synthetic oligonucleotide
ctgcccacgcaggagccccg

SEQ ID NO: 250852 - DNA, 20 bp, Artificial Sequence
  Description of Artificial Sequence: Synthetic oligonucleotide
tgcccacgcaggagccccgg

SEQ ID NO: 250853 - DNA, 20 bp, Artificial Sequence
  Description of Artificial Sequence: Synthetic oligonucleotide
gcccacgcaggagccccggt

SEQ ID NO: 250854 - DNA, 20 bp, Artificial Sequence
  Description of Artificial Sequence: Synthetic oligonucleotide
cccacgcaggagccccggga

SEQ ID NO: 250855 - DNA, 20 bp, Artificial Sequence
  Description of Artificial Sequence: Synthetic oligonucleotide
ccacgcaggagccccgggag

SEQ ID NO: 250856 - DNA, 21 bp, Artificial Sequence
  Description of Artificial Sequence: Synthetic oligonucleotide
cacgcaggagccccgggagga

SEQ ID NO: 250857 - DNA, 21 bp, Artificial Sequence
  Description of Artificial Sequence: Synthetic oligonucleotide
acgcaggagccccgggaggag

SEQ ID NO: 250858 - DNA, 20 bp, Artificial Sequence
  Description of Artificial Sequence: Synthetic oligonucleotide
cgcaggagccccgggaggag

SEQ ID NO: 250859 - DNA, 20 bp, Artificial Sequence
  Description of Artificial Sequence: Synthetic oligonucleotide
gcaggagccccgggaggagc

SEQ ID NO: 250860 - DNA, 21 bp, Artificial Sequence
  Description of Artificial Sequence: Synthetic oligonucleotide
caggagccccgggaggagcct

SEQ ID NO: 250861 - DNA, 21 bp, Artificial Sequence
  Description of Artificial Sequence: Synthetic oligonucleotide
aggagccccgggaggagcctg

SEQ ID NO: 250862 - DNA, 20 bp, Artificial Sequence
  Description of Artificial Sequence: Synthetic oligonucleotide
ggagccccgggaggagcctg

SEQ ID NO: 250863 - DNA, 21 bp, Artificial Sequence
  Description of Artificial Sequence: Synthetic oligonucleotide
gagccccgggaggagcctgca

SEQ ID NO: 250864 - DNA, 21 bp, Artificial Sequence
  Description of Artificial Sequence: Synthetic oligonucleotide
agccccgggaggagcctgcag

SEQ ID NO: 250865 - DNA, 20 bp, Artificial Sequence
  Description of Artificial Sequence: Synthetic oligonucleotide
gccccgggaggagcctgcag

SEQ ID NO: 250866 - DNA, 20 bp, Artificial Sequence
  Description of Artificial Sequence: Synthetic oligonucleotide
ccccgggaggagcctgcagc

SEQ ID NO: 250867 - DNA, 20 bp, Artificial Sequence
  Description of Artificial Sequence: Synthetic oligonucleotide
cccgggaggagcctgcagcc

SEQ ID NO: 250868 - DNA, 20 bp, Artificial Sequence
  Description of Artificial Sequence: Synthetic oligonucleotide
ccgggaggagcctgcagccc

SEQ ID NO: 250869 - DNA, 20 bp, Artificial Sequence
  Description of Artificial Sequence: Synthetic oligonucleotide
cgggaggagcctgcagcccc

SEQ ID NO: 250870 - DNA, 22 bp, Artificial Sequence
  Description of Artificial Sequence: Synthetic oligonucleotide
gggaggagcctgcagccccgat

SEQ ID NO: 250871 - DNA, 22 bp, Artificial Sequence
  Description of Artificial Sequence: Synthetic oligonucleotide
ggaggagcctgcagccccgatc

SEQ ID NO: 250872 - DNA, 22 bp, Artificial Sequence
  Description of Artificial Sequence: Synthetic oligonucleotide
gaggagcctgcagccccgatcc

SEQ ID NO: 250873 - DNA, 22 bp, Artificial Sequence
  Description of Artificial Sequence: Synthetic oligonucleotide
aggagcctgcagccccgatccc

SEQ ID NO: 250874 - DNA, 21 bp, Artificial Sequence
  Description of Artificial Sequence: Synthetic oligonucleotide
ggagcctgcagccccgatccc

SEQ ID NO: 250875 - DNA, 21 bp, Artificial Sequence
  Description of Artificial Sequence: Synthetic oligonucleotide
gagcctgcagccccgatcccg

SEQ ID NO: 250876 - DNA, 22 bp, Artificial Sequence
  Description of Artificial Sequence: Synthetic oligonucleotide
agcctgcagccccgatcccgga

SEQ ID NO: 250877 - DNA, 21 bp, Artificial Sequence
  Description of Artificial Sequence: Synthetic oligonucleotide
gcctgcagccccgatcccgga

SEQ ID NO: 250878 - DNA, 21 bp, Artificial Sequence
  Description of Artificial Sequence: Synthetic oligonucleotide
cctgcagccccgatcccggag

SEQ ID NO: 250879 - DNA, 21 bp, Artificial Sequence
  Description of Artificial Sequence: Synthetic oligonucleotide
ctgcagccccgatcccggagc

SEQ ID NO: 250880 - DNA, 22 bp, Artificial Sequence
  Description of Artificial Sequence: Synthetic oligonucleotide
tgcagccccgatcccggagcga

SEQ ID NO: 250881 - DNA, 21 bp, Artificial Sequence
  Description of Artificial Sequence: Synthetic oligonucleotide
gcagccccgatcccggagcga

SEQ ID NO: 250882 - DNA, 21 bp, Artificial Sequence
  Description of Artificial Sequence: Synthetic oligonucleotide
cagccccgatcccggagcgac

SEQ ID NO: 250883 - DNA, 21 bp, Artificial Sequence
  Description of Artificial Sequence: Synthetic oligonucleotide
agccccgatcccggagcgacc

SEQ ID NO: 250884 - DNA, 20 bp, Artificial Sequence
  Description of Artificial Sequence: Synthetic oligonucleotide
gccccgatcccggagcgacc

SEQ ID NO: 250885 - DNA, 20 bp, Artificial Sequence
  Description of Artificial Sequence: Synthetic oligonucleotide
ccccgatcccggagcgaccg

SEQ ID NO: 250886 - DNA, 20 bp, Artificial Sequence
  Description of Artificial Sequence: Synthetic oligonucleotide
cccgatcccggagcgaccgg

SEQ ID NO: 250887 - DNA, 20 bp, Artificial Sequence
  Description of Artificial Sequence: Synthetic oligonucleotide
ccgatcccggagcgaccggc

SEQ ID NO: 250888 - DNA, 22 bp, Artificial Sequence
  Description of Artificial Sequence: Synthetic oligonucleotide
cgatcccggagcgaccggccaa

SEQ ID NO: 250889 - DNA, 23 bp, Artificial Sequence
  Description of Artificial Sequence: Synthetic oligonucleotide
gatcccggagcgaccggccaagt

SEQ ID NO: 250890 - DNA, 23 bp, Artificial Sequence
  Description of Artificial Sequence: Synthetic oligonucleotide
atcccggagcgaccggccaagtc

SEQ ID NO: 250891 - DNA, 22 bp, Artificial Sequence
  Description of Artificial Sequence: Synthetic oligonucleotide
tcccggagcgaccggccaagtc

SEQ ID NO: 250892 - DNA, 21 bp, Artificial Sequence
  Description of Artificial Sequence: Synthetic oligonucleotide
cccggagcgaccggccaagtc

SEQ ID NO: 250893 - DNA, 22 bp, Artificial Sequence
  Description of Artificial Sequence: Synthetic oligonucleotide
ccggagcgaccggccaagtcca

SEQ ID NO: 250894 - DNA, 25 bp, Artificial Sequence
  Description of Artificial Sequence: Synthetic oligonucleotide
cggagcgaccggccaagtccactat

SEQ ID NO: 250895 - DNA, 25 bp, Artificial Sequence
  Description of Artificial Sequence: Synthetic oligonucleotide
ggagcgaccggccaagtccactatg

SEQ ID NO: 250896 - DNA, 25 bp, Artificial Sequence
  Description of Artificial Sequence: Synthetic oligonucleotide
gagcgaccggccaagtccactatgc

SEQ ID NO: 250897 - DNA, 25 bp, Artificial Sequence
  Description of Artificial Sequence: Synthetic oligonucleotide
agcgaccggccaagtccactatgcg

SEQ ID NO: 250898 - DNA, 24 bp, Artificial Sequence
  Description of Artificial Sequence: Synthetic oligonucleotide
gcgaccggccaagtccactatgcg

SEQ ID NO: 250899 - DNA, 25 bp, Artificial Sequence
  Description of Artificial Sequence: Synthetic oligonucleotide
cgaccggccaagtccactatgcggt

SEQ ID NO: 250900 - DNA, 25 bp, Artificial Sequence
  Description of Artificial Sequence: Synthetic oligonucleotide
gaccggccaagtccactatgcggtc

SEQ ID NO: 250901 - DNA, 27 bp, Artificial Sequence
  Description of Artificial Sequence: Synthetic oligonucleotide
accggccaagtccactatgcggtccaa

SEQ ID NO: 250902 - DNA, 26 bp, Artificial Sequence
  Description of Artificial Sequence: Synthetic oligonucleotide
ccggccaagtccactatgcggtccaa

SEQ ID NO: 250903 - DNA, 26 bp, Artificial Sequence
  Description of Artificial Sequence: Synthetic oligonucleotide
cggccaagtccactatgcggtccaag

SEQ ID NO: 250904 - DNA, 27 bp, Artificial Sequence
  Description of Artificial Sequence: Synthetic oligonucleotide
ggccaagtccactatgcggtccaaggt

SEQ ID NO: 250905 - DNA, 27 bp, Artificial Sequence
  Description of Artificial Sequence: Synthetic oligonucleotide
gccaagtccactatgcggtccaaggtg

SEQ ID NO: 250906 - DNA, 27 bp, Artificial Sequence
  Description of Artificial Sequence: Synthetic oligonucleotide
ccaagtccactatgcggtccaaggtgg

SEQ ID NO: 250907 - DNA, 29 bp, Artificial Sequence
  Description of Artificial Sequence: Synthetic oligonucleotide
caagtccactatgcggtccaaggtggaac

SEQ ID NO: 250908 - DNA, 30 bp, Artificial Sequence
  Description of Artificial Sequence: Synthetic oligonucleotide
aagtccactatgcggtccaaggtggaactg

SEQ ID NO: 250909 - DNA, 29 bp, Artificial Sequence
  Description of Artificial Sequence: Synthetic oligonucleotide
agtccactatgcggtccaaggtggaactg

SEQ ID NO: 250910 - DNA, 28 bp, Artificial Sequence
  Description of Artificial Sequence: Synthetic oligonucleotide
gtccactatgcggtccaaggtggaactg

SEQ ID NO: 250911 - DNA, 30 bp, Artificial Sequence
  Description of Artificial Sequence: Synthetic oligonucleotide
tccactatgcggtccaaggtggaactgtac

SEQ ID NO: 250912 - DNA, 21 bp, Artificial Sequence
  Description of Artificial Sequence: Synthetic oligonucleotide
aagcgcctccggcgcctagcg

SEQ ID NO: 250913 - DNA, 20 bp, Artificial Sequence
  Description of Artificial Sequence: Synthetic oligonucleotide
agcgcctccggcgcctagcg

SEQ ID NO: 250914 - DNA, 20 bp, Artificial Sequence
  Description of Artificial Sequence: Synthetic oligonucleotide
gcgcctccggcgcctagcgt

SEQ ID NO: 250915 - DNA, 20 bp, Artificial Sequence
  Description of Artificial Sequence: Synthetic oligonucleotide
cgcctccggcgcctagcggt

SEQ ID NO: 250916 - DNA, 22 bp, Artificial Sequence
  Description of Artificial Sequence: Synthetic oligonucleotide
gcctccggcgcctagcggtgtt

SEQ ID NO: 250917 - DNA, 22 bp, Artificial Sequence
  Description of Artificial Sequence: Synthetic oligonucleotide
cctccggcgcctagcggtgttc

SEQ ID NO: 250918 - DNA, 22 bp, Artificial Sequence
  Description of Artificial Sequence: Synthetic oligonucleotide
ctccggcgcctagcggtgttcc

SEQ ID NO: 250919 - DNA, 22 bp, Artificial Sequence
  Description of Artificial Sequence: Synthetic oligonucleotide
tccggcgcctagcggtgttccc

SEQ ID NO: 250920 - DNA, 21 bp, Artificial Sequence
  Description of Artificial Sequence: Synthetic oligonucleotide
ccggcgcctagcggtgttccc

SEQ ID NO: 250921 - DNA, 21 bp, Artificial Sequence
  Description of Artificial Sequence: Synthetic oligonucleotide
cggcgcctagcggtgttcccg

SEQ ID NO: 250922 - DNA, 21 bp, Artificial Sequence
  Description of Artificial Sequence: Synthetic oligonucleotide
ggcgcctagcggtgttcccgg

SEQ ID NO: 250923 - DNA, 22 bp, Artificial Sequence
  Description of Artificial Sequence: Synthetic oligonucleotide
gcgcctagcggtgttcccggct

SEQ ID NO: 250924 - DNA, 23 bp, Artificial Sequence
  Description of Artificial Sequence: Synthetic oligonucleotide
cgcctagcggtgttcccggctgt

SEQ ID NO: 250925 - DNA, 23 bp, Artificial Sequence
  Description of Artificial Sequence: Synthetic oligonucleotide
gcctagcggtgttcccggctgtg

SEQ ID NO: 250926 - DNA, 23 bp, Artificial Sequence
  Description of Artificial Sequence: Synthetic oligonucleotide
cctagcggtgttcccggctgtgg

SEQ ID NO: 250927 - DNA, 23 bp, Artificial Sequence
  Description of Artificial Sequence: Synthetic oligonucleotide
ctagcggtgttcccggctgtggc

SEQ ID NO: 250928 - DNA, 23 bp, Artificial Sequence
  Description of Artificial Sequence: Synthetic oligonucleotide
tagcggtgttcccggctgtggcg

SEQ ID NO: 250929 - DNA, 22 bp, Artificial Sequence
  Description of Artificial Sequence: Synthetic oligonucleotide
agcggtgttcccggctgtggcg

SEQ ID NO: 250930 - DNA, 21 bp, Artificial Sequence
  Description of Artificial Sequence: Synthetic oligonucleotide
gcggtgttcccggctgtggcg

SEQ ID NO: 250931 - DNA, 22 bp, Artificial Sequence
  Description of Artificial Sequence: Synthetic oligonucleotide
cggtgttcccggctgtggcgct

SEQ ID NO: 250932 - DNA, 22 bp, Artificial Sequence
  Description of Artificial Sequence: Synthetic oligonucleotide
ggtgttcccggctgtggcgctc

SEQ ID NO: 250933 - DNA, 24 bp, Artificial Sequence
  Description of Artificial Sequence: Synthetic oligonucleotide
gtgttcccggctgtggcgctcctt

SEQ ID NO: 250934 - DNA, 26 bp, Artificial Sequence
  Description of Artificial Sequence: Synthetic oligonucleotide
tgttcccggctgtggcgctccttctt

SEQ ID NO: 250935 - DNA, 25 bp, Artificial Sequence
  Description of Artificial Sequence: Synthetic oligonucleotide
gttcccggctgtggcgctccttctt

SEQ ID NO: 250936 - DNA, 25 bp, Artificial Sequence
  Description of Artificial Sequence: Synthetic oligonucleotide
ttcccggctgtggcgctccttcttg

SEQ ID NO: 250937 - DNA, 24 bp, Artificial Sequence
  Description of Artificial Sequence: Synthetic oligonucleotide
tcccggctgtggcgctccttcttg

SEQ ID NO: 250938 - DNA, 23 bp, Artificial Sequence
  Description of Artificial Sequence: Synthetic oligonucleotide
cccggctgtggcgctccttcttg

SEQ ID NO: 250939 - DNA, 23 bp, Artificial Sequence
  Description of Artificial Sequence: Synthetic oligonucleotide
ccggctgtggcgctccttcttgc

SEQ ID NO: 250940 - DNA, 23 bp, Artificial Sequence
  Description of Artificial Sequence: Synthetic oligonucleotide
cggctgtggcgctccttcttgcc

SEQ ID NO: 250941 - DNA, 23 bp, Artificial Sequence
  Description of Artificial Sequence: Synthetic oligonucleotide
ggctgtggcgctccttcttgccc

SEQ ID NO: 250942 - DNA, 23 bp, Artificial Sequence
  Description of Artificial Sequence: Synthetic oligonucleotide
gctgtggcgctccttcttgcccc

SEQ ID NO: 250943 - DNA, 23 bp, Artificial Sequence
  Description of Artificial Sequence: Synthetic oligonucleotide
ctgtggcgctccttcttgccccg

SEQ ID NO: 250944 - DNA, 23 bp, Artificial Sequence
  Description of Artificial Sequence: Synthetic oligonucleotide
tgtggcgctccttcttgccccgg

SEQ ID NO: 250945 - DNA, 22 bp, Artificial Sequence
  Description of Artificial Sequence: Synthetic oligonucleotide
gtggcgctccttcttgccccgg

SEQ ID NO: 250946 - DNA, 22 bp, Artificial Sequence
  Description of Artificial Sequence: Synthetic oligonucleotide
tggcgctccttcttgccccggc

SEQ ID NO: 250947 - DNA, 21 bp, Artificial Sequence
  Description of Artificial Sequence: Synthetic oligonucleotide
ggcgctccttcttgccccggc

SEQ ID NO: 250948 - DNA, 21 bp, Artificial Sequence
  Description of Artificial Sequence: Synthetic oligonucleotide
gcgctccttcttgccccggcc

SEQ ID NO: 250949 - DNA, 21 bp, Artificial Sequence
  Description of Artificial Sequence: Synthetic oligonucleotide
cgctccttcttgccccggccc

SEQ ID NO: 250950 - DNA, 21 bp, Artificial Sequence
  Description of Artificial Sequence: Synthetic oligonucleotide
gctccttcttgccccggcccg

SEQ ID NO: 250951 - DNA, 21 bp, Artificial Sequence
  Description of Artificial Sequence: Synthetic oligonucleotide
ctccttcttgccccggcccgc

SEQ ID NO: 250952 - DNA, 22 bp, Artificial Sequence
  Description of Artificial Sequence: Synthetic oligonucleotide
tccttcttgccccggcccgcca

SEQ ID NO: 250953 - DNA, 21 bp, Artificial Sequence
  Description of Artificial Sequence: Synthetic oligonucleotide
ccttcttgccccggcccgcca

SEQ ID NO: 250954 - DNA, 21 bp, Artificial Sequence
  Description of Artificial Sequence: Synthetic oligonucleotide
cttcttgccccggcccgccac

SEQ ID NO: 250955 - DNA, 21 bp, Artificial Sequence
  Description of Artificial Sequence: Synthetic oligonucleotide
ttcttgccccggcccgccacg

SEQ ID NO: 250956 - DNA, 20 bp, Artificial Sequence
  Description of Artificial Sequence: Synthetic oligonucleotide
tcttgccccggcccgccacg

SEQ ID NO: 250957 - DNA, 20 bp, Artificial Sequence
  Description of Artificial Sequence: Synthetic oligonucleotide
cttgccccggcccgccacgt

SEQ ID NO: 250958 - DNA, 20 bp, Artificial Sequence
  Description of Artificial Sequence: Synthetic oligonucleotide
ttgccccggcccgccacgct

SEQ ID NO: 250959 - DNA, 20 bp, Artificial Sequence
  Description of Artificial Sequence: Synthetic oligonucleotide
tgccccggcccgccacgctt

SEQ ID NO: 250960 - DNA, 20 bp, Artificial Sequence
  Description of Artificial Sequence: Synthetic oligonucleotide
gccccggcccgccacgcttt

SEQ ID NO: 250961 - DNA, 20 bp, Artificial Sequence
  Description of Artificial Sequence: Synthetic oligonucleotide
ccccggcccgccacgccttt

SEQ ID NO: 250962 - DNA, 20 bp, Artificial Sequence
  Description of Artificial Sequence: Synthetic oligonucleotide
cccggcccgccacgccgttt

SEQ ID NO: 250963 - DNA, 20 bp, Artificial Sequence
  Description of Artificial Sequence: Synthetic oligonucleotide
ccggcccgccacgccgcttt

SEQ ID NO: 250964 - DNA, 20 bp, Artificial Sequence
  Description of Artificial Sequence: Synthetic oligonucleotide
cggcccgccacgccgctgtt

SEQ ID NO: 250965 - DNA, 20 bp, Artificial Sequence
  Description of Artificial Sequence: Synthetic oligonucleotide
ggcccgccacgccgctgctt

SEQ ID NO: 250966 - DNA, 20 bp, Artificial Sequence
  Description of Artificial Sequence: Synthetic oligonucleotide
gcccgccacgccgctgcgtt

SEQ ID NO: 250967 - DNA, 20 bp, Artificial Sequence
  Description of Artificial Sequence: Synthetic oligonucleotide
cccgccacgccgctgcgtct

SEQ ID NO: 250968 - DNA, 20 bp, Artificial Sequence
  Description of Artificial Sequence: Synthetic oligonucleotide
ccgccacgccgctgcgtcct

SEQ ID NO: 250969 - DNA, 20 bp, Artificial Sequence
  Description of Artificial Sequence: Synthetic oligonucleotide
cgccacgccgctgcgtccga

SEQ ID NO: 250970 - DNA, 20 bp, Artificial Sequence
  Description of Artificial Sequence: Synthetic oligonucleotide
gccacgccgctgcgtccgac

SEQ ID NO: 250971 - DNA, 21 bp, Artificial Sequence
  Description of Artificial Sequence: Synthetic oligonucleotide
ccacgccgctgcgtccgacgt

SEQ ID NO: 250972 - DNA, 21 bp, Artificial Sequence
  Description of Artificial Sequence: Synthetic oligonucleotide
cacgccgctgcgtccgacgtg

SEQ ID NO: 250973 - DNA, 23 bp, Artificial Sequence
  Description of Artificial Sequence: Synthetic oligonucleotide
acgccgctgcgtccgacgtggta

SEQ ID NO: 250974 - DNA, 22 bp, Artificial Sequence
  Description of Artificial Sequence: Synthetic oligonucleotide
cgccgctgcgtccgacgtggta

SEQ ID NO: 250975 - DNA, 24 bp, Artificial Sequence
  Description of Artificial Sequence: Synthetic oligonucleotide
gccgctgcgtccgacgtggtagaa

SEQ ID NO: 250976 - DNA, 25 bp, Artificial Sequence
  Description of Artificial Sequence: Synthetic oligonucleotide
ccgctgcgtccgacgtggtagaact

SEQ ID NO: 250977 - DNA, 26 bp, Artificial Sequence
  Description of Artificial Sequence: Synthetic oligonucleotide
cgctgcgtccgacgtggtagaactca

SEQ ID NO: 250978 - DNA, 26 bp, Artificial Sequence
  Description of Artificial Sequence: Synthetic oligonucleotide
gctgcgtccgacgtggtagaactcag

SEQ ID NO: 250979 - DNA, 26 bp, Artificial Sequence
  Description of Artificial Sequence: Synthetic oligonucleotide
ctgcgtccgacgtggtagaactcagg

SEQ ID NO: 250980 - DNA, 27 bp, Artificial Sequence
  Description of Artificial Sequence: Synthetic oligonucleotide
tgcgtccgacgtggtagaactcaggga

SEQ ID NO: 250981 - DNA, 26 bp, Artificial Sequence
  Description of Artificial Sequence: Synthetic oligonucleotide
gcgtccgacgtggtagaactcaggga

SEQ ID NO: 250982 - DNA, 26 bp, Artificial Sequence
  Description of Artificial Sequence: Synthetic oligonucleotide
cgtccgacgtggtagaactcagggac

SEQ ID NO: 250983 - DNA, 27 bp, Artificial Sequence
  Description of Artificial Sequence: Synthetic oligonucleotide
gtccgacgtggtagaactcagggacga

SEQ ID NO: 250984 - DNA, 27 bp, Artificial Sequence
  Description of Artificial Sequence: Synthetic oligonucleotide
tccgacgtggtagaactcagggacgac

SEQ ID NO: 250985 - DNA, 27 bp, Artificial Sequence
  Description of Artificial Sequence: Synthetic oligonucleotide
ccgacgtggtagaactcagggacgaca

SEQ ID NO: 250986 - DNA, 28 bp, Artificial Sequence
  Description of Artificial Sequence: Synthetic oligonucleotide
cgacgtggtagaactcagggacgacaag

SEQ ID NO: 250987 - DNA, 30 bp, Artificial Sequence
  Description of Artificial Sequence: Synthetic oligonucleotide
gacgtggtagaactcagggacgacaagttc

SEQ ID NO: 250988 - DNA, 30 bp, Artificial Sequence
  Description of Artificial Sequence: Synthetic oligonucleotide
acgtggtagaactcagggacgacaagttcg

SEQ ID NO: 250989 - DNA, 29 bp, Artificial Sequence
  Description of Artificial Sequence: Synthetic oligonucleotide
cgtggtagaactcagggacgacaagttcg

SEQ ID NO: 250990 - DNA, 30 bp, Artificial Sequence
  Description of Artificial Sequence: Synthetic oligonucleotide
gtggtagaactcagggacgacaagttcgag

SEQ ID NO: 250991 - DNA, 31 bp, Artificial Sequence
  Description of Artificial Sequence: Synthetic oligonucleotide
tggtagaactcagggacgacaagttcgagag

SEQ ID NO: 250992 - DNA, 30 bp, Artificial Sequence
  Description of Artificial Sequence: Synthetic oligonucleotide
ggtagaactcagggacgacaagttcgagag

SEQ ID NO: 250993 - DNA, 31 bp, Artificial Sequence
  Description of Artificial Sequence: Synthetic oligonucleotide
gtagaactcagggacgacaagttcgagagtg

SEQ ID NO: 250994 - DNA, 31 bp, Artificial Sequence
  Description of Artificial Sequence: Synthetic oligonucleotide
tagaactcagggacgacaagttcgagagtgg

SEQ ID NO: 250995 - DNA, 30 bp, Artificial Sequence
  Description of Artificial Sequence: Synthetic oligonucleotide
agaactcagggacgacaagttcgagagtgg

SEQ ID NO: 250996 - DNA, 29 bp, Artificial Sequence
  Description of Artificial Sequence: Synthetic oligonucleotide
gaactcagggacgacaagttcgagagtgg

SEQ ID NO: 250997 - DNA, 29 bp, Artificial Sequence
  Description of Artificial Sequence: Synthetic oligonucleotide
aactcagggacgacaagttcgagagtggc

SEQ ID NO: 250998 - DNA, 28 bp, Artificial Sequence
  Description of Artificial Sequence: Synthetic oligonucleotide
actcagggacgacaagttcgagagtggc

SEQ ID NO: 250999 - DNA, 27 bp, Artificial Sequence
  Description of Artificial Sequence: Synthetic oligonucleotide
ctcagggacgacaagttcgagagtggc

SEQ ID NO: 251000 - DNA, 29 bp, Artificial Sequence
  Description of Artificial Sequence: Synthetic oligonucleotide
tcagggacgacaagttcgagagtggcatc

SEQ ID NO: 251001 - DNA, 28 bp, Artificial Sequence
  Description of Artificial Sequence: Synthetic oligonucleotide
cagggacgacaagttcgagagtggcatc

SEQ ID NO: 251002 - DNA, 29 bp, Artificial Sequence
  Description of Artificial Sequence: Synthetic oligonucleotide
agggacgacaagttcgagagtggcatctc

SEQ ID NO: 251003 - DNA, 28 bp, Artificial Sequence
  Description of Artificial Sequence: Synthetic oligonucleotide
gggacgacaagttcgagagtggcatctc

SEQ ID NO: 251004 - DNA, 28 bp, Artificial Sequence
  Description of Artificial Sequence: Synthetic oligonucleotide
ggacgacaagttcgagagtggcatctcc

SEQ ID NO: 251005 - DNA, 28 bp, Artificial Sequence
  Description of Artificial Sequence: Synthetic oligonucleotide
gacgacaagttcgagagtggcatctccg

SEQ ID NO: 251006 - DNA, 29 bp, Artificial Sequence
  Description of Artificial Sequence: Synthetic oligonucleotide
acgacaagttcgagagtggcatctccgtc

SEQ ID NO: 251007 - DNA, 28 bp, Artificial Sequence
  Description of Artificial Sequence: Synthetic oligonucleotide
cgacaagttcgagagtggcatctccgtc

SEQ ID NO: 251008 - DNA, 29 bp, Artificial Sequence
  Description of Artificial Sequence: Synthetic oligonucleotide
gacaagttcgagagtggcatctccgtcac

SEQ ID NO: 251009 - DNA, 29 bp, Artificial Sequence
  Description of Artificial Sequence: Synthetic oligonucleotide
acaagttcgagagtggcatctccgtcacg

SEQ ID NO: 251010 - DNA, 28 bp, Artificial Sequence
  Description of Artificial Sequence: Synthetic oligonucleotide
caagttcgagagtggcatctccgtcacg

SEQ ID NO: 251011 - DNA, 28 bp, Artificial Sequence
  Description of Artificial Sequence: Synthetic oligonucleotide
aagttcgagagtggcatctccgtcacgg

SEQ ID NO: 251012 - DNA, 27 bp, Artificial Sequence
  Description of Artificial Sequence: Synthetic oligonucleotide
agttcgagagtggcatctccgtcacgg

SEQ ID NO: 251013 - DNA, 26 bp, Artificial Sequence
  Description of Artificial Sequence: Synthetic oligonucleotide
gttcgagagtggcatctccgtcacgg

SEQ ID NO: 251014 - DNA, 26 bp, Artificial Sequence
  Description of Artificial Sequence: Synthetic oligonucleotide
ttcgagagtggcatctccgtcacggg

SEQ ID NO: 251015 - DNA, 25 bp, Artificial Sequence
  Description of Artificial Sequence: Synthetic oligonucleotide
tcgagagtggcatctccgtcacggg

SEQ ID NO: 251016 - DNA, 24 bp, Artificial Sequence
  Description of Artificial Sequence: Synthetic oligonucleotide
cgagagtggcatctccgtcacggg

SEQ ID NO: 251017 - DNA, 25 bp, Artificial Sequence
  Description of Artificial Sequence: Synthetic oligonucleotide
gagagtggcatctccgtcacgggct

SEQ ID NO: 251018 - DNA, 26 bp, Artificial Sequence
  Description of Artificial Sequence: Synthetic oligonucleotide
agagtggcatctccgtcacgggctca

SEQ ID NO: 251019 - DNA, 25 bp, Artificial Sequence
  Description of Artificial Sequence: Synthetic oligonucleotide
gagtggcatctccgtcacgggctca

SEQ ID NO: 251020 - DNA, 25 bp, Artificial Sequence
  Description of Artificial Sequence: Synthetic oligonucleotide
agtggcatctccgtcacgggctcag

SEQ ID NO: 251021 - DNA, 24 bp, Artificial Sequence
  Description of Artificial Sequence: Synthetic oligonucleotide
gtggcatctccgtcacgggctcag

SEQ ID NO: 251022 - DNA, 24 bp, Artificial Sequence
  Description of Artificial Sequence: Synthetic oligonucleotide
tggcatctccgtcacgggctcagc

SEQ ID NO: 251023 - DNA, 23 bp, Artificial Sequence
  Description of Artificial Sequence: Synthetic oligonucleotide
ggcatctccgtcacgggctcagc

SEQ ID NO: 251024 - DNA, 23 bp, Artificial Sequence
  Description of Artificial Sequence: Synthetic oligonucleotide
gcatctccgtcacgggctcagcg

SEQ ID NO: 251025 - DNA, 23 bp, Artificial Sequence
  Description of Artificial Sequence: Synthetic oligonucleotide
catctccgtcacgggctcagcgg

SEQ ID NO: 251026 - DNA, 23 bp, Artificial Sequence
  Description of Artificial Sequence: Synthetic oligonucleotide
atctccgtcacgggctcagcggg

SEQ ID NO: 251027 - DNA, 22 bp, Artificial Sequence
  Description of Artificial Sequence: Synthetic oligonucleotide
tctccgtcacgggctcagcggg

SEQ ID NO: 251028 - DNA, 21 bp, Artificial Sequence
  Description of Artificial Sequence: Synthetic oligonucleotide
ctccgtcacgggctcagcggg

SEQ ID NO: 251029 - DNA, 21 bp, Artificial Sequence
  Description of Artificial Sequence: Synthetic oligonucleotide
tccgtcacgggctcagcgggc

SEQ ID NO: 251030 - DNA, 20 bp, Artificial Sequence
  Description of Artificial Sequence: Synthetic oligonucleotide
ccgtcacgggctcagcgggc

SEQ ID NO: 251031 - DNA, 21 bp, Artificial Sequence
  Description of Artificial Sequence: Synthetic oligonucleotide
cgtcacgggctcagcgggcct

SEQ ID NO: 251032 - DNA, 23 bp, Artificial Sequence
  Description of Artificial Sequence: Synthetic oligonucleotide
gtcacgggctcagcgggcctctt

SEQ ID NO: 251033 - DNA, 23 bp, Artificial Sequence
  Description of Artificial Sequence: Synthetic oligonucleotide
tcacgggctcagcgggcctcttg

SEQ ID NO: 251034 - DNA, 22 bp, Artificial Sequence
  Description of Artificial Sequence: Synthetic oligonucleotide
cacgggctcagcgggcctcttg

SEQ ID NO: 251035 - DNA, 23 bp, Artificial Sequence
  Description of Artificial Sequence: Synthetic oligonucleotide
acgggctcagcgggcctcttgct

SEQ ID NO: 251036 - DNA, 22 bp, Artificial Sequence
  Description of Artificial Sequence: Synthetic oligonucleotide
cgggctcagcgggcctcttgct

SEQ ID NO: 251037 - DNA, 22 bp, Artificial Sequence
  Description of Artificial Sequence: Synthetic oligonucleotide
gggctcagcgggcctcttgctc

SEQ ID NO: 251038 - DNA, 23 bp, Artificial Sequence
  Description of Artificial Sequence: Synthetic oligonucleotide
ggctcagcgggcctcttgctcgt

SEQ ID NO: 251039 - DNA, 23 bp, Artificial Sequence
  Description of Artificial Sequence: Synthetic oligonucleotide
gctcagcgggcctcttgctcgtc

SEQ ID NO: 251040 - DNA, 24 bp, Artificial Sequence
  Description of Artificial Sequence: Synthetic oligonucleotide
ctcagcgggcctcttgctcgtcgt

SEQ ID NO: 251041 - DNA, 26 bp, Artificial Sequence
  Description of Artificial Sequence: Synthetic oligonucleotide
tcagcgggcctcttgctcgtcgtgtt

SEQ ID NO: 251042 - DNA, 25 bp, Artificial Sequence
  Description of Artificial Sequence: Synthetic oligonucleotide
cagcgggcctcttgctcgtcgtgtt

SEQ ID NO: 251043 - DNA, 27 bp, Artificial Sequence
  Description of Artificial Sequence: Synthetic oligonucleotide
agcgggcctcttgctcgtcgtgttctt

SEQ ID NO: 251044 - DNA, 26 bp, Artificial Sequence
  Description of Artificial Sequence: Synthetic oligonucleotide
gcgggcctcttgctcgtcgtgttctt

SEQ ID NO: 251045 - DNA, 26 bp, Artificial Sequence
  Description of Artificial Sequence: Synthetic oligonucleotide
cgggcctcttgctcgtcgtgttcttc

SEQ ID NO: 251046 - DNA, 26 bp, Artificial Sequence
  Description of Artificial Sequence: Synthetic oligonucleotide
gggcctcttgctcgtcgtgttcttcg

SEQ ID NO: 251047 - DNA, 26 bp, Artificial Sequence
  Description of Artificial Sequence: Synthetic oligonucleotide
ggcctcttgctcgtcgtgttcttcgc

SEQ ID NO: 251048 - DNA, 26 bp, Artificial Sequence
  Description of Artificial Sequence: Synthetic oligonucleotide
gcctcttgctcgtcgtgttcttcgcg

SEQ ID NO: 251049 - DNA, 26 bp, Artificial Sequence
  Description of Artificial Sequence: Synthetic oligonucleotide
cctcttgctcgtcgtgttcttcgcgc

SEQ ID NO: 251050 - DNA, 26 bp, Artificial Sequence
  Description of Artificial Sequence: Synthetic oligonucleotide
ctcttgctcgtcgtgttcttcgcgcc

SEQ ID NO: 251051 - DNA, 27 bp, Artificial Sequence
  Description of Artificial Sequence: Synthetic oligonucleotide
tcttgctcgtcgtgttcttcgcgccct

SEQ ID NO: 251052 - DNA, 26 bp, Artificial Sequence
  Description of Artificial Sequence: Synthetic oligonucleotide
cttgctcgtcgtgttcttcgcgccct

SEQ ID NO: 251053 - DNA, 26 bp, Artificial Sequence
  Description of Artificial Sequence: Synthetic oligonucleotide
ttgctcgtcgtgttcttcgcgccctg

SEQ ID NO: 251054 - DNA, 25 bp, Artificial Sequence
  Description of Artificial Sequence: Synthetic oligonucleotide
tgctcgtcgtgttcttcgcgccctg

SEQ ID NO: 251055 - DNA, 24 bp, Artificial Sequence
  Description of Artificial Sequence: Synthetic oligonucleotide
gctcgtcgtgttcttcgcgccctg

SEQ ID NO: 251056 - DNA, 25 bp, Artificial Sequence
  Description of Artificial Sequence: Synthetic oligonucleotide
ctcgtcgtgttcttcgcgccctggt

SEQ ID NO: 251057 - DNA, 26 bp, Artificial Sequence
  Description of Artificial Sequence: Synthetic oligonucleotide
tcgtcgtgttcttcgcgccctggtgt

SEQ ID NO: 251058 - DNA, 25 bp, Artificial Sequence
  Description of Artificial Sequence: Synthetic oligonucleotide
cgtcgtgttcttcgcgccctggtgt

SEQ ID NO: 251059 - DNA, 25 bp, Artificial Sequence
  Description of Artificial Sequence: Synthetic oligonucleotide
gtcgtgttcttcgcgccctggtgtc

SEQ ID NO: 251060 - DNA, 26 bp, Artificial Sequence
  Description of Artificial Sequence: Synthetic oligonucleotide
tcgtgttcttcgcgccctggtgtcga

SEQ ID NO: 251061 - DNA, 25 bp, Artificial Sequence
  Description of Artificial Sequence: Synthetic oligonucleotide
cgtgttcttcgcgccctggtgtcga

SEQ ID NO: 251062 - DNA, 26 bp, Artificial Sequence
  Description of Artificial Sequence: Synthetic oligonucleotide
gtgttcttcgcgccctggtgtcgaca

SEQ ID NO: 251063 - DNA, 27 bp, Artificial Sequence
  Description of Artificial Sequence: Synthetic oligonucleotide
tgttcttcgcgccctggtgtcgacact

SEQ ID NO: 251064 - DNA, 26 bp, Artificial Sequence
  Description of Artificial Sequence: Synthetic oligonucleotide
gttcttcgcgccctggtgtcgacact

SEQ ID NO: 251065 - DNA, 26 bp, Artificial Sequence
  Description of Artificial Sequence: Synthetic oligonucleotide
ttcttcgcgccctggtgtcgacactg

SEQ ID NO: 251066 - DNA, 25 bp, Artificial Sequence
  Description of Artificial Sequence: Synthetic oligonucleotide
tcttcgcgccctggtgtcgacactg

SEQ ID NO: 251067 - DNA, 24 bp, Artificial Sequence
  Description of Artificial Sequence: Synthetic oligonucleotide
cttcgcgccctggtgtcgacactg

SEQ ID NO: 251068 - DNA, 26 bp, Artificial Sequence
  Description of Artificial Sequence: Synthetic oligonucleotide
ttcgcgccctggtgtcgacactgcat

SEQ ID NO: 251069 - DNA, 25 bp, Artificial Sequence
  Description of Artificial Sequence: Synthetic oligonucleotide
tcgcgccctggtgtcgacactgcat

SEQ ID NO: 251070 - DNA, 24 bp, Artificial Sequence
  Description of Artificial Sequence: Synthetic oligonucleotide
cgcgccctggtgtcgacactgcat

SEQ ID NO: 251071 - DNA, 25 bp, Artificial Sequence
  Description of Artificial Sequence: Synthetic oligonucleotide
gcgccctggtgtcgacactgcatga

SEQ ID NO: 251072 - DNA, 26 bp, Artificial Sequence
  Description of Artificial Sequence: Synthetic oligonucleotide
cgccctggtgtcgacactgcatgaga

SEQ ID NO: 251073 - DNA, 27 bp, Artificial Sequence
  Description of Artificial Sequence: Synthetic oligonucleotide
gccctggtgtcgacactgcatgagact

SEQ ID NO: 251074 - DNA, 28 bp, Artificial Sequence
  Description of Artificial Sequence: Synthetic oligonucleotide
ccctggtgtcgacactgcatgagacttg

SEQ ID NO: 251075 - DNA, 28 bp, Artificial Sequence
  Description of Artificial Sequence: Synthetic oligonucleotide
cctggtgtcgacactgcatgagacttgc

SEQ ID NO: 251076 - DNA, 29 bp, Artificial Sequence
  Description of Artificial Sequence: Synthetic oligonucleotide
ctggtgtcgacactgcatgagacttgctc

SEQ ID NO: 251077 - DNA, 29 bp, Artificial Sequence
  Description of Artificial Sequence: Synthetic oligonucleotide
tggtgtcgacactgcatgagacttgctcc

SEQ ID NO: 251078 - DNA, 28 bp, Artificial Sequence
  Description of Artificial Sequence: Synthetic oligonucleotide
ggtgtcgacactgcatgagacttgctcc

SEQ ID NO: 251079 - DNA, 29 bp, Artificial Sequence
  Description of Artificial Sequence: Synthetic oligonucleotide
gtgtcgacactgcatgagacttgctcctg

SEQ ID NO: 251080 - DNA, 30 bp, Artificial Sequence
  Description of Artificial Sequence: Synthetic oligonucleotide
tgtcgacactgcatgagacttgctcctgag

SEQ ID NO: 251081 - DNA, 29 bp, Artificial Sequence
  Description of Artificial Sequence: Synthetic oligonucleotide
gtcgacactgcatgagacttgctcctgag

SEQ ID NO: 251082 - DNA, 32 bp, Artificial Sequence
  Description of Artificial Sequence: Synthetic oligonucleotide
tcgacactgcatgagacttgctcctgagtatc

SEQ ID NO: 251083 - DNA, 31 bp, Artificial Sequence
  Description of Artificial Sequence: Synthetic oligonucleotide
cgacactgcatgagacttgctcctgagtatc

SEQ ID NO: 251084 - DNA, 33 bp, Artificial Sequence
  Description of Artificial Sequence: Synthetic oligonucleotide
gacactgcatgagacttgctcctgagtatcaag

SEQ ID NO: 251085 - DNA, 33 bp, Artificial Sequence
  Description of Artificial Sequence: Synthetic oligonucleotide
acactgcatgagacttgctcctgagtatcaagc

SEQ ID NO: 251086 - DNA, 32 bp, Artificial Sequence
  Description of Artificial Sequence: Synthetic oligonucleotide
cactgcatgagacttgctcctgagtatcaagc

SEQ ID NO: 251087 - DNA, 33 bp, Artificial Sequence
  Description of Artificial Sequence: Synthetic oligonucleotide
actgcatgagacttgctcctgagtatcaagctg

SEQ ID NO: 251088 - DNA, 32 bp, Artificial Sequence
  Description of Artificial Sequence: Synthetic oligonucleotide
ctgcatgagacttgctcctgagtatcaagctg

SEQ ID NO: 251089 - DNA, 32 bp, Artificial Sequence
  Description of Artificial Sequence: Synthetic oligonucleotide
tgcatgagacttgctcctgagtatcaagctgc

SEQ ID NO: 251090 - DNA, 31 bp, Artificial Sequence
  Description of Artificial Sequence: Synthetic oligonucleotide
gcatgagacttgctcctgagtatcaagctgc

SEQ ID NO: 251091 - DNA, 32 bp, Artificial Sequence
  Description of Artificial Sequence: Synthetic oligonucleotide
catgagacttgctcctgagtatcaagctgcag

SEQ ID NO: 251092 - DNA, 32 bp, Artificial Sequence
  Description of Artificial Sequence: Synthetic oligonucleotide
atgagacttgctcctgagtatcaagctgcagg

SEQ ID NO: 251093 - DNA, 31 bp, Artificial Sequence
  Description of Artificial Sequence: Synthetic oligonucleotide
tgagacttgctcctgagtatcaagctgcagg

SEQ ID NO: 251094 - DNA, 30 bp, Artificial Sequence
  Description of Artificial Sequence: Synthetic oligonucleotide
gagacttgctcctgagtatcaagctgcagg

SEQ ID NO: 251095 - DNA, 32 bp, Artificial Sequence
  Description of Artificial Sequence: Synthetic oligonucleotide
agacttgctcctgagtatcaagctgcaggtac

SEQ ID NO: 251096 - DNA, 31 bp, Artificial Sequence
  Description of Artificial Sequence: Synthetic oligonucleotide
gacttgctcctgagtatcaagctgcaggtac

SEQ ID NO: 251097 - DNA, 31 bp, Artificial Sequence
  Description of Artificial Sequence: Synthetic oligonucleotide
acttgctcctgagtatcaagctgcaggtacc

SEQ ID NO: 251098 - DNA, 30 bp, Artificial Sequence
  Description of Artificial Sequence: Synthetic oligonucleotide
cttgctcctgagtatcaagctgcaggtacc

SEQ ID NO: 251099 - DNA, 31 bp, Artificial Sequence
  Description of Artificial Sequence: Synthetic oligonucleotide
ttgctcctgagtatcaagctgcaggtaccag

SEQ ID NO: 251100 - DNA, 30 bp, Artificial Sequence
  Description of Artificial Sequence: Synthetic oligonucleotide
tgctcctgagtatcaagctgcaggtaccag

SEQ ID NO: 251101 - DNA, 29 bp, Artificial Sequence
  Description of Artificial Sequence: Synthetic oligonucleotide
gctcctgagtatcaagctgcaggtaccag

SEQ ID NO: 251102 - DNA, 36 bp, Artificial Sequence
  Description of Artificial Sequence: Synthetic oligonucleotide
ctcctgagtatcaagctgcaggtaccagatttaaag

SEQ ID NO: 251103 - DNA, 36 bp, Artificial Sequence
  Description of Artificial Sequence: Synthetic oligonucleotide
tcctgagtatcaagctgcaggtaccagatttaaagg

SEQ ID NO: 251104 - DNA, 35 bp, Artificial Sequence
  Description of Artificial Sequence: Synthetic oligonucleotide
cctgagtatcaagctgcaggtaccagatttaaagg

SEQ ID NO: 251105 - DNA, 39 bp, Artificial Sequence
  Description of Artificial Sequence: Synthetic oligonucleotide
ctgagtatcaagctgcaggtaccagatttaaaggaatac

SEQ ID NO: 251106 - DNA, 40 bp, Artificial Sequence
  Description of Artificial Sequence: Synthetic oligonucleotide
tgagtatcaagctgcaggtaccagatttaaaggaatactc

SEQ ID NO: 251107 - DNA, 39 bp, Artificial Sequence
  Description of Artificial Sequence: Synthetic oligonucleotide
gagtatcaagctgcaggtaccagatttaaaggaatactc

SEQ ID NO: 251108 - DNA, 39 bp, Artificial Sequence
  Description of Artificial Sequence: Synthetic oligonucleotide
agtatcaagctgcaggtaccagatttaaaggaatactcc

SEQ ID NO: 251109 - DNA, 38 bp, Artificial Sequence
  Description of Artificial Sequence: Synthetic oligonucleotide
gtatcaagctgcaggtaccagatttaaaggaatactcc

SEQ ID NO: 251110 - DNA, 38 bp, Artificial Sequence
  Description of Artificial Sequence: Synthetic oligonucleotide
tatcaagctgcaggtaccagatttaaaggaatactccc

SEQ ID NO: 251111 - DNA, 37 bp, Artificial Sequence
  Description of Artificial Sequence: Synthetic oligonucleotide
atcaagctgcaggtaccagatttaaaggaatactccc

SEQ ID NO: 251112 - DNA, 36 bp, Artificial Sequence
  Description of Artificial Sequence: Synthetic oligonucleotide
tcaagctgcaggtaccagatttaaaggaatactccc

SEQ ID NO: 251113 - DNA, 35 bp, Artificial Sequence
  Description of Artificial Sequence: Synthetic oligonucleotide
caagctgcaggtaccagatttaaaggaatactccc

SEQ ID NO: 251114 - DNA, 39 bp, Artificial Sequence
  Description of Artificial Sequence: Synthetic oligonucleotide
aagctgcaggtaccagatttaaaggaatactcccattag

SEQ ID NO: 251115 - DNA, 38 bp, Artificial Sequence
  Description of Artificial Sequence: Synthetic oligonucleotide
agctgcaggtaccagatttaaaggaatactcccattag

SEQ ID NO: 251116 - DNA, 37 bp, Artificial Sequence
  Description of Artificial Sequence: Synthetic oligonucleotide
gctgcaggtaccagatttaaaggaatactcccattag

SEQ ID NO: 251117 - DNA, 37 bp, Artificial Sequence
  Description of Artificial Sequence: Synthetic oligonucleotide
ctgcaggtaccagatttaaaggaatactcccattagg

SEQ ID NO: 251118 - DNA, 40 bp, Artificial Sequence
  Description of Artificial Sequence: Synthetic oligonucleotide
tgcaggtaccagatttaaaggaatactcccattaggaaag

SEQ ID NO: 251119 - DNA, 39 bp, Artificial Sequence
  Description of Artificial Sequence: Synthetic oligonucleotide
gcaggtaccagatttaaaggaatactcccattaggaaag

SEQ ID NO: 251120 - DNA, 39 bp, Artificial Sequence
  Description of Artificial Sequence: Synthetic oligonucleotide
caggtaccagatttaaaggaatactcccattaggaaagg

SEQ ID NO: 251121 - DNA, 41 bp, Artificial Sequence
  Description of Artificial Sequence: Synthetic oligonucleotide
aggtaccagatttaaaggaatactcccattaggaaaggttg

SEQ ID NO: 251122 - DNA, 40 bp, Artificial Sequence
  Description of Artificial Sequence: Synthetic oligonucleotide
ggtaccagatttaaaggaatactcccattaggaaaggttg

SEQ ID NO: 251123 - DNA, 43 bp, Artificial Sequence
  Description of Artificial Sequence: Synthetic oligonucleotide
gtaccagatttaaaggaatactcccattaggaaaggttgaatg

SEQ ID NO: 251124 - DNA, 43 bp, Artificial Sequence
  Description of Artificial Sequence: Synthetic oligonucleotide
taccagatttaaaggaatactcccattaggaaaggttgaatgc

SEQ ID NO: 251125 - DNA, 42 bp, Artificial Sequence
  Description of Artificial Sequence: Synthetic oligonucleotide
accagatttaaaggaatactcccattaggaaaggttgaatgc

SEQ ID NO: 251126 - DNA, 41 bp, Artificial Sequence
  Description of Artificial Sequence: Synthetic oligonucleotide
ccagatttaaaggaatactcccattaggaaaggttgaatgc

SEQ ID NO: 251127 - DNA, 42 bp, Artificial Sequence
  Description of Artificial Sequence: Synthetic oligonucleotide
cagatttaaaggaatactcccattaggaaaggttgaatgcac

SEQ ID NO: 251128 - DNA, 43 bp, Artificial Sequence
  Description of Artificial Sequence: Synthetic oligonucleotide
agatttaaaggaatactcccattaggaaaggttgaatgcactg

SEQ ID NO: 251129 - DNA, 42 bp, Artificial Sequence
  Description of Artificial Sequence: Synthetic oligonucleotide
gatttaaaggaatactcccattaggaaaggttgaatgcactg

SEQ ID NO: 251130 - DNA, 42 bp, Artificial Sequence
  Description of Artificial Sequence: Synthetic oligonucleotide
atttaaaggaatactcccattaggaaaggttgaatgcactgc

SEQ ID NO: 251131 - DNA, 41 bp, Artificial Sequence
  Description of Artificial Sequence: Synthetic oligonucleotide
tttaaaggaatactcccattaggaaaggttgaatgcactgc

SEQ ID NO: 251132 - DNA, 40 bp, Artificial Sequence
  Description of Artificial Sequence: Synthetic oligonucleotide
ttaaaggaatactcccattaggaaaggttgaatgcactgc

SEQ ID NO: 251133 - DNA, 39 bp, Artificial Sequence
  Description of Artificial Sequence: Synthetic oligonucleotide
taaaggaatactcccattaggaaaggttgaatgcactgc

SEQ ID NO: 251134 - DNA, 38 bp, Artificial Sequence
  Description of Artificial Sequence: Synthetic oligonucleotide
aaaggaatactcccattaggaaaggttgaatgcactgc

SEQ ID NO: 251135 - DNA, 37 bp, Artificial Sequence
  Description of Artificial Sequence: Synthetic oligonucleotide
aaggaatactcccattaggaaaggttgaatgcactgc

SEQ ID NO: 251136 - DNA, 36 bp, Artificial Sequence
  Description of Artificial Sequence: Synthetic oligonucleotide
aggaatactcccattaggaaaggttgaatgcactgc

SEQ ID NO: 251137 - DNA, 35 bp, Artificial Sequence
  Description of Artificial Sequence: Synthetic oligonucleotide
ggaatactcccattaggaaaggttgaatgcactgc

SEQ ID NO: 251138 - DNA, 35 bp, Artificial Sequence
  Description of Artificial Sequence: Synthetic oligonucleotide
gaatactcccattaggaaaggttgaatgcactgcc

SEQ ID NO: 251139 - DNA, 37 bp, Artificial Sequence
  Description of Artificial Sequence: Synthetic oligonucleotide
aatactcccattaggaaaggttgaatgcactgcctac

SEQ ID NO: 251140 - DNA, 36 bp, Artificial Sequence
  Description of Artificial Sequence: Synthetic oligonucleotide
atactcccattaggaaaggttgaatgcactgcctac

SEQ ID NO: 251141 - DNA, 35 bp, Artificial Sequence
  Description of Artificial Sequence: Synthetic oligonucleotide
tactcccattaggaaaggttgaatgcactgcctac

SEQ ID NO: 251142 - DNA, 34 bp, Artificial Sequence
  Description of Artificial Sequence: Synthetic oligonucleotide
actcccattaggaaaggttgaatgcactgcctac

SEQ ID NO: 251143 - DNA, 33 bp, Artificial Sequence
  Description of Artificial Sequence: Synthetic oligonucleotide
ctcccattaggaaaggttgaatgcactgcctac

SEQ ID NO: 251144 - DNA, 34 bp, Artificial Sequence
  Description of Artificial Sequence: Synthetic oligonucleotide
tcccattaggaaaggttgaatgcactgcctacac

SEQ ID NO: 251145 - DNA, 33 bp, Artificial Sequence
  Description of Artificial Sequence: Synthetic oligonucleotide
cccattaggaaaggttgaatgcactgcctacac

SEQ ID NO: 251146 - DNA, 36 bp, Artificial Sequence
  Description of Artificial Sequence: Synthetic oligonucleotide
ccattaggaaaggttgaatgcactgcctacactaac

SEQ ID NO: 251147 - DNA, 37 bp, Artificial Sequence
  Description of Artificial Sequence: Synthetic oligonucleotide
cattaggaaaggttgaatgcactgcctacactaacag

SEQ ID NO: 251148 - DNA, 37 bp, Artificial Sequence
  Description of Artificial Sequence: Synthetic oligonucleotide
attaggaaaggttgaatgcactgcctacactaacagc

SEQ ID NO: 251149 - DNA, 36 bp, Artificial Sequence
  Description of Artificial Sequence: Synthetic oligonucleotide
ttaggaaaggttgaatgcactgcctacactaacagc

SEQ ID NO: 251150 - DNA, 35 bp, Artificial Sequence
  Description of Artificial Sequence: Synthetic oligonucleotide
taggaaaggttgaatgcactgcctacactaacagc

SEQ ID NO: 251151 - DNA, 34 bp, Artificial Sequence
  Description of Artificial Sequence: Synthetic oligonucleotide
aggaaaggttgaatgcactgcctacactaacagc

SEQ ID NO: 251152 - DNA, 33 bp, Artificial Sequence
  Description of Artificial Sequence: Synthetic oligonucleotide
ggaaaggttgaatgcactgcctacactaacagc

SEQ ID NO: 251153 - DNA, 34 bp, Artificial Sequence
  Description of Artificial Sequence: Synthetic oligonucleotide
gaaaggttgaatgcactgcctacactaacagctg

SEQ ID NO: 251154 - DNA, 44 bp, Artificial Sequence
  Description of Artificial Sequence: Synthetic oligonucleotide
aaaggttgaatgcactgcctacactaacagctgtaataattatg

SEQ ID NO: 251155 - DNA, 43 bp, Artificial Sequence
  Description of Artificial Sequence: Synthetic oligonucleotide
aaggttgaatgcactgcctacactaacagctgtaataattatg

SEQ ID NO: 251156 - DNA, 42 bp, Artificial Sequence
  Description of Artificial Sequence: Synthetic oligonucleotide
aggttgaatgcactgcctacactaacagctgtaataattatg

SEQ ID NO: 251157 - DNA, 41 bp, Artificial Sequence
  Description of Artificial Sequence: Synthetic oligonucleotide
ggttgaatgcactgcctacactaacagctgtaataattatg

SEQ ID NO: 251158 - DNA, 41 bp, Artificial Sequence
  Description of Artificial Sequence: Synthetic oligonucleotide
gttgaatgcactgcctacactaacagctgtaataattatgg

SEQ ID NO: 251159 - DNA, 42 bp, Artificial Sequence
  Description of Artificial Sequence: Synthetic oligonucleotide
ttgaatgcactgcctacactaacagctgtaataattatggag

SEQ ID NO: 251160 - DNA, 41 bp, Artificial Sequence
  Description of Artificial Sequence: Synthetic oligonucleotide
tgaatgcactgcctacactaacagctgtaataattatggag

SEQ ID NO: 251161 - DNA, 40 bp, Artificial Sequence
  Description of Artificial Sequence: Synthetic oligonucleotide
gaatgcactgcctacactaacagctgtaataattatggag

SEQ ID NO: 251162 - DNA, 41 bp, Artificial Sequence
  Description of Artificial Sequence: Synthetic oligonucleotide
aatgcactgcctacactaacagctgtaataattatggagtc

SEQ ID NO: 251163 - DNA, 40 bp, Artificial Sequence
  Description of Artificial Sequence: Synthetic oligonucleotide
atgcactgcctacactaacagctgtaataattatggagtc

SEQ ID NO: 251164 - DNA, 39 bp, Artificial Sequence
  Description of Artificial Sequence: Synthetic oligonucleotide
tgcactgcctacactaacagctgtaataattatggagtc

SEQ ID NO: 251165 - DNA, 38 bp, Artificial Sequence
  Description of Artificial Sequence: Synthetic oligonucleotide
gcactgcctacactaacagctgtaataattatggagtc

SEQ ID NO: 251166 - DNA, 39 bp, Artificial Sequence
  Description of Artificial Sequence: Synthetic oligonucleotide
cactgcctacactaacagctgtaataattatggagtctg

SEQ ID NO: 251167 - DNA, 40 bp, Artificial Sequence
  Description of Artificial Sequence: Synthetic oligonucleotide
actgcctacactaacagctgtaataattatggagtctgtg

SEQ ID NO: 251168 - DNA, 39 bp, Artificial Sequence
  Description of Artificial Sequence: Synthetic oligonucleotide
ctgcctacactaacagctgtaataattatggagtctgtg

SEQ ID NO: 251169 - DNA, 39 bp, Artificial Sequence
  Description of Artificial Sequence: Synthetic oligonucleotide
tgcctacactaacagctgtaataattatggagtctgtgg

SEQ ID NO: 251170 - DNA, 38 bp, Artificial Sequence
  Description of Artificial Sequence: Synthetic oligonucleotide
gcctacactaacagctgtaataattatggagtctgtgg

SEQ ID NO: 251171 - DNA, 42 bp, Artificial Sequence
  Description of Artificial Sequence: Synthetic oligonucleotide
cctacactaacagctgtaataattatggagtctgtggatatc

SEQ ID NO: 251172 - DNA, 42 bp, Artificial Sequence
  Description of Artificial Sequence: Synthetic oligonucleotide
ctacactaacagctgtaataattatggagtctgtggatatcg

SEQ ID NO: 251173 - DNA, 44 bp, Artificial Sequence
  Description of Artificial Sequence: Synthetic oligonucleotide
tacactaacagctgtaataattatggagtctgtggatatcgaac

SEQ ID NO: 251174 - DNA, 43 bp, Artificial Sequence
  Description of Artificial Sequence: Synthetic oligonucleotide
acactaacagctgtaataattatggagtctgtggatatcgaac

SEQ ID NO: 251175 - DNA, 42 bp, Artificial Sequence
  Description of Artificial Sequence: Synthetic oligonucleotide
cactaacagctgtaataattatggagtctgtggatatcgaac

SEQ ID NO: 251176 - DNA, 42 bp, Artificial Sequence
  Description of Artificial Sequence: Synthetic oligonucleotide
actaacagctgtaataattatggagtctgtggatatcgaacc

SEQ ID NO: 251177 - DNA, 41 bp, Artificial Sequence
  Description of Artificial Sequence: Synthetic oligonucleotide
ctaacagctgtaataattatggagtctgtggatatcgaacc

SEQ ID NO: 251178 - DNA, 41 bp, Artificial Sequence
  Description of Artificial Sequence: Synthetic oligonucleotide
taacagctgtaataattatggagtctgtggatatcgaaccc

SEQ ID NO: 251179 - DNA, 40 bp, Artificial Sequence
  Description of Artificial Sequence: Synthetic oligonucleotide
aacagctgtaataattatggagtctgtggatatcgaaccc

SEQ ID NO: 251180 - DNA, 39 bp, Artificial Sequence
  Description of Artificial Sequence: Synthetic oligonucleotide
acagctgtaataattatggagtctgtggatatcgaaccc

SEQ ID NO: 251181 - DNA, 38 bp, Artificial Sequence
  Description of Artificial Sequence: Synthetic oligonucleotide
cagctgtaataattatggagtctgtggatatcgaaccc

SEQ ID NO: 251182 - DNA, 39 bp, Artificial Sequence
  Description of Artificial Sequence: Synthetic oligonucleotide
agctgtaataattatggagtctgtggatatcgaaccctg

SEQ ID NO: 251183 - DNA, 38 bp, Artificial Sequence
  Description of Artificial Sequence: Synthetic oligonucleotide
gctgtaataattatggagtctgtggatatcgaaccctg

SEQ ID NO: 251184 - DNA, 40 bp, Artificial Sequence
  Description of Artificial Sequence: Synthetic oligonucleotide
ctgtaataattatggagtctgtggatatcgaaccctgaac

SEQ ID NO: 251185 - DNA, 47 bp, Artificial Sequence
  Description of Artificial Sequence: Synthetic oligonucleotide
tgtaataattatggagtctgtggatatcgaaccctgaacatatttag

SEQ ID NO: 251186 - DNA, 46 bp, Artificial Sequence
  Description of Artificial Sequence: Synthetic oligonucleotide
gtaataattatggagtctgtggatatcgaaccctgaacatatttag

SEQ ID NO: 251187 - DNA, 47 bp, Artificial Sequence
  Description of Artificial Sequence: Synthetic oligonucleotide
taataattatggagtctgtggatatcgaaccctgaacatatttagac

SEQ ID NO: 251188 - DNA, 46 bp, Artificial Sequence
  Description of Artificial Sequence: Synthetic oligonucleotide
aataattatggagtctgtggatatcgaaccctgaacatatttagac

SEQ ID NO: 251189 - DNA, 45 bp, Artificial Sequence
  Description of Artificial Sequence: Synthetic oligonucleotide
ataattatggagtctgtggatatcgaaccctgaacatatttagac

SEQ ID NO: 251190 - DNA, 44 bp, Artificial Sequence
  Description of Artificial Sequence: Synthetic oligonucleotide
taattatggagtctgtggatatcgaaccctgaacatatttagac

SEQ ID NO: 251191 - DNA, 43 bp, Artificial Sequence
  Description of Artificial Sequence: Synthetic oligonucleotide
aattatggagtctgtggatatcgaaccctgaacatatttagac

SEQ ID NO: 251192 - DNA, 42 bp, Artificial Sequence
  Description of Artificial Sequence: Synthetic oligonucleotide
attatggagtctgtggatatcgaaccctgaacatatttagac

SEQ ID NO: 251193 - DNA, 41 bp, Artificial Sequence
  Description of Artificial Sequence: Synthetic oligonucleotide
ttatggagtctgtggatatcgaaccctgaacatatttagac

SEQ ID NO: 251194 - DNA, 40 bp, Artificial Sequence
  Description of Artificial Sequence: Synthetic oligonucleotide
tatggagtctgtggatatcgaaccctgaacatatttagac

SEQ ID NO: 251195 - DNA, 39 bp, Artificial Sequence
  Description of Artificial Sequence: Synthetic oligonucleotide
atggagtctgtggatatcgaaccctgaacatatttagac

SEQ ID NO: 251196 - DNA, 38 bp, Artificial Sequence
  Description of Artificial Sequence: Synthetic oligonucleotide
tggagtctgtggatatcgaaccctgaacatatttagac

SEQ ID NO: 251197 - DNA, 37 bp, Artificial Sequence
  Description of Artificial Sequence: Synthetic oligonucleotide
ggagtctgtggatatcgaaccctgaacatatttagac

SEQ ID NO: 251198 - DNA, 39 bp, Artificial Sequence
  Description of Artificial Sequence: Synthetic oligonucleotide
gagtctgtggatatcgaaccctgaacatatttagacatg

SEQ ID NO: 251199 - DNA, 39 bp, Artificial Sequence
  Description of Artificial Sequence: Synthetic oligonucleotide
agtctgtggatatcgaaccctgaacatatttagacatgg

SEQ ID NO: 251200 - DNA, 38 bp, Artificial Sequence
  Description of Artificial Sequence: Synthetic oligonucleotide
gtctgtggatatcgaaccctgaacatatttagacatgg

SEQ ID NO: 251201 - DNA, 39 bp, Artificial Sequence
  Description of Artificial Sequence: Synthetic oligonucleotide
tctgtggatatcgaaccctgaacatatttagacatggtg

SEQ ID NO: 251202 - DNA, 38 bp, Artificial Sequence
  Description of Artificial Sequence: Synthetic oligonucleotide
ctgtggatatcgaaccctgaacatatttagacatggtg

SEQ ID NO: 251203 - DNA, 40 bp, Artificial Sequence
  Description of Artificial Sequence: Synthetic oligonucleotide
tgtggatatcgaaccctgaacatatttagacatggtgaag

SEQ ID NO: 251204 - DNA, 39 bp, Artificial Sequence
  Description of Artificial Sequence: Synthetic oligonucleotide
gtggatatcgaaccctgaacatatttagacatggtgaag

SEQ ID NO: 251205 - DNA, 41 bp, Artificial Sequence
  Description of Artificial Sequence: Synthetic oligonucleotide
tggatatcgaaccctgaacatatttagacatggtgaagtag

SEQ ID NO: 251206 - DNA, 40 bp, Artificial Sequence
  Description of Artificial Sequence: Synthetic oligonucleotide
ggatatcgaaccctgaacatatttagacatggtgaagtag

SEQ ID NO: 251207 - DNA, 40 bp, Artificial Sequence
  Description of Artificial Sequence: Synthetic oligonucleotide
gatatcgaaccctgaacatatttagacatggtgaagtagc

SEQ ID NO: 251208 - DNA, 41 bp, Artificial Sequence
  Description of Artificial Sequence: Synthetic oligonucleotide
atatcgaaccctgaacatatttagacatggtgaagtagcag

SEQ ID NO: 251209 - DNA, 40 bp, Artificial Sequence
  Description of Artificial Sequence: Synthetic oligonucleotide
tatcgaaccctgaacatatttagacatggtgaagtagcag

SEQ ID NO: 251210 - DNA, 39 bp, Artificial Sequence
  Description of Artificial Sequence: Synthetic oligonucleotide
atcgaaccctgaacatatttagacatggtgaagtagcag

SEQ ID NO: 251211 - DNA, 38 bp, Artificial Sequence
  Description of Artificial Sequence: Synthetic oligonucleotide
tcgaaccctgaacatatttagacatggtgaagtagcag

SEQ ID NO: 251212 - DNA, 37 bp, Artificial Sequence
  Description of Artificial Sequence: Synthetic oligonucleotide
cgaaccctgaacatatttagacatggtgaagtagcag

SEQ ID NO: 251213 - DNA, 37 bp, Artificial Sequence
  Description of Artificial Sequence: Synthetic oligonucleotide
gaaccctgaacatatttagacatggtgaagtagcagg

SEQ ID NO: 251214 - DNA, 38 bp, Artificial Sequence
  Description of Artificial Sequence: Synthetic oligonucleotide
aaccctgaacatatttagacatggtgaagtagcaggtg

SEQ ID NO: 251215 - DNA, 37 bp, Artificial Sequence
  Description of Artificial Sequence: Synthetic oligonucleotide
accctgaacatatttagacatggtgaagtagcaggtg

SEQ ID NO: 251216 - DNA, 36 bp, Artificial Sequence
  Description of Artificial Sequence: Synthetic oligonucleotide
ccctgaacatatttagacatggtgaagtagcaggtg

SEQ ID NO: 251217 - DNA, 36 bp, Artificial Sequence
  Description of Artificial Sequence: Synthetic oligonucleotide
cctgaacatatttagacatggtgaagtagcaggtgc

SEQ ID NO: 251218 - DNA, 40 bp, Artificial Sequence
  Description of Artificial Sequence: Synthetic oligonucleotide
ctgaacatatttagacatggtgaagtagcaggtgcatatg

SEQ ID NO: 251219 - DNA, 42 bp, Artificial Sequence
  Description of Artificial Sequence: Synthetic oligonucleotide
tgaacatatttagacatggtgaagtagcaggtgcatatgatg

SEQ ID NO: 251220 - DNA, 41 bp, Artificial Sequence
  Description of Artificial Sequence: Synthetic oligonucleotide
gaacatatttagacatggtgaagtagcaggtgcatatgatg

SEQ ID NO: 251221 - DNA, 41 bp, Artificial Sequence
  Description of Artificial Sequence: Synthetic oligonucleotide
aacatatttagacatggtgaagtagcaggtgcatatgatgg

SEQ ID NO: 251222 - DNA, 40 bp, Artificial Sequence
  Description of Artificial Sequence: Synthetic oligonucleotide
acatatttagacatggtgaagtagcaggtgcatatgatgg

SEQ ID NO: 251223 - DNA, 39 bp, Artificial Sequence
  Description of Artificial Sequence: Synthetic oligonucleotide
catatttagacatggtgaagtagcaggtgcatatgatgg

SEQ ID NO: 251224 - DNA, 40 bp, Artificial Sequence
  Description of Artificial Sequence: Synthetic oligonucleotide
atatttagacatggtgaagtagcaggtgcatatgatggag

SEQ ID NO: 251225 - DNA, 39 bp, Artificial Sequence
  Description of Artificial Sequence: Synthetic oligonucleotide
tatttagacatggtgaagtagcaggtgcatatgatggag

SEQ ID NO: 251226 - DNA, 38 bp, Artificial Sequence
  Description of Artificial Sequence: Synthetic oligonucleotide
atttagacatggtgaagtagcaggtgcatatgatggag

SEQ ID NO: 251227 - DNA, 37 bp, Artificial Sequence
  Description of Artificial Sequence: Synthetic oligonucleotide
tttagacatggtgaagtagcaggtgcatatgatggag

SEQ ID NO: 251228 - DNA, 36 bp, Artificial Sequence
  Description of Artificial Sequence: Synthetic oligonucleotide
ttagacatggtgaagtagcaggtgcatatgatggag

SEQ ID NO: 251229 - DNA, 35 bp, Artificial Sequence
  Description of Artificial Sequence: Synthetic oligonucleotide
tagacatggtgaagtagcaggtgcatatgatggag

SEQ ID NO: 251230 - DNA, 34 bp, Artificial Sequence
  Description of Artificial Sequence: Synthetic oligonucleotide
agacatggtgaagtagcaggtgcatatgatggag

SEQ ID NO: 251231 - DNA, 33 bp, Artificial Sequence
  Description of Artificial Sequence: Synthetic oligonucleotide
gacatggtgaagtagcaggtgcatatgatggag

SEQ ID NO: 251232 - DNA, 33 bp, Artificial Sequence
  Description of Artificial Sequence: Synthetic oligonucleotide
acatggtgaagtagcaggtgcatatgatggagc

SEQ ID NO: 251233 - DNA, 32 bp, Artificial Sequence
  Description of Artificial Sequence: Synthetic oligonucleotide
catggtgaagtagcaggtgcatatgatggagc

SEQ ID NO: 251234 - DNA, 34 bp, Artificial Sequence
  Description of Artificial Sequence: Synthetic oligonucleotide
atggtgaagtagcaggtgcatatgatggagctag

SEQ ID NO: 251235 - DNA, 33 bp, Artificial Sequence
  Description of Artificial Sequence: Synthetic oligonucleotide
tggtgaagtagcaggtgcatatgatggagctag

SEQ ID NO: 251236 - DNA, 32 bp, Artificial Sequence
  Description of Artificial Sequence: Synthetic oligonucleotide
ggtgaagtagcaggtgcatatgatggagctag

SEQ ID NO: 251237 - DNA, 32 bp, Artificial Sequence
  Description of Artificial Sequence: Synthetic oligonucleotide
gtgaagtagcaggtgcatatgatggagctagg

SEQ ID NO: 251238 - DNA, 33 bp, Artificial Sequence
  Description of Artificial Sequence: Synthetic oligonucleotide
tgaagtagcaggtgcatatgatggagctaggac

SEQ ID NO: 251239 - DNA, 32 bp, Artificial Sequence
  Description of Artificial Sequence: Synthetic oligonucleotide
gaagtagcaggtgcatatgatggagctaggac

SEQ ID NO: 251240 - DNA, 33 bp, Artificial Sequence
  Description of Artificial Sequence: Synthetic oligonucleotide
aagtagcaggtgcatatgatggagctaggactg

SEQ ID NO: 251241 - DNA, 32 bp, Artificial Sequence
  Description of Artificial Sequence: Synthetic oligonucleotide
agtagcaggtgcatatgatggagctaggactg

SEQ ID NO: 251242 - DNA, 31 bp, Artificial Sequence
  Description of Artificial Sequence: Synthetic oligonucleotide
gtagcaggtgcatatgatggagctaggactg

SEQ ID NO: 251243 - DNA, 31 bp, Artificial Sequence
  Description of Artificial Sequence: Synthetic oligonucleotide
tagcaggtgcatatgatggagctaggactgg

SEQ ID NO: 251244 - DNA, 30 bp, Artificial Sequence
  Description of Artificial Sequence: Synthetic oligonucleotide
agcaggtgcatatgatggagctaggactgg

SEQ ID NO: 251245 - DNA, 29 bp, Artificial Sequence
  Description of Artificial Sequence: Synthetic oligonucleotide
gcaggtgcatatgatggagctaggactgg

SEQ ID NO: 251246 - DNA, 30 bp, Artificial Sequence
  Description of Artificial Sequence: Synthetic oligonucleotide
caggtgcatatgatggagctaggactggtg

SEQ ID NO: 251247 - DNA, 32 bp, Artificial Sequence
  Description of Artificial Sequence: Synthetic oligonucleotide
aggtgcatatgatggagctaggactggtgatg

SEQ ID NO: 251248 - DNA, 31 bp, Artificial Sequence
  Description of Artificial Sequence: Synthetic oligonucleotide
ggtgcatatgatggagctaggactggtgatg

SEQ ID NO: 251249 - DNA, 31 bp, Artificial Sequence
  Description of Artificial Sequence: Synthetic oligonucleotide
gtgcatatgatggagctaggactggtgatgg

SEQ ID NO: 251250 - DNA, 35 bp, Artificial Sequence
  Description of Artificial Sequence: Synthetic oligonucleotide
tgcatatgatggagctaggactggtgatggaatag

SEQ ID NO: 251251 - DNA, 34 bp, Artificial Sequence
  Description of Artificial Sequence: Synthetic oligonucleotide
gcatatgatggagctaggactggtgatggaatag

SEQ ID NO: 251252 - DNA, 35 bp, Artificial Sequence
  Description of Artificial Sequence: Synthetic oligonucleotide
catatgatggagctaggactggtgatggaatagtc

SEQ ID NO: 251253 - DNA, 36 bp, Artificial Sequence
  Description of Artificial Sequence: Synthetic oligonucleotide
atatgatggagctaggactggtgatggaatagtcag

SEQ ID NO: 251254 - DNA, 35 bp, Artificial Sequence
  Description of Artificial Sequence: Synthetic oligonucleotide
tatgatggagctaggactggtgatggaatagtcag

SEQ ID NO: 251255 - DNA, 34 bp, Artificial Sequence
  Description of Artificial Sequence: Synthetic oligonucleotide
atgatggagctaggactggtgatggaatagtcag

SEQ ID NO: 251256 - DNA, 33 bp, Artificial Sequence
  Description of Artificial Sequence: Synthetic oligonucleotide
tgatggagctaggactggtgatggaatagtcag

SEQ ID NO: 251257 - DNA, 32 bp, Artificial Sequence
  Description of Artificial Sequence: Synthetic oligonucleotide
gatggagctaggactggtgatggaatagtcag

SEQ ID NO: 251258 - DNA, 32 bp, Artificial Sequence
  Description of Artificial Sequence: Synthetic oligonucleotide
atggagctaggactggtgatggaatagtcagc

SEQ ID NO: 251259 - DNA, 31 bp, Artificial Sequence
  Description of Artificial Sequence: Synthetic oligonucleotide
tggagctaggactggtgatggaatagtcagc

SEQ ID NO: 251260 - DNA, 30 bp, Artificial Sequence
  Description of Artificial Sequence: Synthetic oligonucleotide
ggagctaggactggtgatggaatagtcagc

SEQ ID NO: 251261 - DNA, 30 bp, Artificial Sequence
  Description of Artificial Sequence: Synthetic oligonucleotide
gagctaggactggtgatggaatagtcagcc

SEQ ID NO: 251262 - DNA, 31 bp, Artificial Sequence
  Description of Artificial Sequence: Synthetic oligonucleotide
agctaggactggtgatggaatagtcagccac

SEQ ID NO: 251263 - DNA, 30 bp, Artificial Sequence
  Description of Artificial Sequence: Synthetic oligonucleotide
gctaggactggtgatggaatagtcagccac

SEQ ID NO: 251264 - DNA, 32 bp, Artificial Sequence
  Description of Artificial Sequence: Synthetic oligonucleotide
ctaggactggtgatggaatagtcagccacatg

SEQ ID NO: 251265 - DNA, 34 bp, Artificial Sequence
  Description of Artificial Sequence: Synthetic oligonucleotide
taggactggtgatggaatagtcagccacatgaag

SEQ ID NO: 251266 - DNA, 33 bp, Artificial Sequence
  Description of Artificial Sequence: Synthetic oligonucleotide
aggactggtgatggaatagtcagccacatgaag

SEQ ID NO: 251267 - DNA, 32 bp, Artificial Sequence
  Description of Artificial Sequence: Synthetic oligonucleotide
ggactggtgatggaatagtcagccacatgaag

SEQ ID NO: 251268 - DNA, 34 bp, Artificial Sequence
  Description of Artificial Sequence: Synthetic oligonucleotide
gactggtgatggaatagtcagccacatgaagaag

SEQ ID NO: 251269 - DNA, 34 bp, Artificial Sequence
  Description of Artificial Sequence: Synthetic oligonucleotide
actggtgatggaatagtcagccacatgaagaagc

SEQ ID NO: 251270 - DNA, 33 bp, Artificial Sequence
  Description of Artificial Sequence: Synthetic oligonucleotide
ctggtgatggaatagtcagccacatgaagaagc

SEQ ID NO: 251271 - DNA, 34 bp, Artificial Sequence
  Description of Artificial Sequence: Synthetic oligonucleotide
tggtgatggaatagtcagccacatgaagaagctg

SEQ ID NO: 251272 - DNA, 33 bp, Artificial Sequence
  Description of Artificial Sequence: Synthetic oligonucleotide
ggtgatggaatagtcagccacatgaagaagctg

SEQ ID NO: 251273 - DNA, 33 bp, Artificial Sequence
  Description of Artificial Sequence: Synthetic oligonucleotide
gtgatggaatagtcagccacatgaagaagctgg

SEQ ID NO: 251274 - DNA, 33 bp, Artificial Sequence
  Description of Artificial Sequence: Synthetic oligonucleotide
tgatggaatagtcagccacatgaagaagctggc

SEQ ID NO: 251275 - DNA, 32 bp, Artificial Sequence
  Description of Artificial Sequence: Synthetic oligonucleotide
gatggaatagtcagccacatgaagaagctggc

SEQ ID NO: 251276 - DNA, 33 bp, Artificial Sequence
  Description of Artificial Sequence: Synthetic oligonucleotide
atggaatagtcagccacatgaagaagctggcag

SEQ ID NO: 251277 - DNA, 32 bp, Artificial Sequence
  Description of Artificial Sequence: Synthetic oligonucleotide
tggaatagtcagccacatgaagaagctggcag

SEQ ID NO: 251278 - DNA, 31 bp, Artificial Sequence
  Description of Artificial Sequence: Synthetic oligonucleotide
ggaatagtcagccacatgaagaagctggcag

SEQ ID NO: 251279 - DNA, 31 bp, Artificial Sequence
  Description of Artificial Sequence: Synthetic oligonucleotide
gaatagtcagccacatgaagaagctggcagg

SEQ ID NO: 251280 - DNA, 32 bp, Artificial Sequence
  Description of Artificial Sequence: Synthetic oligonucleotide
aatagtcagccacatgaagaagctggcaggac

SEQ ID NO: 251281 - DNA, 31 bp, Artificial Sequence
  Description of Artificial Sequence: Synthetic oligonucleotide
atagtcagccacatgaagaagctggcaggac

SEQ ID NO: 251282 - DNA, 30 bp, Artificial Sequence
  Description of Artificial Sequence: Synthetic oligonucleotide
tagtcagccacatgaagaagctggcaggac

SEQ ID NO: 251283 - DNA, 29 bp, Artificial Sequence
  Description of Artificial Sequence: Synthetic oligonucleotide
agtcagccacatgaagaagctggcaggac

SEQ ID NO: 251284 - DNA, 28 bp, Artificial Sequence
  Description of Artificial Sequence: Synthetic oligonucleotide
gtcagccacatgaagaagctggcaggac

SEQ ID NO: 251285 - DNA, 28 bp, Artificial Sequence
  Description of Artificial Sequence: Synthetic oligonucleotide
tcagccacatgaagaagctggcaggacc

SEQ ID NO: 251286 - DNA, 27 bp, Artificial Sequence
  Description of Artificial Sequence: Synthetic oligonucleotide
cagccacatgaagaagctggcaggacc

SEQ ID NO: 251287 - DNA, 28 bp, Artificial Sequence
  Description of Artificial Sequence: Synthetic oligonucleotide
agccacatgaagaagctggcaggacctg

SEQ ID NO: 251288 - DNA, 27 bp, Artificial Sequence
  Description of Artificial Sequence: Synthetic oligonucleotide
gccacatgaagaagctggcaggacctg

SEQ ID NO: 251289 - DNA, 27 bp, Artificial Sequence
  Description of Artificial Sequence: Synthetic oligonucleotide
ccacatgaagaagctggcaggacctgc

SEQ ID NO: 251290 - DNA, 29 bp, Artificial Sequence
  Description of Artificial Sequence: Synthetic oligonucleotide
cacatgaagaagctggcaggacctgcttc

SEQ ID NO: 251291 - DNA, 30 bp, Artificial Sequence
  Description of Artificial Sequence: Synthetic oligonucleotide
acatgaagaagctggcaggacctgcttcag

SEQ ID NO: 251292 - DNA, 29 bp, Artificial Sequence
  Description of Artificial Sequence: Synthetic oligonucleotide
catgaagaagctggcaggacctgcttcag

SEQ ID NO: 251293 - DNA, 30 bp, Artificial Sequence
  Description of Artificial Sequence: Synthetic oligonucleotide
atgaagaagctggcaggacctgcttcagtg

SEQ ID NO: 251294 - DNA, 29 bp, Artificial Sequence
  Description of Artificial Sequence: Synthetic oligonucleotide
tgaagaagctggcaggacctgcttcagtg

SEQ ID NO: 251295 - DNA, 28 bp, Artificial Sequence
  Description of Artificial Sequence: Synthetic oligonucleotide
gaagaagctggcaggacctgcttcagtg

SEQ ID NO: 251296 - DNA, 28 bp, Artificial Sequence
  Description of Artificial Sequence: Synthetic oligonucleotide
aagaagctggcaggacctgcttcagtgg

SEQ ID NO: 251297 - DNA, 27 bp, Artificial Sequence
  Description of Artificial Sequence: Synthetic oligonucleotide
agaagctggcaggacctgcttcagtgg

SEQ ID NO: 251298 - DNA, 26 bp, Artificial Sequence
  Description of Artificial Sequence: Synthetic oligonucleotide
gaagctggcaggacctgcttcagtgg

SEQ ID NO: 251299 - DNA, 27 bp, Artificial Sequence
  Description of Artificial Sequence: Synthetic oligonucleotide
aagctggcaggacctgcttcagtggct

SEQ ID NO: 251300 - DNA, 26 bp, Artificial Sequence
  Description of Artificial Sequence: Synthetic oligonucleotide
agctggcaggacctgcttcagtggct

SEQ ID NO: 251301 - DNA, 25 bp, Artificial Sequence
  Description of Artificial Sequence: Synthetic oligonucleotide
gctggcaggacctgcttcagtggct

SEQ ID NO: 251302 - DNA, 26 bp, Artificial Sequence
  Description of Artificial Sequence: Synthetic oligonucleotide
ctggcaggacctgcttcagtggctct

SEQ ID NO: 251303 - DNA, 27 bp, Artificial Sequence
  Description of Artificial Sequence: Synthetic oligonucleotide
tggcaggacctgcttcagtggctctca

SEQ ID NO: 251304 - DNA, 26 bp, Artificial Sequence
  Description of Artificial Sequence: Synthetic oligonucleotide
ggcaggacctgcttcagtggctctca

SEQ ID NO: 251305 - DNA, 26 bp, Artificial Sequence
  Description of Artificial Sequence: Synthetic oligonucleotide
gcaggacctgcttcagtggctctcag

SEQ ID NO: 251306 - DNA, 27 bp, Artificial Sequence
  Description of Artificial Sequence: Synthetic oligonucleotide
caggacctgcttcagtggctctcagga

SEQ ID NO: 251307 - DNA, 27 bp, Artificial Sequence
  Description of Artificial Sequence: Synthetic oligonucleotide
aggacctgcttcagtggctctcaggag

SEQ ID NO: 251308 - DNA, 27 bp, Artificial Sequence
  Description of Artificial Sequence: Synthetic oligonucleotide
ggacctgcttcagtggctctcaggagt

SEQ ID NO: 251309 - DNA, 27 bp, Artificial Sequence
  Description of Artificial Sequence: Synthetic oligonucleotide
gacctgcttcagtggctctcaggagtg

SEQ ID NO: 251310 - DNA, 28 bp, Artificial Sequence
  Description of Artificial Sequence: Synthetic oligonucleotide
acctgcttcagtggctctcaggagtgag

SEQ ID NO: 251311 - DNA, 27 bp, Artificial Sequence
  Description of Artificial Sequence: Synthetic oligonucleotide
cctgcttcagtggctctcaggagtgag

SEQ ID NO: 251312 - DNA, 27 bp, Artificial Sequence
  Description of Artificial Sequence: Synthetic oligonucleotide
ctgcttcagtggctctcaggagtgagg

SEQ ID NO: 251313 - DNA, 29 bp, Artificial Sequence
  Description of Artificial Sequence: Synthetic oligonucleotide
tgcttcagtggctctcaggagtgaggaag

SEQ ID NO: 251314 - DNA, 28 bp, Artificial Sequence
  Description of Artificial Sequence: Synthetic oligonucleotide
gcttcagtggctctcaggagtgaggaag

SEQ ID NO: 251315 - DNA, 35 bp, Artificial Sequence
  Description of Artificial Sequence: Synthetic oligonucleotide
cttcagtggctctcaggagtgaggaagattttaag

SEQ ID NO: 251316 - DNA, 40 bp, Artificial Sequence
  Description of Artificial Sequence: Synthetic oligonucleotide
ttcagtggctctcaggagtgaggaagattttaagaaaatc

SEQ ID NO: 251317 - DNA, 39 bp, Artificial Sequence
  Description of Artificial Sequence: Synthetic oligonucleotide
tcagtggctctcaggagtgaggaagattttaagaaaatc

SEQ ID NO: 251318 - DNA, 38 bp, Artificial Sequence
  Description of Artificial Sequence: Synthetic oligonucleotide
cagtggctctcaggagtgaggaagattttaagaaaatc

SEQ ID NO: 251319 - DNA, 42 bp, Artificial Sequence
  Description of Artificial Sequence: Synthetic oligonucleotide
agtggctctcaggagtgaggaagattttaagaaaatcattag

SEQ ID NO: 251320 - DNA, 41 bp, Artificial Sequence
  Description of Artificial Sequence: Synthetic oligonucleotide
gtggctctcaggagtgaggaagattttaagaaaatcattag

SEQ ID NO: 251321 - DNA, 42 bp, Artificial Sequence
  Description of Artificial Sequence: Synthetic oligonucleotide
tggctctcaggagtgaggaagattttaagaaaatcattagtg

SEQ ID NO: 251322 - DNA, 41 bp, Artificial Sequence
  Description of Artificial Sequence: Synthetic oligonucleotide
ggctctcaggagtgaggaagattttaagaaaatcattagtg

SEQ ID NO: 251323 - DNA, 46 bp, Artificial Sequence
  Description of Artificial Sequence: Synthetic oligonucleotide
gctctcaggagtgaggaagattttaagaaaatcattagtgttaaag

SEQ ID NO: 251324 - DNA, 48 bp, Artificial Sequence
  Description of Artificial Sequence: Synthetic oligonucleotide
ctctcaggagtgaggaagattttaagaaaatcattagtgttaaagatg

SEQ ID NO: 251325 - DNA, 48 bp, Artificial Sequence
  Description of Artificial Sequence: Synthetic oligonucleotide
tctcaggagtgaggaagattttaagaaaatcattagtgttaaagatgc

SEQ ID NO: 251326 - DNA, 47 bp, Artificial Sequence
  Description of Artificial Sequence: Synthetic oligonucleotide
ctcaggagtgaggaagattttaagaaaatcattagtgttaaagatgc

SEQ ID NO: 251327 - DNA, 47 bp, Artificial Sequence
  Description of Artificial Sequence: Synthetic oligonucleotide
tcaggagtgaggaagattttaagaaaatcattagtgttaaagatgcg

SEQ ID NO: 251328 - DNA, 46 bp, Artificial Sequence
  Description of Artificial Sequence: Synthetic oligonucleotide
caggagtgaggaagattttaagaaaatcattagtgttaaagatgcg

SEQ ID NO: 251329 - DNA, 47 bp, Artificial Sequence
  Description of Artificial Sequence: Synthetic oligonucleotide
aggagtgaggaagattttaagaaaatcattagtgttaaagatgcgtc

SEQ ID NO: 251330 - DNA, 46 bp, Artificial Sequence
  Description of Artificial Sequence: Synthetic oligonucleotide
ggagtgaggaagattttaagaaaatcattagtgttaaagatgcgtc

SEQ ID NO: 251331 - DNA, 50 bp, Artificial Sequence
  Description of Artificial Sequence: Synthetic oligonucleotide
gagtgaggaagattttaagaaaatcattagtgttaaagatgcgtctatag

SEQ ID NO: 251332 - DNA, 52 bp, Artificial Sequence
  Description of Artificial Sequence: Synthetic oligonucleotide
agtgaggaagattttaagaaaatcattagtgttaaagatgcgtctatagtac

SEQ ID NO: 251333 - DNA, 51 bp, Artificial Sequence
  Description of Artificial Sequence: Synthetic oligonucleotide
gtgaggaagattttaagaaaatcattagtgttaaagatgcgtctatagtac

SEQ ID NO: 251334 - DNA, 51 bp, Artificial Sequence
  Description of Artificial Sequence: Synthetic oligonucleotide
tgaggaagattttaagaaaatcattagtgttaaagatgcgtctatagtacg

SEQ ID NO: 251335 - DNA, 50 bp, Artificial Sequence
  Description of Artificial Sequence: Synthetic oligonucleotide
gaggaagattttaagaaaatcattagtgttaaagatgcgtctatagtacg

SEQ ID NO: 251336 - DNA, 56 bp, Artificial Sequence
  Description of Artificial Sequence: Synthetic oligonucleotide
aggaagattttaagaaaatcattagtgttaaagatgcgtctatagtacgttttttc

SEQ ID NO: 251337 - DNA, 55 bp, Artificial Sequence
  Description of Artificial Sequence: Synthetic oligonucleotide
ggaagattttaagaaaatcattagtgttaaagatgcgtctatagtacgttttttc

SEQ ID NO: 251338 - DNA, 55 bp, Artificial Sequence
  Description of Artificial Sequence: Synthetic oligonucleotide
gaagattttaagaaaatcattagtgttaaagatgcgtctatagtacgttttttcg

SEQ ID NO: 251339 - DNA, 57 bp, Artificial Sequence
  Description of Artificial Sequence: Synthetic oligonucleotide
aagattttaagaaaatcattagtgttaaagatgcgtctatagtacgttttttcgttg

SEQ ID NO: 251340 - DNA, 56 bp, Artificial Sequence
  Description of Artificial Sequence: Synthetic oligonucleotide
agattttaagaaaatcattagtgttaaagatgcgtctatagtacgttttttcgttg

SEQ ID NO: 251341 - DNA, 55 bp, Artificial Sequence
  Description of Artificial Sequence: Synthetic oligonucleotide
gattttaagaaaatcattagtgttaaagatgcgtctatagtacgttttttcgttg

SEQ ID NO: 251342 - DNA, 58 bp, Artificial Sequence
  Description of Artificial Sequence: Synthetic oligonucleotide
attttaagaaaatcattagtgttaaagatgcgtctatagtacgttttttcgttgattc

SEQ ID NO: 251343 - DNA, 57 bp, Artificial Sequence
  Description of Artificial Sequence: Synthetic oligonucleotide
ttttaagaaaatcattagtgttaaagatgcgtctatagtacgttttttcgttgattc

SEQ ID NO: 251344 - DNA, 56 bp, Artificial Sequence
  Description of Artificial Sequence: Synthetic oligonucleotide
tttaagaaaatcattagtgttaaagatgcgtctatagtacgttttttcgttgattc

SEQ ID NO: 251345 - DNA, 55 bp, Artificial Sequence
  Description of Artificial Sequence: Synthetic oligonucleotide
ttaagaaaatcattagtgttaaagatgcgtctatagtacgttttttcgttgattc

SEQ ID NO: 251346 - DNA, 54 bp, Artificial Sequence
  Description of Artificial Sequence: Synthetic oligonucleotide
taagaaaatcattagtgttaaagatgcgtctatagtacgttttttcgttgattc

SEQ ID NO: 251347 - DNA, 53 bp, Artificial Sequence
  Description of Artificial Sequence: Synthetic oligonucleotide
aagaaaatcattagtgttaaagatgcgtctatagtacgttttttcgttgattc

SEQ ID NO: 251348 - DNA, 52 bp, Artificial Sequence
  Description of Artificial Sequence: Synthetic oligonucleotide
agaaaatcattagtgttaaagatgcgtctatagtacgttttttcgttgattc

SEQ ID NO: 251349 - DNA, 51 bp, Artificial Sequence
  Description of Artificial Sequence: Synthetic oligonucleotide
gaaaatcattagtgttaaagatgcgtctatagtacgttttttcgttgattc

SEQ ID NO: 251350 - DNA, 54 bp, Artificial Sequence
  Description of Artificial Sequence: Synthetic oligonucleotide
aaaatcattagtgttaaagatgcgtctatagtacgttttttcgttgattcattg

SEQ ID NO: 251351 - DNA, 53 bp, Artificial Sequence
  Description of Artificial Sequence: Synthetic oligonucleotide
aaatcattagtgttaaagatgcgtctatagtacgttttttcgttgattcattg

SEQ ID NO: 251352 - DNA, 52 bp, Artificial Sequence
  Description of Artificial Sequence: Synthetic oligonucleotide
aatcattagtgttaaagatgcgtctatagtacgttttttcgttgattcattg

SEQ ID NO: 251353 - DNA, 51 bp, Artificial Sequence
  Description of Artificial Sequence: Synthetic oligonucleotide
atcattagtgttaaagatgcgtctatagtacgttttttcgttgattcattg

SEQ ID NO: 251354 - DNA, 50 bp, Artificial Sequence
  Description of Artificial Sequence: Synthetic oligonucleotide
tcattagtgttaaagatgcgtctatagtacgttttttcgttgattcattg

SEQ ID NO: 251355 - DNA, 49 bp, Artificial Sequence
  Description of Artificial Sequence: Synthetic oligonucleotide
cattagtgttaaagatgcgtctatagtacgttttttcgttgattcattg

SEQ ID NO: 251356 - DNA, 50 bp, Artificial Sequence
  Description of Artificial Sequence: Synthetic oligonucleotide
attagtgttaaagatgcgtctatagtacgttttttcgttgattcattgag

SEQ ID NO: 251357 - DNA, 49 bp, Artificial Sequence
  Description of Artificial Sequence: Synthetic oligonucleotide
ttagtgttaaagatgcgtctatagtacgttttttcgttgattcattgag

SEQ ID NO: 251358 - DNA, 48 bp, Artificial Sequence
  Description of Artificial Sequence: Synthetic oligonucleotide
tagtgttaaagatgcgtctatagtacgttttttcgttgattcattgag

SEQ ID NO: 251359 - DNA, 47 bp, Artificial Sequence
  Description of Artificial Sequence: Synthetic oligonucleotide
agtgttaaagatgcgtctatagtacgttttttcgttgattcattgag

SEQ ID NO: 251360 - DNA, 46 bp, Artificial Sequence
  Description of Artificial Sequence: Synthetic oligonucleotide
gtgttaaagatgcgtctatagtacgttttttcgttgattcattgag

SEQ ID NO: 251361 - DNA, 47 bp, Artificial Sequence
  Description of Artificial Sequence: Synthetic oligonucleotide
tgttaaagatgcgtctatagtacgttttttcgttgattcattgagtg

SEQ ID NO: 251362 - DNA, 46 bp, Artificial Sequence
  Description of Artificial Sequence: Synthetic oligonucleotide
gttaaagatgcgtctatagtacgttttttcgttgattcattgagtg

SEQ ID NO: 251363 - DNA, 47 bp, Artificial Sequence
  Description of Artificial Sequence: Synthetic oligonucleotide
ttaaagatgcgtctatagtacgttttttcgttgattcattgagtgag

SEQ ID NO: 251364 - DNA, 46 bp, Artificial Sequence
  Description of Artificial Sequence: Synthetic oligonucleotide
taaagatgcgtctatagtacgttttttcgttgattcattgagtgag

SEQ ID NO: 251365 - DNA, 45 bp, Artificial Sequence
  Description of Artificial Sequence: Synthetic oligonucleotide
aaagatgcgtctatagtacgttttttcgttgattcattgagtgag

SEQ ID NO: 251366 - DNA, 44 bp, Artificial Sequence
  Description of Artificial Sequence: Synthetic oligonucleotide
aagatgcgtctatagtacgttttttcgttgattcattgagtgag

SEQ ID NO: 251367 - DNA, 43 bp, Artificial Sequence
  Description of Artificial Sequence: Synthetic oligonucleotide
agatgcgtctatagtacgttttttcgttgattcattgagtgag

SEQ ID NO: 251368 - DNA, 42 bp, Artificial Sequence
  Description of Artificial Sequence: Synthetic oligonucleotide
gatgcgtctatagtacgttttttcgttgattcattgagtgag

SEQ ID NO: 251369 - DNA, 42 bp, Artificial Sequence
  Description of Artificial Sequence: Synthetic oligonucleotide
atgcgtctatagtacgttttttcgttgattcattgagtgagg

SEQ ID NO: 251370 - DNA, 41 bp, Artificial Sequence
  Description of Artificial Sequence: Synthetic oligonucleotide
tgcgtctatagtacgttttttcgttgattcattgagtgagg

SEQ ID NO: 251371 - DNA, 40 bp, Artificial Sequence
  Description of Artificial Sequence: Synthetic oligonucleotide
gcgtctatagtacgttttttcgttgattcattgagtgagg

SEQ ID NO: 251372 - DNA, 40 bp, Artificial Sequence
  Description of Artificial Sequence: Synthetic oligonucleotide
cgtctatagtacgttttttcgttgattcattgagtgaggc

SEQ ID NO: 251373 - DNA, 41 bp, Artificial Sequence
  Description of Artificial Sequence: Synthetic oligonucleotide
gtctatagtacgttttttcgttgattcattgagtgaggctg

SEQ ID NO: 251374 - DNA, 42 bp, Artificial Sequence
  Description of Artificial Sequence: Synthetic oligonucleotide
tctatagtacgttttttcgttgattcattgagtgaggctgac

SEQ ID NO: 251375 - DNA, 41 bp, Artificial Sequence
  Description of Artificial Sequence: Synthetic oligonucleotide
ctatagtacgttttttcgttgattcattgagtgaggctgac

SEQ ID NO: 251376 - DNA, 42 bp, Artificial Sequence
  Description of Artificial Sequence: Synthetic oligonucleotide
tatagtacgttttttcgttgattcattgagtgaggctgactc

SEQ ID NO: 251377 - DNA, 41 bp, Artificial Sequence
  Description of Artificial Sequence: Synthetic oligonucleotide
atagtacgttttttcgttgattcattgagtgaggctgactc

SEQ ID NO: 251378 - DNA, 40 bp, Artificial Sequence
  Description of Artificial Sequence: Synthetic oligonucleotide
tagtacgttttttcgttgattcattgagtgaggctgactc

SEQ ID NO: 251379 - DNA, 39 bp, Artificial Sequence
  Description of Artificial Sequence: Synthetic oligonucleotide
agtacgttttttcgttgattcattgagtgaggctgactc

SEQ ID NO: 251380 - DNA, 38 bp, Artificial Sequence
  Description of Artificial Sequence: Synthetic oligonucleotide
gtacgttttttcgttgattcattgagtgaggctgactc

SEQ ID NO: 251381 - DNA, 38 bp, Artificial Sequence
  Description of Artificial Sequence: Synthetic oligonucleotide
tacgttttttcgttgattcattgagtgaggctgactcc

SEQ ID NO: 251382 - DNA, 37 bp, Artificial Sequence
  Description of Artificial Sequence: Synthetic oligonucleotide
acgttttttcgttgattcattgagtgaggctgactcc

SEQ ID NO: 251383 - DNA, 36 bp, Artificial Sequence
  Description of Artificial Sequence: Synthetic oligonucleotide
cgttttttcgttgattcattgagtgaggctgactcc

SEQ ID NO: 251384 - DNA, 36 bp, Artificial Sequence
  Description of Artificial Sequence: Synthetic oligonucleotide
gttttttcgttgattcattgagtgaggctgactccg

SEQ ID NO: 251385 - DNA, 37 bp, Artificial Sequence
  Description of Artificial Sequence: Synthetic oligonucleotide
ttttttcgttgattcattgagtgaggctgactccgag

SEQ ID NO: 251386 - DNA, 36 bp, Artificial Sequence
  Description of Artificial Sequence: Synthetic oligonucleotide
tttttcgttgattcattgagtgaggctgactccgag

SEQ ID NO: 251387 - DNA, 35 bp, Artificial Sequence
  Description of Artificial Sequence: Synthetic oligonucleotide
ttttcgttgattcattgagtgaggctgactccgag

SEQ ID NO: 251388 - DNA, 34 bp, Artificial Sequence
  Description of Artificial Sequence: Synthetic oligonucleotide
tttcgttgattcattgagtgaggctgactccgag

SEQ ID NO: 251389 - DNA, 33 bp, Artificial Sequence
  Description of Artificial Sequence: Synthetic oligonucleotide
ttcgttgattcattgagtgaggctgactccgag

SEQ ID NO: 251390 - DNA, 32 bp, Artificial Sequence
  Description of Artificial Sequence: Synthetic oligonucleotide
tcgttgattcattgagtgaggctgactccgag

SEQ ID NO: 251391 - DNA, 31 bp, Artificial Sequence
  Description of Artificial Sequence: Synthetic oligonucleotide
cgttgattcattgagtgaggctgactccgag

SEQ ID NO: 251392 - DNA, 33 bp, Artificial Sequence
  Description of Artificial Sequence: Synthetic oligonucleotide
gttgattcattgagtgaggctgactccgagtac

SEQ ID NO: 251393 - DNA, 33 bp, Artificial Sequence
  Description of Artificial Sequence: Synthetic oligonucleotide
ttgattcattgagtgaggctgactccgagtacc

SEQ ID NO: 251394 - DNA, 32 bp, Artificial Sequence
  Description of Artificial Sequence: Synthetic oligonucleotide
tgattcattgagtgaggctgactccgagtacc

SEQ ID NO: 251395 - DNA, 31 bp, Artificial Sequence
  Description of Artificial Sequence: Synthetic oligonucleotide
gattcattgagtgaggctgactccgagtacc

SEQ ID NO: 251396 - DNA, 36 bp, Artificial Sequence
  Description of Artificial Sequence: Synthetic oligonucleotide
attcattgagtgaggctgactccgagtacctaaaag

SEQ ID NO: 251397 - DNA, 35 bp, Artificial Sequence
  Description of Artificial Sequence: Synthetic oligonucleotide
ttcattgagtgaggctgactccgagtacctaaaag

SEQ ID NO: 251398 - DNA, 34 bp, Artificial Sequence
  Description of Artificial Sequence: Synthetic oligonucleotide
tcattgagtgaggctgactccgagtacctaaaag

SEQ ID NO: 251399 - DNA, 33 bp, Artificial Sequence
  Description of Artificial Sequence: Synthetic oligonucleotide
cattgagtgaggctgactccgagtacctaaaag

SEQ ID NO: 251400 - DNA, 33 bp, Artificial Sequence
  Description of Artificial Sequence: Synthetic oligonucleotide
attgagtgaggctgactccgagtacctaaaagc

SEQ ID NO: 251401 - DNA, 32 bp, Artificial Sequence
  Description of Artificial Sequence: Synthetic oligonucleotide
ttgagtgaggctgactccgagtacctaaaagc

SEQ ID NO: 251402 - DNA, 31 bp, Artificial Sequence
  Description of Artificial Sequence: Synthetic oligonucleotide
tgagtgaggctgactccgagtacctaaaagc

SEQ ID NO: 251403 - DNA, 30 bp, Artificial Sequence
  Description of Artificial Sequence: Synthetic oligonucleotide
gagtgaggctgactccgagtacctaaaagc

SEQ ID NO: 251404 - DNA, 31 bp, Artificial Sequence
  Description of Artificial Sequence: Synthetic oligonucleotide
agtgaggctgactccgagtacctaaaagctg

SEQ ID NO: 251405 - DNA, 30 bp, Artificial Sequence
  Description of Artificial Sequence: Synthetic oligonucleotide
gtgaggctgactccgagtacctaaaagctg

SEQ ID NO: 251406 - DNA, 30 bp, Artificial Sequence
  Description of Artificial Sequence: Synthetic oligonucleotide
tgaggctgactccgagtacctaaaagctgc

SEQ ID NO: 251407 - DNA, 29 bp, Artificial Sequence
  Description of Artificial Sequence: Synthetic oligonucleotide
gaggctgactccgagtacctaaaagctgc

SEQ ID NO: 251408 - DNA, 29 bp, Artificial Sequence
  Description of Artificial Sequence: Synthetic oligonucleotide
aggctgactccgagtacctaaaagctgcc

SEQ ID NO: 251409 - DNA, 28 bp, Artificial Sequence
  Description of Artificial Sequence: Synthetic oligonucleotide
ggctgactccgagtacctaaaagctgcc

SEQ ID NO: 251410 - DNA, 29 bp, Artificial Sequence
  Description of Artificial Sequence: Synthetic oligonucleotide
gctgactccgagtacctaaaagctgccag

SEQ ID NO: 251411 - DNA, 29 bp, Artificial Sequence
  Description of Artificial Sequence: Synthetic oligonucleotide
ctgactccgagtacctaaaagctgccagc

SEQ ID NO: 251412 - DNA, 31 bp, Artificial Sequence
  Description of Artificial Sequence: Synthetic oligonucleotide
tgactccgagtacctaaaagctgccagcaac

SEQ ID NO: 251413 - DNA, 30 bp, Artificial Sequence
  Description of Artificial Sequence: Synthetic oligonucleotide
gactccgagtacctaaaagctgccagcaac

SEQ ID NO: 251414 - DNA, 32 bp, Artificial Sequence
  Description of Artificial Sequence: Synthetic oligonucleotide
actccgagtacctaaaagctgccagcaacatg

SEQ ID NO: 251415 - DNA, 31 bp, Artificial Sequence
  Description of Artificial Sequence: Synthetic oligonucleotide
ctccgagtacctaaaagctgccagcaacatg

SEQ ID NO: 251416 - DNA, 32 bp, Artificial Sequence
  Description of Artificial Sequence: Synthetic oligonucleotide
tccgagtacctaaaagctgccagcaacatgag

SEQ ID NO: 251417 - DNA, 31 bp, Artificial Sequence
  Description of Artificial Sequence: Synthetic oligonucleotide
ccgagtacctaaaagctgccagcaacatgag

SEQ ID NO: 251418 - DNA, 31 bp, Artificial Sequence
  Description of Artificial Sequence: Synthetic oligonucleotide
cgagtacctaaaagctgccagcaacatgagg

SEQ ID NO: 251419 - DNA, 31 bp, Artificial Sequence
  Description of Artificial Sequence: Synthetic oligonucleotide
gagtacctaaaagctgccagcaacatgaggg

SEQ ID NO: 251420 - DNA, 35 bp, Artificial Sequence
  Description of Artificial Sequence: Synthetic oligonucleotide
agtacctaaaagctgccagcaacatgagggatatc

SEQ ID NO: 251421 - DNA, 34 bp, Artificial Sequence
  Description of Artificial Sequence: Synthetic oligonucleotide
gtacctaaaagctgccagcaacatgagggatatc

SEQ ID NO: 251422 - DNA, 36 bp, Artificial Sequence
  Description of Artificial Sequence: Synthetic oligonucleotide
tacctaaaagctgccagcaacatgagggatatctac

SEQ ID NO: 251423 - DNA, 35 bp, Artificial Sequence
  Description of Artificial Sequence: Synthetic oligonucleotide
acctaaaagctgccagcaacatgagggatatctac

SEQ ID NO: 251424 - DNA, 34 bp, Artificial Sequence
  Description of Artificial Sequence: Synthetic oligonucleotide
cctaaaagctgccagcaacatgagggatatctac

SEQ ID NO: 251425 - DNA, 34 bp, Artificial Sequence
  Description of Artificial Sequence: Synthetic oligonucleotide
ctaaaagctgccagcaacatgagggatatctacc

SEQ ID NO: 251426 - DNA, 34 bp, Artificial Sequence
  Description of Artificial Sequence: Synthetic oligonucleotide
taaaagctgccagcaacatgagggatatctaccg

SEQ ID NO: 251427 - DNA, 33 bp, Artificial Sequence
  Description of Artificial Sequence: Synthetic oligonucleotide
aaaagctgccagcaacatgagggatatctaccg

SEQ ID NO: 251428 - DNA, 32 bp, Artificial Sequence
  Description of Artificial Sequence: Synthetic oligonucleotide
aaagctgccagcaacatgagggatatctaccg

SEQ ID NO: 251429 - DNA, 31 bp, Artificial Sequence
  Description of Artificial Sequence: Synthetic oligonucleotide
aagctgccagcaacatgagggatatctaccg

SEQ ID NO: 251430 - DNA, 30 bp, Artificial Sequence
  Description of Artificial Sequence: Synthetic oligonucleotide
agctgccagcaacatgagggatatctaccg

SEQ ID NO: 251431 - DNA, 29 bp, Artificial Sequence
  Description of Artificial Sequence: Synthetic oligonucleotide
gctgccagcaacatgagggatatctaccg

SEQ ID NO: 251432 - DNA, 33 bp, Artificial Sequence
  Description of Artificial Sequence: Synthetic oligonucleotide
ctgccagcaacatgagggatatctaccgattag

SEQ ID NO: 251433 - DNA, 33 bp, Artificial Sequence
  Description of Artificial Sequence: Synthetic oligonucleotide
tgccagcaacatgagggatatctaccgattagc

SEQ ID NO: 251434 - DNA, 32 bp, Artificial Sequence
  Description of Artificial Sequence: Synthetic oligonucleotide
gccagcaacatgagggatatctaccgattagc

SEQ ID NO: 251435 - DNA, 33 bp, Artificial Sequence
  Description of Artificial Sequence: Synthetic oligonucleotide
ccagcaacatgagggatatctaccgattagcac

SEQ ID NO: 251436 - DNA, 36 bp, Artificial Sequence
  Description of Artificial Sequence: Synthetic oligonucleotide
cagcaacatgagggatatctaccgattagcacatac

SEQ ID NO: 251437 - DNA, 36 bp, Artificial Sequence
  Description of Artificial Sequence: Synthetic oligonucleotide
agcaacatgagggatatctaccgattagcacatacg

SEQ ID NO: 251438 - DNA, 35 bp, Artificial Sequence
  Description of Artificial Sequence: Synthetic oligonucleotide
gcaacatgagggatatctaccgattagcacatacg

SEQ ID NO: 251439 - DNA, 38 bp, Artificial Sequence
  Description of Artificial Sequence: Synthetic oligonucleotide
caacatgagggatatctaccgattagcacatacgtatg

SEQ ID NO: 251440 - DNA, 40 bp, Artificial Sequence
  Description of Artificial Sequence: Synthetic oligonucleotide
aacatgagggatatctaccgattagcacatacgtatgttg

SEQ ID NO: 251441 - DNA, 39 bp, Artificial Sequence
  Description of Artificial Sequence: Synthetic oligonucleotide
acatgagggatatctaccgattagcacatacgtatgttg

SEQ ID NO: 251442 - DNA, 38 bp, Artificial Sequence
  Description of Artificial Sequence: Synthetic oligonucleotide
catgagggatatctaccgattagcacatacgtatgttg

SEQ ID NO: 251443 - DNA, 39 bp, Artificial Sequence
  Description of Artificial Sequence: Synthetic oligonucleotide
atgagggatatctaccgattagcacatacgtatgttgag

SEQ ID NO: 251444 - DNA, 38 bp, Artificial Sequence
  Description of Artificial Sequence: Synthetic oligonucleotide
tgagggatatctaccgattagcacatacgtatgttgag

SEQ ID NO: 251445 - DNA, 37 bp, Artificial Sequence
  Description of Artificial Sequence: Synthetic oligonucleotide
gagggatatctaccgattagcacatacgtatgttgag

SEQ ID NO: 251446 - DNA, 38 bp, Artificial Sequence
  Description of Artificial Sequence: Synthetic oligonucleotide
agggatatctaccgattagcacatacgtatgttgagtg

SEQ ID NO: 251447 - DNA, 37 bp, Artificial Sequence
  Description of Artificial Sequence: Synthetic oligonucleotide
gggatatctaccgattagcacatacgtatgttgagtg

SEQ ID NO: 251448 - DNA, 38 bp, Artificial Sequence
  Description of Artificial Sequence: Synthetic oligonucleotide
ggatatctaccgattagcacatacgtatgttgagtgtc

SEQ ID NO: 251449 - DNA, 39 bp, Artificial Sequence
  Description of Artificial Sequence: Synthetic oligonucleotide
gatatctaccgattagcacatacgtatgttgagtgtctg

SEQ ID NO: 251450 - DNA, 39 bp, Artificial Sequence
  Description of Artificial Sequence: Synthetic oligonucleotide
atatctaccgattagcacatacgtatgttgagtgtctgg

SEQ ID NO: 251451 - DNA, 38 bp, Artificial Sequence
  Description of Artificial Sequence: Synthetic oligonucleotide
tatctaccgattagcacatacgtatgttgagtgtctgg

SEQ ID NO: 251452 - DNA, 37 bp, Artificial Sequence
  Description of Artificial Sequence: Synthetic oligonucleotide
atctaccgattagcacatacgtatgttgagtgtctgg

SEQ ID NO: 251453 - DNA, 36 bp, Artificial Sequence
  Description of Artificial Sequence: Synthetic oligonucleotide
tctaccgattagcacatacgtatgttgagtgtctgg

SEQ ID NO: 251454 - DNA, 35 bp, Artificial Sequence
  Description of Artificial Sequence: Synthetic oligonucleotide
ctaccgattagcacatacgtatgttgagtgtctgg

SEQ ID NO: 251455 - DNA, 36 bp, Artificial Sequence
  Description of Artificial Sequence: Synthetic oligonucleotide
taccgattagcacatacgtatgttgagtgtctggtg

SEQ ID NO: 251456 - DNA, 35 bp, Artificial Sequence
  Description of Artificial Sequence: Synthetic oligonucleotide
accgattagcacatacgtatgttgagtgtctggtg

SEQ ID NO: 251457 - DNA, 34 bp, Artificial Sequence
  Description of Artificial Sequence: Synthetic oligonucleotide
ccgattagcacatacgtatgttgagtgtctggtg

SEQ ID NO: 251458 - DNA, 36 bp, Artificial Sequence
  Description of Artificial Sequence: Synthetic oligonucleotide
cgattagcacatacgtatgttgagtgtctggtgaag

SEQ ID NO: 251459 - DNA, 36 bp, Artificial Sequence
  Description of Artificial Sequence: Synthetic oligonucleotide
gattagcacatacgtatgttgagtgtctggtgaagg

SEQ ID NO: 251460 - DNA, 37 bp, Artificial Sequence
  Description of Artificial Sequence: Synthetic oligonucleotide
attagcacatacgtatgttgagtgtctggtgaaggag

SEQ ID NO: 251461 - DNA, 36 bp, Artificial Sequence
  Description of Artificial Sequence: Synthetic oligonucleotide
ttagcacatacgtatgttgagtgtctggtgaaggag

SEQ ID NO: 251462 - DNA, 35 bp, Artificial Sequence
  Description of Artificial Sequence: Synthetic oligonucleotide
tagcacatacgtatgttgagtgtctggtgaaggag

SEQ ID NO: 251463 - DNA, 34 bp, Artificial Sequence
  Description of Artificial Sequence: Synthetic oligonucleotide
agcacatacgtatgttgagtgtctggtgaaggag

SEQ ID NO: 251464 - DNA, 33 bp, Artificial Sequence
  Description of Artificial Sequence: Synthetic oligonucleotide
gcacatacgtatgttgagtgtctggtgaaggag

SEQ ID NO: 251465 - DNA, 36 bp, Artificial Sequence
  Description of Artificial Sequence: Synthetic oligonucleotide
cacatacgtatgttgagtgtctggtgaaggagtatg

SEQ ID NO: 251466 - DNA, 38 bp, Artificial Sequence
  Description of Artificial Sequence: Synthetic oligonucleotide
acatacgtatgttgagtgtctggtgaaggagtatgatc

SEQ ID NO: 251467 - DNA, 37 bp, Artificial Sequence
  Description of Artificial Sequence: Synthetic oligonucleotide
catacgtatgttgagtgtctggtgaaggagtatgatc

SEQ ID NO: 251468 - DNA, 42 bp, Artificial Sequence
  Description of Artificial Sequence: Synthetic oligonucleotide
atacgtatgttgagtgtctggtgaaggagtatgatcataatg

SEQ ID NO: 251469 - DNA, 41 bp, Artificial Sequence
  Description of Artificial Sequence: Synthetic oligonucleotide
tacgtatgttgagtgtctggtgaaggagtatgatcataatg

SEQ ID NO: 251470 - DNA, 40 bp, Artificial Sequence
  Description of Artificial Sequence: Synthetic oligonucleotide
acgtatgttgagtgtctggtgaaggagtatgatcataatg

SEQ ID NO: 251471 - DNA, 39 bp, Artificial Sequence
  Description of Artificial Sequence: Synthetic oligonucleotide
cgtatgttgagtgtctggtgaaggagtatgatcataatg

SEQ ID NO: 251472 - DNA, 39 bp, Artificial Sequence
  Description of Artificial Sequence: Synthetic oligonucleotide
gtatgttgagtgtctggtgaaggagtatgatcataatgg

SEQ ID NO: 251473 - DNA, 40 bp, Artificial Sequence
  Description of Artificial Sequence: Synthetic oligonucleotide
tatgttgagtgtctggtgaaggagtatgatcataatggag

SEQ ID NO: 251474 - DNA, 39 bp, Artificial Sequence
  Description of Artificial Sequence: Synthetic oligonucleotide
atgttgagtgtctggtgaaggagtatgatcataatggag

SEQ ID NO: 251475 - DNA, 38 bp, Artificial Sequence
  Description of Artificial Sequence: Synthetic oligonucleotide
tgttgagtgtctggtgaaggagtatgatcataatggag

SEQ ID NO: 251476 - DNA, 37 bp, Artificial Sequence
  Description of Artificial Sequence: Synthetic oligonucleotide
gttgagtgtctggtgaaggagtatgatcataatggag

SEQ ID NO: 251477 - DNA, 38 bp, Artificial Sequence
  Description of Artificial Sequence: Synthetic oligonucleotide
ttgagtgtctggtgaaggagtatgatcataatggagtg

SEQ ID NO: 251478 - DNA, 37 bp, Artificial Sequence
  Description of Artificial Sequence: Synthetic oligonucleotide
tgagtgtctggtgaaggagtatgatcataatggagtg

SEQ ID NO: 251479 - DNA, 36 bp, Artificial Sequence
  Description of Artificial Sequence: Synthetic oligonucleotide
gagtgtctggtgaaggagtatgatcataatggagtg

SEQ ID NO: 251480 - DNA, 36 bp, Artificial Sequence
  Description of Artificial Sequence: Synthetic oligonucleotide
agtgtctggtgaaggagtatgatcataatggagtgg

SEQ ID NO: 251481 - DNA, 35 bp, Artificial Sequence
  Description of Artificial Sequence: Synthetic oligonucleotide
gtgtctggtgaaggagtatgatcataatggagtgg

SEQ ID NO: 251482 - DNA, 35 bp, Artificial Sequence
  Description of Artificial Sequence: Synthetic oligonucleotide
tgtctggtgaaggagtatgatcataatggagtggg

SEQ ID NO: 251483 - DNA, 34 bp, Artificial Sequence
  Description of Artificial Sequence: Synthetic oligonucleotide
gtctggtgaaggagtatgatcataatggagtggg

SEQ ID NO: 251484 - DNA, 37 bp, Artificial Sequence
  Description of Artificial Sequence: Synthetic oligonucleotide
tctggtgaaggagtatgatcataatggagtgggtatc

SEQ ID NO: 251485 - DNA, 36 bp, Artificial Sequence
  Description of Artificial Sequence: Synthetic oligonucleotide
ctggtgaaggagtatgatcataatggagtgggtatc

SEQ ID NO: 251486 - DNA, 38 bp, Artificial Sequence
  Description of Artificial Sequence: Synthetic oligonucleotide
tggtgaaggagtatgatcataatggagtgggtatcatg

SEQ ID NO: 251487 - DNA, 37 bp, Artificial Sequence
  Description of Artificial Sequence: Synthetic oligonucleotide
ggtgaaggagtatgatcataatggagtgggtatcatg

SEQ ID NO: 251488 - DNA, 43 bp, Artificial Sequence
  Description of Artificial Sequence: Synthetic oligonucleotide
gtgaaggagtatgatcataatggagtgggtatcatgttatttc

SEQ ID NO: 251489 - DNA, 43 bp, Artificial Sequence
  Description of Artificial Sequence: Synthetic oligonucleotide
tgaaggagtatgatcataatggagtgggtatcatgttatttcg

SEQ ID NO: 251490 - DNA, 42 bp, Artificial Sequence
  Description of Artificial Sequence: Synthetic oligonucleotide
gaaggagtatgatcataatggagtgggtatcatgttatttcg

SEQ ID NO: 251491 - DNA, 43 bp, Artificial Sequence
  Description of Artificial Sequence: Synthetic oligonucleotide
aaggagtatgatcataatggagtgggtatcatgttatttcgtg

SEQ ID NO: 251492 - DNA, 42 bp, Artificial Sequence
  Description of Artificial Sequence: Synthetic oligonucleotide
aggagtatgatcataatggagtgggtatcatgttatttcgtg

SEQ ID NO: 251493 - DNA, 41 bp, Artificial Sequence
  Description of Artificial Sequence: Synthetic oligonucleotide
ggagtatgatcataatggagtgggtatcatgttatttcgtg

SEQ ID NO: 251494 - DNA, 41 bp, Artificial Sequence
  Description of Artificial Sequence: Synthetic oligonucleotide
gagtatgatcataatggagtgggtatcatgttatttcgtgc

SEQ ID NO: 251495 - DNA, 43 bp, Artificial Sequence
  Description of Artificial Sequence: Synthetic oligonucleotide
agtatgatcataatggagtgggtatcatgttatttcgtgcttc

SEQ ID NO: 251496 - DNA, 42 bp, Artificial Sequence
  Description of Artificial Sequence: Synthetic oligonucleotide
gtatgatcataatggagtgggtatcatgttatttcgtgcttc

SEQ ID NO: 251497 - DNA, 43 bp, Artificial Sequence
  Description of Artificial Sequence: Synthetic oligonucleotide
tatgatcataatggagtgggtatcatgttatttcgtgcttcac

SEQ ID NO: 251498 - DNA, 42 bp, Artificial Sequence
  Description of Artificial Sequence: Synthetic oligonucleotide
atgatcataatggagtgggtatcatgttatttcgtgcttcac

SEQ ID NO: 251499 - DNA, 41 bp, Artificial Sequence
  Description of Artificial Sequence: Synthetic oligonucleotide
tgatcataatggagtgggtatcatgttatttcgtgcttcac

SEQ ID NO: 251500 - DNA, 40 bp, Artificial Sequence
  Description of Artificial Sequence: Synthetic oligonucleotide
gatcataatggagtgggtatcatgttatttcgtgcttcac

SEQ ID NO: 251501 - DNA, 42 bp, Artificial Sequence
  Description of Artificial Sequence: Synthetic oligonucleotide
atcataatggagtgggtatcatgttatttcgtgcttcacatc

SEQ ID NO: 251502 - DNA, 41 bp, Artificial Sequence
  Description of Artificial Sequence: Synthetic oligonucleotide
tcataatggagtgggtatcatgttatttcgtgcttcacatc

SEQ ID NO: 251503 - DNA, 40 bp, Artificial Sequence
  Description of Artificial Sequence: Synthetic oligonucleotide
cataatggagtgggtatcatgttatttcgtgcttcacatc

SEQ ID NO: 251504 - DNA, 41 bp, Artificial Sequence
  Description of Artificial Sequence: Synthetic oligonucleotide
ataatggagtgggtatcatgttatttcgtgcttcacatcac

SEQ ID NO: 251505 - DNA, 40 bp, Artificial Sequence
  Description of Artificial Sequence: Synthetic oligonucleotide
taatggagtgggtatcatgttatttcgtgcttcacatcac

SEQ ID NO: 251506 - DNA, 39 bp, Artificial Sequence
  Description of Artificial Sequence: Synthetic oligonucleotide
aatggagtgggtatcatgttatttcgtgcttcacatcac

SEQ ID NO: 251507 - DNA, 38 bp, Artificial Sequence
  Description of Artificial Sequence: Synthetic oligonucleotide
atggagtgggtatcatgttatttcgtgcttcacatcac

SEQ ID NO: 251508 - DNA, 37 bp, Artificial Sequence
  Description of Artificial Sequence: Synthetic oligonucleotide
tggagtgggtatcatgttatttcgtgcttcacatcac

SEQ ID NO: 251509 - DNA, 36 bp, Artificial Sequence
  Description of Artificial Sequence: Synthetic oligonucleotide
ggagtgggtatcatgttatttcgtgcttcacatcac

SEQ ID NO: 251510 - DNA, 37 bp, Artificial Sequence
  Description of Artificial Sequence: Synthetic oligonucleotide
gagtgggtatcatgttatttcgtgcttcacatcacac

SEQ ID NO: 251511 - DNA, 40 bp, Artificial Sequence
  Description of Artificial Sequence: Synthetic oligonucleotide
agtgggtatcatgttatttcgtgcttcacatcacactaac

SEQ ID NO: 251512 - DNA, 39 bp, Artificial Sequence
  Description of Artificial Sequence: Synthetic oligonucleotide
gtgggtatcatgttatttcgtgcttcacatcacactaac

SEQ ID NO: 251513 - DNA, 41 bp, Artificial Sequence
  Description of Artificial Sequence: Synthetic oligonucleotide
tgggtatcatgttatttcgtgcttcacatcacactaacaac

SEQ ID NO: 251514 - DNA, 40 bp, Artificial Sequence
  Description of Artificial Sequence: Synthetic oligonucleotide
gggtatcatgttatttcgtgcttcacatcacactaacaac

SEQ ID NO: 251515 - DNA, 43 bp, Artificial Sequence
  Description of Artificial Sequence: Synthetic oligonucleotide
ggtatcatgttatttcgtgcttcacatcacactaacaactttg

SEQ ID NO: 251516 - DNA, 44 bp, Artificial Sequence
  Description of Artificial Sequence: Synthetic oligonucleotide
gtatcatgttatttcgtgcttcacatcacactaacaactttgag

SEQ ID NO: 251517 - DNA, 44 bp, Artificial Sequence
  Description of Artificial Sequence: Synthetic oligonucleotide
tatcatgttatttcgtgcttcacatcacactaacaactttgagg

SEQ ID NO: 251518 - DNA, 43 bp, Artificial Sequence
  Description of Artificial Sequence: Synthetic oligonucleotide
atcatgttatttcgtgcttcacatcacactaacaactttgagg

SEQ ID NO: 251519 - DNA, 42 bp, Artificial Sequence
  Description of Artificial Sequence: Synthetic oligonucleotide
tcatgttatttcgtgcttcacatcacactaacaactttgagg

SEQ ID NO: 251520 - DNA, 41 bp, Artificial Sequence
  Description of Artificial Sequence: Synthetic oligonucleotide
catgttatttcgtgcttcacatcacactaacaactttgagg

SEQ ID NO: 251521 - DNA, 42 bp, Artificial Sequence
  Description of Artificial Sequence: Synthetic oligonucleotide
atgttatttcgtgcttcacatcacactaacaactttgaggac

SEQ ID NO: 251522 - DNA, 41 bp, Artificial Sequence
  Description of Artificial Sequence: Synthetic oligonucleotide
tgttatttcgtgcttcacatcacactaacaactttgaggac

SEQ ID NO: 251523 - DNA, 40 bp, Artificial Sequence
  Description of Artificial Sequence: Synthetic oligonucleotide
gttatttcgtgcttcacatcacactaacaactttgaggac

SEQ ID NO: 251524 - DNA, 42 bp, Artificial Sequence
  Description of Artificial Sequence: Synthetic oligonucleotide
ttatttcgtgcttcacatcacactaacaactttgaggactag

SEQ ID NO: 251525 - DNA, 41 bp, Artificial Sequence
  Description of Artificial Sequence: Synthetic oligonucleotide
tatttcgtgcttcacatcacactaacaactttgaggactag

SEQ ID NO: 251526 - DNA, 40 bp, Artificial Sequence
  Description of Artificial Sequence: Synthetic oligonucleotide
atttcgtgcttcacatcacactaacaactttgaggactag

SEQ ID NO: 251527 - DNA, 39 bp, Artificial Sequence
  Description of Artificial Sequence: Synthetic oligonucleotide
tttcgtgcttcacatcacactaacaactttgaggactag

SEQ ID NO: 251528 - DNA, 38 bp, Artificial Sequence
  Description of Artificial Sequence: Synthetic oligonucleotide
ttcgtgcttcacatcacactaacaactttgaggactag

SEQ ID NO: 251529 - DNA, 37 bp, Artificial Sequence
  Description of Artificial Sequence: Synthetic oligonucleotide
tcgtgcttcacatcacactaacaactttgaggactag

SEQ ID NO: 251530 - DNA, 36 bp, Artificial Sequence
  Description of Artificial Sequence: Synthetic oligonucleotide
cgtgcttcacatcacactaacaactttgaggactag

SEQ ID NO: 251531 - DNA, 37 bp, Artificial Sequence
  Description of Artificial Sequence: Synthetic oligonucleotide
gtgcttcacatcacactaacaactttgaggactagac

SEQ ID NO: 251532 - DNA, 38 bp, Artificial Sequence
  Description of Artificial Sequence: Synthetic oligonucleotide
tgcttcacatcacactaacaactttgaggactagactg

SEQ ID NO: 251533 - DNA, 37 bp, Artificial Sequence
  Description of Artificial Sequence: Synthetic oligonucleotide
gcttcacatcacactaacaactttgaggactagactg

SEQ ID NO: 251534 - DNA, 38 bp, Artificial Sequence
  Description of Artificial Sequence: Synthetic oligonucleotide
cttcacatcacactaacaactttgaggactagactgtg

SEQ ID NO: 251535 - DNA, 38 bp, Artificial Sequence
  Description of Artificial Sequence: Synthetic oligonucleotide
ttcacatcacactaacaactttgaggactagactgtgg

SEQ ID NO: 251536 - DNA, 37 bp, Artificial Sequence
  Description of Artificial Sequence: Synthetic oligonucleotide
tcacatcacactaacaactttgaggactagactgtgg

SEQ ID NO: 251537 - DNA, 36 bp, Artificial Sequence
  Description of Artificial Sequence: Synthetic oligonucleotide
cacatcacactaacaactttgaggactagactgtgg

SEQ ID NO: 251538 - DNA, 36 bp, Artificial Sequence
  Description of Artificial Sequence: Synthetic oligonucleotide
acatcacactaacaactttgaggactagactgtggg

SEQ ID NO: 251539 - DNA, 35 bp, Artificial Sequence
  Description of Artificial Sequence: Synthetic oligonucleotide
catcacactaacaactttgaggactagactgtggg

SEQ ID NO: 251540 - DNA, 40 bp, Artificial Sequence
  Description of Artificial Sequence: Synthetic oligonucleotide
atcacactaacaactttgaggactagactgtgggatatac

SEQ ID NO: 251541 - DNA, 39 bp, Artificial Sequence
  Description of Artificial Sequence: Synthetic oligonucleotide
tcacactaacaactttgaggactagactgtgggatatac

SEQ ID NO: 251542 - DNA, 38 bp, Artificial Sequence
  Description of Artificial Sequence: Synthetic oligonucleotide
cacactaacaactttgaggactagactgtgggatatac

SEQ ID NO: 251543 - DNA, 39 bp, Artificial Sequence
  Description of Artificial Sequence: Synthetic oligonucleotide
acactaacaactttgaggactagactgtgggatatacag

SEQ ID NO: 251544 - DNA, 38 bp, Artificial Sequence
  Description of Artificial Sequence: Synthetic oligonucleotide
cactaacaactttgaggactagactgtgggatatacag

SEQ ID NO: 251545 - DNA, 39 bp, Artificial Sequence
  Description of Artificial Sequence: Synthetic oligonucleotide
actaacaactttgaggactagactgtgggatatacagac

SEQ ID NO: 251546 - DNA, 38 bp, Artificial Sequence
  Description of Artificial Sequence: Synthetic oligonucleotide
ctaacaactttgaggactagactgtgggatatacagac

SEQ ID NO: 251547 - DNA, 38 bp, Artificial Sequence
  Description of Artificial Sequence: Synthetic oligonucleotide
taacaactttgaggactagactgtgggatatacagacc

SEQ ID NO: 251548 - DNA, 37 bp, Artificial Sequence
  Description of Artificial Sequence: Synthetic oligonucleotide
aacaactttgaggactagactgtgggatatacagacc

SEQ ID NO: 251549 - DNA, 36 bp, Artificial Sequence
  Description of Artificial Sequence: Synthetic oligonucleotide
acaactttgaggactagactgtgggatatacagacc

SEQ ID NO: 251550 - DNA, 35 bp, Artificial Sequence
  Description of Artificial Sequence: Synthetic oligonucleotide
caactttgaggactagactgtgggatatacagacc

SEQ ID NO: 251551 - DNA, 42 bp, Artificial Sequence
  Description of Artificial Sequence: Synthetic oligonucleotide
aactttgaggactagactgtgggatatacagaccaaaaaatg

SEQ ID NO: 251552 - DNA, 41 bp, Artificial Sequence
  Description of Artificial Sequence: Synthetic oligonucleotide
actttgaggactagactgtgggatatacagaccaaaaaatg

SEQ ID NO: 251553 - DNA, 40 bp, Artificial Sequence
  Description of Artificial Sequence: Synthetic oligonucleotide
ctttgaggactagactgtgggatatacagaccaaaaaatg

SEQ ID NO: 251554 - DNA, 41 bp, Artificial Sequence
  Description of Artificial Sequence: Synthetic oligonucleotide
tttgaggactagactgtgggatatacagaccaaaaaatgtc

SEQ ID NO: 251555 - DNA, 40 bp, Artificial Sequence
  Description of Artificial Sequence: Synthetic oligonucleotide
ttgaggactagactgtgggatatacagaccaaaaaatgtc

SEQ ID NO: 251556 - DNA, 39 bp, Artificial Sequence
  Description of Artificial Sequence: Synthetic oligonucleotide
tgaggactagactgtgggatatacagaccaaaaaatgtc

SEQ ID NO: 251557 - DNA, 38 bp, Artificial Sequence
  Description of Artificial Sequence: Synthetic oligonucleotide
gaggactagactgtgggatatacagaccaaaaaatgtc

SEQ ID NO: 251558 - DNA, 38 bp, Artificial Sequence
  Description of Artificial Sequence: Synthetic oligonucleotide
aggactagactgtgggatatacagaccaaaaaatgtcc

SEQ ID NO: 251559 - DNA, 37 bp, Artificial Sequence
  Description of Artificial Sequence: Synthetic oligonucleotide
ggactagactgtgggatatacagaccaaaaaatgtcc

SEQ ID NO: 251560 - DNA, 38 bp, Artificial Sequence
  Description of Artificial Sequence: Synthetic oligonucleotide
gactagactgtgggatatacagaccaaaaaatgtccag

SEQ ID NO: 251561 - DNA, 39 bp, Artificial Sequence
  Description of Artificial Sequence: Synthetic oligonucleotide
actagactgtgggatatacagaccaaaaaatgtccagtg

SEQ ID NO: 251562 - DNA, 38 bp, Artificial Sequence
  Description of Artificial Sequence: Synthetic oligonucleotide
ctagactgtgggatatacagaccaaaaaatgtccagtg

SEQ ID NO: 251563 - DNA, 38 bp, Artificial Sequence
  Description of Artificial Sequence: Synthetic oligonucleotide
tagactgtgggatatacagaccaaaaaatgtccagtgg

SEQ ID NO: 251564 - DNA, 37 bp, Artificial Sequence
  Description of Artificial Sequence: Synthetic oligonucleotide
agactgtgggatatacagaccaaaaaatgtccagtgg

SEQ ID NO: 251565 - DNA, 36 bp, Artificial Sequence
  Description of Artificial Sequence: Synthetic oligonucleotide
gactgtgggatatacagaccaaaaaatgtccagtgg

SEQ ID NO: 251566 - DNA, 36 bp, Artificial Sequence
  Description of Artificial Sequence: Synthetic oligonucleotide
actgtgggatatacagaccaaaaaatgtccagtggc

SEQ ID NO: 251567 - DNA, 35 bp, Artificial Sequence
  Description of Artificial Sequence: Synthetic oligonucleotide
ctgtgggatatacagaccaaaaaatgtccagtggc

SEQ ID NO: 251568 - DNA, 46 bp, Artificial Sequence
  Description of Artificial Sequence: Synthetic oligonucleotide
tgtgggatatacagaccaaaaaatgtccagtggcataattaaaaac

SEQ ID NO: 251569 - DNA, 45 bp, Artificial Sequence
  Description of Artificial Sequence: Synthetic oligonucleotide
gtgggatatacagaccaaaaaatgtccagtggcataattaaaaac

SEQ ID NO: 251570 - DNA, 50 bp, Artificial Sequence
  Description of Artificial Sequence: Synthetic oligonucleotide
tgggatatacagaccaaaaaatgtccagtggcataattaaaaactttatc

SEQ ID NO: 251571 - DNA, 49 bp, Artificial Sequence
  Description of Artificial Sequence: Synthetic oligonucleotide
gggatatacagaccaaaaaatgtccagtggcataattaaaaactttatc

SEQ ID NO: 251572 - DNA, 49 bp, Artificial Sequence
  Description of Artificial Sequence: Synthetic oligonucleotide
ggatatacagaccaaaaaatgtccagtggcataattaaaaactttatcc

SEQ ID NO: 251573 - DNA, 50 bp, Artificial Sequence
  Description of Artificial Sequence: Synthetic oligonucleotide
gatatacagaccaaaaaatgtccagtggcataattaaaaactttatccag

SEQ ID NO: 251574 - DNA, 50 bp, Artificial Sequence
  Description of Artificial Sequence: Synthetic oligonucleotide
atatacagaccaaaaaatgtccagtggcataattaaaaactttatccagc

SEQ ID NO: 251575 - DNA, 49 bp, Artificial Sequence
  Description of Artificial Sequence: Synthetic oligonucleotide
tatacagaccaaaaaatgtccagtggcataattaaaaactttatccagc

SEQ ID NO: 251576 - DNA, 48 bp, Artificial Sequence
  Description of Artificial Sequence: Synthetic oligonucleotide
atacagaccaaaaaatgtccagtggcataattaaaaactttatccagc

SEQ ID NO: 251577 - DNA, 47 bp, Artificial Sequence
  Description of Artificial Sequence: Synthetic oligonucleotide
tacagaccaaaaaatgtccagtggcataattaaaaactttatccagc

SEQ ID NO: 251578 - DNA, 46 bp, Artificial Sequence
  Description of Artificial Sequence: Synthetic oligonucleotide
acagaccaaaaaatgtccagtggcataattaaaaactttatccagc

SEQ ID NO: 251579 - DNA, 45 bp, Artificial Sequence
  Description of Artificial Sequence: Synthetic oligonucleotide
cagaccaaaaaatgtccagtggcataattaaaaactttatccagc

SEQ ID NO: 251580 - DNA, 49 bp, Artificial Sequence
  Description of Artificial Sequence: Synthetic oligonucleotide
agaccaaaaaatgtccagtggcataattaaaaactttatccagcaaaac

SEQ ID NO: 251581 - DNA, 48 bp, Artificial Sequence
  Description of Artificial Sequence: Synthetic oligonucleotide
gaccaaaaaatgtccagtggcataattaaaaactttatccagcaaaac

SEQ ID NO: 251582 - DNA, 54 bp, Artificial Sequence
  Description of Artificial Sequence: Synthetic oligonucleotide
accaaaaaatgtccagtggcataattaaaaactttatccagcaaaacatttatg

SEQ ID NO: 251583 - DNA, 53 bp, Artificial Sequence
  Description of Artificial Sequence: Synthetic oligonucleotide
ccaaaaaatgtccagtggcataattaaaaactttatccagcaaaacatttatg

SEQ ID NO: 251584 - DNA, 53 bp, Artificial Sequence
  Description of Artificial Sequence: Synthetic oligonucleotide
caaaaaatgtccagtggcataattaaaaactttatccagcaaaacatttatgg

SEQ ID NO: 251585 - DNA, 56 bp, Artificial Sequence
  Description of Artificial Sequence: Synthetic oligonucleotide
aaaaaatgtccagtggcataattaaaaactttatccagcaaaacatttatggtatc

SEQ ID NO: 251586 - DNA, 55 bp, Artificial Sequence
  Description of Artificial Sequence: Synthetic oligonucleotide
aaaaatgtccagtggcataattaaaaactttatccagcaaaacatttatggtatc

SEQ ID NO: 251587 - DNA, 54 bp, Artificial Sequence
  Description of Artificial Sequence: Synthetic oligonucleotide
aaaatgtccagtggcataattaaaaactttatccagcaaaacatttatggtatc

SEQ ID NO: 251588 - DNA, 53 bp, Artificial Sequence
  Description of Artificial Sequence: Synthetic oligonucleotide
aaatgtccagtggcataattaaaaactttatccagcaaaacatttatggtatc

SEQ ID NO: 251589 - DNA, 52 bp, Artificial Sequence
  Description of Artificial Sequence: Synthetic oligonucleotide
aatgtccagtggcataattaaaaactttatccagcaaaacatttatggtatc

SEQ ID NO: 251590 - DNA, 51 bp, Artificial Sequence
  Description of Artificial Sequence: Synthetic oligonucleotide
atgtccagtggcataattaaaaactttatccagcaaaacatttatggtatc

SEQ ID NO: 251591 - DNA, 50 bp, Artificial Sequence
  Description of Artificial Sequence: Synthetic oligonucleotide
tgtccagtggcataattaaaaactttatccagcaaaacatttatggtatc

SEQ ID NO: 251592 - DNA, 49 bp, Artificial Sequence
  Description of Artificial Sequence: Synthetic oligonucleotide
gtccagtggcataattaaaaactttatccagcaaaacatttatggtatc

SEQ ID NO: 251593 - DNA, 50 bp, Artificial Sequence
  Description of Artificial Sequence: Synthetic oligonucleotide
tccagtggcataattaaaaactttatccagcaaaacatttatggtatctg

SEQ ID NO: 251594 - DNA, 49 bp, Artificial Sequence
  Description of Artificial Sequence: Synthetic oligonucleotide
ccagtggcataattaaaaactttatccagcaaaacatttatggtatctg

SEQ ID NO: 251595 - DNA, 49 bp, Artificial Sequence
  Description of Artificial Sequence: Synthetic oligonucleotide
cagtggcataattaaaaactttatccagcaaaacatttatggtatctgg

SEQ ID NO: 251596 - DNA, 49 bp, Artificial Sequence
  Description of Artificial Sequence: Synthetic oligonucleotide
agtggcataattaaaaactttatccagcaaaacatttatggtatctggc

SEQ ID NO: 251597 - DNA, 48 bp, Artificial Sequence
  Description of Artificial Sequence: Synthetic oligonucleotide
gtggcataattaaaaactttatccagcaaaacatttatggtatctggc

SEQ ID NO: 251598 - DNA, 48 bp, Artificial Sequence
  Description of Artificial Sequence: Synthetic oligonucleotide
tggcataattaaaaactttatccagcaaaacatttatggtatctggcc

SEQ ID NO: 251599 - DNA, 47 bp, Artificial Sequence
  Description of Artificial Sequence: Synthetic oligonucleotide
ggcataattaaaaactttatccagcaaaacatttatggtatctggcc

SEQ ID NO: 251600 - DNA, 48 bp, Artificial Sequence
  Description of Artificial Sequence: Synthetic oligonucleotide
gcataattaaaaactttatccagcaaaacatttatggtatctggcctc

SEQ ID NO: 251601 - DNA, 49 bp, Artificial Sequence
  Description of Artificial Sequence: Synthetic oligonucleotide
cataattaaaaactttatccagcaaaacatttatggtatctggcctcac

SEQ ID NO: 251602 - DNA, 51 bp, Artificial Sequence
  Description of Artificial Sequence: Synthetic oligonucleotide
ataattaaaaactttatccagcaaaacatttatggtatctggcctcacatg

SEQ ID NO: 251603 - DNA, 50 bp, Artificial Sequence
  Description of Artificial Sequence: Synthetic oligonucleotide
taattaaaaactttatccagcaaaacatttatggtatctggcctcacatg

SEQ ID NO: 251604 - DNA, 49 bp, Artificial Sequence
  Description of Artificial Sequence: Synthetic oligonucleotide
aattaaaaactttatccagcaaaacatttatggtatctggcctcacatg

SEQ ID NO: 251605 - DNA, 48 bp, Artificial Sequence
  Description of Artificial Sequence: Synthetic oligonucleotide
attaaaaactttatccagcaaaacatttatggtatctggcctcacatg

SEQ ID NO: 251606 - DNA, 47 bp, Artificial Sequence
  Description of Artificial Sequence: Synthetic oligonucleotide
ttaaaaactttatccagcaaaacatttatggtatctggcctcacatg

SEQ ID NO: 251607 - DNA, 46 bp, Artificial Sequence
  Description of Artificial Sequence: Synthetic oligonucleotide
taaaaactttatccagcaaaacatttatggtatctggcctcacatg

SEQ ID NO: 251608 - DNA, 45 bp, Artificial Sequence
  Description of Artificial Sequence: Synthetic oligonucleotide
aaaaactttatccagcaaaacatttatggtatctggcctcacatg

SEQ ID NO: 251609 - DNA, 44 bp, Artificial Sequence
  Description of Artificial Sequence: Synthetic oligonucleotide
aaaactttatccagcaaaacatttatggtatctggcctcacatg

SEQ ID NO: 251610 - DNA, 43 bp, Artificial Sequence
  Description of Artificial Sequence: Synthetic oligonucleotide
aaactttatccagcaaaacatttatggtatctggcctcacatg

SEQ ID NO: 251611 - DNA, 42 bp, Artificial Sequence
  Description of Artificial Sequence: Synthetic oligonucleotide
aactttatccagcaaaacatttatggtatctggcctcacatg

SEQ ID NO: 251612 - DNA, 41 bp, Artificial Sequence
  Description of Artificial Sequence: Synthetic oligonucleotide
actttatccagcaaaacatttatggtatctggcctcacatg

SEQ ID NO: 251613 - DNA, 40 bp, Artificial Sequence
  Description of Artificial Sequence: Synthetic oligonucleotide
ctttatccagcaaaacatttatggtatctggcctcacatg

SEQ ID NO: 251614 - DNA, 41 bp, Artificial Sequence
  Description of Artificial Sequence: Synthetic oligonucleotide
tttatccagcaaaacatttatggtatctggcctcacatgtc

SEQ ID NO: 251615 - DNA, 40 bp, Artificial Sequence
  Description of Artificial Sequence: Synthetic oligonucleotide
ttatccagcaaaacatttatggtatctggcctcacatgtc

SEQ ID NO: 251616 - DNA, 39 bp, Artificial Sequence
  Description of Artificial Sequence: Synthetic oligonucleotide
tatccagcaaaacatttatggtatctggcctcacatgtc

SEQ ID NO: 251617 - DNA, 38 bp, Artificial Sequence
  Description of Artificial Sequence: Synthetic oligonucleotide
atccagcaaaacatttatggtatctggcctcacatgtc

SEQ ID NO: 251618 - DNA, 37 bp, Artificial Sequence
  Description of Artificial Sequence: Synthetic oligonucleotide
tccagcaaaacatttatggtatctggcctcacatgtc

SEQ ID NO: 251619 - DNA, 36 bp, Artificial Sequence
  Description of Artificial Sequence: Synthetic oligonucleotide
ccagcaaaacatttatggtatctggcctcacatgtc

SEQ ID NO: 251620 - DNA, 37 bp, Artificial Sequence
  Description of Artificial Sequence: Synthetic oligonucleotide
cagcaaaacatttatggtatctggcctcacatgtcag

SEQ ID NO: 251621 - DNA, 39 bp, Artificial Sequence
  Description of Artificial Sequence: Synthetic oligonucleotide
agcaaaacatttatggtatctggcctcacatgtcagaag

SEQ ID NO: 251622 - DNA, 38 bp, Artificial Sequence
  Description of Artificial Sequence: Synthetic oligonucleotide
gcaaaacatttatggtatctggcctcacatgtcagaag

SEQ ID NO: 251623 - DNA, 39 bp, Artificial Sequence
  Description of Artificial Sequence: Synthetic oligonucleotide
caaaacatttatggtatctggcctcacatgtcagaagac

SEQ ID NO: 251624 - DNA, 45 bp, Artificial Sequence
  Description of Artificial Sequence: Synthetic oligonucleotide
aaaacatttatggtatctggcctcacatgtcagaagacattaaag

SEQ ID NO: 251625 - DNA, 44 bp, Artificial Sequence
  Description of Artificial Sequence: Synthetic oligonucleotide
aaacatttatggtatctggcctcacatgtcagaagacattaaag

SEQ ID NO: 251626 - DNA, 43 bp, Artificial Sequence
  Description of Artificial Sequence: Synthetic oligonucleotide
aacatttatggtatctggcctcacatgtcagaagacattaaag

SEQ ID NO: 251627 - DNA, 42 bp, Artificial Sequence
  Description of Artificial Sequence: Synthetic oligonucleotide
acatttatggtatctggcctcacatgtcagaagacattaaag

SEQ ID NO: 251628 - DNA, 41 bp, Artificial Sequence
  Description of Artificial Sequence: Synthetic oligonucleotide
catttatggtatctggcctcacatgtcagaagacattaaag

SEQ ID NO: 251629 - DNA, 45 bp, Artificial Sequence
  Description of Artificial Sequence: Synthetic oligonucleotide
atttatggtatctggcctcacatgtcagaagacattaaagatttc

SEQ ID NO: 251630 - DNA, 44 bp, Artificial Sequence
  Description of Artificial Sequence: Synthetic oligonucleotide
tttatggtatctggcctcacatgtcagaagacattaaagatttc

SEQ ID NO: 251631 - DNA, 43 bp, Artificial Sequence
  Description of Artificial Sequence: Synthetic oligonucleotide
ttatggtatctggcctcacatgtcagaagacattaaagatttc

SEQ ID NO: 251632 - DNA, 42 bp, Artificial Sequence
  Description of Artificial Sequence: Synthetic oligonucleotide
tatggtatctggcctcacatgtcagaagacattaaagatttc

SEQ ID NO: 251633 - DNA, 41 bp, Artificial Sequence
  Description of Artificial Sequence: Synthetic oligonucleotide
atggtatctggcctcacatgtcagaagacattaaagatttc

SEQ ID NO: 251634 - DNA, 40 bp, Artificial Sequence
  Description of Artificial Sequence: Synthetic oligonucleotide
tggtatctggcctcacatgtcagaagacattaaagatttc

SEQ ID NO: 251635 - DNA, 39 bp, Artificial Sequence
  Description of Artificial Sequence: Synthetic oligonucleotide
ggtatctggcctcacatgtcagaagacattaaagatttc

SEQ ID NO: 251636 - DNA, 42 bp, Artificial Sequence
  Description of Artificial Sequence: Synthetic oligonucleotide
gtatctggcctcacatgtcagaagacattaaagatttcatac

SEQ ID NO: 251637 - DNA, 43 bp, Artificial Sequence
  Description of Artificial Sequence: Synthetic oligonucleotide
tatctggcctcacatgtcagaagacattaaagatttcatacag

SEQ ID NO: 251638 - DNA, 42 bp, Artificial Sequence
  Description of Artificial Sequence: Synthetic oligonucleotide
atctggcctcacatgtcagaagacattaaagatttcatacag

SEQ ID NO: 251639 - DNA, 41 bp, Artificial Sequence
  Description of Artificial Sequence: Synthetic oligonucleotide
tctggcctcacatgtcagaagacattaaagatttcatacag

SEQ ID NO: 251640 - DNA, 40 bp, Artificial Sequence
  Description of Artificial Sequence: Synthetic oligonucleotide
ctggcctcacatgtcagaagacattaaagatttcatacag

SEQ ID NO: 251641 - DNA, 40 bp, Artificial Sequence
  Description of Artificial Sequence: Synthetic oligonucleotide
tggcctcacatgtcagaagacattaaagatttcatacagg

SEQ ID NO: 251642 - DNA, 39 bp, Artificial Sequence
  Description of Artificial Sequence: Synthetic oligonucleotide
ggcctcacatgtcagaagacattaaagatttcatacagg

SEQ ID NO: 251643 - DNA, 39 bp, Artificial Sequence
  Description of Artificial Sequence: Synthetic oligonucleotide
gcctcacatgtcagaagacattaaagatttcatacaggg

SEQ ID NO: 251644 - DNA, 39 bp, Artificial Sequence
  Description of Artificial Sequence: Synthetic oligonucleotide
cctcacatgtcagaagacattaaagatttcatacagggc

SEQ ID NO: 251645 - DNA, 41 bp, Artificial Sequence
  Description of Artificial Sequence: Synthetic oligonucleotide
ctcacatgtcagaagacattaaagatttcatacagggctag

SEQ ID NO: 251646 - DNA, 41 bp, Artificial Sequence
  Description of Artificial Sequence: Synthetic oligonucleotide
tcacatgtcagaagacattaaagatttcatacagggctagg

SEQ ID NO: 251647 - DNA, 40 bp, Artificial Sequence
  Description of Artificial Sequence: Synthetic oligonucleotide
cacatgtcagaagacattaaagatttcatacagggctagg

SEQ ID NO: 251648 - DNA, 41 bp, Artificial Sequence
  Description of Artificial Sequence: Synthetic oligonucleotide
acatgtcagaagacattaaagatttcatacagggctaggac

SEQ ID NO: 251649 - DNA, 40 bp, Artificial Sequence
  Description of Artificial Sequence: Synthetic oligonucleotide
catgtcagaagacattaaagatttcatacagggctaggac

SEQ ID NO: 251650 - DNA, 43 bp, Artificial Sequence
  Description of Artificial Sequence: Synthetic oligonucleotide
atgtcagaagacattaaagatttcatacagggctaggacttac

SEQ ID NO: 251651 - DNA, 42 bp, Artificial Sequence
  Description of Artificial Sequence: Synthetic oligonucleotide
tgtcagaagacattaaagatttcatacagggctaggacttac

SEQ ID NO: 251652 - DNA, 41 bp, Artificial Sequence
  Description of Artificial Sequence: Synthetic oligonucleotide
gtcagaagacattaaagatttcatacagggctaggacttac

SEQ ID NO: 251653 - DNA, 46 bp, Artificial Sequence
  Description of Artificial Sequence: Synthetic oligonucleotide
tcagaagacattaaagatttcatacagggctaggacttacatattg

SEQ ID NO: 251654 - DNA, 45 bp, Artificial Sequence
  Description of Artificial Sequence: Synthetic oligonucleotide
cagaagacattaaagatttcatacagggctaggacttacatattg

SEQ ID NO: 251655 - DNA, 45 bp, Artificial Sequence
  Description of Artificial Sequence: Synthetic oligonucleotide
agaagacattaaagatttcatacagggctaggacttacatattgc

SEQ ID NO: 251656 - DNA, 44 bp, Artificial Sequence
  Description of Artificial Sequence: Synthetic oligonucleotide
gaagacattaaagatttcatacagggctaggacttacatattgc

SEQ ID NO: 251657 - DNA, 47 bp, Artificial Sequence
  Description of Artificial Sequence: Synthetic oligonucleotide
aagacattaaagatttcatacagggctaggacttacatattgcttag

SEQ ID NO: 251658 - DNA, 46 bp, Artificial Sequence
  Description of Artificial Sequence: Synthetic oligonucleotide
agacattaaagatttcatacagggctaggacttacatattgcttag

SEQ ID NO: 251659 - DNA, 45 bp, Artificial Sequence
  Description of Artificial Sequence: Synthetic oligonucleotide
gacattaaagatttcatacagggctaggacttacatattgcttag

SEQ ID NO: 251660 - DNA, 48 bp, Artificial Sequence
  Description of Artificial Sequence: Synthetic oligonucleotide
acattaaagatttcatacagggctaggacttacatattgcttagtatg

SEQ ID NO: 251661 - DNA, 47 bp, Artificial Sequence
  Description of Artificial Sequence: Synthetic oligonucleotide
cattaaagatttcatacagggctaggacttacatattgcttagtatg

SEQ ID NO: 251662 - DNA, 49 bp, Artificial Sequence
  Description of Artificial Sequence: Synthetic oligonucleotide
attaaagatttcatacagggctaggacttacatattgcttagtatgatg

SEQ ID NO: 251663 - DNA, 48 bp, Artificial Sequence
  Description of Artificial Sequence: Synthetic oligonucleotide
ttaaagatttcatacagggctaggacttacatattgcttagtatgatg

SEQ ID NO: 251664 - DNA, 47 bp, Artificial Sequence
  Description of Artificial Sequence: Synthetic oligonucleotide
taaagatttcatacagggctaggacttacatattgcttagtatgatg

SEQ ID NO: 251665 - DNA, 46 bp, Artificial Sequence
  Description of Artificial Sequence: Synthetic oligonucleotide
aaagatttcatacagggctaggacttacatattgcttagtatgatg

SEQ ID NO: 251666 - DNA, 45 bp, Artificial Sequence
  Description of Artificial Sequence: Synthetic oligonucleotide
aagatttcatacagggctaggacttacatattgcttagtatgatg

SEQ ID NO: 251667 - DNA, 44 bp, Artificial Sequence
  Description of Artificial Sequence: Synthetic oligonucleotide
agatttcatacagggctaggacttacatattgcttagtatgatg

SEQ ID NO: 251668 - DNA, 43 bp, Artificial Sequence
  Description of Artificial Sequence: Synthetic oligonucleotide
gatttcatacagggctaggacttacatattgcttagtatgatg

SEQ ID NO: 251669 - DNA, 44 bp, Artificial Sequence
  Description of Artificial Sequence: Synthetic oligonucleotide
atttcatacagggctaggacttacatattgcttagtatgatgtg

SEQ ID NO: 251670 - DNA, 43 bp, Artificial Sequence
  Description of Artificial Sequence: Synthetic oligonucleotide
tttcatacagggctaggacttacatattgcttagtatgatgtg

SEQ ID NO: 251671 - DNA, 42 bp, Artificial Sequence
  Description of Artificial Sequence: Synthetic oligonucleotide
ttcatacagggctaggacttacatattgcttagtatgatgtg

SEQ ID NO: 251672 - DNA, 41 bp, Artificial Sequence
  Description of Artificial Sequence: Synthetic oligonucleotide
tcatacagggctaggacttacatattgcttagtatgatgtg

SEQ ID NO: 251673 - DNA, 40 bp, Artificial Sequence
  Description of Artificial Sequence: Synthetic oligonucleotide
catacagggctaggacttacatattgcttagtatgatgtg

SEQ ID NO: 251674 - DNA, 40 bp, Artificial Sequence
  Description of Artificial Sequence: Synthetic oligonucleotide
atacagggctaggacttacatattgcttagtatgatgtgc

SEQ ID NO: 251675 - DNA, 39 bp, Artificial Sequence
  Description of Artificial Sequence: Synthetic oligonucleotide
tacagggctaggacttacatattgcttagtatgatgtgc

SEQ ID NO: 251676 - DNA, 38 bp, Artificial Sequence
  Description of Artificial Sequence: Synthetic oligonucleotide
acagggctaggacttacatattgcttagtatgatgtgc

SEQ ID NO: 251677 - DNA, 37 bp, Artificial Sequence
  Description of Artificial Sequence: Synthetic oligonucleotide
cagggctaggacttacatattgcttagtatgatgtgc

SEQ ID NO: 251678 - DNA, 38 bp, Artificial Sequence
  Description of Artificial Sequence: Synthetic oligonucleotide
agggctaggacttacatattgcttagtatgatgtgcac

SEQ ID NO: 251679 - DNA, 37 bp, Artificial Sequence
  Description of Artificial Sequence: Synthetic oligonucleotide
gggctaggacttacatattgcttagtatgatgtgcac

SEQ ID NO: 251680 - DNA, 40 bp, Artificial Sequence
  Description of Artificial Sequence: Synthetic oligonucleotide
ggctaggacttacatattgcttagtatgatgtgcactatg

SEQ ID NO: 251681 - DNA, 44 bp, Artificial Sequence
  Description of Artificial Sequence: Synthetic oligonucleotide
gctaggacttacatattgcttagtatgatgtgcactatgaaatg

SEQ ID NO: 251682 - DNA, 46 bp, Artificial Sequence
  Description of Artificial Sequence: Synthetic oligonucleotide
ctaggacttacatattgcttagtatgatgtgcactatgaaatgaac

SEQ ID NO: 251683 - DNA, 46 bp, Artificial Sequence
  Description of Artificial Sequence: Synthetic oligonucleotide
taggacttacatattgcttagtatgatgtgcactatgaaatgaacg

SEQ ID NO: 251684 - DNA, 45 bp, Artificial Sequence
  Description of Artificial Sequence: Synthetic oligonucleotide
aggacttacatattgcttagtatgatgtgcactatgaaatgaacg

SEQ ID NO: 251685 - DNA, 44 bp, Artificial Sequence
  Description of Artificial Sequence: Synthetic oligonucleotide
ggacttacatattgcttagtatgatgtgcactatgaaatgaacg

SEQ ID NO: 251686 - DNA, 44 bp, Artificial Sequence
  Description of Artificial Sequence: Synthetic oligonucleotide
gacttacatattgcttagtatgatgtgcactatgaaatgaacgc

SEQ ID NO: 251687 - DNA, 48 bp, Artificial Sequence
  Description of Artificial Sequence: Synthetic oligonucleotide
acttacatattgcttagtatgatgtgcactatgaaatgaacgctaatg

SEQ ID NO: 251688 - DNA, 47 bp, Artificial Sequence
  Description of Artificial Sequence: Synthetic oligonucleotide
cttacatattgcttagtatgatgtgcactatgaaatgaacgctaatg

SEQ ID NO: 251689 - DNA, 47 bp, Artificial Sequence
  Description of Artificial Sequence: Synthetic oligonucleotide
ttacatattgcttagtatgatgtgcactatgaaatgaacgctaatgg

SEQ ID NO: 251690 - DNA, 46 bp, Artificial Sequence
  Description of Artificial Sequence: Synthetic oligonucleotide
tacatattgcttagtatgatgtgcactatgaaatgaacgctaatgg

SEQ ID NO: 251691 - DNA, 45 bp, Artificial Sequence
  Description of Artificial Sequence: Synthetic oligonucleotide
acatattgcttagtatgatgtgcactatgaaatgaacgctaatgg

SEQ ID NO: 251692 - DNA, 44 bp, Artificial Sequence
  Description of Artificial Sequence: Synthetic oligonucleotide
catattgcttagtatgatgtgcactatgaaatgaacgctaatgg

SEQ ID NO: 251693 - DNA, 46 bp, Artificial Sequence
  Description of Artificial Sequence: Synthetic oligonucleotide
atattgcttagtatgatgtgcactatgaaatgaacgctaatggttc

SEQ ID NO: 251694 - DNA, 45 bp, Artificial Sequence
  Description of Artificial Sequence: Synthetic oligonucleotide
tattgcttagtatgatgtgcactatgaaatgaacgctaatggttc

SEQ ID NO: 251695 - DNA, 44 bp, Artificial Sequence
  Description of Artificial Sequence: Synthetic oligonucleotide
attgcttagtatgatgtgcactatgaaatgaacgctaatggttc

SEQ ID NO: 251696 - DNA, 43 bp, Artificial Sequence
  Description of Artificial Sequence: Synthetic oligonucleotide
ttgcttagtatgatgtgcactatgaaatgaacgctaatggttc

SEQ ID NO: 251697 - DNA, 42 bp, Artificial Sequence
  Description of Artificial Sequence: Synthetic oligonucleotide
tgcttagtatgatgtgcactatgaaatgaacgctaatggttc

SEQ ID NO: 251698 - DNA, 41 bp, Artificial Sequence
  Description of Artificial Sequence: Synthetic oligonucleotide
gcttagtatgatgtgcactatgaaatgaacgctaatggttc

SEQ ID NO: 251699 - DNA, 41 bp, Artificial Sequence
  Description of Artificial Sequence: Synthetic oligonucleotide
cttagtatgatgtgcactatgaaatgaacgctaatggttcc

SEQ ID NO: 251700 - DNA, 43 bp, Artificial Sequence
  Description of Artificial Sequence: Synthetic oligonucleotide
ttagtatgatgtgcactatgaaatgaacgctaatggttccaac

SEQ ID NO: 251701 - DNA, 42 bp, Artificial Sequence
  Description of Artificial Sequence: Synthetic oligonucleotide
tagtatgatgtgcactatgaaatgaacgctaatggttccaac

SEQ ID NO: 251702 - DNA, 41 bp, Artificial Sequence
  Description of Artificial Sequence: Synthetic oligonucleotide
agtatgatgtgcactatgaaatgaacgctaatggttccaac

SEQ ID NO: 251703 - DNA, 40 bp, Artificial Sequence
  Description of Artificial Sequence: Synthetic oligonucleotide
gtatgatgtgcactatgaaatgaacgctaatggttccaac

SEQ ID NO: 251704 - DNA, 42 bp, Artificial Sequence
  Description of Artificial Sequence: Synthetic oligonucleotide
tatgatgtgcactatgaaatgaacgctaatggttccaacaac

SEQ ID NO: 251705 - DNA, 41 bp, Artificial Sequence
  Description of Artificial Sequence: Synthetic oligonucleotide
atgatgtgcactatgaaatgaacgctaatggttccaacaac

SEQ ID NO: 251706 - DNA, 40 bp, Artificial Sequence
  Description of Artificial Sequence: Synthetic oligonucleotide
tgatgtgcactatgaaatgaacgctaatggttccaacaac

SEQ ID NO: 251707 - DNA, 39 bp, Artificial Sequence
  Description of Artificial Sequence: Synthetic oligonucleotide
gatgtgcactatgaaatgaacgctaatggttccaacaac

SEQ ID NO: 251708 - DNA, 40 bp, Artificial Sequence
  Description of Artificial Sequence: Synthetic oligonucleotide
atgtgcactatgaaatgaacgctaatggttccaacaactg

SEQ ID NO: 251709 - DNA, 39 bp, Artificial Sequence
  Description of Artificial Sequence: Synthetic oligonucleotide
tgtgcactatgaaatgaacgctaatggttccaacaactg

SEQ ID NO: 251710 - DNA, 38 bp, Artificial Sequence
  Description of Artificial Sequence: Synthetic oligonucleotide
gtgcactatgaaatgaacgctaatggttccaacaactg

SEQ ID NO: 251711 - DNA, 38 bp, Artificial Sequence
  Description of Artificial Sequence: Synthetic oligonucleotide
tgcactatgaaatgaacgctaatggttccaacaactgg

SEQ ID NO: 251712 - DNA, 37 bp, Artificial Sequence
  Description of Artificial Sequence: Synthetic oligonucleotide
gcactatgaaatgaacgctaatggttccaacaactgg

SEQ ID NO: 251713 - DNA, 38 bp, Artificial Sequence
  Description of Artificial Sequence: Synthetic oligonucleotide
cactatgaaatgaacgctaatggttccaacaactggag

SEQ ID NO: 251714 - DNA, 41 bp, Artificial Sequence
  Description of Artificial Sequence: Synthetic oligonucleotide
actatgaaatgaacgctaatggttccaacaactggagaatc

SEQ ID NO: 251715 - DNA, 40 bp, Artificial Sequence
  Description of Artificial Sequence: Synthetic oligonucleotide
ctatgaaatgaacgctaatggttccaacaactggagaatc

SEQ ID NO: 251716 - DNA, 41 bp, Artificial Sequence
  Description of Artificial Sequence: Synthetic oligonucleotide
tatgaaatgaacgctaatggttccaacaactggagaatcag

SEQ ID NO: 251717 - DNA, 40 bp, Artificial Sequence
  Description of Artificial Sequence: Synthetic oligonucleotide
atgaaatgaacgctaatggttccaacaactggagaatcag

SEQ ID NO: 251718 - DNA, 39 bp, Artificial Sequence
  Description of Artificial Sequence: Synthetic oligonucleotide
tgaaatgaacgctaatggttccaacaactggagaatcag

SEQ ID NO: 251719 - DNA, 38 bp, Artificial Sequence
  Description of Artificial Sequence: Synthetic oligonucleotide
gaaatgaacgctaatggttccaacaactggagaatcag

SEQ ID NO: 251720 - DNA, 38 bp, Artificial Sequence
  Description of Artificial Sequence: Synthetic oligonucleotide
aaatgaacgctaatggttccaacaactggagaatcagg

SEQ ID NO: 251721 - DNA, 37 bp, Artificial Sequence
  Description of Artificial Sequence: Synthetic oligonucleotide
aatgaacgctaatggttccaacaactggagaatcagg

SEQ ID NO: 251722 - DNA, 36 bp, Artificial Sequence
  Description of Artificial Sequence: Synthetic oligonucleotide
atgaacgctaatggttccaacaactggagaatcagg

SEQ ID NO: 251723 - DNA, 35 bp, Artificial Sequence
  Description of Artificial Sequence: Synthetic oligonucleotide
tgaacgctaatggttccaacaactggagaatcagg

SEQ ID NO: 251724 - DNA, 34 bp, Artificial Sequence
  Description of Artificial Sequence: Synthetic oligonucleotide
gaacgctaatggttccaacaactggagaatcagg

SEQ ID NO: 251725 - DNA, 34 bp, Artificial Sequence
  Description of Artificial Sequence: Synthetic oligonucleotide
aacgctaatggttccaacaactggagaatcaggg

SEQ ID NO: 251726 - DNA, 33 bp, Artificial Sequence
  Description of Artificial Sequence: Synthetic oligonucleotide
acgctaatggttccaacaactggagaatcaggg

SEQ ID NO: 251727 - DNA, 32 bp, Artificial Sequence
  Description of Artificial Sequence: Synthetic oligonucleotide
cgctaatggttccaacaactggagaatcaggg

SEQ ID NO: 251728 - DNA, 36 bp, Artificial Sequence
  Description of Artificial Sequence: Synthetic oligonucleotide
gctaatggttccaacaactggagaatcagggtaatc

SEQ ID NO: 251729 - DNA, 38 bp, Artificial Sequence
  Description of Artificial Sequence: Synthetic oligonucleotide
ctaatggttccaacaactggagaatcagggtaatcatg

SEQ ID NO: 251730 - DNA, 38 bp, Artificial Sequence
  Description of Artificial Sequence: Synthetic oligonucleotide
taatggttccaacaactggagaatcagggtaatcatgg

SEQ ID NO: 251731 - DNA, 37 bp, Artificial Sequence
  Description of Artificial Sequence: Synthetic oligonucleotide
aatggttccaacaactggagaatcagggtaatcatgg

SEQ ID NO: 251732 - DNA, 36 bp, Artificial Sequence
  Description of Artificial Sequence: Synthetic oligonucleotide
atggttccaacaactggagaatcagggtaatcatgg

SEQ ID NO: 251733 - DNA, 35 bp, Artificial Sequence
  Description of Artificial Sequence: Synthetic oligonucleotide
tggttccaacaactggagaatcagggtaatcatgg

SEQ ID NO: 251734 - DNA, 34 bp, Artificial Sequence
  Description of Artificial Sequence: Synthetic oligonucleotide
ggttccaacaactggagaatcagggtaatcatgg

SEQ ID NO: 251735 - DNA, 35 bp, Artificial Sequence
  Description of Artificial Sequence: Synthetic oligonucleotide
gttccaacaactggagaatcagggtaatcatggtg

SEQ ID NO: 251736 - DNA, 35 bp, Artificial Sequence
  Description of Artificial Sequence: Synthetic oligonucleotide
ttccaacaactggagaatcagggtaatcatggtgg

SEQ ID NO: 251737 - DNA, 34 bp, Artificial Sequence
  Description of Artificial Sequence: Synthetic oligonucleotide
tccaacaactggagaatcagggtaatcatggtgg

SEQ ID NO: 251738 - DNA, 33 bp, Artificial Sequence
  Description of Artificial Sequence: Synthetic oligonucleotide
ccaacaactggagaatcagggtaatcatggtgg

SEQ ID NO: 251739 - DNA, 33 bp, Artificial Sequence
  Description of Artificial Sequence: Synthetic oligonucleotide
caacaactggagaatcagggtaatcatggtggc

SEQ ID NO: 251740 - DNA, 36 bp, Artificial Sequence
  Description of Artificial Sequence: Synthetic oligonucleotide
aacaactggagaatcagggtaatcatggtggcatag

SEQ ID NO: 251741 - DNA, 35 bp, Artificial Sequence
  Description of Artificial Sequence: Synthetic oligonucleotide
acaactggagaatcagggtaatcatggtggcatag

SEQ ID NO: 251742 - DNA, 34 bp, Artificial Sequence
  Description of Artificial Sequence: Synthetic oligonucleotide
caactggagaatcagggtaatcatggtggcatag

SEQ ID NO: 251743 - DNA, 39 bp, Artificial Sequence
  Description of Artificial Sequence: Synthetic oligonucleotide
aactggagaatcagggtaatcatggtggcatagaaattc

SEQ ID NO: 251744 - DNA, 38 bp, Artificial Sequence
  Description of Artificial Sequence: Synthetic oligonucleotide
actggagaatcagggtaatcatggtggcatagaaattc

SEQ ID NO: 251745 - DNA, 37 bp, Artificial Sequence
  Description of Artificial Sequence: Synthetic oligonucleotide
ctggagaatcagggtaatcatggtggcatagaaattc

SEQ ID NO: 251746 - DNA, 37 bp, Artificial Sequence
  Description of Artificial Sequence: Synthetic oligonucleotide
tggagaatcagggtaatcatggtggcatagaaattcc

SEQ ID NO: 251747 - DNA, 36 bp, Artificial Sequence
  Description of Artificial Sequence: Synthetic oligonucleotide
ggagaatcagggtaatcatggtggcatagaaattcc

SEQ ID NO: 251748 - DNA, 37 bp, Artificial Sequence
  Description of Artificial Sequence: Synthetic oligonucleotide
gagaatcagggtaatcatggtggcatagaaattccag

SEQ ID NO: 251749 - DNA, 37 bp, Artificial Sequence
  Description of Artificial Sequence: Synthetic oligonucleotide
agaatcagggtaatcatggtggcatagaaattccagg

SEQ ID NO: 251750 - DNA, 36 bp, Artificial Sequence
  Description of Artificial Sequence: Synthetic oligonucleotide
gaatcagggtaatcatggtggcatagaaattccagg

SEQ ID NO: 251751 - DNA, 38 bp, Artificial Sequence
  Description of Artificial Sequence: Synthetic oligonucleotide
aatcagggtaatcatggtggcatagaaattccaggatg

SEQ ID NO: 251752 - DNA, 37 bp, Artificial Sequence
  Description of Artificial Sequence: Synthetic oligonucleotide
atcagggtaatcatggtggcatagaaattccaggatg

SEQ ID NO: 251753 - DNA, 36 bp, Artificial Sequence
  Description of Artificial Sequence: Synthetic oligonucleotide
tcagggtaatcatggtggcatagaaattccaggatg

SEQ ID NO: 251754 - DNA, 35 bp, Artificial Sequence
  Description of Artificial Sequence: Synthetic oligonucleotide
cagggtaatcatggtggcatagaaattccaggatg

SEQ ID NO: 251755 - DNA, 35 bp, Artificial Sequence
  Description of Artificial Sequence: Synthetic oligonucleotide
agggtaatcatggtggcatagaaattccaggatgc

SEQ ID NO: 251756 - DNA, 34 bp, Artificial Sequence
  Description of Artificial Sequence: Synthetic oligonucleotide
gggtaatcatggtggcatagaaattccaggatgc

SEQ ID NO: 251757 - DNA, 35 bp, Artificial Sequence
  Description of Artificial Sequence: Synthetic oligonucleotide
ggtaatcatggtggcatagaaattccaggatgctg

SEQ ID NO: 251758 - DNA, 35 bp, Artificial Sequence
  Description of Artificial Sequence: Synthetic oligonucleotide
gtaatcatggtggcatagaaattccaggatgctgg

SEQ ID NO: 251759 - DNA, 35 bp, Artificial Sequence
  Description of Artificial Sequence: Synthetic oligonucleotide
taatcatggtggcatagaaattccaggatgctggc

SEQ ID NO: 251760 - DNA, 34 bp, Artificial Sequence
  Description of Artificial Sequence: Synthetic oligonucleotide
aatcatggtggcatagaaattccaggatgctggc

SEQ ID NO: 251761 - DNA, 33 bp, Artificial Sequence
  Description of Artificial Sequence: Synthetic oligonucleotide
atcatggtggcatagaaattccaggatgctggc

SEQ ID NO: 251762 - DNA, 32 bp, Artificial Sequence
  Description of Artificial Sequence: Synthetic oligonucleotide
tcatggtggcatagaaattccaggatgctggc

SEQ ID NO: 251763 - DNA, 31 bp, Artificial Sequence
  Description of Artificial Sequence: Synthetic oligonucleotide
catggtggcatagaaattccaggatgctggc

SEQ ID NO: 251764 - DNA, 31 bp, Artificial Sequence
  Description of Artificial Sequence: Synthetic oligonucleotide
atggtggcatagaaattccaggatgctggcc

SEQ ID NO: 251765 - DNA, 30 bp, Artificial Sequence
  Description of Artificial Sequence: Synthetic oligonucleotide
tggtggcatagaaattccaggatgctggcc

SEQ ID NO: 251766 - DNA, 29 bp, Artificial Sequence
  Description of Artificial Sequence: Synthetic oligonucleotide
ggtggcatagaaattccaggatgctggcc

SEQ ID NO: 251767 - DNA, 30 bp, Artificial Sequence
  Description of Artificial Sequence: Synthetic oligonucleotide
gtggcatagaaattccaggatgctggccac

SEQ ID NO: 251768 - DNA, 33 bp, Artificial Sequence
  Description of Artificial Sequence: Synthetic oligonucleotide
tggcatagaaattccaggatgctggccacaaac

SEQ ID NO: 251769 - DNA, 32 bp, Artificial Sequence
  Description of Artificial Sequence: Synthetic oligonucleotide
ggcatagaaattccaggatgctggccacaaac

SEQ ID NO: 251770 - DNA, 33 bp, Artificial Sequence
  Description of Artificial Sequence: Synthetic oligonucleotide
gcatagaaattccaggatgctggccacaaactc

SEQ ID NO: 251771 - DNA, 35 bp, Artificial Sequence
  Description of Artificial Sequence: Synthetic oligonucleotide
catagaaattccaggatgctggccacaaactctac

SEQ ID NO: 251772 - DNA, 38 bp, Artificial Sequence
  Description of Artificial Sequence: Synthetic oligonucleotide
atagaaattccaggatgctggccacaaactctactttg

SEQ ID NO: 251773 - DNA, 37 bp, Artificial Sequence
  Description of Artificial Sequence: Synthetic oligonucleotide
tagaaattccaggatgctggccacaaactctactttg

SEQ ID NO: 251774 - DNA, 36 bp, Artificial Sequence
  Description of Artificial Sequence: Synthetic oligonucleotide
agaaattccaggatgctggccacaaactctactttg

SEQ ID NO: 251775 - DNA, 35 bp, Artificial Sequence
  Description of Artificial Sequence: Synthetic oligonucleotide
gaaattccaggatgctggccacaaactctactttg

SEQ ID NO: 251776 - DNA, 35 bp, Artificial Sequence
  Description of Artificial Sequence: Synthetic oligonucleotide
aaattccaggatgctggccacaaactctactttgc

SEQ ID NO: 251777 - DNA, 34 bp, Artificial Sequence
  Description of Artificial Sequence: Synthetic oligonucleotide
aattccaggatgctggccacaaactctactttgc

SEQ ID NO: 251778 - DNA, 33 bp, Artificial Sequence
  Description of Artificial Sequence: Synthetic oligonucleotide
attccaggatgctggccacaaactctactttgc

SEQ ID NO: 251779 - DNA, 32 bp, Artificial Sequence
  Description of Artificial Sequence: Synthetic oligonucleotide
ttccaggatgctggccacaaactctactttgc

SEQ ID NO: 251780 - DNA, 31 bp, Artificial Sequence
  Description of Artificial Sequence: Synthetic oligonucleotide
tccaggatgctggccacaaactctactttgc

SEQ ID NO: 251781 - DNA, 30 bp, Artificial Sequence
  Description of Artificial Sequence: Synthetic oligonucleotide
ccaggatgctggccacaaactctactttgc

SEQ ID NO: 251782 - DNA, 31 bp, Artificial Sequence
  Description of Artificial Sequence: Synthetic oligonucleotide
caggatgctggccacaaactctactttgctg

SEQ ID NO: 251783 - DNA, 33 bp, Artificial Sequence
  Description of Artificial Sequence: Synthetic oligonucleotide
aggatgctggccacaaactctactttgctgaag

SEQ ID NO: 251784 - DNA, 32 bp, Artificial Sequence
  Description of Artificial Sequence: Synthetic oligonucleotide
ggatgctggccacaaactctactttgctgaag

SEQ ID NO: 251785 - DNA, 32 bp, Artificial Sequence
  Description of Artificial Sequence: Synthetic oligonucleotide
gatgctggccacaaactctactttgctgaagc

SEQ ID NO: 251786 - DNA, 34 bp, Artificial Sequence
  Description of Artificial Sequence: Synthetic oligonucleotide
atgctggccacaaactctactttgctgaagctag

SEQ ID NO: 251787 - DNA, 33 bp, Artificial Sequence
  Description of Artificial Sequence: Synthetic oligonucleotide
tgctggccacaaactctactttgctgaagctag

SEQ ID NO: 251788 - DNA, 32 bp, Artificial Sequence
  Description of Artificial Sequence: Synthetic oligonucleotide
gctggccacaaactctactttgctgaagctag

SEQ ID NO: 251789 - DNA, 32 bp, Artificial Sequence
  Description of Artificial Sequence: Synthetic oligonucleotide
ctggccacaaactctactttgctgaagctagc

SEQ ID NO: 251790 - DNA, 32 bp, Artificial Sequence
  Description of Artificial Sequence: Synthetic oligonucleotide
tggccacaaactctactttgctgaagctagcc

SEQ ID NO: 251791 - DNA, 31 bp, Artificial Sequence
  Description of Artificial Sequence: Synthetic oligonucleotide
ggccacaaactctactttgctgaagctagcc

SEQ ID NO: 251792 - DNA, 31 bp, Artificial Sequence
  Description of Artificial Sequence: Synthetic oligonucleotide
gccacaaactctactttgctgaagctagccg

SEQ ID NO: 251793 - DNA, 31 bp, Artificial Sequence
  Description of Artificial Sequence: Synthetic oligonucleotide
ccacaaactctactttgctgaagctagccgg

SEQ ID NO: 251794 - DNA, 35 bp, Artificial Sequence
  Description of Artificial Sequence: Synthetic oligonucleotide
cacaaactctactttgctgaagctagccggaaaac

SEQ ID NO: 251795 - DNA, 35 bp, Artificial Sequence
  Description of Artificial Sequence: Synthetic oligonucleotide
acaaactctactttgctgaagctagccggaaaacc

SEQ ID NO: 251796 - DNA, 34 bp, Artificial Sequence
  Description of Artificial Sequence: Synthetic oligonucleotide
caaactctactttgctgaagctagccggaaaacc

SEQ ID NO: 251797 - DNA, 38 bp, Artificial Sequence
  Description of Artificial Sequence: Synthetic oligonucleotide
aaactctactttgctgaagctagccggaaaaccttttg

SEQ ID NO: 251798 - DNA, 37 bp, Artificial Sequence
  Description of Artificial Sequence: Synthetic oligonucleotide
aactctactttgctgaagctagccggaaaaccttttg

SEQ ID NO: 251799 - DNA, 36 bp, Artificial Sequence
  Description of Artificial Sequence: Synthetic oligonucleotide
actctactttgctgaagctagccggaaaaccttttg

SEQ ID NO: 251800 - DNA, 35 bp, Artificial Sequence
  Description of Artificial Sequence: Synthetic oligonucleotide
ctctactttgctgaagctagccggaaaaccttttg

SEQ ID NO: 251801 - DNA, 35 bp, Artificial Sequence
  Description of Artificial Sequence: Synthetic oligonucleotide
tctactttgctgaagctagccggaaaaccttttgc

SEQ ID NO: 251802 - DNA, 34 bp, Artificial Sequence
  Description of Artificial Sequence: Synthetic oligonucleotide
ctactttgctgaagctagccggaaaaccttttgc

SEQ ID NO: 251803 - DNA, 34 bp, Artificial Sequence
  Description of Artificial Sequence: Synthetic oligonucleotide
tactttgctgaagctagccggaaaaccttttgcc

SEQ ID NO: 251804 - DNA, 33 bp, Artificial Sequence
  Description of Artificial Sequence: Synthetic oligonucleotide
actttgctgaagctagccggaaaaccttttgcc

SEQ ID NO: 251805 - DNA, 32 bp, Artificial Sequence
  Description of Artificial Sequence: Synthetic oligonucleotide
ctttgctgaagctagccggaaaaccttttgcc

SEQ ID NO: 251806 - DNA, 34 bp, Artificial Sequence
  Description of Artificial Sequence: Synthetic oligonucleotide
tttgctgaagctagccggaaaaccttttgccatg

SEQ ID NO: 251807 - DNA, 33 bp, Artificial Sequence
  Description of Artificial Sequence: Synthetic oligonucleotide
ttgctgaagctagccggaaaaccttttgccatg

SEQ ID NO: 251808 - DNA, 32 bp, Artificial Sequence
  Description of Artificial Sequence: Synthetic oligonucleotide
tgctgaagctagccggaaaaccttttgccatg

SEQ ID NO: 251809 - DNA, 31 bp, Artificial Sequence
  Description of Artificial Sequence: Synthetic oligonucleotide
gctgaagctagccggaaaaccttttgccatg

SEQ ID NO: 251810 - DNA, 33 bp, Artificial Sequence
  Description of Artificial Sequence: Synthetic oligonucleotide
ctgaagctagccggaaaaccttttgccatgaac

SEQ ID NO: 251811 - DNA, 36 bp, Artificial Sequence
  Description of Artificial Sequence: Synthetic oligonucleotide
tgaagctagccggaaaaccttttgccatgaacattc

SEQ ID NO: 251812 - DNA, 35 bp, Artificial Sequence
  Description of Artificial Sequence: Synthetic oligonucleotide
gaagctagccggaaaaccttttgccatgaacattc

SEQ ID NO: 251813 - DNA, 36 bp, Artificial Sequence
  Description of Artificial Sequence: Synthetic oligonucleotide
aagctagccggaaaaccttttgccatgaacattctg

SEQ ID NO: 251814 - DNA, 35 bp, Artificial Sequence
  Description of Artificial Sequence: Synthetic oligonucleotide
agctagccggaaaaccttttgccatgaacattctg

SEQ ID NO: 251815 - DNA, 34 bp, Artificial Sequence
  Description of Artificial Sequence: Synthetic oligonucleotide
gctagccggaaaaccttttgccatgaacattctg

SEQ ID NO: 251816 - DNA, 39 bp, Artificial Sequence
  Description of Artificial Sequence: Synthetic oligonucleotide
ctagccggaaaaccttttgccatgaacattctgatttag

SEQ ID NO: 251817 - DNA, 39 bp, Artificial Sequence
  Description of Artificial Sequence: Synthetic oligonucleotide
tagccggaaaaccttttgccatgaacattctgatttagg

SEQ ID NO: 251818 - DNA, 38 bp, Artificial Sequence
  Description of Artificial Sequence: Synthetic oligonucleotide
agccggaaaaccttttgccatgaacattctgatttagg

SEQ ID NO: 251819 - DNA, 37 bp, Artificial Sequence
  Description of Artificial Sequence: Synthetic oligonucleotide
gccggaaaaccttttgccatgaacattctgatttagg

SEQ ID NO: 251820 - DNA, 37 bp, Artificial Sequence
  Description of Artificial Sequence: Synthetic oligonucleotide
ccggaaaaccttttgccatgaacattctgatttaggc

SEQ ID NO: 251821 - DNA, 39 bp, Artificial Sequence
  Description of Artificial Sequence: Synthetic oligonucleotide
cggaaaaccttttgccatgaacattctgatttaggcttg

SEQ ID NO: 251822 - DNA, 39 bp, Artificial Sequence
  Description of Artificial Sequence: Synthetic oligonucleotide
ggaaaaccttttgccatgaacattctgatttaggcttgg

SEQ ID NO: 251823 - DNA, 40 bp, Artificial Sequence
  Description of Artificial Sequence: Synthetic oligonucleotide
gaaaaccttttgccatgaacattctgatttaggcttggag

SEQ ID NO: 251824 - DNA, 41 bp, Artificial Sequence
  Description of Artificial Sequence: Synthetic oligonucleotide
aaaaccttttgccatgaacattctgatttaggcttggagtg

SEQ ID NO: 251825 - DNA, 40 bp, Artificial Sequence
  Description of Artificial Sequence: Synthetic oligonucleotide
aaaccttttgccatgaacattctgatttaggcttggagtg

SEQ ID NO: 251826 - DNA, 39 bp, Artificial Sequence
  Description of Artificial Sequence: Synthetic oligonucleotide
aaccttttgccatgaacattctgatttaggcttggagtg

SEQ ID NO: 251827 - DNA, 38 bp, Artificial Sequence
  Description of Artificial Sequence: Synthetic oligonucleotide
accttttgccatgaacattctgatttaggcttggagtg

SEQ ID NO: 251828 - DNA, 37 bp, Artificial Sequence
  Description of Artificial Sequence: Synthetic oligonucleotide
ccttttgccatgaacattctgatttaggcttggagtg

SEQ ID NO: 251829 - DNA, 37 bp, Artificial Sequence
  Description of Artificial Sequence: Synthetic oligonucleotide
cttttgccatgaacattctgatttaggcttggagtgc

SEQ ID NO: 251830 - DNA, 38 bp, Artificial Sequence
  Description of Artificial Sequence: Synthetic oligonucleotide
ttttgccatgaacattctgatttaggcttggagtgcac

SEQ ID NO: 251831 - DNA, 37 bp, Artificial Sequence
  Description of Artificial Sequence: Synthetic oligonucleotide
tttgccatgaacattctgatttaggcttggagtgcac

SEQ ID NO: 251832 - DNA, 36 bp, Artificial Sequence
  Description of Artificial Sequence: Synthetic oligonucleotide
ttgccatgaacattctgatttaggcttggagtgcac

SEQ ID NO: 251833 - DNA, 35 bp, Artificial Sequence
  Description of Artificial Sequence: Synthetic oligonucleotide
tgccatgaacattctgatttaggcttggagtgcac

SEQ ID NO: 251834 - DNA, 34 bp, Artificial Sequence
  Description of Artificial Sequence: Synthetic oligonucleotide
gccatgaacattctgatttaggcttggagtgcac

SEQ ID NO: 251835 - DNA, 35 bp, Artificial Sequence
  Description of Artificial Sequence: Synthetic oligonucleotide
ccatgaacattctgatttaggcttggagtgcactg

SEQ ID NO: 251836 - DNA, 35 bp, Artificial Sequence
  Description of Artificial Sequence: Synthetic oligonucleotide
catgaacattctgatttaggcttggagtgcactgc

SEQ ID NO: 251837 - DNA, 36 bp, Artificial Sequence
  Description of Artificial Sequence: Synthetic oligonucleotide
atgaacattctgatttaggcttggagtgcactgctg

SEQ ID NO: 251838 - DNA, 35 bp, Artificial Sequence
  Description of Artificial Sequence: Synthetic oligonucleotide
tgaacattctgatttaggcttggagtgcactgctg

SEQ ID NO: 251839 - DNA, 34 bp, Artificial Sequence
  Description of Artificial Sequence: Synthetic oligonucleotide
gaacattctgatttaggcttggagtgcactgctg

SEQ ID NO: 251840 - DNA, 34 bp, Artificial Sequence
  Description of Artificial Sequence: Synthetic oligonucleotide
aacattctgatttaggcttggagtgcactgctgc

SEQ ID NO: 251841 - DNA, 33 bp, Artificial Sequence
  Description of Artificial Sequence: Synthetic oligonucleotide
acattctgatttaggcttggagtgcactgctgc

SEQ ID NO: 251842 - DNA, 32 bp, Artificial Sequence
  Description of Artificial Sequence: Synthetic oligonucleotide
cattctgatttaggcttggagtgcactgctgc

SEQ ID NO: 251843 - DNA, 33 bp, Artificial Sequence
  Description of Artificial Sequence: Synthetic oligonucleotide
attctgatttaggcttggagtgcactgctgcag

SEQ ID NO: 251844 - DNA, 32 bp, Artificial Sequence
  Description of Artificial Sequence: Synthetic oligonucleotide
ttctgatttaggcttggagtgcactgctgcag

SEQ ID NO: 251845 - DNA, 31 bp, Artificial Sequence
  Description of Artificial Sequence: Synthetic oligonucleotide
tctgatttaggcttggagtgcactgctgcag

SEQ ID NO: 251846 - DNA, 30 bp, Artificial Sequence
  Description of Artificial Sequence: Synthetic oligonucleotide
ctgatttaggcttggagtgcactgctgcag

SEQ ID NO: 251847 - DNA, 31 bp, Artificial Sequence
  Description of Artificial Sequence: Synthetic oligonucleotide
tgatttaggcttggagtgcactgctgcagag

SEQ ID NO: 251848 - DNA, 30 bp, Artificial Sequence
  Description of Artificial Sequence: Synthetic oligonucleotide
gatttaggcttggagtgcactgctgcagag

SEQ ID NO: 251849 - DNA, 33 bp, Artificial Sequence
  Description of Artificial Sequence: Synthetic oligonucleotide
atttaggcttggagtgcactgctgcagagattc

SEQ ID NO: 251850 - DNA, 32 bp, Artificial Sequence
  Description of Artificial Sequence: Synthetic oligonucleotide
tttaggcttggagtgcactgctgcagagattc

SEQ ID NO: 251851 - DNA, 31 bp, Artificial Sequence
  Description of Artificial Sequence: Synthetic oligonucleotide
ttaggcttggagtgcactgctgcagagattc

SEQ ID NO: 251852 - DNA, 30 bp, Artificial Sequence
  Description of Artificial Sequence: Synthetic oligonucleotide
taggcttggagtgcactgctgcagagattc

SEQ ID NO: 251853 - DNA, 29 bp, Artificial Sequence
  Description of Artificial Sequence: Synthetic oligonucleotide
aggcttggagtgcactgctgcagagattc

SEQ ID NO: 251854 - DNA, 28 bp, Artificial Sequence
  Description of Artificial Sequence: Synthetic oligonucleotide
ggcttggagtgcactgctgcagagattc

SEQ ID NO: 251855 - DNA, 28 bp, Artificial Sequence
  Description of Artificial Sequence: Synthetic oligonucleotide
gcttggagtgcactgctgcagagattcc

SEQ ID NO: 251856 - DNA, 29 bp, Artificial Sequence
  Description of Artificial Sequence: Synthetic oligonucleotide
cttggagtgcactgctgcagagattccag

SEQ ID NO: 251857 - DNA, 31 bp, Artificial Sequence
  Description of Artificial Sequence: Synthetic oligonucleotide
ttggagtgcactgctgcagagattccagttg

SEQ ID NO: 251858 - DNA, 30 bp, Artificial Sequence
  Description of Artificial Sequence: Synthetic oligonucleotide
tggagtgcactgctgcagagattccagttg

SEQ ID NO: 251859 - DNA, 29 bp, Artificial Sequence
  Description of Artificial Sequence: Synthetic oligonucleotide
ggagtgcactgctgcagagattccagttg

SEQ ID NO: 251860 - DNA, 31 bp, Artificial Sequence
  Description of Artificial Sequence: Synthetic oligonucleotide
gagtgcactgctgcagagattccagttgttg

SEQ ID NO: 251861 - DNA, 31 bp, Artificial Sequence
  Description of Artificial Sequence: Synthetic oligonucleotide
agtgcactgctgcagagattccagttgttgc

SEQ ID NO: 251862 - DNA, 30 bp, Artificial Sequence
  Description of Artificial Sequence: Synthetic oligonucleotide
gtgcactgctgcagagattccagttgttgc

SEQ ID NO: 251863 - DNA, 33 bp, Artificial Sequence
  Description of Artificial Sequence: Synthetic oligonucleotide
tgcactgctgcagagattccagttgttgctttc

SEQ ID NO: 251864 - DNA, 32 bp, Artificial Sequence
  Description of Artificial Sequence: Synthetic oligonucleotide
gcactgctgcagagattccagttgttgctttc

SEQ ID NO: 251865 - DNA, 33 bp, Artificial Sequence
  Description of Artificial Sequence: Synthetic oligonucleotide
cactgctgcagagattccagttgttgctttcag

SEQ ID NO: 251866 - DNA, 35 bp, Artificial Sequence
  Description of Artificial Sequence: Synthetic oligonucleotide
actgctgcagagattccagttgttgctttcagaac

SEQ ID NO: 251867 - DNA, 34 bp, Artificial Sequence
  Description of Artificial Sequence: Synthetic oligonucleotide
ctgctgcagagattccagttgttgctttcagaac

SEQ ID NO: 251868 - DNA, 35 bp, Artificial Sequence
  Description of Artificial Sequence: Synthetic oligonucleotide
tgctgcagagattccagttgttgctttcagaactg

SEQ ID NO: 251869 - DNA, 34 bp, Artificial Sequence
  Description of Artificial Sequence: Synthetic oligonucleotide
gctgcagagattccagttgttgctttcagaactg

SEQ ID NO: 251870 - DNA, 34 bp, Artificial Sequence
  Description of Artificial Sequence: Synthetic oligonucleotide
ctgcagagattccagttgttgctttcagaactgg

SEQ ID NO: 251871 - DNA, 38 bp, Artificial Sequence
  Description of Artificial Sequence: Synthetic oligonucleotide
tgcagagattccagttgttgctttcagaactggtaaag

SEQ ID NO: 251872 - DNA, 37 bp, Artificial Sequence
  Description of Artificial Sequence: Synthetic oligonucleotide
gcagagattccagttgttgctttcagaactggtaaag

SEQ ID NO: 251873 - DNA, 37 bp, Artificial Sequence
  Description of Artificial Sequence: Synthetic oligonucleotide
cagagattccagttgttgctttcagaactggtaaagg

SEQ ID NO: 251874 - DNA, 38 bp, Artificial Sequence
  Description of Artificial Sequence: Synthetic oligonucleotide
agagattccagttgttgctttcagaactggtaaaggag

SEQ ID NO: 251875 - DNA, 37 bp, Artificial Sequence
  Description of Artificial Sequence: Synthetic oligonucleotide
gagattccagttgttgctttcagaactggtaaaggag

SEQ ID NO: 251876 - DNA, 38 bp, Artificial Sequence
  Description of Artificial Sequence: Synthetic oligonucleotide
agattccagttgttgctttcagaactggtaaaggagac

SEQ ID NO: 251877 - DNA, 37 bp, Artificial Sequence
  Description of Artificial Sequence: Synthetic oligonucleotide
gattccagttgttgctttcagaactggtaaaggagac

SEQ ID NO: 251878 - DNA, 39 bp, Artificial Sequence
  Description of Artificial Sequence: Synthetic oligonucleotide
attccagttgttgctttcagaactggtaaaggagacaag

SEQ ID NO: 251879 - DNA, 38 bp, Artificial Sequence
  Description of Artificial Sequence: Synthetic oligonucleotide
ttccagttgttgctttcagaactggtaaaggagacaag

SEQ ID NO: 251880 - DNA, 37 bp, Artificial Sequence
  Description of Artificial Sequence: Synthetic oligonucleotide
tccagttgttgctttcagaactggtaaaggagacaag

SEQ ID NO: 251881 - DNA, 36 bp, Artificial Sequence
  Description of Artificial Sequence: Synthetic oligonucleotide
ccagttgttgctttcagaactggtaaaggagacaag

SEQ ID NO: 251882 - DNA, 39 bp, Artificial Sequence
  Description of Artificial Sequence: Synthetic oligonucleotide
cagttgttgctttcagaactggtaaaggagacaagtttg

SEQ ID NO: 251883 - DNA, 40 bp, Artificial Sequence
  Description of Artificial Sequence: Synthetic oligonucleotide
agttgttgctttcagaactggtaaaggagacaagtttgtc

SEQ ID NO: 251884 - DNA, 39 bp, Artificial Sequence
  Description of Artificial Sequence: Synthetic oligonucleotide
gttgttgctttcagaactggtaaaggagacaagtttgtc

SEQ ID NO: 251885 - DNA, 41 bp, Artificial Sequence
  Description of Artificial Sequence: Synthetic oligonucleotide
ttgttgctttcagaactggtaaaggagacaagtttgtcttg

SEQ ID NO: 251886 - DNA, 40 bp, Artificial Sequence
  Description of Artificial Sequence: Synthetic oligonucleotide
tgttgctttcagaactggtaaaggagacaagtttgtcttg

SEQ ID NO: 251887 - DNA, 39 bp, Artificial Sequence
  Description of Artificial Sequence: Synthetic oligonucleotide
gttgctttcagaactggtaaaggagacaagtttgtcttg

SEQ ID NO: 251888 - DNA, 39 bp, Artificial Sequence
  Description of Artificial Sequence: Synthetic oligonucleotide
ttgctttcagaactggtaaaggagacaagtttgtcttgc

SEQ ID NO: 251889 - DNA, 38 bp, Artificial Sequence
  Description of Artificial Sequence: Synthetic oligonucleotide
tgctttcagaactggtaaaggagacaagtttgtcttgc

SEQ ID NO: 251890 - DNA, 37 bp, Artificial Sequence
  Description of Artificial Sequence: Synthetic oligonucleotide
gctttcagaactggtaaaggagacaagtttgtcttgc

SEQ ID NO: 251891 - DNA, 38 bp, Artificial Sequence
  Description of Artificial Sequence: Synthetic oligonucleotide
ctttcagaactggtaaaggagacaagtttgtcttgcag

SEQ ID NO: 251892 - DNA, 38 bp, Artificial Sequence
  Description of Artificial Sequence: Synthetic oligonucleotide
tttcagaactggtaaaggagacaagtttgtcttgcagg

SEQ ID NO: 251893 - DNA, 37 bp, Artificial Sequence
  Description of Artificial Sequence: Synthetic oligonucleotide
ttcagaactggtaaaggagacaagtttgtcttgcagg

SEQ ID NO: 251894 - DNA, 36 bp, Artificial Sequence
  Description of Artificial Sequence: Synthetic oligonucleotide
tcagaactggtaaaggagacaagtttgtcttgcagg

SEQ ID NO: 251895 - DNA, 35 bp, Artificial Sequence
  Description of Artificial Sequence: Synthetic oligonucleotide
cagaactggtaaaggagacaagtttgtcttgcagg

SEQ ID NO: 251896 - DNA, 36 bp, Artificial Sequence
  Description of Artificial Sequence: Synthetic oligonucleotide
agaactggtaaaggagacaagtttgtcttgcaggag

SEQ ID NO: 251897 - DNA, 35 bp, Artificial Sequence
  Description of Artificial Sequence: Synthetic oligonucleotide
gaactggtaaaggagacaagtttgtcttgcaggag

SEQ ID NO: 251898 - DNA, 35 bp, Artificial Sequence
  Description of Artificial Sequence: Synthetic oligonucleotide
aactggtaaaggagacaagtttgtcttgcaggagg

SEQ ID NO: 251899 - DNA, 34 bp, Artificial Sequence
  Description of Artificial Sequence: Synthetic oligonucleotide
actggtaaaggagacaagtttgtcttgcaggagg

SEQ ID NO: 251900 - DNA, 33 bp, Artificial Sequence
  Description of Artificial Sequence: Synthetic oligonucleotide
ctggtaaaggagacaagtttgtcttgcaggagg

SEQ ID NO: 251901 - DNA, 34 bp, Artificial Sequence
  Description of Artificial Sequence: Synthetic oligonucleotide
tggtaaaggagacaagtttgtcttgcaggaggtg

SEQ ID NO: 251902 - DNA, 33 bp, Artificial Sequence
  Description of Artificial Sequence: Synthetic oligonucleotide
ggtaaaggagacaagtttgtcttgcaggaggtg

SEQ ID NO: 251903 - DNA, 35 bp, Artificial Sequence
  Description of Artificial Sequence: Synthetic oligonucleotide
gtaaaggagacaagtttgtcttgcaggaggtgttc

SEQ ID NO: 251904 - DNA, 36 bp, Artificial Sequence
  Description of Artificial Sequence: Synthetic oligonucleotide
taaaggagacaagtttgtcttgcaggaggtgttctc

SEQ ID NO: 251905 - DNA, 35 bp, Artificial Sequence
  Description of Artificial Sequence: Synthetic oligonucleotide
aaaggagacaagtttgtcttgcaggaggtgttctc

SEQ ID NO: 251906 - DNA, 34 bp, Artificial Sequence
  Description of Artificial Sequence: Synthetic oligonucleotide
aaggagacaagtttgtcttgcaggaggtgttctc

SEQ ID NO: 251907 - DNA, 33 bp, Artificial Sequence
  Description of Artificial Sequence: Synthetic oligonucleotide
aggagacaagtttgtcttgcaggaggtgttctc

SEQ ID NO: 251908 - DNA, 32 bp, Artificial Sequence
  Description of Artificial Sequence: Synthetic oligonucleotide
ggagacaagtttgtcttgcaggaggtgttctc

SEQ ID NO: 251909 - DNA, 32 bp, Artificial Sequence
  Description of Artificial Sequence: Synthetic oligonucleotide
gagacaagtttgtcttgcaggaggtgttctcg

SEQ ID NO: 251910 - DNA, 32 bp, Artificial Sequence
  Description of Artificial Sequence: Synthetic oligonucleotide
agacaagtttgtcttgcaggaggtgttctcgc

SEQ ID NO: 251911 - DNA, 31 bp, Artificial Sequence
  Description of Artificial Sequence: Synthetic oligonucleotide
gacaagtttgtcttgcaggaggtgttctcgc

SEQ ID NO: 251912 - DNA, 31 bp, Artificial Sequence
  Description of Artificial Sequence: Synthetic oligonucleotide
acaagtttgtcttgcaggaggtgttctcgcg

SEQ ID NO: 251913 - DNA, 30 bp, Artificial Sequence
  Description of Artificial Sequence: Synthetic oligonucleotide
caagtttgtcttgcaggaggtgttctcgcg

SEQ ID NO: 251914 - DNA, 31 bp, Artificial Sequence
  Description of Artificial Sequence: Synthetic oligonucleotide
aagtttgtcttgcaggaggtgttctcgcgag

SEQ ID NO: 251915 - DNA, 30 bp, Artificial Sequence
  Description of Artificial Sequence: Synthetic oligonucleotide
agtttgtcttgcaggaggtgttctcgcgag

SEQ ID NO: 251916 - DNA, 29 bp, Artificial Sequence
  Description of Artificial Sequence: Synthetic oligonucleotide
gtttgtcttgcaggaggtgttctcgcgag

SEQ ID NO: 251917 - DNA, 31 bp, Artificial Sequence
  Description of Artificial Sequence: Synthetic oligonucleotide
tttgtcttgcaggaggtgttctcgcgagatg

SEQ ID NO: 251918 - DNA, 30 bp, Artificial Sequence
  Description of Artificial Sequence: Synthetic oligonucleotide
ttgtcttgcaggaggtgttctcgcgagatg

SEQ ID NO: 251919 - DNA, 29 bp, Artificial Sequence
  Description of Artificial Sequence: Synthetic oligonucleotide
tgtcttgcaggaggtgttctcgcgagatg

SEQ ID NO: 251920 - DNA, 28 bp, Artificial Sequence
  Description of Artificial Sequence: Synthetic oligonucleotide
gtcttgcaggaggtgttctcgcgagatg

SEQ ID NO: 251921 - DNA, 28 bp, Artificial Sequence
  Description of Artificial Sequence: Synthetic oligonucleotide
tcttgcaggaggtgttctcgcgagatgg

SEQ ID NO: 251922 - DNA, 27 bp, Artificial Sequence
  Description of Artificial Sequence: Synthetic oligonucleotide
cttgcaggaggtgttctcgcgagatgg

SEQ ID NO: 251923 - DNA, 27 bp, Artificial Sequence
  Description of Artificial Sequence: Synthetic oligonucleotide
ttgcaggaggtgttctcgcgagatggg

SEQ ID NO: 251924 - DNA, 27 bp, Artificial Sequence
  Description of Artificial Sequence: Synthetic oligonucleotide
tgcaggaggtgttctcgcgagatggga

SEQ ID NO: 251925 - DNA, 27 bp, Artificial Sequence
  Description of Artificial Sequence: Synthetic oligonucleotide
gcaggaggtgttctcgcgagatgggaa

SEQ ID NO: 251926 - DNA, 27 bp, Artificial Sequence
  Description of Artificial Sequence: Synthetic oligonucleotide
caggaggtgttctcgcgagatgggaag

SEQ ID NO: 251927 - DNA, 27 bp, Artificial Sequence
  Description of Artificial Sequence: Synthetic oligonucleotide
aggaggtgttctcgcgagatgggaagc

SEQ ID NO: 251928 - DNA, 26 bp, Artificial Sequence
  Description of Artificial Sequence: Synthetic oligonucleotide
ggaggtgttctcgcgagatgggaagc

SEQ ID NO: 251929 - DNA, 27 bp, Artificial Sequence
  Description of Artificial Sequence: Synthetic oligonucleotide
gaggtgttctcgcgagatgggaagcct

SEQ ID NO: 251930 - DNA, 27 bp, Artificial Sequence
  Description of Artificial Sequence: Synthetic oligonucleotide
aggtgttctcgcgagatgggaagcctc

SEQ ID NO: 251931 - DNA, 27 bp, Artificial Sequence
  Description of Artificial Sequence: Synthetic oligonucleotide
ggtgttctcgcgagatgggaagcctct

SEQ ID NO: 251932 - DNA, 27 bp, Artificial Sequence
  Description of Artificial Sequence: Synthetic oligonucleotide
gtgttctcgcgagatgggaagcctctg

SEQ ID NO: 251933 - DNA, 27 bp, Artificial Sequence
  Description of Artificial Sequence: Synthetic oligonucleotide
tgttctcgcgagatgggaagcctctgg

SEQ ID NO: 251934 - DNA, 27 bp, Artificial Sequence
  Description of Artificial Sequence: Synthetic oligonucleotide
gttctcgcgagatgggaagcctctgga

SEQ ID NO: 251935 - DNA, 27 bp, Artificial Sequence
  Description of Artificial Sequence: Synthetic oligonucleotide
ttctcgcgagatgggaagcctctggag

SEQ ID NO: 251936 - DNA, 27 bp, Artificial Sequence
  Description of Artificial Sequence: Synthetic oligonucleotide
tctcgcgagatgggaagcctctggaga

SEQ ID NO: 251937 - DNA, 26 bp, Artificial Sequence
  Description of Artificial Sequence: Synthetic oligonucleotide
ctcgcgagatgggaagcctctggaga

SEQ ID NO: 251938 - DNA, 26 bp, Artificial Sequence
  Description of Artificial Sequence: Synthetic oligonucleotide
tcgcgagatgggaagcctctggagac

SEQ ID NO: 251939 - DNA, 25 bp, Artificial Sequence
  Description of Artificial Sequence: Synthetic oligonucleotide
cgcgagatgggaagcctctggagac

SEQ ID NO: 251940 - DNA, 27 bp, Artificial Sequence
  Description of Artificial Sequence: Synthetic oligonucleotide
gcgagatgggaagcctctggagacgtt

SEQ ID NO: 251941 - DNA, 27 bp, Artificial Sequence
  Description of Artificial Sequence: Synthetic oligonucleotide
cgagatgggaagcctctggagacgttc

SEQ ID NO: 251942 - DNA, 27 bp, Artificial Sequence
  Description of Artificial Sequence: Synthetic oligonucleotide
gagatgggaagcctctggagacgttcc

SEQ ID NO: 251943 - DNA, 28 bp, Artificial Sequence
  Description of Artificial Sequence: Synthetic oligonucleotide
agatgggaagcctctggagacgttcctg

SEQ ID NO: 251944 - DNA, 27 bp, Artificial Sequence
  Description of Artificial Sequence: Synthetic oligonucleotide
gatgggaagcctctggagacgttcctg

SEQ ID NO: 251945 - DNA, 27 bp, Artificial Sequence
  Description of Artificial Sequence: Synthetic oligonucleotide
atgggaagcctctggagacgttcctgc

SEQ ID NO: 251946 - DNA, 27 bp, Artificial Sequence
  Description of Artificial Sequence: Synthetic oligonucleotide
tgggaagcctctggagacgttcctgca

SEQ ID NO: 251947 - DNA, 26 bp, Artificial Sequence
  Description of Artificial Sequence: Synthetic oligonucleotide
gggaagcctctggagacgttcctgca

SEQ ID NO: 251948 - DNA, 26 bp, Artificial Sequence
  Description of Artificial Sequence: Synthetic oligonucleotide
ggaagcctctggagacgttcctgcac

SEQ ID NO: 251949 - DNA, 27 bp, Artificial Sequence
  Description of Artificial Sequence: Synthetic oligonucleotide
gaagcctctggagacgttcctgcacga

SEQ ID NO: 251950 - DNA, 30 bp, Artificial Sequence
  Description of Artificial Sequence: Synthetic oligonucleotide
aagcctctggagacgttcctgcacgattac

SEQ ID NO: 251951 - DNA, 29 bp, Artificial Sequence
  Description of Artificial Sequence: Synthetic oligonucleotide
agcctctggagacgttcctgcacgattac

SEQ ID NO: 251952 - DNA, 28 bp, Artificial Sequence
  Description of Artificial Sequence: Synthetic oligonucleotide
gcctctggagacgttcctgcacgattac

SEQ ID NO: 251953 - DNA, 31 bp, Artificial Sequence
  Description of Artificial Sequence: Synthetic oligonucleotide
cctctggagacgttcctgcacgattactttc

SEQ ID NO: 251954 - DNA, 33 bp, Artificial Sequence
  Description of Artificial Sequence: Synthetic oligonucleotide
ctctggagacgttcctgcacgattactttcatg

SEQ ID NO: 251955 - DNA, 33 bp, Artificial Sequence
  Description of Artificial Sequence: Synthetic oligonucleotide
tctggagacgttcctgcacgattactttcatgg

SEQ ID NO: 251956 - DNA, 32 bp, Artificial Sequence
  Description of Artificial Sequence: Synthetic oligonucleotide
ctggagacgttcctgcacgattactttcatgg

SEQ ID NO: 251957 - DNA, 32 bp, Artificial Sequence
  Description of Artificial Sequence: Synthetic oligonucleotide
tggagacgttcctgcacgattactttcatggc

SEQ ID NO: 251958 - DNA, 31 bp, Artificial Sequence
  Description of Artificial Sequence: Synthetic oligonucleotide
ggagacgttcctgcacgattactttcatggc

SEQ ID NO: 251959 - DNA, 34 bp, Artificial Sequence
  Description of Artificial Sequence: Synthetic oligonucleotide
gagacgttcctgcacgattactttcatggcaatc

SEQ ID NO: 251960 - DNA, 35 bp, Artificial Sequence
  Description of Artificial Sequence: Synthetic oligonucleotide
agacgttcctgcacgattactttcatggcaatcag

SEQ ID NO: 251961 - DNA, 34 bp, Artificial Sequence
  Description of Artificial Sequence: Synthetic oligonucleotide
gacgttcctgcacgattactttcatggcaatcag

SEQ ID NO: 251962 - DNA, 36 bp, Artificial Sequence
  Description of Artificial Sequence: Synthetic oligonucleotide
acgttcctgcacgattactttcatggcaatcagaag

SEQ ID NO: 251963 - DNA, 35 bp, Artificial Sequence
  Description of Artificial Sequence: Synthetic oligonucleotide
cgttcctgcacgattactttcatggcaatcagaag

SEQ ID NO: 251964 - DNA, 36 bp, Artificial Sequence
  Description of Artificial Sequence: Synthetic oligonucleotide
gttcctgcacgattactttcatggcaatcagaagag

SEQ ID NO: 251965 - DNA, 39 bp, Artificial Sequence
  Description of Artificial Sequence: Synthetic oligonucleotide
ttcctgcacgattactttcatggcaatcagaagagatag

SEQ ID NO: 251966 - DNA, 38 bp, Artificial Sequence
  Description of Artificial Sequence: Synthetic oligonucleotide
tcctgcacgattactttcatggcaatcagaagagatag

SEQ ID NO: 251967 - DNA, 37 bp, Artificial Sequence
  Description of Artificial Sequence: Synthetic oligonucleotide
cctgcacgattactttcatggcaatcagaagagatag

SEQ ID NO: 251968 - DNA, 37 bp, Artificial Sequence
  Description of Artificial Sequence: Synthetic oligonucleotide
ctgcacgattactttcatggcaatcagaagagatagc

SEQ ID NO: 251969 - DNA, 38 bp, Artificial Sequence
  Description of Artificial Sequence: Synthetic oligonucleotide
tgcacgattactttcatggcaatcagaagagatagctg

SEQ ID NO: 251970 - DNA, 37 bp, Artificial Sequence
  Description of Artificial Sequence: Synthetic oligonucleotide
gcacgattactttcatggcaatcagaagagatagctg

SEQ ID NO: 251971 - DNA, 39 bp, Artificial Sequence
  Description of Artificial Sequence: Synthetic oligonucleotide
cacgattactttcatggcaatcagaagagatagctgaag

SEQ ID NO: 251972 - DNA, 40 bp, Artificial Sequence
  Description of Artificial Sequence: Synthetic oligonucleotide
acgattactttcatggcaatcagaagagatagctgaagtc

SEQ ID NO: 251973 - DNA, 39 bp, Artificial Sequence
  Description of Artificial Sequence: Synthetic oligonucleotide
cgattactttcatggcaatcagaagagatagctgaagtc

SEQ ID NO: 251974 - DNA, 40 bp, Artificial Sequence
  Description of Artificial Sequence: Synthetic oligonucleotide
gattactttcatggcaatcagaagagatagctgaagtctc

SEQ ID NO: 251975 - DNA, 42 bp, Artificial Sequence
  Description of Artificial Sequence: Synthetic oligonucleotide
attactttcatggcaatcagaagagatagctgaagtctcaac

SEQ ID NO: 251976 - DNA, 41 bp, Artificial Sequence
  Description of Artificial Sequence: Synthetic oligonucleotide
ttactttcatggcaatcagaagagatagctgaagtctcaac

SEQ ID NO: 251977 - DNA, 40 bp, Artificial Sequence
  Description of Artificial Sequence: Synthetic oligonucleotide
tactttcatggcaatcagaagagatagctgaagtctcaac

SEQ ID NO: 251978 - DNA, 39 bp, Artificial Sequence
  Description of Artificial Sequence: Synthetic oligonucleotide
actttcatggcaatcagaagagatagctgaagtctcaac

SEQ ID NO: 251979 - DNA, 38 bp, Artificial Sequence
  Description of Artificial Sequence: Synthetic oligonucleotide
ctttcatggcaatcagaagagatagctgaagtctcaac

SEQ ID NO: 251980 - DNA, 38 bp, Artificial Sequence
  Description of Artificial Sequence: Synthetic oligonucleotide
tttcatggcaatcagaagagatagctgaagtctcaacc

SEQ ID NO: 251981 - DNA, 37 bp, Artificial Sequence
  Description of Artificial Sequence: Synthetic oligonucleotide
ttcatggcaatcagaagagatagctgaagtctcaacc

SEQ ID NO: 251982 - DNA, 36 bp, Artificial Sequence
  Description of Artificial Sequence: Synthetic oligonucleotide
tcatggcaatcagaagagatagctgaagtctcaacc

SEQ ID NO: 251983 - DNA, 35 bp, Artificial Sequence
  Description of Artificial Sequence: Synthetic oligonucleotide
catggcaatcagaagagatagctgaagtctcaacc

SEQ ID NO: 251984 - DNA, 38 bp, Artificial Sequence
  Description of Artificial Sequence: Synthetic oligonucleotide
atggcaatcagaagagatagctgaagtctcaacctatc

SEQ ID NO: 251985 - DNA, 37 bp, Artificial Sequence
  Description of Artificial Sequence: Synthetic oligonucleotide
tggcaatcagaagagatagctgaagtctcaacctatc

SEQ ID NO: 251986 - DNA, 36 bp, Artificial Sequence
  Description of Artificial Sequence: Synthetic oligonucleotide
ggcaatcagaagagatagctgaagtctcaacctatc

SEQ ID NO: 251987 - DNA, 36 bp, Artificial Sequence
  Description of Artificial Sequence: Synthetic oligonucleotide
gcaatcagaagagatagctgaagtctcaacctatcc

SEQ ID NO: 251988 - DNA, 36 bp, Artificial Sequence
  Description of Artificial Sequence: Synthetic oligonucleotide
caatcagaagagatagctgaagtctcaacctatccg

SEQ ID NO: 251989 - DNA, 37 bp, Artificial Sequence
  Description of Artificial Sequence: Synthetic oligonucleotide
aatcagaagagatagctgaagtctcaacctatccgag

SEQ ID NO: 251990 - DNA, 36 bp, Artificial Sequence
  Description of Artificial Sequence: Synthetic oligonucleotide
atcagaagagatagctgaagtctcaacctatccgag

SEQ ID NO: 251991 - DNA, 35 bp, Artificial Sequence
  Description of Artificial Sequence: Synthetic oligonucleotide
tcagaagagatagctgaagtctcaacctatccgag

SEQ ID NO: 251992 - DNA, 34 bp, Artificial Sequence
  Description of Artificial Sequence: Synthetic oligonucleotide
cagaagagatagctgaagtctcaacctatccgag

SEQ ID NO: 251993 - DNA, 35 bp, Artificial Sequence
  Description of Artificial Sequence: Synthetic oligonucleotide
agaagagatagctgaagtctcaacctatccgagag

SEQ ID NO: 251994 - DNA, 34 bp, Artificial Sequence
  Description of Artificial Sequence: Synthetic oligonucleotide
gaagagatagctgaagtctcaacctatccgagag

SEQ ID NO: 251995 - DNA, 35 bp, Artificial Sequence
  Description of Artificial Sequence: Synthetic oligonucleotide
aagagatagctgaagtctcaacctatccgagagag

SEQ ID NO: 251996 - DNA, 34 bp, Artificial Sequence
  Description of Artificial Sequence: Synthetic oligonucleotide
agagatagctgaagtctcaacctatccgagagag

SEQ ID NO: 251997 - DNA, 33 bp, Artificial Sequence
  Description of Artificial Sequence: Synthetic oligonucleotide
gagatagctgaagtctcaacctatccgagagag

SEQ ID NO: 251998 - DNA, 33 bp, Artificial Sequence
  Description of Artificial Sequence: Synthetic oligonucleotide
agatagctgaagtctcaacctatccgagagagc

SEQ ID NO: 251999 - DNA, 32 bp, Artificial Sequence
  Description of Artificial Sequence: Synthetic oligonucleotide
gatagctgaagtctcaacctatccgagagagc

SEQ ID NO: 252000 - DNA, 35 bp, Artificial Sequence
  Description of Artificial Sequence: Synthetic oligonucleotide
atagctgaagtctcaacctatccgagagagcaaag

SEQ ID NO: 252001 - DNA, 34 bp, Artificial Sequence
  Description of Artificial Sequence: Synthetic oligonucleotide
tagctgaagtctcaacctatccgagagagcaaag

SEQ ID NO: 252002 - DNA, 33 bp, Artificial Sequence
  Description of Artificial Sequence: Synthetic oligonucleotide
agctgaagtctcaacctatccgagagagcaaag

SEQ ID NO: 252003 - DNA, 32 bp, Artificial Sequence
  Description of Artificial Sequence: Synthetic oligonucleotide
gctgaagtctcaacctatccgagagagcaaag

SEQ ID NO: 252004 - DNA, 34 bp, Artificial Sequence
  Description of Artificial Sequence: Synthetic oligonucleotide
ctgaagtctcaacctatccgagagagcaaagatg

SEQ ID NO: 252005 - DNA, 34 bp, Artificial Sequence
  Description of Artificial Sequence: Synthetic oligonucleotide
tgaagtctcaacctatccgagagagcaaagatgg

SEQ ID NO: 252006 - DNA, 33 bp, Artificial Sequence
  Description of Artificial Sequence: Synthetic oligonucleotide
gaagtctcaacctatccgagagagcaaagatgg

SEQ ID NO: 252007 - DNA, 33 bp, Artificial Sequence
  Description of Artificial Sequence: Synthetic oligonucleotide
aagtctcaacctatccgagagagcaaagatggg

SEQ ID NO: 252008 - DNA, 32 bp, Artificial Sequence
  Description of Artificial Sequence: Synthetic oligonucleotide
agtctcaacctatccgagagagcaaagatggg

SEQ ID NO: 252009 - DNA, 31 bp, Artificial Sequence
  Description of Artificial Sequence: Synthetic oligonucleotide
gtctcaacctatccgagagagcaaagatggg

SEQ ID NO: 252010 - DNA, 31 bp, Artificial Sequence
  Description of Artificial Sequence: Synthetic oligonucleotide
tctcaacctatccgagagagcaaagatgggc

SEQ ID NO: 252011 - DNA, 30 bp, Artificial Sequence
  Description of Artificial Sequence: Synthetic oligonucleotide
ctcaacctatccgagagagcaaagatgggc

SEQ ID NO: 252012 - DNA, 30 bp, Artificial Sequence
  Description of Artificial Sequence: Synthetic oligonucleotide
tcaacctatccgagagagcaaagatgggcc

SEQ ID NO: 252013 - DNA, 29 bp, Artificial Sequence
  Description of Artificial Sequence: Synthetic oligonucleotide
caacctatccgagagagcaaagatgggcc

SEQ ID NO: 252014 - DNA, 30 bp, Artificial Sequence
  Description of Artificial Sequence: Synthetic oligonucleotide
aacctatccgagagagcaaagatgggcctc

SEQ ID NO: 252015 - DNA, 29 bp, Artificial Sequence
  Description of Artificial Sequence: Synthetic oligonucleotide
acctatccgagagagcaaagatgggcctc

SEQ ID NO: 252016 - DNA, 28 bp, Artificial Sequence
  Description of Artificial Sequence: Synthetic oligonucleotide
cctatccgagagagcaaagatgggcctc

SEQ ID NO: 252017 - DNA, 29 bp, Artificial Sequence
  Description of Artificial Sequence: Synthetic oligonucleotide
ctatccgagagagcaaagatgggcctctg

SEQ ID NO: 252018 - DNA, 31 bp, Artificial Sequence
  Description of Artificial Sequence: Synthetic oligonucleotide
tatccgagagagcaaagatgggcctctgaag

SEQ ID NO: 252019 - DNA, 30 bp, Artificial Sequence
  Description of Artificial Sequence: Synthetic oligonucleotide
atccgagagagcaaagatgggcctctgaag

SEQ ID NO: 252020 - DNA, 29 bp, Artificial Sequence
  Description of Artificial Sequence: Synthetic oligonucleotide
tccgagagagcaaagatgggcctctgaag

SEQ ID NO: 252021 - DNA, 28 bp, Artificial Sequence
  Description of Artificial Sequence: Synthetic oligonucleotide
ccgagagagcaaagatgggcctctgaag

SEQ ID NO: 252022 - DNA, 28 bp, Artificial Sequence
  Description of Artificial Sequence: Synthetic oligonucleotide
cgagagagcaaagatgggcctctgaagg

SEQ ID NO: 252023 - DNA, 30 bp, Artificial Sequence
  Description of Artificial Sequence: Synthetic oligonucleotide
gagagagcaaagatgggcctctgaaggtag

SEQ ID NO: 252024 - DNA, 31 bp, Artificial Sequence
  Description of Artificial Sequence: Synthetic oligonucleotide
agagagcaaagatgggcctctgaaggtagag

SEQ ID NO: 252025 - DNA, 30 bp, Artificial Sequence
  Description of Artificial Sequence: Synthetic oligonucleotide
gagagcaaagatgggcctctgaaggtagag

SEQ ID NO: 252026 - DNA, 30 bp, Artificial Sequence
  Description of Artificial Sequence: Synthetic oligonucleotide
agagcaaagatgggcctctgaaggtagagg

SEQ ID NO: 252027 - DNA, 29 bp, Artificial Sequence
  Description of Artificial Sequence: Synthetic oligonucleotide
gagcaaagatgggcctctgaaggtagagg

SEQ ID NO: 252028 - DNA, 31 bp, Artificial Sequence
  Description of Artificial Sequence: Synthetic oligonucleotide
agcaaagatgggcctctgaaggtagaggtag

SEQ ID NO: 252029 - DNA, 30 bp, Artificial Sequence
  Description of Artificial Sequence: Synthetic oligonucleotide
gcaaagatgggcctctgaaggtagaggtag

SEQ ID NO: 252030 - DNA, 30 bp, Artificial Sequence
  Description of Artificial Sequence: Synthetic oligonucleotide
caaagatgggcctctgaaggtagaggtagc

SEQ ID NO: 252031 - DNA, 31 bp, Artificial Sequence
  Description of Artificial Sequence: Synthetic oligonucleotide
aaagatgggcctctgaaggtagaggtagcag

SEQ ID NO: 252032 - DNA, 30 bp, Artificial Sequence
  Description of Artificial Sequence: Synthetic oligonucleotide
aagatgggcctctgaaggtagaggtagcag

SEQ ID NO: 252033 - DNA, 29 bp, Artificial Sequence
  Description of Artificial Sequence: Synthetic oligonucleotide
agatgggcctctgaaggtagaggtagcag

SEQ ID NO: 252034 - DNA, 28 bp, Artificial Sequence
  Description of Artificial Sequence: Synthetic oligonucleotide
gatgggcctctgaaggtagaggtagcag

SEQ ID NO: 252035 - DNA, 29 bp, Artificial Sequence
  Description of Artificial Sequence: Synthetic oligonucleotide
atgggcctctgaaggtagaggtagcagac

SEQ ID NO: 252036 - DNA, 28 bp, Artificial Sequence
  Description of Artificial Sequence: Synthetic oligonucleotide
tgggcctctgaaggtagaggtagcagac

SEQ ID NO: 252037 - DNA, 27 bp, Artificial Sequence
  Description of Artificial Sequence: Synthetic oligonucleotide
gggcctctgaaggtagaggtagcagac

SEQ ID NO: 252038 - DNA, 33 bp, Artificial Sequence
  Description of Artificial Sequence: Synthetic oligonucleotide
ggcctctgaaggtagaggtagcagacaattttg

SEQ ID NO: 252039 - DNA, 35 bp, Artificial Sequence
  Description of Artificial Sequence: Synthetic oligonucleotide
gcctctgaaggtagaggtagcagacaattttgatc

SEQ ID NO: 252040 - DNA, 40 bp, Artificial Sequence
  Description of Artificial Sequence: Synthetic oligonucleotide
cctctgaaggtagaggtagcagacaattttgatcaaatag

SEQ ID NO: 252041 - DNA, 41 bp, Artificial Sequence
  Description of Artificial Sequence: Synthetic oligonucleotide
ctctgaaggtagaggtagcagacaattttgatcaaatagtg

SEQ ID NO: 252042 - DNA, 47 bp, Artificial Sequence
  Description of Artificial Sequence: Synthetic oligonucleotide
tctgaaggtagaggtagcagacaattttgatcaaatagtgattaatg

SEQ ID NO: 252043 - DNA, 46 bp, Artificial Sequence
  Description of Artificial Sequence: Synthetic oligonucleotide
ctgaaggtagaggtagcagacaattttgatcaaatagtgattaatg

SEQ ID NO: 252044 - DNA, 54 bp, Artificial Sequence
  Description of Artificial Sequence: Synthetic oligonucleotide
tgaaggtagaggtagcagacaattttgatcaaatagtgattaatgaaaaaaaag

SEQ ID NO: 252045 - DNA, 53 bp, Artificial Sequence
  Description of Artificial Sequence: Synthetic oligonucleotide
gaaggtagaggtagcagacaattttgatcaaatagtgattaatgaaaaaaaag

SEQ ID NO: 252046 - DNA, 55 bp, Artificial Sequence
  Description of Artificial Sequence: Synthetic oligonucleotide
aaggtagaggtagcagacaattttgatcaaatagtgattaatgaaaaaaaagatg

SEQ ID NO: 252047 - DNA, 54 bp, Artificial Sequence
  Description of Artificial Sequence: Synthetic oligonucleotide
aggtagaggtagcagacaattttgatcaaatagtgattaatgaaaaaaaagatg

SEQ ID NO: 252048 - DNA, 53 bp, Artificial Sequence
  Description of Artificial Sequence: Synthetic oligonucleotide
ggtagaggtagcagacaattttgatcaaatagtgattaatgaaaaaaaagatg

SEQ ID NO: 252049 - DNA, 54 bp, Artificial Sequence
  Description of Artificial Sequence: Synthetic oligonucleotide
gtagaggtagcagacaattttgatcaaatagtgattaatgaaaaaaaagatgtg

SEQ ID NO: 252050 - DNA, 54 bp, Artificial Sequence
  Description of Artificial Sequence: Synthetic oligonucleotide
tagaggtagcagacaattttgatcaaatagtgattaatgaaaaaaaagatgtgg

SEQ ID NO: 252051 - DNA, 53 bp, Artificial Sequence
  Description of Artificial Sequence: Synthetic oligonucleotide
agaggtagcagacaattttgatcaaatagtgattaatgaaaaaaaagatgtgg

SEQ ID NO: 252052 - DNA, 52 bp, Artificial Sequence
  Description of Artificial Sequence: Synthetic oligonucleotide
gaggtagcagacaattttgatcaaatagtgattaatgaaaaaaaagatgtgg

SEQ ID NO: 252053 - DNA, 53 bp, Artificial Sequence
  Description of Artificial Sequence: Synthetic oligonucleotide
aggtagcagacaattttgatcaaatagtgattaatgaaaaaaaagatgtggtg

SEQ ID NO: 252054 - DNA, 52 bp, Artificial Sequence
  Description of Artificial Sequence: Synthetic oligonucleotide
ggtagcagacaattttgatcaaatagtgattaatgaaaaaaaagatgtggtg

SEQ ID NO: 252055 - DNA, 55 bp, Artificial Sequence
  Description of Artificial Sequence: Synthetic oligonucleotide
gtagcagacaattttgatcaaatagtgattaatgaaaaaaaagatgtggtgattg

SEQ ID NO: 252056 - DNA, 60 bp, Artificial Sequence
  Description of Artificial Sequence: Synthetic oligonucleotide
tagcagacaattttgatcaaatagtgattaatgaaaaaaaagatgtggtgattgaatatt

SEQ ID NO: 252057 - DNA, 60 bp, Artificial Sequence
  Description of Artificial Sequence: Synthetic oligonucleotide
agcagacaattttgatcaaatagtgattaatgaaaaaaaagatgtggtgattgaatatta

SEQ ID NO: 252058 - DNA, 60 bp, Artificial Sequence
  Description of Artificial Sequence: Synthetic oligonucleotide
gcagacaattttgatcaaatagtgattaatgaaaaaaaagatgtggtgattgaatattat

SEQ ID NO: 252059 - DNA, 60 bp, Artificial Sequence
  Description of Artificial Sequence: Synthetic oligonucleotide
cagacaattttgatcaaatagtgattaatgaaaaaaaagatgtggtgattgaatattatg

SEQ ID NO: 252060 - DNA, 60 bp, Artificial Sequence
  Description of Artificial Sequence: Synthetic oligonucleotide
agacaattttgatcaaatagtgattaatgaaaaaaaagatgtggtgattgaatattatgc

SEQ ID NO: 252061 - DNA, 60 bp, Artificial Sequence
  Description of Artificial Sequence: Synthetic oligonucleotide
gacaattttgatcaaatagtgattaatgaaaaaaaagatgtggtgattgaatattatgcc

SEQ ID NO: 252062 - DNA, 60 bp, Artificial Sequence
  Description of Artificial Sequence: Synthetic oligonucleotide
acaattttgatcaaatagtgattaatgaaaaaaaagatgtggtgattgaatattatgccc

SEQ ID NO: 252063 - DNA, 59 bp, Artificial Sequence
  Description of Artificial Sequence: Synthetic oligonucleotide
caattttgatcaaatagtgattaatgaaaaaaaagatgtggtgattgaatattatgccc

SEQ ID NO: 252064 - DNA, 59 bp, Artificial Sequence
  Description of Artificial Sequence: Synthetic oligonucleotide
aattttgatcaaatagtgattaatgaaaaaaaagatgtggtgattgaatattatgcccc

SEQ ID NO: 252065 - DNA, 58 bp, Artificial Sequence
  Description of Artificial Sequence: Synthetic oligonucleotide
attttgatcaaatagtgattaatgaaaaaaaagatgtggtgattgaatattatgcccc

SEQ ID NO: 252066 - DNA, 57 bp, Artificial Sequence
  Description of Artificial Sequence: Synthetic oligonucleotide
ttttgatcaaatagtgattaatgaaaaaaaagatgtggtgattgaatattatgcccc

SEQ ID NO: 252067 - DNA, 56 bp, Artificial Sequence
  Description of Artificial Sequence: Synthetic oligonucleotide
tttgatcaaatagtgattaatgaaaaaaaagatgtggtgattgaatattatgcccc

SEQ ID NO: 252068 - DNA, 55 bp, Artificial Sequence
  Description of Artificial Sequence: Synthetic oligonucleotide
ttgatcaaatagtgattaatgaaaaaaaagatgtggtgattgaatattatgcccc

SEQ ID NO: 252069 - DNA, 54 bp, Artificial Sequence
  Description of Artificial Sequence: Synthetic oligonucleotide
tgatcaaatagtgattaatgaaaaaaaagatgtggtgattgaatattatgcccc

SEQ ID NO: 252070 - DNA, 53 bp, Artificial Sequence
  Description of Artificial Sequence: Synthetic oligonucleotide
gatcaaatagtgattaatgaaaaaaaagatgtggtgattgaatattatgcccc

SEQ ID NO: 252071 - DNA, 55 bp, Artificial Sequence
  Description of Artificial Sequence: Synthetic oligonucleotide
atcaaatagtgattaatgaaaaaaaagatgtggtgattgaatattatgccccatg

SEQ ID NO: 252072 - DNA, 54 bp, Artificial Sequence
  Description of Artificial Sequence: Synthetic oligonucleotide
tcaaatagtgattaatgaaaaaaaagatgtggtgattgaatattatgccccatg

SEQ ID NO: 252073 - DNA, 53 bp, Artificial Sequence
  Description of Artificial Sequence: Synthetic oligonucleotide
caaatagtgattaatgaaaaaaaagatgtggtgattgaatattatgccccatg

SEQ ID NO: 252074 - DNA, 53 bp, Artificial Sequence
  Description of Artificial Sequence: Synthetic oligonucleotide
aaatagtgattaatgaaaaaaaagatgtggtgattgaatattatgccccatgg

SEQ ID NO: 252075 - DNA, 52 bp, Artificial Sequence
  Description of Artificial Sequence: Synthetic oligonucleotide
aatagtgattaatgaaaaaaaagatgtggtgattgaatattatgccccatgg

SEQ ID NO: 252076 - DNA, 51 bp, Artificial Sequence
  Description of Artificial Sequence: Synthetic oligonucleotide
atagtgattaatgaaaaaaaagatgtggtgattgaatattatgccccatgg

SEQ ID NO: 252077 - DNA, 50 bp, Artificial Sequence
  Description of Artificial Sequence: Synthetic oligonucleotide
tagtgattaatgaaaaaaaagatgtggtgattgaatattatgccccatgg

SEQ ID NO: 252078 - DNA, 49 bp, Artificial Sequence
  Description of Artificial Sequence: Synthetic oligonucleotide
agtgattaatgaaaaaaaagatgtggtgattgaatattatgccccatgg

SEQ ID NO: 252079 - DNA, 48 bp, Artificial Sequence
  Description of Artificial Sequence: Synthetic oligonucleotide
gtgattaatgaaaaaaaagatgtggtgattgaatattatgccccatgg

SEQ ID NO: 252080 - DNA, 49 bp, Artificial Sequence
  Description of Artificial Sequence: Synthetic oligonucleotide
tgattaatgaaaaaaaagatgtggtgattgaatattatgccccatggtg

SEQ ID NO: 252081 - DNA, 48 bp, Artificial Sequence
  Description of Artificial Sequence: Synthetic oligonucleotide
gattaatgaaaaaaaagatgtggtgattgaatattatgccccatggtg

SEQ ID NO: 252082 - DNA, 49 bp, Artificial Sequence
  Description of Artificial Sequence: Synthetic oligonucleotide
attaatgaaaaaaaagatgtggtgattgaatattatgccccatggtgtg

SEQ ID NO: 252083 - DNA, 48 bp, Artificial Sequence
  Description of Artificial Sequence: Synthetic oligonucleotide
ttaatgaaaaaaaagatgtggtgattgaatattatgccccatggtgtg

SEQ ID NO: 252084 - DNA, 47 bp, Artificial Sequence
  Description of Artificial Sequence: Synthetic oligonucleotide
taatgaaaaaaaagatgtggtgattgaatattatgccccatggtgtg

SEQ ID NO: 252085 - DNA, 46 bp, Artificial Sequence
  Description of Artificial Sequence: Synthetic oligonucleotide
aatgaaaaaaaagatgtggtgattgaatattatgccccatggtgtg

SEQ ID NO: 252086 - DNA, 45 bp, Artificial Sequence
  Description of Artificial Sequence: Synthetic oligonucleotide
atgaaaaaaaagatgtggtgattgaatattatgccccatggtgtg

SEQ ID NO: 252087 - DNA, 44 bp, Artificial Sequence
  Description of Artificial Sequence: Synthetic oligonucleotide
tgaaaaaaaagatgtggtgattgaatattatgccccatggtgtg

SEQ ID NO: 252088 - DNA, 43 bp, Artificial Sequence
  Description of Artificial Sequence: Synthetic oligonucleotide
gaaaaaaaagatgtggtgattgaatattatgccccatggtgtg

SEQ ID NO: 252089 - DNA, 43 bp, Artificial Sequence
  Description of Artificial Sequence: Synthetic oligonucleotide
aaaaaaaagatgtggtgattgaatattatgccccatggtgtgg

SEQ ID NO: 252090 - DNA, 42 bp, Artificial Sequence
  Description of Artificial Sequence: Synthetic oligonucleotide
aaaaaaagatgtggtgattgaatattatgccccatggtgtgg

SEQ ID NO: 252091 - DNA, 41 bp, Artificial Sequence
  Description of Artificial Sequence: Synthetic oligonucleotide
aaaaaagatgtggtgattgaatattatgccccatggtgtgg

SEQ ID NO: 252092 - DNA, 40 bp, Artificial Sequence
  Description of Artificial Sequence: Synthetic oligonucleotide
aaaaagatgtggtgattgaatattatgccccatggtgtgg

SEQ ID NO: 252093 - DNA, 39 bp, Artificial Sequence
  Description of Artificial Sequence: Synthetic oligonucleotide
aaaagatgtggtgattgaatattatgccccatggtgtgg

SEQ ID NO: 252094 - DNA, 38 bp, Artificial Sequence
  Description of Artificial Sequence: Synthetic oligonucleotide
aaagatgtggtgattgaatattatgccccatggtgtgg

SEQ ID NO: 252095 - DNA, 37 bp, Artificial Sequence
  Description of Artificial Sequence: Synthetic oligonucleotide
aagatgtggtgattgaatattatgccccatggtgtgg

SEQ ID NO: 252096 - DNA, 36 bp, Artificial Sequence
  Description of Artificial Sequence: Synthetic oligonucleotide
agatgtggtgattgaatattatgccccatggtgtgg

SEQ ID NO: 252097 - DNA, 35 bp, Artificial Sequence
  Description of Artificial Sequence: Synthetic oligonucleotide
gatgtggtgattgaatattatgccccatggtgtgg

SEQ ID NO: 252098 - DNA, 36 bp, Artificial Sequence
  Description of Artificial Sequence: Synthetic oligonucleotide
atgtggtgattgaatattatgccccatggtgtggtg

SEQ ID NO: 252099 - DNA, 35 bp, Artificial Sequence
  Description of Artificial Sequence: Synthetic oligonucleotide
tgtggtgattgaatattatgccccatggtgtggtg

SEQ ID NO: 252100 - DNA, 34 bp, Artificial Sequence
  Description of Artificial Sequence: Synthetic oligonucleotide
gtggtgattgaatattatgccccatggtgtggtg

SEQ ID NO: 252101 - DNA, 35 bp, Artificial Sequence
  Description of Artificial Sequence: Synthetic oligonucleotide
tggtgattgaatattatgccccatggtgtggtgac

SEQ ID NO: 252102 - DNA, 34 bp, Artificial Sequence
  Description of Artificial Sequence: Synthetic oligonucleotide
ggtgattgaatattatgccccatggtgtggtgac

SEQ ID NO: 252103 - DNA, 35 bp, Artificial Sequence
  Description of Artificial Sequence: Synthetic oligonucleotide
gtgattgaatattatgccccatggtgtggtgactg

SEQ ID NO: 252104 - DNA, 38 bp, Artificial Sequence
  Description of Artificial Sequence: Synthetic oligonucleotide
tgattgaatattatgccccatggtgtggtgactgtaag

SEQ ID NO: 252105 - DNA, 37 bp, Artificial Sequence
  Description of Artificial Sequence: Synthetic oligonucleotide
gattgaatattatgccccatggtgtggtgactgtaag

SEQ ID NO: 252106 - DNA, 39 bp, Artificial Sequence
  Description of Artificial Sequence: Synthetic oligonucleotide
attgaatattatgccccatggtgtggtgactgtaagatc

SEQ ID NO: 252107 - DNA, 38 bp, Artificial Sequence
  Description of Artificial Sequence: Synthetic oligonucleotide
ttgaatattatgccccatggtgtggtgactgtaagatc

SEQ ID NO: 252108 - DNA, 37 bp, Artificial Sequence
  Description of Artificial Sequence: Synthetic oligonucleotide
tgaatattatgccccatggtgtggtgactgtaagatc

SEQ ID NO: 252109 - DNA, 36 bp, Artificial Sequence
  Description of Artificial Sequence: Synthetic oligonucleotide
gaatattatgccccatggtgtggtgactgtaagatc

SEQ ID NO: 252110 - DNA, 36 bp, Artificial Sequence
  Description of Artificial Sequence: Synthetic oligonucleotide
aatattatgccccatggtgtggtgactgtaagatcc

SEQ ID NO: 252111 - DNA, 35 bp, Artificial Sequence
  Description of Artificial Sequence: Synthetic oligonucleotide
atattatgccccatggtgtggtgactgtaagatcc

SEQ ID NO: 252112 - DNA, 34 bp, Artificial Sequence
  Description of Artificial Sequence: Synthetic oligonucleotide
tattatgccccatggtgtggtgactgtaagatcc

SEQ ID NO: 252113 - DNA, 33 bp, Artificial Sequence
  Description of Artificial Sequence: Synthetic oligonucleotide
attatgccccatggtgtggtgactgtaagatcc

SEQ ID NO: 252114 - DNA, 32 bp, Artificial Sequence
  Description of Artificial Sequence: Synthetic oligonucleotide
ttatgccccatggtgtggtgactgtaagatcc

SEQ ID NO: 252115 - DNA, 31 bp, Artificial Sequence
  Description of Artificial Sequence: Synthetic oligonucleotide
tatgccccatggtgtggtgactgtaagatcc

SEQ ID NO: 252116 - DNA, 30 bp, Artificial Sequence
  Description of Artificial Sequence: Synthetic oligonucleotide
atgccccatggtgtggtgactgtaagatcc

SEQ ID NO: 252117 - DNA, 29 bp, Artificial Sequence
  Description of Artificial Sequence: Synthetic oligonucleotide
tgccccatggtgtggtgactgtaagatcc

SEQ ID NO: 252118 - DNA, 28 bp, Artificial Sequence
  Description of Artificial Sequence: Synthetic oligonucleotide
gccccatggtgtggtgactgtaagatcc

SEQ ID NO: 252119 - DNA, 29 bp, Artificial Sequence
  Description of Artificial Sequence: Synthetic oligonucleotide
ccccatggtgtggtgactgtaagatcctg

SEQ ID NO: 252120 - DNA, 29 bp, Artificial Sequence
  Description of Artificial Sequence: Synthetic oligonucleotide
cccatggtgtggtgactgtaagatcctgg

SEQ ID NO: 252121 - DNA, 30 bp, Artificial Sequence
  Description of Artificial Sequence: Synthetic oligonucleotide
ccatggtgtggtgactgtaagatcctggag

SEQ ID NO: 252122 - DNA, 30 bp, Artificial Sequence
  Description of Artificial Sequence: Synthetic oligonucleotide
catggtgtggtgactgtaagatcctggagc

SEQ ID NO: 252123 - DNA, 30 bp, Artificial Sequence
  Description of Artificial Sequence: Synthetic oligonucleotide
atggtgtggtgactgtaagatcctggagcc

SEQ ID NO: 252124 - DNA, 29 bp, Artificial Sequence
  Description of Artificial Sequence: Synthetic oligonucleotide
tggtgtggtgactgtaagatcctggagcc

SEQ ID NO: 252125 - DNA, 28 bp, Artificial Sequence
  Description of Artificial Sequence: Synthetic oligonucleotide
ggtgtggtgactgtaagatcctggagcc

SEQ ID NO: 252126 - DNA, 28 bp, Artificial Sequence
  Description of Artificial Sequence: Synthetic oligonucleotide
gtgtggtgactgtaagatcctggagccg

SEQ ID NO: 252127 - DNA, 30 bp, Artificial Sequence
  Description of Artificial Sequence: Synthetic oligonucleotide
tgtggtgactgtaagatcctggagccgaag

SEQ ID NO: 252128 - DNA, 29 bp, Artificial Sequence
  Description of Artificial Sequence: Synthetic oligonucleotide
gtggtgactgtaagatcctggagccgaag

SEQ ID NO: 252129 - DNA, 35 bp, Artificial Sequence
  Description of Artificial Sequence: Synthetic oligonucleotide
tggtgactgtaagatcctggagccgaagtataaac

SEQ ID NO: 252130 - DNA, 34 bp, Artificial Sequence
  Description of Artificial Sequence: Synthetic oligonucleotide
ggtgactgtaagatcctggagccgaagtataaac

SEQ ID NO: 252131 - DNA, 36 bp, Artificial Sequence
  Description of Artificial Sequence: Synthetic oligonucleotide
gtgactgtaagatcctggagccgaagtataaacaac

SEQ ID NO: 252132 - DNA, 38 bp, Artificial Sequence
  Description of Artificial Sequence: Synthetic oligonucleotide
tgactgtaagatcctggagccgaagtataaacaacttg

SEQ ID NO: 252133 - DNA, 37 bp, Artificial Sequence
  Description of Artificial Sequence: Synthetic oligonucleotide
gactgtaagatcctggagccgaagtataaacaacttg

SEQ ID NO: 252134 - DNA, 37 bp, Artificial Sequence
  Description of Artificial Sequence: Synthetic oligonucleotide
actgtaagatcctggagccgaagtataaacaacttgg

SEQ ID NO: 252135 - DNA, 36 bp, Artificial Sequence
  Description of Artificial Sequence: Synthetic oligonucleotide
ctgtaagatcctggagccgaagtataaacaacttgg

SEQ ID NO: 252136 - DNA, 36 bp, Artificial Sequence
  Description of Artificial Sequence: Synthetic oligonucleotide
tgtaagatcctggagccgaagtataaacaacttggc

SEQ ID NO: 252137 - DNA, 35 bp, Artificial Sequence
  Description of Artificial Sequence: Synthetic oligonucleotide
gtaagatcctggagccgaagtataaacaacttggc

SEQ ID NO: 252138 - DNA, 35 bp, Artificial Sequence
  Description of Artificial Sequence: Synthetic oligonucleotide
taagatcctggagccgaagtataaacaacttggcg

SEQ ID NO: 252139 - DNA, 34 bp, Artificial Sequence
  Description of Artificial Sequence: Synthetic oligonucleotide
aagatcctggagccgaagtataaacaacttggcg

SEQ ID NO: 252140 - DNA, 33 bp, Artificial Sequence
  Description of Artificial Sequence: Synthetic oligonucleotide
agatcctggagccgaagtataaacaacttggcg

SEQ ID NO: 252141 - DNA, 32 bp, Artificial Sequence
  Description of Artificial Sequence: Synthetic oligonucleotide
gatcctggagccgaagtataaacaacttggcg

SEQ ID NO: 252142 - DNA, 33 bp, Artificial Sequence
  Description of Artificial Sequence: Synthetic oligonucleotide
atcctggagccgaagtataaacaacttggcgtg

SEQ ID NO: 252143 - DNA, 32 bp, Artificial Sequence
  Description of Artificial Sequence: Synthetic oligonucleotide
tcctggagccgaagtataaacaacttggcgtg

SEQ ID NO: 252144 - DNA, 31 bp, Artificial Sequence
  Description of Artificial Sequence: Synthetic oligonucleotide
cctggagccgaagtataaacaacttggcgtg

SEQ ID NO: 252145 - DNA, 33 bp, Artificial Sequence
  Description of Artificial Sequence: Synthetic oligonucleotide
ctggagccgaagtataaacaacttggcgtgaag

SEQ ID NO: 252146 - DNA, 33 bp, Artificial Sequence
  Description of Artificial Sequence: Synthetic oligonucleotide
tggagccgaagtataaacaacttggcgtgaagc

SEQ ID NO: 252147 - DNA, 32 bp, Artificial Sequence
  Description of Artificial Sequence: Synthetic oligonucleotide
ggagccgaagtataaacaacttggcgtgaagc

SEQ ID NO: 252148 - DNA, 33 bp, Artificial Sequence
  Description of Artificial Sequence: Synthetic oligonucleotide
gagccgaagtataaacaacttggcgtgaagctc

SEQ ID NO: 252149 - DNA, 34 bp, Artificial Sequence
  Description of Artificial Sequence: Synthetic oligonucleotide
agccgaagtataaacaacttggcgtgaagctcag

SEQ ID NO: 252150 - DNA, 33 bp, Artificial Sequence
  Description of Artificial Sequence: Synthetic oligonucleotide
gccgaagtataaacaacttggcgtgaagctcag

SEQ ID NO: 252151 - DNA, 33 bp, Artificial Sequence
  Description of Artificial Sequence: Synthetic oligonucleotide
ccgaagtataaacaacttggcgtgaagctcagg

SEQ ID NO: 252152 - DNA, 36 bp, Artificial Sequence
  Description of Artificial Sequence: Synthetic oligonucleotide
cgaagtataaacaacttggcgtgaagctcaggaaag

SEQ ID NO: 252153 - DNA, 37 bp, Artificial Sequence
  Description of Artificial Sequence: Synthetic oligonucleotide
gaagtataaacaacttggcgtgaagctcaggaaagac

SEQ ID NO: 252154 - DNA, 37 bp, Artificial Sequence
  Description of Artificial Sequence: Synthetic oligonucleotide
aagtataaacaacttggcgtgaagctcaggaaagacc

SEQ ID NO: 252155 - DNA, 36 bp, Artificial Sequence
  Description of Artificial Sequence: Synthetic oligonucleotide
agtataaacaacttggcgtgaagctcaggaaagacc

SEQ ID NO: 252156 - DNA, 35 bp, Artificial Sequence
  Description of Artificial Sequence: Synthetic oligonucleotide
gtataaacaacttggcgtgaagctcaggaaagacc

SEQ ID NO: 252157 - DNA, 35 bp, Artificial Sequence
  Description of Artificial Sequence: Synthetic oligonucleotide
tataaacaacttggcgtgaagctcaggaaagaccc

SEQ ID NO: 252158 - DNA, 34 bp, Artificial Sequence
  Description of Artificial Sequence: Synthetic oligonucleotide
ataaacaacttggcgtgaagctcaggaaagaccc

SEQ ID NO: 252159 - DNA, 33 bp, Artificial Sequence
  Description of Artificial Sequence: Synthetic oligonucleotide
taaacaacttggcgtgaagctcaggaaagaccc

SEQ ID NO: 252160 - DNA, 32 bp, Artificial Sequence
  Description of Artificial Sequence: Synthetic oligonucleotide
aaacaacttggcgtgaagctcaggaaagaccc

SEQ ID NO: 252161 - DNA, 31 bp, Artificial Sequence
  Description of Artificial Sequence: Synthetic oligonucleotide
aacaacttggcgtgaagctcaggaaagaccc

SEQ ID NO: 252162 - DNA, 30 bp, Artificial Sequence
  Description of Artificial Sequence: Synthetic oligonucleotide
acaacttggcgtgaagctcaggaaagaccc

SEQ ID NO: 252163 - DNA, 29 bp, Artificial Sequence
  Description of Artificial Sequence: Synthetic oligonucleotide
caacttggcgtgaagctcaggaaagaccc

SEQ ID NO: 252164 - DNA, 35 bp, Artificial Sequence
  Description of Artificial Sequence: Synthetic oligonucleotide
aacttggcgtgaagctcaggaaagacccatatatc

SEQ ID NO: 252165 - DNA, 34 bp, Artificial Sequence
  Description of Artificial Sequence: Synthetic oligonucleotide
acttggcgtgaagctcaggaaagacccatatatc

SEQ ID NO: 252166 - DNA, 33 bp, Artificial Sequence
  Description of Artificial Sequence: Synthetic oligonucleotide
cttggcgtgaagctcaggaaagacccatatatc

SEQ ID NO: 252167 - DNA, 33 bp, Artificial Sequence
  Description of Artificial Sequence: Synthetic oligonucleotide
ttggcgtgaagctcaggaaagacccatatatcg

SEQ ID NO: 252168 - DNA, 32 bp, Artificial Sequence
  Description of Artificial Sequence: Synthetic oligonucleotide
tggcgtgaagctcaggaaagacccatatatcg

SEQ ID NO: 252169 - DNA, 31 bp, Artificial Sequence
  Description of Artificial Sequence: Synthetic oligonucleotide
ggcgtgaagctcaggaaagacccatatatcg

SEQ ID NO: 252170 - DNA, 32 bp, Artificial Sequence
  Description of Artificial Sequence: Synthetic oligonucleotide
gcgtgaagctcaggaaagacccatatatcgtc

SEQ ID NO: 252171 - DNA, 35 bp, Artificial Sequence
  Description of Artificial Sequence: Synthetic oligonucleotide
cgtgaagctcaggaaagacccatatatcgtcaaag

SEQ ID NO: 252172 - DNA, 35 bp, Artificial Sequence
  Description of Artificial Sequence: Synthetic oligonucleotide
gtgaagctcaggaaagacccatatatcgtcaaagc

SEQ ID NO: 252173 - DNA, 35 bp, Artificial Sequence
  Description of Artificial Sequence: Synthetic oligonucleotide
tgaagctcaggaaagacccatatatcgtcaaagcc

SEQ ID NO: 252174 - DNA, 34 bp, Artificial Sequence
  Description of Artificial Sequence: Synthetic oligonucleotide
gaagctcaggaaagacccatatatcgtcaaagcc

SEQ ID NO: 252175 - DNA, 36 bp, Artificial Sequence
  Description of Artificial Sequence: Synthetic oligonucleotide
aagctcaggaaagacccatatatcgtcaaagccaag

SEQ ID NO: 252176 - DNA, 35 bp, Artificial Sequence
  Description of Artificial Sequence: Synthetic oligonucleotide
agctcaggaaagacccatatatcgtcaaagccaag

SEQ ID NO: 252177 - DNA, 34 bp, Artificial Sequence
  Description of Artificial Sequence: Synthetic oligonucleotide
gctcaggaaagacccatatatcgtcaaagccaag

SEQ ID NO: 252178 - DNA, 36 bp, Artificial Sequence
  Description of Artificial Sequence: Synthetic oligonucleotide
ctcaggaaagacccatatatcgtcaaagccaagatc

SEQ ID NO: 252179 - DNA, 36 bp, Artificial Sequence
  Description of Artificial Sequence: Synthetic oligonucleotide
tcaggaaagacccatatatcgtcaaagccaagatcg

SEQ ID NO: 252180 - DNA, 35 bp, Artificial Sequence
  Description of Artificial Sequence: Synthetic oligonucleotide
caggaaagacccatatatcgtcaaagccaagatcg

SEQ ID NO: 252181 - DNA, 37 bp, Artificial Sequence
  Description of Artificial Sequence: Synthetic oligonucleotide
aggaaagacccatatatcgtcaaagccaagatcgatg

SEQ ID NO: 252182 - DNA, 36 bp, Artificial Sequence
  Description of Artificial Sequence: Synthetic oligonucleotide
ggaaagacccatatatcgtcaaagccaagatcgatg

SEQ ID NO: 252183 - DNA, 36 bp, Artificial Sequence
  Description of Artificial Sequence: Synthetic oligonucleotide
gaaagacccatatatcgtcaaagccaagatcgatgc

SEQ ID NO: 252184 - DNA, 36 bp, Artificial Sequence
  Description of Artificial Sequence: Synthetic oligonucleotide
aaagacccatatatcgtcaaagccaagatcgatgcc

SEQ ID NO: 252185 - DNA, 35 bp, Artificial Sequence
  Description of Artificial Sequence: Synthetic oligonucleotide
aagacccatatatcgtcaaagccaagatcgatgcc

SEQ ID NO: 252186 - DNA, 34 bp, Artificial Sequence
  Description of Artificial Sequence: Synthetic oligonucleotide
agacccatatatcgtcaaagccaagatcgatgcc

SEQ ID NO: 252187 - DNA, 33 bp, Artificial Sequence
  Description of Artificial Sequence: Synthetic oligonucleotide
gacccatatatcgtcaaagccaagatcgatgcc

SEQ ID NO: 252188 - DNA, 34 bp, Artificial Sequence
  Description of Artificial Sequence: Synthetic oligonucleotide
acccatatatcgtcaaagccaagatcgatgccac

SEQ ID NO: 252189 - DNA, 33 bp, Artificial Sequence
  Description of Artificial Sequence: Synthetic oligonucleotide
cccatatatcgtcaaagccaagatcgatgccac

SEQ ID NO: 252190 - DNA, 34 bp, Artificial Sequence
  Description of Artificial Sequence: Synthetic oligonucleotide
ccatatatcgtcaaagccaagatcgatgccacac

SEQ ID NO: 252191 - DNA, 34 bp, Artificial Sequence
  Description of Artificial Sequence: Synthetic oligonucleotide
catatatcgtcaaagccaagatcgatgccacacc

SEQ ID NO: 252192 - DNA, 34 bp, Artificial Sequence
  Description of Artificial Sequence: Synthetic oligonucleotide
atatatcgtcaaagccaagatcgatgccacaccc

SEQ ID NO: 252193 - DNA, 33 bp, Artificial Sequence
  Description of Artificial Sequence: Synthetic oligonucleotide
tatatcgtcaaagccaagatcgatgccacaccc

SEQ ID NO: 252194 - DNA, 32 bp, Artificial Sequence
  Description of Artificial Sequence: Synthetic oligonucleotide
atatcgtcaaagccaagatcgatgccacaccc

SEQ ID NO: 252195 - DNA, 31 bp, Artificial Sequence
  Description of Artificial Sequence: Synthetic oligonucleotide
tatcgtcaaagccaagatcgatgccacaccc

SEQ ID NO: 252196 - DNA, 30 bp, Artificial Sequence
  Description of Artificial Sequence: Synthetic oligonucleotide
atcgtcaaagccaagatcgatgccacaccc

SEQ ID NO: 252197 - DNA, 29 bp, Artificial Sequence
  Description of Artificial Sequence: Synthetic oligonucleotide
tcgtcaaagccaagatcgatgccacaccc

SEQ ID NO: 252198 - DNA, 28 bp, Artificial Sequence
  Description of Artificial Sequence: Synthetic oligonucleotide
cgtcaaagccaagatcgatgccacaccc

SEQ ID NO: 252199 - DNA, 31 bp, Artificial Sequence
  Description of Artificial Sequence: Synthetic oligonucleotide
gtcaaagccaagatcgatgccacacccaatg

SEQ ID NO: 252200 - DNA, 33 bp, Artificial Sequence
  Description of Artificial Sequence: Synthetic oligonucleotide
tcaaagccaagatcgatgccacacccaatgatg

SEQ ID NO: 252201 - DNA, 32 bp, Artificial Sequence
  Description of Artificial Sequence: Synthetic oligonucleotide
caaagccaagatcgatgccacacccaatgatg

SEQ ID NO: 252202 - DNA, 33 bp, Artificial Sequence
  Description of Artificial Sequence: Synthetic oligonucleotide
aaagccaagatcgatgccacacccaatgatgag

SEQ ID NO: 252203 - DNA, 32 bp, Artificial Sequence
  Description of Artificial Sequence: Synthetic oligonucleotide
aagccaagatcgatgccacacccaatgatgag

SEQ ID NO: 252204 - DNA, 31 bp, Artificial Sequence
  Description of Artificial Sequence: Synthetic oligonucleotide
agccaagatcgatgccacacccaatgatgag

SEQ ID NO: 252205 - DNA, 30 bp, Artificial Sequence
  Description of Artificial Sequence: Synthetic oligonucleotide
gccaagatcgatgccacacccaatgatgag

SEQ ID NO: 252206 - DNA, 30 bp, Artificial Sequence
  Description of Artificial Sequence: Synthetic oligonucleotide
ccaagatcgatgccacacccaatgatgagc

SEQ ID NO: 252207 - DNA, 30 bp, Artificial Sequence
  Description of Artificial Sequence: Synthetic oligonucleotide
caagatcgatgccacacccaatgatgagcc

SEQ ID NO: 252208 - DNA, 32 bp, Artificial Sequence
  Description of Artificial Sequence: Synthetic oligonucleotide
aagatcgatgccacacccaatgatgagccttc

SEQ ID NO: 252209 - DNA, 31 bp, Artificial Sequence
  Description of Artificial Sequence: Synthetic oligonucleotide
agatcgatgccacacccaatgatgagccttc

SEQ ID NO: 252210 - DNA, 30 bp, Artificial Sequence
  Description of Artificial Sequence: Synthetic oligonucleotide
gatcgatgccacacccaatgatgagccttc

SEQ ID NO: 252211 - DNA, 31 bp, Artificial Sequence
  Description of Artificial Sequence: Synthetic oligonucleotide
atcgatgccacacccaatgatgagccttctc

SEQ ID NO: 252212 - DNA, 30 bp, Artificial Sequence
  Description of Artificial Sequence: Synthetic oligonucleotide
tcgatgccacacccaatgatgagccttctc

SEQ ID NO: 252213 - DNA, 29 bp, Artificial Sequence
  Description of Artificial Sequence: Synthetic oligonucleotide
cgatgccacacccaatgatgagccttctc

SEQ ID NO: 252214 - DNA, 29 bp, Artificial Sequence
  Description of Artificial Sequence: Synthetic oligonucleotide
gatgccacacccaatgatgagccttctcc

SEQ ID NO: 252215 - DNA, 33 bp, Artificial Sequence
  Description of Artificial Sequence: Synthetic oligonucleotide
atgccacacccaatgatgagccttctccttatg

SEQ ID NO: 252216 - DNA, 32 bp, Artificial Sequence
  Description of Artificial Sequence: Synthetic oligonucleotide
tgccacacccaatgatgagccttctccttatg

SEQ ID NO: 252217 - DNA, 31 bp, Artificial Sequence
  Description of Artificial Sequence: Synthetic oligonucleotide
gccacacccaatgatgagccttctccttatg

SEQ ID NO: 252218 - DNA, 33 bp, Artificial Sequence
  Description of Artificial Sequence: Synthetic oligonucleotide
ccacacccaatgatgagccttctccttatgaag

SEQ ID NO: 252219 - DNA, 34 bp, Artificial Sequence
  Description of Artificial Sequence: Synthetic oligonucleotide
cacacccaatgatgagccttctccttatgaagtc

SEQ ID NO: 252220 - DNA, 35 bp, Artificial Sequence
  Description of Artificial Sequence: Synthetic oligonucleotide
acacccaatgatgagccttctccttatgaagtctg

SEQ ID NO: 252221 - DNA, 34 bp, Artificial Sequence
  Description of Artificial Sequence: Synthetic oligonucleotide
cacccaatgatgagccttctccttatgaagtctg

SEQ ID NO: 252222 - DNA, 35 bp, Artificial Sequence
  Description of Artificial Sequence: Synthetic oligonucleotide
acccaatgatgagccttctccttatgaagtctgag

SEQ ID NO: 252223 - DNA, 34 bp, Artificial Sequence
  Description of Artificial Sequence: Synthetic oligonucleotide
cccaatgatgagccttctccttatgaagtctgag

SEQ ID NO: 252224 - DNA, 34 bp, Artificial Sequence
  Description of Artificial Sequence: Synthetic oligonucleotide
ccaatgatgagccttctccttatgaagtctgagg

SEQ ID NO: 252225 - DNA, 38 bp, Artificial Sequence
  Description of Artificial Sequence: Synthetic oligonucleotide
caatgatgagccttctccttatgaagtctgaggttttc

SEQ ID NO: 252226 - DNA, 38 bp, Artificial Sequence
  Description of Artificial Sequence: Synthetic oligonucleotide
aatgatgagccttctccttatgaagtctgaggttttcg

SEQ ID NO: 252227 - DNA, 37 bp, Artificial Sequence
  Description of Artificial Sequence: Synthetic oligonucleotide
atgatgagccttctccttatgaagtctgaggttttcg

SEQ ID NO: 252228 - DNA, 36 bp, Artificial Sequence
  Description of Artificial Sequence: Synthetic oligonucleotide
tgatgagccttctccttatgaagtctgaggttttcg

SEQ ID NO: 252229 - DNA, 35 bp, Artificial Sequence
  Description of Artificial Sequence: Synthetic oligonucleotide
gatgagccttctccttatgaagtctgaggttttcg

SEQ ID NO: 252230 - DNA, 37 bp, Artificial Sequence
  Description of Artificial Sequence: Synthetic oligonucleotide
atgagccttctccttatgaagtctgaggttttcgtac

SEQ ID NO: 252231 - DNA, 36 bp, Artificial Sequence
  Description of Artificial Sequence: Synthetic oligonucleotide
tgagccttctccttatgaagtctgaggttttcgtac

SEQ ID NO: 252232 - DNA, 35 bp, Artificial Sequence
  Description of Artificial Sequence: Synthetic oligonucleotide
gagccttctccttatgaagtctgaggttttcgtac

SEQ ID NO: 252233 - DNA, 35 bp, Artificial Sequence
  Description of Artificial Sequence: Synthetic oligonucleotide
agccttctccttatgaagtctgaggttttcgtacc

SEQ ID NO: 252234 - DNA, 34 bp, Artificial Sequence
  Description of Artificial Sequence: Synthetic oligonucleotide
gccttctccttatgaagtctgaggttttcgtacc

SEQ ID NO: 252235 - DNA, 39 bp, Artificial Sequence
  Description of Artificial Sequence: Synthetic oligonucleotide
ccttctccttatgaagtctgaggttttcgtaccatatag

SEQ ID NO: 252236 - DNA, 41 bp, Artificial Sequence
  Description of Artificial Sequence: Synthetic oligonucleotide
cttctccttatgaagtctgaggttttcgtaccatatagttc

SEQ ID NO: 252237 - DNA, 42 bp, Artificial Sequence
  Description of Artificial Sequence: Synthetic oligonucleotide
ttctccttatgaagtctgaggttttcgtaccatatagttctc

SEQ ID NO: 252238 - DNA, 41 bp, Artificial Sequence
  Description of Artificial Sequence: Synthetic oligonucleotide
tctccttatgaagtctgaggttttcgtaccatatagttctc

SEQ ID NO: 252239 - DNA, 40 bp, Artificial Sequence
  Description of Artificial Sequence: Synthetic oligonucleotide
ctccttatgaagtctgaggttttcgtaccatatagttctc

SEQ ID NO: 252240 - DNA, 41 bp, Artificial Sequence
  Description of Artificial Sequence: Synthetic oligonucleotide
tccttatgaagtctgaggttttcgtaccatatagttctctc

SEQ ID NO: 252241 - DNA, 40 bp, Artificial Sequence
  Description of Artificial Sequence: Synthetic oligonucleotide
ccttatgaagtctgaggttttcgtaccatatagttctctc

SEQ ID NO: 252242 - DNA, 40 bp, Artificial Sequence
  Description of Artificial Sequence: Synthetic oligonucleotide
cttatgaagtctgaggttttcgtaccatatagttctctcc

SEQ ID NO: 252243 - DNA, 41 bp, Artificial Sequence
  Description of Artificial Sequence: Synthetic oligonucleotide
ttatgaagtctgaggttttcgtaccatatagttctctccac

SEQ ID NO: 252244 - DNA, 40 bp, Artificial Sequence
  Description of Artificial Sequence: Synthetic oligonucleotide
tatgaagtctgaggttttcgtaccatatagttctctccac

SEQ ID NO: 252245 - DNA, 39 bp, Artificial Sequence
  Description of Artificial Sequence: Synthetic oligonucleotide
atgaagtctgaggttttcgtaccatatagttctctccac

SEQ ID NO: 252246 - DNA, 38 bp, Artificial Sequence
  Description of Artificial Sequence: Synthetic oligonucleotide
tgaagtctgaggttttcgtaccatatagttctctccac

SEQ ID NO: 252247 - DNA, 37 bp, Artificial Sequence
  Description of Artificial Sequence: Synthetic oligonucleotide
gaagtctgaggttttcgtaccatatagttctctccac

SEQ ID NO: 252248 - DNA, 37 bp, Artificial Sequence
  Description of Artificial Sequence: Synthetic oligonucleotide
aagtctgaggttttcgtaccatatagttctctccacc

SEQ ID NO: 252249 - DNA, 36 bp, Artificial Sequence
  Description of Artificial Sequence: Synthetic oligonucleotide
agtctgaggttttcgtaccatatagttctctccacc

SEQ ID NO: 252250 - DNA, 35 bp, Artificial Sequence
  Description of Artificial Sequence: Synthetic oligonucleotide
gtctgaggttttcgtaccatatagttctctccacc

SEQ ID NO: 252251 - DNA, 35 bp, Artificial Sequence
  Description of Artificial Sequence: Synthetic oligonucleotide
tctgaggttttcgtaccatatagttctctccaccc

SEQ ID NO: 252252 - DNA, 34 bp, Artificial Sequence
  Description of Artificial Sequence: Synthetic oligonucleotide
ctgaggttttcgtaccatatagttctctccaccc

SEQ ID NO: 252253 - DNA, 36 bp, Artificial Sequence
  Description of Artificial Sequence: Synthetic oligonucleotide
tgaggttttcgtaccatatagttctctccacccaac

SEQ ID NO: 252254 - DNA, 35 bp, Artificial Sequence
  Description of Artificial Sequence: Synthetic oligonucleotide
gaggttttcgtaccatatagttctctccacccaac

SEQ ID NO: 252255 - DNA, 37 bp, Artificial Sequence
  Description of Artificial Sequence: Synthetic oligonucleotide
aggttttcgtaccatatagttctctccacccaacaag

SEQ ID NO: 252256 - DNA, 36 bp, Artificial Sequence
  Description of Artificial Sequence: Synthetic oligonucleotide
ggttttcgtaccatatagttctctccacccaacaag

SEQ ID NO: 252257 - DNA, 38 bp, Artificial Sequence
  Description of Artificial Sequence: Synthetic oligonucleotide
gttttcgtaccatatagttctctccacccaacaagatg

SEQ ID NO: 252258 - DNA, 38 bp, Artificial Sequence
  Description of Artificial Sequence: Synthetic oligonucleotide
ttttcgtaccatatagttctctccacccaacaagatgc

SEQ ID NO: 252259 - DNA, 37 bp, Artificial Sequence
  Description of Artificial Sequence: Synthetic oligonucleotide
tttcgtaccatatagttctctccacccaacaagatgc

SEQ ID NO: 252260 - DNA, 36 bp, Artificial Sequence
  Description of Artificial Sequence: Synthetic oligonucleotide
ttcgtaccatatagttctctccacccaacaagatgc

SEQ ID NO: 252261 - DNA, 35 bp, Artificial Sequence
  Description of Artificial Sequence: Synthetic oligonucleotide
tcgtaccatatagttctctccacccaacaagatgc

SEQ ID NO: 252262 - DNA, 34 bp, Artificial Sequence
  Description of Artificial Sequence: Synthetic oligonucleotide
cgtaccatatagttctctccacccaacaagatgc

SEQ ID NO: 252263 - DNA, 39 bp, Artificial Sequence
  Description of Artificial Sequence: Synthetic oligonucleotide
gtaccatatagttctctccacccaacaagatgctaaatc

SEQ ID NO: 252264 - DNA, 39 bp, Artificial Sequence
  Description of Artificial Sequence: Synthetic oligonucleotide
taccatatagttctctccacccaacaagatgctaaatcc

SEQ ID NO: 252265 - DNA, 38 bp, Artificial Sequence
  Description of Artificial Sequence: Synthetic oligonucleotide
accatatagttctctccacccaacaagatgctaaatcc

SEQ ID NO: 252266 - DNA, 37 bp, Artificial Sequence
  Description of Artificial Sequence: Synthetic oligonucleotide
ccatatagttctctccacccaacaagatgctaaatcc

SEQ ID NO: 252267 - DNA, 40 bp, Artificial Sequence
  Description of Artificial Sequence: Synthetic oligonucleotide
catatagttctctccacccaacaagatgctaaatcctaag

SEQ ID NO: 252268 - DNA, 46 bp, Artificial Sequence
  Description of Artificial Sequence: Synthetic oligonucleotide
atatagttctctccacccaacaagatgctaaatcctaagaaatatc

SEQ ID NO: 252269 - DNA, 45 bp, Artificial Sequence
  Description of Artificial Sequence: Synthetic oligonucleotide
tatagttctctccacccaacaagatgctaaatcctaagaaatatc

SEQ ID NO: 252270 - DNA, 44 bp, Artificial Sequence
  Description of Artificial Sequence: Synthetic oligonucleotide
atagttctctccacccaacaagatgctaaatcctaagaaatatc

SEQ ID NO: 252271 - DNA, 43 bp, Artificial Sequence
  Description of Artificial Sequence: Synthetic oligonucleotide
tagttctctccacccaacaagatgctaaatcctaagaaatatc

SEQ ID NO: 252272 - DNA, 42 bp, Artificial Sequence
  Description of Artificial Sequence: Synthetic oligonucleotide
agttctctccacccaacaagatgctaaatcctaagaaatatc

SEQ ID NO: 252273 - DNA, 41 bp, Artificial Sequence
  Description of Artificial Sequence: Synthetic oligonucleotide
gttctctccacccaacaagatgctaaatcctaagaaatatc

SEQ ID NO: 252274 - DNA, 43 bp, Artificial Sequence
  Description of Artificial Sequence: Synthetic oligonucleotide
ttctctccacccaacaagatgctaaatcctaagaaatatcaag

SEQ ID NO: 252275 - DNA, 42 bp, Artificial Sequence
  Description of Artificial Sequence: Synthetic oligonucleotide
tctctccacccaacaagatgctaaatcctaagaaatatcaag

SEQ ID NO: 252276 - DNA, 41 bp, Artificial Sequence
  Description of Artificial Sequence: Synthetic oligonucleotide
ctctccacccaacaagatgctaaatcctaagaaatatcaag

SEQ ID NO: 252277 - DNA, 41 bp, Artificial Sequence
  Description of Artificial Sequence: Synthetic oligonucleotide
tctccacccaacaagatgctaaatcctaagaaatatcaagg

SEQ ID NO: 252278 - DNA, 40 bp, Artificial Sequence
  Description of Artificial Sequence: Synthetic oligonucleotide
ctccacccaacaagatgctaaatcctaagaaatatcaagg

SEQ ID NO: 252279 - DNA, 41 bp, Artificial Sequence
  Description of Artificial Sequence: Synthetic oligonucleotide
tccacccaacaagatgctaaatcctaagaaatatcaaggtg

SEQ ID NO: 252280 - DNA, 40 bp, Artificial Sequence
  Description of Artificial Sequence: Synthetic oligonucleotide
ccacccaacaagatgctaaatcctaagaaatatcaaggtg

SEQ ID NO: 252281 - DNA, 40 bp, Artificial Sequence
  Description of Artificial Sequence: Synthetic oligonucleotide
cacccaacaagatgctaaatcctaagaaatatcaaggtgg

SEQ ID NO: 252282 - DNA, 40 bp, Artificial Sequence
  Description of Artificial Sequence: Synthetic oligonucleotide
acccaacaagatgctaaatcctaagaaatatcaaggtggc

SEQ ID NO: 252283 - DNA, 39 bp, Artificial Sequence
  Description of Artificial Sequence: Synthetic oligonucleotide
cccaacaagatgctaaatcctaagaaatatcaaggtggc

SEQ ID NO: 252284 - DNA, 39 bp, Artificial Sequence
  Description of Artificial Sequence: Synthetic oligonucleotide
ccaacaagatgctaaatcctaagaaatatcaaggtggcc

SEQ ID NO: 252285 - DNA, 39 bp, Artificial Sequence
  Description of Artificial Sequence: Synthetic oligonucleotide
caacaagatgctaaatcctaagaaatatcaaggtggccc

SEQ ID NO: 252286 - DNA, 40 bp, Artificial Sequence
  Description of Artificial Sequence: Synthetic oligonucleotide
aacaagatgctaaatcctaagaaatatcaaggtggccctg

SEQ ID NO: 252287 - DNA, 39 bp, Artificial Sequence
  Description of Artificial Sequence: Synthetic oligonucleotide
acaagatgctaaatcctaagaaatatcaaggtggccctg

SEQ ID NO: 252288 - DNA, 38 bp, Artificial Sequence
  Description of Artificial Sequence: Synthetic oligonucleotide
caagatgctaaatcctaagaaatatcaaggtggccctg

SEQ ID NO: 252289 - DNA, 44 bp, Artificial Sequence
  Description of Artificial Sequence: Synthetic oligonucleotide
aagatgctaaatcctaagaaatatcaaggtggccctgaattaag

SEQ ID NO: 252290 - DNA, 43 bp, Artificial Sequence
  Description of Artificial Sequence: Synthetic oligonucleotide
agatgctaaatcctaagaaatatcaaggtggccctgaattaag

SEQ ID NO: 252291 - DNA, 42 bp, Artificial Sequence
  Description of Artificial Sequence: Synthetic oligonucleotide
gatgctaaatcctaagaaatatcaaggtggccctgaattaag

SEQ ID NO: 252292 - DNA, 43 bp, Artificial Sequence
  Description of Artificial Sequence: Synthetic oligonucleotide
atgctaaatcctaagaaatatcaaggtggccctgaattaagag

SEQ ID NO: 252293 - DNA, 42 bp, Artificial Sequence
  Description of Artificial Sequence: Synthetic oligonucleotide
tgctaaatcctaagaaatatcaaggtggccctgaattaagag

SEQ ID NO: 252294 - DNA, 41 bp, Artificial Sequence
  Description of Artificial Sequence: Synthetic oligonucleotide
gctaaatcctaagaaatatcaaggtggccctgaattaagag

SEQ ID NO: 252295 - DNA, 50 bp, Artificial Sequence
  Description of Artificial Sequence: Synthetic oligonucleotide
ctaaatcctaagaaatatcaaggtggccctgaattaagagattttatttg

SEQ ID NO: 252296 - DNA, 50 bp, Artificial Sequence
  Description of Artificial Sequence: Synthetic oligonucleotide
taaatcctaagaaatatcaaggtggccctgaattaagagattttatttgc

SEQ ID NO: 252297 - DNA, 49 bp, Artificial Sequence
  Description of Artificial Sequence: Synthetic oligonucleotide
aaatcctaagaaatatcaaggtggccctgaattaagagattttatttgc

SEQ ID NO: 252298 - DNA, 48 bp, Artificial Sequence
  Description of Artificial Sequence: Synthetic oligonucleotide
aatcctaagaaatatcaaggtggccctgaattaagagattttatttgc

SEQ ID NO: 252299 - DNA, 47 bp, Artificial Sequence
  Description of Artificial Sequence: Synthetic oligonucleotide
atcctaagaaatatcaaggtggccctgaattaagagattttatttgc

SEQ ID NO: 252300 - DNA, 46 bp, Artificial Sequence
  Description of Artificial Sequence: Synthetic oligonucleotide
tcctaagaaatatcaaggtggccctgaattaagagattttatttgc

SEQ ID NO: 252301 - DNA, 45 bp, Artificial Sequence
  Description of Artificial Sequence: Synthetic oligonucleotide
cctaagaaatatcaaggtggccctgaattaagagattttatttgc

SEQ ID NO: 252302 - DNA, 48 bp, Artificial Sequence
  Description of Artificial Sequence: Synthetic oligonucleotide
ctaagaaatatcaaggtggccctgaattaagagattttatttgctatc

SEQ ID NO: 252303 - DNA, 50 bp, Artificial Sequence
  Description of Artificial Sequence: Synthetic oligonucleotide
taagaaatatcaaggtggccctgaattaagagattttatttgctatctac

SEQ ID NO: 252304 - DNA, 49 bp, Artificial Sequence
  Description of Artificial Sequence: Synthetic oligonucleotide
aagaaatatcaaggtggccctgaattaagagattttatttgctatctac

SEQ ID NO: 252305 - DNA, 48 bp, Artificial Sequence
  Description of Artificial Sequence: Synthetic oligonucleotide
agaaatatcaaggtggccctgaattaagagattttatttgctatctac

SEQ ID NO: 252306 - DNA, 47 bp, Artificial Sequence
  Description of Artificial Sequence: Synthetic oligonucleotide
gaaatatcaaggtggccctgaattaagagattttatttgctatctac

SEQ ID NO: 252307 - DNA, 50 bp, Artificial Sequence
  Description of Artificial Sequence: Synthetic oligonucleotide
aaatatcaaggtggccctgaattaagagattttatttgctatctactaag

SEQ ID NO: 252308 - DNA, 49 bp, Artificial Sequence
  Description of Artificial Sequence: Synthetic oligonucleotide
aatatcaaggtggccctgaattaagagattttatttgctatctactaag

SEQ ID NO: 252309 - DNA, 48 bp, Artificial Sequence
  Description of Artificial Sequence: Synthetic oligonucleotide
atatcaaggtggccctgaattaagagattttatttgctatctactaag

SEQ ID NO: 252310 - DNA, 47 bp, Artificial Sequence
  Description of Artificial Sequence: Synthetic oligonucleotide
tatcaaggtggccctgaattaagagattttatttgctatctactaag

SEQ ID NO: 252311 - DNA, 46 bp, Artificial Sequence
  Description of Artificial Sequence: Synthetic oligonucleotide
atcaaggtggccctgaattaagagattttatttgctatctactaag

SEQ ID NO: 252312 - DNA, 45 bp, Artificial Sequence
  Description of Artificial Sequence: Synthetic oligonucleotide
tcaaggtggccctgaattaagagattttatttgctatctactaag

SEQ ID NO: 252313 - DNA, 44 bp, Artificial Sequence
  Description of Artificial Sequence: Synthetic oligonucleotide
caaggtggccctgaattaagagattttatttgctatctactaag

SEQ ID NO: 252314 - DNA, 45 bp, Artificial Sequence
  Description of Artificial Sequence: Synthetic oligonucleotide
aaggtggccctgaattaagagattttatttgctatctactaagag

SEQ ID NO: 252315 - DNA, 44 bp, Artificial Sequence
  Description of Artificial Sequence: Synthetic oligonucleotide
aggtggccctgaattaagagattttatttgctatctactaagag

SEQ ID NO: 252316 - DNA, 43 bp, Artificial Sequence
  Description of Artificial Sequence: Synthetic oligonucleotide
ggtggccctgaattaagagattttatttgctatctactaagag

SEQ ID NO: 252317 - DNA, 45 bp, Artificial Sequence
  Description of Artificial Sequence: Synthetic oligonucleotide
gtggccctgaattaagagattttatttgctatctactaagagaag

SEQ ID NO: 252318 - DNA, 45 bp, Artificial Sequence
  Description of Artificial Sequence: Synthetic oligonucleotide
tggccctgaattaagagattttatttgctatctactaagagaagc

SEQ ID NO: 252319 - DNA, 44 bp, Artificial Sequence
  Description of Artificial Sequence: Synthetic oligonucleotide
ggccctgaattaagagattttatttgctatctactaagagaagc

SEQ ID NO: 252320 - DNA, 46 bp, Artificial Sequence
  Description of Artificial Sequence: Synthetic oligonucleotide
gccctgaattaagagattttatttgctatctactaagagaagcaac

SEQ ID NO: 252321 - DNA, 49 bp, Artificial Sequence
  Description of Artificial Sequence: Synthetic oligonucleotide
ccctgaattaagagattttatttgctatctactaagagaagcaacaaac

SEQ ID NO: 252322 - DNA, 49 bp, Artificial Sequence
  Description of Artificial Sequence: Synthetic oligonucleotide
cctgaattaagagattttatttgctatctactaagagaagcaacaaacc

SEQ ID NO: 252323 - DNA, 49 bp, Artificial Sequence
  Description of Artificial Sequence: Synthetic oligonucleotide
ctgaattaagagattttatttgctatctactaagagaagcaacaaaccc

SEQ ID NO: 252324 - DNA, 49 bp, Artificial Sequence
  Description of Artificial Sequence: Synthetic oligonucleotide
tgaattaagagattttatttgctatctactaagagaagcaacaaacccc

SEQ ID NO: 252325 - DNA, 48 bp, Artificial Sequence
  Description of Artificial Sequence: Synthetic oligonucleotide
gaattaagagattttatttgctatctactaagagaagcaacaaacccc

SEQ ID NO: 252326 - DNA, 48 bp, Artificial Sequence
  Description of Artificial Sequence: Synthetic oligonucleotide
aattaagagattttatttgctatctactaagagaagcaacaaaccccg

SEQ ID NO: 252327 - DNA, 47 bp, Artificial Sequence
  Description of Artificial Sequence: Synthetic oligonucleotide
attaagagattttatttgctatctactaagagaagcaacaaaccccg

SEQ ID NO: 252328 - DNA, 46 bp, Artificial Sequence
  Description of Artificial Sequence: Synthetic oligonucleotide
ttaagagattttatttgctatctactaagagaagcaacaaaccccg

SEQ ID NO: 252329 - DNA, 45 bp, Artificial Sequence
  Description of Artificial Sequence: Synthetic oligonucleotide
taagagattttatttgctatctactaagagaagcaacaaaccccg

SEQ ID NO: 252330 - DNA, 44 bp, Artificial Sequence
  Description of Artificial Sequence: Synthetic oligonucleotide
aagagattttatttgctatctactaagagaagcaacaaaccccg

SEQ ID NO: 252331 - DNA, 43 bp, Artificial Sequence
  Description of Artificial Sequence: Synthetic oligonucleotide
agagattttatttgctatctactaagagaagcaacaaaccccg

SEQ ID NO: 252332 - DNA, 42 bp, Artificial Sequence
  Description of Artificial Sequence: Synthetic oligonucleotide
gagattttatttgctatctactaagagaagcaacaaaccccg

SEQ ID NO: 252333 - DNA, 42 bp, Artificial Sequence
  Description of Artificial Sequence: Synthetic oligonucleotide
agattttatttgctatctactaagagaagcaacaaaccccgc

SEQ ID NO: 252334 - DNA, 41 bp, Artificial Sequence
  Description of Artificial Sequence: Synthetic oligonucleotide
gattttatttgctatctactaagagaagcaacaaaccccgc

SEQ ID NO: 252335 - DNA, 42 bp, Artificial Sequence
  Description of Artificial Sequence: Synthetic oligonucleotide
attttatttgctatctactaagagaagcaacaaaccccgctg

SEQ ID NO: 252336 - DNA, 41 bp, Artificial Sequence
  Description of Artificial Sequence: Synthetic oligonucleotide
ttttatttgctatctactaagagaagcaacaaaccccgctg

SEQ ID NO: 252337 - DNA, 40 bp, Artificial Sequence
  Description of Artificial Sequence: Synthetic oligonucleotide
tttatttgctatctactaagagaagcaacaaaccccgctg

SEQ ID NO: 252338 - DNA, 39 bp, Artificial Sequence
  Description of Artificial Sequence: Synthetic oligonucleotide
ttatttgctatctactaagagaagcaacaaaccccgctg

SEQ ID NO: 252339 - DNA, 38 bp, Artificial Sequence
  Description of Artificial Sequence: Synthetic oligonucleotide
tatttgctatctactaagagaagcaacaaaccccgctg

SEQ ID NO: 252340 - DNA, 37 bp, Artificial Sequence
  Description of Artificial Sequence: Synthetic oligonucleotide
atttgctatctactaagagaagcaacaaaccccgctg

SEQ ID NO: 252341 - DNA, 36 bp, Artificial Sequence
  Description of Artificial Sequence: Synthetic oligonucleotide
tttgctatctactaagagaagcaacaaaccccgctg

SEQ ID NO: 252342 - DNA, 35 bp, Artificial Sequence
  Description of Artificial Sequence: Synthetic oligonucleotide
ttgctatctactaagagaagcaacaaaccccgctg

SEQ ID NO: 252343 - DNA, 34 bp, Artificial Sequence
  Description of Artificial Sequence: Synthetic oligonucleotide
tgctatctactaagagaagcaacaaaccccgctg

SEQ ID NO: 252344 - DNA, 33 bp, Artificial Sequence
  Description of Artificial Sequence: Synthetic oligonucleotide
gctatctactaagagaagcaacaaaccccgctg

SEQ ID NO: 252345 - DNA, 38 bp, Artificial Sequence
  Description of Artificial Sequence: Synthetic oligonucleotide
ctatctactaagagaagcaacaaaccccgctgtaattc

SEQ ID NO: 252346 - DNA, 40 bp, Artificial Sequence
  Description of Artificial Sequence: Synthetic oligonucleotide
tatctactaagagaagcaacaaaccccgctgtaattctag

SEQ ID NO: 252347 - DNA, 39 bp, Artificial Sequence
  Description of Artificial Sequence: Synthetic oligonucleotide
atctactaagagaagcaacaaaccccgctgtaattctag

SEQ ID NO: 252348 - DNA, 38 bp, Artificial Sequence
  Description of Artificial Sequence: Synthetic oligonucleotide
tctactaagagaagcaacaaaccccgctgtaattctag

SEQ ID NO: 252349 - DNA, 37 bp, Artificial Sequence
  Description of Artificial Sequence: Synthetic oligonucleotide
ctactaagagaagcaacaaaccccgctgtaattctag

SEQ ID NO: 252350 - DNA, 39 bp, Artificial Sequence
  Description of Artificial Sequence: Synthetic oligonucleotide
tactaagagaagcaacaaaccccgctgtaattctagaag

SEQ ID NO: 252351 - DNA, 38 bp, Artificial Sequence
  Description of Artificial Sequence: Synthetic oligonucleotide
actaagagaagcaacaaaccccgctgtaattctagaag

SEQ ID NO: 252352 - DNA, 37 bp, Artificial Sequence
  Description of Artificial Sequence: Synthetic oligonucleotide
ctaagagaagcaacaaaccccgctgtaattctagaag

SEQ ID NO: 252353 - DNA, 42 bp, Artificial Sequence
  Description of Artificial Sequence: Synthetic oligonucleotide
taagagaagcaacaaaccccgctgtaattctagaagaaaatc

SEQ ID NO: 252354 - DNA, 41 bp, Artificial Sequence
  Description of Artificial Sequence: Synthetic oligonucleotide
aagagaagcaacaaaccccgctgtaattctagaagaaaatc

SEQ ID NO: 252355 - DNA, 40 bp, Artificial Sequence
  Description of Artificial Sequence: Synthetic oligonucleotide
agagaagcaacaaaccccgctgtaattctagaagaaaatc

SEQ ID NO: 252356 - DNA, 39 bp, Artificial Sequence
  Description of Artificial Sequence: Synthetic oligonucleotide
gagaagcaacaaaccccgctgtaattctagaagaaaatc

SEQ ID NO: 252357 - DNA, 39 bp, Artificial Sequence
  Description of Artificial Sequence: Synthetic oligonucleotide
agaagcaacaaaccccgctgtaattctagaagaaaatcc

SEQ ID NO: 252358 - DNA, 38 bp, Artificial Sequence
  Description of Artificial Sequence: Synthetic oligonucleotide
gaagcaacaaaccccgctgtaattctagaagaaaatcc

SEQ ID NO: 252359 - DNA, 38 bp, Artificial Sequence
  Description of Artificial Sequence: Synthetic oligonucleotide
aagcaacaaaccccgctgtaattctagaagaaaatccc

SEQ ID NO: 252360 - DNA, 37 bp, Artificial Sequence
  Description of Artificial Sequence: Synthetic oligonucleotide
agcaacaaaccccgctgtaattctagaagaaaatccc

SEQ ID NO: 252361 - DNA, 36 bp, Artificial Sequence
  Description of Artificial Sequence: Synthetic oligonucleotide
gcaacaaaccccgctgtaattctagaagaaaatccc

SEQ ID NO: 252362 - DNA, 38 bp, Artificial Sequence
  Description of Artificial Sequence: Synthetic oligonucleotide
caacaaaccccgctgtaattctagaagaaaatcccaag

SEQ ID NO: 252363 - DNA, 40 bp, Artificial Sequence
  Description of Artificial Sequence: Synthetic oligonucleotide
aacaaaccccgctgtaattctagaagaaaatcccaagaag

SEQ ID NO: 252364 - DNA, 39 bp, Artificial Sequence
  Description of Artificial Sequence: Synthetic oligonucleotide
acaaaccccgctgtaattctagaagaaaatcccaagaag

SEQ ID NO: 252365 - DNA, 38 bp, Artificial Sequence
  Description of Artificial Sequence: Synthetic oligonucleotide
caaaccccgctgtaattctagaagaaaatcccaagaag

SEQ ID NO: 252366 - DNA, 40 bp, Artificial Sequence
  Description of Artificial Sequence: Synthetic oligonucleotide
aaaccccgctgtaattctagaagaaaatcccaagaagtag

SEQ ID NO: 252367 - DNA, 39 bp, Artificial Sequence
  Description of Artificial Sequence: Synthetic oligonucleotide
aaccccgctgtaattctagaagaaaatcccaagaagtag

SEQ ID NO: 252368 - DNA, 38 bp, Artificial Sequence
  Description of Artificial Sequence: Synthetic oligonucleotide
accccgctgtaattctagaagaaaatcccaagaagtag

SEQ ID NO: 252369 - DNA, 37 bp, Artificial Sequence
  Description of Artificial Sequence: Synthetic oligonucleotide
ccccgctgtaattctagaagaaaatcccaagaagtag

SEQ ID NO: 252370 - DNA, 39 bp, Artificial Sequence
  Description of Artificial Sequence: Synthetic oligonucleotide
cccgctgtaattctagaagaaaatcccaagaagtagaag

SEQ ID NO: 252371 - DNA, 41 bp, Artificial Sequence
  Description of Artificial Sequence: Synthetic oligonucleotide
ccgctgtaattctagaagaaaatcccaagaagtagaagaag

SEQ ID NO: 252372 - DNA, 41 bp, Artificial Sequence
  Description of Artificial Sequence: Synthetic oligonucleotide
cgctgtaattctagaagaaaatcccaagaagtagaagaagg

SEQ ID NO: 252373 - DNA, 41 bp, Artificial Sequence
  Description of Artificial Sequence: Synthetic oligonucleotide
gctgtaattctagaagaaaatcccaagaagtagaagaaggg

SEQ ID NO: 252374 - DNA, 42 bp, Artificial Sequence
  Description of Artificial Sequence: Synthetic oligonucleotide
ctgtaattctagaagaaaatcccaagaagtagaagaagggac

SEQ ID NO: 252375 - DNA, 43 bp, Artificial Sequence
  Description of Artificial Sequence: Synthetic oligonucleotide
tgtaattctagaagaaaatcccaagaagtagaagaagggacag

SEQ ID NO: 252376 - DNA, 42 bp, Artificial Sequence
  Description of Artificial Sequence: Synthetic oligonucleotide
gtaattctagaagaaaatcccaagaagtagaagaagggacag

SEQ ID NO: 252377 - DNA, 42 bp, Artificial Sequence
  Description of Artificial Sequence: Synthetic oligonucleotide
taattctagaagaaaatcccaagaagtagaagaagggacagg

SEQ ID NO: 252378 - DNA, 41 bp, Artificial Sequence
  Description of Artificial Sequence: Synthetic oligonucleotide
aattctagaagaaaatcccaagaagtagaagaagggacagg

SEQ ID NO: 252379 - DNA, 40 bp, Artificial Sequence
  Description of Artificial Sequence: Synthetic oligonucleotide
attctagaagaaaatcccaagaagtagaagaagggacagg

SEQ ID NO: 252380 - DNA, 39 bp, Artificial Sequence
  Description of Artificial Sequence: Synthetic oligonucleotide
ttctagaagaaaatcccaagaagtagaagaagggacagg

SEQ ID NO: 252381 - DNA, 38 bp, Artificial Sequence
  Description of Artificial Sequence: Synthetic oligonucleotide
tctagaagaaaatcccaagaagtagaagaagggacagg

SEQ ID NO: 252382 - DNA, 37 bp, Artificial Sequence
  Description of Artificial Sequence: Synthetic oligonucleotide
ctagaagaaaatcccaagaagtagaagaagggacagg

SEQ ID NO: 252383 - DNA, 38 bp, Artificial Sequence
  Description of Artificial Sequence: Synthetic oligonucleotide
tagaagaaaatcccaagaagtagaagaagggacaggag

SEQ ID NO: 252384 - DNA, 37 bp, Artificial Sequence
  Description of Artificial Sequence: Synthetic oligonucleotide
agaagaaaatcccaagaagtagaagaagggacaggag

SEQ ID NO: 252385 - DNA, 36 bp, Artificial Sequence
  Description of Artificial Sequence: Synthetic oligonucleotide
gaagaaaatcccaagaagtagaagaagggacaggag

SEQ ID NO: 252386 - DNA, 36 bp, Artificial Sequence
  Description of Artificial Sequence: Synthetic oligonucleotide
aagaaaatcccaagaagtagaagaagggacaggagg

SEQ ID NO: 252387 - DNA, 35 bp, Artificial Sequence
  Description of Artificial Sequence: Synthetic oligonucleotide
agaaaatcccaagaagtagaagaagggacaggagg

SEQ ID NO: 252388 - DNA, 34 bp, Artificial Sequence
  Description of Artificial Sequence: Synthetic oligonucleotide
gaaaatcccaagaagtagaagaagggacaggagg

SEQ ID NO: 252389 - DNA, 36 bp, Artificial Sequence
  Description of Artificial Sequence: Synthetic oligonucleotide
aaaatcccaagaagtagaagaagggacaggaggaac

SEQ ID NO: 252390 - DNA, 35 bp, Artificial Sequence
  Description of Artificial Sequence: Synthetic oligonucleotide
aaatcccaagaagtagaagaagggacaggaggaac

SEQ ID NO: 252391 - DNA, 34 bp, Artificial Sequence
  Description of Artificial Sequence: Synthetic oligonucleotide
aatcccaagaagtagaagaagggacaggaggaac

SEQ ID NO: 252392 - DNA, 33 bp, Artificial Sequence
  Description of Artificial Sequence: Synthetic oligonucleotide
atcccaagaagtagaagaagggacaggaggaac

SEQ ID NO: 252393 - DNA, 32 bp, Artificial Sequence
  Description of Artificial Sequence: Synthetic oligonucleotide
tcccaagaagtagaagaagggacaggaggaac

SEQ ID NO: 252394 - DNA, 31 bp, Artificial Sequence
  Description of Artificial Sequence: Synthetic oligonucleotide
cccaagaagtagaagaagggacaggaggaac

SEQ ID NO: 252395 - DNA, 32 bp, Artificial Sequence
  Description of Artificial Sequence: Synthetic oligonucleotide
ccaagaagtagaagaagggacaggaggaactc

SEQ ID NO: 252396 - DNA, 31 bp, Artificial Sequence
  Description of Artificial Sequence: Synthetic oligonucleotide
atcgtgtttctggccctcaaatcgtcccttg

SEQ ID NO: 252397 - DNA, 30 bp, Artificial Sequence
  Description of Artificial Sequence: Synthetic oligonucleotide
tcgtgtttctggccctcaaatcgtcccttg

SEQ ID NO: 252398 - DNA, 29 bp, Artificial Sequence
  Description of Artificial Sequence: Synthetic oligonucleotide
cgtgtttctggccctcaaatcgtcccttg

SEQ ID NO: 252399 - DNA, 29 bp, Artificial Sequence
  Description of Artificial Sequence: Synthetic oligonucleotide
gtgtttctggccctcaaatcgtcccttgc

SEQ ID NO: 252400 - DNA, 31 bp, Artificial Sequence
  Description of Artificial Sequence: Synthetic oligonucleotide
tgtttctggccctcaaatcgtcccttgctac

SEQ ID NO: 252401 - DNA, 30 bp, Artificial Sequence
  Description of Artificial Sequence: Synthetic oligonucleotide
gtttctggccctcaaatcgtcccttgctac

SEQ ID NO: 252402 - DNA, 30 bp, Artificial Sequence
  Description of Artificial Sequence: Synthetic oligonucleotide
tttctggccctcaaatcgtcccttgctacc

SEQ ID NO: 252403 - DNA, 29 bp, Artificial Sequence
  Description of Artificial Sequence: Synthetic oligonucleotide
ttctggccctcaaatcgtcccttgctacc

SEQ ID NO: 252404 - DNA, 28 bp, Artificial Sequence
  Description of Artificial Sequence: Synthetic oligonucleotide
tctggccctcaaatcgtcccttgctacc

SEQ ID NO: 252405 - DNA, 27 bp, Artificial Sequence
  Description of Artificial Sequence: Synthetic oligonucleotide
ctggccctcaaatcgtcccttgctacc

SEQ ID NO: 252406 - DNA, 29 bp, Artificial Sequence
  Description of Artificial Sequence: Synthetic oligonucleotide
tggccctcaaatcgtcccttgctaccatg

SEQ ID NO: 252407 - DNA, 28 bp, Artificial Sequence
  Description of Artificial Sequence: Synthetic oligonucleotide
ggccctcaaatcgtcccttgctaccatg

SEQ ID NO: 252408 - DNA, 29 bp, Artificial Sequence
  Description of Artificial Sequence: Synthetic oligonucleotide
gccctcaaatcgtcccttgctaccatgtc

SEQ ID NO: 252409 - DNA, 33 bp, Artificial Sequence
  Description of Artificial Sequence: Synthetic oligonucleotide
ccctcaaatcgtcccttgctaccatgtcaattc

SEQ ID NO: 252410 - DNA, 35 bp, Artificial Sequence
  Description of Artificial Sequence: Synthetic oligonucleotide
cctcaaatcgtcccttgctaccatgtcaattctac

SEQ ID NO: 252411 - DNA, 38 bp, Artificial Sequence
  Description of Artificial Sequence: Synthetic oligonucleotide
ctcaaatcgtcccttgctaccatgtcaattctactttg

SEQ ID NO: 252412 - DNA, 38 bp, Artificial Sequence
  Description of Artificial Sequence: Synthetic oligonucleotide
tcaaatcgtcccttgctaccatgtcaattctactttgc

SEQ ID NO: 252413 - DNA, 37 bp, Artificial Sequence
  Description of Artificial Sequence: Synthetic oligonucleotide
caaatcgtcccttgctaccatgtcaattctactttgc

SEQ ID NO: 252414 - DNA, 38 bp, Artificial Sequence
  Description of Artificial Sequence: Synthetic oligonucleotide
aaatcgtcccttgctaccatgtcaattctactttgctc

SEQ ID NO: 252415 - DNA, 37 bp, Artificial Sequence
  Description of Artificial Sequence: Synthetic oligonucleotide
aatcgtcccttgctaccatgtcaattctactttgctc

SEQ ID NO: 252416 - DNA, 36 bp, Artificial Sequence
  Description of Artificial Sequence: Synthetic oligonucleotide
atcgtcccttgctaccatgtcaattctactttgctc

SEQ ID NO: 252417 - DNA, 35 bp, Artificial Sequence
  Description of Artificial Sequence: Synthetic oligonucleotide
tcgtcccttgctaccatgtcaattctactttgctc

SEQ ID NO: 252418 - DNA, 34 bp, Artificial Sequence
  Description of Artificial Sequence: Synthetic oligonucleotide
cgtcccttgctaccatgtcaattctactttgctc

SEQ ID NO: 252419 - DNA, 35 bp, Artificial Sequence
  Description of Artificial Sequence: Synthetic oligonucleotide
gtcccttgctaccatgtcaattctactttgctcac

SEQ ID NO: 252420 - DNA, 36 bp, Artificial Sequence
  Description of Artificial Sequence: Synthetic oligonucleotide
tcccttgctaccatgtcaattctactttgctcactg

SEQ ID NO: 252421 - DNA, 35 bp, Artificial Sequence
  Description of Artificial Sequence: Synthetic oligonucleotide
cccttgctaccatgtcaattctactttgctcactg

SEQ ID NO: 252422 - DNA, 37 bp, Artificial Sequence
  Description of Artificial Sequence: Synthetic oligonucleotide
ccttgctaccatgtcaattctactttgctcactgttc

SEQ ID NO: 252423 - DNA, 37 bp, Artificial Sequence
  Description of Artificial Sequence: Synthetic oligonucleotide
cttgctaccatgtcaattctactttgctcactgttcg

SEQ ID NO: 252424 - DNA, 37 bp, Artificial Sequence
  Description of Artificial Sequence: Synthetic oligonucleotide
ttgctaccatgtcaattctactttgctcactgttcgc

SEQ ID NO: 252425 - DNA, 36 bp, Artificial Sequence
  Description of Artificial Sequence: Synthetic oligonucleotide
tgctaccatgtcaattctactttgctcactgttcgc

SEQ ID NO: 252426 - DNA, 35 bp, Artificial Sequence
  Description of Artificial Sequence: Synthetic oligonucleotide
gctaccatgtcaattctactttgctcactgttcgc

SEQ ID NO: 252427 - DNA, 36 bp, Artificial Sequence
  Description of Artificial Sequence: Synthetic oligonucleotide
ctaccatgtcaattctactttgctcactgttcgctc

SEQ ID NO: 252428 - DNA, 37 bp, Artificial Sequence
  Description of Artificial Sequence: Synthetic oligonucleotide
taccatgtcaattctactttgctcactgttcgctctc

SEQ ID NO: 252429 - DNA, 36 bp, Artificial Sequence
  Description of Artificial Sequence: Synthetic oligonucleotide
accatgtcaattctactttgctcactgttcgctctc

SEQ ID NO: 252430 - DNA, 35 bp, Artificial Sequence
  Description of Artificial Sequence: Synthetic oligonucleotide
ccatgtcaattctactttgctcactgttcgctctc

SEQ ID NO: 252431 - DNA, 39 bp, Artificial Sequence
  Description of Artificial Sequence: Synthetic oligonucleotide
catgtcaattctactttgctcactgttcgctctcttatc

SEQ ID NO: 252432 - DNA, 40 bp, Artificial Sequence
  Description of Artificial Sequence: Synthetic oligonucleotide
atgtcaattctactttgctcactgttcgctctcttatctg

SEQ ID NO: 252433 - DNA, 39 bp, Artificial Sequence
  Description of Artificial Sequence: Synthetic oligonucleotide
tgtcaattctactttgctcactgttcgctctcttatctg

SEQ ID NO: 252434 - DNA, 38 bp, Artificial Sequence
  Description of Artificial Sequence: Synthetic oligonucleotide
gtcaattctactttgctcactgttcgctctcttatctg

SEQ ID NO: 252435 - DNA, 39 bp, Artificial Sequence
  Description of Artificial Sequence: Synthetic oligonucleotide
tcaattctactttgctcactgttcgctctcttatctgtg

SEQ ID NO: 252436 - DNA, 38 bp, Artificial Sequence
  Description of Artificial Sequence: Synthetic oligonucleotide
caattctactttgctcactgttcgctctcttatctgtg

SEQ ID NO: 252437 - DNA, 39 bp, Artificial Sequence
  Description of Artificial Sequence: Synthetic oligonucleotide
aattctactttgctcactgttcgctctcttatctgtgtc

SEQ ID NO: 252438 - DNA, 38 bp, Artificial Sequence
  Description of Artificial Sequence: Synthetic oligonucleotide
attctactttgctcactgttcgctctcttatctgtgtc

SEQ ID NO: 252439 - DNA, 37 bp, Artificial Sequence
  Description of Artificial Sequence: Synthetic oligonucleotide
ttctactttgctcactgttcgctctcttatctgtgtc

SEQ ID NO: 252440 - DNA, 36 bp, Artificial Sequence
  Description of Artificial Sequence: Synthetic oligonucleotide
tctactttgctcactgttcgctctcttatctgtgtc

SEQ ID NO: 252441 - DNA, 35 bp, Artificial Sequence
  Description of Artificial Sequence: Synthetic oligonucleotide
ctactttgctcactgttcgctctcttatctgtgtc

SEQ ID NO: 252442 - DNA, 35 bp, Artificial Sequence
  Description of Artificial Sequence: Synthetic oligonucleotide
tactttgctcactgttcgctctcttatctgtgtcc

SEQ ID NO: 252443 - DNA, 34 bp, Artificial Sequence
  Description of Artificial Sequence: Synthetic oligonucleotide
actttgctcactgttcgctctcttatctgtgtcc

SEQ ID NO: 252444 - DNA, 33 bp, Artificial Sequence
  Description of Artificial Sequence: Synthetic oligonucleotide
ctttgctcactgttcgctctcttatctgtgtcc

SEQ ID NO: 252445 - DNA, 34 bp, Artificial Sequence
  Description of Artificial Sequence: Synthetic oligonucleotide
tttgctcactgttcgctctcttatctgtgtccag

SEQ ID NO: 252446 - DNA, 33 bp, Artificial Sequence
  Description of Artificial Sequence: Synthetic oligonucleotide
ttgctcactgttcgctctcttatctgtgtccag

SEQ ID NO: 252447 - DNA, 32 bp, Artificial Sequence
  Description of Artificial Sequence: Synthetic oligonucleotide
tgctcactgttcgctctcttatctgtgtccag

SEQ ID NO: 252448 - DNA, 31 bp, Artificial Sequence
  Description of Artificial Sequence: Synthetic oligonucleotide
gctcactgttcgctctcttatctgtgtccag

SEQ ID NO: 252449 - DNA, 32 bp, Artificial Sequence
  Description of Artificial Sequence: Synthetic oligonucleotide
ctcactgttcgctctcttatctgtgtccagtc

SEQ ID NO: 252450 - DNA, 32 bp, Artificial Sequence
  Description of Artificial Sequence: Synthetic oligonucleotide
tcactgttcgctctcttatctgtgtccagtcc

SEQ ID NO: 252451 - DNA, 31 bp, Artificial Sequence
  Description of Artificial Sequence: Synthetic oligonucleotide
cactgttcgctctcttatctgtgtccagtcc

SEQ ID NO: 252452 - DNA, 33 bp, Artificial Sequence
  Description of Artificial Sequence: Synthetic oligonucleotide
actgttcgctctcttatctgtgtccagtccttc

SEQ ID NO: 252453 - DNA, 32 bp, Artificial Sequence
  Description of Artificial Sequence: Synthetic oligonucleotide
ctgttcgctctcttatctgtgtccagtccttc

SEQ ID NO: 252454 - DNA, 34 bp, Artificial Sequence
  Description of Artificial Sequence: Synthetic oligonucleotide
tgttcgctctcttatctgtgtccagtccttcatg

SEQ ID NO: 252455 - DNA, 33 bp, Artificial Sequence
  Description of Artificial Sequence: Synthetic oligonucleotide
gttcgctctcttatctgtgtccagtccttcatg

SEQ ID NO: 252456 - DNA, 33 bp, Artificial Sequence
  Description of Artificial Sequence: Synthetic oligonucleotide
ttcgctctcttatctgtgtccagtccttcatgc

SEQ ID NO: 252457 - DNA, 32 bp, Artificial Sequence
  Description of Artificial Sequence: Synthetic oligonucleotide
tcgctctcttatctgtgtccagtccttcatgc

SEQ ID NO: 252458 - DNA, 31 bp, Artificial Sequence
  Description of Artificial Sequence: Synthetic oligonucleotide
cgctctcttatctgtgtccagtccttcatgc

SEQ ID NO: 252459 - DNA, 32 bp, Artificial Sequence
  Description of Artificial Sequence: Synthetic oligonucleotide
gctctcttatctgtgtccagtccttcatgctg

SEQ ID NO: 252460 - DNA, 33 bp, Artificial Sequence
  Description of Artificial Sequence: Synthetic oligonucleotide
ctctcttatctgtgtccagtccttcatgctgtc

SEQ ID NO: 252461 - DNA, 34 bp, Artificial Sequence
  Description of Artificial Sequence: Synthetic oligonucleotide
tctcttatctgtgtccagtccttcatgctgtcag

SEQ ID NO: 252462 - DNA, 33 bp, Artificial Sequence
  Description of Artificial Sequence: Synthetic oligonucleotide
ctcttatctgtgtccagtccttcatgctgtcag

SEQ ID NO: 252463 - DNA, 34 bp, Artificial Sequence
  Description of Artificial Sequence: Synthetic oligonucleotide
tcttatctgtgtccagtccttcatgctgtcagag

SEQ ID NO: 252464 - DNA, 33 bp, Artificial Sequence
  Description of Artificial Sequence: Synthetic oligonucleotide
cttatctgtgtccagtccttcatgctgtcagag

SEQ ID NO: 252465 - DNA, 33 bp, Artificial Sequence
  Description of Artificial Sequence: Synthetic oligonucleotide
ttatctgtgtccagtccttcatgctgtcagagc

SEQ ID NO: 252466 - DNA, 32 bp, Artificial Sequence
  Description of Artificial Sequence: Synthetic oligonucleotide
tatctgtgtccagtccttcatgctgtcagagc

SEQ ID NO: 252467 - DNA, 31 bp, Artificial Sequence
  Description of Artificial Sequence: Synthetic oligonucleotide
atctgtgtccagtccttcatgctgtcagagc

SEQ ID NO: 252468 - DNA, 30 bp, Artificial Sequence
  Description of Artificial Sequence: Synthetic oligonucleotide
tctgtgtccagtccttcatgctgtcagagc

SEQ ID NO: 252469 - DNA, 29 bp, Artificial Sequence
  Description of Artificial Sequence: Synthetic oligonucleotide
ctgtgtccagtccttcatgctgtcagagc

SEQ ID NO: 252470 - DNA, 30 bp, Artificial Sequence
  Description of Artificial Sequence: Synthetic oligonucleotide
tgtgtccagtccttcatgctgtcagagctc

SEQ ID NO: 252471 - DNA, 29 bp, Artificial Sequence
  Description of Artificial Sequence: Synthetic oligonucleotide
gtgtccagtccttcatgctgtcagagctc

SEQ ID NO: 252472 - DNA, 30 bp, Artificial Sequence
  Description of Artificial Sequence: Synthetic oligonucleotide
tgtccagtccttcatgctgtcagagctctg

SEQ ID NO: 252473 - DNA, 29 bp, Artificial Sequence
  Description of Artificial Sequence: Synthetic oligonucleotide
gtccagtccttcatgctgtcagagctctg

SEQ ID NO: 252474 - DNA, 31 bp, Artificial Sequence
  Description of Artificial Sequence: Synthetic oligonucleotide
tccagtccttcatgctgtcagagctctgaag

SEQ ID NO: 252475 - DNA, 30 bp, Artificial Sequence
  Description of Artificial Sequence: Synthetic oligonucleotide
ccagtccttcatgctgtcagagctctgaag

SEQ ID NO: 252476 - DNA, 30 bp, Artificial Sequence
  Description of Artificial Sequence: Synthetic oligonucleotide
cagtccttcatgctgtcagagctctgaagc

SEQ ID NO: 252477 - DNA, 32 bp, Artificial Sequence
  Description of Artificial Sequence: Synthetic oligonucleotide
agtccttcatgctgtcagagctctgaagcatg

SEQ ID NO: 252478 - DNA, 31 bp, Artificial Sequence
  Description of Artificial Sequence: Synthetic oligonucleotide
gtccttcatgctgtcagagctctgaagcatg

SEQ ID NO: 252479 - DNA, 32 bp, Artificial Sequence
  Description of Artificial Sequence: Synthetic oligonucleotide
tccttcatgctgtcagagctctgaagcatgtc

SEQ ID NO: 252480 - DNA, 31 bp, Artificial Sequence
  Description of Artificial Sequence: Synthetic oligonucleotide
ccttcatgctgtcagagctctgaagcatgtc

SEQ ID NO: 252481 - DNA, 31 bp, Artificial Sequence
  Description of Artificial Sequence: Synthetic oligonucleotide
cttcatgctgtcagagctctgaagcatgtcc

SEQ ID NO: 252482 - DNA, 35 bp, Artificial Sequence
  Description of Artificial Sequence: Synthetic oligonucleotide
ttcatgctgtcagagctctgaagcatgtccaaaac

SEQ ID NO: 252483 - DNA, 34 bp, Artificial Sequence
  Description of Artificial Sequence: Synthetic oligonucleotide
tcatgctgtcagagctctgaagcatgtccaaaac

SEQ ID NO: 252484 - DNA, 33 bp, Artificial Sequence
  Description of Artificial Sequence: Synthetic oligonucleotide
catgctgtcagagctctgaagcatgtccaaaac

SEQ ID NO: 252485 - DNA, 33 bp, Artificial Sequence
  Description of Artificial Sequence: Synthetic oligonucleotide
atgctgtcagagctctgaagcatgtccaaaacg

SEQ ID NO: 252486 - DNA, 32 bp, Artificial Sequence
  Description of Artificial Sequence: Synthetic oligonucleotide
tgctgtcagagctctgaagcatgtccaaaacg

SEQ ID NO: 252487 - DNA, 31 bp, Artificial Sequence
  Description of Artificial Sequence: Synthetic oligonucleotide
gctgtcagagctctgaagcatgtccaaaacg

SEQ ID NO: 252488 - DNA, 33 bp, Artificial Sequence
  Description of Artificial Sequence: Synthetic oligonucleotide
ctgtcagagctctgaagcatgtccaaaacgaag

SEQ ID NO: 252489 - DNA, 34 bp, Artificial Sequence
  Description of Artificial Sequence: Synthetic oligonucleotide
tgtcagagctctgaagcatgtccaaaacgaagtg

SEQ ID NO: 252490 - DNA, 33 bp, Artificial Sequence
  Description of Artificial Sequence: Synthetic oligonucleotide
gtcagagctctgaagcatgtccaaaacgaagtg

SEQ ID NO: 252491 - DNA, 35 bp, Artificial Sequence
  Description of Artificial Sequence: Synthetic oligonucleotide
tcagagctctgaagcatgtccaaaacgaagtgatg

SEQ ID NO: 252492 - DNA, 34 bp, Artificial Sequence
  Description of Artificial Sequence: Synthetic oligonucleotide
cagagctctgaagcatgtccaaaacgaagtgatg

SEQ ID NO: 252493 - DNA, 34 bp, Artificial Sequence
  Description of Artificial Sequence: Synthetic oligonucleotide
agagctctgaagcatgtccaaaacgaagtgatgg

SEQ ID NO: 252494 - DNA, 33 bp, Artificial Sequence
  Description of Artificial Sequence: Synthetic oligonucleotide
gagctctgaagcatgtccaaaacgaagtgatgg

SEQ ID NO: 252495 - DNA, 33 bp, Artificial Sequence
  Description of Artificial Sequence: Synthetic oligonucleotide
agctctgaagcatgtccaaaacgaagtgatggg

SEQ ID NO: 252496 - DNA, 32 bp, Artificial Sequence
  Description of Artificial Sequence: Synthetic oligonucleotide
gctctgaagcatgtccaaaacgaagtgatggg

SEQ ID NO: 252497 - DNA, 33 bp, Artificial Sequence
  Description of Artificial Sequence: Synthetic oligonucleotide
ctctgaagcatgtccaaaacgaagtgatgggtc

SEQ ID NO: 252498 - DNA, 34 bp, Artificial Sequence
  Description of Artificial Sequence: Synthetic oligonucleotide
tctgaagcatgtccaaaacgaagtgatgggtcac

SEQ ID NO: 252499 - DNA, 33 bp, Artificial Sequence
  Description of Artificial Sequence: Synthetic oligonucleotide
ctgaagcatgtccaaaacgaagtgatgggtcac

SEQ ID NO: 252500 - DNA, 33 bp, Artificial Sequence
  Description of Artificial Sequence: Synthetic oligonucleotide
tgaagcatgtccaaaacgaagtgatgggtcacc

SEQ ID NO: 252501 - DNA, 32 bp, Artificial Sequence
  Description of Artificial Sequence: Synthetic oligonucleotide
gaagcatgtccaaaacgaagtgatgggtcacc

SEQ ID NO: 252502 - DNA, 36 bp, Artificial Sequence
  Description of Artificial Sequence: Synthetic oligonucleotide
aagcatgtccaaaacgaagtgatgggtcaccatttc

SEQ ID NO: 252503 - DNA, 35 bp, Artificial Sequence
  Description of Artificial Sequence: Synthetic oligonucleotide
agcatgtccaaaacgaagtgatgggtcaccatttc

SEQ ID NO: 252504 - DNA, 34 bp, Artificial Sequence
  Description of Artificial Sequence: Synthetic oligonucleotide
gcatgtccaaaacgaagtgatgggtcaccatttc

SEQ ID NO: 252505 - DNA, 34 bp, Artificial Sequence
  Description of Artificial Sequence: Synthetic oligonucleotide
catgtccaaaacgaagtgatgggtcaccatttcg

SEQ ID NO: 252506 - DNA, 36 bp, Artificial Sequence
  Description of Artificial Sequence: Synthetic oligonucleotide
atgtccaaaacgaagtgatgggtcaccatttcgttg

SEQ ID NO: 252507 - DNA, 35 bp, Artificial Sequence
  Description of Artificial Sequence: Synthetic oligonucleotide
tgtccaaaacgaagtgatgggtcaccatttcgttg

SEQ ID NO: 252508 - DNA, 34 bp, Artificial Sequence
  Description of Artificial Sequence: Synthetic oligonucleotide
gtccaaaacgaagtgatgggtcaccatttcgttg

SEQ ID NO: 252509 - DNA, 34 bp, Artificial Sequence
  Description of Artificial Sequence: Synthetic oligonucleotide
tccaaaacgaagtgatgggtcaccatttcgttgg

SEQ ID NO: 252510 - DNA, 33 bp, Artificial Sequence
  Description of Artificial Sequence: Synthetic oligonucleotide
ccaaaacgaagtgatgggtcaccatttcgttgg

SEQ ID NO: 252511 - DNA, 42 bp, Artificial Sequence
  Description of Artificial Sequence: Synthetic oligonucleotide
caaaacgaagtgatgggtcaccatttcgttggaataatatac

SEQ ID NO: 252512 - DNA, 42 bp, Artificial Sequence
  Description of Artificial Sequence: Synthetic oligonucleotide
aaaacgaagtgatgggtcaccatttcgttggaataatatacg

SEQ ID NO: 252513 - DNA, 41 bp, Artificial Sequence
  Description of Artificial Sequence: Synthetic oligonucleotide
aaacgaagtgatgggtcaccatttcgttggaataatatacg

SEQ ID NO: 252514 - DNA, 40 bp, Artificial Sequence
  Description of Artificial Sequence: Synthetic oligonucleotide
aacgaagtgatgggtcaccatttcgttggaataatatacg

SEQ ID NO: 252515 - DNA, 39 bp, Artificial Sequence
  Description of Artificial Sequence: Synthetic oligonucleotide
acgaagtgatgggtcaccatttcgttggaataatatacg

SEQ ID NO: 252516 - DNA, 38 bp, Artificial Sequence
  Description of Artificial Sequence: Synthetic oligonucleotide
cgaagtgatgggtcaccatttcgttggaataatatacg

SEQ ID NO: 252517 - DNA, 39 bp, Artificial Sequence
  Description of Artificial Sequence: Synthetic oligonucleotide
gaagtgatgggtcaccatttcgttggaataatatacgac

SEQ ID NO: 252518 - DNA, 41 bp, Artificial Sequence
  Description of Artificial Sequence: Synthetic oligonucleotide
aagtgatgggtcaccatttcgttggaataatatacgacttg

SEQ ID NO: 252519 - DNA, 40 bp, Artificial Sequence
  Description of Artificial Sequence: Synthetic oligonucleotide
agtgatgggtcaccatttcgttggaataatatacgacttg

SEQ ID NO: 252520 - DNA, 39 bp, Artificial Sequence
  Description of Artificial Sequence: Synthetic oligonucleotide
gtgatgggtcaccatttcgttggaataatatacgacttg

SEQ ID NO: 252521 - DNA, 39 bp, Artificial Sequence
  Description of Artificial Sequence: Synthetic oligonucleotide
tgatgggtcaccatttcgttggaataatatacgacttgc

SEQ ID NO: 252522 - DNA, 38 bp, Artificial Sequence
  Description of Artificial Sequence: Synthetic oligonucleotide
gatgggtcaccatttcgttggaataatatacgacttgc

SEQ ID NO: 252523 - DNA, 39 bp, Artificial Sequence
  Description of Artificial Sequence: Synthetic oligonucleotide
atgggtcaccatttcgttggaataatatacgacttgctg

SEQ ID NO: 252524 - DNA, 38 bp, Artificial Sequence
  Description of Artificial Sequence: Synthetic oligonucleotide
tgggtcaccatttcgttggaataatatacgacttgctg

SEQ ID NO: 252525 - DNA, 37 bp, Artificial Sequence
  Description of Artificial Sequence: Synthetic oligonucleotide
gggtcaccatttcgttggaataatatacgacttgctg

SEQ ID NO: 252526 - DNA, 38 bp, Artificial Sequence
  Description of Artificial Sequence: Synthetic oligonucleotide
ggtcaccatttcgttggaataatatacgacttgctgag

SEQ ID NO: 252527 - DNA, 40 bp, Artificial Sequence
  Description of Artificial Sequence: Synthetic oligonucleotide
gtcaccatttcgttggaataatatacgacttgctgagtac

SEQ ID NO: 252528 - DNA, 40 bp, Artificial Sequence
  Description of Artificial Sequence: Synthetic oligonucleotide
tcaccatttcgttggaataatatacgacttgctgagtacg

SEQ ID NO: 252529 - DNA, 39 bp, Artificial Sequence
  Description of Artificial Sequence: Synthetic oligonucleotide
caccatttcgttggaataatatacgacttgctgagtacg

SEQ ID NO: 252530 - DNA, 40 bp, Artificial Sequence
  Description of Artificial Sequence: Synthetic oligonucleotide
accatttcgttggaataatatacgacttgctgagtacgac

SEQ ID NO: 252531 - DNA, 39 bp, Artificial Sequence
  Description of Artificial Sequence: Synthetic oligonucleotide
ccatttcgttggaataatatacgacttgctgagtacgac

SEQ ID NO: 252532 - DNA, 41 bp, Artificial Sequence
  Description of Artificial Sequence: Synthetic oligonucleotide
catttcgttggaataatatacgacttgctgagtacgacatc

SEQ ID NO: 252533 - DNA, 41 bp, Artificial Sequence
  Description of Artificial Sequence: Synthetic oligonucleotide
atttcgttggaataatatacgacttgctgagtacgacatcc

SEQ ID NO: 252534 - DNA, 40 bp, Artificial Sequence
  Description of Artificial Sequence: Synthetic oligonucleotide
tttcgttggaataatatacgacttgctgagtacgacatcc

SEQ ID NO: 252535 - DNA, 39 bp, Artificial Sequence
  Description of Artificial Sequence: Synthetic oligonucleotide
ttcgttggaataatatacgacttgctgagtacgacatcc

SEQ ID NO: 252536 - DNA, 38 bp, Artificial Sequence
  Description of Artificial Sequence: Synthetic oligonucleotide
tcgttggaataatatacgacttgctgagtacgacatcc

SEQ ID NO: 252537 - DNA, 37 bp, Artificial Sequence
  Description of Artificial Sequence: Synthetic oligonucleotide
cgttggaataatatacgacttgctgagtacgacatcc

SEQ ID NO: 252538 - DNA, 37 bp, Artificial Sequence
  Description of Artificial Sequence: Synthetic oligonucleotide
gttggaataatatacgacttgctgagtacgacatccc

SEQ ID NO: 252539 - DNA, 38 bp, Artificial Sequence
  Description of Artificial Sequence: Synthetic oligonucleotide
ttggaataatatacgacttgctgagtacgacatcccag

SEQ ID NO: 252540 - DNA, 37 bp, Artificial Sequence
  Description of Artificial Sequence: Synthetic oligonucleotide
tggaataatatacgacttgctgagtacgacatcccag

SEQ ID NO: 252541 - DNA, 36 bp, Artificial Sequence
  Description of Artificial Sequence: Synthetic oligonucleotide
ggaataatatacgacttgctgagtacgacatcccag

SEQ ID NO: 252542 - DNA, 38 bp, Artificial Sequence
  Description of Artificial Sequence: Synthetic oligonucleotide
gaataatatacgacttgctgagtacgacatcccagtac

SEQ ID NO: 252543 - DNA, 43 bp, Artificial Sequence
  Description of Artificial Sequence: Synthetic oligonucleotide
aataatatacgacttgctgagtacgacatcccagtacattatg

SEQ ID NO: 252544 - DNA, 42 bp, Artificial Sequence
  Description of Artificial Sequence: Synthetic oligonucleotide
ataatatacgacttgctgagtacgacatcccagtacattatg

SEQ ID NO: 252545 - DNA, 41 bp, Artificial Sequence
  Description of Artificial Sequence: Synthetic oligonucleotide
taatatacgacttgctgagtacgacatcccagtacattatg

SEQ ID NO: 252546 - DNA, 40 bp, Artificial Sequence
  Description of Artificial Sequence: Synthetic oligonucleotide
aatatacgacttgctgagtacgacatcccagtacattatg

SEQ ID NO: 252547 - DNA, 39 bp, Artificial Sequence
  Description of Artificial Sequence: Synthetic oligonucleotide
atatacgacttgctgagtacgacatcccagtacattatg

SEQ ID NO: 252548 - DNA, 38 bp, Artificial Sequence
  Description of Artificial Sequence: Synthetic oligonucleotide
tatacgacttgctgagtacgacatcccagtacattatg

SEQ ID NO: 252549 - DNA, 37 bp, Artificial Sequence
  Description of Artificial Sequence: Synthetic oligonucleotide
atacgacttgctgagtacgacatcccagtacattatg

SEQ ID NO: 252550 - DNA, 36 bp, Artificial Sequence
  Description of Artificial Sequence: Synthetic oligonucleotide
tacgacttgctgagtacgacatcccagtacattatg

SEQ ID NO: 252551 - DNA, 35 bp, Artificial Sequence
  Description of Artificial Sequence: Synthetic oligonucleotide
acgacttgctgagtacgacatcccagtacattatg

SEQ ID NO: 252552 - DNA, 34 bp, Artificial Sequence
  Description of Artificial Sequence: Synthetic oligonucleotide
cgacttgctgagtacgacatcccagtacattatg

SEQ ID NO: 252553 - DNA, 36 bp, Artificial Sequence
  Description of Artificial Sequence: Synthetic oligonucleotide
gacttgctgagtacgacatcccagtacattatgatg

SEQ ID NO: 252554 - DNA, 37 bp, Artificial Sequence
  Description of Artificial Sequence: Synthetic oligonucleotide
acttgctgagtacgacatcccagtacattatgatgtc

SEQ ID NO: 252555 - DNA, 36 bp, Artificial Sequence
  Description of Artificial Sequence: Synthetic oligonucleotide
cttgctgagtacgacatcccagtacattatgatgtc

SEQ ID NO: 252556 - DNA, 38 bp, Artificial Sequence
  Description of Artificial Sequence: Synthetic oligonucleotide
ttgctgagtacgacatcccagtacattatgatgtcttg

SEQ ID NO: 252557 - DNA, 37 bp, Artificial Sequence
  Description of Artificial Sequence: Synthetic oligonucleotide
tgctgagtacgacatcccagtacattatgatgtcttg

SEQ ID NO: 252558 - DNA, 36 bp, Artificial Sequence
  Description of Artificial Sequence: Synthetic oligonucleotide
gctgagtacgacatcccagtacattatgatgtcttg

SEQ ID NO: 252559 - DNA, 38 bp, Artificial Sequence
  Description of Artificial Sequence: Synthetic oligonucleotide
ctgagtacgacatcccagtacattatgatgtcttgatc

SEQ ID NO: 252560 - DNA, 38 bp, Artificial Sequence
  Description of Artificial Sequence: Synthetic oligonucleotide
tgagtacgacatcccagtacattatgatgtcttgatcc

SEQ ID NO: 252561 - DNA, 37 bp, Artificial Sequence
  Description of Artificial Sequence: Synthetic oligonucleotide
gagtacgacatcccagtacattatgatgtcttgatcc

SEQ ID NO: 252562 - DNA, 39 bp, Artificial Sequence
  Description of Artificial Sequence: Synthetic oligonucleotide
agtacgacatcccagtacattatgatgtcttgatccttg

SEQ ID NO: 252563 - DNA, 38 bp, Artificial Sequence
  Description of Artificial Sequence: Synthetic oligonucleotide
gtacgacatcccagtacattatgatgtcttgatccttg

SEQ ID NO: 252564 - DNA, 38 bp, Artificial Sequence
  Description of Artificial Sequence: Synthetic oligonucleotide
tacgacatcccagtacattatgatgtcttgatccttgc

SEQ ID NO: 252565 - DNA, 37 bp, Artificial Sequence
  Description of Artificial Sequence: Synthetic oligonucleotide
acgacatcccagtacattatgatgtcttgatccttgc

SEQ ID NO: 252566 - DNA, 36 bp, Artificial Sequence
  Description of Artificial Sequence: Synthetic oligonucleotide
cgacatcccagtacattatgatgtcttgatccttgc

SEQ ID NO: 252567 - DNA, 39 bp, Artificial Sequence
  Description of Artificial Sequence: Synthetic oligonucleotide
gacatcccagtacattatgatgtcttgatccttgcaaac

SEQ ID NO: 252568 - DNA, 39 bp, Artificial Sequence
  Description of Artificial Sequence: Synthetic oligonucleotide
acatcccagtacattatgatgtcttgatccttgcaaacc

SEQ ID NO: 252569 - DNA, 38 bp, Artificial Sequence
  Description of Artificial Sequence: Synthetic oligonucleotide
catcccagtacattatgatgtcttgatccttgcaaacc

SEQ ID NO: 252570 - DNA, 41 bp, Artificial Sequence
  Description of Artificial Sequence: Synthetic oligonucleotide
atcccagtacattatgatgtcttgatccttgcaaacctaac

SEQ ID NO: 252571 - DNA, 40 bp, Artificial Sequence
  Description of Artificial Sequence: Synthetic oligonucleotide
tcccagtacattatgatgtcttgatccttgcaaacctaac

SEQ ID NO: 252572 - DNA, 39 bp, Artificial Sequence
  Description of Artificial Sequence: Synthetic oligonucleotide
cccagtacattatgatgtcttgatccttgcaaacctaac

SEQ ID NO: 252573 - DNA, 39 bp, Artificial Sequence
  Description of Artificial Sequence: Synthetic oligonucleotide
ccagtacattatgatgtcttgatccttgcaaacctaacc

SEQ ID NO: 252574 - DNA, 40 bp, Artificial Sequence
  Description of Artificial Sequence: Synthetic oligonucleotide
cagtacattatgatgtcttgatccttgcaaacctaaccac

SEQ ID NO: 252575 - DNA, 40 bp, Artificial Sequence
  Description of Artificial Sequence: Synthetic oligonucleotide
agtacattatgatgtcttgatccttgcaaacctaaccacg

SEQ ID NO: 252576 - DNA, 39 bp, Artificial Sequence
  Description of Artificial Sequence: Synthetic oligonucleotide
gtacattatgatgtcttgatccttgcaaacctaaccacg

SEQ ID NO: 252577 - DNA, 39 bp, Artificial Sequence
  Description of Artificial Sequence: Synthetic oligonucleotide
tacattatgatgtcttgatccttgcaaacctaaccacgc

SEQ ID NO: 252578 - DNA, 38 bp, Artificial Sequence
  Description of Artificial Sequence: Synthetic oligonucleotide
acattatgatgtcttgatccttgcaaacctaaccacgc

SEQ ID NO: 252579 - DNA, 37 bp, Artificial Sequence
  Description of Artificial Sequence: Synthetic oligonucleotide
cattatgatgtcttgatccttgcaaacctaaccacgc

SEQ ID NO: 252580 - DNA, 38 bp, Artificial Sequence
  Description of Artificial Sequence: Synthetic oligonucleotide
attatgatgtcttgatccttgcaaacctaaccacgctg

SEQ ID NO: 252581 - DNA, 37 bp, Artificial Sequence
  Description of Artificial Sequence: Synthetic oligonucleotide
ttatgatgtcttgatccttgcaaacctaaccacgctg

SEQ ID NO: 252582 - DNA, 36 bp, Artificial Sequence
  Description of Artificial Sequence: Synthetic oligonucleotide
tatgatgtcttgatccttgcaaacctaaccacgctg

SEQ ID NO: 252583 - DNA, 35 bp, Artificial Sequence
  Description of Artificial Sequence: Synthetic oligonucleotide
atgatgtcttgatccttgcaaacctaaccacgctg

SEQ ID NO: 252584 - DNA, 34 bp, Artificial Sequence
  Description of Artificial Sequence: Synthetic oligonucleotide
tgatgtcttgatccttgcaaacctaaccacgctg

SEQ ID NO: 252585 - DNA, 33 bp, Artificial Sequence
  Description of Artificial Sequence: Synthetic oligonucleotide
gatgtcttgatccttgcaaacctaaccacgctg

SEQ ID NO: 252586 - DNA, 34 bp, Artificial Sequence
  Description of Artificial Sequence: Synthetic oligonucleotide
atgtcttgatccttgcaaacctaaccacgctgtc

SEQ ID NO: 252587 - DNA, 33 bp, Artificial Sequence
  Description of Artificial Sequence: Synthetic oligonucleotide
tgtcttgatccttgcaaacctaaccacgctgtc

SEQ ID NO: 252588 - DNA, 32 bp, Artificial Sequence
  Description of Artificial Sequence: Synthetic oligonucleotide
gtcttgatccttgcaaacctaaccacgctgtc

SEQ ID NO: 252589 - DNA, 32 bp, Artificial Sequence
  Description of Artificial Sequence: Synthetic oligonucleotide
tcttgatccttgcaaacctaaccacgctgtcc

SEQ ID NO: 252590 - DNA, 31 bp, Artificial Sequence
  Description of Artificial Sequence: Synthetic oligonucleotide
cttgatccttgcaaacctaaccacgctgtcc

SEQ ID NO: 252591 - DNA, 33 bp, Artificial Sequence
  Description of Artificial Sequence: Synthetic oligonucleotide
ttgatccttgcaaacctaaccacgctgtccttc

SEQ ID NO: 252592 - DNA, 32 bp, Artificial Sequence
  Description of Artificial Sequence: Synthetic oligonucleotide
tgatccttgcaaacctaaccacgctgtccttc

SEQ ID NO: 252593 - DNA, 31 bp, Artificial Sequence
  Description of Artificial Sequence: Synthetic oligonucleotide
gatccttgcaaacctaaccacgctgtccttc

SEQ ID NO: 252594 - DNA, 32 bp, Artificial Sequence
  Description of Artificial Sequence: Synthetic oligonucleotide
atccttgcaaacctaaccacgctgtccttctg

SEQ ID NO: 252595 - DNA, 31 bp, Artificial Sequence
  Description of Artificial Sequence: Synthetic oligonucleotide
tccttgcaaacctaaccacgctgtccttctg

SEQ ID NO: 252596 - DNA, 30 bp, Artificial Sequence
  Description of Artificial Sequence: Synthetic oligonucleotide
ccttgcaaacctaaccacgctgtccttctg

SEQ ID NO: 252597 - DNA, 30 bp, Artificial Sequence
  Description of Artificial Sequence: Synthetic oligonucleotide
cttgcaaacctaaccacgctgtccttctgg

SEQ ID NO: 252598 - DNA, 30 bp, Artificial Sequence
  Description of Artificial Sequence: Synthetic oligonucleotide
ttgcaaacctaaccacgctgtccttctggg

SEQ ID NO: 252599 - DNA, 29 bp, Artificial Sequence
  Description of Artificial Sequence: Synthetic oligonucleotide
tgcaaacctaaccacgctgtccttctggg

SEQ ID NO: 252600 - DNA, 28 bp, Artificial Sequence
  Description of Artificial Sequence: Synthetic oligonucleotide
gcaaacctaaccacgctgtccttctggg

SEQ ID NO: 252601 - DNA, 28 bp, Artificial Sequence
  Description of Artificial Sequence: Synthetic oligonucleotide
caaacctaaccacgctgtccttctgggc

SEQ ID NO: 252602 - DNA, 30 bp, Artificial Sequence
  Description of Artificial Sequence: Synthetic oligonucleotide
aaacctaaccacgctgtccttctgggcaac

SEQ ID NO: 252603 - DNA, 29 bp, Artificial Sequence
  Description of Artificial Sequence: Synthetic oligonucleotide
aacctaaccacgctgtccttctgggcaac

SEQ ID NO: 252604 - DNA, 28 bp, Artificial Sequence
  Description of Artificial Sequence: Synthetic oligonucleotide
acctaaccacgctgtccttctgggcaac

SEQ ID NO: 252605 - DNA, 27 bp, Artificial Sequence
  Description of Artificial Sequence: Synthetic oligonucleotide
cctaaccacgctgtccttctgggcaac

SEQ ID NO: 252606 - DNA, 27 bp, Artificial Sequence
  Description of Artificial Sequence: Synthetic oligonucleotide
ctaaccacgctgtccttctgggcaacc

SEQ ID NO: 252607 - DNA, 28 bp, Artificial Sequence
  Description of Artificial Sequence: Synthetic oligonucleotide
taaccacgctgtccttctgggcaaccac

SEQ ID NO: 252608 - DNA, 27 bp, Artificial Sequence
  Description of Artificial Sequence: Synthetic oligonucleotide
aaccacgctgtccttctgggcaaccac

SEQ ID NO: 252609 - DNA, 26 bp, Artificial Sequence
  Description of Artificial Sequence: Synthetic oligonucleotide
accacgctgtccttctgggcaaccac

SEQ ID NO: 252610 - DNA, 25 bp, Artificial Sequence
  Description of Artificial Sequence: Synthetic oligonucleotide
ccacgctgtccttctgggcaaccac

SEQ ID NO: 252611 - DNA, 27 bp, Artificial Sequence
  Description of Artificial Sequence: Synthetic oligonucleotide
cacgctgtccttctgggcaaccacgaa

SEQ ID NO: 252612 - DNA, 28 bp, Artificial Sequence
  Description of Artificial Sequence: Synthetic oligonucleotide
acgctgtccttctgggcaaccacgaatg

SEQ ID NO: 252613 - DNA, 27 bp, Artificial Sequence
  Description of Artificial Sequence: Synthetic oligonucleotide
cgctgtccttctgggcaaccacgaatg

SEQ ID NO: 252614 - DNA, 29 bp, Artificial Sequence
  Description of Artificial Sequence: Synthetic oligonucleotide
gctgtccttctgggcaaccacgaatgtag

SEQ ID NO: 252615 - DNA, 33 bp, Artificial Sequence
  Description of Artificial Sequence: Synthetic oligonucleotide
ctgtccttctgggcaaccacgaatgtagaaatc

SEQ ID NO: 252616 - DNA, 34 bp, Artificial Sequence
  Description of Artificial Sequence: Synthetic oligonucleotide
tgtccttctgggcaaccacgaatgtagaaatctc

SEQ ID NO: 252617 - DNA, 33 bp, Artificial Sequence
  Description of Artificial Sequence: Synthetic oligonucleotide
gtccttctgggcaaccacgaatgtagaaatctc

SEQ ID NO: 252618 - DNA, 34 bp, Artificial Sequence
  Description of Artificial Sequence: Synthetic oligonucleotide
tccttctgggcaaccacgaatgtagaaatctcag

SEQ ID NO: 252619 - DNA, 33 bp, Artificial Sequence
  Description of Artificial Sequence: Synthetic oligonucleotide
ccttctgggcaaccacgaatgtagaaatctcag

SEQ ID NO: 252620 - DNA, 33 bp, Artificial Sequence
  Description of Artificial Sequence: Synthetic oligonucleotide
cttctgggcaaccacgaatgtagaaatctcagc

SEQ ID NO: 252621 - DNA, 33 bp, Artificial Sequence
  Description of Artificial Sequence: Synthetic oligonucleotide
ttctgggcaaccacgaatgtagaaatctcagcc

SEQ ID NO: 252622 - DNA, 32 bp, Artificial Sequence
  Description of Artificial Sequence: Synthetic oligonucleotide
tctgggcaaccacgaatgtagaaatctcagcc

SEQ ID NO: 252623 - DNA, 31 bp, Artificial Sequence
  Description of Artificial Sequence: Synthetic oligonucleotide
ctgggcaaccacgaatgtagaaatctcagcc

SEQ ID NO: 252624 - DNA, 32 bp, Artificial Sequence
  Description of Artificial Sequence: Synthetic oligonucleotide
tgggcaaccacgaatgtagaaatctcagccag

SEQ ID NO: 252625 - DNA, 31 bp, Artificial Sequence
  Description of Artificial Sequence: Synthetic oligonucleotide
gggcaaccacgaatgtagaaatctcagccag

SEQ ID NO: 252626 - DNA, 32 bp, Artificial Sequence
  Description of Artificial Sequence: Synthetic oligonucleotide
ggcaaccacgaatgtagaaatctcagccagtc

SEQ ID NO: 252627 - DNA, 33 bp, Artificial Sequence
  Description of Artificial Sequence: Synthetic oligonucleotide
gcaaccacgaatgtagaaatctcagccagtctg

SEQ ID NO: 252628 - DNA, 33 bp, Artificial Sequence
  Description of Artificial Sequence: Synthetic oligonucleotide
caaccacgaatgtagaaatctcagccagtctgc

SEQ ID NO: 252629 - DNA, 33 bp, Artificial Sequence
  Description of Artificial Sequence: Synthetic oligonucleotide
aaccacgaatgtagaaatctcagccagtctgcc

SEQ ID NO: 252630 - DNA, 32 bp, Artificial Sequence
  Description of Artificial Sequence: Synthetic oligonucleotide
accacgaatgtagaaatctcagccagtctgcc

SEQ ID NO: 252631 - DNA, 31 bp, Artificial Sequence
  Description of Artificial Sequence: Synthetic oligonucleotide
ccacgaatgtagaaatctcagccagtctgcc

SEQ ID NO: 252632 - DNA, 31 bp, Artificial Sequence
  Description of Artificial Sequence: Synthetic oligonucleotide
cacgaatgtagaaatctcagccagtctgccc

SEQ ID NO: 252633 - DNA, 32 bp, Artificial Sequence
  Description of Artificial Sequence: Synthetic oligonucleotide
acgaatgtagaaatctcagccagtctgcccac

SEQ ID NO: 252634 - DNA, 31 bp, Artificial Sequence
  Description of Artificial Sequence: Synthetic oligonucleotide
cgaatgtagaaatctcagccagtctgcccac

SEQ ID NO: 252635 - DNA, 31 bp, Artificial Sequence
  Description of Artificial Sequence: Synthetic oligonucleotide
gaatgtagaaatctcagccagtctgcccacc

SEQ ID NO: 252636 - DNA, 32 bp, Artificial Sequence
  Description of Artificial Sequence: Synthetic oligonucleotide
aatgtagaaatctcagccagtctgcccaccag

SEQ ID NO: 252637 - DNA, 31 bp, Artificial Sequence
  Description of Artificial Sequence: Synthetic oligonucleotide
atgtagaaatctcagccagtctgcccaccag

SEQ ID NO: 252638 - DNA, 30 bp, Artificial Sequence
  Description of Artificial Sequence: Synthetic oligonucleotide
tgtagaaatctcagccagtctgcccaccag

SEQ ID NO: 252639 - DNA, 29 bp, Artificial Sequence
  Description of Artificial Sequence: Synthetic oligonucleotide
gtagaaatctcagccagtctgcccaccag

SEQ ID NO: 252640 - DNA, 29 bp, Artificial Sequence
  Description of Artificial Sequence: Synthetic oligonucleotide
tagaaatctcagccagtctgcccaccagg

SEQ ID NO: 252641 - DNA, 28 bp, Artificial Sequence
  Description of Artificial Sequence: Synthetic oligonucleotide
agaaatctcagccagtctgcccaccagg

SEQ ID NO: 252642 - DNA, 27 bp, Artificial Sequence
  Description of Artificial Sequence: Synthetic oligonucleotide
gaaatctcagccagtctgcccaccagg

SEQ ID NO: 252643 - DNA, 28 bp, Artificial Sequence
  Description of Artificial Sequence: Synthetic oligonucleotide
aaatctcagccagtctgcccaccaggac

SEQ ID NO: 252644 - DNA, 27 bp, Artificial Sequence
  Description of Artificial Sequence: Synthetic oligonucleotide
aatctcagccagtctgcccaccaggac

SEQ ID NO: 252645 - DNA, 26 bp, Artificial Sequence
  Description of Artificial Sequence: Synthetic oligonucleotide
atctcagccagtctgcccaccaggac

SEQ ID NO: 252646 - DNA, 25 bp, Artificial Sequence
  Description of Artificial Sequence: Synthetic oligonucleotide
tctcagccagtctgcccaccaggac

SEQ ID NO: 252647 - DNA, 24 bp, Artificial Sequence
  Description of Artificial Sequence: Synthetic oligonucleotide
ctcagccagtctgcccaccaggac

SEQ ID NO: 252648 - DNA, 26 bp, Artificial Sequence
  Description of Artificial Sequence: Synthetic oligonucleotide
tcagccagtctgcccaccaggaccat

SEQ ID NO: 252649 - DNA, 25 bp, Artificial Sequence
  Description of Artificial Sequence: Synthetic oligonucleotide
cagccagtctgcccaccaggaccat

SEQ ID NO: 252650 - DNA, 27 bp, Artificial Sequence
  Description of Artificial Sequence: Synthetic oligonucleotide
agccagtctgcccaccaggaccatcat

SEQ ID NO: 252651 - DNA, 26 bp, Artificial Sequence
  Description of Artificial Sequence: Synthetic oligonucleotide
gccagtctgcccaccaggaccatcat

SEQ ID NO: 252652 - DNA, 26 bp, Artificial Sequence
  Description of Artificial Sequence: Synthetic oligonucleotide
ccagtctgcccaccaggaccatcatc

SEQ ID NO: 252653 - DNA, 27 bp, Artificial Sequence
  Description of Artificial Sequence: Synthetic oligonucleotide
cagtctgcccaccaggaccatcatcgt

SEQ ID NO: 252654 - DNA, 27 bp, Artificial Sequence
  Description of Artificial Sequence: Synthetic oligonucleotide
agtctgcccaccaggaccatcatcgtg

SEQ ID NO: 252655 - DNA, 26 bp, Artificial Sequence
  Description of Artificial Sequence: Synthetic oligonucleotide
gtctgcccaccaggaccatcatcgtg

SEQ ID NO: 252656 - DNA, 27 bp, Artificial Sequence
  Description of Artificial Sequence: Synthetic oligonucleotide
tctgcccaccaggaccatcatcgtgca

SEQ ID NO: 252657 - DNA, 27 bp, Artificial Sequence
  Description of Artificial Sequence: Synthetic oligonucleotide
ctgcccaccaggaccatcatcgtgcat

SEQ ID NO: 252658 - DNA, 28 bp, Artificial Sequence
  Description of Artificial Sequence: Synthetic oligonucleotide
tgcccaccaggaccatcatcgtgcatag

SEQ ID NO: 252659 - DNA, 27 bp, Artificial Sequence
  Description of Artificial Sequence: Synthetic oligonucleotide
gcccaccaggaccatcatcgtgcatag

SEQ ID NO: 252660 - DNA, 28 bp, Artificial Sequence
  Description of Artificial Sequence: Synthetic oligonucleotide
cccaccaggaccatcatcgtgcatagtc

SEQ ID NO: 252661 - DNA, 29 bp, Artificial Sequence
  Description of Artificial Sequence: Synthetic oligonucleotide
ccaccaggaccatcatcgtgcatagtctc

SEQ ID NO: 252662 - DNA, 29 bp, Artificial Sequence
  Description of Artificial Sequence: Synthetic oligonucleotide
caccaggaccatcatcgtgcatagtctcc

SEQ ID NO: 252663 - DNA, 30 bp, Artificial Sequence
  Description of Artificial Sequence: Synthetic oligonucleotide
accaggaccatcatcgtgcatagtctccac

SEQ ID NO: 252664 - DNA, 29 bp, Artificial Sequence
  Description of Artificial Sequence: Synthetic oligonucleotide
ccaggaccatcatcgtgcatagtctccac

SEQ ID NO: 252665 - DNA, 29 bp, Artificial Sequence
  Description of Artificial Sequence: Synthetic oligonucleotide
caggaccatcatcgtgcatagtctccacc

SEQ ID NO: 252666 - DNA, 30 bp, Artificial Sequence
  Description of Artificial Sequence: Synthetic oligonucleotide
aggaccatcatcgtgcatagtctccacctg

SEQ ID NO: 252667 - DNA, 29 bp, Artificial Sequence
  Description of Artificial Sequence: Synthetic oligonucleotide
ggaccatcatcgtgcatagtctccacctg

SEQ ID NO: 252668 - DNA, 29 bp, Artificial Sequence
  Description of Artificial Sequence: Synthetic oligonucleotide
gaccatcatcgtgcatagtctccacctgc

SEQ ID NO: 252669 - DNA, 30 bp, Artificial Sequence
  Description of Artificial Sequence: Synthetic oligonucleotide
accatcatcgtgcatagtctccacctgcac

SEQ ID NO: 252670 - DNA, 29 bp, Artificial Sequence
  Description of Artificial Sequence: Synthetic oligonucleotide
ccatcatcgtgcatagtctccacctgcac

SEQ ID NO: 252671 - DNA, 33 bp, Artificial Sequence
  Description of Artificial Sequence: Synthetic oligonucleotide
catcatcgtgcatagtctccacctgcacatatc

SEQ ID NO: 252672 - DNA, 35 bp, Artificial Sequence
  Description of Artificial Sequence: Synthetic oligonucleotide
atcatcgtgcatagtctccacctgcacatatctag

SEQ ID NO: 252673 - DNA, 34 bp, Artificial Sequence
  Description of Artificial Sequence: Synthetic oligonucleotide
tcatcgtgcatagtctccacctgcacatatctag

SEQ ID NO: 252674 - DNA, 33 bp, Artificial Sequence
  Description of Artificial Sequence: Synthetic oligonucleotide
catcgtgcatagtctccacctgcacatatctag

SEQ ID NO: 252675 - DNA, 33 bp, Artificial Sequence
  Description of Artificial Sequence: Synthetic oligonucleotide
atcgtgcatagtctccacctgcacatatctagg

SEQ ID NO: 252676 - DNA, 32 bp, Artificial Sequence
  Description of Artificial Sequence: Synthetic oligonucleotide
tcgtgcatagtctccacctgcacatatctagg

SEQ ID NO: 252677 - DNA, 31 bp, Artificial Sequence
  Description of Artificial Sequence: Synthetic oligonucleotide
cgtgcatagtctccacctgcacatatctagg

SEQ ID NO: 252678 - DNA, 31 bp, Artificial Sequence
  Description of Artificial Sequence: Synthetic oligonucleotide
gtgcatagtctccacctgcacatatctaggc

SEQ ID NO: 252679 - DNA, 31 bp, Artificial Sequence
  Description of Artificial Sequence: Synthetic oligonucleotide
tgcatagtctccacctgcacatatctaggcc

SEQ ID NO: 252680 - DNA, 30 bp, Artificial Sequence
  Description of Artificial Sequence: Synthetic oligonucleotide
gcatagtctccacctgcacatatctaggcc

SEQ ID NO: 252681 - DNA, 30 bp, Artificial Sequence
  Description of Artificial Sequence: Synthetic oligonucleotide
catagtctccacctgcacatatctaggccc

SEQ ID NO: 252682 - DNA, 31 bp, Artificial Sequence
  Description of Artificial Sequence: Synthetic oligonucleotide
atagtctccacctgcacatatctaggcccac

SEQ ID NO: 252683 - DNA, 30 bp, Artificial Sequence
  Description of Artificial Sequence: Synthetic oligonucleotide
tagtctccacctgcacatatctaggcccac

SEQ ID NO: 252684 - DNA, 29 bp, Artificial Sequence
  Description of Artificial Sequence: Synthetic oligonucleotide
agtctccacctgcacatatctaggcccac

SEQ ID NO: 252685 - DNA, 28 bp, Artificial Sequence
  Description of Artificial Sequence: Synthetic oligonucleotide
gtctccacctgcacatatctaggcccac

SEQ ID NO: 252686 - DNA, 28 bp, Artificial Sequence
  Description of Artificial Sequence: Synthetic oligonucleotide
tctccacctgcacatatctaggcccacc

SEQ ID NO: 252687 - DNA, 27 bp, Artificial Sequence
  Description of Artificial Sequence: Synthetic oligonucleotide
ctccacctgcacatatctaggcccacc

SEQ ID NO: 252688 - DNA, 27 bp, Artificial Sequence
  Description of Artificial Sequence: Synthetic oligonucleotide
tccacctgcacatatctaggcccaccc

SEQ ID NO: 252689 - DNA, 27 bp, Artificial Sequence
  Description of Artificial Sequence: Synthetic oligonucleotide
ccacctgcacatatctaggcccaccct

SEQ ID NO: 252690 - DNA, 27 bp, Artificial Sequence
  Description of Artificial Sequence: Synthetic oligonucleotide
cacctgcacatatctaggcccaccctc

SEQ ID NO: 252691 - DNA, 28 bp, Artificial Sequence
  Description of Artificial Sequence: Synthetic oligonucleotide
acctgcacatatctaggcccaccctcac

SEQ ID NO: 252692 - DNA, 27 bp, Artificial Sequence
  Description of Artificial Sequence: Synthetic oligonucleotide
cctgcacatatctaggcccaccctcac

SEQ ID NO: 252693 - DNA, 27 bp, Artificial Sequence
  Description of Artificial Sequence: Synthetic oligonucleotide
ctgcacatatctaggcccaccctcacg

SEQ ID NO: 252694 - DNA, 29 bp, Artificial Sequence
  Description of Artificial Sequence: Synthetic oligonucleotide
tgcacatatctaggcccaccctcacgaag

SEQ ID NO: 252695 - DNA, 28 bp, Artificial Sequence
  Description of Artificial Sequence: Synthetic oligonucleotide
gcacatatctaggcccaccctcacgaag

SEQ ID NO: 252696 - DNA, 28 bp, Artificial Sequence
  Description of Artificial Sequence: Synthetic oligonucleotide
cacatatctaggcccaccctcacgaagg

SEQ ID NO: 252697 - DNA, 28 bp, Artificial Sequence
  Description of Artificial Sequence: Synthetic oligonucleotide
acatatctaggcccaccctcacgaaggg

SEQ ID NO: 252698 - DNA, 27 bp, Artificial Sequence
  Description of Artificial Sequence: Synthetic oligonucleotide
catatctaggcccaccctcacgaaggg

SEQ ID NO: 252699 - DNA, 28 bp, Artificial Sequence
  Description of Artificial Sequence: Synthetic oligonucleotide
atatctaggcccaccctcacgaagggag

SEQ ID NO: 252700 - DNA, 27 bp, Artificial Sequence
  Description of Artificial Sequence: Synthetic oligonucleotide
tatctaggcccaccctcacgaagggag

SEQ ID NO: 252701 - DNA, 26 bp, Artificial Sequence
  Description of Artificial Sequence: Synthetic oligonucleotide
atctaggcccaccctcacgaagggag

SEQ ID NO: 252702 - DNA, 25 bp, Artificial Sequence
  Description of Artificial Sequence: Synthetic oligonucleotide
tctaggcccaccctcacgaagggag

SEQ ID NO: 252703 - DNA, 24 bp, Artificial Sequence
  Description of Artificial Sequence: Synthetic oligonucleotide
ctaggcccaccctcacgaagggag

SEQ ID NO: 252704 - DNA, 25 bp, Artificial Sequence
  Description of Artificial Sequence: Synthetic oligonucleotide
taggcccaccctcacgaagggagca

SEQ ID NO: 252705 - DNA, 24 bp, Artificial Sequence
  Description of Artificial Sequence: Synthetic oligonucleotide
aggcccaccctcacgaagggagca

SEQ ID NO: 252706 - DNA, 23 bp, Artificial Sequence
  Description of Artificial Sequence: Synthetic oligonucleotide
ggcccaccctcacgaagggagca

SEQ ID NO: 252707 - DNA, 23 bp, Artificial Sequence
  Description of Artificial Sequence: Synthetic oligonucleotide
gcccaccctcacgaagggagcag

SEQ ID NO: 252708 - DNA, 24 bp, Artificial Sequence
  Description of Artificial Sequence: Synthetic oligonucleotide
cccaccctcacgaagggagcagga

SEQ ID NO: 252709 - DNA, 25 bp, Artificial Sequence
  Description of Artificial Sequence: Synthetic oligonucleotide
ccaccctcacgaagggagcaggaga

SEQ ID NO: 252710 - DNA, 26 bp, Artificial Sequence
  Description of Artificial Sequence: Synthetic oligonucleotide
caccctcacgaagggagcaggagaga

SEQ ID NO: 252711 - DNA, 26 bp, Artificial Sequence
  Description of Artificial Sequence: Synthetic oligonucleotide
accctcacgaagggagcaggagagag

SEQ ID NO: 252712 - DNA, 25 bp, Artificial Sequence
  Description of Artificial Sequence: Synthetic oligonucleotide
ccctcacgaagggagcaggagagag

SEQ ID NO: 252713 - DNA, 25 bp, Artificial Sequence
  Description of Artificial Sequence: Synthetic oligonucleotide
cctcacgaagggagcaggagagagg

SEQ ID NO: 252714 - DNA, 27 bp, Artificial Sequence
  Description of Artificial Sequence: Synthetic oligonucleotide
ctcacgaagggagcaggagagagggta

SEQ ID NO: 252715 - DNA, 28 bp, Artificial Sequence
  Description of Artificial Sequence: Synthetic oligonucleotide
tcacgaagggagcaggagagagggtatc

SEQ ID NO: 252716 - DNA, 27 bp, Artificial Sequence
  Description of Artificial Sequence: Synthetic oligonucleotide
cacgaagggagcaggagagagggtatc

SEQ ID NO: 252717 - DNA, 27 bp, Artificial Sequence
  Description of Artificial Sequence: Synthetic oligonucleotide
acgaagggagcaggagagagggtatcg

SEQ ID NO: 252718 - DNA, 26 bp, Artificial Sequence
  Description of Artificial Sequence: Synthetic oligonucleotide
cgaagggagcaggagagagggtatcg

SEQ ID NO: 252719 - DNA, 27 bp, Artificial Sequence
  Description of Artificial Sequence: Synthetic oligonucleotide
gaagggagcaggagagagggtatcgga

SEQ ID NO: 252720 - DNA, 28 bp, Artificial Sequence
  Description of Artificial Sequence: Synthetic oligonucleotide
aagggagcaggagagagggtatcggaag

SEQ ID NO: 252721 - DNA, 27 bp, Artificial Sequence
  Description of Artificial Sequence: Synthetic oligonucleotide
agggagcaggagagagggtatcggaag

SEQ ID NO: 252722 - DNA, 27 bp, Artificial Sequence
  Description of Artificial Sequence: Synthetic oligonucleotide
gggagcaggagagagggtatcggaagt

SEQ ID NO: 252723 - DNA, 28 bp, Artificial Sequence
  Description of Artificial Sequence: Synthetic oligonucleotide
ggagcaggagagagggtatcggaagtac

SEQ ID NO: 252724 - DNA, 28 bp, Artificial Sequence
  Description of Artificial Sequence: Synthetic oligonucleotide
gagcaggagagagggtatcggaagtacc

SEQ ID NO: 252725 - DNA, 28 bp, Artificial Sequence
  Description of Artificial Sequence: Synthetic oligonucleotide
agcaggagagagggtatcggaagtaccc

SEQ ID NO: 252726 - DNA, 27 bp, Artificial Sequence
  Description of Artificial Sequence: Synthetic oligonucleotide
gcaggagagagggtatcggaagtaccc

SEQ ID NO: 252727 - DNA, 27 bp, Artificial Sequence
  Description of Artificial Sequence: Synthetic oligonucleotide
caggagagagggtatcggaagtacccc

SEQ ID NO: 252728 - DNA, 28 bp, Artificial Sequence
  Description of Artificial Sequence: Synthetic oligonucleotide
aggagagagggtatcggaagtacccctg

SEQ ID NO: 252729 - DNA, 27 bp, Artificial Sequence
  Description of Artificial Sequence: Synthetic oligonucleotide
ggagagagggtatcggaagtacccctg

SEQ ID NO: 252730 - DNA, 27 bp, Artificial Sequence
  Description of Artificial Sequence: Synthetic oligonucleotide
gagagagggtatcggaagtacccctgc

SEQ ID NO: 252731 - DNA, 28 bp, Artificial Sequence
  Description of Artificial Sequence: Synthetic oligonucleotide
agagagggtatcggaagtacccctgcac

SEQ ID NO: 252732 - DNA, 27 bp, Artificial Sequence
  Description of Artificial Sequence: Synthetic oligonucleotide
gagagggtatcggaagtacccctgcac

SEQ ID NO: 252733 - DNA, 27 bp, Artificial Sequence
  Description of Artificial Sequence: Synthetic oligonucleotide
agagggtatcggaagtacccctgcacg

SEQ ID NO: 252734 - DNA, 27 bp, Artificial Sequence
  Description of Artificial Sequence: Synthetic oligonucleotide
gagggtatcggaagtacccctgcacgt

SEQ ID NO: 252735 - DNA, 27 bp, Artificial Sequence
  Description of Artificial Sequence: Synthetic oligonucleotide
agggtatcggaagtacccctgcacgtc

SEQ ID NO: 252736 - DNA, 26 bp, Artificial Sequence
  Description of Artificial Sequence: Synthetic oligonucleotide
gggtatcggaagtacccctgcacgtc

SEQ ID NO: 252737 - DNA, 27 bp, Artificial Sequence
  Description of Artificial Sequence: Synthetic oligonucleotide
ggtatcggaagtacccctgcacgtcct

SEQ ID NO: 252738 - DNA, 27 bp, Artificial Sequence
  Description of Artificial Sequence: Synthetic oligonucleotide
gtatcggaagtacccctgcacgtcctg

SEQ ID NO: 252739 - DNA, 27 bp, Artificial Sequence
  Description of Artificial Sequence: Synthetic oligonucleotide
tatcggaagtacccctgcacgtcctgg

SEQ ID NO: 252740 - DNA, 27 bp, Artificial Sequence
  Description of Artificial Sequence: Synthetic oligonucleotide
atcggaagtacccctgcacgtcctgga

SEQ ID NO: 252741 - DNA, 27 bp, Artificial Sequence
  Description of Artificial Sequence: Synthetic oligonucleotide
tcggaagtacccctgcacgtcctggaa

SEQ ID NO: 252742 - DNA, 26 bp, Artificial Sequence
  Description of Artificial Sequence: Synthetic oligonucleotide
cggaagtacccctgcacgtcctggaa

SEQ ID NO: 252743 - DNA, 27 bp, Artificial Sequence
  Description of Artificial Sequence: Synthetic oligonucleotide
ggaagtacccctgcacgtcctggaaga

SEQ ID NO: 252744 - DNA, 27 bp, Artificial Sequence
  Description of Artificial Sequence: Synthetic oligonucleotide
gaagtacccctgcacgtcctggaagac

SEQ ID NO: 252745 - DNA, 27 bp, Artificial Sequence
  Description of Artificial Sequence: Synthetic oligonucleotide
aagtacccctgcacgtcctggaagacc

SEQ ID NO: 252746 - DNA, 26 bp, Artificial Sequence
  Description of Artificial Sequence: Synthetic oligonucleotide
agtacccctgcacgtcctggaagacc

SEQ ID NO: 252747 - DNA, 25 bp, Artificial Sequence
  Description of Artificial Sequence: Synthetic oligonucleotide
gtacccctgcacgtcctggaagacc

SEQ ID NO: 252748 - DNA, 25 bp, Artificial Sequence
  Description of Artificial Sequence: Synthetic oligonucleotide
tacccctgcacgtcctggaagaccc

SEQ ID NO: 252749 - DNA, 24 bp, Artificial Sequence
  Description of Artificial Sequence: Synthetic oligonucleotide
acccctgcacgtcctggaagaccc

SEQ ID NO: 252750 - DNA, 23 bp, Artificial Sequence
  Description of Artificial Sequence: Synthetic oligonucleotide
cccctgcacgtcctggaagaccc

SEQ ID NO: 252751 - DNA, 23 bp, Artificial Sequence
  Description of Artificial Sequence: Synthetic oligonucleotide
ccctgcacgtcctggaagacccc

SEQ ID NO: 252752 - DNA, 23 bp, Artificial Sequence
  Description of Artificial Sequence: Synthetic oligonucleotide
cctgcacgtcctggaagaccccc

SEQ ID NO: 252753 - DNA, 24 bp, Artificial Sequence
  Description of Artificial Sequence: Synthetic oligonucleotide
ctgcacgtcctggaagacccccgt

SEQ ID NO: 252754 - DNA, 25 bp, Artificial Sequence
  Description of Artificial Sequence: Synthetic oligonucleotide
tgcacgtcctggaagacccccgtct

SEQ ID NO: 252755 - DNA, 24 bp, Artificial Sequence
  Description of Artificial Sequence: Synthetic oligonucleotide
gcacgtcctggaagacccccgtct

SEQ ID NO: 252756 - DNA, 24 bp, Artificial Sequence
  Description of Artificial Sequence: Synthetic oligonucleotide
cacgtcctggaagacccccgtctg

SEQ ID NO: 252757 - DNA, 25 bp, Artificial Sequence
  Description of Artificial Sequence: Synthetic oligonucleotide
acgtcctggaagacccccgtctgga

SEQ ID NO: 252758 - DNA, 24 bp, Artificial Sequence
  Description of Artificial Sequence: Synthetic oligonucleotide
cgtcctggaagacccccgtctgga

SEQ ID NO: 252759 - DNA, 24 bp, Artificial Sequence
  Description of Artificial Sequence: Synthetic oligonucleotide
gtcctggaagacccccgtctggag

SEQ ID NO: 252760 - DNA, 27 bp, Artificial Sequence
  Description of Artificial Sequence: Synthetic oligonucleotide
tcctggaagacccccgtctggagcaaa

SEQ ID NO: 252761 - DNA, 27 bp, Artificial Sequence
  Description of Artificial Sequence: Synthetic oligonucleotide
cctggaagacccccgtctggagcaaat

SEQ ID NO: 252762 - DNA, 28 bp, Artificial Sequence
  Description of Artificial Sequence: Synthetic oligonucleotide
ctggaagacccccgtctggagcaaatag

SEQ ID NO: 252763 - DNA, 28 bp, Artificial Sequence
  Description of Artificial Sequence: Synthetic oligonucleotide
tggaagacccccgtctggagcaaatagc

SEQ ID NO: 252764 - DNA, 27 bp, Artificial Sequence
  Description of Artificial Sequence: Synthetic oligonucleotide
ggaagacccccgtctggagcaaatagc

SEQ ID NO: 252765 - DNA, 28 bp, Artificial Sequence
  Description of Artificial Sequence: Synthetic oligonucleotide
gaagacccccgtctggagcaaatagcac

SEQ ID NO: 252766 - DNA, 29 bp, Artificial Sequence
  Description of Artificial Sequence: Synthetic oligonucleotide
aagacccccgtctggagcaaatagcactg

SEQ ID NO: 252767 - DNA, 28 bp, Artificial Sequence
  Description of Artificial Sequence: Synthetic oligonucleotide
agacccccgtctggagcaaatagcactg

SEQ ID NO: 252768 - DNA, 27 bp, Artificial Sequence
  Description of Artificial Sequence: Synthetic oligonucleotide
gacccccgtctggagcaaatagcactg

SEQ ID NO: 252769 - DNA, 27 bp, Artificial Sequence
  Description of Artificial Sequence: Synthetic oligonucleotide
acccccgtctggagcaaatagcactgc

SEQ ID NO: 252770 - DNA, 27 bp, Artificial Sequence
  Description of Artificial Sequence: Synthetic oligonucleotide
cccccgtctggagcaaatagcactgct

SEQ ID NO: 252771 - DNA, 27 bp, Artificial Sequence
  Description of Artificial Sequence: Synthetic oligonucleotide
ccccgtctggagcaaatagcactgctg

SEQ ID NO: 252772 - DNA, 27 bp, Artificial Sequence
  Description of Artificial Sequence: Synthetic oligonucleotide
cccgtctggagcaaatagcactgctgc

SEQ ID NO: 252773 - DNA, 27 bp, Artificial Sequence
  Description of Artificial Sequence: Synthetic oligonucleotide
ccgtctggagcaaatagcactgctgcc

SEQ ID NO: 252774 - DNA, 28 bp, Artificial Sequence
  Description of Artificial Sequence: Synthetic oligonucleotide
cgtctggagcaaatagcactgctgcctc

SEQ ID NO: 252775 - DNA, 28 bp, Artificial Sequence
  Description of Artificial Sequence: Synthetic oligonucleotide
gtctggagcaaatagcactgctgcctcc

SEQ ID NO: 252776 - DNA, 28 bp, Artificial Sequence
  Description of Artificial Sequence: Synthetic oligonucleotide
tctggagcaaatagcactgctgcctccc

SEQ ID NO: 252777 - DNA, 27 bp, Artificial Sequence
  Description of Artificial Sequence: Synthetic oligonucleotide
ctggagcaaatagcactgctgcctccc

SEQ ID NO: 252778 - DNA, 27 bp, Artificial Sequence
  Description of Artificial Sequence: Synthetic oligonucleotide
tggagcaaatagcactgctgcctcccg

SEQ ID NO: 252779 - DNA, 27 bp, Artificial Sequence
  Description of Artificial Sequence: Synthetic oligonucleotide
ggagcaaatagcactgctgcctcccga

SEQ ID NO: 252780 - DNA, 27 bp, Artificial Sequence
  Description of Artificial Sequence: Synthetic oligonucleotide
gagcaaatagcactgctgcctcccgag

SEQ ID NO: 252781 - DNA, 27 bp, Artificial Sequence
  Description of Artificial Sequence: Synthetic oligonucleotide
agcaaatagcactgctgcctcccgagc

SEQ ID NO: 252782 - DNA, 26 bp, Artificial Sequence
  Description of Artificial Sequence: Synthetic oligonucleotide
gcaaatagcactgctgcctcccgagc

SEQ ID NO: 252783 - DNA, 26 bp, Artificial Sequence
  Description of Artificial Sequence: Synthetic oligonucleotide
caaatagcactgctgcctcccgagcg

SEQ ID NO: 252784 - DNA, 26 bp, Artificial Sequence
  Description of Artificial Sequence: Synthetic oligonucleotide
aaatagcactgctgcctcccgagcgc

SEQ ID NO: 252785 - DNA, 25 bp, Artificial Sequence
  Description of Artificial Sequence: Synthetic oligonucleotide
aatagcactgctgcctcccgagcgc

SEQ ID NO: 252786 - DNA, 24 bp, Artificial Sequence
  Description of Artificial Sequence: Synthetic oligonucleotide
atagcactgctgcctcccgagcgc

SEQ ID NO: 252787 - DNA, 23 bp, Artificial Sequence
  Description of Artificial Sequence: Synthetic oligonucleotide
tagcactgctgcctcccgagcgc

SEQ ID NO: 252788 - DNA, 22 bp, Artificial Sequence
  Description of Artificial Sequence: Synthetic oligonucleotide
agcactgctgcctcccgagcgc

SEQ ID NO: 252789 - DNA, 21 bp, Artificial Sequence
  Description of Artificial Sequence: Synthetic oligonucleotide
gcactgctgcctcccgagcgc

SEQ ID NO: 252790 - DNA, 22 bp, Artificial Sequence
  Description of Artificial Sequence: Synthetic oligonucleotide
cactgctgcctcccgagcgcct

SEQ ID NO: 252791 - DNA, 22 bp, Artificial Sequence
  Description of Artificial Sequence: Synthetic oligonucleotide
actgctgcctcccgagcgcctc

SEQ ID NO: 252792 - DNA, 21 bp, Artificial Sequence
  Description of Artificial Sequence: Synthetic oligonucleotide
ctgctgcctcccgagcgcctc

SEQ ID NO: 252793 - DNA, 23 bp, Artificial Sequence
  Description of Artificial Sequence: Synthetic oligonucleotide
tgctgcctcccgagcgcctcctt

SEQ ID NO: 252794 - DNA, 22 bp, Artificial Sequence
  Description of Artificial Sequence: Synthetic oligonucleotide
gctgcctcccgagcgcctcctt

SEQ ID NO: 252795 - DNA, 23 bp, Artificial Sequence
  Description of Artificial Sequence: Synthetic oligonucleotide
ctgcctcccgagcgcctccttgt

SEQ ID NO: 252796 - DNA, 23 bp, Artificial Sequence
  Description of Artificial Sequence: Synthetic oligonucleotide
tgcctcccgagcgcctccttgtg

SEQ ID NO: 252797 - DNA, 22 bp, Artificial Sequence
  Description of Artificial Sequence: Synthetic oligonucleotide
gcctcccgagcgcctccttgtg

SEQ ID NO: 252798 - DNA, 22 bp, Artificial Sequence
  Description of Artificial Sequence: Synthetic oligonucleotide
cctcccgagcgcctccttgtgg

SEQ ID NO: 252799 - DNA, 22 bp, Artificial Sequence
  Description of Artificial Sequence: Synthetic oligonucleotide
ctcccgagcgcctccttgtggg

SEQ ID NO: 252800 - DNA, 22 bp, Artificial Sequence
  Description of Artificial Sequence: Synthetic oligonucleotide
tcccgagcgcctccttgtgggg

SEQ ID NO: 252801 - DNA, 21 bp, Artificial Sequence
  Description of Artificial Sequence: Synthetic oligonucleotide
cccgagcgcctccttgtgggg

SEQ ID NO: 252802 - DNA, 22 bp, Artificial Sequence
  Description of Artificial Sequence: Synthetic oligonucleotide
ccgagcgcctccttgtggggct

SEQ ID NO: 252803 - DNA, 22 bp, Artificial Sequence
  Description of Artificial Sequence: Synthetic oligonucleotide
cgagcgcctccttgtggggctc

SEQ ID NO: 252804 - DNA, 22 bp, Artificial Sequence
  Description of Artificial Sequence: Synthetic oligonucleotide
gagcgcctccttgtggggctcc

SEQ ID NO: 252805 - DNA, 22 bp, Artificial Sequence
  Description of Artificial Sequence: Synthetic oligonucleotide
agcgcctccttgtggggctccc

SEQ ID NO: 252806 - DNA, 21 bp, Artificial Sequence
  Description of Artificial Sequence: Synthetic oligonucleotide
gcgcctccttgtggggctccc

SEQ ID NO: 252807 - DNA, 23 bp, Artificial Sequence
  Description of Artificial Sequence: Synthetic oligonucleotide
cgcctccttgtggggctcccgaa

SEQ ID NO: 252808 - DNA, 24 bp, Artificial Sequence
  Description of Artificial Sequence: Synthetic oligonucleotide
gcctccttgtggggctcccgaaca

SEQ ID NO: 252809 - DNA, 25 bp, Artificial Sequence
  Description of Artificial Sequence: Synthetic oligonucleotide
cctccttgtggggctcccgaacaca

SEQ ID NO: 252810 - DNA, 27 bp, Artificial Sequence
  Description of Artificial Sequence: Synthetic oligonucleotide
ctccttgtggggctcccgaacacagtt

SEQ ID NO: 252811 - DNA, 27 bp, Artificial Sequence
  Description of Artificial Sequence: Synthetic oligonucleotide
tccttgtggggctcccgaacacagttg

SEQ ID NO: 252812 - DNA, 27 bp, Artificial Sequence
  Description of Artificial Sequence: Synthetic oligonucleotide
ccttgtggggctcccgaacacagttga

SEQ ID NO: 252813 - DNA, 27 bp, Artificial Sequence
  Description of Artificial Sequence: Synthetic oligonucleotide
cttgtggggctcccgaacacagttgac

SEQ ID NO: 252814 - DNA, 30 bp, Artificial Sequence
  Description of Artificial Sequence: Synthetic oligonucleotide
ttgtggggctcccgaacacagttgacattc

SEQ ID NO: 252815 - DNA, 29 bp, Artificial Sequence
  Description of Artificial Sequence: Synthetic oligonucleotide
tgtggggctcccgaacacagttgacattc

SEQ ID NO: 252816 - DNA, 28 bp, Artificial Sequence
  Description of Artificial Sequence: Synthetic oligonucleotide
gtggggctcccgaacacagttgacattc

SEQ ID NO: 252817 - DNA, 29 bp, Artificial Sequence
  Description of Artificial Sequence: Synthetic oligonucleotide
tggggctcccgaacacagttgacattcac

SEQ ID NO: 252818 - DNA, 28 bp, Artificial Sequence
  Description of Artificial Sequence: Synthetic oligonucleotide
ggggctcccgaacacagttgacattcac

SEQ ID NO: 252819 - DNA, 31 bp, Artificial Sequence
  Description of Artificial Sequence: Synthetic oligonucleotide
gggctcccgaacacagttgacattcactaag

SEQ ID NO: 252820 - DNA, 31 bp, Artificial Sequence
  Description of Artificial Sequence: Synthetic oligonucleotide
ggctcccgaacacagttgacattcactaagc

SEQ ID NO: 252821 - DNA, 32 bp, Artificial Sequence
  Description of Artificial Sequence: Synthetic oligonucleotide
gctcccgaacacagttgacattcactaagctg

SEQ ID NO: 252822 - DNA, 32 bp, Artificial Sequence
  Description of Artificial Sequence: Synthetic oligonucleotide
ctcccgaacacagttgacattcactaagctgg

SEQ ID NO: 252823 - DNA, 32 bp, Artificial Sequence
  Description of Artificial Sequence: Synthetic oligonucleotide
tcccgaacacagttgacattcactaagctggc

SEQ ID NO: 252824 - DNA, 31 bp, Artificial Sequence
  Description of Artificial Sequence: Synthetic oligonucleotide
cccgaacacagttgacattcactaagctggc

SEQ ID NO: 252825 - DNA, 34 bp, Artificial Sequence
  Description of Artificial Sequence: Synthetic oligonucleotide
ccgaacacagttgacattcactaagctggcaatg

SEQ ID NO: 252826 - DNA, 37 bp, Artificial Sequence
  Description of Artificial Sequence: Synthetic oligonucleotide
cgaacacagttgacattcactaagctggcaatgtttc

SEQ ID NO: 252827 - DNA, 37 bp, Artificial Sequence
  Description of Artificial Sequence: Synthetic oligonucleotide
gaacacagttgacattcactaagctggcaatgtttcg

SEQ ID NO: 252828 - DNA, 37 bp, Artificial Sequence
  Description of Artificial Sequence: Synthetic oligonucleotide
aacacagttgacattcactaagctggcaatgtttcgg

SEQ ID NO: 252829 - DNA, 36 bp, Artificial Sequence
  Description of Artificial Sequence: Synthetic oligonucleotide
acacagttgacattcactaagctggcaatgtttcgg

SEQ ID NO: 252830 - DNA, 35 bp, Artificial Sequence
  Description of Artificial Sequence: Synthetic oligonucleotide
cacagttgacattcactaagctggcaatgtttcgg

SEQ ID NO: 252831 - DNA, 36 bp, Artificial Sequence
  Description of Artificial Sequence: Synthetic oligonucleotide
acagttgacattcactaagctggcaatgtttcggag

SEQ ID NO: 252832 - DNA, 35 bp, Artificial Sequence
  Description of Artificial Sequence: Synthetic oligonucleotide
cagttgacattcactaagctggcaatgtttcggag

SEQ ID NO: 252833 - DNA, 36 bp, Artificial Sequence
  Description of Artificial Sequence: Synthetic oligonucleotide
agttgacattcactaagctggcaatgtttcggagag

SEQ ID NO: 252834 - DNA, 35 bp, Artificial Sequence
  Description of Artificial Sequence: Synthetic oligonucleotide
gttgacattcactaagctggcaatgtttcggagag

SEQ ID NO: 252835 - DNA, 38 bp, Artificial Sequence
  Description of Artificial Sequence: Synthetic oligonucleotide
ttgacattcactaagctggcaatgtttcggagagtttc

SEQ ID NO: 252836 - DNA, 37 bp, Artificial Sequence
  Description of Artificial Sequence: Synthetic oligonucleotide
tgacattcactaagctggcaatgtttcggagagtttc

SEQ ID NO: 252837 - DNA, 36 bp, Artificial Sequence
  Description of Artificial Sequence: Synthetic oligonucleotide
gacattcactaagctggcaatgtttcggagagtttc

SEQ ID NO: 252838 - DNA, 36 bp, Artificial Sequence
  Description of Artificial Sequence: Synthetic oligonucleotide
acattcactaagctggcaatgtttcggagagtttcc

SEQ ID NO: 252839 - DNA, 35 bp, Artificial Sequence
  Description of Artificial Sequence: Synthetic oligonucleotide
cattcactaagctggcaatgtttcggagagtttcc

SEQ ID NO: 252840 - DNA, 36 bp, Artificial Sequence
  Description of Artificial Sequence: Synthetic oligonucleotide
attcactaagctggcaatgtttcggagagtttccac

SEQ ID NO: 252841 - DNA, 35 bp, Artificial Sequence
  Description of Artificial Sequence: Synthetic oligonucleotide
ttcactaagctggcaatgtttcggagagtttccac

SEQ ID NO: 252842 - DNA, 34 bp, Artificial Sequence
  Description of Artificial Sequence: Synthetic oligonucleotide
tcactaagctggcaatgtttcggagagtttccac

SEQ ID NO: 252843 - DNA, 33 bp, Artificial Sequence
  Description of Artificial Sequence: Synthetic oligonucleotide
cactaagctggcaatgtttcggagagtttccac

SEQ ID NO: 252844 - DNA, 33 bp, Artificial Sequence
  Description of Artificial Sequence: Synthetic oligonucleotide
actaagctggcaatgtttcggagagtttccacg

SEQ ID NO: 252845 - DNA, 32 bp, Artificial Sequence
  Description of Artificial Sequence: Synthetic oligonucleotide
ctaagctggcaatgtttcggagagtttccacg

SEQ ID NO: 252846 - DNA, 32 bp, Artificial Sequence
  Description of Artificial Sequence: Synthetic oligonucleotide
taagctggcaatgtttcggagagtttccacgg

SEQ ID NO: 252847 - DNA, 31 bp, Artificial Sequence
  Description of Artificial Sequence: Synthetic oligonucleotide
aagctggcaatgtttcggagagtttccacgg

SEQ ID NO: 252848 - DNA, 30 bp, Artificial Sequence
  Description of Artificial Sequence: Synthetic oligonucleotide
agctggcaatgtttcggagagtttccacgg

SEQ ID NO: 252849 - DNA, 29 bp, Artificial Sequence
  Description of Artificial Sequence: Synthetic oligonucleotide
gctggcaatgtttcggagagtttccacgg

SEQ ID NO: 252850 - DNA, 35 bp, Artificial Sequence
  Description of Artificial Sequence: Synthetic oligonucleotide
ctggcaatgtttcggagagtttccacggtttttac

SEQ ID NO: 252851 - DNA, 39 bp, Artificial Sequence
  Description of Artificial Sequence: Synthetic oligonucleotide
tggcaatgtttcggagagtttccacggtttttacaaatg

SEQ ID NO: 252852 - DNA, 38 bp, Artificial Sequence
  Description of Artificial Sequence: Synthetic oligonucleotide
ggcaatgtttcggagagtttccacggtttttacaaatg

SEQ ID NO: 252853 - DNA, 38 bp, Artificial Sequence
  Description of Artificial Sequence: Synthetic oligonucleotide
gcaatgtttcggagagtttccacggtttttacaaatgc

SEQ ID NO: 252854 - DNA, 39 bp, Artificial Sequence
  Description of Artificial Sequence: Synthetic oligonucleotide
caatgtttcggagagtttccacggtttttacaaatgcac

SEQ ID NO: 252855 - DNA, 39 bp, Artificial Sequence
  Description of Artificial Sequence: Synthetic oligonucleotide
aatgtttcggagagtttccacggtttttacaaatgcacc

SEQ ID NO: 252856 - DNA, 38 bp, Artificial Sequence
  Description of Artificial Sequence: Synthetic oligonucleotide
atgtttcggagagtttccacggtttttacaaatgcacc

SEQ ID NO: 252857 - DNA, 37 bp, Artificial Sequence
  Description of Artificial Sequence: Synthetic oligonucleotide
tgtttcggagagtttccacggtttttacaaatgcacc

SEQ ID NO: 252858 - DNA, 36 bp, Artificial Sequence
  Description of Artificial Sequence: Synthetic oligonucleotide
gtttcggagagtttccacggtttttacaaatgcacc

SEQ ID NO: 252859 - DNA, 38 bp, Artificial Sequence
  Description of Artificial Sequence: Synthetic oligonucleotide
tttcggagagtttccacggtttttacaaatgcacctac

SEQ ID NO: 252860 - DNA, 37 bp, Artificial Sequence
  Description of Artificial Sequence: Synthetic oligonucleotide
ttcggagagtttccacggtttttacaaatgcacctac

SEQ ID NO: 252861 - DNA, 36 bp, Artificial Sequence
  Description of Artificial Sequence: Synthetic oligonucleotide
tcggagagtttccacggtttttacaaatgcacctac

SEQ ID NO: 252862 - DNA, 35 bp, Artificial Sequence
  Description of Artificial Sequence: Synthetic oligonucleotide
cggagagtttccacggtttttacaaatgcacctac

SEQ ID NO: 252863 - DNA, 36 bp, Artificial Sequence
  Description of Artificial Sequence: Synthetic oligonucleotide
ggagagtttccacggtttttacaaatgcacctacac

SEQ ID NO: 252864 - DNA, 38 bp, Artificial Sequence
  Description of Artificial Sequence: Synthetic oligonucleotide
gagagtttccacggtttttacaaatgcacctacacaac

SEQ ID NO: 252865 - DNA, 38 bp, Artificial Sequence
  Description of Artificial Sequence: Synthetic oligonucleotide
agagtttccacggtttttacaaatgcacctacacaacc

SEQ ID NO: 252866 - DNA, 37 bp, Artificial Sequence
  Description of Artificial Sequence: Synthetic oligonucleotide
gagtttccacggtttttacaaatgcacctacacaacc

SEQ ID NO: 252867 - DNA, 39 bp, Artificial Sequence
  Description of Artificial Sequence: Synthetic oligonucleotide
agtttccacggtttttacaaatgcacctacacaaccaag

SEQ ID NO: 252868 - DNA, 38 bp, Artificial Sequence
  Description of Artificial Sequence: Synthetic oligonucleotide
gtttccacggtttttacaaatgcacctacacaaccaag

SEQ ID NO: 252869 - DNA, 38 bp, Artificial Sequence
  Description of Artificial Sequence: Synthetic oligonucleotide
tttccacggtttttacaaatgcacctacacaaccaagg

SEQ ID NO: 252870 - DNA, 37 bp, Artificial Sequence
  Description of Artificial Sequence: Synthetic oligonucleotide
ttccacggtttttacaaatgcacctacacaaccaagg

SEQ ID NO: 252871 - DNA, 36 bp, Artificial Sequence
  Description of Artificial Sequence: Synthetic oligonucleotide
tccacggtttttacaaatgcacctacacaaccaagg

SEQ ID NO: 252872 - DNA, 35 bp, Artificial Sequence
  Description of Artificial Sequence: Synthetic oligonucleotide
ccacggtttttacaaatgcacctacacaaccaagg

SEQ ID NO: 252873 - DNA, 37 bp, Artificial Sequence
  Description of Artificial Sequence: Synthetic oligonucleotide
cacggtttttacaaatgcacctacacaaccaaggatg

SEQ ID NO: 252874 - DNA, 37 bp, Artificial Sequence
  Description of Artificial Sequence: Synthetic oligonucleotide
acggtttttacaaatgcacctacacaaccaaggatgg

SEQ ID NO: 252875 - DNA, 36 bp, Artificial Sequence
  Description of Artificial Sequence: Synthetic oligonucleotide
cggtttttacaaatgcacctacacaaccaaggatgg

SEQ ID NO: 252876 - DNA, 36 bp, Artificial Sequence
  Description of Artificial Sequence: Synthetic oligonucleotide
ggtttttacaaatgcacctacacaaccaaggatggg

SEQ ID NO: 252877 - DNA, 36 bp, Artificial Sequence
  Description of Artificial Sequence: Synthetic oligonucleotide
gtttttacaaatgcacctacacaaccaaggatgggg

SEQ ID NO: 252878 - DNA, 38 bp, Artificial Sequence
  Description of Artificial Sequence: Synthetic oligonucleotide
tttttacaaatgcacctacacaaccaaggatggggaac

SEQ ID NO: 252879 - DNA, 37 bp, Artificial Sequence
  Description of Artificial Sequence: Synthetic oligonucleotide
ttttacaaatgcacctacacaaccaaggatggggaac

SEQ ID NO: 252880 - DNA, 36 bp, Artificial Sequence
  Description of Artificial Sequence: Synthetic oligonucleotide
tttacaaatgcacctacacaaccaaggatggggaac

SEQ ID NO: 252881 - DNA, 35 bp, Artificial Sequence
  Description of Artificial Sequence: Synthetic oligonucleotide
ttacaaatgcacctacacaaccaaggatggggaac

SEQ ID NO: 252882 - DNA, 34 bp, Artificial Sequence
  Description of Artificial Sequence: Synthetic oligonucleotide
tacaaatgcacctacacaaccaaggatggggaac

SEQ ID NO: 252883 - DNA, 33 bp, Artificial Sequence
  Description of Artificial Sequence: Synthetic oligonucleotide
acaaatgcacctacacaaccaaggatggggaac

SEQ ID NO: 252884 - DNA, 32 bp, Artificial Sequence
  Description of Artificial Sequence: Synthetic oligonucleotide
caaatgcacctacacaaccaaggatggggaac

SEQ ID NO: 252885 - DNA, 33 bp, Artificial Sequence
  Description of Artificial Sequence: Synthetic oligonucleotide
aaatgcacctacacaaccaaggatggggaactg

SEQ ID NO: 252886 - DNA, 32 bp, Artificial Sequence
  Description of Artificial Sequence: Synthetic oligonucleotide
aatgcacctacacaaccaaggatggggaactg

SEQ ID NO: 252887 - DNA, 31 bp, Artificial Sequence
  Description of Artificial Sequence: Synthetic oligonucleotide
atgcacctacacaaccaaggatggggaactg

SEQ ID NO: 252888 - DNA, 30 bp, Artificial Sequence
  Description of Artificial Sequence: Synthetic oligonucleotide
tgcacctacacaaccaaggatggggaactg

SEQ ID NO: 252889 - DNA, 29 bp, Artificial Sequence
  Description of Artificial Sequence: Synthetic oligonucleotide
gcacctacacaaccaaggatggggaactg

SEQ ID NO: 252890 - DNA, 30 bp, Artificial Sequence
  Description of Artificial Sequence: Synthetic oligonucleotide
cacctacacaaccaaggatggggaactgtg

SEQ ID NO: 252891 - DNA, 30 bp, Artificial Sequence
  Description of Artificial Sequence: Synthetic oligonucleotide
acctacacaaccaaggatggggaactgtgg

SEQ ID NO: 252892 - DNA, 29 bp, Artificial Sequence
  Description of Artificial Sequence: Synthetic oligonucleotide
cctacacaaccaaggatggggaactgtgg

SEQ ID NO: 252893 - DNA, 32 bp, Artificial Sequence
  Description of Artificial Sequence: Synthetic oligonucleotide
ctacacaaccaaggatggggaactgtggatac

SEQ ID NO: 252894 - DNA, 34 bp, Artificial Sequence
  Description of Artificial Sequence: Synthetic oligonucleotide
tacacaaccaaggatggggaactgtggatactag

SEQ ID NO: 252895 - DNA, 33 bp, Artificial Sequence
  Description of Artificial Sequence: Synthetic oligonucleotide
acacaaccaaggatggggaactgtggatactag

SEQ ID NO: 252896 - DNA, 32 bp, Artificial Sequence
  Description of Artificial Sequence: Synthetic oligonucleotide
cacaaccaaggatggggaactgtggatactag

SEQ ID NO: 252897 - DNA, 32 bp, Artificial Sequence
  Description of Artificial Sequence: Synthetic oligonucleotide
acaaccaaggatggggaactgtggatactagg

SEQ ID NO: 252898 - DNA, 31 bp, Artificial Sequence
  Description of Artificial Sequence: Synthetic oligonucleotide
caaccaaggatggggaactgtggatactagg

SEQ ID NO: 252899 - DNA, 33 bp, Artificial Sequence
  Description of Artificial Sequence: Synthetic oligonucleotide
aaccaaggatggggaactgtggatactaggatc

SEQ ID NO: 252900 - DNA, 32 bp, Artificial Sequence
  Description of Artificial Sequence: Synthetic oligonucleotide
accaaggatggggaactgtggatactaggatc

SEQ ID NO: 252901 - DNA, 31 bp, Artificial Sequence
  Description of Artificial Sequence: Synthetic oligonucleotide
ccaaggatggggaactgtggatactaggatc

SEQ ID NO: 252902 - DNA, 33 bp, Artificial Sequence
  Description of Artificial Sequence: Synthetic oligonucleotide
caaggatggggaactgtggatactaggatcaac

SEQ ID NO: 252903 - DNA, 34 bp, Artificial Sequence
  Description of Artificial Sequence: Synthetic oligonucleotide
aaggatggggaactgtggatactaggatcaacac

SEQ ID NO: 252904 - DNA, 33 bp, Artificial Sequence
  Description of Artificial Sequence: Synthetic oligonucleotide
aggatggggaactgtggatactaggatcaacac

SEQ ID NO: 252905 - DNA, 32 bp, Artificial Sequence
  Description of Artificial Sequence: Synthetic oligonucleotide
ggatggggaactgtggatactaggatcaacac

SEQ ID NO: 252906 - DNA, 37 bp, Artificial Sequence
  Description of Artificial Sequence: Synthetic oligonucleotide
gatggggaactgtggatactaggatcaacacattttg

SEQ ID NO: 252907 - DNA, 39 bp, Artificial Sequence
  Description of Artificial Sequence: Synthetic oligonucleotide
atggggaactgtggatactaggatcaacacattttgaac

SEQ ID NO: 252908 - DNA, 38 bp, Artificial Sequence
  Description of Artificial Sequence: Synthetic oligonucleotide
tggggaactgtggatactaggatcaacacattttgaac

SEQ ID NO: 252909 - DNA, 37 bp, Artificial Sequence
  Description of Artificial Sequence: Synthetic oligonucleotide
ggggaactgtggatactaggatcaacacattttgaac

SEQ ID NO: 252910 - DNA, 37 bp, Artificial Sequence
  Description of Artificial Sequence: Synthetic oligonucleotide
gggaactgtggatactaggatcaacacattttgaacc

SEQ ID NO: 252911 - DNA, 37 bp, Artificial Sequence
  Description of Artificial Sequence: Synthetic oligonucleotide
ggaactgtggatactaggatcaacacattttgaaccc

SEQ ID NO: 252912 - DNA, 38 bp, Artificial Sequence
  Description of Artificial Sequence: Synthetic oligonucleotide
gaactgtggatactaggatcaacacattttgaaccctc

SEQ ID NO: 252913 - DNA, 39 bp, Artificial Sequence
  Description of Artificial Sequence: Synthetic oligonucleotide
aactgtggatactaggatcaacacattttgaaccctctg

SEQ ID NO: 252914 - DNA, 38 bp, Artificial Sequence
  Description of Artificial Sequence: Synthetic oligonucleotide
actgtggatactaggatcaacacattttgaaccctctg

SEQ ID NO: 252915 - DNA, 37 bp, Artificial Sequence
  Description of Artificial Sequence: Synthetic oligonucleotide
ctgtggatactaggatcaacacattttgaaccctctg

SEQ ID NO: 252916 - DNA, 37 bp, Artificial Sequence
  Description of Artificial Sequence: Synthetic oligonucleotide
tgtggatactaggatcaacacattttgaaccctctgc

SEQ ID NO: 252917 - DNA, 36 bp, Artificial Sequence
  Description of Artificial Sequence: Synthetic oligonucleotide
gtggatactaggatcaacacattttgaaccctctgc

SEQ ID NO: 252918 - DNA, 37 bp, Artificial Sequence
  Description of Artificial Sequence: Synthetic oligonucleotide
tggatactaggatcaacacattttgaaccctctgcag

SEQ ID NO: 252919 - DNA, 36 bp, Artificial Sequence
  Description of Artificial Sequence: Synthetic oligonucleotide
ggatactaggatcaacacattttgaaccctctgcag

SEQ ID NO: 252920 - DNA, 36 bp, Artificial Sequence
  Description of Artificial Sequence: Synthetic oligonucleotide
gatactaggatcaacacattttgaaccctctgcagc

SEQ ID NO: 252921 - DNA, 38 bp, Artificial Sequence
  Description of Artificial Sequence: Synthetic oligonucleotide
atactaggatcaacacattttgaaccctctgcagctac

SEQ ID NO: 252922 - DNA, 37 bp, Artificial Sequence
  Description of Artificial Sequence: Synthetic oligonucleotide
tactaggatcaacacattttgaaccctctgcagctac

SEQ ID NO: 252923 - DNA, 36 bp, Artificial Sequence
  Description of Artificial Sequence: Synthetic oligonucleotide
actaggatcaacacattttgaaccctctgcagctac

SEQ ID NO: 252924 - DNA, 35 bp, Artificial Sequence
  Description of Artificial Sequence: Synthetic oligonucleotide
ctaggatcaacacattttgaaccctctgcagctac

SEQ ID NO: 252925 - DNA, 38 bp, Artificial Sequence
  Description of Artificial Sequence: Synthetic oligonucleotide
taggatcaacacattttgaaccctctgcagctacaatg

SEQ ID NO: 252926 - DNA, 37 bp, Artificial Sequence
  Description of Artificial Sequence: Synthetic oligonucleotide
aggatcaacacattttgaaccctctgcagctacaatg

SEQ ID NO: 252927 - DNA, 36 bp, Artificial Sequence
  Description of Artificial Sequence: Synthetic oligonucleotide
ggatcaacacattttgaaccctctgcagctacaatg

SEQ ID NO: 252928 - DNA, 36 bp, Artificial Sequence
  Description of Artificial Sequence: Synthetic oligonucleotide
gatcaacacattttgaaccctctgcagctacaatgg

SEQ ID NO: 252929 - DNA, 36 bp, Artificial Sequence
  Description of Artificial Sequence: Synthetic oligonucleotide
atcaacacattttgaaccctctgcagctacaatggc

SEQ ID NO: 252930 - DNA, 35 bp, Artificial Sequence
  Description of Artificial Sequence: Synthetic oligonucleotide
tcaacacattttgaaccctctgcagctacaatggc

SEQ ID NO: 252931 - DNA, 34 bp, Artificial Sequence
  Description of Artificial Sequence: Synthetic oligonucleotide
caacacattttgaaccctctgcagctacaatggc

SEQ ID NO: 252932 - DNA, 34 bp, Artificial Sequence
  Description of Artificial Sequence: Synthetic oligonucleotide
aacacattttgaaccctctgcagctacaatggcc

SEQ ID NO: 252933 - DNA, 33 bp, Artificial Sequence
  Description of Artificial Sequence: Synthetic oligonucleotide
acacattttgaaccctctgcagctacaatggcc

SEQ ID NO: 252934 - DNA, 32 bp, Artificial Sequence
  Description of Artificial Sequence: Synthetic oligonucleotide
cacattttgaaccctctgcagctacaatggcc

SEQ ID NO: 252935 - DNA, 35 bp, Artificial Sequence
  Description of Artificial Sequence: Synthetic oligonucleotide
acattttgaaccctctgcagctacaatggccttac

SEQ ID NO: 252936 - DNA, 34 bp, Artificial Sequence
  Description of Artificial Sequence: Synthetic oligonucleotide
cattttgaaccctctgcagctacaatggccttac

SEQ ID NO: 252937 - DNA, 34 bp, Artificial Sequence
  Description of Artificial Sequence: Synthetic oligonucleotide
attttgaaccctctgcagctacaatggccttacc

SEQ ID NO: 252938 - DNA, 33 bp, Artificial Sequence
  Description of Artificial Sequence: Synthetic oligonucleotide
ttttgaaccctctgcagctacaatggccttacc

SEQ ID NO: 252939 - DNA, 32 bp, Artificial Sequence
  Description of Artificial Sequence: Synthetic oligonucleotide
tttgaaccctctgcagctacaatggccttacc

SEQ ID NO: 252940 - DNA, 31 bp, Artificial Sequence
  Description of Artificial Sequence: Synthetic oligonucleotide
ttgaaccctctgcagctacaatggccttacc

SEQ ID NO: 252941 - DNA, 30 bp, Artificial Sequence
  Description of Artificial Sequence: Synthetic oligonucleotide
tgaaccctctgcagctacaatggccttacc

SEQ ID NO: 252942 - DNA, 29 bp, Artificial Sequence
  Description of Artificial Sequence: Synthetic oligonucleotide
gaaccctctgcagctacaatggccttacc

SEQ ID NO: 252943 - DNA, 29 bp, Artificial Sequence
  Description of Artificial Sequence: Synthetic oligonucleotide
aaccctctgcagctacaatggccttaccc

SEQ ID NO: 252944 - DNA, 28 bp, Artificial Sequence
  Description of Artificial Sequence: Synthetic oligonucleotide
accctctgcagctacaatggccttaccc

SEQ ID NO: 252945 - DNA, 27 bp, Artificial Sequence
  Description of Artificial Sequence: Synthetic oligonucleotide
ccctctgcagctacaatggccttaccc

SEQ ID NO: 252946 - DNA, 28 bp, Artificial Sequence
  Description of Artificial Sequence: Synthetic oligonucleotide
cctctgcagctacaatggccttaccctg

SEQ ID NO: 252947 - DNA, 28 bp, Artificial Sequence
  Description of Artificial Sequence: Synthetic oligonucleotide
ctctgcagctacaatggccttaccctgc

SEQ ID NO: 252948 - DNA, 31 bp, Artificial Sequence
  Description of Artificial Sequence: Synthetic oligonucleotide
tctgcagctacaatggccttaccctgctttc

SEQ ID NO: 252949 - DNA, 30 bp, Artificial Sequence
  Description of Artificial Sequence: Synthetic oligonucleotide
ctgcagctacaatggccttaccctgctttc

SEQ ID NO: 252950 - DNA, 32 bp, Artificial Sequence
  Description of Artificial Sequence: Synthetic oligonucleotide
tgcagctacaatggccttaccctgctttcatg

SEQ ID NO: 252951 - DNA, 31 bp, Artificial Sequence
  Description of Artificial Sequence: Synthetic oligonucleotide
gcagctacaatggccttaccctgctttcatg

SEQ ID NO: 252952 - DNA, 33 bp, Artificial Sequence
  Description of Artificial Sequence: Synthetic oligonucleotide
cagctacaatggccttaccctgctttcatgaac

SEQ ID NO: 252953 - DNA, 33 bp, Artificial Sequence
  Description of Artificial Sequence: Synthetic oligonucleotide
agctacaatggccttaccctgctttcatgaacc

SEQ ID NO: 252954 - DNA, 32 bp, Artificial Sequence
  Description of Artificial Sequence: Synthetic oligonucleotide
gctacaatggccttaccctgctttcatgaacc

SEQ ID NO: 252955 - DNA, 33 bp, Artificial Sequence
  Description of Artificial Sequence: Synthetic oligonucleotide
ctacaatggccttaccctgctttcatgaacctg

SEQ ID NO: 252956 - DNA, 33 bp, Artificial Sequence
  Description of Artificial Sequence: Synthetic oligonucleotide
tacaatggccttaccctgctttcatgaacctgg

SEQ ID NO: 252957 - DNA, 32 bp, Artificial Sequence
  Description of Artificial Sequence: Synthetic oligonucleotide
acaatggccttaccctgctttcatgaacctgg

SEQ ID NO: 252958 - DNA, 31 bp, Artificial Sequence
  Description of Artificial Sequence: Synthetic oligonucleotide
caatggccttaccctgctttcatgaacctgg

SEQ ID NO: 252959 - DNA, 31 bp, Artificial Sequence
  Description of Artificial Sequence: Synthetic oligonucleotide
aatggccttaccctgctttcatgaacctggc

SEQ ID NO: 252960 - DNA, 30 bp, Artificial Sequence
  Description of Artificial Sequence: Synthetic oligonucleotide
atggccttaccctgctttcatgaacctggc

SEQ ID NO: 252961 - DNA, 29 bp, Artificial Sequence
  Description of Artificial Sequence: Synthetic oligonucleotide
tggccttaccctgctttcatgaacctggc

SEQ ID NO: 252962 - DNA, 28 bp, Artificial Sequence
  Description of Artificial Sequence: Synthetic oligonucleotide
ggccttaccctgctttcatgaacctggc

SEQ ID NO: 252963 - DNA, 30 bp, Artificial Sequence
  Description of Artificial Sequence: Synthetic oligonucleotide
gccttaccctgctttcatgaacctggcttc

SEQ ID NO: 252964 - DNA, 33 bp, Artificial Sequence
  Description of Artificial Sequence: Synthetic oligonucleotide
ccttaccctgctttcatgaacctggcttcaaag

SEQ ID NO: 252965 - DNA, 33 bp, Artificial Sequence
  Description of Artificial Sequence: Synthetic oligonucleotide
cttaccctgctttcatgaacctggcttcaaagc

SEQ ID NO: 252966 - DNA, 35 bp, Artificial Sequence
  Description of Artificial Sequence: Synthetic oligonucleotide
ttaccctgctttcatgaacctggcttcaaagctag

SEQ ID NO: 252967 - DNA, 34 bp, Artificial Sequence
  Description of Artificial Sequence: Synthetic oligonucleotide
taccctgctttcatgaacctggcttcaaagctag

SEQ ID NO: 252968 - DNA, 33 bp, Artificial Sequence
  Description of Artificial Sequence: Synthetic oligonucleotide
accctgctttcatgaacctggcttcaaagctag

SEQ ID NO: 252969 - DNA, 32 bp, Artificial Sequence
  Description of Artificial Sequence: Synthetic oligonucleotide
ccctgctttcatgaacctggcttcaaagctag

SEQ ID NO: 252970 - DNA, 35 bp, Artificial Sequence
  Description of Artificial Sequence: Synthetic oligonucleotide
cctgctttcatgaacctggcttcaaagctagtttc

SEQ ID NO: 252971 - DNA, 36 bp, Artificial Sequence
  Description of Artificial Sequence: Synthetic oligonucleotide
ctgctttcatgaacctggcttcaaagctagtttctc

SEQ ID NO: 252972 - DNA, 39 bp, Artificial Sequence
  Description of Artificial Sequence: Synthetic oligonucleotide
tgctttcatgaacctggcttcaaagctagtttctcattc

SEQ ID NO: 252973 - DNA, 38 bp, Artificial Sequence
  Description of Artificial Sequence: Synthetic oligonucleotide
gctttcatgaacctggcttcaaagctagtttctcattc

SEQ ID NO: 252974 - DNA, 45 bp, Artificial Sequence
  Description of Artificial Sequence: Synthetic oligonucleotide
ctttcatgaacctggcttcaaagctagtttctcattcaaaattac

SEQ ID NO: 252975 - DNA, 47 bp, Artificial Sequence
  Description of Artificial Sequence: Synthetic oligonucleotide
tttcatgaacctggcttcaaagctagtttctcattcaaaattacaag

SEQ ID NO: 252976 - DNA, 46 bp, Artificial Sequence
  Description of Artificial Sequence: Synthetic oligonucleotide
ttcatgaacctggcttcaaagctagtttctcattcaaaattacaag

SEQ ID NO: 252977 - DNA, 45 bp, Artificial Sequence
  Description of Artificial Sequence: Synthetic oligonucleotide
tcatgaacctggcttcaaagctagtttctcattcaaaattacaag

SEQ ID NO: 252978 - DNA, 44 bp, Artificial Sequence
  Description of Artificial Sequence: Synthetic oligonucleotide
catgaacctggcttcaaagctagtttctcattcaaaattacaag

SEQ ID NO: 252979 - DNA, 45 bp, Artificial Sequence
  Description of Artificial Sequence: Synthetic oligonucleotide
atgaacctggcttcaaagctagtttctcattcaaaattacaagag

SEQ ID NO: 252980 - DNA, 44 bp, Artificial Sequence
  Description of Artificial Sequence: Synthetic oligonucleotide
tgaacctggcttcaaagctagtttctcattcaaaattacaagag

SEQ ID NO: 252981 - DNA, 43 bp, Artificial Sequence
  Description of Artificial Sequence: Synthetic oligonucleotide
gaacctggcttcaaagctagtttctcattcaaaattacaagag

SEQ ID NO: 252982 - DNA, 44 bp, Artificial Sequence
  Description of Artificial Sequence: Synthetic oligonucleotide
aacctggcttcaaagctagtttctcattcaaaattacaagagag

SEQ ID NO: 252983 - DNA, 43 bp, Artificial Sequence
  Description of Artificial Sequence: Synthetic oligonucleotide
acctggcttcaaagctagtttctcattcaaaattacaagagag

SEQ ID NO: 252984 - DNA, 42 bp, Artificial Sequence
  Description of Artificial Sequence: Synthetic oligonucleotide
cctggcttcaaagctagtttctcattcaaaattacaagagag

SEQ ID NO: 252985 - DNA, 42 bp, Artificial Sequence
  Description of Artificial Sequence: Synthetic oligonucleotide
ctggcttcaaagctagtttctcattcaaaattacaagagagc

SEQ ID NO: 252986 - DNA, 42 bp, Artificial Sequence
  Description of Artificial Sequence: Synthetic oligonucleotide
tggcttcaaagctagtttctcattcaaaattacaagagagcc

SEQ ID NO: 252987 - DNA, 41 bp, Artificial Sequence
  Description of Artificial Sequence: Synthetic oligonucleotide
ggcttcaaagctagtttctcattcaaaattacaagagagcc

SEQ ID NO: 252988 - DNA, 43 bp, Artificial Sequence
  Description of Artificial Sequence: Synthetic oligonucleotide
gcttcaaagctagtttctcattcaaaattacaagagagcctag

SEQ ID NO: 252989 - DNA, 43 bp, Artificial Sequence
  Description of Artificial Sequence: Synthetic oligonucleotide
cttcaaagctagtttctcattcaaaattacaagagagcctagg

SEQ ID NO: 252990 - DNA, 43 bp, Artificial Sequence
  Description of Artificial Sequence: Synthetic oligonucleotide
ttcaaagctagtttctcattcaaaattacaagagagcctaggc

SEQ ID NO: 252991 - DNA, 42 bp, Artificial Sequence
  Description of Artificial Sequence: Synthetic oligonucleotide
tcaaagctagtttctcattcaaaattacaagagagcctaggc

SEQ ID NO: 252992 - DNA, 41 bp, Artificial Sequence
  Description of Artificial Sequence: Synthetic oligonucleotide
caaagctagtttctcattcaaaattacaagagagcctaggc

SEQ ID NO: 252993 - DNA, 42 bp, Artificial Sequence
  Description of Artificial Sequence: Synthetic oligonucleotide
aaagctagtttctcattcaaaattacaagagagcctaggcac

SEQ ID NO: 252994 - DNA, 41 bp, Artificial Sequence
  Description of Artificial Sequence: Synthetic oligonucleotide
aagctagtttctcattcaaaattacaagagagcctaggcac

SEQ ID NO: 252995 - DNA, 40 bp, Artificial Sequence
  Description of Artificial Sequence: Synthetic oligonucleotide
agctagtttctcattcaaaattacaagagagcctaggcac

SEQ ID NO: 252996 - DNA, 39 bp, Artificial Sequence
  Description of Artificial Sequence: Synthetic oligonucleotide
gctagtttctcattcaaaattacaagagagcctaggcac

SEQ ID NO: 252997 - DNA, 39 bp, Artificial Sequence
  Description of Artificial Sequence: Synthetic oligonucleotide
ctagtttctcattcaaaattacaagagagcctaggcacc

SEQ ID NO: 252998 - DNA, 41 bp, Artificial Sequence
  Description of Artificial Sequence: Synthetic oligonucleotide
tagtttctcattcaaaattacaagagagcctaggcacctac

SEQ ID NO: 252999 - DNA, 40 bp, Artificial Sequence
  Description of Artificial Sequence: Synthetic oligonucleotide
agtttctcattcaaaattacaagagagcctaggcacctac

SEQ ID NO: 253000 - DNA, 39 bp, Artificial Sequence
  Description of Artificial Sequence: Synthetic oligonucleotide
gtttctcattcaaaattacaagagagcctaggcacctac

SEQ ID NO: 253001 - DNA, 39 bp, Artificial Sequence
  Description of Artificial Sequence: Synthetic oligonucleotide
tttctcattcaaaattacaagagagcctaggcacctacc

SEQ ID NO: 253002 - DNA, 38 bp, Artificial Sequence
  Description of Artificial Sequence: Synthetic oligonucleotide
ttctcattcaaaattacaagagagcctaggcacctacc

SEQ ID NO: 253003 - DNA, 37 bp, Artificial Sequence
  Description of Artificial Sequence: Synthetic oligonucleotide
tctcattcaaaattacaagagagcctaggcacctacc

SEQ ID NO: 253004 - DNA, 36 bp, Artificial Sequence
  Description of Artificial Sequence: Synthetic oligonucleotide
ctcattcaaaattacaagagagcctaggcacctacc

SEQ ID NO: 253005 - DNA, 36 bp, Artificial Sequence
  Description of Artificial Sequence: Synthetic oligonucleotide
tcattcaaaattacaagagagcctaggcacctaccc

SEQ ID NO: 253006 - DNA, 35 bp, Artificial Sequence
  Description of Artificial Sequence: Synthetic oligonucleotide
cattcaaaattacaagagagcctaggcacctaccc

SEQ ID NO: 253007 - DNA, 37 bp, Artificial Sequence
  Description of Artificial Sequence: Synthetic oligonucleotide
attcaaaattacaagagagcctaggcacctacccatc

SEQ ID NO: 253008 - DNA, 36 bp, Artificial Sequence
  Description of Artificial Sequence: Synthetic oligonucleotide
ttcaaaattacaagagagcctaggcacctacccatc

SEQ ID NO: 253009 - DNA, 35 bp, Artificial Sequence
  Description of Artificial Sequence: Synthetic oligonucleotide
tcaaaattacaagagagcctaggcacctacccatc

SEQ ID NO: 253010 - DNA, 34 bp, Artificial Sequence
  Description of Artificial Sequence: Synthetic oligonucleotide
caaaattacaagagagcctaggcacctacccatc

SEQ ID NO: 253011 - DNA, 35 bp, Artificial Sequence
  Description of Artificial Sequence: Synthetic oligonucleotide
aaaattacaagagagcctaggcacctacccatctc

SEQ ID NO: 253012 - DNA, 34 bp, Artificial Sequence
  Description of Artificial Sequence: Synthetic oligonucleotide
aaattacaagagagcctaggcacctacccatctc

SEQ ID NO: 253013 - DNA, 33 bp, Artificial Sequence
  Description of Artificial Sequence: Synthetic oligonucleotide
aattacaagagagcctaggcacctacccatctc

SEQ ID NO: 253014 - DNA, 32 bp, Artificial Sequence
  Description of Artificial Sequence: Synthetic oligonucleotide
attacaagagagcctaggcacctacccatctc

SEQ ID NO: 253015 - DNA, 31 bp, Artificial Sequence
  Description of Artificial Sequence: Synthetic oligonucleotide
ttacaagagagcctaggcacctacccatctc

SEQ ID NO: 253016 - DNA, 30 bp, Artificial Sequence
  Description of Artificial Sequence: Synthetic oligonucleotide
tacaagagagcctaggcacctacccatctc

SEQ ID NO: 253017 - DNA, 29 bp, Artificial Sequence
  Description of Artificial Sequence: Synthetic oligonucleotide
acaagagagcctaggcacctacccatctc

SEQ ID NO: 253018 - DNA, 28 bp, Artificial Sequence
  Description of Artificial Sequence: Synthetic oligonucleotide
caagagagcctaggcacctacccatctc

SEQ ID NO: 253019 - DNA, 28 bp, Artificial Sequence
  Description of Artificial Sequence: Synthetic oligonucleotide
aagagagcctaggcacctacccatctcc

SEQ ID NO: 253020 - DNA, 27 bp, Artificial Sequence
  Description of Artificial Sequence: Synthetic oligonucleotide
agagagcctaggcacctacccatctcc

SEQ ID NO: 253021 - DNA, 27 bp, Artificial Sequence
  Description of Artificial Sequence: Synthetic oligonucleotide
gagagcctaggcacctacccatctcca

SEQ ID NO: 253022 - DNA, 31 bp, Artificial Sequence
  Description of Artificial Sequence: Synthetic oligonucleotide
agagcctaggcacctacccatctccattatg

SEQ ID NO: 253023 - DNA, 30 bp, Artificial Sequence
  Description of Artificial Sequence: Synthetic oligonucleotide
gagcctaggcacctacccatctccattatg

SEQ ID NO: 253024 - DNA, 30 bp, Artificial Sequence
  Description of Artificial Sequence: Synthetic oligonucleotide
agcctaggcacctacccatctccattatgc

SEQ ID NO: 253025 - DNA, 29 bp, Artificial Sequence
  Description of Artificial Sequence: Synthetic oligonucleotide
gcctaggcacctacccatctccattatgc

SEQ ID NO: 253026 - DNA, 29 bp, Artificial Sequence
  Description of Artificial Sequence: Synthetic oligonucleotide
cctaggcacctacccatctccattatgcc

SEQ ID NO: 253027 - DNA, 32 bp, Artificial Sequence
  Description of Artificial Sequence: Synthetic oligonucleotide
ctaggcacctacccatctccattatgccattc

SEQ ID NO: 253028 - DNA, 32 bp, Artificial Sequence
  Description of Artificial Sequence: Synthetic oligonucleotide
taggcacctacccatctccattatgccattcg

SEQ ID NO: 253029 - DNA, 31 bp, Artificial Sequence
  Description of Artificial Sequence: Synthetic oligonucleotide
aggcacctacccatctccattatgccattcg

SEQ ID NO: 253030 - DNA, 30 bp, Artificial Sequence
  Description of Artificial Sequence: Synthetic oligonucleotide
ggcacctacccatctccattatgccattcg

SEQ ID NO: 253031 - DNA, 31 bp, Artificial Sequence
  Description of Artificial Sequence: Synthetic oligonucleotide
gcacctacccatctccattatgccattcgtg

SEQ ID NO: 253032 - DNA, 35 bp, Artificial Sequence
  Description of Artificial Sequence: Synthetic oligonucleotide
cacctacccatctccattatgccattcgtgaaatc

SEQ ID NO: 253033 - DNA, 36 bp, Artificial Sequence
  Description of Artificial Sequence: Synthetic oligonucleotide
acctacccatctccattatgccattcgtgaaatctc

SEQ ID NO: 253034 - DNA, 35 bp, Artificial Sequence
  Description of Artificial Sequence: Synthetic oligonucleotide
cctacccatctccattatgccattcgtgaaatctc

SEQ ID NO: 253035 - DNA, 36 bp, Artificial Sequence
  Description of Artificial Sequence: Synthetic oligonucleotide
ctacccatctccattatgccattcgtgaaatctctg

SEQ ID NO: 253036 - DNA, 37 bp, Artificial Sequence
  Description of Artificial Sequence: Synthetic oligonucleotide
tacccatctccattatgccattcgtgaaatctctgac

SEQ ID NO: 253037 - DNA, 36 bp, Artificial Sequence
  Description of Artificial Sequence: Synthetic oligonucleotide
acccatctccattatgccattcgtgaaatctctgac

SEQ ID NO: 253038 - DNA, 35 bp, Artificial Sequence
  Description of Artificial Sequence: Synthetic oligonucleotide
cccatctccattatgccattcgtgaaatctctgac

SEQ ID NO: 253039 - DNA, 36 bp, Artificial Sequence
  Description of Artificial Sequence: Synthetic oligonucleotide
ccatctccattatgccattcgtgaaatctctgactg

SEQ ID NO: 253040 - DNA, 38 bp, Artificial Sequence
  Description of Artificial Sequence: Synthetic oligonucleotide
catctccattatgccattcgtgaaatctctgactgttg

SEQ ID NO: 253041 - DNA, 38 bp, Artificial Sequence
  Description of Artificial Sequence: Synthetic oligonucleotide
atctccattatgccattcgtgaaatctctgactgttgg

SEQ ID NO: 253042 - DNA, 37 bp, Artificial Sequence
  Description of Artificial Sequence: Synthetic oligonucleotide
tctccattatgccattcgtgaaatctctgactgttgg

SEQ ID NO: 253043 - DNA, 36 bp, Artificial Sequence
  Description of Artificial Sequence: Synthetic oligonucleotide
ctccattatgccattcgtgaaatctctgactgttgg

SEQ ID NO: 253044 - DNA, 37 bp, Artificial Sequence
  Description of Artificial Sequence: Synthetic oligonucleotide
tccattatgccattcgtgaaatctctgactgttggtg

SEQ ID NO: 253045 - DNA, 36 bp, Artificial Sequence
  Description of Artificial Sequence: Synthetic oligonucleotide
ccattatgccattcgtgaaatctctgactgttggtg

SEQ ID NO: 253046 - DNA, 38 bp, Artificial Sequence
  Description of Artificial Sequence: Synthetic oligonucleotide
cattatgccattcgtgaaatctctgactgttggtgaag

SEQ ID NO: 253047 - DNA, 38 bp, Artificial Sequence
  Description of Artificial Sequence: Synthetic oligonucleotide
attatgccattcgtgaaatctctgactgttggtgaagg

SEQ ID NO: 253048 - DNA, 37 bp, Artificial Sequence
  Description of Artificial Sequence: Synthetic oligonucleotide
ttatgccattcgtgaaatctctgactgttggtgaagg

SEQ ID NO: 253049 - DNA, 36 bp, Artificial Sequence
  Description of Artificial Sequence: Synthetic oligonucleotide
tatgccattcgtgaaatctctgactgttggtgaagg

SEQ ID NO: 253050 - DNA, 35 bp, Artificial Sequence
  Description of Artificial Sequence: Synthetic oligonucleotide
atgccattcgtgaaatctctgactgttggtgaagg

SEQ ID NO: 253051 - DNA, 34 bp, Artificial Sequence
  Description of Artificial Sequence: Synthetic oligonucleotide
tgccattcgtgaaatctctgactgttggtgaagg

SEQ ID NO: 253052 - DNA, 33 bp, Artificial Sequence
  Description of Artificial Sequence: Synthetic oligonucleotide
gccattcgtgaaatctctgactgttggtgaagg

SEQ ID NO: 253053 - DNA, 34 bp, Artificial Sequence
  Description of Artificial Sequence: Synthetic oligonucleotide
ccattcgtgaaatctctgactgttggtgaaggac

SEQ ID NO: 253054 - DNA, 35 bp, Artificial Sequence
  Description of Artificial Sequence: Synthetic oligonucleotide
cattcgtgaaatctctgactgttggtgaaggactg

SEQ ID NO: 253055 - DNA, 38 bp, Artificial Sequence
  Description of Artificial Sequence: Synthetic oligonucleotide
attcgtgaaatctctgactgttggtgaaggactgatag

SEQ ID NO: 253056 - DNA, 37 bp, Artificial Sequence
  Description of Artificial Sequence: Synthetic oligonucleotide
ttcgtgaaatctctgactgttggtgaaggactgatag

SEQ ID NO: 253057 - DNA, 36 bp, Artificial Sequence
  Description of Artificial Sequence: Synthetic oligonucleotide
tcgtgaaatctctgactgttggtgaaggactgatag

SEQ ID NO: 253058 - DNA, 35 bp, Artificial Sequence
  Description of Artificial Sequence: Synthetic oligonucleotide
cgtgaaatctctgactgttggtgaaggactgatag

SEQ ID NO: 253059 - DNA, 37 bp, Artificial Sequence
  Description of Artificial Sequence: Synthetic oligonucleotide
gtgaaatctctgactgttggtgaaggactgatagaag

SEQ ID NO: 253060 - DNA, 38 bp, Artificial Sequence
  Description of Artificial Sequence: Synthetic oligonucleotide
tgaaatctctgactgttggtgaaggactgatagaagac

SEQ ID NO: 253061 - DNA, 37 bp, Artificial Sequence
  Description of Artificial Sequence: Synthetic oligonucleotide
gaaatctctgactgttggtgaaggactgatagaagac

SEQ ID NO: 253062 - DNA, 37 bp, Artificial Sequence
  Description of Artificial Sequence: Synthetic oligonucleotide
aaatctctgactgttggtgaaggactgatagaagacg

SEQ ID NO: 253063 - DNA, 36 bp, Artificial Sequence
  Description of Artificial Sequence: Synthetic oligonucleotide
aatctctgactgttggtgaaggactgatagaagacg

SEQ ID NO: 253064 - DNA, 35 bp, Artificial Sequence
  Description of Artificial Sequence: Synthetic oligonucleotide
atctctgactgttggtgaaggactgatagaagacg

SEQ ID NO: 253065 - DNA, 34 bp, Artificial Sequence
  Description of Artificial Sequence: Synthetic oligonucleotide
tctctgactgttggtgaaggactgatagaagacg

SEQ ID NO: 253066 - DNA, 33 bp, Artificial Sequence
  Description of Artificial Sequence: Synthetic oligonucleotide
ctctgactgttggtgaaggactgatagaagacg

SEQ ID NO: 253067 - DNA, 38 bp, Artificial Sequence
  Description of Artificial Sequence: Synthetic oligonucleotide
tctgactgttggtgaaggactgatagaagacgattttg

SEQ ID NO: 253068 - DNA, 37 bp, Artificial Sequence
  Description of Artificial Sequence: Synthetic oligonucleotide
ctgactgttggtgaaggactgatagaagacgattttg

SEQ ID NO: 253069 - DNA, 39 bp, Artificial Sequence
  Description of Artificial Sequence: Synthetic oligonucleotide
tgactgttggtgaaggactgatagaagacgattttgatg

SEQ ID NO: 253070 - DNA, 38 bp, Artificial Sequence
  Description of Artificial Sequence: Synthetic oligonucleotide
gactgttggtgaaggactgatagaagacgattttgatg

SEQ ID NO: 253071 - DNA, 39 bp, Artificial Sequence
  Description of Artificial Sequence: Synthetic oligonucleotide
actgttggtgaaggactgatagaagacgattttgatgac

SEQ ID NO: 253072 - DNA, 38 bp, Artificial Sequence
  Description of Artificial Sequence: Synthetic oligonucleotide
ctgttggtgaaggactgatagaagacgattttgatgac

SEQ ID NO: 253073 - DNA, 39 bp, Artificial Sequence
  Description of Artificial Sequence: Synthetic oligonucleotide
tgttggtgaaggactgatagaagacgattttgatgacac

SEQ ID NO: 253074 - DNA, 38 bp, Artificial Sequence
  Description of Artificial Sequence: Synthetic oligonucleotide
gttggtgaaggactgatagaagacgattttgatgacac

SEQ ID NO: 253075 - DNA, 39 bp, Artificial Sequence
  Description of Artificial Sequence: Synthetic oligonucleotide
ttggtgaaggactgatagaagacgattttgatgacactg

SEQ ID NO: 253076 - DNA, 38 bp, Artificial Sequence
  Description of Artificial Sequence: Synthetic oligonucleotide
tggtgaaggactgatagaagacgattttgatgacactg

SEQ ID NO: 253077 - DNA, 37 bp, Artificial Sequence
  Description of Artificial Sequence: Synthetic oligonucleotide
ggtgaaggactgatagaagacgattttgatgacactg

SEQ ID NO: 253078 - DNA, 38 bp, Artificial Sequence
  Description of Artificial Sequence: Synthetic oligonucleotide
gtgaaggactgatagaagacgattttgatgacactgtg

SEQ ID NO: 253079 - DNA, 40 bp, Artificial Sequence
  Description of Artificial Sequence: Synthetic oligonucleotide
tgaaggactgatagaagacgattttgatgacactgtgaac

SEQ ID NO: 253080 - DNA, 39 bp, Artificial Sequence
  Description of Artificial Sequence: Synthetic oligonucleotide
gaaggactgatagaagacgattttgatgacactgtgaac

SEQ ID NO: 253081 - DNA, 41 bp, Artificial Sequence
  Description of Artificial Sequence: Synthetic oligonucleotide
aaggactgatagaagacgattttgatgacactgtgaacatg

SEQ ID NO: 253082 - DNA, 40 bp, Artificial Sequence
  Description of Artificial Sequence: Synthetic oligonucleotide
aggactgatagaagacgattttgatgacactgtgaacatg

SEQ ID NO: 253083 - DNA, 39 bp, Artificial Sequence
  Description of Artificial Sequence: Synthetic oligonucleotide
ggactgatagaagacgattttgatgacactgtgaacatg

SEQ ID NO: 253084 - DNA, 40 bp, Artificial Sequence
  Description of Artificial Sequence: Synthetic oligonucleotide
gactgatagaagacgattttgatgacactgtgaacatgag

SEQ ID NO: 253085 - DNA, 40 bp, Artificial Sequence
  Description of Artificial Sequence: Synthetic oligonucleotide
actgatagaagacgattttgatgacactgtgaacatgagc

SEQ ID NO: 253086 - DNA, 39 bp, Artificial Sequence
  Description of Artificial Sequence: Synthetic oligonucleotide
ctgatagaagacgattttgatgacactgtgaacatgagc

SEQ ID NO: 253087 - DNA, 40 bp, Artificial Sequence
  Description of Artificial Sequence: Synthetic oligonucleotide
tgatagaagacgattttgatgacactgtgaacatgagcac

SEQ ID NO: 253088 - DNA, 39 bp, Artificial Sequence
  Description of Artificial Sequence: Synthetic oligonucleotide
gatagaagacgattttgatgacactgtgaacatgagcac

SEQ ID NO: 253089 - DNA, 39 bp, Artificial Sequence
  Description of Artificial Sequence: Synthetic oligonucleotide
atagaagacgattttgatgacactgtgaacatgagcacc

SEQ ID NO: 253090 - DNA, 38 bp, Artificial Sequence
  Description of Artificial Sequence: Synthetic oligonucleotide
tagaagacgattttgatgacactgtgaacatgagcacc

SEQ ID NO: 253091 - DNA, 37 bp, Artificial Sequence
  Description of Artificial Sequence: Synthetic oligonucleotide
agaagacgattttgatgacactgtgaacatgagcacc

SEQ ID NO: 253092 - DNA, 36 bp, Artificial Sequence
  Description of Artificial Sequence: Synthetic oligonucleotide
gaagacgattttgatgacactgtgaacatgagcacc

SEQ ID NO: 253093 - DNA, 39 bp, Artificial Sequence
  Description of Artificial Sequence: Synthetic oligonucleotide
aagacgattttgatgacactgtgaacatgagcaccaatc

SEQ ID NO: 253094 - DNA, 38 bp, Artificial Sequence
  Description of Artificial Sequence: Synthetic oligonucleotide
agacgattttgatgacactgtgaacatgagcaccaatc

SEQ ID NO: 253095 - DNA, 37 bp, Artificial Sequence
  Description of Artificial Sequence: Synthetic oligonucleotide
gacgattttgatgacactgtgaacatgagcaccaatc

SEQ ID NO: 253096 - DNA, 38 bp, Artificial Sequence
  Description of Artificial Sequence: Synthetic oligonucleotide
acgattttgatgacactgtgaacatgagcaccaatctg

SEQ ID NO: 253097 - DNA, 37 bp, Artificial Sequence
  Description of Artificial Sequence: Synthetic oligonucleotide
cgattttgatgacactgtgaacatgagcaccaatctg

SEQ ID NO: 253098 - DNA, 37 bp, Artificial Sequence
  Description of Artificial Sequence: Synthetic oligonucleotide
gattttgatgacactgtgaacatgagcaccaatctgg

SEQ ID NO: 253099 - DNA, 38 bp, Artificial Sequence
  Description of Artificial Sequence: Synthetic oligonucleotide
attttgatgacactgtgaacatgagcaccaatctggtg

SEQ ID NO: 253100 - DNA, 37 bp, Artificial Sequence
  Description of Artificial Sequence: Synthetic oligonucleotide
ttttgatgacactgtgaacatgagcaccaatctggtg

SEQ ID NO: 253101 - DNA, 36 bp, Artificial Sequence
  Description of Artificial Sequence: Synthetic oligonucleotide
tttgatgacactgtgaacatgagcaccaatctggtg

SEQ ID NO: 253102 - DNA, 35 bp, Artificial Sequence
  Description of Artificial Sequence: Synthetic oligonucleotide
ttgatgacactgtgaacatgagcaccaatctggtg

SEQ ID NO: 253103 - DNA, 34 bp, Artificial Sequence
  Description of Artificial Sequence: Synthetic oligonucleotide
tgatgacactgtgaacatgagcaccaatctggtg

SEQ ID NO: 253104 - DNA, 33 bp, Artificial Sequence
  Description of Artificial Sequence: Synthetic oligonucleotide
gatgacactgtgaacatgagcaccaatctggtg

SEQ ID NO: 253105 - DNA, 33 bp, Artificial Sequence
  Description of Artificial Sequence: Synthetic oligonucleotide
atgacactgtgaacatgagcaccaatctggtgg

SEQ ID NO: 253106 - DNA, 32 bp, Artificial Sequence
  Description of Artificial Sequence: Synthetic oligonucleotide
tgacactgtgaacatgagcaccaatctggtgg

SEQ ID NO: 253107 - DNA, 31 bp, Artificial Sequence
  Description of Artificial Sequence: Synthetic oligonucleotide
gacactgtgaacatgagcaccaatctggtgg

SEQ ID NO: 253108 - DNA, 31 bp, Artificial Sequence
  Description of Artificial Sequence: Synthetic oligonucleotide
acactgtgaacatgagcaccaatctggtggg

SEQ ID NO: 253109 - DNA, 30 bp, Artificial Sequence
  Description of Artificial Sequence: Synthetic oligonucleotide
cactgtgaacatgagcaccaatctggtggg

SEQ ID NO: 253110 - DNA, 30 bp, Artificial Sequence
  Description of Artificial Sequence: Synthetic oligonucleotide
actgtgaacatgagcaccaatctggtgggc

SEQ ID NO: 253111 - DNA, 29 bp, Artificial Sequence
  Description of Artificial Sequence: Synthetic oligonucleotide
ctgtgaacatgagcaccaatctggtgggc

SEQ ID NO: 253112 - DNA, 31 bp, Artificial Sequence
  Description of Artificial Sequence: Synthetic oligonucleotide
tgtgaacatgagcaccaatctggtgggcttc

SEQ ID NO: 253113 - DNA, 30 bp, Artificial Sequence
  Description of Artificial Sequence: Synthetic oligonucleotide
gtgaacatgagcaccaatctggtgggcttc

SEQ ID NO: 253114 - DNA, 32 bp, Artificial Sequence
  Description of Artificial Sequence: Synthetic oligonucleotide
tgaacatgagcaccaatctggtgggcttcatc

SEQ ID NO: 253115 - DNA, 31 bp, Artificial Sequence
  Description of Artificial Sequence: Synthetic oligonucleotide
gaacatgagcaccaatctggtgggcttcatc

SEQ ID NO: 253116 - DNA, 35 bp, Artificial Sequence
  Description of Artificial Sequence: Synthetic oligonucleotide
aacatgagcaccaatctggtgggcttcatcatatc

SEQ ID NO: 253117 - DNA, 34 bp, Artificial Sequence
  Description of Artificial Sequence: Synthetic oligonucleotide
acatgagcaccaatctggtgggcttcatcatatc

SEQ ID NO: 253118 - DNA, 33 bp, Artificial Sequence
  Description of Artificial Sequence: Synthetic oligonucleotide
catgagcaccaatctggtgggcttcatcatatc

SEQ ID NO: 253119 - DNA, 34 bp, Artificial Sequence
  Description of Artificial Sequence: Synthetic oligonucleotide
atgagcaccaatctggtgggcttcatcatatcag

SEQ ID NO: 253120 - DNA, 33 bp, Artificial Sequence
  Description of Artificial Sequence: Synthetic oligonucleotide
tgagcaccaatctggtgggcttcatcatatcag

SEQ ID NO: 253121 - DNA, 32 bp, Artificial Sequence
  Description of Artificial Sequence: Synthetic oligonucleotide
gagcaccaatctggtgggcttcatcatatcag

SEQ ID NO: 253122 - DNA, 37 bp, Artificial Sequence
  Description of Artificial Sequence: Synthetic oligonucleotide
agcaccaatctggtgggcttcatcatatcagattttc

SEQ ID NO: 253123 - DNA, 36 bp, Artificial Sequence
  Description of Artificial Sequence: Synthetic oligonucleotide
gcaccaatctggtgggcttcatcatatcagattttc

SEQ ID NO: 253124 - DNA, 37 bp, Artificial Sequence
  Description of Artificial Sequence: Synthetic oligonucleotide
caccaatctggtgggcttcatcatatcagattttcag

SEQ ID NO: 253125 - DNA, 38 bp, Artificial Sequence
  Description of Artificial Sequence: Synthetic oligonucleotide
accaatctggtgggcttcatcatatcagattttcagtc

SEQ ID NO: 253126 - DNA, 37 bp, Artificial Sequence
  Description of Artificial Sequence: Synthetic oligonucleotide
ccaatctggtgggcttcatcatatcagattttcagtc

SEQ ID NO: 253127 - DNA, 38 bp, Artificial Sequence
  Description of Artificial Sequence: Synthetic oligonucleotide
caatctggtgggcttcatcatatcagattttcagtctg

SEQ ID NO: 253128 - DNA, 39 bp, Artificial Sequence
  Description of Artificial Sequence: Synthetic oligonucleotide
aatctggtgggcttcatcatatcagattttcagtctgtc

SEQ ID NO: 253129 - DNA, 38 bp, Artificial Sequence
  Description of Artificial Sequence: Synthetic oligonucleotide
atctggtgggcttcatcatatcagattttcagtctgtc

SEQ ID NO: 253130 - DNA, 37 bp, Artificial Sequence
  Description of Artificial Sequence: Synthetic oligonucleotide
tctggtgggcttcatcatatcagattttcagtctgtc

SEQ ID NO: 253131 - DNA, 36 bp, Artificial Sequence
  Description of Artificial Sequence: Synthetic oligonucleotide
ctggtgggcttcatcatatcagattttcagtctgtc

SEQ ID NO: 253132 - DNA, 37 bp, Artificial Sequence
  Description of Artificial Sequence: Synthetic oligonucleotide
tggtgggcttcatcatatcagattttcagtctgtcac

SEQ ID NO: 253133 - DNA, 36 bp, Artificial Sequence
  Description of Artificial Sequence: Synthetic oligonucleotide
ggtgggcttcatcatatcagattttcagtctgtcac

SEQ ID NO: 253134 - DNA, 36 bp, Artificial Sequence
  Description of Artificial Sequence: Synthetic oligonucleotide
gtgggcttcatcatatcagattttcagtctgtcacc

SEQ ID NO: 253135 - DNA, 38 bp, Artificial Sequence
  Description of Artificial Sequence: Synthetic oligonucleotide
tgggcttcatcatatcagattttcagtctgtcaccaag

SEQ ID NO: 253136 - DNA, 37 bp, Artificial Sequence
  Description of Artificial Sequence: Synthetic oligonucleotide
gggcttcatcatatcagattttcagtctgtcaccaag

SEQ ID NO: 253137 - DNA, 41 bp, Artificial Sequence
  Description of Artificial Sequence: Synthetic oligonucleotide
ggcttcatcatatcagattttcagtctgtcaccaagataac

SEQ ID NO: 253138 - DNA, 41 bp, Artificial Sequence
  Description of Artificial Sequence: Synthetic oligonucleotide
gcttcatcatatcagattttcagtctgtcaccaagataacg

SEQ ID NO: 253139 - DNA, 43 bp, Artificial Sequence
  Description of Artificial Sequence: Synthetic oligonucleotide
cttcatcatatcagattttcagtctgtcaccaagataacgaag

SEQ ID NO: 253140 - DNA, 44 bp, Artificial Sequence
  Description of Artificial Sequence: Synthetic oligonucleotide
ttcatcatatcagattttcagtctgtcaccaagataacgaagag

SEQ ID NO: 253141 - DNA, 43 bp, Artificial Sequence
  Description of Artificial Sequence: Synthetic oligonucleotide
tcatcatatcagattttcagtctgtcaccaagataacgaagag

SEQ ID NO: 253142 - DNA, 42 bp, Artificial Sequence
  Description of Artificial Sequence: Synthetic oligonucleotide
catcatatcagattttcagtctgtcaccaagataacgaagag

SEQ ID NO: 253143 - DNA, 43 bp, Artificial Sequence
  Description of Artificial Sequence: Synthetic oligonucleotide
atcatatcagattttcagtctgtcaccaagataacgaagagtg

SEQ ID NO: 253144 - DNA, 42 bp, Artificial Sequence
  Description of Artificial Sequence: Synthetic oligonucleotide
tcatatcagattttcagtctgtcaccaagataacgaagagtg

SEQ ID NO: 253145 - DNA, 41 bp, Artificial Sequence
  Description of Artificial Sequence: Synthetic oligonucleotide
catatcagattttcagtctgtcaccaagataacgaagagtg

SEQ ID NO: 253146 - DNA, 41 bp, Artificial Sequence
  Description of Artificial Sequence: Synthetic oligonucleotide
atatcagattttcagtctgtcaccaagataacgaagagtgg

SEQ ID NO: 253147 - DNA, 40 bp, Artificial Sequence
  Description of Artificial Sequence: Synthetic oligonucleotide
tatcagattttcagtctgtcaccaagataacgaagagtgg

SEQ ID NO: 253148 - DNA, 39 bp, Artificial Sequence
  Description of Artificial Sequence: Synthetic oligonucleotide
atcagattttcagtctgtcaccaagataacgaagagtgg

SEQ ID NO: 253149 - DNA, 38 bp, Artificial Sequence
  Description of Artificial Sequence: Synthetic oligonucleotide
tcagattttcagtctgtcaccaagataacgaagagtgg

SEQ ID NO: 253150 - DNA, 37 bp, Artificial Sequence
  Description of Artificial Sequence: Synthetic oligonucleotide
cagattttcagtctgtcaccaagataacgaagagtgg

SEQ ID NO: 253151 - DNA, 38 bp, Artificial Sequence
  Description of Artificial Sequence: Synthetic oligonucleotide
agattttcagtctgtcaccaagataacgaagagtggac

SEQ ID NO: 253152 - DNA, 37 bp, Artificial Sequence
  Description of Artificial Sequence: Synthetic oligonucleotide
gattttcagtctgtcaccaagataacgaagagtggac

SEQ ID NO: 253153 - DNA, 38 bp, Artificial Sequence
  Description of Artificial Sequence: Synthetic oligonucleotide
attttcagtctgtcaccaagataacgaagagtggactc

SEQ ID NO: 253154 - DNA, 37 bp, Artificial Sequence
  Description of Artificial Sequence: Synthetic oligonucleotide
ttttcagtctgtcaccaagataacgaagagtggactc

SEQ ID NO: 253155 - DNA, 36 bp, Artificial Sequence
  Description of Artificial Sequence: Synthetic oligonucleotide
tttcagtctgtcaccaagataacgaagagtggactc

SEQ ID NO: 253156 - DNA, 35 bp, Artificial Sequence
  Description of Artificial Sequence: Synthetic oligonucleotide
ttcagtctgtcaccaagataacgaagagtggactc

SEQ ID NO: 253157 - DNA, 34 bp, Artificial Sequence
  Description of Artificial Sequence: Synthetic oligonucleotide
tcagtctgtcaccaagataacgaagagtggactc

SEQ ID NO: 253158 - DNA, 33 bp, Artificial Sequence
  Description of Artificial Sequence: Synthetic oligonucleotide
cagtctgtcaccaagataacgaagagtggactc

SEQ ID NO: 253159 - DNA, 35 bp, Artificial Sequence
  Description of Artificial Sequence: Synthetic oligonucleotide
agtctgtcaccaagataacgaagagtggactcaag

SEQ ID NO: 253160 - DNA, 34 bp, Artificial Sequence
  Description of Artificial Sequence: Synthetic oligonucleotide
gtctgtcaccaagataacgaagagtggactcaag

SEQ ID NO: 253161 - DNA, 34 bp, Artificial Sequence
  Description of Artificial Sequence: Synthetic oligonucleotide
tctgtcaccaagataacgaagagtggactcaagg

SEQ ID NO: 253162 - DNA, 33 bp, Artificial Sequence
  Description of Artificial Sequence: Synthetic oligonucleotide
ctgtcaccaagataacgaagagtggactcaagg

SEQ ID NO: 253163 - DNA, 36 bp, Artificial Sequence
  Description of Artificial Sequence: Synthetic oligonucleotide
tgtcaccaagataacgaagagtggactcaaggtttg

SEQ ID NO: 253164 - DNA, 35 bp, Artificial Sequence
  Description of Artificial Sequence: Synthetic oligonucleotide
gtcaccaagataacgaagagtggactcaaggtttg

SEQ ID NO: 253165 - DNA, 36 bp, Artificial Sequence
  Description of Artificial Sequence: Synthetic oligonucleotide
tcaccaagataacgaagagtggactcaaggtttgtg

SEQ ID NO: 253166 - DNA, 35 bp, Artificial Sequence
  Description of Artificial Sequence: Synthetic oligonucleotide
caccaagataacgaagagtggactcaaggtttgtg

SEQ ID NO: 253167 - DNA, 40 bp, Artificial Sequence
  Description of Artificial Sequence: Synthetic oligonucleotide
accaagataacgaagagtggactcaaggtttgtgtttatg

SEQ ID NO: 253168 - DNA, 39 bp, Artificial Sequence
  Description of Artificial Sequence: Synthetic oligonucleotide
ccaagataacgaagagtggactcaaggtttgtgtttatg

SEQ ID NO: 253169 - DNA, 39 bp, Artificial Sequence
  Description of Artificial Sequence: Synthetic oligonucleotide
caagataacgaagagtggactcaaggtttgtgtttatgc

SEQ ID NO: 253170 - DNA, 40 bp, Artificial Sequence
  Description of Artificial Sequence: Synthetic oligonucleotide
aagataacgaagagtggactcaaggtttgtgtttatgcag

SEQ ID NO: 253171 - DNA, 39 bp, Artificial Sequence
  Description of Artificial Sequence: Synthetic oligonucleotide
agataacgaagagtggactcaaggtttgtgtttatgcag

SEQ ID NO: 253172 - DNA, 38 bp, Artificial Sequence
  Description of Artificial Sequence: Synthetic oligonucleotide
gataacgaagagtggactcaaggtttgtgtttatgcag

SEQ ID NO: 253173 - DNA, 39 bp, Artificial Sequence
  Description of Artificial Sequence: Synthetic oligonucleotide
ataacgaagagtggactcaaggtttgtgtttatgcagtg

SEQ ID NO: 253174 - DNA, 38 bp, Artificial Sequence
  Description of Artificial Sequence: Synthetic oligonucleotide
taacgaagagtggactcaaggtttgtgtttatgcagtg

SEQ ID NO: 253175 - DNA, 37 bp, Artificial Sequence
  Description of Artificial Sequence: Synthetic oligonucleotide
aacgaagagtggactcaaggtttgtgtttatgcagtg

SEQ ID NO: 253176 - DNA, 36 bp, Artificial Sequence
  Description of Artificial Sequence: Synthetic oligonucleotide
acgaagagtggactcaaggtttgtgtttatgcagtg

SEQ ID NO: 253177 - DNA, 35 bp, Artificial Sequence
  Description of Artificial Sequence: Synthetic oligonucleotide
cgaagagtggactcaaggtttgtgtttatgcagtg

SEQ ID NO: 253178 - DNA, 35 bp, Artificial Sequence
  Description of Artificial Sequence: Synthetic oligonucleotide
gaagagtggactcaaggtttgtgtttatgcagtgc

SEQ ID NO: 253179 - DNA, 35 bp, Artificial Sequence
  Description of Artificial Sequence: Synthetic oligonucleotide
aagagtggactcaaggtttgtgtttatgcagtgcc

SEQ ID NO: 253180 - DNA, 34 bp, Artificial Sequence
  Description of Artificial Sequence: Synthetic oligonucleotide
agagtggactcaaggtttgtgtttatgcagtgcc

SEQ ID NO: 253181 - DNA, 33 bp, Artificial Sequence
  Description of Artificial Sequence: Synthetic oligonucleotide
gagtggactcaaggtttgtgtttatgcagtgcc

SEQ ID NO: 253182 - DNA, 34 bp, Artificial Sequence
  Description of Artificial Sequence: Synthetic oligonucleotide
agtggactcaaggtttgtgtttatgcagtgccag

SEQ ID NO: 253183 - DNA, 33 bp, Artificial Sequence
  Description of Artificial Sequence: Synthetic oligonucleotide
gtggactcaaggtttgtgtttatgcagtgccag

SEQ ID NO: 253184 - DNA, 34 bp, Artificial Sequence
  Description of Artificial Sequence: Synthetic oligonucleotide
tggactcaaggtttgtgtttatgcagtgccagac

SEQ ID NO: 253185 - DNA, 33 bp, Artificial Sequence
  Description of Artificial Sequence: Synthetic oligonucleotide
ggactcaaggtttgtgtttatgcagtgccagac

SEQ ID NO: 253186 - DNA, 35 bp, Artificial Sequence
  Description of Artificial Sequence: Synthetic oligonucleotide
gactcaaggtttgtgtttatgcagtgccagactag

SEQ ID NO: 253187 - DNA, 41 bp, Artificial Sequence
  Description of Artificial Sequence: Synthetic oligonucleotide
actcaaggtttgtgtttatgcagtgccagactagataaatc

SEQ ID NO: 253188 - DNA, 40 bp, Artificial Sequence
  Description of Artificial Sequence: Synthetic oligonucleotide
ctcaaggtttgtgtttatgcagtgccagactagataaatc

SEQ ID NO: 253189 - DNA, 42 bp, Artificial Sequence
  Description of Artificial Sequence: Synthetic oligonucleotide
tcaaggtttgtgtttatgcagtgccagactagataaatctag

SEQ ID NO: 253190 - DNA, 41 bp, Artificial Sequence
  Description of Artificial Sequence: Synthetic oligonucleotide
caaggtttgtgtttatgcagtgccagactagataaatctag

SEQ ID NO: 253191 - DNA, 41 bp, Artificial Sequence
  Description of Artificial Sequence: Synthetic oligonucleotide
aaggtttgtgtttatgcagtgccagactagataaatctagc

SEQ ID NO: 253192 - DNA, 40 bp, Artificial Sequence
  Description of Artificial Sequence: Synthetic oligonucleotide
aggtttgtgtttatgcagtgccagactagataaatctagc

SEQ ID NO: 253193 - DNA, 39 bp, Artificial Sequence
  Description of Artificial Sequence: Synthetic oligonucleotide
ggtttgtgtttatgcagtgccagactagataaatctagc

SEQ ID NO: 253194 - DNA, 40 bp, Artificial Sequence
  Description of Artificial Sequence: Synthetic oligonucleotide
gtttgtgtttatgcagtgccagactagataaatctagcag

SEQ ID NO: 253195 - DNA, 45 bp, Artificial Sequence
  Description of Artificial Sequence: Synthetic oligonucleotide
tttgtgtttatgcagtgccagactagataaatctagcagattaag

SEQ ID NO: 253196 - DNA, 44 bp, Artificial Sequence
  Description of Artificial Sequence: Synthetic oligonucleotide
ttgtgtttatgcagtgccagactagataaatctagcagattaag

SEQ ID NO: 253197 - DNA, 43 bp, Artificial Sequence
  Description of Artificial Sequence: Synthetic oligonucleotide
tgtgtttatgcagtgccagactagataaatctagcagattaag

SEQ ID NO: 253198 - DNA, 42 bp, Artificial Sequence
  Description of Artificial Sequence: Synthetic oligonucleotide
gtgtttatgcagtgccagactagataaatctagcagattaag

SEQ ID NO: 253199 - DNA, 42 bp, Artificial Sequence
  Description of Artificial Sequence: Synthetic oligonucleotide
tgtttatgcagtgccagactagataaatctagcagattaagc

SEQ ID NO: 253200 - DNA, 41 bp, Artificial Sequence
  Description of Artificial Sequence: Synthetic oligonucleotide
gtttatgcagtgccagactagataaatctagcagattaagc

SEQ ID NO: 253201 - DNA, 42 bp, Artificial Sequence
  Description of Artificial Sequence: Synthetic oligonucleotide
tttatgcagtgccagactagataaatctagcagattaagcac

SEQ ID NO: 253202 - DNA, 41 bp, Artificial Sequence
  Description of Artificial Sequence: Synthetic oligonucleotide
ttatgcagtgccagactagataaatctagcagattaagcac

SEQ ID NO: 253203 - DNA, 40 bp, Artificial Sequence
  Description of Artificial Sequence: Synthetic oligonucleotide
tatgcagtgccagactagataaatctagcagattaagcac

SEQ ID NO: 253204 - DNA, 39 bp, Artificial Sequence
  Description of Artificial Sequence: Synthetic oligonucleotide
atgcagtgccagactagataaatctagcagattaagcac

SEQ ID NO: 253205 - DNA, 38 bp, Artificial Sequence
  Description of Artificial Sequence: Synthetic oligonucleotide
tgcagtgccagactagataaatctagcagattaagcac

SEQ ID NO: 253206 - DNA, 37 bp, Artificial Sequence
  Description of Artificial Sequence: Synthetic oligonucleotide
gcagtgccagactagataaatctagcagattaagcac

SEQ ID NO: 253207 - DNA, 38 bp, Artificial Sequence
  Description of Artificial Sequence: Synthetic oligonucleotide
cagtgccagactagataaatctagcagattaagcactg

SEQ ID NO: 253208 - DNA, 38 bp, Artificial Sequence
  Description of Artificial Sequence: Synthetic oligonucleotide
agtgccagactagataaatctagcagattaagcactgg

SEQ ID NO: 253209 - DNA, 37 bp, Artificial Sequence
  Description of Artificial Sequence: Synthetic oligonucleotide
gtgccagactagataaatctagcagattaagcactgg

SEQ ID NO: 253210 - DNA, 39 bp, Artificial Sequence
  Description of Artificial Sequence: Synthetic oligonucleotide
tgccagactagataaatctagcagattaagcactggatc

SEQ ID NO: 253211 - DNA, 38 bp, Artificial Sequence
  Description of Artificial Sequence: Synthetic oligonucleotide
gccagactagataaatctagcagattaagcactggatc

SEQ ID NO: 253212 - DNA, 38 bp, Artificial Sequence
  Description of Artificial Sequence: Synthetic oligonucleotide
ccagactagataaatctagcagattaagcactggatcc

SEQ ID NO: 253213 - DNA, 39 bp, Artificial Sequence
  Description of Artificial Sequence: Synthetic oligonucleotide
cagactagataaatctagcagattaagcactggatcctg

SEQ ID NO: 253214 - DNA, 39 bp, Artificial Sequence
  Description of Artificial Sequence: Synthetic oligonucleotide
agactagataaatctagcagattaagcactggatcctgc

SEQ ID NO: 253215 - DNA, 38 bp, Artificial Sequence
  Description of Artificial Sequence: Synthetic oligonucleotide
gactagataaatctagcagattaagcactggatcctgc

SEQ ID NO: 253216 - DNA, 38 bp, Artificial Sequence
  Description of Artificial Sequence: Synthetic oligonucleotide
actagataaatctagcagattaagcactggatcctgcg

SEQ ID NO: 253217 - DNA, 37 bp, Artificial Sequence
  Description of Artificial Sequence: Synthetic oligonucleotide
ctagataaatctagcagattaagcactggatcctgcg

SEQ ID NO: 253218 - DNA, 37 bp, Artificial Sequence
  Description of Artificial Sequence: Synthetic oligonucleotide
tagataaatctagcagattaagcactggatcctgcgg

SEQ ID NO: 253219 - DNA, 36 bp, Artificial Sequence
  Description of Artificial Sequence: Synthetic oligonucleotide
agataaatctagcagattaagcactggatcctgcgg

SEQ ID NO: 253220 - DNA, 35 bp, Artificial Sequence
  Description of Artificial Sequence: Synthetic oligonucleotide
gataaatctagcagattaagcactggatcctgcgg

SEQ ID NO: 253221 - DNA, 36 bp, Artificial Sequence
  Description of Artificial Sequence: Synthetic oligonucleotide
ataaatctagcagattaagcactggatcctgcggtg

SEQ ID NO: 253222 - DNA, 35 bp, Artificial Sequence
  Description of Artificial Sequence: Synthetic oligonucleotide
taaatctagcagattaagcactggatcctgcggtg

SEQ ID NO: 253223 - DNA, 34 bp, Artificial Sequence
  Description of Artificial Sequence: Synthetic oligonucleotide
aaatctagcagattaagcactggatcctgcggtg

SEQ ID NO: 253224 - DNA, 33 bp, Artificial Sequence
  Description of Artificial Sequence: Synthetic oligonucleotide
aatctagcagattaagcactggatcctgcggtg

SEQ ID NO: 253225 - DNA, 32 bp, Artificial Sequence
  Description of Artificial Sequence: Synthetic oligonucleotide
atctagcagattaagcactggatcctgcggtg

SEQ ID NO: 253226 - DNA, 31 bp, Artificial Sequence
  Description of Artificial Sequence: Synthetic oligonucleotide
tctagcagattaagcactggatcctgcggtg

SEQ ID NO: 253227 - DNA, 30 bp, Artificial Sequence
  Description of Artificial Sequence: Synthetic oligonucleotide
ctagcagattaagcactggatcctgcggtg

SEQ ID NO: 253228 - DNA, 31 bp, Artificial Sequence
  Description of Artificial Sequence: Synthetic oligonucleotide
tagcagattaagcactggatcctgcggtgag

SEQ ID NO: 253229 - DNA, 30 bp, Artificial Sequence
  Description of Artificial Sequence: Synthetic oligonucleotide
agcagattaagcactggatcctgcggtgag

SEQ ID NO: 253230 - DNA, 29 bp, Artificial Sequence
  Description of Artificial Sequence: Synthetic oligonucleotide
gcagattaagcactggatcctgcggtgag

SEQ ID NO: 253231 - DNA, 30 bp, Artificial Sequence
  Description of Artificial Sequence: Synthetic oligonucleotide
cagattaagcactggatcctgcggtgagtc

SEQ ID NO: 253232 - DNA, 32 bp, Artificial Sequence
  Description of Artificial Sequence: Synthetic oligonucleotide
agattaagcactggatcctgcggtgagtcttc

SEQ ID NO: 253233 - DNA, 31 bp, Artificial Sequence
  Description of Artificial Sequence: Synthetic oligonucleotide
gattaagcactggatcctgcggtgagtcttc

SEQ ID NO: 253234 - DNA, 33 bp, Artificial Sequence
  Description of Artificial Sequence: Synthetic oligonucleotide
attaagcactggatcctgcggtgagtcttctag

SEQ ID NO: 253235 - DNA, 32 bp, Artificial Sequence
  Description of Artificial Sequence: Synthetic oligonucleotide
ttaagcactggatcctgcggtgagtcttctag

SEQ ID NO: 253236 - DNA, 31 bp, Artificial Sequence
  Description of Artificial Sequence: Synthetic oligonucleotide
taagcactggatcctgcggtgagtcttctag

SEQ ID NO: 253237 - DNA, 30 bp, Artificial Sequence
  Description of Artificial Sequence: Synthetic oligonucleotide
aagcactggatcctgcggtgagtcttctag

SEQ ID NO: 253238 - DNA, 29 bp, Artificial Sequence
  Description of Artificial Sequence: Synthetic oligonucleotide
agcactggatcctgcggtgagtcttctag

SEQ ID NO: 253239 - DNA, 28 bp, Artificial Sequence
  Description of Artificial Sequence: Synthetic oligonucleotide
gcactggatcctgcggtgagtcttctag

SEQ ID NO: 253240 - DNA, 36 bp, Artificial Sequence
  Description of Artificial Sequence: Synthetic oligonucleotide
cactggatcctgcggtgagtcttctagatttttatg

SEQ ID NO: 253241 - DNA, 37 bp, Artificial Sequence
  Description of Artificial Sequence: Synthetic oligonucleotide
actggatcctgcggtgagtcttctagatttttatgag

SEQ ID NO: 253242 - DNA, 36 bp, Artificial Sequence
  Description of Artificial Sequence: Synthetic oligonucleotide
ctggatcctgcggtgagtcttctagatttttatgag

SEQ ID NO: 253243 - DNA, 36 bp, Artificial Sequence
  Description of Artificial Sequence: Synthetic oligonucleotide
tggatcctgcggtgagtcttctagatttttatgagc

SEQ ID NO: 253244 - DNA, 35 bp, Artificial Sequence
  Description of Artificial Sequence: Synthetic oligonucleotide
ggatcctgcggtgagtcttctagatttttatgagc

SEQ ID NO: 253245 - DNA, 42 bp, Artificial Sequence
  Description of Artificial Sequence: Synthetic oligonucleotide
gatcctgcggtgagtcttctagatttttatgagcattatttc

SEQ ID NO: 253246 - DNA, 43 bp, Artificial Sequence
  Description of Artificial Sequence: Synthetic oligonucleotide
atcctgcggtgagtcttctagatttttatgagcattatttcac

SEQ ID NO: 253247 - DNA, 42 bp, Artificial Sequence
  Description of Artificial Sequence: Synthetic oligonucleotide
tcctgcggtgagtcttctagatttttatgagcattatttcac

SEQ ID NO: 253248 - DNA, 41 bp, Artificial Sequence
  Description of Artificial Sequence: Synthetic oligonucleotide
cctgcggtgagtcttctagatttttatgagcattatttcac

SEQ ID NO: 253249 - DNA, 41 bp, Artificial Sequence
  Description of Artificial Sequence: Synthetic oligonucleotide
ctgcggtgagtcttctagatttttatgagcattatttcacc

SEQ ID NO: 253250 - DNA, 44 bp, Artificial Sequence
  Description of Artificial Sequence: Synthetic oligonucleotide
tgcggtgagtcttctagatttttatgagcattatttcaccatac

SEQ ID NO: 253251 - DNA, 43 bp, Artificial Sequence
  Description of Artificial Sequence: Synthetic oligonucleotide
gcggtgagtcttctagatttttatgagcattatttcaccatac

SEQ ID NO: 253252 - DNA, 43 bp, Artificial Sequence
  Description of Artificial Sequence: Synthetic oligonucleotide
cggtgagtcttctagatttttatgagcattatttcaccatacc

SEQ ID NO: 253253 - DNA, 43 bp, Artificial Sequence
  Description of Artificial Sequence: Synthetic oligonucleotide
ggtgagtcttctagatttttatgagcattatttcaccataccg

SEQ ID NO: 253254 - DNA, 46 bp, Artificial Sequence
  Description of Artificial Sequence: Synthetic oligonucleotide
gtgagtcttctagatttttatgagcattatttcaccataccgtaac

SEQ ID NO: 253255 - DNA, 46 bp, Artificial Sequence
  Description of Artificial Sequence: Synthetic oligonucleotide
tgagtcttctagatttttatgagcattatttcaccataccgtaacc

SEQ ID NO: 253256 - DNA, 45 bp, Artificial Sequence
  Description of Artificial Sequence: Synthetic oligonucleotide
gagtcttctagatttttatgagcattatttcaccataccgtaacc

SEQ ID NO: 253257 - DNA, 45 bp, Artificial Sequence
  Description of Artificial Sequence: Synthetic oligonucleotide
agtcttctagatttttatgagcattatttcaccataccgtaaccc

SEQ ID NO: 253258 - DNA, 44 bp, Artificial Sequence
  Description of Artificial Sequence: Synthetic oligonucleotide
gtcttctagatttttatgagcattatttcaccataccgtaaccc

SEQ ID NO: 253259 - DNA, 44 bp, Artificial Sequence
  Description of Artificial Sequence: Synthetic oligonucleotide
tcttctagatttttatgagcattatttcaccataccgtaacccc

SEQ ID NO: 253260 - DNA, 43 bp, Artificial Sequence
  Description of Artificial Sequence: Synthetic oligonucleotide
cttctagatttttatgagcattatttcaccataccgtaacccc

SEQ ID NO: 253261 - DNA, 45 bp, Artificial Sequence
  Description of Artificial Sequence: Synthetic oligonucleotide
ttctagatttttatgagcattatttcaccataccgtaacccctac

SEQ ID NO: 253262 - DNA, 44 bp, Artificial Sequence
  Description of Artificial Sequence: Synthetic oligonucleotide
tctagatttttatgagcattatttcaccataccgtaacccctac

SEQ ID NO: 253263 - DNA, 43 bp, Artificial Sequence
  Description of Artificial Sequence: Synthetic oligonucleotide
ctagatttttatgagcattatttcaccataccgtaacccctac

SEQ ID NO: 253264 - DNA, 43 bp, Artificial Sequence
  Description of Artificial Sequence: Synthetic oligonucleotide
tagatttttatgagcattatttcaccataccgtaacccctacc

SEQ ID NO: 253265 - DNA, 42 bp, Artificial Sequence
  Description of Artificial Sequence: Synthetic oligonucleotide
agatttttatgagcattatttcaccataccgtaacccctacc

SEQ ID NO: 253266 - DNA, 41 bp, Artificial Sequence
  Description of Artificial Sequence: Synthetic oligonucleotide
gatttttatgagcattatttcaccataccgtaacccctacc

SEQ ID NO: 253267 - DNA, 41 bp, Artificial Sequence
  Description of Artificial Sequence: Synthetic oligonucleotide
atttttatgagcattatttcaccataccgtaacccctaccc

SEQ ID NO: 253268 - DNA, 40 bp, Artificial Sequence
  Description of Artificial Sequence: Synthetic oligonucleotide
tttttatgagcattatttcaccataccgtaacccctaccc

SEQ ID NO: 253269 - DNA, 39 bp, Artificial Sequence
  Description of Artificial Sequence: Synthetic oligonucleotide
ttttatgagcattatttcaccataccgtaacccctaccc

SEQ ID NO: 253270 - DNA, 38 bp, Artificial Sequence
  Description of Artificial Sequence: Synthetic oligonucleotide
tttatgagcattatttcaccataccgtaacccctaccc

SEQ ID NO: 253271 - DNA, 37 bp, Artificial Sequence
  Description of Artificial Sequence: Synthetic oligonucleotide
ttatgagcattatttcaccataccgtaacccctaccc

SEQ ID NO: 253272 - DNA, 36 bp, Artificial Sequence
  Description of Artificial Sequence: Synthetic oligonucleotide
tatgagcattatttcaccataccgtaacccctaccc

SEQ ID NO: 253273 - DNA, 35 bp, Artificial Sequence
  Description of Artificial Sequence: Synthetic oligonucleotide
atgagcattatttcaccataccgtaacccctaccc

SEQ ID NO: 253274 - DNA, 34 bp, Artificial Sequence
  Description of Artificial Sequence: Synthetic oligonucleotide
tgagcattatttcaccataccgtaacccctaccc

SEQ ID NO: 253275 - DNA, 33 bp, Artificial Sequence
  Description of Artificial Sequence: Synthetic oligonucleotide
gagcattatttcaccataccgtaacccctaccc

SEQ ID NO: 253276 - DNA, 36 bp, Artificial Sequence
  Description of Artificial Sequence: Synthetic oligonucleotide
agcattatttcaccataccgtaacccctaccctaac

SEQ ID NO: 253277 - DNA, 35 bp, Artificial Sequence
  Description of Artificial Sequence: Synthetic oligonucleotide
gcattatttcaccataccgtaacccctaccctaac

SEQ ID NO: 253278 - DNA, 37 bp, Artificial Sequence
  Description of Artificial Sequence: Synthetic oligonucleotide
cattatttcaccataccgtaacccctaccctaacaag

SEQ ID NO: 253279 - DNA, 39 bp, Artificial Sequence
  Description of Artificial Sequence: Synthetic oligonucleotide
attatttcaccataccgtaacccctaccctaacaagatc

SEQ ID NO: 253280 - DNA, 38 bp, Artificial Sequence
  Description of Artificial Sequence: Synthetic oligonucleotide
ttatttcaccataccgtaacccctaccctaacaagatc

SEQ ID NO: 253281 - DNA, 37 bp, Artificial Sequence
  Description of Artificial Sequence: Synthetic oligonucleotide
tatttcaccataccgtaacccctaccctaacaagatc

SEQ ID NO: 253282 - DNA, 36 bp, Artificial Sequence
  Description of Artificial Sequence: Synthetic oligonucleotide
atttcaccataccgtaacccctaccctaacaagatc

SEQ ID NO: 253283 - DNA, 35 bp, Artificial Sequence
  Description of Artificial Sequence: Synthetic oligonucleotide
tttcaccataccgtaacccctaccctaacaagatc

SEQ ID NO: 253284 - DNA, 34 bp, Artificial Sequence
  Description of Artificial Sequence: Synthetic oligonucleotide
ttcaccataccgtaacccctaccctaacaagatc

SEQ ID NO: 253285 - DNA, 33 bp, Artificial Sequence
  Description of Artificial Sequence: Synthetic oligonucleotide
tcaccataccgtaacccctaccctaacaagatc

SEQ ID NO: 253286 - DNA, 32 bp, Artificial Sequence
  Description of Artificial Sequence: Synthetic oligonucleotide
caccataccgtaacccctaccctaacaagatc

SEQ ID NO: 253287 - DNA, 34 bp, Artificial Sequence
  Description of Artificial Sequence: Synthetic oligonucleotide
accataccgtaacccctaccctaacaagatcatg

SEQ ID NO: 253288 - DNA, 33 bp, Artificial Sequence
  Description of Artificial Sequence: Synthetic oligonucleotide
ccataccgtaacccctaccctaacaagatcatg

SEQ ID NO: 253289 - DNA, 33 bp, Artificial Sequence
  Description of Artificial Sequence: Synthetic oligonucleotide
cataccgtaacccctaccctaacaagatcatgc

SEQ ID NO: 253290 - DNA, 34 bp, Artificial Sequence
  Description of Artificial Sequence: Synthetic oligonucleotide
ataccgtaacccctaccctaacaagatcatgctg

SEQ ID NO: 253291 - DNA, 33 bp, Artificial Sequence
  Description of Artificial Sequence: Synthetic oligonucleotide
taccgtaacccctaccctaacaagatcatgctg

SEQ ID NO: 253292 - DNA, 32 bp, Artificial Sequence
  Description of Artificial Sequence: Synthetic oligonucleotide
accgtaacccctaccctaacaagatcatgctg

SEQ ID NO: 253293 - DNA, 31 bp, Artificial Sequence
  Description of Artificial Sequence: Synthetic oligonucleotide
ccgtaacccctaccctaacaagatcatgctg

SEQ ID NO: 253294 - DNA, 31 bp, Artificial Sequence
  Description of Artificial Sequence: Synthetic oligonucleotide
cgtaacccctaccctaacaagatcatgctgc

SEQ ID NO: 253295 - DNA, 35 bp, Artificial Sequence
  Description of Artificial Sequence: Synthetic oligonucleotide
gtaacccctaccctaacaagatcatgctgctatac

SEQ ID NO: 253296 - DNA, 35 bp, Artificial Sequence
  Description of Artificial Sequence: Synthetic oligonucleotide
taacccctaccctaacaagatcatgctgctatacc

SEQ ID NO: 253297 - DNA, 34 bp, Artificial Sequence
  Description of Artificial Sequence: Synthetic oligonucleotide
aacccctaccctaacaagatcatgctgctatacc

SEQ ID NO: 253298 - DNA, 33 bp, Artificial Sequence
  Description of Artificial Sequence: Synthetic oligonucleotide
acccctaccctaacaagatcatgctgctatacc

SEQ ID NO: 253299 - DNA, 32 bp, Artificial Sequence
  Description of Artificial Sequence: Synthetic oligonucleotide
cccctaccctaacaagatcatgctgctatacc

SEQ ID NO: 253300 - DNA, 32 bp, Artificial Sequence
  Description of Artificial Sequence: Synthetic oligonucleotide
ccctaccctaacaagatcatgctgctataccc

SEQ ID NO: 253301 - DNA, 32 bp, Artificial Sequence
  Description of Artificial Sequence: Synthetic oligonucleotide
cctaccctaacaagatcatgctgctatacccg

SEQ ID NO: 253302 - DNA, 33 bp, Artificial Sequence
  Description of Artificial Sequence: Synthetic oligonucleotide
ctaccctaacaagatcatgctgctatacccgac

SEQ ID NO: 253303 - DNA, 36 bp, Artificial Sequence
  Description of Artificial Sequence: Synthetic oligonucleotide
taccctaacaagatcatgctgctatacccgactttg

SEQ ID NO: 253304 - DNA, 35 bp, Artificial Sequence
  Description of Artificial Sequence: Synthetic oligonucleotide
accctaacaagatcatgctgctatacccgactttg

SEQ ID NO: 253305 - DNA, 34 bp, Artificial Sequence
  Description of Artificial Sequence: Synthetic oligonucleotide
ccctaacaagatcatgctgctatacccgactttg

SEQ ID NO: 253306 - DNA, 35 bp, Artificial Sequence
  Description of Artificial Sequence: Synthetic oligonucleotide
cctaacaagatcatgctgctatacccgactttgag

SEQ ID NO: 253307 - DNA, 36 bp, Artificial Sequence
  Description of Artificial Sequence: Synthetic oligonucleotide
ctaacaagatcatgctgctatacccgactttgagtc

SEQ ID NO: 253308 - DNA, 37 bp, Artificial Sequence
  Description of Artificial Sequence: Synthetic oligonucleotide
taacaagatcatgctgctatacccgactttgagtctg

SEQ ID NO: 253309 - DNA, 36 bp, Artificial Sequence
  Description of Artificial Sequence: Synthetic oligonucleotide
aacaagatcatgctgctatacccgactttgagtctg

SEQ ID NO: 253310 - DNA, 35 bp, Artificial Sequence
  Description of Artificial Sequence: Synthetic oligonucleotide
acaagatcatgctgctatacccgactttgagtctg

SEQ ID NO: 253311 - DNA, 34 bp, Artificial Sequence
  Description of Artificial Sequence: Synthetic oligonucleotide
caagatcatgctgctatacccgactttgagtctg

SEQ ID NO: 253312 - DNA, 34 bp, Artificial Sequence
  Description of Artificial Sequence: Synthetic oligonucleotide
aagatcatgctgctatacccgactttgagtctgg

SEQ ID NO: 253313 - DNA, 33 bp, Artificial Sequence
  Description of Artificial Sequence: Synthetic oligonucleotide
agatcatgctgctatacccgactttgagtctgg

SEQ ID NO: 253314 - DNA, 32 bp, Artificial Sequence
  Description of Artificial Sequence: Synthetic oligonucleotide
gatcatgctgctatacccgactttgagtctgg

SEQ ID NO: 253315 - DNA, 33 bp, Artificial Sequence
  Description of Artificial Sequence: Synthetic oligonucleotide
atcatgctgctatacccgactttgagtctggtg

SEQ ID NO: 253316 - DNA, 32 bp, Artificial Sequence
  Description of Artificial Sequence: Synthetic oligonucleotide
tcatgctgctatacccgactttgagtctggtg

SEQ ID NO: 253317 - DNA, 31 bp, Artificial Sequence
  Description of Artificial Sequence: Synthetic oligonucleotide
catgctgctatacccgactttgagtctggtg

SEQ ID NO: 253318 - DNA, 31 bp, Artificial Sequence
  Description of Artificial Sequence: Synthetic oligonucleotide
atgctgctatacccgactttgagtctggtgg

SEQ ID NO: 253319 - DNA, 30 bp, Artificial Sequence
  Description of Artificial Sequence: Synthetic oligonucleotide
tgctgctatacccgactttgagtctggtgg

SEQ ID NO: 253320 - DNA, 29 bp, Artificial Sequence
  Description of Artificial Sequence: Synthetic oligonucleotide
gctgctatacccgactttgagtctggtgg

SEQ ID NO: 253321 - DNA, 32 bp, Artificial Sequence
  Description of Artificial Sequence: Synthetic oligonucleotide
ctgctatacccgactttgagtctggtggtatg

SEQ ID NO: 253322 - DNA, 32 bp, Artificial Sequence
  Description of Artificial Sequence: Synthetic oligonucleotide
tgctatacccgactttgagtctggtggtatgg

SEQ ID NO: 253323 - DNA, 31 bp, Artificial Sequence
  Description of Artificial Sequence: Synthetic oligonucleotide
gctatacccgactttgagtctggtggtatgg

SEQ ID NO: 253324 - DNA, 35 bp, Artificial Sequence
  Description of Artificial Sequence: Synthetic oligonucleotide
ctatacccgactttgagtctggtggtatggaaaag

SEQ ID NO: 253325 - DNA, 36 bp, Artificial Sequence
  Description of Artificial Sequence: Synthetic oligonucleotide
tatacccgactttgagtctggtggtatggaaaagtg

SEQ ID NO: 253326 - DNA, 35 bp, Artificial Sequence
  Description of Artificial Sequence: Synthetic oligonucleotide
atacccgactttgagtctggtggtatggaaaagtg

SEQ ID NO: 253327 - DNA, 34 bp, Artificial Sequence
  Description of Artificial Sequence: Synthetic oligonucleotide
tacccgactttgagtctggtggtatggaaaagtg

SEQ ID NO: 253328 - DNA, 33 bp, Artificial Sequence
  Description of Artificial Sequence: Synthetic oligonucleotide
acccgactttgagtctggtggtatggaaaagtg

SEQ ID NO: 253329 - DNA, 32 bp, Artificial Sequence
  Description of Artificial Sequence: Synthetic oligonucleotide
cccgactttgagtctggtggtatggaaaagtg

SEQ ID NO: 253330 - DNA, 32 bp, Artificial Sequence
  Description of Artificial Sequence: Synthetic oligonucleotide
ccgactttgagtctggtggtatggaaaagtgg

SEQ ID NO: 253331 - DNA, 32 bp, Artificial Sequence
  Description of Artificial Sequence: Synthetic oligonucleotide
cgactttgagtctggtggtatggaaaagtggg

SEQ ID NO: 253332 - DNA, 32 bp, Artificial Sequence
  Description of Artificial Sequence: Synthetic oligonucleotide
gactttgagtctggtggtatggaaaagtgggg

SEQ ID NO: 253333 - DNA, 33 bp, Artificial Sequence
  Description of Artificial Sequence: Synthetic oligonucleotide
actttgagtctggtggtatggaaaagtggggac

SEQ ID NO: 253334 - DNA, 32 bp, Artificial Sequence
  Description of Artificial Sequence: Synthetic oligonucleotide
ctttgagtctggtggtatggaaaagtggggac

SEQ ID NO: 253335 - DNA, 33 bp, Artificial Sequence
  Description of Artificial Sequence: Synthetic oligonucleotide
tttgagtctggtggtatggaaaagtggggactg

SEQ ID NO: 253336 - DNA, 32 bp, Artificial Sequence
  Description of Artificial Sequence: Synthetic oligonucleotide
ttgagtctggtggtatggaaaagtggggactg

SEQ ID NO: 253337 - DNA, 31 bp, Artificial Sequence
  Description of Artificial Sequence: Synthetic oligonucleotide
tgagtctggtggtatggaaaagtggggactg

SEQ ID NO: 253338 - DNA, 30 bp, Artificial Sequence
  Description of Artificial Sequence: Synthetic oligonucleotide
gagtctggtggtatggaaaagtggggactg

SEQ ID NO: 253339 - DNA, 31 bp, Artificial Sequence
  Description of Artificial Sequence: Synthetic oligonucleotide
agtctggtggtatggaaaagtggggactgtc

SEQ ID NO: 253340 - DNA, 30 bp, Artificial Sequence
  Description of Artificial Sequence: Synthetic oligonucleotide
gtctggtggtatggaaaagtggggactgtc

SEQ ID NO: 253341 - DNA, 32 bp, Artificial Sequence
  Description of Artificial Sequence: Synthetic oligonucleotide
tctggtggtatggaaaagtggggactgtcaac

SEQ ID NO: 253342 - DNA, 31 bp, Artificial Sequence
  Description of Artificial Sequence: Synthetic oligonucleotide
ctggtggtatggaaaagtggggactgtcaac

SEQ ID NO: 253343 - DNA, 36 bp, Artificial Sequence
  Description of Artificial Sequence: Synthetic oligonucleotide
tggtggtatggaaaagtggggactgtcaacatatac

SEQ ID NO: 253344 - DNA, 35 bp, Artificial Sequence
  Description of Artificial Sequence: Synthetic oligonucleotide
ggtggtatggaaaagtggggactgtcaacatatac

SEQ ID NO: 253345 - DNA, 36 bp, Artificial Sequence
  Description of Artificial Sequence: Synthetic oligonucleotide
gtggtatggaaaagtggggactgtcaacatatacag

SEQ ID NO: 253346 - DNA, 39 bp, Artificial Sequence
  Description of Artificial Sequence: Synthetic oligonucleotide
tggtatggaaaagtggggactgtcaacatatacagaatc

SEQ ID NO: 253347 - DNA, 38 bp, Artificial Sequence
  Description of Artificial Sequence: Synthetic oligonucleotide
ggtatggaaaagtggggactgtcaacatatacagaatc

SEQ ID NO: 253348 - DNA, 39 bp, Artificial Sequence
  Description of Artificial Sequence: Synthetic oligonucleotide
gtatggaaaagtggggactgtcaacatatacagaatctg

SEQ ID NO: 253349 - DNA, 39 bp, Artificial Sequence
  Description of Artificial Sequence: Synthetic oligonucleotide
tatggaaaagtggggactgtcaacatatacagaatctgc

SEQ ID NO: 253350 - DNA, 38 bp, Artificial Sequence
  Description of Artificial Sequence: Synthetic oligonucleotide
atggaaaagtggggactgtcaacatatacagaatctgc

SEQ ID NO: 253351 - DNA, 37 bp, Artificial Sequence
  Description of Artificial Sequence: Synthetic oligonucleotide
tggaaaagtggggactgtcaacatatacagaatctgc

SEQ ID NO: 253352 - DNA, 36 bp, Artificial Sequence
  Description of Artificial Sequence: Synthetic oligonucleotide
ggaaaagtggggactgtcaacatatacagaatctgc

SEQ ID NO: 253353 - DNA, 37 bp, Artificial Sequence
  Description of Artificial Sequence: Synthetic oligonucleotide
gaaaagtggggactgtcaacatatacagaatctgcac

SEQ ID NO: 253354 - DNA, 38 bp, Artificial Sequence
  Description of Artificial Sequence: Synthetic oligonucleotide
aaaagtggggactgtcaacatatacagaatctgcactg

SEQ ID NO: 253355 - DNA, 37 bp, Artificial Sequence
  Description of Artificial Sequence: Synthetic oligonucleotide
aaagtggggactgtcaacatatacagaatctgcactg

SEQ ID NO: 253356 - DNA, 36 bp, Artificial Sequence
  Description of Artificial Sequence: Synthetic oligonucleotide
aagtggggactgtcaacatatacagaatctgcactg

SEQ ID NO: 253357 - DNA, 35 bp, Artificial Sequence
  Description of Artificial Sequence: Synthetic oligonucleotide
agtggggactgtcaacatatacagaatctgcactg

SEQ ID NO: 253358 - DNA, 34 bp, Artificial Sequence
  Description of Artificial Sequence: Synthetic oligonucleotide
gtggggactgtcaacatatacagaatctgcactg

SEQ ID NO: 253359 - DNA, 36 bp, Artificial Sequence
  Description of Artificial Sequence: Synthetic oligonucleotide
tggggactgtcaacatatacagaatctgcactgttg

SEQ ID NO: 253360 - DNA, 35 bp, Artificial Sequence
  Description of Artificial Sequence: Synthetic oligonucleotide
ggggactgtcaacatatacagaatctgcactgttg

SEQ ID NO: 253361 - DNA, 38 bp, Artificial Sequence
  Description of Artificial Sequence: Synthetic oligonucleotide
gggactgtcaacatatacagaatctgcactgttgtttc

SEQ ID NO: 253362 - DNA, 40 bp, Artificial Sequence
  Description of Artificial Sequence: Synthetic oligonucleotide
ggactgtcaacatatacagaatctgcactgttgtttcatg

SEQ ID NO: 253363 - DNA, 40 bp, Artificial Sequence
  Description of Artificial Sequence: Synthetic oligonucleotide
gactgtcaacatatacagaatctgcactgttgtttcatgc

SEQ ID NO: 253364 - DNA, 41 bp, Artificial Sequence
  Description of Artificial Sequence: Synthetic oligonucleotide
actgtcaacatatacagaatctgcactgttgtttcatgcag

SEQ ID NO: 253365 - DNA, 40 bp, Artificial Sequence
  Description of Artificial Sequence: Synthetic oligonucleotide
ctgtcaacatatacagaatctgcactgttgtttcatgcag

SEQ ID NO: 253366 - DNA, 44 bp, Artificial Sequence
  Description of Artificial Sequence: Synthetic oligonucleotide
tgtcaacatatacagaatctgcactgttgtttcatgcagaaatg

SEQ ID NO: 253367 - DNA, 43 bp, Artificial Sequence
  Description of Artificial Sequence: Synthetic oligonucleotide
gtcaacatatacagaatctgcactgttgtttcatgcagaaatg

SEQ ID NO: 253368 - DNA, 44 bp, Artificial Sequence
  Description of Artificial Sequence: Synthetic oligonucleotide
tcaacatatacagaatctgcactgttgtttcatgcagaaatgtc

SEQ ID NO: 253369 - DNA, 43 bp, Artificial Sequence
  Description of Artificial Sequence: Synthetic oligonucleotide
caacatatacagaatctgcactgttgtttcatgcagaaatgtc

SEQ ID NO: 253370 - DNA, 45 bp, Artificial Sequence
  Description of Artificial Sequence: Synthetic oligonucleotide
aacatatacagaatctgcactgttgtttcatgcagaaatgtcttc

SEQ ID NO: 253371 - DNA, 44 bp, Artificial Sequence
  Description of Artificial Sequence: Synthetic oligonucleotide
acatatacagaatctgcactgttgtttcatgcagaaatgtcttc

SEQ ID NO: 253372 - DNA, 43 bp, Artificial Sequence
  Description of Artificial Sequence: Synthetic oligonucleotide
catatacagaatctgcactgttgtttcatgcagaaatgtcttc

SEQ ID NO: 253373 - DNA, 44 bp, Artificial Sequence
  Description of Artificial Sequence: Synthetic oligonucleotide
atatacagaatctgcactgttgtttcatgcagaaatgtcttctg

SEQ ID NO: 253374 - DNA, 43 bp, Artificial Sequence
  Description of Artificial Sequence: Synthetic oligonucleotide
tatacagaatctgcactgttgtttcatgcagaaatgtcttctg

SEQ ID NO: 253375 - DNA, 42 bp, Artificial Sequence
  Description of Artificial Sequence: Synthetic oligonucleotide
atacagaatctgcactgttgtttcatgcagaaatgtcttctg

SEQ ID NO: 253376 - DNA, 41 bp, Artificial Sequence
  Description of Artificial Sequence: Synthetic oligonucleotide
tacagaatctgcactgttgtttcatgcagaaatgtcttctg

SEQ ID NO: 253377 - DNA, 40 bp, Artificial Sequence
  Description of Artificial Sequence: Synthetic oligonucleotide
acagaatctgcactgttgtttcatgcagaaatgtcttctg

SEQ ID NO: 253378 - DNA, 39 bp, Artificial Sequence
  Description of Artificial Sequence: Synthetic oligonucleotide
cagaatctgcactgttgtttcatgcagaaatgtcttctg

SEQ ID NO: 253379 - DNA, 39 bp, Artificial Sequence
  Description of Artificial Sequence: Synthetic oligonucleotide
agaatctgcactgttgtttcatgcagaaatgtcttctgc

SEQ ID NO: 253380 - DNA, 38 bp, Artificial Sequence
  Description of Artificial Sequence: Synthetic oligonucleotide
gaatctgcactgttgtttcatgcagaaatgtcttctgc

SEQ ID NO: 253381 - DNA, 40 bp, Artificial Sequence
  Description of Artificial Sequence: Synthetic oligonucleotide
aatctgcactgttgtttcatgcagaaatgtcttctgcttc

SEQ ID NO: 253382 - DNA, 39 bp, Artificial Sequence
  Description of Artificial Sequence: Synthetic oligonucleotide
atctgcactgttgtttcatgcagaaatgtcttctgcttc

SEQ ID NO: 253383 - DNA, 38 bp, Artificial Sequence
  Description of Artificial Sequence: Synthetic oligonucleotide
tctgcactgttgtttcatgcagaaatgtcttctgcttc

SEQ ID NO: 253384 - DNA, 37 bp, Artificial Sequence
  Description of Artificial Sequence: Synthetic oligonucleotide
ctgcactgttgtttcatgcagaaatgtcttctgcttc

SEQ ID NO: 253385 - DNA, 39 bp, Artificial Sequence
  Description of Artificial Sequence: Synthetic oligonucleotide
tgcactgttgtttcatgcagaaatgtcttctgcttcaag

SEQ ID NO: 253386 - DNA, 38 bp, Artificial Sequence
  Description of Artificial Sequence: Synthetic oligonucleotide
gcactgttgtttcatgcagaaatgtcttctgcttcaag

SEQ ID NO: 253387 - DNA, 41 bp, Artificial Sequence
  Description of Artificial Sequence: Synthetic oligonucleotide
cactgttgtttcatgcagaaatgtcttctgcttcaagtaag

SEQ ID NO: 253388 - DNA, 41 bp, Artificial Sequence
  Description of Artificial Sequence: Synthetic oligonucleotide
actgttgtttcatgcagaaatgtcttctgcttcaagtaagg

SEQ ID NO: 253389 - DNA, 40 bp, Artificial Sequence
  Description of Artificial Sequence: Synthetic oligonucleotide
ctgttgtttcatgcagaaatgtcttctgcttcaagtaagg

SEQ ID NO: 253390 - DNA, 42 bp, Artificial Sequence
  Description of Artificial Sequence: Synthetic oligonucleotide
tgttgtttcatgcagaaatgtcttctgcttcaagtaaggttg

SEQ ID NO: 253391 - DNA, 41 bp, Artificial Sequence
  Description of Artificial Sequence: Synthetic oligonucleotide
gttgtttcatgcagaaatgtcttctgcttcaagtaaggttg

SEQ ID NO: 253392 - DNA, 41 bp, Artificial Sequence
  Description of Artificial Sequence: Synthetic oligonucleotide
ttgtttcatgcagaaatgtcttctgcttcaagtaaggttgg

SEQ ID NO: 253393 - DNA, 40 bp, Artificial Sequence
  Description of Artificial Sequence: Synthetic oligonucleotide
tgtttcatgcagaaatgtcttctgcttcaagtaaggttgg

SEQ ID NO: 253394 - DNA, 39 bp, Artificial Sequence
  Description of Artificial Sequence: Synthetic oligonucleotide
gtttcatgcagaaatgtcttctgcttcaagtaaggttgg

SEQ ID NO: 253395 - DNA, 39 bp, Artificial Sequence
  Description of Artificial Sequence: Synthetic oligonucleotide
tttcatgcagaaatgtcttctgcttcaagtaaggttggc

SEQ ID NO: 253396 - DNA, 38 bp, Artificial Sequence
  Description of Artificial Sequence: Synthetic oligonucleotide
ttcatgcagaaatgtcttctgcttcaagtaaggttggc

SEQ ID NO: 253397 - DNA, 37 bp, Artificial Sequence
  Description of Artificial Sequence: Synthetic oligonucleotide
tcatgcagaaatgtcttctgcttcaagtaaggttggc

SEQ ID NO: 253398 - DNA, 36 bp, Artificial Sequence
  Description of Artificial Sequence: Synthetic oligonucleotide
catgcagaaatgtcttctgcttcaagtaaggttggc

SEQ ID NO: 253399 - DNA, 38 bp, Artificial Sequence
  Description of Artificial Sequence: Synthetic oligonucleotide
atgcagaaatgtcttctgcttcaagtaaggttggcatc

SEQ ID NO: 253400 - DNA, 37 bp, Artificial Sequence
  Description of Artificial Sequence: Synthetic oligonucleotide
tgcagaaatgtcttctgcttcaagtaaggttggcatc

SEQ ID NO: 253401 - DNA, 36 bp, Artificial Sequence
  Description of Artificial Sequence: Synthetic oligonucleotide
gcagaaatgtcttctgcttcaagtaaggttggcatc

SEQ ID NO: 253402 - DNA, 37 bp, Artificial Sequence
  Description of Artificial Sequence: Synthetic oligonucleotide
cagaaatgtcttctgcttcaagtaaggttggcatcag

SEQ ID NO: 253403 - DNA, 40 bp, Artificial Sequence
  Description of Artificial Sequence: Synthetic oligonucleotide
agaaatgtcttctgcttcaagtaaggttggcatcagaatg

SEQ ID NO: 253404 - DNA, 39 bp, Artificial Sequence
  Description of Artificial Sequence: Synthetic oligonucleotide
gaaatgtcttctgcttcaagtaaggttggcatcagaatg

SEQ ID NO: 253405 - DNA, 40 bp, Artificial Sequence
  Description of Artificial Sequence: Synthetic oligonucleotide
aaatgtcttctgcttcaagtaaggttggcatcagaatgac

SEQ ID NO: 253406 - DNA, 39 bp, Artificial Sequence
  Description of Artificial Sequence: Synthetic oligonucleotide
aatgtcttctgcttcaagtaaggttggcatcagaatgac

SEQ ID NO: 253407 - DNA, 38 bp, Artificial Sequence
  Description of Artificial Sequence: Synthetic oligonucleotide
atgtcttctgcttcaagtaaggttggcatcagaatgac

SEQ ID NO: 253408 - DNA, 37 bp, Artificial Sequence
  Description of Artificial Sequence: Synthetic oligonucleotide
tgtcttctgcttcaagtaaggttggcatcagaatgac

SEQ ID NO: 253409 - DNA, 36 bp, Artificial Sequence
  Description of Artificial Sequence: Synthetic oligonucleotide
gtcttctgcttcaagtaaggttggcatcagaatgac

SEQ ID NO: 253410 - DNA, 37 bp, Artificial Sequence
  Description of Artificial Sequence: Synthetic oligonucleotide
tcttctgcttcaagtaaggttggcatcagaatgactg

SEQ ID NO: 253411 - DNA, 36 bp, Artificial Sequence
  Description of Artificial Sequence: Synthetic oligonucleotide
cttctgcttcaagtaaggttggcatcagaatgactg

SEQ ID NO: 253412 - DNA, 37 bp, Artificial Sequence
  Description of Artificial Sequence: Synthetic oligonucleotide
ttctgcttcaagtaaggttggcatcagaatgactgtc

SEQ ID NO: 253413 - DNA, 36 bp, Artificial Sequence
  Description of Artificial Sequence: Synthetic oligonucleotide
tctgcttcaagtaaggttggcatcagaatgactgtc

SEQ ID NO: 253414 - DNA, 35 bp, Artificial Sequence
  Description of Artificial Sequence: Synthetic oligonucleotide
ctgcttcaagtaaggttggcatcagaatgactgtc

SEQ ID NO: 253415 - DNA, 35 bp, Artificial Sequence
  Description of Artificial Sequence: Synthetic oligonucleotide
tgcttcaagtaaggttggcatcagaatgactgtcg

SEQ ID NO: 253416 - DNA, 34 bp, Artificial Sequence
  Description of Artificial Sequence: Synthetic oligonucleotide
gcttcaagtaaggttggcatcagaatgactgtcg

SEQ ID NO: 253417 - DNA, 34 bp, Artificial Sequence
  Description of Artificial Sequence: Synthetic oligonucleotide
cttcaagtaaggttggcatcagaatgactgtcgc

SEQ ID NO: 253418 - DNA, 34 bp, Artificial Sequence
  Description of Artificial Sequence: Synthetic oligonucleotide
ttcaagtaaggttggcatcagaatgactgtcgcc

SEQ ID NO: 253419 - DNA, 33 bp, Artificial Sequence
  Description of Artificial Sequence: Synthetic oligonucleotide
tcaagtaaggttggcatcagaatgactgtcgcc

SEQ ID NO: 253420 - DNA, 32 bp, Artificial Sequence
  Description of Artificial Sequence: Synthetic oligonucleotide
caagtaaggttggcatcagaatgactgtcgcc

SEQ ID NO: 253421 - DNA, 32 bp, Artificial Sequence
  Description of Artificial Sequence: Synthetic oligonucleotide
aagtaaggttggcatcagaatgactgtcgccc

SEQ ID NO: 253422 - DNA, 31 bp, Artificial Sequence
  Description of Artificial Sequence: Synthetic oligonucleotide
agtaaggttggcatcagaatgactgtcgccc

SEQ ID NO: 253423 - DNA, 30 bp, Artificial Sequence
  Description of Artificial Sequence: Synthetic oligonucleotide
gtaaggttggcatcagaatgactgtcgccc

SEQ ID NO: 253424 - DNA, 32 bp, Artificial Sequence
  Description of Artificial Sequence: Synthetic oligonucleotide
taaggttggcatcagaatgactgtcgcccatg

SEQ ID NO: 253425 - DNA, 31 bp, Artificial Sequence
  Description of Artificial Sequence: Synthetic oligonucleotide
aaggttggcatcagaatgactgtcgcccatg

SEQ ID NO: 253426 - DNA, 30 bp, Artificial Sequence
  Description of Artificial Sequence: Synthetic oligonucleotide
aggttggcatcagaatgactgtcgcccatg

SEQ ID NO: 253427 - DNA, 29 bp, Artificial Sequence
  Description of Artificial Sequence: Synthetic oligonucleotide
ggttggcatcagaatgactgtcgcccatg

SEQ ID NO: 253428 - DNA, 31 bp, Artificial Sequence
  Description of Artificial Sequence: Synthetic oligonucleotide
gttggcatcagaatgactgtcgcccatgaag

SEQ ID NO: 253429 - DNA, 32 bp, Artificial Sequence
  Description of Artificial Sequence: Synthetic oligonucleotide
ttggcatcagaatgactgtcgcccatgaagtg

SEQ ID NO: 253430 - DNA, 31 bp, Artificial Sequence
  Description of Artificial Sequence: Synthetic oligonucleotide
tggcatcagaatgactgtcgcccatgaagtg

SEQ ID NO: 253431 - DNA, 30 bp, Artificial Sequence
  Description of Artificial Sequence: Synthetic oligonucleotide
ggcatcagaatgactgtcgcccatgaagtg

SEQ ID NO: 253432 - DNA, 30 bp, Artificial Sequence
  Description of Artificial Sequence: Synthetic oligonucleotide
gcatcagaatgactgtcgcccatgaagtgg

SEQ ID NO: 253433 - DNA, 30 bp, Artificial Sequence
  Description of Artificial Sequence: Synthetic oligonucleotide
catcagaatgactgtcgcccatgaagtggc

SEQ ID NO: 253434 - DNA, 31 bp, Artificial Sequence
  Description of Artificial Sequence: Synthetic oligonucleotide
atcagaatgactgtcgcccatgaagtggctc

SEQ ID NO: 253435 - DNA, 30 bp, Artificial Sequence
  Description of Artificial Sequence: Synthetic oligonucleotide
tcagaatgactgtcgcccatgaagtggctc

SEQ ID NO: 253436 - DNA, 29 bp, Artificial Sequence
  Description of Artificial Sequence: Synthetic oligonucleotide
cagaatgactgtcgcccatgaagtggctc

SEQ ID NO: 253437 - DNA, 30 bp, Artificial Sequence
  Description of Artificial Sequence: Synthetic oligonucleotide
agaatgactgtcgcccatgaagtggctcac

SEQ ID NO: 253438 - DNA, 29 bp, Artificial Sequence
  Description of Artificial Sequence: Synthetic oligonucleotide
gaatgactgtcgcccatgaagtggctcac

SEQ ID NO: 253439 - DNA, 29 bp, Artificial Sequence
  Description of Artificial Sequence: Synthetic oligonucleotide
aatgactgtcgcccatgaagtggctcacc

SEQ ID NO: 253440 - DNA, 28 bp, Artificial Sequence
  Description of Artificial Sequence: Synthetic oligonucleotide
atgactgtcgcccatgaagtggctcacc

SEQ ID NO: 253441 - DNA, 27 bp, Artificial Sequence
  Description of Artificial Sequence: Synthetic oligonucleotide
tgactgtcgcccatgaagtggctcacc

SEQ ID NO: 253442 - DNA, 27 bp, Artificial Sequence
  Description of Artificial Sequence: Synthetic oligonucleotide
gactgtcgcccatgaagtggctcacct

SEQ ID NO: 253443 - DNA, 27 bp, Artificial Sequence
  Description of Artificial Sequence: Synthetic oligonucleotide
actgtcgcccatgaagtggctcacctg

SEQ ID NO: 253444 - DNA, 27 bp, Artificial Sequence
  Description of Artificial Sequence: Synthetic oligonucleotide
ctgtcgcccatgaagtggctcacctgt

SEQ ID NO: 253445 - DNA, 27 bp, Artificial Sequence
  Description of Artificial Sequence: Synthetic oligonucleotide
tgtcgcccatgaagtggctcacctgtg

SEQ ID NO: 253446 - DNA, 26 bp, Artificial Sequence
  Description of Artificial Sequence: Synthetic oligonucleotide
gtcgcccatgaagtggctcacctgtg

SEQ ID NO: 253447 - DNA, 27 bp, Artificial Sequence
  Description of Artificial Sequence: Synthetic oligonucleotide
tcgcccatgaagtggctcacctgtggt

SEQ ID NO: 253448 - DNA, 27 bp, Artificial Sequence
  Description of Artificial Sequence: Synthetic oligonucleotide
cgcccatgaagtggctcacctgtggtt

SEQ ID NO: 253449 - DNA, 28 bp, Artificial Sequence
  Description of Artificial Sequence: Synthetic oligonucleotide
gcccatgaagtggctcacctgtggtttg

SEQ ID NO: 253450 - DNA, 28 bp, Artificial Sequence
  Description of Artificial Sequence: Synthetic oligonucleotide
cccatgaagtggctcacctgtggtttgg

SEQ ID NO: 253451 - DNA, 28 bp, Artificial Sequence
  Description of Artificial Sequence: Synthetic oligonucleotide
ccatgaagtggctcacctgtggtttggc

SEQ ID NO: 253452 - DNA, 30 bp, Artificial Sequence
  Description of Artificial Sequence: Synthetic oligonucleotide
catgaagtggctcacctgtggtttggcaac

SEQ ID NO: 253453 - DNA, 30 bp, Artificial Sequence
  Description of Artificial Sequence: Synthetic oligonucleotide
atgaagtggctcacctgtggtttggcaacc

SEQ ID NO: 253454 - DNA, 29 bp, Artificial Sequence
  Description of Artificial Sequence: Synthetic oligonucleotide
tgaagtggctcacctgtggtttggcaacc

SEQ ID NO: 253455 - DNA, 28 bp, Artificial Sequence
  Description of Artificial Sequence: Synthetic oligonucleotide
gaagtggctcacctgtggtttggcaacc

SEQ ID NO: 253456 - DNA, 29 bp, Artificial Sequence
  Description of Artificial Sequence: Synthetic oligonucleotide
aagtggctcacctgtggtttggcaacctg

SEQ ID NO: 253457 - DNA, 28 bp, Artificial Sequence
  Description of Artificial Sequence: Synthetic oligonucleotide
agtggctcacctgtggtttggcaacctg

SEQ ID NO: 253458 - DNA, 27 bp, Artificial Sequence
  Description of Artificial Sequence: Synthetic oligonucleotide
gtggctcacctgtggtttggcaacctg

SEQ ID NO: 253459 - DNA, 27 bp, Artificial Sequence
  Description of Artificial Sequence: Synthetic oligonucleotide
tggctcacctgtggtttggcaacctgg

SEQ ID NO: 253460 - DNA, 27 bp, Artificial Sequence
  Description of Artificial Sequence: Synthetic oligonucleotide
ggctcacctgtggtttggcaacctggt

SEQ ID NO: 253461 - DNA, 27 bp, Artificial Sequence
  Description of Artificial Sequence: Synthetic oligonucleotide
gctcacctgtggtttggcaacctggtc

SEQ ID NO: 253462 - DNA, 28 bp, Artificial Sequence
  Description of Artificial Sequence: Synthetic oligonucleotide
ctcacctgtggtttggcaacctggtctc

SEQ ID NO: 253463 - DNA, 31 bp, Artificial Sequence
  Description of Artificial Sequence: Synthetic oligonucleotide
tcacctgtggtttggcaacctggtctctatg

SEQ ID NO: 253464 - DNA, 30 bp, Artificial Sequence
  Description of Artificial Sequence: Synthetic oligonucleotide
cacctgtggtttggcaacctggtctctatg

SEQ ID NO: 253465 - DNA, 30 bp, Artificial Sequence
  Description of Artificial Sequence: Synthetic oligonucleotide
acctgtggtttggcaacctggtctctatgg

SEQ ID NO: 253466 - DNA, 29 bp, Artificial Sequence
  Description of Artificial Sequence: Synthetic oligonucleotide
cctgtggtttggcaacctggtctctatgg

SEQ ID NO: 253467 - DNA, 32 bp, Artificial Sequence
  Description of Artificial Sequence: Synthetic oligonucleotide
ctgtggtttggcaacctggtctctatggaatc

SEQ ID NO: 253468 - DNA, 32 bp, Artificial Sequence
  Description of Artificial Sequence: Synthetic oligonucleotide
tgtggtttggcaacctggtctctatggaatcg

SEQ ID NO: 253469 - DNA, 31 bp, Artificial Sequence
  Description of Artificial Sequence: Synthetic oligonucleotide
gtggtttggcaacctggtctctatggaatcg

SEQ ID NO: 253470 - DNA, 32 bp, Artificial Sequence
  Description of Artificial Sequence: Synthetic oligonucleotide
tggtttggcaacctggtctctatggaatcgtg

SEQ ID NO: 253471 - DNA, 31 bp, Artificial Sequence
  Description of Artificial Sequence: Synthetic oligonucleotide
ggtttggcaacctggtctctatggaatcgtg

SEQ ID NO: 253472 - DNA, 31 bp, Artificial Sequence
  Description of Artificial Sequence: Synthetic oligonucleotide
gtttggcaacctggtctctatggaatcgtgg

SEQ ID NO: 253473 - DNA, 34 bp, Artificial Sequence
  Description of Artificial Sequence: Synthetic oligonucleotide
tttggcaacctggtctctatggaatcgtggaatg

SEQ ID NO: 253474 - DNA, 33 bp, Artificial Sequence
  Description of Artificial Sequence: Synthetic oligonucleotide
ttggcaacctggtctctatggaatcgtggaatg

SEQ ID NO: 253475 - DNA, 32 bp, Artificial Sequence
  Description of Artificial Sequence: Synthetic oligonucleotide
tggcaacctggtctctatggaatcgtggaatg

SEQ ID NO: 253476 - DNA, 31 bp, Artificial Sequence
  Description of Artificial Sequence: Synthetic oligonucleotide
ggcaacctggtctctatggaatcgtggaatg

SEQ ID NO: 253477 - DNA, 33 bp, Artificial Sequence
  Description of Artificial Sequence: Synthetic oligonucleotide
gcaacctggtctctatggaatcgtggaatgaac

SEQ ID NO: 253478 - DNA, 36 bp, Artificial Sequence
  Description of Artificial Sequence: Synthetic oligonucleotide
caacctggtctctatggaatcgtggaatgaactttg

SEQ ID NO: 253479 - DNA, 36 bp, Artificial Sequence
  Description of Artificial Sequence: Synthetic oligonucleotide
aacctggtctctatggaatcgtggaatgaactttgg

SEQ ID NO: 253480 - DNA, 35 bp, Artificial Sequence
  Description of Artificial Sequence: Synthetic oligonucleotide
acctggtctctatggaatcgtggaatgaactttgg

SEQ ID NO: 253481 - DNA, 34 bp, Artificial Sequence
  Description of Artificial Sequence: Synthetic oligonucleotide
cctggtctctatggaatcgtggaatgaactttgg

SEQ ID NO: 253482 - DNA, 34 bp, Artificial Sequence
  Description of Artificial Sequence: Synthetic oligonucleotide
ctggtctctatggaatcgtggaatgaactttggc

SEQ ID NO: 253483 - DNA, 39 bp, Artificial Sequence
  Description of Artificial Sequence: Synthetic oligonucleotide
tggtctctatggaatcgtggaatgaactttggctatatg

SEQ ID NO: 253484 - DNA, 38 bp, Artificial Sequence
  Description of Artificial Sequence: Synthetic oligonucleotide
ggtctctatggaatcgtggaatgaactttggctatatg

SEQ ID NO: 253485 - DNA, 40 bp, Artificial Sequence
  Description of Artificial Sequence: Synthetic oligonucleotide
gtctctatggaatcgtggaatgaactttggctatatgaag

SEQ ID NO: 253486 - DNA, 40 bp, Artificial Sequence
  Description of Artificial Sequence: Synthetic oligonucleotide
tctctatggaatcgtggaatgaactttggctatatgaagg

SEQ ID NO: 253487 - DNA, 39 bp, Artificial Sequence
  Description of Artificial Sequence: Synthetic oligonucleotide
ctctatggaatcgtggaatgaactttggctatatgaagg

SEQ ID NO: 253488 - DNA, 43 bp, Artificial Sequence
  Description of Artificial Sequence: Synthetic oligonucleotide
tctatggaatcgtggaatgaactttggctatatgaaggatatg

SEQ ID NO: 253489 - DNA, 42 bp, Artificial Sequence
  Description of Artificial Sequence: Synthetic oligonucleotide
ctatggaatcgtggaatgaactttggctatatgaaggatatg

SEQ ID NO: 253490 - DNA, 42 bp, Artificial Sequence
  Description of Artificial Sequence: Synthetic oligonucleotide
tatggaatcgtggaatgaactttggctatatgaaggatatgc

SEQ ID NO: 253491 - DNA, 41 bp, Artificial Sequence
  Description of Artificial Sequence: Synthetic oligonucleotide
atggaatcgtggaatgaactttggctatatgaaggatatgc

SEQ ID NO: 253492 - DNA, 40 bp, Artificial Sequence
  Description of Artificial Sequence: Synthetic oligonucleotide
tggaatcgtggaatgaactttggctatatgaaggatatgc

SEQ ID NO: 253493 - DNA, 39 bp, Artificial Sequence
  Description of Artificial Sequence: Synthetic oligonucleotide
ggaatcgtggaatgaactttggctatatgaaggatatgc

SEQ ID NO: 253494 - DNA, 39 bp, Artificial Sequence
  Description of Artificial Sequence: Synthetic oligonucleotide
gaatcgtggaatgaactttggctatatgaaggatatgcc

SEQ ID NO: 253495 - DNA, 47 bp, Artificial Sequence
  Description of Artificial Sequence: Synthetic oligonucleotide
aatcgtggaatgaactttggctatatgaaggatatgccaaattaatg

SEQ ID NO: 253496 - DNA, 46 bp, Artificial Sequence
  Description of Artificial Sequence: Synthetic oligonucleotide
atcgtggaatgaactttggctatatgaaggatatgccaaattaatg

SEQ ID NO: 253497 - DNA, 45 bp, Artificial Sequence
  Description of Artificial Sequence: Synthetic oligonucleotide
tcgtggaatgaactttggctatatgaaggatatgccaaattaatg

SEQ ID NO: 253498 - DNA, 44 bp, Artificial Sequence
  Description of Artificial Sequence: Synthetic oligonucleotide
cgtggaatgaactttggctatatgaaggatatgccaaattaatg

SEQ ID NO: 253499 - DNA, 44 bp, Artificial Sequence
  Description of Artificial Sequence: Synthetic oligonucleotide
gtggaatgaactttggctatatgaaggatatgccaaattaatgg

SEQ ID NO: 253500 - DNA, 45 bp, Artificial Sequence
  Description of Artificial Sequence: Synthetic oligonucleotide
tggaatgaactttggctatatgaaggatatgccaaattaatggag

SEQ ID NO: 253501 - DNA, 44 bp, Artificial Sequence
  Description of Artificial Sequence: Synthetic oligonucleotide
ggaatgaactttggctatatgaaggatatgccaaattaatggag

SEQ ID NO: 253502 - DNA, 47 bp, Artificial Sequence
  Description of Artificial Sequence: Synthetic oligonucleotide
gaatgaactttggctatatgaaggatatgccaaattaatggagtttc

SEQ ID NO: 253503 - DNA, 48 bp, Artificial Sequence
  Description of Artificial Sequence: Synthetic oligonucleotide
aatgaactttggctatatgaaggatatgccaaattaatggagtttctg

SEQ ID NO: 253504 - DNA, 47 bp, Artificial Sequence
  Description of Artificial Sequence: Synthetic oligonucleotide
atgaactttggctatatgaaggatatgccaaattaatggagtttctg

SEQ ID NO: 253505 - DNA, 46 bp, Artificial Sequence
  Description of Artificial Sequence: Synthetic oligonucleotide
tgaactttggctatatgaaggatatgccaaattaatggagtttctg

SEQ ID NO: 253506 - DNA, 45 bp, Artificial Sequence
  Description of Artificial Sequence: Synthetic oligonucleotide
gaactttggctatatgaaggatatgccaaattaatggagtttctg

SEQ ID NO: 253507 - DNA, 46 bp, Artificial Sequence
  Description of Artificial Sequence: Synthetic oligonucleotide
aactttggctatatgaaggatatgccaaattaatggagtttctgtc

SEQ ID NO: 253508 - DNA, 45 bp, Artificial Sequence
  Description of Artificial Sequence: Synthetic oligonucleotide
actttggctatatgaaggatatgccaaattaatggagtttctgtc

SEQ ID NO: 253509 - DNA, 44 bp, Artificial Sequence
  Description of Artificial Sequence: Synthetic oligonucleotide
ctttggctatatgaaggatatgccaaattaatggagtttctgtc

SEQ ID NO: 253510 - DNA, 45 bp, Artificial Sequence
  Description of Artificial Sequence: Synthetic oligonucleotide
tttggctatatgaaggatatgccaaattaatggagtttctgtctg

SEQ ID NO: 253511 - DNA, 44 bp, Artificial Sequence
  Description of Artificial Sequence: Synthetic oligonucleotide
ttggctatatgaaggatatgccaaattaatggagtttctgtctg

SEQ ID NO: 253512 - DNA, 43 bp, Artificial Sequence
  Description of Artificial Sequence: Synthetic oligonucleotide
tggctatatgaaggatatgccaaattaatggagtttctgtctg

SEQ ID NO: 253513 - DNA, 42 bp, Artificial Sequence
  Description of Artificial Sequence: Synthetic oligonucleotide
ggctatatgaaggatatgccaaattaatggagtttctgtctg

SEQ ID NO: 253514 - DNA, 43 bp, Artificial Sequence
  Description of Artificial Sequence: Synthetic oligonucleotide
gctatatgaaggatatgccaaattaatggagtttctgtctgtc

SEQ ID NO: 253515 - DNA, 44 bp, Artificial Sequence
  Description of Artificial Sequence: Synthetic oligonucleotide
ctatatgaaggatatgccaaattaatggagtttctgtctgtcac

SEQ ID NO: 253516 - DNA, 45 bp, Artificial Sequence
  Description of Artificial Sequence: Synthetic oligonucleotide
tatatgaaggatatgccaaattaatggagtttctgtctgtcactg

SEQ ID NO: 253517 - DNA, 44 bp, Artificial Sequence
  Description of Artificial Sequence: Synthetic oligonucleotide
atatgaaggatatgccaaattaatggagtttctgtctgtcactg

SEQ ID NO: 253518 - DNA, 43 bp, Artificial Sequence
  Description of Artificial Sequence: Synthetic oligonucleotide
tatgaaggatatgccaaattaatggagtttctgtctgtcactg

SEQ ID NO: 253519 - DNA, 42 bp, Artificial Sequence
  Description of Artificial Sequence: Synthetic oligonucleotide
atgaaggatatgccaaattaatggagtttctgtctgtcactg

SEQ ID NO: 253520 - DNA, 41 bp, Artificial Sequence
  Description of Artificial Sequence: Synthetic oligonucleotide
tgaaggatatgccaaattaatggagtttctgtctgtcactg

SEQ ID NO: 253521 - DNA, 40 bp, Artificial Sequence
  Description of Artificial Sequence: Synthetic oligonucleotide
gaaggatatgccaaattaatggagtttctgtctgtcactg

SEQ ID NO: 253522 - DNA, 41 bp, Artificial Sequence
  Description of Artificial Sequence: Synthetic oligonucleotide
aaggatatgccaaattaatggagtttctgtctgtcactgtg

SEQ ID NO: 253523 - DNA, 40 bp, Artificial Sequence
  Description of Artificial Sequence: Synthetic oligonucleotide
aggatatgccaaattaatggagtttctgtctgtcactgtg

SEQ ID NO: 253524 - DNA, 39 bp, Artificial Sequence
  Description of Artificial Sequence: Synthetic oligonucleotide
ggatatgccaaattaatggagtttctgtctgtcactgtg

SEQ ID NO: 253525 - DNA, 40 bp, Artificial Sequence
  Description of Artificial Sequence: Synthetic oligonucleotide
gatatgccaaattaatggagtttctgtctgtcactgtgac

SEQ ID NO: 253526 - DNA, 40 bp, Artificial Sequence
  Description of Artificial Sequence: Synthetic oligonucleotide
atatgccaaattaatggagtttctgtctgtcactgtgacc

SEQ ID NO: 253527 - DNA, 39 bp, Artificial Sequence
  Description of Artificial Sequence: Synthetic oligonucleotide
tatgccaaattaatggagtttctgtctgtcactgtgacc

SEQ ID NO: 253528 - DNA, 38 bp, Artificial Sequence
  Description of Artificial Sequence: Synthetic oligonucleotide
atgccaaattaatggagtttctgtctgtcactgtgacc

SEQ ID NO: 253529 - DNA, 37 bp, Artificial Sequence
  Description of Artificial Sequence: Synthetic oligonucleotide
tgccaaattaatggagtttctgtctgtcactgtgacc

SEQ ID NO: 253530 - DNA, 36 bp, Artificial Sequence
  Description of Artificial Sequence: Synthetic oligonucleotide
gccaaattaatggagtttctgtctgtcactgtgacc

SEQ ID NO: 253531 - DNA, 36 bp, Artificial Sequence
  Description of Artificial Sequence: Synthetic oligonucleotide
ccaaattaatggagtttctgtctgtcactgtgaccc

SEQ ID NO: 253532 - DNA, 38 bp, Artificial Sequence
  Description of Artificial Sequence: Synthetic oligonucleotide
caaattaatggagtttctgtctgtcactgtgacccaac

SEQ ID NO: 253533 - DNA, 38 bp, Artificial Sequence
  Description of Artificial Sequence: Synthetic oligonucleotide
aaattaatggagtttctgtctgtcactgtgacccaacc

SEQ ID NO: 253534 - DNA, 37 bp, Artificial Sequence
  Description of Artificial Sequence: Synthetic oligonucleotide
aattaatggagtttctgtctgtcactgtgacccaacc

SEQ ID NO: 253535 - DNA, 36 bp, Artificial Sequence
  Description of Artificial Sequence: Synthetic oligonucleotide
attaatggagtttctgtctgtcactgtgacccaacc

SEQ ID NO: 253536 - DNA, 35 bp, Artificial Sequence
  Description of Artificial Sequence: Synthetic oligonucleotide
ttaatggagtttctgtctgtcactgtgacccaacc

SEQ ID NO: 253537 - DNA, 34 bp, Artificial Sequence
  Description of Artificial Sequence: Synthetic oligonucleotide
taatggagtttctgtctgtcactgtgacccaacc

SEQ ID NO: 253538 - DNA, 33 bp, Artificial Sequence
  Description of Artificial Sequence: Synthetic oligonucleotide
aatggagtttctgtctgtcactgtgacccaacc

SEQ ID NO: 253539 - DNA, 32 bp, Artificial Sequence
  Description of Artificial Sequence: Synthetic oligonucleotide
atggagtttctgtctgtcactgtgacccaacc

SEQ ID NO: 253540 - DNA, 31 bp, Artificial Sequence
  Description of Artificial Sequence: Synthetic oligonucleotide
tggagtttctgtctgtcactgtgacccaacc

SEQ ID NO: 253541 - DNA, 30 bp, Artificial Sequence
  Description of Artificial Sequence: Synthetic oligonucleotide
ggagtttctgtctgtcactgtgacccaacc

SEQ ID NO: 253542 - DNA, 31 bp, Artificial Sequence
  Description of Artificial Sequence: Synthetic oligonucleotide
gagtttctgtctgtcactgtgacccaacctg

SEQ ID NO: 253543 - DNA, 33 bp, Artificial Sequence
  Description of Artificial Sequence: Synthetic oligonucleotide
agtttctgtctgtcactgtgacccaacctgaac

SEQ ID NO: 253544 - DNA, 32 bp, Artificial Sequence
  Description of Artificial Sequence: Synthetic oligonucleotide
gtttctgtctgtcactgtgacccaacctgaac

SEQ ID NO: 253545 - DNA, 33 bp, Artificial Sequence
  Description of Artificial Sequence: Synthetic oligonucleotide
tttctgtctgtcactgtgacccaacctgaactg

SEQ ID NO: 253546 - DNA, 32 bp, Artificial Sequence
  Description of Artificial Sequence: Synthetic oligonucleotide
ttctgtctgtcactgtgacccaacctgaactg

SEQ ID NO: 253547 - DNA, 31 bp, Artificial Sequence
  Description of Artificial Sequence: Synthetic oligonucleotide
tctgtctgtcactgtgacccaacctgaactg

SEQ ID NO: 253548 - DNA, 30 bp, Artificial Sequence
  Description of Artificial Sequence: Synthetic oligonucleotide
ctgtctgtcactgtgacccaacctgaactg

SEQ ID NO: 253549 - DNA, 33 bp, Artificial Sequence
  Description of Artificial Sequence: Synthetic oligonucleotide
tgtctgtcactgtgacccaacctgaactgtaag

SEQ ID NO: 253550 - DNA, 32 bp, Artificial Sequence
  Description of Artificial Sequence: Synthetic oligonucleotide
gtctgtcactgtgacccaacctgaactgtaag

SEQ ID NO: 253551 - DNA, 34 bp, Artificial Sequence
  Description of Artificial Sequence: Synthetic oligonucleotide
tctgtcactgtgacccaacctgaactgtaagttg

SEQ ID NO: 253552 - DNA, 33 bp, Artificial Sequence
  Description of Artificial Sequence: Synthetic oligonucleotide
ctgtcactgtgacccaacctgaactgtaagttg

SEQ ID NO: 253553 - DNA, 33 bp, Artificial Sequence
  Description of Artificial Sequence: Synthetic oligonucleotide
tgtcactgtgacccaacctgaactgtaagttgg

SEQ ID NO: 253554 - DNA, 32 bp, Artificial Sequence
  Description of Artificial Sequence: Synthetic oligonucleotide
gtcactgtgacccaacctgaactgtaagttgg

SEQ ID NO: 253555 - DNA, 33 bp, Artificial Sequence
  Description of Artificial Sequence: Synthetic oligonucleotide
tcactgtgacccaacctgaactgtaagttggag

SEQ ID NO: 253556 - DNA, 32 bp, Artificial Sequence
  Description of Artificial Sequence: Synthetic oligonucleotide
cactgtgacccaacctgaactgtaagttggag

SEQ ID NO: 253557 - DNA, 39 bp, Artificial Sequence
  Description of Artificial Sequence: Synthetic oligonucleotide
actgtgacccaacctgaactgtaagttggagtttatttc

SEQ ID NO: 253558 - DNA, 38 bp, Artificial Sequence
  Description of Artificial Sequence: Synthetic oligonucleotide
ctgtgacccaacctgaactgtaagttggagtttatttc

SEQ ID NO: 253559 - DNA, 41 bp, Artificial Sequence
  Description of Artificial Sequence: Synthetic oligonucleotide
tgtgacccaacctgaactgtaagttggagtttatttcttag

SEQ ID NO: 253560 - DNA, 40 bp, Artificial Sequence
  Description of Artificial Sequence: Synthetic oligonucleotide
gtgacccaacctgaactgtaagttggagtttatttcttag

SEQ ID NO: 253561 - DNA, 40 bp, Artificial Sequence
  Description of Artificial Sequence: Synthetic oligonucleotide
tgacccaacctgaactgtaagttggagtttatttcttagg

SEQ ID NO: 253562 - DNA, 39 bp, Artificial Sequence
  Description of Artificial Sequence: Synthetic oligonucleotide
gacccaacctgaactgtaagttggagtttatttcttagg

SEQ ID NO: 253563 - DNA, 39 bp, Artificial Sequence
  Description of Artificial Sequence: Synthetic oligonucleotide
acccaacctgaactgtaagttggagtttatttcttaggc

SEQ ID NO: 253564 - DNA, 38 bp, Artificial Sequence
  Description of Artificial Sequence: Synthetic oligonucleotide
cccaacctgaactgtaagttggagtttatttcttaggc

SEQ ID NO: 253565 - DNA, 42 bp, Artificial Sequence
  Description of Artificial Sequence: Synthetic oligonucleotide
ccaacctgaactgtaagttggagtttatttcttaggcaaatg

SEQ ID NO: 253566 - DNA, 46 bp, Artificial Sequence
  Description of Artificial Sequence: Synthetic oligonucleotide
caacctgaactgtaagttggagtttatttcttaggcaaatgtattg

SEQ ID NO: 253567 - DNA, 47 bp, Artificial Sequence
  Description of Artificial Sequence: Synthetic oligonucleotide
aacctgaactgtaagttggagtttatttcttaggcaaatgtattgac

SEQ ID NO: 253568 - DNA, 46 bp, Artificial Sequence
  Description of Artificial Sequence: Synthetic oligonucleotide
acctgaactgtaagttggagtttatttcttaggcaaatgtattgac

SEQ ID NO: 253569 - DNA, 45 bp, Artificial Sequence
  Description of Artificial Sequence: Synthetic oligonucleotide
cctgaactgtaagttggagtttatttcttaggcaaatgtattgac

SEQ ID NO: 253570 - DNA, 45 bp, Artificial Sequence
  Description of Artificial Sequence: Synthetic oligonucleotide
ctgaactgtaagttggagtttatttcttaggcaaatgtattgacg

SEQ ID NO: 253571 - DNA, 45 bp, Artificial Sequence
  Description of Artificial Sequence: Synthetic oligonucleotide
tgaactgtaagttggagtttatttcttaggcaaatgtattgacgc

SEQ ID NO: 253572 - DNA, 44 bp, Artificial Sequence
  Description of Artificial Sequence: Synthetic oligonucleotide
gaactgtaagttggagtttatttcttaggcaaatgtattgacgc

SEQ ID NO: 253573 - DNA, 47 bp, Artificial Sequence
  Description of Artificial Sequence: Synthetic oligonucleotide
aactgtaagttggagtttatttcttaggcaaatgtattgacgcaaag

SEQ ID NO: 253574 - DNA, 46 bp, Artificial Sequence
  Description of Artificial Sequence: Synthetic oligonucleotide
actgtaagttggagtttatttcttaggcaaatgtattgacgcaaag

SEQ ID NO: 253575 - DNA, 45 bp, Artificial Sequence
  Description of Artificial Sequence: Synthetic oligonucleotide
ctgtaagttggagtttatttcttaggcaaatgtattgacgcaaag

SEQ ID NO: 253576 - DNA, 45 bp, Artificial Sequence
  Description of Artificial Sequence: Synthetic oligonucleotide
tgtaagttggagtttatttcttaggcaaatgtattgacgcaaagg

SEQ ID NO: 253577 - DNA, 44 bp, Artificial Sequence
  Description of Artificial Sequence: Synthetic oligonucleotide
gtaagttggagtttatttcttaggcaaatgtattgacgcaaagg

SEQ ID NO: 253578 - DNA, 45 bp, Artificial Sequence
  Description of Artificial Sequence: Synthetic oligonucleotide
taagttggagtttatttcttaggcaaatgtattgacgcaaaggag

SEQ ID NO: 253579 - DNA, 44 bp, Artificial Sequence
  Description of Artificial Sequence: Synthetic oligonucleotide
aagttggagtttatttcttaggcaaatgtattgacgcaaaggag

SEQ ID NO: 253580 - DNA, 43 bp, Artificial Sequence
  Description of Artificial Sequence: Synthetic oligonucleotide
agttggagtttatttcttaggcaaatgtattgacgcaaaggag

SEQ ID NO: 253581 - DNA, 42 bp, Artificial Sequence
  Description of Artificial Sequence: Synthetic oligonucleotide
gttggagtttatttcttaggcaaatgtattgacgcaaaggag

SEQ ID NO: 253582 - DNA, 42 bp, Artificial Sequence
  Description of Artificial Sequence: Synthetic oligonucleotide
ttggagtttatttcttaggcaaatgtattgacgcaaaggagg

SEQ ID NO: 253583 - DNA, 41 bp, Artificial Sequence
  Description of Artificial Sequence: Synthetic oligonucleotide
tggagtttatttcttaggcaaatgtattgacgcaaaggagg

SEQ ID NO: 253584 - DNA, 40 bp, Artificial Sequence
  Description of Artificial Sequence: Synthetic oligonucleotide
ggagtttatttcttaggcaaatgtattgacgcaaaggagg

SEQ ID NO: 253585 - DNA, 42 bp, Artificial Sequence
  Description of Artificial Sequence: Synthetic oligonucleotide
gagtttatttcttaggcaaatgtattgacgcaaaggaggtag

SEQ ID NO: 253586 - DNA, 44 bp, Artificial Sequence
  Description of Artificial Sequence: Synthetic oligonucleotide
agtttatttcttaggcaaatgtattgacgcaaaggaggtagaag

SEQ ID NO: 253587 - DNA, 43 bp, Artificial Sequence
  Description of Artificial Sequence: Synthetic oligonucleotide
gtttatttcttaggcaaatgtattgacgcaaaggaggtagaag

SEQ ID NO: 253588 - DNA, 43 bp, Artificial Sequence
  Description of Artificial Sequence: Synthetic oligonucleotide
tttatttcttaggcaaatgtattgacgcaaaggaggtagaagc

SEQ ID NO: 253589 - DNA, 42 bp, Artificial Sequence
  Description of Artificial Sequence: Synthetic oligonucleotide
ttatttcttaggcaaatgtattgacgcaaaggaggtagaagc

SEQ ID NO: 253590 - DNA, 41 bp, Artificial Sequence
  Description of Artificial Sequence: Synthetic oligonucleotide
tatttcttaggcaaatgtattgacgcaaaggaggtagaagc

SEQ ID NO: 253591 - DNA, 40 bp, Artificial Sequence
  Description of Artificial Sequence: Synthetic oligonucleotide
atttcttaggcaaatgtattgacgcaaaggaggtagaagc

SEQ ID NO: 253592 - DNA, 39 bp, Artificial Sequence
  Description of Artificial Sequence: Synthetic oligonucleotide
tttcttaggcaaatgtattgacgcaaaggaggtagaagc

SEQ ID NO: 253593 - DNA, 38 bp, Artificial Sequence
  Description of Artificial Sequence: Synthetic oligonucleotide
ttcttaggcaaatgtattgacgcaaaggaggtagaagc

SEQ ID NO: 253594 - DNA, 37 bp, Artificial Sequence
  Description of Artificial Sequence: Synthetic oligonucleotide
tcttaggcaaatgtattgacgcaaaggaggtagaagc

SEQ ID NO: 253595 - DNA, 36 bp, Artificial Sequence
  Description of Artificial Sequence: Synthetic oligonucleotide
cttaggcaaatgtattgacgcaaaggaggtagaagc

SEQ ID NO: 253596 - DNA, 44 bp, Artificial Sequence
  Description of Artificial Sequence: Synthetic oligonucleotide
ttaggcaaatgtattgacgcaaaggaggtagaagctttaaatac

SEQ ID NO: 253597 - DNA, 43 bp, Artificial Sequence
  Description of Artificial Sequence: Synthetic oligonucleotide
taggcaaatgtattgacgcaaaggaggtagaagctttaaatac

SEQ ID NO: 253598 - DNA, 42 bp, Artificial Sequence
  Description of Artificial Sequence: Synthetic oligonucleotide
aggcaaatgtattgacgcaaaggaggtagaagctttaaatac

SEQ ID NO: 253599 - DNA, 41 bp, Artificial Sequence
  Description of Artificial Sequence: Synthetic oligonucleotide
ggcaaatgtattgacgcaaaggaggtagaagctttaaatac

SEQ ID NO: 253600 - DNA, 41 bp, Artificial Sequence
  Description of Artificial Sequence: Synthetic oligonucleotide
gcaaatgtattgacgcaaaggaggtagaagctttaaatacc

SEQ ID NO: 253601 - DNA, 42 bp, Artificial Sequence
  Description of Artificial Sequence: Synthetic oligonucleotide
caaatgtattgacgcaaaggaggtagaagctttaaatacctc

SEQ ID NO: 253602 - DNA, 43 bp, Artificial Sequence
  Description of Artificial Sequence: Synthetic oligonucleotide
aaatgtattgacgcaaaggaggtagaagctttaaatacctcac

SEQ ID NO: 253603 - DNA, 42 bp, Artificial Sequence
  Description of Artificial Sequence: Synthetic oligonucleotide
aatgtattgacgcaaaggaggtagaagctttaaatacctcac

SEQ ID NO: 253604 - DNA, 41 bp, Artificial Sequence
  Description of Artificial Sequence: Synthetic oligonucleotide
atgtattgacgcaaaggaggtagaagctttaaatacctcac

SEQ ID NO: 253605 - DNA, 40 bp, Artificial Sequence
  Description of Artificial Sequence: Synthetic oligonucleotide
tgtattgacgcaaaggaggtagaagctttaaatacctcac

SEQ ID NO: 253606 - DNA, 39 bp, Artificial Sequence
  Description of Artificial Sequence: Synthetic oligonucleotide
gtattgacgcaaaggaggtagaagctttaaatacctcac

SEQ ID NO: 253607 - DNA, 40 bp, Artificial Sequence
  Description of Artificial Sequence: Synthetic oligonucleotide
tattgacgcaaaggaggtagaagctttaaatacctcacac

SEQ ID NO: 253608 - DNA, 39 bp, Artificial Sequence
  Description of Artificial Sequence: Synthetic oligonucleotide
attgacgcaaaggaggtagaagctttaaatacctcacac

SEQ ID NO: 253609 - DNA, 38 bp, Artificial Sequence
  Description of Artificial Sequence: Synthetic oligonucleotide
ttgacgcaaaggaggtagaagctttaaatacctcacac

SEQ ID NO: 253610 - DNA, 37 bp, Artificial Sequence
  Description of Artificial Sequence: Synthetic oligonucleotide
tgacgcaaaggaggtagaagctttaaatacctcacac

SEQ ID NO: 253611 - DNA, 36 bp, Artificial Sequence
  Description of Artificial Sequence: Synthetic oligonucleotide
gacgcaaaggaggtagaagctttaaatacctcacac

SEQ ID NO: 253612 - DNA, 36 bp, Artificial Sequence
  Description of Artificial Sequence: Synthetic oligonucleotide
acgcaaaggaggtagaagctttaaatacctcacacc

SEQ ID NO: 253613 - DNA, 35 bp, Artificial Sequence
  Description of Artificial Sequence: Synthetic oligonucleotide
cgcaaaggaggtagaagctttaaatacctcacacc

SEQ ID NO: 253614 - DNA, 35 bp, Artificial Sequence
  Description of Artificial Sequence: Synthetic oligonucleotide
gcaaaggaggtagaagctttaaatacctcacaccg

SEQ ID NO: 253615 - DNA, 36 bp, Artificial Sequence
  Description of Artificial Sequence: Synthetic oligonucleotide
caaaggaggtagaagctttaaatacctcacaccgtg

SEQ ID NO: 253616 - DNA, 37 bp, Artificial Sequence
  Description of Artificial Sequence: Synthetic oligonucleotide
aaaggaggtagaagctttaaatacctcacaccgtgtg

SEQ ID NO: 253617 - DNA, 36 bp, Artificial Sequence
  Description of Artificial Sequence: Synthetic oligonucleotide
aaggaggtagaagctttaaatacctcacaccgtgtg

SEQ ID NO: 253618 - DNA, 35 bp, Artificial Sequence
  Description of Artificial Sequence: Synthetic oligonucleotide
aggaggtagaagctttaaatacctcacaccgtgtg

SEQ ID NO: 253619 - DNA, 34 bp, Artificial Sequence
  Description of Artificial Sequence: Synthetic oligonucleotide
ggaggtagaagctttaaatacctcacaccgtgtg

SEQ ID NO: 253620 - DNA, 35 bp, Artificial Sequence
  Description of Artificial Sequence: Synthetic oligonucleotide
gaggtagaagctttaaatacctcacaccgtgtgtc

SEQ ID NO: 253621 - DNA, 37 bp, Artificial Sequence
  Description of Artificial Sequence: Synthetic oligonucleotide
aggtagaagctttaaatacctcacaccgtgtgtctac

SEQ ID NO: 253622 - DNA, 36 bp, Artificial Sequence
  Description of Artificial Sequence: Synthetic oligonucleotide
ggtagaagctttaaatacctcacaccgtgtgtctac

SEQ ID NO: 253623 - DNA, 37 bp, Artificial Sequence
  Description of Artificial Sequence: Synthetic oligonucleotide
gtagaagctttaaatacctcacaccgtgtgtctactc

SEQ ID NO: 253624 - DNA, 37 bp, Artificial Sequence
  Description of Artificial Sequence: Synthetic oligonucleotide
tagaagctttaaatacctcacaccgtgtgtctactcc

SEQ ID NO: 253625 - DNA, 36 bp, Artificial Sequence
  Description of Artificial Sequence: Synthetic oligonucleotide
agaagctttaaatacctcacaccgtgtgtctactcc

SEQ ID NO: 253626 - DNA, 35 bp, Artificial Sequence
  Description of Artificial Sequence: Synthetic oligonucleotide
gaagctttaaatacctcacaccgtgtgtctactcc

SEQ ID NO: 253627 - DNA, 36 bp, Artificial Sequence
  Description of Artificial Sequence: Synthetic oligonucleotide
aagctttaaatacctcacaccgtgtgtctactcctg

SEQ ID NO: 253628 - DNA, 35 bp, Artificial Sequence
  Description of Artificial Sequence: Synthetic oligonucleotide
agctttaaatacctcacaccgtgtgtctactcctg

SEQ ID NO: 253629 - DNA, 34 bp, Artificial Sequence
  Description of Artificial Sequence: Synthetic oligonucleotide
gctttaaatacctcacaccgtgtgtctactcctg

SEQ ID NO: 253630 - DNA, 35 bp, Artificial Sequence
  Description of Artificial Sequence: Synthetic oligonucleotide
ctttaaatacctcacaccgtgtgtctactcctgtg

SEQ ID NO: 253631 - DNA, 35 bp, Artificial Sequence
  Description of Artificial Sequence: Synthetic oligonucleotide
tttaaatacctcacaccgtgtgtctactcctgtgg

SEQ ID NO: 253632 - DNA, 34 bp, Artificial Sequence
  Description of Artificial Sequence: Synthetic oligonucleotide
ttaaatacctcacaccgtgtgtctactcctgtgg

SEQ ID NO: 253633 - DNA, 33 bp, Artificial Sequence
  Description of Artificial Sequence: Synthetic oligonucleotide
taaatacctcacaccgtgtgtctactcctgtgg

SEQ ID NO: 253634 - DNA, 32 bp, Artificial Sequence
  Description of Artificial Sequence: Synthetic oligonucleotide
aaatacctcacaccgtgtgtctactcctgtgg

SEQ ID NO: 253635 - DNA, 31 bp, Artificial Sequence
  Description of Artificial Sequence: Synthetic oligonucleotide
aatacctcacaccgtgtgtctactcctgtgg

SEQ ID NO: 253636 - DNA, 30 bp, Artificial Sequence
  Description of Artificial Sequence: Synthetic oligonucleotide
atacctcacaccgtgtgtctactcctgtgg

SEQ ID NO: 253637 - DNA, 29 bp, Artificial Sequence
  Description of Artificial Sequence: Synthetic oligonucleotide
tacctcacaccgtgtgtctactcctgtgg

SEQ ID NO: 253638 - DNA, 28 bp, Artificial Sequence
  Description of Artificial Sequence: Synthetic oligonucleotide
acctcacaccgtgtgtctactcctgtgg

SEQ ID NO: 253639 - DNA, 27 bp, Artificial Sequence
  Description of Artificial Sequence: Synthetic oligonucleotide
cctcacaccgtgtgtctactcctgtgg

SEQ ID NO: 253640 - DNA, 32 bp, Artificial Sequence
  Description of Artificial Sequence: Synthetic oligonucleotide
ctcacaccgtgtgtctactcctgtggaatatc

SEQ ID NO: 253641 - DNA, 32 bp, Artificial Sequence
  Description of Artificial Sequence: Synthetic oligonucleotide
tcacaccgtgtgtctactcctgtggaatatcc

SEQ ID NO: 253642 - DNA, 31 bp, Artificial Sequence
  Description of Artificial Sequence: Synthetic oligonucleotide
cacaccgtgtgtctactcctgtggaatatcc

SEQ ID NO: 253643 - DNA, 32 bp, Artificial Sequence
  Description of Artificial Sequence: Synthetic oligonucleotide
acaccgtgtgtctactcctgtggaatatcctg

SEQ ID NO: 253644 - DNA, 31 bp, Artificial Sequence
  Description of Artificial Sequence: Synthetic oligonucleotide
caccgtgtgtctactcctgtggaatatcctg

SEQ ID NO: 253645 - DNA, 31 bp, Artificial Sequence
  Description of Artificial Sequence: Synthetic oligonucleotide
accgtgtgtctactcctgtggaatatcctgc

SEQ ID NO: 253646 - DNA, 30 bp, Artificial Sequence
  Description of Artificial Sequence: Synthetic oligonucleotide
ccgtgtgtctactcctgtggaatatcctgc

SEQ ID NO: 253647 - DNA, 31 bp, Artificial Sequence
  Description of Artificial Sequence: Synthetic oligonucleotide
cgtgtgtctactcctgtggaatatcctgctc

SEQ ID NO: 253648 - DNA, 32 bp, Artificial Sequence
  Description of Artificial Sequence: Synthetic oligonucleotide
gtgtgtctactcctgtggaatatcctgctctg

SEQ ID NO: 253649 - DNA, 34 bp, Artificial Sequence
  Description of Artificial Sequence: Synthetic oligonucleotide
tgtgtctactcctgtggaatatcctgctctgatc

SEQ ID NO: 253650 - DNA, 33 bp, Artificial Sequence
  Description of Artificial Sequence: Synthetic oligonucleotide
gtgtctactcctgtggaatatcctgctctgatc

SEQ ID NO: 253651 - DNA, 33 bp, Artificial Sequence
  Description of Artificial Sequence: Synthetic oligonucleotide
tgtctactcctgtggaatatcctgctctgatcc

SEQ ID NO: 253652 - DNA, 32 bp, Artificial Sequence
  Description of Artificial Sequence: Synthetic oligonucleotide
gtctactcctgtggaatatcctgctctgatcc

SEQ ID NO: 253653 - DNA, 32 bp, Artificial Sequence
  Description of Artificial Sequence: Synthetic oligonucleotide
tctactcctgtggaatatcctgctctgatccg

SEQ ID NO: 253654 - DNA, 31 bp, Artificial Sequence
  Description of Artificial Sequence: Synthetic oligonucleotide
ctactcctgtggaatatcctgctctgatccg

SEQ ID NO: 253655 - DNA, 31 bp, Artificial Sequence
  Description of Artificial Sequence: Synthetic oligonucleotide
tactcctgtggaatatcctgctctgatccgg

SEQ ID NO: 253656 - DNA, 30 bp, Artificial Sequence
  Description of Artificial Sequence: Synthetic oligonucleotide
actcctgtggaatatcctgctctgatccgg

SEQ ID NO: 253657 - DNA, 29 bp, Artificial Sequence
  Description of Artificial Sequence: Synthetic oligonucleotide
ctcctgtggaatatcctgctctgatccgg

SEQ ID NO: 253658 - DNA, 29 bp, Artificial Sequence
  Description of Artificial Sequence: Synthetic oligonucleotide
tcctgtggaatatcctgctctgatccggg

SEQ ID NO: 253659 - DNA, 28 bp, Artificial Sequence
  Description of Artificial Sequence: Synthetic oligonucleotide
cctgtggaatatcctgctctgatccggg

SEQ ID NO: 253660 - DNA, 29 bp, Artificial Sequence
  Description of Artificial Sequence: Synthetic oligonucleotide
ctgtggaatatcctgctctgatccgggac

SEQ ID NO: 253661 - DNA, 31 bp, Artificial Sequence
  Description of Artificial Sequence: Synthetic oligonucleotide
tgtggaatatcctgctctgatccgggacatg

SEQ ID NO: 253662 - DNA, 30 bp, Artificial Sequence
  Description of Artificial Sequence: Synthetic oligonucleotide
gtggaatatcctgctctgatccgggacatg

SEQ ID NO: 253663 - DNA, 33 bp, Artificial Sequence
  Description of Artificial Sequence: Synthetic oligonucleotide
tggaatatcctgctctgatccgggacatgtttg

SEQ ID NO: 253664 - DNA, 32 bp, Artificial Sequence
  Description of Artificial Sequence: Synthetic oligonucleotide
ggaatatcctgctctgatccgggacatgtttg

SEQ ID NO: 253665 - DNA, 34 bp, Artificial Sequence
  Description of Artificial Sequence: Synthetic oligonucleotide
gaatatcctgctctgatccgggacatgtttgatc

SEQ ID NO: 253666 - DNA, 36 bp, Artificial Sequence
  Description of Artificial Sequence: Synthetic oligonucleotide
aatatcctgctctgatccgggacatgtttgatcatg

SEQ ID NO: 253667 - DNA, 35 bp, Artificial Sequence
  Description of Artificial Sequence: Synthetic oligonucleotide
atatcctgctctgatccgggacatgtttgatcatg

SEQ ID NO: 253668 - DNA, 34 bp, Artificial Sequence
  Description of Artificial Sequence: Synthetic oligonucleotide
tatcctgctctgatccgggacatgtttgatcatg

SEQ ID NO: 253669 - DNA, 33 bp, Artificial Sequence
  Description of Artificial Sequence: Synthetic oligonucleotide
atcctgctctgatccgggacatgtttgatcatg

SEQ ID NO: 253670 - DNA, 32 bp, Artificial Sequence
  Description of Artificial Sequence: Synthetic oligonucleotide
tcctgctctgatccgggacatgtttgatcatg

SEQ ID NO: 253671 - DNA, 31 bp, Artificial Sequence
  Description of Artificial Sequence: Synthetic oligonucleotide
cctgctctgatccgggacatgtttgatcatg

SEQ ID NO: 253672 - DNA, 34 bp, Artificial Sequence
  Description of Artificial Sequence: Synthetic oligonucleotide
ctgctctgatccgggacatgtttgatcatgtttc

SEQ ID NO: 253673 - DNA, 38 bp, Artificial Sequence
  Description of Artificial Sequence: Synthetic oligonucleotide
tgctctgatccgggacatgtttgatcatgtttcttttg

SEQ ID NO: 253674 - DNA, 37 bp, Artificial Sequence
  Description of Artificial Sequence: Synthetic oligonucleotide
gctctgatccgggacatgtttgatcatgtttcttttg

SEQ ID NO: 253675 - DNA, 41 bp, Artificial Sequence
  Description of Artificial Sequence: Synthetic oligonucleotide
ctctgatccgggacatgtttgatcatgtttcttttgataag

SEQ ID NO: 253676 - DNA, 41 bp, Artificial Sequence
  Description of Artificial Sequence: Synthetic oligonucleotide
tctgatccgggacatgtttgatcatgtttcttttgataagg

SEQ ID NO: 253677 - DNA, 40 bp, Artificial Sequence
  Description of Artificial Sequence: Synthetic oligonucleotide
ctgatccgggacatgtttgatcatgtttcttttgataagg

SEQ ID NO: 253678 - DNA, 40 bp, Artificial Sequence
  Description of Artificial Sequence: Synthetic oligonucleotide
tgatccgggacatgtttgatcatgtttcttttgataaggg

SEQ ID NO: 253679 - DNA, 39 bp, Artificial Sequence
  Description of Artificial Sequence: Synthetic oligonucleotide
gatccgggacatgtttgatcatgtttcttttgataaggg

SEQ ID NO: 253680 - DNA, 40 bp, Artificial Sequence
  Description of Artificial Sequence: Synthetic oligonucleotide
atccgggacatgtttgatcatgtttcttttgataagggtg

SEQ ID NO: 253681 - DNA, 39 bp, Artificial Sequence
  Description of Artificial Sequence: Synthetic oligonucleotide
tccgggacatgtttgatcatgtttcttttgataagggtg

SEQ ID NO: 253682 - DNA, 38 bp, Artificial Sequence
  Description of Artificial Sequence: Synthetic oligonucleotide
ccgggacatgtttgatcatgtttcttttgataagggtg

SEQ ID NO: 253683 - DNA, 38 bp, Artificial Sequence
  Description of Artificial Sequence: Synthetic oligonucleotide
cgggacatgtttgatcatgtttcttttgataagggtgc

SEQ ID NO: 253684 - DNA, 40 bp, Artificial Sequence
  Description of Artificial Sequence: Synthetic oligonucleotide
gggacatgtttgatcatgtttcttttgataagggtgcttg

SEQ ID NO: 253685 - DNA, 44 bp, Artificial Sequence
  Description of Artificial Sequence: Synthetic oligonucleotide
ggacatgtttgatcatgtttcttttgataagggtgcttgtattg

SEQ ID NO: 253686 - DNA, 45 bp, Artificial Sequence
  Description of Artificial Sequence: Synthetic oligonucleotide
gacatgtttgatcatgtttcttttgataagggtgcttgtattgtg

SEQ ID NO: 253687 - DNA, 50 bp, Artificial Sequence
  Description of Artificial Sequence: Synthetic oligonucleotide
acatgtttgatcatgtttcttttgataagggtgcttgtattgtgaatatg

SEQ ID NO: 253688 - DNA, 49 bp, Artificial Sequence
  Description of Artificial Sequence: Synthetic oligonucleotide
catgtttgatcatgtttcttttgataagggtgcttgtattgtgaatatg

SEQ ID NO: 253689 - DNA, 49 bp, Artificial Sequence
  Description of Artificial Sequence: Synthetic oligonucleotide
atgtttgatcatgtttcttttgataagggtgcttgtattgtgaatatgc

SEQ ID NO: 253690 - DNA, 48 bp, Artificial Sequence
  Description of Artificial Sequence: Synthetic oligonucleotide
tgtttgatcatgtttcttttgataagggtgcttgtattgtgaatatgc

SEQ ID NO: 253691 - DNA, 47 bp, Artificial Sequence
  Description of Artificial Sequence: Synthetic oligonucleotide
gtttgatcatgtttcttttgataagggtgcttgtattgtgaatatgc

SEQ ID NO: 253692 - DNA, 50 bp, Artificial Sequence
  Description of Artificial Sequence: Synthetic oligonucleotide
tttgatcatgtttcttttgataagggtgcttgtattgtgaatatgcaaag

SEQ ID NO: 253693 - DNA, 49 bp, Artificial Sequence
  Description of Artificial Sequence: Synthetic oligonucleotide
ttgatcatgtttcttttgataagggtgcttgtattgtgaatatgcaaag

SEQ ID NO: 253694 - DNA, 48 bp, Artificial Sequence
  Description of Artificial Sequence: Synthetic oligonucleotide
tgatcatgtttcttttgataagggtgcttgtattgtgaatatgcaaag

SEQ ID NO: 253695 - DNA, 47 bp, Artificial Sequence
  Description of Artificial Sequence: Synthetic oligonucleotide
gatcatgtttcttttgataagggtgcttgtattgtgaatatgcaaag

SEQ ID NO: 253696 - DNA, 47 bp, Artificial Sequence
  Description of Artificial Sequence: Synthetic oligonucleotide
atcatgtttcttttgataagggtgcttgtattgtgaatatgcaaagg

SEQ ID NO: 253697 - DNA, 46 bp, Artificial Sequence
  Description of Artificial Sequence: Synthetic oligonucleotide
tcatgtttcttttgataagggtgcttgtattgtgaatatgcaaagg

SEQ ID NO: 253698 - DNA, 45 bp, Artificial Sequence
  Description of Artificial Sequence: Synthetic oligonucleotide
catgtttcttttgataagggtgcttgtattgtgaatatgcaaagg

SEQ ID NO: 253699 - DNA, 45 bp, Artificial Sequence
  Description of Artificial Sequence: Synthetic oligonucleotide
atgtttcttttgataagggtgcttgtattgtgaatatgcaaaggg

SEQ ID NO: 253700 - DNA, 44 bp, Artificial Sequence
  Description of Artificial Sequence: Synthetic oligonucleotide
tgtttcttttgataagggtgcttgtattgtgaatatgcaaaggg

SEQ ID NO: 253701 - DNA, 43 bp, Artificial Sequence
  Description of Artificial Sequence: Synthetic oligonucleotide
gtttcttttgataagggtgcttgtattgtgaatatgcaaaggg

SEQ ID NO: 253702 - DNA, 44 bp, Artificial Sequence
  Description of Artificial Sequence: Synthetic oligonucleotide
tttcttttgataagggtgcttgtattgtgaatatgcaaagggag

SEQ ID NO: 253703 - DNA, 43 bp, Artificial Sequence
  Description of Artificial Sequence: Synthetic oligonucleotide
ttcttttgataagggtgcttgtattgtgaatatgcaaagggag

SEQ ID NO: 253704 - DNA, 42 bp, Artificial Sequence
  Description of Artificial Sequence: Synthetic oligonucleotide
tcttttgataagggtgcttgtattgtgaatatgcaaagggag

SEQ ID NO: 253705 - DNA, 41 bp, Artificial Sequence
  Description of Artificial Sequence: Synthetic oligonucleotide
cttttgataagggtgcttgtattgtgaatatgcaaagggag

SEQ ID NO: 253706 - DNA, 44 bp, Artificial Sequence
  Description of Artificial Sequence: Synthetic oligonucleotide
ttttgataagggtgcttgtattgtgaatatgcaaagggagtaac

SEQ ID NO: 253707 - DNA, 43 bp, Artificial Sequence
  Description of Artificial Sequence: Synthetic oligonucleotide
tttgataagggtgcttgtattgtgaatatgcaaagggagtaac

SEQ ID NO: 253708 - DNA, 42 bp, Artificial Sequence
  Description of Artificial Sequence: Synthetic oligonucleotide
ttgataagggtgcttgtattgtgaatatgcaaagggagtaac

SEQ ID NO: 253709 - DNA, 41 bp, Artificial Sequence
  Description of Artificial Sequence: Synthetic oligonucleotide
tgataagggtgcttgtattgtgaatatgcaaagggagtaac

SEQ ID NO: 253710 - DNA, 40 bp, Artificial Sequence
  Description of Artificial Sequence: Synthetic oligonucleotide
gataagggtgcttgtattgtgaatatgcaaagggagtaac

SEQ ID NO: 253711 - DNA, 43 bp, Artificial Sequence
  Description of Artificial Sequence: Synthetic oligonucleotide
ataagggtgcttgtattgtgaatatgcaaagggagtaacttag

SEQ ID NO: 253712 - DNA, 42 bp, Artificial Sequence
  Description of Artificial Sequence: Synthetic oligonucleotide
taagggtgcttgtattgtgaatatgcaaagggagtaacttag

SEQ ID NO: 253713 - DNA, 41 bp, Artificial Sequence
  Description of Artificial Sequence: Synthetic oligonucleotide
aagggtgcttgtattgtgaatatgcaaagggagtaacttag

SEQ ID NO: 253714 - DNA, 40 bp, Artificial Sequence
  Description of Artificial Sequence: Synthetic oligonucleotide
agggtgcttgtattgtgaatatgcaaagggagtaacttag

SEQ ID NO: 253715 - DNA, 39 bp, Artificial Sequence
  Description of Artificial Sequence: Synthetic oligonucleotide
gggtgcttgtattgtgaatatgcaaagggagtaacttag

SEQ ID NO: 253716 - DNA, 40 bp, Artificial Sequence
  Description of Artificial Sequence: Synthetic oligonucleotide
ggtgcttgtattgtgaatatgcaaagggagtaacttagtg

SEQ ID NO: 253717 - DNA, 40 bp, Artificial Sequence
  Description of Artificial Sequence: Synthetic oligonucleotide
gtgcttgtattgtgaatatgcaaagggagtaacttagtgc

SEQ ID NO: 253718 - DNA, 41 bp, Artificial Sequence
  Description of Artificial Sequence: Synthetic oligonucleotide
tgcttgtattgtgaatatgcaaagggagtaacttagtgctc

SEQ ID NO: 253719 - DNA, 40 bp, Artificial Sequence
  Description of Artificial Sequence: Synthetic oligonucleotide
gcttgtattgtgaatatgcaaagggagtaacttagtgctc

SEQ ID NO: 253720 - DNA, 41 bp, Artificial Sequence
  Description of Artificial Sequence: Synthetic oligonucleotide
cttgtattgtgaatatgcaaagggagtaacttagtgctcac

SEQ ID NO: 253721 - DNA, 41 bp, Artificial Sequence
  Description of Artificial Sequence: Synthetic oligonucleotide
ttgtattgtgaatatgcaaagggagtaacttagtgctcacg

SEQ ID NO: 253722 - DNA, 40 bp, Artificial Sequence
  Description of Artificial Sequence: Synthetic oligonucleotide
tgtattgtgaatatgcaaagggagtaacttagtgctcacg

SEQ ID NO: 253723 - DNA, 39 bp, Artificial Sequence
  Description of Artificial Sequence: Synthetic oligonucleotide
gtattgtgaatatgcaaagggagtaacttagtgctcacg

SEQ ID NO: 253724 - DNA, 39 bp, Artificial Sequence
  Description of Artificial Sequence: Synthetic oligonucleotide
tattgtgaatatgcaaagggagtaacttagtgctcacgc

SEQ ID NO: 253725 - DNA, 38 bp, Artificial Sequence
  Description of Artificial Sequence: Synthetic oligonucleotide
attgtgaatatgcaaagggagtaacttagtgctcacgc

SEQ ID NO: 253726 - DNA, 37 bp, Artificial Sequence
  Description of Artificial Sequence: Synthetic oligonucleotide
ttgtgaatatgcaaagggagtaacttagtgctcacgc

SEQ ID NO: 253727 - DNA, 36 bp, Artificial Sequence
  Description of Artificial Sequence: Synthetic oligonucleotide
tgtgaatatgcaaagggagtaacttagtgctcacgc

SEQ ID NO: 253728 - DNA, 35 bp, Artificial Sequence
  Description of Artificial Sequence: Synthetic oligonucleotide
gtgaatatgcaaagggagtaacttagtgctcacgc

SEQ ID NO: 253729 - DNA, 43 bp, Artificial Sequence
  Description of Artificial Sequence: Synthetic oligonucleotide
tgaatatgcaaagggagtaacttagtgctcacgcatttataag

SEQ ID NO: 253730 - DNA, 42 bp, Artificial Sequence
  Description of Artificial Sequence: Synthetic oligonucleotide
gaatatgcaaagggagtaacttagtgctcacgcatttataag

SEQ ID NO: 253731 - DNA, 43 bp, Artificial Sequence
  Description of Artificial Sequence: Synthetic oligonucleotide
aatatgcaaagggagtaacttagtgctcacgcatttataagtg

SEQ ID NO: 253732 - DNA, 42 bp, Artificial Sequence
  Description of Artificial Sequence: Synthetic oligonucleotide
atatgcaaagggagtaacttagtgctcacgcatttataagtg

SEQ ID NO: 253733 - DNA, 41 bp, Artificial Sequence
  Description of Artificial Sequence: Synthetic oligonucleotide
tatgcaaagggagtaacttagtgctcacgcatttataagtg

SEQ ID NO: 253734 - DNA, 40 bp, Artificial Sequence
  Description of Artificial Sequence: Synthetic oligonucleotide
atgcaaagggagtaacttagtgctcacgcatttataagtg

SEQ ID NO: 253735 - DNA, 39 bp, Artificial Sequence
  Description of Artificial Sequence: Synthetic oligonucleotide
tgcaaagggagtaacttagtgctcacgcatttataagtg

SEQ ID NO: 253736 - DNA, 38 bp, Artificial Sequence
  Description of Artificial Sequence: Synthetic oligonucleotide
gcaaagggagtaacttagtgctcacgcatttataagtg

SEQ ID NO: 253737 - DNA, 38 bp, Artificial Sequence
  Description of Artificial Sequence: Synthetic oligonucleotide
caaagggagtaacttagtgctcacgcatttataagtgg

SEQ ID NO: 253738 - DNA, 42 bp, Artificial Sequence
  Description of Artificial Sequence: Synthetic oligonucleotide
aaagggagtaacttagtgctcacgcatttataagtggtatag

SEQ ID NO: 253739 - DNA, 41 bp, Artificial Sequence
  Description of Artificial Sequence: Synthetic oligonucleotide
aagggagtaacttagtgctcacgcatttataagtggtatag

SEQ ID NO: 253740 - DNA, 40 bp, Artificial Sequence
  Description of Artificial Sequence: Synthetic oligonucleotide
agggagtaacttagtgctcacgcatttataagtggtatag

SEQ ID NO: 253741 - DNA, 39 bp, Artificial Sequence
  Description of Artificial Sequence: Synthetic oligonucleotide
gggagtaacttagtgctcacgcatttataagtggtatag

SEQ ID NO: 253742 - DNA, 41 bp, Artificial Sequence
  Description of Artificial Sequence: Synthetic oligonucleotide
ggagtaacttagtgctcacgcatttataagtggtatagtac

SEQ ID NO: 253743 - DNA, 42 bp, Artificial Sequence
  Description of Artificial Sequence: Synthetic oligonucleotide
gagtaacttagtgctcacgcatttataagtggtatagtacag

SEQ ID NO: 253744 - DNA, 45 bp, Artificial Sequence
  Description of Artificial Sequence: Synthetic oligonucleotide
agtaacttagtgctcacgcatttataagtggtatagtacagtatg

SEQ ID NO: 253745 - DNA, 44 bp, Artificial Sequence
  Description of Artificial Sequence: Synthetic oligonucleotide
gtaacttagtgctcacgcatttataagtggtatagtacagtatg

SEQ ID NO: 253746 - DNA, 45 bp, Artificial Sequence
  Description of Artificial Sequence: Synthetic oligonucleotide
taacttagtgctcacgcatttataagtggtatagtacagtatgtc

SEQ ID NO: 253747 - DNA, 44 bp, Artificial Sequence
  Description of Artificial Sequence: Synthetic oligonucleotide
aacttagtgctcacgcatttataagtggtatagtacagtatgtc

SEQ ID NO: 253748 - DNA, 43 bp, Artificial Sequence
  Description of Artificial Sequence: Synthetic oligonucleotide
acttagtgctcacgcatttataagtggtatagtacagtatgtc

SEQ ID NO: 253749 - DNA, 42 bp, Artificial Sequence
  Description of Artificial Sequence: Synthetic oligonucleotide
cttagtgctcacgcatttataagtggtatagtacagtatgtc

SEQ ID NO: 253750 - DNA, 42 bp, Artificial Sequence
  Description of Artificial Sequence: Synthetic oligonucleotide
ttagtgctcacgcatttataagtggtatagtacagtatgtcc

SEQ ID NO: 253751 - DNA, 41 bp, Artificial Sequence
  Description of Artificial Sequence: Synthetic oligonucleotide
tagtgctcacgcatttataagtggtatagtacagtatgtcc

SEQ ID NO: 253752 - DNA, 40 bp, Artificial Sequence
  Description of Artificial Sequence: Synthetic oligonucleotide
agtgctcacgcatttataagtggtatagtacagtatgtcc

SEQ ID NO: 253753 - DNA, 39 bp, Artificial Sequence
  Description of Artificial Sequence: Synthetic oligonucleotide
gtgctcacgcatttataagtggtatagtacagtatgtcc

SEQ ID NO: 253754 - DNA, 40 bp, Artificial Sequence
  Description of Artificial Sequence: Synthetic oligonucleotide
tgctcacgcatttataagtggtatagtacagtatgtccag

SEQ ID NO: 253755 - DNA, 39 bp, Artificial Sequence
  Description of Artificial Sequence: Synthetic oligonucleotide
gctcacgcatttataagtggtatagtacagtatgtccag

SEQ ID NO: 253756 - DNA, 41 bp, Artificial Sequence
  Description of Artificial Sequence: Synthetic oligonucleotide
ctcacgcatttataagtggtatagtacagtatgtccagaag

SEQ ID NO: 253757 - DNA, 41 bp, Artificial Sequence
  Description of Artificial Sequence: Synthetic oligonucleotide
tcacgcatttataagtggtatagtacagtatgtccagaagc

SEQ ID NO: 253758 - DNA, 40 bp, Artificial Sequence
  Description of Artificial Sequence: Synthetic oligonucleotide
cacgcatttataagtggtatagtacagtatgtccagaagc

SEQ ID NO: 253759 - DNA, 43 bp, Artificial Sequence
  Description of Artificial Sequence: Synthetic oligonucleotide
acgcatttataagtggtatagtacagtatgtccagaagcttag

SEQ ID NO: 253760 - DNA, 42 bp, Artificial Sequence
  Description of Artificial Sequence: Synthetic oligonucleotide
cgcatttataagtggtatagtacagtatgtccagaagcttag

SEQ ID NO: 253761 - DNA, 42 bp, Artificial Sequence
  Description of Artificial Sequence: Synthetic oligonucleotide
gcatttataagtggtatagtacagtatgtccagaagcttagc

SEQ ID NO: 253762 - DNA, 52 bp, Artificial Sequence
  Description of Artificial Sequence: Synthetic oligonucleotide
catttataagtggtatagtacagtatgtccagaagcttagctataataatac

SEQ ID NO: 253763 - DNA, 58 bp, Artificial Sequence
  Description of Artificial Sequence: Synthetic oligonucleotide
atttataagtggtatagtacagtatgtccagaagcttagctataataatacaaaatac

SEQ ID NO: 253764 - DNA, 57 bp, Artificial Sequence
  Description of Artificial Sequence: Synthetic oligonucleotide
tttataagtggtatagtacagtatgtccagaagcttagctataataatacaaaatac

SEQ ID NO: 253765 - DNA, 56 bp, Artificial Sequence
  Description of Artificial Sequence: Synthetic oligonucleotide
ttataagtggtatagtacagtatgtccagaagcttagctataataatacaaaatac

SEQ ID NO: 253766 - DNA, 55 bp, Artificial Sequence
  Description of Artificial Sequence: Synthetic oligonucleotide
tataagtggtatagtacagtatgtccagaagcttagctataataatacaaaatac

SEQ ID NO: 253767 - DNA, 54 bp, Artificial Sequence
  Description of Artificial Sequence: Synthetic oligonucleotide
ataagtggtatagtacagtatgtccagaagcttagctataataatacaaaatac

SEQ ID NO: 253768 - DNA, 53 bp, Artificial Sequence
  Description of Artificial Sequence: Synthetic oligonucleotide
taagtggtatagtacagtatgtccagaagcttagctataataatacaaaatac

SEQ ID NO: 253769 - DNA, 52 bp, Artificial Sequence
  Description of Artificial Sequence: Synthetic oligonucleotide
aagtggtatagtacagtatgtccagaagcttagctataataatacaaaatac

SEQ ID NO: 253770 - DNA, 51 bp, Artificial Sequence
  Description of Artificial Sequence: Synthetic oligonucleotide
agtggtatagtacagtatgtccagaagcttagctataataatacaaaatac

SEQ ID NO: 253771 - DNA, 50 bp, Artificial Sequence
  Description of Artificial Sequence: Synthetic oligonucleotide
gtggtatagtacagtatgtccagaagcttagctataataatacaaaatac

SEQ ID NO: 253772 - DNA, 50 bp, Artificial Sequence
  Description of Artificial Sequence: Synthetic oligonucleotide
tggtatagtacagtatgtccagaagcttagctataataatacaaaatacg

SEQ ID NO: 253773 - DNA, 49 bp, Artificial Sequence
  Description of Artificial Sequence: Synthetic oligonucleotide
ggtatagtacagtatgtccagaagcttagctataataatacaaaatacg

SEQ ID NO: 253774 - DNA, 50 bp, Artificial Sequence
  Description of Artificial Sequence: Synthetic oligonucleotide
gtatagtacagtatgtccagaagcttagctataataatacaaaatacgag

SEQ ID NO: 253775 - DNA, 50 bp, Artificial Sequence
  Description of Artificial Sequence: Synthetic oligonucleotide
tatagtacagtatgtccagaagcttagctataataatacaaaatacgagg

SEQ ID NO: 253776 - DNA, 49 bp, Artificial Sequence
  Description of Artificial Sequence: Synthetic oligonucleotide
atagtacagtatgtccagaagcttagctataataatacaaaatacgagg

SEQ ID NO: 253777 - DNA, 48 bp, Artificial Sequence
  Description of Artificial Sequence: Synthetic oligonucleotide
tagtacagtatgtccagaagcttagctataataatacaaaatacgagg

SEQ ID NO: 253778 - DNA, 47 bp, Artificial Sequence
  Description of Artificial Sequence: Synthetic oligonucleotide
agtacagtatgtccagaagcttagctataataatacaaaatacgagg

SEQ ID NO: 253779 - DNA, 46 bp, Artificial Sequence
  Description of Artificial Sequence: Synthetic oligonucleotide
gtacagtatgtccagaagcttagctataataatacaaaatacgagg

SEQ ID NO: 253780 - DNA, 47 bp, Artificial Sequence
  Description of Artificial Sequence: Synthetic oligonucleotide
tacagtatgtccagaagcttagctataataatacaaaatacgaggac

SEQ ID NO: 253781 - DNA, 46 bp, Artificial Sequence
  Description of Artificial Sequence: Synthetic oligonucleotide
acagtatgtccagaagcttagctataataatacaaaatacgaggac

SEQ ID NO: 253782 - DNA, 45 bp, Artificial Sequence
  Description of Artificial Sequence: Synthetic oligonucleotide
cagtatgtccagaagcttagctataataatacaaaatacgaggac

SEQ ID NO: 253783 - DNA, 45 bp, Artificial Sequence
  Description of Artificial Sequence: Synthetic oligonucleotide
agtatgtccagaagcttagctataataatacaaaatacgaggacc

SEQ ID NO: 253784 - DNA, 44 bp, Artificial Sequence
  Description of Artificial Sequence: Synthetic oligonucleotide
gtatgtccagaagcttagctataataatacaaaatacgaggacc

SEQ ID NO: 253785 - DNA, 45 bp, Artificial Sequence
  Description of Artificial Sequence: Synthetic oligonucleotide
tatgtccagaagcttagctataataatacaaaatacgaggaccag

SEQ ID NO: 253786 - DNA, 44 bp, Artificial Sequence
  Description of Artificial Sequence: Synthetic oligonucleotide
atgtccagaagcttagctataataatacaaaatacgaggaccag

SEQ ID NO: 253787 - DNA, 43 bp, Artificial Sequence
  Description of Artificial Sequence: Synthetic oligonucleotide
tgtccagaagcttagctataataatacaaaatacgaggaccag

SEQ ID NO: 253788 - DNA, 42 bp, Artificial Sequence
  Description of Artificial Sequence: Synthetic oligonucleotide
gtccagaagcttagctataataatacaaaatacgaggaccag

SEQ ID NO: 253789 - DNA, 43 bp, Artificial Sequence
  Description of Artificial Sequence: Synthetic oligonucleotide
tccagaagcttagctataataatacaaaatacgaggaccagtg

SEQ ID NO: 253790 - DNA, 42 bp, Artificial Sequence
  Description of Artificial Sequence: Synthetic oligonucleotide
ccagaagcttagctataataatacaaaatacgaggaccagtg

SEQ ID NO: 253791 - DNA, 42 bp, Artificial Sequence
  Description of Artificial Sequence: Synthetic oligonucleotide
cagaagcttagctataataatacaaaatacgaggaccagtgg

SEQ ID NO: 253792 - DNA, 42 bp, Artificial Sequence
  Description of Artificial Sequence: Synthetic oligonucleotide
agaagcttagctataataatacaaaatacgaggaccagtggg

SEQ ID NO: 253793 - DNA, 41 bp, Artificial Sequence
  Description of Artificial Sequence: Synthetic oligonucleotide
gaagcttagctataataatacaaaatacgaggaccagtggg

SEQ ID NO: 253794 - DNA, 44 bp, Artificial Sequence
  Description of Artificial Sequence: Synthetic oligonucleotide
aagcttagctataataatacaaaatacgaggaccagtgggatag

SEQ ID NO: 253795 - DNA, 43 bp, Artificial Sequence
  Description of Artificial Sequence: Synthetic oligonucleotide
agcttagctataataatacaaaatacgaggaccagtgggatag

SEQ ID NO: 253796 - DNA, 42 bp, Artificial Sequence
  Description of Artificial Sequence: Synthetic oligonucleotide
gcttagctataataatacaaaatacgaggaccagtgggatag

SEQ ID NO: 253797 - DNA, 45 bp, Artificial Sequence
  Description of Artificial Sequence: Synthetic oligonucleotide
cttagctataataatacaaaatacgaggaccagtgggatagaatg

SEQ ID NO: 253798 - DNA, 45 bp, Artificial Sequence
  Description of Artificial Sequence: Synthetic oligonucleotide
ttagctataataatacaaaatacgaggaccagtgggatagaatgg

SEQ ID NO: 253799 - DNA, 44 bp, Artificial Sequence
  Description of Artificial Sequence: Synthetic oligonucleotide
tagctataataatacaaaatacgaggaccagtgggatagaatgg

SEQ ID NO: 253800 - DNA, 43 bp, Artificial Sequence
  Description of Artificial Sequence: Synthetic oligonucleotide
agctataataatacaaaatacgaggaccagtgggatagaatgg

SEQ ID NO: 253801 - DNA, 42 bp, Artificial Sequence
  Description of Artificial Sequence: Synthetic oligonucleotide
gctataataatacaaaatacgaggaccagtgggatagaatgg

SEQ ID NO: 253802 - DNA, 42 bp, Artificial Sequence
  Description of Artificial Sequence: Synthetic oligonucleotide
ctataataatacaaaatacgaggaccagtgggatagaatggc

SEQ ID NO: 253803 - DNA, 44 bp, Artificial Sequence
  Description of Artificial Sequence: Synthetic oligonucleotide
tataataatacaaaatacgaggaccagtgggatagaatggcaag

SEQ ID NO: 253804 - DNA, 43 bp, Artificial Sequence
  Description of Artificial Sequence: Synthetic oligonucleotide
ataataatacaaaatacgaggaccagtgggatagaatggcaag

SEQ ID NO: 253805 - DNA, 42 bp, Artificial Sequence
  Description of Artificial Sequence: Synthetic oligonucleotide
taataatacaaaatacgaggaccagtgggatagaatggcaag

SEQ ID NO: 253806 - DNA, 41 bp, Artificial Sequence
  Description of Artificial Sequence: Synthetic oligonucleotide
aataatacaaaatacgaggaccagtgggatagaatggcaag

SEQ ID NO: 253807 - DNA, 40 bp, Artificial Sequence
  Description of Artificial Sequence: Synthetic oligonucleotide
ataatacaaaatacgaggaccagtgggatagaatggcaag

SEQ ID NO: 253808 - DNA, 39 bp, Artificial Sequence
  Description of Artificial Sequence: Synthetic oligonucleotide
taatacaaaatacgaggaccagtgggatagaatggcaag

SEQ ID NO: 253809 - DNA, 38 bp, Artificial Sequence
  Description of Artificial Sequence: Synthetic oligonucleotide
aatacaaaatacgaggaccagtgggatagaatggcaag

SEQ ID NO: 253810 - DNA, 37 bp, Artificial Sequence
  Description of Artificial Sequence: Synthetic oligonucleotide
atacaaaatacgaggaccagtgggatagaatggcaag

SEQ ID NO: 253811 - DNA, 36 bp, Artificial Sequence
  Description of Artificial Sequence: Synthetic oligonucleotide
tacaaaatacgaggaccagtgggatagaatggcaag

SEQ ID NO: 253812 - DNA, 35 bp, Artificial Sequence
  Description of Artificial Sequence: Synthetic oligonucleotide
acaaaatacgaggaccagtgggatagaatggcaag

SEQ ID NO: 253813 - DNA, 34 bp, Artificial Sequence
  Description of Artificial Sequence: Synthetic oligonucleotide
caaaatacgaggaccagtgggatagaatggcaag

SEQ ID NO: 253814 - DNA, 39 bp, Artificial Sequence
  Description of Artificial Sequence: Synthetic oligonucleotide
aaaatacgaggaccagtgggatagaatggcaagtttttg

SEQ ID NO: 253815 - DNA, 38 bp, Artificial Sequence
  Description of Artificial Sequence: Synthetic oligonucleotide
aaatacgaggaccagtgggatagaatggcaagtttttg

SEQ ID NO: 253816 - DNA, 37 bp, Artificial Sequence
  Description of Artificial Sequence: Synthetic oligonucleotide
aatacgaggaccagtgggatagaatggcaagtttttg

SEQ ID NO: 253817 - DNA, 36 bp, Artificial Sequence
  Description of Artificial Sequence: Synthetic oligonucleotide
atacgaggaccagtgggatagaatggcaagtttttg

SEQ ID NO: 253818 - DNA, 35 bp, Artificial Sequence
  Description of Artificial Sequence: Synthetic oligonucleotide
tacgaggaccagtgggatagaatggcaagtttttg

SEQ ID NO: 253819 - DNA, 34 bp, Artificial Sequence
  Description of Artificial Sequence: Synthetic oligonucleotide
acgaggaccagtgggatagaatggcaagtttttg

SEQ ID NO: 253820 - DNA, 33 bp, Artificial Sequence
  Description of Artificial Sequence: Synthetic oligonucleotide
cgaggaccagtgggatagaatggcaagtttttg

SEQ ID NO: 253821 - DNA, 33 bp, Artificial Sequence
  Description of Artificial Sequence: Synthetic oligonucleotide
gaggaccagtgggatagaatggcaagtttttgc

SEQ ID NO: 253822 - DNA, 33 bp, Artificial Sequence
  Description of Artificial Sequence: Synthetic oligonucleotide
aggaccagtgggatagaatggcaagtttttgcc

SEQ ID NO: 253823 - DNA, 32 bp, Artificial Sequence
  Description of Artificial Sequence: Synthetic oligonucleotide
ggaccagtgggatagaatggcaagtttttgcc

SEQ ID NO: 253824 - DNA, 32 bp, Artificial Sequence
  Description of Artificial Sequence: Synthetic oligonucleotide
gaccagtgggatagaatggcaagtttttgccc

SEQ ID NO: 253825 - DNA, 34 bp, Artificial Sequence
  Description of Artificial Sequence: Synthetic oligonucleotide
accagtgggatagaatggcaagtttttgccctag

SEQ ID NO: 253826 - DNA, 33 bp, Artificial Sequence
  Description of Artificial Sequence: Synthetic oligonucleotide
ccagtgggatagaatggcaagtttttgccctag

SEQ ID NO: 253827 - DNA, 34 bp, Artificial Sequence
  Description of Artificial Sequence: Synthetic oligonucleotide
cagtgggatagaatggcaagtttttgccctagag

SEQ ID NO: 253828 - DNA, 36 bp, Artificial Sequence
  Description of Artificial Sequence: Synthetic oligonucleotide
agtgggatagaatggcaagtttttgccctagagatg

SEQ ID NO: 253829 - DNA, 35 bp, Artificial Sequence
  Description of Artificial Sequence: Synthetic oligonucleotide
gtgggatagaatggcaagtttttgccctagagatg

SEQ ID NO: 253830 - DNA, 35 bp, Artificial Sequence
  Description of Artificial Sequence: Synthetic oligonucleotide
tgggatagaatggcaagtttttgccctagagatgg

SEQ ID NO: 253831 - DNA, 34 bp, Artificial Sequence
  Description of Artificial Sequence: Synthetic oligonucleotide
gggatagaatggcaagtttttgccctagagatgg

SEQ ID NO: 253832 - DNA, 35 bp, Artificial Sequence
  Description of Artificial Sequence: Synthetic oligonucleotide
ggatagaatggcaagtttttgccctagagatggtg

SEQ ID NO: 253833 - DNA, 40 bp, Artificial Sequence
  Description of Artificial Sequence: Synthetic oligonucleotide
gatagaatggcaagtttttgccctagagatggtgttaaag

SEQ ID NO: 253834 - DNA, 40 bp, Artificial Sequence
  Description of Artificial Sequence: Synthetic oligonucleotide
atagaatggcaagtttttgccctagagatggtgttaaagg

SEQ ID NO: 253835 - DNA, 39 bp, Artificial Sequence
  Description of Artificial Sequence: Synthetic oligonucleotide
tagaatggcaagtttttgccctagagatggtgttaaagg

SEQ ID NO: 253836 - DNA, 38 bp, Artificial Sequence
  Description of Artificial Sequence: Synthetic oligonucleotide
agaatggcaagtttttgccctagagatggtgttaaagg

SEQ ID NO: 253837 - DNA, 37 bp, Artificial Sequence
  Description of Artificial Sequence: Synthetic oligonucleotide
gaatggcaagtttttgccctagagatggtgttaaagg

SEQ ID NO: 253838 - DNA, 37 bp, Artificial Sequence
  Description of Artificial Sequence: Synthetic oligonucleotide
aatggcaagtttttgccctagagatggtgttaaaggg

SEQ ID NO: 253839 - DNA, 36 bp, Artificial Sequence
  Description of Artificial Sequence: Synthetic oligonucleotide
atggcaagtttttgccctagagatggtgttaaaggg

SEQ ID NO: 253840 - DNA, 35 bp, Artificial Sequence
  Description of Artificial Sequence: Synthetic oligonucleotide
tggcaagtttttgccctagagatggtgttaaaggg

SEQ ID NO: 253841 - DNA, 34 bp, Artificial Sequence
  Description of Artificial Sequence: Synthetic oligonucleotide
ggcaagtttttgccctagagatggtgttaaaggg

SEQ ID NO: 253842 - DNA, 36 bp, Artificial Sequence
  Description of Artificial Sequence: Synthetic oligonucleotide
gcaagtttttgccctagagatggtgttaaagggatg

SEQ ID NO: 253843 - DNA, 36 bp, Artificial Sequence
  Description of Artificial Sequence: Synthetic oligonucleotide
caagtttttgccctagagatggtgttaaagggatgc

SEQ ID NO: 253844 - DNA, 38 bp, Artificial Sequence
  Description of Artificial Sequence: Synthetic oligonucleotide
aagtttttgccctagagatggtgttaaagggatgcatg

SEQ ID NO: 253845 - DNA, 37 bp, Artificial Sequence
  Description of Artificial Sequence: Synthetic oligonucleotide
agtttttgccctagagatggtgttaaagggatgcatg

SEQ ID NO: 253846 - DNA, 36 bp, Artificial Sequence
  Description of Artificial Sequence: Synthetic oligonucleotide
gtttttgccctagagatggtgttaaagggatgcatg

SEQ ID NO: 253847 - DNA, 36 bp, Artificial Sequence
  Description of Artificial Sequence: Synthetic oligonucleotide
tttttgccctagagatggtgttaaagggatgcatgg

SEQ ID NO: 253848 - DNA, 35 bp, Artificial Sequence
  Description of Artificial Sequence: Synthetic oligonucleotide
ttttgccctagagatggtgttaaagggatgcatgg

SEQ ID NO: 253849 - DNA, 34 bp, Artificial Sequence
  Description of Artificial Sequence: Synthetic oligonucleotide
tttgccctagagatggtgttaaagggatgcatgg

SEQ ID NO: 253850 - DNA, 33 bp, Artificial Sequence
  Description of Artificial Sequence: Synthetic oligonucleotide
ttgccctagagatggtgttaaagggatgcatgg

SEQ ID NO: 253851 - DNA, 32 bp, Artificial Sequence
  Description of Artificial Sequence: Synthetic oligonucleotide
tgccctagagatggtgttaaagggatgcatgg

SEQ ID NO: 253852 - DNA, 31 bp, Artificial Sequence
  Description of Artificial Sequence: Synthetic oligonucleotide
gccctagagatggtgttaaagggatgcatgg

SEQ ID NO: 253853 - DNA, 31 bp, Artificial Sequence
  Description of Artificial Sequence: Synthetic oligonucleotide
ccctagagatggtgttaaagggatgcatggc

SEQ ID NO: 253854 - DNA, 35 bp, Artificial Sequence
  Description of Artificial Sequence: Synthetic oligonucleotide
cctagagatggtgttaaagggatgcatggcttttc

SEQ ID NO: 253855 - DNA, 35 bp, Artificial Sequence
  Description of Artificial Sequence: Synthetic oligonucleotide
ctagagatggtgttaaagggatgcatggcttttcc

SEQ ID NO: 253856 - DNA, 36 bp, Artificial Sequence
  Description of Artificial Sequence: Synthetic oligonucleotide
tagagatggtgttaaagggatgcatggcttttcctc

SEQ ID NO: 253857 - DNA, 35 bp, Artificial Sequence
  Description of Artificial Sequence: Synthetic oligonucleotide
agagatggtgttaaagggatgcatggcttttcctc

SEQ ID NO: 253858 - DNA, 34 bp, Artificial Sequence
  Description of Artificial Sequence: Synthetic oligonucleotide
gagatggtgttaaagggatgcatggcttttcctc

SEQ ID NO: 253859 - DNA, 36 bp, Artificial Sequence
  Description of Artificial Sequence: Synthetic oligonucleotide
agatggtgttaaagggatgcatggcttttcctctag

SEQ ID NO: 253860 - DNA, 35 bp, Artificial Sequence
  Description of Artificial Sequence: Synthetic oligonucleotide
gatggtgttaaagggatgcatggcttttcctctag

SEQ ID NO: 253861 - DNA, 37 bp, Artificial Sequence
  Description of Artificial Sequence: Synthetic oligonucleotide
atggtgttaaagggatgcatggcttttcctctagaag

SEQ ID NO: 253862 - DNA, 36 bp, Artificial Sequence
  Description of Artificial Sequence: Synthetic oligonucleotide
tggtgttaaagggatgcatggcttttcctctagaag

SEQ ID NO: 253863 - DNA, 35 bp, Artificial Sequence
  Description of Artificial Sequence: Synthetic oligonucleotide
ggtgttaaagggatgcatggcttttcctctagaag

SEQ ID NO: 253864 - DNA, 36 bp, Artificial Sequence
  Description of Artificial Sequence: Synthetic oligonucleotide
gtgttaaagggatgcatggcttttcctctagaagac

SEQ ID NO: 253865 - DNA, 38 bp, Artificial Sequence
  Description of Artificial Sequence: Synthetic oligonucleotide
tgttaaagggatgcatggcttttcctctagaagacaac

SEQ ID NO: 253866 - DNA, 37 bp, Artificial Sequence
  Description of Artificial Sequence: Synthetic oligonucleotide
gttaaagggatgcatggcttttcctctagaagacaac

SEQ ID NO: 253867 - DNA, 40 bp, Artificial Sequence
  Description of Artificial Sequence: Synthetic oligonucleotide
ttaaagggatgcatggcttttcctctagaagacaacattc

SEQ ID NO: 253868 - DNA, 39 bp, Artificial Sequence
  Description of Artificial Sequence: Synthetic oligonucleotide
taaagggatgcatggcttttcctctagaagacaacattc

SEQ ID NO: 253869 - DNA, 38 bp, Artificial Sequence
  Description of Artificial Sequence: Synthetic oligonucleotide
aaagggatgcatggcttttcctctagaagacaacattc

SEQ ID NO: 253870 - DNA, 37 bp, Artificial Sequence
  Description of Artificial Sequence: Synthetic oligonucleotide
aagggatgcatggcttttcctctagaagacaacattc

SEQ ID NO: 253871 - DNA, 36 bp, Artificial Sequence
  Description of Artificial Sequence: Synthetic oligonucleotide
agggatgcatggcttttcctctagaagacaacattc

SEQ ID NO: 253872 - DNA, 35 bp, Artificial Sequence
  Description of Artificial Sequence: Synthetic oligonucleotide
gggatgcatggcttttcctctagaagacaacattc

SEQ ID NO: 253873 - DNA, 37 bp, Artificial Sequence
  Description of Artificial Sequence: Synthetic oligonucleotide
ggatgcatggcttttcctctagaagacaacattcaac

SEQ ID NO: 253874 - DNA, 39 bp, Artificial Sequence
  Description of Artificial Sequence: Synthetic oligonucleotide
gatgcatggcttttcctctagaagacaacattcaacttc

SEQ ID NO: 253875 - DNA, 41 bp, Artificial Sequence
  Description of Artificial Sequence: Synthetic oligonucleotide
atgcatggcttttcctctagaagacaacattcaacttcatc

SEQ ID NO: 253876 - DNA, 40 bp, Artificial Sequence
  Description of Artificial Sequence: Synthetic oligonucleotide
tgcatggcttttcctctagaagacaacattcaacttcatc

SEQ ID NO: 253877 - DNA, 39 bp, Artificial Sequence
  Description of Artificial Sequence: Synthetic oligonucleotide
gcatggcttttcctctagaagacaacattcaacttcatc

SEQ ID NO: 253878 - DNA, 39 bp, Artificial Sequence
  Description of Artificial Sequence: Synthetic oligonucleotide
catggcttttcctctagaagacaacattcaacttcatcc

SEQ ID NO: 253879 - DNA, 40 bp, Artificial Sequence
  Description of Artificial Sequence: Synthetic oligonucleotide
atggcttttcctctagaagacaacattcaacttcatcctg

SEQ ID NO: 253880 - DNA, 39 bp, Artificial Sequence
  Description of Artificial Sequence: Synthetic oligonucleotide
tggcttttcctctagaagacaacattcaacttcatcctg

SEQ ID NO: 253881 - DNA, 38 bp, Artificial Sequence
  Description of Artificial Sequence: Synthetic oligonucleotide
ggcttttcctctagaagacaacattcaacttcatcctg

SEQ ID NO: 253882 - DNA, 39 bp, Artificial Sequence
  Description of Artificial Sequence: Synthetic oligonucleotide
gcttttcctctagaagacaacattcaacttcatcctgac

SEQ ID NO: 253883 - DNA, 42 bp, Artificial Sequence
  Description of Artificial Sequence: Synthetic oligonucleotide
cttttcctctagaagacaacattcaacttcatcctgacattg

SEQ ID NO: 253884 - DNA, 42 bp, Artificial Sequence
  Description of Artificial Sequence: Synthetic oligonucleotide
ttttcctctagaagacaacattcaacttcatcctgacattgg

SEQ ID NO: 253885 - DNA, 41 bp, Artificial Sequence
  Description of Artificial Sequence: Synthetic oligonucleotide
tttcctctagaagacaacattcaacttcatcctgacattgg

SEQ ID NO: 253886 - DNA, 40 bp, Artificial Sequence
  Description of Artificial Sequence: Synthetic oligonucleotide
ttcctctagaagacaacattcaacttcatcctgacattgg

SEQ ID NO: 253887 - DNA, 39 bp, Artificial Sequence
  Description of Artificial Sequence: Synthetic oligonucleotide
tcctctagaagacaacattcaacttcatcctgacattgg

SEQ ID NO: 253888 - DNA, 38 bp, Artificial Sequence
  Description of Artificial Sequence: Synthetic oligonucleotide
cctctagaagacaacattcaacttcatcctgacattgg

SEQ ID NO: 253889 - DNA, 38 bp, Artificial Sequence
  Description of Artificial Sequence: Synthetic oligonucleotide
ctctagaagacaacattcaacttcatcctgacattggc

SEQ ID NO: 253890 - DNA, 40 bp, Artificial Sequence
  Description of Artificial Sequence: Synthetic oligonucleotide
tctagaagacaacattcaacttcatcctgacattggcaac

SEQ ID NO: 253891 - DNA, 39 bp, Artificial Sequence
  Description of Artificial Sequence: Synthetic oligonucleotide
ctagaagacaacattcaacttcatcctgacattggcaac

SEQ ID NO: 253892 - DNA, 40 bp, Artificial Sequence
  Description of Artificial Sequence: Synthetic oligonucleotide
tagaagacaacattcaacttcatcctgacattggcaacag

SEQ ID NO: 253893 - DNA, 39 bp, Artificial Sequence
  Description of Artificial Sequence: Synthetic oligonucleotide
agaagacaacattcaacttcatcctgacattggcaacag

SEQ ID NO: 253894 - DNA, 38 bp, Artificial Sequence
  Description of Artificial Sequence: Synthetic oligonucleotide
gaagacaacattcaacttcatcctgacattggcaacag

SEQ ID NO: 253895 - DNA, 38 bp, Artificial Sequence
  Description of Artificial Sequence: Synthetic oligonucleotide
aagacaacattcaacttcatcctgacattggcaacagg

SEQ ID NO: 253896 - DNA, 37 bp, Artificial Sequence
  Description of Artificial Sequence: Synthetic oligonucleotide
agacaacattcaacttcatcctgacattggcaacagg

SEQ ID NO: 253897 - DNA, 36 bp, Artificial Sequence
  Description of Artificial Sequence: Synthetic oligonucleotide
gacaacattcaacttcatcctgacattggcaacagg

SEQ ID NO: 253898 - DNA, 38 bp, Artificial Sequence
  Description of Artificial Sequence: Synthetic oligonucleotide
acaacattcaacttcatcctgacattggcaacaggaag

SEQ ID NO: 253899 - DNA, 37 bp, Artificial Sequence
  Description of Artificial Sequence: Synthetic oligonucleotide
caacattcaacttcatcctgacattggcaacaggaag

SEQ ID NO: 253900 - DNA, 37 bp, Artificial Sequence
  Description of Artificial Sequence: Synthetic oligonucleotide
aacattcaacttcatcctgacattggcaacaggaagg

SEQ ID NO: 253901 - DNA, 36 bp, Artificial Sequence
  Description of Artificial Sequence: Synthetic oligonucleotide
acattcaacttcatcctgacattggcaacaggaagg

SEQ ID NO: 253902 - DNA, 35 bp, Artificial Sequence
  Description of Artificial Sequence: Synthetic oligonucleotide
cattcaacttcatcctgacattggcaacaggaagg

SEQ ID NO: 253903 - DNA, 35 bp, Artificial Sequence
  Description of Artificial Sequence: Synthetic oligonucleotide
attcaacttcatcctgacattggcaacaggaaggg

SEQ ID NO: 253904 - DNA, 34 bp, Artificial Sequence
  Description of Artificial Sequence: Synthetic oligonucleotide
ttcaacttcatcctgacattggcaacaggaaggg

SEQ ID NO: 253905 - DNA, 33 bp, Artificial Sequence
  Description of Artificial Sequence: Synthetic oligonucleotide
tcaacttcatcctgacattggcaacaggaaggg

SEQ ID NO: 253906 - DNA, 32 bp, Artificial Sequence
  Description of Artificial Sequence: Synthetic oligonucleotide
caacttcatcctgacattggcaacaggaaggg

SEQ ID NO: 253907 - DNA, 32 bp, Artificial Sequence
  Description of Artificial Sequence: Synthetic oligonucleotide
aacttcatcctgacattggcaacaggaagggc

SEQ ID NO: 253908 - DNA, 31 bp, Artificial Sequence
  Description of Artificial Sequence: Synthetic oligonucleotide
acttcatcctgacattggcaacaggaagggc

SEQ ID NO: 253909 - DNA, 30 bp, Artificial Sequence
  Description of Artificial Sequence: Synthetic oligonucleotide
cttcatcctgacattggcaacaggaagggc

SEQ ID NO: 253910 - DNA, 31 bp, Artificial Sequence
  Description of Artificial Sequence: Synthetic oligonucleotide
ttcatcctgacattggcaacaggaagggctg

SEQ ID NO: 253911 - DNA, 30 bp, Artificial Sequence
  Description of Artificial Sequence: Synthetic oligonucleotide
tcatcctgacattggcaacaggaagggctg

SEQ ID NO: 253912 - DNA, 29 bp, Artificial Sequence
  Description of Artificial Sequence: Synthetic oligonucleotide
catcctgacattggcaacaggaagggctg

SEQ ID NO: 253913 - DNA, 29 bp, Artificial Sequence
  Description of Artificial Sequence: Synthetic oligonucleotide
atcctgacattggcaacaggaagggctgg

SEQ ID NO: 253914 - DNA, 28 bp, Artificial Sequence
  Description of Artificial Sequence: Synthetic oligonucleotide
tcctgacattggcaacaggaagggctgg

SEQ ID NO: 253915 - DNA, 27 bp, Artificial Sequence
  Description of Artificial Sequence: Synthetic oligonucleotide
cctgacattggcaacaggaagggctgg

SEQ ID NO: 253916 - DNA, 29 bp, Artificial Sequence
  Description of Artificial Sequence: Synthetic oligonucleotide
ctgacattggcaacaggaagggctggatg

SEQ ID NO: 253917 - DNA, 30 bp, Artificial Sequence
  Description of Artificial Sequence: Synthetic oligonucleotide
tgacattggcaacaggaagggctggatgtg

SEQ ID NO: 253918 - DNA, 29 bp, Artificial Sequence
  Description of Artificial Sequence: Synthetic oligonucleotide
gacattggcaacaggaagggctggatgtg

SEQ ID NO: 253919 - DNA, 33 bp, Artificial Sequence
  Description of Artificial Sequence: Synthetic oligonucleotide
acattggcaacaggaagggctggatgtgataac

SEQ ID NO: 253920 - DNA, 32 bp, Artificial Sequence
  Description of Artificial Sequence: Synthetic oligonucleotide
cattggcaacaggaagggctggatgtgataac

SEQ ID NO: 253921 - DNA, 32 bp, Artificial Sequence
  Description of Artificial Sequence: Synthetic oligonucleotide
attggcaacaggaagggctggatgtgataacc

SEQ ID NO: 253922 - DNA, 31 bp, Artificial Sequence
  Description of Artificial Sequence: Synthetic oligonucleotide
ttggcaacaggaagggctggatgtgataacc

SEQ ID NO: 253923 - DNA, 30 bp, Artificial Sequence
  Description of Artificial Sequence: Synthetic oligonucleotide
tggcaacaggaagggctggatgtgataacc

SEQ ID NO: 253924 - DNA, 29 bp, Artificial Sequence
  Description of Artificial Sequence: Synthetic oligonucleotide
ggcaacaggaagggctggatgtgataacc

SEQ ID NO: 253925 - DNA, 31 bp, Artificial Sequence
  Description of Artificial Sequence: Synthetic oligonucleotide
gcaacaggaagggctggatgtgataaccatg

SEQ ID NO: 253926 - DNA, 33 bp, Artificial Sequence
  Description of Artificial Sequence: Synthetic oligonucleotide
caacaggaagggctggatgtgataaccatgatc

SEQ ID NO: 253927 - DNA, 35 bp, Artificial Sequence
  Description of Artificial Sequence: Synthetic oligonucleotide
aacaggaagggctggatgtgataaccatgatcaac

SEQ ID NO: 253928 - DNA, 34 bp, Artificial Sequence
  Description of Artificial Sequence: Synthetic oligonucleotide
acaggaagggctggatgtgataaccatgatcaac

SEQ ID NO: 253929 - DNA, 33 bp, Artificial Sequence
  Description of Artificial Sequence: Synthetic oligonucleotide
caggaagggctggatgtgataaccatgatcaac

SEQ ID NO: 253930 - DNA, 34 bp, Artificial Sequence
  Description of Artificial Sequence: Synthetic oligonucleotide
aggaagggctggatgtgataaccatgatcaacac

SEQ ID NO: 253931 - DNA, 33 bp, Artificial Sequence
  Description of Artificial Sequence: Synthetic oligonucleotide
ggaagggctggatgtgataaccatgatcaacac

SEQ ID NO: 253932 - DNA, 35 bp, Artificial Sequence
  Description of Artificial Sequence: Synthetic oligonucleotide
gaagggctggatgtgataaccatgatcaacacttg

SEQ ID NO: 253933 - DNA, 35 bp, Artificial Sequence
  Description of Artificial Sequence: Synthetic oligonucleotide
aagggctggatgtgataaccatgatcaacacttgg

SEQ ID NO: 253934 - DNA, 34 bp, Artificial Sequence
  Description of Artificial Sequence: Synthetic oligonucleotide
agggctggatgtgataaccatgatcaacacttgg

SEQ ID NO: 253935 - DNA, 33 bp, Artificial Sequence
  Description of Artificial Sequence: Synthetic oligonucleotide
gggctggatgtgataaccatgatcaacacttgg

SEQ ID NO: 253936 - DNA, 34 bp, Artificial Sequence
  Description of Artificial Sequence: Synthetic oligonucleotide
ggctggatgtgataaccatgatcaacacttggtc

SEQ ID NO: 253937 - DNA, 35 bp, Artificial Sequence
  Description of Artificial Sequence: Synthetic oligonucleotide
gctggatgtgataaccatgatcaacacttggtcac

SEQ ID NO: 253938 - DNA, 36 bp, Artificial Sequence
  Description of Artificial Sequence: Synthetic oligonucleotide
ctggatgtgataaccatgatcaacacttggtcactg

SEQ ID NO: 253939 - DNA, 36 bp, Artificial Sequence
  Description of Artificial Sequence: Synthetic oligonucleotide
tggatgtgataaccatgatcaacacttggtcactgc

SEQ ID NO: 253940 - DNA, 35 bp, Artificial Sequence
  Description of Artificial Sequence: Synthetic oligonucleotide
ggatgtgataaccatgatcaacacttggtcactgc

SEQ ID NO: 253941 - DNA, 36 bp, Artificial Sequence
  Description of Artificial Sequence: Synthetic oligonucleotide
gatgtgataaccatgatcaacacttggtcactgcag

SEQ ID NO: 253942 - DNA, 38 bp, Artificial Sequence
  Description of Artificial Sequence: Synthetic oligonucleotide
atgtgataaccatgatcaacacttggtcactgcagatg

SEQ ID NO: 253943 - DNA, 37 bp, Artificial Sequence
  Description of Artificial Sequence: Synthetic oligonucleotide
tgtgataaccatgatcaacacttggtcactgcagatg

SEQ ID NO: 253944 - DNA, 36 bp, Artificial Sequence
  Description of Artificial Sequence: Synthetic oligonucleotide
gtgataaccatgatcaacacttggtcactgcagatg

SEQ ID NO: 253945 - DNA, 36 bp, Artificial Sequence
  Description of Artificial Sequence: Synthetic oligonucleotide
tgataaccatgatcaacacttggtcactgcagatgg

SEQ ID NO: 253946 - DNA, 35 bp, Artificial Sequence
  Description of Artificial Sequence: Synthetic oligonucleotide
gataaccatgatcaacacttggtcactgcagatgg

SEQ ID NO: 253947 - DNA, 35 bp, Artificial Sequence
  Description of Artificial Sequence: Synthetic oligonucleotide
ataaccatgatcaacacttggtcactgcagatggg

SEQ ID NO: 253948 - DNA, 34 bp, Artificial Sequence
  Description of Artificial Sequence: Synthetic oligonucleotide
taaccatgatcaacacttggtcactgcagatggg

SEQ ID NO: 253949 - DNA, 33 bp, Artificial Sequence
  Description of Artificial Sequence: Synthetic oligonucleotide
aaccatgatcaacacttggtcactgcagatggg

SEQ ID NO: 253950 - DNA, 32 bp, Artificial Sequence
  Description of Artificial Sequence: Synthetic oligonucleotide
accatgatcaacacttggtcactgcagatggg

SEQ ID NO: 253951 - DNA, 31 bp, Artificial Sequence
  Description of Artificial Sequence: Synthetic oligonucleotide
ccatgatcaacacttggtcactgcagatggg

SEQ ID NO: 253952 - DNA, 35 bp, Artificial Sequence
  Description of Artificial Sequence: Synthetic oligonucleotide
catgatcaacacttggtcactgcagatgggttttc

SEQ ID NO: 253953 - DNA, 35 bp, Artificial Sequence
  Description of Artificial Sequence: Synthetic oligonucleotide
atgatcaacacttggtcactgcagatgggttttcc

SEQ ID NO: 253954 - DNA, 34 bp, Artificial Sequence
  Description of Artificial Sequence: Synthetic oligonucleotide
tgatcaacacttggtcactgcagatgggttttcc

SEQ ID NO: 253955 - DNA, 33 bp, Artificial Sequence
  Description of Artificial Sequence: Synthetic oligonucleotide
gatcaacacttggtcactgcagatgggttttcc

SEQ ID NO: 253956 - DNA, 33 bp, Artificial Sequence
  Description of Artificial Sequence: Synthetic oligonucleotide
atcaacacttggtcactgcagatgggttttccg

SEQ ID NO: 253957 - DNA, 32 bp, Artificial Sequence
  Description of Artificial Sequence: Synthetic oligonucleotide
tcaacacttggtcactgcagatgggttttccg

SEQ ID NO: 253958 - DNA, 31 bp, Artificial Sequence
  Description of Artificial Sequence: Synthetic oligonucleotide
caacacttggtcactgcagatgggttttccg

SEQ ID NO: 253959 - DNA, 31 bp, Artificial Sequence
  Description of Artificial Sequence: Synthetic oligonucleotide
aacacttggtcactgcagatgggttttccgc

SEQ ID NO: 253960 - DNA, 30 bp, Artificial Sequence
  Description of Artificial Sequence: Synthetic oligonucleotide
acacttggtcactgcagatgggttttccgc

SEQ ID NO: 253961 - DNA, 29 bp, Artificial Sequence
  Description of Artificial Sequence: Synthetic oligonucleotide
cacttggtcactgcagatgggttttccgc

SEQ ID NO: 253962 - DNA, 35 bp, Artificial Sequence
  Description of Artificial Sequence: Synthetic oligonucleotide
acttggtcactgcagatgggttttccgctaataac

SEQ ID NO: 253963 - DNA, 34 bp, Artificial Sequence
  Description of Artificial Sequence: Synthetic oligonucleotide
cttggtcactgcagatgggttttccgctaataac

SEQ ID NO: 253964 - DNA, 34 bp, Artificial Sequence
  Description of Artificial Sequence: Synthetic oligonucleotide
ttggtcactgcagatgggttttccgctaataacc

SEQ ID NO: 253965 - DNA, 33 bp, Artificial Sequence
  Description of Artificial Sequence: Synthetic oligonucleotide
tggtcactgcagatgggttttccgctaataacc

SEQ ID NO: 253966 - DNA, 32 bp, Artificial Sequence
  Description of Artificial Sequence: Synthetic oligonucleotide
ggtcactgcagatgggttttccgctaataacc

SEQ ID NO: 253967 - DNA, 34 bp, Artificial Sequence
  Description of Artificial Sequence: Synthetic oligonucleotide
gtcactgcagatgggttttccgctaataaccttc

SEQ ID NO: 253968 - DNA, 35 bp, Artificial Sequence
  Description of Artificial Sequence: Synthetic oligonucleotide
tcactgcagatgggttttccgctaataaccttcac

SEQ ID NO: 253969 - DNA, 34 bp, Artificial Sequence
  Description of Artificial Sequence: Synthetic oligonucleotide
cactgcagatgggttttccgctaataaccttcac

SEQ ID NO: 253970 - DNA, 35 bp, Artificial Sequence
  Description of Artificial Sequence: Synthetic oligonucleotide
actgcagatgggttttccgctaataaccttcacag

SEQ ID NO: 253971 - DNA, 34 bp, Artificial Sequence
  Description of Artificial Sequence: Synthetic oligonucleotide
ctgcagatgggttttccgctaataaccttcacag

SEQ ID NO: 253972 - DNA, 35 bp, Artificial Sequence
  Description of Artificial Sequence: Synthetic oligonucleotide
tgcagatgggttttccgctaataaccttcacagtg

SEQ ID NO: 253973 - DNA, 34 bp, Artificial Sequence
  Description of Artificial Sequence: Synthetic oligonucleotide
gcagatgggttttccgctaataaccttcacagtg

SEQ ID NO: 253974 - DNA, 35 bp, Artificial Sequence
  Description of Artificial Sequence: Synthetic oligonucleotide
cagatgggttttccgctaataaccttcacagtgac

SEQ ID NO: 253975 - DNA, 35 bp, Artificial Sequence
  Description of Artificial Sequence: Synthetic oligonucleotide
agatgggttttccgctaataaccttcacagtgacg

SEQ ID NO: 253976 - DNA, 34 bp, Artificial Sequence
  Description of Artificial Sequence: Synthetic oligonucleotide
gatgggttttccgctaataaccttcacagtgacg

SEQ ID NO: 253977 - DNA, 34 bp, Artificial Sequence
  Description of Artificial Sequence: Synthetic oligonucleotide
atgggttttccgctaataaccttcacagtgacgg

SEQ ID NO: 253978 - DNA, 33 bp, Artificial Sequence
  Description of Artificial Sequence: Synthetic oligonucleotide
tgggttttccgctaataaccttcacagtgacgg

SEQ ID NO: 253979 - DNA, 32 bp, Artificial Sequence
  Description of Artificial Sequence: Synthetic oligonucleotide
gggttttccgctaataaccttcacagtgacgg

SEQ ID NO: 253980 - DNA, 32 bp, Artificial Sequence
  Description of Artificial Sequence: Synthetic oligonucleotide
ggttttccgctaataaccttcacagtgacggg

SEQ ID NO: 253981 - DNA, 32 bp, Artificial Sequence
  Description of Artificial Sequence: Synthetic oligonucleotide
gttttccgctaataaccttcacagtgacgggg

SEQ ID NO: 253982 - DNA, 33 bp, Artificial Sequence
  Description of Artificial Sequence: Synthetic oligonucleotide
ttttccgctaataaccttcacagtgacggggag

SEQ ID NO: 253983 - DNA, 32 bp, Artificial Sequence
  Description of Artificial Sequence: Synthetic oligonucleotide
tttccgctaataaccttcacagtgacggggag

SEQ ID NO: 253984 - DNA, 31 bp, Artificial Sequence
  Description of Artificial Sequence: Synthetic oligonucleotide
ttccgctaataaccttcacagtgacggggag

SEQ ID NO: 253985 - DNA, 30 bp, Artificial Sequence
  Description of Artificial Sequence: Synthetic oligonucleotide
tccgctaataaccttcacagtgacggggag

SEQ ID NO: 253986 - DNA, 29 bp, Artificial Sequence
  Description of Artificial Sequence: Synthetic oligonucleotide
ccgctaataaccttcacagtgacggggag

SEQ ID NO: 253987 - DNA, 29 bp, Artificial Sequence
  Description of Artificial Sequence: Synthetic oligonucleotide
cgctaataaccttcacagtgacggggagg

SEQ ID NO: 253988 - DNA, 32 bp, Artificial Sequence
  Description of Artificial Sequence: Synthetic oligonucleotide
gctaataaccttcacagtgacggggaggaaag

SEQ ID NO: 253989 - DNA, 34 bp, Artificial Sequence
  Description of Artificial Sequence: Synthetic oligonucleotide
ctaataaccttcacagtgacggggaggaaagtac

SEQ ID NO: 253990 - DNA, 35 bp, Artificial Sequence
  Description of Artificial Sequence: Synthetic oligonucleotide
taataaccttcacagtgacggggaggaaagtacac

SEQ ID NO: 253991 - DNA, 34 bp, Artificial Sequence
  Description of Artificial Sequence: Synthetic oligonucleotide
aataaccttcacagtgacggggaggaaagtacac

SEQ ID NO: 253992 - DNA, 33 bp, Artificial Sequence
  Description of Artificial Sequence: Synthetic oligonucleotide
ataaccttcacagtgacggggaggaaagtacac

SEQ ID NO: 253993 - DNA, 32 bp, Artificial Sequence
  Description of Artificial Sequence: Synthetic oligonucleotide
taaccttcacagtgacggggaggaaagtacac

SEQ ID NO: 253994 - DNA, 31 bp, Artificial Sequence
  Description of Artificial Sequence: Synthetic oligonucleotide
aaccttcacagtgacggggaggaaagtacac

SEQ ID NO: 253995 - DNA, 30 bp, Artificial Sequence
  Description of Artificial Sequence: Synthetic oligonucleotide
accttcacagtgacggggaggaaagtacac

SEQ ID NO: 253996 - DNA, 29 bp, Artificial Sequence
  Description of Artificial Sequence: Synthetic oligonucleotide
ccttcacagtgacggggaggaaagtacac

SEQ ID NO: 253997 - DNA, 31 bp, Artificial Sequence
  Description of Artificial Sequence: Synthetic oligonucleotide
cttcacagtgacggggaggaaagtacacatg

SEQ ID NO: 253998 - DNA, 33 bp, Artificial Sequence
  Description of Artificial Sequence: Synthetic oligonucleotide
ttcacagtgacggggaggaaagtacacatgtag

SEQ ID NO: 253999 - DNA, 32 bp, Artificial Sequence
  Description of Artificial Sequence: Synthetic oligonucleotide
tcacagtgacggggaggaaagtacacatgtag

SEQ ID NO: 254000 - DNA, 31 bp, Artificial Sequence
  Description of Artificial Sequence: Synthetic oligonucleotide
cacagtgacggggaggaaagtacacatgtag

SEQ ID NO: 254001 - DNA, 31 bp, Artificial Sequence
  Description of Artificial Sequence: Synthetic oligonucleotide
acagtgacggggaggaaagtacacatgtagc

SEQ ID NO: 254002 - DNA, 30 bp, Artificial Sequence
  Description of Artificial Sequence: Synthetic oligonucleotide
cagtgacggggaggaaagtacacatgtagc

SEQ ID NO: 254003 - DNA, 32 bp, Artificial Sequence
  Description of Artificial Sequence: Synthetic oligonucleotide
agtgacggggaggaaagtacacatgtagcaag

SEQ ID NO: 254004 - DNA, 31 bp, Artificial Sequence
  Description of Artificial Sequence: Synthetic oligonucleotide
gtgacggggaggaaagtacacatgtagcaag

SEQ ID NO: 254005 - DNA, 32 bp, Artificial Sequence
  Description of Artificial Sequence: Synthetic oligonucleotide
tgacggggaggaaagtacacatgtagcaagag

SEQ ID NO: 254006 - DNA, 31 bp, Artificial Sequence
  Description of Artificial Sequence: Synthetic oligonucleotide
gacggggaggaaagtacacatgtagcaagag

SEQ ID NO: 254007 - DNA, 31 bp, Artificial Sequence
  Description of Artificial Sequence: Synthetic oligonucleotide
acggggaggaaagtacacatgtagcaagagc

SEQ ID NO: 254008 - DNA, 30 bp, Artificial Sequence
  Description of Artificial Sequence: Synthetic oligonucleotide
cggggaggaaagtacacatgtagcaagagc

SEQ ID NO: 254009 - DNA, 31 bp, Artificial Sequence
  Description of Artificial Sequence: Synthetic oligonucleotide
ggggaggaaagtacacatgtagcaagagctc

SEQ ID NO: 254010 - DNA, 33 bp, Artificial Sequence
  Description of Artificial Sequence: Synthetic oligonucleotide
gggaggaaagtacacatgtagcaagagctctac

SEQ ID NO: 254011 - DNA, 35 bp, Artificial Sequence
  Description of Artificial Sequence: Synthetic oligonucleotide
ggaggaaagtacacatgtagcaagagctctacatg

SEQ ID NO: 254012 - DNA, 37 bp, Artificial Sequence
  Description of Artificial Sequence: Synthetic oligonucleotide
gaggaaagtacacatgtagcaagagctctacatgaac

SEQ ID NO: 254013 - DNA, 37 bp, Artificial Sequence
  Description of Artificial Sequence: Synthetic oligonucleotide
aggaaagtacacatgtagcaagagctctacatgaacg

SEQ ID NO: 254014 - DNA, 36 bp, Artificial Sequence
  Description of Artificial Sequence: Synthetic oligonucleotide
ggaaagtacacatgtagcaagagctctacatgaacg

SEQ ID NO: 254015 - DNA, 36 bp, Artificial Sequence
  Description of Artificial Sequence: Synthetic oligonucleotide
gaaagtacacatgtagcaagagctctacatgaacgg

SEQ ID NO: 254016 - DNA, 36 bp, Artificial Sequence
  Description of Artificial Sequence: Synthetic oligonucleotide
aaagtacacatgtagcaagagctctacatgaacggc

SEQ ID NO: 254017 - DNA, 35 bp, Artificial Sequence
  Description of Artificial Sequence: Synthetic oligonucleotide
aagtacacatgtagcaagagctctacatgaacggc

SEQ ID NO: 254018 - DNA, 34 bp, Artificial Sequence
  Description of Artificial Sequence: Synthetic oligonucleotide
agtacacatgtagcaagagctctacatgaacggc

SEQ ID NO: 254019 - DNA, 33 bp, Artificial Sequence
  Description of Artificial Sequence: Synthetic oligonucleotide
gtacacatgtagcaagagctctacatgaacggc

SEQ ID NO: 254020 - DNA, 34 bp, Artificial Sequence
  Description of Artificial Sequence: Synthetic oligonucleotide
tacacatgtagcaagagctctacatgaacggctc

SEQ ID NO: 254021 - DNA, 33 bp, Artificial Sequence
  Description of Artificial Sequence: Synthetic oligonucleotide
acacatgtagcaagagctctacatgaacggctc

SEQ ID NO: 254022 - DNA, 32 bp, Artificial Sequence
  Description of Artificial Sequence: Synthetic oligonucleotide
cacatgtagcaagagctctacatgaacggctc

SEQ ID NO: 254023 - DNA, 33 bp, Artificial Sequence
  Description of Artificial Sequence: Synthetic oligonucleotide
acatgtagcaagagctctacatgaacggctctg

SEQ ID NO: 254024 - DNA, 32 bp, Artificial Sequence
  Description of Artificial Sequence: Synthetic oligonucleotide
catgtagcaagagctctacatgaacggctctg

SEQ ID NO: 254025 - DNA, 33 bp, Artificial Sequence
  Description of Artificial Sequence: Synthetic oligonucleotide
atgtagcaagagctctacatgaacggctctgac

SEQ ID NO: 254026 - DNA, 32 bp, Artificial Sequence
  Description of Artificial Sequence: Synthetic oligonucleotide
tgtagcaagagctctacatgaacggctctgac

SEQ ID NO: 254027 - DNA, 31 bp, Artificial Sequence
  Description of Artificial Sequence: Synthetic oligonucleotide
gtagcaagagctctacatgaacggctctgac

SEQ ID NO: 254028 - DNA, 31 bp, Artificial Sequence
  Description of Artificial Sequence: Synthetic oligonucleotide
tagcaagagctctacatgaacggctctgacc

SEQ ID NO: 254029 - DNA, 30 bp, Artificial Sequence
  Description of Artificial Sequence: Synthetic oligonucleotide
agcaagagctctacatgaacggctctgacc

SEQ ID NO: 254030 - DNA, 29 bp, Artificial Sequence
  Description of Artificial Sequence: Synthetic oligonucleotide
gcaagagctctacatgaacggctctgacc

SEQ ID NO: 254031 - DNA, 29 bp, Artificial Sequence
  Description of Artificial Sequence: Synthetic oligonucleotide
caagagctctacatgaacggctctgaccg

SEQ ID NO: 254032 - DNA, 29 bp, Artificial Sequence
  Description of Artificial Sequence: Synthetic oligonucleotide
aagagctctacatgaacggctctgaccgc

SEQ ID NO: 254033 - DNA, 28 bp, Artificial Sequence
  Description of Artificial Sequence: Synthetic oligonucleotide
agagctctacatgaacggctctgaccgc

SEQ ID NO: 254034 - DNA, 27 bp, Artificial Sequence
  Description of Artificial Sequence: Synthetic oligonucleotide
gagctctacatgaacggctctgaccgc

SEQ ID NO: 254035 - DNA, 27 bp, Artificial Sequence
  Description of Artificial Sequence: Synthetic oligonucleotide
agctctacatgaacggctctgaccgcg

SEQ ID NO: 254036 - DNA, 26 bp, Artificial Sequence
  Description of Artificial Sequence: Synthetic oligonucleotide
gctctacatgaacggctctgaccgcg

SEQ ID NO: 254037 - DNA, 26 bp, Artificial Sequence
  Description of Artificial Sequence: Synthetic oligonucleotide
ctctacatgaacggctctgaccgcgc

SEQ ID NO: 254038 - DNA, 26 bp, Artificial Sequence
  Description of Artificial Sequence: Synthetic oligonucleotide
tctacatgaacggctctgaccgcgcc

SEQ ID NO: 254039 - DNA, 25 bp, Artificial Sequence
  Description of Artificial Sequence: Synthetic oligonucleotide
ctacatgaacggctctgaccgcgcc

SEQ ID NO: 254040 - DNA, 25 bp, Artificial Sequence
  Description of Artificial Sequence: Synthetic oligonucleotide
tacatgaacggctctgaccgcgccc

SEQ ID NO: 254041 - DNA, 24 bp, Artificial Sequence
  Description of Artificial Sequence: Synthetic oligonucleotide
acatgaacggctctgaccgcgccc

SEQ ID NO: 254042 - DNA, 23 bp, Artificial Sequence
  Description of Artificial Sequence: Synthetic oligonucleotide
catgaacggctctgaccgcgccc

SEQ ID NO: 254043 - DNA, 23 bp, Artificial Sequence
  Description of Artificial Sequence: Synthetic oligonucleotide
atgaacggctctgaccgcgcccc

SEQ ID NO: 254044 - DNA, 22 bp, Artificial Sequence
  Description of Artificial Sequence: Synthetic oligonucleotide
tgaacggctctgaccgcgcccc

SEQ ID NO: 254045 - DNA, 21 bp, Artificial Sequence
  Description of Artificial Sequence: Synthetic oligonucleotide
gaacggctctgaccgcgcccc

SEQ ID NO: 254046 - DNA, 21 bp, Artificial Sequence
  Description of Artificial Sequence: Synthetic oligonucleotide
aacggctctgaccgcgccccg

SEQ ID NO: 254047 - DNA, 20 bp, Artificial Sequence
  Description of Artificial Sequence: Synthetic oligonucleotide
acggctctgaccgcgccccg

SEQ ID NO: 254048 - DNA, 20 bp, Artificial Sequence
  Description of Artificial Sequence: Synthetic oligonucleotide
cggctctgaccgcgccccgt

SEQ ID NO: 254049 - DNA, 20 bp, Artificial Sequence
  Description of Artificial Sequence: Synthetic oligonucleotide
ggctctgaccgcgccccggt

SEQ ID NO: 254050 - DNA, 21 bp, Artificial Sequence
  Description of Artificial Sequence: Synthetic oligonucleotide
gctctgaccgcgccccggtca

SEQ ID NO: 254051 - DNA, 22 bp, Artificial Sequence
  Description of Artificial Sequence: Synthetic oligonucleotide
ctctgaccgcgccccggtcact

SEQ ID NO: 254052 - DNA, 22 bp, Artificial Sequence
  Description of Artificial Sequence: Synthetic oligonucleotide
tctgaccgcgccccggtcactg

SEQ ID NO: 254053 - DNA, 21 bp, Artificial Sequence
  Description of Artificial Sequence: Synthetic oligonucleotide
ctgaccgcgccccggtcactg

SEQ ID NO: 254054 - DNA, 21 bp, Artificial Sequence
  Description of Artificial Sequence: Synthetic oligonucleotide
tgaccgcgccccggtcactgg

SEQ ID NO: 254055 - DNA, 20 bp, Artificial Sequence
  Description of Artificial Sequence: Synthetic oligonucleotide
gaccgcgccccggtcactgg

SEQ ID NO: 254056 - DNA, 22 bp, Artificial Sequence
  Description of Artificial Sequence: Synthetic oligonucleotide
accgcgccccggtcactgggta

SEQ ID NO: 254057 - DNA, 21 bp, Artificial Sequence
  Description of Artificial Sequence: Synthetic oligonucleotide
ccgcgccccggtcactgggta

SEQ ID NO: 254058 - DNA, 21 bp, Artificial Sequence
  Description of Artificial Sequence: Synthetic oligonucleotide
cgcgccccggtcactgggtag

SEQ ID NO: 254059 - DNA, 22 bp, Artificial Sequence
  Description of Artificial Sequence: Synthetic oligonucleotide
gcgccccggtcactgggtagct

SEQ ID NO: 254060 - DNA, 23 bp, Artificial Sequence
  Description of Artificial Sequence: Synthetic oligonucleotide
cgccccggtcactgggtagctgt

SEQ ID NO: 254061 - DNA, 23 bp, Artificial Sequence
  Description of Artificial Sequence: Synthetic oligonucleotide
gccccggtcactgggtagctgtg

SEQ ID NO: 254062 - DNA, 23 bp, Artificial Sequence
  Description of Artificial Sequence: Synthetic oligonucleotide
ccccggtcactgggtagctgtgg

SEQ ID NO: 254063 - DNA, 25 bp, Artificial Sequence
  Description of Artificial Sequence: Synthetic oligonucleotide
cccggtcactgggtagctgtggcat

SEQ ID NO: 254064 - DNA, 27 bp, Artificial Sequence
  Description of Artificial Sequence: Synthetic oligonucleotide
ccggtcactgggtagctgtggcatctt

SEQ ID NO: 254065 - DNA, 27 bp, Artificial Sequence
  Description of Artificial Sequence: Synthetic oligonucleotide
cggtcactgggtagctgtggcatcttc

SEQ ID NO: 254066 - DNA, 27 bp, Artificial Sequence
  Description of Artificial Sequence: Synthetic oligonucleotide
ggtcactgggtagctgtggcatcttcc

SEQ ID NO: 254067 - DNA, 30 bp, Artificial Sequence
  Description of Artificial Sequence: Synthetic oligonucleotide
gtcactgggtagctgtggcatcttccattg

SEQ ID NO: 254068 - DNA, 31 bp, Artificial Sequence
  Description of Artificial Sequence: Synthetic oligonucleotide
tcactgggtagctgtggcatcttccattgag

SEQ ID NO: 254069 - DNA, 30 bp, Artificial Sequence
  Description of Artificial Sequence: Synthetic oligonucleotide
cactgggtagctgtggcatcttccattgag

SEQ ID NO: 254070 - DNA, 33 bp, Artificial Sequence
  Description of Artificial Sequence: Synthetic oligonucleotide
actgggtagctgtggcatcttccattgagattc

SEQ ID NO: 254071 - DNA, 32 bp, Artificial Sequence
  Description of Artificial Sequence: Synthetic oligonucleotide
ctgggtagctgtggcatcttccattgagattc

SEQ ID NO: 254072 - DNA, 34 bp, Artificial Sequence
  Description of Artificial Sequence: Synthetic oligonucleotide
tgggtagctgtggcatcttccattgagattcatc

SEQ ID NO: 254073 - DNA, 33 bp, Artificial Sequence
  Description of Artificial Sequence: Synthetic oligonucleotide
gggtagctgtggcatcttccattgagattcatc

SEQ ID NO: 254074 - DNA, 34 bp, Artificial Sequence
  Description of Artificial Sequence: Synthetic oligonucleotide
ggtagctgtggcatcttccattgagattcatcac

SEQ ID NO: 254075 - DNA, 34 bp, Artificial Sequence
  Description of Artificial Sequence: Synthetic oligonucleotide
gtagctgtggcatcttccattgagattcatcacg

SEQ ID NO: 254076 - DNA, 35 bp, Artificial Sequence
  Description of Artificial Sequence: Synthetic oligonucleotide
tagctgtggcatcttccattgagattcatcacgag

SEQ ID NO: 254077 - DNA, 34 bp, Artificial Sequence
  Description of Artificial Sequence: Synthetic oligonucleotide
agctgtggcatcttccattgagattcatcacgag

SEQ ID NO: 254078 - DNA, 33 bp, Artificial Sequence
  Description of Artificial Sequence: Synthetic oligonucleotide
gctgtggcatcttccattgagattcatcacgag

SEQ ID NO: 254079 - DNA, 33 bp, Artificial Sequence
  Description of Artificial Sequence: Synthetic oligonucleotide
ctgtggcatcttccattgagattcatcacgagc

SEQ ID NO: 254080 - DNA, 37 bp, Artificial Sequence
  Description of Artificial Sequence: Synthetic oligonucleotide
tgtggcatcttccattgagattcatcacgagcaaatc

SEQ ID NO: 254081 - DNA, 36 bp, Artificial Sequence
  Description of Artificial Sequence: Synthetic oligonucleotide
gtggcatcttccattgagattcatcacgagcaaatc

SEQ ID NO: 254082 - DNA, 36 bp, Artificial Sequence
  Description of Artificial Sequence: Synthetic oligonucleotide
tggcatcttccattgagattcatcacgagcaaatcc

SEQ ID NO: 254083 - DNA, 35 bp, Artificial Sequence
  Description of Artificial Sequence: Synthetic oligonucleotide
ggcatcttccattgagattcatcacgagcaaatcc

SEQ ID NO: 254084 - DNA, 35 bp, Artificial Sequence
  Description of Artificial Sequence: Synthetic oligonucleotide
gcatcttccattgagattcatcacgagcaaatccc

SEQ ID NO: 254085 - DNA, 36 bp, Artificial Sequence
  Description of Artificial Sequence: Synthetic oligonucleotide
catcttccattgagattcatcacgagcaaatcccac

SEQ ID NO: 254086 - DNA, 38 bp, Artificial Sequence
  Description of Artificial Sequence: Synthetic oligonucleotide
atcttccattgagattcatcacgagcaaatcccacatg

SEQ ID NO: 254087 - DNA, 37 bp, Artificial Sequence
  Description of Artificial Sequence: Synthetic oligonucleotide
tcttccattgagattcatcacgagcaaatcccacatg

SEQ ID NO: 254088 - DNA, 36 bp, Artificial Sequence
  Description of Artificial Sequence: Synthetic oligonucleotide
cttccattgagattcatcacgagcaaatcccacatg

SEQ ID NO: 254089 - DNA, 36 bp, Artificial Sequence
  Description of Artificial Sequence: Synthetic oligonucleotide
ttccattgagattcatcacgagcaaatcccacatgg

SEQ ID NO: 254090 - DNA, 35 bp, Artificial Sequence
  Description of Artificial Sequence: Synthetic oligonucleotide
tccattgagattcatcacgagcaaatcccacatgg

SEQ ID NO: 254091 - DNA, 34 bp, Artificial Sequence
  Description of Artificial Sequence: Synthetic oligonucleotide
ccattgagattcatcacgagcaaatcccacatgg

SEQ ID NO: 254092 - DNA, 35 bp, Artificial Sequence
  Description of Artificial Sequence: Synthetic oligonucleotide
cattgagattcatcacgagcaaatcccacatggtc

SEQ ID NO: 254093 - DNA, 35 bp, Artificial Sequence
  Description of Artificial Sequence: Synthetic oligonucleotide
attgagattcatcacgagcaaatcccacatggtcc

SEQ ID NO: 254094 - DNA, 34 bp, Artificial Sequence
  Description of Artificial Sequence: Synthetic oligonucleotide
ttgagattcatcacgagcaaatcccacatggtcc

SEQ ID NO: 254095 - DNA, 33 bp, Artificial Sequence
  Description of Artificial Sequence: Synthetic oligonucleotide
tgagattcatcacgagcaaatcccacatggtcc

SEQ ID NO: 254096 - DNA, 32 bp, Artificial Sequence
  Description of Artificial Sequence: Synthetic oligonucleotide
gagattcatcacgagcaaatcccacatggtcc

SEQ ID NO: 254097 - DNA, 34 bp, Artificial Sequence
  Description of Artificial Sequence: Synthetic oligonucleotide
agattcatcacgagcaaatcccacatggtccttc

SEQ ID NO: 254098 - DNA, 33 bp, Artificial Sequence
  Description of Artificial Sequence: Synthetic oligonucleotide
gattcatcacgagcaaatcccacatggtccttc

SEQ ID NO: 254099 - DNA, 33 bp, Artificial Sequence
  Description of Artificial Sequence: Synthetic oligonucleotide
attcatcacgagcaaatcccacatggtccttcg

SEQ ID NO: 254100 - DNA, 32 bp, Artificial Sequence
  Description of Artificial Sequence: Synthetic oligonucleotide
ttcatcacgagcaaatcccacatggtccttcg

SEQ ID NO: 254101 - DNA, 31 bp, Artificial Sequence
  Description of Artificial Sequence: Synthetic oligonucleotide
tcatcacgagcaaatcccacatggtccttcg

SEQ ID NO: 254102 - DNA, 30 bp, Artificial Sequence
  Description of Artificial Sequence: Synthetic oligonucleotide
catcacgagcaaatcccacatggtccttcg

SEQ ID NO: 254103 - DNA, 36 bp, Artificial Sequence
  Description of Artificial Sequence: Synthetic oligonucleotide
atcacgagcaaatcccacatggtccttcgatttttc

SEQ ID NO: 254104 - DNA, 35 bp, Artificial Sequence
  Description of Artificial Sequence: Synthetic oligonucleotide
tcacgagcaaatcccacatggtccttcgatttttc

SEQ ID NO: 254105 - DNA, 34 bp, Artificial Sequence
  Description of Artificial Sequence: Synthetic oligonucleotide
cacgagcaaatcccacatggtccttcgatttttc

SEQ ID NO: 254106 - DNA, 34 bp, Artificial Sequence
  Description of Artificial Sequence: Synthetic oligonucleotide
acgagcaaatcccacatggtccttcgatttttcc

SEQ ID NO: 254107 - DNA, 33 bp, Artificial Sequence
  Description of Artificial Sequence: Synthetic oligonucleotide
cgagcaaatcccacatggtccttcgatttttcc

SEQ ID NO: 254108 - DNA, 39 bp, Artificial Sequence
  Description of Artificial Sequence: Synthetic oligonucleotide
gagcaaatcccacatggtccttcgatttttcctaaaaac

SEQ ID NO: 254109 - DNA, 44 bp, Artificial Sequence
  Description of Artificial Sequence: Synthetic oligonucleotide
agcaaatcccacatggtccttcgatttttcctaaaaacataaac

SEQ ID NO: 254110 - DNA, 43 bp, Artificial Sequence
  Description of Artificial Sequence: Synthetic oligonucleotide
gcaaatcccacatggtccttcgatttttcctaaaaacataaac

SEQ ID NO: 254111 - DNA, 44 bp, Artificial Sequence
  Description of Artificial Sequence: Synthetic oligonucleotide
caaatcccacatggtccttcgatttttcctaaaaacataaacag

SEQ ID NO: 254112 - DNA, 46 bp, Artificial Sequence
  Description of Artificial Sequence: Synthetic oligonucleotide
aaatcccacatggtccttcgatttttcctaaaaacataaacagatg

SEQ ID NO: 254113 - DNA, 45 bp, Artificial Sequence
  Description of Artificial Sequence: Synthetic oligonucleotide
aatcccacatggtccttcgatttttcctaaaaacataaacagatg

SEQ ID NO: 254114 - DNA, 44 bp, Artificial Sequence
  Description of Artificial Sequence: Synthetic oligonucleotide
atcccacatggtccttcgatttttcctaaaaacataaacagatg

SEQ ID NO: 254115 - DNA, 43 bp, Artificial Sequence
  Description of Artificial Sequence: Synthetic oligonucleotide
tcccacatggtccttcgatttttcctaaaaacataaacagatg

SEQ ID NO: 254116 - DNA, 42 bp, Artificial Sequence
  Description of Artificial Sequence: Synthetic oligonucleotide
cccacatggtccttcgatttttcctaaaaacataaacagatg

SEQ ID NO: 254117 - DNA, 43 bp, Artificial Sequence
  Description of Artificial Sequence: Synthetic oligonucleotide
ccacatggtccttcgatttttcctaaaaacataaacagatgag

SEQ ID NO: 254118 - DNA, 43 bp, Artificial Sequence
  Description of Artificial Sequence: Synthetic oligonucleotide
cacatggtccttcgatttttcctaaaaacataaacagatgagc

SEQ ID NO: 254119 - DNA, 44 bp, Artificial Sequence
  Description of Artificial Sequence: Synthetic oligonucleotide
acatggtccttcgatttttcctaaaaacataaacagatgagctc

SEQ ID NO: 254120 - DNA, 43 bp, Artificial Sequence
  Description of Artificial Sequence: Synthetic oligonucleotide
catggtccttcgatttttcctaaaaacataaacagatgagctc

SEQ ID NO: 254121 - DNA, 45 bp, Artificial Sequence
  Description of Artificial Sequence: Synthetic oligonucleotide
atggtccttcgatttttcctaaaaacataaacagatgagctcatc

SEQ ID NO: 254122 - DNA, 44 bp, Artificial Sequence
  Description of Artificial Sequence: Synthetic oligonucleotide
tggtccttcgatttttcctaaaaacataaacagatgagctcatc

SEQ ID NO: 254123 - DNA, 43 bp, Artificial Sequence
  Description of Artificial Sequence: Synthetic oligonucleotide
ggtccttcgatttttcctaaaaacataaacagatgagctcatc

SEQ ID NO: 254124 - DNA, 43 bp, Artificial Sequence
  Description of Artificial Sequence: Synthetic oligonucleotide
gtccttcgatttttcctaaaaacataaacagatgagctcatcc

SEQ ID NO: 254125 - DNA, 44 bp, Artificial Sequence
  Description of Artificial Sequence: Synthetic oligonucleotide
tccttcgatttttcctaaaaacataaacagatgagctcatcctg

SEQ ID NO: 254126 - DNA, 43 bp, Artificial Sequence
  Description of Artificial Sequence: Synthetic oligonucleotide
ccttcgatttttcctaaaaacataaacagatgagctcatcctg

SEQ ID NO: 254127 - DNA, 43 bp, Artificial Sequence
  Description of Artificial Sequence: Synthetic oligonucleotide
cttcgatttttcctaaaaacataaacagatgagctcatcctgc

SEQ ID NO: 254128 - DNA, 43 bp, Artificial Sequence
  Description of Artificial Sequence: Synthetic oligonucleotide
ttcgatttttcctaaaaacataaacagatgagctcatcctgcc

SEQ ID NO: 254129 - DNA, 42 bp, Artificial Sequence
  Description of Artificial Sequence: Synthetic oligonucleotide
tcgatttttcctaaaaacataaacagatgagctcatcctgcc

SEQ ID NO: 254130 - DNA, 41 bp, Artificial Sequence
  Description of Artificial Sequence: Synthetic oligonucleotide
cgatttttcctaaaaacataaacagatgagctcatcctgcc

SEQ ID NO: 254131 - DNA, 42 bp, Artificial Sequence
  Description of Artificial Sequence: Synthetic oligonucleotide
gatttttcctaaaaacataaacagatgagctcatcctgccag

SEQ ID NO: 254132 - DNA, 44 bp, Artificial Sequence
  Description of Artificial Sequence: Synthetic oligonucleotide
atttttcctaaaaacataaacagatgagctcatcctgccagaag

SEQ ID NO: 254133 - DNA, 43 bp, Artificial Sequence
  Description of Artificial Sequence: Synthetic oligonucleotide
tttttcctaaaaacataaacagatgagctcatcctgccagaag

SEQ ID NO: 254134 - DNA, 42 bp, Artificial Sequence
  Description of Artificial Sequence: Synthetic oligonucleotide
ttttcctaaaaacataaacagatgagctcatcctgccagaag

SEQ ID NO: 254135 - DNA, 41 bp, Artificial Sequence
  Description of Artificial Sequence: Synthetic oligonucleotide
tttcctaaaaacataaacagatgagctcatcctgccagaag

SEQ ID NO: 254136 - DNA, 40 bp, Artificial Sequence
  Description of Artificial Sequence: Synthetic oligonucleotide
ttcctaaaaacataaacagatgagctcatcctgccagaag

SEQ ID NO: 254137 - DNA, 39 bp, Artificial Sequence
  Description of Artificial Sequence: Synthetic oligonucleotide
tcctaaaaacataaacagatgagctcatcctgccagaag

SEQ ID NO: 254138 - DNA, 38 bp, Artificial Sequence
  Description of Artificial Sequence: Synthetic oligonucleotide
cctaaaaacataaacagatgagctcatcctgccagaag

SEQ ID NO: 254139 - DNA, 39 bp, Artificial Sequence
  Description of Artificial Sequence: Synthetic oligonucleotide
ctaaaaacataaacagatgagctcatcctgccagaagag

SEQ ID NO: 254140 - DNA, 39 bp, Artificial Sequence
  Description of Artificial Sequence: Synthetic oligonucleotide
taaaaacataaacagatgagctcatcctgccagaagagc

SEQ ID NO: 254141 - DNA, 38 bp, Artificial Sequence
  Description of Artificial Sequence: Synthetic oligonucleotide
aaaaacataaacagatgagctcatcctgccagaagagc

SEQ ID NO: 254142 - DNA, 37 bp, Artificial Sequence
  Description of Artificial Sequence: Synthetic oligonucleotide
aaaacataaacagatgagctcatcctgccagaagagc

SEQ ID NO: 254143 - DNA, 36 bp, Artificial Sequence
  Description of Artificial Sequence: Synthetic oligonucleotide
aaacataaacagatgagctcatcctgccagaagagc

SEQ ID NO: 254144 - DNA, 35 bp, Artificial Sequence
  Description of Artificial Sequence: Synthetic oligonucleotide
aacataaacagatgagctcatcctgccagaagagc

SEQ ID NO: 254145 - DNA, 34 bp, Artificial Sequence
  Description of Artificial Sequence: Synthetic oligonucleotide
acataaacagatgagctcatcctgccagaagagc

SEQ ID NO: 254146 - DNA, 33 bp, Artificial Sequence
  Description of Artificial Sequence: Synthetic oligonucleotide
cataaacagatgagctcatcctgccagaagagc

SEQ ID NO: 254147 - DNA, 34 bp, Artificial Sequence
  Description of Artificial Sequence: Synthetic oligonucleotide
ataaacagatgagctcatcctgccagaagagctg

SEQ ID NO: 254148 - DNA, 33 bp, Artificial Sequence
  Description of Artificial Sequence: Synthetic oligonucleotide
taaacagatgagctcatcctgccagaagagctg

SEQ ID NO: 254149 - DNA, 32 bp, Artificial Sequence
  Description of Artificial Sequence: Synthetic oligonucleotide
aaacagatgagctcatcctgccagaagagctg

SEQ ID NO: 254150 - DNA, 31 bp, Artificial Sequence
  Description of Artificial Sequence: Synthetic oligonucleotide
aacagatgagctcatcctgccagaagagctg

SEQ ID NO: 254151 - DNA, 30 bp, Artificial Sequence
  Description of Artificial Sequence: Synthetic oligonucleotide
acagatgagctcatcctgccagaagagctg

SEQ ID NO: 254152 - DNA, 29 bp, Artificial Sequence
  Description of Artificial Sequence: Synthetic oligonucleotide
cagatgagctcatcctgccagaagagctg

SEQ ID NO: 254153 - DNA, 29 bp, Artificial Sequence
  Description of Artificial Sequence: Synthetic oligonucleotide
agatgagctcatcctgccagaagagctgg

SEQ ID NO: 254154 - DNA, 28 bp, Artificial Sequence
  Description of Artificial Sequence: Synthetic oligonucleotide
gatgagctcatcctgccagaagagctgg

SEQ ID NO: 254155 - DNA, 31 bp, Artificial Sequence
  Description of Artificial Sequence: Synthetic oligonucleotide
atgagctcatcctgccagaagagctggaatg

SEQ ID NO: 254156 - DNA, 30 bp, Artificial Sequence
  Description of Artificial Sequence: Synthetic oligonucleotide
tgagctcatcctgccagaagagctggaatg

SEQ ID NO: 254157 - DNA, 29 bp, Artificial Sequence
  Description of Artificial Sequence: Synthetic oligonucleotide
gagctcatcctgccagaagagctggaatg

SEQ ID NO: 254158 - DNA, 29 bp, Artificial Sequence
  Description of Artificial Sequence: Synthetic oligonucleotide
agctcatcctgccagaagagctggaatgg

SEQ ID NO: 254159 - DNA, 28 bp, Artificial Sequence
  Description of Artificial Sequence: Synthetic oligonucleotide
gctcatcctgccagaagagctggaatgg

SEQ ID NO: 254160 - DNA, 30 bp, Artificial Sequence
  Description of Artificial Sequence: Synthetic oligonucleotide
ctcatcctgccagaagagctggaatggaac

SEQ ID NO: 254161 - DNA, 39 bp, Artificial Sequence
  Description of Artificial Sequence: Synthetic oligonucleotide
tcatcctgccagaagagctggaatggaacaaatttaaag

SEQ ID NO: 254162 - DNA, 38 bp, Artificial Sequence
  Description of Artificial Sequence: Synthetic oligonucleotide
catcctgccagaagagctggaatggaacaaatttaaag

SEQ ID NO: 254163 - DNA, 39 bp, Artificial Sequence
  Description of Artificial Sequence: Synthetic oligonucleotide
atcctgccagaagagctggaatggaacaaatttaaagtg

SEQ ID NO: 254164 - DNA, 38 bp, Artificial Sequence
  Description of Artificial Sequence: Synthetic oligonucleotide
tcctgccagaagagctggaatggaacaaatttaaagtg

SEQ ID NO: 254165 - DNA, 37 bp, Artificial Sequence
  Description of Artificial Sequence: Synthetic oligonucleotide
cctgccagaagagctggaatggaacaaatttaaagtg

SEQ ID NO: 254166 - DNA, 37 bp, Artificial Sequence
  Description of Artificial Sequence: Synthetic oligonucleotide
ctgccagaagagctggaatggaacaaatttaaagtgg

SEQ ID NO: 254167 - DNA, 37 bp, Artificial Sequence
  Description of Artificial Sequence: Synthetic oligonucleotide
tgccagaagagctggaatggaacaaatttaaagtggg

SEQ ID NO: 254168 - DNA, 36 bp, Artificial Sequence
  Description of Artificial Sequence: Synthetic oligonucleotide
gccagaagagctggaatggaacaaatttaaagtggg

SEQ ID NO: 254169 - DNA, 36 bp, Artificial Sequence
  Description of Artificial Sequence: Synthetic oligonucleotide
ccagaagagctggaatggaacaaatttaaagtgggc

SEQ ID NO: 254170 - DNA, 38 bp, Artificial Sequence
  Description of Artificial Sequence: Synthetic oligonucleotide
cagaagagctggaatggaacaaatttaaagtgggcatg

SEQ ID NO: 254171 - DNA, 41 bp, Artificial Sequence
  Description of Artificial Sequence: Synthetic oligonucleotide
agaagagctggaatggaacaaatttaaagtgggcatgtatg

SEQ ID NO: 254172 - DNA, 40 bp, Artificial Sequence
  Description of Artificial Sequence: Synthetic oligonucleotide
gaagagctggaatggaacaaatttaaagtgggcatgtatg

SEQ ID NO: 254173 - DNA, 40 bp, Artificial Sequence
  Description of Artificial Sequence: Synthetic oligonucleotide
aagagctggaatggaacaaatttaaagtgggcatgtatgg

SEQ ID NO: 254174 - DNA, 39 bp, Artificial Sequence
  Description of Artificial Sequence: Synthetic oligonucleotide
agagctggaatggaacaaatttaaagtgggcatgtatgg

SEQ ID NO: 254175 - DNA, 38 bp, Artificial Sequence
  Description of Artificial Sequence: Synthetic oligonucleotide
gagctggaatggaacaaatttaaagtgggcatgtatgg

SEQ ID NO: 254176 - DNA, 38 bp, Artificial Sequence
  Description of Artificial Sequence: Synthetic oligonucleotide
agctggaatggaacaaatttaaagtgggcatgtatggc

SEQ ID NO: 254177 - DNA, 37 bp, Artificial Sequence
  Description of Artificial Sequence: Synthetic oligonucleotide
gctggaatggaacaaatttaaagtgggcatgtatggc

SEQ ID NO: 254178 - DNA, 42 bp, Artificial Sequence
  Description of Artificial Sequence: Synthetic oligonucleotide
ctggaatggaacaaatttaaagtgggcatgtatggctatttc

SEQ ID NO: 254179 - DNA, 45 bp, Artificial Sequence
  Description of Artificial Sequence: Synthetic oligonucleotide
tggaatggaacaaatttaaagtgggcatgtatggctatttcattg

SEQ ID NO: 254180 - DNA, 44 bp, Artificial Sequence
  Description of Artificial Sequence: Synthetic oligonucleotide
ggaatggaacaaatttaaagtgggcatgtatggctatttcattg

SEQ ID NO: 254181 - DNA, 45 bp, Artificial Sequence
  Description of Artificial Sequence: Synthetic oligonucleotide
gaatggaacaaatttaaagtgggcatgtatggctatttcattgtg

SEQ ID NO: 254182 - DNA, 45 bp, Artificial Sequence
  Description of Artificial Sequence: Synthetic oligonucleotide
aatggaacaaatttaaagtgggcatgtatggctatttcattgtgc

SEQ ID NO: 254183 - DNA, 44 bp, Artificial Sequence
  Description of Artificial Sequence: Synthetic oligonucleotide
atggaacaaatttaaagtgggcatgtatggctatttcattgtgc

SEQ ID NO: 254184 - DNA, 43 bp, Artificial Sequence
  Description of Artificial Sequence: Synthetic oligonucleotide
tggaacaaatttaaagtgggcatgtatggctatttcattgtgc

SEQ ID NO: 254185 - DNA, 42 bp, Artificial Sequence
  Description of Artificial Sequence: Synthetic oligonucleotide
ggaacaaatttaaagtgggcatgtatggctatttcattgtgc

SEQ ID NO: 254186 - DNA, 46 bp, Artificial Sequence
  Description of Artificial Sequence: Synthetic oligonucleotide
gaacaaatttaaagtgggcatgtatggctatttcattgtgcaatac

SEQ ID NO: 254187 - DNA, 46 bp, Artificial Sequence
  Description of Artificial Sequence: Synthetic oligonucleotide
aacaaatttaaagtgggcatgtatggctatttcattgtgcaatacg

SEQ ID NO: 254188 - DNA, 45 bp, Artificial Sequence
  Description of Artificial Sequence: Synthetic oligonucleotide
acaaatttaaagtgggcatgtatggctatttcattgtgcaatacg

SEQ ID NO: 254189 - DNA, 44 bp, Artificial Sequence
  Description of Artificial Sequence: Synthetic oligonucleotide
caaatttaaagtgggcatgtatggctatttcattgtgcaatacg

SEQ ID NO: 254190 - DNA, 45 bp, Artificial Sequence
  Description of Artificial Sequence: Synthetic oligonucleotide
aaatttaaagtgggcatgtatggctatttcattgtgcaatacgag

SEQ ID NO: 254191 - DNA, 44 bp, Artificial Sequence
  Description of Artificial Sequence: Synthetic oligonucleotide
aatttaaagtgggcatgtatggctatttcattgtgcaatacgag

SEQ ID NO: 254192 - DNA, 43 bp, Artificial Sequence
  Description of Artificial Sequence: Synthetic oligonucleotide
atttaaagtgggcatgtatggctatttcattgtgcaatacgag

SEQ ID NO: 254193 - DNA, 42 bp, Artificial Sequence
  Description of Artificial Sequence: Synthetic oligonucleotide
tttaaagtgggcatgtatggctatttcattgtgcaatacgag

SEQ ID NO: 254194 - DNA, 41 bp, Artificial Sequence
  Description of Artificial Sequence: Synthetic oligonucleotide
ttaaagtgggcatgtatggctatttcattgtgcaatacgag

SEQ ID NO: 254195 - DNA, 40 bp, Artificial Sequence
  Description of Artificial Sequence: Synthetic oligonucleotide
taaagtgggcatgtatggctatttcattgtgcaatacgag

SEQ ID NO: 254196 - DNA, 39 bp, Artificial Sequence
  Description of Artificial Sequence: Synthetic oligonucleotide
aaagtgggcatgtatggctatttcattgtgcaatacgag

SEQ ID NO: 254197 - DNA, 38 bp, Artificial Sequence
  Description of Artificial Sequence: Synthetic oligonucleotide
aagtgggcatgtatggctatttcattgtgcaatacgag

SEQ ID NO: 254198 - DNA, 37 bp, Artificial Sequence
  Description of Artificial Sequence: Synthetic oligonucleotide
agtgggcatgtatggctatttcattgtgcaatacgag

SEQ ID NO: 254199 - DNA, 36 bp, Artificial Sequence
  Description of Artificial Sequence: Synthetic oligonucleotide
gtgggcatgtatggctatttcattgtgcaatacgag

SEQ ID NO: 254200 - DNA, 36 bp, Artificial Sequence
  Description of Artificial Sequence: Synthetic oligonucleotide
tgggcatgtatggctatttcattgtgcaatacgagg

SEQ ID NO: 254201 - DNA, 35 bp, Artificial Sequence
  Description of Artificial Sequence: Synthetic oligonucleotide
gggcatgtatggctatttcattgtgcaatacgagg

SEQ ID NO: 254202 - DNA, 37 bp, Artificial Sequence
  Description of Artificial Sequence: Synthetic oligonucleotide
ggcatgtatggctatttcattgtgcaatacgaggatc

SEQ ID NO: 254203 - DNA, 39 bp, Artificial Sequence
  Description of Artificial Sequence: Synthetic oligonucleotide
gcatgtatggctatttcattgtgcaatacgaggatcatg

SEQ ID NO: 254204 - DNA, 39 bp, Artificial Sequence
  Description of Artificial Sequence: Synthetic oligonucleotide
catgtatggctatttcattgtgcaatacgaggatcatgg

SEQ ID NO: 254205 - DNA, 41 bp, Artificial Sequence
  Description of Artificial Sequence: Synthetic oligonucleotide
atgtatggctatttcattgtgcaatacgaggatcatggatg

SEQ ID NO: 254206 - DNA, 40 bp, Artificial Sequence
  Description of Artificial Sequence: Synthetic oligonucleotide
tgtatggctatttcattgtgcaatacgaggatcatggatg

SEQ ID NO: 254207 - DNA, 39 bp, Artificial Sequence
  Description of Artificial Sequence: Synthetic oligonucleotide
gtatggctatttcattgtgcaatacgaggatcatggatg

SEQ ID NO: 254208 - DNA, 39 bp, Artificial Sequence
  Description of Artificial Sequence: Synthetic oligonucleotide
tatggctatttcattgtgcaatacgaggatcatggatgg

SEQ ID NO: 254209 - DNA, 38 bp, Artificial Sequence
  Description of Artificial Sequence: Synthetic oligonucleotide
atggctatttcattgtgcaatacgaggatcatggatgg

SEQ ID NO: 254210 - DNA, 37 bp, Artificial Sequence
  Description of Artificial Sequence: Synthetic oligonucleotide
tggctatttcattgtgcaatacgaggatcatggatgg

SEQ ID NO: 254211 - DNA, 36 bp, Artificial Sequence
  Description of Artificial Sequence: Synthetic oligonucleotide
ggctatttcattgtgcaatacgaggatcatggatgg

SEQ ID NO: 254212 - DNA, 36 bp, Artificial Sequence
  Description of Artificial Sequence: Synthetic oligonucleotide
gctatttcattgtgcaatacgaggatcatggatggg

SEQ ID NO: 254213 - DNA, 37 bp, Artificial Sequence
  Description of Artificial Sequence: Synthetic oligonucleotide
ctatttcattgtgcaatacgaggatcatggatgggtc

SEQ ID NO: 254214 - DNA, 38 bp, Artificial Sequence
  Description of Artificial Sequence: Synthetic oligonucleotide
tatttcattgtgcaatacgaggatcatggatgggtctc

SEQ ID NO: 254215 - DNA, 37 bp, Artificial Sequence
  Description of Artificial Sequence: Synthetic oligonucleotide
atttcattgtgcaatacgaggatcatggatgggtctc

SEQ ID NO: 254216 - DNA, 36 bp, Artificial Sequence
  Description of Artificial Sequence: Synthetic oligonucleotide
tttcattgtgcaatacgaggatcatggatgggtctc

SEQ ID NO: 254217 - DNA, 35 bp, Artificial Sequence
  Description of Artificial Sequence: Synthetic oligonucleotide
ttcattgtgcaatacgaggatcatggatgggtctc

SEQ ID NO: 254218 - DNA, 34 bp, Artificial Sequence
  Description of Artificial Sequence: Synthetic oligonucleotide
tcattgtgcaatacgaggatcatggatgggtctc

SEQ ID NO: 254219 - DNA, 33 bp, Artificial Sequence
  Description of Artificial Sequence: Synthetic oligonucleotide
cattgtgcaatacgaggatcatggatgggtctc

SEQ ID NO: 254220 - DNA, 36 bp, Artificial Sequence
  Description of Artificial Sequence: Synthetic oligonucleotide
attgtgcaatacgaggatcatggatgggtctctttg

SEQ ID NO: 254221 - DNA, 35 bp, Artificial Sequence
  Description of Artificial Sequence: Synthetic oligonucleotide
ttgtgcaatacgaggatcatggatgggtctctttg

SEQ ID NO: 254222 - DNA, 34 bp, Artificial Sequence
  Description of Artificial Sequence: Synthetic oligonucleotide
tgtgcaatacgaggatcatggatgggtctctttg

SEQ ID NO: 254223 - DNA, 33 bp, Artificial Sequence
  Description of Artificial Sequence: Synthetic oligonucleotide
gtgcaatacgaggatcatggatgggtctctttg

SEQ ID NO: 254224 - DNA, 34 bp, Artificial Sequence
  Description of Artificial Sequence: Synthetic oligonucleotide
tgcaatacgaggatcatggatgggtctctttgac

SEQ ID NO: 254225 - DNA, 33 bp, Artificial Sequence
  Description of Artificial Sequence: Synthetic oligonucleotide
gcaatacgaggatcatggatgggtctctttgac

SEQ ID NO: 254226 - DNA, 34 bp, Artificial Sequence
  Description of Artificial Sequence: Synthetic oligonucleotide
caatacgaggatcatggatgggtctctttgacag

SEQ ID NO: 254227 - DNA, 34 bp, Artificial Sequence
  Description of Artificial Sequence: Synthetic oligonucleotide
aatacgaggatcatggatgggtctctttgacagg

SEQ ID NO: 254228 - DNA, 33 bp, Artificial Sequence
  Description of Artificial Sequence: Synthetic oligonucleotide
atacgaggatcatggatgggtctctttgacagg

SEQ ID NO: 254229 - DNA, 32 bp, Artificial Sequence
  Description of Artificial Sequence: Synthetic oligonucleotide
tacgaggatcatggatgggtctctttgacagg

SEQ ID NO: 254230 - DNA, 31 bp, Artificial Sequence
  Description of Artificial Sequence: Synthetic oligonucleotide
acgaggatcatggatgggtctctttgacagg

SEQ ID NO: 254231 - DNA, 30 bp, Artificial Sequence
  Description of Artificial Sequence: Synthetic oligonucleotide
cgaggatcatggatgggtctctttgacagg

SEQ ID NO: 254232 - DNA, 30 bp, Artificial Sequence
  Description of Artificial Sequence: Synthetic oligonucleotide
gaggatcatggatgggtctctttgacaggc

SEQ ID NO: 254233 - DNA, 30 bp, Artificial Sequence
  Description of Artificial Sequence: Synthetic oligonucleotide
aggatcatggatgggtctctttgacaggcc

SEQ ID NO: 254234 - DNA, 29 bp, Artificial Sequence
  Description of Artificial Sequence: Synthetic oligonucleotide
ggatcatggatgggtctctttgacaggcc

SEQ ID NO: 254235 - DNA, 37 bp, Artificial Sequence
  Description of Artificial Sequence: Synthetic oligonucleotide
gatcatggatgggtctctttgacaggccttttataag

SEQ ID NO: 254236 - DNA, 37 bp, Artificial Sequence
  Description of Artificial Sequence: Synthetic oligonucleotide
atcatggatgggtctctttgacaggccttttataagg

SEQ ID NO: 254237 - DNA, 36 bp, Artificial Sequence
  Description of Artificial Sequence: Synthetic oligonucleotide
tcatggatgggtctctttgacaggccttttataagg

SEQ ID NO: 254238 - DNA, 35 bp, Artificial Sequence
  Description of Artificial Sequence: Synthetic oligonucleotide
catggatgggtctctttgacaggccttttataagg

SEQ ID NO: 254239 - DNA, 37 bp, Artificial Sequence
  Description of Artificial Sequence: Synthetic oligonucleotide
atggatgggtctctttgacaggccttttataaggaac

SEQ ID NO: 254240 - DNA, 36 bp, Artificial Sequence
  Description of Artificial Sequence: Synthetic oligonucleotide
tggatgggtctctttgacaggccttttataaggaac

SEQ ID NO: 254241 - DNA, 35 bp, Artificial Sequence
  Description of Artificial Sequence: Synthetic oligonucleotide
ggatgggtctctttgacaggccttttataaggaac

SEQ ID NO: 254242 - DNA, 36 bp, Artificial Sequence
  Description of Artificial Sequence: Synthetic oligonucleotide
gatgggtctctttgacaggccttttataaggaacac

SEQ ID NO: 254243 - DNA, 37 bp, Artificial Sequence
  Description of Artificial Sequence: Synthetic oligonucleotide
atgggtctctttgacaggccttttataaggaacactc

SEQ ID NO: 254244 - DNA, 36 bp, Artificial Sequence
  Description of Artificial Sequence: Synthetic oligonucleotide
tgggtctctttgacaggccttttataaggaacactc

SEQ ID NO: 254245 - DNA, 35 bp, Artificial Sequence
  Description of Artificial Sequence: Synthetic oligonucleotide
gggtctctttgacaggccttttataaggaacactc

SEQ ID NO: 254246 - DNA, 36 bp, Artificial Sequence
  Description of Artificial Sequence: Synthetic oligonucleotide
ggtctctttgacaggccttttataaggaacactcac

SEQ ID NO: 254247 - DNA, 37 bp, Artificial Sequence
  Description of Artificial Sequence: Synthetic oligonucleotide
gtctctttgacaggccttttataaggaacactcacag

SEQ ID NO: 254248 - DNA, 37 bp, Artificial Sequence
  Description of Artificial Sequence: Synthetic oligonucleotide
tctctttgacaggccttttataaggaacactcacagc

SEQ ID NO: 254249 - DNA, 36 bp, Artificial Sequence
  Description of Artificial Sequence: Synthetic oligonucleotide
ctctttgacaggccttttataaggaacactcacagc

SEQ ID NO: 254250 - DNA, 37 bp, Artificial Sequence
  Description of Artificial Sequence: Synthetic oligonucleotide
tctttgacaggccttttataaggaacactcacagcag

SEQ ID NO: 254251 - DNA, 36 bp, Artificial Sequence
  Description of Artificial Sequence: Synthetic oligonucleotide
ctttgacaggccttttataaggaacactcacagcag

SEQ ID NO: 254252 - DNA, 37 bp, Artificial Sequence
  Description of Artificial Sequence: Synthetic oligonucleotide
tttgacaggccttttataaggaacactcacagcagtg

SEQ ID NO: 254253 - DNA, 36 bp, Artificial Sequence
  Description of Artificial Sequence: Synthetic oligonucleotide
ttgacaggccttttataaggaacactcacagcagtg

SEQ ID NO: 254254 - DNA, 35 bp, Artificial Sequence
  Description of Artificial Sequence: Synthetic oligonucleotide
tgacaggccttttataaggaacactcacagcagtg

SEQ ID NO: 254255 - DNA, 34 bp, Artificial Sequence
  Description of Artificial Sequence: Synthetic oligonucleotide
gacaggccttttataaggaacactcacagcagtg

SEQ ID NO: 254256 - DNA, 35 bp, Artificial Sequence
  Description of Artificial Sequence: Synthetic oligonucleotide
acaggccttttataaggaacactcacagcagtgag

SEQ ID NO: 254257 - DNA, 34 bp, Artificial Sequence
  Description of Artificial Sequence: Synthetic oligonucleotide
caggccttttataaggaacactcacagcagtgag

SEQ ID NO: 254258 - DNA, 34 bp, Artificial Sequence
  Description of Artificial Sequence: Synthetic oligonucleotide
aggccttttataaggaacactcacagcagtgagc

SEQ ID NO: 254259 - DNA, 33 bp, Artificial Sequence
  Description of Artificial Sequence: Synthetic oligonucleotide
ggccttttataaggaacactcacagcagtgagc

SEQ ID NO: 254260 - DNA, 34 bp, Artificial Sequence
  Description of Artificial Sequence: Synthetic oligonucleotide
gccttttataaggaacactcacagcagtgagcag

SEQ ID NO: 254261 - DNA, 38 bp, Artificial Sequence
  Description of Artificial Sequence: Synthetic oligonucleotide
ccttttataaggaacactcacagcagtgagcagtaatc

SEQ ID NO: 254262 - DNA, 40 bp, Artificial Sequence
  Description of Artificial Sequence: Synthetic oligonucleotide
cttttataaggaacactcacagcagtgagcagtaatcatc

SEQ ID NO: 254263 - DNA, 40 bp, Artificial Sequence
  Description of Artificial Sequence: Synthetic oligonucleotide
ttttataaggaacactcacagcagtgagcagtaatcatcg

SEQ ID NO: 254264 - DNA, 39 bp, Artificial Sequence
  Description of Artificial Sequence: Synthetic oligonucleotide
tttataaggaacactcacagcagtgagcagtaatcatcg

SEQ ID NO: 254265 - DNA, 38 bp, Artificial Sequence
  Description of Artificial Sequence: Synthetic oligonucleotide
ttataaggaacactcacagcagtgagcagtaatcatcg

SEQ ID NO: 254266 - DNA, 37 bp, Artificial Sequence
  Description of Artificial Sequence: Synthetic oligonucleotide
tataaggaacactcacagcagtgagcagtaatcatcg

SEQ ID NO: 254267 - DNA, 36 bp, Artificial Sequence
  Description of Artificial Sequence: Synthetic oligonucleotide
ataaggaacactcacagcagtgagcagtaatcatcg

SEQ ID NO: 254268 - DNA, 35 bp, Artificial Sequence
  Description of Artificial Sequence: Synthetic oligonucleotide
taaggaacactcacagcagtgagcagtaatcatcg

SEQ ID NO: 254269 - DNA, 34 bp, Artificial Sequence
  Description of Artificial Sequence: Synthetic oligonucleotide
aaggaacactcacagcagtgagcagtaatcatcg

SEQ ID NO: 254270 - DNA, 33 bp, Artificial Sequence
  Description of Artificial Sequence: Synthetic oligonucleotide
aggaacactcacagcagtgagcagtaatcatcg

SEQ ID NO: 254271 - DNA, 32 bp, Artificial Sequence
  Description of Artificial Sequence: Synthetic oligonucleotide
ggaacactcacagcagtgagcagtaatcatcg

SEQ ID NO: 254272 - DNA, 32 bp, Artificial Sequence
  Description of Artificial Sequence: Synthetic oligonucleotide
gaacactcacagcagtgagcagtaatcatcgg

SEQ ID NO: 254273 - DNA, 32 bp, Artificial Sequence
  Description of Artificial Sequence: Synthetic oligonucleotide
aacactcacagcagtgagcagtaatcatcggg

SEQ ID NO: 254274 - DNA, 31 bp, Artificial Sequence
  Description of Artificial Sequence: Synthetic oligonucleotide
acactcacagcagtgagcagtaatcatcggg

SEQ ID NO: 254275 - DNA, 30 bp, Artificial Sequence
  Description of Artificial Sequence: Synthetic oligonucleotide
cactcacagcagtgagcagtaatcatcggg

SEQ ID NO: 254276 - DNA, 30 bp, Artificial Sequence
  Description of Artificial Sequence: Synthetic oligonucleotide
actcacagcagtgagcagtaatcatcgggc

SEQ ID NO: 254277 - DNA, 29 bp, Artificial Sequence
  Description of Artificial Sequence: Synthetic oligonucleotide
ctcacagcagtgagcagtaatcatcgggc

SEQ ID NO: 254278 - DNA, 29 bp, Artificial Sequence
  Description of Artificial Sequence: Synthetic oligonucleotide
tcacagcagtgagcagtaatcatcgggcg

SEQ ID NO: 254279 - DNA, 28 bp, Artificial Sequence
  Description of Artificial Sequence: Synthetic oligonucleotide
cacagcagtgagcagtaatcatcgggcg

SEQ ID NO: 254280 - DNA, 29 bp, Artificial Sequence
  Description of Artificial Sequence: Synthetic oligonucleotide
acagcagtgagcagtaatcatcgggcgac

SEQ ID NO: 254281 - DNA, 28 bp, Artificial Sequence
  Description of Artificial Sequence: Synthetic oligonucleotide
cagcagtgagcagtaatcatcgggcgac

SEQ ID NO: 254282 - DNA, 29 bp, Artificial Sequence
  Description of Artificial Sequence: Synthetic oligonucleotide
agcagtgagcagtaatcatcgggcgactc

SEQ ID NO: 254283 - DNA, 28 bp, Artificial Sequence
  Description of Artificial Sequence: Synthetic oligonucleotide
gcagtgagcagtaatcatcgggcgactc

SEQ ID NO: 254284 - DNA, 29 bp, Artificial Sequence
  Description of Artificial Sequence: Synthetic oligonucleotide
cagtgagcagtaatcatcgggcgactctc

SEQ ID NO: 254285 - DNA, 34 bp, Artificial Sequence
  Description of Artificial Sequence: Synthetic oligonucleotide
agtgagcagtaatcatcgggcgactctcattaag

SEQ ID NO: 254286 - DNA, 33 bp, Artificial Sequence
  Description of Artificial Sequence: Synthetic oligonucleotide
gtgagcagtaatcatcgggcgactctcattaag

SEQ ID NO: 254287 - DNA, 36 bp, Artificial Sequence
  Description of Artificial Sequence: Synthetic oligonucleotide
tgagcagtaatcatcgggcgactctcattaagaatg

SEQ ID NO: 254288 - DNA, 35 bp, Artificial Sequence
  Description of Artificial Sequence: Synthetic oligonucleotide
gagcagtaatcatcgggcgactctcattaagaatg

SEQ ID NO: 254289 - DNA, 35 bp, Artificial Sequence
  Description of Artificial Sequence: Synthetic oligonucleotide
agcagtaatcatcgggcgactctcattaagaatgc

SEQ ID NO: 254290 - DNA, 34 bp, Artificial Sequence
  Description of Artificial Sequence: Synthetic oligonucleotide
gcagtaatcatcgggcgactctcattaagaatgc

SEQ ID NO: 254291 - DNA, 38 bp, Artificial Sequence
  Description of Artificial Sequence: Synthetic oligonucleotide
cagtaatcatcgggcgactctcattaagaatgcatttg

SEQ ID NO: 254292 - DNA, 39 bp, Artificial Sequence
  Description of Artificial Sequence: Synthetic oligonucleotide
agtaatcatcgggcgactctcattaagaatgcatttgag

SEQ ID NO: 254293 - DNA, 38 bp, Artificial Sequence
  Description of Artificial Sequence: Synthetic oligonucleotide
gtaatcatcgggcgactctcattaagaatgcatttgag

SEQ ID NO: 254294 - DNA, 38 bp, Artificial Sequence
  Description of Artificial Sequence: Synthetic oligonucleotide
taatcatcgggcgactctcattaagaatgcatttgagc

SEQ ID NO: 254295 - DNA, 37 bp, Artificial Sequence
  Description of Artificial Sequence: Synthetic oligonucleotide
aatcatcgggcgactctcattaagaatgcatttgagc

SEQ ID NO: 254296 - DNA, 36 bp, Artificial Sequence
  Description of Artificial Sequence: Synthetic oligonucleotide
atcatcgggcgactctcattaagaatgcatttgagc

SEQ ID NO: 254297 - DNA, 35 bp, Artificial Sequence
  Description of Artificial Sequence: Synthetic oligonucleotide
tcatcgggcgactctcattaagaatgcatttgagc

SEQ ID NO: 254298 - DNA, 34 bp, Artificial Sequence
  Description of Artificial Sequence: Synthetic oligonucleotide
catcgggcgactctcattaagaatgcatttgagc

SEQ ID NO: 254299 - DNA, 35 bp, Artificial Sequence
  Description of Artificial Sequence: Synthetic oligonucleotide
atcgggcgactctcattaagaatgcatttgagctc

SEQ ID NO: 254300 - DNA, 34 bp, Artificial Sequence
  Description of Artificial Sequence: Synthetic oligonucleotide
tcgggcgactctcattaagaatgcatttgagctc

SEQ ID NO: 254301 - DNA, 33 bp, Artificial Sequence
  Description of Artificial Sequence: Synthetic oligonucleotide
cgggcgactctcattaagaatgcatttgagctc

SEQ ID NO: 254302 - DNA, 33 bp, Artificial Sequence
  Description of Artificial Sequence: Synthetic oligonucleotide
gggcgactctcattaagaatgcatttgagctcg

SEQ ID NO: 254303 - DNA, 34 bp, Artificial Sequence
  Description of Artificial Sequence: Synthetic oligonucleotide
ggcgactctcattaagaatgcatttgagctcgtc

SEQ ID NO: 254304 - DNA, 35 bp, Artificial Sequence
  Description of Artificial Sequence: Synthetic oligonucleotide
gcgactctcattaagaatgcatttgagctcgtcac

SEQ ID NO: 254305 - DNA, 35 bp, Artificial Sequence
  Description of Artificial Sequence: Synthetic oligonucleotide
cgactctcattaagaatgcatttgagctcgtcacc

SEQ ID NO: 254306 - DNA, 38 bp, Artificial Sequence
  Description of Artificial Sequence: Synthetic oligonucleotide
gactctcattaagaatgcatttgagctcgtcaccattg

SEQ ID NO: 254307 - DNA, 38 bp, Artificial Sequence
  Description of Artificial Sequence: Synthetic oligonucleotide
actctcattaagaatgcatttgagctcgtcaccattgg

SEQ ID NO: 254308 - DNA, 37 bp, Artificial Sequence
  Description of Artificial Sequence: Synthetic oligonucleotide
ctctcattaagaatgcatttgagctcgtcaccattgg

SEQ ID NO: 254309 - DNA, 37 bp, Artificial Sequence
  Description of Artificial Sequence: Synthetic oligonucleotide
tctcattaagaatgcatttgagctcgtcaccattggg

SEQ ID NO: 254310 - DNA, 36 bp, Artificial Sequence
  Description of Artificial Sequence: Synthetic oligonucleotide
ctcattaagaatgcatttgagctcgtcaccattggg

SEQ ID NO: 254311 - DNA, 38 bp, Artificial Sequence
  Description of Artificial Sequence: Synthetic oligonucleotide
tcattaagaatgcatttgagctcgtcaccattgggaac

SEQ ID NO: 254312 - DNA, 37 bp, Artificial Sequence
  Description of Artificial Sequence: Synthetic oligonucleotide
cattaagaatgcatttgagctcgtcaccattgggaac

SEQ ID NO: 254313 - DNA, 37 bp, Artificial Sequence
  Description of Artificial Sequence: Synthetic oligonucleotide
attaagaatgcatttgagctcgtcaccattgggaacc

SEQ ID NO: 254314 - DNA, 36 bp, Artificial Sequence
  Description of Artificial Sequence: Synthetic oligonucleotide
ttaagaatgcatttgagctcgtcaccattgggaacc

SEQ ID NO: 254315 - DNA, 35 bp, Artificial Sequence
  Description of Artificial Sequence: Synthetic oligonucleotide
taagaatgcatttgagctcgtcaccattgggaacc

SEQ ID NO: 254316 - DNA, 34 bp, Artificial Sequence
  Description of Artificial Sequence: Synthetic oligonucleotide
aagaatgcatttgagctcgtcaccattgggaacc

SEQ ID NO: 254317 - DNA, 33 bp, Artificial Sequence
  Description of Artificial Sequence: Synthetic oligonucleotide
agaatgcatttgagctcgtcaccattgggaacc

SEQ ID NO: 254318 - DNA, 32 bp, Artificial Sequence
  Description of Artificial Sequence: Synthetic oligonucleotide
gaatgcatttgagctcgtcaccattgggaacc

SEQ ID NO: 254319 - DNA, 33 bp, Artificial Sequence
  Description of Artificial Sequence: Synthetic oligonucleotide
aatgcatttgagctcgtcaccattgggaacctg

SEQ ID NO: 254320 - DNA, 32 bp, Artificial Sequence
  Description of Artificial Sequence: Synthetic oligonucleotide
atgcatttgagctcgtcaccattgggaacctg

SEQ ID NO: 254321 - DNA, 31 bp, Artificial Sequence
  Description of Artificial Sequence: Synthetic oligonucleotide
tgcatttgagctcgtcaccattgggaacctg

SEQ ID NO: 254322 - DNA, 30 bp, Artificial Sequence
  Description of Artificial Sequence: Synthetic oligonucleotide
gcatttgagctcgtcaccattgggaacctg

SEQ ID NO: 254323 - DNA, 31 bp, Artificial Sequence
  Description of Artificial Sequence: Synthetic oligonucleotide
catttgagctcgtcaccattgggaacctgtc

SEQ ID NO: 254324 - DNA, 31 bp, Artificial Sequence
  Description of Artificial Sequence: Synthetic oligonucleotide
atttgagctcgtcaccattgggaacctgtcc

SEQ ID NO: 254325 - DNA, 30 bp, Artificial Sequence
  Description of Artificial Sequence: Synthetic oligonucleotide
tttgagctcgtcaccattgggaacctgtcc

SEQ ID NO: 254326 - DNA, 29 bp, Artificial Sequence
  Description of Artificial Sequence: Synthetic oligonucleotide
ttgagctcgtcaccattgggaacctgtcc

SEQ ID NO: 254327 - DNA, 28 bp, Artificial Sequence
  Description of Artificial Sequence: Synthetic oligonucleotide
tgagctcgtcaccattgggaacctgtcc

SEQ ID NO: 254328 - DNA, 27 bp, Artificial Sequence
  Description of Artificial Sequence: Synthetic oligonucleotide
gagctcgtcaccattgggaacctgtcc

SEQ ID NO: 254329 - DNA, 30 bp, Artificial Sequence
  Description of Artificial Sequence: Synthetic oligonucleotide
agctcgtcaccattgggaacctgtccattc

SEQ ID NO: 254330 - DNA, 29 bp, Artificial Sequence
  Description of Artificial Sequence: Synthetic oligonucleotide
gctcgtcaccattgggaacctgtccattc

SEQ ID NO: 254331 - DNA, 33 bp, Artificial Sequence
  Description of Artificial Sequence: Synthetic oligonucleotide
ctcgtcaccattgggaacctgtccattcaaaag

SEQ ID NO: 254332 - DNA, 33 bp, Artificial Sequence
  Description of Artificial Sequence: Synthetic oligonucleotide
tcgtcaccattgggaacctgtccattcaaaagg

SEQ ID NO: 254333 - DNA, 32 bp, Artificial Sequence
  Description of Artificial Sequence: Synthetic oligonucleotide
cgtcaccattgggaacctgtccattcaaaagg

SEQ ID NO: 254334 - DNA, 32 bp, Artificial Sequence
  Description of Artificial Sequence: Synthetic oligonucleotide
gtcaccattgggaacctgtccattcaaaaggc

SEQ ID NO: 254335 - DNA, 32 bp, Artificial Sequence
  Description of Artificial Sequence: Synthetic oligonucleotide
tcaccattgggaacctgtccattcaaaaggcc

SEQ ID NO: 254336 - DNA, 31 bp, Artificial Sequence
  Description of Artificial Sequence: Synthetic oligonucleotide
caccattgggaacctgtccattcaaaaggcc

SEQ ID NO: 254337 - DNA, 33 bp, Artificial Sequence
  Description of Artificial Sequence: Synthetic oligonucleotide
accattgggaacctgtccattcaaaaggcctag

SEQ ID NO: 254338 - DNA, 32 bp, Artificial Sequence
  Description of Artificial Sequence: Synthetic oligonucleotide
ccattgggaacctgtccattcaaaaggcctag

SEQ ID NO: 254339 - DNA, 32 bp, Artificial Sequence
  Description of Artificial Sequence: Synthetic oligonucleotide
cattgggaacctgtccattcaaaaggcctagg

SEQ ID NO: 254340 - DNA, 38 bp, Artificial Sequence
  Description of Artificial Sequence: Synthetic oligonucleotide
attgggaacctgtccattcaaaaggcctaggatttatc

SEQ ID NO: 254341 - DNA, 37 bp, Artificial Sequence
  Description of Artificial Sequence: Synthetic oligonucleotide
ttgggaacctgtccattcaaaaggcctaggatttatc

SEQ ID NO: 254342 - DNA, 36 bp, Artificial Sequence
  Description of Artificial Sequence: Synthetic oligonucleotide
tgggaacctgtccattcaaaaggcctaggatttatc

SEQ ID NO: 254343 - DNA, 35 bp, Artificial Sequence
  Description of Artificial Sequence: Synthetic oligonucleotide
gggaacctgtccattcaaaaggcctaggatttatc

SEQ ID NO: 254344 - DNA, 35 bp, Artificial Sequence
  Description of Artificial Sequence: Synthetic oligonucleotide
ggaacctgtccattcaaaaggcctaggatttatcg

SEQ ID NO: 254345 - DNA, 35 bp, Artificial Sequence
  Description of Artificial Sequence: Synthetic oligonucleotide
gaacctgtccattcaaaaggcctaggatttatcgc

SEQ ID NO: 254346 - DNA, 36 bp, Artificial Sequence
  Description of Artificial Sequence: Synthetic oligonucleotide
aacctgtccattcaaaaggcctaggatttatcgctg

SEQ ID NO: 254347 - DNA, 35 bp, Artificial Sequence
  Description of Artificial Sequence: Synthetic oligonucleotide
acctgtccattcaaaaggcctaggatttatcgctg

SEQ ID NO: 254348 - DNA, 34 bp, Artificial Sequence
  Description of Artificial Sequence: Synthetic oligonucleotide
cctgtccattcaaaaggcctaggatttatcgctg

SEQ ID NO: 254349 - DNA, 36 bp, Artificial Sequence
  Description of Artificial Sequence: Synthetic oligonucleotide
ctgtccattcaaaaggcctaggatttatcgctgtac

SEQ ID NO: 254350 - DNA, 38 bp, Artificial Sequence
  Description of Artificial Sequence: Synthetic oligonucleotide
tgtccattcaaaaggcctaggatttatcgctgtacttg

SEQ ID NO: 254351 - DNA, 37 bp, Artificial Sequence
  Description of Artificial Sequence: Synthetic oligonucleotide
gtccattcaaaaggcctaggatttatcgctgtacttg

SEQ ID NO: 254352 - DNA, 40 bp, Artificial Sequence
  Description of Artificial Sequence: Synthetic oligonucleotide
tccattcaaaaggcctaggatttatcgctgtacttgtaac

SEQ ID NO: 254353 - DNA, 39 bp, Artificial Sequence
  Description of Artificial Sequence: Synthetic oligonucleotide
ccattcaaaaggcctaggatttatcgctgtacttgtaac

SEQ ID NO: 254354 - DNA, 41 bp, Artificial Sequence
  Description of Artificial Sequence: Synthetic oligonucleotide
cattcaaaaggcctaggatttatcgctgtacttgtaacatg

SEQ ID NO: 254355 - DNA, 44 bp, Artificial Sequence
  Description of Artificial Sequence: Synthetic oligonucleotide
attcaaaaggcctaggatttatcgctgtacttgtaacatgaaag

SEQ ID NO: 254356 - DNA, 43 bp, Artificial Sequence
  Description of Artificial Sequence: Synthetic oligonucleotide
ttcaaaaggcctaggatttatcgctgtacttgtaacatgaaag

SEQ ID NO: 254357 - DNA, 42 bp, Artificial Sequence
  Description of Artificial Sequence: Synthetic oligonucleotide
tcaaaaggcctaggatttatcgctgtacttgtaacatgaaag

SEQ ID NO: 254358 - DNA, 41 bp, Artificial Sequence
  Description of Artificial Sequence: Synthetic oligonucleotide
caaaaggcctaggatttatcgctgtacttgtaacatgaaag

SEQ ID NO: 254359 - DNA, 42 bp, Artificial Sequence
  Description of Artificial Sequence: Synthetic oligonucleotide
aaaaggcctaggatttatcgctgtacttgtaacatgaaagtg

SEQ ID NO: 254360 - DNA, 41 bp, Artificial Sequence
  Description of Artificial Sequence: Synthetic oligonucleotide
aaaggcctaggatttatcgctgtacttgtaacatgaaagtg

SEQ ID NO: 254361 - DNA, 40 bp, Artificial Sequence
  Description of Artificial Sequence: Synthetic oligonucleotide
aaggcctaggatttatcgctgtacttgtaacatgaaagtg

SEQ ID NO: 254362 - DNA, 39 bp, Artificial Sequence
  Description of Artificial Sequence: Synthetic oligonucleotide
aggcctaggatttatcgctgtacttgtaacatgaaagtg

SEQ ID NO: 254363 - DNA, 38 bp, Artificial Sequence
  Description of Artificial Sequence: Synthetic oligonucleotide
ggcctaggatttatcgctgtacttgtaacatgaaagtg

SEQ ID NO: 254364 - DNA, 45 bp, Artificial Sequence
  Description of Artificial Sequence: Synthetic oligonucleotide
gcctaggatttatcgctgtacttgtaacatgaaagtgaaattatc

SEQ ID NO: 254365 - DNA, 45 bp, Artificial Sequence
  Description of Artificial Sequence: Synthetic oligonucleotide
cctaggatttatcgctgtacttgtaacatgaaagtgaaattatcc

SEQ ID NO: 254366 - DNA, 45 bp, Artificial Sequence
  Description of Artificial Sequence: Synthetic oligonucleotide
ctaggatttatcgctgtacttgtaacatgaaagtgaaattatccc

SEQ ID NO: 254367 - DNA, 45 bp, Artificial Sequence
  Description of Artificial Sequence: Synthetic oligonucleotide
taggatttatcgctgtacttgtaacatgaaagtgaaattatcccc

SEQ ID NO: 254368 - DNA, 44 bp, Artificial Sequence
  Description of Artificial Sequence: Synthetic oligonucleotide
aggatttatcgctgtacttgtaacatgaaagtgaaattatcccc

SEQ ID NO: 254369 - DNA, 43 bp, Artificial Sequence
  Description of Artificial Sequence: Synthetic oligonucleotide
ggatttatcgctgtacttgtaacatgaaagtgaaattatcccc

SEQ ID NO: 254370 - DNA, 43 bp, Artificial Sequence
  Description of Artificial Sequence: Synthetic oligonucleotide
gatttatcgctgtacttgtaacatgaaagtgaaattatccccg

SEQ ID NO: 254371 - DNA, 44 bp, Artificial Sequence
  Description of Artificial Sequence: Synthetic oligonucleotide
atttatcgctgtacttgtaacatgaaagtgaaattatccccgtg

SEQ ID NO: 254372 - DNA, 43 bp, Artificial Sequence
  Description of Artificial Sequence: Synthetic oligonucleotide
tttatcgctgtacttgtaacatgaaagtgaaattatccccgtg

SEQ ID NO: 254373 - DNA, 42 bp, Artificial Sequence
  Description of Artificial Sequence: Synthetic oligonucleotide
ttatcgctgtacttgtaacatgaaagtgaaattatccccgtg

SEQ ID NO: 254374 - DNA, 41 bp, Artificial Sequence
  Description of Artificial Sequence: Synthetic oligonucleotide
tatcgctgtacttgtaacatgaaagtgaaattatccccgtg

SEQ ID NO: 254375 - DNA, 40 bp, Artificial Sequence
  Description of Artificial Sequence: Synthetic oligonucleotide
atcgctgtacttgtaacatgaaagtgaaattatccccgtg

SEQ ID NO: 254376 - DNA, 39 bp, Artificial Sequence
  Description of Artificial Sequence: Synthetic oligonucleotide
tcgctgtacttgtaacatgaaagtgaaattatccccgtg

SEQ ID NO: 254377 - DNA, 38 bp, Artificial Sequence
  Description of Artificial Sequence: Synthetic oligonucleotide
cgctgtacttgtaacatgaaagtgaaattatccccgtg

SEQ ID NO: 254378 - DNA, 41 bp, Artificial Sequence
  Description of Artificial Sequence: Synthetic oligonucleotide
gctgtacttgtaacatgaaagtgaaattatccccgtgtttg

SEQ ID NO: 254379 - DNA, 43 bp, Artificial Sequence
  Description of Artificial Sequence: Synthetic oligonucleotide
ctgtacttgtaacatgaaagtgaaattatccccgtgtttgaag

SEQ ID NO: 254380 - DNA, 43 bp, Artificial Sequence
  Description of Artificial Sequence: Synthetic oligonucleotide
tgtacttgtaacatgaaagtgaaattatccccgtgtttgaagg

SEQ ID NO: 254381 - DNA, 42 bp, Artificial Sequence
  Description of Artificial Sequence: Synthetic oligonucleotide
gtacttgtaacatgaaagtgaaattatccccgtgtttgaagg

SEQ ID NO: 254382 - DNA, 45 bp, Artificial Sequence
  Description of Artificial Sequence: Synthetic oligonucleotide
tacttgtaacatgaaagtgaaattatccccgtgtttgaaggtttg

SEQ ID NO: 254383 - DNA, 44 bp, Artificial Sequence
  Description of Artificial Sequence: Synthetic oligonucleotide
acttgtaacatgaaagtgaaattatccccgtgtttgaaggtttg

SEQ ID NO: 254384 - DNA, 43 bp, Artificial Sequence
  Description of Artificial Sequence: Synthetic oligonucleotide
cttgtaacatgaaagtgaaattatccccgtgtttgaaggtttg

SEQ ID NO: 254385 - DNA, 46 bp, Artificial Sequence
  Description of Artificial Sequence: Synthetic oligonucleotide
ttgtaacatgaaagtgaaattatccccgtgtttgaaggtttgattg

SEQ ID NO: 254386 - DNA, 45 bp, Artificial Sequence
  Description of Artificial Sequence: Synthetic oligonucleotide
tgtaacatgaaagtgaaattatccccgtgtttgaaggtttgattg

SEQ ID NO: 254387 - DNA, 44 bp, Artificial Sequence
  Description of Artificial Sequence: Synthetic oligonucleotide
gtaacatgaaagtgaaattatccccgtgtttgaaggtttgattg

SEQ ID NO: 254388 - DNA, 45 bp, Artificial Sequence
  Description of Artificial Sequence: Synthetic oligonucleotide
taacatgaaagtgaaattatccccgtgtttgaaggtttgattgag

SEQ ID NO: 254389 - DNA, 44 bp, Artificial Sequence
  Description of Artificial Sequence: Synthetic oligonucleotide
aacatgaaagtgaaattatccccgtgtttgaaggtttgattgag

SEQ ID NO: 254390 - DNA, 43 bp, Artificial Sequence
  Description of Artificial Sequence: Synthetic oligonucleotide
acatgaaagtgaaattatccccgtgtttgaaggtttgattgag

SEQ ID NO: 254391 - DNA, 42 bp, Artificial Sequence
  Description of Artificial Sequence: Synthetic oligonucleotide
catgaaagtgaaattatccccgtgtttgaaggtttgattgag

SEQ ID NO: 254392 - DNA, 42 bp, Artificial Sequence
  Description of Artificial Sequence: Synthetic oligonucleotide
atgaaagtgaaattatccccgtgtttgaaggtttgattgagc

SEQ ID NO: 254393 - DNA, 41 bp, Artificial Sequence
  Description of Artificial Sequence: Synthetic oligonucleotide
tgaaagtgaaattatccccgtgtttgaaggtttgattgagc

SEQ ID NO: 254394 - DNA, 40 bp, Artificial Sequence
  Description of Artificial Sequence: Synthetic oligonucleotide
gaaagtgaaattatccccgtgtttgaaggtttgattgagc

SEQ ID NO: 254395 - DNA, 41 bp, Artificial Sequence
  Description of Artificial Sequence: Synthetic oligonucleotide
aaagtgaaattatccccgtgtttgaaggtttgattgagctg

SEQ ID NO: 254396 - DNA, 40 bp, Artificial Sequence
  Description of Artificial Sequence: Synthetic oligonucleotide
aagtgaaattatccccgtgtttgaaggtttgattgagctg

SEQ ID NO: 254397 - DNA, 39 bp, Artificial Sequence
  Description of Artificial Sequence: Synthetic oligonucleotide
agtgaaattatccccgtgtttgaaggtttgattgagctg

SEQ ID NO: 254398 - DNA, 38 bp, Artificial Sequence
  Description of Artificial Sequence: Synthetic oligonucleotide
gtgaaattatccccgtgtttgaaggtttgattgagctg

SEQ ID NO: 254399 - DNA, 41 bp, Artificial Sequence
  Description of Artificial Sequence: Synthetic oligonucleotide
tgaaattatccccgtgtttgaaggtttgattgagctgatac

SEQ ID NO: 254400 - DNA, 40 bp, Artificial Sequence
  Description of Artificial Sequence: Synthetic oligonucleotide
gaaattatccccgtgtttgaaggtttgattgagctgatac

SEQ ID NO: 254401 - DNA, 40 bp, Artificial Sequence
  Description of Artificial Sequence: Synthetic oligonucleotide
aaattatccccgtgtttgaaggtttgattgagctgatacc

SEQ ID NO: 254402 - DNA, 39 bp, Artificial Sequence
  Description of Artificial Sequence: Synthetic oligonucleotide
aattatccccgtgtttgaaggtttgattgagctgatacc

SEQ ID NO: 254403 - DNA, 38 bp, Artificial Sequence
  Description of Artificial Sequence: Synthetic oligonucleotide
attatccccgtgtttgaaggtttgattgagctgatacc

SEQ ID NO: 254404 - DNA, 37 bp, Artificial Sequence
  Description of Artificial Sequence: Synthetic oligonucleotide
ttatccccgtgtttgaaggtttgattgagctgatacc

SEQ ID NO: 254405 - DNA, 36 bp, Artificial Sequence
  Description of Artificial Sequence: Synthetic oligonucleotide
tatccccgtgtttgaaggtttgattgagctgatacc

SEQ ID NO: 254406 - DNA, 35 bp, Artificial Sequence
  Description of Artificial Sequence: Synthetic oligonucleotide
atccccgtgtttgaaggtttgattgagctgatacc

SEQ ID NO: 254407 - DNA, 34 bp, Artificial Sequence
  Description of Artificial Sequence: Synthetic oligonucleotide
tccccgtgtttgaaggtttgattgagctgatacc

SEQ ID NO: 254408 - DNA, 33 bp, Artificial Sequence
  Description of Artificial Sequence: Synthetic oligonucleotide
ccccgtgtttgaaggtttgattgagctgatacc

SEQ ID NO: 254409 - DNA, 36 bp, Artificial Sequence
  Description of Artificial Sequence: Synthetic oligonucleotide
cccgtgtttgaaggtttgattgagctgatacctatg

SEQ ID NO: 254410 - DNA, 41 bp, Artificial Sequence
  Description of Artificial Sequence: Synthetic oligonucleotide
ccgtgtttgaaggtttgattgagctgatacctatgtattag

SEQ ID NO: 254411 - DNA, 46 bp, Artificial Sequence
  Description of Artificial Sequence: Synthetic oligonucleotide
cgtgtttgaaggtttgattgagctgatacctatgtattagttaatg

SEQ ID NO: 254412 - DNA, 46 bp, Artificial Sequence
  Description of Artificial Sequence: Synthetic oligonucleotide
gtgtttgaaggtttgattgagctgatacctatgtattagttaatgg

SEQ ID NO: 254413 - DNA, 47 bp, Artificial Sequence
  Description of Artificial Sequence: Synthetic oligonucleotide
tgtttgaaggtttgattgagctgatacctatgtattagttaatggtg

SEQ ID NO: 254414 - DNA, 46 bp, Artificial Sequence
  Description of Artificial Sequence: Synthetic oligonucleotide
gtttgaaggtttgattgagctgatacctatgtattagttaatggtg

SEQ ID NO: 254415 - DNA, 50 bp, Artificial Sequence
  Description of Artificial Sequence: Synthetic oligonucleotide
tttgaaggtttgattgagctgatacctatgtattagttaatggtgaaaag

SEQ ID NO: 254416 - DNA, 49 bp, Artificial Sequence
  Description of Artificial Sequence: Synthetic oligonucleotide
ttgaaggtttgattgagctgatacctatgtattagttaatggtgaaaag

SEQ ID NO: 254417 - DNA, 48 bp, Artificial Sequence
  Description of Artificial Sequence: Synthetic oligonucleotide
tgaaggtttgattgagctgatacctatgtattagttaatggtgaaaag

SEQ ID NO: 254418 - DNA, 47 bp, Artificial Sequence
  Description of Artificial Sequence: Synthetic oligonucleotide
gaaggtttgattgagctgatacctatgtattagttaatggtgaaaag

SEQ ID NO: 254419 - DNA, 48 bp, Artificial Sequence
  Description of Artificial Sequence: Synthetic oligonucleotide
aaggtttgattgagctgatacctatgtattagttaatggtgaaaagag

SEQ ID NO: 254420 - DNA, 47 bp, Artificial Sequence
  Description of Artificial Sequence: Synthetic oligonucleotide
aggtttgattgagctgatacctatgtattagttaatggtgaaaagag

SEQ ID NO: 254421 - DNA, 46 bp, Artificial Sequence
  Description of Artificial Sequence: Synthetic oligonucleotide
ggtttgattgagctgatacctatgtattagttaatggtgaaaagag

SEQ ID NO: 254422 - DNA, 50 bp, Artificial Sequence
  Description of Artificial Sequence: Synthetic oligonucleotide
gtttgattgagctgatacctatgtattagttaatggtgaaaagagaaatg

SEQ ID NO: 254423 - DNA, 53 bp, Artificial Sequence
  Description of Artificial Sequence: Synthetic oligonucleotide
tttgattgagctgatacctatgtattagttaatggtgaaaagagaaatgaatg

SEQ ID NO: 254424 - DNA, 52 bp, Artificial Sequence
  Description of Artificial Sequence: Synthetic oligonucleotide
ttgattgagctgatacctatgtattagttaatggtgaaaagagaaatgaatg

SEQ ID NO: 254425 - DNA, 51 bp, Artificial Sequence
  Description of Artificial Sequence: Synthetic oligonucleotide
tgattgagctgatacctatgtattagttaatggtgaaaagagaaatgaatg

SEQ ID NO: 254426 - DNA, 50 bp, Artificial Sequence
  Description of Artificial Sequence: Synthetic oligonucleotide
gattgagctgatacctatgtattagttaatggtgaaaagagaaatgaatg

SEQ ID NO: 254427 - DNA, 52 bp, Artificial Sequence
  Description of Artificial Sequence: Synthetic oligonucleotide
attgagctgatacctatgtattagttaatggtgaaaagagaaatgaatgaac

SEQ ID NO: 254428 - DNA, 51 bp, Artificial Sequence
  Description of Artificial Sequence: Synthetic oligonucleotide
ttgagctgatacctatgtattagttaatggtgaaaagagaaatgaatgaac

SEQ ID NO: 254429 - DNA, 50 bp, Artificial Sequence
  Description of Artificial Sequence: Synthetic oligonucleotide
tgagctgatacctatgtattagttaatggtgaaaagagaaatgaatgaac

SEQ ID NO: 254430 - DNA, 49 bp, Artificial Sequence
  Description of Artificial Sequence: Synthetic oligonucleotide
gagctgatacctatgtattagttaatggtgaaaagagaaatgaatgaac

SEQ ID NO: 254431 - DNA, 50 bp, Artificial Sequence
  Description of Artificial Sequence: Synthetic oligonucleotide
agctgatacctatgtattagttaatggtgaaaagagaaatgaatgaactg

SEQ ID NO: 254432 - DNA, 49 bp, Artificial Sequence
  Description of Artificial Sequence: Synthetic oligonucleotide
gctgatacctatgtattagttaatggtgaaaagagaaatgaatgaactg

SEQ ID NO: 254433 - DNA, 49 bp, Artificial Sequence
  Description of Artificial Sequence: Synthetic oligonucleotide
ctgatacctatgtattagttaatggtgaaaagagaaatgaatgaactgg

SEQ ID NO: 254434 - DNA, 52 bp, Artificial Sequence
  Description of Artificial Sequence: Synthetic oligonucleotide
tgatacctatgtattagttaatggtgaaaagagaaatgaatgaactggaaac

SEQ ID NO: 254435 - DNA, 51 bp, Artificial Sequence
  Description of Artificial Sequence: Synthetic oligonucleotide
gatacctatgtattagttaatggtgaaaagagaaatgaatgaactggaaac

SEQ ID NO: 254436 - DNA, 52 bp, Artificial Sequence
  Description of Artificial Sequence: Synthetic oligonucleotide
atacctatgtattagttaatggtgaaaagagaaatgaatgaactggaaactc

SEQ ID NO: 254437 - DNA, 51 bp, Artificial Sequence
  Description of Artificial Sequence: Synthetic oligonucleotide
tacctatgtattagttaatggtgaaaagagaaatgaatgaactggaaactc

SEQ ID NO: 254438 - DNA, 50 bp, Artificial Sequence
  Description of Artificial Sequence: Synthetic oligonucleotide
acctatgtattagttaatggtgaaaagagaaatgaatgaactggaaactc

SEQ ID NO: 254439 - DNA, 49 bp, Artificial Sequence
  Description of Artificial Sequence: Synthetic oligonucleotide
cctatgtattagttaatggtgaaaagagaaatgaatgaactggaaactc

SEQ ID NO: 254440 - DNA, 53 bp, Artificial Sequence
  Description of Artificial Sequence: Synthetic oligonucleotide
ctatgtattagttaatggtgaaaagagaaatgaatgaactggaaactctattc

SEQ ID NO: 254441 - DNA, 55 bp, Artificial Sequence
  Description of Artificial Sequence: Synthetic oligonucleotide
tatgtattagttaatggtgaaaagagaaatgaatgaactggaaactctattcaag

SEQ ID NO: 254442 - DNA, 54 bp, Artificial Sequence
  Description of Artificial Sequence: Synthetic oligonucleotide
atgtattagttaatggtgaaaagagaaatgaatgaactggaaactctattcaag

SEQ ID NO: 254443 - DNA, 53 bp, Artificial Sequence
  Description of Artificial Sequence: Synthetic oligonucleotide
tgtattagttaatggtgaaaagagaaatgaatgaactggaaactctattcaag

SEQ ID NO: 254444 - DNA, 52 bp, Artificial Sequence
  Description of Artificial Sequence: Synthetic oligonucleotide
gtattagttaatggtgaaaagagaaatgaatgaactggaaactctattcaag

SEQ ID NO: 254445 - DNA, 52 bp, Artificial Sequence
  Description of Artificial Sequence: Synthetic oligonucleotide
tattagttaatggtgaaaagagaaatgaatgaactggaaactctattcaagg

SEQ ID NO: 254446 - DNA, 51 bp, Artificial Sequence
  Description of Artificial Sequence: Synthetic oligonucleotide
attagttaatggtgaaaagagaaatgaatgaactggaaactctattcaagg

SEQ ID NO: 254447 - DNA, 50 bp, Artificial Sequence
  Description of Artificial Sequence: Synthetic oligonucleotide
ttagttaatggtgaaaagagaaatgaatgaactggaaactctattcaagg

SEQ ID NO: 254448 - DNA, 49 bp, Artificial Sequence
  Description of Artificial Sequence: Synthetic oligonucleotide
tagttaatggtgaaaagagaaatgaatgaactggaaactctattcaagg

SEQ ID NO: 254449 - DNA, 48 bp, Artificial Sequence
  Description of Artificial Sequence: Synthetic oligonucleotide
agttaatggtgaaaagagaaatgaatgaactggaaactctattcaagg

SEQ ID NO: 254450 - DNA, 47 bp, Artificial Sequence
  Description of Artificial Sequence: Synthetic oligonucleotide
gttaatggtgaaaagagaaatgaatgaactggaaactctattcaagg

SEQ ID NO: 254451 - DNA, 47 bp, Artificial Sequence
  Description of Artificial Sequence: Synthetic oligonucleotide
ttaatggtgaaaagagaaatgaatgaactggaaactctattcaaggc

SEQ ID NO: 254452 - DNA, 46 bp, Artificial Sequence
  Description of Artificial Sequence: Synthetic oligonucleotide
taatggtgaaaagagaaatgaatgaactggaaactctattcaaggc

SEQ ID NO: 254453 - DNA, 45 bp, Artificial Sequence
  Description of Artificial Sequence: Synthetic oligonucleotide
aatggtgaaaagagaaatgaatgaactggaaactctattcaaggc

SEQ ID NO: 254454 - DNA, 44 bp, Artificial Sequence
  Description of Artificial Sequence: Synthetic oligonucleotide
atggtgaaaagagaaatgaatgaactggaaactctattcaaggc

SEQ ID NO: 254455 - DNA, 43 bp, Artificial Sequence
  Description of Artificial Sequence: Synthetic oligonucleotide
tggtgaaaagagaaatgaatgaactggaaactctattcaaggc

SEQ ID NO: 254456 - DNA, 42 bp, Artificial Sequence
  Description of Artificial Sequence: Synthetic oligonucleotide
ggtgaaaagagaaatgaatgaactggaaactctattcaaggc

SEQ ID NO: 254457 - DNA, 42 bp, Artificial Sequence
  Description of Artificial Sequence: Synthetic oligonucleotide
gtgaaaagagaaatgaatgaactggaaactctattcaaggcg

SEQ ID NO: 254458 - DNA, 44 bp, Artificial Sequence
  Description of Artificial Sequence: Synthetic oligonucleotide
tgaaaagagaaatgaatgaactggaaactctattcaaggcgttc

SEQ ID NO: 254459 - DNA, 43 bp, Artificial Sequence
  Description of Artificial Sequence: Synthetic oligonucleotide
gaaaagagaaatgaatgaactggaaactctattcaaggcgttc

SEQ ID NO: 254460 - DNA, 43 bp, Artificial Sequence
  Description of Artificial Sequence: Synthetic oligonucleotide
aaaagagaaatgaatgaactggaaactctattcaaggcgttcc

SEQ ID NO: 254461 - DNA, 42 bp, Artificial Sequence
  Description of Artificial Sequence: Synthetic oligonucleotide
aaagagaaatgaatgaactggaaactctattcaaggcgttcc

SEQ ID NO: 254462 - DNA, 41 bp, Artificial Sequence
  Description of Artificial Sequence: Synthetic oligonucleotide
aagagaaatgaatgaactggaaactctattcaaggcgttcc

SEQ ID NO: 254463 - DNA, 40 bp, Artificial Sequence
  Description of Artificial Sequence: Synthetic oligonucleotide
agagaaatgaatgaactggaaactctattcaaggcgttcc

SEQ ID NO: 254464 - DNA, 39 bp, Artificial Sequence
  Description of Artificial Sequence: Synthetic oligonucleotide
gagaaatgaatgaactggaaactctattcaaggcgttcc

SEQ ID NO: 254465 - DNA, 40 bp, Artificial Sequence
  Description of Artificial Sequence: Synthetic oligonucleotide
agaaatgaatgaactggaaactctattcaaggcgttcctc

SEQ ID NO: 254466 - DNA, 39 bp, Artificial Sequence
  Description of Artificial Sequence: Synthetic oligonucleotide
gaaatgaatgaactggaaactctattcaaggcgttcctc

SEQ ID NO: 254467 - DNA, 41 bp, Artificial Sequence
  Description of Artificial Sequence: Synthetic oligonucleotide
aaatgaatgaactggaaactctattcaaggcgttcctcatc

SEQ ID NO: 254468 - DNA, 40 bp, Artificial Sequence
  Description of Artificial Sequence: Synthetic oligonucleotide
aatgaatgaactggaaactctattcaaggcgttcctcatc

SEQ ID NO: 254469 - DNA, 39 bp, Artificial Sequence
  Description of Artificial Sequence: Synthetic oligonucleotide
atgaatgaactggaaactctattcaaggcgttcctcatc

SEQ ID NO: 254470 - DNA, 38 bp, Artificial Sequence
  Description of Artificial Sequence: Synthetic oligonucleotide
tgaatgaactggaaactctattcaaggcgttcctcatc

SEQ ID NO: 254471 - DNA, 37 bp, Artificial Sequence
  Description of Artificial Sequence: Synthetic oligonucleotide
gaatgaactggaaactctattcaaggcgttcctcatc

SEQ ID NO: 254472 - DNA, 38 bp, Artificial Sequence
  Description of Artificial Sequence: Synthetic oligonucleotide
aatgaactggaaactctattcaaggcgttcctcatctg

SEQ ID NO: 254473 - DNA, 37 bp, Artificial Sequence
  Description of Artificial Sequence: Synthetic oligonucleotide
atgaactggaaactctattcaaggcgttcctcatctg

SEQ ID NO: 254474 - DNA, 36 bp, Artificial Sequence
  Description of Artificial Sequence: Synthetic oligonucleotide
tgaactggaaactctattcaaggcgttcctcatctg

SEQ ID NO: 254475 - DNA, 35 bp, Artificial Sequence
  Description of Artificial Sequence: Synthetic oligonucleotide
gaactggaaactctattcaaggcgttcctcatctg

SEQ ID NO: 254476 - DNA, 35 bp, Artificial Sequence
  Description of Artificial Sequence: Synthetic oligonucleotide
aactggaaactctattcaaggcgttcctcatctgg

SEQ ID NO: 254477 - DNA, 34 bp, Artificial Sequence
  Description of Artificial Sequence: Synthetic oligonucleotide
actggaaactctattcaaggcgttcctcatctgg

SEQ ID NO: 254478 - DNA, 33 bp, Artificial Sequence
  Description of Artificial Sequence: Synthetic oligonucleotide
ctggaaactctattcaaggcgttcctcatctgg

SEQ ID NO: 254479 - DNA, 33 bp, Artificial Sequence
  Description of Artificial Sequence: Synthetic oligonucleotide
tggaaactctattcaaggcgttcctcatctggc

SEQ ID NO: 254480 - DNA, 32 bp, Artificial Sequence
  Description of Artificial Sequence: Synthetic oligonucleotide
ggaaactctattcaaggcgttcctcatctggc

SEQ ID NO: 254481 - DNA, 33 bp, Artificial Sequence
  Description of Artificial Sequence: Synthetic oligonucleotide
gaaactctattcaaggcgttcctcatctggctg

SEQ ID NO: 254482 - DNA, 33 bp, Artificial Sequence
  Description of Artificial Sequence: Synthetic oligonucleotide
aaactctattcaaggcgttcctcatctggctgc

SEQ ID NO: 254483 - DNA, 32 bp, Artificial Sequence
  Description of Artificial Sequence: Synthetic oligonucleotide
aactctattcaaggcgttcctcatctggctgc

SEQ ID NO: 254484 - DNA, 31 bp, Artificial Sequence
  Description of Artificial Sequence: Synthetic oligonucleotide
actctattcaaggcgttcctcatctggctgc

SEQ ID NO: 254485 - DNA, 30 bp, Artificial Sequence
  Description of Artificial Sequence: Synthetic oligonucleotide
ctctattcaaggcgttcctcatctggctgc

SEQ ID NO: 254486 - DNA, 33 bp, Artificial Sequence
  Description of Artificial Sequence: Synthetic oligonucleotide
tctattcaaggcgttcctcatctggctgctaac

SEQ ID NO: 254487 - DNA, 32 bp, Artificial Sequence
  Description of Artificial Sequence: Synthetic oligonucleotide
ctattcaaggcgttcctcatctggctgctaac

SEQ ID NO: 254488 - DNA, 32 bp, Artificial Sequence
  Description of Artificial Sequence: Synthetic oligonucleotide
tattcaaggcgttcctcatctggctgctaacg

SEQ ID NO: 254489 - DNA, 31 bp, Artificial Sequence
  Description of Artificial Sequence: Synthetic oligonucleotide
attcaaggcgttcctcatctggctgctaacg

SEQ ID NO: 254490 - DNA, 30 bp, Artificial Sequence
  Description of Artificial Sequence: Synthetic oligonucleotide
ttcaaggcgttcctcatctggctgctaacg

SEQ ID NO: 254491 - DNA, 29 bp, Artificial Sequence
  Description of Artificial Sequence: Synthetic oligonucleotide
tcaaggcgttcctcatctggctgctaacg

SEQ ID NO: 254492 - DNA, 28 bp, Artificial Sequence
  Description of Artificial Sequence: Synthetic oligonucleotide
caaggcgttcctcatctggctgctaacg

SEQ ID NO: 254493 - DNA, 28 bp, Artificial Sequence
  Description of Artificial Sequence: Synthetic oligonucleotide
aaggcgttcctcatctggctgctaacgg

SEQ ID NO: 254494 - DNA, 27 bp, Artificial Sequence
  Description of Artificial Sequence: Synthetic oligonucleotide
aggcgttcctcatctggctgctaacgg

SEQ ID NO: 254495 - DNA, 27 bp, Artificial Sequence
  Description of Artificial Sequence: Synthetic oligonucleotide
ggcgttcctcatctggctgctaacgga

SEQ ID NO: 254496 - DNA, 27 bp, Artificial Sequence
  Description of Artificial Sequence: Synthetic oligonucleotide
gcgttcctcatctggctgctaacggac

SEQ ID NO: 254497 - DNA, 27 bp, Artificial Sequence
  Description of Artificial Sequence: Synthetic oligonucleotide
cgttcctcatctggctgctaacggacc

SEQ ID NO: 254498 - DNA, 28 bp, Artificial Sequence
  Description of Artificial Sequence: Synthetic oligonucleotide
gttcctcatctggctgctaacggacctc

SEQ ID NO: 254499 - DNA, 31 bp, Artificial Sequence
  Description of Artificial Sequence: Synthetic oligonucleotide
ttcctcatctggctgctaacggacctcatag

SEQ ID NO: 254500 - DNA, 30 bp, Artificial Sequence
  Description of Artificial Sequence: Synthetic oligonucleotide
tcctcatctggctgctaacggacctcatag

SEQ ID NO: 254501 - DNA, 29 bp, Artificial Sequence
  Description of Artificial Sequence: Synthetic oligonucleotide
cctcatctggctgctaacggacctcatag

SEQ ID NO: 254502 - DNA, 33 bp, Artificial Sequence
  Description of Artificial Sequence: Synthetic oligonucleotide
ctcatctggctgctaacggacctcatagataag

SEQ ID NO: 254503 - DNA, 33 bp, Artificial Sequence
  Description of Artificial Sequence: Synthetic oligonucleotide
tcatctggctgctaacggacctcatagataagc

SEQ ID NO: 254504 - DNA, 32 bp, Artificial Sequence
  Description of Artificial Sequence: Synthetic oligonucleotide
catctggctgctaacggacctcatagataagc

SEQ ID NO: 254505 - DNA, 33 bp, Artificial Sequence
  Description of Artificial Sequence: Synthetic oligonucleotide
atctggctgctaacggacctcatagataagcag

SEQ ID NO: 254506 - DNA, 32 bp, Artificial Sequence
  Description of Artificial Sequence: Synthetic oligonucleotide
tctggctgctaacggacctcatagataagcag

SEQ ID NO: 254507 - DNA, 31 bp, Artificial Sequence
  Description of Artificial Sequence: Synthetic oligonucleotide
ctggctgctaacggacctcatagataagcag

SEQ ID NO: 254508 - DNA, 32 bp, Artificial Sequence
  Description of Artificial Sequence: Synthetic oligonucleotide
tggctgctaacggacctcatagataagcagtc

SEQ ID NO: 254509 - DNA, 31 bp, Artificial Sequence
  Description of Artificial Sequence: Synthetic oligonucleotide
ggctgctaacggacctcatagataagcagtc

SEQ ID NO: 254510 - DNA, 33 bp, Artificial Sequence
  Description of Artificial Sequence: Synthetic oligonucleotide
gctgctaacggacctcatagataagcagtcatg

SEQ ID NO: 254511 - DNA, 33 bp, Artificial Sequence
  Description of Artificial Sequence: Synthetic oligonucleotide
ctgctaacggacctcatagataagcagtcatgg

SEQ ID NO: 254512 - DNA, 34 bp, Artificial Sequence
  Description of Artificial Sequence: Synthetic oligonucleotide
tgctaacggacctcatagataagcagtcatggac

SEQ ID NO: 254513 - DNA, 33 bp, Artificial Sequence
  Description of Artificial Sequence: Synthetic oligonucleotide
gctaacggacctcatagataagcagtcatggac

SEQ ID NO: 254514 - DNA, 34 bp, Artificial Sequence
  Description of Artificial Sequence: Synthetic oligonucleotide
ctaacggacctcatagataagcagtcatggacag

SEQ ID NO: 254515 - DNA, 35 bp, Artificial Sequence
  Description of Artificial Sequence: Synthetic oligonucleotide
taacggacctcatagataagcagtcatggacagtc

SEQ ID NO: 254516 - DNA, 34 bp, Artificial Sequence
  Description of Artificial Sequence: Synthetic oligonucleotide
aacggacctcatagataagcagtcatggacagtc

SEQ ID NO: 254517 - DNA, 33 bp, Artificial Sequence
  Description of Artificial Sequence: Synthetic oligonucleotide
acggacctcatagataagcagtcatggacagtc

SEQ ID NO: 254518 - DNA, 32 bp, Artificial Sequence
  Description of Artificial Sequence: Synthetic oligonucleotide
cggacctcatagataagcagtcatggacagtc

SEQ ID NO: 254519 - DNA, 32 bp, Artificial Sequence
  Description of Artificial Sequence: Synthetic oligonucleotide
ggacctcatagataagcagtcatggacagtcg

SEQ ID NO: 254520 - DNA, 33 bp, Artificial Sequence
  Description of Artificial Sequence: Synthetic oligonucleotide
gacctcatagataagcagtcatggacagtcgag

SEQ ID NO: 254521 - DNA, 33 bp, Artificial Sequence
  Description of Artificial Sequence: Synthetic oligonucleotide
acctcatagataagcagtcatggacagtcgagg

SEQ ID NO: 254522 - DNA, 32 bp, Artificial Sequence
  Description of Artificial Sequence: Synthetic oligonucleotide
cctcatagataagcagtcatggacagtcgagg

SEQ ID NO: 254523 - DNA, 32 bp, Artificial Sequence
  Description of Artificial Sequence: Synthetic oligonucleotide
ctcatagataagcagtcatggacagtcgaggg

SEQ ID NO: 254524 - DNA, 32 bp, Artificial Sequence
  Description of Artificial Sequence: Synthetic oligonucleotide
tcatagataagcagtcatggacagtcgagggc

SEQ ID NO: 254525 - DNA, 31 bp, Artificial Sequence
  Description of Artificial Sequence: Synthetic oligonucleotide
catagataagcagtcatggacagtcgagggc

SEQ ID NO: 254526 - DNA, 32 bp, Artificial Sequence
  Description of Artificial Sequence: Synthetic oligonucleotide
atagataagcagtcatggacagtcgagggctc

SEQ ID NO: 254527 - DNA, 31 bp, Artificial Sequence
  Description of Artificial Sequence: Synthetic oligonucleotide
tagataagcagtcatggacagtcgagggctc

SEQ ID NO: 254528 - DNA, 30 bp, Artificial Sequence
  Description of Artificial Sequence: Synthetic oligonucleotide
agataagcagtcatggacagtcgagggctc

SEQ ID NO: 254529 - DNA, 29 bp, Artificial Sequence
  Description of Artificial Sequence: Synthetic oligonucleotide
gataagcagtcatggacagtcgagggctc

SEQ ID NO: 254530 - DNA, 30 bp, Artificial Sequence
  Description of Artificial Sequence: Synthetic oligonucleotide
ataagcagtcatggacagtcgagggctctg

SEQ ID NO: 254531 - DNA, 29 bp, Artificial Sequence
  Description of Artificial Sequence: Synthetic oligonucleotide
taagcagtcatggacagtcgagggctctg

SEQ ID NO: 254532 - DNA, 28 bp, Artificial Sequence
  Description of Artificial Sequence: Synthetic oligonucleotide
aagcagtcatggacagtcgagggctctg

SEQ ID NO: 254533 - DNA, 27 bp, Artificial Sequence
  Description of Artificial Sequence: Synthetic oligonucleotide
agcagtcatggacagtcgagggctctg

SEQ ID NO: 254534 - DNA, 27 bp, Artificial Sequence
  Description of Artificial Sequence: Synthetic oligonucleotide
gcagtcatggacagtcgagggctctgt

SEQ ID NO: 254535 - DNA, 27 bp, Artificial Sequence
  Description of Artificial Sequence: Synthetic oligonucleotide
cagtcatggacagtcgagggctctgtc

SEQ ID NO: 254536 - DNA, 28 bp, Artificial Sequence
  Description of Artificial Sequence: Synthetic oligonucleotide
agtcatggacagtcgagggctctgtctc

SEQ ID NO: 254537 - DNA, 27 bp, Artificial Sequence
  Description of Artificial Sequence: Synthetic oligonucleotide
gtcatggacagtcgagggctctgtctc

SEQ ID NO: 254538 - DNA, 28 bp, Artificial Sequence
  Description of Artificial Sequence: Synthetic oligonucleotide
tcatggacagtcgagggctctgtctcag

SEQ ID NO: 254539 - DNA, 27 bp, Artificial Sequence
  Description of Artificial Sequence: Synthetic oligonucleotide
catggacagtcgagggctctgtctcag

SEQ ID NO: 254540 - DNA, 28 bp, Artificial Sequence
  Description of Artificial Sequence: Synthetic oligonucleotide
atggacagtcgagggctctgtctcagag

SEQ ID NO: 254541 - DNA, 27 bp, Artificial Sequence
  Description of Artificial Sequence: Synthetic oligonucleotide
tggacagtcgagggctctgtctcagag

SEQ ID NO: 254542 - DNA, 26 bp, Artificial Sequence
  Description of Artificial Sequence: Synthetic oligonucleotide
ggacagtcgagggctctgtctcagag

SEQ ID NO: 254543 - DNA, 26 bp, Artificial Sequence
  Description of Artificial Sequence: Synthetic oligonucleotide
gacagtcgagggctctgtctcagagg

SEQ ID NO: 254544 - DNA, 27 bp, Artificial Sequence
  Description of Artificial Sequence: Synthetic oligonucleotide
acagtcgagggctctgtctcagaggga

SEQ ID NO: 254545 - DNA, 27 bp, Artificial Sequence
  Description of Artificial Sequence: Synthetic oligonucleotide
cagtcgagggctctgtctcagagggaa

SEQ ID NO: 254546 - DNA, 28 bp, Artificial Sequence
  Description of Artificial Sequence: Synthetic oligonucleotide
agtcgagggctctgtctcagagggaatg

SEQ ID NO: 254547 - DNA, 27 bp, Artificial Sequence
  Description of Artificial Sequence: Synthetic oligonucleotide
gtcgagggctctgtctcagagggaatg

SEQ ID NO: 254548 - DNA, 27 bp, Artificial Sequence
  Description of Artificial Sequence: Synthetic oligonucleotide
tcgagggctctgtctcagagggaatgc

SEQ ID NO: 254549 - DNA, 27 bp, Artificial Sequence
  Description of Artificial Sequence: Synthetic oligonucleotide
cgagggctctgtctcagagggaatgct

SEQ ID NO: 254550 - DNA, 27 bp, Artificial Sequence
  Description of Artificial Sequence: Synthetic oligonucleotide
gagggctctgtctcagagggaatgctg

SEQ ID NO: 254551 - DNA, 27 bp, Artificial Sequence
  Description of Artificial Sequence: Synthetic oligonucleotide
agggctctgtctcagagggaatgctgc

SEQ ID NO: 254552 - DNA, 26 bp, Artificial Sequence
  Description of Artificial Sequence: Synthetic oligonucleotide
gggctctgtctcagagggaatgctgc

SEQ ID NO: 254553 - DNA, 26 bp, Artificial Sequence
  Description of Artificial Sequence: Synthetic oligonucleotide
ggctctgtctcagagggaatgctgcc

SEQ ID NO: 254554 - DNA, 27 bp, Artificial Sequence
  Description of Artificial Sequence: Synthetic oligonucleotide
gctctgtctcagagggaatgctgccga

SEQ ID NO: 254555 - DNA, 27 bp, Artificial Sequence
  Description of Artificial Sequence: Synthetic oligonucleotide
ctctgtctcagagggaatgctgccgag

SEQ ID NO: 254556 - DNA, 28 bp, Artificial Sequence
  Description of Artificial Sequence: Synthetic oligonucleotide
tctgtctcagagggaatgctgccgagtc

SEQ ID NO: 254557 - DNA, 27 bp, Artificial Sequence
  Description of Artificial Sequence: Synthetic oligonucleotide
ctgtctcagagggaatgctgccgagtc

SEQ ID NO: 254558 - DNA, 29 bp, Artificial Sequence
  Description of Artificial Sequence: Synthetic oligonucleotide
tgtctcagagggaatgctgccgagtcaac

SEQ ID NO: 254559 - DNA, 28 bp, Artificial Sequence
  Description of Artificial Sequence: Synthetic oligonucleotide
gtctcagagggaatgctgccgagtcaac

SEQ ID NO: 254560 - DNA, 30 bp, Artificial Sequence
  Description of Artificial Sequence: Synthetic oligonucleotide
tctcagagggaatgctgccgagtcaacttc

SEQ ID NO: 254561 - DNA, 29 bp, Artificial Sequence
  Description of Artificial Sequence: Synthetic oligonucleotide
ctcagagggaatgctgccgagtcaacttc

SEQ ID NO: 254562 - DNA, 31 bp, Artificial Sequence
  Description of Artificial Sequence: Synthetic oligonucleotide
tcagagggaatgctgccgagtcaacttctac

SEQ ID NO: 254563 - DNA, 30 bp, Artificial Sequence
  Description of Artificial Sequence: Synthetic oligonucleotide
cagagggaatgctgccgagtcaacttctac

SEQ ID NO: 254564 - DNA, 31 bp, Artificial Sequence
  Description of Artificial Sequence: Synthetic oligonucleotide
agagggaatgctgccgagtcaacttctactc

SEQ ID NO: 254565 - DNA, 30 bp, Artificial Sequence
  Description of Artificial Sequence: Synthetic oligonucleotide
gagggaatgctgccgagtcaacttctactc

SEQ ID NO: 254566 - DNA, 30 bp, Artificial Sequence
  Description of Artificial Sequence: Synthetic oligonucleotide
agggaatgctgccgagtcaacttctactcc

SEQ ID NO: 254567 - DNA, 29 bp, Artificial Sequence
  Description of Artificial Sequence: Synthetic oligonucleotide
gggaatgctgccgagtcaacttctactcc

SEQ ID NO: 254568 - DNA, 30 bp, Artificial Sequence
  Description of Artificial Sequence: Synthetic oligonucleotide
ggaatgctgccgagtcaacttctactcctc

SEQ ID NO: 254569 - DNA, 30 bp, Artificial Sequence
  Description of Artificial Sequence: Synthetic oligonucleotide
gaatgctgccgagtcaacttctactcctcc

SEQ ID NO: 254570 - DNA, 30 bp, Artificial Sequence
  Description of Artificial Sequence: Synthetic oligonucleotide
aatgctgccgagtcaacttctactcctccc

SEQ ID NO: 254571 - DNA, 29 bp, Artificial Sequence
  Description of Artificial Sequence: Synthetic oligonucleotide
atgctgccgagtcaacttctactcctccc

SEQ ID NO: 254572 - DNA, 28 bp, Artificial Sequence
  Description of Artificial Sequence: Synthetic oligonucleotide
tgctgccgagtcaacttctactcctccc

SEQ ID NO: 254573 - DNA, 27 bp, Artificial Sequence
  Description of Artificial Sequence: Synthetic oligonucleotide
gctgccgagtcaacttctactcctccc

SEQ ID NO: 254574 - DNA, 27 bp, Artificial Sequence
  Description of Artificial Sequence: Synthetic oligonucleotide
ctgccgagtcaacttctactcctcccc

SEQ ID NO: 254575 - DNA, 28 bp, Artificial Sequence
  Description of Artificial Sequence: Synthetic oligonucleotide
tgccgagtcaacttctactcctcccctg

SEQ ID NO: 254576 - DNA, 27 bp, Artificial Sequence
  Description of Artificial Sequence: Synthetic oligonucleotide
gccgagtcaacttctactcctcccctg

SEQ ID NO: 254577 - DNA, 28 bp, Artificial Sequence
  Description of Artificial Sequence: Synthetic oligonucleotide
ccgagtcaacttctactcctcccctgtg

SEQ ID NO: 254578 - DNA, 29 bp, Artificial Sequence
  Description of Artificial Sequence: Synthetic oligonucleotide
cgagtcaacttctactcctcccctgtgtg

SEQ ID NO: 254579 - DNA, 29 bp, Artificial Sequence
  Description of Artificial Sequence: Synthetic oligonucleotide
gagtcaacttctactcctcccctgtgtgc

SEQ ID NO: 254580 - DNA, 30 bp, Artificial Sequence
  Description of Artificial Sequence: Synthetic oligonucleotide
agtcaacttctactcctcccctgtgtgctc

SEQ ID NO: 254581 - DNA, 29 bp, Artificial Sequence
  Description of Artificial Sequence: Synthetic oligonucleotide
gtcaacttctactcctcccctgtgtgctc

SEQ ID NO: 254582 - DNA, 31 bp, Artificial Sequence
  Description of Artificial Sequence: Synthetic oligonucleotide
tcaacttctactcctcccctgtgtgctcaac

SEQ ID NO: 254583 - DNA, 30 bp, Artificial Sequence
  Description of Artificial Sequence: Synthetic oligonucleotide
caacttctactcctcccctgtgtgctcaac

SEQ ID NO: 254584 - DNA, 33 bp, Artificial Sequence
  Description of Artificial Sequence: Synthetic oligonucleotide
aacttctactcctcccctgtgtgctcaactatc

SEQ ID NO: 254585 - DNA, 32 bp, Artificial Sequence
  Description of Artificial Sequence: Synthetic oligonucleotide
acttctactcctcccctgtgtgctcaactatc

SEQ ID NO: 254586 - DNA, 31 bp, Artificial Sequence
  Description of Artificial Sequence: Synthetic oligonucleotide
cttctactcctcccctgtgtgctcaactatc

SEQ ID NO: 254587 - DNA, 32 bp, Artificial Sequence
  Description of Artificial Sequence: Synthetic oligonucleotide
ttctactcctcccctgtgtgctcaactatcac

SEQ ID NO: 254588 - DNA, 31 bp, Artificial Sequence
  Description of Artificial Sequence: Synthetic oligonucleotide
tctactcctcccctgtgtgctcaactatcac

SEQ ID NO: 254589 - DNA, 30 bp, Artificial Sequence
  Description of Artificial Sequence: Synthetic oligonucleotide
ctactcctcccctgtgtgctcaactatcac

SEQ ID NO: 254590 - DNA, 30 bp, Artificial Sequence
  Description of Artificial Sequence: Synthetic oligonucleotide
tactcctcccctgtgtgctcaactatcacc

SEQ ID NO: 254591 - DNA, 29 bp, Artificial Sequence
  Description of Artificial Sequence: Synthetic oligonucleotide
actcctcccctgtgtgctcaactatcacc

SEQ ID NO: 254592 - DNA, 28 bp, Artificial Sequence
  Description of Artificial Sequence: Synthetic oligonucleotide
ctcctcccctgtgtgctcaactatcacc

SEQ ID NO: 254593 - DNA, 28 bp, Artificial Sequence
  Description of Artificial Sequence: Synthetic oligonucleotide
tcctcccctgtgtgctcaactatcaccc

SEQ ID NO: 254594 - DNA, 27 bp, Artificial Sequence
  Description of Artificial Sequence: Synthetic oligonucleotide
cctcccctgtgtgctcaactatcaccc

SEQ ID NO: 254595 - DNA, 27 bp, Artificial Sequence
  Description of Artificial Sequence: Synthetic oligonucleotide
ctcccctgtgtgctcaactatcacccg

SEQ ID NO: 254596 - DNA, 28 bp, Artificial Sequence
  Description of Artificial Sequence: Synthetic oligonucleotide
tcccctgtgtgctcaactatcacccgtg

SEQ ID NO: 254597 - DNA, 27 bp, Artificial Sequence
  Description of Artificial Sequence: Synthetic oligonucleotide
cccctgtgtgctcaactatcacccgtg

SEQ ID NO: 254598 - DNA, 27 bp, Artificial Sequence
  Description of Artificial Sequence: Synthetic oligonucleotide
ccctgtgtgctcaactatcacccgtgc

SEQ ID NO: 254599 - DNA, 27 bp, Artificial Sequence
  Description of Artificial Sequence: Synthetic oligonucleotide
cctgtgtgctcaactatcacccgtgcg

SEQ ID NO: 254600 - DNA, 29 bp, Artificial Sequence
  Description of Artificial Sequence: Synthetic oligonucleotide
ctgtgtgctcaactatcacccgtgcgtag

SEQ ID NO: 254601 - DNA, 30 bp, Artificial Sequence
  Description of Artificial Sequence: Synthetic oligonucleotide
tgtgtgctcaactatcacccgtgcgtagag

SEQ ID NO: 254602 - DNA, 29 bp, Artificial Sequence
  Description of Artificial Sequence: Synthetic oligonucleotide
gtgtgctcaactatcacccgtgcgtagag

SEQ ID NO: 254603 - DNA, 30 bp, Artificial Sequence
  Description of Artificial Sequence: Synthetic oligonucleotide
tgtgctcaactatcacccgtgcgtagagag

SEQ ID NO: 254604 - DNA, 29 bp, Artificial Sequence
  Description of Artificial Sequence: Synthetic oligonucleotide
gtgctcaactatcacccgtgcgtagagag

SEQ ID NO: 254605 - DNA, 29 bp, Artificial Sequence
  Description of Artificial Sequence: Synthetic oligonucleotide
tgctcaactatcacccgtgcgtagagagg

SEQ ID NO: 254606 - DNA, 28 bp, Artificial Sequence
  Description of Artificial Sequence: Synthetic oligonucleotide
gctcaactatcacccgtgcgtagagagg

SEQ ID NO: 254607 - DNA, 28 bp, Artificial Sequence
  Description of Artificial Sequence: Synthetic oligonucleotide
ctcaactatcacccgtgcgtagagaggg

SEQ ID NO: 254608 - DNA, 28 bp, Artificial Sequence
  Description of Artificial Sequence: Synthetic oligonucleotide
tcaactatcacccgtgcgtagagagggc

SEQ ID NO: 254609 - DNA, 27 bp, Artificial Sequence
  Description of Artificial Sequence: Synthetic oligonucleotide
caactatcacccgtgcgtagagagggc

SEQ ID NO: 254610 - DNA, 28 bp, Artificial Sequence
  Description of Artificial Sequence: Synthetic oligonucleotide
aactatcacccgtgcgtagagagggcag

SEQ ID NO: 254611 - DNA, 27 bp, Artificial Sequence
  Description of Artificial Sequence: Synthetic oligonucleotide
actatcacccgtgcgtagagagggcag

SEQ ID NO: 254612 - DNA, 27 bp, Artificial Sequence
  Description of Artificial Sequence: Synthetic oligonucleotide
ctatcacccgtgcgtagagagggcagt

SEQ ID NO: 254613 - DNA, 28 bp, Artificial Sequence
  Description of Artificial Sequence: Synthetic oligonucleotide
tatcacccgtgcgtagagagggcagtag

SEQ ID NO: 254614 - DNA, 27 bp, Artificial Sequence
  Description of Artificial Sequence: Synthetic oligonucleotide
atcacccgtgcgtagagagggcagtag

SEQ ID NO: 254615 - DNA, 26 bp, Artificial Sequence
  Description of Artificial Sequence: Synthetic oligonucleotide
tcacccgtgcgtagagagggcagtag

SEQ ID NO: 254616 - DNA, 25 bp, Artificial Sequence
  Description of Artificial Sequence: Synthetic oligonucleotide
cacccgtgcgtagagagggcagtag

SEQ ID NO: 254617 - DNA, 25 bp, Artificial Sequence
  Description of Artificial Sequence: Synthetic oligonucleotide
acccgtgcgtagagagggcagtagg

SEQ ID NO: 254618 - DNA, 24 bp, Artificial Sequence
  Description of Artificial Sequence: Synthetic oligonucleotide
cccgtgcgtagagagggcagtagg

SEQ ID NO: 254619 - DNA, 27 bp, Artificial Sequence
  Description of Artificial Sequence: Synthetic oligonucleotide
ccgtgcgtagagagggcagtaggctat

SEQ ID NO: 254620 - DNA, 29 bp, Artificial Sequence
  Description of Artificial Sequence: Synthetic oligonucleotide
cgtgcgtagagagggcagtaggctatttg

SEQ ID NO: 254621 - DNA, 30 bp, Artificial Sequence
  Description of Artificial Sequence: Synthetic oligonucleotide
gtgcgtagagagggcagtaggctatttgag

SEQ ID NO: 254622 - DNA, 33 bp, Artificial Sequence
  Description of Artificial Sequence: Synthetic oligonucleotide
tgcgtagagagggcagtaggctatttgagaaag

SEQ ID NO: 254623 - DNA, 32 bp, Artificial Sequence
  Description of Artificial Sequence: Synthetic oligonucleotide
gcgtagagagggcagtaggctatttgagaaag

SEQ ID NO: 254624 - DNA, 33 bp, Artificial Sequence
  Description of Artificial Sequence: Synthetic oligonucleotide
cgtagagagggcagtaggctatttgagaaagtg

SEQ ID NO: 254625 - DNA, 33 bp, Artificial Sequence
  Description of Artificial Sequence: Synthetic oligonucleotide
gtagagagggcagtaggctatttgagaaagtgg

SEQ ID NO: 254626 - DNA, 35 bp, Artificial Sequence
  Description of Artificial Sequence: Synthetic oligonucleotide
tagagagggcagtaggctatttgagaaagtggtag

SEQ ID NO: 254627 - DNA, 34 bp, Artificial Sequence
  Description of Artificial Sequence: Synthetic oligonucleotide
agagagggcagtaggctatttgagaaagtggtag

SEQ ID NO: 254628 - DNA, 33 bp, Artificial Sequence
  Description of Artificial Sequence: Synthetic oligonucleotide
gagagggcagtaggctatttgagaaagtggtag

SEQ ID NO: 254629 - DNA, 33 bp, Artificial Sequence
  Description of Artificial Sequence: Synthetic oligonucleotide
agagggcagtaggctatttgagaaagtggtagg

SEQ ID NO: 254630 - DNA, 32 bp, Artificial Sequence
  Description of Artificial Sequence: Synthetic oligonucleotide
gagggcagtaggctatttgagaaagtggtagg

SEQ ID NO: 254631 - DNA, 35 bp, Artificial Sequence
  Description of Artificial Sequence: Synthetic oligonucleotide
agggcagtaggctatttgagaaagtggtaggaatc

SEQ ID NO: 254632 - DNA, 34 bp, Artificial Sequence
  Description of Artificial Sequence: Synthetic oligonucleotide
gggcagtaggctatttgagaaagtggtaggaatc

SEQ ID NO: 254633 - DNA, 34 bp, Artificial Sequence
  Description of Artificial Sequence: Synthetic oligonucleotide
ggcagtaggctatttgagaaagtggtaggaatcc

SEQ ID NO: 254634 - DNA, 37 bp, Artificial Sequence
  Description of Artificial Sequence: Synthetic oligonucleotide
gcagtaggctatttgagaaagtggtaggaatccattg

SEQ ID NO: 254635 - DNA, 37 bp, Artificial Sequence
  Description of Artificial Sequence: Synthetic oligonucleotide
cagtaggctatttgagaaagtggtaggaatccattgg

SEQ ID NO: 254636 - DNA, 40 bp, Artificial Sequence
  Description of Artificial Sequence: Synthetic oligonucleotide
agtaggctatttgagaaagtggtaggaatccattggaaac

SEQ ID NO: 254637 - DNA, 39 bp, Artificial Sequence
  Description of Artificial Sequence: Synthetic oligonucleotide
gtaggctatttgagaaagtggtaggaatccattggaaac

SEQ ID NO: 254638 - DNA, 41 bp, Artificial Sequence
  Description of Artificial Sequence: Synthetic oligonucleotide
taggctatttgagaaagtggtaggaatccattggaaacttc

SEQ ID NO: 254639 - DNA, 40 bp, Artificial Sequence
  Description of Artificial Sequence: Synthetic oligonucleotide
aggctatttgagaaagtggtaggaatccattggaaacttc

SEQ ID NO: 254640 - DNA, 39 bp, Artificial Sequence
  Description of Artificial Sequence: Synthetic oligonucleotide
ggctatttgagaaagtggtaggaatccattggaaacttc

SEQ ID NO: 254641 - DNA, 40 bp, Artificial Sequence
  Description of Artificial Sequence: Synthetic oligonucleotide
gctatttgagaaagtggtaggaatccattggaaacttcag

SEQ ID NO: 254642 - DNA, 40 bp, Artificial Sequence
  Description of Artificial Sequence: Synthetic oligonucleotide
ctatttgagaaagtggtaggaatccattggaaacttcagc

SEQ ID NO: 254643 - DNA, 40 bp, Artificial Sequence
  Description of Artificial Sequence: Synthetic oligonucleotide
tatttgagaaagtggtaggaatccattggaaacttcagcc

SEQ ID NO: 254644 - DNA, 39 bp, Artificial Sequence
  Description of Artificial Sequence: Synthetic oligonucleotide
atttgagaaagtggtaggaatccattggaaacttcagcc

SEQ ID NO: 254645 - DNA, 38 bp, Artificial Sequence
  Description of Artificial Sequence: Synthetic oligonucleotide
tttgagaaagtggtaggaatccattggaaacttcagcc

SEQ ID NO: 254646 - DNA, 37 bp, Artificial Sequence
  Description of Artificial Sequence: Synthetic oligonucleotide
ttgagaaagtggtaggaatccattggaaacttcagcc

SEQ ID NO: 254647 - DNA, 36 bp, Artificial Sequence
  Description of Artificial Sequence: Synthetic oligonucleotide
tgagaaagtggtaggaatccattggaaacttcagcc

SEQ ID NO: 254648 - DNA, 35 bp, Artificial Sequence
  Description of Artificial Sequence: Synthetic oligonucleotide
gagaaagtggtaggaatccattggaaacttcagcc

SEQ ID NO: 254649 - DNA, 36 bp, Artificial Sequence
  Description of Artificial Sequence: Synthetic oligonucleotide
agaaagtggtaggaatccattggaaacttcagcctg

SEQ ID NO: 254650 - DNA, 35 bp, Artificial Sequence
  Description of Artificial Sequence: Synthetic oligonucleotide
gaaagtggtaggaatccattggaaacttcagcctg

SEQ ID NO: 254651 - DNA, 35 bp, Artificial Sequence
  Description of Artificial Sequence: Synthetic oligonucleotide
aaagtggtaggaatccattggaaacttcagcctgc

SEQ ID NO: 254652 - DNA, 34 bp, Artificial Sequence
  Description of Artificial Sequence: Synthetic oligonucleotide
aagtggtaggaatccattggaaacttcagcctgc

SEQ ID NO: 254653 - DNA, 33 bp, Artificial Sequence
  Description of Artificial Sequence: Synthetic oligonucleotide
agtggtaggaatccattggaaacttcagcctgc

SEQ ID NO: 254654 - DNA, 32 bp, Artificial Sequence
  Description of Artificial Sequence: Synthetic oligonucleotide
gtggtaggaatccattggaaacttcagcctgc

SEQ ID NO: 254655 - DNA, 32 bp, Artificial Sequence
  Description of Artificial Sequence: Synthetic oligonucleotide
tggtaggaatccattggaaacttcagcctgcc

SEQ ID NO: 254656 - DNA, 31 bp, Artificial Sequence
  Description of Artificial Sequence: Synthetic oligonucleotide
ggtaggaatccattggaaacttcagcctgcc

SEQ ID NO: 254657 - DNA, 32 bp, Artificial Sequence
  Description of Artificial Sequence: Synthetic oligonucleotide
gtaggaatccattggaaacttcagcctgcctc

SEQ ID NO: 254658 - DNA, 33 bp, Artificial Sequence
  Description of Artificial Sequence: Synthetic oligonucleotide
taggaatccattggaaacttcagcctgcctctc

SEQ ID NO: 254659 - DNA, 32 bp, Artificial Sequence
  Description of Artificial Sequence: Synthetic oligonucleotide
aggaatccattggaaacttcagcctgcctctc

SEQ ID NO: 254660 - DNA, 31 bp, Artificial Sequence
  Description of Artificial Sequence: Synthetic oligonucleotide
ggaatccattggaaacttcagcctgcctctc

SEQ ID NO: 254661 - DNA, 31 bp, Artificial Sequence
  Description of Artificial Sequence: Synthetic oligonucleotide
gaatccattggaaacttcagcctgcctctcg

SEQ ID NO: 254662 - DNA, 32 bp, Artificial Sequence
  Description of Artificial Sequence: Synthetic oligonucleotide
aatccattggaaacttcagcctgcctctcgac

SEQ ID NO: 254663 - DNA, 31 bp, Artificial Sequence
  Description of Artificial Sequence: Synthetic oligonucleotide
atccattggaaacttcagcctgcctctcgac

SEQ ID NO: 254664 - DNA, 30 bp, Artificial Sequence
  Description of Artificial Sequence: Synthetic oligonucleotide
tccattggaaacttcagcctgcctctcgac

SEQ ID NO: 254665 - DNA, 29 bp, Artificial Sequence
  Description of Artificial Sequence: Synthetic oligonucleotide
ccattggaaacttcagcctgcctctcgac

SEQ ID NO: 254666 - DNA, 29 bp, Artificial Sequence
  Description of Artificial Sequence: Synthetic oligonucleotide
cattggaaacttcagcctgcctctcgacg

SEQ ID NO: 254667 - DNA, 30 bp, Artificial Sequence
  Description of Artificial Sequence: Synthetic oligonucleotide
attggaaacttcagcctgcctctcgacgtg

SEQ ID NO: 254668 - DNA, 29 bp, Artificial Sequence
  Description of Artificial Sequence: Synthetic oligonucleotide
ttggaaacttcagcctgcctctcgacgtg

SEQ ID NO: 254669 - DNA, 28 bp, Artificial Sequence
  Description of Artificial Sequence: Synthetic oligonucleotide
tggaaacttcagcctgcctctcgacgtg

SEQ ID NO: 254670 - DNA, 27 bp, Artificial Sequence
  Description of Artificial Sequence: Synthetic oligonucleotide
ggaaacttcagcctgcctctcgacgtg

SEQ ID NO: 254671 - DNA, 28 bp, Artificial Sequence
  Description of Artificial Sequence: Synthetic oligonucleotide
gaaacttcagcctgcctctcgacgtgag

SEQ ID NO: 254672 - DNA, 28 bp, Artificial Sequence
  Description of Artificial Sequence: Synthetic oligonucleotide
aaacttcagcctgcctctcgacgtgagc

SEQ ID NO: 254673 - DNA, 27 bp, Artificial Sequence
  Description of Artificial Sequence: Synthetic oligonucleotide
aacttcagcctgcctctcgacgtgagc

SEQ ID NO: 254674 - DNA, 27 bp, Artificial Sequence
  Description of Artificial Sequence: Synthetic oligonucleotide
acttcagcctgcctctcgacgtgagct

SEQ ID NO: 254675 - DNA, 27 bp, Artificial Sequence
  Description of Artificial Sequence: Synthetic oligonucleotide
cttcagcctgcctctcgacgtgagctt

SEQ ID NO: 254676 - DNA, 27 bp, Artificial Sequence
  Description of Artificial Sequence: Synthetic oligonucleotide
ttcagcctgcctctcgacgtgagcttg

SEQ ID NO: 254677 - DNA, 26 bp, Artificial Sequence
  Description of Artificial Sequence: Synthetic oligonucleotide
tcagcctgcctctcgacgtgagcttg

SEQ ID NO: 254678 - DNA, 25 bp, Artificial Sequence
  Description of Artificial Sequence: Synthetic oligonucleotide
cagcctgcctctcgacgtgagcttg

SEQ ID NO: 254679 - DNA, 25 bp, Artificial Sequence
  Description of Artificial Sequence: Synthetic oligonucleotide
agcctgcctctcgacgtgagcttgg

SEQ ID NO: 254680 - DNA, 24 bp, Artificial Sequence
  Description of Artificial Sequence: Synthetic oligonucleotide
gcctgcctctcgacgtgagcttgg

SEQ ID NO: 254681 - DNA, 25 bp, Artificial Sequence
  Description of Artificial Sequence: Synthetic oligonucleotide
cctgcctctcgacgtgagcttggca

SEQ ID NO: 254682 - DNA, 26 bp, Artificial Sequence
  Description of Artificial Sequence: Synthetic oligonucleotide
ctgcctctcgacgtgagcttggcagt

SEQ ID NO: 254683 - DNA, 27 bp, Artificial Sequence
  Description of Artificial Sequence: Synthetic oligonucleotide
tgcctctcgacgtgagcttggcagtct

SEQ ID NO: 254684 - DNA, 27 bp, Artificial Sequence
  Description of Artificial Sequence: Synthetic oligonucleotide
gcctctcgacgtgagcttggcagtctt

SEQ ID NO: 254685 - DNA, 28 bp, Artificial Sequence
  Description of Artificial Sequence: Synthetic oligonucleotide
cctctcgacgtgagcttggcagtctttg

SEQ ID NO: 254686 - DNA, 28 bp, Artificial Sequence
  Description of Artificial Sequence: Synthetic oligonucleotide
ctctcgacgtgagcttggcagtctttgc

SEQ ID NO: 254687 - DNA, 29 bp, Artificial Sequence
  Description of Artificial Sequence: Synthetic oligonucleotide
tctcgacgtgagcttggcagtctttgctg

SEQ ID NO: 254688 - DNA, 28 bp, Artificial Sequence
  Description of Artificial Sequence: Synthetic oligonucleotide
ctcgacgtgagcttggcagtctttgctg

SEQ ID NO: 254689 - DNA, 29 bp, Artificial Sequence
  Description of Artificial Sequence: Synthetic oligonucleotide
tcgacgtgagcttggcagtctttgctgtg

SEQ ID NO: 254690 - DNA, 28 bp, Artificial Sequence
  Description of Artificial Sequence: Synthetic oligonucleotide
cgacgtgagcttggcagtctttgctgtg

SEQ ID NO: 254691 - DNA, 28 bp, Artificial Sequence
  Description of Artificial Sequence: Synthetic oligonucleotide
gacgtgagcttggcagtctttgctgtgc

SEQ ID NO: 254692 - DNA, 28 bp, Artificial Sequence
  Description of Artificial Sequence: Synthetic oligonucleotide
acgtgagcttggcagtctttgctgtgcg

SEQ ID NO: 254693 - DNA, 27 bp, Artificial Sequence
  Description of Artificial Sequence: Synthetic oligonucleotide
cgtgagcttggcagtctttgctgtgcg

SEQ ID NO: 254694 - DNA, 27 bp, Artificial Sequence
  Description of Artificial Sequence: Synthetic oligonucleotide
gtgagcttggcagtctttgctgtgcgg

SEQ ID NO: 254695 - DNA, 27 bp, Artificial Sequence
  Description of Artificial Sequence: Synthetic oligonucleotide
tgagcttggcagtctttgctgtgcggg

SEQ ID NO: 254696 - DNA, 26 bp, Artificial Sequence
  Description of Artificial Sequence: Synthetic oligonucleotide
gagcttggcagtctttgctgtgcggg

SEQ ID NO: 254697 - DNA, 26 bp, Artificial Sequence
  Description of Artificial Sequence: Synthetic oligonucleotide
agcttggcagtctttgctgtgcgggc

SEQ ID NO: 254698 - DNA, 25 bp, Artificial Sequence
  Description of Artificial Sequence: Synthetic oligonucleotide
gcttggcagtctttgctgtgcgggc

SEQ ID NO: 254699 - DNA, 25 bp, Artificial Sequence
  Description of Artificial Sequence: Synthetic oligonucleotide
cttggcagtctttgctgtgcgggcc

SEQ ID NO: 254700 - DNA, 26 bp, Artificial Sequence
  Description of Artificial Sequence: Synthetic oligonucleotide
ttggcagtctttgctgtgcgggccca

SEQ ID NO: 254701 - DNA, 25 bp, Artificial Sequence
  Description of Artificial Sequence: Synthetic oligonucleotide
tggcagtctttgctgtgcgggccca

SEQ ID NO: 254702 - DNA, 24 bp, Artificial Sequence
  Description of Artificial Sequence: Synthetic oligonucleotide
ggcagtctttgctgtgcgggccca

SEQ ID NO: 254703 - DNA, 25 bp, Artificial Sequence
  Description of Artificial Sequence: Synthetic oligonucleotide
gcagtctttgctgtgcgggcccaga

SEQ ID NO: 254704 - DNA, 25 bp, Artificial Sequence
  Description of Artificial Sequence: Synthetic oligonucleotide
cagtctttgctgtgcgggcccagac

SEQ ID NO: 254705 - DNA, 26 bp, Artificial Sequence
  Description of Artificial Sequence: Synthetic oligonucleotide
agtctttgctgtgcgggcccagacca

SEQ ID NO: 254706 - DNA, 25 bp, Artificial Sequence
  Description of Artificial Sequence: Synthetic oligonucleotide
gtctttgctgtgcgggcccagacca

SEQ ID NO: 254707 - DNA, 26 bp, Artificial Sequence
  Description of Artificial Sequence: Synthetic oligonucleotide
tctttgctgtgcgggcccagaccaca

SEQ ID NO: 254708 - DNA, 25 bp, Artificial Sequence
  Description of Artificial Sequence: Synthetic oligonucleotide
ctttgctgtgcgggcccagaccaca

SEQ ID NO: 254709 - DNA, 27 bp, Artificial Sequence
  Description of Artificial Sequence: Synthetic oligonucleotide
tttgctgtgcgggcccagaccacagaa

SEQ ID NO: 254710 - DNA, 26 bp, Artificial Sequence
  Description of Artificial Sequence: Synthetic oligonucleotide
ttgctgtgcgggcccagaccacagaa

SEQ ID NO: 254711 - DNA, 25 bp, Artificial Sequence
  Description of Artificial Sequence: Synthetic oligonucleotide
tgctgtgcgggcccagaccacagaa

SEQ ID NO: 254712 - DNA, 24 bp, Artificial Sequence
  Description of Artificial Sequence: Synthetic oligonucleotide
gctgtgcgggcccagaccacagaa

SEQ ID NO: 254713 - DNA, 24 bp, Artificial Sequence
  Description of Artificial Sequence: Synthetic oligonucleotide
ctgtgcgggcccagaccacagaag

SEQ ID NO: 254714 - DNA, 24 bp, Artificial Sequence
  Description of Artificial Sequence: Synthetic oligonucleotide
tgtgcgggcccagaccacagaagg

SEQ ID NO: 254715 - DNA, 23 bp, Artificial Sequence
  Description of Artificial Sequence: Synthetic oligonucleotide
gtgcgggcccagaccacagaagg

SEQ ID NO: 254716 - DNA, 24 bp, Artificial Sequence
  Description of Artificial Sequence: Synthetic oligonucleotide
tgcgggcccagaccacagaagggt

SEQ ID NO: 254717 - DNA, 23 bp, Artificial Sequence
  Description of Artificial Sequence: Synthetic oligonucleotide
gcgggcccagaccacagaagggt

SEQ ID NO: 254718 - DNA, 23 bp, Artificial Sequence
  Description of Artificial Sequence: Synthetic oligonucleotide
cgggcccagaccacagaagggtg

SEQ ID NO: 254719 - DNA, 23 bp, Artificial Sequence
  Description of Artificial Sequence: Synthetic oligonucleotide
gggcccagaccacagaagggtgg

SEQ ID NO: 254720 - DNA, 27 bp, Artificial Sequence
  Description of Artificial Sequence: Synthetic oligonucleotide
ggcccagaccacagaagggtgggattt

SEQ ID NO: 254721 - DNA, 28 bp, Artificial Sequence
  Description of Artificial Sequence: Synthetic oligonucleotide
gcccagaccacagaagggtgggattttg

SEQ ID NO: 254722 - DNA, 34 bp, Artificial Sequence
  Description of Artificial Sequence: Synthetic oligonucleotide
cccagaccacagaagggtgggattttgtttatag

SEQ ID NO: 254723 - DNA, 41 bp, Artificial Sequence
  Description of Artificial Sequence: Synthetic oligonucleotide
ccagaccacagaagggtgggattttgtttatagtatatatc

SEQ ID NO: 254724 - DNA, 42 bp, Artificial Sequence
  Description of Artificial Sequence: Synthetic oligonucleotide
cagaccacagaagggtgggattttgtttatagtatatatcag

SEQ ID NO: 254725 - DNA, 46 bp, Artificial Sequence
  Description of Artificial Sequence: Synthetic oligonucleotide
agaccacagaagggtgggattttgtttatagtatatatcagttatc

SEQ ID NO: 254726 - DNA, 45 bp, Artificial Sequence
  Description of Artificial Sequence: Synthetic oligonucleotide
gaccacagaagggtgggattttgtttatagtatatatcagttatc

SEQ ID NO: 254727 - DNA, 48 bp, Artificial Sequence
  Description of Artificial Sequence: Synthetic oligonucleotide
accacagaagggtgggattttgtttatagtatatatcagttatctttg

SEQ ID NO: 254728 - DNA, 47 bp, Artificial Sequence
  Description of Artificial Sequence: Synthetic oligonucleotide
ccacagaagggtgggattttgtttatagtatatatcagttatctttg

SEQ ID NO: 254729 - DNA, 48 bp, Artificial Sequence
  Description of Artificial Sequence: Synthetic oligonucleotide
cacagaagggtgggattttgtttatagtatatatcagttatctttgtc

SEQ ID NO: 254730 - DNA, 48 bp, Artificial Sequence
  Description of Artificial Sequence: Synthetic oligonucleotide
acagaagggtgggattttgtttatagtatatatcagttatctttgtcc

SEQ ID NO: 254731 - DNA, 47 bp, Artificial Sequence
  Description of Artificial Sequence: Synthetic oligonucleotide
cagaagggtgggattttgtttatagtatatatcagttatctttgtcc

SEQ ID NO: 254732 - DNA, 48 bp, Artificial Sequence
  Description of Artificial Sequence: Synthetic oligonucleotide
agaagggtgggattttgtttatagtatatatcagttatctttgtcctg

SEQ ID NO: 254733 - DNA, 47 bp, Artificial Sequence
  Description of Artificial Sequence: Synthetic oligonucleotide
gaagggtgggattttgtttatagtatatatcagttatctttgtcctg

SEQ ID NO: 254734 - DNA, 49 bp, Artificial Sequence
  Description of Artificial Sequence: Synthetic oligonucleotide
aagggtgggattttgtttatagtatatatcagttatctttgtcctgtac

SEQ ID NO: 254735 - DNA, 48 bp, Artificial Sequence
  Description of Artificial Sequence: Synthetic oligonucleotide
agggtgggattttgtttatagtatatatcagttatctttgtcctgtac

SEQ ID NO: 254736 - DNA, 47 bp, Artificial Sequence
  Description of Artificial Sequence: Synthetic oligonucleotide
gggtgggattttgtttatagtatatatcagttatctttgtcctgtac

SEQ ID NO: 254737 - DNA, 48 bp, Artificial Sequence
  Description of Artificial Sequence: Synthetic oligonucleotide
ggtgggattttgtttatagtatatatcagttatctttgtcctgtactg

SEQ ID NO: 254738 - DNA, 49 bp, Artificial Sequence
  Description of Artificial Sequence: Synthetic oligonucleotide
gtgggattttgtttatagtatatatcagttatctttgtcctgtactgag

SEQ ID NO: 254739 - DNA, 53 bp, Artificial Sequence
  Description of Artificial Sequence: Synthetic oligonucleotide
tgggattttgtttatagtatatatcagttatctttgtcctgtactgagataag

SEQ ID NO: 254740 - DNA, 52 bp, Artificial Sequence
  Description of Artificial Sequence: Synthetic oligonucleotide
gggattttgtttatagtatatatcagttatctttgtcctgtactgagataag

SEQ ID NO: 254741 - DNA, 52 bp, Artificial Sequence
  Description of Artificial Sequence: Synthetic oligonucleotide
ggattttgtttatagtatatatcagttatctttgtcctgtactgagataagc

SEQ ID NO: 254742 - DNA, 52 bp, Artificial Sequence
  Description of Artificial Sequence: Synthetic oligonucleotide
gattttgtttatagtatatatcagttatctttgtcctgtactgagataagcc

SEQ ID NO: 254743 - DNA, 57 bp, Artificial Sequence
  Description of Artificial Sequence: Synthetic oligonucleotide
attttgtttatagtatatatcagttatctttgtcctgtactgagataagccaaatag

SEQ ID NO: 254744 - DNA, 56 bp, Artificial Sequence
  Description of Artificial Sequence: Synthetic oligonucleotide
ttttgtttatagtatatatcagttatctttgtcctgtactgagataagccaaatag

SEQ ID NO: 254745 - DNA, 55 bp, Artificial Sequence
  Description of Artificial Sequence: Synthetic oligonucleotide
tttgtttatagtatatatcagttatctttgtcctgtactgagataagccaaatag

SEQ ID NO: 254746 - DNA, 54 bp, Artificial Sequence
  Description of Artificial Sequence: Synthetic oligonucleotide
ttgtttatagtatatatcagttatctttgtcctgtactgagataagccaaatag

SEQ ID NO: 254747 - DNA, 53 bp, Artificial Sequence
  Description of Artificial Sequence: Synthetic oligonucleotide
tgtttatagtatatatcagttatctttgtcctgtactgagataagccaaatag

SEQ ID NO: 254748 - DNA, 52 bp, Artificial Sequence
  Description of Artificial Sequence: Synthetic oligonucleotide
gtttatagtatatatcagttatctttgtcctgtactgagataagccaaatag

SEQ ID NO: 254749 - DNA, 57 bp, Artificial Sequence
  Description of Artificial Sequence: Synthetic oligonucleotide
tttatagtatatatcagttatctttgtcctgtactgagataagccaaatagaatttg

SEQ ID NO: 254750 - DNA, 56 bp, Artificial Sequence
  Description of Artificial Sequence: Synthetic oligonucleotide
ttatagtatatatcagttatctttgtcctgtactgagataagccaaatagaatttg

SEQ ID NO: 254751 - DNA, 55 bp, Artificial Sequence
  Description of Artificial Sequence: Synthetic oligonucleotide
tatagtatatatcagttatctttgtcctgtactgagataagccaaatagaatttg

SEQ ID NO: 254752 - DNA, 54 bp, Artificial Sequence
  Description of Artificial Sequence: Synthetic oligonucleotide
atagtatatatcagttatctttgtcctgtactgagataagccaaatagaatttg

SEQ ID NO: 254753 - DNA, 53 bp, Artificial Sequence
  Description of Artificial Sequence: Synthetic oligonucleotide
tagtatatatcagttatctttgtcctgtactgagataagccaaatagaatttg

SEQ ID NO: 254754 - DNA, 52 bp, Artificial Sequence
  Description of Artificial Sequence: Synthetic oligonucleotide
agtatatatcagttatctttgtcctgtactgagataagccaaatagaatttg

SEQ ID NO: 254755 - DNA, 51 bp, Artificial Sequence
  Description of Artificial Sequence: Synthetic oligonucleotide
gtatatatcagttatctttgtcctgtactgagataagccaaatagaatttg

SEQ ID NO: 254756 - DNA, 51 bp, Artificial Sequence
  Description of Artificial Sequence: Synthetic oligonucleotide
tatatatcagttatctttgtcctgtactgagataagccaaatagaatttgc

SEQ ID NO: 254757 - DNA, 50 bp, Artificial Sequence
  Description of Artificial Sequence: Synthetic oligonucleotide
atatatcagttatctttgtcctgtactgagataagccaaatagaatttgc

SEQ ID NO: 254758 - DNA, 49 bp, Artificial Sequence
  Description of Artificial Sequence: Synthetic oligonucleotide
tatatcagttatctttgtcctgtactgagataagccaaatagaatttgc

SEQ ID NO: 254759 - DNA, 48 bp, Artificial Sequence
  Description of Artificial Sequence: Synthetic oligonucleotide
atatcagttatctttgtcctgtactgagataagccaaatagaatttgc

SEQ ID NO: 254760 - DNA, 47 bp, Artificial Sequence
  Description of Artificial Sequence: Synthetic oligonucleotide
tatcagttatctttgtcctgtactgagataagccaaatagaatttgc

SEQ ID NO: 254761 - DNA, 46 bp, Artificial Sequence
  Description of Artificial Sequence: Synthetic oligonucleotide
atcagttatctttgtcctgtactgagataagccaaatagaatttgc

SEQ ID NO: 254762 - DNA, 45 bp, Artificial Sequence
  Description of Artificial Sequence: Synthetic oligonucleotide
tcagttatctttgtcctgtactgagataagccaaatagaatttgc

SEQ ID NO: 254763 - DNA, 44 bp, Artificial Sequence
  Description of Artificial Sequence: Synthetic oligonucleotide
cagttatctttgtcctgtactgagataagccaaatagaatttgc

SEQ ID NO: 254764 - DNA, 44 bp, Artificial Sequence
  Description of Artificial Sequence: Synthetic oligonucleotide
agttatctttgtcctgtactgagataagccaaatagaatttgcc

SEQ ID NO: 254765 - DNA, 43 bp, Artificial Sequence
  Description of Artificial Sequence: Synthetic oligonucleotide
gttatctttgtcctgtactgagataagccaaatagaatttgcc

SEQ ID NO: 254766 - DNA, 43 bp, Artificial Sequence
  Description of Artificial Sequence: Synthetic oligonucleotide
ttatctttgtcctgtactgagataagccaaatagaatttgccg

SEQ ID NO: 254767 - DNA, 42 bp, Artificial Sequence
  Description of Artificial Sequence: Synthetic oligonucleotide
tatctttgtcctgtactgagataagccaaatagaatttgccg

SEQ ID NO: 254768 - DNA, 41 bp, Artificial Sequence
  Description of Artificial Sequence: Synthetic oligonucleotide
atctttgtcctgtactgagataagccaaatagaatttgccg

SEQ ID NO: 254769 - DNA, 40 bp, Artificial Sequence
  Description of Artificial Sequence: Synthetic oligonucleotide
tctttgtcctgtactgagataagccaaatagaatttgccg

SEQ ID NO: 254770 - DNA, 39 bp, Artificial Sequence
  Description of Artificial Sequence: Synthetic oligonucleotide
ctttgtcctgtactgagataagccaaatagaatttgccg

SEQ ID NO: 254771 - DNA, 40 bp, Artificial Sequence
  Description of Artificial Sequence: Synthetic oligonucleotide
tttgtcctgtactgagataagccaaatagaatttgccgtc

SEQ ID NO: 254772 - DNA, 39 bp, Artificial Sequence
  Description of Artificial Sequence: Synthetic oligonucleotide
ttgtcctgtactgagataagccaaatagaatttgccgtc

SEQ ID NO: 254773 - DNA, 38 bp, Artificial Sequence
  Description of Artificial Sequence: Synthetic oligonucleotide
tgtcctgtactgagataagccaaatagaatttgccgtc

SEQ ID NO: 254774 - DNA, 37 bp, Artificial Sequence
  Description of Artificial Sequence: Synthetic oligonucleotide
gtcctgtactgagataagccaaatagaatttgccgtc

SEQ ID NO: 254775 - DNA, 38 bp, Artificial Sequence
  Description of Artificial Sequence: Synthetic oligonucleotide
tcctgtactgagataagccaaatagaatttgccgtctg

SEQ ID NO: 254776 - DNA, 37 bp, Artificial Sequence
  Description of Artificial Sequence: Synthetic oligonucleotide
cctgtactgagataagccaaatagaatttgccgtctg

SEQ ID NO: 254777 - DNA, 37 bp, Artificial Sequence
  Description of Artificial Sequence: Synthetic oligonucleotide
ctgtactgagataagccaaatagaatttgccgtctgc

SEQ ID NO: 254778 - DNA, 38 bp, Artificial Sequence
  Description of Artificial Sequence: Synthetic oligonucleotide
tgtactgagataagccaaatagaatttgccgtctgcag

SEQ ID NO: 254779 - DNA, 37 bp, Artificial Sequence
  Description of Artificial Sequence: Synthetic oligonucleotide
gtactgagataagccaaatagaatttgccgtctgcag

SEQ ID NO: 254780 - DNA, 39 bp, Artificial Sequence
  Description of Artificial Sequence: Synthetic oligonucleotide
tactgagataagccaaatagaatttgccgtctgcagaag

SEQ ID NO: 254781 - DNA, 38 bp, Artificial Sequence
  Description of Artificial Sequence: Synthetic oligonucleotide
actgagataagccaaatagaatttgccgtctgcagaag

SEQ ID NO: 254782 - DNA, 37 bp, Artificial Sequence
  Description of Artificial Sequence: Synthetic oligonucleotide
ctgagataagccaaatagaatttgccgtctgcagaag

SEQ ID NO: 254783 - DNA, 37 bp, Artificial Sequence
  Description of Artificial Sequence: Synthetic oligonucleotide
tgagataagccaaatagaatttgccgtctgcagaagc

SEQ ID NO: 254784 - DNA, 36 bp, Artificial Sequence
  Description of Artificial Sequence: Synthetic oligonucleotide
gagataagccaaatagaatttgccgtctgcagaagc

SEQ ID NO: 254785 - DNA, 36 bp, Artificial Sequence
  Description of Artificial Sequence: Synthetic oligonucleotide
agataagccaaatagaatttgccgtctgcagaagcc

SEQ ID NO: 254786 - DNA, 35 bp, Artificial Sequence
  Description of Artificial Sequence: Synthetic oligonucleotide
gataagccaaatagaatttgccgtctgcagaagcc

SEQ ID NO: 254787 - DNA, 42 bp, Artificial Sequence
  Description of Artificial Sequence: Synthetic oligonucleotide
ataagccaaatagaatttgccgtctgcagaagccaaaataac

SEQ ID NO: 254788 - DNA, 41 bp, Artificial Sequence
  Description of Artificial Sequence: Synthetic oligonucleotide
taagccaaatagaatttgccgtctgcagaagccaaaataac

SEQ ID NO: 254789 - DNA, 40 bp, Artificial Sequence
  Description of Artificial Sequence: Synthetic oligonucleotide
aagccaaatagaatttgccgtctgcagaagccaaaataac

SEQ ID NO: 254790 - DNA, 39 bp, Artificial Sequence
  Description of Artificial Sequence: Synthetic oligonucleotide
agccaaatagaatttgccgtctgcagaagccaaaataac

SEQ ID NO: 254791 - DNA, 38 bp, Artificial Sequence
  Description of Artificial Sequence: Synthetic oligonucleotide
gccaaatagaatttgccgtctgcagaagccaaaataac

SEQ ID NO: 254792 - DNA, 38 bp, Artificial Sequence
  Description of Artificial Sequence: Synthetic oligonucleotide
ccaaatagaatttgccgtctgcagaagccaaaataacg

SEQ ID NO: 254793 - DNA, 42 bp, Artificial Sequence
  Description of Artificial Sequence: Synthetic oligonucleotide
caaatagaatttgccgtctgcagaagccaaaataacgaaaag

SEQ ID NO: 254794 - DNA, 42 bp, Artificial Sequence
  Description of Artificial Sequence: Synthetic oligonucleotide
aaatagaatttgccgtctgcagaagccaaaataacgaaaagc

SEQ ID NO: 254795 - DNA, 41 bp, Artificial Sequence
  Description of Artificial Sequence: Synthetic oligonucleotide
aatagaatttgccgtctgcagaagccaaaataacgaaaagc

SEQ ID NO: 254796 - DNA, 40 bp, Artificial Sequence
  Description of Artificial Sequence: Synthetic oligonucleotide
atagaatttgccgtctgcagaagccaaaataacgaaaagc

SEQ ID NO: 254797 - DNA, 39 bp, Artificial Sequence
  Description of Artificial Sequence: Synthetic oligonucleotide
tagaatttgccgtctgcagaagccaaaataacgaaaagc

SEQ ID NO: 254798 - DNA, 38 bp, Artificial Sequence
  Description of Artificial Sequence: Synthetic oligonucleotide
agaatttgccgtctgcagaagccaaaataacgaaaagc

SEQ ID NO: 254799 - DNA, 37 bp, Artificial Sequence
  Description of Artificial Sequence: Synthetic oligonucleotide
gaatttgccgtctgcagaagccaaaataacgaaaagc

SEQ ID NO: 254800 - DNA, 39 bp, Artificial Sequence
  Description of Artificial Sequence: Synthetic oligonucleotide
aatttgccgtctgcagaagccaaaataacgaaaagcttg

SEQ ID NO: 254801 - DNA, 38 bp, Artificial Sequence
  Description of Artificial Sequence: Synthetic oligonucleotide
atttgccgtctgcagaagccaaaataacgaaaagcttg

SEQ ID NO: 254802 - DNA, 37 bp, Artificial Sequence
  Description of Artificial Sequence: Synthetic oligonucleotide
tttgccgtctgcagaagccaaaataacgaaaagcttg

SEQ ID NO: 254803 - DNA, 36 bp, Artificial Sequence
  Description of Artificial Sequence: Synthetic oligonucleotide
ttgccgtctgcagaagccaaaataacgaaaagcttg

SEQ ID NO: 254804 - DNA, 35 bp, Artificial Sequence
  Description of Artificial Sequence: Synthetic oligonucleotide
tgccgtctgcagaagccaaaataacgaaaagcttg

SEQ ID NO: 254805 - DNA, 34 bp, Artificial Sequence
  Description of Artificial Sequence: Synthetic oligonucleotide
gccgtctgcagaagccaaaataacgaaaagcttg

SEQ ID NO: 254806 - DNA, 37 bp, Artificial Sequence
  Description of Artificial Sequence: Synthetic oligonucleotide
ccgtctgcagaagccaaaataacgaaaagcttgaatg

SEQ ID NO: 254807 - DNA, 37 bp, Artificial Sequence
  Description of Artificial Sequence: Synthetic oligonucleotide
cgtctgcagaagccaaaataacgaaaagcttgaatgg

SEQ ID NO: 254808 - DNA, 37 bp, Artificial Sequence
  Description of Artificial Sequence: Synthetic oligonucleotide
gtctgcagaagccaaaataacgaaaagcttgaatggc

SEQ ID NO: 254809 - DNA, 39 bp, Artificial Sequence
  Description of Artificial Sequence: Synthetic oligonucleotide
tctgcagaagccaaaataacgaaaagcttgaatggctac

SEQ ID NO: 254810 - DNA, 38 bp, Artificial Sequence
  Description of Artificial Sequence: Synthetic oligonucleotide
ctgcagaagccaaaataacgaaaagcttgaatggctac

SEQ ID NO: 254811 - DNA, 40 bp, Artificial Sequence
  Description of Artificial Sequence: Synthetic oligonucleotide
tgcagaagccaaaataacgaaaagcttgaatggctacaag

SEQ ID NO: 254812 - DNA, 39 bp, Artificial Sequence
  Description of Artificial Sequence: Synthetic oligonucleotide
gcagaagccaaaataacgaaaagcttgaatggctacaag

SEQ ID NO: 254813 - DNA, 41 bp, Artificial Sequence
  Description of Artificial Sequence: Synthetic oligonucleotide
cagaagccaaaataacgaaaagcttgaatggctacaagatg

SEQ ID NO: 254814 - DNA, 44 bp, Artificial Sequence
  Description of Artificial Sequence: Synthetic oligonucleotide
agaagccaaaataacgaaaagcttgaatggctacaagatgaaag

SEQ ID NO: 254815 - DNA, 43 bp, Artificial Sequence
  Description of Artificial Sequence: Synthetic oligonucleotide
gaagccaaaataacgaaaagcttgaatggctacaagatgaaag

SEQ ID NO: 254816 - DNA, 43 bp, Artificial Sequence
  Description of Artificial Sequence: Synthetic oligonucleotide
aagccaaaataacgaaaagcttgaatggctacaagatgaaagg

SEQ ID NO: 254817 - DNA, 42 bp, Artificial Sequence
  Description of Artificial Sequence: Synthetic oligonucleotide
agccaaaataacgaaaagcttgaatggctacaagatgaaagg

SEQ ID NO: 254818 - DNA, 41 bp, Artificial Sequence
  Description of Artificial Sequence: Synthetic oligonucleotide
gccaaaataacgaaaagcttgaatggctacaagatgaaagg

SEQ ID NO: 254819 - DNA, 46 bp, Artificial Sequence
  Description of Artificial Sequence: Synthetic oligonucleotide
ccaaaataacgaaaagcttgaatggctacaagatgaaaggtttaag

SEQ ID NO: 254820 - DNA, 46 bp, Artificial Sequence
  Description of Artificial Sequence: Synthetic oligonucleotide
caaaataacgaaaagcttgaatggctacaagatgaaaggtttaagg

SEQ ID NO: 254821 - DNA, 46 bp, Artificial Sequence
  Description of Artificial Sequence: Synthetic oligonucleotide
aaaataacgaaaagcttgaatggctacaagatgaaaggtttaaggg

SEQ ID NO: 254822 - DNA, 45 bp, Artificial Sequence
  Description of Artificial Sequence: Synthetic oligonucleotide
aaataacgaaaagcttgaatggctacaagatgaaaggtttaaggg

SEQ ID NO: 254823 - DNA, 44 bp, Artificial Sequence
  Description of Artificial Sequence: Synthetic oligonucleotide
aataacgaaaagcttgaatggctacaagatgaaaggtttaaggg

SEQ ID NO: 254824 - DNA, 43 bp, Artificial Sequence
  Description of Artificial Sequence: Synthetic oligonucleotide
ataacgaaaagcttgaatggctacaagatgaaaggtttaaggg

SEQ ID NO: 254825 - DNA, 42 bp, Artificial Sequence
  Description of Artificial Sequence: Synthetic oligonucleotide
taacgaaaagcttgaatggctacaagatgaaaggtttaaggg

SEQ ID NO: 254826 - DNA, 41 bp, Artificial Sequence
  Description of Artificial Sequence: Synthetic oligonucleotide
aacgaaaagcttgaatggctacaagatgaaaggtttaaggg

SEQ ID NO: 254827 - DNA, 40 bp, Artificial Sequence
  Description of Artificial Sequence: Synthetic oligonucleotide
acgaaaagcttgaatggctacaagatgaaaggtttaaggg

SEQ ID NO: 254828 - DNA, 39 bp, Artificial Sequence
  Description of Artificial Sequence: Synthetic oligonucleotide
cgaaaagcttgaatggctacaagatgaaaggtttaaggg

SEQ ID NO: 254829 - DNA, 40 bp, Artificial Sequence
  Description of Artificial Sequence: Synthetic oligonucleotide
gaaaagcttgaatggctacaagatgaaaggtttaagggac

SEQ ID NO: 254830 - DNA, 52 bp, Artificial Sequence
  Description of Artificial Sequence: Synthetic oligonucleotide
aaaagcttgaatggctacaagatgaaaggtttaagggacataaaataataac

SEQ ID NO: 254831 - DNA, 51 bp, Artificial Sequence
  Description of Artificial Sequence: Synthetic oligonucleotide
aaagcttgaatggctacaagatgaaaggtttaagggacataaaataataac

SEQ ID NO: 254832 - DNA, 50 bp, Artificial Sequence
  Description of Artificial Sequence: Synthetic oligonucleotide
aagcttgaatggctacaagatgaaaggtttaagggacataaaataataac

SEQ ID NO: 254833 - DNA, 49 bp, Artificial Sequence
  Description of Artificial Sequence: Synthetic oligonucleotide
agcttgaatggctacaagatgaaaggtttaagggacataaaataataac

SEQ ID NO: 254834 - DNA, 48 bp, Artificial Sequence
  Description of Artificial Sequence: Synthetic oligonucleotide
gcttgaatggctacaagatgaaaggtttaagggacataaaataataac

SEQ ID NO: 254835 - DNA, 49 bp, Artificial Sequence
  Description of Artificial Sequence: Synthetic oligonucleotide
cttgaatggctacaagatgaaaggtttaagggacataaaataataactc

SEQ ID NO: 254836 - DNA, 50 bp, Artificial Sequence
  Description of Artificial Sequence: Synthetic oligonucleotide
ttgaatggctacaagatgaaaggtttaagggacataaaataataactcag

SEQ ID NO: 254837 - DNA, 49 bp, Artificial Sequence
  Description of Artificial Sequence: Synthetic oligonucleotide
tgaatggctacaagatgaaaggtttaagggacataaaataataactcag

SEQ ID NO: 254838 - DNA, 48 bp, Artificial Sequence
  Description of Artificial Sequence: Synthetic oligonucleotide
gaatggctacaagatgaaaggtttaagggacataaaataataactcag

SEQ ID NO: 254839 - DNA, 48 bp, Artificial Sequence
  Description of Artificial Sequence: Synthetic oligonucleotide
aatggctacaagatgaaaggtttaagggacataaaataataactcagg

SEQ ID NO: 254840 - DNA, 47 bp, Artificial Sequence
  Description of Artificial Sequence: Synthetic oligonucleotide
atggctacaagatgaaaggtttaagggacataaaataataactcagg

SEQ ID NO: 254841 - DNA, 46 bp, Artificial Sequence
  Description of Artificial Sequence: Synthetic oligonucleotide
tggctacaagatgaaaggtttaagggacataaaataataactcagg

SEQ ID NO: 254842 - DNA, 45 bp, Artificial Sequence
  Description of Artificial Sequence: Synthetic oligonucleotide
ggctacaagatgaaaggtttaagggacataaaataataactcagg

SEQ ID NO: 254843 - DNA, 46 bp, Artificial Sequence
  Description of Artificial Sequence: Synthetic oligonucleotide
gctacaagatgaaaggtttaagggacataaaataataactcaggac

SEQ ID NO: 254844 - DNA, 49 bp, Artificial Sequence
  Description of Artificial Sequence: Synthetic oligonucleotide
ctacaagatgaaaggtttaagggacataaaataataactcaggactttc

SEQ ID NO: 254845 - DNA, 49 bp, Artificial Sequence
  Description of Artificial Sequence: Synthetic oligonucleotide
tacaagatgaaaggtttaagggacataaaataataactcaggactttcc

SEQ ID NO: 254846 - DNA, 48 bp, Artificial Sequence
  Description of Artificial Sequence: Synthetic oligonucleotide
acaagatgaaaggtttaagggacataaaataataactcaggactttcc

SEQ ID NO: 254847 - DNA, 47 bp, Artificial Sequence
  Description of Artificial Sequence: Synthetic oligonucleotide
caagatgaaaggtttaagggacataaaataataactcaggactttcc

SEQ ID NO: 254848 - DNA, 48 bp, Artificial Sequence
  Description of Artificial Sequence: Synthetic oligonucleotide
aagatgaaaggtttaagggacataaaataataactcaggactttccac

SEQ ID NO: 254849 - DNA, 47 bp, Artificial Sequence
  Description of Artificial Sequence: Synthetic oligonucleotide
agatgaaaggtttaagggacataaaataataactcaggactttccac

SEQ ID NO: 254850 - DNA, 46 bp, Artificial Sequence
  Description of Artificial Sequence: Synthetic oligonucleotide
gatgaaaggtttaagggacataaaataataactcaggactttccac

SEQ ID NO: 254851 - DNA, 51 bp, Artificial Sequence
  Description of Artificial Sequence: Synthetic oligonucleotide
atgaaaggtttaagggacataaaataataactcaggactttccacaatttc

SEQ ID NO: 254852 - DNA, 50 bp, Artificial Sequence
  Description of Artificial Sequence: Synthetic oligonucleotide
tgaaaggtttaagggacataaaataataactcaggactttccacaatttc

SEQ ID NO: 254853 - DNA, 49 bp, Artificial Sequence
  Description of Artificial Sequence: Synthetic oligonucleotide
gaaaggtttaagggacataaaataataactcaggactttccacaatttc

SEQ ID NO: 254854 - DNA, 52 bp, Artificial Sequence
  Description of Artificial Sequence: Synthetic oligonucleotide
aaaggtttaagggacataaaataataactcaggactttccacaatttcttac

SEQ ID NO: 254855 - DNA, 51 bp, Artificial Sequence
  Description of Artificial Sequence: Synthetic oligonucleotide
aaggtttaagggacataaaataataactcaggactttccacaatttcttac

SEQ ID NO: 254856 - DNA, 50 bp, Artificial Sequence
  Description of Artificial Sequence: Synthetic oligonucleotide
aggtttaagggacataaaataataactcaggactttccacaatttcttac

SEQ ID NO: 254857 - DNA, 49 bp, Artificial Sequence
  Description of Artificial Sequence: Synthetic oligonucleotide
ggtttaagggacataaaataataactcaggactttccacaatttcttac

SEQ ID NO: 254858 - DNA, 50 bp, Artificial Sequence
  Description of Artificial Sequence: Synthetic oligonucleotide
gtttaagggacataaaataataactcaggactttccacaatttcttacac

SEQ ID NO: 254859 - DNA, 51 bp, Artificial Sequence
  Description of Artificial Sequence: Synthetic oligonucleotide
tttaagggacataaaataataactcaggactttccacaatttcttacacac

SEQ ID NO: 254860 - DNA, 50 bp, Artificial Sequence
  Description of Artificial Sequence: Synthetic oligonucleotide
ttaagggacataaaataataactcaggactttccacaatttcttacacac

SEQ ID NO: 254861 - DNA, 49 bp, Artificial Sequence
  Description of Artificial Sequence: Synthetic oligonucleotide
taagggacataaaataataactcaggactttccacaatttcttacacac

SEQ ID NO: 254862 - DNA, 48 bp, Artificial Sequence
  Description of Artificial Sequence: Synthetic oligonucleotide
aagggacataaaataataactcaggactttccacaatttcttacacac

SEQ ID NO: 254863 - DNA, 47 bp, Artificial Sequence
  Description of Artificial Sequence: Synthetic oligonucleotide
agggacataaaataataactcaggactttccacaatttcttacacac

SEQ ID NO: 254864 - DNA, 46 bp, Artificial Sequence
  Description of Artificial Sequence: Synthetic oligonucleotide
gggacataaaataataactcaggactttccacaatttcttacacac

SEQ ID NO: 254865 - DNA, 49 bp, Artificial Sequence
  Description of Artificial Sequence: Synthetic oligonucleotide
ggacataaaataataactcaggactttccacaatttcttacacacattg

SEQ ID NO: 254866 - DNA, 49 bp, Artificial Sequence
  Description of Artificial Sequence: Synthetic oligonucleotide
gacataaaataataactcaggactttccacaatttcttacacacattgg

SEQ ID NO: 254867 - DNA, 49 bp, Artificial Sequence
  Description of Artificial Sequence: Synthetic oligonucleotide
acataaaataataactcaggactttccacaatttcttacacacattggc

SEQ ID NO: 254868 - DNA, 48 bp, Artificial Sequence
  Description of Artificial Sequence: Synthetic oligonucleotide
cataaaataataactcaggactttccacaatttcttacacacattggc

SEQ ID NO: 254869 - DNA, 49 bp, Artificial Sequence
  Description of Artificial Sequence: Synthetic oligonucleotide
ataaaataataactcaggactttccacaatttcttacacacattggcag

SEQ ID NO: 254870 - DNA, 48 bp, Artificial Sequence
  Description of Artificial Sequence: Synthetic oligonucleotide
taaaataataactcaggactttccacaatttcttacacacattggcag

SEQ ID NO: 254871 - DNA, 47 bp, Artificial Sequence
  Description of Artificial Sequence: Synthetic oligonucleotide
aaaataataactcaggactttccacaatttcttacacacattggcag

SEQ ID NO: 254872 - DNA, 46 bp, Artificial Sequence
  Description of Artificial Sequence: Synthetic oligonucleotide
aaataataactcaggactttccacaatttcttacacacattggcag

SEQ ID NO: 254873 - DNA, 45 bp, Artificial Sequence
  Description of Artificial Sequence: Synthetic oligonucleotide
aataataactcaggactttccacaatttcttacacacattggcag

SEQ ID NO: 254874 - DNA, 44 bp, Artificial Sequence
  Description of Artificial Sequence: Synthetic oligonucleotide
ataataactcaggactttccacaatttcttacacacattggcag

SEQ ID NO: 254875 - DNA, 43 bp, Artificial Sequence
  Description of Artificial Sequence: Synthetic oligonucleotide
taataactcaggactttccacaatttcttacacacattggcag

SEQ ID NO: 254876 - DNA, 42 bp, Artificial Sequence
  Description of Artificial Sequence: Synthetic oligonucleotide
aataactcaggactttccacaatttcttacacacattggcag

SEQ ID NO: 254877 - DNA, 41 bp, Artificial Sequence
  Description of Artificial Sequence: Synthetic oligonucleotide
ataactcaggactttccacaatttcttacacacattggcag

SEQ ID NO: 254878 - DNA, 40 bp, Artificial Sequence
  Description of Artificial Sequence: Synthetic oligonucleotide
taactcaggactttccacaatttcttacacacattggcag

SEQ ID NO: 254879 - DNA, 39 bp, Artificial Sequence
  Description of Artificial Sequence: Synthetic oligonucleotide
aactcaggactttccacaatttcttacacacattggcag

SEQ ID NO: 254880 - DNA, 38 bp, Artificial Sequence
  Description of Artificial Sequence: Synthetic oligonucleotide
actcaggactttccacaatttcttacacacattggcag

SEQ ID NO: 254881 - DNA, 37 bp, Artificial Sequence
  Description of Artificial Sequence: Synthetic oligonucleotide
ctcaggactttccacaatttcttacacacattggcag

SEQ ID NO: 254882 - DNA, 37 bp, Artificial Sequence
  Description of Artificial Sequence: Synthetic oligonucleotide
tcaggactttccacaatttcttacacacattggcagc

SEQ ID NO: 254883 - DNA, 36 bp, Artificial Sequence
  Description of Artificial Sequence: Synthetic oligonucleotide
caggactttccacaatttcttacacacattggcagc

SEQ ID NO: 254884 - DNA, 38 bp, Artificial Sequence
  Description of Artificial Sequence: Synthetic oligonucleotide
aggactttccacaatttcttacacacattggcagcaac

SEQ ID NO: 254885 - DNA, 37 bp, Artificial Sequence
  Description of Artificial Sequence: Synthetic oligonucleotide
ggactttccacaatttcttacacacattggcagcaac

SEQ ID NO: 254886 - DNA, 37 bp, Artificial Sequence
  Description of Artificial Sequence: Synthetic oligonucleotide
gactttccacaatttcttacacacattggcagcaacc

SEQ ID NO: 254887 - DNA, 37 bp, Artificial Sequence
  Description of Artificial Sequence: Synthetic oligonucleotide
actttccacaatttcttacacacattggcagcaaccc

SEQ ID NO: 254888 - DNA, 36 bp, Artificial Sequence
  Description of Artificial Sequence: Synthetic oligonucleotide
ctttccacaatttcttacacacattggcagcaaccc

SEQ ID NO: 254889 - DNA, 37 bp, Artificial Sequence
  Description of Artificial Sequence: Synthetic oligonucleotide
tttccacaatttcttacacacattggcagcaacccag

SEQ ID NO: 254890 - DNA, 36 bp, Artificial Sequence
  Description of Artificial Sequence: Synthetic oligonucleotide
ttccacaatttcttacacacattggcagcaacccag

SEQ ID NO: 254891 - DNA, 35 bp, Artificial Sequence
  Description of Artificial Sequence: Synthetic oligonucleotide
tccacaatttcttacacacattggcagcaacccag

SEQ ID NO: 254892 - DNA, 34 bp, Artificial Sequence
  Description of Artificial Sequence: Synthetic oligonucleotide
ccacaatttcttacacacattggcagcaacccag

SEQ ID NO: 254893 - DNA, 36 bp, Artificial Sequence
  Description of Artificial Sequence: Synthetic oligonucleotide
cacaatttcttacacacattggcagcaacccagtac

SEQ ID NO: 254894 - DNA, 36 bp, Artificial Sequence
  Description of Artificial Sequence: Synthetic oligonucleotide
acaatttcttacacacattggcagcaacccagtacg

SEQ ID NO: 254895 - DNA, 35 bp, Artificial Sequence
  Description of Artificial Sequence: Synthetic oligonucleotide
caatttcttacacacattggcagcaacccagtacg

SEQ ID NO: 254896 - DNA, 38 bp, Artificial Sequence
  Description of Artificial Sequence: Synthetic oligonucleotide
aatttcttacacacattggcagcaacccagtacgatac

SEQ ID NO: 254897 - DNA, 37 bp, Artificial Sequence
  Description of Artificial Sequence: Synthetic oligonucleotide
atttcttacacacattggcagcaacccagtacgatac

SEQ ID NO: 254898 - DNA, 36 bp, Artificial Sequence
  Description of Artificial Sequence: Synthetic oligonucleotide
tttcttacacacattggcagcaacccagtacgatac

SEQ ID NO: 254899 - DNA, 35 bp, Artificial Sequence
  Description of Artificial Sequence: Synthetic oligonucleotide
ttcttacacacattggcagcaacccagtacgatac

SEQ ID NO: 254900 - DNA, 34 bp, Artificial Sequence
  Description of Artificial Sequence: Synthetic oligonucleotide
tcttacacacattggcagcaacccagtacgatac

SEQ ID NO: 254901 - DNA, 33 bp, Artificial Sequence
  Description of Artificial Sequence: Synthetic oligonucleotide
cttacacacattggcagcaacccagtacgatac

SEQ ID NO: 254902 - DNA, 33 bp, Artificial Sequence
  Description of Artificial Sequence: Synthetic oligonucleotide
ttacacacattggcagcaacccagtacgatacc

SEQ ID NO: 254903 - DNA, 32 bp, Artificial Sequence
  Description of Artificial Sequence: Synthetic oligonucleotide
tacacacattggcagcaacccagtacgatacc

SEQ ID NO: 254904 - DNA, 31 bp, Artificial Sequence
  Description of Artificial Sequence: Synthetic oligonucleotide
acacacattggcagcaacccagtacgatacc

SEQ ID NO: 254905 - DNA, 30 bp, Artificial Sequence
  Description of Artificial Sequence: Synthetic oligonucleotide
cacacattggcagcaacccagtacgatacc

SEQ ID NO: 254906 - DNA, 30 bp, Artificial Sequence
  Description of Artificial Sequence: Synthetic oligonucleotide
acacattggcagcaacccagtacgataccc

SEQ ID NO: 254907 - DNA, 29 bp, Artificial Sequence
  Description of Artificial Sequence: Synthetic oligonucleotide
cacattggcagcaacccagtacgataccc

SEQ ID NO: 254908 - DNA, 30 bp, Artificial Sequence
  Description of Artificial Sequence: Synthetic oligonucleotide
acattggcagcaacccagtacgatacccac

SEQ ID NO: 254909 - DNA, 29 bp, Artificial Sequence
  Description of Artificial Sequence: Synthetic oligonucleotide
cattggcagcaacccagtacgatacccac

SEQ ID NO: 254910 - DNA, 30 bp, Artificial Sequence
  Description of Artificial Sequence: Synthetic oligonucleotide
attggcagcaacccagtacgatacccacag

SEQ ID NO: 254911 - DNA, 29 bp, Artificial Sequence
  Description of Artificial Sequence: Synthetic oligonucleotide
ttggcagcaacccagtacgatacccacag

SEQ ID NO: 254912 - DNA, 28 bp, Artificial Sequence
  Description of Artificial Sequence: Synthetic oligonucleotide
tggcagcaacccagtacgatacccacag

SEQ ID NO: 254913 - DNA, 27 bp, Artificial Sequence
  Description of Artificial Sequence: Synthetic oligonucleotide
ggcagcaacccagtacgatacccacag

SEQ ID NO: 254914 - DNA, 27 bp, Artificial Sequence
  Description of Artificial Sequence: Synthetic oligonucleotide
gcagcaacccagtacgatacccacagg

SEQ ID NO: 254915 - DNA, 27 bp, Artificial Sequence
  Description of Artificial Sequence: Synthetic oligonucleotide
cagcaacccagtacgatacccacaggc

SEQ ID NO: 254916 - DNA, 27 bp, Artificial Sequence
  Description of Artificial Sequence: Synthetic oligonucleotide
agcaacccagtacgatacccacaggcc

SEQ ID NO: 254917 - DNA, 27 bp, Artificial Sequence
  Description of Artificial Sequence: Synthetic oligonucleotide
gcaacccagtacgatacccacaggcct

SEQ ID NO: 254918 - DNA, 27 bp, Artificial Sequence
  Description of Artificial Sequence: Synthetic oligonucleotide
caacccagtacgatacccacaggcctg

SEQ ID NO: 254919 - DNA, 27 bp, Artificial Sequence
  Description of Artificial Sequence: Synthetic oligonucleotide
aacccagtacgatacccacaggcctgg

SEQ ID NO: 254920 - DNA, 26 bp, Artificial Sequence
  Description of Artificial Sequence: Synthetic oligonucleotide
acccagtacgatacccacaggcctgg

SEQ ID NO: 254921 - DNA, 25 bp, Artificial Sequence
  Description of Artificial Sequence: Synthetic oligonucleotide
cccagtacgatacccacaggcctgg

SEQ ID NO: 254922 - DNA, 27 bp, Artificial Sequence
  Description of Artificial Sequence: Synthetic oligonucleotide
ccagtacgatacccacaggcctggcat

SEQ ID NO: 254923 - DNA, 30 bp, Artificial Sequence
  Description of Artificial Sequence: Synthetic oligonucleotide
cagtacgatacccacaggcctggcattttc

SEQ ID NO: 254924 - DNA, 31 bp, Artificial Sequence
  Description of Artificial Sequence: Synthetic oligonucleotide
agtacgatacccacaggcctggcattttctg

SEQ ID NO: 254925 - DNA, 30 bp, Artificial Sequence
  Description of Artificial Sequence: Synthetic oligonucleotide
gtacgatacccacaggcctggcattttctg

SEQ ID NO: 254926 - DNA, 31 bp, Artificial Sequence
  Description of Artificial Sequence: Synthetic oligonucleotide
tacgatacccacaggcctggcattttctgag

SEQ ID NO: 254927 - DNA, 30 bp, Artificial Sequence
  Description of Artificial Sequence: Synthetic oligonucleotide
acgatacccacaggcctggcattttctgag

SEQ ID NO: 254928 - DNA, 29 bp, Artificial Sequence
  Description of Artificial Sequence: Synthetic oligonucleotide
cgatacccacaggcctggcattttctgag

SEQ ID NO: 254929 - DNA, 29 bp, Artificial Sequence
  Description of Artificial Sequence: Synthetic oligonucleotide
gatacccacaggcctggcattttctgagg

SEQ ID NO: 254930 - DNA, 34 bp, Artificial Sequence
  Description of Artificial Sequence: Synthetic oligonucleotide
atacccacaggcctggcattttctgaggtaaaac

SEQ ID NO: 254931 - DNA, 33 bp, Artificial Sequence
  Description of Artificial Sequence: Synthetic oligonucleotide
tacccacaggcctggcattttctgaggtaaaac

SEQ ID NO: 254932 - DNA, 32 bp, Artificial Sequence
  Description of Artificial Sequence: Synthetic oligonucleotide
acccacaggcctggcattttctgaggtaaaac

SEQ ID NO: 254933 - DNA, 31 bp, Artificial Sequence
  Description of Artificial Sequence: Synthetic oligonucleotide
cccacaggcctggcattttctgaggtaaaac

SEQ ID NO: 254934 - DNA, 32 bp, Artificial Sequence
  Description of Artificial Sequence: Synthetic oligonucleotide
ccacaggcctggcattttctgaggtaaaactg

SEQ ID NO: 254935 - DNA, 32 bp, Artificial Sequence
  Description of Artificial Sequence: Synthetic oligonucleotide
cacaggcctggcattttctgaggtaaaactgg

SEQ ID NO: 254936 - DNA, 34 bp, Artificial Sequence
  Description of Artificial Sequence: Synthetic oligonucleotide
acaggcctggcattttctgaggtaaaactggatc

SEQ ID NO: 254937 - DNA, 33 bp, Artificial Sequence
  Description of Artificial Sequence: Synthetic oligonucleotide
caggcctggcattttctgaggtaaaactggatc

SEQ ID NO: 254938 - DNA, 36 bp, Artificial Sequence
  Description of Artificial Sequence: Synthetic oligonucleotide
aggcctggcattttctgaggtaaaactggatcaaac

SEQ ID NO: 254939 - DNA, 35 bp, Artificial Sequence
  Description of Artificial Sequence: Synthetic oligonucleotide
ggcctggcattttctgaggtaaaactggatcaaac

SEQ ID NO: 254940 - DNA, 37 bp, Artificial Sequence
  Description of Artificial Sequence: Synthetic oligonucleotide
gcctggcattttctgaggtaaaactggatcaaacttg

SEQ ID NO: 254941 - DNA, 39 bp, Artificial Sequence
  Description of Artificial Sequence: Synthetic oligonucleotide
cctggcattttctgaggtaaaactggatcaaacttgttc

SEQ ID NO: 254942 - DNA, 43 bp, Artificial Sequence
  Description of Artificial Sequence: Synthetic oligonucleotide
ctggcattttctgaggtaaaactggatcaaacttgttcaaaag

SEQ ID NO: 254943 - DNA, 46 bp, Artificial Sequence
  Description of Artificial Sequence: Synthetic oligonucleotide
tggcattttctgaggtaaaactggatcaaacttgttcaaaagtttc

SEQ ID NO: 254944 - DNA, 45 bp, Artificial Sequence
  Description of Artificial Sequence: Synthetic oligonucleotide
ggcattttctgaggtaaaactggatcaaacttgttcaaaagtttc

SEQ ID NO: 254945 - DNA, 47 bp, Artificial Sequence
  Description of Artificial Sequence: Synthetic oligonucleotide
gcattttctgaggtaaaactggatcaaacttgttcaaaagtttcaac

SEQ ID NO: 254946 - DNA, 49 bp, Artificial Sequence
  Description of Artificial Sequence: Synthetic oligonucleotide
cattttctgaggtaaaactggatcaaacttgttcaaaagtttcaacttg

SEQ ID NO: 254947 - DNA, 49 bp, Artificial Sequence
  Description of Artificial Sequence: Synthetic oligonucleotide
attttctgaggtaaaactggatcaaacttgttcaaaagtttcaacttgg

SEQ ID NO: 254948 - DNA, 48 bp, Artificial Sequence
  Description of Artificial Sequence: Synthetic oligonucleotide
ttttctgaggtaaaactggatcaaacttgttcaaaagtttcaacttgg

SEQ ID NO: 254949 - DNA, 47 bp, Artificial Sequence
  Description of Artificial Sequence: Synthetic oligonucleotide
tttctgaggtaaaactggatcaaacttgttcaaaagtttcaacttgg

SEQ ID NO: 254950 - DNA, 46 bp, Artificial Sequence
  Description of Artificial Sequence: Synthetic oligonucleotide
ttctgaggtaaaactggatcaaacttgttcaaaagtttcaacttgg

SEQ ID NO: 254951 - DNA, 45 bp, Artificial Sequence
  Description of Artificial Sequence: Synthetic oligonucleotide
tctgaggtaaaactggatcaaacttgttcaaaagtttcaacttgg

SEQ ID NO: 254952 - DNA, 44 bp, Artificial Sequence
  Description of Artificial Sequence: Synthetic oligonucleotide
ctgaggtaaaactggatcaaacttgttcaaaagtttcaacttgg

SEQ ID NO: 254953 - DNA, 44 bp, Artificial Sequence
  Description of Artificial Sequence: Synthetic oligonucleotide
tgaggtaaaactggatcaaacttgttcaaaagtttcaacttggc

SEQ ID NO: 254954 - DNA, 43 bp, Artificial Sequence
  Description of Artificial Sequence: Synthetic oligonucleotide
gaggtaaaactggatcaaacttgttcaaaagtttcaacttggc

SEQ ID NO: 254955 - DNA, 44 bp, Artificial Sequence
  Description of Artificial Sequence: Synthetic oligonucleotide
aggtaaaactggatcaaacttgttcaaaagtttcaacttggctg

SEQ ID NO: 254956 - DNA, 43 bp, Artificial Sequence
  Description of Artificial Sequence: Synthetic oligonucleotide
ggtaaaactggatcaaacttgttcaaaagtttcaacttggctg

SEQ ID NO: 254957 - DNA, 45 bp, Artificial Sequence
  Description of Artificial Sequence: Synthetic oligonucleotide
gtaaaactggatcaaacttgttcaaaagtttcaacttggctgatc

SEQ ID NO: 254958 - DNA, 47 bp, Artificial Sequence
  Description of Artificial Sequence: Synthetic oligonucleotide
taaaactggatcaaacttgttcaaaagtttcaacttggctgatcttc

SEQ ID NO: 254959 - DNA, 46 bp, Artificial Sequence
  Description of Artificial Sequence: Synthetic oligonucleotide
aaaactggatcaaacttgttcaaaagtttcaacttggctgatcttc

SEQ ID NO: 254960 - DNA, 45 bp, Artificial Sequence
  Description of Artificial Sequence: Synthetic oligonucleotide
aaactggatcaaacttgttcaaaagtttcaacttggctgatcttc

SEQ ID NO: 254961 - DNA, 44 bp, Artificial Sequence
  Description of Artificial Sequence: Synthetic oligonucleotide
aactggatcaaacttgttcaaaagtttcaacttggctgatcttc

SEQ ID NO: 254962 - DNA, 43 bp, Artificial Sequence
  Description of Artificial Sequence: Synthetic oligonucleotide
actggatcaaacttgttcaaaagtttcaacttggctgatcttc

SEQ ID NO: 254963 - DNA, 42 bp, Artificial Sequence
  Description of Artificial Sequence: Synthetic oligonucleotide
ctggatcaaacttgttcaaaagtttcaacttggctgatcttc

SEQ ID NO: 254964 - DNA, 42 bp, Artificial Sequence
  Description of Artificial Sequence: Synthetic oligonucleotide
tggatcaaacttgttcaaaagtttcaacttggctgatcttcc

SEQ ID NO: 254965 - DNA, 41 bp, Artificial Sequence
  Description of Artificial Sequence: Synthetic oligonucleotide
ggatcaaacttgttcaaaagtttcaacttggctgatcttcc

SEQ ID NO: 254966 - DNA, 44 bp, Artificial Sequence
  Description of Artificial Sequence: Synthetic oligonucleotide
gatcaaacttgttcaaaagtttcaacttggctgatcttccattg

SEQ ID NO: 254967 - DNA, 44 bp, Artificial Sequence
  Description of Artificial Sequence: Synthetic oligonucleotide
atcaaacttgttcaaaagtttcaacttggctgatcttccattgc

SEQ ID NO: 254968 - DNA, 43 bp, Artificial Sequence
  Description of Artificial Sequence: Synthetic oligonucleotide
tcaaacttgttcaaaagtttcaacttggctgatcttccattgc

SEQ ID NO: 254969 - DNA, 42 bp, Artificial Sequence
  Description of Artificial Sequence: Synthetic oligonucleotide
caaacttgttcaaaagtttcaacttggctgatcttccattgc

SEQ ID NO: 254970 - DNA, 42 bp, Artificial Sequence
  Description of Artificial Sequence: Synthetic oligonucleotide
aaacttgttcaaaagtttcaacttggctgatcttccattgcc

SEQ ID NO: 254971 - DNA, 41 bp, Artificial Sequence
  Description of Artificial Sequence: Synthetic oligonucleotide
aacttgttcaaaagtttcaacttggctgatcttccattgcc

SEQ ID NO: 254972 - DNA, 40 bp, Artificial Sequence
  Description of Artificial Sequence: Synthetic oligonucleotide
acttgttcaaaagtttcaacttggctgatcttccattgcc

SEQ ID NO: 254973 - DNA, 39 bp, Artificial Sequence
  Description of Artificial Sequence: Synthetic oligonucleotide
cttgttcaaaagtttcaacttggctgatcttccattgcc

SEQ ID NO: 254974 - DNA, 39 bp, Artificial Sequence
  Description of Artificial Sequence: Synthetic oligonucleotide
ttgttcaaaagtttcaacttggctgatcttccattgccc

SEQ ID NO: 254975 - DNA, 38 bp, Artificial Sequence
  Description of Artificial Sequence: Synthetic oligonucleotide
tgttcaaaagtttcaacttggctgatcttccattgccc

SEQ ID NO: 254976 - DNA, 37 bp, Artificial Sequence
  Description of Artificial Sequence: Synthetic oligonucleotide
gttcaaaagtttcaacttggctgatcttccattgccc

SEQ ID NO: 254977 - DNA, 38 bp, Artificial Sequence
  Description of Artificial Sequence: Synthetic oligonucleotide
ttcaaaagtttcaacttggctgatcttccattgcccac

SEQ ID NO: 254978 - DNA, 37 bp, Artificial Sequence
  Description of Artificial Sequence: Synthetic oligonucleotide
tcaaaagtttcaacttggctgatcttccattgcccac

SEQ ID NO: 254979 - DNA, 36 bp, Artificial Sequence
  Description of Artificial Sequence: Synthetic oligonucleotide
caaaagtttcaacttggctgatcttccattgcccac

SEQ ID NO: 254980 - DNA, 38 bp, Artificial Sequence
  Description of Artificial Sequence: Synthetic oligonucleotide
aaaagtttcaacttggctgatcttccattgcccacatg

SEQ ID NO: 254981 - DNA, 37 bp, Artificial Sequence
  Description of Artificial Sequence: Synthetic oligonucleotide
aaagtttcaacttggctgatcttccattgcccacatg

SEQ ID NO: 254982 - DNA, 36 bp, Artificial Sequence
  Description of Artificial Sequence: Synthetic oligonucleotide
aagtttcaacttggctgatcttccattgcccacatg

SEQ ID NO: 254983 - DNA, 35 bp, Artificial Sequence
  Description of Artificial Sequence: Synthetic oligonucleotide
agtttcaacttggctgatcttccattgcccacatg

SEQ ID NO: 254984 - DNA, 34 bp, Artificial Sequence
  Description of Artificial Sequence: Synthetic oligonucleotide
gtttcaacttggctgatcttccattgcccacatg

SEQ ID NO: 254985 - DNA, 34 bp, Artificial Sequence
  Description of Artificial Sequence: Synthetic oligonucleotide
tttcaacttggctgatcttccattgcccacatgc

SEQ ID NO: 254986 - DNA, 33 bp, Artificial Sequence
  Description of Artificial Sequence: Synthetic oligonucleotide
ttcaacttggctgatcttccattgcccacatgc

SEQ ID NO: 254987 - DNA, 32 bp, Artificial Sequence
  Description of Artificial Sequence: Synthetic oligonucleotide
tcaacttggctgatcttccattgcccacatgc

SEQ ID NO: 254988 - DNA, 31 bp, Artificial Sequence
  Description of Artificial Sequence: Synthetic oligonucleotide
caacttggctgatcttccattgcccacatgc

SEQ ID NO: 254989 - DNA, 35 bp, Artificial Sequence
  Description of Artificial Sequence: Synthetic oligonucleotide
aacttggctgatcttccattgcccacatgctaatg

SEQ ID NO: 254990 - DNA, 34 bp, Artificial Sequence
  Description of Artificial Sequence: Synthetic oligonucleotide
acttggctgatcttccattgcccacatgctaatg

SEQ ID NO: 254991 - DNA, 33 bp, Artificial Sequence
  Description of Artificial Sequence: Synthetic oligonucleotide
cttggctgatcttccattgcccacatgctaatg

SEQ ID NO: 254992 - DNA, 33 bp, Artificial Sequence
  Description of Artificial Sequence: Synthetic oligonucleotide
ttggctgatcttccattgcccacatgctaatgg

SEQ ID NO: 254993 - DNA, 32 bp, Artificial Sequence
  Description of Artificial Sequence: Synthetic oligonucleotide
tggctgatcttccattgcccacatgctaatgg

SEQ ID NO: 254994 - DNA, 31 bp, Artificial Sequence
  Description of Artificial Sequence: Synthetic oligonucleotide
ggctgatcttccattgcccacatgctaatgg

SEQ ID NO: 254995 - DNA, 31 bp, Artificial Sequence
  Description of Artificial Sequence: Synthetic oligonucleotide
gctgatcttccattgcccacatgctaatggg

SEQ ID NO: 254996 - DNA, 33 bp, Artificial Sequence
  Description of Artificial Sequence: Synthetic oligonucleotide
ctgatcttccattgcccacatgctaatgggtag

SEQ ID NO: 254997 - DNA, 35 bp, Artificial Sequence
  Description of Artificial Sequence: Synthetic oligonucleotide
tgatcttccattgcccacatgctaatgggtagaac

SEQ ID NO: 254998 - DNA, 34 bp, Artificial Sequence
  Description of Artificial Sequence: Synthetic oligonucleotide
gatcttccattgcccacatgctaatgggtagaac

SEQ ID NO: 254999 - DNA, 38 bp, Artificial Sequence
  Description of Artificial Sequence: Synthetic oligonucleotide
atcttccattgcccacatgctaatgggtagaacaaatc

SEQ ID NO: 255000 - DNA, 37 bp, Artificial Sequence
  Description of Artificial Sequence: Synthetic oligonucleotide
tcttccattgcccacatgctaatgggtagaacaaatc

SEQ ID NO: 255001 - DNA, 36 bp, Artificial Sequence
  Description of Artificial Sequence: Synthetic oligonucleotide
cttccattgcccacatgctaatgggtagaacaaatc

SEQ ID NO: 255002 - DNA, 40 bp, Artificial Sequence
  Description of Artificial Sequence: Synthetic oligonucleotide
ttccattgcccacatgctaatgggtagaacaaatcatttc

SEQ ID NO: 255003 - DNA, 39 bp, Artificial Sequence
  Description of Artificial Sequence: Synthetic oligonucleotide
tccattgcccacatgctaatgggtagaacaaatcatttc

SEQ ID NO: 255004 - DNA, 38 bp, Artificial Sequence
  Description of Artificial Sequence: Synthetic oligonucleotide
ccattgcccacatgctaatgggtagaacaaatcatttc

SEQ ID NO: 255005 - DNA, 39 bp, Artificial Sequence
  Description of Artificial Sequence: Synthetic oligonucleotide
cattgcccacatgctaatgggtagaacaaatcatttctc

SEQ ID NO: 255006 - DNA, 39 bp, Artificial Sequence
  Description of Artificial Sequence: Synthetic oligonucleotide
attgcccacatgctaatgggtagaacaaatcatttctcc

SEQ ID NO: 255007 - DNA, 38 bp, Artificial Sequence
  Description of Artificial Sequence: Synthetic oligonucleotide
ttgcccacatgctaatgggtagaacaaatcatttctcc

SEQ ID NO: 255008 - DNA, 37 bp, Artificial Sequence
  Description of Artificial Sequence: Synthetic oligonucleotide
tgcccacatgctaatgggtagaacaaatcatttctcc

SEQ ID NO: 255009 - DNA, 36 bp, Artificial Sequence
  Description of Artificial Sequence: Synthetic oligonucleotide
gcccacatgctaatgggtagaacaaatcatttctcc

SEQ ID NO: 255010 - DNA, 37 bp, Artificial Sequence
  Description of Artificial Sequence: Synthetic oligonucleotide
cccacatgctaatgggtagaacaaatcatttctccac

SEQ ID NO: 255011 - DNA, 39 bp, Artificial Sequence
  Description of Artificial Sequence: Synthetic oligonucleotide
ccacatgctaatgggtagaacaaatcatttctccacatg

SEQ ID NO: 255012 - DNA, 41 bp, Artificial Sequence
  Description of Artificial Sequence: Synthetic oligonucleotide
cacatgctaatgggtagaacaaatcatttctccacatgaac

SEQ ID NO: 255013 - DNA, 42 bp, Artificial Sequence
  Description of Artificial Sequence: Synthetic oligonucleotide
acatgctaatgggtagaacaaatcatttctccacatgaacac

SEQ ID NO: 255014 - DNA, 41 bp, Artificial Sequence
  Description of Artificial Sequence: Synthetic oligonucleotide
catgctaatgggtagaacaaatcatttctccacatgaacac

SEQ ID NO: 255015 - DNA, 41 bp, Artificial Sequence
  Description of Artificial Sequence: Synthetic oligonucleotide
atgctaatgggtagaacaaatcatttctccacatgaacacg

SEQ ID NO: 255016 - DNA, 40 bp, Artificial Sequence
  Description of Artificial Sequence: Synthetic oligonucleotide
tgctaatgggtagaacaaatcatttctccacatgaacacg

SEQ ID NO: 255017 - DNA, 39 bp, Artificial Sequence
  Description of Artificial Sequence: Synthetic oligonucleotide
gctaatgggtagaacaaatcatttctccacatgaacacg

SEQ ID NO: 255018 - DNA, 39 bp, Artificial Sequence
  Description of Artificial Sequence: Synthetic oligonucleotide
ctaatgggtagaacaaatcatttctccacatgaacacgg

SEQ ID NO: 255019 - DNA, 39 bp, Artificial Sequence
  Description of Artificial Sequence: Synthetic oligonucleotide
taatgggtagaacaaatcatttctccacatgaacacggc

SEQ ID NO: 255020 - DNA, 38 bp, Artificial Sequence
  Description of Artificial Sequence: Synthetic oligonucleotide
aatgggtagaacaaatcatttctccacatgaacacggc

SEQ ID NO: 255021 - DNA, 37 bp, Artificial Sequence
  Description of Artificial Sequence: Synthetic oligonucleotide
atgggtagaacaaatcatttctccacatgaacacggc

SEQ ID NO: 255022 - DNA, 36 bp, Artificial Sequence
  Description of Artificial Sequence: Synthetic oligonucleotide
tgggtagaacaaatcatttctccacatgaacacggc

SEQ ID NO: 255023 - DNA, 35 bp, Artificial Sequence
  Description of Artificial Sequence: Synthetic oligonucleotide
gggtagaacaaatcatttctccacatgaacacggc

SEQ ID NO: 255024 - DNA, 37 bp, Artificial Sequence
  Description of Artificial Sequence: Synthetic oligonucleotide
ggtagaacaaatcatttctccacatgaacacggcatg

SEQ ID NO: 255025 - DNA, 39 bp, Artificial Sequence
  Description of Artificial Sequence: Synthetic oligonucleotide
gtagaacaaatcatttctccacatgaacacggcatgaag

SEQ ID NO: 255026 - DNA, 40 bp, Artificial Sequence
  Description of Artificial Sequence: Synthetic oligonucleotide
tagaacaaatcatttctccacatgaacacggcatgaagag

SEQ ID NO: 255027 - DNA, 39 bp, Artificial Sequence
  Description of Artificial Sequence: Synthetic oligonucleotide
agaacaaatcatttctccacatgaacacggcatgaagag

SEQ ID NO: 255028 - DNA, 38 bp, Artificial Sequence
  Description of Artificial Sequence: Synthetic oligonucleotide
gaacaaatcatttctccacatgaacacggcatgaagag

SEQ ID NO: 255029 - DNA, 38 bp, Artificial Sequence
  Description of Artificial Sequence: Synthetic oligonucleotide
aacaaatcatttctccacatgaacacggcatgaagagg

SEQ ID NO: 255030 - DNA, 37 bp, Artificial Sequence
  Description of Artificial Sequence: Synthetic oligonucleotide
acaaatcatttctccacatgaacacggcatgaagagg

SEQ ID NO: 255031 - DNA, 36 bp, Artificial Sequence
  Description of Artificial Sequence: Synthetic oligonucleotide
caaatcatttctccacatgaacacggcatgaagagg

SEQ ID NO: 255032 - DNA, 41 bp, Artificial Sequence
  Description of Artificial Sequence: Synthetic oligonucleotide
aaatcatttctccacatgaacacggcatgaagaggttaaag

SEQ ID NO: 255033 - DNA, 40 bp, Artificial Sequence
  Description of Artificial Sequence: Synthetic oligonucleotide
aatcatttctccacatgaacacggcatgaagaggttaaag

SEQ ID NO: 255034 - DNA, 39 bp, Artificial Sequence
  Description of Artificial Sequence: Synthetic oligonucleotide
atcatttctccacatgaacacggcatgaagaggttaaag

SEQ ID NO: 255035 - DNA, 38 bp, Artificial Sequence
  Description of Artificial Sequence: Synthetic oligonucleotide
tcatttctccacatgaacacggcatgaagaggttaaag

SEQ ID NO: 255036 - DNA, 37 bp, Artificial Sequence
  Description of Artificial Sequence: Synthetic oligonucleotide
catttctccacatgaacacggcatgaagaggttaaag

SEQ ID NO: 255037 - DNA, 37 bp, Artificial Sequence
  Description of Artificial Sequence: Synthetic oligonucleotide
atttctccacatgaacacggcatgaagaggttaaagg

SEQ ID NO: 255038 - DNA, 36 bp, Artificial Sequence
  Description of Artificial Sequence: Synthetic oligonucleotide
tttctccacatgaacacggcatgaagaggttaaagg

SEQ ID NO: 255039 - DNA, 35 bp, Artificial Sequence
  Description of Artificial Sequence: Synthetic oligonucleotide
ttctccacatgaacacggcatgaagaggttaaagg

SEQ ID NO: 255040 - DNA, 34 bp, Artificial Sequence
  Description of Artificial Sequence: Synthetic oligonucleotide
tctccacatgaacacggcatgaagaggttaaagg

SEQ ID NO: 255041 - DNA, 33 bp, Artificial Sequence
  Description of Artificial Sequence: Synthetic oligonucleotide
ctccacatgaacacggcatgaagaggttaaagg

SEQ ID NO: 255042 - DNA, 36 bp, Artificial Sequence
  Description of Artificial Sequence: Synthetic oligonucleotide
tccacatgaacacggcatgaagaggttaaaggattc

SEQ ID NO: 255043 - DNA, 35 bp, Artificial Sequence
  Description of Artificial Sequence: Synthetic oligonucleotide
ccacatgaacacggcatgaagaggttaaaggattc

SEQ ID NO: 255044 - DNA, 37 bp, Artificial Sequence
  Description of Artificial Sequence: Synthetic oligonucleotide
cacatgaacacggcatgaagaggttaaaggattcatc

SEQ ID NO: 255045 - DNA, 38 bp, Artificial Sequence
  Description of Artificial Sequence: Synthetic oligonucleotide
acatgaacacggcatgaagaggttaaaggattcatcag

SEQ ID NO: 255046 - DNA, 37 bp, Artificial Sequence
  Description of Artificial Sequence: Synthetic oligonucleotide
catgaacacggcatgaagaggttaaaggattcatcag

SEQ ID NO: 255047 - DNA, 37 bp, Artificial Sequence
  Description of Artificial Sequence: Synthetic oligonucleotide
atgaacacggcatgaagaggttaaaggattcatcagc

SEQ ID NO: 255048 - DNA, 36 bp, Artificial Sequence
  Description of Artificial Sequence: Synthetic oligonucleotide
tgaacacggcatgaagaggttaaaggattcatcagc

SEQ ID NO: 255049 - DNA, 35 bp, Artificial Sequence
  Description of Artificial Sequence: Synthetic oligonucleotide
gaacacggcatgaagaggttaaaggattcatcagc

SEQ ID NO: 255050 - DNA, 36 bp, Artificial Sequence
  Description of Artificial Sequence: Synthetic oligonucleotide
aacacggcatgaagaggttaaaggattcatcagctc

SEQ ID NO: 255051 - DNA, 35 bp, Artificial Sequence
  Description of Artificial Sequence: Synthetic oligonucleotide
acacggcatgaagaggttaaaggattcatcagctc

SEQ ID NO: 255052 - DNA, 34 bp, Artificial Sequence
  Description of Artificial Sequence: Synthetic oligonucleotide
cacggcatgaagaggttaaaggattcatcagctc

SEQ ID NO: 255053 - DNA, 37 bp, Artificial Sequence
  Description of Artificial Sequence: Synthetic oligonucleotide
acggcatgaagaggttaaaggattcatcagctcttag

SEQ ID NO: 255054 - DNA, 36 bp, Artificial Sequence
  Description of Artificial Sequence: Synthetic oligonucleotide
cggcatgaagaggttaaaggattcatcagctcttag

SEQ ID NO: 255055 - DNA, 39 bp, Artificial Sequence
  Description of Artificial Sequence: Synthetic oligonucleotide
ggcatgaagaggttaaaggattcatcagctcttagaaag

SEQ ID NO: 255056 - DNA, 44 bp, Artificial Sequence
  Description of Artificial Sequence: Synthetic oligonucleotide
gcatgaagaggttaaaggattcatcagctcttagaaagaaaaag

SEQ ID NO: 255057 - DNA, 44 bp, Artificial Sequence
  Description of Artificial Sequence: Synthetic oligonucleotide
catgaagaggttaaaggattcatcagctcttagaaagaaaaagg

SEQ ID NO: 255058 - DNA, 46 bp, Artificial Sequence
  Description of Artificial Sequence: Synthetic oligonucleotide
atgaagaggttaaaggattcatcagctcttagaaagaaaaaggttc

SEQ ID NO: 255059 - DNA, 45 bp, Artificial Sequence
  Description of Artificial Sequence: Synthetic oligonucleotide
tgaagaggttaaaggattcatcagctcttagaaagaaaaaggttc

SEQ ID NO: 255060 - DNA, 44 bp, Artificial Sequence
  Description of Artificial Sequence: Synthetic oligonucleotide
gaagaggttaaaggattcatcagctcttagaaagaaaaaggttc

SEQ ID NO: 255061 - DNA, 45 bp, Artificial Sequence
  Description of Artificial Sequence: Synthetic oligonucleotide
aagaggttaaaggattcatcagctcttagaaagaaaaaggttctc

SEQ ID NO: 255062 - DNA, 44 bp, Artificial Sequence
  Description of Artificial Sequence: Synthetic oligonucleotide
agaggttaaaggattcatcagctcttagaaagaaaaaggttctc

SEQ ID NO: 255063 - DNA, 43 bp, Artificial Sequence
  Description of Artificial Sequence: Synthetic oligonucleotide
gaggttaaaggattcatcagctcttagaaagaaaaaggttctc

SEQ ID NO: 255064 - DNA, 44 bp, Artificial Sequence
  Description of Artificial Sequence: Synthetic oligonucleotide
aggttaaaggattcatcagctcttagaaagaaaaaggttctcag

SEQ ID NO: 255065 - DNA, 43 bp, Artificial Sequence
  Description of Artificial Sequence: Synthetic oligonucleotide
ggttaaaggattcatcagctcttagaaagaaaaaggttctcag

SEQ ID NO: 255066 - DNA, 43 bp, Artificial Sequence
  Description of Artificial Sequence: Synthetic oligonucleotide
gttaaaggattcatcagctcttagaaagaaaaaggttctcagg

SEQ ID NO: 255067 - DNA, 44 bp, Artificial Sequence
  Description of Artificial Sequence: Synthetic oligonucleotide
ttaaaggattcatcagctcttagaaagaaaaaggttctcaggtc

SEQ ID NO: 255068 - DNA, 43 bp, Artificial Sequence
  Description of Artificial Sequence: Synthetic oligonucleotide
taaaggattcatcagctcttagaaagaaaaaggttctcaggtc

SEQ ID NO: 255069 - DNA, 42 bp, Artificial Sequence
  Description of Artificial Sequence: Synthetic oligonucleotide
aaaggattcatcagctcttagaaagaaaaaggttctcaggtc

SEQ ID NO: 255070 - DNA, 41 bp, Artificial Sequence
  Description of Artificial Sequence: Synthetic oligonucleotide
aaggattcatcagctcttagaaagaaaaaggttctcaggtc

SEQ ID NO: 255071 - DNA, 40 bp, Artificial Sequence
  Description of Artificial Sequence: Synthetic oligonucleotide
aggattcatcagctcttagaaagaaaaaggttctcaggtc

SEQ ID NO: 255072 - DNA, 39 bp, Artificial Sequence
  Description of Artificial Sequence: Synthetic oligonucleotide
ggattcatcagctcttagaaagaaaaaggttctcaggtc

SEQ ID NO: 255073 - DNA, 39 bp, Artificial Sequence
  Description of Artificial Sequence: Synthetic oligonucleotide
gattcatcagctcttagaaagaaaaaggttctcaggtcc

SEQ ID NO: 255074 - DNA, 39 bp, Artificial Sequence
  Description of Artificial Sequence: Synthetic oligonucleotide
attcatcagctcttagaaagaaaaaggttctcaggtccg

SEQ ID NO: 255075 - DNA, 38 bp, Artificial Sequence
  Description of Artificial Sequence: Synthetic oligonucleotide
ttcatcagctcttagaaagaaaaaggttctcaggtccg

SEQ ID NO: 255076 - DNA, 37 bp, Artificial Sequence
  Description of Artificial Sequence: Synthetic oligonucleotide
tcatcagctcttagaaagaaaaaggttctcaggtccg

SEQ ID NO: 255077 - DNA, 36 bp, Artificial Sequence
  Description of Artificial Sequence: Synthetic oligonucleotide
catcagctcttagaaagaaaaaggttctcaggtccg

SEQ ID NO: 255078 - DNA, 38 bp, Artificial Sequence
  Description of Artificial Sequence: Synthetic oligonucleotide
atcagctcttagaaagaaaaaggttctcaggtccgttg

SEQ ID NO: 255079 - DNA, 37 bp, Artificial Sequence
  Description of Artificial Sequence: Synthetic oligonucleotide
tcagctcttagaaagaaaaaggttctcaggtccgttg

SEQ ID NO: 255080 - DNA, 36 bp, Artificial Sequence
  Description of Artificial Sequence: Synthetic oligonucleotide
cagctcttagaaagaaaaaggttctcaggtccgttg

SEQ ID NO: 255081 - DNA, 37 bp, Artificial Sequence
  Description of Artificial Sequence: Synthetic oligonucleotide
agctcttagaaagaaaaaggttctcaggtccgttgtg

SEQ ID NO: 255082 - DNA, 36 bp, Artificial Sequence
  Description of Artificial Sequence: Synthetic oligonucleotide
gctcttagaaagaaaaaggttctcaggtccgttgtg

SEQ ID NO: 255083 - DNA, 37 bp, Artificial Sequence
  Description of Artificial Sequence: Synthetic oligonucleotide
ctcttagaaagaaaaaggttctcaggtccgttgtgac

SEQ ID NO: 255084 - DNA, 37 bp, Artificial Sequence
  Description of Artificial Sequence: Synthetic oligonucleotide
tcttagaaagaaaaaggttctcaggtccgttgtgacc

SEQ ID NO: 255085 - DNA, 36 bp, Artificial Sequence
  Description of Artificial Sequence: Synthetic oligonucleotide
cttagaaagaaaaaggttctcaggtccgttgtgacc

SEQ ID NO: 255086 - DNA, 38 bp, Artificial Sequence
  Description of Artificial Sequence: Synthetic oligonucleotide
ttagaaagaaaaaggttctcaggtccgttgtgaccaac

SEQ ID NO: 255087 - DNA, 37 bp, Artificial Sequence
  Description of Artificial Sequence: Synthetic oligonucleotide
tagaaagaaaaaggttctcaggtccgttgtgaccaac

SEQ ID NO: 255088 - DNA, 36 bp, Artificial Sequence
  Description of Artificial Sequence: Synthetic oligonucleotide
agaaagaaaaaggttctcaggtccgttgtgaccaac

SEQ ID NO: 255089 - DNA, 35 bp, Artificial Sequence
  Description of Artificial Sequence: Synthetic oligonucleotide
gaaagaaaaaggttctcaggtccgttgtgaccaac

SEQ ID NO: 255090 - DNA, 36 bp, Artificial Sequence
  Description of Artificial Sequence: Synthetic oligonucleotide
aaagaaaaaggttctcaggtccgttgtgaccaacag

SEQ ID NO: 255091 - DNA, 35 bp, Artificial Sequence
  Description of Artificial Sequence: Synthetic oligonucleotide
aagaaaaaggttctcaggtccgttgtgaccaacag

SEQ ID NO: 255092 - DNA, 34 bp, Artificial Sequence
  Description of Artificial Sequence: Synthetic oligonucleotide
agaaaaaggttctcaggtccgttgtgaccaacag

SEQ ID NO: 255093 - DNA, 33 bp, Artificial Sequence
  Description of Artificial Sequence: Synthetic oligonucleotide
gaaaaaggttctcaggtccgttgtgaccaacag

SEQ ID NO: 255094 - DNA, 34 bp, Artificial Sequence
  Description of Artificial Sequence: Synthetic oligonucleotide
aaaaaggttctcaggtccgttgtgaccaacagac

SEQ ID NO: 255095 - DNA, 33 bp, Artificial Sequence
  Description of Artificial Sequence: Synthetic oligonucleotide
aaaaggttctcaggtccgttgtgaccaacagac

SEQ ID NO: 255096 - DNA, 32 bp, Artificial Sequence
  Description of Artificial Sequence: Synthetic oligonucleotide
aaaggttctcaggtccgttgtgaccaacagac

SEQ ID NO: 255097 - DNA, 31 bp, Artificial Sequence
  Description of Artificial Sequence: Synthetic oligonucleotide
aaggttctcaggtccgttgtgaccaacagac

SEQ ID NO: 255098 - DNA, 30 bp, Artificial Sequence
  Description of Artificial Sequence: Synthetic oligonucleotide
aggttctcaggtccgttgtgaccaacagac

SEQ ID NO: 255099 - DNA, 29 bp, Artificial Sequence
  Description of Artificial Sequence: Synthetic oligonucleotide
ggttctcaggtccgttgtgaccaacagac

SEQ ID NO: 255100 - DNA, 33 bp, Artificial Sequence
  Description of Artificial Sequence: Synthetic oligonucleotide
gttctcaggtccgttgtgaccaacagactattg

SEQ ID NO: 255101 - DNA, 36 bp, Artificial Sequence
  Description of Artificial Sequence: Synthetic oligonucleotide
ttctcaggtccgttgtgaccaacagactattgaaac

SEQ ID NO: 255102 - DNA, 35 bp, Artificial Sequence
  Description of Artificial Sequence: Synthetic oligonucleotide
tctcaggtccgttgtgaccaacagactattgaaac

SEQ ID NO: 255103 - DNA, 34 bp, Artificial Sequence
  Description of Artificial Sequence: Synthetic oligonucleotide
ctcaggtccgttgtgaccaacagactattgaaac

SEQ ID NO: 255104 - DNA, 34 bp, Artificial Sequence
  Description of Artificial Sequence: Synthetic oligonucleotide
tcaggtccgttgtgaccaacagactattgaaacc

SEQ ID NO: 255105 - DNA, 33 bp, Artificial Sequence
  Description of Artificial Sequence: Synthetic oligonucleotide
caggtccgttgtgaccaacagactattgaaacc

SEQ ID NO: 255106 - DNA, 36 bp, Artificial Sequence
  Description of Artificial Sequence: Synthetic oligonucleotide
aggtccgttgtgaccaacagactattgaaacctttg

SEQ ID NO: 255107 - DNA, 35 bp, Artificial Sequence
  Description of Artificial Sequence: Synthetic oligonucleotide
ggtccgttgtgaccaacagactattgaaacctttg

SEQ ID NO: 255108 - DNA, 37 bp, Artificial Sequence
  Description of Artificial Sequence: Synthetic oligonucleotide
gtccgttgtgaccaacagactattgaaacctttgaag

SEQ ID NO: 255109 - DNA, 41 bp, Artificial Sequence
  Description of Artificial Sequence: Synthetic oligonucleotide
tccgttgtgaccaacagactattgaaacctttgaagaaatc

SEQ ID NO: 255110 - DNA, 40 bp, Artificial Sequence
  Description of Artificial Sequence: Synthetic oligonucleotide
ccgttgtgaccaacagactattgaaacctttgaagaaatc

SEQ ID NO: 255111 - DNA, 42 bp, Artificial Sequence
  Description of Artificial Sequence: Synthetic oligonucleotide
cgttgtgaccaacagactattgaaacctttgaagaaatcatc

SEQ ID NO: 255112 - DNA, 42 bp, Artificial Sequence
  Description of Artificial Sequence: Synthetic oligonucleotide
gttgtgaccaacagactattgaaacctttgaagaaatcatcg

SEQ ID NO: 255113 - DNA, 42 bp, Artificial Sequence
  Description of Artificial Sequence: Synthetic oligonucleotide
ttgtgaccaacagactattgaaacctttgaagaaatcatcgg

SEQ ID NO: 255114 - DNA, 41 bp, Artificial Sequence
  Description of Artificial Sequence: Synthetic oligonucleotide
tgtgaccaacagactattgaaacctttgaagaaatcatcgg

SEQ ID NO: 255115 - DNA, 40 bp, Artificial Sequence
  Description of Artificial Sequence: Synthetic oligonucleotide
gtgaccaacagactattgaaacctttgaagaaatcatcgg

SEQ ID NO: 255116 - DNA, 42 bp, Artificial Sequence
  Description of Artificial Sequence: Synthetic oligonucleotide
tgaccaacagactattgaaacctttgaagaaatcatcggttg

SEQ ID NO: 255117 - DNA, 41 bp, Artificial Sequence
  Description of Artificial Sequence: Synthetic oligonucleotide
gaccaacagactattgaaacctttgaagaaatcatcggttg

SEQ ID NO: 255118 - DNA, 41 bp, Artificial Sequence
  Description of Artificial Sequence: Synthetic oligonucleotide
accaacagactattgaaacctttgaagaaatcatcggttgc

SEQ ID NO: 255119 - DNA, 40 bp, Artificial Sequence
  Description of Artificial Sequence: Synthetic oligonucleotide
ccaacagactattgaaacctttgaagaaatcatcggttgc

SEQ ID NO: 255120 - DNA, 42 bp, Artificial Sequence
  Description of Artificial Sequence: Synthetic oligonucleotide
caacagactattgaaacctttgaagaaatcatcggttgcatg

SEQ ID NO: 255121 - DNA, 42 bp, Artificial Sequence
  Description of Artificial Sequence: Synthetic oligonucleotide
aacagactattgaaacctttgaagaaatcatcggttgcatgg

SEQ ID NO: 255122 - DNA, 41 bp, Artificial Sequence
  Description of Artificial Sequence: Synthetic oligonucleotide
acagactattgaaacctttgaagaaatcatcggttgcatgg

SEQ ID NO: 255123 - DNA, 40 bp, Artificial Sequence
  Description of Artificial Sequence: Synthetic oligonucleotide
cagactattgaaacctttgaagaaatcatcggttgcatgg

SEQ ID NO: 255124 - DNA, 44 bp, Artificial Sequence
  Description of Artificial Sequence: Synthetic oligonucleotide
agactattgaaacctttgaagaaatcatcggttgcatggataag

SEQ ID NO: 255125 - DNA, 43 bp, Artificial Sequence
  Description of Artificial Sequence: Synthetic oligonucleotide
gactattgaaacctttgaagaaatcatcggttgcatggataag

SEQ ID NO: 255126 - DNA, 49 bp, Artificial Sequence
  Description of Artificial Sequence: Synthetic oligonucleotide
actattgaaacctttgaagaaatcatcggttgcatggataagtattttg

SEQ ID NO: 255127 - DNA, 48 bp, Artificial Sequence
  Description of Artificial Sequence: Synthetic oligonucleotide
ctattgaaacctttgaagaaatcatcggttgcatggataagtattttg

SEQ ID NO: 255128 - DNA, 55 bp, Artificial Sequence
  Description of Artificial Sequence: Synthetic oligonucleotide
tattgaaacctttgaagaaatcatcggttgcatggataagtattttgatataatc

SEQ ID NO: 255129 - DNA, 54 bp, Artificial Sequence
  Description of Artificial Sequence: Synthetic oligonucleotide
attgaaacctttgaagaaatcatcggttgcatggataagtattttgatataatc

SEQ ID NO: 255130 - DNA, 53 bp, Artificial Sequence
  Description of Artificial Sequence: Synthetic oligonucleotide
ttgaaacctttgaagaaatcatcggttgcatggataagtattttgatataatc

SEQ ID NO: 255131 - DNA, 52 bp, Artificial Sequence
  Description of Artificial Sequence: Synthetic oligonucleotide
tgaaacctttgaagaaatcatcggttgcatggataagtattttgatataatc

SEQ ID NO: 255132 - DNA, 51 bp, Artificial Sequence
  Description of Artificial Sequence: Synthetic oligonucleotide
gaaacctttgaagaaatcatcggttgcatggataagtattttgatataatc

SEQ ID NO: 255133 - DNA, 52 bp, Artificial Sequence
  Description of Artificial Sequence: Synthetic oligonucleotide
aaacctttgaagaaatcatcggttgcatggataagtattttgatataatcag

SEQ ID NO: 255134 - DNA, 51 bp, Artificial Sequence
  Description of Artificial Sequence: Synthetic oligonucleotide
aacctttgaagaaatcatcggttgcatggataagtattttgatataatcag

SEQ ID NO: 255135 - DNA, 50 bp, Artificial Sequence
  Description of Artificial Sequence: Synthetic oligonucleotide
acctttgaagaaatcatcggttgcatggataagtattttgatataatcag

SEQ ID NO: 255136 - DNA, 49 bp, Artificial Sequence
  Description of Artificial Sequence: Synthetic oligonucleotide
cctttgaagaaatcatcggttgcatggataagtattttgatataatcag

SEQ ID NO: 255137 - DNA, 50 bp, Artificial Sequence
  Description of Artificial Sequence: Synthetic oligonucleotide
ctttgaagaaatcatcggttgcatggataagtattttgatataatcagag

SEQ ID NO: 255138 - DNA, 51 bp, Artificial Sequence
  Description of Artificial Sequence: Synthetic oligonucleotide
tttgaagaaatcatcggttgcatggataagtattttgatataatcagagtc

SEQ ID NO: 255139 - DNA, 50 bp, Artificial Sequence
  Description of Artificial Sequence: Synthetic oligonucleotide
ttgaagaaatcatcggttgcatggataagtattttgatataatcagagtc

SEQ ID NO: 255140 - DNA, 49 bp, Artificial Sequence
  Description of Artificial Sequence: Synthetic oligonucleotide
tgaagaaatcatcggttgcatggataagtattttgatataatcagagtc

SEQ ID NO: 255141 - DNA, 48 bp, Artificial Sequence
  Description of Artificial Sequence: Synthetic oligonucleotide
gaagaaatcatcggttgcatggataagtattttgatataatcagagtc

SEQ ID NO: 255142 - DNA, 49 bp, Artificial Sequence
  Description of Artificial Sequence: Synthetic oligonucleotide
aagaaatcatcggttgcatggataagtattttgatataatcagagtctg

SEQ ID NO: 255143 - DNA, 48 bp, Artificial Sequence
  Description of Artificial Sequence: Synthetic oligonucleotide
agaaatcatcggttgcatggataagtattttgatataatcagagtctg

SEQ ID NO: 255144 - DNA, 47 bp, Artificial Sequence
  Description of Artificial Sequence: Synthetic oligonucleotide
gaaatcatcggttgcatggataagtattttgatataatcagagtctg

SEQ ID NO: 255145 - DNA, 47 bp, Artificial Sequence
  Description of Artificial Sequence: Synthetic oligonucleotide
aaatcatcggttgcatggataagtattttgatataatcagagtctgg

SEQ ID NO: 255146 - DNA, 46 bp, Artificial Sequence
  Description of Artificial Sequence: Synthetic oligonucleotide
aatcatcggttgcatggataagtattttgatataatcagagtctgg

SEQ ID NO: 255147 - DNA, 45 bp, Artificial Sequence
  Description of Artificial Sequence: Synthetic oligonucleotide
atcatcggttgcatggataagtattttgatataatcagagtctgg

SEQ ID NO: 255148 - DNA, 44 bp, Artificial Sequence
  Description of Artificial Sequence: Synthetic oligonucleotide
tcatcggttgcatggataagtattttgatataatcagagtctgg

SEQ ID NO: 255149 - DNA, 43 bp, Artificial Sequence
  Description of Artificial Sequence: Synthetic oligonucleotide
catcggttgcatggataagtattttgatataatcagagtctgg

SEQ ID NO: 255150 - DNA, 43 bp, Artificial Sequence
  Description of Artificial Sequence: Synthetic oligonucleotide
atcggttgcatggataagtattttgatataatcagagtctggc

SEQ ID NO: 255151 - DNA, 42 bp, Artificial Sequence
  Description of Artificial Sequence: Synthetic oligonucleotide
tcggttgcatggataagtattttgatataatcagagtctggc

SEQ ID NO: 255152 - DNA, 41 bp, Artificial Sequence
  Description of Artificial Sequence: Synthetic oligonucleotide
cggttgcatggataagtattttgatataatcagagtctggc

SEQ ID NO: 255153 - DNA, 42 bp, Artificial Sequence
  Description of Artificial Sequence: Synthetic oligonucleotide
ggttgcatggataagtattttgatataatcagagtctggctg

SEQ ID NO: 255154 - DNA, 42 bp, Artificial Sequence
  Description of Artificial Sequence: Synthetic oligonucleotide
gttgcatggataagtattttgatataatcagagtctggctgc

SEQ ID NO: 255155 - DNA, 45 bp, Artificial Sequence
  Description of Artificial Sequence: Synthetic oligonucleotide
ttgcatggataagtattttgatataatcagagtctggctgcaatg

SEQ ID NO: 255156 - DNA, 44 bp, Artificial Sequence
  Description of Artificial Sequence: Synthetic oligonucleotide
tgcatggataagtattttgatataatcagagtctggctgcaatg

SEQ ID NO: 255157 - DNA, 43 bp, Artificial Sequence
  Description of Artificial Sequence: Synthetic oligonucleotide
gcatggataagtattttgatataatcagagtctggctgcaatg

SEQ ID NO: 255158 - DNA, 44 bp, Artificial Sequence
  Description of Artificial Sequence: Synthetic oligonucleotide
catggataagtattttgatataatcagagtctggctgcaatgtg

SEQ ID NO: 255159 - DNA, 48 bp, Artificial Sequence
  Description of Artificial Sequence: Synthetic oligonucleotide
atggataagtattttgatataatcagagtctggctgcaatgtgaaaag

SEQ ID NO: 255160 - DNA, 47 bp, Artificial Sequence
  Description of Artificial Sequence: Synthetic oligonucleotide
tggataagtattttgatataatcagagtctggctgcaatgtgaaaag

SEQ ID NO: 255161 - DNA, 46 bp, Artificial Sequence
  Description of Artificial Sequence: Synthetic oligonucleotide
ggataagtattttgatataatcagagtctggctgcaatgtgaaaag

SEQ ID NO: 255162 - DNA, 46 bp, Artificial Sequence
  Description of Artificial Sequence: Synthetic oligonucleotide
gataagtattttgatataatcagagtctggctgcaatgtgaaaagc

SEQ ID NO: 255163 - DNA, 48 bp, Artificial Sequence
  Description of Artificial Sequence: Synthetic oligonucleotide
ataagtattttgatataatcagagtctggctgcaatgtgaaaagcatg

SEQ ID NO: 255164 - DNA, 47 bp, Artificial Sequence
  Description of Artificial Sequence: Synthetic oligonucleotide
taagtattttgatataatcagagtctggctgcaatgtgaaaagcatg

SEQ ID NO: 255165 - DNA, 46 bp, Artificial Sequence
  Description of Artificial Sequence: Synthetic oligonucleotide
aagtattttgatataatcagagtctggctgcaatgtgaaaagcatg

SEQ ID NO: 255166 - DNA, 45 bp, Artificial Sequence
  Description of Artificial Sequence: Synthetic oligonucleotide
agtattttgatataatcagagtctggctgcaatgtgaaaagcatg

SEQ ID NO: 255167 - DNA, 44 bp, Artificial Sequence
  Description of Artificial Sequence: Synthetic oligonucleotide
gtattttgatataatcagagtctggctgcaatgtgaaaagcatg

SEQ ID NO: 255168 - DNA, 46 bp, Artificial Sequence
  Description of Artificial Sequence: Synthetic oligonucleotide
tattttgatataatcagagtctggctgcaatgtgaaaagcatgaac

SEQ ID NO: 255169 - DNA, 45 bp, Artificial Sequence
  Description of Artificial Sequence: Synthetic oligonucleotide
attttgatataatcagagtctggctgcaatgtgaaaagcatgaac

SEQ ID NO: 255170 - DNA, 44 bp, Artificial Sequence
  Description of Artificial Sequence: Synthetic oligonucleotide
ttttgatataatcagagtctggctgcaatgtgaaaagcatgaac

SEQ ID NO: 255171 - DNA, 43 bp, Artificial Sequence
  Description of Artificial Sequence: Synthetic oligonucleotide
tttgatataatcagagtctggctgcaatgtgaaaagcatgaac

SEQ ID NO: 255172 - DNA, 42 bp, Artificial Sequence
  Description of Artificial Sequence: Synthetic oligonucleotide
ttgatataatcagagtctggctgcaatgtgaaaagcatgaac

SEQ ID NO: 255173 - DNA, 41 bp, Artificial Sequence
  Description of Artificial Sequence: Synthetic oligonucleotide
tgatataatcagagtctggctgcaatgtgaaaagcatgaac

SEQ ID NO: 255174 - DNA, 40 bp, Artificial Sequence
  Description of Artificial Sequence: Synthetic oligonucleotide
gatataatcagagtctggctgcaatgtgaaaagcatgaac

SEQ ID NO: 255175 - DNA, 42 bp, Artificial Sequence
  Description of Artificial Sequence: Synthetic oligonucleotide
atataatcagagtctggctgcaatgtgaaaagcatgaacatg

SEQ ID NO: 255176 - DNA, 41 bp, Artificial Sequence
  Description of Artificial Sequence: Synthetic oligonucleotide
tataatcagagtctggctgcaatgtgaaaagcatgaacatg

SEQ ID NO: 255177 - DNA, 40 bp, Artificial Sequence
  Description of Artificial Sequence: Synthetic oligonucleotide
ataatcagagtctggctgcaatgtgaaaagcatgaacatg

SEQ ID NO: 255178 - DNA, 39 bp, Artificial Sequence
  Description of Artificial Sequence: Synthetic oligonucleotide
taatcagagtctggctgcaatgtgaaaagcatgaacatg

SEQ ID NO: 255179 - DNA, 38 bp, Artificial Sequence
  Description of Artificial Sequence: Synthetic oligonucleotide
aatcagagtctggctgcaatgtgaaaagcatgaacatg

SEQ ID NO: 255180 - DNA, 37 bp, Artificial Sequence
  Description of Artificial Sequence: Synthetic oligonucleotide
atcagagtctggctgcaatgtgaaaagcatgaacatg

SEQ ID NO: 255181 - DNA, 36 bp, Artificial Sequence
  Description of Artificial Sequence: Synthetic oligonucleotide
tcagagtctggctgcaatgtgaaaagcatgaacatg

SEQ ID NO: 255182 - DNA, 35 bp, Artificial Sequence
  Description of Artificial Sequence: Synthetic oligonucleotide
cagagtctggctgcaatgtgaaaagcatgaacatg

SEQ ID NO: 255183 - DNA, 37 bp, Artificial Sequence
  Description of Artificial Sequence: Synthetic oligonucleotide
agagtctggctgcaatgtgaaaagcatgaacatgaac

SEQ ID NO: 255184 - DNA, 36 bp, Artificial Sequence
  Description of Artificial Sequence: Synthetic oligonucleotide
gagtctggctgcaatgtgaaaagcatgaacatgaac

SEQ ID NO: 255185 - DNA, 36 bp, Artificial Sequence
  Description of Artificial Sequence: Synthetic oligonucleotide
agtctggctgcaatgtgaaaagcatgaacatgaacc

SEQ ID NO: 255186 - DNA, 35 bp, Artificial Sequence
  Description of Artificial Sequence: Synthetic oligonucleotide
gtctggctgcaatgtgaaaagcatgaacatgaacc

SEQ ID NO: 255187 - DNA, 36 bp, Artificial Sequence
  Description of Artificial Sequence: Synthetic oligonucleotide
tctggctgcaatgtgaaaagcatgaacatgaacctg

SEQ ID NO: 255188 - DNA, 35 bp, Artificial Sequence
  Description of Artificial Sequence: Synthetic oligonucleotide
ctggctgcaatgtgaaaagcatgaacatgaacctg

SEQ ID NO: 255189 - DNA, 37 bp, Artificial Sequence
  Description of Artificial Sequence: Synthetic oligonucleotide
tggctgcaatgtgaaaagcatgaacatgaacctgaag

SEQ ID NO: 255190 - DNA, 36 bp, Artificial Sequence
  Description of Artificial Sequence: Synthetic oligonucleotide
ggctgcaatgtgaaaagcatgaacatgaacctgaag

SEQ ID NO: 255191 - DNA, 36 bp, Artificial Sequence
  Description of Artificial Sequence: Synthetic oligonucleotide
gctgcaatgtgaaaagcatgaacatgaacctgaagc

SEQ ID NO: 255192 - DNA, 37 bp, Artificial Sequence
  Description of Artificial Sequence: Synthetic oligonucleotide
ctgcaatgtgaaaagcatgaacatgaacctgaagctc

SEQ ID NO: 255193 - DNA, 38 bp, Artificial Sequence
  Description of Artificial Sequence: Synthetic oligonucleotide
tgcaatgtgaaaagcatgaacatgaacctgaagctcac

SEQ ID NO: 255194 - DNA, 37 bp, Artificial Sequence
  Description of Artificial Sequence: Synthetic oligonucleotide
gcaatgtgaaaagcatgaacatgaacctgaagctcac

SEQ ID NO: 255195 - DNA, 37 bp, Artificial Sequence
  Description of Artificial Sequence: Synthetic oligonucleotide
caatgtgaaaagcatgaacatgaacctgaagctcacg

SEQ ID NO: 255196 - DNA, 37 bp, Artificial Sequence
  Description of Artificial Sequence: Synthetic oligonucleotide
aatgtgaaaagcatgaacatgaacctgaagctcacgc

SEQ ID NO: 255197 - DNA, 36 bp, Artificial Sequence
  Description of Artificial Sequence: Synthetic oligonucleotide
atgtgaaaagcatgaacatgaacctgaagctcacgc

SEQ ID NO: 255198 - DNA, 35 bp, Artificial Sequence
  Description of Artificial Sequence: Synthetic oligonucleotide
tgtgaaaagcatgaacatgaacctgaagctcacgc

SEQ ID NO: 255199 - DNA, 34 bp, Artificial Sequence
  Description of Artificial Sequence: Synthetic oligonucleotide
gtgaaaagcatgaacatgaacctgaagctcacgc

SEQ ID NO: 255200 - DNA, 36 bp, Artificial Sequence
  Description of Artificial Sequence: Synthetic oligonucleotide
tgaaaagcatgaacatgaacctgaagctcacgcaac

SEQ ID NO: 255201 - DNA, 35 bp, Artificial Sequence
  Description of Artificial Sequence: Synthetic oligonucleotide
gaaaagcatgaacatgaacctgaagctcacgcaac

SEQ ID NO: 255202 - DNA, 36 bp, Artificial Sequence
  Description of Artificial Sequence: Synthetic oligonucleotide
aaaagcatgaacatgaacctgaagctcacgcaactg

SEQ ID NO: 255203 - DNA, 35 bp, Artificial Sequence
  Description of Artificial Sequence: Synthetic oligonucleotide
aaagcatgaacatgaacctgaagctcacgcaactg

SEQ ID NO: 255204 - DNA, 34 bp, Artificial Sequence
  Description of Artificial Sequence: Synthetic oligonucleotide
aagcatgaacatgaacctgaagctcacgcaactg

SEQ ID NO: 255205 - DNA, 33 bp, Artificial Sequence
  Description of Artificial Sequence: Synthetic oligonucleotide
agcatgaacatgaacctgaagctcacgcaactg

SEQ ID NO: 255206 - DNA, 32 bp, Artificial Sequence
  Description of Artificial Sequence: Synthetic oligonucleotide
gcatgaacatgaacctgaagctcacgcaactg

SEQ ID NO: 255207 - DNA, 32 bp, Artificial Sequence
  Description of Artificial Sequence: Synthetic oligonucleotide
catgaacatgaacctgaagctcacgcaactgg

SEQ ID NO: 255208 - DNA, 34 bp, Artificial Sequence
  Description of Artificial Sequence: Synthetic oligonucleotide
atgaacatgaacctgaagctcacgcaactggatg

SEQ ID NO: 255209 - DNA, 33 bp, Artificial Sequence
  Description of Artificial Sequence: Synthetic oligonucleotide
tgaacatgaacctgaagctcacgcaactggatg

SEQ ID NO: 255210 - DNA, 32 bp, Artificial Sequence
  Description of Artificial Sequence: Synthetic oligonucleotide
gaacatgaacctgaagctcacgcaactggatg

SEQ ID NO: 255211 - DNA, 24 bp, Artificial Sequence
  Description of Artificial Sequence: Synthetic oligonucleotide
atggcctccgctgcgagtgaggag

SEQ ID NO: 255212 - DNA, 23 bp, Artificial Sequence
  Description of Artificial Sequence: Synthetic oligonucleotide
tggcctccgctgcgagtgaggag

SEQ ID NO: 255213 - DNA, 22 bp, Artificial Sequence
  Description of Artificial Sequence: Synthetic oligonucleotide
ggcctccgctgcgagtgaggag

SEQ ID NO: 255214 - DNA, 22 bp, Artificial Sequence
  Description of Artificial Sequence: Synthetic oligonucleotide
gcctccgctgcgagtgaggagc

SEQ ID NO: 255215 - DNA, 22 bp, Artificial Sequence
  Description of Artificial Sequence: Synthetic oligonucleotide
cctccgctgcgagtgaggagcc

SEQ ID NO: 255216 - DNA, 24 bp, Artificial Sequence
  Description of Artificial Sequence: Synthetic oligonucleotide
ctccgctgcgagtgaggagccgtt

SEQ ID NO: 255217 - DNA, 24 bp, Artificial Sequence
  Description of Artificial Sequence: Synthetic oligonucleotide
tccgctgcgagtgaggagccgttc

SEQ ID NO: 255218 - DNA, 23 bp, Artificial Sequence
  Description of Artificial Sequence: Synthetic oligonucleotide
ccgctgcgagtgaggagccgttc

SEQ ID NO: 255219 - DNA, 23 bp, Artificial Sequence
  Description of Artificial Sequence: Synthetic oligonucleotide
cgctgcgagtgaggagccgttcc

SEQ ID NO: 255220 - DNA, 27 bp, Artificial Sequence
  Description of Artificial Sequence: Synthetic oligonucleotide
gctgcgagtgaggagccgttccctttt

SEQ ID NO: 255221 - DNA, 27 bp, Artificial Sequence
  Description of Artificial Sequence: Synthetic oligonucleotide
ctgcgagtgaggagccgttcccttttg

SEQ ID NO: 255222 - DNA, 28 bp, Artificial Sequence
  Description of Artificial Sequence: Synthetic oligonucleotide
tgcgagtgaggagccgttcccttttgac

SEQ ID NO: 255223 - DNA, 27 bp, Artificial Sequence
  Description of Artificial Sequence: Synthetic oligonucleotide
gcgagtgaggagccgttcccttttgac

SEQ ID NO: 255224 - DNA, 27 bp, Artificial Sequence
  Description of Artificial Sequence: Synthetic oligonucleotide
cgagtgaggagccgttcccttttgacg

SEQ ID NO: 255225 - DNA, 27 bp, Artificial Sequence
  Description of Artificial Sequence: Synthetic oligonucleotide
gagtgaggagccgttcccttttgacgg

SEQ ID NO: 255226 - DNA, 28 bp, Artificial Sequence
  Description of Artificial Sequence: Synthetic oligonucleotide
agtgaggagccgttcccttttgacggtc

SEQ ID NO: 255227 - DNA, 27 bp, Artificial Sequence
  Description of Artificial Sequence: Synthetic oligonucleotide
gtgaggagccgttcccttttgacggtc

SEQ ID NO: 255228 - DNA, 28 bp, Artificial Sequence
  Description of Artificial Sequence: Synthetic oligonucleotide
tgaggagccgttcccttttgacggtctc

SEQ ID NO: 255229 - DNA, 27 bp, Artificial Sequence
  Description of Artificial Sequence: Synthetic oligonucleotide
gaggagccgttcccttttgacggtctc

SEQ ID NO: 255230 - DNA, 27 bp, Artificial Sequence
  Description of Artificial Sequence: Synthetic oligonucleotide
aggagccgttcccttttgacggtctcc

SEQ ID NO: 255231 - DNA, 27 bp, Artificial Sequence
  Description of Artificial Sequence: Synthetic oligonucleotide
ggagccgttcccttttgacggtctcca

SEQ ID NO: 255232 - DNA, 27 bp, Artificial Sequence
  Description of Artificial Sequence: Synthetic oligonucleotide
gagccgttcccttttgacggtctccag

SEQ ID NO: 255233 - DNA, 27 bp, Artificial Sequence
  Description of Artificial Sequence: Synthetic oligonucleotide
agccgttcccttttgacggtctccagc

SEQ ID NO: 255234 - DNA, 26 bp, Artificial Sequence
  Description of Artificial Sequence: Synthetic oligonucleotide
gccgttcccttttgacggtctccagc

SEQ ID NO: 255235 - DNA, 26 bp, Artificial Sequence
  Description of Artificial Sequence: Synthetic oligonucleotide
ccgttcccttttgacggtctccagcc

SEQ ID NO: 255236 - DNA, 27 bp, Artificial Sequence
  Description of Artificial Sequence: Synthetic oligonucleotide
cgttcccttttgacggtctccagccga

SEQ ID NO: 255237 - DNA, 28 bp, Artificial Sequence
  Description of Artificial Sequence: Synthetic oligonucleotide
gttcccttttgacggtctccagccgaag

SEQ ID NO: 255238 - DNA, 30 bp, Artificial Sequence
  Description of Artificial Sequence: Synthetic oligonucleotide
ttcccttttgacggtctccagccgaagaac

SEQ ID NO: 255239 - DNA, 29 bp, Artificial Sequence
  Description of Artificial Sequence: Synthetic oligonucleotide
tcccttttgacggtctccagccgaagaac

SEQ ID NO: 255240 - DNA, 28 bp, Artificial Sequence
  Description of Artificial Sequence: Synthetic oligonucleotide
cccttttgacggtctccagccgaagaac

SEQ ID NO: 255241 - DNA, 28 bp, Artificial Sequence
  Description of Artificial Sequence: Synthetic oligonucleotide
ccttttgacggtctccagccgaagaacg

SEQ ID NO: 255242 - DNA, 29 bp, Artificial Sequence
  Description of Artificial Sequence: Synthetic oligonucleotide
cttttgacggtctccagccgaagaacgag

SEQ ID NO: 255243 - DNA, 30 bp, Artificial Sequence
  Description of Artificial Sequence: Synthetic oligonucleotide
ttttgacggtctccagccgaagaacgagac

SEQ ID NO: 255244 - DNA, 29 bp, Artificial Sequence
  Description of Artificial Sequence: Synthetic oligonucleotide
tttgacggtctccagccgaagaacgagac

SEQ ID NO: 255245 - DNA, 28 bp, Artificial Sequence
  Description of Artificial Sequence: Synthetic oligonucleotide
ttgacggtctccagccgaagaacgagac

SEQ ID NO: 255246 - DNA, 27 bp, Artificial Sequence
  Description of Artificial Sequence: Synthetic oligonucleotide
tgacggtctccagccgaagaacgagac

SEQ ID NO: 255247 - DNA, 26 bp, Artificial Sequence
  Description of Artificial Sequence: Synthetic oligonucleotide
gacggtctccagccgaagaacgagac

SEQ ID NO: 255248 - DNA, 26 bp, Artificial Sequence
  Description of Artificial Sequence: Synthetic oligonucleotide
acggtctccagccgaagaacgagacc

SEQ ID NO: 255249 - DNA, 25 bp, Artificial Sequence
  Description of Artificial Sequence: Synthetic oligonucleotide
cggtctccagccgaagaacgagacc

SEQ ID NO: 255250 - DNA, 25 bp, Artificial Sequence
  Description of Artificial Sequence: Synthetic oligonucleotide
ggtctccagccgaagaacgagaccg

SEQ ID NO: 255251 - DNA, 26 bp, Artificial Sequence
  Description of Artificial Sequence: Synthetic oligonucleotide
gtctccagccgaagaacgagaccgga

SEQ ID NO: 255252 - DNA, 26 bp, Artificial Sequence
  Description of Artificial Sequence: Synthetic oligonucleotide
tctccagccgaagaacgagaccggac

SEQ ID NO: 255253 - DNA, 25 bp, Artificial Sequence
  Description of Artificial Sequence: Synthetic oligonucleotide
ctccagccgaagaacgagaccggac

SEQ ID NO: 255254 - DNA, 25 bp, Artificial Sequence
  Description of Artificial Sequence: Synthetic oligonucleotide
tccagccgaagaacgagaccggacc

SEQ ID NO: 255255 - DNA, 24 bp, Artificial Sequence
  Description of Artificial Sequence: Synthetic oligonucleotide
ccagccgaagaacgagaccggacc

SEQ ID NO: 255256 - DNA, 24 bp, Artificial Sequence
  Description of Artificial Sequence: Synthetic oligonucleotide
cagccgaagaacgagaccggaccc

SEQ ID NO: 255257 - DNA, 24 bp, Artificial Sequence
  Description of Artificial Sequence: Synthetic oligonucleotide
agccgaagaacgagaccggacccg

SEQ ID NO: 255258 - DNA, 23 bp, Artificial Sequence
  Description of Artificial Sequence: Synthetic oligonucleotide
gccgaagaacgagaccggacccg

SEQ ID NO: 255259 - DNA, 23 bp, Artificial Sequence
  Description of Artificial Sequence: Synthetic oligonucleotide
ccgaagaacgagaccggacccgc

SEQ ID NO: 255260 - DNA, 24 bp, Artificial Sequence
  Description of Artificial Sequence: Synthetic oligonucleotide
cgaagaacgagaccggacccgcct

SEQ ID NO: 255261 - DNA, 24 bp, Artificial Sequence
  Description of Artificial Sequence: Synthetic oligonucleotide
gaagaacgagaccggacccgcctc

SEQ ID NO: 255262 - DNA, 26 bp, Artificial Sequence
  Description of Artificial Sequence: Synthetic oligonucleotide
aagaacgagaccggacccgcctccta

SEQ ID NO: 255263 - DNA, 25 bp, Artificial Sequence
  Description of Artificial Sequence: Synthetic oligonucleotide
agaacgagaccggacccgcctccta

SEQ ID NO: 255264 - DNA, 24 bp, Artificial Sequence
  Description of Artificial Sequence: Synthetic oligonucleotide
gaacgagaccggacccgcctccta

SEQ ID NO: 255265 - DNA, 24 bp, Artificial Sequence
  Description of Artificial Sequence: Synthetic oligonucleotide
aacgagaccggacccgcctcctac

SEQ ID NO: 255266 - DNA, 23 bp, Artificial Sequence
  Description of Artificial Sequence: Synthetic oligonucleotide
acgagaccggacccgcctcctac

SEQ ID NO: 255267 - DNA, 22 bp, Artificial Sequence
  Description of Artificial Sequence: Synthetic oligonucleotide
cgagaccggacccgcctcctac

SEQ ID NO: 255268 - DNA, 23 bp, Artificial Sequence
  Description of Artificial Sequence: Synthetic oligonucleotide
gagaccggacccgcctcctacct

SEQ ID NO: 255269 - DNA, 24 bp, Artificial Sequence
  Description of Artificial Sequence: Synthetic oligonucleotide
agaccggacccgcctcctacctct

SEQ ID NO: 255270 - DNA, 23 bp, Artificial Sequence
  Description of Artificial Sequence: Synthetic oligonucleotide
gaccggacccgcctcctacctct

SEQ ID NO: 255271 - DNA, 23 bp, Artificial Sequence
  Description of Artificial Sequence: Synthetic oligonucleotide
accggacccgcctcctacctctg

SEQ ID NO: 255272 - DNA, 22 bp, Artificial Sequence
  Description of Artificial Sequence: Synthetic oligonucleotide
ccggacccgcctcctacctctg

SEQ ID NO: 255273 - DNA, 22 bp, Artificial Sequence
  Description of Artificial Sequence: Synthetic oligonucleotide
cggacccgcctcctacctctgc

SEQ ID NO: 255274 - DNA, 22 bp, Artificial Sequence
  Description of Artificial Sequence: Synthetic oligonucleotide
ggacccgcctcctacctctgcc

SEQ ID NO: 255275 - DNA, 22 bp, Artificial Sequence
  Description of Artificial Sequence: Synthetic oligonucleotide
gacccgcctcctacctctgccg

SEQ ID NO: 255276 - DNA, 24 bp, Artificial Sequence
  Description of Artificial Sequence: Synthetic oligonucleotide
acccgcctcctacctctgccggta

SEQ ID NO: 255277 - DNA, 23 bp, Artificial Sequence
  Description of Artificial Sequence: Synthetic oligonucleotide
cccgcctcctacctctgccggta

SEQ ID NO: 255278 - DNA, 23 bp, Artificial Sequence
  Description of Artificial Sequence: Synthetic oligonucleotide
ccgcctcctacctctgccggtac

SEQ ID NO: 255279 - DNA, 23 bp, Artificial Sequence
  Description of Artificial Sequence: Synthetic oligonucleotide
cgcctcctacctctgccggtacc

SEQ ID NO: 255280 - DNA, 23 bp, Artificial Sequence
  Description of Artificial Sequence: Synthetic oligonucleotide
gcctcctacctctgccggtaccc

SEQ ID NO: 255281 - DNA, 23 bp, Artificial Sequence
  Description of Artificial Sequence: Synthetic oligonucleotide
cctcctacctctgccggtacccg

SEQ ID NO: 255282 - DNA, 24 bp, Artificial Sequence
  Description of Artificial Sequence: Synthetic oligonucleotide
ctcctacctctgccggtacccgga

SEQ ID NO: 255283 - DNA, 27 bp, Artificial Sequence
  Description of Artificial Sequence: Synthetic oligonucleotide
tcctacctctgccggtacccggagaat

SEQ ID NO: 255284 - DNA, 26 bp, Artificial Sequence
  Description of Artificial Sequence: Synthetic oligonucleotide
cctacctctgccggtacccggagaat

SEQ ID NO: 255285 - DNA, 27 bp, Artificial Sequence
  Description of Artificial Sequence: Synthetic oligonucleotide
ctacctctgccggtacccggagaatga

SEQ ID NO: 255286 - DNA, 28 bp, Artificial Sequence
  Description of Artificial Sequence: Synthetic oligonucleotide
tacctctgccggtacccggagaatgatg

SEQ ID NO: 255287 - DNA, 27 bp, Artificial Sequence
  Description of Artificial Sequence: Synthetic oligonucleotide
acctctgccggtacccggagaatgatg

SEQ ID NO: 255288 - DNA, 26 bp, Artificial Sequence
  Description of Artificial Sequence: Synthetic oligonucleotide
cctctgccggtacccggagaatgatg

SEQ ID NO: 255289 - DNA, 26 bp, Artificial Sequence
  Description of Artificial Sequence: Synthetic oligonucleotide
ctctgccggtacccggagaatgatgg

SEQ ID NO: 255290 - DNA, 26 bp, Artificial Sequence
  Description of Artificial Sequence: Synthetic oligonucleotide
tctgccggtacccggagaatgatggg

SEQ ID NO: 255291 - DNA, 25 bp, Artificial Sequence
  Description of Artificial Sequence: Synthetic oligonucleotide
ctgccggtacccggagaatgatggg

SEQ ID NO: 255292 - DNA, 25 bp, Artificial Sequence
  Description of Artificial Sequence: Synthetic oligonucleotide
tgccggtacccggagaatgatgggc

SEQ ID NO: 255293 - DNA, 24 bp, Artificial Sequence
  Description of Artificial Sequence: Synthetic oligonucleotide
gccggtacccggagaatgatgggc

SEQ ID NO: 255294 - DNA, 24 bp, Artificial Sequence
  Description of Artificial Sequence: Synthetic oligonucleotide
ccggtacccggagaatgatgggcc

SEQ ID NO: 255295 - DNA, 24 bp, Artificial Sequence
  Description of Artificial Sequence: Synthetic oligonucleotide
cggtacccggagaatgatgggccg

SEQ ID NO: 255296 - DNA, 24 bp, Artificial Sequence
  Description of Artificial Sequence: Synthetic oligonucleotide
ggtacccggagaatgatgggccgg

SEQ ID NO: 255297 - DNA, 24 bp, Artificial Sequence
  Description of Artificial Sequence: Synthetic oligonucleotide
gtacccggagaatgatgggccggg

SEQ ID NO: 255298 - DNA, 24 bp, Artificial Sequence
  Description of Artificial Sequence: Synthetic oligonucleotide
tacccggagaatgatgggccgggg

SEQ ID NO: 255299 - DNA, 23 bp, Artificial Sequence
  Description of Artificial Sequence: Synthetic oligonucleotide
acccggagaatgatgggccgggg

SEQ ID NO: 255300 - DNA, 22 bp, Artificial Sequence
  Description of Artificial Sequence: Synthetic oligonucleotide
cccggagaatgatgggccgggg

SEQ ID NO: 255301 - DNA, 23 bp, Artificial Sequence
  Description of Artificial Sequence: Synthetic oligonucleotide
ccggagaatgatgggccgggggt

SEQ ID NO: 255302 - DNA, 23 bp, Artificial Sequence
  Description of Artificial Sequence: Synthetic oligonucleotide
cggagaatgatgggccgggggtg

SEQ ID NO: 255303 - DNA, 24 bp, Artificial Sequence
  Description of Artificial Sequence: Synthetic oligonucleotide
ggagaatgatgggccgggggtgct

SEQ ID NO: 255304 - DNA, 26 bp, Artificial Sequence
  Description of Artificial Sequence: Synthetic oligonucleotide
gagaatgatgggccgggggtgctgat

SEQ ID NO: 255305 - DNA, 26 bp, Artificial Sequence
  Description of Artificial Sequence: Synthetic oligonucleotide
agaatgatgggccgggggtgctgatc

SEQ ID NO: 255306 - DNA, 25 bp, Artificial Sequence
  Description of Artificial Sequence: Synthetic oligonucleotide
gaatgatgggccgggggtgctgatc

SEQ ID NO: 255307 - DNA, 25 bp, Artificial Sequence
  Description of Artificial Sequence: Synthetic oligonucleotide
aatgatgggccgggggtgctgatcg

SEQ ID NO: 255308 - DNA, 24 bp, Artificial Sequence
  Description of Artificial Sequence: Synthetic oligonucleotide
atgatgggccgggggtgctgatcg

SEQ ID NO: 255309 - DNA, 23 bp, Artificial Sequence
  Description of Artificial Sequence: Synthetic oligonucleotide
tgatgggccgggggtgctgatcg

SEQ ID NO: 255310 - DNA, 22 bp, Artificial Sequence
  Description of Artificial Sequence: Synthetic oligonucleotide
gatgggccgggggtgctgatcg

SEQ ID NO: 255311 - DNA, 23 bp, Artificial Sequence
  Description of Artificial Sequence: Synthetic oligonucleotide
atgggccgggggtgctgatcgca

SEQ ID NO: 255312 - DNA, 22 bp, Artificial Sequence
  Description of Artificial Sequence: Synthetic oligonucleotide
tgggccgggggtgctgatcgca

SEQ ID NO: 255313 - DNA, 21 bp, Artificial Sequence
  Description of Artificial Sequence: Synthetic oligonucleotide
gggccgggggtgctgatcgca

SEQ ID NO: 255314 - DNA, 22 bp, Artificial Sequence
  Description of Artificial Sequence: Synthetic oligonucleotide
ggccgggggtgctgatcgcagt

SEQ ID NO: 255315 - DNA, 22 bp, Artificial Sequence
  Description of Artificial Sequence: Synthetic oligonucleotide
gccgggggtgctgatcgcagtc

SEQ ID NO: 255316 - DNA, 23 bp, Artificial Sequence
  Description of Artificial Sequence: Synthetic oligonucleotide
ccgggggtgctgatcgcagtcgt

SEQ ID NO: 255317 - DNA, 23 bp, Artificial Sequence
  Description of Artificial Sequence: Synthetic oligonucleotide
cgggggtgctgatcgcagtcgtg

SEQ ID NO: 255318 - DNA, 24 bp, Artificial Sequence
  Description of Artificial Sequence: Synthetic oligonucleotide
gggggtgctgatcgcagtcgtgga

SEQ ID NO: 255319 - DNA, 25 bp, Artificial Sequence
  Description of Artificial Sequence: Synthetic oligonucleotide
ggggtgctgatcgcagtcgtggaca

SEQ ID NO: 255320 - DNA, 25 bp, Artificial Sequence
  Description of Artificial Sequence: Synthetic oligonucleotide
gggtgctgatcgcagtcgtggacac

SEQ ID NO: 255321 - DNA, 25 bp, Artificial Sequence
  Description of Artificial Sequence: Synthetic oligonucleotide
ggtgctgatcgcagtcgtggacacg

SEQ ID NO: 255322 - DNA, 25 bp, Artificial Sequence
  Description of Artificial Sequence: Synthetic oligonucleotide
gtgctgatcgcagtcgtggacacgg

SEQ ID NO: 255323 - DNA, 25 bp, Artificial Sequence
  Description of Artificial Sequence: Synthetic oligonucleotide
tgctgatcgcagtcgtggacacggc

SEQ ID NO: 255324 - DNA, 24 bp, Artificial Sequence
  Description of Artificial Sequence: Synthetic oligonucleotide
gctgatcgcagtcgtggacacggc

SEQ ID NO: 255325 - DNA, 24 bp, Artificial Sequence
  Description of Artificial Sequence: Synthetic oligonucleotide
ctgatcgcagtcgtggacacggcg

SEQ ID NO: 255326 - DNA, 25 bp, Artificial Sequence
  Description of Artificial Sequence: Synthetic oligonucleotide
tgatcgcagtcgtggacacggcggt

SEQ ID NO: 255327 - DNA, 24 bp, Artificial Sequence
  Description of Artificial Sequence: Synthetic oligonucleotide
gatcgcagtcgtggacacggcggt

SEQ ID NO: 255328 - DNA, 24 bp, Artificial Sequence
  Description of Artificial Sequence: Synthetic oligonucleotide
atcgcagtcgtggacacggcggtc

SEQ ID NO: 255329 - DNA, 23 bp, Artificial Sequence
  Description of Artificial Sequence: Synthetic oligonucleotide
tcgcagtcgtggacacggcggtc

SEQ ID NO: 255330 - DNA, 22 bp, Artificial Sequence
  Description of Artificial Sequence: Synthetic oligonucleotide
cgcagtcgtggacacggcggtc

SEQ ID NO: 255331 - DNA, 23 bp, Artificial Sequence
  Description of Artificial Sequence: Synthetic oligonucleotide
gcagtcgtggacacggcggtcga

SEQ ID NO: 255332 - DNA, 23 bp, Artificial Sequence
  Description of Artificial Sequence: Synthetic oligonucleotide
cagtcgtggacacggcggtcgac

SEQ ID NO: 255333 - DNA, 23 bp, Artificial Sequence
  Description of Artificial Sequence: Synthetic oligonucleotide
agtcgtggacacggcggtcgacc

SEQ ID NO: 255334 - DNA, 22 bp, Artificial Sequence
  Description of Artificial Sequence: Synthetic oligonucleotide
gtcgtggacacggcggtcgacc

SEQ ID NO: 255335 - DNA, 22 bp, Artificial Sequence
  Description of Artificial Sequence: Synthetic oligonucleotide
tcgtggacacggcggtcgaccc

SEQ ID NO: 255336 - DNA, 21 bp, Artificial Sequence
  Description of Artificial Sequence: Synthetic oligonucleotide
cgtggacacggcggtcgaccc

SEQ ID NO: 255337 - DNA, 21 bp, Artificial Sequence
  Description of Artificial Sequence: Synthetic oligonucleotide
gtggacacggcggtcgacccc

SEQ ID NO: 255338 - DNA, 21 bp, Artificial Sequence
  Description of Artificial Sequence: Synthetic oligonucleotide
tggacacggcggtcgaccccg

SEQ ID NO: 255339 - DNA, 20 bp, Artificial Sequence
  Description of Artificial Sequence: Synthetic oligonucleotide
ggacacggcggtcgaccccg

SEQ ID NO: 255340 - DNA, 20 bp, Artificial Sequence
  Description of Artificial Sequence: Synthetic oligonucleotide
gacacggcggtcgaccccgg

SEQ ID NO: 255341 - DNA, 20 bp, Artificial Sequence
  Description of Artificial Sequence: Synthetic oligonucleotide
acacggcggtcgaccccggg

SEQ ID NO: 255342 - DNA, 20 bp, Artificial Sequence
  Description of Artificial Sequence: Synthetic oligonucleotide
cacggcggtcgaccccgggt

SEQ ID NO: 255343 - DNA, 20 bp, Artificial Sequence
  Description of Artificial Sequence: Synthetic oligonucleotide
acggcggtcgaccccggggt

SEQ ID NO: 255344 - DNA, 20 bp, Artificial Sequence
  Description of Artificial Sequence: Synthetic oligonucleotide
cggcggtcgaccccggggtt

SEQ ID NO: 255345 - DNA, 20 bp, Artificial Sequence
  Description of Artificial Sequence: Synthetic oligonucleotide
ggcggtcgaccccggggctt

SEQ ID NO: 255346 - DNA, 20 bp, Artificial Sequence
  Description of Artificial Sequence: Synthetic oligonucleotide
gcggtcgaccccggggctct

SEQ ID NO: 255347 - DNA, 20 bp, Artificial Sequence
  Description of Artificial Sequence: Synthetic oligonucleotide
cggtcgaccccggggctcct

SEQ ID NO: 255348 - DNA, 20 bp, Artificial Sequence
  Description of Artificial Sequence: Synthetic oligonucleotide
ggtcgaccccggggctccgt

SEQ ID NO: 255349 - DNA, 20 bp, Artificial Sequence
  Description of Artificial Sequence: Synthetic oligonucleotide
gtcgaccccggggctccgct

SEQ ID NO: 255350 - DNA, 20 bp, Artificial Sequence
  Description of Artificial Sequence: Synthetic oligonucleotide
tcgaccccggggctccgcgt

SEQ ID NO: 255351 - DNA, 20 bp, Artificial Sequence
  Description of Artificial Sequence: Synthetic oligonucleotide
cgaccccggggctccgcgtt

SEQ ID NO: 255352 - DNA, 20 bp, Artificial Sequence
  Description of Artificial Sequence: Synthetic oligonucleotide
gaccccggggctccgcgcat

SEQ ID NO: 255353 - DNA, 20 bp, Artificial Sequence
  Description of Artificial Sequence: Synthetic oligonucleotide
accccggggctccgcgcatg

SEQ ID NO: 255354 - DNA, 20 bp, Artificial Sequence
  Description of Artificial Sequence: Synthetic oligonucleotide
ccccggggctccgcgcatgt

SEQ ID NO: 255355 - DNA, 20 bp, Artificial Sequence
  Description of Artificial Sequence: Synthetic oligonucleotide
cccggggctccgcgcatgca

SEQ ID NO: 255356 - DNA, 20 bp, Artificial Sequence
  Description of Artificial Sequence: Synthetic oligonucleotide
ccggggctccgcgcatgcag

SEQ ID NO: 255357 - DNA, 23 bp, Artificial Sequence
  Description of Artificial Sequence: Synthetic oligonucleotide
cggggctccgcgcatgcaggata

SEQ ID NO: 255358 - DNA, 25 bp, Artificial Sequence
  Description of Artificial Sequence: Synthetic oligonucleotide
ggggctccgcgcatgcaggatacaa

SEQ ID NO: 255359 - DNA, 26 bp, Artificial Sequence
  Description of Artificial Sequence: Synthetic oligonucleotide
gggctccgcgcatgcaggatacaact

SEQ ID NO: 255360 - DNA, 27 bp, Artificial Sequence
  Description of Artificial Sequence: Synthetic oligonucleotide
ggctccgcgcatgcaggatacaactga

SEQ ID NO: 255361 - DNA, 28 bp, Artificial Sequence
  Description of Artificial Sequence: Synthetic oligonucleotide
gctccgcgcatgcaggatacaactgaag

SEQ ID NO: 255362 - DNA, 28 bp, Artificial Sequence
  Description of Artificial Sequence: Synthetic oligonucleotide
ctccgcgcatgcaggatacaactgaagg

SEQ ID NO: 255363 - DNA, 32 bp, Artificial Sequence
  Description of Artificial Sequence: Synthetic oligonucleotide
tccgcgcatgcaggatacaactgaaggaaaac

SEQ ID NO: 255364 - DNA, 31 bp, Artificial Sequence
  Description of Artificial Sequence: Synthetic oligonucleotide
ccgcgcatgcaggatacaactgaaggaaaac

SEQ ID NO: 255365 - DNA, 31 bp, Artificial Sequence
  Description of Artificial Sequence: Synthetic oligonucleotide
cgcgcatgcaggatacaactgaaggaaaacc

SEQ ID NO: 255366 - DNA, 37 bp, Artificial Sequence
  Description of Artificial Sequence: Synthetic oligonucleotide
gcgcatgcaggatacaactgaaggaaaaccataaatc

SEQ ID NO: 255367 - DNA, 37 bp, Artificial Sequence
  Description of Artificial Sequence: Synthetic oligonucleotide
cgcatgcaggatacaactgaaggaaaaccataaatcg

SEQ ID NO: 255368 - DNA, 39 bp, Artificial Sequence
  Description of Artificial Sequence: Synthetic oligonucleotide
gcatgcaggatacaactgaaggaaaaccataaatcgttg

SEQ ID NO: 255369 - DNA, 43 bp, Artificial Sequence
  Description of Artificial Sequence: Synthetic oligonucleotide
catgcaggatacaactgaaggaaaaccataaatcgttgttatc

SEQ ID NO: 255370 - DNA, 46 bp, Artificial Sequence
  Description of Artificial Sequence: Synthetic oligonucleotide
atgcaggatacaactgaaggaaaaccataaatcgttgttatcattg

SEQ ID NO: 255371 - DNA, 45 bp, Artificial Sequence
  Description of Artificial Sequence: Synthetic oligonucleotide
tgcaggatacaactgaaggaaaaccataaatcgttgttatcattg

SEQ ID NO: 255372 - DNA, 44 bp, Artificial Sequence
  Description of Artificial Sequence: Synthetic oligonucleotide
gcaggatacaactgaaggaaaaccataaatcgttgttatcattg

SEQ ID NO: 255373 - DNA, 47 bp, Artificial Sequence
  Description of Artificial Sequence: Synthetic oligonucleotide
caggatacaactgaaggaaaaccataaatcgttgttatcattgaaac

SEQ ID NO: 255374 - DNA, 49 bp, Artificial Sequence
  Description of Artificial Sequence: Synthetic oligonucleotide
aggatacaactgaaggaaaaccataaatcgttgttatcattgaaacaac

SEQ ID NO: 255375 - DNA, 48 bp, Artificial Sequence
  Description of Artificial Sequence: Synthetic oligonucleotide
ggatacaactgaaggaaaaccataaatcgttgttatcattgaaacaac

SEQ ID NO: 255376 - DNA, 49 bp, Artificial Sequence
  Description of Artificial Sequence: Synthetic oligonucleotide
gatacaactgaaggaaaaccataaatcgttgttatcattgaaacaacag

SEQ ID NO: 255377 - DNA, 49 bp, Artificial Sequence
  Description of Artificial Sequence: Synthetic oligonucleotide
atacaactgaaggaaaaccataaatcgttgttatcattgaaacaacagg

SEQ ID NO: 255378 - DNA, 48 bp, Artificial Sequence
  Description of Artificial Sequence: Synthetic oligonucleotide
tacaactgaaggaaaaccataaatcgttgttatcattgaaacaacagg

SEQ ID NO: 255379 - DNA, 47 bp, Artificial Sequence
  Description of Artificial Sequence: Synthetic oligonucleotide
acaactgaaggaaaaccataaatcgttgttatcattgaaacaacagg

SEQ ID NO: 255380 - DNA, 46 bp, Artificial Sequence
  Description of Artificial Sequence: Synthetic oligonucleotide
caactgaaggaaaaccataaatcgttgttatcattgaaacaacagg

SEQ ID NO: 255381 - DNA, 48 bp, Artificial Sequence
  Description of Artificial Sequence: Synthetic oligonucleotide
aactgaaggaaaaccataaatcgttgttatcattgaaacaacaggatg

SEQ ID NO: 255382 - DNA, 47 bp, Artificial Sequence
  Description of Artificial Sequence: Synthetic oligonucleotide
actgaaggaaaaccataaatcgttgttatcattgaaacaacaggatg

SEQ ID NO: 255383 - DNA, 46 bp, Artificial Sequence
  Description of Artificial Sequence: Synthetic oligonucleotide
ctgaaggaaaaccataaatcgttgttatcattgaaacaacaggatg

SEQ ID NO: 255384 - DNA, 47 bp, Artificial Sequence
  Description of Artificial Sequence: Synthetic oligonucleotide
tgaaggaaaaccataaatcgttgttatcattgaaacaacaggatgtg

SEQ ID NO: 255385 - DNA, 46 bp, Artificial Sequence
  Description of Artificial Sequence: Synthetic oligonucleotide
gaaggaaaaccataaatcgttgttatcattgaaacaacaggatgtg

SEQ ID NO: 255386 - DNA, 46 bp, Artificial Sequence
  Description of Artificial Sequence: Synthetic oligonucleotide
aaggaaaaccataaatcgttgttatcattgaaacaacaggatgtgg

SEQ ID NO: 255387 - DNA, 45 bp, Artificial Sequence
  Description of Artificial Sequence: Synthetic oligonucleotide
aggaaaaccataaatcgttgttatcattgaaacaacaggatgtgg

SEQ ID NO: 255388 - DNA, 44 bp, Artificial Sequence
  Description of Artificial Sequence: Synthetic oligonucleotide
ggaaaaccataaatcgttgttatcattgaaacaacaggatgtgg

SEQ ID NO: 255389 - DNA, 44 bp, Artificial Sequence
  Description of Artificial Sequence: Synthetic oligonucleotide
gaaaaccataaatcgttgttatcattgaaacaacaggatgtggc

SEQ ID NO: 255390 - DNA, 44 bp, Artificial Sequence
  Description of Artificial Sequence: Synthetic oligonucleotide
aaaaccataaatcgttgttatcattgaaacaacaggatgtggcg

SEQ ID NO: 255391 - DNA, 43 bp, Artificial Sequence
  Description of Artificial Sequence: Synthetic oligonucleotide
aaaccataaatcgttgttatcattgaaacaacaggatgtggcg

SEQ ID NO: 255392 - DNA, 42 bp, Artificial Sequence
  Description of Artificial Sequence: Synthetic oligonucleotide
aaccataaatcgttgttatcattgaaacaacaggatgtggcg

SEQ ID NO: 255393 - DNA, 41 bp, Artificial Sequence
  Description of Artificial Sequence: Synthetic oligonucleotide
accataaatcgttgttatcattgaaacaacaggatgtggcg

SEQ ID NO: 255394 - DNA, 40 bp, Artificial Sequence
  Description of Artificial Sequence: Synthetic oligonucleotide
ccataaatcgttgttatcattgaaacaacaggatgtggcg

SEQ ID NO: 255395 - DNA, 42 bp, Artificial Sequence
  Description of Artificial Sequence: Synthetic oligonucleotide
cataaatcgttgttatcattgaaacaacaggatgtggcgatg

SEQ ID NO: 255396 - DNA, 43 bp, Artificial Sequence
  Description of Artificial Sequence: Synthetic oligonucleotide
ataaatcgttgttatcattgaaacaacaggatgtggcgatgag

SEQ ID NO: 255397 - DNA, 42 bp, Artificial Sequence
  Description of Artificial Sequence: Synthetic oligonucleotide
taaatcgttgttatcattgaaacaacaggatgtggcgatgag

SEQ ID NO: 255398 - DNA, 41 bp, Artificial Sequence
  Description of Artificial Sequence: Synthetic oligonucleotide
aaatcgttgttatcattgaaacaacaggatgtggcgatgag

SEQ ID NO: 255399 - DNA, 40 bp, Artificial Sequence
  Description of Artificial Sequence: Synthetic oligonucleotide
aatcgttgttatcattgaaacaacaggatgtggcgatgag

SEQ ID NO: 255400 - DNA, 39 bp, Artificial Sequence
  Description of Artificial Sequence: Synthetic oligonucleotide
atcgttgttatcattgaaacaacaggatgtggcgatgag

SEQ ID NO: 255401 - DNA, 38 bp, Artificial Sequence
  Description of Artificial Sequence: Synthetic oligonucleotide
tcgttgttatcattgaaacaacaggatgtggcgatgag

SEQ ID NO: 255402 - DNA, 37 bp, Artificial Sequence
  Description of Artificial Sequence: Synthetic oligonucleotide
cgttgttatcattgaaacaacaggatgtggcgatgag

SEQ ID NO: 255403 - DNA, 41 bp, Artificial Sequence
  Description of Artificial Sequence: Synthetic oligonucleotide
gttgttatcattgaaacaacaggatgtggcgatgagaatac

SEQ ID NO: 255404 - DNA, 42 bp, Artificial Sequence
  Description of Artificial Sequence: Synthetic oligonucleotide
ttgttatcattgaaacaacaggatgtggcgatgagaatactg

SEQ ID NO: 255405 - DNA, 41 bp, Artificial Sequence
  Description of Artificial Sequence: Synthetic oligonucleotide
tgttatcattgaaacaacaggatgtggcgatgagaatactg

SEQ ID NO: 255406 - DNA, 40 bp, Artificial Sequence
  Description of Artificial Sequence: Synthetic oligonucleotide
gttatcattgaaacaacaggatgtggcgatgagaatactg

SEQ ID NO: 255407 - DNA, 40 bp, Artificial Sequence
  Description of Artificial Sequence: Synthetic oligonucleotide
ttatcattgaaacaacaggatgtggcgatgagaatactgc

SEQ ID NO: 255408 - DNA, 39 bp, Artificial Sequence
  Description of Artificial Sequence: Synthetic oligonucleotide
tatcattgaaacaacaggatgtggcgatgagaatactgc

SEQ ID NO: 255409 - DNA, 38 bp, Artificial Sequence
  Description of Artificial Sequence: Synthetic oligonucleotide
atcattgaaacaacaggatgtggcgatgagaatactgc

SEQ ID NO: 255410 - DNA, 37 bp, Artificial Sequence
  Description of Artificial Sequence: Synthetic oligonucleotide
tcattgaaacaacaggatgtggcgatgagaatactgc

SEQ ID NO: 255411 - DNA, 36 bp, Artificial Sequence
  Description of Artificial Sequence: Synthetic oligonucleotide
cattgaaacaacaggatgtggcgatgagaatactgc

SEQ ID NO: 255412 - DNA, 38 bp, Artificial Sequence
  Description of Artificial Sequence: Synthetic oligonucleotide
attgaaacaacaggatgtggcgatgagaatactgcaac

SEQ ID NO: 255413 - DNA, 37 bp, Artificial Sequence
  Description of Artificial Sequence: Synthetic oligonucleotide
ttgaaacaacaggatgtggcgatgagaatactgcaac

SEQ ID NO: 255414 - DNA, 36 bp, Artificial Sequence
  Description of Artificial Sequence: Synthetic oligonucleotide
tgaaacaacaggatgtggcgatgagaatactgcaac

SEQ ID NO: 255415 - DNA, 35 bp, Artificial Sequence
  Description of Artificial Sequence: Synthetic oligonucleotide
gaaacaacaggatgtggcgatgagaatactgcaac

SEQ ID NO: 255416 - DNA, 36 bp, Artificial Sequence
  Description of Artificial Sequence: Synthetic oligonucleotide
aaacaacaggatgtggcgatgagaatactgcaacag

SEQ ID NO: 255417 - DNA, 35 bp, Artificial Sequence
  Description of Artificial Sequence: Synthetic oligonucleotide
aacaacaggatgtggcgatgagaatactgcaacag

SEQ ID NO: 255418 - DNA, 34 bp, Artificial Sequence
  Description of Artificial Sequence: Synthetic oligonucleotide
acaacaggatgtggcgatgagaatactgcaacag

SEQ ID NO: 255419 - DNA, 33 bp, Artificial Sequence
  Description of Artificial Sequence: Synthetic oligonucleotide
caacaggatgtggcgatgagaatactgcaacag

SEQ ID NO: 255420 - DNA, 35 bp, Artificial Sequence
  Description of Artificial Sequence: Synthetic oligonucleotide
aacaggatgtggcgatgagaatactgcaacagaag

SEQ ID NO: 255421 - DNA, 34 bp, Artificial Sequence
  Description of Artificial Sequence: Synthetic oligonucleotide
acaggatgtggcgatgagaatactgcaacagaag

SEQ ID NO: 255422 - DNA, 33 bp, Artificial Sequence
  Description of Artificial Sequence: Synthetic oligonucleotide
caggatgtggcgatgagaatactgcaacagaag

SEQ ID NO: 255423 - DNA, 35 bp, Artificial Sequence
  Description of Artificial Sequence: Synthetic oligonucleotide
aggatgtggcgatgagaatactgcaacagaagtac

SEQ ID NO: 255424 - DNA, 34 bp, Artificial Sequence
  Description of Artificial Sequence: Synthetic oligonucleotide
ggatgtggcgatgagaatactgcaacagaagtac

SEQ ID NO: 255425 - DNA, 35 bp, Artificial Sequence
  Description of Artificial Sequence: Synthetic oligonucleotide
gatgtggcgatgagaatactgcaacagaagtacag

SEQ ID NO: 255426 - DNA, 35 bp, Artificial Sequence
  Description of Artificial Sequence: Synthetic oligonucleotide
atgtggcgatgagaatactgcaacagaagtacagc

SEQ ID NO: 255427 - DNA, 34 bp, Artificial Sequence
  Description of Artificial Sequence: Synthetic oligonucleotide
tgtggcgatgagaatactgcaacagaagtacagc

SEQ ID NO: 255428 - DNA, 33 bp, Artificial Sequence
  Description of Artificial Sequence: Synthetic oligonucleotide
gtggcgatgagaatactgcaacagaagtacagc

SEQ ID NO: 255429 - DNA, 33 bp, Artificial Sequence
  Description of Artificial Sequence: Synthetic oligonucleotide
tggcgatgagaatactgcaacagaagtacagcc

SEQ ID NO: 255430 - DNA, 32 bp, Artificial Sequence
  Description of Artificial Sequence: Synthetic oligonucleotide
ggcgatgagaatactgcaacagaagtacagcc

SEQ ID NO: 255431 - DNA, 35 bp, Artificial Sequence
  Description of Artificial Sequence: Synthetic oligonucleotide
gcgatgagaatactgcaacagaagtacagccaaag

SEQ ID NO: 255432 - DNA, 35 bp, Artificial Sequence
  Description of Artificial Sequence: Synthetic oligonucleotide
cgatgagaatactgcaacagaagtacagccaaagg

SEQ ID NO: 255433 - DNA, 37 bp, Artificial Sequence
  Description of Artificial Sequence: Synthetic oligonucleotide
gatgagaatactgcaacagaagtacagccaaaggttg

SEQ ID NO: 255434 - DNA, 37 bp, Artificial Sequence
  Description of Artificial Sequence: Synthetic oligonucleotide
atgagaatactgcaacagaagtacagccaaaggttgg

SEQ ID NO: 255435 - DNA, 36 bp, Artificial Sequence
  Description of Artificial Sequence: Synthetic oligonucleotide
tgagaatactgcaacagaagtacagccaaaggttgg

SEQ ID NO: 255436 - DNA, 35 bp, Artificial Sequence
  Description of Artificial Sequence: Synthetic oligonucleotide
gagaatactgcaacagaagtacagccaaaggttgg

SEQ ID NO: 255437 - DNA, 36 bp, Artificial Sequence
  Description of Artificial Sequence: Synthetic oligonucleotide
agaatactgcaacagaagtacagccaaaggttggtg

SEQ ID NO: 255438 - DNA, 35 bp, Artificial Sequence
  Description of Artificial Sequence: Synthetic oligonucleotide
gaatactgcaacagaagtacagccaaaggttggtg

SEQ ID NO: 255439 - DNA, 36 bp, Artificial Sequence
  Description of Artificial Sequence: Synthetic oligonucleotide
aatactgcaacagaagtacagccaaaggttggtgag

SEQ ID NO: 255440 - DNA, 35 bp, Artificial Sequence
  Description of Artificial Sequence: Synthetic oligonucleotide
atactgcaacagaagtacagccaaaggttggtgag

SEQ ID NO: 255441 - DNA, 34 bp, Artificial Sequence
  Description of Artificial Sequence: Synthetic oligonucleotide
tactgcaacagaagtacagccaaaggttggtgag

SEQ ID NO: 255442 - DNA, 33 bp, Artificial Sequence
  Description of Artificial Sequence: Synthetic oligonucleotide
actgcaacagaagtacagccaaaggttggtgag

SEQ ID NO: 255443 - DNA, 32 bp, Artificial Sequence
  Description of Artificial Sequence: Synthetic oligonucleotide
ctgcaacagaagtacagccaaaggttggtgag

SEQ ID NO: 255444 - DNA, 35 bp, Artificial Sequence
  Description of Artificial Sequence: Synthetic oligonucleotide
tgcaacagaagtacagccaaaggttggtgagatag

SEQ ID NO: 255445 - DNA, 34 bp, Artificial Sequence
  Description of Artificial Sequence: Synthetic oligonucleotide
gcaacagaagtacagccaaaggttggtgagatag

SEQ ID NO: 255446 - DNA, 36 bp, Artificial Sequence
  Description of Artificial Sequence: Synthetic oligonucleotide
caacagaagtacagccaaaggttggtgagatagttg

SEQ ID NO: 255447 - DNA, 36 bp, Artificial Sequence
  Description of Artificial Sequence: Synthetic oligonucleotide
aacagaagtacagccaaaggttggtgagatagttgg

SEQ ID NO: 255448 - DNA, 35 bp, Artificial Sequence
  Description of Artificial Sequence: Synthetic oligonucleotide
acagaagtacagccaaaggttggtgagatagttgg

SEQ ID NO: 255449 - DNA, 34 bp, Artificial Sequence
  Description of Artificial Sequence: Synthetic oligonucleotide
cagaagtacagccaaaggttggtgagatagttgg

SEQ ID NO: 255450 - DNA, 34 bp, Artificial Sequence
  Description of Artificial Sequence: Synthetic oligonucleotide
agaagtacagccaaaggttggtgagatagttggc

SEQ ID NO: 255451 - DNA, 33 bp, Artificial Sequence
  Description of Artificial Sequence: Synthetic oligonucleotide
gaagtacagccaaaggttggtgagatagttggc

SEQ ID NO: 255452 - DNA, 33 bp, Artificial Sequence
  Description of Artificial Sequence: Synthetic oligonucleotide
aagtacagccaaaggttggtgagatagttggcc

SEQ ID NO: 255453 - DNA, 32 bp, Artificial Sequence
  Description of Artificial Sequence: Synthetic oligonucleotide
agtacagccaaaggttggtgagatagttggcc

SEQ ID NO: 255454 - DNA, 31 bp, Artificial Sequence
  Description of Artificial Sequence: Synthetic oligonucleotide
gtacagccaaaggttggtgagatagttggcc

SEQ ID NO: 255455 - DNA, 34 bp, Artificial Sequence
  Description of Artificial Sequence: Synthetic oligonucleotide
tacagccaaaggttggtgagatagttggccttac

SEQ ID NO: 255456 - DNA, 33 bp, Artificial Sequence
  Description of Artificial Sequence: Synthetic oligonucleotide
acagccaaaggttggtgagatagttggccttac

SEQ ID NO: 255457 - DNA, 32 bp, Artificial Sequence
  Description of Artificial Sequence: Synthetic oligonucleotide
cagccaaaggttggtgagatagttggccttac

SEQ ID NO: 255458 - DNA, 33 bp, Artificial Sequence
  Description of Artificial Sequence: Synthetic oligonucleotide
agccaaaggttggtgagatagttggccttacag

SEQ ID NO: 255459 - DNA, 32 bp, Artificial Sequence
  Description of Artificial Sequence: Synthetic oligonucleotide
gccaaaggttggtgagatagttggccttacag

SEQ ID NO: 255460 - DNA, 32 bp, Artificial Sequence
  Description of Artificial Sequence: Synthetic oligonucleotide
ccaaaggttggtgagatagttggccttacagg

SEQ ID NO: 255461 - DNA, 34 bp, Artificial Sequence
  Description of Artificial Sequence: Synthetic oligonucleotide
caaaggttggtgagatagttggccttacaggaag

SEQ ID NO: 255462 - DNA, 35 bp, Artificial Sequence
  Description of Artificial Sequence: Synthetic oligonucleotide
aaaggttggtgagatagttggccttacaggaagag

SEQ ID NO: 255463 - DNA, 34 bp, Artificial Sequence
  Description of Artificial Sequence: Synthetic oligonucleotide
aaggttggtgagatagttggccttacaggaagag

SEQ ID NO: 255464 - DNA, 33 bp, Artificial Sequence
  Description of Artificial Sequence: Synthetic oligonucleotide
aggttggtgagatagttggccttacaggaagag

SEQ ID NO: 255465 - DNA, 32 bp, Artificial Sequence
  Description of Artificial Sequence: Synthetic oligonucleotide
ggttggtgagatagttggccttacaggaagag

SEQ ID NO: 255466 - DNA, 33 bp, Artificial Sequence
  Description of Artificial Sequence: Synthetic oligonucleotide
gttggtgagatagttggccttacaggaagagag

SEQ ID NO: 255467 - DNA, 33 bp, Artificial Sequence
  Description of Artificial Sequence: Synthetic oligonucleotide
ttggtgagatagttggccttacaggaagagagc

SEQ ID NO: 255468 - DNA, 32 bp, Artificial Sequence
  Description of Artificial Sequence: Synthetic oligonucleotide
tggtgagatagttggccttacaggaagagagc

SEQ ID NO: 255469 - DNA, 31 bp, Artificial Sequence
  Description of Artificial Sequence: Synthetic oligonucleotide
ggtgagatagttggccttacaggaagagagc

SEQ ID NO: 255470 - DNA, 35 bp, Artificial Sequence
  Description of Artificial Sequence: Synthetic oligonucleotide
gtgagatagttggccttacaggaagagagcttaag

SEQ ID NO: 255471 - DNA, 38 bp, Artificial Sequence
  Description of Artificial Sequence: Synthetic oligonucleotide
tgagatagttggccttacaggaagagagcttaagatac

SEQ ID NO: 255472 - DNA, 37 bp, Artificial Sequence
  Description of Artificial Sequence: Synthetic oligonucleotide
gagatagttggccttacaggaagagagcttaagatac

SEQ ID NO: 255473 - DNA, 37 bp, Artificial Sequence
  Description of Artificial Sequence: Synthetic oligonucleotide
agatagttggccttacaggaagagagcttaagatacc

SEQ ID NO: 255474 - DNA, 36 bp, Artificial Sequence
  Description of Artificial Sequence: Synthetic oligonucleotide
gatagttggccttacaggaagagagcttaagatacc

SEQ ID NO: 255475 - DNA, 37 bp, Artificial Sequence
  Description of Artificial Sequence: Synthetic oligonucleotide
atagttggccttacaggaagagagcttaagatacctg

SEQ ID NO: 255476 - DNA, 36 bp, Artificial Sequence
  Description of Artificial Sequence: Synthetic oligonucleotide
tagttggccttacaggaagagagcttaagatacctg

SEQ ID NO: 255477 - DNA, 35 bp, Artificial Sequence
  Description of Artificial Sequence: Synthetic oligonucleotide
agttggccttacaggaagagagcttaagatacctg

SEQ ID NO: 255478 - DNA, 34 bp, Artificial Sequence
  Description of Artificial Sequence: Synthetic oligonucleotide
gttggccttacaggaagagagcttaagatacctg

SEQ ID NO: 255479 - DNA, 34 bp, Artificial Sequence
  Description of Artificial Sequence: Synthetic oligonucleotide
ttggccttacaggaagagagcttaagatacctgc

SEQ ID NO: 255480 - DNA, 33 bp, Artificial Sequence
  Description of Artificial Sequence: Synthetic oligonucleotide
tggccttacaggaagagagcttaagatacctgc

SEQ ID NO: 255481 - DNA, 32 bp, Artificial Sequence
  Description of Artificial Sequence: Synthetic oligonucleotide
ggccttacaggaagagagcttaagatacctgc

SEQ ID NO: 255482 - DNA, 34 bp, Artificial Sequence
  Description of Artificial Sequence: Synthetic oligonucleotide
gccttacaggaagagagcttaagatacctgcaag

SEQ ID NO: 255483 - DNA, 34 bp, Artificial Sequence
  Description of Artificial Sequence: Synthetic oligonucleotide
ccttacaggaagagagcttaagatacctgcaagc

SEQ ID NO: 255484 - DNA, 35 bp, Artificial Sequence
  Description of Artificial Sequence: Synthetic oligonucleotide
cttacaggaagagagcttaagatacctgcaagcag

SEQ ID NO: 255485 - DNA, 35 bp, Artificial Sequence
  Description of Artificial Sequence: Synthetic oligonucleotide
ttacaggaagagagcttaagatacctgcaagcagg

SEQ ID NO: 255486 - DNA, 34 bp, Artificial Sequence
  Description of Artificial Sequence: Synthetic oligonucleotide
tacaggaagagagcttaagatacctgcaagcagg

SEQ ID NO: 255487 - DNA, 33 bp, Artificial Sequence
  Description of Artificial Sequence: Synthetic oligonucleotide
acaggaagagagcttaagatacctgcaagcagg

SEQ ID NO: 255488 - DNA, 32 bp, Artificial Sequence
  Description of Artificial Sequence: Synthetic oligonucleotide
caggaagagagcttaagatacctgcaagcagg

SEQ ID NO: 255489 - DNA, 33 bp, Artificial Sequence
  Description of Artificial Sequence: Synthetic oligonucleotide
aggaagagagcttaagatacctgcaagcaggac

SEQ ID NO: 255490 - DNA, 32 bp, Artificial Sequence
  Description of Artificial Sequence: Synthetic oligonucleotide
ggaagagagcttaagatacctgcaagcaggac

SEQ ID NO: 255491 - DNA, 36 bp, Artificial Sequence
  Description of Artificial Sequence: Synthetic oligonucleotide
gaagagagcttaagatacctgcaagcaggacaaatc

SEQ ID NO: 255492 - DNA, 36 bp, Artificial Sequence
  Description of Artificial Sequence: Synthetic oligonucleotide
aagagagcttaagatacctgcaagcaggacaaatcg

SEQ ID NO: 255493 - DNA, 35 bp, Artificial Sequence
  Description of Artificial Sequence: Synthetic oligonucleotide
agagagcttaagatacctgcaagcaggacaaatcg

SEQ ID NO: 255494 - DNA, 34 bp, Artificial Sequence
  Description of Artificial Sequence: Synthetic oligonucleotide
gagagcttaagatacctgcaagcaggacaaatcg

SEQ ID NO: 255495 - DNA, 34 bp, Artificial Sequence
  Description of Artificial Sequence: Synthetic oligonucleotide
agagcttaagatacctgcaagcaggacaaatcgc

SEQ ID NO: 255496 - DNA, 33 bp, Artificial Sequence
  Description of Artificial Sequence: Synthetic oligonucleotide
gagcttaagatacctgcaagcaggacaaatcgc

SEQ ID NO: 255497 - DNA, 34 bp, Artificial Sequence
  Description of Artificial Sequence: Synthetic oligonucleotide
agcttaagatacctgcaagcaggacaaatcgctc

SEQ ID NO: 255498 - DNA, 33 bp, Artificial Sequence
  Description of Artificial Sequence: Synthetic oligonucleotide
gcttaagatacctgcaagcaggacaaatcgctc

SEQ ID NO: 255499 - DNA, 34 bp, Artificial Sequence
  Description of Artificial Sequence: Synthetic oligonucleotide
cttaagatacctgcaagcaggacaaatcgctcag

SEQ ID NO: 255500 - DNA, 34 bp, Artificial Sequence
  Description of Artificial Sequence: Synthetic oligonucleotide
ttaagatacctgcaagcaggacaaatcgctcagg

SEQ ID NO: 255501 - DNA, 33 bp, Artificial Sequence
  Description of Artificial Sequence: Synthetic oligonucleotide
taagatacctgcaagcaggacaaatcgctcagg

SEQ ID NO: 255502 - DNA, 32 bp, Artificial Sequence
  Description of Artificial Sequence: Synthetic oligonucleotide
aagatacctgcaagcaggacaaatcgctcagg

SEQ ID NO: 255503 - DNA, 31 bp, Artificial Sequence
  Description of Artificial Sequence: Synthetic oligonucleotide
agatacctgcaagcaggacaaatcgctcagg

SEQ ID NO: 255504 - DNA, 30 bp, Artificial Sequence
  Description of Artificial Sequence: Synthetic oligonucleotide
gatacctgcaagcaggacaaatcgctcagg

SEQ ID NO: 255505 - DNA, 30 bp, Artificial Sequence
  Description of Artificial Sequence: Synthetic oligonucleotide
atacctgcaagcaggacaaatcgctcaggc

SEQ ID NO: 255506 - DNA, 29 bp, Artificial Sequence
  Description of Artificial Sequence: Synthetic oligonucleotide
tacctgcaagcaggacaaatcgctcaggc

SEQ ID NO: 255507 - DNA, 28 bp, Artificial Sequence
  Description of Artificial Sequence: Synthetic oligonucleotide
acctgcaagcaggacaaatcgctcaggc

SEQ ID NO: 255508 - DNA, 27 bp, Artificial Sequence
  Description of Artificial Sequence: Synthetic oligonucleotide
cctgcaagcaggacaaatcgctcaggc

SEQ ID NO: 255509 - DNA, 33 bp, Artificial Sequence
  Description of Artificial Sequence: Synthetic oligonucleotide
ctgcaagcaggacaaatcgctcaggcaattatc

SEQ ID NO: 255510 - DNA, 38 bp, Artificial Sequence
  Description of Artificial Sequence: Synthetic oligonucleotide
tgcaagcaggacaaatcgctcaggcaattatcatattc

SEQ ID NO: 255511 - DNA, 37 bp, Artificial Sequence
  Description of Artificial Sequence: Synthetic oligonucleotide
gcaagcaggacaaatcgctcaggcaattatcatattc

SEQ ID NO: 255512 - DNA, 37 bp, Artificial Sequence
  Description of Artificial Sequence: Synthetic oligonucleotide
caagcaggacaaatcgctcaggcaattatcatattcg

SEQ ID NO: 255513 - DNA, 37 bp, Artificial Sequence
  Description of Artificial Sequence: Synthetic oligonucleotide
aagcaggacaaatcgctcaggcaattatcatattcgc

SEQ ID NO: 255514 - DNA, 36 bp, Artificial Sequence
  Description of Artificial Sequence: Synthetic oligonucleotide
agcaggacaaatcgctcaggcaattatcatattcgc

SEQ ID NO: 255515 - DNA, 35 bp, Artificial Sequence
  Description of Artificial Sequence: Synthetic oligonucleotide
gcaggacaaatcgctcaggcaattatcatattcgc

SEQ ID NO: 255516 - DNA, 44 bp, Artificial Sequence
  Description of Artificial Sequence: Synthetic oligonucleotide
caggacaaatcgctcaggcaattatcatattcgcataaaaattg

SEQ ID NO: 255517 - DNA, 44 bp, Artificial Sequence
  Description of Artificial Sequence: Synthetic oligonucleotide
aggacaaatcgctcaggcaattatcatattcgcataaaaattgg

SEQ ID NO: 255518 - DNA, 43 bp, Artificial Sequence
  Description of Artificial Sequence: Synthetic oligonucleotide
ggacaaatcgctcaggcaattatcatattcgcataaaaattgg

SEQ ID NO: 255519 - DNA, 43 bp, Artificial Sequence
  Description of Artificial Sequence: Synthetic oligonucleotide
gacaaatcgctcaggcaattatcatattcgcataaaaattggc

SEQ ID NO: 255520 - DNA, 46 bp, Artificial Sequence
  Description of Artificial Sequence: Synthetic oligonucleotide
acaaatcgctcaggcaattatcatattcgcataaaaattggctatg

SEQ ID NO: 255521 - DNA, 45 bp, Artificial Sequence
  Description of Artificial Sequence: Synthetic oligonucleotide
caaatcgctcaggcaattatcatattcgcataaaaattggctatg

SEQ ID NO: 255522 - DNA, 46 bp, Artificial Sequence
  Description of Artificial Sequence: Synthetic oligonucleotide
aaatcgctcaggcaattatcatattcgcataaaaattggctatgag

SEQ ID NO: 255523 - DNA, 45 bp, Artificial Sequence
  Description of Artificial Sequence: Synthetic oligonucleotide
aatcgctcaggcaattatcatattcgcataaaaattggctatgag

SEQ ID NO: 255524 - DNA, 44 bp, Artificial Sequence
  Description of Artificial Sequence: Synthetic oligonucleotide
atcgctcaggcaattatcatattcgcataaaaattggctatgag

SEQ ID NO: 255525 - DNA, 43 bp, Artificial Sequence
  Description of Artificial Sequence: Synthetic oligonucleotide
tcgctcaggcaattatcatattcgcataaaaattggctatgag

SEQ ID NO: 255526 - DNA, 42 bp, Artificial Sequence
  Description of Artificial Sequence: Synthetic oligonucleotide
cgctcaggcaattatcatattcgcataaaaattggctatgag

SEQ ID NO: 255527 - DNA, 44 bp, Artificial Sequence
  Description of Artificial Sequence: Synthetic oligonucleotide
gctcaggcaattatcatattcgcataaaaattggctatgagttc

SEQ ID NO: 255528 - DNA, 47 bp, Artificial Sequence
  Description of Artificial Sequence: Synthetic oligonucleotide
ctcaggcaattatcatattcgcataaaaattggctatgagttctatc

SEQ ID NO: 255529 - DNA, 47 bp, Artificial Sequence
  Description of Artificial Sequence: Synthetic oligonucleotide
tcaggcaattatcatattcgcataaaaattggctatgagttctatcc

SEQ ID NO: 255530 - DNA, 46 bp, Artificial Sequence
  Description of Artificial Sequence: Synthetic oligonucleotide
caggcaattatcatattcgcataaaaattggctatgagttctatcc

SEQ ID NO: 255531 - DNA, 49 bp, Artificial Sequence
  Description of Artificial Sequence: Synthetic oligonucleotide
aggcaattatcatattcgcataaaaattggctatgagttctatccttag

SEQ ID NO: 255532 - DNA, 48 bp, Artificial Sequence
  Description of Artificial Sequence: Synthetic oligonucleotide
ggcaattatcatattcgcataaaaattggctatgagttctatccttag

SEQ ID NO: 255533 - DNA, 48 bp, Artificial Sequence
  Description of Artificial Sequence: Synthetic oligonucleotide
gcaattatcatattcgcataaaaattggctatgagttctatccttagg

SEQ ID NO: 255534 - DNA, 48 bp, Artificial Sequence
  Description of Artificial Sequence: Synthetic oligonucleotide
caattatcatattcgcataaaaattggctatgagttctatccttaggc

SEQ ID NO: 255535 - DNA, 49 bp, Artificial Sequence
  Description of Artificial Sequence: Synthetic oligonucleotide
aattatcatattcgcataaaaattggctatgagttctatccttaggcac

SEQ ID NO: 255536 - DNA, 48 bp, Artificial Sequence
  Description of Artificial Sequence: Synthetic oligonucleotide
attatcatattcgcataaaaattggctatgagttctatccttaggcac

SEQ ID NO: 255537 - DNA, 47 bp, Artificial Sequence
  Description of Artificial Sequence: Synthetic oligonucleotide
ttatcatattcgcataaaaattggctatgagttctatccttaggcac

SEQ ID NO: 255538 - DNA, 46 bp, Artificial Sequence
  Description of Artificial Sequence: Synthetic oligonucleotide
tatcatattcgcataaaaattggctatgagttctatccttaggcac

SEQ ID NO: 255539 - DNA, 45 bp, Artificial Sequence
  Description of Artificial Sequence: Synthetic oligonucleotide
atcatattcgcataaaaattggctatgagttctatccttaggcac

SEQ ID NO: 255540 - DNA, 44 bp, Artificial Sequence
  Description of Artificial Sequence: Synthetic oligonucleotide
tcatattcgcataaaaattggctatgagttctatccttaggcac

SEQ ID NO: 255541 - DNA, 43 bp, Artificial Sequence
  Description of Artificial Sequence: Synthetic oligonucleotide
catattcgcataaaaattggctatgagttctatccttaggcac

SEQ ID NO: 255542 - DNA, 44 bp, Artificial Sequence
  Description of Artificial Sequence: Synthetic oligonucleotide
atattcgcataaaaattggctatgagttctatccttaggcactc

SEQ ID NO: 255543 - DNA, 43 bp, Artificial Sequence
  Description of Artificial Sequence: Synthetic oligonucleotide
tattcgcataaaaattggctatgagttctatccttaggcactc

SEQ ID NO: 255544 - DNA, 42 bp, Artificial Sequence
  Description of Artificial Sequence: Synthetic oligonucleotide
attcgcataaaaattggctatgagttctatccttaggcactc

SEQ ID NO: 255545 - DNA, 41 bp, Artificial Sequence
  Description of Artificial Sequence: Synthetic oligonucleotide
ttcgcataaaaattggctatgagttctatccttaggcactc

SEQ ID NO: 255546 - DNA, 40 bp, Artificial Sequence
  Description of Artificial Sequence: Synthetic oligonucleotide
tcgcataaaaattggctatgagttctatccttaggcactc

SEQ ID NO: 255547 - DNA, 39 bp, Artificial Sequence
  Description of Artificial Sequence: Synthetic oligonucleotide
cgcataaaaattggctatgagttctatccttaggcactc

SEQ ID NO: 255548 - DNA, 41 bp, Artificial Sequence
  Description of Artificial Sequence: Synthetic oligonucleotide
gcataaaaattggctatgagttctatccttaggcactcatg

SEQ ID NO: 255549 - DNA, 41 bp, Artificial Sequence
  Description of Artificial Sequence: Synthetic oligonucleotide
cataaaaattggctatgagttctatccttaggcactcatgg

SEQ ID NO: 255550 - DNA, 44 bp, Artificial Sequence
  Description of Artificial Sequence: Synthetic oligonucleotide
ataaaaattggctatgagttctatccttaggcactcatggaaag

SEQ ID NO: 255551 - DNA, 43 bp, Artificial Sequence
  Description of Artificial Sequence: Synthetic oligonucleotide
taaaaattggctatgagttctatccttaggcactcatggaaag

SEQ ID NO: 255552 - DNA, 42 bp, Artificial Sequence
  Description of Artificial Sequence: Synthetic oligonucleotide
aaaaattggctatgagttctatccttaggcactcatggaaag

SEQ ID NO: 255553 - DNA, 41 bp, Artificial Sequence
  Description of Artificial Sequence: Synthetic oligonucleotide
aaaattggctatgagttctatccttaggcactcatggaaag

SEQ ID NO: 255554 - DNA, 40 bp, Artificial Sequence
  Description of Artificial Sequence: Synthetic oligonucleotide
aaattggctatgagttctatccttaggcactcatggaaag

SEQ ID NO: 255555 - DNA, 39 bp, Artificial Sequence
  Description of Artificial Sequence: Synthetic oligonucleotide
aattggctatgagttctatccttaggcactcatggaaag

SEQ ID NO: 255556 - DNA, 38 bp, Artificial Sequence
  Description of Artificial Sequence: Synthetic oligonucleotide
attggctatgagttctatccttaggcactcatggaaag

SEQ ID NO: 255557 - DNA, 37 bp, Artificial Sequence
  Description of Artificial Sequence: Synthetic oligonucleotide
ttggctatgagttctatccttaggcactcatggaaag

SEQ ID NO: 255558 - DNA, 36 bp, Artificial Sequence
  Description of Artificial Sequence: Synthetic oligonucleotide
tggctatgagttctatccttaggcactcatggaaag

SEQ ID NO: 255559 - DNA, 35 bp, Artificial Sequence
  Description of Artificial Sequence: Synthetic oligonucleotide
ggctatgagttctatccttaggcactcatggaaag

SEQ ID NO: 255560 - DNA, 35 bp, Artificial Sequence
  Description of Artificial Sequence: Synthetic oligonucleotide
gctatgagttctatccttaggcactcatggaaagg

SEQ ID NO: 255561 - DNA, 38 bp, Artificial Sequence
  Description of Artificial Sequence: Synthetic oligonucleotide
ctatgagttctatccttaggcactcatggaaaggattc

SEQ ID NO: 255562 - DNA, 39 bp, Artificial Sequence
  Description of Artificial Sequence: Synthetic oligonucleotide
tatgagttctatccttaggcactcatggaaaggattcag

SEQ ID NO: 255563 - DNA, 38 bp, Artificial Sequence
  Description of Artificial Sequence: Synthetic oligonucleotide
atgagttctatccttaggcactcatggaaaggattcag

SEQ ID NO: 255564 - DNA, 37 bp, Artificial Sequence
  Description of Artificial Sequence: Synthetic oligonucleotide
tgagttctatccttaggcactcatggaaaggattcag

SEQ ID NO: 255565 - DNA, 36 bp, Artificial Sequence
  Description of Artificial Sequence: Synthetic oligonucleotide
gagttctatccttaggcactcatggaaaggattcag

SEQ ID NO: 255566 - DNA, 39 bp, Artificial Sequence
  Description of Artificial Sequence: Synthetic oligonucleotide
agttctatccttaggcactcatggaaaggattcagaaag

SEQ ID NO: 255567 - DNA, 38 bp, Artificial Sequence
  Description of Artificial Sequence: Synthetic oligonucleotide
gttctatccttaggcactcatggaaaggattcagaaag

SEQ ID NO: 255568 - DNA, 40 bp, Artificial Sequence
  Description of Artificial Sequence: Synthetic oligonucleotide
ttctatccttaggcactcatggaaaggattcagaaagaag

SEQ ID NO: 255569 - DNA, 39 bp, Artificial Sequence
  Description of Artificial Sequence: Synthetic oligonucleotide
tctatccttaggcactcatggaaaggattcagaaagaag

SEQ ID NO: 255570 - DNA, 38 bp, Artificial Sequence
  Description of Artificial Sequence: Synthetic oligonucleotide
ctatccttaggcactcatggaaaggattcagaaagaag

SEQ ID NO: 255571 - DNA, 38 bp, Artificial Sequence
  Description of Artificial Sequence: Synthetic oligonucleotide
tatccttaggcactcatggaaaggattcagaaagaagg

SEQ ID NO: 255572 - DNA, 37 bp, Artificial Sequence
  Description of Artificial Sequence: Synthetic oligonucleotide
atccttaggcactcatggaaaggattcagaaagaagg

SEQ ID NO: 255573 - DNA, 36 bp, Artificial Sequence
  Description of Artificial Sequence: Synthetic oligonucleotide
tccttaggcactcatggaaaggattcagaaagaagg

SEQ ID NO: 255574 - DNA, 35 bp, Artificial Sequence
  Description of Artificial Sequence: Synthetic oligonucleotide
ccttaggcactcatggaaaggattcagaaagaagg

SEQ ID NO: 255575 - DNA, 35 bp, Artificial Sequence
  Description of Artificial Sequence: Synthetic oligonucleotide
cttaggcactcatggaaaggattcagaaagaaggg

SEQ ID NO: 255576 - DNA, 37 bp, Artificial Sequence
  Description of Artificial Sequence: Synthetic oligonucleotide
ttaggcactcatggaaaggattcagaaagaagggaag

SEQ ID NO: 255577 - DNA, 36 bp, Artificial Sequence
  Description of Artificial Sequence: Synthetic oligonucleotide
taggcactcatggaaaggattcagaaagaagggaag

SEQ ID NO: 255578 - DNA, 35 bp, Artificial Sequence
  Description of Artificial Sequence: Synthetic oligonucleotide
aggcactcatggaaaggattcagaaagaagggaag

SEQ ID NO: 255579 - DNA, 34 bp, Artificial Sequence
  Description of Artificial Sequence: Synthetic oligonucleotide
ggcactcatggaaaggattcagaaagaagggaag

SEQ ID NO: 255580 - DNA, 34 bp, Artificial Sequence
  Description of Artificial Sequence: Synthetic oligonucleotide
gcactcatggaaaggattcagaaagaagggaagg

SEQ ID NO: 255581 - DNA, 41 bp, Artificial Sequence
  Description of Artificial Sequence: Synthetic oligonucleotide
cactcatggaaaggattcagaaagaagggaaggaaataatc

SEQ ID NO: 255582 - DNA, 42 bp, Artificial Sequence
  Description of Artificial Sequence: Synthetic oligonucleotide
actcatggaaaggattcagaaagaagggaaggaaataatctg

SEQ ID NO: 255583 - DNA, 41 bp, Artificial Sequence
  Description of Artificial Sequence: Synthetic oligonucleotide
ctcatggaaaggattcagaaagaagggaaggaaataatctg

SEQ ID NO: 255584 - DNA, 41 bp, Artificial Sequence
  Description of Artificial Sequence: Synthetic oligonucleotide
tcatggaaaggattcagaaagaagggaaggaaataatctgg

SEQ ID NO: 255585 - DNA, 40 bp, Artificial Sequence
  Description of Artificial Sequence: Synthetic oligonucleotide
catggaaaggattcagaaagaagggaaggaaataatctgg

SEQ ID NO: 255586 - DNA, 40 bp, Artificial Sequence
  Description of Artificial Sequence: Synthetic oligonucleotide
atggaaaggattcagaaagaagggaaggaaataatctggg

SEQ ID NO: 255587 - DNA, 39 bp, Artificial Sequence
  Description of Artificial Sequence: Synthetic oligonucleotide
tggaaaggattcagaaagaagggaaggaaataatctggg

SEQ ID NO: 255588 - DNA, 38 bp, Artificial Sequence
  Description of Artificial Sequence: Synthetic oligonucleotide
ggaaaggattcagaaagaagggaaggaaataatctggg

SEQ ID NO: 255589 - DNA, 39 bp, Artificial Sequence
  Description of Artificial Sequence: Synthetic oligonucleotide
gaaaggattcagaaagaagggaaggaaataatctgggag

SEQ ID NO: 255590 - DNA, 39 bp, Artificial Sequence
  Description of Artificial Sequence: Synthetic oligonucleotide
aaaggattcagaaagaagggaaggaaataatctgggagc

SEQ ID NO: 255591 - DNA, 38 bp, Artificial Sequence
  Description of Artificial Sequence: Synthetic oligonucleotide
aaggattcagaaagaagggaaggaaataatctgggagc

SEQ ID NO: 255592 - DNA, 37 bp, Artificial Sequence
  Description of Artificial Sequence: Synthetic oligonucleotide
aggattcagaaagaagggaaggaaataatctgggagc

SEQ ID NO: 255593 - DNA, 36 bp, Artificial Sequence
  Description of Artificial Sequence: Synthetic oligonucleotide
ggattcagaaagaagggaaggaaataatctgggagc

SEQ ID NO: 255594 - DNA, 36 bp, Artificial Sequence
  Description of Artificial Sequence: Synthetic oligonucleotide
gattcagaaagaagggaaggaaataatctgggagcc

SEQ ID NO: 255595 - DNA, 37 bp, Artificial Sequence
  Description of Artificial Sequence: Synthetic oligonucleotide
attcagaaagaagggaaggaaataatctgggagcctg

SEQ ID NO: 255596 - DNA, 36 bp, Artificial Sequence
  Description of Artificial Sequence: Synthetic oligonucleotide
ttcagaaagaagggaaggaaataatctgggagcctg

SEQ ID NO: 255597 - DNA, 35 bp, Artificial Sequence
  Description of Artificial Sequence: Synthetic oligonucleotide
tcagaaagaagggaaggaaataatctgggagcctg

SEQ ID NO: 255598 - DNA, 34 bp, Artificial Sequence
  Description of Artificial Sequence: Synthetic oligonucleotide
cagaaagaagggaaggaaataatctgggagcctg

SEQ ID NO: 255599 - DNA, 36 bp, Artificial Sequence
  Description of Artificial Sequence: Synthetic oligonucleotide
agaaagaagggaaggaaataatctgggagcctgttc

SEQ ID NO: 255600 - DNA, 35 bp, Artificial Sequence
  Description of Artificial Sequence: Synthetic oligonucleotide
gaaagaagggaaggaaataatctgggagcctgttc

SEQ ID NO: 255601 - DNA, 36 bp, Artificial Sequence
  Description of Artificial Sequence: Synthetic oligonucleotide
aaagaagggaaggaaataatctgggagcctgttcac

SEQ ID NO: 255602 - DNA, 35 bp, Artificial Sequence
  Description of Artificial Sequence: Synthetic oligonucleotide
aagaagggaaggaaataatctgggagcctgttcac

SEQ ID NO: 255603 - DNA, 34 bp, Artificial Sequence
  Description of Artificial Sequence: Synthetic oligonucleotide
agaagggaaggaaataatctgggagcctgttcac

SEQ ID NO: 255604 - DNA, 33 bp, Artificial Sequence
  Description of Artificial Sequence: Synthetic oligonucleotide
gaagggaaggaaataatctgggagcctgttcac

SEQ ID NO: 255605 - DNA, 34 bp, Artificial Sequence
  Description of Artificial Sequence: Synthetic oligonucleotide
aagggaaggaaataatctgggagcctgttcactg

SEQ ID NO: 255606 - DNA, 33 bp, Artificial Sequence
  Description of Artificial Sequence: Synthetic oligonucleotide
agggaaggaaataatctgggagcctgttcactg

SEQ ID NO: 255607 - DNA, 32 bp, Artificial Sequence
  Description of Artificial Sequence: Synthetic oligonucleotide
gggaaggaaataatctgggagcctgttcactg

SEQ ID NO: 255608 - DNA, 33 bp, Artificial Sequence
  Description of Artificial Sequence: Synthetic oligonucleotide
ggaaggaaataatctgggagcctgttcactgag

SEQ ID NO: 255609 - DNA, 34 bp, Artificial Sequence
  Description of Artificial Sequence: Synthetic oligonucleotide
gaaggaaataatctgggagcctgttcactgagtg

SEQ ID NO: 255610 - DNA, 34 bp, Artificial Sequence
  Description of Artificial Sequence: Synthetic oligonucleotide
aaggaaataatctgggagcctgttcactgagtgg

SEQ ID NO: 255611 - DNA, 33 bp, Artificial Sequence
  Description of Artificial Sequence: Synthetic oligonucleotide
aggaaataatctgggagcctgttcactgagtgg

SEQ ID NO: 255612 - DNA, 32 bp, Artificial Sequence
  Description of Artificial Sequence: Synthetic oligonucleotide
ggaaataatctgggagcctgttcactgagtgg

SEQ ID NO: 255613 - DNA, 32 bp, Artificial Sequence
  Description of Artificial Sequence: Synthetic oligonucleotide
gaaataatctgggagcctgttcactgagtggc

SEQ ID NO: 255614 - DNA, 32 bp, Artificial Sequence
  Description of Artificial Sequence: Synthetic oligonucleotide
aaataatctgggagcctgttcactgagtggcc

SEQ ID NO: 255615 - DNA, 31 bp, Artificial Sequence
  Description of Artificial Sequence: Synthetic oligonucleotide
aataatctgggagcctgttcactgagtggcc

SEQ ID NO: 255616 - DNA, 30 bp, Artificial Sequence
  Description of Artificial Sequence: Synthetic oligonucleotide
ataatctgggagcctgttcactgagtggcc

SEQ ID NO: 255617 - DNA, 29 bp, Artificial Sequence
  Description of Artificial Sequence: Synthetic oligonucleotide
taatctgggagcctgttcactgagtggcc

SEQ ID NO: 255618 - DNA, 28 bp, Artificial Sequence
  Description of Artificial Sequence: Synthetic oligonucleotide
aatctgggagcctgttcactgagtggcc

SEQ ID NO: 255619 - DNA, 27 bp, Artificial Sequence
  Description of Artificial Sequence: Synthetic oligonucleotide
atctgggagcctgttcactgagtggcc

SEQ ID NO: 255620 - DNA, 26 bp, Artificial Sequence
  Description of Artificial Sequence: Synthetic oligonucleotide
tctgggagcctgttcactgagtggcc

SEQ ID NO: 255621 - DNA, 25 bp, Artificial Sequence
  Description of Artificial Sequence: Synthetic oligonucleotide
ctgggagcctgttcactgagtggcc

SEQ ID NO: 255622 - DNA, 27 bp, Artificial Sequence
  Description of Artificial Sequence: Synthetic oligonucleotide
tgggagcctgttcactgagtggcccat

SEQ ID NO: 255623 - DNA, 26 bp, Artificial Sequence
  Description of Artificial Sequence: Synthetic oligonucleotide
gggagcctgttcactgagtggcccat

SEQ ID NO: 255624 - DNA, 26 bp, Artificial Sequence
  Description of Artificial Sequence: Synthetic oligonucleotide
ggagcctgttcactgagtggcccatg

SEQ ID NO: 255625 - DNA, 27 bp, Artificial Sequence
  Description of Artificial Sequence: Synthetic oligonucleotide
gagcctgttcactgagtggcccatgca

SEQ ID NO: 255626 - DNA, 27 bp, Artificial Sequence
  Description of Artificial Sequence: Synthetic oligonucleotide
agcctgttcactgagtggcccatgcag

SEQ ID NO: 255627 - DNA, 27 bp, Artificial Sequence
  Description of Artificial Sequence: Synthetic oligonucleotide
gcctgttcactgagtggcccatgcaga

SEQ ID NO: 255628 - DNA, 28 bp, Artificial Sequence
  Description of Artificial Sequence: Synthetic oligonucleotide
cctgttcactgagtggcccatgcagaag

SEQ ID NO: 255629 - DNA, 28 bp, Artificial Sequence
  Description of Artificial Sequence: Synthetic oligonucleotide
ctgttcactgagtggcccatgcagaagc

SEQ ID NO: 255630 - DNA, 28 bp, Artificial Sequence
  Description of Artificial Sequence: Synthetic oligonucleotide
tgttcactgagtggcccatgcagaagcg

SEQ ID NO: 255631 - DNA, 27 bp, Artificial Sequence
  Description of Artificial Sequence: Synthetic oligonucleotide
gttcactgagtggcccatgcagaagcg

SEQ ID NO: 255632 - DNA, 28 bp, Artificial Sequence
  Description of Artificial Sequence: Synthetic oligonucleotide
ttcactgagtggcccatgcagaagcgtg

SEQ ID NO: 255633 - DNA, 27 bp, Artificial Sequence
  Description of Artificial Sequence: Synthetic oligonucleotide
tcactgagtggcccatgcagaagcgtg

SEQ ID NO: 255634 - DNA, 27 bp, Artificial Sequence
  Description of Artificial Sequence: Synthetic oligonucleotide
cactgagtggcccatgcagaagcgtgt

SEQ ID NO: 255635 - DNA, 28 bp, Artificial Sequence
  Description of Artificial Sequence: Synthetic oligonucleotide
actgagtggcccatgcagaagcgtgtag

SEQ ID NO: 255636 - DNA, 27 bp, Artificial Sequence
  Description of Artificial Sequence: Synthetic oligonucleotide
ctgagtggcccatgcagaagcgtgtag

SEQ ID NO: 255637 - DNA, 31 bp, Artificial Sequence
  Description of Artificial Sequence: Synthetic oligonucleotide
tgagtggcccatgcagaagcgtgtagaaaag

SEQ ID NO: 255638 - DNA, 30 bp, Artificial Sequence
  Description of Artificial Sequence: Synthetic oligonucleotide
gagtggcccatgcagaagcgtgtagaaaag

SEQ ID NO: 255639 - DNA, 31 bp, Artificial Sequence
  Description of Artificial Sequence: Synthetic oligonucleotide
agtggcccatgcagaagcgtgtagaaaagag

SEQ ID NO: 255640 - DNA, 30 bp, Artificial Sequence
  Description of Artificial Sequence: Synthetic oligonucleotide
gtggcccatgcagaagcgtgtagaaaagag

SEQ ID NO: 255641 - DNA, 30 bp, Artificial Sequence
  Description of Artificial Sequence: Synthetic oligonucleotide
tggcccatgcagaagcgtgtagaaaagagg

SEQ ID NO: 255642 - DNA, 29 bp, Artificial Sequence
  Description of Artificial Sequence: Synthetic oligonucleotide
ggcccatgcagaagcgtgtagaaaagagg

SEQ ID NO: 255643 - DNA, 31 bp, Artificial Sequence
  Description of Artificial Sequence: Synthetic oligonucleotide
gcccatgcagaagcgtgtagaaaagaggaag

SEQ ID NO: 255644 - DNA, 36 bp, Artificial Sequence
  Description of Artificial Sequence: Synthetic oligonucleotide
cccatgcagaagcgtgtagaaaagaggaagaatatg

SEQ ID NO: 255645 - DNA, 38 bp, Artificial Sequence
  Description of Artificial Sequence: Synthetic oligonucleotide
ccatgcagaagcgtgtagaaaagaggaagaatatgatg

SEQ ID NO: 255646 - DNA, 40 bp, Artificial Sequence
  Description of Artificial Sequence: Synthetic oligonucleotide
catgcagaagcgtgtagaaaagaggaagaatatgatgttg

SEQ ID NO: 255647 - DNA, 40 bp, Artificial Sequence
  Description of Artificial Sequence: Synthetic oligonucleotide
atgcagaagcgtgtagaaaagaggaagaatatgatgttgc

SEQ ID NO: 255648 - DNA, 39 bp, Artificial Sequence
  Description of Artificial Sequence: Synthetic oligonucleotide
tgcagaagcgtgtagaaaagaggaagaatatgatgttgc

SEQ ID NO: 255649 - DNA, 38 bp, Artificial Sequence
  Description of Artificial Sequence: Synthetic oligonucleotide
gcagaagcgtgtagaaaagaggaagaatatgatgttgc

SEQ ID NO: 255650 - DNA, 38 bp, Artificial Sequence
  Description of Artificial Sequence: Synthetic oligonucleotide
cagaagcgtgtagaaaagaggaagaatatgatgttgcg

SEQ ID NO: 255651 - DNA, 40 bp, Artificial Sequence
  Description of Artificial Sequence: Synthetic oligonucleotide
agaagcgtgtagaaaagaggaagaatatgatgttgcgaac

SEQ ID NO: 255652 - DNA, 39 bp, Artificial Sequence
  Description of Artificial Sequence: Synthetic oligonucleotide
gaagcgtgtagaaaagaggaagaatatgatgttgcgaac

SEQ ID NO: 255653 - DNA, 41 bp, Artificial Sequence
  Description of Artificial Sequence: Synthetic oligonucleotide
aagcgtgtagaaaagaggaagaatatgatgttgcgaacaac

SEQ ID NO: 255654 - DNA, 40 bp, Artificial Sequence
  Description of Artificial Sequence: Synthetic oligonucleotide
agcgtgtagaaaagaggaagaatatgatgttgcgaacaac

SEQ ID NO: 255655 - DNA, 39 bp, Artificial Sequence
  Description of Artificial Sequence: Synthetic oligonucleotide
gcgtgtagaaaagaggaagaatatgatgttgcgaacaac

SEQ ID NO: 255656 - DNA, 39 bp, Artificial Sequence
  Description of Artificial Sequence: Synthetic oligonucleotide
cgtgtagaaaagaggaagaatatgatgttgcgaacaacg

SEQ ID NO: 255657 - DNA, 39 bp, Artificial Sequence
  Description of Artificial Sequence: Synthetic oligonucleotide
gtgtagaaaagaggaagaatatgatgttgcgaacaacgg

SEQ ID NO: 255658 - DNA, 39 bp, Artificial Sequence
  Description of Artificial Sequence: Synthetic oligonucleotide
tgtagaaaagaggaagaatatgatgttgcgaacaacggc

SEQ ID NO: 255659 - DNA, 38 bp, Artificial Sequence
  Description of Artificial Sequence: Synthetic oligonucleotide
gtagaaaagaggaagaatatgatgttgcgaacaacggc

SEQ ID NO: 255660 - DNA, 39 bp, Artificial Sequence
  Description of Artificial Sequence: Synthetic oligonucleotide
tagaaaagaggaagaatatgatgttgcgaacaacggcac

SEQ ID NO: 255661 - DNA, 38 bp, Artificial Sequence
  Description of Artificial Sequence: Synthetic oligonucleotide
agaaaagaggaagaatatgatgttgcgaacaacggcac

SEQ ID NO: 255662 - DNA, 37 bp, Artificial Sequence
  Description of Artificial Sequence: Synthetic oligonucleotide
gaaaagaggaagaatatgatgttgcgaacaacggcac

SEQ ID NO: 255663 - DNA, 39 bp, Artificial Sequence
  Description of Artificial Sequence: Synthetic oligonucleotide
aaaagaggaagaatatgatgttgcgaacaacggcacttc

SEQ ID NO: 255664 - DNA, 38 bp, Artificial Sequence
  Description of Artificial Sequence: Synthetic oligonucleotide
aaagaggaagaatatgatgttgcgaacaacggcacttc

SEQ ID NO: 255665 - DNA, 37 bp, Artificial Sequence
  Description of Artificial Sequence: Synthetic oligonucleotide
aagaggaagaatatgatgttgcgaacaacggcacttc

SEQ ID NO: 255666 - DNA, 36 bp, Artificial Sequence
  Description of Artificial Sequence: Synthetic oligonucleotide
agaggaagaatatgatgttgcgaacaacggcacttc

SEQ ID NO: 255667 - DNA, 35 bp, Artificial Sequence
  Description of Artificial Sequence: Synthetic oligonucleotide
gaggaagaatatgatgttgcgaacaacggcacttc

SEQ ID NO: 255668 - DNA, 36 bp, Artificial Sequence
  Description of Artificial Sequence: Synthetic oligonucleotide
aggaagaatatgatgttgcgaacaacggcacttctc

SEQ ID NO: 255669 - DNA, 35 bp, Artificial Sequence
  Description of Artificial Sequence: Synthetic oligonucleotide
ggaagaatatgatgttgcgaacaacggcacttctc

SEQ ID NO: 255670 - DNA, 37 bp, Artificial Sequence
  Description of Artificial Sequence: Synthetic oligonucleotide
gaagaatatgatgttgcgaacaacggcacttctcaag

SEQ ID NO: 255671 - DNA, 37 bp, Artificial Sequence
  Description of Artificial Sequence: Synthetic oligonucleotide
aagaatatgatgttgcgaacaacggcacttctcaagg

SEQ ID NO: 255672 - DNA, 36 bp, Artificial Sequence
  Description of Artificial Sequence: Synthetic oligonucleotide
agaatatgatgttgcgaacaacggcacttctcaagg

SEQ ID NO: 255673 - DNA, 35 bp, Artificial Sequence
  Description of Artificial Sequence: Synthetic oligonucleotide
gaatatgatgttgcgaacaacggcacttctcaagg

SEQ ID NO: 255674 - DNA, 42 bp, Artificial Sequence
  Description of Artificial Sequence: Synthetic oligonucleotide
aatatgatgttgcgaacaacggcacttctcaaggaaataaac

SEQ ID NO: 255675 - DNA, 41 bp, Artificial Sequence
  Description of Artificial Sequence: Synthetic oligonucleotide
atatgatgttgcgaacaacggcacttctcaaggaaataaac

SEQ ID NO: 255676 - DNA, 40 bp, Artificial Sequence
  Description of Artificial Sequence: Synthetic oligonucleotide
tatgatgttgcgaacaacggcacttctcaaggaaataaac

SEQ ID NO: 255677 - DNA, 39 bp, Artificial Sequence
  Description of Artificial Sequence: Synthetic oligonucleotide
atgatgttgcgaacaacggcacttctcaaggaaataaac

SEQ ID NO: 255678 - DNA, 38 bp, Artificial Sequence
  Description of Artificial Sequence: Synthetic oligonucleotide
tgatgttgcgaacaacggcacttctcaaggaaataaac

SEQ ID NO: 255679 - DNA, 37 bp, Artificial Sequence
  Description of Artificial Sequence: Synthetic oligonucleotide
gatgttgcgaacaacggcacttctcaaggaaataaac

SEQ ID NO: 255680 - DNA, 41 bp, Artificial Sequence
  Description of Artificial Sequence: Synthetic oligonucleotide
atgttgcgaacaacggcacttctcaaggaaataaacttatc

SEQ ID NO: 255681 - DNA, 40 bp, Artificial Sequence
  Description of Artificial Sequence: Synthetic oligonucleotide
tgttgcgaacaacggcacttctcaaggaaataaacttatc

SEQ ID NO: 255682 - DNA, 39 bp, Artificial Sequence
  Description of Artificial Sequence: Synthetic oligonucleotide
gttgcgaacaacggcacttctcaaggaaataaacttatc

SEQ ID NO: 255683 - DNA, 41 bp, Artificial Sequence
  Description of Artificial Sequence: Synthetic oligonucleotide
ttgcgaacaacggcacttctcaaggaaataaacttatcaag

SEQ ID NO: 255684 - DNA, 40 bp, Artificial Sequence
  Description of Artificial Sequence: Synthetic oligonucleotide
tgcgaacaacggcacttctcaaggaaataaacttatcaag

SEQ ID NO: 255685 - DNA, 39 bp, Artificial Sequence
  Description of Artificial Sequence: Synthetic oligonucleotide
gcgaacaacggcacttctcaaggaaataaacttatcaag

SEQ ID NO: 255686 - DNA, 39 bp, Artificial Sequence
  Description of Artificial Sequence: Synthetic oligonucleotide
cgaacaacggcacttctcaaggaaataaacttatcaagg

SEQ ID NO: 255687 - DNA, 40 bp, Artificial Sequence
  Description of Artificial Sequence: Synthetic oligonucleotide
gaacaacggcacttctcaaggaaataaacttatcaaggag

SEQ ID NO: 255688 - DNA, 40 bp, Artificial Sequence
  Description of Artificial Sequence: Synthetic oligonucleotide
aacaacggcacttctcaaggaaataaacttatcaaggagc

SEQ ID NO: 255689 - DNA, 39 bp, Artificial Sequence
  Description of Artificial Sequence: Synthetic oligonucleotide
acaacggcacttctcaaggaaataaacttatcaaggagc

SEQ ID NO: 255690 - DNA, 38 bp, Artificial Sequence
  Description of Artificial Sequence: Synthetic oligonucleotide
caacggcacttctcaaggaaataaacttatcaaggagc

SEQ ID NO: 255691 - DNA, 40 bp, Artificial Sequence
  Description of Artificial Sequence: Synthetic oligonucleotide
aacggcacttctcaaggaaataaacttatcaaggagcaac

SEQ ID NO: 255692 - DNA, 39 bp, Artificial Sequence
  Description of Artificial Sequence: Synthetic oligonucleotide
acggcacttctcaaggaaataaacttatcaaggagcaac

SEQ ID NO: 255693 - DNA, 38 bp, Artificial Sequence
  Description of Artificial Sequence: Synthetic oligonucleotide
cggcacttctcaaggaaataaacttatcaaggagcaac

SEQ ID NO: 255694 - DNA, 40 bp, Artificial Sequence
  Description of Artificial Sequence: Synthetic oligonucleotide
ggcacttctcaaggaaataaacttatcaaggagcaacttc

SEQ ID NO: 255695 - DNA, 43 bp, Artificial Sequence
  Description of Artificial Sequence: Synthetic oligonucleotide
gcacttctcaaggaaataaacttatcaaggagcaacttcaaac

SEQ ID NO: 255696 - DNA, 44 bp, Artificial Sequence
  Description of Artificial Sequence: Synthetic oligonucleotide
cacttctcaaggaaataaacttatcaaggagcaacttcaaactc

SEQ ID NO: 255697 - DNA, 46 bp, Artificial Sequence
  Description of Artificial Sequence: Synthetic oligonucleotide
acttctcaaggaaataaacttatcaaggagcaacttcaaactcaag

SEQ ID NO: 255698 - DNA, 45 bp, Artificial Sequence
  Description of Artificial Sequence: Synthetic oligonucleotide
cttctcaaggaaataaacttatcaaggagcaacttcaaactcaag

SEQ ID NO: 255699 - DNA, 46 bp, Artificial Sequence
  Description of Artificial Sequence: Synthetic oligonucleotide
ttctcaaggaaataaacttatcaaggagcaacttcaaactcaagtg

SEQ ID NO: 255700 - DNA, 45 bp, Artificial Sequence
  Description of Artificial Sequence: Synthetic oligonucleotide
tctcaaggaaataaacttatcaaggagcaacttcaaactcaagtg

SEQ ID NO: 255701 - DNA, 44 bp, Artificial Sequence
  Description of Artificial Sequence: Synthetic oligonucleotide
ctcaaggaaataaacttatcaaggagcaacttcaaactcaagtg

SEQ ID NO: 255702 - DNA, 44 bp, Artificial Sequence
  Description of Artificial Sequence: Synthetic oligonucleotide
tcaaggaaataaacttatcaaggagcaacttcaaactcaagtgg

SEQ ID NO: 255703 - DNA, 43 bp, Artificial Sequence
  Description of Artificial Sequence: Synthetic oligonucleotide
caaggaaataaacttatcaaggagcaacttcaaactcaagtgg

SEQ ID NO: 255704 - DNA, 47 bp, Artificial Sequence
  Description of Artificial Sequence: Synthetic oligonucleotide
aaggaaataaacttatcaaggagcaacttcaaactcaagtggatttg

SEQ ID NO: 255705 - DNA, 46 bp, Artificial Sequence
  Description of Artificial Sequence: Synthetic oligonucleotide
aggaaataaacttatcaaggagcaacttcaaactcaagtggatttg

SEQ ID NO: 255706 - DNA, 45 bp, Artificial Sequence
  Description of Artificial Sequence: Synthetic oligonucleotide
ggaaataaacttatcaaggagcaacttcaaactcaagtggatttg

SEQ ID NO: 255707 - DNA, 45 bp, Artificial Sequence
  Description of Artificial Sequence: Synthetic oligonucleotide
gaaataaacttatcaaggagcaacttcaaactcaagtggatttgc

SEQ ID NO: 255708 - DNA, 51 bp, Artificial Sequence
  Description of Artificial Sequence: Synthetic oligonucleotide
aaataaacttatcaaggagcaacttcaaactcaagtggatttgctaaatac

SEQ ID NO: 255709 - DNA, 50 bp, Artificial Sequence
  Description of Artificial Sequence: Synthetic oligonucleotide
aataaacttatcaaggagcaacttcaaactcaagtggatttgctaaatac

SEQ ID NO: 255710 - DNA, 49 bp, Artificial Sequence
  Description of Artificial Sequence: Synthetic oligonucleotide
ataaacttatcaaggagcaacttcaaactcaagtggatttgctaaatac

SEQ ID NO: 255711 - DNA, 48 bp, Artificial Sequence
  Description of Artificial Sequence: Synthetic oligonucleotide
taaacttatcaaggagcaacttcaaactcaagtggatttgctaaatac

SEQ ID NO: 255712 - DNA, 47 bp, Artificial Sequence
  Description of Artificial Sequence: Synthetic oligonucleotide
aaacttatcaaggagcaacttcaaactcaagtggatttgctaaatac

SEQ ID NO: 255713 - DNA, 46 bp, Artificial Sequence
  Description of Artificial Sequence: Synthetic oligonucleotide
aacttatcaaggagcaacttcaaactcaagtggatttgctaaatac

SEQ ID NO: 255714 - DNA, 45 bp, Artificial Sequence
  Description of Artificial Sequence: Synthetic oligonucleotide
acttatcaaggagcaacttcaaactcaagtggatttgctaaatac

SEQ ID NO: 255715 - DNA, 44 bp, Artificial Sequence
  Description of Artificial Sequence: Synthetic oligonucleotide
cttatcaaggagcaacttcaaactcaagtggatttgctaaatac

SEQ ID NO: 255716 - DNA, 48 bp, Artificial Sequence
  Description of Artificial Sequence: Synthetic oligonucleotide
ttatcaaggagcaacttcaaactcaagtggatttgctaaatacttttg

SEQ ID NO: 255717 - DNA, 47 bp, Artificial Sequence
  Description of Artificial Sequence: Synthetic oligonucleotide
tatcaaggagcaacttcaaactcaagtggatttgctaaatacttttg

SEQ ID NO: 255718 - DNA, 46 bp, Artificial Sequence
  Description of Artificial Sequence: Synthetic oligonucleotide
atcaaggagcaacttcaaactcaagtggatttgctaaatacttttg

SEQ ID NO: 255719 - DNA, 45 bp, Artificial Sequence
  Description of Artificial Sequence: Synthetic oligonucleotide
tcaaggagcaacttcaaactcaagtggatttgctaaatacttttg

SEQ ID NO: 255720 - DNA, 44 bp, Artificial Sequence
  Description of Artificial Sequence: Synthetic oligonucleotide
caaggagcaacttcaaactcaagtggatttgctaaatacttttg

SEQ ID NO: 255721 - DNA, 45 bp, Artificial Sequence
  Description of Artificial Sequence: Synthetic oligonucleotide
aaggagcaacttcaaactcaagtggatttgctaaatacttttgag

SEQ ID NO: 255722 - DNA, 44 bp, Artificial Sequence
  Description of Artificial Sequence: Synthetic oligonucleotide
aggagcaacttcaaactcaagtggatttgctaaatacttttgag

SEQ ID NO: 255723 - DNA, 43 bp, Artificial Sequence
  Description of Artificial Sequence: Synthetic oligonucleotide
ggagcaacttcaaactcaagtggatttgctaaatacttttgag

SEQ ID NO: 255724 - DNA, 45 bp, Artificial Sequence
  Description of Artificial Sequence: Synthetic oligonucleotide
gagcaacttcaaactcaagtggatttgctaaatacttttgagatg

SEQ ID NO: 255725 - DNA, 50 bp, Artificial Sequence
  Description of Artificial Sequence: Synthetic oligonucleotide
agcaacttcaaactcaagtggatttgctaaatacttttgagatgaaatac

SEQ ID NO: 255726 - DNA, 49 bp, Artificial Sequence
  Description of Artificial Sequence: Synthetic oligonucleotide
gcaacttcaaactcaagtggatttgctaaatacttttgagatgaaatac

SEQ ID NO: 255727 - DNA, 50 bp, Artificial Sequence
  Description of Artificial Sequence: Synthetic oligonucleotide
caacttcaaactcaagtggatttgctaaatacttttgagatgaaatacag

SEQ ID NO: 255728 - DNA, 50 bp, Artificial Sequence
  Description of Artificial Sequence: Synthetic oligonucleotide
aacttcaaactcaagtggatttgctaaatacttttgagatgaaatacagg

SEQ ID NO: 255729 - DNA, 49 bp, Artificial Sequence
  Description of Artificial Sequence: Synthetic oligonucleotide
acttcaaactcaagtggatttgctaaatacttttgagatgaaatacagg

SEQ ID NO: 255730 - DNA, 48 bp, Artificial Sequence
  Description of Artificial Sequence: Synthetic oligonucleotide
cttcaaactcaagtggatttgctaaatacttttgagatgaaatacagg

SEQ ID NO: 255731 - DNA, 48 bp, Artificial Sequence
  Description of Artificial Sequence: Synthetic oligonucleotide
ttcaaactcaagtggatttgctaaatacttttgagatgaaatacaggg

SEQ ID NO: 255732 - DNA, 47 bp, Artificial Sequence
  Description of Artificial Sequence: Synthetic oligonucleotide
tcaaactcaagtggatttgctaaatacttttgagatgaaatacaggg

SEQ ID NO: 255733 - DNA, 46 bp, Artificial Sequence
  Description of Artificial Sequence: Synthetic oligonucleotide
caaactcaagtggatttgctaaatacttttgagatgaaatacaggg

SEQ ID NO: 255734 - DNA, 48 bp, Artificial Sequence
  Description of Artificial Sequence: Synthetic oligonucleotide
aaactcaagtggatttgctaaatacttttgagatgaaatacagggatc

SEQ ID NO: 255735 - DNA, 47 bp, Artificial Sequence
  Description of Artificial Sequence: Synthetic oligonucleotide
aactcaagtggatttgctaaatacttttgagatgaaatacagggatc

SEQ ID NO: 255736 - DNA, 46 bp, Artificial Sequence
  Description of Artificial Sequence: Synthetic oligonucleotide
actcaagtggatttgctaaatacttttgagatgaaatacagggatc

SEQ ID NO: 255737 - DNA, 45 bp, Artificial Sequence
  Description of Artificial Sequence: Synthetic oligonucleotide
ctcaagtggatttgctaaatacttttgagatgaaatacagggatc

SEQ ID NO: 255738 - DNA, 45 bp, Artificial Sequence
  Description of Artificial Sequence: Synthetic oligonucleotide
tcaagtggatttgctaaatacttttgagatgaaatacagggatcc

SEQ ID NO: 255739 - DNA, 44 bp, Artificial Sequence
  Description of Artificial Sequence: Synthetic oligonucleotide
caagtggatttgctaaatacttttgagatgaaatacagggatcc

SEQ ID NO: 255740 - DNA, 45 bp, Artificial Sequence
  Description of Artificial Sequence: Synthetic oligonucleotide
aagtggatttgctaaatacttttgagatgaaatacagggatcctg

SEQ ID NO: 255741 - DNA, 44 bp, Artificial Sequence
  Description of Artificial Sequence: Synthetic oligonucleotide
agtggatttgctaaatacttttgagatgaaatacagggatcctg

SEQ ID NO: 255742 - DNA, 43 bp, Artificial Sequence
  Description of Artificial Sequence: Synthetic oligonucleotide
gtggatttgctaaatacttttgagatgaaatacagggatcctg

SEQ ID NO: 255743 - DNA, 43 bp, Artificial Sequence
  Description of Artificial Sequence: Synthetic oligonucleotide
tggatttgctaaatacttttgagatgaaatacagggatcctgg

SEQ ID NO: 255744 - DNA, 42 bp, Artificial Sequence
  Description of Artificial Sequence: Synthetic oligonucleotide
ggatttgctaaatacttttgagatgaaatacagggatcctgg

SEQ ID NO: 255745 - DNA, 42 bp, Artificial Sequence
  Description of Artificial Sequence: Synthetic oligonucleotide
gatttgctaaatacttttgagatgaaatacagggatcctggc

SEQ ID NO: 255746 - DNA, 42 bp, Artificial Sequence
  Description of Artificial Sequence: Synthetic oligonucleotide
atttgctaaatacttttgagatgaaatacagggatcctggcg

SEQ ID NO: 255747 - DNA, 41 bp, Artificial Sequence
  Description of Artificial Sequence: Synthetic oligonucleotide
tttgctaaatacttttgagatgaaatacagggatcctggcg

SEQ ID NO: 255748 - DNA, 40 bp, Artificial Sequence
  Description of Artificial Sequence: Synthetic oligonucleotide
ttgctaaatacttttgagatgaaatacagggatcctggcg

SEQ ID NO: 255749 - DNA, 39 bp, Artificial Sequence
  Description of Artificial Sequence: Synthetic oligonucleotide
tgctaaatacttttgagatgaaatacagggatcctggcg

SEQ ID NO: 255750 - DNA, 38 bp, Artificial Sequence
  Description of Artificial Sequence: Synthetic oligonucleotide
gctaaatacttttgagatgaaatacagggatcctggcg

SEQ ID NO: 255751 - DNA, 38 bp, Artificial Sequence
  Description of Artificial Sequence: Synthetic oligonucleotide
ctaaatacttttgagatgaaatacagggatcctggcgc

SEQ ID NO: 255752 - DNA, 39 bp, Artificial Sequence
  Description of Artificial Sequence: Synthetic oligonucleotide
taaatacttttgagatgaaatacagggatcctggcgctg

SEQ ID NO: 255753 - DNA, 38 bp, Artificial Sequence
  Description of Artificial Sequence: Synthetic oligonucleotide
aaatacttttgagatgaaatacagggatcctggcgctg

SEQ ID NO: 255754 - DNA, 37 bp, Artificial Sequence
  Description of Artificial Sequence: Synthetic oligonucleotide
aatacttttgagatgaaatacagggatcctggcgctg

SEQ ID NO: 255755 - DNA, 36 bp, Artificial Sequence
  Description of Artificial Sequence: Synthetic oligonucleotide
atacttttgagatgaaatacagggatcctggcgctg

SEQ ID NO: 255756 - DNA, 35 bp, Artificial Sequence
  Description of Artificial Sequence: Synthetic oligonucleotide
tacttttgagatgaaatacagggatcctggcgctg

SEQ ID NO: 255757 - DNA, 34 bp, Artificial Sequence
  Description of Artificial Sequence: Synthetic oligonucleotide
acttttgagatgaaatacagggatcctggcgctg

SEQ ID NO: 255758 - DNA, 33 bp, Artificial Sequence
  Description of Artificial Sequence: Synthetic oligonucleotide
cttttgagatgaaatacagggatcctggcgctg

SEQ ID NO: 255759 - DNA, 38 bp, Artificial Sequence
  Description of Artificial Sequence: Synthetic oligonucleotide
ttttgagatgaaatacagggatcctggcgctgtatatg

SEQ ID NO: 255760 - DNA, 37 bp, Artificial Sequence
  Description of Artificial Sequence: Synthetic oligonucleotide
tttgagatgaaatacagggatcctggcgctgtatatg

SEQ ID NO: 255761 - DNA, 36 bp, Artificial Sequence
  Description of Artificial Sequence: Synthetic oligonucleotide
ttgagatgaaatacagggatcctggcgctgtatatg

SEQ ID NO: 255762 - DNA, 35 bp, Artificial Sequence
  Description of Artificial Sequence: Synthetic oligonucleotide
tgagatgaaatacagggatcctggcgctgtatatg

SEQ ID NO: 255763 - DNA, 34 bp, Artificial Sequence
  Description of Artificial Sequence: Synthetic oligonucleotide
gagatgaaatacagggatcctggcgctgtatatg

SEQ ID NO: 255764 - DNA, 35 bp, Artificial Sequence
  Description of Artificial Sequence: Synthetic oligonucleotide
agatgaaatacagggatcctggcgctgtatatgtc

SEQ ID NO: 255765 - DNA, 34 bp, Artificial Sequence
  Description of Artificial Sequence: Synthetic oligonucleotide
gatgaaatacagggatcctggcgctgtatatgtc

SEQ ID NO: 255766 - DNA, 35 bp, Artificial Sequence
  Description of Artificial Sequence: Synthetic oligonucleotide
atgaaatacagggatcctggcgctgtatatgtctg

SEQ ID NO: 255767 - DNA, 34 bp, Artificial Sequence
  Description of Artificial Sequence: Synthetic oligonucleotide
tgaaatacagggatcctggcgctgtatatgtctg

SEQ ID NO: 255768 - DNA, 33 bp, Artificial Sequence
  Description of Artificial Sequence: Synthetic oligonucleotide
gaaatacagggatcctggcgctgtatatgtctg

SEQ ID NO: 255769 - DNA, 33 bp, Artificial Sequence
  Description of Artificial Sequence: Synthetic oligonucleotide
aaatacagggatcctggcgctgtatatgtctgc

SEQ ID NO: 255770 - DNA, 32 bp, Artificial Sequence
  Description of Artificial Sequence: Synthetic oligonucleotide
aatacagggatcctggcgctgtatatgtctgc

SEQ ID NO: 255771 - DNA, 31 bp, Artificial Sequence
  Description of Artificial Sequence: Synthetic oligonucleotide
atacagggatcctggcgctgtatatgtctgc

SEQ ID NO: 255772 - DNA, 30 bp, Artificial Sequence
  Description of Artificial Sequence: Synthetic oligonucleotide
tacagggatcctggcgctgtatatgtctgc

SEQ ID NO: 255773 - DNA, 29 bp, Artificial Sequence
  Description of Artificial Sequence: Synthetic oligonucleotide
acagggatcctggcgctgtatatgtctgc

SEQ ID NO: 255774 - DNA, 28 bp, Artificial Sequence
  Description of Artificial Sequence: Synthetic oligonucleotide
cagggatcctggcgctgtatatgtctgc

SEQ ID NO: 255775 - DNA, 30 bp, Artificial Sequence
  Description of Artificial Sequence: Synthetic oligonucleotide
agggatcctggcgctgtatatgtctgcttg

SEQ ID NO: 255776 - DNA, 29 bp, Artificial Sequence
  Description of Artificial Sequence: Synthetic oligonucleotide
gggatcctggcgctgtatatgtctgcttg

SEQ ID NO: 255777 - DNA, 29 bp, Artificial Sequence
  Description of Artificial Sequence: Synthetic oligonucleotide
ggatcctggcgctgtatatgtctgcttgg

SEQ ID NO: 255778 - DNA, 32 bp, Artificial Sequence
  Description of Artificial Sequence: Synthetic oligonucleotide
gatcctggcgctgtatatgtctgcttggtttg

SEQ ID NO: 255779 - DNA, 32 bp, Artificial Sequence
  Description of Artificial Sequence: Synthetic oligonucleotide
atcctggcgctgtatatgtctgcttggtttgg

SEQ ID NO: 255780 - DNA, 31 bp, Artificial Sequence
  Description of Artificial Sequence: Synthetic oligonucleotide
tcctggcgctgtatatgtctgcttggtttgg

SEQ ID NO: 255781 - DNA, 30 bp, Artificial Sequence
  Description of Artificial Sequence: Synthetic oligonucleotide
cctggcgctgtatatgtctgcttggtttgg

SEQ ID NO: 255782 - DNA, 30 bp, Artificial Sequence
  Description of Artificial Sequence: Synthetic oligonucleotide
ctggcgctgtatatgtctgcttggtttggc

SEQ ID NO: 255783 - DNA, 32 bp, Artificial Sequence
  Description of Artificial Sequence: Synthetic oligonucleotide
tggcgctgtatatgtctgcttggtttggcatg

SEQ ID NO: 255784 - DNA, 31 bp, Artificial Sequence
  Description of Artificial Sequence: Synthetic oligonucleotide
ggcgctgtatatgtctgcttggtttggcatg

SEQ ID NO: 255785 - DNA, 33 bp, Artificial Sequence
  Description of Artificial Sequence: Synthetic oligonucleotide
gcgctgtatatgtctgcttggtttggcatgatc

SEQ ID NO: 255786 - DNA, 33 bp, Artificial Sequence
  Description of Artificial Sequence: Synthetic oligonucleotide
cgctgtatatgtctgcttggtttggcatgatcg

SEQ ID NO: 255787 - DNA, 33 bp, Artificial Sequence
  Description of Artificial Sequence: Synthetic oligonucleotide
gctgtatatgtctgcttggtttggcatgatcgc

SEQ ID NO: 255788 - DNA, 33 bp, Artificial Sequence
  Description of Artificial Sequence: Synthetic oligonucleotide
ctgtatatgtctgcttggtttggcatgatcgcg

SEQ ID NO: 255789 - DNA, 35 bp, Artificial Sequence
  Description of Artificial Sequence: Synthetic oligonucleotide
tgtatatgtctgcttggtttggcatgatcgcgaag

SEQ ID NO: 255790 - DNA, 34 bp, Artificial Sequence
  Description of Artificial Sequence: Synthetic oligonucleotide
gtatatgtctgcttggtttggcatgatcgcgaag

SEQ ID NO: 255791 - DNA, 35 bp, Artificial Sequence
  Description of Artificial Sequence: Synthetic oligonucleotide
tatatgtctgcttggtttggcatgatcgcgaagtc

SEQ ID NO: 255792 - DNA, 34 bp, Artificial Sequence
  Description of Artificial Sequence: Synthetic oligonucleotide
atatgtctgcttggtttggcatgatcgcgaagtc

SEQ ID NO: 255793 - DNA, 33 bp, Artificial Sequence
  Description of Artificial Sequence: Synthetic oligonucleotide
tatgtctgcttggtttggcatgatcgcgaagtc

SEQ ID NO: 255794 - DNA, 32 bp, Artificial Sequence
  Description of Artificial Sequence: Synthetic oligonucleotide
atgtctgcttggtttggcatgatcgcgaagtc

SEQ ID NO: 255795 - DNA, 31 bp, Artificial Sequence
  Description of Artificial Sequence: Synthetic oligonucleotide
tgtctgcttggtttggcatgatcgcgaagtc

SEQ ID NO: 255796 - DNA, 30 bp, Artificial Sequence
  Description of Artificial Sequence: Synthetic oligonucleotide
gtctgcttggtttggcatgatcgcgaagtc

SEQ ID NO: 255797 - DNA, 31 bp, Artificial Sequence
  Description of Artificial Sequence: Synthetic oligonucleotide
tctgcttggtttggcatgatcgcgaagtctc

SEQ ID NO: 255798 - DNA, 30 bp, Artificial Sequence
  Description of Artificial Sequence: Synthetic oligonucleotide
ctgcttggtttggcatgatcgcgaagtctc

SEQ ID NO: 255799 - DNA, 30 bp, Artificial Sequence
  Description of Artificial Sequence: Synthetic oligonucleotide
tgcttggtttggcatgatcgcgaagtctcg

SEQ ID NO: 255800 - DNA, 29 bp, Artificial Sequence
  Description of Artificial Sequence: Synthetic oligonucleotide
gcttggtttggcatgatcgcgaagtctcg

SEQ ID NO: 255801 - DNA, 30 bp, Artificial Sequence
  Description of Artificial Sequence: Synthetic oligonucleotide
cttggtttggcatgatcgcgaagtctcgag

SEQ ID NO: 255802 - DNA, 31 bp, Artificial Sequence
  Description of Artificial Sequence: Synthetic oligonucleotide
ttggtttggcatgatcgcgaagtctcgagag

SEQ ID NO: 255803 - DNA, 30 bp, Artificial Sequence
  Description of Artificial Sequence: Synthetic oligonucleotide
tggtttggcatgatcgcgaagtctcgagag

SEQ ID NO: 255804 - DNA, 29 bp, Artificial Sequence
  Description of Artificial Sequence: Synthetic oligonucleotide
ggtttggcatgatcgcgaagtctcgagag

SEQ ID NO: 255805 - DNA, 29 bp, Artificial Sequence
  Description of Artificial Sequence: Synthetic oligonucleotide
gtttggcatgatcgcgaagtctcgagagc

SEQ ID NO: 255806 - DNA, 29 bp, Artificial Sequence
  Description of Artificial Sequence: Synthetic oligonucleotide
tttggcatgatcgcgaagtctcgagagcc

SEQ ID NO: 255807 - DNA, 28 bp, Artificial Sequence
  Description of Artificial Sequence: Synthetic oligonucleotide
ttggcatgatcgcgaagtctcgagagcc

SEQ ID NO: 255808 - DNA, 27 bp, Artificial Sequence
  Description of Artificial Sequence: Synthetic oligonucleotide
tggcatgatcgcgaagtctcgagagcc

SEQ ID NO: 255809 - DNA, 27 bp, Artificial Sequence
  Description of Artificial Sequence: Synthetic oligonucleotide
ggcatgatcgcgaagtctcgagagcct

SEQ ID NO: 255810 - DNA, 27 bp, Artificial Sequence
  Description of Artificial Sequence: Synthetic oligonucleotide
gcatgatcgcgaagtctcgagagcctg

SEQ ID NO: 255811 - DNA, 27 bp, Artificial Sequence
  Description of Artificial Sequence: Synthetic oligonucleotide
catgatcgcgaagtctcgagagcctgg

SEQ ID NO: 255812 - DNA, 30 bp, Artificial Sequence
  Description of Artificial Sequence: Synthetic oligonucleotide
atgatcgcgaagtctcgagagcctggattg

SEQ ID NO: 255813 - DNA, 29 bp, Artificial Sequence
  Description of Artificial Sequence: Synthetic oligonucleotide
tgatcgcgaagtctcgagagcctggattg

SEQ ID NO: 255814 - DNA, 28 bp, Artificial Sequence
  Description of Artificial Sequence: Synthetic oligonucleotide
gatcgcgaagtctcgagagcctggattg

SEQ ID NO: 255815 - DNA, 31 bp, Artificial Sequence
  Description of Artificial Sequence: Synthetic oligonucleotide
atcgcgaagtctcgagagcctggattgattc

SEQ ID NO: 255816 - DNA, 30 bp, Artificial Sequence
  Description of Artificial Sequence: Synthetic oligonucleotide
tcgcgaagtctcgagagcctggattgattc

SEQ ID NO: 255817 - DNA, 29 bp, Artificial Sequence
  Description of Artificial Sequence: Synthetic oligonucleotide
cgcgaagtctcgagagcctggattgattc

SEQ ID NO: 255818 - DNA, 33 bp, Artificial Sequence
  Description of Artificial Sequence: Synthetic oligonucleotide
gcgaagtctcgagagcctggattgattcttatg

SEQ ID NO: 255819 - DNA, 35 bp, Artificial Sequence
  Description of Artificial Sequence: Synthetic oligonucleotide
cgaagtctcgagagcctggattgattcttatgaag

SEQ ID NO: 255820 - DNA, 37 bp, Artificial Sequence
  Description of Artificial Sequence: Synthetic oligonucleotide
gaagtctcgagagcctggattgattcttatgaagatg

SEQ ID NO: 255821 - DNA, 37 bp, Artificial Sequence
  Description of Artificial Sequence: Synthetic oligonucleotide
aagtctcgagagcctggattgattcttatgaagatgc

SEQ ID NO: 255822 - DNA, 36 bp, Artificial Sequence
  Description of Artificial Sequence: Synthetic oligonucleotide
agtctcgagagcctggattgattcttatgaagatgc

SEQ ID NO: 255823 - DNA, 35 bp, Artificial Sequence
  Description of Artificial Sequence: Synthetic oligonucleotide
gtctcgagagcctggattgattcttatgaagatgc

SEQ ID NO: 255824 - DNA, 35 bp, Artificial Sequence
  Description of Artificial Sequence: Synthetic oligonucleotide
tctcgagagcctggattgattcttatgaagatgcg

SEQ ID NO: 255825 - DNA, 34 bp, Artificial Sequence
  Description of Artificial Sequence: Synthetic oligonucleotide
ctcgagagcctggattgattcttatgaagatgcg

SEQ ID NO: 255826 - DNA, 34 bp, Artificial Sequence
  Description of Artificial Sequence: Synthetic oligonucleotide
tcgagagcctggattgattcttatgaagatgcgg

SEQ ID NO: 255827 - DNA, 33 bp, Artificial Sequence
  Description of Artificial Sequence: Synthetic oligonucleotide
cgagagcctggattgattcttatgaagatgcgg

SEQ ID NO: 255828 - DNA, 34 bp, Artificial Sequence
  Description of Artificial Sequence: Synthetic oligonucleotide
gagagcctggattgattcttatgaagatgcggac

SEQ ID NO: 255829 - DNA, 36 bp, Artificial Sequence
  Description of Artificial Sequence: Synthetic oligonucleotide
agagcctggattgattcttatgaagatgcggacttg

SEQ ID NO: 255830 - DNA, 35 bp, Artificial Sequence
  Description of Artificial Sequence: Synthetic oligonucleotide
gagcctggattgattcttatgaagatgcggacttg

SEQ ID NO: 255831 - DNA, 36 bp, Artificial Sequence
  Description of Artificial Sequence: Synthetic oligonucleotide
agcctggattgattcttatgaagatgcggacttgag

SEQ ID NO: 255832 - DNA, 35 bp, Artificial Sequence
  Description of Artificial Sequence: Synthetic oligonucleotide
gcctggattgattcttatgaagatgcggacttgag

SEQ ID NO: 255833 - DNA, 40 bp, Artificial Sequence
  Description of Artificial Sequence: Synthetic oligonucleotide
cctggattgattcttatgaagatgcggacttgagaaaatc

SEQ ID NO: 255834 - DNA, 42 bp, Artificial Sequence
  Description of Artificial Sequence: Synthetic oligonucleotide
ctggattgattcttatgaagatgcggacttgagaaaatctac

SEQ ID NO: 255835 - DNA, 42 bp, Artificial Sequence
  Description of Artificial Sequence: Synthetic oligonucleotide
tggattgattcttatgaagatgcggacttgagaaaatctacc

SEQ ID NO: 255836 - DNA, 41 bp, Artificial Sequence
  Description of Artificial Sequence: Synthetic oligonucleotide
ggattgattcttatgaagatgcggacttgagaaaatctacc

SEQ ID NO: 255837 - DNA, 41 bp, Artificial Sequence
  Description of Artificial Sequence: Synthetic oligonucleotide
gattgattcttatgaagatgcggacttgagaaaatctaccc

SEQ ID NO: 255838 - DNA, 42 bp, Artificial Sequence
  Description of Artificial Sequence: Synthetic oligonucleotide
attgattcttatgaagatgcggacttgagaaaatctaccctg

SEQ ID NO: 255839 - DNA, 41 bp, Artificial Sequence
  Description of Artificial Sequence: Synthetic oligonucleotide
ttgattcttatgaagatgcggacttgagaaaatctaccctg

SEQ ID NO: 255840 - DNA, 40 bp, Artificial Sequence
  Description of Artificial Sequence: Synthetic oligonucleotide
tgattcttatgaagatgcggacttgagaaaatctaccctg

SEQ ID NO: 255841 - DNA, 39 bp, Artificial Sequence
  Description of Artificial Sequence: Synthetic oligonucleotide
gattcttatgaagatgcggacttgagaaaatctaccctg

SEQ ID NO: 255842 - DNA, 41 bp, Artificial Sequence
  Description of Artificial Sequence: Synthetic oligonucleotide
attcttatgaagatgcggacttgagaaaatctaccctgttg

SEQ ID NO: 255843 - DNA, 40 bp, Artificial Sequence
  Description of Artificial Sequence: Synthetic oligonucleotide
ttcttatgaagatgcggacttgagaaaatctaccctgttg

SEQ ID NO: 255844 - DNA, 39 bp, Artificial Sequence
  Description of Artificial Sequence: Synthetic oligonucleotide
tcttatgaagatgcggacttgagaaaatctaccctgttg

SEQ ID NO: 255845 - DNA, 38 bp, Artificial Sequence
  Description of Artificial Sequence: Synthetic oligonucleotide
cttatgaagatgcggacttgagaaaatctaccctgttg

SEQ ID NO: 255846 - DNA, 39 bp, Artificial Sequence
  Description of Artificial Sequence: Synthetic oligonucleotide
ttatgaagatgcggacttgagaaaatctaccctgttgag

SEQ ID NO: 255847 - DNA, 38 bp, Artificial Sequence
  Description of Artificial Sequence: Synthetic oligonucleotide
tatgaagatgcggacttgagaaaatctaccctgttgag

SEQ ID NO: 255848 - DNA, 37 bp, Artificial Sequence
  Description of Artificial Sequence: Synthetic oligonucleotide
atgaagatgcggacttgagaaaatctaccctgttgag

SEQ ID NO: 255849 - DNA, 36 bp, Artificial Sequence
  Description of Artificial Sequence: Synthetic oligonucleotide
tgaagatgcggacttgagaaaatctaccctgttgag

SEQ ID NO: 255850 - DNA, 35 bp, Artificial Sequence
  Description of Artificial Sequence: Synthetic oligonucleotide
gaagatgcggacttgagaaaatctaccctgttgag

SEQ ID NO: 255851 - DNA, 38 bp, Artificial Sequence
  Description of Artificial Sequence: Synthetic oligonucleotide
aagatgcggacttgagaaaatctaccctgttgagaatc

SEQ ID NO: 255852 - DNA, 37 bp, Artificial Sequence
  Description of Artificial Sequence: Synthetic oligonucleotide
agatgcggacttgagaaaatctaccctgttgagaatc

SEQ ID NO: 255853 - DNA, 36 bp, Artificial Sequence
  Description of Artificial Sequence: Synthetic oligonucleotide
gatgcggacttgagaaaatctaccctgttgagaatc

SEQ ID NO: 255854 - DNA, 38 bp, Artificial Sequence
  Description of Artificial Sequence: Synthetic oligonucleotide
atgcggacttgagaaaatctaccctgttgagaatctac

SEQ ID NO: 255855 - DNA, 37 bp, Artificial Sequence
  Description of Artificial Sequence: Synthetic oligonucleotide
tgcggacttgagaaaatctaccctgttgagaatctac

SEQ ID NO: 255856 - DNA, 36 bp, Artificial Sequence
  Description of Artificial Sequence: Synthetic oligonucleotide
gcggacttgagaaaatctaccctgttgagaatctac

SEQ ID NO: 255857 - DNA, 39 bp, Artificial Sequence
  Description of Artificial Sequence: Synthetic oligonucleotide
cggacttgagaaaatctaccctgttgagaatctacaaag

SEQ ID NO: 255858 - DNA, 41 bp, Artificial Sequence
  Description of Artificial Sequence: Synthetic oligonucleotide
ggacttgagaaaatctaccctgttgagaatctacaaagatg

SEQ ID NO: 255859 - DNA, 41 bp, Artificial Sequence
  Description of Artificial Sequence: Synthetic oligonucleotide
gacttgagaaaatctaccctgttgagaatctacaaagatgc

SEQ ID NO: 255860 - DNA, 41 bp, Artificial Sequence
  Description of Artificial Sequence: Synthetic oligonucleotide
acttgagaaaatctaccctgttgagaatctacaaagatgcc

SEQ ID NO: 255861 - DNA, 40 bp, Artificial Sequence
  Description of Artificial Sequence: Synthetic oligonucleotide
cttgagaaaatctaccctgttgagaatctacaaagatgcc

SEQ ID NO: 255862 - DNA, 40 bp, Artificial Sequence
  Description of Artificial Sequence: Synthetic oligonucleotide
ttgagaaaatctaccctgttgagaatctacaaagatgccc

SEQ ID NO: 255863 - DNA, 39 bp, Artificial Sequence
  Description of Artificial Sequence: Synthetic oligonucleotide
tgagaaaatctaccctgttgagaatctacaaagatgccc

SEQ ID NO: 255864 - DNA, 38 bp, Artificial Sequence
  Description of Artificial Sequence: Synthetic oligonucleotide
gagaaaatctaccctgttgagaatctacaaagatgccc

SEQ ID NO: 255865 - DNA, 40 bp, Artificial Sequence
  Description of Artificial Sequence: Synthetic oligonucleotide
agaaaatctaccctgttgagaatctacaaagatgcccaag

SEQ ID NO: 255866 - DNA, 39 bp, Artificial Sequence
  Description of Artificial Sequence: Synthetic oligonucleotide
gaaaatctaccctgttgagaatctacaaagatgcccaag

SEQ ID NO: 255867 - DNA, 44 bp, Artificial Sequence
  Description of Artificial Sequence: Synthetic oligonucleotide
aaaatctaccctgttgagaatctacaaagatgcccaagaaaatg

SEQ ID NO: 255868 - DNA, 43 bp, Artificial Sequence
  Description of Artificial Sequence: Synthetic oligonucleotide
aaatctaccctgttgagaatctacaaagatgcccaagaaaatg

SEQ ID NO: 255869 - DNA, 42 bp, Artificial Sequence
  Description of Artificial Sequence: Synthetic oligonucleotide
aatctaccctgttgagaatctacaaagatgcccaagaaaatg

SEQ ID NO: 255870 - DNA, 41 bp, Artificial Sequence
  Description of Artificial Sequence: Synthetic oligonucleotide
atctaccctgttgagaatctacaaagatgcccaagaaaatg

SEQ ID NO: 255871 - DNA, 40 bp, Artificial Sequence
  Description of Artificial Sequence: Synthetic oligonucleotide
tctaccctgttgagaatctacaaagatgcccaagaaaatg

SEQ ID NO: 255872 - DNA, 39 bp, Artificial Sequence
  Description of Artificial Sequence: Synthetic oligonucleotide
ctaccctgttgagaatctacaaagatgcccaagaaaatg

SEQ ID NO: 255873 - DNA, 39 bp, Artificial Sequence
  Description of Artificial Sequence: Synthetic oligonucleotide
taccctgttgagaatctacaaagatgcccaagaaaatgg

SEQ ID NO: 255874 - DNA, 38 bp, Artificial Sequence
  Description of Artificial Sequence: Synthetic oligonucleotide
accctgttgagaatctacaaagatgcccaagaaaatgg

SEQ ID NO: 255875 - DNA, 37 bp, Artificial Sequence
  Description of Artificial Sequence: Synthetic oligonucleotide
ccctgttgagaatctacaaagatgcccaagaaaatgg

SEQ ID NO: 255876 - DNA, 37 bp, Artificial Sequence
  Description of Artificial Sequence: Synthetic oligonucleotide
cctgttgagaatctacaaagatgcccaagaaaatggc

SEQ ID NO: 255877 - DNA, 38 bp, Artificial Sequence
  Description of Artificial Sequence: Synthetic oligonucleotide
ctgttgagaatctacaaagatgcccaagaaaatggctc

SEQ ID NO: 255878 - DNA, 42 bp, Artificial Sequence
  Description of Artificial Sequence: Synthetic oligonucleotide
tgttgagaatctacaaagatgcccaagaaaatggctcttatg

SEQ ID NO: 255879 - DNA, 41 bp, Artificial Sequence
  Description of Artificial Sequence: Synthetic oligonucleotide
gttgagaatctacaaagatgcccaagaaaatggctcttatg

SEQ ID NO: 255880 - DNA, 41 bp, Artificial Sequence
  Description of Artificial Sequence: Synthetic oligonucleotide
ttgagaatctacaaagatgcccaagaaaatggctcttatgg

SEQ ID NO: 255881 - DNA, 40 bp, Artificial Sequence
  Description of Artificial Sequence: Synthetic oligonucleotide
tgagaatctacaaagatgcccaagaaaatggctcttatgg

SEQ ID NO: 255882 - DNA, 39 bp, Artificial Sequence
  Description of Artificial Sequence: Synthetic oligonucleotide
gagaatctacaaagatgcccaagaaaatggctcttatgg

SEQ ID NO: 255883 - DNA, 39 bp, Artificial Sequence
  Description of Artificial Sequence: Synthetic oligonucleotide
agaatctacaaagatgcccaagaaaatggctcttatggc

SEQ ID NO: 255884 - DNA, 38 bp, Artificial Sequence
  Description of Artificial Sequence: Synthetic oligonucleotide
gaatctacaaagatgcccaagaaaatggctcttatggc

SEQ ID NO: 255885 - DNA, 39 bp, Artificial Sequence
  Description of Artificial Sequence: Synthetic oligonucleotide
aatctacaaagatgcccaagaaaatggctcttatggcac

SEQ ID NO: 255886 - DNA, 38 bp, Artificial Sequence
  Description of Artificial Sequence: Synthetic oligonucleotide
atctacaaagatgcccaagaaaatggctcttatggcac

SEQ ID NO: 255887 - DNA, 37 bp, Artificial Sequence
  Description of Artificial Sequence: Synthetic oligonucleotide
tctacaaagatgcccaagaaaatggctcttatggcac

SEQ ID NO: 255888 - DNA, 36 bp, Artificial Sequence
  Description of Artificial Sequence: Synthetic oligonucleotide
ctacaaagatgcccaagaaaatggctcttatggcac

SEQ ID NO: 255889 - DNA, 37 bp, Artificial Sequence
  Description of Artificial Sequence: Synthetic oligonucleotide
tacaaagatgcccaagaaaatggctcttatggcacag

SEQ ID NO: 255890 - DNA, 36 bp, Artificial Sequence
  Description of Artificial Sequence: Synthetic oligonucleotide
acaaagatgcccaagaaaatggctcttatggcacag

SEQ ID NO: 255891 - DNA, 35 bp, Artificial Sequence
  Description of Artificial Sequence: Synthetic oligonucleotide
caaagatgcccaagaaaatggctcttatggcacag

SEQ ID NO: 255892 - DNA, 35 bp, Artificial Sequence
  Description of Artificial Sequence: Synthetic oligonucleotide
aaagatgcccaagaaaatggctcttatggcacagc

SEQ ID NO: 255893 - DNA, 34 bp, Artificial Sequence
  Description of Artificial Sequence: Synthetic oligonucleotide
aagatgcccaagaaaatggctcttatggcacagc

SEQ ID NO: 255894 - DNA, 33 bp, Artificial Sequence
  Description of Artificial Sequence: Synthetic oligonucleotide
agatgcccaagaaaatggctcttatggcacagc

SEQ ID NO: 255895 - DNA, 32 bp, Artificial Sequence
  Description of Artificial Sequence: Synthetic oligonucleotide
gatgcccaagaaaatggctcttatggcacagc

SEQ ID NO: 255896 - DNA, 33 bp, Artificial Sequence
  Description of Artificial Sequence: Synthetic oligonucleotide
atgcccaagaaaatggctcttatggcacagcag

SEQ ID NO: 255897 - DNA, 32 bp, Artificial Sequence
  Description of Artificial Sequence: Synthetic oligonucleotide
tgcccaagaaaatggctcttatggcacagcag

SEQ ID NO: 255898 - DNA, 31 bp, Artificial Sequence
  Description of Artificial Sequence: Synthetic oligonucleotide
gcccaagaaaatggctcttatggcacagcag

SEQ ID NO: 255899 - DNA, 32 bp, Artificial Sequence
  Description of Artificial Sequence: Synthetic oligonucleotide
cccaagaaaatggctcttatggcacagcagag

SEQ ID NO: 255900 - DNA, 34 bp, Artificial Sequence
  Description of Artificial Sequence: Synthetic oligonucleotide
ccaagaaaatggctcttatggcacagcagagatg

SEQ ID NO: 255901 - DNA, 36 bp, Artificial Sequence
  Description of Artificial Sequence: Synthetic oligonucleotide
caagaaaatggctcttatggcacagcagagatgttg

SEQ ID NO: 255902 - DNA, 41 bp, Artificial Sequence
  Description of Artificial Sequence: Synthetic oligonucleotide
aagaaaatggctcttatggcacagcagagatgttgtattac

SEQ ID NO: 255903 - DNA, 40 bp, Artificial Sequence
  Description of Artificial Sequence: Synthetic oligonucleotide
agaaaatggctcttatggcacagcagagatgttgtattac

SEQ ID NO: 255904 - DNA, 39 bp, Artificial Sequence
  Description of Artificial Sequence: Synthetic oligonucleotide
gaaaatggctcttatggcacagcagagatgttgtattac

SEQ ID NO: 255905 - DNA, 40 bp, Artificial Sequence
  Description of Artificial Sequence: Synthetic oligonucleotide
aaaatggctcttatggcacagcagagatgttgtattactc

SEQ ID NO: 255906 - DNA, 39 bp, Artificial Sequence
  Description of Artificial Sequence: Synthetic oligonucleotide
aaatggctcttatggcacagcagagatgttgtattactc

SEQ ID NO: 255907 - DNA, 38 bp, Artificial Sequence
  Description of Artificial Sequence: Synthetic oligonucleotide
aatggctcttatggcacagcagagatgttgtattactc

SEQ ID NO: 255908 - DNA, 37 bp, Artificial Sequence
  Description of Artificial Sequence: Synthetic oligonucleotide
atggctcttatggcacagcagagatgttgtattactc

SEQ ID NO: 255909 - DNA, 36 bp, Artificial Sequence
  Description of Artificial Sequence: Synthetic oligonucleotide
tggctcttatggcacagcagagatgttgtattactc

SEQ ID NO: 255910 - DNA, 35 bp, Artificial Sequence
  Description of Artificial Sequence: Synthetic oligonucleotide
ggctcttatggcacagcagagatgttgtattactc

SEQ ID NO: 255911 - DNA, 35 bp, Artificial Sequence
  Description of Artificial Sequence: Synthetic oligonucleotide
gctcttatggcacagcagagatgttgtattactcc

SEQ ID NO: 255912 - DNA, 35 bp, Artificial Sequence
  Description of Artificial Sequence: Synthetic oligonucleotide
ctcttatggcacagcagagatgttgtattactccg

SEQ ID NO: 255913 - DNA, 45 bp, Artificial Sequence
  Description of Artificial Sequence: Synthetic oligonucleotide
tcttatggcacagcagagatgttgtattactccgataatatatag

SEQ ID NO: 255914 - DNA, 44 bp, Artificial Sequence
  Description of Artificial Sequence: Synthetic oligonucleotide
cttatggcacagcagagatgttgtattactccgataatatatag

SEQ ID NO: 255915 - DNA, 44 bp, Artificial Sequence
  Description of Artificial Sequence: Synthetic oligonucleotide
ttatggcacagcagagatgttgtattactccgataatatatagg

SEQ ID NO: 255916 - DNA, 43 bp, Artificial Sequence
  Description of Artificial Sequence: Synthetic oligonucleotide
tatggcacagcagagatgttgtattactccgataatatatagg

SEQ ID NO: 255917 - DNA, 42 bp, Artificial Sequence
  Description of Artificial Sequence: Synthetic oligonucleotide
atggcacagcagagatgttgtattactccgataatatatagg

SEQ ID NO: 255918 - DNA, 41 bp, Artificial Sequence
  Description of Artificial Sequence: Synthetic oligonucleotide
tggcacagcagagatgttgtattactccgataatatatagg

SEQ ID NO: 255919 - DNA, 40 bp, Artificial Sequence
  Description of Artificial Sequence: Synthetic oligonucleotide
ggcacagcagagatgttgtattactccgataatatatagg

SEQ ID NO: 255920 - DNA, 42 bp, Artificial Sequence
  Description of Artificial Sequence: Synthetic oligonucleotide
gcacagcagagatgttgtattactccgataatatataggatg

SEQ ID NO: 255921 - DNA, 44 bp, Artificial Sequence
  Description of Artificial Sequence: Synthetic oligonucleotide
cacagcagagatgttgtattactccgataatatataggatgatg

SEQ ID NO: 255922 - DNA, 44 bp, Artificial Sequence
  Description of Artificial Sequence: Synthetic oligonucleotide
acagcagagatgttgtattactccgataatatataggatgatgg

SEQ ID NO: 255923 - DNA, 43 bp, Artificial Sequence
  Description of Artificial Sequence: Synthetic oligonucleotide
cagcagagatgttgtattactccgataatatataggatgatgg

SEQ ID NO: 255924 - DNA, 46 bp, Artificial Sequence
  Description of Artificial Sequence: Synthetic oligonucleotide
agcagagatgttgtattactccgataatatataggatgatggatac

SEQ ID NO: 255925 - DNA, 45 bp, Artificial Sequence
  Description of Artificial Sequence: Synthetic oligonucleotide
gcagagatgttgtattactccgataatatataggatgatggatac

SEQ ID NO: 255926 - DNA, 45 bp, Artificial Sequence
  Description of Artificial Sequence: Synthetic oligonucleotide
cagagatgttgtattactccgataatatataggatgatggatacc

SEQ ID NO: 255927 - DNA, 46 bp, Artificial Sequence
  Description of Artificial Sequence: Synthetic oligonucleotide
agagatgttgtattactccgataatatataggatgatggatacctg

SEQ ID NO: 255928 - DNA, 45 bp, Artificial Sequence
  Description of Artificial Sequence: Synthetic oligonucleotide
gagatgttgtattactccgataatatataggatgatggatacctg

SEQ ID NO: 255929 - DNA, 45 bp, Artificial Sequence
  Description of Artificial Sequence: Synthetic oligonucleotide
agatgttgtattactccgataatatataggatgatggatacctgc

SEQ ID NO: 255930 - DNA, 44 bp, Artificial Sequence
  Description of Artificial Sequence: Synthetic oligonucleotide
gatgttgtattactccgataatatataggatgatggatacctgc

SEQ ID NO: 255931 - DNA, 45 bp, Artificial Sequence
  Description of Artificial Sequence: Synthetic oligonucleotide
atgttgtattactccgataatatataggatgatggatacctgctc

SEQ ID NO: 255932 - DNA, 44 bp, Artificial Sequence
  Description of Artificial Sequence: Synthetic oligonucleotide
tgttgtattactccgataatatataggatgatggatacctgctc

SEQ ID NO: 255933 - DNA, 43 bp, Artificial Sequence
  Description of Artificial Sequence: Synthetic oligonucleotide
gttgtattactccgataatatataggatgatggatacctgctc

SEQ ID NO: 255934 - DNA, 44 bp, Artificial Sequence
  Description of Artificial Sequence: Synthetic oligonucleotide
ttgtattactccgataatatataggatgatggatacctgctctg

SEQ ID NO: 255935 - DNA, 43 bp, Artificial Sequence
  Description of Artificial Sequence: Synthetic oligonucleotide
tgtattactccgataatatataggatgatggatacctgctctg

SEQ ID NO: 255936 - DNA, 42 bp, Artificial Sequence
  Description of Artificial Sequence: Synthetic oligonucleotide
gtattactccgataatatataggatgatggatacctgctctg

SEQ ID NO: 255937 - DNA, 42 bp, Artificial Sequence
  Description of Artificial Sequence: Synthetic oligonucleotide
tattactccgataatatataggatgatggatacctgctctgc

SEQ ID NO: 255938 - DNA, 41 bp, Artificial Sequence
  Description of Artificial Sequence: Synthetic oligonucleotide
attactccgataatatataggatgatggatacctgctctgc

SEQ ID NO: 255939 - DNA, 40 bp, Artificial Sequence
  Description of Artificial Sequence: Synthetic oligonucleotide
ttactccgataatatataggatgatggatacctgctctgc

SEQ ID NO: 255940 - DNA, 39 bp, Artificial Sequence
  Description of Artificial Sequence: Synthetic oligonucleotide
tactccgataatatataggatgatggatacctgctctgc

SEQ ID NO: 255941 - DNA, 38 bp, Artificial Sequence
  Description of Artificial Sequence: Synthetic oligonucleotide
actccgataatatataggatgatggatacctgctctgc

SEQ ID NO: 255942 - DNA, 37 bp, Artificial Sequence
  Description of Artificial Sequence: Synthetic oligonucleotide
ctccgataatatataggatgatggatacctgctctgc

SEQ ID NO: 255943 - DNA, 40 bp, Artificial Sequence
  Description of Artificial Sequence: Synthetic oligonucleotide
tccgataatatataggatgatggatacctgctctgcattg

SEQ ID NO: 255944 - DNA, 39 bp, Artificial Sequence
  Description of Artificial Sequence: Synthetic oligonucleotide
ccgataatatataggatgatggatacctgctctgcattg

SEQ ID NO: 255945 - DNA, 40 bp, Artificial Sequence
  Description of Artificial Sequence: Synthetic oligonucleotide
cgataatatataggatgatggatacctgctctgcattgtg

SEQ ID NO: 255946 - DNA, 41 bp, Artificial Sequence
  Description of Artificial Sequence: Synthetic oligonucleotide
gataatatataggatgatggatacctgctctgcattgtgac

SEQ ID NO: 255947 - DNA, 41 bp, Artificial Sequence
  Description of Artificial Sequence: Synthetic oligonucleotide
ataatatataggatgatggatacctgctctgcattgtgacg

SEQ ID NO: 255948 - DNA, 40 bp, Artificial Sequence
  Description of Artificial Sequence: Synthetic oligonucleotide
taatatataggatgatggatacctgctctgcattgtgacg

SEQ ID NO: 255949 - DNA, 39 bp, Artificial Sequence
  Description of Artificial Sequence: Synthetic oligonucleotide
aatatataggatgatggatacctgctctgcattgtgacg

SEQ ID NO: 255950 - DNA, 38 bp, Artificial Sequence
  Description of Artificial Sequence: Synthetic oligonucleotide
atatataggatgatggatacctgctctgcattgtgacg

SEQ ID NO: 255951 - DNA, 37 bp, Artificial Sequence
  Description of Artificial Sequence: Synthetic oligonucleotide
tatataggatgatggatacctgctctgcattgtgacg

SEQ ID NO: 255952 - DNA, 36 bp, Artificial Sequence
  Description of Artificial Sequence: Synthetic oligonucleotide
atataggatgatggatacctgctctgcattgtgacg

SEQ ID NO: 255953 - DNA, 35 bp, Artificial Sequence
  Description of Artificial Sequence: Synthetic oligonucleotide
tataggatgatggatacctgctctgcattgtgacg

SEQ ID NO: 255954 - DNA, 34 bp, Artificial Sequence
  Description of Artificial Sequence: Synthetic oligonucleotide
ataggatgatggatacctgctctgcattgtgacg

SEQ ID NO: 255955 - DNA, 33 bp, Artificial Sequence
  Description of Artificial Sequence: Synthetic oligonucleotide
taggatgatggatacctgctctgcattgtgacg

SEQ ID NO: 255956 - DNA, 32 bp, Artificial Sequence
  Description of Artificial Sequence: Synthetic oligonucleotide
aggatgatggatacctgctctgcattgtgacg

SEQ ID NO: 255957 - DNA, 31 bp, Artificial Sequence
  Description of Artificial Sequence: Synthetic oligonucleotide
ggatgatggatacctgctctgcattgtgacg

SEQ ID NO: 255958 - DNA, 32 bp, Artificial Sequence
  Description of Artificial Sequence: Synthetic oligonucleotide
gatgatggatacctgctctgcattgtgacgag

SEQ ID NO: 255959 - DNA, 33 bp, Artificial Sequence
  Description of Artificial Sequence: Synthetic oligonucleotide
atgatggatacctgctctgcattgtgacgagtg

SEQ ID NO: 255960 - DNA, 32 bp, Artificial Sequence
  Description of Artificial Sequence: Synthetic oligonucleotide
tgatggatacctgctctgcattgtgacgagtg

SEQ ID NO: 255961 - DNA, 31 bp, Artificial Sequence
  Description of Artificial Sequence: Synthetic oligonucleotide
gatggatacctgctctgcattgtgacgagtg

SEQ ID NO: 255962 - DNA, 31 bp, Artificial Sequence
  Description of Artificial Sequence: Synthetic oligonucleotide
atggatacctgctctgcattgtgacgagtgg

SEQ ID NO: 255963 - DNA, 30 bp, Artificial Sequence
  Description of Artificial Sequence: Synthetic oligonucleotide
tggatacctgctctgcattgtgacgagtgg

SEQ ID NO: 255964 - DNA, 29 bp, Artificial Sequence
  Description of Artificial Sequence: Synthetic oligonucleotide
ggatacctgctctgcattgtgacgagtgg

SEQ ID NO: 255965 - DNA, 30 bp, Artificial Sequence
  Description of Artificial Sequence: Synthetic oligonucleotide
gatacctgctctgcattgtgacgagtggag

SEQ ID NO: 255966 - DNA, 30 bp, Artificial Sequence
  Description of Artificial Sequence: Synthetic oligonucleotide
atacctgctctgcattgtgacgagtggagg

SEQ ID NO: 255967 - DNA, 29 bp, Artificial Sequence
  Description of Artificial Sequence: Synthetic oligonucleotide
tacctgctctgcattgtgacgagtggagg

SEQ ID NO: 255968 - DNA, 28 bp, Artificial Sequence
  Description of Artificial Sequence: Synthetic oligonucleotide
acctgctctgcattgtgacgagtggagg

SEQ ID NO: 255969 - DNA, 27 bp, Artificial Sequence
  Description of Artificial Sequence: Synthetic oligonucleotide
cctgctctgcattgtgacgagtggagg

SEQ ID NO: 255970 - DNA, 28 bp, Artificial Sequence
  Description of Artificial Sequence: Synthetic oligonucleotide
ctgctctgcattgtgacgagtggaggac

SEQ ID NO: 255971 - DNA, 28 bp, Artificial Sequence
  Description of Artificial Sequence: Synthetic oligonucleotide
tgctctgcattgtgacgagtggaggacc

SEQ ID NO: 255972 - DNA, 27 bp, Artificial Sequence
  Description of Artificial Sequence: Synthetic oligonucleotide
gctctgcattgtgacgagtggaggacc

SEQ ID NO: 255973 - DNA, 28 bp, Artificial Sequence
  Description of Artificial Sequence: Synthetic oligonucleotide
ctctgcattgtgacgagtggaggacctc

SEQ ID NO: 255974 - DNA, 30 bp, Artificial Sequence
  Description of Artificial Sequence: Synthetic oligonucleotide
tctgcattgtgacgagtggaggacctcatg

SEQ ID NO: 255975 - DNA, 29 bp, Artificial Sequence
  Description of Artificial Sequence: Synthetic oligonucleotide
ctgcattgtgacgagtggaggacctcatg

SEQ ID NO: 255976 - DNA, 29 bp, Artificial Sequence
  Description of Artificial Sequence: Synthetic oligonucleotide
tgcattgtgacgagtggaggacctcatgg

SEQ ID NO: 255977 - DNA, 28 bp, Artificial Sequence
  Description of Artificial Sequence: Synthetic oligonucleotide
gcattgtgacgagtggaggacctcatgg

SEQ ID NO: 255978 - DNA, 28 bp, Artificial Sequence
  Description of Artificial Sequence: Synthetic oligonucleotide
cattgtgacgagtggaggacctcatggg

SEQ ID NO: 255979 - DNA, 29 bp, Artificial Sequence
  Description of Artificial Sequence: Synthetic oligonucleotide
attgtgacgagtggaggacctcatgggag

SEQ ID NO: 255980 - DNA, 28 bp, Artificial Sequence
  Description of Artificial Sequence: Synthetic oligonucleotide
ttgtgacgagtggaggacctcatgggag

SEQ ID NO: 255981 - DNA, 27 bp, Artificial Sequence
  Description of Artificial Sequence: Synthetic oligonucleotide
tgtgacgagtggaggacctcatgggag

SEQ ID NO: 255982 - DNA, 27 bp, Artificial Sequence
  Description of Artificial Sequence: Synthetic oligonucleotide
gtgacgagtggaggacctcatgggaga

SEQ ID NO: 255983 - DNA, 27 bp, Artificial Sequence
  Description of Artificial Sequence: Synthetic oligonucleotide
tgacgagtggaggacctcatgggagac

SEQ ID NO: 255984 - DNA, 27 bp, Artificial Sequence
  Description of Artificial Sequence: Synthetic oligonucleotide
gacgagtggaggacctcatgggagaca

SEQ ID NO: 255985 - DNA, 28 bp, Artificial Sequence
  Description of Artificial Sequence: Synthetic oligonucleotide
acgagtggaggacctcatgggagacatg

SEQ ID NO: 255986 - DNA, 27 bp, Artificial Sequence
  Description of Artificial Sequence: Synthetic oligonucleotide
cgagtggaggacctcatgggagacatg

SEQ ID NO: 255987 - DNA, 29 bp, Artificial Sequence
  Description of Artificial Sequence: Synthetic oligonucleotide
gagtggaggacctcatgggagacatgtag

SEQ ID NO: 255988 - DNA, 29 bp, Artificial Sequence
  Description of Artificial Sequence: Synthetic oligonucleotide
agtggaggacctcatgggagacatgtagc

SEQ ID NO: 255989 - DNA, 28 bp, Artificial Sequence
  Description of Artificial Sequence: Synthetic oligonucleotide
gtggaggacctcatgggagacatgtagc

SEQ ID NO: 255990 - DNA, 30 bp, Artificial Sequence
  Description of Artificial Sequence: Synthetic oligonucleotide
tggaggacctcatgggagacatgtagcaag

SEQ ID NO: 255991 - DNA, 29 bp, Artificial Sequence
  Description of Artificial Sequence: Synthetic oligonucleotide
ggaggacctcatgggagacatgtagcaag

SEQ ID NO: 255992 - DNA, 33 bp, Artificial Sequence
  Description of Artificial Sequence: Synthetic oligonucleotide
gaggacctcatgggagacatgtagcaagtatag

SEQ ID NO: 255993 - DNA, 33 bp, Artificial Sequence
  Description of Artificial Sequence: Synthetic oligonucleotide
aggacctcatgggagacatgtagcaagtatagc

SEQ ID NO: 255994 - DNA, 32 bp, Artificial Sequence
  Description of Artificial Sequence: Synthetic oligonucleotide
ggacctcatgggagacatgtagcaagtatagc

SEQ ID NO: 255995 - DNA, 33 bp, Artificial Sequence
  Description of Artificial Sequence: Synthetic oligonucleotide
gacctcatgggagacatgtagcaagtatagctc

SEQ ID NO: 255996 - DNA, 33 bp, Artificial Sequence
  Description of Artificial Sequence: Synthetic oligonucleotide
acctcatgggagacatgtagcaagtatagctcc

SEQ ID NO: 255997 - DNA, 32 bp, Artificial Sequence
  Description of Artificial Sequence: Synthetic oligonucleotide
cctcatgggagacatgtagcaagtatagctcc

SEQ ID NO: 255998 - DNA, 33 bp, Artificial Sequence
  Description of Artificial Sequence: Synthetic oligonucleotide
ctcatgggagacatgtagcaagtatagctcctg

SEQ ID NO: 255999 - DNA, 33 bp, Artificial Sequence
  Description of Artificial Sequence: Synthetic oligonucleotide
tcatgggagacatgtagcaagtatagctcctgg

SEQ ID NO: 256000 - DNA, 32 bp, Artificial Sequence
  Description of Artificial Sequence: Synthetic oligonucleotide
catgggagacatgtagcaagtatagctcctgg

SEQ ID NO: 256001 - DNA, 33 bp, Artificial Sequence
  Description of Artificial Sequence: Synthetic oligonucleotide
atgggagacatgtagcaagtatagctcctggac

SEQ ID NO: 256002 - DNA, 32 bp, Artificial Sequence
  Description of Artificial Sequence: Synthetic oligonucleotide
tgggagacatgtagcaagtatagctcctggac

SEQ ID NO: 256003 - DNA, 31 bp, Artificial Sequence
  Description of Artificial Sequence: Synthetic oligonucleotide
gggagacatgtagcaagtatagctcctggac

SEQ ID NO: 256004 - DNA, 32 bp, Artificial Sequence
  Description of Artificial Sequence: Synthetic oligonucleotide
ggagacatgtagcaagtatagctcctggacac

SEQ ID NO: 256005 - DNA, 35 bp, Artificial Sequence
  Description of Artificial Sequence: Synthetic oligonucleotide
gagacatgtagcaagtatagctcctggacactatc

SEQ ID NO: 256006 - DNA, 35 bp, Artificial Sequence
  Description of Artificial Sequence: Synthetic oligonucleotide
agacatgtagcaagtatagctcctggacactatcc

SEQ ID NO: 256007 - DNA, 34 bp, Artificial Sequence
  Description of Artificial Sequence: Synthetic oligonucleotide
gacatgtagcaagtatagctcctggacactatcc

SEQ ID NO: 256008 - DNA, 35 bp, Artificial Sequence
  Description of Artificial Sequence: Synthetic oligonucleotide
acatgtagcaagtatagctcctggacactatccag

SEQ ID NO: 256009 - DNA, 34 bp, Artificial Sequence
  Description of Artificial Sequence: Synthetic oligonucleotide
catgtagcaagtatagctcctggacactatccag

SEQ ID NO: 256010 - DNA, 36 bp, Artificial Sequence
  Description of Artificial Sequence: Synthetic oligonucleotide
atgtagcaagtatagctcctggacactatccagaag

SEQ ID NO: 256011 - DNA, 35 bp, Artificial Sequence
  Description of Artificial Sequence: Synthetic oligonucleotide
tgtagcaagtatagctcctggacactatccagaag

SEQ ID NO: 256012 - DNA, 34 bp, Artificial Sequence
  Description of Artificial Sequence: Synthetic oligonucleotide
gtagcaagtatagctcctggacactatccagaag

SEQ ID NO: 256013 - DNA, 36 bp, Artificial Sequence
  Description of Artificial Sequence: Synthetic oligonucleotide
tagcaagtatagctcctggacactatccagaagatc

SEQ ID NO: 256014 - DNA, 35 bp, Artificial Sequence
  Description of Artificial Sequence: Synthetic oligonucleotide
agcaagtatagctcctggacactatccagaagatc

SEQ ID NO: 256015 - DNA, 34 bp, Artificial Sequence
  Description of Artificial Sequence: Synthetic oligonucleotide
gcaagtatagctcctggacactatccagaagatc

SEQ ID NO: 256016 - DNA, 34 bp, Artificial Sequence
  Description of Artificial Sequence: Synthetic oligonucleotide
caagtatagctcctggacactatccagaagatcc

SEQ ID NO: 256017 - DNA, 35 bp, Artificial Sequence
  Description of Artificial Sequence: Synthetic oligonucleotide
aagtatagctcctggacactatccagaagatcctg

SEQ ID NO: 256018 - DNA, 34 bp, Artificial Sequence
  Description of Artificial Sequence: Synthetic oligonucleotide
agtatagctcctggacactatccagaagatcctg

SEQ ID NO: 256019 - DNA, 33 bp, Artificial Sequence
  Description of Artificial Sequence: Synthetic oligonucleotide
gtatagctcctggacactatccagaagatcctg

SEQ ID NO: 256020 - DNA, 35 bp, Artificial Sequence
  Description of Artificial Sequence: Synthetic oligonucleotide
tatagctcctggacactatccagaagatcctgaac

SEQ ID NO: 256021 - DNA, 34 bp, Artificial Sequence
  Description of Artificial Sequence: Synthetic oligonucleotide
atagctcctggacactatccagaagatcctgaac

SEQ ID NO: 256022 - DNA, 33 bp, Artificial Sequence
  Description of Artificial Sequence: Synthetic oligonucleotide
tagctcctggacactatccagaagatcctgaac

SEQ ID NO: 256023 - DNA, 32 bp, Artificial Sequence
  Description of Artificial Sequence: Synthetic oligonucleotide
agctcctggacactatccagaagatcctgaac

SEQ ID NO: 256024 - DNA, 31 bp, Artificial Sequence
  Description of Artificial Sequence: Synthetic oligonucleotide
gctcctggacactatccagaagatcctgaac

SEQ ID NO: 256025 - DNA, 31 bp, Artificial Sequence
  Description of Artificial Sequence: Synthetic oligonucleotide
ctcctggacactatccagaagatcctgaacg

SEQ ID NO: 256026 - DNA, 31 bp, Artificial Sequence
  Description of Artificial Sequence: Synthetic oligonucleotide
tcctggacactatccagaagatcctgaacgg

SEQ ID NO: 256027 - DNA, 30 bp, Artificial Sequence
  Description of Artificial Sequence: Synthetic oligonucleotide
cctggacactatccagaagatcctgaacgg

SEQ ID NO: 256028 - DNA, 33 bp, Artificial Sequence
  Description of Artificial Sequence: Synthetic oligonucleotide
ctggacactatccagaagatcctgaacggtatg

SEQ ID NO: 256029 - DNA, 33 bp, Artificial Sequence
  Description of Artificial Sequence: Synthetic oligonucleotide
tggacactatccagaagatcctgaacggtatgg

SEQ ID NO: 256030 - DNA, 32 bp, Artificial Sequence
  Description of Artificial Sequence: Synthetic oligonucleotide
ggacactatccagaagatcctgaacggtatgg

SEQ ID NO: 256031 - DNA, 32 bp, Artificial Sequence
  Description of Artificial Sequence: Synthetic oligonucleotide
gacactatccagaagatcctgaacggtatggg

SEQ ID NO: 256032 - DNA, 32 bp, Artificial Sequence
  Description of Artificial Sequence: Synthetic oligonucleotide
acactatccagaagatcctgaacggtatgggg

SEQ ID NO: 256033 - DNA, 31 bp, Artificial Sequence
  Description of Artificial Sequence: Synthetic oligonucleotide
cactatccagaagatcctgaacggtatgggg

SEQ ID NO: 256034 - DNA, 33 bp, Artificial Sequence
  Description of Artificial Sequence: Synthetic oligonucleotide
actatccagaagatcctgaacggtatggggtag

SEQ ID NO: 256035 - DNA, 32 bp, Artificial Sequence
  Description of Artificial Sequence: Synthetic oligonucleotide
ctatccagaagatcctgaacggtatggggtag

SEQ ID NO: 256036 - DNA, 32 bp, Artificial Sequence
  Description of Artificial Sequence: Synthetic oligonucleotide
tatccagaagatcctgaacggtatggggtagg

SEQ ID NO: 256037 - DNA, 31 bp, Artificial Sequence
  Description of Artificial Sequence: Synthetic oligonucleotide
atccagaagatcctgaacggtatggggtagg

SEQ ID NO: 256038 - DNA, 30 bp, Artificial Sequence
  Description of Artificial Sequence: Synthetic oligonucleotide
tccagaagatcctgaacggtatggggtagg

SEQ ID NO: 256039 - DNA, 29 bp, Artificial Sequence
  Description of Artificial Sequence: Synthetic oligonucleotide
ccagaagatcctgaacggtatggggtagg

SEQ ID NO: 256040 - DNA, 30 bp, Artificial Sequence
  Description of Artificial Sequence: Synthetic oligonucleotide
cagaagatcctgaacggtatggggtaggtc

SEQ ID NO: 256041 - DNA, 30 bp, Artificial Sequence
  Description of Artificial Sequence: Synthetic oligonucleotide
agaagatcctgaacggtatggggtaggtcc

SEQ ID NO: 256042 - DNA, 29 bp, Artificial Sequence
  Description of Artificial Sequence: Synthetic oligonucleotide
gaagatcctgaacggtatggggtaggtcc

SEQ ID NO: 256043 - DNA, 30 bp, Artificial Sequence
  Description of Artificial Sequence: Synthetic oligonucleotide
aagatcctgaacggtatggggtaggtcctg

SEQ ID NO: 256044 - DNA, 29 bp, Artificial Sequence
  Description of Artificial Sequence: Synthetic oligonucleotide
agatcctgaacggtatggggtaggtcctg

SEQ ID NO: 256045 - DNA, 28 bp, Artificial Sequence
  Description of Artificial Sequence: Synthetic oligonucleotide
gatcctgaacggtatggggtaggtcctg

SEQ ID NO: 256046 - DNA, 28 bp, Artificial Sequence
  Description of Artificial Sequence: Synthetic oligonucleotide
atcctgaacggtatggggtaggtcctgg

SEQ ID NO: 256047 - DNA, 27 bp, Artificial Sequence
  Description of Artificial Sequence: Synthetic oligonucleotide
tcctgaacggtatggggtaggtcctgg

SEQ ID NO: 256048 - DNA, 27 bp, Artificial Sequence
  Description of Artificial Sequence: Synthetic oligonucleotide
cctgaacggtatggggtaggtcctggt

SEQ ID NO: 256049 - DNA, 27 bp, Artificial Sequence
  Description of Artificial Sequence: Synthetic oligonucleotide
ctgaacggtatggggtaggtcctggtg

SEQ ID NO: 256050 - DNA, 27 bp, Artificial Sequence
  Description of Artificial Sequence: Synthetic oligonucleotide
tgaacggtatggggtaggtcctggtgc

SEQ ID NO: 256051 - DNA, 27 bp, Artificial Sequence
  Description of Artificial Sequence: Synthetic oligonucleotide
gaacggtatggggtaggtcctggtgca

SEQ ID NO: 256052 - DNA, 27 bp, Artificial Sequence
  Description of Artificial Sequence: Synthetic oligonucleotide
aacggtatggggtaggtcctggtgcac

SEQ ID NO: 256053 - DNA, 27 bp, Artificial Sequence
  Description of Artificial Sequence: Synthetic oligonucleotide
acggtatggggtaggtcctggtgcaca

SEQ ID NO: 256054 - DNA, 27 bp, Artificial Sequence
  Description of Artificial Sequence: Synthetic oligonucleotide
cggtatggggtaggtcctggtgcacaa

SEQ ID NO: 256055 - DNA, 30 bp, Artificial Sequence
  Description of Artificial Sequence: Synthetic oligonucleotide
ggtatggggtaggtcctggtgcacaaattc

SEQ ID NO: 256056 - DNA, 33 bp, Artificial Sequence
  Description of Artificial Sequence: Synthetic oligonucleotide
gtatggggtaggtcctggtgcacaaattcttac

SEQ ID NO: 256057 - DNA, 33 bp, Artificial Sequence
  Description of Artificial Sequence: Synthetic oligonucleotide
tatggggtaggtcctggtgcacaaattcttacc

SEQ ID NO: 256058 - DNA, 32 bp, Artificial Sequence
  Description of Artificial Sequence: Synthetic oligonucleotide
atggggtaggtcctggtgcacaaattcttacc

SEQ ID NO: 256059 - DNA, 31 bp, Artificial Sequence
  Description of Artificial Sequence: Synthetic oligonucleotide
tggggtaggtcctggtgcacaaattcttacc

SEQ ID NO: 256060 - DNA, 30 bp, Artificial Sequence
  Description of Artificial Sequence: Synthetic oligonucleotide
ggggtaggtcctggtgcacaaattcttacc

SEQ ID NO: 256061 - DNA, 32 bp, Artificial Sequence
  Description of Artificial Sequence: Synthetic oligonucleotide
gggtaggtcctggtgcacaaattcttaccatc

SEQ ID NO: 256062 - DNA, 34 bp, Artificial Sequence
  Description of Artificial Sequence: Synthetic oligonucleotide
ggtaggtcctggtgcacaaattcttaccatcaag

SEQ ID NO: 256063 - DNA, 37 bp, Artificial Sequence
  Description of Artificial Sequence: Synthetic oligonucleotide
gtaggtcctggtgcacaaattcttaccatcaagaatg

SEQ ID NO: 256064 - DNA, 37 bp, Artificial Sequence
  Description of Artificial Sequence: Synthetic oligonucleotide
taggtcctggtgcacaaattcttaccatcaagaatgg

SEQ ID NO: 256065 - DNA, 36 bp, Artificial Sequence
  Description of Artificial Sequence: Synthetic oligonucleotide
aggtcctggtgcacaaattcttaccatcaagaatgg

SEQ ID NO: 256066 - DNA, 35 bp, Artificial Sequence
  Description of Artificial Sequence: Synthetic oligonucleotide
ggtcctggtgcacaaattcttaccatcaagaatgg

SEQ ID NO: 256067 - DNA, 36 bp, Artificial Sequence
  Description of Artificial Sequence: Synthetic oligonucleotide
gtcctggtgcacaaattcttaccatcaagaatggtg

SEQ ID NO: 256068 - DNA, 39 bp, Artificial Sequence
  Description of Artificial Sequence: Synthetic oligonucleotide
tcctggtgcacaaattcttaccatcaagaatggtgatac

SEQ ID NO: 256069 - DNA, 38 bp, Artificial Sequence
  Description of Artificial Sequence: Synthetic oligonucleotide
cctggtgcacaaattcttaccatcaagaatggtgatac

SEQ ID NO: 256070 - DNA, 40 bp, Artificial Sequence
  Description of Artificial Sequence: Synthetic oligonucleotide
ctggtgcacaaattcttaccatcaagaatggtgatactag

SEQ ID NO: 256071 - DNA, 41 bp, Artificial Sequence
  Description of Artificial Sequence: Synthetic oligonucleotide
tggtgcacaaattcttaccatcaagaatggtgatactagac

SEQ ID NO: 256072 - DNA, 40 bp, Artificial Sequence
  Description of Artificial Sequence: Synthetic oligonucleotide
ggtgcacaaattcttaccatcaagaatggtgatactagac

SEQ ID NO: 256073 - DNA, 43 bp, Artificial Sequence
  Description of Artificial Sequence: Synthetic oligonucleotide
gtgcacaaattcttaccatcaagaatggtgatactagactaag

SEQ ID NO: 256074 - DNA, 43 bp, Artificial Sequence
  Description of Artificial Sequence: Synthetic oligonucleotide
tgcacaaattcttaccatcaagaatggtgatactagactaagc

SEQ ID NO: 256075 - DNA, 42 bp, Artificial Sequence
  Description of Artificial Sequence: Synthetic oligonucleotide
gcacaaattcttaccatcaagaatggtgatactagactaagc

SEQ ID NO: 256076 - DNA, 43 bp, Artificial Sequence
  Description of Artificial Sequence: Synthetic oligonucleotide
cacaaattcttaccatcaagaatggtgatactagactaagctc

SEQ ID NO: 256077 - DNA, 46 bp, Artificial Sequence
  Description of Artificial Sequence: Synthetic oligonucleotide
acaaattcttaccatcaagaatggtgatactagactaagctcaatg

SEQ ID NO: 256078 - DNA, 45 bp, Artificial Sequence
  Description of Artificial Sequence: Synthetic oligonucleotide
caaattcttaccatcaagaatggtgatactagactaagctcaatg

SEQ ID NO: 256079 - DNA, 45 bp, Artificial Sequence
  Description of Artificial Sequence: Synthetic oligonucleotide
aaattcttaccatcaagaatggtgatactagactaagctcaatgg

SEQ ID NO: 256080 - DNA, 44 bp, Artificial Sequence
  Description of Artificial Sequence: Synthetic oligonucleotide
aattcttaccatcaagaatggtgatactagactaagctcaatgg

SEQ ID NO: 256081 - DNA, 43 bp, Artificial Sequence
  Description of Artificial Sequence: Synthetic oligonucleotide
attcttaccatcaagaatggtgatactagactaagctcaatgg

SEQ ID NO: 256082 - DNA, 42 bp, Artificial Sequence
  Description of Artificial Sequence: Synthetic oligonucleotide
ttcttaccatcaagaatggtgatactagactaagctcaatgg

SEQ ID NO: 256083 - DNA, 41 bp, Artificial Sequence
  Description of Artificial Sequence: Synthetic oligonucleotide
tcttaccatcaagaatggtgatactagactaagctcaatgg

SEQ ID NO: 256084 - DNA, 40 bp, Artificial Sequence
  Description of Artificial Sequence: Synthetic oligonucleotide
cttaccatcaagaatggtgatactagactaagctcaatgg

SEQ ID NO: 256085 - DNA, 43 bp, Artificial Sequence
  Description of Artificial Sequence: Synthetic oligonucleotide
ttaccatcaagaatggtgatactagactaagctcaatggaaag

SEQ ID NO: 256086 - DNA, 42 bp, Artificial Sequence
  Description of Artificial Sequence: Synthetic oligonucleotide
taccatcaagaatggtgatactagactaagctcaatggaaag

SEQ ID NO: 256087 - DNA, 41 bp, Artificial Sequence
  Description of Artificial Sequence: Synthetic oligonucleotide
accatcaagaatggtgatactagactaagctcaatggaaag

SEQ ID NO: 256088 - DNA, 40 bp, Artificial Sequence
  Description of Artificial Sequence: Synthetic oligonucleotide
ccatcaagaatggtgatactagactaagctcaatggaaag

SEQ ID NO: 256089 - DNA, 41 bp, Artificial Sequence
  Description of Artificial Sequence: Synthetic oligonucleotide
catcaagaatggtgatactagactaagctcaatggaaagag

SEQ ID NO: 256090 - DNA, 41 bp, Artificial Sequence
  Description of Artificial Sequence: Synthetic oligonucleotide
atcaagaatggtgatactagactaagctcaatggaaagagg

SEQ ID NO: 256091 - DNA, 40 bp, Artificial Sequence
  Description of Artificial Sequence: Synthetic oligonucleotide
tcaagaatggtgatactagactaagctcaatggaaagagg

SEQ ID NO: 256092 - DNA, 39 bp, Artificial Sequence
  Description of Artificial Sequence: Synthetic oligonucleotide
caagaatggtgatactagactaagctcaatggaaagagg

SEQ ID NO: 256093 - DNA, 39 bp, Artificial Sequence
  Description of Artificial Sequence: Synthetic oligonucleotide
aagaatggtgatactagactaagctcaatggaaagaggc

SEQ ID NO: 256094 - DNA, 38 bp, Artificial Sequence
  Description of Artificial Sequence: Synthetic oligonucleotide
agaatggtgatactagactaagctcaatggaaagaggc

SEQ ID NO: 256095 - DNA, 37 bp, Artificial Sequence
  Description of Artificial Sequence: Synthetic oligonucleotide
gaatggtgatactagactaagctcaatggaaagaggc

SEQ ID NO: 256096 - DNA, 38 bp, Artificial Sequence
  Description of Artificial Sequence: Synthetic oligonucleotide
aatggtgatactagactaagctcaatggaaagaggcac

SEQ ID NO: 256097 - DNA, 37 bp, Artificial Sequence
  Description of Artificial Sequence: Synthetic oligonucleotide
atggtgatactagactaagctcaatggaaagaggcac

SEQ ID NO: 256098 - DNA, 36 bp, Artificial Sequence
  Description of Artificial Sequence: Synthetic oligonucleotide
tggtgatactagactaagctcaatggaaagaggcac

SEQ ID NO: 256099 - DNA, 35 bp, Artificial Sequence
  Description of Artificial Sequence: Synthetic oligonucleotide
ggtgatactagactaagctcaatggaaagaggcac

SEQ ID NO: 256100 - DNA, 36 bp, Artificial Sequence
  Description of Artificial Sequence: Synthetic oligonucleotide
gtgatactagactaagctcaatggaaagaggcacag

SEQ ID NO: 256101 - DNA, 36 bp, Artificial Sequence
  Description of Artificial Sequence: Synthetic oligonucleotide
tgatactagactaagctcaatggaaagaggcacagg

SEQ ID NO: 256102 - DNA, 35 bp, Artificial Sequence
  Description of Artificial Sequence: Synthetic oligonucleotide
gatactagactaagctcaatggaaagaggcacagg

SEQ ID NO: 256103 - DNA, 35 bp, Artificial Sequence
  Description of Artificial Sequence: Synthetic oligonucleotide
atactagactaagctcaatggaaagaggcacaggg

SEQ ID NO: 256104 - DNA, 34 bp, Artificial Sequence
  Description of Artificial Sequence: Synthetic oligonucleotide
tactagactaagctcaatggaaagaggcacaggg

SEQ ID NO: 256105 - DNA, 33 bp, Artificial Sequence
  Description of Artificial Sequence: Synthetic oligonucleotide
actagactaagctcaatggaaagaggcacaggg

SEQ ID NO: 256106 - DNA, 32 bp, Artificial Sequence
  Description of Artificial Sequence: Synthetic oligonucleotide
ctagactaagctcaatggaaagaggcacaggg

SEQ ID NO: 256107 - DNA, 32 bp, Artificial Sequence
  Description of Artificial Sequence: Synthetic oligonucleotide
tagactaagctcaatggaaagaggcacagggc

SEQ ID NO: 256108 - DNA, 31 bp, Artificial Sequence
  Description of Artificial Sequence: Synthetic oligonucleotide
agactaagctcaatggaaagaggcacagggc

SEQ ID NO: 256109 - DNA, 30 bp, Artificial Sequence
  Description of Artificial Sequence: Synthetic oligonucleotide
gactaagctcaatggaaagaggcacagggc

SEQ ID NO: 256110 - DNA, 31 bp, Artificial Sequence
  Description of Artificial Sequence: Synthetic oligonucleotide
actaagctcaatggaaagaggcacagggctc

SEQ ID NO: 256111 - DNA, 30 bp, Artificial Sequence
  Description of Artificial Sequence: Synthetic oligonucleotide
ctaagctcaatggaaagaggcacagggctc

SEQ ID NO: 256112 - DNA, 34 bp, Artificial Sequence
  Description of Artificial Sequence: Synthetic oligonucleotide
taagctcaatggaaagaggcacagggctcataag

SEQ ID NO: 256113 - DNA, 33 bp, Artificial Sequence
  Description of Artificial Sequence: Synthetic oligonucleotide
aagctcaatggaaagaggcacagggctcataag

SEQ ID NO: 256114 - DNA, 32 bp, Artificial Sequence
  Description of Artificial Sequence: Synthetic oligonucleotide
agctcaatggaaagaggcacagggctcataag

SEQ ID NO: 256115 - DNA, 31 bp, Artificial Sequence
  Description of Artificial Sequence: Synthetic oligonucleotide
gctcaatggaaagaggcacagggctcataag

SEQ ID NO: 256116 - DNA, 32 bp, Artificial Sequence
  Description of Artificial Sequence: Synthetic oligonucleotide
ctcaatggaaagaggcacagggctcataagac

SEQ ID NO: 256117 - DNA, 32 bp, Artificial Sequence
  Description of Artificial Sequence: Synthetic oligonucleotide
tcaatggaaagaggcacagggctcataagacc

SEQ ID NO: 256118 - DNA, 31 bp, Artificial Sequence
  Description of Artificial Sequence: Synthetic oligonucleotide
caatggaaagaggcacagggctcataagacc

SEQ ID NO: 256119 - DNA, 34 bp, Artificial Sequence
  Description of Artificial Sequence: Synthetic oligonucleotide
aatggaaagaggcacagggctcataagacctatg

SEQ ID NO: 256120 - DNA, 33 bp, Artificial Sequence
  Description of Artificial Sequence: Synthetic oligonucleotide
atggaaagaggcacagggctcataagacctatg

SEQ ID NO: 256121 - DNA, 32 bp, Artificial Sequence
  Description of Artificial Sequence: Synthetic oligonucleotide
tggaaagaggcacagggctcataagacctatg

SEQ ID NO: 256122 - DNA, 31 bp, Artificial Sequence
  Description of Artificial Sequence: Synthetic oligonucleotide
ggaaagaggcacagggctcataagacctatg

SEQ ID NO: 256123 - DNA, 34 bp, Artificial Sequence
  Description of Artificial Sequence: Synthetic oligonucleotide
gaaagaggcacagggctcataagacctatgatag

SEQ ID NO: 256124 - DNA, 36 bp, Artificial Sequence
  Description of Artificial Sequence: Synthetic oligonucleotide
aaagaggcacagggctcataagacctatgatagtag

SEQ ID NO: 256125 - DNA, 35 bp, Artificial Sequence
  Description of Artificial Sequence: Synthetic oligonucleotide
aagaggcacagggctcataagacctatgatagtag

SEQ ID NO: 256126 - DNA, 34 bp, Artificial Sequence
  Description of Artificial Sequence: Synthetic oligonucleotide
agaggcacagggctcataagacctatgatagtag

SEQ ID NO: 256127 - DNA, 33 bp, Artificial Sequence
  Description of Artificial Sequence: Synthetic oligonucleotide
gaggcacagggctcataagacctatgatagtag

SEQ ID NO: 256128 - DNA, 41 bp, Artificial Sequence
  Description of Artificial Sequence: Synthetic oligonucleotide
aggcacagggctcataagacctatgatagtagttataaaac

SEQ ID NO: 256129 - DNA, 40 bp, Artificial Sequence
  Description of Artificial Sequence: Synthetic oligonucleotide
ggcacagggctcataagacctatgatagtagttataaaac

SEQ ID NO: 256130 - DNA, 44 bp, Artificial Sequence
  Description of Artificial Sequence: Synthetic oligonucleotide
gcacagggctcataagacctatgatagtagttataaaacataag

SEQ ID NO: 256131 - DNA, 45 bp, Artificial Sequence
  Description of Artificial Sequence: Synthetic oligonucleotide
cacagggctcataagacctatgatagtagttataaaacataagtg

SEQ ID NO: 256132 - DNA, 46 bp, Artificial Sequence
  Description of Artificial Sequence: Synthetic oligonucleotide
acagggctcataagacctatgatagtagttataaaacataagtgtc

SEQ ID NO: 256133 - DNA, 45 bp, Artificial Sequence
  Description of Artificial Sequence: Synthetic oligonucleotide
cagggctcataagacctatgatagtagttataaaacataagtgtc

SEQ ID NO: 256134 - DNA, 47 bp, Artificial Sequence
  Description of Artificial Sequence: Synthetic oligonucleotide
agggctcataagacctatgatagtagttataaaacataagtgtcatc

SEQ ID NO: 256135 - DNA, 46 bp, Artificial Sequence
  Description of Artificial Sequence: Synthetic oligonucleotide
gggctcataagacctatgatagtagttataaaacataagtgtcatc

SEQ ID NO: 256136 - DNA, 48 bp, Artificial Sequence
  Description of Artificial Sequence: Synthetic oligonucleotide
ggctcataagacctatgatagtagttataaaacataagtgtcatcttg

SEQ ID NO: 256137 - DNA, 49 bp, Artificial Sequence
  Description of Artificial Sequence: Synthetic oligonucleotide
gctcataagacctatgatagtagttataaaacataagtgtcatcttgtc

SEQ ID NO: 256138 - DNA, 51 bp, Artificial Sequence
  Description of Artificial Sequence: Synthetic oligonucleotide
ctcataagacctatgatagtagttataaaacataagtgtcatcttgtcatc

SEQ ID NO: 256139 - DNA, 53 bp, Artificial Sequence
  Description of Artificial Sequence: Synthetic oligonucleotide
tcataagacctatgatagtagttataaaacataagtgtcatcttgtcatctac

SEQ ID NO: 256140 - DNA, 52 bp, Artificial Sequence
  Description of Artificial Sequence: Synthetic oligonucleotide
cataagacctatgatagtagttataaaacataagtgtcatcttgtcatctac

SEQ ID NO: 256141 - DNA, 53 bp, Artificial Sequence
  Description of Artificial Sequence: Synthetic oligonucleotide
ataagacctatgatagtagttataaaacataagtgtcatcttgtcatctacag

SEQ ID NO: 256142 - DNA, 52 bp, Artificial Sequence
  Description of Artificial Sequence: Synthetic oligonucleotide
taagacctatgatagtagttataaaacataagtgtcatcttgtcatctacag

SEQ ID NO: 256143 - DNA, 51 bp, Artificial Sequence
  Description of Artificial Sequence: Synthetic oligonucleotide
aagacctatgatagtagttataaaacataagtgtcatcttgtcatctacag

SEQ ID NO: 256144 - DNA, 50 bp, Artificial Sequence
  Description of Artificial Sequence: Synthetic oligonucleotide
agacctatgatagtagttataaaacataagtgtcatcttgtcatctacag

SEQ ID NO: 256145 - DNA, 49 bp, Artificial Sequence
  Description of Artificial Sequence: Synthetic oligonucleotide
gacctatgatagtagttataaaacataagtgtcatcttgtcatctacag

SEQ ID NO: 256146 - DNA, 52 bp, Artificial Sequence
  Description of Artificial Sequence: Synthetic oligonucleotide
acctatgatagtagttataaaacataagtgtcatcttgtcatctacagttag

SEQ ID NO: 256147 - DNA, 51 bp, Artificial Sequence
  Description of Artificial Sequence: Synthetic oligonucleotide
cctatgatagtagttataaaacataagtgtcatcttgtcatctacagttag

SEQ ID NO: 256148 - DNA, 51 bp, Artificial Sequence
  Description of Artificial Sequence: Synthetic oligonucleotide
ctatgatagtagttataaaacataagtgtcatcttgtcatctacagttagg

SEQ ID NO: 256149 - DNA, 51 bp, Artificial Sequence
  Description of Artificial Sequence: Synthetic oligonucleotide
tatgatagtagttataaaacataagtgtcatcttgtcatctacagttaggg

SEQ ID NO: 256150 - DNA, 50 bp, Artificial Sequence
  Description of Artificial Sequence: Synthetic oligonucleotide
atgatagtagttataaaacataagtgtcatcttgtcatctacagttaggg

SEQ ID NO: 256151 - DNA, 49 bp, Artificial Sequence
  Description of Artificial Sequence: Synthetic oligonucleotide
tgatagtagttataaaacataagtgtcatcttgtcatctacagttaggg

SEQ ID NO: 256152 - DNA, 48 bp, Artificial Sequence
  Description of Artificial Sequence: Synthetic oligonucleotide
gatagtagttataaaacataagtgtcatcttgtcatctacagttaggg

SEQ ID NO: 256153 - DNA, 49 bp, Artificial Sequence
  Description of Artificial Sequence: Synthetic oligonucleotide
atagtagttataaaacataagtgtcatcttgtcatctacagttagggag

SEQ ID NO: 256154 - DNA, 48 bp, Artificial Sequence
  Description of Artificial Sequence: Synthetic oligonucleotide
tagtagttataaaacataagtgtcatcttgtcatctacagttagggag

SEQ ID NO: 256155 - DNA, 47 bp, Artificial Sequence
  Description of Artificial Sequence: Synthetic oligonucleotide
agtagttataaaacataagtgtcatcttgtcatctacagttagggag

SEQ ID NO: 256156 - DNA, 46 bp, Artificial Sequence
  Description of Artificial Sequence: Synthetic oligonucleotide
gtagttataaaacataagtgtcatcttgtcatctacagttagggag

SEQ ID NO: 256157 - DNA, 48 bp, Artificial Sequence
  Description of Artificial Sequence: Synthetic oligonucleotide
tagttataaaacataagtgtcatcttgtcatctacagttagggagaag

SEQ ID NO: 256158 - DNA, 47 bp, Artificial Sequence
  Description of Artificial Sequence: Synthetic oligonucleotide
agttataaaacataagtgtcatcttgtcatctacagttagggagaag

SEQ ID NO: 256159 - DNA, 46 bp, Artificial Sequence
  Description of Artificial Sequence: Synthetic oligonucleotide
gttataaaacataagtgtcatcttgtcatctacagttagggagaag

SEQ ID NO: 256160 - DNA, 46 bp, Artificial Sequence
  Description of Artificial Sequence: Synthetic oligonucleotide
ttataaaacataagtgtcatcttgtcatctacagttagggagaagc

SEQ ID NO: 256161 - DNA, 45 bp, Artificial Sequence
  Description of Artificial Sequence: Synthetic oligonucleotide
tataaaacataagtgtcatcttgtcatctacagttagggagaagc

SEQ ID NO: 256162 - DNA, 44 bp, Artificial Sequence
  Description of Artificial Sequence: Synthetic oligonucleotide
ataaaacataagtgtcatcttgtcatctacagttagggagaagc

SEQ ID NO: 256163 - DNA, 43 bp, Artificial Sequence
  Description of Artificial Sequence: Synthetic oligonucleotide
taaaacataagtgtcatcttgtcatctacagttagggagaagc

SEQ ID NO: 256164 - DNA, 42 bp, Artificial Sequence
  Description of Artificial Sequence: Synthetic oligonucleotide
aaaacataagtgtcatcttgtcatctacagttagggagaagc

SEQ ID NO: 256165 - DNA, 41 bp, Artificial Sequence
  Description of Artificial Sequence: Synthetic oligonucleotide
aaacataagtgtcatcttgtcatctacagttagggagaagc

SEQ ID NO: 256166 - DNA, 40 bp, Artificial Sequence
  Description of Artificial Sequence: Synthetic oligonucleotide
aacataagtgtcatcttgtcatctacagttagggagaagc

SEQ ID NO: 256167 - DNA, 39 bp, Artificial Sequence
  Description of Artificial Sequence: Synthetic oligonucleotide
acataagtgtcatcttgtcatctacagttagggagaagc

SEQ ID NO: 256168 - DNA, 38 bp, Artificial Sequence
  Description of Artificial Sequence: Synthetic oligonucleotide
cataagtgtcatcttgtcatctacagttagggagaagc

SEQ ID NO: 256169 - DNA, 40 bp, Artificial Sequence
  Description of Artificial Sequence: Synthetic oligonucleotide
ataagtgtcatcttgtcatctacagttagggagaagcatc

SEQ ID NO: 256170 - DNA, 39 bp, Artificial Sequence
  Description of Artificial Sequence: Synthetic oligonucleotide
taagtgtcatcttgtcatctacagttagggagaagcatc

SEQ ID NO: 256171 - DNA, 38 bp, Artificial Sequence
  Description of Artificial Sequence: Synthetic oligonucleotide
aagtgtcatcttgtcatctacagttagggagaagcatc

SEQ ID NO: 256172 - DNA, 37 bp, Artificial Sequence
  Description of Artificial Sequence: Synthetic oligonucleotide
agtgtcatcttgtcatctacagttagggagaagcatc

SEQ ID NO: 256173 - DNA, 36 bp, Artificial Sequence
  Description of Artificial Sequence: Synthetic oligonucleotide
gtgtcatcttgtcatctacagttagggagaagcatc

SEQ ID NO: 256174 - DNA, 37 bp, Artificial Sequence
  Description of Artificial Sequence: Synthetic oligonucleotide
tgtcatcttgtcatctacagttagggagaagcatctc

SEQ ID NO: 256175 - DNA, 36 bp, Artificial Sequence
  Description of Artificial Sequence: Synthetic oligonucleotide
gtcatcttgtcatctacagttagggagaagcatctc

SEQ ID NO: 256176 - DNA, 37 bp, Artificial Sequence
  Description of Artificial Sequence: Synthetic oligonucleotide
tcatcttgtcatctacagttagggagaagcatctcac

SEQ ID NO: 256177 - DNA, 36 bp, Artificial Sequence
  Description of Artificial Sequence: Synthetic oligonucleotide
catcttgtcatctacagttagggagaagcatctcac

SEQ ID NO: 256178 - DNA, 37 bp, Artificial Sequence
  Description of Artificial Sequence: Synthetic oligonucleotide
atcttgtcatctacagttagggagaagcatctcactg

SEQ ID NO: 256179 - DNA, 36 bp, Artificial Sequence
  Description of Artificial Sequence: Synthetic oligonucleotide
tcttgtcatctacagttagggagaagcatctcactg

SEQ ID NO: 256180 - DNA, 35 bp, Artificial Sequence
  Description of Artificial Sequence: Synthetic oligonucleotide
cttgtcatctacagttagggagaagcatctcactg

SEQ ID NO: 256181 - DNA, 35 bp, Artificial Sequence
  Description of Artificial Sequence: Synthetic oligonucleotide
ttgtcatctacagttagggagaagcatctcactgg

SEQ ID NO: 256182 - DNA, 34 bp, Artificial Sequence
  Description of Artificial Sequence: Synthetic oligonucleotide
tgtcatctacagttagggagaagcatctcactgg

SEQ ID NO: 256183 - DNA, 33 bp, Artificial Sequence
  Description of Artificial Sequence: Synthetic oligonucleotide
gtcatctacagttagggagaagcatctcactgg

SEQ ID NO: 256184 - DNA, 33 bp, Artificial Sequence
  Description of Artificial Sequence: Synthetic oligonucleotide
tcatctacagttagggagaagcatctcactggc

SEQ ID NO: 256185 - DNA, 32 bp, Artificial Sequence
  Description of Artificial Sequence: Synthetic oligonucleotide
catctacagttagggagaagcatctcactggc

SEQ ID NO: 256186 - DNA, 32 bp, Artificial Sequence
  Description of Artificial Sequence: Synthetic oligonucleotide
atctacagttagggagaagcatctcactggcg

SEQ ID NO: 256187 - DNA, 31 bp, Artificial Sequence
  Description of Artificial Sequence: Synthetic oligonucleotide
tctacagttagggagaagcatctcactggcg

SEQ ID NO: 256188 - DNA, 30 bp, Artificial Sequence
  Description of Artificial Sequence: Synthetic oligonucleotide
ctacagttagggagaagcatctcactggcg

SEQ ID NO: 256189 - DNA, 35 bp, Artificial Sequence
  Description of Artificial Sequence: Synthetic oligonucleotide
tacagttagggagaagcatctcactggcgaaattc

SEQ ID NO: 256190 - DNA, 34 bp, Artificial Sequence
  Description of Artificial Sequence: Synthetic oligonucleotide
acagttagggagaagcatctcactggcgaaattc

SEQ ID NO: 256191 - DNA, 33 bp, Artificial Sequence
  Description of Artificial Sequence: Synthetic oligonucleotide
cagttagggagaagcatctcactggcgaaattc

SEQ ID NO: 256192 - DNA, 34 bp, Artificial Sequence
  Description of Artificial Sequence: Synthetic oligonucleotide
agttagggagaagcatctcactggcgaaattctg

SEQ ID NO: 256193 - DNA, 33 bp, Artificial Sequence
  Description of Artificial Sequence: Synthetic oligonucleotide
gttagggagaagcatctcactggcgaaattctg

SEQ ID NO: 256194 - DNA, 33 bp, Artificial Sequence
  Description of Artificial Sequence: Synthetic oligonucleotide
ttagggagaagcatctcactggcgaaattctgg

SEQ ID NO: 256195 - DNA, 32 bp, Artificial Sequence
  Description of Artificial Sequence: Synthetic oligonucleotide
tagggagaagcatctcactggcgaaattctgg

SEQ ID NO: 256196 - DNA, 31 bp, Artificial Sequence
  Description of Artificial Sequence: Synthetic oligonucleotide
agggagaagcatctcactggcgaaattctgg

SEQ ID NO: 256197 - DNA, 30 bp, Artificial Sequence
  Description of Artificial Sequence: Synthetic oligonucleotide
gggagaagcatctcactggcgaaattctgg

SEQ ID NO: 256198 - DNA, 30 bp, Artificial Sequence
  Description of Artificial Sequence: Synthetic oligonucleotide
ggagaagcatctcactggcgaaattctggc

SEQ ID NO: 256199 - DNA, 31 bp, Artificial Sequence
  Description of Artificial Sequence: Synthetic oligonucleotide
gagaagcatctcactggcgaaattctggcag

SEQ ID NO: 256200 - DNA, 36 bp, Artificial Sequence
  Description of Artificial Sequence: Synthetic oligonucleotide
agaagcatctcactggcgaaattctggcagaatttg

SEQ ID NO: 256201 - DNA, 35 bp, Artificial Sequence
  Description of Artificial Sequence: Synthetic oligonucleotide
gaagcatctcactggcgaaattctggcagaatttg

SEQ ID NO: 256202 - DNA, 36 bp, Artificial Sequence
  Description of Artificial Sequence: Synthetic oligonucleotide
aagcatctcactggcgaaattctggcagaatttgtc

SEQ ID NO: 256203 - DNA, 35 bp, Artificial Sequence
  Description of Artificial Sequence: Synthetic oligonucleotide
agcatctcactggcgaaattctggcagaatttgtc

SEQ ID NO: 256204 - DNA, 34 bp, Artificial Sequence
  Description of Artificial Sequence: Synthetic oligonucleotide
gcatctcactggcgaaattctggcagaatttgtc

SEQ ID NO: 256205 - DNA, 36 bp, Artificial Sequence
  Description of Artificial Sequence: Synthetic oligonucleotide
catctcactggcgaaattctggcagaatttgtcaag

SEQ ID NO: 256206 - DNA, 44 bp, Artificial Sequence
  Description of Artificial Sequence: Synthetic oligonucleotide
atctcactggcgaaattctggcagaatttgtcaagtaattattg

SEQ ID NO: 256207 - DNA, 43 bp, Artificial Sequence
  Description of Artificial Sequence: Synthetic oligonucleotide
tctcactggcgaaattctggcagaatttgtcaagtaattattg

SEQ ID NO: 256208 - DNA, 42 bp, Artificial Sequence
  Description of Artificial Sequence: Synthetic oligonucleotide
ctcactggcgaaattctggcagaatttgtcaagtaattattg

SEQ ID NO: 256209 - DNA, 44 bp, Artificial Sequence
  Description of Artificial Sequence: Synthetic oligonucleotide
tcactggcgaaattctggcagaatttgtcaagtaattattgaag

SEQ ID NO: 256210 - DNA, 43 bp, Artificial Sequence
  Description of Artificial Sequence: Synthetic oligonucleotide
cactggcgaaattctggcagaatttgtcaagtaattattgaag

SEQ ID NO: 256211 - DNA, 43 bp, Artificial Sequence
  Description of Artificial Sequence: Synthetic oligonucleotide
actggcgaaattctggcagaatttgtcaagtaattattgaagc

SEQ ID NO: 256212 - DNA, 42 bp, Artificial Sequence
  Description of Artificial Sequence: Synthetic oligonucleotide
ctggcgaaattctggcagaatttgtcaagtaattattgaagc

SEQ ID NO: 256213 - DNA, 43 bp, Artificial Sequence
  Description of Artificial Sequence: Synthetic oligonucleotide
tggcgaaattctggcagaatttgtcaagtaattattgaagcag

SEQ ID NO: 256214 - DNA, 42 bp, Artificial Sequence
  Description of Artificial Sequence: Synthetic oligonucleotide
ggcgaaattctggcagaatttgtcaagtaattattgaagcag

SEQ ID NO: 256215 - DNA, 45 bp, Artificial Sequence
  Description of Artificial Sequence: Synthetic oligonucleotide
gcgaaattctggcagaatttgtcaagtaattattgaagcagtttg

SEQ ID NO: 256216 - DNA, 45 bp, Artificial Sequence
  Description of Artificial Sequence: Synthetic oligonucleotide
cgaaattctggcagaatttgtcaagtaattattgaagcagtttgg

SEQ ID NO: 256217 - DNA, 47 bp, Artificial Sequence
  Description of Artificial Sequence: Synthetic oligonucleotide
gaaattctggcagaatttgtcaagtaattattgaagcagtttggaag

SEQ ID NO: 256218 - DNA, 47 bp, Artificial Sequence
  Description of Artificial Sequence: Synthetic oligonucleotide
aaattctggcagaatttgtcaagtaattattgaagcagtttggaagc

SEQ ID NO: 256219 - DNA, 46 bp, Artificial Sequence
  Description of Artificial Sequence: Synthetic oligonucleotide
aattctggcagaatttgtcaagtaattattgaagcagtttggaagc

SEQ ID NO: 256220 - DNA, 45 bp, Artificial Sequence
  Description of Artificial Sequence: Synthetic oligonucleotide
attctggcagaatttgtcaagtaattattgaagcagtttggaagc

SEQ ID NO: 256221 - DNA, 44 bp, Artificial Sequence
  Description of Artificial Sequence: Synthetic oligonucleotide
ttctggcagaatttgtcaagtaattattgaagcagtttggaagc

SEQ ID NO: 256222 - DNA, 43 bp, Artificial Sequence
  Description of Artificial Sequence: Synthetic oligonucleotide
tctggcagaatttgtcaagtaattattgaagcagtttggaagc

SEQ ID NO: 256223 - DNA, 42 bp, Artificial Sequence
  Description of Artificial Sequence: Synthetic oligonucleotide
ctggcagaatttgtcaagtaattattgaagcagtttggaagc

SEQ ID NO: 256224 - DNA, 56 bp, Artificial Sequence
  Description of Artificial Sequence: Synthetic oligonucleotide
tggcagaatttgtcaagtaattattgaagcagtttggaagcattatataatttttg

SEQ ID NO: 256225 - DNA, 55 bp, Artificial Sequence
  Description of Artificial Sequence: Synthetic oligonucleotide
ggcagaatttgtcaagtaattattgaagcagtttggaagcattatataatttttg

SEQ ID NO: 256226 - DNA, 58 bp, Artificial Sequence
  Description of Artificial Sequence: Synthetic oligonucleotide
gcagaatttgtcaagtaattattgaagcagtttggaagcattatataatttttgtttc

SEQ ID NO: 256227 - DNA, 60 bp, Artificial Sequence
  Description of Artificial Sequence: Synthetic oligonucleotide
cagaatttgtcaagtaattattgaagcagtttggaagcattatataatttttgtttcaag

SEQ ID NO: 256228 - DNA, 60 bp, Artificial Sequence
  Description of Artificial Sequence: Synthetic oligonucleotide
agaatttgtcaagtaattattgaagcagtttggaagcattatataatttttgtttcaaga

SEQ ID NO: 256229 - DNA, 60 bp, Artificial Sequence
  Description of Artificial Sequence: Synthetic oligonucleotide
gaatttgtcaagtaattattgaagcagtttggaagcattatataatttttgtttcaagag

SEQ ID NO: 256230 - DNA, 60 bp, Artificial Sequence
  Description of Artificial Sequence: Synthetic oligonucleotide
aatttgtcaagtaattattgaagcagtttggaagcattatataatttttgtttcaagagc

SEQ ID NO: 256231 - DNA, 59 bp, Artificial Sequence
  Description of Artificial Sequence: Synthetic oligonucleotide
atttgtcaagtaattattgaagcagtttggaagcattatataatttttgtttcaagagc

SEQ ID NO: 256232 - DNA, 58 bp, Artificial Sequence
  Description of Artificial Sequence: Synthetic oligonucleotide
tttgtcaagtaattattgaagcagtttggaagcattatataatttttgtttcaagagc

SEQ ID NO: 256233 - DNA, 57 bp, Artificial Sequence
  Description of Artificial Sequence: Synthetic oligonucleotide
ttgtcaagtaattattgaagcagtttggaagcattatataatttttgtttcaagagc

SEQ ID NO: 256234 - DNA, 56 bp, Artificial Sequence
  Description of Artificial Sequence: Synthetic oligonucleotide
tgtcaagtaattattgaagcagtttggaagcattatataatttttgtttcaagagc

SEQ ID NO: 256235 - DNA, 55 bp, Artificial Sequence
  Description of Artificial Sequence: Synthetic oligonucleotide
gtcaagtaattattgaagcagtttggaagcattatataatttttgtttcaagagc

SEQ ID NO: 256236 - DNA, 56 bp, Artificial Sequence
  Description of Artificial Sequence: Synthetic oligonucleotide
tcaagtaattattgaagcagtttggaagcattatataatttttgtttcaagagctg

SEQ ID NO: 256237 - DNA, 55 bp, Artificial Sequence
  Description of Artificial Sequence: Synthetic oligonucleotide
caagtaattattgaagcagtttggaagcattatataatttttgtttcaagagctg

SEQ ID NO: 256238 - DNA, 55 bp, Artificial Sequence
  Description of Artificial Sequence: Synthetic oligonucleotide
aagtaattattgaagcagtttggaagcattatataatttttgtttcaagagctgg

SEQ ID NO: 256239 - DNA, 54 bp, Artificial Sequence
  Description of Artificial Sequence: Synthetic oligonucleotide
agtaattattgaagcagtttggaagcattatataatttttgtttcaagagctgg

SEQ ID NO: 256240 - DNA, 53 bp, Artificial Sequence
  Description of Artificial Sequence: Synthetic oligonucleotide
gtaattattgaagcagtttggaagcattatataatttttgtttcaagagctgg

SEQ ID NO: 256241 - DNA, 60 bp, Artificial Sequence
  Description of Artificial Sequence: Synthetic oligonucleotide
taattattgaagcagtttggaagcattatataatttttgtttcaagagctggaaattatg

SEQ ID NO: 256242 - DNA, 59 bp, Artificial Sequence
  Description of Artificial Sequence: Synthetic oligonucleotide
aattattgaagcagtttggaagcattatataatttttgtttcaagagctggaaattatg

SEQ ID NO: 256243 - DNA, 58 bp, Artificial Sequence
  Description of Artificial Sequence: Synthetic oligonucleotide
attattgaagcagtttggaagcattatataatttttgtttcaagagctggaaattatg

SEQ ID NO: 256244 - DNA, 57 bp, Artificial Sequence
  Description of Artificial Sequence: Synthetic oligonucleotide
ttattgaagcagtttggaagcattatataatttttgtttcaagagctggaaattatg

SEQ ID NO: 256245 - DNA, 56 bp, Artificial Sequence
  Description of Artificial Sequence: Synthetic oligonucleotide
tattgaagcagtttggaagcattatataatttttgtttcaagagctggaaattatg

SEQ ID NO: 256246 - DNA, 55 bp, Artificial Sequence
  Description of Artificial Sequence: Synthetic oligonucleotide
attgaagcagtttggaagcattatataatttttgtttcaagagctggaaattatg

SEQ ID NO: 256247 - DNA, 54 bp, Artificial Sequence
  Description of Artificial Sequence: Synthetic oligonucleotide
ttgaagcagtttggaagcattatataatttttgtttcaagagctggaaattatg

SEQ ID NO: 256248 - DNA, 53 bp, Artificial Sequence
  Description of Artificial Sequence: Synthetic oligonucleotide
tgaagcagtttggaagcattatataatttttgtttcaagagctggaaattatg

SEQ ID NO: 256249 - DNA, 52 bp, Artificial Sequence
  Description of Artificial Sequence: Synthetic oligonucleotide
gaagcagtttggaagcattatataatttttgtttcaagagctggaaattatg

SEQ ID NO: 256250 - DNA, 52 bp, Artificial Sequence
  Description of Artificial Sequence: Synthetic oligonucleotide
aagcagtttggaagcattatataatttttgtttcaagagctggaaattatgg

SEQ ID NO: 256251 - DNA, 51 bp, Artificial Sequence
  Description of Artificial Sequence: Synthetic oligonucleotide
agcagtttggaagcattatataatttttgtttcaagagctggaaattatgg

SEQ ID NO: 256252 - DNA, 50 bp, Artificial Sequence
  Description of Artificial Sequence: Synthetic oligonucleotide
gcagtttggaagcattatataatttttgtttcaagagctggaaattatgg

SEQ ID NO: 256253 - DNA, 51 bp, Artificial Sequence
  Description of Artificial Sequence: Synthetic oligonucleotide
cagtttggaagcattatataatttttgtttcaagagctggaaattatggtc

SEQ ID NO: 256254 - DNA, 51 bp, Artificial Sequence
  Description of Artificial Sequence: Synthetic oligonucleotide
agtttggaagcattatataatttttgtttcaagagctggaaattatggtcc

SEQ ID NO: 256255 - DNA, 50 bp, Artificial Sequence
  Description of Artificial Sequence: Synthetic oligonucleotide
gtttggaagcattatataatttttgtttcaagagctggaaattatggtcc

SEQ ID NO: 256256 - DNA, 52 bp, Artificial Sequence
  Description of Artificial Sequence: Synthetic oligonucleotide
tttggaagcattatataatttttgtttcaagagctggaaattatggtccatc

SEQ ID NO: 256257 - DNA, 51 bp, Artificial Sequence
  Description of Artificial Sequence: Synthetic oligonucleotide
ttggaagcattatataatttttgtttcaagagctggaaattatggtccatc

SEQ ID NO: 256258 - DNA, 50 bp, Artificial Sequence
  Description of Artificial Sequence: Synthetic oligonucleotide
tggaagcattatataatttttgtttcaagagctggaaattatggtccatc

SEQ ID NO: 256259 - DNA, 49 bp, Artificial Sequence
  Description of Artificial Sequence: Synthetic oligonucleotide
ggaagcattatataatttttgtttcaagagctggaaattatggtccatc

SEQ ID NO: 256260 - DNA, 49 bp, Artificial Sequence
  Description of Artificial Sequence: Synthetic oligonucleotide
gaagcattatataatttttgtttcaagagctggaaattatggtccatcc

SEQ ID NO: 256261 - DNA, 49 bp, Artificial Sequence
  Description of Artificial Sequence: Synthetic oligonucleotide
aagcattatataatttttgtttcaagagctggaaattatggtccatccc

SEQ ID NO: 256262 - DNA, 48 bp, Artificial Sequence
  Description of Artificial Sequence: Synthetic oligonucleotide
agcattatataatttttgtttcaagagctggaaattatggtccatccc

SEQ ID NO: 256263 - DNA, 47 bp, Artificial Sequence
  Description of Artificial Sequence: Synthetic oligonucleotide
gcattatataatttttgtttcaagagctggaaattatggtccatccc

SEQ ID NO: 256264 - DNA, 48 bp, Artificial Sequence
  Description of Artificial Sequence: Synthetic oligonucleotide
cattatataatttttgtttcaagagctggaaattatggtccatccctg

SEQ ID NO: 256265 - DNA, 49 bp, Artificial Sequence
  Description of Artificial Sequence: Synthetic oligonucleotide
attatataatttttgtttcaagagctggaaattatggtccatccctgtc

SEQ ID NO: 256266 - DNA, 48 bp, Artificial Sequence
  Description of Artificial Sequence: Synthetic oligonucleotide
ttatataatttttgtttcaagagctggaaattatggtccatccctgtc

SEQ ID NO: 256267 - DNA, 47 bp, Artificial Sequence
  Description of Artificial Sequence: Synthetic oligonucleotide
tatataatttttgtttcaagagctggaaattatggtccatccctgtc

SEQ ID NO: 256268 - DNA, 46 bp, Artificial Sequence
  Description of Artificial Sequence: Synthetic oligonucleotide
atataatttttgtttcaagagctggaaattatggtccatccctgtc

SEQ ID NO: 256269 - DNA, 45 bp, Artificial Sequence
  Description of Artificial Sequence: Synthetic oligonucleotide
tataatttttgtttcaagagctggaaattatggtccatccctgtc

SEQ ID NO: 256270 - DNA, 44 bp, Artificial Sequence
  Description of Artificial Sequence: Synthetic oligonucleotide
ataatttttgtttcaagagctggaaattatggtccatccctgtc

SEQ ID NO: 256271 - DNA, 43 bp, Artificial Sequence
  Description of Artificial Sequence: Synthetic oligonucleotide
taatttttgtttcaagagctggaaattatggtccatccctgtc

SEQ ID NO: 256272 - DNA, 42 bp, Artificial Sequence
  Description of Artificial Sequence: Synthetic oligonucleotide
aatttttgtttcaagagctggaaattatggtccatccctgtc

SEQ ID NO: 256273 - DNA, 41 bp, Artificial Sequence
  Description of Artificial Sequence: Synthetic oligonucleotide
atttttgtttcaagagctggaaattatggtccatccctgtc

SEQ ID NO: 256274 - DNA, 40 bp, Artificial Sequence
  Description of Artificial Sequence: Synthetic oligonucleotide
tttttgtttcaagagctggaaattatggtccatccctgtc

SEQ ID NO: 256275 - DNA, 39 bp, Artificial Sequence
  Description of Artificial Sequence: Synthetic oligonucleotide
ttttgtttcaagagctggaaattatggtccatccctgtc

SEQ ID NO: 256276 - DNA, 38 bp, Artificial Sequence
  Description of Artificial Sequence: Synthetic oligonucleotide
tttgtttcaagagctggaaattatggtccatccctgtc

SEQ ID NO: 256277 - DNA, 37 bp, Artificial Sequence
  Description of Artificial Sequence: Synthetic oligonucleotide
ttgtttcaagagctggaaattatggtccatccctgtc

SEQ ID NO: 256278 - DNA, 36 bp, Artificial Sequence
  Description of Artificial Sequence: Synthetic oligonucleotide
tgtttcaagagctggaaattatggtccatccctgtc

SEQ ID NO: 256279 - DNA, 35 bp, Artificial Sequence
  Description of Artificial Sequence: Synthetic oligonucleotide
gtttcaagagctggaaattatggtccatccctgtc

SEQ ID NO: 256280 - DNA, 37 bp, Artificial Sequence
  Description of Artificial Sequence: Synthetic oligonucleotide
tttcaagagctggaaattatggtccatccctgtctac

SEQ ID NO: 256281 - DNA, 36 bp, Artificial Sequence
  Description of Artificial Sequence: Synthetic oligonucleotide
ttcaagagctggaaattatggtccatccctgtctac

SEQ ID NO: 256282 - DNA, 35 bp, Artificial Sequence
  Description of Artificial Sequence: Synthetic oligonucleotide
tcaagagctggaaattatggtccatccctgtctac

SEQ ID NO: 256283 - DNA, 34 bp, Artificial Sequence
  Description of Artificial Sequence: Synthetic oligonucleotide
caagagctggaaattatggtccatccctgtctac

SEQ ID NO: 256284 - DNA, 35 bp, Artificial Sequence
  Description of Artificial Sequence: Synthetic oligonucleotide
aagagctggaaattatggtccatccctgtctactg

SEQ ID NO: 256285 - DNA, 34 bp, Artificial Sequence
  Description of Artificial Sequence: Synthetic oligonucleotide
agagctggaaattatggtccatccctgtctactg

SEQ ID NO: 256286 - DNA, 33 bp, Artificial Sequence
  Description of Artificial Sequence: Synthetic oligonucleotide
gagctggaaattatggtccatccctgtctactg

SEQ ID NO: 256287 - DNA, 35 bp, Artificial Sequence
  Description of Artificial Sequence: Synthetic oligonucleotide
agctggaaattatggtccatccctgtctactgttg

SEQ ID NO: 256288 - DNA, 34 bp, Artificial Sequence
  Description of Artificial Sequence: Synthetic oligonucleotide
gctggaaattatggtccatccctgtctactgttg

SEQ ID NO: 256289 - DNA, 34 bp, Artificial Sequence
  Description of Artificial Sequence: Synthetic oligonucleotide
ctggaaattatggtccatccctgtctactgttgg

SEQ ID NO: 256290 - DNA, 36 bp, Artificial Sequence
  Description of Artificial Sequence: Synthetic oligonucleotide
tggaaattatggtccatccctgtctactgttggttg

SEQ ID NO: 256291 - DNA, 35 bp, Artificial Sequence
  Description of Artificial Sequence: Synthetic oligonucleotide
ggaaattatggtccatccctgtctactgttggttg

SEQ ID NO: 256292 - DNA, 36 bp, Artificial Sequence
  Description of Artificial Sequence: Synthetic oligonucleotide
gaaattatggtccatccctgtctactgttggttgtg

SEQ ID NO: 256293 - DNA, 36 bp, Artificial Sequence
  Description of Artificial Sequence: Synthetic oligonucleotide
aaattatggtccatccctgtctactgttggttgtgc

SEQ ID NO: 256294 - DNA, 35 bp, Artificial Sequence
  Description of Artificial Sequence: Synthetic oligonucleotide
aattatggtccatccctgtctactgttggttgtgc

SEQ ID NO: 256295 - DNA, 34 bp, Artificial Sequence
  Description of Artificial Sequence: Synthetic oligonucleotide
attatggtccatccctgtctactgttggttgtgc

SEQ ID NO: 256296 - DNA, 33 bp, Artificial Sequence
  Description of Artificial Sequence: Synthetic oligonucleotide
ttatggtccatccctgtctactgttggttgtgc

SEQ ID NO: 256297 - DNA, 32 bp, Artificial Sequence
  Description of Artificial Sequence: Synthetic oligonucleotide
tatggtccatccctgtctactgttggttgtgc

SEQ ID NO: 256298 - DNA, 31 bp, Artificial Sequence
  Description of Artificial Sequence: Synthetic oligonucleotide
atggtccatccctgtctactgttggttgtgc

SEQ ID NO: 256299 - DNA, 30 bp, Artificial Sequence
  Description of Artificial Sequence: Synthetic oligonucleotide
tggtccatccctgtctactgttggttgtgc

SEQ ID NO: 256300 - DNA, 29 bp, Artificial Sequence
  Description of Artificial Sequence: Synthetic oligonucleotide
ggtccatccctgtctactgttggttgtgc

SEQ ID NO: 256301 - DNA, 30 bp, Artificial Sequence
  Description of Artificial Sequence: Synthetic oligonucleotide
gtccatccctgtctactgttggttgtgcag

SEQ ID NO: 256302 - DNA, 30 bp, Artificial Sequence
  Description of Artificial Sequence: Synthetic oligonucleotide
tccatccctgtctactgttggttgtgcagg

SEQ ID NO: 256303 - DNA, 29 bp, Artificial Sequence
  Description of Artificial Sequence: Synthetic oligonucleotide
ccatccctgtctactgttggttgtgcagg

SEQ ID NO: 256304 - DNA, 30 bp, Artificial Sequence
  Description of Artificial Sequence: Synthetic oligonucleotide
catccctgtctactgttggttgtgcaggtg

SEQ ID NO: 256305 - DNA, 30 bp, Artificial Sequence
  Description of Artificial Sequence: Synthetic oligonucleotide
atccctgtctactgttggttgtgcaggtgg

SEQ ID NO: 256306 - DNA, 29 bp, Artificial Sequence
  Description of Artificial Sequence: Synthetic oligonucleotide
tccctgtctactgttggttgtgcaggtgg

SEQ ID NO: 256307 - DNA, 28 bp, Artificial Sequence
  Description of Artificial Sequence: Synthetic oligonucleotide
ccctgtctactgttggttgtgcaggtgg

SEQ ID NO: 256308 - DNA, 30 bp, Artificial Sequence
  Description of Artificial Sequence: Synthetic oligonucleotide
cctgtctactgttggttgtgcaggtggaag

SEQ ID NO: 256309 - DNA, 32 bp, Artificial Sequence
  Description of Artificial Sequence: Synthetic oligonucleotide
ctgtctactgttggttgtgcaggtggaagtac

SEQ ID NO: 256310 - DNA, 34 bp, Artificial Sequence
  Description of Artificial Sequence: Synthetic oligonucleotide
tgtctactgttggttgtgcaggtggaagtacatc

SEQ ID NO: 256311 - DNA, 33 bp, Artificial Sequence
  Description of Artificial Sequence: Synthetic oligonucleotide
gtctactgttggttgtgcaggtggaagtacatc

SEQ ID NO: 256312 - DNA, 35 bp, Artificial Sequence
  Description of Artificial Sequence: Synthetic oligonucleotide
tctactgttggttgtgcaggtggaagtacatcaag

SEQ ID NO: 256313 - DNA, 34 bp, Artificial Sequence
  Description of Artificial Sequence: Synthetic oligonucleotide
ctactgttggttgtgcaggtggaagtacatcaag

SEQ ID NO: 256314 - DNA, 35 bp, Artificial Sequence
  Description of Artificial Sequence: Synthetic oligonucleotide
tactgttggttgtgcaggtggaagtacatcaagag

SEQ ID NO: 256315 - DNA, 34 bp, Artificial Sequence
  Description of Artificial Sequence: Synthetic oligonucleotide
actgttggttgtgcaggtggaagtacatcaagag

SEQ ID NO: 256316 - DNA, 33 bp, Artificial Sequence
  Description of Artificial Sequence: Synthetic oligonucleotide
ctgttggttgtgcaggtggaagtacatcaagag

SEQ ID NO: 256317 - DNA, 34 bp, Artificial Sequence
  Description of Artificial Sequence: Synthetic oligonucleotide
tgttggttgtgcaggtggaagtacatcaagagtg

SEQ ID NO: 256318 - DNA, 33 bp, Artificial Sequence
  Description of Artificial Sequence: Synthetic oligonucleotide
gttggttgtgcaggtggaagtacatcaagagtg

SEQ ID NO: 256319 - DNA, 36 bp, Artificial Sequence
  Description of Artificial Sequence: Synthetic oligonucleotide
ttggttgtgcaggtggaagtacatcaagagtgatag

SEQ ID NO: 256320 - DNA, 35 bp, Artificial Sequence
  Description of Artificial Sequence: Synthetic oligonucleotide
tggttgtgcaggtggaagtacatcaagagtgatag

SEQ ID NO: 256321 - DNA, 34 bp, Artificial Sequence
  Description of Artificial Sequence: Synthetic oligonucleotide
ggttgtgcaggtggaagtacatcaagagtgatag

SEQ ID NO: 256322 - DNA, 34 bp, Artificial Sequence
  Description of Artificial Sequence: Synthetic oligonucleotide
gttgtgcaggtggaagtacatcaagagtgatagg

SEQ ID NO: 256323 - DNA, 35 bp, Artificial Sequence
  Description of Artificial Sequence: Synthetic oligonucleotide
ttgtgcaggtggaagtacatcaagagtgataggtc

SEQ ID NO: 256324 - DNA, 34 bp, Artificial Sequence
  Description of Artificial Sequence: Synthetic oligonucleotide
tgtgcaggtggaagtacatcaagagtgataggtc

SEQ ID NO: 256325 - DNA, 33 bp, Artificial Sequence
  Description of Artificial Sequence: Synthetic oligonucleotide
gtgcaggtggaagtacatcaagagtgataggtc

SEQ ID NO: 256326 - DNA, 35 bp, Artificial Sequence
  Description of Artificial Sequence: Synthetic oligonucleotide
tgcaggtggaagtacatcaagagtgataggtcttg

SEQ ID NO: 256327 - DNA, 34 bp, Artificial Sequence
  Description of Artificial Sequence: Synthetic oligonucleotide
gcaggtggaagtacatcaagagtgataggtcttg

SEQ ID NO: 256328 - DNA, 34 bp, Artificial Sequence
  Description of Artificial Sequence: Synthetic oligonucleotide
caggtggaagtacatcaagagtgataggtcttgg

SEQ ID NO: 256329 - DNA, 35 bp, Artificial Sequence
  Description of Artificial Sequence: Synthetic oligonucleotide
aggtggaagtacatcaagagtgataggtcttggtg

SEQ ID NO: 256330 - DNA, 34 bp, Artificial Sequence
  Description of Artificial Sequence: Synthetic oligonucleotide
ggtggaagtacatcaagagtgataggtcttggtg

SEQ ID NO: 256331 - DNA, 34 bp, Artificial Sequence
  Description of Artificial Sequence: Synthetic oligonucleotide
gtggaagtacatcaagagtgataggtcttggtgc

SEQ ID NO: 256332 - DNA, 38 bp, Artificial Sequence
  Description of Artificial Sequence: Synthetic oligonucleotide
tggaagtacatcaagagtgataggtcttggtgcttttg

SEQ ID NO: 256333 - DNA, 37 bp, Artificial Sequence
  Description of Artificial Sequence: Synthetic oligonucleotide
ggaagtacatcaagagtgataggtcttggtgcttttg

SEQ ID NO: 256334 - DNA, 40 bp, Artificial Sequence
  Description of Artificial Sequence: Synthetic oligonucleotide
gaagtacatcaagagtgataggtcttggtgcttttgtttc

SEQ ID NO: 256335 - DNA, 41 bp, Artificial Sequence
  Description of Artificial Sequence: Synthetic oligonucleotide
aagtacatcaagagtgataggtcttggtgcttttgtttctc

SEQ ID NO: 256336 - DNA, 40 bp, Artificial Sequence
  Description of Artificial Sequence: Synthetic oligonucleotide
agtacatcaagagtgataggtcttggtgcttttgtttctc

SEQ ID NO: 256337 - DNA, 39 bp, Artificial Sequence
  Description of Artificial Sequence: Synthetic oligonucleotide
gtacatcaagagtgataggtcttggtgcttttgtttctc

SEQ ID NO: 256338 - DNA, 39 bp, Artificial Sequence
  Description of Artificial Sequence: Synthetic oligonucleotide
tacatcaagagtgataggtcttggtgcttttgtttctcc

SEQ ID NO: 256339 - DNA, 38 bp, Artificial Sequence
  Description of Artificial Sequence: Synthetic oligonucleotide
acatcaagagtgataggtcttggtgcttttgtttctcc

SEQ ID NO: 256340 - DNA, 37 bp, Artificial Sequence
  Description of Artificial Sequence: Synthetic oligonucleotide
catcaagagtgataggtcttggtgcttttgtttctcc

SEQ ID NO: 256341 - DNA, 38 bp, Artificial Sequence
  Description of Artificial Sequence: Synthetic oligonucleotide
atcaagagtgataggtcttggtgcttttgtttctccag

SEQ ID NO: 256342 - DNA, 37 bp, Artificial Sequence
  Description of Artificial Sequence: Synthetic oligonucleotide
tcaagagtgataggtcttggtgcttttgtttctccag

SEQ ID NO: 256343 - DNA, 36 bp, Artificial Sequence
  Description of Artificial Sequence: Synthetic oligonucleotide
caagagtgataggtcttggtgcttttgtttctccag

SEQ ID NO: 256344 - DNA, 40 bp, Artificial Sequence
  Description of Artificial Sequence: Synthetic oligonucleotide
aagagtgataggtcttggtgcttttgtttctccagatatg

SEQ ID NO: 256345 - DNA, 39 bp, Artificial Sequence
  Description of Artificial Sequence: Synthetic oligonucleotide
agagtgataggtcttggtgcttttgtttctccagatatg

SEQ ID NO: 256346 - DNA, 38 bp, Artificial Sequence
  Description of Artificial Sequence: Synthetic oligonucleotide
gagtgataggtcttggtgcttttgtttctccagatatg

SEQ ID NO: 256347 - DNA, 40 bp, Artificial Sequence
  Description of Artificial Sequence: Synthetic oligonucleotide
agtgataggtcttggtgcttttgtttctccagatatgatg

SEQ ID NO: 256348 - DNA, 39 bp, Artificial Sequence
  Description of Artificial Sequence: Synthetic oligonucleotide
gtgataggtcttggtgcttttgtttctccagatatgatg

SEQ ID NO: 256349 - DNA, 39 bp, Artificial Sequence
  Description of Artificial Sequence: Synthetic oligonucleotide
tgataggtcttggtgcttttgtttctccagatatgatgc

SEQ ID NO: 256350 - DNA, 38 bp, Artificial Sequence
  Description of Artificial Sequence: Synthetic oligonucleotide
gataggtcttggtgcttttgtttctccagatatgatgc

SEQ ID NO: 256351 - DNA, 40 bp, Artificial Sequence
  Description of Artificial Sequence: Synthetic oligonucleotide
ataggtcttggtgcttttgtttctccagatatgatgcttg

SEQ ID NO: 256352 - DNA, 39 bp, Artificial Sequence
  Description of Artificial Sequence: Synthetic oligonucleotide
taggtcttggtgcttttgtttctccagatatgatgcttg

SEQ ID NO: 256353 - DNA, 38 bp, Artificial Sequence
  Description of Artificial Sequence: Synthetic oligonucleotide
aggtcttggtgcttttgtttctccagatatgatgcttg

SEQ ID NO: 256354 - DNA, 37 bp, Artificial Sequence
  Description of Artificial Sequence: Synthetic oligonucleotide
ggtcttggtgcttttgtttctccagatatgatgcttg

SEQ ID NO: 256355 - DNA, 37 bp, Artificial Sequence
  Description of Artificial Sequence: Synthetic oligonucleotide
gtcttggtgcttttgtttctccagatatgatgcttgc

SEQ ID NO: 256356 - DNA, 38 bp, Artificial Sequence
  Description of Artificial Sequence: Synthetic oligonucleotide
tcttggtgcttttgtttctccagatatgatgcttgctg

SEQ ID NO: 256357 - DNA, 37 bp, Artificial Sequence
  Description of Artificial Sequence: Synthetic oligonucleotide
cttggtgcttttgtttctccagatatgatgcttgctg

SEQ ID NO: 256358 - DNA, 38 bp, Artificial Sequence
  Description of Artificial Sequence: Synthetic oligonucleotide
ttggtgcttttgtttctccagatatgatgcttgctgag

SEQ ID NO: 256359 - DNA, 37 bp, Artificial Sequence
  Description of Artificial Sequence: Synthetic oligonucleotide
tggtgcttttgtttctccagatatgatgcttgctgag

SEQ ID NO: 256360 - DNA, 36 bp, Artificial Sequence
  Description of Artificial Sequence: Synthetic oligonucleotide
ggtgcttttgtttctccagatatgatgcttgctgag

SEQ ID NO: 256361 - DNA, 40 bp, Artificial Sequence
  Description of Artificial Sequence: Synthetic oligonucleotide
gtgcttttgtttctccagatatgatgcttgctgagttttc

SEQ ID NO: 256362 - DNA, 41 bp, Artificial Sequence
  Description of Artificial Sequence: Synthetic oligonucleotide
tgcttttgtttctccagatatgatgcttgctgagttttcac

SEQ ID NO: 256363 - DNA, 40 bp, Artificial Sequence
  Description of Artificial Sequence: Synthetic oligonucleotide
gcttttgtttctccagatatgatgcttgctgagttttcac

SEQ ID NO: 256364 - DNA, 41 bp, Artificial Sequence
  Description of Artificial Sequence: Synthetic oligonucleotide
cttttgtttctccagatatgatgcttgctgagttttcactg

SEQ ID NO: 256365 - DNA, 42 bp, Artificial Sequence
  Description of Artificial Sequence: Synthetic oligonucleotide
ttttgtttctccagatatgatgcttgctgagttttcactgag

SEQ ID NO: 256366 - DNA, 41 bp, Artificial Sequence
  Description of Artificial Sequence: Synthetic oligonucleotide
tttgtttctccagatatgatgcttgctgagttttcactgag

SEQ ID NO: 256367 - DNA, 40 bp, Artificial Sequence
  Description of Artificial Sequence: Synthetic oligonucleotide
ttgtttctccagatatgatgcttgctgagttttcactgag

SEQ ID NO: 256368 - DNA, 39 bp, Artificial Sequence
  Description of Artificial Sequence: Synthetic oligonucleotide
tgtttctccagatatgatgcttgctgagttttcactgag

SEQ ID NO: 256369 - DNA, 38 bp, Artificial Sequence
  Description of Artificial Sequence: Synthetic oligonucleotide
gtttctccagatatgatgcttgctgagttttcactgag

SEQ ID NO: 256370 - DNA, 39 bp, Artificial Sequence
  Description of Artificial Sequence: Synthetic oligonucleotide
tttctccagatatgatgcttgctgagttttcactgagtg

SEQ ID NO: 256371 - DNA, 38 bp, Artificial Sequence
  Description of Artificial Sequence: Synthetic oligonucleotide
ttctccagatatgatgcttgctgagttttcactgagtg

SEQ ID NO: 256372 - DNA, 37 bp, Artificial Sequence
  Description of Artificial Sequence: Synthetic oligonucleotide
tctccagatatgatgcttgctgagttttcactgagtg

SEQ ID NO: 256373 - DNA, 36 bp, Artificial Sequence
  Description of Artificial Sequence: Synthetic oligonucleotide
ctccagatatgatgcttgctgagttttcactgagtg

SEQ ID NO: 256374 - DNA, 37 bp, Artificial Sequence
  Description of Artificial Sequence: Synthetic oligonucleotide
tccagatatgatgcttgctgagttttcactgagtgag

SEQ ID NO: 256375 - DNA, 36 bp, Artificial Sequence
  Description of Artificial Sequence: Synthetic oligonucleotide
ccagatatgatgcttgctgagttttcactgagtgag

SEQ ID NO: 256376 - DNA, 42 bp, Artificial Sequence
  Description of Artificial Sequence: Synthetic oligonucleotide
cagatatgatgcttgctgagttttcactgagtgagaaattag

SEQ ID NO: 256377 - DNA, 42 bp, Artificial Sequence
  Description of Artificial Sequence: Synthetic oligonucleotide
agatatgatgcttgctgagttttcactgagtgagaaattagc

SEQ ID NO: 256378 - DNA, 41 bp, Artificial Sequence
  Description of Artificial Sequence: Synthetic oligonucleotide
gatatgatgcttgctgagttttcactgagtgagaaattagc

SEQ ID NO: 256379 - DNA, 42 bp, Artificial Sequence
  Description of Artificial Sequence: Synthetic oligonucleotide
atatgatgcttgctgagttttcactgagtgagaaattagctg

SEQ ID NO: 256380 - DNA, 41 bp, Artificial Sequence
  Description of Artificial Sequence: Synthetic oligonucleotide
tatgatgcttgctgagttttcactgagtgagaaattagctg

SEQ ID NO: 256381 - DNA, 40 bp, Artificial Sequence
  Description of Artificial Sequence: Synthetic oligonucleotide
atgatgcttgctgagttttcactgagtgagaaattagctg

SEQ ID NO: 256382 - DNA, 39 bp, Artificial Sequence
  Description of Artificial Sequence: Synthetic oligonucleotide
tgatgcttgctgagttttcactgagtgagaaattagctg

SEQ ID NO: 256383 - DNA, 38 bp, Artificial Sequence
  Description of Artificial Sequence: Synthetic oligonucleotide
gatgcttgctgagttttcactgagtgagaaattagctg

SEQ ID NO: 256384 - DNA, 38 bp, Artificial Sequence
  Description of Artificial Sequence: Synthetic oligonucleotide
atgcttgctgagttttcactgagtgagaaattagctgc

SEQ ID NO: 256385 - DNA, 37 bp, Artificial Sequence
  Description of Artificial Sequence: Synthetic oligonucleotide
tgcttgctgagttttcactgagtgagaaattagctgc

SEQ ID NO: 256386 - DNA, 36 bp, Artificial Sequence
  Description of Artificial Sequence: Synthetic oligonucleotide
gcttgctgagttttcactgagtgagaaattagctgc

SEQ ID NO: 256387 - DNA, 40 bp, Artificial Sequence
  Description of Artificial Sequence: Synthetic oligonucleotide
cttgctgagttttcactgagtgagaaattagctgcaaatc

SEQ ID NO: 256388 - DNA, 46 bp, Artificial Sequence
  Description of Artificial Sequence: Synthetic oligonucleotide
ttgctgagttttcactgagtgagaaattagctgcaaatctatatac

SEQ ID NO: 256389 - DNA, 45 bp, Artificial Sequence
  Description of Artificial Sequence: Synthetic oligonucleotide
tgctgagttttcactgagtgagaaattagctgcaaatctatatac

SEQ ID NO: 256390 - DNA, 44 bp, Artificial Sequence
  Description of Artificial Sequence: Synthetic oligonucleotide
gctgagttttcactgagtgagaaattagctgcaaatctatatac

SEQ ID NO: 256391 - DNA, 46 bp, Artificial Sequence
  Description of Artificial Sequence: Synthetic oligonucleotide
ctgagttttcactgagtgagaaattagctgcaaatctatatacttg

SEQ ID NO: 256392 - DNA, 46 bp, Artificial Sequence
  Description of Artificial Sequence: Synthetic oligonucleotide
tgagttttcactgagtgagaaattagctgcaaatctatatacttgc

SEQ ID NO: 256393 - DNA, 45 bp, Artificial Sequence
  Description of Artificial Sequence: Synthetic oligonucleotide
gagttttcactgagtgagaaattagctgcaaatctatatacttgc

SEQ ID NO: 256394 - DNA, 46 bp, Artificial Sequence
  Description of Artificial Sequence: Synthetic oligonucleotide
agttttcactgagtgagaaattagctgcaaatctatatacttgctc

SEQ ID NO: 256395 - DNA, 45 bp, Artificial Sequence
  Description of Artificial Sequence: Synthetic oligonucleotide
gttttcactgagtgagaaattagctgcaaatctatatacttgctc

SEQ ID NO: 256396 - DNA, 47 bp, Artificial Sequence
  Description of Artificial Sequence: Synthetic oligonucleotide
ttttcactgagtgagaaattagctgcaaatctatatacttgctcttc

SEQ ID NO: 256397 - DNA, 46 bp, Artificial Sequence
  Description of Artificial Sequence: Synthetic oligonucleotide
tttcactgagtgagaaattagctgcaaatctatatacttgctcttc

SEQ ID NO: 256398 - DNA, 45 bp, Artificial Sequence
  Description of Artificial Sequence: Synthetic oligonucleotide
ttcactgagtgagaaattagctgcaaatctatatacttgctcttc

SEQ ID NO: 256399 - DNA, 44 bp, Artificial Sequence
  Description of Artificial Sequence: Synthetic oligonucleotide
tcactgagtgagaaattagctgcaaatctatatacttgctcttc

SEQ ID NO: 256400 - DNA, 43 bp, Artificial Sequence
  Description of Artificial Sequence: Synthetic oligonucleotide
cactgagtgagaaattagctgcaaatctatatacttgctcttc

SEQ ID NO: 256401 - DNA, 45 bp, Artificial Sequence
  Description of Artificial Sequence: Synthetic oligonucleotide
actgagtgagaaattagctgcaaatctatatacttgctcttctag

SEQ ID NO: 256402 - DNA, 44 bp, Artificial Sequence
  Description of Artificial Sequence: Synthetic oligonucleotide
ctgagtgagaaattagctgcaaatctatatacttgctcttctag

SEQ ID NO: 256403 - DNA, 45 bp, Artificial Sequence
  Description of Artificial Sequence: Synthetic oligonucleotide
tgagtgagaaattagctgcaaatctatatacttgctcttctagac

SEQ ID NO: 256404 - DNA, 44 bp, Artificial Sequence
  Description of Artificial Sequence: Synthetic oligonucleotide
gagtgagaaattagctgcaaatctatatacttgctcttctagac

SEQ ID NO: 256405 - DNA, 44 bp, Artificial Sequence
  Description of Artificial Sequence: Synthetic oligonucleotide
agtgagaaattagctgcaaatctatatacttgctcttctagacg

SEQ ID NO: 256406 - DNA, 43 bp, Artificial Sequence
  Description of Artificial Sequence: Synthetic oligonucleotide
gtgagaaattagctgcaaatctatatacttgctcttctagacg

SEQ ID NO: 256407 - DNA, 44 bp, Artificial Sequence
  Description of Artificial Sequence: Synthetic oligonucleotide
tgagaaattagctgcaaatctatatacttgctcttctagacgac

SEQ ID NO: 256408 - DNA, 43 bp, Artificial Sequence
  Description of Artificial Sequence: Synthetic oligonucleotide
gagaaattagctgcaaatctatatacttgctcttctagacgac

SEQ ID NO: 256409 - DNA, 43 bp, Artificial Sequence
  Description of Artificial Sequence: Synthetic oligonucleotide
agaaattagctgcaaatctatatacttgctcttctagacgacc

SEQ ID NO: 256410 - DNA, 42 bp, Artificial Sequence
  Description of Artificial Sequence: Synthetic oligonucleotide
gaaattagctgcaaatctatatacttgctcttctagacgacc

SEQ ID NO: 256411 - DNA, 44 bp, Artificial Sequence
  Description of Artificial Sequence: Synthetic oligonucleotide
aaattagctgcaaatctatatacttgctcttctagacgacctag

SEQ ID NO: 256412 - DNA, 43 bp, Artificial Sequence
  Description of Artificial Sequence: Synthetic oligonucleotide
aattagctgcaaatctatatacttgctcttctagacgacctag

SEQ ID NO: 256413 - DNA, 42 bp, Artificial Sequence
  Description of Artificial Sequence: Synthetic oligonucleotide
attagctgcaaatctatatacttgctcttctagacgacctag

SEQ ID NO: 256414 - DNA, 41 bp, Artificial Sequence
  Description of Artificial Sequence: Synthetic oligonucleotide
ttagctgcaaatctatatacttgctcttctagacgacctag

SEQ ID NO: 256415 - DNA, 40 bp, Artificial Sequence
  Description of Artificial Sequence: Synthetic oligonucleotide
tagctgcaaatctatatacttgctcttctagacgacctag

SEQ ID NO: 256416 - DNA, 39 bp, Artificial Sequence
  Description of Artificial Sequence: Synthetic oligonucleotide
agctgcaaatctatatacttgctcttctagacgacctag

SEQ ID NO: 256417 - DNA, 38 bp, Artificial Sequence
  Description of Artificial Sequence: Synthetic oligonucleotide
gctgcaaatctatatacttgctcttctagacgacctag

SEQ ID NO: 256418 - DNA, 39 bp, Artificial Sequence
  Description of Artificial Sequence: Synthetic oligonucleotide
ctgcaaatctatatacttgctcttctagacgacctagtg

SEQ ID NO: 256419 - DNA, 39 bp, Artificial Sequence
  Description of Artificial Sequence: Synthetic oligonucleotide
tgcaaatctatatacttgctcttctagacgacctagtgg

SEQ ID NO: 256420 - DNA, 38 bp, Artificial Sequence
  Description of Artificial Sequence: Synthetic oligonucleotide
gcaaatctatatacttgctcttctagacgacctagtgg

SEQ ID NO: 256421 - DNA, 39 bp, Artificial Sequence
  Description of Artificial Sequence: Synthetic oligonucleotide
caaatctatatacttgctcttctagacgacctagtggtg

SEQ ID NO: 256422 - DNA, 40 bp, Artificial Sequence
  Description of Artificial Sequence: Synthetic oligonucleotide
aaatctatatacttgctcttctagacgacctagtggtgac

SEQ ID NO: 256423 - DNA, 39 bp, Artificial Sequence
  Description of Artificial Sequence: Synthetic oligonucleotide
aatctatatacttgctcttctagacgacctagtggtgac

SEQ ID NO: 256424 - DNA, 38 bp, Artificial Sequence
  Description of Artificial Sequence: Synthetic oligonucleotide
atctatatacttgctcttctagacgacctagtggtgac

SEQ ID NO: 256425 - DNA, 37 bp, Artificial Sequence
  Description of Artificial Sequence: Synthetic oligonucleotide
tctatatacttgctcttctagacgacctagtggtgac

SEQ ID NO: 256426 - DNA, 36 bp, Artificial Sequence
  Description of Artificial Sequence: Synthetic oligonucleotide
ctatatacttgctcttctagacgacctagtggtgac

SEQ ID NO: 256427 - DNA, 36 bp, Artificial Sequence
  Description of Artificial Sequence: Synthetic oligonucleotide
tatatacttgctcttctagacgacctagtggtgacg

SEQ ID NO: 256428 - DNA, 35 bp, Artificial Sequence
  Description of Artificial Sequence: Synthetic oligonucleotide
atatacttgctcttctagacgacctagtggtgacg

SEQ ID NO: 256429 - DNA, 34 bp, Artificial Sequence
  Description of Artificial Sequence: Synthetic oligonucleotide
tatacttgctcttctagacgacctagtggtgacg

SEQ ID NO: 256430 - DNA, 33 bp, Artificial Sequence
  Description of Artificial Sequence: Synthetic oligonucleotide
atacttgctcttctagacgacctagtggtgacg

SEQ ID NO: 256431 - DNA, 32 bp, Artificial Sequence
  Description of Artificial Sequence: Synthetic oligonucleotide
tacttgctcttctagacgacctagtggtgacg

SEQ ID NO: 256432 - DNA, 31 bp, Artificial Sequence
  Description of Artificial Sequence: Synthetic oligonucleotide
acttgctcttctagacgacctagtggtgacg

SEQ ID NO: 256433 - DNA, 30 bp, Artificial Sequence
  Description of Artificial Sequence: Synthetic oligonucleotide
cttgctcttctagacgacctagtggtgacg

SEQ ID NO: 256434 - DNA, 30 bp, Artificial Sequence
  Description of Artificial Sequence: Synthetic oligonucleotide
ttgctcttctagacgacctagtggtgacgg

SEQ ID NO: 256435 - DNA, 29 bp, Artificial Sequence
  Description of Artificial Sequence: Synthetic oligonucleotide
tgctcttctagacgacctagtggtgacgg

SEQ ID NO: 256436 - DNA, 28 bp, Artificial Sequence
  Description of Artificial Sequence: Synthetic oligonucleotide
gctcttctagacgacctagtggtgacgg

SEQ ID NO: 256437 - DNA, 28 bp, Artificial Sequence
  Description of Artificial Sequence: Synthetic oligonucleotide
ctcttctagacgacctagtggtgacggg

SEQ ID NO: 256438 - DNA, 28 bp, Artificial Sequence
  Description of Artificial Sequence: Synthetic oligonucleotide
tcttctagacgacctagtggtgacgggg

SEQ ID NO: 256439 - DNA, 27 bp, Artificial Sequence
  Description of Artificial Sequence: Synthetic oligonucleotide
cttctagacgacctagtggtgacgggg

SEQ ID NO: 256440 - DNA, 27 bp, Artificial Sequence
  Description of Artificial Sequence: Synthetic oligonucleotide
ttctagacgacctagtggtgacggggc

SEQ ID NO: 256441 - DNA, 26 bp, Artificial Sequence
  Description of Artificial Sequence: Synthetic oligonucleotide
tctagacgacctagtggtgacggggc

SEQ ID NO: 256442 - DNA, 25 bp, Artificial Sequence
  Description of Artificial Sequence: Synthetic oligonucleotide
ctagacgacctagtggtgacggggc

SEQ ID NO: 256443 - DNA, 25 bp, Artificial Sequence
  Description of Artificial Sequence: Synthetic oligonucleotide
tagacgacctagtggtgacggggcg

SEQ ID NO: 256444 - DNA, 24 bp, Artificial Sequence
  Description of Artificial Sequence: Synthetic oligonucleotide
agacgacctagtggtgacggggcg

SEQ ID NO: 256445 - DNA, 23 bp, Artificial Sequence
  Description of Artificial Sequence: Synthetic oligonucleotide
gacgacctagtggtgacggggcg

SEQ ID NO: 256446 - DNA, 25 bp, Artificial Sequence
  Description of Artificial Sequence: Synthetic oligonucleotide
acgacctagtggtgacggggcgctt

SEQ ID NO: 256447 - DNA, 24 bp, Artificial Sequence
  Description of Artificial Sequence: Synthetic oligonucleotide
cgacctagtggtgacggggcgctt

SEQ ID NO: 256448 - DNA, 24 bp, Artificial Sequence
  Description of Artificial Sequence: Synthetic oligonucleotide
gacctagtggtgacggggcgcttg

SEQ ID NO: 256449 - DNA, 25 bp, Artificial Sequence
  Description of Artificial Sequence: Synthetic oligonucleotide
acctagtggtgacggggcgcttggt

SEQ ID NO: 256450 - DNA, 24 bp, Artificial Sequence
  Description of Artificial Sequence: Synthetic oligonucleotide
cctagtggtgacggggcgcttggt

SEQ ID NO: 256451 - DNA, 25 bp, Artificial Sequence
  Description of Artificial Sequence: Synthetic oligonucleotide
ctagtggtgacggggcgcttggtgt

SEQ ID NO: 256452 - DNA, 26 bp, Artificial Sequence
  Description of Artificial Sequence: Synthetic oligonucleotide
tagtggtgacggggcgcttggtgtgt

SEQ ID NO: 256453 - DNA, 25 bp, Artificial Sequence
  Description of Artificial Sequence: Synthetic oligonucleotide
agtggtgacggggcgcttggtgtgt

SEQ ID NO: 256454 - DNA, 24 bp, Artificial Sequence
  Description of Artificial Sequence: Synthetic oligonucleotide
gtggtgacggggcgcttggtgtgt

SEQ ID NO: 256455 - DNA, 27 bp, Artificial Sequence
  Description of Artificial Sequence: Synthetic oligonucleotide
tggtgacggggcgcttggtgtgtgtat

SEQ ID NO: 256456 - DNA, 26 bp, Artificial Sequence
  Description of Artificial Sequence: Synthetic oligonucleotide
ggtgacggggcgcttggtgtgtgtat

SEQ ID NO: 256457 - DNA, 27 bp, Artificial Sequence
  Description of Artificial Sequence: Synthetic oligonucleotide
gtgacggggcgcttggtgtgtgtatca

SEQ ID NO: 256458 - DNA, 27 bp, Artificial Sequence
  Description of Artificial Sequence: Synthetic oligonucleotide
tgacggggcgcttggtgtgtgtatcag

SEQ ID NO: 256459 - DNA, 27 bp, Artificial Sequence
  Description of Artificial Sequence: Synthetic oligonucleotide
gacggggcgcttggtgtgtgtatcagt

SEQ ID NO: 256460 - DNA, 27 bp, Artificial Sequence
  Description of Artificial Sequence: Synthetic oligonucleotide
acggggcgcttggtgtgtgtatcagtg

SEQ ID NO: 256461 - DNA, 26 bp, Artificial Sequence
  Description of Artificial Sequence: Synthetic oligonucleotide
cggggcgcttggtgtgtgtatcagtg

SEQ ID NO: 256462 - DNA, 26 bp, Artificial Sequence
  Description of Artificial Sequence: Synthetic oligonucleotide
ggggcgcttggtgtgtgtatcagtgg

SEQ ID NO: 256463 - DNA, 26 bp, Artificial Sequence
  Description of Artificial Sequence: Synthetic oligonucleotide
gggcgcttggtgtgtgtatcagtggg

SEQ ID NO: 256464 - DNA, 26 bp, Artificial Sequence
  Description of Artificial Sequence: Synthetic oligonucleotide
ggcgcttggtgtgtgtatcagtgggc

SEQ ID NO: 256465 - DNA, 27 bp, Artificial Sequence
  Description of Artificial Sequence: Synthetic oligonucleotide
gcgcttggtgtgtgtatcagtgggcca

SEQ ID NO: 256466 - DNA, 27 bp, Artificial Sequence
  Description of Artificial Sequence: Synthetic oligonucleotide
cgcttggtgtgtgtatcagtgggccag

SEQ ID NO: 256467 - DNA, 27 bp, Artificial Sequence
  Description of Artificial Sequence: Synthetic oligonucleotide
gcttggtgtgtgtatcagtgggccagg

SEQ ID NO: 256468 - DNA, 28 bp, Artificial Sequence
  Description of Artificial Sequence: Synthetic oligonucleotide
cttggtgtgtgtatcagtgggccaggag

SEQ ID NO: 256469 - DNA, 28 bp, Artificial Sequence
  Description of Artificial Sequence: Synthetic oligonucleotide
ttggtgtgtgtatcagtgggccaggagg

SEQ ID NO: 256470 - DNA, 27 bp, Artificial Sequence
  Description of Artificial Sequence: Synthetic oligonucleotide
tggtgtgtgtatcagtgggccaggagg

SEQ ID NO: 256471 - DNA, 27 bp, Artificial Sequence
  Description of Artificial Sequence: Synthetic oligonucleotide
ggtgtgtgtatcagtgggccaggaggt

SEQ ID NO: 256472 - DNA, 27 bp, Artificial Sequence
  Description of Artificial Sequence: Synthetic oligonucleotide
gtgtgtgtatcagtgggccaggaggtg

SEQ ID NO: 256473 - DNA, 27 bp, Artificial Sequence
  Description of Artificial Sequence: Synthetic oligonucleotide
tgtgtgtatcagtgggccaggaggtgc

SEQ ID NO: 256474 - DNA, 26 bp, Artificial Sequence
  Description of Artificial Sequence: Synthetic oligonucleotide
gtgtgtatcagtgggccaggaggtgc

SEQ ID NO: 256475 - DNA, 27 bp, Artificial Sequence
  Description of Artificial Sequence: Synthetic oligonucleotide
tgtgtatcagtgggccaggaggtgcca

SEQ ID NO: 256476 - DNA, 27 bp, Artificial Sequence
  Description of Artificial Sequence: Synthetic oligonucleotide
gtgtatcagtgggccaggaggtgccat

SEQ ID NO: 256477 - DNA, 28 bp, Artificial Sequence
  Description of Artificial Sequence: Synthetic oligonucleotide
tgtatcagtgggccaggaggtgccattg

SEQ ID NO: 256478 - DNA, 27 bp, Artificial Sequence
  Description of Artificial Sequence: Synthetic oligonucleotide
gtatcagtgggccaggaggtgccattg

SEQ ID NO: 256479 - DNA, 27 bp, Artificial Sequence
  Description of Artificial Sequence: Synthetic oligonucleotide
tatcagtgggccaggaggtgccattgc

SEQ ID NO: 256480 - DNA, 27 bp, Artificial Sequence
  Description of Artificial Sequence: Synthetic oligonucleotide
atcagtgggccaggaggtgccattgct

SEQ ID NO: 256481 - DNA, 27 bp, Artificial Sequence
  Description of Artificial Sequence: Synthetic oligonucleotide
tcagtgggccaggaggtgccattgcta

SEQ ID NO: 256482 - DNA, 26 bp, Artificial Sequence
  Description of Artificial Sequence: Synthetic oligonucleotide
cagtgggccaggaggtgccattgcta

SEQ ID NO: 256483 - DNA, 27 bp, Artificial Sequence
  Description of Artificial Sequence: Synthetic oligonucleotide
agtgggccaggaggtgccattgctact

SEQ ID NO: 256484 - DNA, 26 bp, Artificial Sequence
  Description of Artificial Sequence: Synthetic oligonucleotide
gtgggccaggaggtgccattgctact

SEQ ID NO: 256485 - DNA, 27 bp, Artificial Sequence
  Description of Artificial Sequence: Synthetic oligonucleotide
tgggccaggaggtgccattgctactgt

SEQ ID NO: 256486 - DNA, 27 bp, Artificial Sequence
  Description of Artificial Sequence: Synthetic oligonucleotide
gggccaggaggtgccattgctactgtt

SEQ ID NO: 256487 - DNA, 27 bp, Artificial Sequence
  Description of Artificial Sequence: Synthetic oligonucleotide
ggccaggaggtgccattgctactgttc

SEQ ID NO: 256488 - DNA, 27 bp, Artificial Sequence
  Description of Artificial Sequence: Synthetic oligonucleotide
gccaggaggtgccattgctactgttcc

SEQ ID NO: 256489 - DNA, 30 bp, Artificial Sequence
  Description of Artificial Sequence: Synthetic oligonucleotide
ccaggaggtgccattgctactgttcctatc

SEQ ID NO: 256490 - DNA, 31 bp, Artificial Sequence
  Description of Artificial Sequence: Synthetic oligonucleotide
caggaggtgccattgctactgttcctatctg

SEQ ID NO: 256491 - DNA, 31 bp, Artificial Sequence
  Description of Artificial Sequence: Synthetic oligonucleotide
aggaggtgccattgctactgttcctatctgg

SEQ ID NO: 256492 - DNA, 30 bp, Artificial Sequence
  Description of Artificial Sequence: Synthetic oligonucleotide
ggaggtgccattgctactgttcctatctgg

SEQ ID NO: 256493 - DNA, 31 bp, Artificial Sequence
  Description of Artificial Sequence: Synthetic oligonucleotide
gaggtgccattgctactgttcctatctggac

SEQ ID NO: 256494 - DNA, 32 bp, Artificial Sequence
  Description of Artificial Sequence: Synthetic oligonucleotide
aggtgccattgctactgttcctatctggacac

SEQ ID NO: 256495 - DNA, 31 bp, Artificial Sequence
  Description of Artificial Sequence: Synthetic oligonucleotide
ggtgccattgctactgttcctatctggacac

SEQ ID NO: 256496 - DNA, 32 bp, Artificial Sequence
  Description of Artificial Sequence: Synthetic oligonucleotide
gtgccattgctactgttcctatctggacactc

SEQ ID NO: 256497 - DNA, 33 bp, Artificial Sequence
  Description of Artificial Sequence: Synthetic oligonucleotide
tgccattgctactgttcctatctggacactcag

SEQ ID NO: 256498 - DNA, 32 bp, Artificial Sequence
  Description of Artificial Sequence: Synthetic oligonucleotide
gccattgctactgttcctatctggacactcag

SEQ ID NO: 256499 - DNA, 33 bp, Artificial Sequence
  Description of Artificial Sequence: Synthetic oligonucleotide
ccattgctactgttcctatctggacactcagag

SEQ ID NO: 256500 - DNA, 33 bp, Artificial Sequence
  Description of Artificial Sequence: Synthetic oligonucleotide
cattgctactgttcctatctggacactcagagg

SEQ ID NO: 256501 - DNA, 33 bp, Artificial Sequence
  Description of Artificial Sequence: Synthetic oligonucleotide
attgctactgttcctatctggacactcagaggg

SEQ ID NO: 256502 - DNA, 32 bp, Artificial Sequence
  Description of Artificial Sequence: Synthetic oligonucleotide
ttgctactgttcctatctggacactcagaggg

SEQ ID NO: 256503 - DNA, 31 bp, Artificial Sequence
  Description of Artificial Sequence: Synthetic oligonucleotide
tgctactgttcctatctggacactcagaggg

SEQ ID NO: 256504 - DNA, 30 bp, Artificial Sequence
  Description of Artificial Sequence: Synthetic oligonucleotide
gctactgttcctatctggacactcagaggg

SEQ ID NO: 256505 - DNA, 31 bp, Artificial Sequence
  Description of Artificial Sequence: Synthetic oligonucleotide
ctactgttcctatctggacactcagagggac

SEQ ID NO: 256506 - DNA, 31 bp, Artificial Sequence
  Description of Artificial Sequence: Synthetic oligonucleotide
tactgttcctatctggacactcagagggacg

SEQ ID NO: 256507 - DNA, 30 bp, Artificial Sequence
  Description of Artificial Sequence: Synthetic oligonucleotide
actgttcctatctggacactcagagggacg

SEQ ID NO: 256508 - DNA, 29 bp, Artificial Sequence
  Description of Artificial Sequence: Synthetic oligonucleotide
ctgttcctatctggacactcagagggacg

SEQ ID NO: 256509 - DNA, 29 bp, Artificial Sequence
  Description of Artificial Sequence: Synthetic oligonucleotide
tgttcctatctggacactcagagggacgg

SEQ ID NO: 256510 - DNA, 28 bp, Artificial Sequence
  Description of Artificial Sequence: Synthetic oligonucleotide
gttcctatctggacactcagagggacgg

SEQ ID NO: 256511 - DNA, 29 bp, Artificial Sequence
  Description of Artificial Sequence: Synthetic oligonucleotide
ttcctatctggacactcagagggacggag

SEQ ID NO: 256512 - DNA, 28 bp, Artificial Sequence
  Description of Artificial Sequence: Synthetic oligonucleotide
tcctatctggacactcagagggacggag

SEQ ID NO: 256513 - DNA, 27 bp, Artificial Sequence
  Description of Artificial Sequence: Synthetic oligonucleotide
cctatctggacactcagagggacggag

SEQ ID NO: 256514 - DNA, 27 bp, Artificial Sequence
  Description of Artificial Sequence: Synthetic oligonucleotide
ctatctggacactcagagggacggagc

SEQ ID NO: 256515 - DNA, 28 bp, Artificial Sequence
  Description of Artificial Sequence: Synthetic oligonucleotide
tatctggacactcagagggacggagctg

SEQ ID NO: 256516 - DNA, 27 bp, Artificial Sequence
  Description of Artificial Sequence: Synthetic oligonucleotide
atctggacactcagagggacggagctg

SEQ ID NO: 256517 - DNA, 27 bp, Artificial Sequence
  Description of Artificial Sequence: Synthetic oligonucleotide
tctggacactcagagggacggagctga

SEQ ID NO: 256518 - DNA, 27 bp, Artificial Sequence
  Description of Artificial Sequence: Synthetic oligonucleotide
ctggacactcagagggacggagctgat

SEQ ID NO: 256519 - DNA, 27 bp, Artificial Sequence
  Description of Artificial Sequence: Synthetic oligonucleotide
tggacactcagagggacggagctgatg

SEQ ID NO: 256520 - DNA, 27 bp, Artificial Sequence
  Description of Artificial Sequence: Synthetic oligonucleotide
ggacactcagagggacggagctgatga

SEQ ID NO: 256521 - DNA, 29 bp, Artificial Sequence
  Description of Artificial Sequence: Synthetic oligonucleotide
gacactcagagggacggagctgatgattg

SEQ ID NO: 256522 - DNA, 29 bp, Artificial Sequence
  Description of Artificial Sequence: Synthetic oligonucleotide
acactcagagggacggagctgatgattgg

SEQ ID NO: 256523 - DNA, 28 bp, Artificial Sequence
  Description of Artificial Sequence: Synthetic oligonucleotide
cactcagagggacggagctgatgattgg

SEQ ID NO: 256524 - DNA, 30 bp, Artificial Sequence
  Description of Artificial Sequence: Synthetic oligonucleotide
actcagagggacggagctgatgattggaac

SEQ ID NO: 256525 - DNA, 29 bp, Artificial Sequence
  Description of Artificial Sequence: Synthetic oligonucleotide
ctcagagggacggagctgatgattggaac

SEQ ID NO: 256526 - DNA, 31 bp, Artificial Sequence
  Description of Artificial Sequence: Synthetic oligonucleotide
tcagagggacggagctgatgattggaacatc

SEQ ID NO: 256527 - DNA, 30 bp, Artificial Sequence
  Description of Artificial Sequence: Synthetic oligonucleotide
cagagggacggagctgatgattggaacatc

SEQ ID NO: 256528 - DNA, 33 bp, Artificial Sequence
  Description of Artificial Sequence: Synthetic oligonucleotide
agagggacggagctgatgattggaacatcaatg

SEQ ID NO: 256529 - DNA, 32 bp, Artificial Sequence
  Description of Artificial Sequence: Synthetic oligonucleotide
gagggacggagctgatgattggaacatcaatg

SEQ ID NO: 256530 - DNA, 33 bp, Artificial Sequence
  Description of Artificial Sequence: Synthetic oligonucleotide
agggacggagctgatgattggaacatcaatgtc

SEQ ID NO: 256531 - DNA, 32 bp, Artificial Sequence
  Description of Artificial Sequence: Synthetic oligonucleotide
gggacggagctgatgattggaacatcaatgtc

SEQ ID NO: 256532 - DNA, 34 bp, Artificial Sequence
  Description of Artificial Sequence: Synthetic oligonucleotide
ggacggagctgatgattggaacatcaatgtcttc

SEQ ID NO: 256533 - DNA, 34 bp, Artificial Sequence
  Description of Artificial Sequence: Synthetic oligonucleotide
gacggagctgatgattggaacatcaatgtcttcc

SEQ ID NO: 256534 - DNA, 34 bp, Artificial Sequence
  Description of Artificial Sequence: Synthetic oligonucleotide
acggagctgatgattggaacatcaatgtcttccg

SEQ ID NO: 256535 - DNA, 33 bp, Artificial Sequence
  Description of Artificial Sequence: Synthetic oligonucleotide
cggagctgatgattggaacatcaatgtcttccg

SEQ ID NO: 256536 - DNA, 33 bp, Artificial Sequence
  Description of Artificial Sequence: Synthetic oligonucleotide
ggagctgatgattggaacatcaatgtcttccgc

SEQ ID NO: 256537 - DNA, 33 bp, Artificial Sequence
  Description of Artificial Sequence: Synthetic oligonucleotide
gagctgatgattggaacatcaatgtcttccgcc

SEQ ID NO: 256538 - DNA, 36 bp, Artificial Sequence
  Description of Artificial Sequence: Synthetic oligonucleotide
agctgatgattggaacatcaatgtcttccgccaatg

SEQ ID NO: 256539 - DNA, 35 bp, Artificial Sequence
  Description of Artificial Sequence: Synthetic oligonucleotide
gctgatgattggaacatcaatgtcttccgccaatg

SEQ ID NO: 256540 - DNA, 35 bp, Artificial Sequence
  Description of Artificial Sequence: Synthetic oligonucleotide
ctgatgattggaacatcaatgtcttccgccaatgc

SEQ ID NO: 256541 - DNA, 37 bp, Artificial Sequence
  Description of Artificial Sequence: Synthetic oligonucleotide
tgatgattggaacatcaatgtcttccgccaatgcatc

SEQ ID NO: 256542 - DNA, 36 bp, Artificial Sequence
  Description of Artificial Sequence: Synthetic oligonucleotide
gatgattggaacatcaatgtcttccgccaatgcatc

SEQ ID NO: 256543 - DNA, 37 bp, Artificial Sequence
  Description of Artificial Sequence: Synthetic oligonucleotide
atgattggaacatcaatgtcttccgccaatgcatctg

SEQ ID NO: 256544 - DNA, 36 bp, Artificial Sequence
  Description of Artificial Sequence: Synthetic oligonucleotide
tgattggaacatcaatgtcttccgccaatgcatctg

SEQ ID NO: 256545 - DNA, 35 bp, Artificial Sequence
  Description of Artificial Sequence: Synthetic oligonucleotide
gattggaacatcaatgtcttccgccaatgcatctg

SEQ ID NO: 256546 - DNA, 35 bp, Artificial Sequence
  Description of Artificial Sequence: Synthetic oligonucleotide
attggaacatcaatgtcttccgccaatgcatctgg

SEQ ID NO: 256547 - DNA, 34 bp, Artificial Sequence
  Description of Artificial Sequence: Synthetic oligonucleotide
ttggaacatcaatgtcttccgccaatgcatctgg

SEQ ID NO: 256548 - DNA, 33 bp, Artificial Sequence
  Description of Artificial Sequence: Synthetic oligonucleotide
tggaacatcaatgtcttccgccaatgcatctgg

SEQ ID NO: 256549 - DNA, 32 bp, Artificial Sequence
  Description of Artificial Sequence: Synthetic oligonucleotide
ggaacatcaatgtcttccgccaatgcatctgg

SEQ ID NO: 256550 - DNA, 33 bp, Artificial Sequence
  Description of Artificial Sequence: Synthetic oligonucleotide
gaacatcaatgtcttccgccaatgcatctggag

SEQ ID NO: 256551 - DNA, 33 bp, Artificial Sequence
  Description of Artificial Sequence: Synthetic oligonucleotide
aacatcaatgtcttccgccaatgcatctggagg

SEQ ID NO: 256552 - DNA, 32 bp, Artificial Sequence
  Description of Artificial Sequence: Synthetic oligonucleotide
acatcaatgtcttccgccaatgcatctggagg

SEQ ID NO: 256553 - DNA, 31 bp, Artificial Sequence
  Description of Artificial Sequence: Synthetic oligonucleotide
catcaatgtcttccgccaatgcatctggagg

SEQ ID NO: 256554 - DNA, 31 bp, Artificial Sequence
  Description of Artificial Sequence: Synthetic oligonucleotide
atcaatgtcttccgccaatgcatctggaggc

SEQ ID NO: 256555 - DNA, 30 bp, Artificial Sequence
  Description of Artificial Sequence: Synthetic oligonucleotide
tcaatgtcttccgccaatgcatctggaggc

SEQ ID NO: 256556 - DNA, 29 bp, Artificial Sequence
  Description of Artificial Sequence: Synthetic oligonucleotide
caatgtcttccgccaatgcatctggaggc

SEQ ID NO: 256557 - DNA, 32 bp, Artificial Sequence
  Description of Artificial Sequence: Synthetic oligonucleotide
aatgtcttccgccaatgcatctggaggcatag

SEQ ID NO: 256558 - DNA, 31 bp, Artificial Sequence
  Description of Artificial Sequence: Synthetic oligonucleotide
atgtcttccgccaatgcatctggaggcatag

SEQ ID NO: 256559 - DNA, 30 bp, Artificial Sequence
  Description of Artificial Sequence: Synthetic oligonucleotide
tgtcttccgccaatgcatctggaggcatag

SEQ ID NO: 256560 - DNA, 29 bp, Artificial Sequence
  Description of Artificial Sequence: Synthetic oligonucleotide
gtcttccgccaatgcatctggaggcatag

SEQ ID NO: 256561 - DNA, 29 bp, Artificial Sequence
  Description of Artificial Sequence: Synthetic oligonucleotide
tcttccgccaatgcatctggaggcatagc

SEQ ID NO: 256562 - DNA, 28 bp, Artificial Sequence
  Description of Artificial Sequence: Synthetic oligonucleotide
cttccgccaatgcatctggaggcatagc

SEQ ID NO: 256563 - DNA, 28 bp, Artificial Sequence
  Description of Artificial Sequence: Synthetic oligonucleotide
ttccgccaatgcatctggaggcatagcc

SEQ ID NO: 256564 - DNA, 27 bp, Artificial Sequence
  Description of Artificial Sequence: Synthetic oligonucleotide
tccgccaatgcatctggaggcatagcc

SEQ ID NO: 256565 - DNA, 26 bp, Artificial Sequence
  Description of Artificial Sequence: Synthetic oligonucleotide
ccgccaatgcatctggaggcatagcc

SEQ ID NO: 256566 - DNA, 27 bp, Artificial Sequence
  Description of Artificial Sequence: Synthetic oligonucleotide
cgccaatgcatctggaggcatagccct

SEQ ID NO: 256567 - DNA, 27 bp, Artificial Sequence
  Description of Artificial Sequence: Synthetic oligonucleotide
gccaatgcatctggaggcatagccctg

SEQ ID NO: 256568 - DNA, 29 bp, Artificial Sequence
  Description of Artificial Sequence: Synthetic oligonucleotide
ccaatgcatctggaggcatagccctgatc

SEQ ID NO: 256569 - DNA, 29 bp, Artificial Sequence
  Description of Artificial Sequence: Synthetic oligonucleotide
caatgcatctggaggcatagccctgatcg

SEQ ID NO: 256570 - DNA, 32 bp, Artificial Sequence
  Description of Artificial Sequence: Synthetic oligonucleotide
aatgcatctggaggcatagccctgatcgtttc

SEQ ID NO: 256571 - DNA, 31 bp, Artificial Sequence
  Description of Artificial Sequence: Synthetic oligonucleotide
atgcatctggaggcatagccctgatcgtttc

SEQ ID NO: 256572 - DNA, 30 bp, Artificial Sequence
  Description of Artificial Sequence: Synthetic oligonucleotide
tgcatctggaggcatagccctgatcgtttc

SEQ ID NO: 256573 - DNA, 29 bp, Artificial Sequence
  Description of Artificial Sequence: Synthetic oligonucleotide
gcatctggaggcatagccctgatcgtttc

SEQ ID NO: 256574 - DNA, 30 bp, Artificial Sequence
  Description of Artificial Sequence: Synthetic oligonucleotide
catctggaggcatagccctgatcgtttcag

SEQ ID NO: 256575 - DNA, 30 bp, Artificial Sequence
  Description of Artificial Sequence: Synthetic oligonucleotide
atctggaggcatagccctgatcgtttcagg

SEQ ID NO: 256576 - DNA, 29 bp, Artificial Sequence
  Description of Artificial Sequence: Synthetic oligonucleotide
tctggaggcatagccctgatcgtttcagg

SEQ ID NO: 256577 - DNA, 28 bp, Artificial Sequence
  Description of Artificial Sequence: Synthetic oligonucleotide
ctggaggcatagccctgatcgtttcagg

SEQ ID NO: 256578 - DNA, 29 bp, Artificial Sequence
  Description of Artificial Sequence: Synthetic oligonucleotide
tggaggcatagccctgatcgtttcaggtc

SEQ ID NO: 256579 - DNA, 28 bp, Artificial Sequence
  Description of Artificial Sequence: Synthetic oligonucleotide
ggaggcatagccctgatcgtttcaggtc

SEQ ID NO: 256580 - DNA, 29 bp, Artificial Sequence
  Description of Artificial Sequence: Synthetic oligonucleotide
gaggcatagccctgatcgtttcaggtcag

SEQ ID NO: 256581 - DNA, 32 bp, Artificial Sequence
  Description of Artificial Sequence: Synthetic oligonucleotide
aggcatagccctgatcgtttcaggtcagaaag

SEQ ID NO: 256582 - DNA, 31 bp, Artificial Sequence
  Description of Artificial Sequence: Synthetic oligonucleotide
ggcatagccctgatcgtttcaggtcagaaag

SEQ ID NO: 256583 - DNA, 31 bp, Artificial Sequence
  Description of Artificial Sequence: Synthetic oligonucleotide
gcatagccctgatcgtttcaggtcagaaagc

SEQ ID NO: 256584 - DNA, 37 bp, Artificial Sequence
  Description of Artificial Sequence: Synthetic oligonucleotide
catagccctgatcgtttcaggtcagaaagctaaaaac

SEQ ID NO: 256585 - DNA, 40 bp, Artificial Sequence
  Description of Artificial Sequence: Synthetic oligonucleotide
atagccctgatcgtttcaggtcagaaagctaaaaacattg

SEQ ID NO: 256586 - DNA, 39 bp, Artificial Sequence
  Description of Artificial Sequence: Synthetic oligonucleotide
tagccctgatcgtttcaggtcagaaagctaaaaacattg

SEQ ID NO: 256587 - DNA, 38 bp, Artificial Sequence
  Description of Artificial Sequence: Synthetic oligonucleotide
agccctgatcgtttcaggtcagaaagctaaaaacattg

SEQ ID NO: 256588 - DNA, 37 bp, Artificial Sequence
  Description of Artificial Sequence: Synthetic oligonucleotide
gccctgatcgtttcaggtcagaaagctaaaaacattg

SEQ ID NO: 256589 - DNA, 38 bp, Artificial Sequence
  Description of Artificial Sequence: Synthetic oligonucleotide
ccctgatcgtttcaggtcagaaagctaaaaacattgac

SEQ ID NO: 256590 - DNA, 40 bp, Artificial Sequence
  Description of Artificial Sequence: Synthetic oligonucleotide
cctgatcgtttcaggtcagaaagctaaaaacattgacaac

SEQ ID NO: 256591 - DNA, 41 bp, Artificial Sequence
  Description of Artificial Sequence: Synthetic oligonucleotide
ctgatcgtttcaggtcagaaagctaaaaacattgacaacac

SEQ ID NO: 256592 - DNA, 42 bp, Artificial Sequence
  Description of Artificial Sequence: Synthetic oligonucleotide
tgatcgtttcaggtcagaaagctaaaaacattgacaacacag

SEQ ID NO: 256593 - DNA, 41 bp, Artificial Sequence
  Description of Artificial Sequence: Synthetic oligonucleotide
gatcgtttcaggtcagaaagctaaaaacattgacaacacag

SEQ ID NO: 256594 - DNA, 43 bp, Artificial Sequence
  Description of Artificial Sequence: Synthetic oligonucleotide
atcgtttcaggtcagaaagctaaaaacattgacaacacagttc

SEQ ID NO: 256595 - DNA, 42 bp, Artificial Sequence
  Description of Artificial Sequence: Synthetic oligonucleotide
tcgtttcaggtcagaaagctaaaaacattgacaacacagttc

SEQ ID NO: 256596 - DNA, 41 bp, Artificial Sequence
  Description of Artificial Sequence: Synthetic oligonucleotide
cgtttcaggtcagaaagctaaaaacattgacaacacagttc

SEQ ID NO: 256597 - DNA, 44 bp, Artificial Sequence
  Description of Artificial Sequence: Synthetic oligonucleotide
gtttcaggtcagaaagctaaaaacattgacaacacagttctttc

SEQ ID NO: 256598 - DNA, 45 bp, Artificial Sequence
  Description of Artificial Sequence: Synthetic oligonucleotide
tttcaggtcagaaagctaaaaacattgacaacacagttctttcag

SEQ ID NO: 256599 - DNA, 44 bp, Artificial Sequence
  Description of Artificial Sequence: Synthetic oligonucleotide
ttcaggtcagaaagctaaaaacattgacaacacagttctttcag

SEQ ID NO: 256600 - DNA, 43 bp, Artificial Sequence
  Description of Artificial Sequence: Synthetic oligonucleotide
tcaggtcagaaagctaaaaacattgacaacacagttctttcag

SEQ ID NO: 256601 - DNA, 42 bp, Artificial Sequence
  Description of Artificial Sequence: Synthetic oligonucleotide
caggtcagaaagctaaaaacattgacaacacagttctttcag

SEQ ID NO: 256602 - DNA, 43 bp, Artificial Sequence
  Description of Artificial Sequence: Synthetic oligonucleotide
aggtcagaaagctaaaaacattgacaacacagttctttcagtc

SEQ ID NO: 256603 - DNA, 42 bp, Artificial Sequence
  Description of Artificial Sequence: Synthetic oligonucleotide
ggtcagaaagctaaaaacattgacaacacagttctttcagtc

SEQ ID NO: 256604 - DNA, 43 bp, Artificial Sequence
  Description of Artificial Sequence: Synthetic oligonucleotide
gtcagaaagctaaaaacattgacaacacagttctttcagtcag

SEQ ID NO: 256605 - DNA, 45 bp, Artificial Sequence
  Description of Artificial Sequence: Synthetic oligonucleotide
tcagaaagctaaaaacattgacaacacagttctttcagtcagtag

SEQ ID NO: 256606 - DNA, 44 bp, Artificial Sequence
  Description of Artificial Sequence: Synthetic oligonucleotide
cagaaagctaaaaacattgacaacacagttctttcagtcagtag

SEQ ID NO: 256607 - DNA, 45 bp, Artificial Sequence
  Description of Artificial Sequence: Synthetic oligonucleotide
agaaagctaaaaacattgacaacacagttctttcagtcagtagag

SEQ ID NO: 256608 - DNA, 44 bp, Artificial Sequence
  Description of Artificial Sequence: Synthetic oligonucleotide
gaaagctaaaaacattgacaacacagttctttcagtcagtagag

SEQ ID NO: 256609 - DNA, 44 bp, Artificial Sequence
  Description of Artificial Sequence: Synthetic oligonucleotide
aaagctaaaaacattgacaacacagttctttcagtcagtagagc

SEQ ID NO: 256610 - DNA, 43 bp, Artificial Sequence
  Description of Artificial Sequence: Synthetic oligonucleotide
aagctaaaaacattgacaacacagttctttcagtcagtagagc

SEQ ID NO: 256611 - DNA, 42 bp, Artificial Sequence
  Description of Artificial Sequence: Synthetic oligonucleotide
agctaaaaacattgacaacacagttctttcagtcagtagagc

SEQ ID NO: 256612 - DNA, 41 bp, Artificial Sequence
  Description of Artificial Sequence: Synthetic oligonucleotide
gctaaaaacattgacaacacagttctttcagtcagtagagc

SEQ ID NO: 256613 - DNA, 42 bp, Artificial Sequence
  Description of Artificial Sequence: Synthetic oligonucleotide
ctaaaaacattgacaacacagttctttcagtcagtagagctc

SEQ ID NO: 256614 - DNA, 44 bp, Artificial Sequence
  Description of Artificial Sequence: Synthetic oligonucleotide
taaaaacattgacaacacagttctttcagtcagtagagctctac

SEQ ID NO: 256615 - DNA, 43 bp, Artificial Sequence
  Description of Artificial Sequence: Synthetic oligonucleotide
aaaaacattgacaacacagttctttcagtcagtagagctctac

SEQ ID NO: 256616 - DNA, 42 bp, Artificial Sequence
  Description of Artificial Sequence: Synthetic oligonucleotide
aaaacattgacaacacagttctttcagtcagtagagctctac

SEQ ID NO: 256617 - DNA, 41 bp, Artificial Sequence
  Description of Artificial Sequence: Synthetic oligonucleotide
aaacattgacaacacagttctttcagtcagtagagctctac

SEQ ID NO: 256618 - DNA, 40 bp, Artificial Sequence
  Description of Artificial Sequence: Synthetic oligonucleotide
aacattgacaacacagttctttcagtcagtagagctctac

SEQ ID NO: 256619 - DNA, 39 bp, Artificial Sequence
  Description of Artificial Sequence: Synthetic oligonucleotide
acattgacaacacagttctttcagtcagtagagctctac

SEQ ID NO: 256620 - DNA, 38 bp, Artificial Sequence
  Description of Artificial Sequence: Synthetic oligonucleotide
cattgacaacacagttctttcagtcagtagagctctac

SEQ ID NO: 256621 - DNA, 42 bp, Artificial Sequence
  Description of Artificial Sequence: Synthetic oligonucleotide
attgacaacacagttctttcagtcagtagagctctacaaaac

SEQ ID NO: 256622 - DNA, 41 bp, Artificial Sequence
  Description of Artificial Sequence: Synthetic oligonucleotide
ttgacaacacagttctttcagtcagtagagctctacaaaac

SEQ ID NO: 256623 - DNA, 40 bp, Artificial Sequence
  Description of Artificial Sequence: Synthetic oligonucleotide
tgacaacacagttctttcagtcagtagagctctacaaaac

SEQ ID NO: 256624 - DNA, 39 bp, Artificial Sequence
  Description of Artificial Sequence: Synthetic oligonucleotide
gacaacacagttctttcagtcagtagagctctacaaaac

SEQ ID NO: 256625 - DNA, 40 bp, Artificial Sequence
  Description of Artificial Sequence: Synthetic oligonucleotide
acaacacagttctttcagtcagtagagctctacaaaacac

SEQ ID NO: 256626 - DNA, 39 bp, Artificial Sequence
  Description of Artificial Sequence: Synthetic oligonucleotide
caacacagttctttcagtcagtagagctctacaaaacac

SEQ ID NO: 256627 - DNA, 40 bp, Artificial Sequence
  Description of Artificial Sequence: Synthetic oligonucleotide
aacacagttctttcagtcagtagagctctacaaaacactg

SEQ ID NO: 256628 - DNA, 39 bp, Artificial Sequence
  Description of Artificial Sequence: Synthetic oligonucleotide
acacagttctttcagtcagtagagctctacaaaacactg

SEQ ID NO: 256629 - DNA, 38 bp, Artificial Sequence
  Description of Artificial Sequence: Synthetic oligonucleotide
cacagttctttcagtcagtagagctctacaaaacactg

SEQ ID NO: 256630 - DNA, 38 bp, Artificial Sequence
  Description of Artificial Sequence: Synthetic oligonucleotide
acagttctttcagtcagtagagctctacaaaacactgg

SEQ ID NO: 256631 - DNA, 37 bp, Artificial Sequence
  Description of Artificial Sequence: Synthetic oligonucleotide
cagttctttcagtcagtagagctctacaaaacactgg

SEQ ID NO: 256632 - DNA, 38 bp, Artificial Sequence
  Description of Artificial Sequence: Synthetic oligonucleotide
agttctttcagtcagtagagctctacaaaacactggag

SEQ ID NO: 256633 - DNA, 37 bp, Artificial Sequence
  Description of Artificial Sequence: Synthetic oligonucleotide
gttctttcagtcagtagagctctacaaaacactggag

SEQ ID NO: 256634 - DNA, 38 bp, Artificial Sequence
  Description of Artificial Sequence: Synthetic oligonucleotide
ttctttcagtcagtagagctctacaaaacactggagtg

SEQ ID NO: 256635 - DNA, 37 bp, Artificial Sequence
  Description of Artificial Sequence: Synthetic oligonucleotide
tctttcagtcagtagagctctacaaaacactggagtg

SEQ ID NO: 256636 - DNA, 36 bp, Artificial Sequence
  Description of Artificial Sequence: Synthetic oligonucleotide
ctttcagtcagtagagctctacaaaacactggagtg

SEQ ID NO: 256637 - DNA, 38 bp, Artificial Sequence
  Description of Artificial Sequence: Synthetic oligonucleotide
tttcagtcagtagagctctacaaaacactggagtgaag

SEQ ID NO: 256638 - DNA, 37 bp, Artificial Sequence
  Description of Artificial Sequence: Synthetic oligonucleotide
ttcagtcagtagagctctacaaaacactggagtgaag

SEQ ID NO: 256639 - DNA, 36 bp, Artificial Sequence
  Description of Artificial Sequence: Synthetic oligonucleotide
tcagtcagtagagctctacaaaacactggagtgaag

SEQ ID NO: 256640 - DNA, 35 bp, Artificial Sequence
  Description of Artificial Sequence: Synthetic oligonucleotide
cagtcagtagagctctacaaaacactggagtgaag

SEQ ID NO: 256641 - DNA, 35 bp, Artificial Sequence
  Description of Artificial Sequence: Synthetic oligonucleotide
agtcagtagagctctacaaaacactggagtgaagg

SEQ ID NO: 256642 - DNA, 34 bp, Artificial Sequence
  Description of Artificial Sequence: Synthetic oligonucleotide
gtcagtagagctctacaaaacactggagtgaagg

SEQ ID NO: 256643 - DNA, 34 bp, Artificial Sequence
  Description of Artificial Sequence: Synthetic oligonucleotide
tcagtagagctctacaaaacactggagtgaaggc

SEQ ID NO: 256644 - DNA, 33 bp, Artificial Sequence
  Description of Artificial Sequence: Synthetic oligonucleotide
cagtagagctctacaaaacactggagtgaaggc

SEQ ID NO: 256645 - DNA, 34 bp, Artificial Sequence
  Description of Artificial Sequence: Synthetic oligonucleotide
agtagagctctacaaaacactggagtgaaggcag

SEQ ID NO: 256646 - DNA, 33 bp, Artificial Sequence
  Description of Artificial Sequence: Synthetic oligonucleotide
gtagagctctacaaaacactggagtgaaggcag

SEQ ID NO: 256647 - DNA, 34 bp, Artificial Sequence
  Description of Artificial Sequence: Synthetic oligonucleotide
tagagctctacaaaacactggagtgaaggcagac

SEQ ID NO: 256648 - DNA, 33 bp, Artificial Sequence
  Description of Artificial Sequence: Synthetic oligonucleotide
agagctctacaaaacactggagtgaaggcagac

SEQ ID NO: 256649 - DNA, 32 bp, Artificial Sequence
  Description of Artificial Sequence: Synthetic oligonucleotide
gagctctacaaaacactggagtgaaggcagac

SEQ ID NO: 256650 - DNA, 38 bp, Artificial Sequence
  Description of Artificial Sequence: Synthetic oligonucleotide
agctctacaaaacactggagtgaaggcagacaatatac

SEQ ID NO: 256651 - DNA, 37 bp, Artificial Sequence
  Description of Artificial Sequence: Synthetic oligonucleotide
gctctacaaaacactggagtgaaggcagacaatatac

SEQ ID NO: 256652 - DNA, 39 bp, Artificial Sequence
  Description of Artificial Sequence: Synthetic oligonucleotide
ctctacaaaacactggagtgaaggcagacaatatacaag

SEQ ID NO: 256653 - DNA, 44 bp, Artificial Sequence
  Description of Artificial Sequence: Synthetic oligonucleotide
tctacaaaacactggagtgaaggcagacaatatacaagtatttg

SEQ ID NO: 256654 - DNA, 43 bp, Artificial Sequence
  Description of Artificial Sequence: Synthetic oligonucleotide
ctacaaaacactggagtgaaggcagacaatatacaagtatttg

SEQ ID NO: 256655 - DNA, 43 bp, Artificial Sequence
  Description of Artificial Sequence: Synthetic oligonucleotide
tacaaaacactggagtgaaggcagacaatatacaagtatttgg

SEQ ID NO: 256656 - DNA, 42 bp, Artificial Sequence
  Description of Artificial Sequence: Synthetic oligonucleotide
acaaaacactggagtgaaggcagacaatatacaagtatttgg

SEQ ID NO: 256657 - DNA, 41 bp, Artificial Sequence
  Description of Artificial Sequence: Synthetic oligonucleotide
caaaacactggagtgaaggcagacaatatacaagtatttgg

SEQ ID NO: 256658 - DNA, 42 bp, Artificial Sequence
  Description of Artificial Sequence: Synthetic oligonucleotide
aaaacactggagtgaaggcagacaatatacaagtatttggtc

SEQ ID NO: 256659 - DNA, 41 bp, Artificial Sequence
  Description of Artificial Sequence: Synthetic oligonucleotide
aaacactggagtgaaggcagacaatatacaagtatttggtc

SEQ ID NO: 256660 - DNA, 40 bp, Artificial Sequence
  Description of Artificial Sequence: Synthetic oligonucleotide
aacactggagtgaaggcagacaatatacaagtatttggtc

SEQ ID NO: 256661 - DNA, 39 bp, Artificial Sequence
  Description of Artificial Sequence: Synthetic oligonucleotide
acactggagtgaaggcagacaatatacaagtatttggtc

SEQ ID NO: 256662 - DNA, 38 bp, Artificial Sequence
  Description of Artificial Sequence: Synthetic oligonucleotide
cactggagtgaaggcagacaatatacaagtatttggtc

SEQ ID NO: 256663 - DNA, 40 bp, Artificial Sequence
  Description of Artificial Sequence: Synthetic oligonucleotide
actggagtgaaggcagacaatatacaagtatttggtcaag

SEQ ID NO: 256664 - DNA, 39 bp, Artificial Sequence
  Description of Artificial Sequence: Synthetic oligonucleotide
ctggagtgaaggcagacaatatacaagtatttggtcaag

SEQ ID NO: 256665 - DNA, 39 bp, Artificial Sequence
  Description of Artificial Sequence: Synthetic oligonucleotide
tggagtgaaggcagacaatatacaagtatttggtcaagg

SEQ ID NO: 256666 - DNA, 38 bp, Artificial Sequence
  Description of Artificial Sequence: Synthetic oligonucleotide
ggagtgaaggcagacaatatacaagtatttggtcaagg

SEQ ID NO: 256667 - DNA, 39 bp, Artificial Sequence
  Description of Artificial Sequence: Synthetic oligonucleotide
gagtgaaggcagacaatatacaagtatttggtcaaggac

SEQ ID NO: 256668 - DNA, 41 bp, Artificial Sequence
  Description of Artificial Sequence: Synthetic oligonucleotide
agtgaaggcagacaatatacaagtatttggtcaaggacaag

SEQ ID NO: 256669 - DNA, 40 bp, Artificial Sequence
  Description of Artificial Sequence: Synthetic oligonucleotide
gtgaaggcagacaatatacaagtatttggtcaaggacaag

SEQ ID NO: 256670 - DNA, 40 bp, Artificial Sequence
  Description of Artificial Sequence: Synthetic oligonucleotide
tgaaggcagacaatatacaagtatttggtcaaggacaagg

SEQ ID NO: 256671 - DNA, 39 bp, Artificial Sequence
  Description of Artificial Sequence: Synthetic oligonucleotide
gaaggcagacaatatacaagtatttggtcaaggacaagg

SEQ ID NO: 256672 - DNA, 46 bp, Artificial Sequence
  Description of Artificial Sequence: Synthetic oligonucleotide
aaggcagacaatatacaagtatttggtcaaggacaaggtattattg

SEQ ID NO: 256673 - DNA, 45 bp, Artificial Sequence
  Description of Artificial Sequence: Synthetic oligonucleotide
aggcagacaatatacaagtatttggtcaaggacaaggtattattg

SEQ ID NO: 256674 - DNA, 44 bp, Artificial Sequence
  Description of Artificial Sequence: Synthetic oligonucleotide
ggcagacaatatacaagtatttggtcaaggacaaggtattattg

SEQ ID NO: 256675 - DNA, 45 bp, Artificial Sequence
  Description of Artificial Sequence: Synthetic oligonucleotide
gcagacaatatacaagtatttggtcaaggacaaggtattattgag

SEQ ID NO: 256676 - DNA, 45 bp, Artificial Sequence
  Description of Artificial Sequence: Synthetic oligonucleotide
cagacaatatacaagtatttggtcaaggacaaggtattattgagg

SEQ ID NO: 256677 - DNA, 47 bp, Artificial Sequence
  Description of Artificial Sequence: Synthetic oligonucleotide
agacaatatacaagtatttggtcaaggacaaggtattattgaggttg

SEQ ID NO: 256678 - DNA, 46 bp, Artificial Sequence
  Description of Artificial Sequence: Synthetic oligonucleotide
gacaatatacaagtatttggtcaaggacaaggtattattgaggttg

SEQ ID NO: 256679 - DNA, 51 bp, Artificial Sequence
  Description of Artificial Sequence: Synthetic oligonucleotide
acaatatacaagtatttggtcaaggacaaggtattattgaggttgatatag

SEQ ID NO: 256680 - DNA, 50 bp, Artificial Sequence
  Description of Artificial Sequence: Synthetic oligonucleotide
caatatacaagtatttggtcaaggacaaggtattattgaggttgatatag

SEQ ID NO: 256681 - DNA, 50 bp, Artificial Sequence
  Description of Artificial Sequence: Synthetic oligonucleotide
aatatacaagtatttggtcaaggacaaggtattattgaggttgatatagc

SEQ ID NO: 256682 - DNA, 49 bp, Artificial Sequence
  Description of Artificial Sequence: Synthetic oligonucleotide
atatacaagtatttggtcaaggacaaggtattattgaggttgatatagc

SEQ ID NO: 256683 - DNA, 48 bp, Artificial Sequence
  Description of Artificial Sequence: Synthetic oligonucleotide
tatacaagtatttggtcaaggacaaggtattattgaggttgatatagc

SEQ ID NO: 256684 - DNA, 47 bp, Artificial Sequence
  Description of Artificial Sequence: Synthetic oligonucleotide
atacaagtatttggtcaaggacaaggtattattgaggttgatatagc

SEQ ID NO: 256685 - DNA, 46 bp, Artificial Sequence
  Description of Artificial Sequence: Synthetic oligonucleotide
tacaagtatttggtcaaggacaaggtattattgaggttgatatagc

SEQ ID NO: 256686 - DNA, 45 bp, Artificial Sequence
  Description of Artificial Sequence: Synthetic oligonucleotide
acaagtatttggtcaaggacaaggtattattgaggttgatatagc

SEQ ID NO: 256687 - DNA, 44 bp, Artificial Sequence
  Description of Artificial Sequence: Synthetic oligonucleotide
caagtatttggtcaaggacaaggtattattgaggttgatatagc

SEQ ID NO: 256688 - DNA, 44 bp, Artificial Sequence
  Description of Artificial Sequence: Synthetic oligonucleotide
aagtatttggtcaaggacaaggtattattgaggttgatatagcc

SEQ ID NO: 256689 - DNA, 43 bp, Artificial Sequence
  Description of Artificial Sequence: Synthetic oligonucleotide
agtatttggtcaaggacaaggtattattgaggttgatatagcc

SEQ ID NO: 256690 - DNA, 42 bp, Artificial Sequence
  Description of Artificial Sequence: Synthetic oligonucleotide
gtatttggtcaaggacaaggtattattgaggttgatatagcc

SEQ ID NO: 256691 - DNA, 45 bp, Artificial Sequence
  Description of Artificial Sequence: Synthetic oligonucleotide
tatttggtcaaggacaaggtattattgaggttgatatagcctatg

SEQ ID NO: 256692 - DNA, 44 bp, Artificial Sequence
  Description of Artificial Sequence: Synthetic oligonucleotide
atttggtcaaggacaaggtattattgaggttgatatagcctatg

SEQ ID NO: 256693 - DNA, 43 bp, Artificial Sequence
  Description of Artificial Sequence: Synthetic oligonucleotide
tttggtcaaggacaaggtattattgaggttgatatagcctatg

SEQ ID NO: 256694 - DNA, 42 bp, Artificial Sequence
  Description of Artificial Sequence: Synthetic oligonucleotide
ttggtcaaggacaaggtattattgaggttgatatagcctatg

SEQ ID NO: 256695 - DNA, 41 bp, Artificial Sequence
  Description of Artificial Sequence: Synthetic oligonucleotide
tggtcaaggacaaggtattattgaggttgatatagcctatg

SEQ ID NO: 256696 - DNA, 40 bp, Artificial Sequence
  Description of Artificial Sequence: Synthetic oligonucleotide
ggtcaaggacaaggtattattgaggttgatatagcctatg

SEQ ID NO: 256697 - DNA, 41 bp, Artificial Sequence
  Description of Artificial Sequence: Synthetic oligonucleotide
gtcaaggacaaggtattattgaggttgatatagcctatgag

SEQ ID NO: 256698 - DNA, 43 bp, Artificial Sequence
  Description of Artificial Sequence: Synthetic oligonucleotide
tcaaggacaaggtattattgaggttgatatagcctatgagtac

SEQ ID NO: 256699 - DNA, 42 bp, Artificial Sequence
  Description of Artificial Sequence: Synthetic oligonucleotide
caaggacaaggtattattgaggttgatatagcctatgagtac

SEQ ID NO: 256700 - DNA, 42 bp, Artificial Sequence
  Description of Artificial Sequence: Synthetic oligonucleotide
aaggacaaggtattattgaggttgatatagcctatgagtacc

SEQ ID NO: 256701 - DNA, 41 bp, Artificial Sequence
  Description of Artificial Sequence: Synthetic oligonucleotide
aggacaaggtattattgaggttgatatagcctatgagtacc

SEQ ID NO: 256702 - DNA, 40 bp, Artificial Sequence
  Description of Artificial Sequence: Synthetic oligonucleotide
ggacaaggtattattgaggttgatatagcctatgagtacc

SEQ ID NO: 256703 - DNA, 41 bp, Artificial Sequence
  Description of Artificial Sequence: Synthetic oligonucleotide
gacaaggtattattgaggttgatatagcctatgagtacctc

SEQ ID NO: 256704 - DNA, 41 bp, Artificial Sequence
  Description of Artificial Sequence: Synthetic oligonucleotide
acaaggtattattgaggttgatatagcctatgagtacctcg

SEQ ID NO: 256705 - DNA, 40 bp, Artificial Sequence
  Description of Artificial Sequence: Synthetic oligonucleotide
caaggtattattgaggttgatatagcctatgagtacctcg

SEQ ID NO: 256706 - DNA, 42 bp, Artificial Sequence
  Description of Artificial Sequence: Synthetic oligonucleotide
aaggtattattgaggttgatatagcctatgagtacctcgttg

SEQ ID NO: 256707 - DNA, 41 bp, Artificial Sequence
  Description of Artificial Sequence: Synthetic oligonucleotide
aggtattattgaggttgatatagcctatgagtacctcgttg

SEQ ID NO: 256708 - DNA, 40 bp, Artificial Sequence
  Description of Artificial Sequence: Synthetic oligonucleotide
ggtattattgaggttgatatagcctatgagtacctcgttg

SEQ ID NO: 256709 - DNA, 41 bp, Artificial Sequence
  Description of Artificial Sequence: Synthetic oligonucleotide
gtattattgaggttgatatagcctatgagtacctcgttgag

SEQ ID NO: 256710 - DNA, 45 bp, Artificial Sequence
  Description of Artificial Sequence: Synthetic oligonucleotide
tattattgaggttgatatagcctatgagtacctcgttgagaatac

SEQ ID NO: 256711 - DNA, 44 bp, Artificial Sequence
  Description of Artificial Sequence: Synthetic oligonucleotide
attattgaggttgatatagcctatgagtacctcgttgagaatac

SEQ ID NO: 256712 - DNA, 43 bp, Artificial Sequence
  Description of Artificial Sequence: Synthetic oligonucleotide
ttattgaggttgatatagcctatgagtacctcgttgagaatac

SEQ ID NO: 256713 - DNA, 42 bp, Artificial Sequence
  Description of Artificial Sequence: Synthetic oligonucleotide
tattgaggttgatatagcctatgagtacctcgttgagaatac

SEQ ID NO: 256714 - DNA, 41 bp, Artificial Sequence
  Description of Artificial Sequence: Synthetic oligonucleotide
attgaggttgatatagcctatgagtacctcgttgagaatac

SEQ ID NO: 256715 - DNA, 40 bp, Artificial Sequence
  Description of Artificial Sequence: Synthetic oligonucleotide
ttgaggttgatatagcctatgagtacctcgttgagaatac

SEQ ID NO: 256716 - DNA, 39 bp, Artificial Sequence
  Description of Artificial Sequence: Synthetic oligonucleotide
tgaggttgatatagcctatgagtacctcgttgagaatac

SEQ ID NO: 256717 - DNA, 38 bp, Artificial Sequence
  Description of Artificial Sequence: Synthetic oligonucleotide
gaggttgatatagcctatgagtacctcgttgagaatac

SEQ ID NO: 256718 - DNA, 40 bp, Artificial Sequence
  Description of Artificial Sequence: Synthetic oligonucleotide
aggttgatatagcctatgagtacctcgttgagaatacatg

SEQ ID NO: 256719 - DNA, 39 bp, Artificial Sequence
  Description of Artificial Sequence: Synthetic oligonucleotide
ggttgatatagcctatgagtacctcgttgagaatacatg

SEQ ID NO: 256720 - DNA, 43 bp, Artificial Sequence
  Description of Artificial Sequence: Synthetic oligonucleotide
gttgatatagcctatgagtacctcgttgagaatacatgatttg

SEQ ID NO: 256721 - DNA, 43 bp, Artificial Sequence
  Description of Artificial Sequence: Synthetic oligonucleotide
ttgatatagcctatgagtacctcgttgagaatacatgatttgc

SEQ ID NO: 256722 - DNA, 42 bp, Artificial Sequence
  Description of Artificial Sequence: Synthetic oligonucleotide
tgatatagcctatgagtacctcgttgagaatacatgatttgc

SEQ ID NO: 256723 - DNA, 41 bp, Artificial Sequence
  Description of Artificial Sequence: Synthetic oligonucleotide
gatatagcctatgagtacctcgttgagaatacatgatttgc

SEQ ID NO: 256724 - DNA, 51 bp, Artificial Sequence
  Description of Artificial Sequence: Synthetic oligonucleotide
atatagcctatgagtacctcgttgagaatacatgatttgctaaaaaattag

SEQ ID NO: 256725 - DNA, 50 bp, Artificial Sequence
  Description of Artificial Sequence: Synthetic oligonucleotide
tatagcctatgagtacctcgttgagaatacatgatttgctaaaaaattag

SEQ ID NO: 256726 - DNA, 49 bp, Artificial Sequence
  Description of Artificial Sequence: Synthetic oligonucleotide
atagcctatgagtacctcgttgagaatacatgatttgctaaaaaattag

SEQ ID NO: 256727 - DNA, 48 bp, Artificial Sequence
  Description of Artificial Sequence: Synthetic oligonucleotide
tagcctatgagtacctcgttgagaatacatgatttgctaaaaaattag

SEQ ID NO: 256728 - DNA, 47 bp, Artificial Sequence
  Description of Artificial Sequence: Synthetic oligonucleotide
agcctatgagtacctcgttgagaatacatgatttgctaaaaaattag

SEQ ID NO: 256729 - DNA, 46 bp, Artificial Sequence
  Description of Artificial Sequence: Synthetic oligonucleotide
gcctatgagtacctcgttgagaatacatgatttgctaaaaaattag

SEQ ID NO: 256730 - DNA, 46 bp, Artificial Sequence
  Description of Artificial Sequence: Synthetic oligonucleotide
cctatgagtacctcgttgagaatacatgatttgctaaaaaattagg

SEQ ID NO: 256731 - DNA, 51 bp, Artificial Sequence
  Description of Artificial Sequence: Synthetic oligonucleotide
ctatgagtacctcgttgagaatacatgatttgctaaaaaattaggtattac

SEQ ID NO: 256732 - DNA, 52 bp, Artificial Sequence
  Description of Artificial Sequence: Synthetic oligonucleotide
tatgagtacctcgttgagaatacatgatttgctaaaaaattaggtattactg

SEQ ID NO: 256733 - DNA, 51 bp, Artificial Sequence
  Description of Artificial Sequence: Synthetic oligonucleotide
atgagtacctcgttgagaatacatgatttgctaaaaaattaggtattactg

SEQ ID NO: 256734 - DNA, 50 bp, Artificial Sequence
  Description of Artificial Sequence: Synthetic oligonucleotide
tgagtacctcgttgagaatacatgatttgctaaaaaattaggtattactg

SEQ ID NO: 256735 - DNA, 49 bp, Artificial Sequence
  Description of Artificial Sequence: Synthetic oligonucleotide
gagtacctcgttgagaatacatgatttgctaaaaaattaggtattactg

SEQ ID NO: 256736 - DNA, 52 bp, Artificial Sequence
  Description of Artificial Sequence: Synthetic oligonucleotide
agtacctcgttgagaatacatgatttgctaaaaaattaggtattactgttag

SEQ ID NO: 256737 - DNA, 51 bp, Artificial Sequence
  Description of Artificial Sequence: Synthetic oligonucleotide
gtacctcgttgagaatacatgatttgctaaaaaattaggtattactgttag

SEQ ID NO: 256738 - DNA, 52 bp, Artificial Sequence
  Description of Artificial Sequence: Synthetic oligonucleotide
tacctcgttgagaatacatgatttgctaaaaaattaggtattactgttagtg

SEQ ID NO: 256739 - DNA, 51 bp, Artificial Sequence
  Description of Artificial Sequence: Synthetic oligonucleotide
acctcgttgagaatacatgatttgctaaaaaattaggtattactgttagtg

SEQ ID NO: 256740 - DNA, 50 bp, Artificial Sequence
  Description of Artificial Sequence: Synthetic oligonucleotide
cctcgttgagaatacatgatttgctaaaaaattaggtattactgttagtg

SEQ ID NO: 256741 - DNA, 52 bp, Artificial Sequence
  Description of Artificial Sequence: Synthetic oligonucleotide
ctcgttgagaatacatgatttgctaaaaaattaggtattactgttagtgttg

SEQ ID NO: 256742 - DNA, 52 bp, Artificial Sequence
  Description of Artificial Sequence: Synthetic oligonucleotide
tcgttgagaatacatgatttgctaaaaaattaggtattactgttagtgttgg

SEQ ID NO: 256743 - DNA, 51 bp, Artificial Sequence
  Description of Artificial Sequence: Synthetic oligonucleotide
cgttgagaatacatgatttgctaaaaaattaggtattactgttagtgttgg

SEQ ID NO: 256744 - DNA, 57 bp, Artificial Sequence
  Description of Artificial Sequence: Synthetic oligonucleotide
gttgagaatacatgatttgctaaaaaattaggtattactgttagtgttggaaaaaac

SEQ ID NO: 256745 - DNA, 57 bp, Artificial Sequence
  Description of Artificial Sequence: Synthetic oligonucleotide
ttgagaatacatgatttgctaaaaaattaggtattactgttagtgttggaaaaaacc

SEQ ID NO: 256746 - DNA, 56 bp, Artificial Sequence
  Description of Artificial Sequence: Synthetic oligonucleotide
tgagaatacatgatttgctaaaaaattaggtattactgttagtgttggaaaaaacc

SEQ ID NO: 256747 - DNA, 55 bp, Artificial Sequence
  Description of Artificial Sequence: Synthetic oligonucleotide
gagaatacatgatttgctaaaaaattaggtattactgttagtgttggaaaaaacc

SEQ ID NO: 256748 - DNA, 55 bp, Artificial Sequence
  Description of Artificial Sequence: Synthetic oligonucleotide
agaatacatgatttgctaaaaaattaggtattactgttagtgttggaaaaaaccg

SEQ ID NO: 256749 - DNA, 54 bp, Artificial Sequence
  Description of Artificial Sequence: Synthetic oligonucleotide
gaatacatgatttgctaaaaaattaggtattactgttagtgttggaaaaaaccg

SEQ ID NO: 256750 - DNA, 55 bp, Artificial Sequence
  Description of Artificial Sequence: Synthetic oligonucleotide
aatacatgatttgctaaaaaattaggtattactgttagtgttggaaaaaaccgtg

SEQ ID NO: 256751 - DNA, 54 bp, Artificial Sequence
  Description of Artificial Sequence: Synthetic oligonucleotide
atacatgatttgctaaaaaattaggtattactgttagtgttggaaaaaaccgtg

SEQ ID NO: 256752 - DNA, 53 bp, Artificial Sequence
  Description of Artificial Sequence: Synthetic oligonucleotide
tacatgatttgctaaaaaattaggtattactgttagtgttggaaaaaaccgtg

SEQ ID NO: 256753 - DNA, 52 bp, Artificial Sequence
  Description of Artificial Sequence: Synthetic oligonucleotide
acatgatttgctaaaaaattaggtattactgttagtgttggaaaaaaccgtg

SEQ ID NO: 256754 - DNA, 51 bp, Artificial Sequence
  Description of Artificial Sequence: Synthetic oligonucleotide
catgatttgctaaaaaattaggtattactgttagtgttggaaaaaaccgtg

SEQ ID NO: 256755 - DNA, 51 bp, Artificial Sequence
  Description of Artificial Sequence: Synthetic oligonucleotide
atgatttgctaaaaaattaggtattactgttagtgttggaaaaaaccgtgg

SEQ ID NO: 256756 - DNA, 50 bp, Artificial Sequence
  Description of Artificial Sequence: Synthetic oligonucleotide
tgatttgctaaaaaattaggtattactgttagtgttggaaaaaaccgtgg

SEQ ID NO: 256757 - DNA, 49 bp, Artificial Sequence
  Description of Artificial Sequence: Synthetic oligonucleotide
gatttgctaaaaaattaggtattactgttagtgttggaaaaaaccgtgg

SEQ ID NO: 256758 - DNA, 49 bp, Artificial Sequence
  Description of Artificial Sequence: Synthetic oligonucleotide
atttgctaaaaaattaggtattactgttagtgttggaaaaaaccgtggc

SEQ ID NO: 256759 - DNA, 48 bp, Artificial Sequence
  Description of Artificial Sequence: Synthetic oligonucleotide
tttgctaaaaaattaggtattactgttagtgttggaaaaaaccgtggc

SEQ ID NO: 256760 - DNA, 47 bp, Artificial Sequence
  Description of Artificial Sequence: Synthetic oligonucleotide
ttgctaaaaaattaggtattactgttagtgttggaaaaaaccgtggc

SEQ ID NO: 256761 - DNA, 46 bp, Artificial Sequence
  Description of Artificial Sequence: Synthetic oligonucleotide
tgctaaaaaattaggtattactgttagtgttggaaaaaaccgtggc

SEQ ID NO: 256762 - DNA, 45 bp, Artificial Sequence
  Description of Artificial Sequence: Synthetic oligonucleotide
gctaaaaaattaggtattactgttagtgttggaaaaaaccgtggc

SEQ ID NO: 256763 - DNA, 47 bp, Artificial Sequence
  Description of Artificial Sequence: Synthetic oligonucleotide
ctaaaaaattaggtattactgttagtgttggaaaaaaccgtggcttc

SEQ ID NO: 256764 - DNA, 49 bp, Artificial Sequence
  Description of Artificial Sequence: Synthetic oligonucleotide
taaaaaattaggtattactgttagtgttggaaaaaaccgtggcttctac

SEQ ID NO: 256765 - DNA, 48 bp, Artificial Sequence
  Description of Artificial Sequence: Synthetic oligonucleotide
aaaaaattaggtattactgttagtgttggaaaaaaccgtggcttctac

SEQ ID NO: 256766 - DNA, 47 bp, Artificial Sequence
  Description of Artificial Sequence: Synthetic oligonucleotide
aaaaattaggtattactgttagtgttggaaaaaaccgtggcttctac

SEQ ID NO: 256767 - DNA, 46 bp, Artificial Sequence
  Description of Artificial Sequence: Synthetic oligonucleotide
aaaattaggtattactgttagtgttggaaaaaaccgtggcttctac

SEQ ID NO: 256768 - DNA, 45 bp, Artificial Sequence
  Description of Artificial Sequence: Synthetic oligonucleotide
aaattaggtattactgttagtgttggaaaaaaccgtggcttctac

SEQ ID NO: 256769 - DNA, 44 bp, Artificial Sequence
  Description of Artificial Sequence: Synthetic oligonucleotide
aattaggtattactgttagtgttggaaaaaaccgtggcttctac

SEQ ID NO: 256770 - DNA, 43 bp, Artificial Sequence
  Description of Artificial Sequence: Synthetic oligonucleotide
attaggtattactgttagtgttggaaaaaaccgtggcttctac

SEQ ID NO: 256771 - DNA, 42 bp, Artificial Sequence
  Description of Artificial Sequence: Synthetic oligonucleotide
ttaggtattactgttagtgttggaaaaaaccgtggcttctac

SEQ ID NO: 256772 - DNA, 41 bp, Artificial Sequence
  Description of Artificial Sequence: Synthetic oligonucleotide
taggtattactgttagtgttggaaaaaaccgtggcttctac

SEQ ID NO: 256773 - DNA, 40 bp, Artificial Sequence
  Description of Artificial Sequence: Synthetic oligonucleotide
aggtattactgttagtgttggaaaaaaccgtggcttctac

SEQ ID NO: 256774 - DNA, 39 bp, Artificial Sequence
  Description of Artificial Sequence: Synthetic oligonucleotide
ggtattactgttagtgttggaaaaaaccgtggcttctac

SEQ ID NO: 256775 - DNA, 39 bp, Artificial Sequence
  Description of Artificial Sequence: Synthetic oligonucleotide
gtattactgttagtgttggaaaaaaccgtggcttctacc

SEQ ID NO: 256776 - DNA, 40 bp, Artificial Sequence
  Description of Artificial Sequence: Synthetic oligonucleotide
tattactgttagtgttggaaaaaaccgtggcttctacctc

SEQ ID NO: 256777 - DNA, 39 bp, Artificial Sequence
  Description of Artificial Sequence: Synthetic oligonucleotide
attactgttagtgttggaaaaaaccgtggcttctacctc

SEQ ID NO: 256778 - DNA, 38 bp, Artificial Sequence
  Description of Artificial Sequence: Synthetic oligonucleotide
ttactgttagtgttggaaaaaaccgtggcttctacctc

SEQ ID NO: 256779 - DNA, 37 bp, Artificial Sequence
  Description of Artificial Sequence: Synthetic oligonucleotide
tactgttagtgttggaaaaaaccgtggcttctacctc

SEQ ID NO: 256780 - DNA, 36 bp, Artificial Sequence
  Description of Artificial Sequence: Synthetic oligonucleotide
actgttagtgttggaaaaaaccgtggcttctacctc

SEQ ID NO: 256781 - DNA, 35 bp, Artificial Sequence
  Description of Artificial Sequence: Synthetic oligonucleotide
ctgttagtgttggaaaaaaccgtggcttctacctc

SEQ ID NO: 256782 - DNA, 35 bp, Artificial Sequence
  Description of Artificial Sequence: Synthetic oligonucleotide
tgttagtgttggaaaaaaccgtggcttctacctcc

SEQ ID NO: 256783 - DNA, 34 bp, Artificial Sequence
  Description of Artificial Sequence: Synthetic oligonucleotide
gttagtgttggaaaaaaccgtggcttctacctcc

SEQ ID NO: 256784 - DNA, 34 bp, Artificial Sequence
  Description of Artificial Sequence: Synthetic oligonucleotide
ttagtgttggaaaaaaccgtggcttctacctccc

SEQ ID NO: 256785 - DNA, 33 bp, Artificial Sequence
  Description of Artificial Sequence: Synthetic oligonucleotide
tagtgttggaaaaaaccgtggcttctacctccc

SEQ ID NO: 256786 - DNA, 32 bp, Artificial Sequence
  Description of Artificial Sequence: Synthetic oligonucleotide
agtgttggaaaaaaccgtggcttctacctccc

SEQ ID NO: 256787 - DNA, 31 bp, Artificial Sequence
  Description of Artificial Sequence: Synthetic oligonucleotide
gtgttggaaaaaaccgtggcttctacctccc

SEQ ID NO: 256788 - DNA, 32 bp, Artificial Sequence
  Description of Artificial Sequence: Synthetic oligonucleotide
tgttggaaaaaaccgtggcttctacctcccag

SEQ ID NO: 256789 - DNA, 31 bp, Artificial Sequence
  Description of Artificial Sequence: Synthetic oligonucleotide
gttggaaaaaaccgtggcttctacctcccag

SEQ ID NO: 256790 - DNA, 33 bp, Artificial Sequence
  Description of Artificial Sequence: Synthetic oligonucleotide
ttggaaaaaaccgtggcttctacctcccagatc

SEQ ID NO: 256791 - DNA, 32 bp, Artificial Sequence
  Description of Artificial Sequence: Synthetic oligonucleotide
tggaaaaaaccgtggcttctacctcccagatc

SEQ ID NO: 256792 - DNA, 31 bp, Artificial Sequence
  Description of Artificial Sequence: Synthetic oligonucleotide
ggaaaaaaccgtggcttctacctcccagatc

SEQ ID NO: 256793 - DNA, 31 bp, Artificial Sequence
  Description of Artificial Sequence: Synthetic oligonucleotide
gaaaaaaccgtggcttctacctcccagatcc

SEQ ID NO: 256794 - DNA, 32 bp, Artificial Sequence
  Description of Artificial Sequence: Synthetic oligonucleotide
aaaaaaccgtggcttctacctcccagatcctg

SEQ ID NO: 256795 - DNA, 31 bp, Artificial Sequence
  Description of Artificial Sequence: Synthetic oligonucleotide
aaaaaccgtggcttctacctcccagatcctg

SEQ ID NO: 256796 - DNA, 30 bp, Artificial Sequence
  Description of Artificial Sequence: Synthetic oligonucleotide
aaaaccgtggcttctacctcccagatcctg

SEQ ID NO: 256797 - DNA, 29 bp, Artificial Sequence
  Description of Artificial Sequence: Synthetic oligonucleotide
aaaccgtggcttctacctcccagatcctg

SEQ ID NO: 256798 - DNA, 28 bp, Artificial Sequence
  Description of Artificial Sequence: Synthetic oligonucleotide
aaccgtggcttctacctcccagatcctg

SEQ ID NO: 256799 - DNA, 27 bp, Artificial Sequence
  Description of Artificial Sequence: Synthetic oligonucleotide
accgtggcttctacctcccagatcctg

SEQ ID NO: 256800 - DNA, 27 bp, Artificial Sequence
  Description of Artificial Sequence: Synthetic oligonucleotide
ccgtggcttctacctcccagatcctgt

SEQ ID NO: 256801 - DNA, 28 bp, Artificial Sequence
  Description of Artificial Sequence: Synthetic oligonucleotide
cgtggcttctacctcccagatcctgtac

SEQ ID NO: 256802 - DNA, 29 bp, Artificial Sequence
  Description of Artificial Sequence: Synthetic oligonucleotide
gtggcttctacctcccagatcctgtacag

SEQ ID NO: 256803 - DNA, 29 bp, Artificial Sequence
  Description of Artificial Sequence: Synthetic oligonucleotide
tggcttctacctcccagatcctgtacagg

SEQ ID NO: 256804 - DNA, 28 bp, Artificial Sequence
  Description of Artificial Sequence: Synthetic oligonucleotide
ggcttctacctcccagatcctgtacagg

SEQ ID NO: 256805 - DNA, 29 bp, Artificial Sequence
  Description of Artificial Sequence: Synthetic oligonucleotide
gcttctacctcccagatcctgtacaggtg

SEQ ID NO: 256806 - DNA, 29 bp, Artificial Sequence
  Description of Artificial Sequence: Synthetic oligonucleotide
cttctacctcccagatcctgtacaggtgg

SEQ ID NO: 256807 - DNA, 29 bp, Artificial Sequence
  Description of Artificial Sequence: Synthetic oligonucleotide
ttctacctcccagatcctgtacaggtggc

SEQ ID NO: 256808 - DNA, 28 bp, Artificial Sequence
  Description of Artificial Sequence: Synthetic oligonucleotide
tctacctcccagatcctgtacaggtggc

SEQ ID NO: 256809 - DNA, 27 bp, Artificial Sequence
  Description of Artificial Sequence: Synthetic oligonucleotide
ctacctcccagatcctgtacaggtggc

SEQ ID NO: 256810 - DNA, 28 bp, Artificial Sequence
  Description of Artificial Sequence: Synthetic oligonucleotide
tacctcccagatcctgtacaggtggctc

SEQ ID NO: 256811 - DNA, 27 bp, Artificial Sequence
  Description of Artificial Sequence: Synthetic oligonucleotide
acctcccagatcctgtacaggtggctc

SEQ ID NO: 256812 - DNA, 26 bp, Artificial Sequence
  Description of Artificial Sequence: Synthetic oligonucleotide
cctcccagatcctgtacaggtggctc

SEQ ID NO: 256813 - DNA, 27 bp, Artificial Sequence
  Description of Artificial Sequence: Synthetic oligonucleotide
ctcccagatcctgtacaggtggctcca

SEQ ID NO: 256814 - DNA, 27 bp, Artificial Sequence
  Description of Artificial Sequence: Synthetic oligonucleotide
tcccagatcctgtacaggtggctccac

SEQ ID NO: 256815 - DNA, 26 bp, Artificial Sequence
  Description of Artificial Sequence: Synthetic oligonucleotide
cccagatcctgtacaggtggctccac

SEQ ID NO: 256816 - DNA, 27 bp, Artificial Sequence
  Description of Artificial Sequence: Synthetic oligonucleotide
ccagatcctgtacaggtggctccacct

SEQ ID NO: 256817 - DNA, 28 bp, Artificial Sequence
  Description of Artificial Sequence: Synthetic oligonucleotide
cagatcctgtacaggtggctccaccttc

SEQ ID NO: 256818 - DNA, 29 bp, Artificial Sequence
  Description of Artificial Sequence: Synthetic oligonucleotide
agatcctgtacaggtggctccaccttcag

SEQ ID NO: 256819 - DNA, 28 bp, Artificial Sequence
  Description of Artificial Sequence: Synthetic oligonucleotide
gatcctgtacaggtggctccaccttcag

SEQ ID NO: 256820 - DNA, 30 bp, Artificial Sequence
  Description of Artificial Sequence: Synthetic oligonucleotide
atcctgtacaggtggctccaccttcagttc

SEQ ID NO: 256821 - DNA, 29 bp, Artificial Sequence
  Description of Artificial Sequence: Synthetic oligonucleotide
tcctgtacaggtggctccaccttcagttc

SEQ ID NO: 256822 - DNA, 28 bp, Artificial Sequence
  Description of Artificial Sequence: Synthetic oligonucleotide
cctgtacaggtggctccaccttcagttc

SEQ ID NO: 256823 - DNA, 30 bp, Artificial Sequence
  Description of Artificial Sequence: Synthetic oligonucleotide
ctgtacaggtggctccaccttcagttcatg

SEQ ID NO: 256824 - DNA, 30 bp, Artificial Sequence
  Description of Artificial Sequence: Synthetic oligonucleotide
tgtacaggtggctccaccttcagttcatgg

SEQ ID NO: 256825 - DNA, 29 bp, Artificial Sequence
  Description of Artificial Sequence: Synthetic oligonucleotide
gtacaggtggctccaccttcagttcatgg

SEQ ID NO: 256826 - DNA, 29 bp, Artificial Sequence
  Description of Artificial Sequence: Synthetic oligonucleotide
tacaggtggctccaccttcagttcatggc

SEQ ID NO: 256827 - DNA, 28 bp, Artificial Sequence
  Description of Artificial Sequence: Synthetic oligonucleotide
acaggtggctccaccttcagttcatggc

SEQ ID NO: 256828 - DNA, 27 bp, Artificial Sequence
  Description of Artificial Sequence: Synthetic oligonucleotide
caggtggctccaccttcagttcatggc

SEQ ID NO: 256829 - DNA, 27 bp, Artificial Sequence
  Description of Artificial Sequence: Synthetic oligonucleotide
aggtggctccaccttcagttcatggcg

SEQ ID NO: 256830 - DNA, 27 bp, Artificial Sequence
  Description of Artificial Sequence: Synthetic oligonucleotide
ggtggctccaccttcagttcatggcgt

SEQ ID NO: 256831 - DNA, 28 bp, Artificial Sequence
  Description of Artificial Sequence: Synthetic oligonucleotide
gtggctccaccttcagttcatggcgtag

SEQ ID NO: 256832 - DNA, 28 bp, Artificial Sequence
  Description of Artificial Sequence: Synthetic oligonucleotide
tggctccaccttcagttcatggcgtagg

SEQ ID NO: 256833 - DNA, 27 bp, Artificial Sequence
  Description of Artificial Sequence: Synthetic oligonucleotide
ggctccaccttcagttcatggcgtagg

SEQ ID NO: 256834 - DNA, 27 bp, Artificial Sequence
  Description of Artificial Sequence: Synthetic oligonucleotide
gctccaccttcagttcatggcgtaggc

SEQ ID NO: 256835 - DNA, 30 bp, Artificial Sequence
  Description of Artificial Sequence: Synthetic oligonucleotide
ctccaccttcagttcatggcgtaggcattg

SEQ ID NO: 256836 - DNA, 32 bp, Artificial Sequence
  Description of Artificial Sequence: Synthetic oligonucleotide
tccaccttcagttcatggcgtaggcattgaag

SEQ ID NO: 256837 - DNA, 31 bp, Artificial Sequence
  Description of Artificial Sequence: Synthetic oligonucleotide
ccaccttcagttcatggcgtaggcattgaag

SEQ ID NO: 256838 - DNA, 31 bp, Artificial Sequence
  Description of Artificial Sequence: Synthetic oligonucleotide
caccttcagttcatggcgtaggcattgaagc

SEQ ID NO: 256839 - DNA, 32 bp, Artificial Sequence
  Description of Artificial Sequence: Synthetic oligonucleotide
accttcagttcatggcgtaggcattgaagctg

SEQ ID NO: 256840 - DNA, 31 bp, Artificial Sequence
  Description of Artificial Sequence: Synthetic oligonucleotide
ccttcagttcatggcgtaggcattgaagctg

SEQ ID NO: 256841 - DNA, 36 bp, Artificial Sequence
  Description of Artificial Sequence: Synthetic oligonucleotide
cttcagttcatggcgtaggcattgaagctgtatttc

SEQ ID NO: 256842 - DNA, 36 bp, Artificial Sequence
  Description of Artificial Sequence: Synthetic oligonucleotide
ttcagttcatggcgtaggcattgaagctgtatttcg

SEQ ID NO: 256843 - DNA, 35 bp, Artificial Sequence
  Description of Artificial Sequence: Synthetic oligonucleotide
tcagttcatggcgtaggcattgaagctgtatttcg

SEQ ID NO: 256844 - DNA, 34 bp, Artificial Sequence
  Description of Artificial Sequence: Synthetic oligonucleotide
cagttcatggcgtaggcattgaagctgtatttcg

SEQ ID NO: 256845 - DNA, 34 bp, Artificial Sequence
  Description of Artificial Sequence: Synthetic oligonucleotide
agttcatggcgtaggcattgaagctgtatttcgg

SEQ ID NO: 256846 - DNA, 33 bp, Artificial Sequence
  Description of Artificial Sequence: Synthetic oligonucleotide
gttcatggcgtaggcattgaagctgtatttcgg

SEQ ID NO: 256847 - DNA, 33 bp, Artificial Sequence
  Description of Artificial Sequence: Synthetic oligonucleotide
ttcatggcgtaggcattgaagctgtatttcggg

SEQ ID NO: 256848 - DNA, 32 bp, Artificial Sequence
  Description of Artificial Sequence: Synthetic oligonucleotide
tcatggcgtaggcattgaagctgtatttcggg

SEQ ID NO: 256849 - DNA, 31 bp, Artificial Sequence
  Description of Artificial Sequence: Synthetic oligonucleotide
catggcgtaggcattgaagctgtatttcggg

SEQ ID NO: 256850 - DNA, 32 bp, Artificial Sequence
  Description of Artificial Sequence: Synthetic oligonucleotide
atggcgtaggcattgaagctgtatttcgggag

SEQ ID NO: 256851 - DNA, 31 bp, Artificial Sequence
  Description of Artificial Sequence: Synthetic oligonucleotide
tggcgtaggcattgaagctgtatttcgggag

SEQ ID NO: 256852 - DNA, 30 bp, Artificial Sequence
  Description of Artificial Sequence: Synthetic oligonucleotide
ggcgtaggcattgaagctgtatttcgggag

SEQ ID NO: 256853 - DNA, 32 bp, Artificial Sequence
  Description of Artificial Sequence: Synthetic oligonucleotide
gcgtaggcattgaagctgtatttcgggagaac

SEQ ID NO: 256854 - DNA, 33 bp, Artificial Sequence
  Description of Artificial Sequence: Synthetic oligonucleotide
cgtaggcattgaagctgtatttcgggagaacac

SEQ ID NO: 256855 - DNA, 34 bp, Artificial Sequence
  Description of Artificial Sequence: Synthetic oligonucleotide
gtaggcattgaagctgtatttcgggagaacactg

SEQ ID NO: 256856 - DNA, 38 bp, Artificial Sequence
  Description of Artificial Sequence: Synthetic oligonucleotide
taggcattgaagctgtatttcgggagaacactgaaaac

SEQ ID NO: 256857 - DNA, 37 bp, Artificial Sequence
  Description of Artificial Sequence: Synthetic oligonucleotide
aggcattgaagctgtatttcgggagaacactgaaaac

SEQ ID NO: 256858 - DNA, 36 bp, Artificial Sequence
  Description of Artificial Sequence: Synthetic oligonucleotide
ggcattgaagctgtatttcgggagaacactgaaaac

SEQ ID NO: 256859 - DNA, 37 bp, Artificial Sequence
  Description of Artificial Sequence: Synthetic oligonucleotide
gcattgaagctgtatttcgggagaacactgaaaactc

SEQ ID NO: 256860 - DNA, 38 bp, Artificial Sequence
  Description of Artificial Sequence: Synthetic oligonucleotide
cattgaagctgtatttcgggagaacactgaaaactctc

SEQ ID NO: 256861 - DNA, 47 bp, Artificial Sequence
  Description of Artificial Sequence: Synthetic oligonucleotide
attgaagctgtatttcgggagaacactgaaaactctcaaaaaatatg

SEQ ID NO: 256862 - DNA, 46 bp, Artificial Sequence
  Description of Artificial Sequence: Synthetic oligonucleotide
ttgaagctgtatttcgggagaacactgaaaactctcaaaaaatatg

SEQ ID NO: 256863 - DNA, 45 bp, Artificial Sequence
  Description of Artificial Sequence: Synthetic oligonucleotide
tgaagctgtatttcgggagaacactgaaaactctcaaaaaatatg

SEQ ID NO: 256864 - DNA, 44 bp, Artificial Sequence
  Description of Artificial Sequence: Synthetic oligonucleotide
gaagctgtatttcgggagaacactgaaaactctcaaaaaatatg

SEQ ID NO: 256865 - DNA, 44 bp, Artificial Sequence
  Description of Artificial Sequence: Synthetic oligonucleotide
aagctgtatttcgggagaacactgaaaactctcaaaaaatatgc

SEQ ID NO: 256866 - DNA, 43 bp, Artificial Sequence
  Description of Artificial Sequence: Synthetic oligonucleotide
agctgtatttcgggagaacactgaaaactctcaaaaaatatgc

SEQ ID NO: 256867 - DNA, 42 bp, Artificial Sequence
  Description of Artificial Sequence: Synthetic oligonucleotide
gctgtatttcgggagaacactgaaaactctcaaaaaatatgc

SEQ ID NO: 256868 - DNA, 42 bp, Artificial Sequence
  Description of Artificial Sequence: Synthetic oligonucleotide
ctgtatttcgggagaacactgaaaactctcaaaaaatatgcc

SEQ ID NO: 256869 - DNA, 44 bp, Artificial Sequence
  Description of Artificial Sequence: Synthetic oligonucleotide
tgtatttcgggagaacactgaaaactctcaaaaaatatgccttc

SEQ ID NO: 256870 - DNA, 43 bp, Artificial Sequence
  Description of Artificial Sequence: Synthetic oligonucleotide
gtatttcgggagaacactgaaaactctcaaaaaatatgccttc

SEQ ID NO: 256871 - DNA, 44 bp, Artificial Sequence
  Description of Artificial Sequence: Synthetic oligonucleotide
tatttcgggagaacactgaaaactctcaaaaaatatgccttcag

SEQ ID NO: 256872 - DNA, 43 bp, Artificial Sequence
  Description of Artificial Sequence: Synthetic oligonucleotide
atttcgggagaacactgaaaactctcaaaaaatatgccttcag

SEQ ID NO: 256873 - DNA, 42 bp, Artificial Sequence
  Description of Artificial Sequence: Synthetic oligonucleotide
tttcgggagaacactgaaaactctcaaaaaatatgccttcag

SEQ ID NO: 256874 - DNA, 41 bp, Artificial Sequence
  Description of Artificial Sequence: Synthetic oligonucleotide
ttcgggagaacactgaaaactctcaaaaaatatgccttcag

SEQ ID NO: 256875 - DNA, 40 bp, Artificial Sequence
  Description of Artificial Sequence: Synthetic oligonucleotide
tcgggagaacactgaaaactctcaaaaaatatgccttcag

SEQ ID NO: 256876 - DNA, 39 bp, Artificial Sequence
  Description of Artificial Sequence: Synthetic oligonucleotide
cgggagaacactgaaaactctcaaaaaatatgccttcag

SEQ ID NO: 256877 - DNA, 39 bp, Artificial Sequence
  Description of Artificial Sequence: Synthetic oligonucleotide
gggagaacactgaaaactctcaaaaaatatgccttcagc

SEQ ID NO: 256878 - DNA, 41 bp, Artificial Sequence
  Description of Artificial Sequence: Synthetic oligonucleotide
ggagaacactgaaaactctcaaaaaatatgccttcagctac

SEQ ID NO: 256879 - DNA, 46 bp, Artificial Sequence
  Description of Artificial Sequence: Synthetic oligonucleotide
gagaacactgaaaactctcaaaaaatatgccttcagctacatttag

SEQ ID NO: 256880 - DNA, 46 bp, Artificial Sequence
  Description of Artificial Sequence: Synthetic oligonucleotide
agaacactgaaaactctcaaaaaatatgccttcagctacatttagc

SEQ ID NO: 256881 - DNA, 45 bp, Artificial Sequence
  Description of Artificial Sequence: Synthetic oligonucleotide
gaacactgaaaactctcaaaaaatatgccttcagctacatttagc

SEQ ID NO: 256882 - DNA, 46 bp, Artificial Sequence
  Description of Artificial Sequence: Synthetic oligonucleotide
aacactgaaaactctcaaaaaatatgccttcagctacatttagctg

SEQ ID NO: 256883 - DNA, 45 bp, Artificial Sequence
  Description of Artificial Sequence: Synthetic oligonucleotide
acactgaaaactctcaaaaaatatgccttcagctacatttagctg

SEQ ID NO: 256884 - DNA, 44 bp, Artificial Sequence
  Description of Artificial Sequence: Synthetic oligonucleotide
cactgaaaactctcaaaaaatatgccttcagctacatttagctg

SEQ ID NO: 256885 - DNA, 45 bp, Artificial Sequence
  Description of Artificial Sequence: Synthetic oligonucleotide
actgaaaactctcaaaaaatatgccttcagctacatttagctgtg

SEQ ID NO: 256886 - DNA, 44 bp, Artificial Sequence
  Description of Artificial Sequence: Synthetic oligonucleotide
ctgaaaactctcaaaaaatatgccttcagctacatttagctgtg

SEQ ID NO: 256887 - DNA, 45 bp, Artificial Sequence
  Description of Artificial Sequence: Synthetic oligonucleotide
tgaaaactctcaaaaaatatgccttcagctacatttagctgtgac

SEQ ID NO: 256888 - DNA, 44 bp, Artificial Sequence
  Description of Artificial Sequence: Synthetic oligonucleotide
gaaaactctcaaaaaatatgccttcagctacatttagctgtgac

SEQ ID NO: 256889 - DNA, 46 bp, Artificial Sequence
  Description of Artificial Sequence: Synthetic oligonucleotide
aaaactctcaaaaaatatgccttcagctacatttagctgtgacttc

SEQ ID NO: 256890 - DNA, 45 bp, Artificial Sequence
  Description of Artificial Sequence: Synthetic oligonucleotide
aaactctcaaaaaatatgccttcagctacatttagctgtgacttc

SEQ ID NO: 256891 - DNA, 44 bp, Artificial Sequence
  Description of Artificial Sequence: Synthetic oligonucleotide
aactctcaaaaaatatgccttcagctacatttagctgtgacttc

SEQ ID NO: 256892 - DNA, 43 bp, Artificial Sequence
  Description of Artificial Sequence: Synthetic oligonucleotide
actctcaaaaaatatgccttcagctacatttagctgtgacttc

SEQ ID NO: 256893 - DNA, 42 bp, Artificial Sequence
  Description of Artificial Sequence: Synthetic oligonucleotide
ctctcaaaaaatatgccttcagctacatttagctgtgacttc

SEQ ID NO: 256894 - DNA, 47 bp, Artificial Sequence
  Description of Artificial Sequence: Synthetic oligonucleotide
tctcaaaaaatatgccttcagctacatttagctgtgacttcaatttc

SEQ ID NO: 256895 - DNA, 46 bp, Artificial Sequence
  Description of Artificial Sequence: Synthetic oligonucleotide
ctcaaaaaatatgccttcagctacatttagctgtgacttcaatttc

SEQ ID NO: 256896 - DNA, 48 bp, Artificial Sequence
  Description of Artificial Sequence: Synthetic oligonucleotide
tcaaaaaatatgccttcagctacatttagctgtgacttcaatttcatc

SEQ ID NO: 256897 - DNA, 47 bp, Artificial Sequence
  Description of Artificial Sequence: Synthetic oligonucleotide
caaaaaatatgccttcagctacatttagctgtgacttcaatttcatc

SEQ ID NO: 256898 - DNA, 49 bp, Artificial Sequence
  Description of Artificial Sequence: Synthetic oligonucleotide
aaaaaatatgccttcagctacatttagctgtgacttcaatttcatcttg

SEQ ID NO: 256899 - DNA, 48 bp, Artificial Sequence
  Description of Artificial Sequence: Synthetic oligonucleotide
aaaaatatgccttcagctacatttagctgtgacttcaatttcatcttg

SEQ ID NO: 256900 - DNA, 47 bp, Artificial Sequence
  Description of Artificial Sequence: Synthetic oligonucleotide
aaaatatgccttcagctacatttagctgtgacttcaatttcatcttg

SEQ ID NO: 256901 - DNA, 46 bp, Artificial Sequence
  Description of Artificial Sequence: Synthetic oligonucleotide
aaatatgccttcagctacatttagctgtgacttcaatttcatcttg

SEQ ID NO: 256902 - DNA, 45 bp, Artificial Sequence
  Description of Artificial Sequence: Synthetic oligonucleotide
aatatgccttcagctacatttagctgtgacttcaatttcatcttg

SEQ ID NO: 256903 - DNA, 44 bp, Artificial Sequence
  Description of Artificial Sequence: Synthetic oligonucleotide
atatgccttcagctacatttagctgtgacttcaatttcatcttg

SEQ ID NO: 256904 - DNA, 43 bp, Artificial Sequence
  Description of Artificial Sequence: Synthetic oligonucleotide
tatgccttcagctacatttagctgtgacttcaatttcatcttg

SEQ ID NO: 256905 - DNA, 42 bp, Artificial Sequence
  Description of Artificial Sequence: Synthetic oligonucleotide
atgccttcagctacatttagctgtgacttcaatttcatcttg

SEQ ID NO: 256906 - DNA, 41 bp, Artificial Sequence
  Description of Artificial Sequence: Synthetic oligonucleotide
tgccttcagctacatttagctgtgacttcaatttcatcttg

SEQ ID NO: 256907 - DNA, 40 bp, Artificial Sequence
  Description of Artificial Sequence: Synthetic oligonucleotide
gccttcagctacatttagctgtgacttcaatttcatcttg

SEQ ID NO: 256908 - DNA, 40 bp, Artificial Sequence
  Description of Artificial Sequence: Synthetic oligonucleotide
ccttcagctacatttagctgtgacttcaatttcatcttgc

SEQ ID NO: 256909 - DNA, 40 bp, Artificial Sequence
  Description of Artificial Sequence: Synthetic oligonucleotide
cttcagctacatttagctgtgacttcaatttcatcttgcg

SEQ ID NO: 256910 - DNA, 42 bp, Artificial Sequence
  Description of Artificial Sequence: Synthetic oligonucleotide
ttcagctacatttagctgtgacttcaatttcatcttgcgttc

SEQ ID NO: 256911 - DNA, 41 bp, Artificial Sequence
  Description of Artificial Sequence: Synthetic oligonucleotide
tcagctacatttagctgtgacttcaatttcatcttgcgttc

SEQ ID NO: 256912 - DNA, 40 bp, Artificial Sequence
  Description of Artificial Sequence: Synthetic oligonucleotide
cagctacatttagctgtgacttcaatttcatcttgcgttc

SEQ ID NO: 256913 - DNA, 41 bp, Artificial Sequence
  Description of Artificial Sequence: Synthetic oligonucleotide
agctacatttagctgtgacttcaatttcatcttgcgttcag

SEQ ID NO: 256914 - DNA, 40 bp, Artificial Sequence
  Description of Artificial Sequence: Synthetic oligonucleotide
gctacatttagctgtgacttcaatttcatcttgcgttcag

SEQ ID NO: 256915 - DNA, 41 bp, Artificial Sequence
  Description of Artificial Sequence: Synthetic oligonucleotide
ctacatttagctgtgacttcaatttcatcttgcgttcagtg

SEQ ID NO: 256916 - DNA, 42 bp, Artificial Sequence
  Description of Artificial Sequence: Synthetic oligonucleotide
tacatttagctgtgacttcaatttcatcttgcgttcagtgtg

SEQ ID NO: 256917 - DNA, 41 bp, Artificial Sequence
  Description of Artificial Sequence: Synthetic oligonucleotide
acatttagctgtgacttcaatttcatcttgcgttcagtgtg

SEQ ID NO: 256918 - DNA, 40 bp, Artificial Sequence
  Description of Artificial Sequence: Synthetic oligonucleotide
catttagctgtgacttcaatttcatcttgcgttcagtgtg

SEQ ID NO: 256919 - DNA, 40 bp, Artificial Sequence
  Description of Artificial Sequence: Synthetic oligonucleotide
atttagctgtgacttcaatttcatcttgcgttcagtgtgc

SEQ ID NO: 256920 - DNA, 39 bp, Artificial Sequence
  Description of Artificial Sequence: Synthetic oligonucleotide
tttagctgtgacttcaatttcatcttgcgttcagtgtgc

SEQ ID NO: 256921 - DNA, 38 bp, Artificial Sequence
  Description of Artificial Sequence: Synthetic oligonucleotide
ttagctgtgacttcaatttcatcttgcgttcagtgtgc

SEQ ID NO: 256922 - DNA, 37 bp, Artificial Sequence
  Description of Artificial Sequence: Synthetic oligonucleotide
tagctgtgacttcaatttcatcttgcgttcagtgtgc

SEQ ID NO: 256923 - DNA, 36 bp, Artificial Sequence
  Description of Artificial Sequence: Synthetic oligonucleotide
agctgtgacttcaatttcatcttgcgttcagtgtgc

SEQ ID NO: 256924 - DNA, 35 bp, Artificial Sequence
  Description of Artificial Sequence: Synthetic oligonucleotide
gctgtgacttcaatttcatcttgcgttcagtgtgc

SEQ ID NO: 256925 - DNA, 35 bp, Artificial Sequence
  Description of Artificial Sequence: Synthetic oligonucleotide
ctgtgacttcaatttcatcttgcgttcagtgtgcc

SEQ ID NO: 256926 - DNA, 36 bp, Artificial Sequence
  Description of Artificial Sequence: Synthetic oligonucleotide
tgtgacttcaatttcatcttgcgttcagtgtgccag

SEQ ID NO: 256927 - DNA, 35 bp, Artificial Sequence
  Description of Artificial Sequence: Synthetic oligonucleotide
gtgacttcaatttcatcttgcgttcagtgtgccag

SEQ ID NO: 256928 - DNA, 35 bp, Artificial Sequence
  Description of Artificial Sequence: Synthetic oligonucleotide
tgacttcaatttcatcttgcgttcagtgtgccagc

SEQ ID NO: 256929 - DNA, 34 bp, Artificial Sequence
  Description of Artificial Sequence: Synthetic oligonucleotide
gacttcaatttcatcttgcgttcagtgtgccagc

SEQ ID NO: 256930 - DNA, 34 bp, Artificial Sequence
  Description of Artificial Sequence: Synthetic oligonucleotide
acttcaatttcatcttgcgttcagtgtgccagcc

SEQ ID NO: 256931 - DNA, 33 bp, Artificial Sequence
  Description of Artificial Sequence: Synthetic oligonucleotide
cttcaatttcatcttgcgttcagtgtgccagcc

SEQ ID NO: 256932 - DNA, 37 bp, Artificial Sequence
  Description of Artificial Sequence: Synthetic oligonucleotide
ttcaatttcatcttgcgttcagtgtgccagccattag

SEQ ID NO: 256933 - DNA, 36 bp, Artificial Sequence
  Description of Artificial Sequence: Synthetic oligonucleotide
tcaatttcatcttgcgttcagtgtgccagccattag

SEQ ID NO: 256934 - DNA, 35 bp, Artificial Sequence
  Description of Artificial Sequence: Synthetic oligonucleotide
caatttcatcttgcgttcagtgtgccagccattag

SEQ ID NO: 256935 - DNA, 35 bp, Artificial Sequence
  Description of Artificial Sequence: Synthetic oligonucleotide
aatttcatcttgcgttcagtgtgccagccattagg

SEQ ID NO: 256936 - DNA, 34 bp, Artificial Sequence
  Description of Artificial Sequence: Synthetic oligonucleotide
atttcatcttgcgttcagtgtgccagccattagg

SEQ ID NO: 256937 - DNA, 33 bp, Artificial Sequence
  Description of Artificial Sequence: Synthetic oligonucleotide
tttcatcttgcgttcagtgtgccagccattagg

SEQ ID NO: 256938 - DNA, 32 bp, Artificial Sequence
  Description of Artificial Sequence: Synthetic oligonucleotide
ttcatcttgcgttcagtgtgccagccattagg

SEQ ID NO: 256939 - DNA, 31 bp, Artificial Sequence
  Description of Artificial Sequence: Synthetic oligonucleotide
tcatcttgcgttcagtgtgccagccattagg

SEQ ID NO: 256940 - DNA, 30 bp, Artificial Sequence
  Description of Artificial Sequence: Synthetic oligonucleotide
catcttgcgttcagtgtgccagccattagg

SEQ ID NO: 256941 - DNA, 32 bp, Artificial Sequence
  Description of Artificial Sequence: Synthetic oligonucleotide
atcttgcgttcagtgtgccagccattaggaac

SEQ ID NO: 256942 - DNA, 31 bp, Artificial Sequence
  Description of Artificial Sequence: Synthetic oligonucleotide
tcttgcgttcagtgtgccagccattaggaac

SEQ ID NO: 256943 - DNA, 30 bp, Artificial Sequence
  Description of Artificial Sequence: Synthetic oligonucleotide
cttgcgttcagtgtgccagccattaggaac

SEQ ID NO: 256944 - DNA, 31 bp, Artificial Sequence
  Description of Artificial Sequence: Synthetic oligonucleotide
ttgcgttcagtgtgccagccattaggaactc

SEQ ID NO: 256945 - DNA, 30 bp, Artificial Sequence
  Description of Artificial Sequence: Synthetic oligonucleotide
tgcgttcagtgtgccagccattaggaactc

SEQ ID NO: 256946 - DNA, 29 bp, Artificial Sequence
  Description of Artificial Sequence: Synthetic oligonucleotide
gcgttcagtgtgccagccattaggaactc

SEQ ID NO: 256947 - DNA, 31 bp, Artificial Sequence
  Description of Artificial Sequence: Synthetic oligonucleotide
cgttcagtgtgccagccattaggaactcatc

SEQ ID NO: 256948 - DNA, 34 bp, Artificial Sequence
  Description of Artificial Sequence: Synthetic oligonucleotide
gttcagtgtgccagccattaggaactcatcaatc

SEQ ID NO: 256949 - DNA, 37 bp, Artificial Sequence
  Description of Artificial Sequence: Synthetic oligonucleotide
ttcagtgtgccagccattaggaactcatcaatcaatg

SEQ ID NO: 256950 - DNA, 36 bp, Artificial Sequence
  Description of Artificial Sequence: Synthetic oligonucleotide
tcagtgtgccagccattaggaactcatcaatcaatg

SEQ ID NO: 256951 - DNA, 35 bp, Artificial Sequence
  Description of Artificial Sequence: Synthetic oligonucleotide
cagtgtgccagccattaggaactcatcaatcaatg

SEQ ID NO: 256952 - DNA, 37 bp, Artificial Sequence
  Description of Artificial Sequence: Synthetic oligonucleotide
agtgtgccagccattaggaactcatcaatcaatgttg

SEQ ID NO: 256953 - DNA, 36 bp, Artificial Sequence
  Description of Artificial Sequence: Synthetic oligonucleotide
gtgtgccagccattaggaactcatcaatcaatgttg

SEQ ID NO: 256954 - DNA, 37 bp, Artificial Sequence
  Description of Artificial Sequence: Synthetic oligonucleotide
tgtgccagccattaggaactcatcaatcaatgttgac

SEQ ID NO: 256955 - DNA, 36 bp, Artificial Sequence
  Description of Artificial Sequence: Synthetic oligonucleotide
gtgccagccattaggaactcatcaatcaatgttgac

SEQ ID NO: 256956 - DNA, 37 bp, Artificial Sequence
  Description of Artificial Sequence: Synthetic oligonucleotide
tgccagccattaggaactcatcaatcaatgttgacac

SEQ ID NO: 256957 - DNA, 36 bp, Artificial Sequence
  Description of Artificial Sequence: Synthetic oligonucleotide
gccagccattaggaactcatcaatcaatgttgacac

SEQ ID NO: 256958 - DNA, 41 bp, Artificial Sequence
  Description of Artificial Sequence: Synthetic oligonucleotide
ccagccattaggaactcatcaatcaatgttgacacataatc

SEQ ID NO: 256959 - DNA, 44 bp, Artificial Sequence
  Description of Artificial Sequence: Synthetic oligonucleotide
cagccattaggaactcatcaatcaatgttgacacataatcatac

SEQ ID NO: 256960 - DNA, 44 bp, Artificial Sequence
  Description of Artificial Sequence: Synthetic oligonucleotide
agccattaggaactcatcaatcaatgttgacacataatcatacg

SEQ ID NO: 256961 - DNA, 43 bp, Artificial Sequence
  Description of Artificial Sequence: Synthetic oligonucleotide
gccattaggaactcatcaatcaatgttgacacataatcatacg

SEQ ID NO: 256962 - DNA, 44 bp, Artificial Sequence
  Description of Artificial Sequence: Synthetic oligonucleotide
ccattaggaactcatcaatcaatgttgacacataatcatacgtg

SEQ ID NO: 256963 - DNA, 45 bp, Artificial Sequence
  Description of Artificial Sequence: Synthetic oligonucleotide
cattaggaactcatcaatcaatgttgacacataatcatacgtgtc

SEQ ID NO: 256964 - DNA, 45 bp, Artificial Sequence
  Description of Artificial Sequence: Synthetic oligonucleotide
attaggaactcatcaatcaatgttgacacataatcatacgtgtcg

SEQ ID NO: 256965 - DNA, 44 bp, Artificial Sequence
  Description of Artificial Sequence: Synthetic oligonucleotide
ttaggaactcatcaatcaatgttgacacataatcatacgtgtcg

SEQ ID NO: 256966 - DNA, 43 bp, Artificial Sequence
  Description of Artificial Sequence: Synthetic oligonucleotide
taggaactcatcaatcaatgttgacacataatcatacgtgtcg

SEQ ID NO: 256967 - DNA, 42 bp, Artificial Sequence
  Description of Artificial Sequence: Synthetic oligonucleotide
aggaactcatcaatcaatgttgacacataatcatacgtgtcg

SEQ ID NO: 256968 - DNA, 41 bp, Artificial Sequence
  Description of Artificial Sequence: Synthetic oligonucleotide
ggaactcatcaatcaatgttgacacataatcatacgtgtcg

SEQ ID NO: 256969 - DNA, 43 bp, Artificial Sequence
  Description of Artificial Sequence: Synthetic oligonucleotide
gaactcatcaatcaatgttgacacataatcatacgtgtcgatc

SEQ ID NO: 256970 - DNA, 43 bp, Artificial Sequence
  Description of Artificial Sequence: Synthetic oligonucleotide
aactcatcaatcaatgttgacacataatcatacgtgtcgatcc

SEQ ID NO: 256971 - DNA, 42 bp, Artificial Sequence
  Description of Artificial Sequence: Synthetic oligonucleotide
actcatcaatcaatgttgacacataatcatacgtgtcgatcc

SEQ ID NO: 256972 - DNA, 41 bp, Artificial Sequence
  Description of Artificial Sequence: Synthetic oligonucleotide
ctcatcaatcaatgttgacacataatcatacgtgtcgatcc

SEQ ID NO: 256973 - DNA, 41 bp, Artificial Sequence
  Description of Artificial Sequence: Synthetic oligonucleotide
tcatcaatcaatgttgacacataatcatacgtgtcgatccc

SEQ ID NO: 256974 - DNA, 40 bp, Artificial Sequence
  Description of Artificial Sequence: Synthetic oligonucleotide
catcaatcaatgttgacacataatcatacgtgtcgatccc

SEQ ID NO: 256975 - DNA, 41 bp, Artificial Sequence
  Description of Artificial Sequence: Synthetic oligonucleotide
atcaatcaatgttgacacataatcatacgtgtcgatcccag

SEQ ID NO: 256976 - DNA, 40 bp, Artificial Sequence
  Description of Artificial Sequence: Synthetic oligonucleotide
tcaatcaatgttgacacataatcatacgtgtcgatcccag

SEQ ID NO: 256977 - DNA, 39 bp, Artificial Sequence
  Description of Artificial Sequence: Synthetic oligonucleotide
caatcaatgttgacacataatcatacgtgtcgatcccag

SEQ ID NO: 256978 - DNA, 39 bp, Artificial Sequence
  Description of Artificial Sequence: Synthetic oligonucleotide
aatcaatgttgacacataatcatacgtgtcgatcccagg

SEQ ID NO: 256979 - DNA, 38 bp, Artificial Sequence
  Description of Artificial Sequence: Synthetic oligonucleotide
atcaatgttgacacataatcatacgtgtcgatcccagg

SEQ ID NO: 256980 - DNA, 37 bp, Artificial Sequence
  Description of Artificial Sequence: Synthetic oligonucleotide
tcaatgttgacacataatcatacgtgtcgatcccagg

SEQ ID NO: 256981 - DNA, 36 bp, Artificial Sequence
  Description of Artificial Sequence: Synthetic oligonucleotide
caatgttgacacataatcatacgtgtcgatcccagg

SEQ ID NO: 256982 - DNA, 36 bp, Artificial Sequence
  Description of Artificial Sequence: Synthetic oligonucleotide
aatgttgacacataatcatacgtgtcgatcccaggc

SEQ ID NO: 256983 - DNA, 35 bp, Artificial Sequence
  Description of Artificial Sequence: Synthetic oligonucleotide
atgttgacacataatcatacgtgtcgatcccaggc

SEQ ID NO: 256984 - DNA, 34 bp, Artificial Sequence
  Description of Artificial Sequence: Synthetic oligonucleotide
tgttgacacataatcatacgtgtcgatcccaggc

SEQ ID NO: 256985 - DNA, 33 bp, Artificial Sequence
  Description of Artificial Sequence: Synthetic oligonucleotide
gttgacacataatcatacgtgtcgatcccaggc

SEQ ID NO: 256986 - DNA, 33 bp, Artificial Sequence
  Description of Artificial Sequence: Synthetic oligonucleotide
ttgacacataatcatacgtgtcgatcccaggcg

SEQ ID NO: 256987 - DNA, 32 bp, Artificial Sequence
  Description of Artificial Sequence: Synthetic oligonucleotide
tgacacataatcatacgtgtcgatcccaggcg

SEQ ID NO: 256988 - DNA, 31 bp, Artificial Sequence
  Description of Artificial Sequence: Synthetic oligonucleotide
gacacataatcatacgtgtcgatcccaggcg

SEQ ID NO: 256989 - DNA, 31 bp, Artificial Sequence
  Description of Artificial Sequence: Synthetic oligonucleotide
acacataatcatacgtgtcgatcccaggcgc

SEQ ID NO: 256990 - DNA, 30 bp, Artificial Sequence
  Description of Artificial Sequence: Synthetic oligonucleotide
cacataatcatacgtgtcgatcccaggcgc

SEQ ID NO: 256991 - DNA, 34 bp, Artificial Sequence
  Description of Artificial Sequence: Synthetic oligonucleotide
acataatcatacgtgtcgatcccaggcgcttaag

SEQ ID NO: 256992 - DNA, 33 bp, Artificial Sequence
  Description of Artificial Sequence: Synthetic oligonucleotide
cataatcatacgtgtcgatcccaggcgcttaag

SEQ ID NO: 256993 - DNA, 34 bp, Artificial Sequence
  Description of Artificial Sequence: Synthetic oligonucleotide
ataatcatacgtgtcgatcccaggcgcttaagag

SEQ ID NO: 256994 - DNA, 33 bp, Artificial Sequence
  Description of Artificial Sequence: Synthetic oligonucleotide
taatcatacgtgtcgatcccaggcgcttaagag

SEQ ID NO: 256995 - DNA, 32 bp, Artificial Sequence
  Description of Artificial Sequence: Synthetic oligonucleotide
aatcatacgtgtcgatcccaggcgcttaagag

SEQ ID NO: 256996 - DNA, 31 bp, Artificial Sequence
  Description of Artificial Sequence: Synthetic oligonucleotide
atcatacgtgtcgatcccaggcgcttaagag

SEQ ID NO: 256997 - DNA, 30 bp, Artificial Sequence
  Description of Artificial Sequence: Synthetic oligonucleotide
tcatacgtgtcgatcccaggcgcttaagag

SEQ ID NO: 256998 - DNA, 29 bp, Artificial Sequence
  Description of Artificial Sequence: Synthetic oligonucleotide
catacgtgtcgatcccaggcgcttaagag

SEQ ID NO: 256999 - DNA, 31 bp, Artificial Sequence
  Description of Artificial Sequence: Synthetic oligonucleotide
atacgtgtcgatcccaggcgcttaagagtag

SEQ ID NO: 257000 - DNA, 30 bp, Artificial Sequence
  Description of Artificial Sequence: Synthetic oligonucleotide
tacgtgtcgatcccaggcgcttaagagtag

SEQ ID NO: 257001 - DNA, 29 bp, Artificial Sequence
  Description of Artificial Sequence: Synthetic oligonucleotide
acgtgtcgatcccaggcgcttaagagtag

SEQ ID NO: 257002 - DNA, 28 bp, Artificial Sequence
  Description of Artificial Sequence: Synthetic oligonucleotide
cgtgtcgatcccaggcgcttaagagtag

SEQ ID NO: 257003 - DNA, 28 bp, Artificial Sequence
  Description of Artificial Sequence: Synthetic oligonucleotide
gtgtcgatcccaggcgcttaagagtagg

SEQ ID NO: 257004 - DNA, 31 bp, Artificial Sequence
  Description of Artificial Sequence: Synthetic oligonucleotide
tgtcgatcccaggcgcttaagagtaggattg

SEQ ID NO: 257005 - DNA, 30 bp, Artificial Sequence
  Description of Artificial Sequence: Synthetic oligonucleotide
gtcgatcccaggcgcttaagagtaggattg

SEQ ID NO: 257006 - DNA, 30 bp, Artificial Sequence
  Description of Artificial Sequence: Synthetic oligonucleotide
tcgatcccaggcgcttaagagtaggattgc

SEQ ID NO: 257007 - DNA, 29 bp, Artificial Sequence
  Description of Artificial Sequence: Synthetic oligonucleotide
cgatcccaggcgcttaagagtaggattgc

SEQ ID NO: 257008 - DNA, 35 bp, Artificial Sequence
  Description of Artificial Sequence: Synthetic oligonucleotide
gatcccaggcgcttaagagtaggattgcaatatac

SEQ ID NO: 257009 - DNA, 36 bp, Artificial Sequence
  Description of Artificial Sequence: Synthetic oligonucleotide
atcccaggcgcttaagagtaggattgcaatatacag

SEQ ID NO: 257010 - DNA, 35 bp, Artificial Sequence
  Description of Artificial Sequence: Synthetic oligonucleotide
tcccaggcgcttaagagtaggattgcaatatacag

SEQ ID NO: 257011 - DNA, 34 bp, Artificial Sequence
  Description of Artificial Sequence: Synthetic oligonucleotide
cccaggcgcttaagagtaggattgcaatatacag

SEQ ID NO: 257012 - DNA, 35 bp, Artificial Sequence
  Description of Artificial Sequence: Synthetic oligonucleotide
ccaggcgcttaagagtaggattgcaatatacagag

SEQ ID NO: 257013 - DNA, 35 bp, Artificial Sequence
  Description of Artificial Sequence: Synthetic oligonucleotide
caggcgcttaagagtaggattgcaatatacagagc

SEQ ID NO: 257014 - DNA, 38 bp, Artificial Sequence
  Description of Artificial Sequence: Synthetic oligonucleotide
aggcgcttaagagtaggattgcaatatacagagctatg

SEQ ID NO: 257015 - DNA, 37 bp, Artificial Sequence
  Description of Artificial Sequence: Synthetic oligonucleotide
ggcgcttaagagtaggattgcaatatacagagctatg

SEQ ID NO: 257016 - DNA, 38 bp, Artificial Sequence
  Description of Artificial Sequence: Synthetic oligonucleotide
gcgcttaagagtaggattgcaatatacagagctatgtg

SEQ ID NO: 257017 - DNA, 38 bp, Artificial Sequence
  Description of Artificial Sequence: Synthetic oligonucleotide
cgcttaagagtaggattgcaatatacagagctatgtgg

SEQ ID NO: 257018 - DNA, 38 bp, Artificial Sequence
  Description of Artificial Sequence: Synthetic oligonucleotide
gcttaagagtaggattgcaatatacagagctatgtggc

SEQ ID NO: 257019 - DNA, 41 bp, Artificial Sequence
  Description of Artificial Sequence: Synthetic oligonucleotide
cttaagagtaggattgcaatatacagagctatgtggctttg

SEQ ID NO: 257020 - DNA, 46 bp, Artificial Sequence
  Description of Artificial Sequence: Synthetic oligonucleotide
ttaagagtaggattgcaatatacagagctatgtggctttgatatag

SEQ ID NO: 257021 - DNA, 45 bp, Artificial Sequence
  Description of Artificial Sequence: Synthetic oligonucleotide
taagagtaggattgcaatatacagagctatgtggctttgatatag

SEQ ID NO: 257022 - DNA, 44 bp, Artificial Sequence
  Description of Artificial Sequence: Synthetic oligonucleotide
aagagtaggattgcaatatacagagctatgtggctttgatatag

SEQ ID NO: 257023 - DNA, 43 bp, Artificial Sequence
  Description of Artificial Sequence: Synthetic oligonucleotide
agagtaggattgcaatatacagagctatgtggctttgatatag

SEQ ID NO: 257024 - DNA, 42 bp, Artificial Sequence
  Description of Artificial Sequence: Synthetic oligonucleotide
gagtaggattgcaatatacagagctatgtggctttgatatag

SEQ ID NO: 257025 - DNA, 42 bp, Artificial Sequence
  Description of Artificial Sequence: Synthetic oligonucleotide
agtaggattgcaatatacagagctatgtggctttgatatagc

SEQ ID NO: 257026 - DNA, 41 bp, Artificial Sequence
  Description of Artificial Sequence: Synthetic oligonucleotide
gtaggattgcaatatacagagctatgtggctttgatatagc

SEQ ID NO: 257027 - DNA, 43 bp, Artificial Sequence
  Description of Artificial Sequence: Synthetic oligonucleotide
taggattgcaatatacagagctatgtggctttgatatagcttc

SEQ ID NO: 257028 - DNA, 42 bp, Artificial Sequence
  Description of Artificial Sequence: Synthetic oligonucleotide
aggattgcaatatacagagctatgtggctttgatatagcttc

SEQ ID NO: 257029 - DNA, 41 bp, Artificial Sequence
  Description of Artificial Sequence: Synthetic oligonucleotide
ggattgcaatatacagagctatgtggctttgatatagcttc

SEQ ID NO: 257030 - DNA, 41 bp, Artificial Sequence
  Description of Artificial Sequence: Synthetic oligonucleotide
gattgcaatatacagagctatgtggctttgatatagcttcc

SEQ ID NO: 257031 - DNA, 41 bp, Artificial Sequence
  Description of Artificial Sequence: Synthetic oligonucleotide
attgcaatatacagagctatgtggctttgatatagcttccc

SEQ ID NO: 257032 - DNA, 40 bp, Artificial Sequence
  Description of Artificial Sequence: Synthetic oligonucleotide
ttgcaatatacagagctatgtggctttgatatagcttccc

SEQ ID NO: 257033 - DNA, 39 bp, Artificial Sequence
  Description of Artificial Sequence: Synthetic oligonucleotide
tgcaatatacagagctatgtggctttgatatagcttccc

SEQ ID NO: 257034 - DNA, 38 bp, Artificial Sequence
  Description of Artificial Sequence: Synthetic oligonucleotide
gcaatatacagagctatgtggctttgatatagcttccc

SEQ ID NO: 257035 - DNA, 38 bp, Artificial Sequence
  Description of Artificial Sequence: Synthetic oligonucleotide
caatatacagagctatgtggctttgatatagcttcccc

SEQ ID NO: 257036 - DNA, 41 bp, Artificial Sequence
  Description of Artificial Sequence: Synthetic oligonucleotide
aatatacagagctatgtggctttgatatagcttcccctaac

SEQ ID NO: 257037 - DNA, 40 bp, Artificial Sequence
  Description of Artificial Sequence: Synthetic oligonucleotide
atatacagagctatgtggctttgatatagcttcccctaac

SEQ ID NO: 257038 - DNA, 39 bp, Artificial Sequence
  Description of Artificial Sequence: Synthetic oligonucleotide
tatacagagctatgtggctttgatatagcttcccctaac

SEQ ID NO: 257039 - DNA, 38 bp, Artificial Sequence
  Description of Artificial Sequence: Synthetic oligonucleotide
atacagagctatgtggctttgatatagcttcccctaac

SEQ ID NO: 257040 - DNA, 37 bp, Artificial Sequence
  Description of Artificial Sequence: Synthetic oligonucleotide
tacagagctatgtggctttgatatagcttcccctaac

SEQ ID NO: 257041 - DNA, 36 bp, Artificial Sequence
  Description of Artificial Sequence: Synthetic oligonucleotide
acagagctatgtggctttgatatagcttcccctaac

SEQ ID NO: 257042 - DNA, 35 bp, Artificial Sequence
  Description of Artificial Sequence: Synthetic oligonucleotide
cagagctatgtggctttgatatagcttcccctaac

SEQ ID NO: 257043 - DNA, 35 bp, Artificial Sequence
  Description of Artificial Sequence: Synthetic oligonucleotide
agagctatgtggctttgatatagcttcccctaacc

SEQ ID NO: 257044 - DNA, 34 bp, Artificial Sequence
  Description of Artificial Sequence: Synthetic oligonucleotide
gagctatgtggctttgatatagcttcccctaacc

SEQ ID NO: 257045 - DNA, 34 bp, Artificial Sequence
  Description of Artificial Sequence: Synthetic oligonucleotide
agctatgtggctttgatatagcttcccctaaccc

SEQ ID NO: 257046 - DNA, 33 bp, Artificial Sequence
  Description of Artificial Sequence: Synthetic oligonucleotide
gctatgtggctttgatatagcttcccctaaccc

SEQ ID NO: 257047 - DNA, 34 bp, Artificial Sequence
  Description of Artificial Sequence: Synthetic oligonucleotide
ctatgtggctttgatatagcttcccctaacccag

SEQ ID NO: 257048 - DNA, 34 bp, Artificial Sequence
  Description of Artificial Sequence: Synthetic oligonucleotide
tatgtggctttgatatagcttcccctaacccagg

SEQ ID NO: 257049 - DNA, 33 bp, Artificial Sequence
  Description of Artificial Sequence: Synthetic oligonucleotide
atgtggctttgatatagcttcccctaacccagg

SEQ ID NO: 257050 - DNA, 32 bp, Artificial Sequence
  Description of Artificial Sequence: Synthetic oligonucleotide
tgtggctttgatatagcttcccctaacccagg

SEQ ID NO: 257051 - DNA, 31 bp, Artificial Sequence
  Description of Artificial Sequence: Synthetic oligonucleotide
gtggctttgatatagcttcccctaacccagg

SEQ ID NO: 257052 - DNA, 32 bp, Artificial Sequence
  Description of Artificial Sequence: Synthetic oligonucleotide
tggctttgatatagcttcccctaacccaggtc

SEQ ID NO: 257053 - DNA, 31 bp, Artificial Sequence
  Description of Artificial Sequence: Synthetic oligonucleotide
ggctttgatatagcttcccctaacccaggtc

SEQ ID NO: 257054 - DNA, 31 bp, Artificial Sequence
  Description of Artificial Sequence: Synthetic oligonucleotide
gctttgatatagcttcccctaacccaggtcc

SEQ ID NO: 257055 - DNA, 31 bp, Artificial Sequence
  Description of Artificial Sequence: Synthetic oligonucleotide
ctttgatatagcttcccctaacccaggtccg

SEQ ID NO: 257056 - DNA, 31 bp, Artificial Sequence
  Description of Artificial Sequence: Synthetic oligonucleotide
tttgatatagcttcccctaacccaggtccgc

SEQ ID NO: 257057 - DNA, 30 bp, Artificial Sequence
  Description of Artificial Sequence: Synthetic oligonucleotide
ttgatatagcttcccctaacccaggtccgc

SEQ ID NO: 257058 - DNA, 29 bp, Artificial Sequence
  Description of Artificial Sequence: Synthetic oligonucleotide
tgatatagcttcccctaacccaggtccgc

SEQ ID NO: 257059 - DNA, 28 bp, Artificial Sequence
  Description of Artificial Sequence: Synthetic oligonucleotide
gatatagcttcccctaacccaggtccgc

SEQ ID NO: 257060 - DNA, 29 bp, Artificial Sequence
  Description of Artificial Sequence: Synthetic oligonucleotide
atatagcttcccctaacccaggtccgcac

SEQ ID NO: 257061 - DNA, 28 bp, Artificial Sequence
  Description of Artificial Sequence: Synthetic oligonucleotide
tatagcttcccctaacccaggtccgcac

SEQ ID NO: 257062 - DNA, 27 bp, Artificial Sequence
  Description of Artificial Sequence: Synthetic oligonucleotide
atagcttcccctaacccaggtccgcac

SEQ ID NO: 257063 - DNA, 27 bp, Artificial Sequence
  Description of Artificial Sequence: Synthetic oligonucleotide
tagcttcccctaacccaggtccgcact

SEQ ID NO: 257064 - DNA, 27 bp, Artificial Sequence
  Description of Artificial Sequence: Synthetic oligonucleotide
agcttcccctaacccaggtccgcactt

SEQ ID NO: 257065 - DNA, 26 bp, Artificial Sequence
  Description of Artificial Sequence: Synthetic oligonucleotide
gcttcccctaacccaggtccgcactt

SEQ ID NO: 257066 - DNA, 27 bp, Artificial Sequence
  Description of Artificial Sequence: Synthetic oligonucleotide
cttcccctaacccaggtccgcacttca

SEQ ID NO: 257067 - DNA, 27 bp, Artificial Sequence
  Description of Artificial Sequence: Synthetic oligonucleotide
ttcccctaacccaggtccgcacttcag

SEQ ID NO: 257068 - DNA, 27 bp, Artificial Sequence
  Description of Artificial Sequence: Synthetic oligonucleotide
tcccctaacccaggtccgcacttcaga

SEQ ID NO: 257069 - DNA, 26 bp, Artificial Sequence
  Description of Artificial Sequence: Synthetic oligonucleotide
cccctaacccaggtccgcacttcaga

SEQ ID NO: 257070 - DNA, 27 bp, Artificial Sequence
  Description of Artificial Sequence: Synthetic oligonucleotide
ccctaacccaggtccgcacttcagagt

SEQ ID NO: 257071 - DNA, 28 bp, Artificial Sequence
  Description of Artificial Sequence: Synthetic oligonucleotide
cctaacccaggtccgcacttcagagtac

SEQ ID NO: 257072 - DNA, 28 bp, Artificial Sequence
  Description of Artificial Sequence: Synthetic oligonucleotide
ctaacccaggtccgcacttcagagtacc

SEQ ID NO: 257073 - DNA, 28 bp, Artificial Sequence
  Description of Artificial Sequence: Synthetic oligonucleotide
taacccaggtccgcacttcagagtaccg

SEQ ID NO: 257074 - DNA, 27 bp, Artificial Sequence
  Description of Artificial Sequence: Synthetic oligonucleotide
aacccaggtccgcacttcagagtaccg

SEQ ID NO: 257075 - DNA, 27 bp, Artificial Sequence
  Description of Artificial Sequence: Synthetic oligonucleotide
acccaggtccgcacttcagagtaccga

SEQ ID NO: 257076 - DNA, 27 bp, Artificial Sequence
  Description of Artificial Sequence: Synthetic oligonucleotide
cccaggtccgcacttcagagtaccgat

SEQ ID NO: 257077 - DNA, 27 bp, Artificial Sequence
  Description of Artificial Sequence: Synthetic oligonucleotide
ccaggtccgcacttcagagtaccgatc

SEQ ID NO: 257078 - DNA, 28 bp, Artificial Sequence
  Description of Artificial Sequence: Synthetic oligonucleotide
caggtccgcacttcagagtaccgatcac

SEQ ID NO: 257079 - DNA, 29 bp, Artificial Sequence
  Description of Artificial Sequence: Synthetic oligonucleotide
aggtccgcacttcagagtaccgatcactc

SEQ ID NO: 257080 - DNA, 28 bp, Artificial Sequence
  Description of Artificial Sequence: Synthetic oligonucleotide
ggtccgcacttcagagtaccgatcactc

SEQ ID NO: 257081 - DNA, 28 bp, Artificial Sequence
  Description of Artificial Sequence: Synthetic oligonucleotide
gtccgcacttcagagtaccgatcactcc

SEQ ID NO: 257082 - DNA, 29 bp, Artificial Sequence
  Description of Artificial Sequence: Synthetic oligonucleotide
tccgcacttcagagtaccgatcactccag

SEQ ID NO: 257083 - DNA, 28 bp, Artificial Sequence
  Description of Artificial Sequence: Synthetic oligonucleotide
ccgcacttcagagtaccgatcactccag

SEQ ID NO: 257084 - DNA, 33 bp, Artificial Sequence
  Description of Artificial Sequence: Synthetic oligonucleotide
cgcacttcagagtaccgatcactccagttatag

SEQ ID NO: 257085 - DNA, 33 bp, Artificial Sequence
  Description of Artificial Sequence: Synthetic oligonucleotide
gcacttcagagtaccgatcactccagttatagg

SEQ ID NO: 257086 - DNA, 34 bp, Artificial Sequence
  Description of Artificial Sequence: Synthetic oligonucleotide
cacttcagagtaccgatcactccagttataggag

SEQ ID NO: 257087 - DNA, 34 bp, Artificial Sequence
  Description of Artificial Sequence: Synthetic oligonucleotide
acttcagagtaccgatcactccagttataggagc

SEQ ID NO: 257088 - DNA, 33 bp, Artificial Sequence
  Description of Artificial Sequence: Synthetic oligonucleotide
cttcagagtaccgatcactccagttataggagc

SEQ ID NO: 257089 - DNA, 37 bp, Artificial Sequence
  Description of Artificial Sequence: Synthetic oligonucleotide
ttcagagtaccgatcactccagttataggagcaaaag

SEQ ID NO: 257090 - DNA, 36 bp, Artificial Sequence
  Description of Artificial Sequence: Synthetic oligonucleotide
tcagagtaccgatcactccagttataggagcaaaag

SEQ ID NO: 257091 - DNA, 35 bp, Artificial Sequence
  Description of Artificial Sequence: Synthetic oligonucleotide
cagagtaccgatcactccagttataggagcaaaag

SEQ ID NO: 257092 - DNA, 40 bp, Artificial Sequence
  Description of Artificial Sequence: Synthetic oligonucleotide
agagtaccgatcactccagttataggagcaaaagttaatg

SEQ ID NO: 257093 - DNA, 39 bp, Artificial Sequence
  Description of Artificial Sequence: Synthetic oligonucleotide
gagtaccgatcactccagttataggagcaaaagttaatg

SEQ ID NO: 257094 - DNA, 42 bp, Artificial Sequence
  Description of Artificial Sequence: Synthetic oligonucleotide
agtaccgatcactccagttataggagcaaaagttaatgaatc

SEQ ID NO: 257095 - DNA, 41 bp, Artificial Sequence
  Description of Artificial Sequence: Synthetic oligonucleotide
gtaccgatcactccagttataggagcaaaagttaatgaatc

SEQ ID NO: 257096 - DNA, 43 bp, Artificial Sequence
  Description of Artificial Sequence: Synthetic oligonucleotide
taccgatcactccagttataggagcaaaagttaatgaatcaac

SEQ ID NO: 257097 - DNA, 42 bp, Artificial Sequence
  Description of Artificial Sequence: Synthetic oligonucleotide
accgatcactccagttataggagcaaaagttaatgaatcaac

SEQ ID NO: 257098 - DNA, 41 bp, Artificial Sequence
  Description of Artificial Sequence: Synthetic oligonucleotide
ccgatcactccagttataggagcaaaagttaatgaatcaac

SEQ ID NO: 257099 - DNA, 42 bp, Artificial Sequence
  Description of Artificial Sequence: Synthetic oligonucleotide
cgatcactccagttataggagcaaaagttaatgaatcaacac

SEQ ID NO: 257100 - DNA, 47 bp, Artificial Sequence
  Description of Artificial Sequence: Synthetic oligonucleotide
gatcactccagttataggagcaaaagttaatgaatcaacacattatg

SEQ ID NO: 257101 - DNA, 49 bp, Artificial Sequence
  Description of Artificial Sequence: Synthetic oligonucleotide
atcactccagttataggagcaaaagttaatgaatcaacacattatgttc

SEQ ID NO: 257102 - DNA, 48 bp, Artificial Sequence
  Description of Artificial Sequence: Synthetic oligonucleotide
tcactccagttataggagcaaaagttaatgaatcaacacattatgttc

SEQ ID NO: 257103 - DNA, 47 bp, Artificial Sequence
  Description of Artificial Sequence: Synthetic oligonucleotide
cactccagttataggagcaaaagttaatgaatcaacacattatgttc

SEQ ID NO: 257104 - DNA, 49 bp, Artificial Sequence
  Description of Artificial Sequence: Synthetic oligonucleotide
actccagttataggagcaaaagttaatgaatcaacacattatgttctag

SEQ ID NO: 257105 - DNA, 48 bp, Artificial Sequence
  Description of Artificial Sequence: Synthetic oligonucleotide
ctccagttataggagcaaaagttaatgaatcaacacattatgttctag

SEQ ID NO: 257106 - DNA, 48 bp, Artificial Sequence
  Description of Artificial Sequence: Synthetic oligonucleotide
tccagttataggagcaaaagttaatgaatcaacacattatgttctagc

SEQ ID NO: 257107 - DNA, 47 bp, Artificial Sequence
  Description of Artificial Sequence: Synthetic oligonucleotide
ccagttataggagcaaaagttaatgaatcaacacattatgttctagc

SEQ ID NO: 257108 - DNA, 47 bp, Artificial Sequence
  Description of Artificial Sequence: Synthetic oligonucleotide
cagttataggagcaaaagttaatgaatcaacacattatgttctagcc

SEQ ID NO: 257109 - DNA, 51 bp, Artificial Sequence
  Description of Artificial Sequence: Synthetic oligonucleotide
agttataggagcaaaagttaatgaatcaacacattatgttctagccttaac

SEQ ID NO: 257110 - DNA, 50 bp, Artificial Sequence
  Description of Artificial Sequence: Synthetic oligonucleotide
gttataggagcaaaagttaatgaatcaacacattatgttctagccttaac

SEQ ID NO: 257111 - DNA, 51 bp, Artificial Sequence
  Description of Artificial Sequence: Synthetic oligonucleotide
ttataggagcaaaagttaatgaatcaacacattatgttctagccttaacag

SEQ ID NO: 257112 - DNA, 50 bp, Artificial Sequence
  Description of Artificial Sequence: Synthetic oligonucleotide
tataggagcaaaagttaatgaatcaacacattatgttctagccttaacag

SEQ ID NO: 257113 - DNA, 49 bp, Artificial Sequence
  Description of Artificial Sequence: Synthetic oligonucleotide
ataggagcaaaagttaatgaatcaacacattatgttctagccttaacag

SEQ ID NO: 257114 - DNA, 48 bp, Artificial Sequence
  Description of Artificial Sequence: Synthetic oligonucleotide
taggagcaaaagttaatgaatcaacacattatgttctagccttaacag

SEQ ID NO: 257115 - DNA, 47 bp, Artificial Sequence
  Description of Artificial Sequence: Synthetic oligonucleotide
aggagcaaaagttaatgaatcaacacattatgttctagccttaacag

SEQ ID NO: 257116 - DNA, 46 bp, Artificial Sequence
  Description of Artificial Sequence: Synthetic oligonucleotide
ggagcaaaagttaatgaatcaacacattatgttctagccttaacag

SEQ ID NO: 257117 - DNA, 48 bp, Artificial Sequence
  Description of Artificial Sequence: Synthetic oligonucleotide
gagcaaaagttaatgaatcaacacattatgttctagccttaacagatg

SEQ ID NO: 257118 - DNA, 50 bp, Artificial Sequence
  Description of Artificial Sequence: Synthetic oligonucleotide
agcaaaagttaatgaatcaacacattatgttctagccttaacagatgtag

SEQ ID NO: 257119 - DNA, 49 bp, Artificial Sequence
  Description of Artificial Sequence: Synthetic oligonucleotide
gcaaaagttaatgaatcaacacattatgttctagccttaacagatgtag

SEQ ID NO: 257120 - DNA, 50 bp, Artificial Sequence
  Description of Artificial Sequence: Synthetic oligonucleotide
caaaagttaatgaatcaacacattatgttctagccttaacagatgtagac

SEQ ID NO: 257121 - DNA, 56 bp, Artificial Sequence
  Description of Artificial Sequence: Synthetic oligonucleotide
aaaagttaatgaatcaacacattatgttctagccttaacagatgtagactttaaac

SEQ ID NO: 257122 - DNA, 55 bp, Artificial Sequence
  Description of Artificial Sequence: Synthetic oligonucleotide
aaagttaatgaatcaacacattatgttctagccttaacagatgtagactttaaac

SEQ ID NO: 257123 - DNA, 54 bp, Artificial Sequence
  Description of Artificial Sequence: Synthetic oligonucleotide
aagttaatgaatcaacacattatgttctagccttaacagatgtagactttaaac

SEQ ID NO: 257124 - DNA, 53 bp, Artificial Sequence
  Description of Artificial Sequence: Synthetic oligonucleotide
agttaatgaatcaacacattatgttctagccttaacagatgtagactttaaac

SEQ ID NO: 257125 - DNA, 52 bp, Artificial Sequence
  Description of Artificial Sequence: Synthetic oligonucleotide
gttaatgaatcaacacattatgttctagccttaacagatgtagactttaaac

SEQ ID NO: 257126 - DNA, 52 bp, Artificial Sequence
  Description of Artificial Sequence: Synthetic oligonucleotide
ttaatgaatcaacacattatgttctagccttaacagatgtagactttaaacg

SEQ ID NO: 257127 - DNA, 51 bp, Artificial Sequence
  Description of Artificial Sequence: Synthetic oligonucleotide
taatgaatcaacacattatgttctagccttaacagatgtagactttaaacg

SEQ ID NO: 257128 - DNA, 50 bp, Artificial Sequence
  Description of Artificial Sequence: Synthetic oligonucleotide
aatgaatcaacacattatgttctagccttaacagatgtagactttaaacg

SEQ ID NO: 257129 - DNA, 49 bp, Artificial Sequence
  Description of Artificial Sequence: Synthetic oligonucleotide
atgaatcaacacattatgttctagccttaacagatgtagactttaaacg

SEQ ID NO: 257130 - DNA, 48 bp, Artificial Sequence
  Description of Artificial Sequence: Synthetic oligonucleotide
tgaatcaacacattatgttctagccttaacagatgtagactttaaacg

SEQ ID NO: 257131 - DNA, 47 bp, Artificial Sequence
  Description of Artificial Sequence: Synthetic oligonucleotide
gaatcaacacattatgttctagccttaacagatgtagactttaaacg

SEQ ID NO: 257132 - DNA, 48 bp, Artificial Sequence
  Description of Artificial Sequence: Synthetic oligonucleotide
aatcaacacattatgttctagccttaacagatgtagactttaaacgtg

SEQ ID NO: 257133 - DNA, 47 bp, Artificial Sequence
  Description of Artificial Sequence: Synthetic oligonucleotide
atcaacacattatgttctagccttaacagatgtagactttaaacgtg

SEQ ID NO: 257134 - DNA, 46 bp, Artificial Sequence
  Description of Artificial Sequence: Synthetic oligonucleotide
tcaacacattatgttctagccttaacagatgtagactttaaacgtg

SEQ ID NO: 257135 - DNA, 45 bp, Artificial Sequence
  Description of Artificial Sequence: Synthetic oligonucleotide
caacacattatgttctagccttaacagatgtagactttaaacgtg

SEQ ID NO: 257136 - DNA, 45 bp, Artificial Sequence
  Description of Artificial Sequence: Synthetic oligonucleotide
aacacattatgttctagccttaacagatgtagactttaaacgtgg

SEQ ID NO: 257137 - DNA, 44 bp, Artificial Sequence
  Description of Artificial Sequence: Synthetic oligonucleotide
acacattatgttctagccttaacagatgtagactttaaacgtgg

SEQ ID NO: 257138 - DNA, 43 bp, Artificial Sequence
  Description of Artificial Sequence: Synthetic oligonucleotide
cacattatgttctagccttaacagatgtagactttaaacgtgg

SEQ ID NO: 257139 - DNA, 44 bp, Artificial Sequence
  Description of Artificial Sequence: Synthetic oligonucleotide
acattatgttctagccttaacagatgtagactttaaacgtggtc

SEQ ID NO: 257140 - DNA, 43 bp, Artificial Sequence
  Description of Artificial Sequence: Synthetic oligonucleotide
cattatgttctagccttaacagatgtagactttaaacgtggtc

SEQ ID NO: 257141 - DNA, 48 bp, Artificial Sequence
  Description of Artificial Sequence: Synthetic oligonucleotide
attatgttctagccttaacagatgtagactttaaacgtggtcaaatac

SEQ ID NO: 257142 - DNA, 47 bp, Artificial Sequence
  Description of Artificial Sequence: Synthetic oligonucleotide
ttatgttctagccttaacagatgtagactttaaacgtggtcaaatac

SEQ ID NO: 257143 - DNA, 46 bp, Artificial Sequence
  Description of Artificial Sequence: Synthetic oligonucleotide
tatgttctagccttaacagatgtagactttaaacgtggtcaaatac

SEQ ID NO: 257144 - DNA, 45 bp, Artificial Sequence
  Description of Artificial Sequence: Synthetic oligonucleotide
atgttctagccttaacagatgtagactttaaacgtggtcaaatac

SEQ ID NO: 257145 - DNA, 44 bp, Artificial Sequence
  Description of Artificial Sequence: Synthetic oligonucleotide
tgttctagccttaacagatgtagactttaaacgtggtcaaatac

SEQ ID NO: 257146 - DNA, 43 bp, Artificial Sequence
  Description of Artificial Sequence: Synthetic oligonucleotide
gttctagccttaacagatgtagactttaaacgtggtcaaatac

SEQ ID NO: 257147 - DNA, 43 bp, Artificial Sequence
  Description of Artificial Sequence: Synthetic oligonucleotide
ttctagccttaacagatgtagactttaaacgtggtcaaatacg

SEQ ID NO: 257148 - DNA, 42 bp, Artificial Sequence
  Description of Artificial Sequence: Synthetic oligonucleotide
tctagccttaacagatgtagactttaaacgtggtcaaatacg

SEQ ID NO: 257149 - DNA, 41 bp, Artificial Sequence
  Description of Artificial Sequence: Synthetic oligonucleotide
ctagccttaacagatgtagactttaaacgtggtcaaatacg

SEQ ID NO: 257150 - DNA, 43 bp, Artificial Sequence
  Description of Artificial Sequence: Synthetic oligonucleotide
tagccttaacagatgtagactttaaacgtggtcaaatacgaag

SEQ ID NO: 257151 - DNA, 42 bp, Artificial Sequence
  Description of Artificial Sequence: Synthetic oligonucleotide
agccttaacagatgtagactttaaacgtggtcaaatacgaag

SEQ ID NO: 257152 - DNA, 41 bp, Artificial Sequence
  Description of Artificial Sequence: Synthetic oligonucleotide
gccttaacagatgtagactttaaacgtggtcaaatacgaag

SEQ ID NO: 257153 - DNA, 41 bp, Artificial Sequence
  Description of Artificial Sequence: Synthetic oligonucleotide
ccttaacagatgtagactttaaacgtggtcaaatacgaagg

SEQ ID NO: 257154 - DNA, 41 bp, Artificial Sequence
  Description of Artificial Sequence: Synthetic oligonucleotide
cttaacagatgtagactttaaacgtggtcaaatacgaaggc

SEQ ID NO: 257155 - DNA, 49 bp, Artificial Sequence
  Description of Artificial Sequence: Synthetic oligonucleotide
ttaacagatgtagactttaaacgtggtcaaatacgaaggcatattattg

SEQ ID NO: 257156 - DNA, 48 bp, Artificial Sequence
  Description of Artificial Sequence: Synthetic oligonucleotide
taacagatgtagactttaaacgtggtcaaatacgaaggcatattattg

SEQ ID NO: 257157 - DNA, 47 bp, Artificial Sequence
  Description of Artificial Sequence: Synthetic oligonucleotide
aacagatgtagactttaaacgtggtcaaatacgaaggcatattattg

SEQ ID NO: 257158 - DNA, 46 bp, Artificial Sequence
  Description of Artificial Sequence: Synthetic oligonucleotide
acagatgtagactttaaacgtggtcaaatacgaaggcatattattg

SEQ ID NO: 257159 - DNA, 45 bp, Artificial Sequence
  Description of Artificial Sequence: Synthetic oligonucleotide
cagatgtagactttaaacgtggtcaaatacgaaggcatattattg

SEQ ID NO: 257160 - DNA, 46 bp, Artificial Sequence
  Description of Artificial Sequence: Synthetic oligonucleotide
agatgtagactttaaacgtggtcaaatacgaaggcatattattgag

SEQ ID NO: 257161 - DNA, 45 bp, Artificial Sequence
  Description of Artificial Sequence: Synthetic oligonucleotide
gatgtagactttaaacgtggtcaaatacgaaggcatattattgag

SEQ ID NO: 257162 - DNA, 45 bp, Artificial Sequence
  Description of Artificial Sequence: Synthetic oligonucleotide
atgtagactttaaacgtggtcaaatacgaaggcatattattgagg

SEQ ID NO: 257163 - DNA, 44 bp, Artificial Sequence
  Description of Artificial Sequence: Synthetic oligonucleotide
tgtagactttaaacgtggtcaaatacgaaggcatattattgagg

SEQ ID NO: 257164 - DNA, 43 bp, Artificial Sequence
  Description of Artificial Sequence: Synthetic oligonucleotide
gtagactttaaacgtggtcaaatacgaaggcatattattgagg

SEQ ID NO: 257165 - DNA, 45 bp, Artificial Sequence
  Description of Artificial Sequence: Synthetic oligonucleotide
tagactttaaacgtggtcaaatacgaaggcatattattgaggatc

SEQ ID NO: 257166 - DNA, 44 bp, Artificial Sequence
  Description of Artificial Sequence: Synthetic oligonucleotide
agactttaaacgtggtcaaatacgaaggcatattattgaggatc

SEQ ID NO: 257167 - DNA, 43 bp, Artificial Sequence
  Description of Artificial Sequence: Synthetic oligonucleotide
gactttaaacgtggtcaaatacgaaggcatattattgaggatc

SEQ ID NO: 257168 - DNA, 43 bp, Artificial Sequence
  Description of Artificial Sequence: Synthetic oligonucleotide
actttaaacgtggtcaaatacgaaggcatattattgaggatcc

SEQ ID NO: 257169 - DNA, 42 bp, Artificial Sequence
  Description of Artificial Sequence: Synthetic oligonucleotide
ctttaaacgtggtcaaatacgaaggcatattattgaggatcc

SEQ ID NO: 257170 - DNA, 43 bp, Artificial Sequence
  Description of Artificial Sequence: Synthetic oligonucleotide
tttaaacgtggtcaaatacgaaggcatattattgaggatcctg

SEQ ID NO: 257171 - DNA, 42 bp, Artificial Sequence
  Description of Artificial Sequence: Synthetic oligonucleotide
ttaaacgtggtcaaatacgaaggcatattattgaggatcctg

SEQ ID NO: 257172 - DNA, 41 bp, Artificial Sequence
  Description of Artificial Sequence: Synthetic oligonucleotide
taaacgtggtcaaatacgaaggcatattattgaggatcctg

SEQ ID NO: 257173 - DNA, 40 bp, Artificial Sequence
  Description of Artificial Sequence: Synthetic oligonucleotide
aaacgtggtcaaatacgaaggcatattattgaggatcctg

SEQ ID NO: 257174 - DNA, 39 bp, Artificial Sequence
  Description of Artificial Sequence: Synthetic oligonucleotide
aacgtggtcaaatacgaaggcatattattgaggatcctg

SEQ ID NO: 257175 - DNA, 38 bp, Artificial Sequence
  Description of Artificial Sequence: Synthetic oligonucleotide
acgtggtcaaatacgaaggcatattattgaggatcctg

SEQ ID NO: 257176 - DNA, 37 bp, Artificial Sequence
  Description of Artificial Sequence: Synthetic oligonucleotide
cgtggtcaaatacgaaggcatattattgaggatcctg

SEQ ID NO: 257177 - DNA, 38 bp, Artificial Sequence
  Description of Artificial Sequence: Synthetic oligonucleotide
gtggtcaaatacgaaggcatattattgaggatcctgag

SEQ ID NO: 257178 - DNA, 38 bp, Artificial Sequence
  Description of Artificial Sequence: Synthetic oligonucleotide
tggtcaaatacgaaggcatattattgaggatcctgagg

SEQ ID NO: 257179 - DNA, 37 bp, Artificial Sequence
  Description of Artificial Sequence: Synthetic oligonucleotide
ggtcaaatacgaaggcatattattgaggatcctgagg

SEQ ID NO: 257180 - DNA, 37 bp, Artificial Sequence
  Description of Artificial Sequence: Synthetic oligonucleotide
gtcaaatacgaaggcatattattgaggatcctgaggg

SEQ ID NO: 257181 - DNA, 38 bp, Artificial Sequence
  Description of Artificial Sequence: Synthetic oligonucleotide
tcaaatacgaaggcatattattgaggatcctgagggag

SEQ ID NO: 257182 - DNA, 37 bp, Artificial Sequence
  Description of Artificial Sequence: Synthetic oligonucleotide
caaatacgaaggcatattattgaggatcctgagggag

SEQ ID NO: 257183 - DNA, 37 bp, Artificial Sequence
  Description of Artificial Sequence: Synthetic oligonucleotide
aaatacgaaggcatattattgaggatcctgagggagc

SEQ ID NO: 257184 - DNA, 36 bp, Artificial Sequence
  Description of Artificial Sequence: Synthetic oligonucleotide
aatacgaaggcatattattgaggatcctgagggagc

SEQ ID NO: 257185 - DNA, 35 bp, Artificial Sequence
  Description of Artificial Sequence: Synthetic oligonucleotide
atacgaaggcatattattgaggatcctgagggagc

SEQ ID NO: 257186 - DNA, 34 bp, Artificial Sequence
  Description of Artificial Sequence: Synthetic oligonucleotide
tacgaaggcatattattgaggatcctgagggagc

SEQ ID NO: 257187 - DNA, 33 bp, Artificial Sequence
  Description of Artificial Sequence: Synthetic oligonucleotide
acgaaggcatattattgaggatcctgagggagc

SEQ ID NO: 257188 - DNA, 32 bp, Artificial Sequence
  Description of Artificial Sequence: Synthetic oligonucleotide
cgaaggcatattattgaggatcctgagggagc

SEQ ID NO: 257189 - DNA, 34 bp, Artificial Sequence
  Description of Artificial Sequence: Synthetic oligonucleotide
gaaggcatattattgaggatcctgagggagcaac

SEQ ID NO: 257190 - DNA, 36 bp, Artificial Sequence
  Description of Artificial Sequence: Synthetic oligonucleotide
aaggcatattattgaggatcctgagggagcaacatg

SEQ ID NO: 257191 - DNA, 35 bp, Artificial Sequence
  Description of Artificial Sequence: Synthetic oligonucleotide
aggcatattattgaggatcctgagggagcaacatg

SEQ ID NO: 257192 - DNA, 34 bp, Artificial Sequence
  Description of Artificial Sequence: Synthetic oligonucleotide
ggcatattattgaggatcctgagggagcaacatg

SEQ ID NO: 257193 - DNA, 34 bp, Artificial Sequence
  Description of Artificial Sequence: Synthetic oligonucleotide
gcatattattgaggatcctgagggagcaacatgg

SEQ ID NO: 257194 - DNA, 34 bp, Artificial Sequence
  Description of Artificial Sequence: Synthetic oligonucleotide
catattattgaggatcctgagggagcaacatggc

SEQ ID NO: 257195 - DNA, 34 bp, Artificial Sequence
  Description of Artificial Sequence: Synthetic oligonucleotide
atattattgaggatcctgagggagcaacatggcc

SEQ ID NO: 257196 - DNA, 33 bp, Artificial Sequence
  Description of Artificial Sequence: Synthetic oligonucleotide
tattattgaggatcctgagggagcaacatggcc

SEQ ID NO: 257197 - DNA, 32 bp, Artificial Sequence
  Description of Artificial Sequence: Synthetic oligonucleotide
attattgaggatcctgagggagcaacatggcc

SEQ ID NO: 257198 - DNA, 31 bp, Artificial Sequence
  Description of Artificial Sequence: Synthetic oligonucleotide
ttattgaggatcctgagggagcaacatggcc

SEQ ID NO: 257199 - DNA, 30 bp, Artificial Sequence
  Description of Artificial Sequence: Synthetic oligonucleotide
tattgaggatcctgagggagcaacatggcc

SEQ ID NO: 257200 - DNA, 29 bp, Artificial Sequence
  Description of Artificial Sequence: Synthetic oligonucleotide
attgaggatcctgagggagcaacatggcc

SEQ ID NO: 257201 - DNA, 28 bp, Artificial Sequence
  Description of Artificial Sequence: Synthetic oligonucleotide
ttgaggatcctgagggagcaacatggcc

SEQ ID NO: 257202 - DNA, 27 bp, Artificial Sequence
  Description of Artificial Sequence: Synthetic oligonucleotide
tgaggatcctgagggagcaacatggcc

SEQ ID NO: 257203 - DNA, 27 bp, Artificial Sequence
  Description of Artificial Sequence: Synthetic oligonucleotide
gaggatcctgagggagcaacatggcct

SEQ ID NO: 257204 - DNA, 27 bp, Artificial Sequence
  Description of Artificial Sequence: Synthetic oligonucleotide
aggatcctgagggagcaacatggcctg

SEQ ID NO: 257205 - DNA, 27 bp, Artificial Sequence
  Description of Artificial Sequence: Synthetic oligonucleotide
ggatcctgagggagcaacatggcctga

SEQ ID NO: 257206 - DNA, 28 bp, Artificial Sequence
  Description of Artificial Sequence: Synthetic oligonucleotide
gatcctgagggagcaacatggcctgaag

SEQ ID NO: 257207 - DNA, 29 bp, Artificial Sequence
  Description of Artificial Sequence: Synthetic oligonucleotide
atcctgagggagcaacatggcctgaagtg

SEQ ID NO: 257208 - DNA, 28 bp, Artificial Sequence
  Description of Artificial Sequence: Synthetic oligonucleotide
tcctgagggagcaacatggcctgaagtg

SEQ ID NO: 257209 - DNA, 27 bp, Artificial Sequence
  Description of Artificial Sequence: Synthetic oligonucleotide
cctgagggagcaacatggcctgaagtg

SEQ ID NO: 257210 - DNA, 28 bp, Artificial Sequence
  Description of Artificial Sequence: Synthetic oligonucleotide
ctgagggagcaacatggcctgaagtgag

SEQ ID NO: 257211 - DNA, 29 bp, Artificial Sequence
  Description of Artificial Sequence: Synthetic oligonucleotide
tgagggagcaacatggcctgaagtgagag

SEQ ID NO: 257212 - DNA, 28 bp, Artificial Sequence
  Description of Artificial Sequence: Synthetic oligonucleotide
gagggagcaacatggcctgaagtgagag

SEQ ID NO: 257213 - DNA, 29 bp, Artificial Sequence
  Description of Artificial Sequence: Synthetic oligonucleotide
agggagcaacatggcctgaagtgagagtg

SEQ ID NO: 257214 - DNA, 28 bp, Artificial Sequence
  Description of Artificial Sequence: Synthetic oligonucleotide
gggagcaacatggcctgaagtgagagtg

SEQ ID NO: 257215 - DNA, 29 bp, Artificial Sequence
  Description of Artificial Sequence: Synthetic oligonucleotide
ggagcaacatggcctgaagtgagagtgtg

SEQ ID NO: 257216 - DNA, 31 bp, Artificial Sequence
  Description of Artificial Sequence: Synthetic oligonucleotide
gagcaacatggcctgaagtgagagtgtgttc

SEQ ID NO: 257217 - DNA, 31 bp, Artificial Sequence
  Description of Artificial Sequence: Synthetic oligonucleotide
agcaacatggcctgaagtgagagtgtgttcc

SEQ ID NO: 257218 - DNA, 30 bp, Artificial Sequence
  Description of Artificial Sequence: Synthetic oligonucleotide
gcaacatggcctgaagtgagagtgtgttcc

SEQ ID NO: 257219 - DNA, 31 bp, Artificial Sequence
  Description of Artificial Sequence: Synthetic oligonucleotide
caacatggcctgaagtgagagtgtgttcctg

SEQ ID NO: 257220 - DNA, 33 bp, Artificial Sequence
  Description of Artificial Sequence: Synthetic oligonucleotide
aacatggcctgaagtgagagtgtgttcctgttc

SEQ ID NO: 257221 - DNA, 32 bp, Artificial Sequence
  Description of Artificial Sequence: Synthetic oligonucleotide
acatggcctgaagtgagagtgtgttcctgttc

SEQ ID NO: 257222 - DNA, 31 bp, Artificial Sequence
  Description of Artificial Sequence: Synthetic oligonucleotide
catggcctgaagtgagagtgtgttcctgttc

SEQ ID NO: 257223 - DNA, 33 bp, Artificial Sequence
  Description of Artificial Sequence: Synthetic oligonucleotide
atggcctgaagtgagagtgtgttcctgttcttc

SEQ ID NO: 257224 - DNA, 32 bp, Artificial Sequence
  Description of Artificial Sequence: Synthetic oligonucleotide
tggcctgaagtgagagtgtgttcctgttcttc

SEQ ID NO: 257225 - DNA, 31 bp, Artificial Sequence
  Description of Artificial Sequence: Synthetic oligonucleotide
ggcctgaagtgagagtgtgttcctgttcttc

SEQ ID NO: 257226 - DNA, 32 bp, Artificial Sequence
  Description of Artificial Sequence: Synthetic oligonucleotide
gcctgaagtgagagtgtgttcctgttcttctc

SEQ ID NO: 257227 - DNA, 33 bp, Artificial Sequence
  Description of Artificial Sequence: Synthetic oligonucleotide
cctgaagtgagagtgtgttcctgttcttctcag

SEQ ID NO: 257228 - DNA, 33 bp, Artificial Sequence
  Description of Artificial Sequence: Synthetic oligonucleotide
ctgaagtgagagtgtgttcctgttcttctcagg

SEQ ID NO: 257229 - DNA, 34 bp, Artificial Sequence
  Description of Artificial Sequence: Synthetic oligonucleotide
tgaagtgagagtgtgttcctgttcttctcaggtg

SEQ ID NO: 257230 - DNA, 33 bp, Artificial Sequence
  Description of Artificial Sequence: Synthetic oligonucleotide
gaagtgagagtgtgttcctgttcttctcaggtg

SEQ ID NO: 257231 - DNA, 34 bp, Artificial Sequence
  Description of Artificial Sequence: Synthetic oligonucleotide
aagtgagagtgtgttcctgttcttctcaggtgtc

SEQ ID NO: 257232 - DNA, 33 bp, Artificial Sequence
  Description of Artificial Sequence: Synthetic oligonucleotide
agtgagagtgtgttcctgttcttctcaggtgtc

SEQ ID NO: 257233 - DNA, 32 bp, Artificial Sequence
  Description of Artificial Sequence: Synthetic oligonucleotide
gtgagagtgtgttcctgttcttctcaggtgtc

SEQ ID NO: 257234 - DNA, 33 bp, Artificial Sequence
  Description of Artificial Sequence: Synthetic oligonucleotide
tgagagtgtgttcctgttcttctcaggtgtcag

SEQ ID NO: 257235 - DNA, 32 bp, Artificial Sequence
  Description of Artificial Sequence: Synthetic oligonucleotide
gagagtgtgttcctgttcttctcaggtgtcag

SEQ ID NO: 257236 - DNA, 32 bp, Artificial Sequence
  Description of Artificial Sequence: Synthetic oligonucleotide
agagtgtgttcctgttcttctcaggtgtcagg

SEQ ID NO: 257237 - DNA, 31 bp, Artificial Sequence
  Description of Artificial Sequence: Synthetic oligonucleotide
gagtgtgttcctgttcttctcaggtgtcagg

SEQ ID NO: 257238 - DNA, 34 bp, Artificial Sequence
  Description of Artificial Sequence: Synthetic oligonucleotide
agtgtgttcctgttcttctcaggtgtcaggaaag

SEQ ID NO: 257239 - DNA, 33 bp, Artificial Sequence
  Description of Artificial Sequence: Synthetic oligonucleotide
gtgtgttcctgttcttctcaggtgtcaggaaag

SEQ ID NO: 257240 - DNA, 36 bp, Artificial Sequence
  Description of Artificial Sequence: Synthetic oligonucleotide
tgtgttcctgttcttctcaggtgtcaggaaagtttg

SEQ ID NO: 257241 - DNA, 35 bp, Artificial Sequence
  Description of Artificial Sequence: Synthetic oligonucleotide
gtgttcctgttcttctcaggtgtcaggaaagtttg

SEQ ID NO: 257242 - DNA, 37 bp, Artificial Sequence
  Description of Artificial Sequence: Synthetic oligonucleotide
tgttcctgttcttctcaggtgtcaggaaagtttgtac

SEQ ID NO: 257243 - DNA, 36 bp, Artificial Sequence
  Description of Artificial Sequence: Synthetic oligonucleotide
gttcctgttcttctcaggtgtcaggaaagtttgtac

SEQ ID NO: 257244 - DNA, 38 bp, Artificial Sequence
  Description of Artificial Sequence: Synthetic oligonucleotide
ttcctgttcttctcaggtgtcaggaaagtttgtactac

SEQ ID NO: 257245 - DNA, 37 bp, Artificial Sequence
  Description of Artificial Sequence: Synthetic oligonucleotide
tcctgttcttctcaggtgtcaggaaagtttgtactac

SEQ ID NO: 257246 - DNA, 36 bp, Artificial Sequence
  Description of Artificial Sequence: Synthetic oligonucleotide
cctgttcttctcaggtgtcaggaaagtttgtactac

SEQ ID NO: 257247 - DNA, 38 bp, Artificial Sequence
  Description of Artificial Sequence: Synthetic oligonucleotide
ctgttcttctcaggtgtcaggaaagtttgtactacatg

SEQ ID NO: 257248 - DNA, 38 bp, Artificial Sequence
  Description of Artificial Sequence: Synthetic oligonucleotide
tgttcttctcaggtgtcaggaaagtttgtactacatgc

SEQ ID NO: 257249 - DNA, 37 bp, Artificial Sequence
  Description of Artificial Sequence: Synthetic oligonucleotide
gttcttctcaggtgtcaggaaagtttgtactacatgc

SEQ ID NO: 257250 - DNA, 38 bp, Artificial Sequence
  Description of Artificial Sequence: Synthetic oligonucleotide
ttcttctcaggtgtcaggaaagtttgtactacatgcac

SEQ ID NO: 257251 - DNA, 37 bp, Artificial Sequence
  Description of Artificial Sequence: Synthetic oligonucleotide
tcttctcaggtgtcaggaaagtttgtactacatgcac

SEQ ID NO: 257252 - DNA, 36 bp, Artificial Sequence
  Description of Artificial Sequence: Synthetic oligonucleotide
cttctcaggtgtcaggaaagtttgtactacatgcac

SEQ ID NO: 257253 - DNA, 37 bp, Artificial Sequence
  Description of Artificial Sequence: Synthetic oligonucleotide
ttctcaggtgtcaggaaagtttgtactacatgcactc

SEQ ID NO: 257254 - DNA, 36 bp, Artificial Sequence
  Description of Artificial Sequence: Synthetic oligonucleotide
tctcaggtgtcaggaaagtttgtactacatgcactc

SEQ ID NO: 257255 - DNA, 35 bp, Artificial Sequence
  Description of Artificial Sequence: Synthetic oligonucleotide
ctcaggtgtcaggaaagtttgtactacatgcactc

SEQ ID NO: 257256 - DNA, 35 bp, Artificial Sequence
  Description of Artificial Sequence: Synthetic oligonucleotide
tcaggtgtcaggaaagtttgtactacatgcactcc

SEQ ID NO: 257257 - DNA, 34 bp, Artificial Sequence
  Description of Artificial Sequence: Synthetic oligonucleotide
caggtgtcaggaaagtttgtactacatgcactcc

SEQ ID NO: 257258 - DNA, 35 bp, Artificial Sequence
  Description of Artificial Sequence: Synthetic oligonucleotide
aggtgtcaggaaagtttgtactacatgcactccag

SEQ ID NO: 257259 - DNA, 34 bp, Artificial Sequence
  Description of Artificial Sequence: Synthetic oligonucleotide
ggtgtcaggaaagtttgtactacatgcactccag

SEQ ID NO: 257260 - DNA, 34 bp, Artificial Sequence
  Description of Artificial Sequence: Synthetic oligonucleotide
gtgtcaggaaagtttgtactacatgcactccagc

SEQ ID NO: 257261 - DNA, 36 bp, Artificial Sequence
  Description of Artificial Sequence: Synthetic oligonucleotide
tgtcaggaaagtttgtactacatgcactccagcttg

SEQ ID NO: 257262 - DNA, 35 bp, Artificial Sequence
  Description of Artificial Sequence: Synthetic oligonucleotide
gtcaggaaagtttgtactacatgcactccagcttg

SEQ ID NO: 257263 - DNA, 36 bp, Artificial Sequence
  Description of Artificial Sequence: Synthetic oligonucleotide
tcaggaaagtttgtactacatgcactccagcttgag

SEQ ID NO: 257264 - DNA, 35 bp, Artificial Sequence
  Description of Artificial Sequence: Synthetic oligonucleotide
caggaaagtttgtactacatgcactccagcttgag

SEQ ID NO: 257265 - DNA, 37 bp, Artificial Sequence
  Description of Artificial Sequence: Synthetic oligonucleotide
aggaaagtttgtactacatgcactccagcttgagaag

SEQ ID NO: 257266 - DNA, 36 bp, Artificial Sequence
  Description of Artificial Sequence: Synthetic oligonucleotide
ggaaagtttgtactacatgcactccagcttgagaag

SEQ ID NO: 257267 - DNA, 36 bp, Artificial Sequence
  Description of Artificial Sequence: Synthetic oligonucleotide
gaaagtttgtactacatgcactccagcttgagaagc

SEQ ID NO: 257268 - DNA, 39 bp, Artificial Sequence
  Description of Artificial Sequence: Synthetic oligonucleotide
aaagtttgtactacatgcactccagcttgagaagcaaag

SEQ ID NO: 257269 - DNA, 38 bp, Artificial Sequence
  Description of Artificial Sequence: Synthetic oligonucleotide
aagtttgtactacatgcactccagcttgagaagcaaag

SEQ ID NO: 257270 - DNA, 37 bp, Artificial Sequence
  Description of Artificial Sequence: Synthetic oligonucleotide
agtttgtactacatgcactccagcttgagaagcaaag

SEQ ID NO: 257271 - DNA, 36 bp, Artificial Sequence
  Description of Artificial Sequence: Synthetic oligonucleotide
gtttgtactacatgcactccagcttgagaagcaaag

SEQ ID NO: 257272 - DNA, 37 bp, Artificial Sequence
  Description of Artificial Sequence: Synthetic oligonucleotide
tttgtactacatgcactccagcttgagaagcaaagtg

SEQ ID NO: 257273 - DNA, 36 bp, Artificial Sequence
  Description of Artificial Sequence: Synthetic oligonucleotide
ttgtactacatgcactccagcttgagaagcaaagtg

SEQ ID NO: 257274 - DNA, 35 bp, Artificial Sequence
  Description of Artificial Sequence: Synthetic oligonucleotide
tgtactacatgcactccagcttgagaagcaaagtg

SEQ ID NO: 257275 - DNA, 34 bp, Artificial Sequence
  Description of Artificial Sequence: Synthetic oligonucleotide
gtactacatgcactccagcttgagaagcaaagtg

SEQ ID NO: 257276 - DNA, 34 bp, Artificial Sequence
  Description of Artificial Sequence: Synthetic oligonucleotide
tactacatgcactccagcttgagaagcaaagtgc

SEQ ID NO: 257277 - DNA, 33 bp, Artificial Sequence
  Description of Artificial Sequence: Synthetic oligonucleotide
actacatgcactccagcttgagaagcaaagtgc

SEQ ID NO: 257278 - DNA, 32 bp, Artificial Sequence
  Description of Artificial Sequence: Synthetic oligonucleotide
ctacatgcactccagcttgagaagcaaagtgc

SEQ ID NO: 257279 - DNA, 36 bp, Artificial Sequence
  Description of Artificial Sequence: Synthetic oligonucleotide
tacatgcactccagcttgagaagcaaagtgcatatc

SEQ ID NO: 257280 - DNA, 35 bp, Artificial Sequence
  Description of Artificial Sequence: Synthetic oligonucleotide
acatgcactccagcttgagaagcaaagtgcatatc

SEQ ID NO: 257281 - DNA, 34 bp, Artificial Sequence
  Description of Artificial Sequence: Synthetic oligonucleotide
catgcactccagcttgagaagcaaagtgcatatc

SEQ ID NO: 257282 - DNA, 34 bp, Artificial Sequence
  Description of Artificial Sequence: Synthetic oligonucleotide
atgcactccagcttgagaagcaaagtgcatatcg

SEQ ID NO: 257283 - DNA, 33 bp, Artificial Sequence
  Description of Artificial Sequence: Synthetic oligonucleotide
tgcactccagcttgagaagcaaagtgcatatcg

SEQ ID NO: 257284 - DNA, 32 bp, Artificial Sequence
  Description of Artificial Sequence: Synthetic oligonucleotide
gcactccagcttgagaagcaaagtgcatatcg

SEQ ID NO: 257285 - DNA, 34 bp, Artificial Sequence
  Description of Artificial Sequence: Synthetic oligonucleotide
cactccagcttgagaagcaaagtgcatatcgatg

SEQ ID NO: 257286 - DNA, 34 bp, Artificial Sequence
  Description of Artificial Sequence: Synthetic oligonucleotide
actccagcttgagaagcaaagtgcatatcgatgc

SEQ ID NO: 257287 - DNA, 33 bp, Artificial Sequence
  Description of Artificial Sequence: Synthetic oligonucleotide
ctccagcttgagaagcaaagtgcatatcgatgc

SEQ ID NO: 257288 - DNA, 33 bp, Artificial Sequence
  Description of Artificial Sequence: Synthetic oligonucleotide
tccagcttgagaagcaaagtgcatatcgatgcc

SEQ ID NO: 257289 - DNA, 32 bp, Artificial Sequence
  Description of Artificial Sequence: Synthetic oligonucleotide
ccagcttgagaagcaaagtgcatatcgatgcc

SEQ ID NO: 257290 - DNA, 34 bp, Artificial Sequence
  Description of Artificial Sequence: Synthetic oligonucleotide
cagcttgagaagcaaagtgcatatcgatgccatg

SEQ ID NO: 257291 - DNA, 38 bp, Artificial Sequence
  Description of Artificial Sequence: Synthetic oligonucleotide
agcttgagaagcaaagtgcatatcgatgccatgaatac

SEQ ID NO: 257292 - DNA, 37 bp, Artificial Sequence
  Description of Artificial Sequence: Synthetic oligonucleotide
gcttgagaagcaaagtgcatatcgatgccatgaatac

SEQ ID NO: 257293 - DNA, 42 bp, Artificial Sequence
  Description of Artificial Sequence: Synthetic oligonucleotide
cttgagaagcaaagtgcatatcgatgccatgaatactataag

SEQ ID NO: 257294 - DNA, 46 bp, Artificial Sequence
  Description of Artificial Sequence: Synthetic oligonucleotide
ttgagaagcaaagtgcatatcgatgccatgaatactataagttatg

SEQ ID NO: 257295 - DNA, 45 bp, Artificial Sequence
  Description of Artificial Sequence: Synthetic oligonucleotide
tgagaagcaaagtgcatatcgatgccatgaatactataagttatg

SEQ ID NO: 257296 - DNA, 44 bp, Artificial Sequence
  Description of Artificial Sequence: Synthetic oligonucleotide
gagaagcaaagtgcatatcgatgccatgaatactataagttatg

SEQ ID NO: 257297 - DNA, 46 bp, Artificial Sequence
  Description of Artificial Sequence: Synthetic oligonucleotide
agaagcaaagtgcatatcgatgccatgaatactataagttatgttc

SEQ ID NO: 257298 - DNA, 45 bp, Artificial Sequence
  Description of Artificial Sequence: Synthetic oligonucleotide
gaagcaaagtgcatatcgatgccatgaatactataagttatgttc

SEQ ID NO: 257299 - DNA, 46 bp, Artificial Sequence
  Description of Artificial Sequence: Synthetic oligonucleotide
aagcaaagtgcatatcgatgccatgaatactataagttatgttctc

SEQ ID NO: 257300 - DNA, 45 bp, Artificial Sequence
  Description of Artificial Sequence: Synthetic oligonucleotide
agcaaagtgcatatcgatgccatgaatactataagttatgttctc

SEQ ID NO: 257301 - DNA, 44 bp, Artificial Sequence
  Description of Artificial Sequence: Synthetic oligonucleotide
gcaaagtgcatatcgatgccatgaatactataagttatgttctc

SEQ ID NO: 257302 - DNA, 46 bp, Artificial Sequence
  Description of Artificial Sequence: Synthetic oligonucleotide
caaagtgcatatcgatgccatgaatactataagttatgttctcttg

SEQ ID NO: 257303 - DNA, 46 bp, Artificial Sequence
  Description of Artificial Sequence: Synthetic oligonucleotide
aaagtgcatatcgatgccatgaatactataagttatgttctcttgc

SEQ ID NO: 257304 - DNA, 45 bp, Artificial Sequence
  Description of Artificial Sequence: Synthetic oligonucleotide
aagtgcatatcgatgccatgaatactataagttatgttctcttgc

SEQ ID NO: 257305 - DNA, 44 bp, Artificial Sequence
  Description of Artificial Sequence: Synthetic oligonucleotide
agtgcatatcgatgccatgaatactataagttatgttctcttgc

SEQ ID NO: 257306 - DNA, 43 bp, Artificial Sequence
  Description of Artificial Sequence: Synthetic oligonucleotide
gtgcatatcgatgccatgaatactataagttatgttctcttgc

SEQ ID NO: 257307 - DNA, 44 bp, Artificial Sequence
  Description of Artificial Sequence: Synthetic oligonucleotide
tgcatatcgatgccatgaatactataagttatgttctcttgcag

SEQ ID NO: 257308 - DNA, 43 bp, Artificial Sequence
  Description of Artificial Sequence: Synthetic oligonucleotide
gcatatcgatgccatgaatactataagttatgttctcttgcag

SEQ ID NO: 257309 - DNA, 44 bp, Artificial Sequence
  Description of Artificial Sequence: Synthetic oligonucleotide
catatcgatgccatgaatactataagttatgttctcttgcagag

SEQ ID NO: 257310 - DNA, 47 bp, Artificial Sequence
  Description of Artificial Sequence: Synthetic oligonucleotide
atatcgatgccatgaatactataagttatgttctcttgcagagaaag

SEQ ID NO: 257311 - DNA, 46 bp, Artificial Sequence
  Description of Artificial Sequence: Synthetic oligonucleotide
tatcgatgccatgaatactataagttatgttctcttgcagagaaag

SEQ ID NO: 257312 - DNA, 45 bp, Artificial Sequence
  Description of Artificial Sequence: Synthetic oligonucleotide
atcgatgccatgaatactataagttatgttctcttgcagagaaag

SEQ ID NO: 257313 - DNA, 44 bp, Artificial Sequence
  Description of Artificial Sequence: Synthetic oligonucleotide
tcgatgccatgaatactataagttatgttctcttgcagagaaag

SEQ ID NO: 257314 - DNA, 43 bp, Artificial Sequence
  Description of Artificial Sequence: Synthetic oligonucleotide
cgatgccatgaatactataagttatgttctcttgcagagaaag

SEQ ID NO: 257315 - DNA, 43 bp, Artificial Sequence
  Description of Artificial Sequence: Synthetic oligonucleotide
gatgccatgaatactataagttatgttctcttgcagagaaagc

SEQ ID NO: 257316 - DNA, 45 bp, Artificial Sequence
  Description of Artificial Sequence: Synthetic oligonucleotide
atgccatgaatactataagttatgttctcttgcagagaaagcaac

SEQ ID NO: 257317 - DNA, 44 bp, Artificial Sequence
  Description of Artificial Sequence: Synthetic oligonucleotide
tgccatgaatactataagttatgttctcttgcagagaaagcaac

SEQ ID NO: 257318 - DNA, 43 bp, Artificial Sequence
  Description of Artificial Sequence: Synthetic oligonucleotide
gccatgaatactataagttatgttctcttgcagagaaagcaac

SEQ ID NO: 257319 - DNA, 44 bp, Artificial Sequence
  Description of Artificial Sequence: Synthetic oligonucleotide
ccatgaatactataagttatgttctcttgcagagaaagcaacac

SEQ ID NO: 257320 - DNA, 45 bp, Artificial Sequence
  Description of Artificial Sequence: Synthetic oligonucleotide
catgaatactataagttatgttctcttgcagagaaagcaacactg

SEQ ID NO: 257321 - DNA, 46 bp, Artificial Sequence
  Description of Artificial Sequence: Synthetic oligonucleotide
atgaatactataagttatgttctcttgcagagaaagcaacactgac

SEQ ID NO: 257322 - DNA, 45 bp, Artificial Sequence
  Description of Artificial Sequence: Synthetic oligonucleotide
tgaatactataagttatgttctcttgcagagaaagcaacactgac

SEQ ID NO: 257323 - DNA, 44 bp, Artificial Sequence
  Description of Artificial Sequence: Synthetic oligonucleotide
gaatactataagttatgttctcttgcagagaaagcaacactgac

SEQ ID NO: 257324 - DNA, 45 bp, Artificial Sequence
  Description of Artificial Sequence: Synthetic oligonucleotide
aatactataagttatgttctcttgcagagaaagcaacactgacag

SEQ ID NO: 257325 - DNA, 44 bp, Artificial Sequence
  Description of Artificial Sequence: Synthetic oligonucleotide
atactataagttatgttctcttgcagagaaagcaacactgacag

SEQ ID NO: 257326 - DNA, 43 bp, Artificial Sequence
  Description of Artificial Sequence: Synthetic oligonucleotide
tactataagttatgttctcttgcagagaaagcaacactgacag

SEQ ID NO: 257327 - DNA, 42 bp, Artificial Sequence
  Description of Artificial Sequence: Synthetic oligonucleotide
actataagttatgttctcttgcagagaaagcaacactgacag

SEQ ID NO: 257328 - DNA, 41 bp, Artificial Sequence
  Description of Artificial Sequence: Synthetic oligonucleotide
ctataagttatgttctcttgcagagaaagcaacactgacag

SEQ ID NO: 257329 - DNA, 43 bp, Artificial Sequence
  Description of Artificial Sequence: Synthetic oligonucleotide
tataagttatgttctcttgcagagaaagcaacactgacagaag

SEQ ID NO: 257330 - DNA, 42 bp, Artificial Sequence
  Description of Artificial Sequence: Synthetic oligonucleotide
ataagttatgttctcttgcagagaaagcaacactgacagaag

SEQ ID NO: 257331 - DNA, 41 bp, Artificial Sequence
  Description of Artificial Sequence: Synthetic oligonucleotide
taagttatgttctcttgcagagaaagcaacactgacagaag

SEQ ID NO: 257332 - DNA, 40 bp, Artificial Sequence
  Description of Artificial Sequence: Synthetic oligonucleotide
aagttatgttctcttgcagagaaagcaacactgacagaag

SEQ ID NO: 257333 - DNA, 39 bp, Artificial Sequence
  Description of Artificial Sequence: Synthetic oligonucleotide
agttatgttctcttgcagagaaagcaacactgacagaag

SEQ ID NO: 257334 - DNA, 38 bp, Artificial Sequence
  Description of Artificial Sequence: Synthetic oligonucleotide
gttatgttctcttgcagagaaagcaacactgacagaag

SEQ ID NO: 257335 - DNA, 38 bp, Artificial Sequence
  Description of Artificial Sequence: Synthetic oligonucleotide
ttatgttctcttgcagagaaagcaacactgacagaagc

SEQ ID NO: 257336 - DNA, 37 bp, Artificial Sequence
  Description of Artificial Sequence: Synthetic oligonucleotide
tatgttctcttgcagagaaagcaacactgacagaagc

SEQ ID NO: 257337 - DNA, 36 bp, Artificial Sequence
  Description of Artificial Sequence: Synthetic oligonucleotide
atgttctcttgcagagaaagcaacactgacagaagc

SEQ ID NO: 257338 - DNA, 35 bp, Artificial Sequence
  Description of Artificial Sequence: Synthetic oligonucleotide
tgttctcttgcagagaaagcaacactgacagaagc

SEQ ID NO: 257339 - DNA, 34 bp, Artificial Sequence
  Description of Artificial Sequence: Synthetic oligonucleotide
gttctcttgcagagaaagcaacactgacagaagc

SEQ ID NO: 257340 - DNA, 38 bp, Artificial Sequence
  Description of Artificial Sequence: Synthetic oligonucleotide
ttctcttgcagagaaagcaacactgacagaagcttttg

SEQ ID NO: 257341 - DNA, 37 bp, Artificial Sequence
  Description of Artificial Sequence: Synthetic oligonucleotide
tctcttgcagagaaagcaacactgacagaagcttttg

SEQ ID NO: 257342 - DNA, 36 bp, Artificial Sequence
  Description of Artificial Sequence: Synthetic oligonucleotide
ctcttgcagagaaagcaacactgacagaagcttttg

SEQ ID NO: 257343 - DNA, 36 bp, Artificial Sequence
  Description of Artificial Sequence: Synthetic oligonucleotide
tcttgcagagaaagcaacactgacagaagcttttgc

SEQ ID NO: 257344 - DNA, 35 bp, Artificial Sequence
  Description of Artificial Sequence: Synthetic oligonucleotide
cttgcagagaaagcaacactgacagaagcttttgc

SEQ ID NO: 257345 - DNA, 36 bp, Artificial Sequence
  Description of Artificial Sequence: Synthetic oligonucleotide
ttgcagagaaagcaacactgacagaagcttttgctg

SEQ ID NO: 257346 - DNA, 35 bp, Artificial Sequence
  Description of Artificial Sequence: Synthetic oligonucleotide
tgcagagaaagcaacactgacagaagcttttgctg

SEQ ID NO: 257347 - DNA, 34 bp, Artificial Sequence
  Description of Artificial Sequence: Synthetic oligonucleotide
gcagagaaagcaacactgacagaagcttttgctg

SEQ ID NO: 257348 - DNA, 35 bp, Artificial Sequence
  Description of Artificial Sequence: Synthetic oligonucleotide
cagagaaagcaacactgacagaagcttttgctgtc

SEQ ID NO: 257349 - DNA, 35 bp, Artificial Sequence
  Description of Artificial Sequence: Synthetic oligonucleotide
agagaaagcaacactgacagaagcttttgctgtcc

SEQ ID NO: 257350 - DNA, 34 bp, Artificial Sequence
  Description of Artificial Sequence: Synthetic oligonucleotide
gagaaagcaacactgacagaagcttttgctgtcc

SEQ ID NO: 257351 - DNA, 36 bp, Artificial Sequence
  Description of Artificial Sequence: Synthetic oligonucleotide
agaaagcaacactgacagaagcttttgctgtcctag

SEQ ID NO: 257352 - DNA, 35 bp, Artificial Sequence
  Description of Artificial Sequence: Synthetic oligonucleotide
gaaagcaacactgacagaagcttttgctgtcctag

SEQ ID NO: 257353 - DNA, 35 bp, Artificial Sequence
  Description of Artificial Sequence: Synthetic oligonucleotide
aaagcaacactgacagaagcttttgctgtcctagc

SEQ ID NO: 257354 - DNA, 34 bp, Artificial Sequence
  Description of Artificial Sequence: Synthetic oligonucleotide
aagcaacactgacagaagcttttgctgtcctagc

SEQ ID NO: 257355 - DNA, 33 bp, Artificial Sequence
  Description of Artificial Sequence: Synthetic oligonucleotide
agcaacactgacagaagcttttgctgtcctagc

SEQ ID NO: 257356 - DNA, 32 bp, Artificial Sequence
  Description of Artificial Sequence: Synthetic oligonucleotide
gcaacactgacagaagcttttgctgtcctagc

SEQ ID NO: 257357 - DNA, 33 bp, Artificial Sequence
  Description of Artificial Sequence: Synthetic oligonucleotide
caacactgacagaagcttttgctgtcctagctg

SEQ ID NO: 257358 - DNA, 33 bp, Artificial Sequence
  Description of Artificial Sequence: Synthetic oligonucleotide
aacactgacagaagcttttgctgtcctagctgg

SEQ ID NO: 257359 - DNA, 32 bp, Artificial Sequence
  Description of Artificial Sequence: Synthetic oligonucleotide
acactgacagaagcttttgctgtcctagctgg

SEQ ID NO: 257360 - DNA, 31 bp, Artificial Sequence
  Description of Artificial Sequence: Synthetic oligonucleotide
cactgacagaagcttttgctgtcctagctgg

SEQ ID NO: 257361 - DNA, 35 bp, Artificial Sequence
  Description of Artificial Sequence: Synthetic oligonucleotide
actgacagaagcttttgctgtcctagctggaaaag

SEQ ID NO: 257362 - DNA, 34 bp, Artificial Sequence
  Description of Artificial Sequence: Synthetic oligonucleotide
ctgacagaagcttttgctgtcctagctggaaaag

SEQ ID NO: 257363 - DNA, 34 bp, Artificial Sequence
  Description of Artificial Sequence: Synthetic oligonucleotide
tgacagaagcttttgctgtcctagctggaaaagc

SEQ ID NO: 257364 - DNA, 33 bp, Artificial Sequence
  Description of Artificial Sequence: Synthetic oligonucleotide
gacagaagcttttgctgtcctagctggaaaagc

SEQ ID NO: 257365 - DNA, 37 bp, Artificial Sequence
  Description of Artificial Sequence: Synthetic oligonucleotide
acagaagcttttgctgtcctagctggaaaagctattg

SEQ ID NO: 257366 - DNA, 36 bp, Artificial Sequence
  Description of Artificial Sequence: Synthetic oligonucleotide
cagaagcttttgctgtcctagctggaaaagctattg

SEQ ID NO: 257367 - DNA, 42 bp, Artificial Sequence
  Description of Artificial Sequence: Synthetic oligonucleotide
agaagcttttgctgtcctagctggaaaagctattgaatttag

SEQ ID NO: 257368 - DNA, 41 bp, Artificial Sequence
  Description of Artificial Sequence: Synthetic oligonucleotide
gaagcttttgctgtcctagctggaaaagctattgaatttag

SEQ ID NO: 257369 - DNA, 41 bp, Artificial Sequence
  Description of Artificial Sequence: Synthetic oligonucleotide
aagcttttgctgtcctagctggaaaagctattgaatttagc

SEQ ID NO: 257370 - DNA, 40 bp, Artificial Sequence
  Description of Artificial Sequence: Synthetic oligonucleotide
agcttttgctgtcctagctggaaaagctattgaatttagc

SEQ ID NO: 257371 - DNA, 39 bp, Artificial Sequence
  Description of Artificial Sequence: Synthetic oligonucleotide
gcttttgctgtcctagctggaaaagctattgaatttagc

SEQ ID NO: 257372 - DNA, 42 bp, Artificial Sequence
  Description of Artificial Sequence: Synthetic oligonucleotide
cttttgctgtcctagctggaaaagctattgaatttagcattg

SEQ ID NO: 257373 - DNA, 42 bp, Artificial Sequence
  Description of Artificial Sequence: Synthetic oligonucleotide
ttttgctgtcctagctggaaaagctattgaatttagcattgc

SEQ ID NO: 257374 - DNA, 41 bp, Artificial Sequence
  Description of Artificial Sequence: Synthetic oligonucleotide
tttgctgtcctagctggaaaagctattgaatttagcattgc

SEQ ID NO: 257375 - DNA, 40 bp, Artificial Sequence
  Description of Artificial Sequence: Synthetic oligonucleotide
ttgctgtcctagctggaaaagctattgaatttagcattgc

SEQ ID NO: 257376 - DNA, 39 bp, Artificial Sequence
  Description of Artificial Sequence: Synthetic oligonucleotide
tgctgtcctagctggaaaagctattgaatttagcattgc

SEQ ID NO: 257377 - DNA, 38 bp, Artificial Sequence
  Description of Artificial Sequence: Synthetic oligonucleotide
gctgtcctagctggaaaagctattgaatttagcattgc

SEQ ID NO: 257378 - DNA, 39 bp, Artificial Sequence
  Description of Artificial Sequence: Synthetic oligonucleotide
ctgtcctagctggaaaagctattgaatttagcattgctc

SEQ ID NO: 257379 - DNA, 39 bp, Artificial Sequence
  Description of Artificial Sequence: Synthetic oligonucleotide
tgtcctagctggaaaagctattgaatttagcattgctcc

SEQ ID NO: 257380 - DNA, 38 bp, Artificial Sequence
  Description of Artificial Sequence: Synthetic oligonucleotide
gtcctagctggaaaagctattgaatttagcattgctcc

SEQ ID NO: 257381 - DNA, 40 bp, Artificial Sequence
  Description of Artificial Sequence: Synthetic oligonucleotide
tcctagctggaaaagctattgaatttagcattgctccttg

SEQ ID NO: 257382 - DNA, 39 bp, Artificial Sequence
  Description of Artificial Sequence: Synthetic oligonucleotide
cctagctggaaaagctattgaatttagcattgctccttg

SEQ ID NO: 257383 - DNA, 39 bp, Artificial Sequence
  Description of Artificial Sequence: Synthetic oligonucleotide
ctagctggaaaagctattgaatttagcattgctccttgg

SEQ ID NO: 257384 - DNA, 40 bp, Artificial Sequence
  Description of Artificial Sequence: Synthetic oligonucleotide
tagctggaaaagctattgaatttagcattgctccttggtg

SEQ ID NO: 257385 - DNA, 39 bp, Artificial Sequence
  Description of Artificial Sequence: Synthetic oligonucleotide
agctggaaaagctattgaatttagcattgctccttggtg

SEQ ID NO: 257386 - DNA, 38 bp, Artificial Sequence
  Description of Artificial Sequence: Synthetic oligonucleotide
gctggaaaagctattgaatttagcattgctccttggtg

SEQ ID NO: 257387 - DNA, 38 bp, Artificial Sequence
  Description of Artificial Sequence: Synthetic oligonucleotide
ctggaaaagctattgaatttagcattgctccttggtgg

SEQ ID NO: 257388 - DNA, 38 bp, Artificial Sequence
  Description of Artificial Sequence: Synthetic oligonucleotide
tggaaaagctattgaatttagcattgctccttggtggg

SEQ ID NO: 257389 - DNA, 37 bp, Artificial Sequence
  Description of Artificial Sequence: Synthetic oligonucleotide
ggaaaagctattgaatttagcattgctccttggtggg

SEQ ID NO: 257390 - DNA, 37 bp, Artificial Sequence
  Description of Artificial Sequence: Synthetic oligonucleotide
gaaaagctattgaatttagcattgctccttggtgggc

SEQ ID NO: 257391 - DNA, 39 bp, Artificial Sequence
  Description of Artificial Sequence: Synthetic oligonucleotide
aaaagctattgaatttagcattgctccttggtgggctag

SEQ ID NO: 257392 - DNA, 38 bp, Artificial Sequence
  Description of Artificial Sequence: Synthetic oligonucleotide
aaagctattgaatttagcattgctccttggtgggctag

SEQ ID NO: 257393 - DNA, 37 bp, Artificial Sequence
  Description of Artificial Sequence: Synthetic oligonucleotide
aagctattgaatttagcattgctccttggtgggctag

SEQ ID NO: 257394 - DNA, 36 bp, Artificial Sequence
  Description of Artificial Sequence: Synthetic oligonucleotide
agctattgaatttagcattgctccttggtgggctag

SEQ ID NO: 257395 - DNA, 35 bp, Artificial Sequence
  Description of Artificial Sequence: Synthetic oligonucleotide
gctattgaatttagcattgctccttggtgggctag

SEQ ID NO: 257396 - DNA, 36 bp, Artificial Sequence
  Description of Artificial Sequence: Synthetic oligonucleotide
ctattgaatttagcattgctccttggtgggctagtc

SEQ ID NO: 257397 - DNA, 37 bp, Artificial Sequence
  Description of Artificial Sequence: Synthetic oligonucleotide
tattgaatttagcattgctccttggtgggctagtctc

SEQ ID NO: 257398 - DNA, 36 bp, Artificial Sequence
  Description of Artificial Sequence: Synthetic oligonucleotide
attgaatttagcattgctccttggtgggctagtctc

SEQ ID NO: 257399 - DNA, 35 bp, Artificial Sequence
  Description of Artificial Sequence: Synthetic oligonucleotide
ttgaatttagcattgctccttggtgggctagtctc

SEQ ID NO: 257400 - DNA, 34 bp, Artificial Sequence
  Description of Artificial Sequence: Synthetic oligonucleotide
tgaatttagcattgctccttggtgggctagtctc

SEQ ID NO: 257401 - DNA, 33 bp, Artificial Sequence
  Description of Artificial Sequence: Synthetic oligonucleotide
gaatttagcattgctccttggtgggctagtctc

SEQ ID NO: 257402 - DNA, 34 bp, Artificial Sequence
  Description of Artificial Sequence: Synthetic oligonucleotide
aatttagcattgctccttggtgggctagtctcag

SEQ ID NO: 257403 - DNA, 33 bp, Artificial Sequence
  Description of Artificial Sequence: Synthetic oligonucleotide
atttagcattgctccttggtgggctagtctcag

SEQ ID NO: 257404 - DNA, 32 bp, Artificial Sequence
  Description of Artificial Sequence: Synthetic oligonucleotide
tttagcattgctccttggtgggctagtctcag

SEQ ID NO: 257405 - DNA, 31 bp, Artificial Sequence
  Description of Artificial Sequence: Synthetic oligonucleotide
ttagcattgctccttggtgggctagtctcag

SEQ ID NO: 257406 - DNA, 30 bp, Artificial Sequence
  Description of Artificial Sequence: Synthetic oligonucleotide
tagcattgctccttggtgggctagtctcag

SEQ ID NO: 257407 - DNA, 29 bp, Artificial Sequence
  Description of Artificial Sequence: Synthetic oligonucleotide
agcattgctccttggtgggctagtctcag

SEQ ID NO: 257408 - DNA, 28 bp, Artificial Sequence
  Description of Artificial Sequence: Synthetic oligonucleotide
gcattgctccttggtgggctagtctcag

SEQ ID NO: 257409 - DNA, 29 bp, Artificial Sequence
  Description of Artificial Sequence: Synthetic oligonucleotide
cattgctccttggtgggctagtctcagtc

SEQ ID NO: 257410 - DNA, 31 bp, Artificial Sequence
  Description of Artificial Sequence: Synthetic oligonucleotide
attgctccttggtgggctagtctcagtcatg

SEQ ID NO: 257411 - DNA, 30 bp, Artificial Sequence
  Description of Artificial Sequence: Synthetic oligonucleotide
ttgctccttggtgggctagtctcagtcatg

SEQ ID NO: 257412 - DNA, 29 bp, Artificial Sequence
  Description of Artificial Sequence: Synthetic oligonucleotide
tgctccttggtgggctagtctcagtcatg

SEQ ID NO: 257413 - DNA, 28 bp, Artificial Sequence
  Description of Artificial Sequence: Synthetic oligonucleotide
gctccttggtgggctagtctcagtcatg

SEQ ID NO: 257414 - DNA, 29 bp, Artificial Sequence
  Description of Artificial Sequence: Synthetic oligonucleotide
ctccttggtgggctagtctcagtcatgtc

SEQ ID NO: 257415 - DNA, 31 bp, Artificial Sequence
  Description of Artificial Sequence: Synthetic oligonucleotide
tccttggtgggctagtctcagtcatgtcaac

SEQ ID NO: 257416 - DNA, 30 bp, Artificial Sequence
  Description of Artificial Sequence: Synthetic oligonucleotide
ccttggtgggctagtctcagtcatgtcaac

SEQ ID NO: 257417 - DNA, 33 bp, Artificial Sequence
  Description of Artificial Sequence: Synthetic oligonucleotide
cttggtgggctagtctcagtcatgtcaacaatg

SEQ ID NO: 257418 - DNA, 39 bp, Artificial Sequence
  Description of Artificial Sequence: Synthetic oligonucleotide
ttggtgggctagtctcagtcatgtcaacaatgattatac

SEQ ID NO: 257419 - DNA, 38 bp, Artificial Sequence
  Description of Artificial Sequence: Synthetic oligonucleotide
tggtgggctagtctcagtcatgtcaacaatgattatac

SEQ ID NO: 257420 - DNA, 37 bp, Artificial Sequence
  Description of Artificial Sequence: Synthetic oligonucleotide
ggtgggctagtctcagtcatgtcaacaatgattatac

SEQ ID NO: 257421 - DNA, 37 bp, Artificial Sequence
  Description of Artificial Sequence: Synthetic oligonucleotide
gtgggctagtctcagtcatgtcaacaatgattatacg

SEQ ID NO: 257422 - DNA, 41 bp, Artificial Sequence
  Description of Artificial Sequence: Synthetic oligonucleotide
tgggctagtctcagtcatgtcaacaatgattatacgatttc

SEQ ID NO: 257423 - DNA, 40 bp, Artificial Sequence
  Description of Artificial Sequence: Synthetic oligonucleotide
gggctagtctcagtcatgtcaacaatgattatacgatttc

SEQ ID NO: 257424 - DNA, 43 bp, Artificial Sequence
  Description of Artificial Sequence: Synthetic oligonucleotide
ggctagtctcagtcatgtcaacaatgattatacgatttctttc

SEQ ID NO: 257425 - DNA, 43 bp, Artificial Sequence
  Description of Artificial Sequence: Synthetic oligonucleotide
gctagtctcagtcatgtcaacaatgattatacgatttctttcg

SEQ ID NO: 257426 - DNA, 45 bp, Artificial Sequence
  Description of Artificial Sequence: Synthetic oligonucleotide
ctagtctcagtcatgtcaacaatgattatacgatttctttcgatg

SEQ ID NO: 257427 - DNA, 45 bp, Artificial Sequence
  Description of Artificial Sequence: Synthetic oligonucleotide
tagtctcagtcatgtcaacaatgattatacgatttctttcgatgg

SEQ ID NO: 257428 - DNA, 44 bp, Artificial Sequence
  Description of Artificial Sequence: Synthetic oligonucleotide
agtctcagtcatgtcaacaatgattatacgatttctttcgatgg

SEQ ID NO: 257429 - DNA, 43 bp, Artificial Sequence
  Description of Artificial Sequence: Synthetic oligonucleotide
gtctcagtcatgtcaacaatgattatacgatttctttcgatgg

SEQ ID NO: 257430 - DNA, 43 bp, Artificial Sequence
  Description of Artificial Sequence: Synthetic oligonucleotide
tctcagtcatgtcaacaatgattatacgatttctttcgatggg

SEQ ID NO: 257431 - DNA, 42 bp, Artificial Sequence
  Description of Artificial Sequence: Synthetic oligonucleotide
ctcagtcatgtcaacaatgattatacgatttctttcgatggg

SEQ ID NO: 257432 - DNA, 45 bp, Artificial Sequence
  Description of Artificial Sequence: Synthetic oligonucleotide
tcagtcatgtcaacaatgattatacgatttctttcgatgggatag

SEQ ID NO: 257433 - DNA, 44 bp, Artificial Sequence
  Description of Artificial Sequence: Synthetic oligonucleotide
cagtcatgtcaacaatgattatacgatttctttcgatgggatag

SEQ ID NO: 257434 - DNA, 45 bp, Artificial Sequence
  Description of Artificial Sequence: Synthetic oligonucleotide
agtcatgtcaacaatgattatacgatttctttcgatgggatagag

SEQ ID NO: 257435 - DNA, 44 bp, Artificial Sequence
  Description of Artificial Sequence: Synthetic oligonucleotide
gtcatgtcaacaatgattatacgatttctttcgatgggatagag

SEQ ID NO: 257436 - DNA, 45 bp, Artificial Sequence
  Description of Artificial Sequence: Synthetic oligonucleotide
tcatgtcaacaatgattatacgatttctttcgatgggatagagtg

SEQ ID NO: 257437 - DNA, 44 bp, Artificial Sequence
  Description of Artificial Sequence: Synthetic oligonucleotide
catgtcaacaatgattatacgatttctttcgatgggatagagtg

SEQ ID NO: 257438 - DNA, 46 bp, Artificial Sequence
  Description of Artificial Sequence: Synthetic oligonucleotide
atgtcaacaatgattatacgatttctttcgatgggatagagtgtac

SEQ ID NO: 257439 - DNA, 45 bp, Artificial Sequence
  Description of Artificial Sequence: Synthetic oligonucleotide
tgtcaacaatgattatacgatttctttcgatgggatagagtgtac

SEQ ID NO: 257440 - DNA, 44 bp, Artificial Sequence
  Description of Artificial Sequence: Synthetic oligonucleotide
gtcaacaatgattatacgatttctttcgatgggatagagtgtac

SEQ ID NO: 257441 - DNA, 45 bp, Artificial Sequence
  Description of Artificial Sequence: Synthetic oligonucleotide
tcaacaatgattatacgatttctttcgatgggatagagtgtactg

SEQ ID NO: 257442 - DNA, 44 bp, Artificial Sequence
  Description of Artificial Sequence: Synthetic oligonucleotide
caacaatgattatacgatttctttcgatgggatagagtgtactg

SEQ ID NO: 257443 - DNA, 44 bp, Artificial Sequence
  Description of Artificial Sequence: Synthetic oligonucleotide
aacaatgattatacgatttctttcgatgggatagagtgtactgc

SEQ ID NO: 257444 - DNA, 43 bp, Artificial Sequence
  Description of Artificial Sequence: Synthetic oligonucleotide
acaatgattatacgatttctttcgatgggatagagtgtactgc

SEQ ID NO: 257445 - DNA, 42 bp, Artificial Sequence
  Description of Artificial Sequence: Synthetic oligonucleotide
caatgattatacgatttctttcgatgggatagagtgtactgc

SEQ ID NO: 257446 - DNA, 43 bp, Artificial Sequence
  Description of Artificial Sequence: Synthetic oligonucleotide
aatgattatacgatttctttcgatgggatagagtgtactgcac

SEQ ID NO: 257447 - DNA, 42 bp, Artificial Sequence
  Description of Artificial Sequence: Synthetic oligonucleotide
atgattatacgatttctttcgatgggatagagtgtactgcac

SEQ ID NO: 257448 - DNA, 41 bp, Artificial Sequence
  Description of Artificial Sequence: Synthetic oligonucleotide
tgattatacgatttctttcgatgggatagagtgtactgcac

SEQ ID NO: 257449 - DNA, 40 bp, Artificial Sequence
  Description of Artificial Sequence: Synthetic oligonucleotide
gattatacgatttctttcgatgggatagagtgtactgcac

SEQ ID NO: 257450 - DNA, 40 bp, Artificial Sequence
  Description of Artificial Sequence: Synthetic oligonucleotide
attatacgatttctttcgatgggatagagtgtactgcacc

SEQ ID NO: 257451 - DNA, 39 bp, Artificial Sequence
  Description of Artificial Sequence: Synthetic oligonucleotide
ttatacgatttctttcgatgggatagagtgtactgcacc

SEQ ID NO: 257452 - DNA, 38 bp, Artificial Sequence
  Description of Artificial Sequence: Synthetic oligonucleotide
tatacgatttctttcgatgggatagagtgtactgcacc

SEQ ID NO: 257453 - DNA, 37 bp, Artificial Sequence
  Description of Artificial Sequence: Synthetic oligonucleotide
atacgatttctttcgatgggatagagtgtactgcacc

SEQ ID NO: 257454 - DNA, 36 bp, Artificial Sequence
  Description of Artificial Sequence: Synthetic oligonucleotide
tacgatttctttcgatgggatagagtgtactgcacc

SEQ ID NO: 257455 - DNA, 35 bp, Artificial Sequence
  Description of Artificial Sequence: Synthetic oligonucleotide
acgatttctttcgatgggatagagtgtactgcacc

SEQ ID NO: 257456 - DNA, 34 bp, Artificial Sequence
  Description of Artificial Sequence: Synthetic oligonucleotide
cgatttctttcgatgggatagagtgtactgcacc

SEQ ID NO: 257457 - DNA, 35 bp, Artificial Sequence
  Description of Artificial Sequence: Synthetic oligonucleotide
gatttctttcgatgggatagagtgtactgcacctc

SEQ ID NO: 257458 - DNA, 36 bp, Artificial Sequence
  Description of Artificial Sequence: Synthetic oligonucleotide
atttctttcgatgggatagagtgtactgcacctcag

SEQ ID NO: 257459 - DNA, 35 bp, Artificial Sequence
  Description of Artificial Sequence: Synthetic oligonucleotide
tttctttcgatgggatagagtgtactgcacctcag

SEQ ID NO: 257460 - DNA, 34 bp, Artificial Sequence
  Description of Artificial Sequence: Synthetic oligonucleotide
ttctttcgatgggatagagtgtactgcacctcag

SEQ ID NO: 257461 - DNA, 33 bp, Artificial Sequence
  Description of Artificial Sequence: Synthetic oligonucleotide
tctttcgatgggatagagtgtactgcacctcag

SEQ ID NO: 257462 - DNA, 32 bp, Artificial Sequence
  Description of Artificial Sequence: Synthetic oligonucleotide
ctttcgatgggatagagtgtactgcacctcag

SEQ ID NO: 257463 - DNA, 37 bp, Artificial Sequence
  Description of Artificial Sequence: Synthetic oligonucleotide
tttcgatgggatagagtgtactgcacctcagttatac

SEQ ID NO: 257464 - DNA, 36 bp, Artificial Sequence
  Description of Artificial Sequence: Synthetic oligonucleotide
ttcgatgggatagagtgtactgcacctcagttatac

SEQ ID NO: 257465 - DNA, 35 bp, Artificial Sequence
  Description of Artificial Sequence: Synthetic oligonucleotide
tcgatgggatagagtgtactgcacctcagttatac

SEQ ID NO: 257466 - DNA, 34 bp, Artificial Sequence
  Description of Artificial Sequence: Synthetic oligonucleotide
cgatgggatagagtgtactgcacctcagttatac

SEQ ID NO: 257467 - DNA, 37 bp, Artificial Sequence
  Description of Artificial Sequence: Synthetic oligonucleotide
gatgggatagagtgtactgcacctcagttatacattc

SEQ ID NO: 257468 - DNA, 39 bp, Artificial Sequence
  Description of Artificial Sequence: Synthetic oligonucleotide
atgggatagagtgtactgcacctcagttatacattcatg

SEQ ID NO: 257469 - DNA, 38 bp, Artificial Sequence
  Description of Artificial Sequence: Synthetic oligonucleotide
tgggatagagtgtactgcacctcagttatacattcatg

SEQ ID NO: 257470 - DNA, 37 bp, Artificial Sequence
  Description of Artificial Sequence: Synthetic oligonucleotide
gggatagagtgtactgcacctcagttatacattcatg

SEQ ID NO: 257471 - DNA, 37 bp, Artificial Sequence
  Description of Artificial Sequence: Synthetic oligonucleotide
ggatagagtgtactgcacctcagttatacattcatgg

SEQ ID NO: 257472 - DNA, 39 bp, Artificial Sequence
  Description of Artificial Sequence: Synthetic oligonucleotide
gatagagtgtactgcacctcagttatacattcatggatc

SEQ ID NO: 257473 - DNA, 39 bp, Artificial Sequence
  Description of Artificial Sequence: Synthetic oligonucleotide
atagagtgtactgcacctcagttatacattcatggatcg

SEQ ID NO: 257474 - DNA, 38 bp, Artificial Sequence
  Description of Artificial Sequence: Synthetic oligonucleotide
tagagtgtactgcacctcagttatacattcatggatcg

SEQ ID NO: 257475 - DNA, 37 bp, Artificial Sequence
  Description of Artificial Sequence: Synthetic oligonucleotide
agagtgtactgcacctcagttatacattcatggatcg

SEQ ID NO: 257476 - DNA, 36 bp, Artificial Sequence
  Description of Artificial Sequence: Synthetic oligonucleotide
gagtgtactgcacctcagttatacattcatggatcg

SEQ ID NO: 257477 - DNA, 36 bp, Artificial Sequence
  Description of Artificial Sequence: Synthetic oligonucleotide
agtgtactgcacctcagttatacattcatggatcgg

SEQ ID NO: 257478 - DNA, 35 bp, Artificial Sequence
  Description of Artificial Sequence: Synthetic oligonucleotide
gtgtactgcacctcagttatacattcatggatcgg

SEQ ID NO: 257479 - DNA, 37 bp, Artificial Sequence
  Description of Artificial Sequence: Synthetic oligonucleotide
tgtactgcacctcagttatacattcatggatcggaag

SEQ ID NO: 257480 - DNA, 36 bp, Artificial Sequence
  Description of Artificial Sequence: Synthetic oligonucleotide
gtactgcacctcagttatacattcatggatcggaag

SEQ ID NO: 257481 - DNA, 36 bp, Artificial Sequence
  Description of Artificial Sequence: Synthetic oligonucleotide
tactgcacctcagttatacattcatggatcggaagg

SEQ ID NO: 257482 - DNA, 35 bp, Artificial Sequence
  Description of Artificial Sequence: Synthetic oligonucleotide
actgcacctcagttatacattcatggatcggaagg

SEQ ID NO: 257483 - DNA, 34 bp, Artificial Sequence
  Description of Artificial Sequence: Synthetic oligonucleotide
ctgcacctcagttatacattcatggatcggaagg

SEQ ID NO: 257484 - DNA, 37 bp, Artificial Sequence
  Description of Artificial Sequence: Synthetic oligonucleotide
tgcacctcagttatacattcatggatcggaaggtatc

SEQ ID NO: 257485 - DNA, 36 bp, Artificial Sequence
  Description of Artificial Sequence: Synthetic oligonucleotide
gcacctcagttatacattcatggatcggaaggtatc

SEQ ID NO: 257486 - DNA, 38 bp, Artificial Sequence
  Description of Artificial Sequence: Synthetic oligonucleotide
cacctcagttatacattcatggatcggaaggtatcaac

SEQ ID NO: 257487 - DNA, 38 bp, Artificial Sequence
  Description of Artificial Sequence: Synthetic oligonucleotide
acctcagttatacattcatggatcggaaggtatcaacc

SEQ ID NO: 257488 - DNA, 37 bp, Artificial Sequence
  Description of Artificial Sequence: Synthetic oligonucleotide
cctcagttatacattcatggatcggaaggtatcaacc

SEQ ID NO: 257489 - DNA, 37 bp, Artificial Sequence
  Description of Artificial Sequence: Synthetic oligonucleotide
ctcagttatacattcatggatcggaaggtatcaaccg

SEQ ID NO: 257490 - DNA, 37 bp, Artificial Sequence
  Description of Artificial Sequence: Synthetic oligonucleotide
tcagttatacattcatggatcggaaggtatcaaccgc

SEQ ID NO: 257491 - DNA, 36 bp, Artificial Sequence
  Description of Artificial Sequence: Synthetic oligonucleotide
cagttatacattcatggatcggaaggtatcaaccgc

SEQ ID NO: 257492 - DNA, 39 bp, Artificial Sequence
  Description of Artificial Sequence: Synthetic oligonucleotide
agttatacattcatggatcggaaggtatcaaccgcattg

SEQ ID NO: 257493 - DNA, 38 bp, Artificial Sequence
  Description of Artificial Sequence: Synthetic oligonucleotide
gttatacattcatggatcggaaggtatcaaccgcattg

SEQ ID NO: 257494 - DNA, 40 bp, Artificial Sequence
  Description of Artificial Sequence: Synthetic oligonucleotide
ttatacattcatggatcggaaggtatcaaccgcattgatg

SEQ ID NO: 257495 - DNA, 39 bp, Artificial Sequence
  Description of Artificial Sequence: Synthetic oligonucleotide
tatacattcatggatcggaaggtatcaaccgcattgatg

SEQ ID NO: 257496 - DNA, 38 bp, Artificial Sequence
  Description of Artificial Sequence: Synthetic oligonucleotide
atacattcatggatcggaaggtatcaaccgcattgatg

SEQ ID NO: 257497 - DNA, 37 bp, Artificial Sequence
  Description of Artificial Sequence: Synthetic oligonucleotide
tacattcatggatcggaaggtatcaaccgcattgatg

SEQ ID NO: 257498 - DNA, 36 bp, Artificial Sequence
  Description of Artificial Sequence: Synthetic oligonucleotide
acattcatggatcggaaggtatcaaccgcattgatg

SEQ ID NO: 257499 - DNA, 35 bp, Artificial Sequence
  Description of Artificial Sequence: Synthetic oligonucleotide
cattcatggatcggaaggtatcaaccgcattgatg

SEQ ID NO: 257500 - DNA, 37 bp, Artificial Sequence
  Description of Artificial Sequence: Synthetic oligonucleotide
attcatggatcggaaggtatcaaccgcattgatgttc

SEQ ID NO: 257501 - DNA, 36 bp, Artificial Sequence
  Description of Artificial Sequence: Synthetic oligonucleotide
ttcatggatcggaaggtatcaaccgcattgatgttc

SEQ ID NO: 257502 - DNA, 35 bp, Artificial Sequence
  Description of Artificial Sequence: Synthetic oligonucleotide
tcatggatcggaaggtatcaaccgcattgatgttc

SEQ ID NO: 257503 - DNA, 34 bp, Artificial Sequence
  Description of Artificial Sequence: Synthetic oligonucleotide
catggatcggaaggtatcaaccgcattgatgttc

SEQ ID NO: 257504 - DNA, 35 bp, Artificial Sequence
  Description of Artificial Sequence: Synthetic oligonucleotide
atggatcggaaggtatcaaccgcattgatgttctg

SEQ ID NO: 257505 - DNA, 34 bp, Artificial Sequence
  Description of Artificial Sequence: Synthetic oligonucleotide
tggatcggaaggtatcaaccgcattgatgttctg

SEQ ID NO: 257506 - DNA, 33 bp, Artificial Sequence
  Description of Artificial Sequence: Synthetic oligonucleotide
ggatcggaaggtatcaaccgcattgatgttctg

SEQ ID NO: 257507 - DNA, 34 bp, Artificial Sequence
  Description of Artificial Sequence: Synthetic oligonucleotide
gatcggaaggtatcaaccgcattgatgttctgtc

SEQ ID NO: 257508 - DNA, 34 bp, Artificial Sequence
  Description of Artificial Sequence: Synthetic oligonucleotide
atcggaaggtatcaaccgcattgatgttctgtcc

SEQ ID NO: 257509 - DNA, 33 bp, Artificial Sequence
  Description of Artificial Sequence: Synthetic oligonucleotide
tcggaaggtatcaaccgcattgatgttctgtcc

SEQ ID NO: 257510 - DNA, 32 bp, Artificial Sequence
  Description of Artificial Sequence: Synthetic oligonucleotide
cggaaggtatcaaccgcattgatgttctgtcc

SEQ ID NO: 257511 - DNA, 33 bp, Artificial Sequence
  Description of Artificial Sequence: Synthetic oligonucleotide
ggaaggtatcaaccgcattgatgttctgtcctc

SEQ ID NO: 257512 - DNA, 33 bp, Artificial Sequence
  Description of Artificial Sequence: Synthetic oligonucleotide
gaaggtatcaaccgcattgatgttctgtcctcc

SEQ ID NO: 257513 - DNA, 35 bp, Artificial Sequence
  Description of Artificial Sequence: Synthetic oligonucleotide
aaggtatcaaccgcattgatgttctgtcctccttc

SEQ ID NO: 257514 - DNA, 34 bp, Artificial Sequence
  Description of Artificial Sequence: Synthetic oligonucleotide
aggtatcaaccgcattgatgttctgtcctccttc

SEQ ID NO: 257515 - DNA, 33 bp, Artificial Sequence
  Description of Artificial Sequence: Synthetic oligonucleotide
ggtatcaaccgcattgatgttctgtcctccttc

SEQ ID NO: 257516 - DNA, 38 bp, Artificial Sequence
  Description of Artificial Sequence: Synthetic oligonucleotide
gtatcaaccgcattgatgttctgtcctccttcaaatac

SEQ ID NO: 257517 - DNA, 38 bp, Artificial Sequence
  Description of Artificial Sequence: Synthetic oligonucleotide
tatcaaccgcattgatgttctgtcctccttcaaatacg

SEQ ID NO: 257518 - DNA, 37 bp, Artificial Sequence
  Description of Artificial Sequence: Synthetic oligonucleotide
atcaaccgcattgatgttctgtcctccttcaaatacg

SEQ ID NO: 257519 - DNA, 36 bp, Artificial Sequence
  Description of Artificial Sequence: Synthetic oligonucleotide
tcaaccgcattgatgttctgtcctccttcaaatacg

SEQ ID NO: 257520 - DNA, 35 bp, Artificial Sequence
  Description of Artificial Sequence: Synthetic oligonucleotide
caaccgcattgatgttctgtcctccttcaaatacg

SEQ ID NO: 257521 - DNA, 37 bp, Artificial Sequence
  Description of Artificial Sequence: Synthetic oligonucleotide
aaccgcattgatgttctgtcctccttcaaatacgaac

SEQ ID NO: 257522 - DNA, 36 bp, Artificial Sequence
  Description of Artificial Sequence: Synthetic oligonucleotide
accgcattgatgttctgtcctccttcaaatacgaac

SEQ ID NO: 257523 - DNA, 35 bp, Artificial Sequence
  Description of Artificial Sequence: Synthetic oligonucleotide
ccgcattgatgttctgtcctccttcaaatacgaac

SEQ ID NO: 257524 - DNA, 37 bp, Artificial Sequence
  Description of Artificial Sequence: Synthetic oligonucleotide
cgcattgatgttctgtcctccttcaaatacgaacatc

SEQ ID NO: 257525 - DNA, 38 bp, Artificial Sequence
  Description of Artificial Sequence: Synthetic oligonucleotide
gcattgatgttctgtcctccttcaaatacgaacatctg

SEQ ID NO: 257526 - DNA, 38 bp, Artificial Sequence
  Description of Artificial Sequence: Synthetic oligonucleotide
cattgatgttctgtcctccttcaaatacgaacatctgg

SEQ ID NO: 257527 - DNA, 38 bp, Artificial Sequence
  Description of Artificial Sequence: Synthetic oligonucleotide
attgatgttctgtcctccttcaaatacgaacatctggc

SEQ ID NO: 257528 - DNA, 37 bp, Artificial Sequence
  Description of Artificial Sequence: Synthetic oligonucleotide
ttgatgttctgtcctccttcaaatacgaacatctggc

SEQ ID NO: 257529 - DNA, 36 bp, Artificial Sequence
  Description of Artificial Sequence: Synthetic oligonucleotide
tgatgttctgtcctccttcaaatacgaacatctggc

SEQ ID NO: 257530 - DNA, 35 bp, Artificial Sequence
  Description of Artificial Sequence: Synthetic oligonucleotide
gatgttctgtcctccttcaaatacgaacatctggc

SEQ ID NO: 257531 - DNA, 36 bp, Artificial Sequence
  Description of Artificial Sequence: Synthetic oligonucleotide
atgttctgtcctccttcaaatacgaacatctggctc

SEQ ID NO: 257532 - DNA, 35 bp, Artificial Sequence
  Description of Artificial Sequence: Synthetic oligonucleotide
tgttctgtcctccttcaaatacgaacatctggctc

SEQ ID NO: 257533 - DNA, 34 bp, Artificial Sequence
  Description of Artificial Sequence: Synthetic oligonucleotide
gttctgtcctccttcaaatacgaacatctggctc

SEQ ID NO: 257534 - DNA, 34 bp, Artificial Sequence
  Description of Artificial Sequence: Synthetic oligonucleotide
ttctgtcctccttcaaatacgaacatctggctcg

SEQ ID NO: 257535 - DNA, 33 bp, Artificial Sequence
  Description of Artificial Sequence: Synthetic oligonucleotide
tctgtcctccttcaaatacgaacatctggctcg

SEQ ID NO: 257536 - DNA, 32 bp, Artificial Sequence
  Description of Artificial Sequence: Synthetic oligonucleotide
ctgtcctccttcaaatacgaacatctggctcg

SEQ ID NO: 257537 - DNA, 32 bp, Artificial Sequence
  Description of Artificial Sequence: Synthetic oligonucleotide
tgtcctccttcaaatacgaacatctggctcgc

SEQ ID NO: 257538 - DNA, 31 bp, Artificial Sequence
  Description of Artificial Sequence: Synthetic oligonucleotide
gtcctccttcaaatacgaacatctggctcgc

SEQ ID NO: 257539 - DNA, 32 bp, Artificial Sequence
  Description of Artificial Sequence: Synthetic oligonucleotide
tcctccttcaaatacgaacatctggctcgctg

SEQ ID NO: 257540 - DNA, 31 bp, Artificial Sequence
  Description of Artificial Sequence: Synthetic oligonucleotide
cctccttcaaatacgaacatctggctcgctg

SEQ ID NO: 257541 - DNA, 31 bp, Artificial Sequence
  Description of Artificial Sequence: Synthetic oligonucleotide
ctccttcaaatacgaacatctggctcgctgc

SEQ ID NO: 257542 - DNA, 35 bp, Artificial Sequence
  Description of Artificial Sequence: Synthetic oligonucleotide
tccttcaaatacgaacatctggctcgctgcataac

SEQ ID NO: 257543 - DNA, 34 bp, Artificial Sequence
  Description of Artificial Sequence: Synthetic oligonucleotide
ccttcaaatacgaacatctggctcgctgcataac

SEQ ID NO: 257544 - DNA, 37 bp, Artificial Sequence
  Description of Artificial Sequence: Synthetic oligonucleotide
cttcaaatacgaacatctggctcgctgcataacattg

SEQ ID NO: 257545 - DNA, 39 bp, Artificial Sequence
  Description of Artificial Sequence: Synthetic oligonucleotide
ttcaaatacgaacatctggctcgctgcataacattgaag

SEQ ID NO: 257546 - DNA, 38 bp, Artificial Sequence
  Description of Artificial Sequence: Synthetic oligonucleotide
tcaaatacgaacatctggctcgctgcataacattgaag

SEQ ID NO: 257547 - DNA, 37 bp, Artificial Sequence
  Description of Artificial Sequence: Synthetic oligonucleotide
caaatacgaacatctggctcgctgcataacattgaag

SEQ ID NO: 257548 - DNA, 39 bp, Artificial Sequence
  Description of Artificial Sequence: Synthetic oligonucleotide
aaatacgaacatctggctcgctgcataacattgaagaac

SEQ ID NO: 257549 - DNA, 38 bp, Artificial Sequence
  Description of Artificial Sequence: Synthetic oligonucleotide
aatacgaacatctggctcgctgcataacattgaagaac

SEQ ID NO: 257550 - DNA, 37 bp, Artificial Sequence
  Description of Artificial Sequence: Synthetic oligonucleotide
atacgaacatctggctcgctgcataacattgaagaac

SEQ ID NO: 257551 - DNA, 36 bp, Artificial Sequence
  Description of Artificial Sequence: Synthetic oligonucleotide
tacgaacatctggctcgctgcataacattgaagaac

SEQ ID NO: 257552 - DNA, 35 bp, Artificial Sequence
  Description of Artificial Sequence: Synthetic oligonucleotide
acgaacatctggctcgctgcataacattgaagaac

SEQ ID NO: 257553 - DNA, 34 bp, Artificial Sequence
  Description of Artificial Sequence: Synthetic oligonucleotide
cgaacatctggctcgctgcataacattgaagaac

SEQ ID NO: 257554 - DNA, 35 bp, Artificial Sequence
  Description of Artificial Sequence: Synthetic oligonucleotide
gaacatctggctcgctgcataacattgaagaacag

SEQ ID NO: 257555 - DNA, 35 bp, Artificial Sequence
  Description of Artificial Sequence: Synthetic oligonucleotide
aacatctggctcgctgcataacattgaagaacagg

SEQ ID NO: 257556 - DNA, 34 bp, Artificial Sequence
  Description of Artificial Sequence: Synthetic oligonucleotide
acatctggctcgctgcataacattgaagaacagg

SEQ ID NO: 257557 - DNA, 33 bp, Artificial Sequence
  Description of Artificial Sequence: Synthetic oligonucleotide
catctggctcgctgcataacattgaagaacagg

SEQ ID NO: 257558 - DNA, 33 bp, Artificial Sequence
  Description of Artificial Sequence: Synthetic oligonucleotide
atctggctcgctgcataacattgaagaacaggg

SEQ ID NO: 257559 - DNA, 32 bp, Artificial Sequence
  Description of Artificial Sequence: Synthetic oligonucleotide
tctggctcgctgcataacattgaagaacaggg

SEQ ID NO: 257560 - DNA, 31 bp, Artificial Sequence
  Description of Artificial Sequence: Synthetic oligonucleotide
ctggctcgctgcataacattgaagaacaggg

SEQ ID NO: 257561 - DNA, 32 bp, Artificial Sequence
  Description of Artificial Sequence: Synthetic oligonucleotide
tggctcgctgcataacattgaagaacagggtc

SEQ ID NO: 257562 - DNA, 31 bp, Artificial Sequence
  Description of Artificial Sequence: Synthetic oligonucleotide
ggctcgctgcataacattgaagaacagggtc

SEQ ID NO: 257563 - DNA, 31 bp, Artificial Sequence
  Description of Artificial Sequence: Synthetic oligonucleotide
gctcgctgcataacattgaagaacagggtcc

SEQ ID NO: 257564 - DNA, 34 bp, Artificial Sequence
  Description of Artificial Sequence: Synthetic oligonucleotide
ctcgctgcataacattgaagaacagggtccaaag

SEQ ID NO: 257565 - DNA, 35 bp, Artificial Sequence
  Description of Artificial Sequence: Synthetic oligonucleotide
tcgctgcataacattgaagaacagggtccaaagac

SEQ ID NO: 257566 - DNA, 34 bp, Artificial Sequence
  Description of Artificial Sequence: Synthetic oligonucleotide
cgctgcataacattgaagaacagggtccaaagac

SEQ ID NO: 257567 - DNA, 35 bp, Artificial Sequence
  Description of Artificial Sequence: Synthetic oligonucleotide
gctgcataacattgaagaacagggtccaaagactg

SEQ ID NO: 257568 - DNA, 35 bp, Artificial Sequence
  Description of Artificial Sequence: Synthetic oligonucleotide
ctgcataacattgaagaacagggtccaaagactgc

SEQ ID NO: 257569 - DNA, 35 bp, Artificial Sequence
  Description of Artificial Sequence: Synthetic oligonucleotide
tgcataacattgaagaacagggtccaaagactgcg

SEQ ID NO: 257570 - DNA, 34 bp, Artificial Sequence
  Description of Artificial Sequence: Synthetic oligonucleotide
gcataacattgaagaacagggtccaaagactgcg

SEQ ID NO: 257571 - DNA, 34 bp, Artificial Sequence
  Description of Artificial Sequence: Synthetic oligonucleotide
cataacattgaagaacagggtccaaagactgcgc

SEQ ID NO: 257572 - DNA, 34 bp, Artificial Sequence
  Description of Artificial Sequence: Synthetic oligonucleotide
ataacattgaagaacagggtccaaagactgcgcc

SEQ ID NO: 257573 - DNA, 33 bp, Artificial Sequence
  Description of Artificial Sequence: Synthetic oligonucleotide
taacattgaagaacagggtccaaagactgcgcc

SEQ ID NO: 257574 - DNA, 32 bp, Artificial Sequence
  Description of Artificial Sequence: Synthetic oligonucleotide
aacattgaagaacagggtccaaagactgcgcc

SEQ ID NO: 257575 - DNA, 31 bp, Artificial Sequence
  Description of Artificial Sequence: Synthetic oligonucleotide
acattgaagaacagggtccaaagactgcgcc

SEQ ID NO: 257576 - DNA, 30 bp, Artificial Sequence
  Description of Artificial Sequence: Synthetic oligonucleotide
cattgaagaacagggtccaaagactgcgcc

SEQ ID NO: 257577 - DNA, 30 bp, Artificial Sequence
  Description of Artificial Sequence: Synthetic oligonucleotide
attgaagaacagggtccaaagactgcgccc

SEQ ID NO: 257578 - DNA, 29 bp, Artificial Sequence
  Description of Artificial Sequence: Synthetic oligonucleotide
ttgaagaacagggtccaaagactgcgccc

SEQ ID NO: 257579 - DNA, 28 bp, Artificial Sequence
  Description of Artificial Sequence: Synthetic oligonucleotide
tgaagaacagggtccaaagactgcgccc

SEQ ID NO: 257580 - DNA, 27 bp, Artificial Sequence
  Description of Artificial Sequence: Synthetic oligonucleotide
gaagaacagggtccaaagactgcgccc

SEQ ID NO: 257581 - DNA, 28 bp, Artificial Sequence
  Description of Artificial Sequence: Synthetic oligonucleotide
aagaacagggtccaaagactgcgccctg

SEQ ID NO: 257582 - DNA, 27 bp, Artificial Sequence
  Description of Artificial Sequence: Synthetic oligonucleotide
agaacagggtccaaagactgcgccctg

SEQ ID NO: 257583 - DNA, 27 bp, Artificial Sequence
  Description of Artificial Sequence: Synthetic oligonucleotide
gaacagggtccaaagactgcgccctgt

SEQ ID NO: 257584 - DNA, 27 bp, Artificial Sequence
  Description of Artificial Sequence: Synthetic oligonucleotide
aacagggtccaaagactgcgccctgtg

SEQ ID NO: 257585 - DNA, 27 bp, Artificial Sequence
  Description of Artificial Sequence: Synthetic oligonucleotide
acagggtccaaagactgcgccctgtga

SEQ ID NO: 257586 - DNA, 26 bp, Artificial Sequence
  Description of Artificial Sequence: Synthetic oligonucleotide
cagggtccaaagactgcgccctgtga

SEQ ID NO: 257587 - DNA, 27 bp, Artificial Sequence
  Description of Artificial Sequence: Synthetic oligonucleotide
agggtccaaagactgcgccctgtgagt

SEQ ID NO: 257588 - DNA, 26 bp, Artificial Sequence
  Description of Artificial Sequence: Synthetic oligonucleotide
gggtccaaagactgcgccctgtgagt

SEQ ID NO: 257589 - DNA, 26 bp, Artificial Sequence
  Description of Artificial Sequence: Synthetic oligonucleotide
ggtccaaagactgcgccctgtgagtg

SEQ ID NO: 257590 - DNA, 27 bp, Artificial Sequence
  Description of Artificial Sequence: Synthetic oligonucleotide
gtccaaagactgcgccctgtgagtgca

SEQ ID NO: 257591 - DNA, 31 bp, Artificial Sequence
  Description of Artificial Sequence: Synthetic oligonucleotide
tccaaagactgcgccctgtgagtgcataaac

SEQ ID NO: 257592 - DNA, 30 bp, Artificial Sequence
  Description of Artificial Sequence: Synthetic oligonucleotide
ccaaagactgcgccctgtgagtgcataaac

SEQ ID NO: 257593 - DNA, 34 bp, Artificial Sequence
  Description of Artificial Sequence: Synthetic oligonucleotide
caaagactgcgccctgtgagtgcataaacaaaac

SEQ ID NO: 257594 - DNA, 34 bp, Artificial Sequence
  Description of Artificial Sequence: Synthetic oligonucleotide
aaagactgcgccctgtgagtgcataaacaaaacg

SEQ ID NO: 257595 - DNA, 33 bp, Artificial Sequence
  Description of Artificial Sequence: Synthetic oligonucleotide
aagactgcgccctgtgagtgcataaacaaaacg

SEQ ID NO: 257596 - DNA, 32 bp, Artificial Sequence
  Description of Artificial Sequence: Synthetic oligonucleotide
agactgcgccctgtgagtgcataaacaaaacg

SEQ ID NO: 257597 - DNA, 31 bp, Artificial Sequence
  Description of Artificial Sequence: Synthetic oligonucleotide
gactgcgccctgtgagtgcataaacaaaacg

SEQ ID NO: 257598 - DNA, 35 bp, Artificial Sequence
  Description of Artificial Sequence: Synthetic oligonucleotide
actgcgccctgtgagtgcataaacaaaacgtttag

SEQ ID NO: 257599 - DNA, 34 bp, Artificial Sequence
  Description of Artificial Sequence: Synthetic oligonucleotide
ctgcgccctgtgagtgcataaacaaaacgtttag

SEQ ID NO: 257600 - DNA, 34 bp, Artificial Sequence
  Description of Artificial Sequence: Synthetic oligonucleotide
tgcgccctgtgagtgcataaacaaaacgtttagg

SEQ ID NO: 257601 - DNA, 33 bp, Artificial Sequence
  Description of Artificial Sequence: Synthetic oligonucleotide
gcgccctgtgagtgcataaacaaaacgtttagg

SEQ ID NO: 257602 - DNA, 35 bp, Artificial Sequence
  Description of Artificial Sequence: Synthetic oligonucleotide
cgccctgtgagtgcataaacaaaacgtttaggatc

SEQ ID NO: 257603 - DNA, 37 bp, Artificial Sequence
  Description of Artificial Sequence: Synthetic oligonucleotide
gccctgtgagtgcataaacaaaacgtttaggatctag

SEQ ID NO: 257604 - DNA, 38 bp, Artificial Sequence
  Description of Artificial Sequence: Synthetic oligonucleotide
ccctgtgagtgcataaacaaaacgtttaggatctagag

SEQ ID NO: 257605 - DNA, 40 bp, Artificial Sequence
  Description of Artificial Sequence: Synthetic oligonucleotide
cctgtgagtgcataaacaaaacgtttaggatctagagatg

SEQ ID NO: 257606 - DNA, 44 bp, Artificial Sequence
  Description of Artificial Sequence: Synthetic oligonucleotide
ctgtgagtgcataaacaaaacgtttaggatctagagatgttatg

SEQ ID NO: 257607 - DNA, 44 bp, Artificial Sequence
  Description of Artificial Sequence: Synthetic oligonucleotide
tgtgagtgcataaacaaaacgtttaggatctagagatgttatgc

SEQ ID NO: 257608 - DNA, 43 bp, Artificial Sequence
  Description of Artificial Sequence: Synthetic oligonucleotide
gtgagtgcataaacaaaacgtttaggatctagagatgttatgc

SEQ ID NO: 257609 - DNA, 43 bp, Artificial Sequence
  Description of Artificial Sequence: Synthetic oligonucleotide
tgagtgcataaacaaaacgtttaggatctagagatgttatgcc

SEQ ID NO: 257610 - DNA, 42 bp, Artificial Sequence
  Description of Artificial Sequence: Synthetic oligonucleotide
gagtgcataaacaaaacgtttaggatctagagatgttatgcc

SEQ ID NO: 257611 - DNA, 48 bp, Artificial Sequence
  Description of Artificial Sequence: Synthetic oligonucleotide
agtgcataaacaaaacgtttaggatctagagatgttatgccaaatatc

SEQ ID NO: 257612 - DNA, 47 bp, Artificial Sequence
  Description of Artificial Sequence: Synthetic oligonucleotide
gtgcataaacaaaacgtttaggatctagagatgttatgccaaatatc

SEQ ID NO: 257613 - DNA, 47 bp, Artificial Sequence
  Description of Artificial Sequence: Synthetic oligonucleotide
tgcataaacaaaacgtttaggatctagagatgttatgccaaatatcc

SEQ ID NO: 257614 - DNA, 46 bp, Artificial Sequence
  Description of Artificial Sequence: Synthetic oligonucleotide
gcataaacaaaacgtttaggatctagagatgttatgccaaatatcc

SEQ ID NO: 257615 - DNA, 46 bp, Artificial Sequence
  Description of Artificial Sequence: Synthetic oligonucleotide
cataaacaaaacgtttaggatctagagatgttatgccaaatatccg

SEQ ID NO: 257616 - DNA, 47 bp, Artificial Sequence
  Description of Artificial Sequence: Synthetic oligonucleotide
ataaacaaaacgtttaggatctagagatgttatgccaaatatccgtc

SEQ ID NO: 257617 - DNA, 46 bp, Artificial Sequence
  Description of Artificial Sequence: Synthetic oligonucleotide
taaacaaaacgtttaggatctagagatgttatgccaaatatccgtc

SEQ ID NO: 257618 - DNA, 45 bp, Artificial Sequence
  Description of Artificial Sequence: Synthetic oligonucleotide
aaacaaaacgtttaggatctagagatgttatgccaaatatccgtc

SEQ ID NO: 257619 - DNA, 44 bp, Artificial Sequence
  Description of Artificial Sequence: Synthetic oligonucleotide
aacaaaacgtttaggatctagagatgttatgccaaatatccgtc

SEQ ID NO: 257620 - DNA, 43 bp, Artificial Sequence
  Description of Artificial Sequence: Synthetic oligonucleotide
acaaaacgtttaggatctagagatgttatgccaaatatccgtc

SEQ ID NO: 257621 - DNA, 42 bp, Artificial Sequence
  Description of Artificial Sequence: Synthetic oligonucleotide
caaaacgtttaggatctagagatgttatgccaaatatccgtc

SEQ ID NO: 257622 - DNA, 44 bp, Artificial Sequence
  Description of Artificial Sequence: Synthetic oligonucleotide
aaaacgtttaggatctagagatgttatgccaaatatccgtcaac

SEQ ID NO: 257623 - DNA, 43 bp, Artificial Sequence
  Description of Artificial Sequence: Synthetic oligonucleotide
aaacgtttaggatctagagatgttatgccaaatatccgtcaac

SEQ ID NO: 257624 - DNA, 42 bp, Artificial Sequence
  Description of Artificial Sequence: Synthetic oligonucleotide
aacgtttaggatctagagatgttatgccaaatatccgtcaac

SEQ ID NO: 257625 - DNA, 41 bp, Artificial Sequence
  Description of Artificial Sequence: Synthetic oligonucleotide
acgtttaggatctagagatgttatgccaaatatccgtcaac

SEQ ID NO: 257626 - DNA, 40 bp, Artificial Sequence
  Description of Artificial Sequence: Synthetic oligonucleotide
cgtttaggatctagagatgttatgccaaatatccgtcaac

SEQ ID NO: 257627 - DNA, 45 bp, Artificial Sequence
  Description of Artificial Sequence: Synthetic oligonucleotide
gtttaggatctagagatgttatgccaaatatccgtcaactatatg

SEQ ID NO: 257628 - DNA, 46 bp, Artificial Sequence
  Description of Artificial Sequence: Synthetic oligonucleotide
tttaggatctagagatgttatgccaaatatccgtcaactatatgag

SEQ ID NO: 257629 - DNA, 45 bp, Artificial Sequence
  Description of Artificial Sequence: Synthetic oligonucleotide
ttaggatctagagatgttatgccaaatatccgtcaactatatgag

SEQ ID NO: 257630 - DNA, 44 bp, Artificial Sequence
  Description of Artificial Sequence: Synthetic oligonucleotide
taggatctagagatgttatgccaaatatccgtcaactatatgag

SEQ ID NO: 257631 - DNA, 43 bp, Artificial Sequence
  Description of Artificial Sequence: Synthetic oligonucleotide
aggatctagagatgttatgccaaatatccgtcaactatatgag

SEQ ID NO: 257632 - DNA, 42 bp, Artificial Sequence
  Description of Artificial Sequence: Synthetic oligonucleotide
ggatctagagatgttatgccaaatatccgtcaactatatgag

SEQ ID NO: 257633 - DNA, 44 bp, Artificial Sequence
  Description of Artificial Sequence: Synthetic oligonucleotide
gatctagagatgttatgccaaatatccgtcaactatatgagatg

SEQ ID NO: 257634 - DNA, 44 bp, Artificial Sequence
  Description of Artificial Sequence: Synthetic oligonucleotide
atctagagatgttatgccaaatatccgtcaactatatgagatgc

SEQ ID NO: 257635 - DNA, 43 bp, Artificial Sequence
  Description of Artificial Sequence: Synthetic oligonucleotide
tctagagatgttatgccaaatatccgtcaactatatgagatgc

SEQ ID NO: 257636 - DNA, 42 bp, Artificial Sequence
  Description of Artificial Sequence: Synthetic oligonucleotide
ctagagatgttatgccaaatatccgtcaactatatgagatgc

SEQ ID NO: 257637 - DNA, 43 bp, Artificial Sequence
  Description of Artificial Sequence: Synthetic oligonucleotide
tagagatgttatgccaaatatccgtcaactatatgagatgctc

SEQ ID NO: 257638 - DNA, 42 bp, Artificial Sequence
  Description of Artificial Sequence: Synthetic oligonucleotide
agagatgttatgccaaatatccgtcaactatatgagatgctc

SEQ ID NO: 257639 - DNA, 41 bp, Artificial Sequence
  Description of Artificial Sequence: Synthetic oligonucleotide
gagatgttatgccaaatatccgtcaactatatgagatgctc

SEQ ID NO: 257640 - DNA, 41 bp, Artificial Sequence
  Description of Artificial Sequence: Synthetic oligonucleotide
agatgttatgccaaatatccgtcaactatatgagatgctcc

SEQ ID NO: 257641 - DNA, 40 bp, Artificial Sequence
  Description of Artificial Sequence: Synthetic oligonucleotide
gatgttatgccaaatatccgtcaactatatgagatgctcc

SEQ ID NO: 257642 - DNA, 41 bp, Artificial Sequence
  Description of Artificial Sequence: Synthetic oligonucleotide
atgttatgccaaatatccgtcaactatatgagatgctcctg

SEQ ID NO: 257643 - DNA, 40 bp, Artificial Sequence
  Description of Artificial Sequence: Synthetic oligonucleotide
tgttatgccaaatatccgtcaactatatgagatgctcctg

SEQ ID NO: 257644 - DNA, 39 bp, Artificial Sequence
  Description of Artificial Sequence: Synthetic oligonucleotide
gttatgccaaatatccgtcaactatatgagatgctcctg

SEQ ID NO: 257645 - DNA, 40 bp, Artificial Sequence
  Description of Artificial Sequence: Synthetic oligonucleotide
ttatgccaaatatccgtcaactatatgagatgctcctgac

SEQ ID NO: 257646 - DNA, 39 bp, Artificial Sequence
  Description of Artificial Sequence: Synthetic oligonucleotide
tatgccaaatatccgtcaactatatgagatgctcctgac

SEQ ID NO: 257647 - DNA, 38 bp, Artificial Sequence
  Description of Artificial Sequence: Synthetic oligonucleotide
atgccaaatatccgtcaactatatgagatgctcctgac

SEQ ID NO: 257648 - DNA, 37 bp, Artificial Sequence
  Description of Artificial Sequence: Synthetic oligonucleotide
tgccaaatatccgtcaactatatgagatgctcctgac

SEQ ID NO: 257649 - DNA, 36 bp, Artificial Sequence
  Description of Artificial Sequence: Synthetic oligonucleotide
gccaaatatccgtcaactatatgagatgctcctgac

SEQ ID NO: 257650 - DNA, 42 bp, Artificial Sequence
  Description of Artificial Sequence: Synthetic oligonucleotide
ccaaatatccgtcaactatatgagatgctcctgacatttaac

SEQ ID NO: 257651 - DNA, 45 bp, Artificial Sequence
  Description of Artificial Sequence: Synthetic oligonucleotide
caaatatccgtcaactatatgagatgctcctgacatttaactttc

SEQ ID NO: 257652 - DNA, 47 bp, Artificial Sequence
  Description of Artificial Sequence: Synthetic oligonucleotide
aaatatccgtcaactatatgagatgctcctgacatttaactttcaac

SEQ ID NO: 257653 - DNA, 46 bp, Artificial Sequence
  Description of Artificial Sequence: Synthetic oligonucleotide
aatatccgtcaactatatgagatgctcctgacatttaactttcaac

SEQ ID NO: 257654 - DNA, 45 bp, Artificial Sequence
  Description of Artificial Sequence: Synthetic oligonucleotide
atatccgtcaactatatgagatgctcctgacatttaactttcaac

SEQ ID NO: 257655 - DNA, 44 bp, Artificial Sequence
  Description of Artificial Sequence: Synthetic oligonucleotide
tatccgtcaactatatgagatgctcctgacatttaactttcaac

SEQ ID NO: 257656 - DNA, 43 bp, Artificial Sequence
  Description of Artificial Sequence: Synthetic oligonucleotide
atccgtcaactatatgagatgctcctgacatttaactttcaac

SEQ ID NO: 257657 - DNA, 42 bp, Artificial Sequence
  Description of Artificial Sequence: Synthetic oligonucleotide
tccgtcaactatatgagatgctcctgacatttaactttcaac

SEQ ID NO: 257658 - DNA, 41 bp, Artificial Sequence
  Description of Artificial Sequence: Synthetic oligonucleotide
ccgtcaactatatgagatgctcctgacatttaactttcaac

SEQ ID NO: 257659 - DNA, 43 bp, Artificial Sequence
  Description of Artificial Sequence: Synthetic oligonucleotide
cgtcaactatatgagatgctcctgacatttaactttcaacaac

SEQ ID NO: 257660 - DNA, 43 bp, Artificial Sequence
  Description of Artificial Sequence: Synthetic oligonucleotide
gtcaactatatgagatgctcctgacatttaactttcaacaacc

SEQ ID NO: 257661 - DNA, 43 bp, Artificial Sequence
  Description of Artificial Sequence: Synthetic oligonucleotide
tcaactatatgagatgctcctgacatttaactttcaacaaccc

SEQ ID NO: 257662 - DNA, 42 bp, Artificial Sequence
  Description of Artificial Sequence: Synthetic oligonucleotide
caactatatgagatgctcctgacatttaactttcaacaaccc

SEQ ID NO: 257663 - DNA, 44 bp, Artificial Sequence
  Description of Artificial Sequence: Synthetic oligonucleotide
aactatatgagatgctcctgacatttaactttcaacaacccaag

SEQ ID NO: 257664 - DNA, 43 bp, Artificial Sequence
  Description of Artificial Sequence: Synthetic oligonucleotide
actatatgagatgctcctgacatttaactttcaacaacccaag

SEQ ID NO: 257665 - DNA, 42 bp, Artificial Sequence
  Description of Artificial Sequence: Synthetic oligonucleotide
ctatatgagatgctcctgacatttaactttcaacaacccaag

SEQ ID NO: 257666 - DNA, 43 bp, Artificial Sequence
  Description of Artificial Sequence: Synthetic oligonucleotide
tatatgagatgctcctgacatttaactttcaacaacccaagtg

SEQ ID NO: 257667 - DNA, 42 bp, Artificial Sequence
  Description of Artificial Sequence: Synthetic oligonucleotide
atatgagatgctcctgacatttaactttcaacaacccaagtg

SEQ ID NO: 257668 - DNA, 41 bp, Artificial Sequence
  Description of Artificial Sequence: Synthetic oligonucleotide
tatgagatgctcctgacatttaactttcaacaacccaagtg

SEQ ID NO: 257669 - DNA, 40 bp, Artificial Sequence
  Description of Artificial Sequence: Synthetic oligonucleotide
atgagatgctcctgacatttaactttcaacaacccaagtg

SEQ ID NO: 257670 - DNA, 39 bp, Artificial Sequence
  Description of Artificial Sequence: Synthetic oligonucleotide
tgagatgctcctgacatttaactttcaacaacccaagtg

SEQ ID NO: 257671 - DNA, 38 bp, Artificial Sequence
  Description of Artificial Sequence: Synthetic oligonucleotide
gagatgctcctgacatttaactttcaacaacccaagtg

SEQ ID NO: 257672 - DNA, 39 bp, Artificial Sequence
  Description of Artificial Sequence: Synthetic oligonucleotide
agatgctcctgacatttaactttcaacaacccaagtgtg

SEQ ID NO: 257673 - DNA, 38 bp, Artificial Sequence
  Description of Artificial Sequence: Synthetic oligonucleotide
gatgctcctgacatttaactttcaacaacccaagtgtg

SEQ ID NO: 257674 - DNA, 38 bp, Artificial Sequence
  Description of Artificial Sequence: Synthetic oligonucleotide
atgctcctgacatttaactttcaacaacccaagtgtgg

SEQ ID NO: 257675 - DNA, 37 bp, Artificial Sequence
  Description of Artificial Sequence: Synthetic oligonucleotide
tgctcctgacatttaactttcaacaacccaagtgtgg

SEQ ID NO: 257676 - DNA, 36 bp, Artificial Sequence
  Description of Artificial Sequence: Synthetic oligonucleotide
gctcctgacatttaactttcaacaacccaagtgtgg

SEQ ID NO: 257677 - DNA, 36 bp, Artificial Sequence
  Description of Artificial Sequence: Synthetic oligonucleotide
ctcctgacatttaactttcaacaacccaagtgtggg

SEQ ID NO: 257678 - DNA, 36 bp, Artificial Sequence
  Description of Artificial Sequence: Synthetic oligonucleotide
tcctgacatttaactttcaacaacccaagtgtgggg

SEQ ID NO: 257679 - DNA, 35 bp, Artificial Sequence
  Description of Artificial Sequence: Synthetic oligonucleotide
cctgacatttaactttcaacaacccaagtgtgggg

SEQ ID NO: 257680 - DNA, 37 bp, Artificial Sequence
  Description of Artificial Sequence: Synthetic oligonucleotide
ctgacatttaactttcaacaacccaagtgtggggaag

SEQ ID NO: 257681 - DNA, 40 bp, Artificial Sequence
  Description of Artificial Sequence: Synthetic oligonucleotide
tgacatttaactttcaacaacccaagtgtggggaagaaac

SEQ ID NO: 257682 - DNA, 39 bp, Artificial Sequence
  Description of Artificial Sequence: Synthetic oligonucleotide
gacatttaactttcaacaacccaagtgtggggaagaaac

SEQ ID NO: 257683 - DNA, 40 bp, Artificial Sequence
  Description of Artificial Sequence: Synthetic oligonucleotide
acatttaactttcaacaacccaagtgtggggaagaaactc

SEQ ID NO: 257684 - DNA, 39 bp, Artificial Sequence
  Description of Artificial Sequence: Synthetic oligonucleotide
catttaactttcaacaacccaagtgtggggaagaaactc

SEQ ID NO: 257685 - DNA, 39 bp, Artificial Sequence
  Description of Artificial Sequence: Synthetic oligonucleotide
atttaactttcaacaacccaagtgtggggaagaaactcc

SEQ ID NO: 257686 - DNA, 38 bp, Artificial Sequence
  Description of Artificial Sequence: Synthetic oligonucleotide
tttaactttcaacaacccaagtgtggggaagaaactcc

SEQ ID NO: 257687 - DNA, 37 bp, Artificial Sequence
  Description of Artificial Sequence: Synthetic oligonucleotide
ttaactttcaacaacccaagtgtggggaagaaactcc

SEQ ID NO: 257688 - DNA, 36 bp, Artificial Sequence
  Description of Artificial Sequence: Synthetic oligonucleotide
taactttcaacaacccaagtgtggggaagaaactcc

SEQ ID NO: 257689 - DNA, 35 bp, Artificial Sequence
  Description of Artificial Sequence: Synthetic oligonucleotide
aactttcaacaacccaagtgtggggaagaaactcc

SEQ ID NO: 257690 - DNA, 34 bp, Artificial Sequence
  Description of Artificial Sequence: Synthetic oligonucleotide
actttcaacaacccaagtgtggggaagaaactcc

SEQ ID NO: 257691 - DNA, 33 bp, Artificial Sequence
  Description of Artificial Sequence: Synthetic oligonucleotide
ctttcaacaacccaagtgtggggaagaaactcc

SEQ ID NO: 257692 - DNA, 35 bp, Artificial Sequence
  Description of Artificial Sequence: Synthetic oligonucleotide
tttcaacaacccaagtgtggggaagaaactccaag

SEQ ID NO: 257693 - DNA, 34 bp, Artificial Sequence
  Description of Artificial Sequence: Synthetic oligonucleotide
ttcaacaacccaagtgtggggaagaaactccaag

SEQ ID NO: 257694 - DNA, 33 bp, Artificial Sequence
  Description of Artificial Sequence: Synthetic oligonucleotide
tcaacaacccaagtgtggggaagaaactccaag

SEQ ID NO: 257695 - DNA, 32 bp, Artificial Sequence
  Description of Artificial Sequence: Synthetic oligonucleotide
caacaacccaagtgtggggaagaaactccaag

SEQ ID NO: 257696 - DNA, 32 bp, Artificial Sequence
  Description of Artificial Sequence: Synthetic oligonucleotide
aacaacccaagtgtggggaagaaactccaagg

SEQ ID NO: 257697 - DNA, 31 bp, Artificial Sequence
  Description of Artificial Sequence: Synthetic oligonucleotide
acaacccaagtgtggggaagaaactccaagg

SEQ ID NO: 257698 - DNA, 30 bp, Artificial Sequence
  Description of Artificial Sequence: Synthetic oligonucleotide
caacccaagtgtggggaagaaactccaagg

SEQ ID NO: 257699 - DNA, 31 bp, Artificial Sequence
  Description of Artificial Sequence: Synthetic oligonucleotide
aacccaagtgtggggaagaaactccaaggtg

SEQ ID NO: 257700 - DNA, 30 bp, Artificial Sequence
  Description of Artificial Sequence: Synthetic oligonucleotide
acccaagtgtggggaagaaactccaaggtg

SEQ ID NO: 257701 - DNA, 29 bp, Artificial Sequence
  Description of Artificial Sequence: Synthetic oligonucleotide
cccaagtgtggggaagaaactccaaggtg

SEQ ID NO: 257702 - DNA, 29 bp, Artificial Sequence
  Description of Artificial Sequence: Synthetic oligonucleotide
ccaagtgtggggaagaaactccaaggtgc

SEQ ID NO: 257703 - DNA, 29 bp, Artificial Sequence
  Description of Artificial Sequence: Synthetic oligonucleotide
caagtgtggggaagaaactccaaggtgcc

SEQ ID NO: 257704 - DNA, 29 bp, Artificial Sequence
  Description of Artificial Sequence: Synthetic oligonucleotide
aagtgtggggaagaaactccaaggtgccc

SEQ ID NO: 257705 - DNA, 28 bp, Artificial Sequence
  Description of Artificial Sequence: Synthetic oligonucleotide
agtgtggggaagaaactccaaggtgccc

SEQ ID NO: 257706 - DNA, 27 bp, Artificial Sequence
  Description of Artificial Sequence: Synthetic oligonucleotide
gtgtggggaagaaactccaaggtgccc

SEQ ID NO: 257707 - DNA, 28 bp, Artificial Sequence
  Description of Artificial Sequence: Synthetic oligonucleotide
tgtggggaagaaactccaaggtgcccac

SEQ ID NO: 257708 - DNA, 27 bp, Artificial Sequence
  Description of Artificial Sequence: Synthetic oligonucleotide
gtggggaagaaactccaaggtgcccac

SEQ ID NO: 257709 - DNA, 29 bp, Artificial Sequence
  Description of Artificial Sequence: Synthetic oligonucleotide
tggggaagaaactccaaggtgcccactag

SEQ ID NO: 257710 - DNA, 28 bp, Artificial Sequence
  Description of Artificial Sequence: Synthetic oligonucleotide
ggggaagaaactccaaggtgcccactag

SEQ ID NO: 257711 - DNA, 31 bp, Artificial Sequence
  Description of Artificial Sequence: Synthetic oligonucleotide
gggaagaaactccaaggtgcccactagtttg

SEQ ID NO: 257712 - DNA, 32 bp, Artificial Sequence
  Description of Artificial Sequence: Synthetic oligonucleotide
ggaagaaactccaaggtgcccactagtttgtg

SEQ ID NO: 257713 - DNA, 34 bp, Artificial Sequence
  Description of Artificial Sequence: Synthetic oligonucleotide
gaagaaactccaaggtgcccactagtttgtgaac

SEQ ID NO: 257714 - DNA, 42 bp, Artificial Sequence
  Description of Artificial Sequence: Synthetic oligonucleotide
aagaaactccaaggtgcccactagtttgtgaacaattatatg

SEQ ID NO: 257715 - DNA, 41 bp, Artificial Sequence
  Description of Artificial Sequence: Synthetic oligonucleotide
agaaactccaaggtgcccactagtttgtgaacaattatatg

SEQ ID NO: 257716 - DNA, 40 bp, Artificial Sequence
  Description of Artificial Sequence: Synthetic oligonucleotide
gaaactccaaggtgcccactagtttgtgaacaattatatg

SEQ ID NO: 257717 - DNA, 43 bp, Artificial Sequence
  Description of Artificial Sequence: Synthetic oligonucleotide
aaactccaaggtgcccactagtttgtgaacaattatatgattc

SEQ ID NO: 257718 - DNA, 42 bp, Artificial Sequence
  Description of Artificial Sequence: Synthetic oligonucleotide
aactccaaggtgcccactagtttgtgaacaattatatgattc

SEQ ID NO: 257719 - DNA, 41 bp, Artificial Sequence
  Description of Artificial Sequence: Synthetic oligonucleotide
actccaaggtgcccactagtttgtgaacaattatatgattc

SEQ ID NO: 257720 - DNA, 40 bp, Artificial Sequence
  Description of Artificial Sequence: Synthetic oligonucleotide
ctccaaggtgcccactagtttgtgaacaattatatgattc

SEQ ID NO: 257721 - DNA, 41 bp, Artificial Sequence
  Description of Artificial Sequence: Synthetic oligonucleotide
tccaaggtgcccactagtttgtgaacaattatatgattctg

SEQ ID NO: 257722 - DNA, 40 bp, Artificial Sequence
  Description of Artificial Sequence: Synthetic oligonucleotide
ccaaggtgcccactagtttgtgaacaattatatgattctg

SEQ ID NO: 257723 - DNA, 45 bp, Artificial Sequence
  Description of Artificial Sequence: Synthetic oligonucleotide
caaggtgcccactagtttgtgaacaattatatgattctgaatttc

SEQ ID NO: 257724 - DNA, 46 bp, Artificial Sequence
  Description of Artificial Sequence: Synthetic oligonucleotide
aaggtgcccactagtttgtgaacaattatatgattctgaatttcac

SEQ ID NO: 257725 - DNA, 45 bp, Artificial Sequence
  Description of Artificial Sequence: Synthetic oligonucleotide
aggtgcccactagtttgtgaacaattatatgattctgaatttcac

SEQ ID NO: 257726 - DNA, 44 bp, Artificial Sequence
  Description of Artificial Sequence: Synthetic oligonucleotide
ggtgcccactagtttgtgaacaattatatgattctgaatttcac

SEQ ID NO: 257727 - DNA, 45 bp, Artificial Sequence
  Description of Artificial Sequence: Synthetic oligonucleotide
gtgcccactagtttgtgaacaattatatgattctgaatttcacag

SEQ ID NO: 257728 - DNA, 45 bp, Artificial Sequence
  Description of Artificial Sequence: Synthetic oligonucleotide
tgcccactagtttgtgaacaattatatgattctgaatttcacagc

SEQ ID NO: 257729 - DNA, 44 bp, Artificial Sequence
  Description of Artificial Sequence: Synthetic oligonucleotide
gcccactagtttgtgaacaattatatgattctgaatttcacagc

SEQ ID NO: 257730 - DNA, 44 bp, Artificial Sequence
  Description of Artificial Sequence: Synthetic oligonucleotide
cccactagtttgtgaacaattatatgattctgaatttcacagcc

SEQ ID NO: 257731 - DNA, 46 bp, Artificial Sequence
  Description of Artificial Sequence: Synthetic oligonucleotide
ccactagtttgtgaacaattatatgattctgaatttcacagccaac

SEQ ID NO: 257732 - DNA, 47 bp, Artificial Sequence
  Description of Artificial Sequence: Synthetic oligonucleotide
cactagtttgtgaacaattatatgattctgaatttcacagccaacag

SEQ ID NO: 257733 - DNA, 48 bp, Artificial Sequence
  Description of Artificial Sequence: Synthetic oligonucleotide
actagtttgtgaacaattatatgattctgaatttcacagccaacagtg

SEQ ID NO: 257734 - DNA, 47 bp, Artificial Sequence
  Description of Artificial Sequence: Synthetic oligonucleotide
ctagtttgtgaacaattatatgattctgaatttcacagccaacagtg

SEQ ID NO: 257735 - DNA, 47 bp, Artificial Sequence
  Description of Artificial Sequence: Synthetic oligonucleotide
tagtttgtgaacaattatatgattctgaatttcacagccaacagtgg

SEQ ID NO: 257736 - DNA, 46 bp, Artificial Sequence
  Description of Artificial Sequence: Synthetic oligonucleotide
agtttgtgaacaattatatgattctgaatttcacagccaacagtgg

SEQ ID NO: 257737 - DNA, 45 bp, Artificial Sequence
  Description of Artificial Sequence: Synthetic oligonucleotide
gtttgtgaacaattatatgattctgaatttcacagccaacagtgg

SEQ ID NO: 257738 - DNA, 54 bp, Artificial Sequence
  Description of Artificial Sequence: Synthetic oligonucleotide
tttgtgaacaattatatgattctgaatttcacagccaacagtggattatatttg

SEQ ID NO: 257739 - DNA, 53 bp, Artificial Sequence
  Description of Artificial Sequence: Synthetic oligonucleotide
ttgtgaacaattatatgattctgaatttcacagccaacagtggattatatttg

SEQ ID NO: 257740 - DNA, 52 bp, Artificial Sequence
  Description of Artificial Sequence: Synthetic oligonucleotide
tgtgaacaattatatgattctgaatttcacagccaacagtggattatatttg

SEQ ID NO: 257741 - DNA, 51 bp, Artificial Sequence
  Description of Artificial Sequence: Synthetic oligonucleotide
gtgaacaattatatgattctgaatttcacagccaacagtggattatatttg

SEQ ID NO: 257742 - DNA, 52 bp, Artificial Sequence
  Description of Artificial Sequence: Synthetic oligonucleotide
tgaacaattatatgattctgaatttcacagccaacagtggattatatttgac

SEQ ID NO: 257743 - DNA, 51 bp, Artificial Sequence
  Description of Artificial Sequence: Synthetic oligonucleotide
gaacaattatatgattctgaatttcacagccaacagtggattatatttgac

SEQ ID NO: 257744 - DNA, 51 bp, Artificial Sequence
  Description of Artificial Sequence: Synthetic oligonucleotide
aacaattatatgattctgaatttcacagccaacagtggattatatttgacc

SEQ ID NO: 257745 - DNA, 50 bp, Artificial Sequence
  Description of Artificial Sequence: Synthetic oligonucleotide
acaattatatgattctgaatttcacagccaacagtggattatatttgacc

SEQ ID NO: 257746 - DNA, 49 bp, Artificial Sequence
  Description of Artificial Sequence: Synthetic oligonucleotide
caattatatgattctgaatttcacagccaacagtggattatatttgacc

SEQ ID NO: 257747 - DNA, 50 bp, Artificial Sequence
  Description of Artificial Sequence: Synthetic oligonucleotide
aattatatgattctgaatttcacagccaacagtggattatatttgaccag

SEQ ID NO: 257748 - DNA, 49 bp, Artificial Sequence
  Description of Artificial Sequence: Synthetic oligonucleotide
attatatgattctgaatttcacagccaacagtggattatatttgaccag

SEQ ID NO: 257749 - DNA, 48 bp, Artificial Sequence
  Description of Artificial Sequence: Synthetic oligonucleotide
ttatatgattctgaatttcacagccaacagtggattatatttgaccag

SEQ ID NO: 257750 - DNA, 47 bp, Artificial Sequence
  Description of Artificial Sequence: Synthetic oligonucleotide
tatatgattctgaatttcacagccaacagtggattatatttgaccag

SEQ ID NO: 257751 - DNA, 46 bp, Artificial Sequence
  Description of Artificial Sequence: Synthetic oligonucleotide
atatgattctgaatttcacagccaacagtggattatatttgaccag

SEQ ID NO: 257752 - DNA, 45 bp, Artificial Sequence
  Description of Artificial Sequence: Synthetic oligonucleotide
tatgattctgaatttcacagccaacagtggattatatttgaccag

SEQ ID NO: 257753 - DNA, 44 bp, Artificial Sequence
  Description of Artificial Sequence: Synthetic oligonucleotide
atgattctgaatttcacagccaacagtggattatatttgaccag

SEQ ID NO: 257754 - DNA, 43 bp, Artificial Sequence
  Description of Artificial Sequence: Synthetic oligonucleotide
tgattctgaatttcacagccaacagtggattatatttgaccag

SEQ ID NO: 257755 - DNA, 42 bp, Artificial Sequence
  Description of Artificial Sequence: Synthetic oligonucleotide
gattctgaatttcacagccaacagtggattatatttgaccag

SEQ ID NO: 257756 - DNA, 44 bp, Artificial Sequence
  Description of Artificial Sequence: Synthetic oligonucleotide
attctgaatttcacagccaacagtggattatatttgaccagtac

SEQ ID NO: 257757 - DNA, 43 bp, Artificial Sequence
  Description of Artificial Sequence: Synthetic oligonucleotide
ttctgaatttcacagccaacagtggattatatttgaccagtac

SEQ ID NO: 257758 - DNA, 42 bp, Artificial Sequence
  Description of Artificial Sequence: Synthetic oligonucleotide
tctgaatttcacagccaacagtggattatatttgaccagtac

SEQ ID NO: 257759 - DNA, 41 bp, Artificial Sequence
  Description of Artificial Sequence: Synthetic oligonucleotide
ctgaatttcacagccaacagtggattatatttgaccagtac

SEQ ID NO: 257760 - DNA, 45 bp, Artificial Sequence
  Description of Artificial Sequence: Synthetic oligonucleotide
tgaatttcacagccaacagtggattatatttgaccagtacaaaag

SEQ ID NO: 257761 - DNA, 44 bp, Artificial Sequence
  Description of Artificial Sequence: Synthetic oligonucleotide
gaatttcacagccaacagtggattatatttgaccagtacaaaag

SEQ ID NO: 257762 - DNA, 45 bp, Artificial Sequence
  Description of Artificial Sequence: Synthetic oligonucleotide
aatttcacagccaacagtggattatatttgaccagtacaaaagac

SEQ ID NO: 257763 - DNA, 44 bp, Artificial Sequence
  Description of Artificial Sequence: Synthetic oligonucleotide
atttcacagccaacagtggattatatttgaccagtacaaaagac

SEQ ID NO: 257764 - DNA, 43 bp, Artificial Sequence
  Description of Artificial Sequence: Synthetic oligonucleotide
tttcacagccaacagtggattatatttgaccagtacaaaagac

SEQ ID NO: 257765 - DNA, 42 bp, Artificial Sequence
  Description of Artificial Sequence: Synthetic oligonucleotide
ttcacagccaacagtggattatatttgaccagtacaaaagac

SEQ ID NO: 257766 - DNA, 41 bp, Artificial Sequence
  Description of Artificial Sequence: Synthetic oligonucleotide
tcacagccaacagtggattatatttgaccagtacaaaagac

SEQ ID NO: 257767 - DNA, 40 bp, Artificial Sequence
  Description of Artificial Sequence: Synthetic oligonucleotide
cacagccaacagtggattatatttgaccagtacaaaagac

SEQ ID NO: 257768 - DNA, 41 bp, Artificial Sequence
  Description of Artificial Sequence: Synthetic oligonucleotide
acagccaacagtggattatatttgaccagtacaaaagactg

SEQ ID NO: 257769 - DNA, 40 bp, Artificial Sequence
  Description of Artificial Sequence: Synthetic oligonucleotide
cagccaacagtggattatatttgaccagtacaaaagactg

SEQ ID NO: 257770 - DNA, 42 bp, Artificial Sequence
  Description of Artificial Sequence: Synthetic oligonucleotide
agccaacagtggattatatttgaccagtacaaaagactgatg

SEQ ID NO: 257771 - DNA, 41 bp, Artificial Sequence
  Description of Artificial Sequence: Synthetic oligonucleotide
gccaacagtggattatatttgaccagtacaaaagactgatg

SEQ ID NO: 257772 - DNA, 41 bp, Artificial Sequence
  Description of Artificial Sequence: Synthetic oligonucleotide
ccaacagtggattatatttgaccagtacaaaagactgatgg

SEQ ID NO: 257773 - DNA, 41 bp, Artificial Sequence
  Description of Artificial Sequence: Synthetic oligonucleotide
caacagtggattatatttgaccagtacaaaagactgatggg

SEQ ID NO: 257774 - DNA, 43 bp, Artificial Sequence
  Description of Artificial Sequence: Synthetic oligonucleotide
aacagtggattatatttgaccagtacaaaagactgatgggttc

SEQ ID NO: 257775 - DNA, 42 bp, Artificial Sequence
  Description of Artificial Sequence: Synthetic oligonucleotide
acagtggattatatttgaccagtacaaaagactgatgggttc

SEQ ID NO: 257776 - DNA, 41 bp, Artificial Sequence
  Description of Artificial Sequence: Synthetic oligonucleotide
cagtggattatatttgaccagtacaaaagactgatgggttc

SEQ ID NO: 257777 - DNA, 42 bp, Artificial Sequence
  Description of Artificial Sequence: Synthetic oligonucleotide
agtggattatatttgaccagtacaaaagactgatgggttctg

SEQ ID NO: 257778 - DNA, 41 bp, Artificial Sequence
  Description of Artificial Sequence: Synthetic oligonucleotide
gtggattatatttgaccagtacaaaagactgatgggttctg

SEQ ID NO: 257779 - DNA, 41 bp, Artificial Sequence
  Description of Artificial Sequence: Synthetic oligonucleotide
tggattatatttgaccagtacaaaagactgatgggttctgg

SEQ ID NO: 257780 - DNA, 40 bp, Artificial Sequence
  Description of Artificial Sequence: Synthetic oligonucleotide
ggattatatttgaccagtacaaaagactgatgggttctgg

SEQ ID NO: 257781 - DNA, 40 bp, Artificial Sequence
  Description of Artificial Sequence: Synthetic oligonucleotide
gattatatttgaccagtacaaaagactgatgggttctggc

SEQ ID NO: 257782 - DNA, 40 bp, Artificial Sequence
  Description of Artificial Sequence: Synthetic oligonucleotide
attatatttgaccagtacaaaagactgatgggttctggcg

SEQ ID NO: 257783 - DNA, 39 bp, Artificial Sequence
  Description of Artificial Sequence: Synthetic oligonucleotide
ttatatttgaccagtacaaaagactgatgggttctggcg

SEQ ID NO: 257784 - DNA, 38 bp, Artificial Sequence
  Description of Artificial Sequence: Synthetic oligonucleotide
tatatttgaccagtacaaaagactgatgggttctggcg

SEQ ID NO: 257785 - DNA, 37 bp, Artificial Sequence
  Description of Artificial Sequence: Synthetic oligonucleotide
atatttgaccagtacaaaagactgatgggttctggcg

SEQ ID NO: 257786 - DNA, 36 bp, Artificial Sequence
  Description of Artificial Sequence: Synthetic oligonucleotide
tatttgaccagtacaaaagactgatgggttctggcg

SEQ ID NO: 257787 - DNA, 35 bp, Artificial Sequence
  Description of Artificial Sequence: Synthetic oligonucleotide
atttgaccagtacaaaagactgatgggttctggcg

SEQ ID NO: 257788 - DNA, 34 bp, Artificial Sequence
  Description of Artificial Sequence: Synthetic oligonucleotide
tttgaccagtacaaaagactgatgggttctggcg

SEQ ID NO: 257789 - DNA, 33 bp, Artificial Sequence
  Description of Artificial Sequence: Synthetic oligonucleotide
ttgaccagtacaaaagactgatgggttctggcg

SEQ ID NO: 257790 - DNA, 32 bp, Artificial Sequence
  Description of Artificial Sequence: Synthetic oligonucleotide
tgaccagtacaaaagactgatgggttctggcg

SEQ ID NO: 257791 - DNA, 31 bp, Artificial Sequence
  Description of Artificial Sequence: Synthetic oligonucleotide
gaccagtacaaaagactgatgggttctggcg

SEQ ID NO: 257792 - DNA, 33 bp, Artificial Sequence
  Description of Artificial Sequence: Synthetic oligonucleotide
accagtacaaaagactgatgggttctggcgatg

SEQ ID NO: 257793 - DNA, 32 bp, Artificial Sequence
  Description of Artificial Sequence: Synthetic oligonucleotide
ccagtacaaaagactgatgggttctggcgatg

SEQ ID NO: 257794 - DNA, 32 bp, Artificial Sequence
  Description of Artificial Sequence: Synthetic oligonucleotide
cagtacaaaagactgatgggttctggcgatgc

SEQ ID NO: 257795 - DNA, 32 bp, Artificial Sequence
  Description of Artificial Sequence: Synthetic oligonucleotide
agtacaaaagactgatgggttctggcgatgcc

SEQ ID NO: 257796 - DNA, 31 bp, Artificial Sequence
  Description of Artificial Sequence: Synthetic oligonucleotide
gtacaaaagactgatgggttctggcgatgcc

SEQ ID NO: 257797 - DNA, 34 bp, Artificial Sequence
  Description of Artificial Sequence: Synthetic oligonucleotide
tacaaaagactgatgggttctggcgatgccaatc

SEQ ID NO: 257798 - DNA, 33 bp, Artificial Sequence
  Description of Artificial Sequence: Synthetic oligonucleotide
acaaaagactgatgggttctggcgatgccaatc

SEQ ID NO: 257799 - DNA, 32 bp, Artificial Sequence
  Description of Artificial Sequence: Synthetic oligonucleotide
caaaagactgatgggttctggcgatgccaatc

SEQ ID NO: 257800 - DNA, 32 bp, Artificial Sequence
  Description of Artificial Sequence: Synthetic oligonucleotide
aaaagactgatgggttctggcgatgccaatcc

SEQ ID NO: 257801 - DNA, 31 bp, Artificial Sequence
  Description of Artificial Sequence: Synthetic oligonucleotide
aaagactgatgggttctggcgatgccaatcc

SEQ ID NO: 257802 - DNA, 30 bp, Artificial Sequence
  Description of Artificial Sequence: Synthetic oligonucleotide
aagactgatgggttctggcgatgccaatcc

SEQ ID NO: 257803 - DNA, 29 bp, Artificial Sequence
  Description of Artificial Sequence: Synthetic oligonucleotide
agactgatgggttctggcgatgccaatcc

SEQ ID NO: 257804 - DNA, 28 bp, Artificial Sequence
  Description of Artificial Sequence: Synthetic oligonucleotide
gactgatgggttctggcgatgccaatcc

SEQ ID NO: 257805 - DNA, 29 bp, Artificial Sequence
  Description of Artificial Sequence: Synthetic oligonucleotide
actgatgggttctggcgatgccaatccac

SEQ ID NO: 257806 - DNA, 28 bp, Artificial Sequence
  Description of Artificial Sequence: Synthetic oligonucleotide
ctgatgggttctggcgatgccaatccac

SEQ ID NO: 257807 - DNA, 30 bp, Artificial Sequence
  Description of Artificial Sequence: Synthetic oligonucleotide
tgatgggttctggcgatgccaatccacatc

SEQ ID NO: 257808 - DNA, 29 bp, Artificial Sequence
  Description of Artificial Sequence: Synthetic oligonucleotide
gatgggttctggcgatgccaatccacatc

SEQ ID NO: 257809 - DNA, 30 bp, Artificial Sequence
  Description of Artificial Sequence: Synthetic oligonucleotide
atgggttctggcgatgccaatccacatctg

SEQ ID NO: 257810 - DNA, 29 bp, Artificial Sequence
  Description of Artificial Sequence: Synthetic oligonucleotide
tgggttctggcgatgccaatccacatctg

SEQ ID NO: 257811 - DNA, 28 bp, Artificial Sequence
  Description of Artificial Sequence: Synthetic oligonucleotide
gggttctggcgatgccaatccacatctg

SEQ ID NO: 257812 - DNA, 32 bp, Artificial Sequence
  Description of Artificial Sequence: Synthetic oligonucleotide
ggttctggcgatgccaatccacatctgtattc

SEQ ID NO: 257813 - DNA, 35 bp, Artificial Sequence
  Description of Artificial Sequence: Synthetic oligonucleotide
gttctggcgatgccaatccacatctgtattctttc

SEQ ID NO: 257814 - DNA, 38 bp, Artificial Sequence
  Description of Artificial Sequence: Synthetic oligonucleotide
ttctggcgatgccaatccacatctgtattctttcaaac

SEQ ID NO: 257815 - DNA, 37 bp, Artificial Sequence
  Description of Artificial Sequence: Synthetic oligonucleotide
tctggcgatgccaatccacatctgtattctttcaaac

SEQ ID NO: 257816 - DNA, 36 bp, Artificial Sequence
  Description of Artificial Sequence: Synthetic oligonucleotide
ctggcgatgccaatccacatctgtattctttcaaac

SEQ ID NO: 257817 - DNA, 37 bp, Artificial Sequence
  Description of Artificial Sequence: Synthetic oligonucleotide
tggcgatgccaatccacatctgtattctttcaaactg

SEQ ID NO: 257818 - DNA, 36 bp, Artificial Sequence
  Description of Artificial Sequence: Synthetic oligonucleotide
ggcgatgccaatccacatctgtattctttcaaactg

SEQ ID NO: 257819 - DNA, 36 bp, Artificial Sequence
  Description of Artificial Sequence: Synthetic oligonucleotide
gcgatgccaatccacatctgtattctttcaaactgg

SEQ ID NO: 257820 - DNA, 37 bp, Artificial Sequence
  Description of Artificial Sequence: Synthetic oligonucleotide
cgatgccaatccacatctgtattctttcaaactggag

SEQ ID NO: 257821 - DNA, 40 bp, Artificial Sequence
  Description of Artificial Sequence: Synthetic oligonucleotide
gatgccaatccacatctgtattctttcaaactggagtaag

SEQ ID NO: 257822 - DNA, 40 bp, Artificial Sequence
  Description of Artificial Sequence: Synthetic oligonucleotide
atgccaatccacatctgtattctttcaaactggagtaagg

SEQ ID NO: 257823 - DNA, 39 bp, Artificial Sequence
  Description of Artificial Sequence: Synthetic oligonucleotide
tgccaatccacatctgtattctttcaaactggagtaagg

SEQ ID NO: 257824 - DNA, 38 bp, Artificial Sequence
  Description of Artificial Sequence: Synthetic oligonucleotide
gccaatccacatctgtattctttcaaactggagtaagg

SEQ ID NO: 257825 - DNA, 39 bp, Artificial Sequence
  Description of Artificial Sequence: Synthetic oligonucleotide
ccaatccacatctgtattctttcaaactggagtaaggag

SEQ ID NO: 257826 - DNA, 45 bp, Artificial Sequence
  Description of Artificial Sequence: Synthetic oligonucleotide
caatccacatctgtattctttcaaactggagtaaggagattttac

SEQ ID NO: 257827 - DNA, 49 bp, Artificial Sequence
  Description of Artificial Sequence: Synthetic oligonucleotide
aatccacatctgtattctttcaaactggagtaaggagattttacaattc

SEQ ID NO: 257828 - DNA, 48 bp, Artificial Sequence
  Description of Artificial Sequence: Synthetic oligonucleotide
atccacatctgtattctttcaaactggagtaaggagattttacaattc

SEQ ID NO: 257829 - DNA, 47 bp, Artificial Sequence
  Description of Artificial Sequence: Synthetic oligonucleotide
tccacatctgtattctttcaaactggagtaaggagattttacaattc

SEQ ID NO: 257830 - DNA, 46 bp, Artificial Sequence
  Description of Artificial Sequence: Synthetic oligonucleotide
ccacatctgtattctttcaaactggagtaaggagattttacaattc

SEQ ID NO: 257831 - DNA, 46 bp, Artificial Sequence
  Description of Artificial Sequence: Synthetic oligonucleotide
cacatctgtattctttcaaactggagtaaggagattttacaattcg

SEQ ID NO: 257832 - DNA, 47 bp, Artificial Sequence
  Description of Artificial Sequence: Synthetic oligonucleotide
acatctgtattctttcaaactggagtaaggagattttacaattcgtc

SEQ ID NO: 257833 - DNA, 46 bp, Artificial Sequence
  Description of Artificial Sequence: Synthetic oligonucleotide
catctgtattctttcaaactggagtaaggagattttacaattcgtc

SEQ ID NO: 257834 - DNA, 48 bp, Artificial Sequence
  Description of Artificial Sequence: Synthetic oligonucleotide
atctgtattctttcaaactggagtaaggagattttacaattcgtctac

SEQ ID NO: 257835 - DNA, 47 bp, Artificial Sequence
  Description of Artificial Sequence: Synthetic oligonucleotide
tctgtattctttcaaactggagtaaggagattttacaattcgtctac

SEQ ID NO: 257836 - DNA, 46 bp, Artificial Sequence
  Description of Artificial Sequence: Synthetic oligonucleotide
ctgtattctttcaaactggagtaaggagattttacaattcgtctac

SEQ ID NO: 257837 - DNA, 47 bp, Artificial Sequence
  Description of Artificial Sequence: Synthetic oligonucleotide
tgtattctttcaaactggagtaaggagattttacaattcgtctacag

SEQ ID NO: 257838 - DNA, 46 bp, Artificial Sequence
  Description of Artificial Sequence: Synthetic oligonucleotide
gtattctttcaaactggagtaaggagattttacaattcgtctacag

SEQ ID NO: 257839 - DNA, 49 bp, Artificial Sequence
  Description of Artificial Sequence: Synthetic oligonucleotide
tattctttcaaactggagtaaggagattttacaattcgtctacagattg

SEQ ID NO: 257840 - DNA, 48 bp, Artificial Sequence
  Description of Artificial Sequence: Synthetic oligonucleotide
attctttcaaactggagtaaggagattttacaattcgtctacagattg

SEQ ID NO: 257841 - DNA, 47 bp, Artificial Sequence
  Description of Artificial Sequence: Synthetic oligonucleotide
ttctttcaaactggagtaaggagattttacaattcgtctacagattg

SEQ ID NO: 257842 - DNA, 46 bp, Artificial Sequence
  Description of Artificial Sequence: Synthetic oligonucleotide
tctttcaaactggagtaaggagattttacaattcgtctacagattg

SEQ ID NO: 257843 - DNA, 45 bp, Artificial Sequence
  Description of Artificial Sequence: Synthetic oligonucleotide
ctttcaaactggagtaaggagattttacaattcgtctacagattg

SEQ ID NO: 257844 - DNA, 45 bp, Artificial Sequence
  Description of Artificial Sequence: Synthetic oligonucleotide
tttcaaactggagtaaggagattttacaattcgtctacagattgg

SEQ ID NO: 257845 - DNA, 44 bp, Artificial Sequence
  Description of Artificial Sequence: Synthetic oligonucleotide
ttcaaactggagtaaggagattttacaattcgtctacagattgg

SEQ ID NO: 257846 - DNA, 43 bp, Artificial Sequence
  Description of Artificial Sequence: Synthetic oligonucleotide
tcaaactggagtaaggagattttacaattcgtctacagattgg

SEQ ID NO: 257847 - DNA, 42 bp, Artificial Sequence
  Description of Artificial Sequence: Synthetic oligonucleotide
caaactggagtaaggagattttacaattcgtctacagattgg

SEQ ID NO: 257848 - DNA, 42 bp, Artificial Sequence
  Description of Artificial Sequence: Synthetic oligonucleotide
aaactggagtaaggagattttacaattcgtctacagattggc

SEQ ID NO: 257849 - DNA, 41 bp, Artificial Sequence
  Description of Artificial Sequence: Synthetic oligonucleotide
aactggagtaaggagattttacaattcgtctacagattggc

SEQ ID NO: 257850 - DNA, 40 bp, Artificial Sequence
  Description of Artificial Sequence: Synthetic oligonucleotide
actggagtaaggagattttacaattcgtctacagattggc

SEQ ID NO: 257851 - DNA, 39 bp, Artificial Sequence
  Description of Artificial Sequence: Synthetic oligonucleotide
ctggagtaaggagattttacaattcgtctacagattggc

SEQ ID NO: 257852 - DNA, 39 bp, Artificial Sequence
  Description of Artificial Sequence: Synthetic oligonucleotide
tggagtaaggagattttacaattcgtctacagattggcc

SEQ ID NO: 257853 - DNA, 38 bp, Artificial Sequence
  Description of Artificial Sequence: Synthetic oligonucleotide
ggagtaaggagattttacaattcgtctacagattggcc

SEQ ID NO: 257854 - DNA, 40 bp, Artificial Sequence
  Description of Artificial Sequence: Synthetic oligonucleotide
gagtaaggagattttacaattcgtctacagattggccatg

SEQ ID NO: 257855 - DNA, 41 bp, Artificial Sequence
  Description of Artificial Sequence: Synthetic oligonucleotide
agtaaggagattttacaattcgtctacagattggccatgag

SEQ ID NO: 257856 - DNA, 40 bp, Artificial Sequence
  Description of Artificial Sequence: Synthetic oligonucleotide
gtaaggagattttacaattcgtctacagattggccatgag

SEQ ID NO: 257857 - DNA, 40 bp, Artificial Sequence
  Description of Artificial Sequence: Synthetic oligonucleotide
taaggagattttacaattcgtctacagattggccatgagc

SEQ ID NO: 257858 - DNA, 39 bp, Artificial Sequence
  Description of Artificial Sequence: Synthetic oligonucleotide
aaggagattttacaattcgtctacagattggccatgagc

SEQ ID NO: 257859 - DNA, 38 bp, Artificial Sequence
  Description of Artificial Sequence: Synthetic oligonucleotide
aggagattttacaattcgtctacagattggccatgagc

SEQ ID NO: 257860 - DNA, 37 bp, Artificial Sequence
  Description of Artificial Sequence: Synthetic oligonucleotide
ggagattttacaattcgtctacagattggccatgagc

SEQ ID NO: 257861 - DNA, 41 bp, Artificial Sequence
  Description of Artificial Sequence: Synthetic oligonucleotide
gagattttacaattcgtctacagattggccatgagctaatc

SEQ ID NO: 257862 - DNA, 42 bp, Artificial Sequence
  Description of Artificial Sequence: Synthetic oligonucleotide
agattttacaattcgtctacagattggccatgagctaatcag

SEQ ID NO: 257863 - DNA, 41 bp, Artificial Sequence
  Description of Artificial Sequence: Synthetic oligonucleotide
gattttacaattcgtctacagattggccatgagctaatcag

SEQ ID NO: 257864 - DNA, 42 bp, Artificial Sequence
  Description of Artificial Sequence: Synthetic oligonucleotide
attttacaattcgtctacagattggccatgagctaatcagtg

SEQ ID NO: 257865 - DNA, 41 bp, Artificial Sequence
  Description of Artificial Sequence: Synthetic oligonucleotide
ttttacaattcgtctacagattggccatgagctaatcagtg

SEQ ID NO: 257866 - DNA, 40 bp, Artificial Sequence
  Description of Artificial Sequence: Synthetic oligonucleotide
tttacaattcgtctacagattggccatgagctaatcagtg

SEQ ID NO: 257867 - DNA, 39 bp, Artificial Sequence
  Description of Artificial Sequence: Synthetic oligonucleotide
ttacaattcgtctacagattggccatgagctaatcagtg

SEQ ID NO: 257868 - DNA, 38 bp, Artificial Sequence
  Description of Artificial Sequence: Synthetic oligonucleotide
tacaattcgtctacagattggccatgagctaatcagtg

SEQ ID NO: 257869 - DNA, 37 bp, Artificial Sequence
  Description of Artificial Sequence: Synthetic oligonucleotide
acaattcgtctacagattggccatgagctaatcagtg

SEQ ID NO: 257870 - DNA, 36 bp, Artificial Sequence
  Description of Artificial Sequence: Synthetic oligonucleotide
caattcgtctacagattggccatgagctaatcagtg

SEQ ID NO: 257871 - DNA, 40 bp, Artificial Sequence
  Description of Artificial Sequence: Synthetic oligonucleotide
aattcgtctacagattggccatgagctaatcagtgaattg

SEQ ID NO: 257872 - DNA, 39 bp, Artificial Sequence
  Description of Artificial Sequence: Synthetic oligonucleotide
attcgtctacagattggccatgagctaatcagtgaattg

SEQ ID NO: 257873 - DNA, 38 bp, Artificial Sequence
  Description of Artificial Sequence: Synthetic oligonucleotide
ttcgtctacagattggccatgagctaatcagtgaattg

SEQ ID NO: 257874 - DNA, 37 bp, Artificial Sequence
  Description of Artificial Sequence: Synthetic oligonucleotide
tcgtctacagattggccatgagctaatcagtgaattg

SEQ ID NO: 257875 - DNA, 36 bp, Artificial Sequence
  Description of Artificial Sequence: Synthetic oligonucleotide
cgtctacagattggccatgagctaatcagtgaattg

SEQ ID NO: 257876 - DNA, 36 bp, Artificial Sequence
  Description of Artificial Sequence: Synthetic oligonucleotide
gtctacagattggccatgagctaatcagtgaattgg

SEQ ID NO: 257877 - DNA, 38 bp, Artificial Sequence
  Description of Artificial Sequence: Synthetic oligonucleotide
tctacagattggccatgagctaatcagtgaattggaac

SEQ ID NO: 257878 - DNA, 37 bp, Artificial Sequence
  Description of Artificial Sequence: Synthetic oligonucleotide
ctacagattggccatgagctaatcagtgaattggaac

SEQ ID NO: 257879 - DNA, 37 bp, Artificial Sequence
  Description of Artificial Sequence: Synthetic oligonucleotide
tacagattggccatgagctaatcagtgaattggaacg

SEQ ID NO: 257880 - DNA, 36 bp, Artificial Sequence
  Description of Artificial Sequence: Synthetic oligonucleotide
acagattggccatgagctaatcagtgaattggaacg

SEQ ID NO: 257881 - DNA, 35 bp, Artificial Sequence
  Description of Artificial Sequence: Synthetic oligonucleotide
cagattggccatgagctaatcagtgaattggaacg

SEQ ID NO: 257882 - DNA, 35 bp, Artificial Sequence
  Description of Artificial Sequence: Synthetic oligonucleotide
agattggccatgagctaatcagtgaattggaacgc

SEQ ID NO: 257883 - DNA, 34 bp, Artificial Sequence
  Description of Artificial Sequence: Synthetic oligonucleotide
gattggccatgagctaatcagtgaattggaacgc

SEQ ID NO: 257884 - DNA, 34 bp, Artificial Sequence
  Description of Artificial Sequence: Synthetic oligonucleotide
attggccatgagctaatcagtgaattggaacgcg

SEQ ID NO: 257885 - DNA, 33 bp, Artificial Sequence
  Description of Artificial Sequence: Synthetic oligonucleotide
ttggccatgagctaatcagtgaattggaacgcg

SEQ ID NO: 257886 - DNA, 32 bp, Artificial Sequence
  Description of Artificial Sequence: Synthetic oligonucleotide
tggccatgagctaatcagtgaattggaacgcg

SEQ ID NO: 257887 - DNA, 31 bp, Artificial Sequence
  Description of Artificial Sequence: Synthetic oligonucleotide
ggccatgagctaatcagtgaattggaacgcg

SEQ ID NO: 257888 - DNA, 36 bp, Artificial Sequence
  Description of Artificial Sequence: Synthetic oligonucleotide
gccatgagctaatcagtgaattggaacgcgttaaag

SEQ ID NO: 257889 - DNA, 37 bp, Artificial Sequence
  Description of Artificial Sequence: Synthetic oligonucleotide
ccatgagctaatcagtgaattggaacgcgttaaagac

SEQ ID NO: 257890 - DNA, 37 bp, Artificial Sequence
  Description of Artificial Sequence: Synthetic oligonucleotide
catgagctaatcagtgaattggaacgcgttaaagacc

SEQ ID NO: 257891 - DNA, 39 bp, Artificial Sequence
  Description of Artificial Sequence: Synthetic oligonucleotide
atgagctaatcagtgaattggaacgcgttaaagaccatc

SEQ ID NO: 257892 - DNA, 38 bp, Artificial Sequence
  Description of Artificial Sequence: Synthetic oligonucleotide
tgagctaatcagtgaattggaacgcgttaaagaccatc

SEQ ID NO: 257893 - DNA, 37 bp, Artificial Sequence
  Description of Artificial Sequence: Synthetic oligonucleotide
gagctaatcagtgaattggaacgcgttaaagaccatc

SEQ ID NO: 257894 - DNA, 37 bp, Artificial Sequence
  Description of Artificial Sequence: Synthetic oligonucleotide
agctaatcagtgaattggaacgcgttaaagaccatcc

SEQ ID NO: 257895 - DNA, 36 bp, Artificial Sequence
  Description of Artificial Sequence: Synthetic oligonucleotide
gctaatcagtgaattggaacgcgttaaagaccatcc

SEQ ID NO: 257896 - DNA, 43 bp, Artificial Sequence
  Description of Artificial Sequence: Synthetic oligonucleotide
ctaatcagtgaattggaacgcgttaaagaccatccatttatag

SEQ ID NO: 257897 - DNA, 46 bp, Artificial Sequence
  Description of Artificial Sequence: Synthetic oligonucleotide
taatcagtgaattggaacgcgttaaagaccatccatttatagtttc

SEQ ID NO: 257898 - DNA, 45 bp, Artificial Sequence
  Description of Artificial Sequence: Synthetic oligonucleotide
aatcagtgaattggaacgcgttaaagaccatccatttatagtttc

SEQ ID NO: 257899 - DNA, 44 bp, Artificial Sequence
  Description of Artificial Sequence: Synthetic oligonucleotide
atcagtgaattggaacgcgttaaagaccatccatttatagtttc

SEQ ID NO: 257900 - DNA, 43 bp, Artificial Sequence
  Description of Artificial Sequence: Synthetic oligonucleotide
tcagtgaattggaacgcgttaaagaccatccatttatagtttc

SEQ ID NO: 257901 - DNA, 42 bp, Artificial Sequence
  Description of Artificial Sequence: Synthetic oligonucleotide
cagtgaattggaacgcgttaaagaccatccatttatagtttc

SEQ ID NO: 257902 - DNA, 43 bp, Artificial Sequence
  Description of Artificial Sequence: Synthetic oligonucleotide
agtgaattggaacgcgttaaagaccatccatttatagtttctc

SEQ ID NO: 257903 - DNA, 42 bp, Artificial Sequence
  Description of Artificial Sequence: Synthetic oligonucleotide
gtgaattggaacgcgttaaagaccatccatttatagtttctc

SEQ ID NO: 257904 - DNA, 45 bp, Artificial Sequence
  Description of Artificial Sequence: Synthetic oligonucleotide
tgaattggaacgcgttaaagaccatccatttatagtttctcattg

SEQ ID NO: 257905 - DNA, 44 bp, Artificial Sequence
  Description of Artificial Sequence: Synthetic oligonucleotide
gaattggaacgcgttaaagaccatccatttatagtttctcattg

SEQ ID NO: 257906 - DNA, 47 bp, Artificial Sequence
  Description of Artificial Sequence: Synthetic oligonucleotide
aattggaacgcgttaaagaccatccatttatagtttctcattgattg

SEQ ID NO: 257907 - DNA, 46 bp, Artificial Sequence
  Description of Artificial Sequence: Synthetic oligonucleotide
attggaacgcgttaaagaccatccatttatagtttctcattgattg

SEQ ID NO: 257908 - DNA, 45 bp, Artificial Sequence
  Description of Artificial Sequence: Synthetic oligonucleotide
ttggaacgcgttaaagaccatccatttatagtttctcattgattg

SEQ ID NO: 257909 - DNA, 44 bp, Artificial Sequence
  Description of Artificial Sequence: Synthetic oligonucleotide
tggaacgcgttaaagaccatccatttatagtttctcattgattg

SEQ ID NO: 257910 - DNA, 43 bp, Artificial Sequence
  Description of Artificial Sequence: Synthetic oligonucleotide
ggaacgcgttaaagaccatccatttatagtttctcattgattg

SEQ ID NO: 257911 - DNA, 44 bp, Artificial Sequence
  Description of Artificial Sequence: Synthetic oligonucleotide
gaacgcgttaaagaccatccatttatagtttctcattgattgtc

SEQ ID NO: 257912 - DNA, 49 bp, Artificial Sequence
  Description of Artificial Sequence: Synthetic oligonucleotide
aacgcgttaaagaccatccatttatagtttctcattgattgtctattac

SEQ ID NO: 257913 - DNA, 48 bp, Artificial Sequence
  Description of Artificial Sequence: Synthetic oligonucleotide
acgcgttaaagaccatccatttatagtttctcattgattgtctattac

SEQ ID NO: 257914 - DNA, 47 bp, Artificial Sequence
  Description of Artificial Sequence: Synthetic oligonucleotide
cgcgttaaagaccatccatttatagtttctcattgattgtctattac

SEQ ID NO: 257915 - DNA, 47 bp, Artificial Sequence
  Description of Artificial Sequence: Synthetic oligonucleotide
gcgttaaagaccatccatttatagtttctcattgattgtctattacc

SEQ ID NO: 257916 - DNA, 49 bp, Artificial Sequence
  Description of Artificial Sequence: Synthetic oligonucleotide
cgttaaagaccatccatttatagtttctcattgattgtctattaccttg

SEQ ID NO: 257917 - DNA, 50 bp, Artificial Sequence
  Description of Artificial Sequence: Synthetic oligonucleotide
gttaaagaccatccatttatagtttctcattgattgtctattaccttgag

SEQ ID NO: 257918 - DNA, 50 bp, Artificial Sequence
  Description of Artificial Sequence: Synthetic oligonucleotide
ttaaagaccatccatttatagtttctcattgattgtctattaccttgagg

SEQ ID NO: 257919 - DNA, 49 bp, Artificial Sequence
  Description of Artificial Sequence: Synthetic oligonucleotide
taaagaccatccatttatagtttctcattgattgtctattaccttgagg

SEQ ID NO: 257920 - DNA, 48 bp, Artificial Sequence
  Description of Artificial Sequence: Synthetic oligonucleotide
aaagaccatccatttatagtttctcattgattgtctattaccttgagg

SEQ ID NO: 257921 - DNA, 47 bp, Artificial Sequence
  Description of Artificial Sequence: Synthetic oligonucleotide
aagaccatccatttatagtttctcattgattgtctattaccttgagg

SEQ ID NO: 257922 - DNA, 46 bp, Artificial Sequence
  Description of Artificial Sequence: Synthetic oligonucleotide
agaccatccatttatagtttctcattgattgtctattaccttgagg

SEQ ID NO: 257923 - DNA, 45 bp, Artificial Sequence
  Description of Artificial Sequence: Synthetic oligonucleotide
gaccatccatttatagtttctcattgattgtctattaccttgagg

SEQ ID NO: 257924 - DNA, 48 bp, Artificial Sequence
  Description of Artificial Sequence: Synthetic oligonucleotide
accatccatttatagtttctcattgattgtctattaccttgaggttag

SEQ ID NO: 257925 - DNA, 47 bp, Artificial Sequence
  Description of Artificial Sequence: Synthetic oligonucleotide
ccatccatttatagtttctcattgattgtctattaccttgaggttag

SEQ ID NO: 257926 - DNA, 52 bp, Artificial Sequence
  Description of Artificial Sequence: Synthetic oligonucleotide
catccatttatagtttctcattgattgtctattaccttgaggttagatattg

SEQ ID NO: 257927 - DNA, 54 bp, Artificial Sequence
  Description of Artificial Sequence: Synthetic oligonucleotide
atccatttatagtttctcattgattgtctattaccttgaggttagatattgatg

SEQ ID NO: 257928 - DNA, 53 bp, Artificial Sequence
  Description of Artificial Sequence: Synthetic oligonucleotide
tccatttatagtttctcattgattgtctattaccttgaggttagatattgatg

SEQ ID NO: 257929 - DNA, 52 bp, Artificial Sequence
  Description of Artificial Sequence: Synthetic oligonucleotide
ccatttatagtttctcattgattgtctattaccttgaggttagatattgatg

SEQ ID NO: 257930 - DNA, 57 bp, Artificial Sequence
  Description of Artificial Sequence: Synthetic oligonucleotide
catttatagtttctcattgattgtctattaccttgaggttagatattgatgaaaatc

SEQ ID NO: 257931 - DNA, 60 bp, Artificial Sequence
  Description of Artificial Sequence: Synthetic oligonucleotide
atttatagtttctcattgattgtctattaccttgaggttagatattgatgaaaatcttag

SEQ ID NO: 257932 - DNA, 59 bp, Artificial Sequence
  Description of Artificial Sequence: Synthetic oligonucleotide
tttatagtttctcattgattgtctattaccttgaggttagatattgatgaaaatcttag

SEQ ID NO: 257933 - DNA, 58 bp, Artificial Sequence
  Description of Artificial Sequence: Synthetic oligonucleotide
ttatagtttctcattgattgtctattaccttgaggttagatattgatgaaaatcttag

SEQ ID NO: 257934 - DNA, 57 bp, Artificial Sequence
  Description of Artificial Sequence: Synthetic oligonucleotide
tatagtttctcattgattgtctattaccttgaggttagatattgatgaaaatcttag

SEQ ID NO: 257935 - DNA, 56 bp, Artificial Sequence
  Description of Artificial Sequence: Synthetic oligonucleotide
atagtttctcattgattgtctattaccttgaggttagatattgatgaaaatcttag

SEQ ID NO: 257936 - DNA, 55 bp, Artificial Sequence
  Description of Artificial Sequence: Synthetic oligonucleotide
tagtttctcattgattgtctattaccttgaggttagatattgatgaaaatcttag

SEQ ID NO: 257937 - DNA, 54 bp, Artificial Sequence
  Description of Artificial Sequence: Synthetic oligonucleotide
agtttctcattgattgtctattaccttgaggttagatattgatgaaaatcttag

SEQ ID NO: 257938 - DNA, 53 bp, Artificial Sequence
  Description of Artificial Sequence: Synthetic oligonucleotide
gtttctcattgattgtctattaccttgaggttagatattgatgaaaatcttag

SEQ ID NO: 257939 - DNA, 57 bp, Artificial Sequence
  Description of Artificial Sequence: Synthetic oligonucleotide
tttctcattgattgtctattaccttgaggttagatattgatgaaaatcttagttttg

SEQ ID NO: 257940 - DNA, 56 bp, Artificial Sequence
  Description of Artificial Sequence: Synthetic oligonucleotide
ttctcattgattgtctattaccttgaggttagatattgatgaaaatcttagttttg

SEQ ID NO: 257941 - DNA, 55 bp, Artificial Sequence
  Description of Artificial Sequence: Synthetic oligonucleotide
tctcattgattgtctattaccttgaggttagatattgatgaaaatcttagttttg

SEQ ID NO: 257942 - DNA, 54 bp, Artificial Sequence
  Description of Artificial Sequence: Synthetic oligonucleotide
ctcattgattgtctattaccttgaggttagatattgatgaaaatcttagttttg

SEQ ID NO: 257943 - DNA, 54 bp, Artificial Sequence
  Description of Artificial Sequence: Synthetic oligonucleotide
tcattgattgtctattaccttgaggttagatattgatgaaaatcttagttttgc

SEQ ID NO: 257944 - DNA, 53 bp, Artificial Sequence
  Description of Artificial Sequence: Synthetic oligonucleotide
cattgattgtctattaccttgaggttagatattgatgaaaatcttagttttgc

SEQ ID NO: 257945 - DNA, 54 bp, Artificial Sequence
  Description of Artificial Sequence: Synthetic oligonucleotide
attgattgtctattaccttgaggttagatattgatgaaaatcttagttttgctc

SEQ ID NO: 257946 - DNA, 53 bp, Artificial Sequence
  Description of Artificial Sequence: Synthetic oligonucleotide
ttgattgtctattaccttgaggttagatattgatgaaaatcttagttttgctc

SEQ ID NO: 257947 - DNA, 52 bp, Artificial Sequence
  Description of Artificial Sequence: Synthetic oligonucleotide
tgattgtctattaccttgaggttagatattgatgaaaatcttagttttgctc

SEQ ID NO: 257948 - DNA, 51 bp, Artificial Sequence
  Description of Artificial Sequence: Synthetic oligonucleotide
gattgtctattaccttgaggttagatattgatgaaaatcttagttttgctc

SEQ ID NO: 257949 - DNA, 53 bp, Artificial Sequence
  Description of Artificial Sequence: Synthetic oligonucleotide
attgtctattaccttgaggttagatattgatgaaaatcttagttttgctcttc

SEQ ID NO: 257950 - DNA, 52 bp, Artificial Sequence
  Description of Artificial Sequence: Synthetic oligonucleotide
ttgtctattaccttgaggttagatattgatgaaaatcttagttttgctcttc

SEQ ID NO: 257951 - DNA, 51 bp, Artificial Sequence
  Description of Artificial Sequence: Synthetic oligonucleotide
tgtctattaccttgaggttagatattgatgaaaatcttagttttgctcttc

SEQ ID NO: 257952 - DNA, 50 bp, Artificial Sequence
  Description of Artificial Sequence: Synthetic oligonucleotide
gtctattaccttgaggttagatattgatgaaaatcttagttttgctcttc

SEQ ID NO: 257953 - DNA, 52 bp, Artificial Sequence
  Description of Artificial Sequence: Synthetic oligonucleotide
tctattaccttgaggttagatattgatgaaaatcttagttttgctcttctag

SEQ ID NO: 257954 - DNA, 51 bp, Artificial Sequence
  Description of Artificial Sequence: Synthetic oligonucleotide
ctattaccttgaggttagatattgatgaaaatcttagttttgctcttctag

SEQ ID NO: 257955 - DNA, 51 bp, Artificial Sequence
  Description of Artificial Sequence: Synthetic oligonucleotide
tattaccttgaggttagatattgatgaaaatcttagttttgctcttctagg

SEQ ID NO: 257956 - DNA, 50 bp, Artificial Sequence
  Description of Artificial Sequence: Synthetic oligonucleotide
attaccttgaggttagatattgatgaaaatcttagttttgctcttctagg

SEQ ID NO: 257957 - DNA, 49 bp, Artificial Sequence
  Description of Artificial Sequence: Synthetic oligonucleotide
ttaccttgaggttagatattgatgaaaatcttagttttgctcttctagg

SEQ ID NO: 257958 - DNA, 48 bp, Artificial Sequence
  Description of Artificial Sequence: Synthetic oligonucleotide
taccttgaggttagatattgatgaaaatcttagttttgctcttctagg

SEQ ID NO: 257959 - DNA, 47 bp, Artificial Sequence
  Description of Artificial Sequence: Synthetic oligonucleotide
accttgaggttagatattgatgaaaatcttagttttgctcttctagg

SEQ ID NO: 257960 - DNA, 46 bp, Artificial Sequence
  Description of Artificial Sequence: Synthetic oligonucleotide
ccttgaggttagatattgatgaaaatcttagttttgctcttctagg

SEQ ID NO: 257961 - DNA, 46 bp, Artificial Sequence
  Description of Artificial Sequence: Synthetic oligonucleotide
cttgaggttagatattgatgaaaatcttagttttgctcttctaggg

SEQ ID NO: 257962 - DNA, 48 bp, Artificial Sequence
  Description of Artificial Sequence: Synthetic oligonucleotide
ttgaggttagatattgatgaaaatcttagttttgctcttctagggtag

SEQ ID NO: 257963 - DNA, 47 bp, Artificial Sequence
  Description of Artificial Sequence: Synthetic oligonucleotide
tgaggttagatattgatgaaaatcttagttttgctcttctagggtag

SEQ ID NO: 257964 - DNA, 46 bp, Artificial Sequence
  Description of Artificial Sequence: Synthetic oligonucleotide
gaggttagatattgatgaaaatcttagttttgctcttctagggtag

SEQ ID NO: 257965 - DNA, 48 bp, Artificial Sequence
  Description of Artificial Sequence: Synthetic oligonucleotide
aggttagatattgatgaaaatcttagttttgctcttctagggtagaag

SEQ ID NO: 257966 - DNA, 47 bp, Artificial Sequence
  Description of Artificial Sequence: Synthetic oligonucleotide
ggttagatattgatgaaaatcttagttttgctcttctagggtagaag

SEQ ID NO: 257967 - DNA, 51 bp, Artificial Sequence
  Description of Artificial Sequence: Synthetic oligonucleotide
gttagatattgatgaaaatcttagttttgctcttctagggtagaagaaatg

SEQ ID NO: 257968 - DNA, 53 bp, Artificial Sequence
  Description of Artificial Sequence: Synthetic oligonucleotide
ttagatattgatgaaaatcttagttttgctcttctagggtagaagaaatgaag

SEQ ID NO: 257969 - DNA, 52 bp, Artificial Sequence
  Description of Artificial Sequence: Synthetic oligonucleotide
tagatattgatgaaaatcttagttttgctcttctagggtagaagaaatgaag

SEQ ID NO: 257970 - DNA, 51 bp, Artificial Sequence
  Description of Artificial Sequence: Synthetic oligonucleotide
agatattgatgaaaatcttagttttgctcttctagggtagaagaaatgaag

SEQ ID NO: 257971 - DNA, 50 bp, Artificial Sequence
  Description of Artificial Sequence: Synthetic oligonucleotide
gatattgatgaaaatcttagttttgctcttctagggtagaagaaatgaag

SEQ ID NO: 257972 - DNA, 50 bp, Artificial Sequence
  Description of Artificial Sequence: Synthetic oligonucleotide
atattgatgaaaatcttagttttgctcttctagggtagaagaaatgaagc

SEQ ID NO: 257973 - DNA, 49 bp, Artificial Sequence
  Description of Artificial Sequence: Synthetic oligonucleotide
tattgatgaaaatcttagttttgctcttctagggtagaagaaatgaagc

SEQ ID NO: 257974 - DNA, 48 bp, Artificial Sequence
  Description of Artificial Sequence: Synthetic oligonucleotide
attgatgaaaatcttagttttgctcttctagggtagaagaaatgaagc

SEQ ID NO: 257975 - DNA, 47 bp, Artificial Sequence
  Description of Artificial Sequence: Synthetic oligonucleotide
ttgatgaaaatcttagttttgctcttctagggtagaagaaatgaagc

SEQ ID NO: 257976 - DNA, 46 bp, Artificial Sequence
  Description of Artificial Sequence: Synthetic oligonucleotide
tgatgaaaatcttagttttgctcttctagggtagaagaaatgaagc

SEQ ID NO: 257977 - DNA, 45 bp, Artificial Sequence
  Description of Artificial Sequence: Synthetic oligonucleotide
gatgaaaatcttagttttgctcttctagggtagaagaaatgaagc

SEQ ID NO: 257978 - DNA, 50 bp, Artificial Sequence
  Description of Artificial Sequence: Synthetic oligonucleotide
atgaaaatcttagttttgctcttctagggtagaagaaatgaagcaatttc

SEQ ID NO: 257979 - DNA, 49 bp, Artificial Sequence
  Description of Artificial Sequence: Synthetic oligonucleotide
tgaaaatcttagttttgctcttctagggtagaagaaatgaagcaatttc

SEQ ID NO: 257980 - DNA, 48 bp, Artificial Sequence
  Description of Artificial Sequence: Synthetic oligonucleotide
gaaaatcttagttttgctcttctagggtagaagaaatgaagcaatttc

SEQ ID NO: 257981 - DNA, 49 bp, Artificial Sequence
  Description of Artificial Sequence: Synthetic oligonucleotide
aaaatcttagttttgctcttctagggtagaagaaatgaagcaatttcac

SEQ ID NO: 257982 - DNA, 48 bp, Artificial Sequence
  Description of Artificial Sequence: Synthetic oligonucleotide
aaatcttagttttgctcttctagggtagaagaaatgaagcaatttcac

SEQ ID NO: 257983 - DNA, 47 bp, Artificial Sequence
  Description of Artificial Sequence: Synthetic oligonucleotide
aatcttagttttgctcttctagggtagaagaaatgaagcaatttcac

SEQ ID NO: 257984 - DNA, 46 bp, Artificial Sequence
  Description of Artificial Sequence: Synthetic oligonucleotide
atcttagttttgctcttctagggtagaagaaatgaagcaatttcac

SEQ ID NO: 257985 - DNA, 45 bp, Artificial Sequence
  Description of Artificial Sequence: Synthetic oligonucleotide
tcttagttttgctcttctagggtagaagaaatgaagcaatttcac

SEQ ID NO: 257986 - DNA, 44 bp, Artificial Sequence
  Description of Artificial Sequence: Synthetic oligonucleotide
cttagttttgctcttctagggtagaagaaatgaagcaatttcac

SEQ ID NO: 257987 - DNA, 48 bp, Artificial Sequence
  Description of Artificial Sequence: Synthetic oligonucleotide
ttagttttgctcttctagggtagaagaaatgaagcaatttcacattac

SEQ ID NO: 257988 - DNA, 47 bp, Artificial Sequence
  Description of Artificial Sequence: Synthetic oligonucleotide
tagttttgctcttctagggtagaagaaatgaagcaatttcacattac

SEQ ID NO: 257989 - DNA, 46 bp, Artificial Sequence
  Description of Artificial Sequence: Synthetic oligonucleotide
agttttgctcttctagggtagaagaaatgaagcaatttcacattac

SEQ ID NO: 257990 - DNA, 45 bp, Artificial Sequence
  Description of Artificial Sequence: Synthetic oligonucleotide
gttttgctcttctagggtagaagaaatgaagcaatttcacattac

SEQ ID NO: 257991 - DNA, 45 bp, Artificial Sequence
  Description of Artificial Sequence: Synthetic oligonucleotide
ttttgctcttctagggtagaagaaatgaagcaatttcacattacc

SEQ ID NO: 257992 - DNA, 44 bp, Artificial Sequence
  Description of Artificial Sequence: Synthetic oligonucleotide
tttgctcttctagggtagaagaaatgaagcaatttcacattacc

SEQ ID NO: 257993 - DNA, 43 bp, Artificial Sequence
  Description of Artificial Sequence: Synthetic oligonucleotide
ttgctcttctagggtagaagaaatgaagcaatttcacattacc

SEQ ID NO: 257994 - DNA, 42 bp, Artificial Sequence
  Description of Artificial Sequence: Synthetic oligonucleotide
tgctcttctagggtagaagaaatgaagcaatttcacattacc

SEQ ID NO: 257995 - DNA, 41 bp, Artificial Sequence
  Description of Artificial Sequence: Synthetic oligonucleotide
gctcttctagggtagaagaaatgaagcaatttcacattacc

SEQ ID NO: 257996 - DNA, 42 bp, Artificial Sequence
  Description of Artificial Sequence: Synthetic oligonucleotide
ctcttctagggtagaagaaatgaagcaatttcacattaccag

SEQ ID NO: 257997 - DNA, 42 bp, Artificial Sequence
  Description of Artificial Sequence: Synthetic oligonucleotide
tcttctagggtagaagaaatgaagcaatttcacattaccagc

SEQ ID NO: 257998 - DNA, 41 bp, Artificial Sequence
  Description of Artificial Sequence: Synthetic oligonucleotide
cttctagggtagaagaaatgaagcaatttcacattaccagc

SEQ ID NO: 257999 - DNA, 41 bp, Artificial Sequence
  Description of Artificial Sequence: Synthetic oligonucleotide
ttctagggtagaagaaatgaagcaatttcacattaccagcc

SEQ ID NO: 258000 - DNA, 40 bp, Artificial Sequence
  Description of Artificial Sequence: Synthetic oligonucleotide
tctagggtagaagaaatgaagcaatttcacattaccagcc

SEQ ID NO: 258001 - DNA, 39 bp, Artificial Sequence
  Description of Artificial Sequence: Synthetic oligonucleotide
ctagggtagaagaaatgaagcaatttcacattaccagcc

SEQ ID NO: 258002 - DNA, 47 bp, Artificial Sequence
  Description of Artificial Sequence: Synthetic oligonucleotide
tagggtagaagaaatgaagcaatttcacattaccagccaaatatatc

SEQ ID NO: 258003 - DNA, 46 bp, Artificial Sequence
  Description of Artificial Sequence: Synthetic oligonucleotide
agggtagaagaaatgaagcaatttcacattaccagccaaatatatc

SEQ ID NO: 258004 - DNA, 45 bp, Artificial Sequence
  Description of Artificial Sequence: Synthetic oligonucleotide
gggtagaagaaatgaagcaatttcacattaccagccaaatatatc

SEQ ID NO: 258005 - DNA, 45 bp, Artificial Sequence
  Description of Artificial Sequence: Synthetic oligonucleotide
ggtagaagaaatgaagcaatttcacattaccagccaaatatatcc

SEQ ID NO: 258006 - DNA, 46 bp, Artificial Sequence
  Description of Artificial Sequence: Synthetic oligonucleotide
gtagaagaaatgaagcaatttcacattaccagccaaatatatccag

SEQ ID NO: 258007 - DNA, 46 bp, Artificial Sequence
  Description of Artificial Sequence: Synthetic oligonucleotide
tagaagaaatgaagcaatttcacattaccagccaaatatatccagc

SEQ ID NO: 258008 - DNA, 45 bp, Artificial Sequence
  Description of Artificial Sequence: Synthetic oligonucleotide
agaagaaatgaagcaatttcacattaccagccaaatatatccagc

SEQ ID NO: 258009 - DNA, 44 bp, Artificial Sequence
  Description of Artificial Sequence: Synthetic oligonucleotide
gaagaaatgaagcaatttcacattaccagccaaatatatccagc

SEQ ID NO: 258010 - DNA, 44 bp, Artificial Sequence
  Description of Artificial Sequence: Synthetic oligonucleotide
aagaaatgaagcaatttcacattaccagccaaatatatccagcc

SEQ ID NO: 258011 - DNA, 43 bp, Artificial Sequence
  Description of Artificial Sequence: Synthetic oligonucleotide
agaaatgaagcaatttcacattaccagccaaatatatccagcc

SEQ ID NO: 258012 - DNA, 42 bp, Artificial Sequence
  Description of Artificial Sequence: Synthetic oligonucleotide
gaaatgaagcaatttcacattaccagccaaatatatccagcc

SEQ ID NO: 258013 - DNA, 45 bp, Artificial Sequence
  Description of Artificial Sequence: Synthetic oligonucleotide
aaatgaagcaatttcacattaccagccaaatatatccagccattg

SEQ ID NO: 258014 - DNA, 44 bp, Artificial Sequence
  Description of Artificial Sequence: Synthetic oligonucleotide
aatgaagcaatttcacattaccagccaaatatatccagccattg

SEQ ID NO: 258015 - DNA, 43 bp, Artificial Sequence
  Description of Artificial Sequence: Synthetic oligonucleotide
atgaagcaatttcacattaccagccaaatatatccagccattg

SEQ ID NO: 258016 - DNA, 42 bp, Artificial Sequence
  Description of Artificial Sequence: Synthetic oligonucleotide
tgaagcaatttcacattaccagccaaatatatccagccattg

SEQ ID NO: 258017 - DNA, 41 bp, Artificial Sequence
  Description of Artificial Sequence: Synthetic oligonucleotide
gaagcaatttcacattaccagccaaatatatccagccattg

SEQ ID NO: 258018 - DNA, 44 bp, Artificial Sequence
  Description of Artificial Sequence: Synthetic oligonucleotide
aagcaatttcacattaccagccaaatatatccagccattgtttg

SEQ ID NO: 258019 - DNA, 43 bp, Artificial Sequence
  Description of Artificial Sequence: Synthetic oligonucleotide
agcaatttcacattaccagccaaatatatccagccattgtttg

SEQ ID NO: 258020 - DNA, 42 bp, Artificial Sequence
  Description of Artificial Sequence: Synthetic oligonucleotide
gcaatttcacattaccagccaaatatatccagccattgtttg

SEQ ID NO: 258021 - DNA, 45 bp, Artificial Sequence
  Description of Artificial Sequence: Synthetic oligonucleotide
caatttcacattaccagccaaatatatccagccattgtttgttac

SEQ ID NO: 258022 - DNA, 47 bp, Artificial Sequence
  Description of Artificial Sequence: Synthetic oligonucleotide
aatttcacattaccagccaaatatatccagccattgtttgttactac

SEQ ID NO: 258023 - DNA, 46 bp, Artificial Sequence
  Description of Artificial Sequence: Synthetic oligonucleotide
atttcacattaccagccaaatatatccagccattgtttgttactac

SEQ ID NO: 258024 - DNA, 45 bp, Artificial Sequence
  Description of Artificial Sequence: Synthetic oligonucleotide
tttcacattaccagccaaatatatccagccattgtttgttactac

SEQ ID NO: 258025 - DNA, 44 bp, Artificial Sequence
  Description of Artificial Sequence: Synthetic oligonucleotide
ttcacattaccagccaaatatatccagccattgtttgttactac

SEQ ID NO: 258026 - DNA, 43 bp, Artificial Sequence
  Description of Artificial Sequence: Synthetic oligonucleotide
tcacattaccagccaaatatatccagccattgtttgttactac

SEQ ID NO: 258027 - DNA, 42 bp, Artificial Sequence
  Description of Artificial Sequence: Synthetic oligonucleotide
cacattaccagccaaatatatccagccattgtttgttactac

SEQ ID NO: 258028 - DNA, 42 bp, Artificial Sequence
  Description of Artificial Sequence: Synthetic oligonucleotide
acattaccagccaaatatatccagccattgtttgttactacc

SEQ ID NO: 258029 - DNA, 41 bp, Artificial Sequence
  Description of Artificial Sequence: Synthetic oligonucleotide
cattaccagccaaatatatccagccattgtttgttactacc

SEQ ID NO: 258030 - DNA, 44 bp, Artificial Sequence
  Description of Artificial Sequence: Synthetic oligonucleotide
attaccagccaaatatatccagccattgtttgttactaccttac

SEQ ID NO: 258031 - DNA, 43 bp, Artificial Sequence
  Description of Artificial Sequence: Synthetic oligonucleotide
ttaccagccaaatatatccagccattgtttgttactaccttac

SEQ ID NO: 258032 - DNA, 42 bp, Artificial Sequence
  Description of Artificial Sequence: Synthetic oligonucleotide
taccagccaaatatatccagccattgtttgttactaccttac

SEQ ID NO: 258033 - DNA, 41 bp, Artificial Sequence
  Description of Artificial Sequence: Synthetic oligonucleotide
accagccaaatatatccagccattgtttgttactaccttac

SEQ ID NO: 258034 - DNA, 40 bp, Artificial Sequence
  Description of Artificial Sequence: Synthetic oligonucleotide
ccagccaaatatatccagccattgtttgttactaccttac

SEQ ID NO: 258035 - DNA, 40 bp, Artificial Sequence
  Description of Artificial Sequence: Synthetic oligonucleotide
cagccaaatatatccagccattgtttgttactaccttacc

SEQ ID NO: 258036 - DNA, 41 bp, Artificial Sequence
  Description of Artificial Sequence: Synthetic oligonucleotide
agccaaatatatccagccattgtttgttactaccttacctg

SEQ ID NO: 258037 - DNA, 40 bp, Artificial Sequence
  Description of Artificial Sequence: Synthetic oligonucleotide
gccaaatatatccagccattgtttgttactaccttacctg

SEQ ID NO: 258038 - DNA, 42 bp, Artificial Sequence
  Description of Artificial Sequence: Synthetic oligonucleotide
ccaaatatatccagccattgtttgttactaccttacctgttg

SEQ ID NO: 258039 - DNA, 50 bp, Artificial Sequence
  Description of Artificial Sequence: Synthetic oligonucleotide
caaatatatccagccattgtttgttactaccttacctgttgataaaattc

SEQ ID NO: 258040 - DNA, 50 bp, Artificial Sequence
  Description of Artificial Sequence: Synthetic oligonucleotide
aaatatatccagccattgtttgttactaccttacctgttgataaaattcc

SEQ ID NO: 258041 - DNA, 49 bp, Artificial Sequence
  Description of Artificial Sequence: Synthetic oligonucleotide
aatatatccagccattgtttgttactaccttacctgttgataaaattcc

SEQ ID NO: 258042 - DNA, 48 bp, Artificial Sequence
  Description of Artificial Sequence: Synthetic oligonucleotide
atatatccagccattgtttgttactaccttacctgttgataaaattcc

SEQ ID NO: 258043 - DNA, 47 bp, Artificial Sequence
  Description of Artificial Sequence: Synthetic oligonucleotide
tatatccagccattgtttgttactaccttacctgttgataaaattcc

SEQ ID NO: 258044 - DNA, 46 bp, Artificial Sequence
  Description of Artificial Sequence: Synthetic oligonucleotide
atatccagccattgtttgttactaccttacctgttgataaaattcc

SEQ ID NO: 258045 - DNA, 45 bp, Artificial Sequence
  Description of Artificial Sequence: Synthetic oligonucleotide
tatccagccattgtttgttactaccttacctgttgataaaattcc

SEQ ID NO: 258046 - DNA, 44 bp, Artificial Sequence
  Description of Artificial Sequence: Synthetic oligonucleotide
atccagccattgtttgttactaccttacctgttgataaaattcc

SEQ ID NO: 258047 - DNA, 43 bp, Artificial Sequence
  Description of Artificial Sequence: Synthetic oligonucleotide
tccagccattgtttgttactaccttacctgttgataaaattcc

SEQ ID NO: 258048 - DNA, 42 bp, Artificial Sequence
  Description of Artificial Sequence: Synthetic oligonucleotide
ccagccattgtttgttactaccttacctgttgataaaattcc

SEQ ID NO: 258049 - DNA, 46 bp, Artificial Sequence
  Description of Artificial Sequence: Synthetic oligonucleotide
cagccattgtttgttactaccttacctgttgataaaattcctaaag

SEQ ID NO: 258050 - DNA, 46 bp, Artificial Sequence
  Description of Artificial Sequence: Synthetic oligonucleotide
agccattgtttgttactaccttacctgttgataaaattcctaaagg

SEQ ID NO: 258051 - DNA, 45 bp, Artificial Sequence
  Description of Artificial Sequence: Synthetic oligonucleotide
gccattgtttgttactaccttacctgttgataaaattcctaaagg

SEQ ID NO: 258052 - DNA, 45 bp, Artificial Sequence
  Description of Artificial Sequence: Synthetic oligonucleotide
ccattgtttgttactaccttacctgttgataaaattcctaaaggg

SEQ ID NO: 258053 - DNA, 45 bp, Artificial Sequence
  Description of Artificial Sequence: Synthetic oligonucleotide
cattgtttgttactaccttacctgttgataaaattcctaaagggc

SEQ ID NO: 258054 - DNA, 45 bp, Artificial Sequence
  Description of Artificial Sequence: Synthetic oligonucleotide
attgtttgttactaccttacctgttgataaaattcctaaagggcc

SEQ ID NO: 258055 - DNA, 44 bp, Artificial Sequence
  Description of Artificial Sequence: Synthetic oligonucleotide
ttgtttgttactaccttacctgttgataaaattcctaaagggcc

SEQ ID NO: 258056 - DNA, 43 bp, Artificial Sequence
  Description of Artificial Sequence: Synthetic oligonucleotide
tgtttgttactaccttacctgttgataaaattcctaaagggcc

SEQ ID NO: 258057 - DNA, 42 bp, Artificial Sequence
  Description of Artificial Sequence: Synthetic oligonucleotide
gtttgttactaccttacctgttgataaaattcctaaagggcc

SEQ ID NO: 258058 - DNA, 43 bp, Artificial Sequence
  Description of Artificial Sequence: Synthetic oligonucleotide
tttgttactaccttacctgttgataaaattcctaaagggccag

SEQ ID NO: 258059 - DNA, 42 bp, Artificial Sequence
  Description of Artificial Sequence: Synthetic oligonucleotide
ttgttactaccttacctgttgataaaattcctaaagggccag

SEQ ID NO: 258060 - DNA, 41 bp, Artificial Sequence
  Description of Artificial Sequence: Synthetic oligonucleotide
tgttactaccttacctgttgataaaattcctaaagggccag

SEQ ID NO: 258061 - DNA, 40 bp, Artificial Sequence
  Description of Artificial Sequence: Synthetic oligonucleotide
gttactaccttacctgttgataaaattcctaaagggccag

SEQ ID NO: 258062 - DNA, 40 bp, Artificial Sequence
  Description of Artificial Sequence: Synthetic oligonucleotide
ttactaccttacctgttgataaaattcctaaagggccagg

SEQ ID NO: 258063 - DNA, 39 bp, Artificial Sequence
  Description of Artificial Sequence: Synthetic oligonucleotide
tactaccttacctgttgataaaattcctaaagggccagg

SEQ ID NO: 258064 - DNA, 38 bp, Artificial Sequence
  Description of Artificial Sequence: Synthetic oligonucleotide
actaccttacctgttgataaaattcctaaagggccagg

SEQ ID NO: 258065 - DNA, 37 bp, Artificial Sequence
  Description of Artificial Sequence: Synthetic oligonucleotide
ctaccttacctgttgataaaattcctaaagggccagg

SEQ ID NO: 258066 - DNA, 38 bp, Artificial Sequence
  Description of Artificial Sequence: Synthetic oligonucleotide
taccttacctgttgataaaattcctaaagggccaggac

SEQ ID NO: 258067 - DNA, 37 bp, Artificial Sequence
  Description of Artificial Sequence: Synthetic oligonucleotide
accttacctgttgataaaattcctaaagggccaggac

SEQ ID NO: 258068 - DNA, 36 bp, Artificial Sequence
  Description of Artificial Sequence: Synthetic oligonucleotide
ccttacctgttgataaaattcctaaagggccaggac

SEQ ID NO: 258069 - DNA, 36 bp, Artificial Sequence
  Description of Artificial Sequence: Synthetic oligonucleotide
cttacctgttgataaaattcctaaagggccaggacc

SEQ ID NO: 258070 - DNA, 37 bp, Artificial Sequence
  Description of Artificial Sequence: Synthetic oligonucleotide
ttacctgttgataaaattcctaaagggccaggacctg

SEQ ID NO: 258071 - DNA, 36 bp, Artificial Sequence
  Description of Artificial Sequence: Synthetic oligonucleotide
tacctgttgataaaattcctaaagggccaggacctg

SEQ ID NO: 258072 - DNA, 35 bp, Artificial Sequence
  Description of Artificial Sequence: Synthetic oligonucleotide
acctgttgataaaattcctaaagggccaggacctg

SEQ ID NO: 258073 - DNA, 34 bp, Artificial Sequence
  Description of Artificial Sequence: Synthetic oligonucleotide
cctgttgataaaattcctaaagggccaggacctg

SEQ ID NO: 258074 - DNA, 34 bp, Artificial Sequence
  Description of Artificial Sequence: Synthetic oligonucleotide
ctgttgataaaattcctaaagggccaggacctgc

SEQ ID NO: 258075 - DNA, 36 bp, Artificial Sequence
  Description of Artificial Sequence: Synthetic oligonucleotide
tgttgataaaattcctaaagggccaggacctgcatg

SEQ ID NO: 258076 - DNA, 35 bp, Artificial Sequence
  Description of Artificial Sequence: Synthetic oligonucleotide
gttgataaaattcctaaagggccaggacctgcatg

SEQ ID NO: 258077 - DNA, 35 bp, Artificial Sequence
  Description of Artificial Sequence: Synthetic oligonucleotide
ttgataaaattcctaaagggccaggacctgcatgc

SEQ ID NO: 258078 - DNA, 34 bp, Artificial Sequence
  Description of Artificial Sequence: Synthetic oligonucleotide
tgataaaattcctaaagggccaggacctgcatgc

SEQ ID NO: 258079 - DNA, 33 bp, Artificial Sequence
  Description of Artificial Sequence: Synthetic oligonucleotide
gataaaattcctaaagggccaggacctgcatgc

SEQ ID NO: 258080 - DNA, 36 bp, Artificial Sequence
  Description of Artificial Sequence: Synthetic oligonucleotide
ataaaattcctaaagggccaggacctgcatgctatc

SEQ ID NO: 258081 - DNA, 35 bp, Artificial Sequence
  Description of Artificial Sequence: Synthetic oligonucleotide
taaaattcctaaagggccaggacctgcatgctatc

SEQ ID NO: 258082 - DNA, 34 bp, Artificial Sequence
  Description of Artificial Sequence: Synthetic oligonucleotide
aaaattcctaaagggccaggacctgcatgctatc

SEQ ID NO: 258083 - DNA, 33 bp, Artificial Sequence
  Description of Artificial Sequence: Synthetic oligonucleotide
aaattcctaaagggccaggacctgcatgctatc

SEQ ID NO: 258084 - DNA, 32 bp, Artificial Sequence
  Description of Artificial Sequence: Synthetic oligonucleotide
aattcctaaagggccaggacctgcatgctatc

SEQ ID NO: 258085 - DNA, 31 bp, Artificial Sequence
  Description of Artificial Sequence: Synthetic oligonucleotide
attcctaaagggccaggacctgcatgctatc

SEQ ID NO: 258086 - DNA, 30 bp, Artificial Sequence
  Description of Artificial Sequence: Synthetic oligonucleotide
ttcctaaagggccaggacctgcatgctatc

SEQ ID NO: 258087 - DNA, 29 bp, Artificial Sequence
  Description of Artificial Sequence: Synthetic oligonucleotide
tcctaaagggccaggacctgcatgctatc

SEQ ID NO: 258088 - DNA, 28 bp, Artificial Sequence
  Description of Artificial Sequence: Synthetic oligonucleotide
cctaaagggccaggacctgcatgctatc

SEQ ID NO: 258089 - DNA, 30 bp, Artificial Sequence
  Description of Artificial Sequence: Synthetic oligonucleotide
ctaaagggccaggacctgcatgctatctag

SEQ ID NO: 258090 - DNA, 30 bp, Artificial Sequence
  Description of Artificial Sequence: Synthetic oligonucleotide
taaagggccaggacctgcatgctatctagc

SEQ ID NO: 258091 - DNA, 29 bp, Artificial Sequence
  Description of Artificial Sequence: Synthetic oligonucleotide
aaagggccaggacctgcatgctatctagc

SEQ ID NO: 258092 - DNA, 28 bp, Artificial Sequence
  Description of Artificial Sequence: Synthetic oligonucleotide
aagggccaggacctgcatgctatctagc

SEQ ID NO: 258093 - DNA, 27 bp, Artificial Sequence
  Description of Artificial Sequence: Synthetic oligonucleotide
agggccaggacctgcatgctatctagc

SEQ ID NO: 258094 - DNA, 27 bp, Artificial Sequence
  Description of Artificial Sequence: Synthetic oligonucleotide
gggccaggacctgcatgctatctagca

SEQ ID NO: 258095 - DNA, 27 bp, Artificial Sequence
  Description of Artificial Sequence: Synthetic oligonucleotide
ggccaggacctgcatgctatctagcag

SEQ ID NO: 258096 - DNA, 27 bp, Artificial Sequence
  Description of Artificial Sequence: Synthetic oligonucleotide
gccaggacctgcatgctatctagcagg

SEQ ID NO: 258097 - DNA, 29 bp, Artificial Sequence
  Description of Artificial Sequence: Synthetic oligonucleotide
ccaggacctgcatgctatctagcaggatc

SEQ ID NO: 258098 - DNA, 29 bp, Artificial Sequence
  Description of Artificial Sequence: Synthetic oligonucleotide
caggacctgcatgctatctagcaggatcc

SEQ ID NO: 258099 - DNA, 33 bp, Artificial Sequence
  Description of Artificial Sequence: Synthetic oligonucleotide
aggacctgcatgctatctagcaggatccataac

SEQ ID NO: 258100 - DNA, 32 bp, Artificial Sequence
  Description of Artificial Sequence: Synthetic oligonucleotide
ggacctgcatgctatctagcaggatccataac

SEQ ID NO: 258101 - DNA, 35 bp, Artificial Sequence
  Description of Artificial Sequence: Synthetic oligonucleotide
gacctgcatgctatctagcaggatccataacattg

SEQ ID NO: 258102 - DNA, 36 bp, Artificial Sequence
  Description of Artificial Sequence: Synthetic oligonucleotide
acctgcatgctatctagcaggatccataacattgtg

SEQ ID NO: 258103 - DNA, 35 bp, Artificial Sequence
  Description of Artificial Sequence: Synthetic oligonucleotide
cctgcatgctatctagcaggatccataacattgtg

SEQ ID NO: 258104 - DNA, 38 bp, Artificial Sequence
  Description of Artificial Sequence: Synthetic oligonucleotide
ctgcatgctatctagcaggatccataacattgtgaaag

SEQ ID NO: 258105 - DNA, 39 bp, Artificial Sequence
  Description of Artificial Sequence: Synthetic oligonucleotide
tgcatgctatctagcaggatccataacattgtgaaagac

SEQ ID NO: 258106 - DNA, 38 bp, Artificial Sequence
  Description of Artificial Sequence: Synthetic oligonucleotide
gcatgctatctagcaggatccataacattgtgaaagac

SEQ ID NO: 258107 - DNA, 39 bp, Artificial Sequence
  Description of Artificial Sequence: Synthetic oligonucleotide
catgctatctagcaggatccataacattgtgaaagactg

SEQ ID NO: 258108 - DNA, 41 bp, Artificial Sequence
  Description of Artificial Sequence: Synthetic oligonucleotide
atgctatctagcaggatccataacattgtgaaagactgatc

SEQ ID NO: 258109 - DNA, 40 bp, Artificial Sequence
  Description of Artificial Sequence: Synthetic oligonucleotide
tgctatctagcaggatccataacattgtgaaagactgatc

SEQ ID NO: 258110 - DNA, 39 bp, Artificial Sequence
  Description of Artificial Sequence: Synthetic oligonucleotide
gctatctagcaggatccataacattgtgaaagactgatc

SEQ ID NO: 258111 - DNA, 41 bp, Artificial Sequence
  Description of Artificial Sequence: Synthetic oligonucleotide
ctatctagcaggatccataacattgtgaaagactgatctag

SEQ ID NO: 258112 - DNA, 41 bp, Artificial Sequence
  Description of Artificial Sequence: Synthetic oligonucleotide
tatctagcaggatccataacattgtgaaagactgatctagg

SEQ ID NO: 258113 - DNA, 40 bp, Artificial Sequence
  Description of Artificial Sequence: Synthetic oligonucleotide
atctagcaggatccataacattgtgaaagactgatctagg

SEQ ID NO: 258114 - DNA, 39 bp, Artificial Sequence
  Description of Artificial Sequence: Synthetic oligonucleotide
tctagcaggatccataacattgtgaaagactgatctagg

SEQ ID NO: 258115 - DNA, 38 bp, Artificial Sequence
  Description of Artificial Sequence: Synthetic oligonucleotide
ctagcaggatccataacattgtgaaagactgatctagg

SEQ ID NO: 258116 - DNA, 41 bp, Artificial Sequence
  Description of Artificial Sequence: Synthetic oligonucleotide
tagcaggatccataacattgtgaaagactgatctaggaaag

SEQ ID NO: 258117 - DNA, 40 bp, Artificial Sequence
  Description of Artificial Sequence: Synthetic oligonucleotide
agcaggatccataacattgtgaaagactgatctaggaaag

SEQ ID NO: 258118 - DNA, 39 bp, Artificial Sequence
  Description of Artificial Sequence: Synthetic oligonucleotide
gcaggatccataacattgtgaaagactgatctaggaaag

SEQ ID NO: 258119 - DNA, 42 bp, Artificial Sequence
  Description of Artificial Sequence: Synthetic oligonucleotide
caggatccataacattgtgaaagactgatctaggaaagtaag

SEQ ID NO: 258120 - DNA, 42 bp, Artificial Sequence
  Description of Artificial Sequence: Synthetic oligonucleotide
aggatccataacattgtgaaagactgatctaggaaagtaagc

SEQ ID NO: 258121 - DNA, 41 bp, Artificial Sequence
  Description of Artificial Sequence: Synthetic oligonucleotide
ggatccataacattgtgaaagactgatctaggaaagtaagc

SEQ ID NO: 258122 - DNA, 42 bp, Artificial Sequence
  Description of Artificial Sequence: Synthetic oligonucleotide
gatccataacattgtgaaagactgatctaggaaagtaagctg

SEQ ID NO: 258123 - DNA, 44 bp, Artificial Sequence
  Description of Artificial Sequence: Synthetic oligonucleotide
atccataacattgtgaaagactgatctaggaaagtaagctgatg

SEQ ID NO: 258124 - DNA, 43 bp, Artificial Sequence
  Description of Artificial Sequence: Synthetic oligonucleotide
tccataacattgtgaaagactgatctaggaaagtaagctgatg

SEQ ID NO: 258125 - DNA, 42 bp, Artificial Sequence
  Description of Artificial Sequence: Synthetic oligonucleotide
ccataacattgtgaaagactgatctaggaaagtaagctgatg

SEQ ID NO: 258126 - DNA, 46 bp, Artificial Sequence
  Description of Artificial Sequence: Synthetic oligonucleotide
cataacattgtgaaagactgatctaggaaagtaagctgatgaaatc

SEQ ID NO: 258127 - DNA, 46 bp, Artificial Sequence
  Description of Artificial Sequence: Synthetic oligonucleotide
ataacattgtgaaagactgatctaggaaagtaagctgatgaaatcc

SEQ ID NO: 258128 - DNA, 45 bp, Artificial Sequence
  Description of Artificial Sequence: Synthetic oligonucleotide
taacattgtgaaagactgatctaggaaagtaagctgatgaaatcc

SEQ ID NO: 258129 - DNA, 44 bp, Artificial Sequence
  Description of Artificial Sequence: Synthetic oligonucleotide
aacattgtgaaagactgatctaggaaagtaagctgatgaaatcc

SEQ ID NO: 258130 - DNA, 43 bp, Artificial Sequence
  Description of Artificial Sequence: Synthetic oligonucleotide
acattgtgaaagactgatctaggaaagtaagctgatgaaatcc

SEQ ID NO: 258131 - DNA, 42 bp, Artificial Sequence
  Description of Artificial Sequence: Synthetic oligonucleotide
cattgtgaaagactgatctaggaaagtaagctgatgaaatcc

SEQ ID NO: 258132 - DNA, 42 bp, Artificial Sequence
  Description of Artificial Sequence: Synthetic oligonucleotide
attgtgaaagactgatctaggaaagtaagctgatgaaatccc

SEQ ID NO: 258133 - DNA, 41 bp, Artificial Sequence
  Description of Artificial Sequence: Synthetic oligonucleotide
ttgtgaaagactgatctaggaaagtaagctgatgaaatccc

SEQ ID NO: 258134 - DNA, 40 bp, Artificial Sequence
  Description of Artificial Sequence: Synthetic oligonucleotide
tgtgaaagactgatctaggaaagtaagctgatgaaatccc

SEQ ID NO: 258135 - DNA, 39 bp, Artificial Sequence
  Description of Artificial Sequence: Synthetic oligonucleotide
gtgaaagactgatctaggaaagtaagctgatgaaatccc

SEQ ID NO: 258136 - DNA, 40 bp, Artificial Sequence
  Description of Artificial Sequence: Synthetic oligonucleotide
tgaaagactgatctaggaaagtaagctgatgaaatccctg

SEQ ID NO: 258137 - DNA, 39 bp, Artificial Sequence
  Description of Artificial Sequence: Synthetic oligonucleotide
gaaagactgatctaggaaagtaagctgatgaaatccctg

SEQ ID NO: 258138 - DNA, 41 bp, Artificial Sequence
  Description of Artificial Sequence: Synthetic oligonucleotide
aaagactgatctaggaaagtaagctgatgaaatccctgtac

SEQ ID NO: 258139 - DNA, 40 bp, Artificial Sequence
  Description of Artificial Sequence: Synthetic oligonucleotide
aagactgatctaggaaagtaagctgatgaaatccctgtac

SEQ ID NO: 258140 - DNA, 39 bp, Artificial Sequence
  Description of Artificial Sequence: Synthetic oligonucleotide
agactgatctaggaaagtaagctgatgaaatccctgtac

SEQ ID NO: 258141 - DNA, 38 bp, Artificial Sequence
  Description of Artificial Sequence: Synthetic oligonucleotide
gactgatctaggaaagtaagctgatgaaatccctgtac

SEQ ID NO: 258142 - DNA, 42 bp, Artificial Sequence
  Description of Artificial Sequence: Synthetic oligonucleotide
actgatctaggaaagtaagctgatgaaatccctgtacattac

SEQ ID NO: 258143 - DNA, 41 bp, Artificial Sequence
  Description of Artificial Sequence: Synthetic oligonucleotide
ctgatctaggaaagtaagctgatgaaatccctgtacattac

SEQ ID NO: 258144 - DNA, 43 bp, Artificial Sequence
  Description of Artificial Sequence: Synthetic oligonucleotide
tgatctaggaaagtaagctgatgaaatccctgtacattactac

SEQ ID NO: 258145 - DNA, 42 bp, Artificial Sequence
  Description of Artificial Sequence: Synthetic oligonucleotide
gatctaggaaagtaagctgatgaaatccctgtacattactac

SEQ ID NO: 258146 - DNA, 48 bp, Artificial Sequence
  Description of Artificial Sequence: Synthetic oligonucleotide
atctaggaaagtaagctgatgaaatccctgtacattactacataatac

SEQ ID NO: 258147 - DNA, 47 bp, Artificial Sequence
  Description of Artificial Sequence: Synthetic oligonucleotide
tctaggaaagtaagctgatgaaatccctgtacattactacataatac

SEQ ID NO: 258148 - DNA, 46 bp, Artificial Sequence
  Description of Artificial Sequence: Synthetic oligonucleotide
ctaggaaagtaagctgatgaaatccctgtacattactacataatac

SEQ ID NO: 258149 - DNA, 46 bp, Artificial Sequence
  Description of Artificial Sequence: Synthetic oligonucleotide
taggaaagtaagctgatgaaatccctgtacattactacataatacc

SEQ ID NO: 258150 - DNA, 45 bp, Artificial Sequence
  Description of Artificial Sequence: Synthetic oligonucleotide
aggaaagtaagctgatgaaatccctgtacattactacataatacc

SEQ ID NO: 258151 - DNA, 44 bp, Artificial Sequence
  Description of Artificial Sequence: Synthetic oligonucleotide
ggaaagtaagctgatgaaatccctgtacattactacataatacc

SEQ ID NO: 258152 - DNA, 45 bp, Artificial Sequence
  Description of Artificial Sequence: Synthetic oligonucleotide
gaaagtaagctgatgaaatccctgtacattactacataatacctc

SEQ ID NO: 258153 - DNA, 45 bp, Artificial Sequence
  Description of Artificial Sequence: Synthetic oligonucleotide
aaagtaagctgatgaaatccctgtacattactacataatacctcg

SEQ ID NO: 258154 - DNA, 44 bp, Artificial Sequence
  Description of Artificial Sequence: Synthetic oligonucleotide
aagtaagctgatgaaatccctgtacattactacataatacctcg

SEQ ID NO: 258155 - DNA, 43 bp, Artificial Sequence
  Description of Artificial Sequence: Synthetic oligonucleotide
agtaagctgatgaaatccctgtacattactacataatacctcg

SEQ ID NO: 258156 - DNA, 42 bp, Artificial Sequence
  Description of Artificial Sequence: Synthetic oligonucleotide
gtaagctgatgaaatccctgtacattactacataatacctcg

SEQ ID NO: 258157 - DNA, 43 bp, Artificial Sequence
  Description of Artificial Sequence: Synthetic oligonucleotide
taagctgatgaaatccctgtacattactacataatacctcgac

SEQ ID NO: 258158 - DNA, 42 bp, Artificial Sequence
  Description of Artificial Sequence: Synthetic oligonucleotide
aagctgatgaaatccctgtacattactacataatacctcgac

SEQ ID NO: 258159 - DNA, 41 bp, Artificial Sequence
  Description of Artificial Sequence: Synthetic oligonucleotide
agctgatgaaatccctgtacattactacataatacctcgac

SEQ ID NO: 258160 - DNA, 40 bp, Artificial Sequence
  Description of Artificial Sequence: Synthetic oligonucleotide
gctgatgaaatccctgtacattactacataatacctcgac

SEQ ID NO: 258161 - DNA, 40 bp, Artificial Sequence
  Description of Artificial Sequence: Synthetic oligonucleotide
ctgatgaaatccctgtacattactacataatacctcgacc

SEQ ID NO: 258162 - DNA, 42 bp, Artificial Sequence
  Description of Artificial Sequence: Synthetic oligonucleotide
tgatgaaatccctgtacattactacataatacctcgaccaac

SEQ ID NO: 258163 - DNA, 41 bp, Artificial Sequence
  Description of Artificial Sequence: Synthetic oligonucleotide
gatgaaatccctgtacattactacataatacctcgaccaac

SEQ ID NO: 258164 - DNA, 44 bp, Artificial Sequence
  Description of Artificial Sequence: Synthetic oligonucleotide
atgaaatccctgtacattactacataatacctcgaccaacaaac

SEQ ID NO: 258165 - DNA, 43 bp, Artificial Sequence
  Description of Artificial Sequence: Synthetic oligonucleotide
tgaaatccctgtacattactacataatacctcgaccaacaaac

SEQ ID NO: 258166 - DNA, 42 bp, Artificial Sequence
  Description of Artificial Sequence: Synthetic oligonucleotide
gaaatccctgtacattactacataatacctcgaccaacaaac

SEQ ID NO: 258167 - DNA, 43 bp, Artificial Sequence
  Description of Artificial Sequence: Synthetic oligonucleotide
aaatccctgtacattactacataatacctcgaccaacaaacac

SEQ ID NO: 258168 - DNA, 42 bp, Artificial Sequence
  Description of Artificial Sequence: Synthetic oligonucleotide
aatccctgtacattactacataatacctcgaccaacaaacac

SEQ ID NO: 258169 - DNA, 41 bp, Artificial Sequence
  Description of Artificial Sequence: Synthetic oligonucleotide
atccctgtacattactacataatacctcgaccaacaaacac

SEQ ID NO: 258170 - DNA, 40 bp, Artificial Sequence
  Description of Artificial Sequence: Synthetic oligonucleotide
tccctgtacattactacataatacctcgaccaacaaacac

SEQ ID NO: 258171 - DNA, 39 bp, Artificial Sequence
  Description of Artificial Sequence: Synthetic oligonucleotide
ccctgtacattactacataatacctcgaccaacaaacac

SEQ ID NO: 258172 - DNA, 42 bp, Artificial Sequence
  Description of Artificial Sequence: Synthetic oligonucleotide
cctgtacattactacataatacctcgaccaacaaacactaag

SEQ ID NO: 258173 - DNA, 45 bp, Artificial Sequence
  Description of Artificial Sequence: Synthetic oligonucleotide
ctgtacattactacataatacctcgaccaacaaacactaagaatc

SEQ ID NO: 258174 - DNA, 45 bp, Artificial Sequence
  Description of Artificial Sequence: Synthetic oligonucleotide
tgtacattactacataatacctcgaccaacaaacactaagaatcg

SEQ ID NO: 258175 - DNA, 44 bp, Artificial Sequence
  Description of Artificial Sequence: Synthetic oligonucleotide
gtacattactacataatacctcgaccaacaaacactaagaatcg

SEQ ID NO: 258176 - DNA, 44 bp, Artificial Sequence
  Description of Artificial Sequence: Synthetic oligonucleotide
tacattactacataatacctcgaccaacaaacactaagaatcgc

SEQ ID NO: 258177 - DNA, 43 bp, Artificial Sequence
  Description of Artificial Sequence: Synthetic oligonucleotide
acattactacataatacctcgaccaacaaacactaagaatcgc

SEQ ID NO: 258178 - DNA, 42 bp, Artificial Sequence
  Description of Artificial Sequence: Synthetic oligonucleotide
cattactacataatacctcgaccaacaaacactaagaatcgc

SEQ ID NO: 258179 - DNA, 43 bp, Artificial Sequence
  Description of Artificial Sequence: Synthetic oligonucleotide
attactacataatacctcgaccaacaaacactaagaatcgcag

SEQ ID NO: 258180 - DNA, 42 bp, Artificial Sequence
  Description of Artificial Sequence: Synthetic oligonucleotide
ttactacataatacctcgaccaacaaacactaagaatcgcag

SEQ ID NO: 258181 - DNA, 41 bp, Artificial Sequence
  Description of Artificial Sequence: Synthetic oligonucleotide
tactacataatacctcgaccaacaaacactaagaatcgcag

SEQ ID NO: 258182 - DNA, 40 bp, Artificial Sequence
  Description of Artificial Sequence: Synthetic oligonucleotide
actacataatacctcgaccaacaaacactaagaatcgcag

SEQ ID NO: 258183 - DNA, 39 bp, Artificial Sequence
  Description of Artificial Sequence: Synthetic oligonucleotide
ctacataatacctcgaccaacaaacactaagaatcgcag

SEQ ID NO: 258184 - DNA, 39 bp, Artificial Sequence
  Description of Artificial Sequence: Synthetic oligonucleotide
tacataatacctcgaccaacaaacactaagaatcgcagc

SEQ ID NO: 258185 - DNA, 38 bp, Artificial Sequence
  Description of Artificial Sequence: Synthetic oligonucleotide
acataatacctcgaccaacaaacactaagaatcgcagc

SEQ ID NO: 258186 - DNA, 37 bp, Artificial Sequence
  Description of Artificial Sequence: Synthetic oligonucleotide
cataatacctcgaccaacaaacactaagaatcgcagc

SEQ ID NO: 258187 - DNA, 40 bp, Artificial Sequence
  Description of Artificial Sequence: Synthetic oligonucleotide
ataatacctcgaccaacaaacactaagaatcgcagcaaag

SEQ ID NO: 258188 - DNA, 39 bp, Artificial Sequence
  Description of Artificial Sequence: Synthetic oligonucleotide
taatacctcgaccaacaaacactaagaatcgcagcaaag

SEQ ID NO: 258189 - DNA, 38 bp, Artificial Sequence
  Description of Artificial Sequence: Synthetic oligonucleotide
aatacctcgaccaacaaacactaagaatcgcagcaaag

SEQ ID NO: 258190 - DNA, 37 bp, Artificial Sequence
  Description of Artificial Sequence: Synthetic oligonucleotide
atacctcgaccaacaaacactaagaatcgcagcaaag

SEQ ID NO: 258191 - DNA, 36 bp, Artificial Sequence
  Description of Artificial Sequence: Synthetic oligonucleotide
tacctcgaccaacaaacactaagaatcgcagcaaag

SEQ ID NO: 258192 - DNA, 35 bp, Artificial Sequence
  Description of Artificial Sequence: Synthetic oligonucleotide
acctcgaccaacaaacactaagaatcgcagcaaag

SEQ ID NO: 258193 - DNA, 34 bp, Artificial Sequence
  Description of Artificial Sequence: Synthetic oligonucleotide
cctcgaccaacaaacactaagaatcgcagcaaag

SEQ ID NO: 258194 - DNA, 38 bp, Artificial Sequence
  Description of Artificial Sequence: Synthetic oligonucleotide
ctcgaccaacaaacactaagaatcgcagcaaagttaag

SEQ ID NO: 258195 - DNA, 38 bp, Artificial Sequence
  Description of Artificial Sequence: Synthetic oligonucleotide
tcgaccaacaaacactaagaatcgcagcaaagttaagg

SEQ ID NO: 258196 - DNA, 37 bp, Artificial Sequence
  Description of Artificial Sequence: Synthetic oligonucleotide
cgaccaacaaacactaagaatcgcagcaaagttaagg

SEQ ID NO: 258197 - DNA, 42 bp, Artificial Sequence
  Description of Artificial Sequence: Synthetic oligonucleotide
gaccaacaaacactaagaatcgcagcaaagttaaggaaaatg

SEQ ID NO: 258198 - DNA, 45 bp, Artificial Sequence
  Description of Artificial Sequence: Synthetic oligonucleotide
accaacaaacactaagaatcgcagcaaagttaaggaaaatgattc

SEQ ID NO: 258199 - DNA, 44 bp, Artificial Sequence
  Description of Artificial Sequence: Synthetic oligonucleotide
ccaacaaacactaagaatcgcagcaaagttaaggaaaatgattc

SEQ ID NO: 258200 - DNA, 45 bp, Artificial Sequence
  Description of Artificial Sequence: Synthetic oligonucleotide
caacaaacactaagaatcgcagcaaagttaaggaaaatgattcag

SEQ ID NO: 258201 - DNA, 50 bp, Artificial Sequence
  Description of Artificial Sequence: Synthetic oligonucleotide
aacaaacactaagaatcgcagcaaagttaaggaaaatgattcagaataag

SEQ ID NO: 258202 - DNA, 49 bp, Artificial Sequence
  Description of Artificial Sequence: Synthetic oligonucleotide
acaaacactaagaatcgcagcaaagttaaggaaaatgattcagaataag

SEQ ID NO: 258203 - DNA, 48 bp, Artificial Sequence
  Description of Artificial Sequence: Synthetic oligonucleotide
caaacactaagaatcgcagcaaagttaaggaaaatgattcagaataag

SEQ ID NO: 258204 - DNA, 49 bp, Artificial Sequence
  Description of Artificial Sequence: Synthetic oligonucleotide
aaacactaagaatcgcagcaaagttaaggaaaatgattcagaataagag

SEQ ID NO: 258205 - DNA, 48 bp, Artificial Sequence
  Description of Artificial Sequence: Synthetic oligonucleotide
aacactaagaatcgcagcaaagttaaggaaaatgattcagaataagag

SEQ ID NO: 258206 - DNA, 47 bp, Artificial Sequence
  Description of Artificial Sequence: Synthetic oligonucleotide
acactaagaatcgcagcaaagttaaggaaaatgattcagaataagag

SEQ ID NO: 258207 - DNA, 46 bp, Artificial Sequence
  Description of Artificial Sequence: Synthetic oligonucleotide
cactaagaatcgcagcaaagttaaggaaaatgattcagaataagag

SEQ ID NO: 258208 - DNA, 49 bp, Artificial Sequence
  Description of Artificial Sequence: Synthetic oligonucleotide
actaagaatcgcagcaaagttaaggaaaatgattcagaataagagaaag

SEQ ID NO: 258209 - DNA, 48 bp, Artificial Sequence
  Description of Artificial Sequence: Synthetic oligonucleotide
ctaagaatcgcagcaaagttaaggaaaatgattcagaataagagaaag

SEQ ID NO: 258210 - DNA, 56 bp, Artificial Sequence
  Description of Artificial Sequence: Synthetic oligonucleotide
taagaatcgcagcaaagttaaggaaaatgattcagaataagagaaagttttaaaag

SEQ ID NO: 258211 - DNA, 55 bp, Artificial Sequence
  Description of Artificial Sequence: Synthetic oligonucleotide
aagaatcgcagcaaagttaaggaaaatgattcagaataagagaaagttttaaaag

SEQ ID NO: 258212 - DNA, 54 bp, Artificial Sequence
  Description of Artificial Sequence: Synthetic oligonucleotide
agaatcgcagcaaagttaaggaaaatgattcagaataagagaaagttttaaaag

SEQ ID NO: 258213 - DNA, 53 bp, Artificial Sequence
  Description of Artificial Sequence: Synthetic oligonucleotide
gaatcgcagcaaagttaaggaaaatgattcagaataagagaaagttttaaaag

SEQ ID NO: 258214 - DNA, 55 bp, Artificial Sequence
  Description of Artificial Sequence: Synthetic oligonucleotide
aatcgcagcaaagttaaggaaaatgattcagaataagagaaagttttaaaagatg

SEQ ID NO: 258215 - DNA, 54 bp, Artificial Sequence
  Description of Artificial Sequence: Synthetic oligonucleotide
atcgcagcaaagttaaggaaaatgattcagaataagagaaagttttaaaagatg

SEQ ID NO: 258216 - DNA, 53 bp, Artificial Sequence
  Description of Artificial Sequence: Synthetic oligonucleotide
tcgcagcaaagttaaggaaaatgattcagaataagagaaagttttaaaagatg

SEQ ID NO: 258217 - DNA, 52 bp, Artificial Sequence
  Description of Artificial Sequence: Synthetic oligonucleotide
cgcagcaaagttaaggaaaatgattcagaataagagaaagttttaaaagatg

SEQ ID NO: 258218 - DNA, 53 bp, Artificial Sequence
  Description of Artificial Sequence: Synthetic oligonucleotide
gcagcaaagttaaggaaaatgattcagaataagagaaagttttaaaagatgag

SEQ ID NO: 258219 - DNA, 57 bp, Artificial Sequence
  Description of Artificial Sequence: Synthetic oligonucleotide
cagcaaagttaaggaaaatgattcagaataagagaaagttttaaaagatgagtttac

SEQ ID NO: 258220 - DNA, 58 bp, Artificial Sequence
  Description of Artificial Sequence: Synthetic oligonucleotide
agcaaagttaaggaaaatgattcagaataagagaaagttttaaaagatgagtttactc

SEQ ID NO: 258221 - DNA, 57 bp, Artificial Sequence
  Description of Artificial Sequence: Synthetic oligonucleotide
gcaaagttaaggaaaatgattcagaataagagaaagttttaaaagatgagtttactc

SEQ ID NO: 258222 - DNA, 59 bp, Artificial Sequence
  Description of Artificial Sequence: Synthetic oligonucleotide
caaagttaaggaaaatgattcagaataagagaaagttttaaaagatgagtttactcaag

SEQ ID NO: 258223 - DNA, 59 bp, Artificial Sequence
  Description of Artificial Sequence: Synthetic oligonucleotide
aaagttaaggaaaatgattcagaataagagaaagttttaaaagatgagtttactcaagc

SEQ ID NO: 258224 - DNA, 58 bp, Artificial Sequence
  Description of Artificial Sequence: Synthetic oligonucleotide
aagttaaggaaaatgattcagaataagagaaagttttaaaagatgagtttactcaagc

SEQ ID NO: 258225 - DNA, 57 bp, Artificial Sequence
  Description of Artificial Sequence: Synthetic oligonucleotide
agttaaggaaaatgattcagaataagagaaagttttaaaagatgagtttactcaagc

SEQ ID NO: 258226 - DNA, 56 bp, Artificial Sequence
  Description of Artificial Sequence: Synthetic oligonucleotide
gttaaggaaaatgattcagaataagagaaagttttaaaagatgagtttactcaagc

SEQ ID NO: 258227 - DNA, 60 bp, Artificial Sequence
  Description of Artificial Sequence: Synthetic oligonucleotide
ttaaggaaaatgattcagaataagagaaagttttaaaagatgagtttactcaagcattac

SEQ ID NO: 258228 - DNA, 59 bp, Artificial Sequence
  Description of Artificial Sequence: Synthetic oligonucleotide
taaggaaaatgattcagaataagagaaagttttaaaagatgagtttactcaagcattac

SEQ ID NO: 258229 - DNA, 58 bp, Artificial Sequence
  Description of Artificial Sequence: Synthetic oligonucleotide
aaggaaaatgattcagaataagagaaagttttaaaagatgagtttactcaagcattac

SEQ ID NO: 258230 - DNA, 57 bp, Artificial Sequence
  Description of Artificial Sequence: Synthetic oligonucleotide
aggaaaatgattcagaataagagaaagttttaaaagatgagtttactcaagcattac

SEQ ID NO: 258231 - DNA, 56 bp, Artificial Sequence
  Description of Artificial Sequence: Synthetic oligonucleotide
ggaaaatgattcagaataagagaaagttttaaaagatgagtttactcaagcattac

SEQ ID NO: 258232 - DNA, 56 bp, Artificial Sequence
  Description of Artificial Sequence: Synthetic oligonucleotide
gaaaatgattcagaataagagaaagttttaaaagatgagtttactcaagcattacc

SEQ ID NO: 258233 - DNA, 57 bp, Artificial Sequence
  Description of Artificial Sequence: Synthetic oligonucleotide
aaaatgattcagaataagagaaagttttaaaagatgagtttactcaagcattaccag

SEQ ID NO: 258234 - DNA, 56 bp, Artificial Sequence
  Description of Artificial Sequence: Synthetic oligonucleotide
aaatgattcagaataagagaaagttttaaaagatgagtttactcaagcattaccag

SEQ ID NO: 258235 - DNA, 55 bp, Artificial Sequence
  Description of Artificial Sequence: Synthetic oligonucleotide
aatgattcagaataagagaaagttttaaaagatgagtttactcaagcattaccag

SEQ ID NO: 258236 - DNA, 54 bp, Artificial Sequence
  Description of Artificial Sequence: Synthetic oligonucleotide
atgattcagaataagagaaagttttaaaagatgagtttactcaagcattaccag

SEQ ID NO: 258237 - DNA, 53 bp, Artificial Sequence
  Description of Artificial Sequence: Synthetic oligonucleotide
tgattcagaataagagaaagttttaaaagatgagtttactcaagcattaccag

SEQ ID NO: 258238 - DNA, 52 bp, Artificial Sequence
  Description of Artificial Sequence: Synthetic oligonucleotide
gattcagaataagagaaagttttaaaagatgagtttactcaagcattaccag

SEQ ID NO: 258239 - DNA, 54 bp, Artificial Sequence
  Description of Artificial Sequence: Synthetic oligonucleotide
attcagaataagagaaagttttaaaagatgagtttactcaagcattaccagatc

SEQ ID NO: 258240 - DNA, 53 bp, Artificial Sequence
  Description of Artificial Sequence: Synthetic oligonucleotide
ttcagaataagagaaagttttaaaagatgagtttactcaagcattaccagatc

SEQ ID NO: 258241 - DNA, 52 bp, Artificial Sequence
  Description of Artificial Sequence: Synthetic oligonucleotide
tcagaataagagaaagttttaaaagatgagtttactcaagcattaccagatc

SEQ ID NO: 258242 - DNA, 51 bp, Artificial Sequence
  Description of Artificial Sequence: Synthetic oligonucleotide
cagaataagagaaagttttaaaagatgagtttactcaagcattaccagatc

SEQ ID NO: 258243 - DNA, 59 bp, Artificial Sequence
  Description of Artificial Sequence: Synthetic oligonucleotide
agaataagagaaagttttaaaagatgagtttactcaagcattaccagatcttaatattc

SEQ ID NO: 258244 - DNA, 58 bp, Artificial Sequence
  Description of Artificial Sequence: Synthetic oligonucleotide
gaataagagaaagttttaaaagatgagtttactcaagcattaccagatcttaatattc

SEQ ID NO: 258245 - DNA, 59 bp, Artificial Sequence
  Description of Artificial Sequence: Synthetic oligonucleotide
aataagagaaagttttaaaagatgagtttactcaagcattaccagatcttaatattcag

SEQ ID NO: 258246 - DNA, 58 bp, Artificial Sequence
  Description of Artificial Sequence: Synthetic oligonucleotide
ataagagaaagttttaaaagatgagtttactcaagcattaccagatcttaatattcag

SEQ ID NO: 258247 - DNA, 57 bp, Artificial Sequence
  Description of Artificial Sequence: Synthetic oligonucleotide
taagagaaagttttaaaagatgagtttactcaagcattaccagatcttaatattcag

SEQ ID NO: 258248 - DNA, 56 bp, Artificial Sequence
  Description of Artificial Sequence: Synthetic oligonucleotide
aagagaaagttttaaaagatgagtttactcaagcattaccagatcttaatattcag

SEQ ID NO: 258249 - DNA, 55 bp, Artificial Sequence
  Description of Artificial Sequence: Synthetic oligonucleotide
agagaaagttttaaaagatgagtttactcaagcattaccagatcttaatattcag

SEQ ID NO: 258250 - DNA, 54 bp, Artificial Sequence
  Description of Artificial Sequence: Synthetic oligonucleotide
gagaaagttttaaaagatgagtttactcaagcattaccagatcttaatattcag

SEQ ID NO: 258251 - DNA, 55 bp, Artificial Sequence
  Description of Artificial Sequence: Synthetic oligonucleotide
agaaagttttaaaagatgagtttactcaagcattaccagatcttaatattcagtg

SEQ ID NO: 258252 - DNA, 54 bp, Artificial Sequence
  Description of Artificial Sequence: Synthetic oligonucleotide
gaaagttttaaaagatgagtttactcaagcattaccagatcttaatattcagtg

SEQ ID NO: 258253 - DNA, 54 bp, Artificial Sequence
  Description of Artificial Sequence: Synthetic oligonucleotide
aaagttttaaaagatgagtttactcaagcattaccagatcttaatattcagtgg

SEQ ID NO: 258254 - DNA, 53 bp, Artificial Sequence
  Description of Artificial Sequence: Synthetic oligonucleotide
aagttttaaaagatgagtttactcaagcattaccagatcttaatattcagtgg

SEQ ID NO: 258255 - DNA, 52 bp, Artificial Sequence
  Description of Artificial Sequence: Synthetic oligonucleotide
agttttaaaagatgagtttactcaagcattaccagatcttaatattcagtgg

SEQ ID NO: 258256 - DNA, 51 bp, Artificial Sequence
  Description of Artificial Sequence: Synthetic oligonucleotide
gttttaaaagatgagtttactcaagcattaccagatcttaatattcagtgg

SEQ ID NO: 258257 - DNA, 53 bp, Artificial Sequence
  Description of Artificial Sequence: Synthetic oligonucleotide
ttttaaaagatgagtttactcaagcattaccagatcttaatattcagtggttg

SEQ ID NO: 258258 - DNA, 52 bp, Artificial Sequence
  Description of Artificial Sequence: Synthetic oligonucleotide
tttaaaagatgagtttactcaagcattaccagatcttaatattcagtggttg

SEQ ID NO: 258259 - DNA, 51 bp, Artificial Sequence
  Description of Artificial Sequence: Synthetic oligonucleotide
ttaaaagatgagtttactcaagcattaccagatcttaatattcagtggttg

SEQ ID NO: 258260 - DNA, 50 bp, Artificial Sequence
  Description of Artificial Sequence: Synthetic oligonucleotide
taaaagatgagtttactcaagcattaccagatcttaatattcagtggttg

SEQ ID NO: 258261 - DNA, 49 bp, Artificial Sequence
  Description of Artificial Sequence: Synthetic oligonucleotide
aaaagatgagtttactcaagcattaccagatcttaatattcagtggttg

SEQ ID NO: 258262 - DNA, 48 bp, Artificial Sequence
  Description of Artificial Sequence: Synthetic oligonucleotide
aaagatgagtttactcaagcattaccagatcttaatattcagtggttg

SEQ ID NO: 258263 - DNA, 47 bp, Artificial Sequence
  Description of Artificial Sequence: Synthetic oligonucleotide
aagatgagtttactcaagcattaccagatcttaatattcagtggttg

SEQ ID NO: 258264 - DNA, 46 bp, Artificial Sequence
  Description of Artificial Sequence: Synthetic oligonucleotide
agatgagtttactcaagcattaccagatcttaatattcagtggttg

SEQ ID NO: 258265 - DNA, 45 bp, Artificial Sequence
  Description of Artificial Sequence: Synthetic oligonucleotide
gatgagtttactcaagcattaccagatcttaatattcagtggttg

SEQ ID NO: 258266 - DNA, 46 bp, Artificial Sequence
  Description of Artificial Sequence: Synthetic oligonucleotide
atgagtttactcaagcattaccagatcttaatattcagtggttgac

SEQ ID NO: 258267 - DNA, 45 bp, Artificial Sequence
  Description of Artificial Sequence: Synthetic oligonucleotide
tgagtttactcaagcattaccagatcttaatattcagtggttgac

SEQ ID NO: 258268 - DNA, 44 bp, Artificial Sequence
  Description of Artificial Sequence: Synthetic oligonucleotide
gagtttactcaagcattaccagatcttaatattcagtggttgac

SEQ ID NO: 258269 - DNA, 47 bp, Artificial Sequence
  Description of Artificial Sequence: Synthetic oligonucleotide
agtttactcaagcattaccagatcttaatattcagtggttgacaaag

SEQ ID NO: 258270 - DNA, 46 bp, Artificial Sequence
  Description of Artificial Sequence: Synthetic oligonucleotide
gtttactcaagcattaccagatcttaatattcagtggttgacaaag

SEQ ID NO: 258271 - DNA, 46 bp, Artificial Sequence
  Description of Artificial Sequence: Synthetic oligonucleotide
tttactcaagcattaccagatcttaatattcagtggttgacaaagc

SEQ ID NO: 258272 - DNA, 45 bp, Artificial Sequence
  Description of Artificial Sequence: Synthetic oligonucleotide
ttactcaagcattaccagatcttaatattcagtggttgacaaagc

SEQ ID NO: 258273 - DNA, 44 bp, Artificial Sequence
  Description of Artificial Sequence: Synthetic oligonucleotide
tactcaagcattaccagatcttaatattcagtggttgacaaagc

SEQ ID NO: 258274 - DNA, 43 bp, Artificial Sequence
  Description of Artificial Sequence: Synthetic oligonucleotide
actcaagcattaccagatcttaatattcagtggttgacaaagc

SEQ ID NO: 258275 - DNA, 42 bp, Artificial Sequence
  Description of Artificial Sequence: Synthetic oligonucleotide
ctcaagcattaccagatcttaatattcagtggttgacaaagc

SEQ ID NO: 258276 - DNA, 43 bp, Artificial Sequence
  Description of Artificial Sequence: Synthetic oligonucleotide
tcaagcattaccagatcttaatattcagtggttgacaaagcag

SEQ ID NO: 258277 - DNA, 42 bp, Artificial Sequence
  Description of Artificial Sequence: Synthetic oligonucleotide
caagcattaccagatcttaatattcagtggttgacaaagcag

SEQ ID NO: 258278 - DNA, 42 bp, Artificial Sequence
  Description of Artificial Sequence: Synthetic oligonucleotide
aagcattaccagatcttaatattcagtggttgacaaagcagg

SEQ ID NO: 258279 - DNA, 41 bp, Artificial Sequence
  Description of Artificial Sequence: Synthetic oligonucleotide
agcattaccagatcttaatattcagtggttgacaaagcagg

SEQ ID NO: 258280 - DNA, 40 bp, Artificial Sequence
  Description of Artificial Sequence: Synthetic oligonucleotide
gcattaccagatcttaatattcagtggttgacaaagcagg

SEQ ID NO: 258281 - DNA, 43 bp, Artificial Sequence
  Description of Artificial Sequence: Synthetic oligonucleotide
cattaccagatcttaatattcagtggttgacaaagcaggattc

SEQ ID NO: 258282 - DNA, 45 bp, Artificial Sequence
  Description of Artificial Sequence: Synthetic oligonucleotide
attaccagatcttaatattcagtggttgacaaagcaggattctag

SEQ ID NO: 258283 - DNA, 44 bp, Artificial Sequence
  Description of Artificial Sequence: Synthetic oligonucleotide
ttaccagatcttaatattcagtggttgacaaagcaggattctag

SEQ ID NO: 258284 - DNA, 43 bp, Artificial Sequence
  Description of Artificial Sequence: Synthetic oligonucleotide
taccagatcttaatattcagtggttgacaaagcaggattctag

SEQ ID NO: 258285 - DNA, 42 bp, Artificial Sequence
  Description of Artificial Sequence: Synthetic oligonucleotide
accagatcttaatattcagtggttgacaaagcaggattctag

SEQ ID NO: 258286 - DNA, 41 bp, Artificial Sequence
  Description of Artificial Sequence: Synthetic oligonucleotide
ccagatcttaatattcagtggttgacaaagcaggattctag

SEQ ID NO: 258287 - DNA, 42 bp, Artificial Sequence
  Description of Artificial Sequence: Synthetic oligonucleotide
cagatcttaatattcagtggttgacaaagcaggattctagag

SEQ ID NO: 258288 - DNA, 43 bp, Artificial Sequence
  Description of Artificial Sequence: Synthetic oligonucleotide
agatcttaatattcagtggttgacaaagcaggattctagagac

SEQ ID NO: 258289 - DNA, 42 bp, Artificial Sequence
  Description of Artificial Sequence: Synthetic oligonucleotide
gatcttaatattcagtggttgacaaagcaggattctagagac

SEQ ID NO: 258290 - DNA, 50 bp, Artificial Sequence
  Description of Artificial Sequence: Synthetic oligonucleotide
atcttaatattcagtggttgacaaagcaggattctagagacatttattac

SEQ ID NO: 258291 - DNA, 49 bp, Artificial Sequence
  Description of Artificial Sequence: Synthetic oligonucleotide
tcttaatattcagtggttgacaaagcaggattctagagacatttattac

SEQ ID NO: 258292 - DNA, 48 bp, Artificial Sequence
  Description of Artificial Sequence: Synthetic oligonucleotide
cttaatattcagtggttgacaaagcaggattctagagacatttattac

SEQ ID NO: 258293 - DNA, 48 bp, Artificial Sequence
  Description of Artificial Sequence: Synthetic oligonucleotide
ttaatattcagtggttgacaaagcaggattctagagacatttattacg

SEQ ID NO: 258294 - DNA, 47 bp, Artificial Sequence
  Description of Artificial Sequence: Synthetic oligonucleotide
taatattcagtggttgacaaagcaggattctagagacatttattacg

SEQ ID NO: 258295 - DNA, 46 bp, Artificial Sequence
  Description of Artificial Sequence: Synthetic oligonucleotide
aatattcagtggttgacaaagcaggattctagagacatttattacg

SEQ ID NO: 258296 - DNA, 45 bp, Artificial Sequence
  Description of Artificial Sequence: Synthetic oligonucleotide
atattcagtggttgacaaagcaggattctagagacatttattacg

SEQ ID NO: 258297 - DNA, 44 bp, Artificial Sequence
  Description of Artificial Sequence: Synthetic oligonucleotide
tattcagtggttgacaaagcaggattctagagacatttattacg

SEQ ID NO: 258298 - DNA, 43 bp, Artificial Sequence
  Description of Artificial Sequence: Synthetic oligonucleotide
attcagtggttgacaaagcaggattctagagacatttattacg

SEQ ID NO: 258299 - DNA, 42 bp, Artificial Sequence
  Description of Artificial Sequence: Synthetic oligonucleotide
ttcagtggttgacaaagcaggattctagagacatttattacg

SEQ ID NO: 258300 - DNA, 41 bp, Artificial Sequence
  Description of Artificial Sequence: Synthetic oligonucleotide
tcagtggttgacaaagcaggattctagagacatttattacg

SEQ ID NO: 258301 - DNA, 40 bp, Artificial Sequence
  Description of Artificial Sequence: Synthetic oligonucleotide
cagtggttgacaaagcaggattctagagacatttattacg

SEQ ID NO: 258302 - DNA, 44 bp, Artificial Sequence
  Description of Artificial Sequence: Synthetic oligonucleotide
agtggttgacaaagcaggattctagagacatttattacgaattg

SEQ ID NO: 258303 - DNA, 43 bp, Artificial Sequence
  Description of Artificial Sequence: Synthetic oligonucleotide
gtggttgacaaagcaggattctagagacatttattacgaattg

SEQ ID NO: 258304 - DNA, 46 bp, Artificial Sequence
  Description of Artificial Sequence: Synthetic oligonucleotide
tggttgacaaagcaggattctagagacatttattacgaattgatag

SEQ ID NO: 258305 - DNA, 45 bp, Artificial Sequence
  Description of Artificial Sequence: Synthetic oligonucleotide
ggttgacaaagcaggattctagagacatttattacgaattgatag

SEQ ID NO: 258306 - DNA, 48 bp, Artificial Sequence
  Description of Artificial Sequence: Synthetic oligonucleotide
gttgacaaagcaggattctagagacatttattacgaattgatagaaac

SEQ ID NO: 258307 - DNA, 52 bp, Artificial Sequence
  Description of Artificial Sequence: Synthetic oligonucleotide
ttgacaaagcaggattctagagacatttattacgaattgatagaaacataac

SEQ ID NO: 258308 - DNA, 51 bp, Artificial Sequence
  Description of Artificial Sequence: Synthetic oligonucleotide
tgacaaagcaggattctagagacatttattacgaattgatagaaacataac

SEQ ID NO: 258309 - DNA, 50 bp, Artificial Sequence
  Description of Artificial Sequence: Synthetic oligonucleotide
gacaaagcaggattctagagacatttattacgaattgatagaaacataac

SEQ ID NO: 258310 - DNA, 50 bp, Artificial Sequence
  Description of Artificial Sequence: Synthetic oligonucleotide
acaaagcaggattctagagacatttattacgaattgatagaaacataacc

SEQ ID NO: 258311 - DNA, 49 bp, Artificial Sequence
  Description of Artificial Sequence: Synthetic oligonucleotide
caaagcaggattctagagacatttattacgaattgatagaaacataacc

SEQ ID NO: 258312 - DNA, 56 bp, Artificial Sequence
  Description of Artificial Sequence: Synthetic oligonucleotide
aaagcaggattctagagacatttattacgaattgatagaaacataacctaattatg

SEQ ID NO: 258313 - DNA, 55 bp, Artificial Sequence
  Description of Artificial Sequence: Synthetic oligonucleotide
aagcaggattctagagacatttattacgaattgatagaaacataacctaattatg

SEQ ID NO: 258314 - DNA, 54 bp, Artificial Sequence
  Description of Artificial Sequence: Synthetic oligonucleotide
agcaggattctagagacatttattacgaattgatagaaacataacctaattatg

SEQ ID NO: 258315 - DNA, 53 bp, Artificial Sequence
  Description of Artificial Sequence: Synthetic oligonucleotide
gcaggattctagagacatttattacgaattgatagaaacataacctaattatg

SEQ ID NO: 258316 - DNA, 55 bp, Artificial Sequence
  Description of Artificial Sequence: Synthetic oligonucleotide
caggattctagagacatttattacgaattgatagaaacataacctaattatgttc

SEQ ID NO: 258317 - DNA, 55 bp, Artificial Sequence
  Description of Artificial Sequence: Synthetic oligonucleotide
aggattctagagacatttattacgaattgatagaaacataacctaattatgttcc

SEQ ID NO: 258318 - DNA, 54 bp, Artificial Sequence
  Description of Artificial Sequence: Synthetic oligonucleotide
ggattctagagacatttattacgaattgatagaaacataacctaattatgttcc

SEQ ID NO: 258319 - DNA, 55 bp, Artificial Sequence
  Description of Artificial Sequence: Synthetic oligonucleotide
gattctagagacatttattacgaattgatagaaacataacctaattatgttcctc

SEQ ID NO: 258320 - DNA, 56 bp, Artificial Sequence
  Description of Artificial Sequence: Synthetic oligonucleotide
attctagagacatttattacgaattgatagaaacataacctaattatgttcctctg

SEQ ID NO: 258321 - DNA, 55 bp, Artificial Sequence
  Description of Artificial Sequence: Synthetic oligonucleotide
ttctagagacatttattacgaattgatagaaacataacctaattatgttcctctg

SEQ ID NO: 258322 - DNA, 54 bp, Artificial Sequence
  Description of Artificial Sequence: Synthetic oligonucleotide
tctagagacatttattacgaattgatagaaacataacctaattatgttcctctg

SEQ ID NO: 258323 - DNA, 53 bp, Artificial Sequence
  Description of Artificial Sequence: Synthetic oligonucleotide
ctagagacatttattacgaattgatagaaacataacctaattatgttcctctg

SEQ ID NO: 258324 - DNA, 55 bp, Artificial Sequence
  Description of Artificial Sequence: Synthetic oligonucleotide
tagagacatttattacgaattgatagaaacataacctaattatgttcctctgttc

SEQ ID NO: 258325 - DNA, 54 bp, Artificial Sequence
  Description of Artificial Sequence: Synthetic oligonucleotide
agagacatttattacgaattgatagaaacataacctaattatgttcctctgttc

SEQ ID NO: 258326 - DNA, 53 bp, Artificial Sequence
  Description of Artificial Sequence: Synthetic oligonucleotide
gagacatttattacgaattgatagaaacataacctaattatgttcctctgttc

SEQ ID NO: 258327 - DNA, 53 bp, Artificial Sequence
  Description of Artificial Sequence: Synthetic oligonucleotide
agacatttattacgaattgatagaaacataacctaattatgttcctctgttcg

SEQ ID NO: 258328 - DNA, 52 bp, Artificial Sequence
  Description of Artificial Sequence: Synthetic oligonucleotide
gacatttattacgaattgatagaaacataacctaattatgttcctctgttcg

SEQ ID NO: 258329 - DNA, 54 bp, Artificial Sequence
  Description of Artificial Sequence: Synthetic oligonucleotide
acatttattacgaattgatagaaacataacctaattatgttcctctgttcgttg

SEQ ID NO: 258330 - DNA, 53 bp, Artificial Sequence
  Description of Artificial Sequence: Synthetic oligonucleotide
catttattacgaattgatagaaacataacctaattatgttcctctgttcgttg

SEQ ID NO: 258331 - DNA, 53 bp, Artificial Sequence
  Description of Artificial Sequence: Synthetic oligonucleotide
atttattacgaattgatagaaacataacctaattatgttcctctgttcgttgc

SEQ ID NO: 258332 - DNA, 52 bp, Artificial Sequence
  Description of Artificial Sequence: Synthetic oligonucleotide
tttattacgaattgatagaaacataacctaattatgttcctctgttcgttgc

SEQ ID NO: 258333 - DNA, 51 bp, Artificial Sequence
  Description of Artificial Sequence: Synthetic oligonucleotide
ttattacgaattgatagaaacataacctaattatgttcctctgttcgttgc

SEQ ID NO: 258334 - DNA, 50 bp, Artificial Sequence
  Description of Artificial Sequence: Synthetic oligonucleotide
tattacgaattgatagaaacataacctaattatgttcctctgttcgttgc

SEQ ID NO: 258335 - DNA, 49 bp, Artificial Sequence
  Description of Artificial Sequence: Synthetic oligonucleotide
attacgaattgatagaaacataacctaattatgttcctctgttcgttgc

SEQ ID NO: 258336 - DNA, 48 bp, Artificial Sequence
  Description of Artificial Sequence: Synthetic oligonucleotide
ttacgaattgatagaaacataacctaattatgttcctctgttcgttgc

SEQ ID NO: 258337 - DNA, 47 bp, Artificial Sequence
  Description of Artificial Sequence: Synthetic oligonucleotide
tacgaattgatagaaacataacctaattatgttcctctgttcgttgc

SEQ ID NO: 258338 - DNA, 46 bp, Artificial Sequence
  Description of Artificial Sequence: Synthetic oligonucleotide
acgaattgatagaaacataacctaattatgttcctctgttcgttgc

SEQ ID NO: 258339 - DNA, 45 bp, Artificial Sequence
  Description of Artificial Sequence: Synthetic oligonucleotide
cgaattgatagaaacataacctaattatgttcctctgttcgttgc

SEQ ID NO: 258340 - DNA, 46 bp, Artificial Sequence
  Description of Artificial Sequence: Synthetic oligonucleotide
gaattgatagaaacataacctaattatgttcctctgttcgttgcac

SEQ ID NO: 258341 - DNA, 46 bp, Artificial Sequence
  Description of Artificial Sequence: Synthetic oligonucleotide
aattgatagaaacataacctaattatgttcctctgttcgttgcacg

SEQ ID NO: 258342 - DNA, 45 bp, Artificial Sequence
  Description of Artificial Sequence: Synthetic oligonucleotide
attgatagaaacataacctaattatgttcctctgttcgttgcacg

SEQ ID NO: 258343 - DNA, 44 bp, Artificial Sequence
  Description of Artificial Sequence: Synthetic oligonucleotide
ttgatagaaacataacctaattatgttcctctgttcgttgcacg

SEQ ID NO: 258344 - DNA, 43 bp, Artificial Sequence
  Description of Artificial Sequence: Synthetic oligonucleotide
tgatagaaacataacctaattatgttcctctgttcgttgcacg

SEQ ID NO: 258345 - DNA, 42 bp, Artificial Sequence
  Description of Artificial Sequence: Synthetic oligonucleotide
gatagaaacataacctaattatgttcctctgttcgttgcacg

SEQ ID NO: 258346 - DNA, 43 bp, Artificial Sequence
  Description of Artificial Sequence: Synthetic oligonucleotide
atagaaacataacctaattatgttcctctgttcgttgcacgtc

SEQ ID NO: 258347 - DNA, 42 bp, Artificial Sequence
  Description of Artificial Sequence: Synthetic oligonucleotide
tagaaacataacctaattatgttcctctgttcgttgcacgtc

SEQ ID NO: 258348 - DNA, 41 bp, Artificial Sequence
  Description of Artificial Sequence: Synthetic oligonucleotide
agaaacataacctaattatgttcctctgttcgttgcacgtc

SEQ ID NO: 258349 - DNA, 40 bp, Artificial Sequence
  Description of Artificial Sequence: Synthetic oligonucleotide
gaaacataacctaattatgttcctctgttcgttgcacgtc

SEQ ID NO: 258350 - DNA, 42 bp, Artificial Sequence
  Description of Artificial Sequence: Synthetic oligonucleotide
aaacataacctaattatgttcctctgttcgttgcacgtcttc

SEQ ID NO: 258351 - DNA, 41 bp, Artificial Sequence
  Description of Artificial Sequence: Synthetic oligonucleotide
aacataacctaattatgttcctctgttcgttgcacgtcttc

SEQ ID NO: 258352 - DNA, 40 bp, Artificial Sequence
  Description of Artificial Sequence: Synthetic oligonucleotide
acataacctaattatgttcctctgttcgttgcacgtcttc

SEQ ID NO: 258353 - DNA, 39 bp, Artificial Sequence
  Description of Artificial Sequence: Synthetic oligonucleotide
cataacctaattatgttcctctgttcgttgcacgtcttc

SEQ ID NO: 258354 - DNA, 41 bp, Artificial Sequence
  Description of Artificial Sequence: Synthetic oligonucleotide
ataacctaattatgttcctctgttcgttgcacgtcttcatc

SEQ ID NO: 258355 - DNA, 40 bp, Artificial Sequence
  Description of Artificial Sequence: Synthetic oligonucleotide
taacctaattatgttcctctgttcgttgcacgtcttcatc

SEQ ID NO: 258356 - DNA, 39 bp, Artificial Sequence
  Description of Artificial Sequence: Synthetic oligonucleotide
aacctaattatgttcctctgttcgttgcacgtcttcatc

SEQ ID NO: 258357 - DNA, 38 bp, Artificial Sequence
  Description of Artificial Sequence: Synthetic oligonucleotide
acctaattatgttcctctgttcgttgcacgtcttcatc

SEQ ID NO: 258358 - DNA, 37 bp, Artificial Sequence
  Description of Artificial Sequence: Synthetic oligonucleotide
cctaattatgttcctctgttcgttgcacgtcttcatc

SEQ ID NO: 258359 - DNA, 41 bp, Artificial Sequence
  Description of Artificial Sequence: Synthetic oligonucleotide
ctaattatgttcctctgttcgttgcacgtcttcatcaaatg

SEQ ID NO: 258360 - DNA, 41 bp, Artificial Sequence
  Description of Artificial Sequence: Synthetic oligonucleotide
taattatgttcctctgttcgttgcacgtcttcatcaaatgg

SEQ ID NO: 258361 - DNA, 40 bp, Artificial Sequence
  Description of Artificial Sequence: Synthetic oligonucleotide
aattatgttcctctgttcgttgcacgtcttcatcaaatgg

SEQ ID NO: 258362 - DNA, 39 bp, Artificial Sequence
  Description of Artificial Sequence: Synthetic oligonucleotide
attatgttcctctgttcgttgcacgtcttcatcaaatgg

SEQ ID NO: 258363 - DNA, 38 bp, Artificial Sequence
  Description of Artificial Sequence: Synthetic oligonucleotide
ttatgttcctctgttcgttgcacgtcttcatcaaatgg

SEQ ID NO: 258364 - DNA, 37 bp, Artificial Sequence
  Description of Artificial Sequence: Synthetic oligonucleotide
tatgttcctctgttcgttgcacgtcttcatcaaatgg

SEQ ID NO: 258365 - DNA, 36 bp, Artificial Sequence
  Description of Artificial Sequence: Synthetic oligonucleotide
atgttcctctgttcgttgcacgtcttcatcaaatgg

SEQ ID NO: 258366 - DNA, 35 bp, Artificial Sequence
  Description of Artificial Sequence: Synthetic oligonucleotide
tgttcctctgttcgttgcacgtcttcatcaaatgg

SEQ ID NO: 258367 - DNA, 34 bp, Artificial Sequence
  Description of Artificial Sequence: Synthetic oligonucleotide
gttcctctgttcgttgcacgtcttcatcaaatgg

SEQ ID NO: 258368 - DNA, 36 bp, Artificial Sequence
  Description of Artificial Sequence: Synthetic oligonucleotide
ttcctctgttcgttgcacgtcttcatcaaatggatg

SEQ ID NO: 258369 - DNA, 35 bp, Artificial Sequence
  Description of Artificial Sequence: Synthetic oligonucleotide
tcctctgttcgttgcacgtcttcatcaaatggatg

SEQ ID NO: 258370 - DNA, 34 bp, Artificial Sequence
  Description of Artificial Sequence: Synthetic oligonucleotide
cctctgttcgttgcacgtcttcatcaaatggatg

SEQ ID NO: 258371 - DNA, 34 bp, Artificial Sequence
  Description of Artificial Sequence: Synthetic oligonucleotide
ctctgttcgttgcacgtcttcatcaaatggatgc

SEQ ID NO: 258372 - DNA, 35 bp, Artificial Sequence
  Description of Artificial Sequence: Synthetic oligonucleotide
tctgttcgttgcacgtcttcatcaaatggatgctg

SEQ ID NO: 258373 - DNA, 34 bp, Artificial Sequence
  Description of Artificial Sequence: Synthetic oligonucleotide
ctgttcgttgcacgtcttcatcaaatggatgctg

SEQ ID NO: 258374 - DNA, 38 bp, Artificial Sequence
  Description of Artificial Sequence: Synthetic oligonucleotide
tgttcgttgcacgtcttcatcaaatggatgctgtaaag

SEQ ID NO: 258375 - DNA, 37 bp, Artificial Sequence
  Description of Artificial Sequence: Synthetic oligonucleotide
gttcgttgcacgtcttcatcaaatggatgctgtaaag

SEQ ID NO: 258376 - DNA, 37 bp, Artificial Sequence
  Description of Artificial Sequence: Synthetic oligonucleotide
ttcgttgcacgtcttcatcaaatggatgctgtaaagg

SEQ ID NO: 258377 - DNA, 36 bp, Artificial Sequence
  Description of Artificial Sequence: Synthetic oligonucleotide
tcgttgcacgtcttcatcaaatggatgctgtaaagg

SEQ ID NO: 258378 - DNA, 35 bp, Artificial Sequence
  Description of Artificial Sequence: Synthetic oligonucleotide
cgttgcacgtcttcatcaaatggatgctgtaaagg

SEQ ID NO: 258379 - DNA, 37 bp, Artificial Sequence
  Description of Artificial Sequence: Synthetic oligonucleotide
gttgcacgtcttcatcaaatggatgctgtaaaggaac

SEQ ID NO: 258380 - DNA, 37 bp, Artificial Sequence
  Description of Artificial Sequence: Synthetic oligonucleotide
ttgcacgtcttcatcaaatggatgctgtaaaggaacg

SEQ ID NO: 258381 - DNA, 36 bp, Artificial Sequence
  Description of Artificial Sequence: Synthetic oligonucleotide
tgcacgtcttcatcaaatggatgctgtaaaggaacg

SEQ ID NO: 258382 - DNA, 35 bp, Artificial Sequence
  Description of Artificial Sequence: Synthetic oligonucleotide
gcacgtcttcatcaaatggatgctgtaaaggaacg

SEQ ID NO: 258383 - DNA, 38 bp, Artificial Sequence
  Description of Artificial Sequence: Synthetic oligonucleotide
cacgtcttcatcaaatggatgctgtaaaggaacgtatg

SEQ ID NO: 258384 - DNA, 42 bp, Artificial Sequence
  Description of Artificial Sequence: Synthetic oligonucleotide
acgtcttcatcaaatggatgctgtaaaggaacgtatgaaaag

SEQ ID NO: 258385 - DNA, 41 bp, Artificial Sequence
  Description of Artificial Sequence: Synthetic oligonucleotide
cgtcttcatcaaatggatgctgtaaaggaacgtatgaaaag

SEQ ID NO: 258386 - DNA, 42 bp, Artificial Sequence
  Description of Artificial Sequence: Synthetic oligonucleotide
gtcttcatcaaatggatgctgtaaaggaacgtatgaaaagag

SEQ ID NO: 258387 - DNA, 47 bp, Artificial Sequence
  Description of Artificial Sequence: Synthetic oligonucleotide
tcttcatcaaatggatgctgtaaaggaacgtatgaaaagagttaatg

SEQ ID NO: 258388 - DNA, 46 bp, Artificial Sequence
  Description of Artificial Sequence: Synthetic oligonucleotide
cttcatcaaatggatgctgtaaaggaacgtatgaaaagagttaatg

SEQ ID NO: 258389 - DNA, 51 bp, Artificial Sequence
  Description of Artificial Sequence: Synthetic oligonucleotide
ttcatcaaatggatgctgtaaaggaacgtatgaaaagagttaatgaaaatg

SEQ ID NO: 258390 - DNA, 50 bp, Artificial Sequence
  Description of Artificial Sequence: Synthetic oligonucleotide
tcatcaaatggatgctgtaaaggaacgtatgaaaagagttaatgaaaatg

SEQ ID NO: 258391 - DNA, 49 bp, Artificial Sequence
  Description of Artificial Sequence: Synthetic oligonucleotide
catcaaatggatgctgtaaaggaacgtatgaaaagagttaatgaaaatg

SEQ ID NO: 258392 - DNA, 51 bp, Artificial Sequence
  Description of Artificial Sequence: Synthetic oligonucleotide
atcaaatggatgctgtaaaggaacgtatgaaaagagttaatgaaaatgttg

SEQ ID NO: 258393 - DNA, 50 bp, Artificial Sequence
  Description of Artificial Sequence: Synthetic oligonucleotide
tcaaatggatgctgtaaaggaacgtatgaaaagagttaatgaaaatgttg

SEQ ID NO: 258394 - DNA, 49 bp, Artificial Sequence
  Description of Artificial Sequence: Synthetic oligonucleotide
caaatggatgctgtaaaggaacgtatgaaaagagttaatgaaaatgttg

SEQ ID NO: 258395 - DNA, 51 bp, Artificial Sequence
  Description of Artificial Sequence: Synthetic oligonucleotide
aaatggatgctgtaaaggaacgtatgaaaagagttaatgaaaatgttgatg

SEQ ID NO: 258396 - DNA, 50 bp, Artificial Sequence
  Description of Artificial Sequence: Synthetic oligonucleotide
aatggatgctgtaaaggaacgtatgaaaagagttaatgaaaatgttgatg

SEQ ID NO: 258397 - DNA, 49 bp, Artificial Sequence
  Description of Artificial Sequence: Synthetic oligonucleotide
atggatgctgtaaaggaacgtatgaaaagagttaatgaaaatgttgatg

SEQ ID NO: 258398 - DNA, 48 bp, Artificial Sequence
  Description of Artificial Sequence: Synthetic oligonucleotide
tggatgctgtaaaggaacgtatgaaaagagttaatgaaaatgttgatg

SEQ ID NO: 258399 - DNA, 47 bp, Artificial Sequence
  Description of Artificial Sequence: Synthetic oligonucleotide
ggatgctgtaaaggaacgtatgaaaagagttaatgaaaatgttgatg

SEQ ID NO: 258400 - DNA, 47 bp, Artificial Sequence
  Description of Artificial Sequence: Synthetic oligonucleotide
gatgctgtaaaggaacgtatgaaaagagttaatgaaaatgttgatgc

SEQ ID NO: 258401 - DNA, 47 bp, Artificial Sequence
  Description of Artificial Sequence: Synthetic oligonucleotide
atgctgtaaaggaacgtatgaaaagagttaatgaaaatgttgatgcc

SEQ ID NO: 258402 - DNA, 46 bp, Artificial Sequence
  Description of Artificial Sequence: Synthetic oligonucleotide
tgctgtaaaggaacgtatgaaaagagttaatgaaaatgttgatgcc

SEQ ID NO: 258403 - DNA, 45 bp, Artificial Sequence
  Description of Artificial Sequence: Synthetic oligonucleotide
gctgtaaaggaacgtatgaaaagagttaatgaaaatgttgatgcc

SEQ ID NO: 258404 - DNA, 45 bp, Artificial Sequence
  Description of Artificial Sequence: Synthetic oligonucleotide
ctgtaaaggaacgtatgaaaagagttaatgaaaatgttgatgccg

SEQ ID NO: 258405 - DNA, 45 bp, Artificial Sequence
  Description of Artificial Sequence: Synthetic oligonucleotide
tgtaaaggaacgtatgaaaagagttaatgaaaatgttgatgccgc

SEQ ID NO: 258406 - DNA, 44 bp, Artificial Sequence
  Description of Artificial Sequence: Synthetic oligonucleotide
gtaaaggaacgtatgaaaagagttaatgaaaatgttgatgccgc

SEQ ID NO: 258407 - DNA, 48 bp, Artificial Sequence
  Description of Artificial Sequence: Synthetic oligonucleotide
taaaggaacgtatgaaaagagttaatgaaaatgttgatgccgcaaatg

SEQ ID NO: 258408 - DNA, 47 bp, Artificial Sequence
  Description of Artificial Sequence: Synthetic oligonucleotide
aaaggaacgtatgaaaagagttaatgaaaatgttgatgccgcaaatg

SEQ ID NO: 258409 - DNA, 46 bp, Artificial Sequence
  Description of Artificial Sequence: Synthetic oligonucleotide
aaggaacgtatgaaaagagttaatgaaaatgttgatgccgcaaatg

SEQ ID NO: 258410 - DNA, 45 bp, Artificial Sequence
  Description of Artificial Sequence: Synthetic oligonucleotide
aggaacgtatgaaaagagttaatgaaaatgttgatgccgcaaatg

SEQ ID NO: 258411 - DNA, 44 bp, Artificial Sequence
  Description of Artificial Sequence: Synthetic oligonucleotide
ggaacgtatgaaaagagttaatgaaaatgttgatgccgcaaatg

SEQ ID NO: 258412 - DNA, 44 bp, Artificial Sequence
  Description of Artificial Sequence: Synthetic oligonucleotide
gaacgtatgaaaagagttaatgaaaatgttgatgccgcaaatgc

SEQ ID NO: 258413 - DNA, 45 bp, Artificial Sequence
  Description of Artificial Sequence: Synthetic oligonucleotide
aacgtatgaaaagagttaatgaaaatgttgatgccgcaaatgctc

SEQ ID NO: 258414 - DNA, 44 bp, Artificial Sequence
  Description of Artificial Sequence: Synthetic oligonucleotide
acgtatgaaaagagttaatgaaaatgttgatgccgcaaatgctc

SEQ ID NO: 258415 - DNA, 43 bp, Artificial Sequence
  Description of Artificial Sequence: Synthetic oligonucleotide
cgtatgaaaagagttaatgaaaatgttgatgccgcaaatgctc

SEQ ID NO: 258416 - DNA, 49 bp, Artificial Sequence
  Description of Artificial Sequence: Synthetic oligonucleotide
gtatgaaaagagttaatgaaaatgttgatgccgcaaatgctcttatttc

SEQ ID NO: 258417 - DNA, 50 bp, Artificial Sequence
  Description of Artificial Sequence: Synthetic oligonucleotide
tatgaaaagagttaatgaaaatgttgatgccgcaaatgctcttatttctc

SEQ ID NO: 258418 - DNA, 49 bp, Artificial Sequence
  Description of Artificial Sequence: Synthetic oligonucleotide
atgaaaagagttaatgaaaatgttgatgccgcaaatgctcttatttctc

SEQ ID NO: 258419 - DNA, 48 bp, Artificial Sequence
  Description of Artificial Sequence: Synthetic oligonucleotide
tgaaaagagttaatgaaaatgttgatgccgcaaatgctcttatttctc

SEQ ID NO: 258420 - DNA, 47 bp, Artificial Sequence
  Description of Artificial Sequence: Synthetic oligonucleotide
gaaaagagttaatgaaaatgttgatgccgcaaatgctcttatttctc

SEQ ID NO: 258421 - DNA, 52 bp, Artificial Sequence
  Description of Artificial Sequence: Synthetic oligonucleotide
aaaagagttaatgaaaatgttgatgccgcaaatgctcttatttctcttatag

SEQ ID NO: 258422 - DNA, 51 bp, Artificial Sequence
  Description of Artificial Sequence: Synthetic oligonucleotide
aaagagttaatgaaaatgttgatgccgcaaatgctcttatttctcttatag

SEQ ID NO: 258423 - DNA, 50 bp, Artificial Sequence
  Description of Artificial Sequence: Synthetic oligonucleotide
aagagttaatgaaaatgttgatgccgcaaatgctcttatttctcttatag

SEQ ID NO: 258424 - DNA, 49 bp, Artificial Sequence
  Description of Artificial Sequence: Synthetic oligonucleotide
agagttaatgaaaatgttgatgccgcaaatgctcttatttctcttatag

SEQ ID NO: 258425 - DNA, 48 bp, Artificial Sequence
  Description of Artificial Sequence: Synthetic oligonucleotide
gagttaatgaaaatgttgatgccgcaaatgctcttatttctcttatag

SEQ ID NO: 258426 - DNA, 50 bp, Artificial Sequence
  Description of Artificial Sequence: Synthetic oligonucleotide
agttaatgaaaatgttgatgccgcaaatgctcttatttctcttatagatc

SEQ ID NO: 258427 - DNA, 49 bp, Artificial Sequence
  Description of Artificial Sequence: Synthetic oligonucleotide
gttaatgaaaatgttgatgccgcaaatgctcttatttctcttatagatc

SEQ ID NO: 258428 - DNA, 52 bp, Artificial Sequence
  Description of Artificial Sequence: Synthetic oligonucleotide
ttaatgaaaatgttgatgccgcaaatgctcttatttctcttatagatcatac

SEQ ID NO: 258429 - DNA, 51 bp, Artificial Sequence
  Description of Artificial Sequence: Synthetic oligonucleotide
taatgaaaatgttgatgccgcaaatgctcttatttctcttatagatcatac

SEQ ID NO: 258430 - DNA, 50 bp, Artificial Sequence
  Description of Artificial Sequence: Synthetic oligonucleotide
aatgaaaatgttgatgccgcaaatgctcttatttctcttatagatcatac

SEQ ID NO: 258431 - DNA, 49 bp, Artificial Sequence
  Description of Artificial Sequence: Synthetic oligonucleotide
atgaaaatgttgatgccgcaaatgctcttatttctcttatagatcatac

SEQ ID NO: 258432 - DNA, 48 bp, Artificial Sequence
  Description of Artificial Sequence: Synthetic oligonucleotide
tgaaaatgttgatgccgcaaatgctcttatttctcttatagatcatac

SEQ ID NO: 258433 - DNA, 47 bp, Artificial Sequence
  Description of Artificial Sequence: Synthetic oligonucleotide
gaaaatgttgatgccgcaaatgctcttatttctcttatagatcatac

SEQ ID NO: 258434 - DNA, 48 bp, Artificial Sequence
  Description of Artificial Sequence: Synthetic oligonucleotide
aaaatgttgatgccgcaaatgctcttatttctcttatagatcatacag

SEQ ID NO: 258435 - DNA, 47 bp, Artificial Sequence
  Description of Artificial Sequence: Synthetic oligonucleotide
aaatgttgatgccgcaaatgctcttatttctcttatagatcatacag

SEQ ID NO: 258436 - DNA, 46 bp, Artificial Sequence
  Description of Artificial Sequence: Synthetic oligonucleotide
aatgttgatgccgcaaatgctcttatttctcttatagatcatacag

SEQ ID NO: 258437 - DNA, 45 bp, Artificial Sequence
  Description of Artificial Sequence: Synthetic oligonucleotide
atgttgatgccgcaaatgctcttatttctcttatagatcatacag

SEQ ID NO: 258438 - DNA, 44 bp, Artificial Sequence
  Description of Artificial Sequence: Synthetic oligonucleotide
tgttgatgccgcaaatgctcttatttctcttatagatcatacag

SEQ ID NO: 258439 - DNA, 43 bp, Artificial Sequence
  Description of Artificial Sequence: Synthetic oligonucleotide
gttgatgccgcaaatgctcttatttctcttatagatcatacag

SEQ ID NO: 258440 - DNA, 43 bp, Artificial Sequence
  Description of Artificial Sequence: Synthetic oligonucleotide
ttgatgccgcaaatgctcttatttctcttatagatcatacagc

SEQ ID NO: 258441 - DNA, 42 bp, Artificial Sequence
  Description of Artificial Sequence: Synthetic oligonucleotide
tgatgccgcaaatgctcttatttctcttatagatcatacagc

SEQ ID NO: 258442 - DNA, 41 bp, Artificial Sequence
  Description of Artificial Sequence: Synthetic oligonucleotide
gatgccgcaaatgctcttatttctcttatagatcatacagc

SEQ ID NO: 258443 - DNA, 41 bp, Artificial Sequence
  Description of Artificial Sequence: Synthetic oligonucleotide
atgccgcaaatgctcttatttctcttatagatcatacagcc

SEQ ID NO: 258444 - DNA, 40 bp, Artificial Sequence
  Description of Artificial Sequence: Synthetic oligonucleotide
tgccgcaaatgctcttatttctcttatagatcatacagcc

SEQ ID NO: 258445 - DNA, 39 bp, Artificial Sequence
  Description of Artificial Sequence: Synthetic oligonucleotide
gccgcaaatgctcttatttctcttatagatcatacagcc

SEQ ID NO: 258446 - DNA, 39 bp, Artificial Sequence
  Description of Artificial Sequence: Synthetic oligonucleotide
ccgcaaatgctcttatttctcttatagatcatacagccc

SEQ ID NO: 258447 - DNA, 41 bp, Artificial Sequence
  Description of Artificial Sequence: Synthetic oligonucleotide
cgcaaatgctcttatttctcttatagatcatacagccctac

SEQ ID NO: 258448 - DNA, 41 bp, Artificial Sequence
  Description of Artificial Sequence: Synthetic oligonucleotide
gcaaatgctcttatttctcttatagatcatacagccctacc

SEQ ID NO: 258449 - DNA, 42 bp, Artificial Sequence
  Description of Artificial Sequence: Synthetic oligonucleotide
caaatgctcttatttctcttatagatcatacagccctaccag

SEQ ID NO: 258450 - DNA, 50 bp, Artificial Sequence
  Description of Artificial Sequence: Synthetic oligonucleotide
aaatgctcttatttctcttatagatcatacagccctaccagtttataatg

SEQ ID NO: 258451 - DNA, 49 bp, Artificial Sequence
  Description of Artificial Sequence: Synthetic oligonucleotide
aatgctcttatttctcttatagatcatacagccctaccagtttataatg

SEQ ID NO: 258452 - DNA, 48 bp, Artificial Sequence
  Description of Artificial Sequence: Synthetic oligonucleotide
atgctcttatttctcttatagatcatacagccctaccagtttataatg

SEQ ID NO: 258453 - DNA, 47 bp, Artificial Sequence
  Description of Artificial Sequence: Synthetic oligonucleotide
tgctcttatttctcttatagatcatacagccctaccagtttataatg

SEQ ID NO: 258454 - DNA, 46 bp, Artificial Sequence
  Description of Artificial Sequence: Synthetic oligonucleotide
gctcttatttctcttatagatcatacagccctaccagtttataatg

SEQ ID NO: 258455 - DNA, 46 bp, Artificial Sequence
  Description of Artificial Sequence: Synthetic oligonucleotide
ctcttatttctcttatagatcatacagccctaccagtttataatgc

SEQ ID NO: 258456 - DNA, 49 bp, Artificial Sequence
  Description of Artificial Sequence: Synthetic oligonucleotide
tcttatttctcttatagatcatacagccctaccagtttataatgcaatg

SEQ ID NO: 258457 - DNA, 48 bp, Artificial Sequence
  Description of Artificial Sequence: Synthetic oligonucleotide
cttatttctcttatagatcatacagccctaccagtttataatgcaatg

SEQ ID NO: 258458 - DNA, 50 bp, Artificial Sequence
  Description of Artificial Sequence: Synthetic oligonucleotide
ttatttctcttatagatcatacagccctaccagtttataatgcaatgaac

SEQ ID NO: 258459 - DNA, 49 bp, Artificial Sequence
  Description of Artificial Sequence: Synthetic oligonucleotide
tatttctcttatagatcatacagccctaccagtttataatgcaatgaac

SEQ ID NO: 258460 - DNA, 48 bp, Artificial Sequence
  Description of Artificial Sequence: Synthetic oligonucleotide
atttctcttatagatcatacagccctaccagtttataatgcaatgaac

SEQ ID NO: 258461 - DNA, 47 bp, Artificial Sequence
  Description of Artificial Sequence: Synthetic oligonucleotide
tttctcttatagatcatacagccctaccagtttataatgcaatgaac

SEQ ID NO: 258462 - DNA, 46 bp, Artificial Sequence
  Description of Artificial Sequence: Synthetic oligonucleotide
ttctcttatagatcatacagccctaccagtttataatgcaatgaac

SEQ ID NO: 258463 - DNA, 45 bp, Artificial Sequence
  Description of Artificial Sequence: Synthetic oligonucleotide
tctcttatagatcatacagccctaccagtttataatgcaatgaac

SEQ ID NO: 258464 - DNA, 44 bp, Artificial Sequence
  Description of Artificial Sequence: Synthetic oligonucleotide
ctcttatagatcatacagccctaccagtttataatgcaatgaac

SEQ ID NO: 258465 - DNA, 45 bp, Artificial Sequence
  Description of Artificial Sequence: Synthetic oligonucleotide
tcttatagatcatacagccctaccagtttataatgcaatgaacac

SEQ ID NO: 258466 - DNA, 44 bp, Artificial Sequence
  Description of Artificial Sequence: Synthetic oligonucleotide
cttatagatcatacagccctaccagtttataatgcaatgaacac

SEQ ID NO: 258467 - DNA, 45 bp, Artificial Sequence
  Description of Artificial Sequence: Synthetic oligonucleotide
ttatagatcatacagccctaccagtttataatgcaatgaacactg

SEQ ID NO: 258468 - DNA, 44 bp, Artificial Sequence
  Description of Artificial Sequence: Synthetic oligonucleotide
tatagatcatacagccctaccagtttataatgcaatgaacactg

SEQ ID NO: 258469 - DNA, 43 bp, Artificial Sequence
  Description of Artificial Sequence: Synthetic oligonucleotide
atagatcatacagccctaccagtttataatgcaatgaacactg

SEQ ID NO: 258470 - DNA, 42 bp, Artificial Sequence
  Description of Artificial Sequence: Synthetic oligonucleotide
tagatcatacagccctaccagtttataatgcaatgaacactg

SEQ ID NO: 258471 - DNA, 41 bp, Artificial Sequence
  Description of Artificial Sequence: Synthetic oligonucleotide
agatcatacagccctaccagtttataatgcaatgaacactg

SEQ ID NO: 258472 - DNA, 40 bp, Artificial Sequence
  Description of Artificial Sequence: Synthetic oligonucleotide
gatcatacagccctaccagtttataatgcaatgaacactg

SEQ ID NO: 258473 - DNA, 42 bp, Artificial Sequence
  Description of Artificial Sequence: Synthetic oligonucleotide
atcatacagccctaccagtttataatgcaatgaacactgatc

SEQ ID NO: 258474 - DNA, 41 bp, Artificial Sequence
  Description of Artificial Sequence: Synthetic oligonucleotide
tcatacagccctaccagtttataatgcaatgaacactgatc

SEQ ID NO: 258475 - DNA, 40 bp, Artificial Sequence
  Description of Artificial Sequence: Synthetic oligonucleotide
catacagccctaccagtttataatgcaatgaacactgatc

SEQ ID NO: 258476 - DNA, 40 bp, Artificial Sequence
  Description of Artificial Sequence: Synthetic oligonucleotide
atacagccctaccagtttataatgcaatgaacactgatcc

SEQ ID NO: 258477 - DNA, 39 bp, Artificial Sequence
  Description of Artificial Sequence: Synthetic oligonucleotide
tacagccctaccagtttataatgcaatgaacactgatcc

SEQ ID NO: 258478 - DNA, 38 bp, Artificial Sequence
  Description of Artificial Sequence: Synthetic oligonucleotide
acagccctaccagtttataatgcaatgaacactgatcc

SEQ ID NO: 258479 - DNA, 37 bp, Artificial Sequence
  Description of Artificial Sequence: Synthetic oligonucleotide
cagccctaccagtttataatgcaatgaacactgatcc

SEQ ID NO: 258480 - DNA, 37 bp, Artificial Sequence
  Description of Artificial Sequence: Synthetic oligonucleotide
agccctaccagtttataatgcaatgaacactgatccc

SEQ ID NO: 258481 - DNA, 36 bp, Artificial Sequence
  Description of Artificial Sequence: Synthetic oligonucleotide
gccctaccagtttataatgcaatgaacactgatccc

SEQ ID NO: 258482 - DNA, 37 bp, Artificial Sequence
  Description of Artificial Sequence: Synthetic oligonucleotide
ccctaccagtttataatgcaatgaacactgatccctg

SEQ ID NO: 258483 - DNA, 37 bp, Artificial Sequence
  Description of Artificial Sequence: Synthetic oligonucleotide
cctaccagtttataatgcaatgaacactgatccctgg

SEQ ID NO: 258484 - DNA, 37 bp, Artificial Sequence
  Description of Artificial Sequence: Synthetic oligonucleotide
ctaccagtttataatgcaatgaacactgatccctggc

SEQ ID NO: 258485 - DNA, 37 bp, Artificial Sequence
  Description of Artificial Sequence: Synthetic oligonucleotide
taccagtttataatgcaatgaacactgatccctggcc

SEQ ID NO: 258486 - DNA, 36 bp, Artificial Sequence
  Description of Artificial Sequence: Synthetic oligonucleotide
accagtttataatgcaatgaacactgatccctggcc

SEQ ID NO: 258487 - DNA, 35 bp, Artificial Sequence
  Description of Artificial Sequence: Synthetic oligonucleotide
ccagtttataatgcaatgaacactgatccctggcc

SEQ ID NO: 258488 - DNA, 36 bp, Artificial Sequence
  Description of Artificial Sequence: Synthetic oligonucleotide
cagtttataatgcaatgaacactgatccctggcctg

SEQ ID NO: 258489 - DNA, 38 bp, Artificial Sequence
  Description of Artificial Sequence: Synthetic oligonucleotide
agtttataatgcaatgaacactgatccctggcctgatg

SEQ ID NO: 258490 - DNA, 37 bp, Artificial Sequence
  Description of Artificial Sequence: Synthetic oligonucleotide
gtttataatgcaatgaacactgatccctggcctgatg

SEQ ID NO: 258491 - DNA, 37 bp, Artificial Sequence
  Description of Artificial Sequence: Synthetic oligonucleotide
tttataatgcaatgaacactgatccctggcctgatgg

SEQ ID NO: 258492 - DNA, 36 bp, Artificial Sequence
  Description of Artificial Sequence: Synthetic oligonucleotide
ttataatgcaatgaacactgatccctggcctgatgg

SEQ ID NO: 258493 - DNA, 35 bp, Artificial Sequence
  Description of Artificial Sequence: Synthetic oligonucleotide
tataatgcaatgaacactgatccctggcctgatgg

SEQ ID NO: 258494 - DNA, 34 bp, Artificial Sequence
  Description of Artificial Sequence: Synthetic oligonucleotide
ataatgcaatgaacactgatccctggcctgatgg

SEQ ID NO: 258495 - DNA, 33 bp, Artificial Sequence
  Description of Artificial Sequence: Synthetic oligonucleotide
taatgcaatgaacactgatccctggcctgatgg

SEQ ID NO: 258496 - DNA, 32 bp, Artificial Sequence
  Description of Artificial Sequence: Synthetic oligonucleotide
aatgcaatgaacactgatccctggcctgatgg

SEQ ID NO: 258497 - DNA, 31 bp, Artificial Sequence
  Description of Artificial Sequence: Synthetic oligonucleotide
atgcaatgaacactgatccctggcctgatgg

SEQ ID NO: 258498 - DNA, 30 bp, Artificial Sequence
  Description of Artificial Sequence: Synthetic oligonucleotide
tgcaatgaacactgatccctggcctgatgg

SEQ ID NO: 258499 - DNA, 29 bp, Artificial Sequence
  Description of Artificial Sequence: Synthetic oligonucleotide
gcaatgaacactgatccctggcctgatgg

SEQ ID NO: 258500 - DNA, 30 bp, Artificial Sequence
  Description of Artificial Sequence: Synthetic oligonucleotide
caatgaacactgatccctggcctgatggag

SEQ ID NO: 258501 - DNA, 30 bp, Artificial Sequence
  Description of Artificial Sequence: Synthetic oligonucleotide
aatgaacactgatccctggcctgatggagc

SEQ ID NO: 258502 - DNA, 29 bp, Artificial Sequence
  Description of Artificial Sequence: Synthetic oligonucleotide
atgaacactgatccctggcctgatggagc

SEQ ID NO: 258503 - DNA, 28 bp, Artificial Sequence
  Description of Artificial Sequence: Synthetic oligonucleotide
tgaacactgatccctggcctgatggagc

SEQ ID NO: 258504 - DNA, 27 bp, Artificial Sequence
  Description of Artificial Sequence: Synthetic oligonucleotide
gaacactgatccctggcctgatggagc

SEQ ID NO: 258505 - DNA, 29 bp, Artificial Sequence
  Description of Artificial Sequence: Synthetic oligonucleotide
aacactgatccctggcctgatggagctac

SEQ ID NO: 258506 - DNA, 28 bp, Artificial Sequence
  Description of Artificial Sequence: Synthetic oligonucleotide
acactgatccctggcctgatggagctac

SEQ ID NO: 258507 - DNA, 27 bp, Artificial Sequence
  Description of Artificial Sequence: Synthetic oligonucleotide
cactgatccctggcctgatggagctac

SEQ ID NO: 258508 - DNA, 37 bp, Artificial Sequence
  Description of Artificial Sequence: Synthetic oligonucleotide
actgatccctggcctgatggagctactattaaaaatg

SEQ ID NO: 258509 - DNA, 36 bp, Artificial Sequence
  Description of Artificial Sequence: Synthetic oligonucleotide
ctgatccctggcctgatggagctactattaaaaatg

SEQ ID NO: 258510 - DNA, 37 bp, Artificial Sequence
  Description of Artificial Sequence: Synthetic oligonucleotide
tgatccctggcctgatggagctactattaaaaatgac

SEQ ID NO: 258511 - DNA, 36 bp, Artificial Sequence
  Description of Artificial Sequence: Synthetic oligonucleotide
gatccctggcctgatggagctactattaaaaatgac

SEQ ID NO: 258512 - DNA, 38 bp, Artificial Sequence
  Description of Artificial Sequence: Synthetic oligonucleotide
atccctggcctgatggagctactattaaaaatgacttg

SEQ ID NO: 258513 - DNA, 37 bp, Artificial Sequence
  Description of Artificial Sequence: Synthetic oligonucleotide
tccctggcctgatggagctactattaaaaatgacttg

SEQ ID NO: 258514 - DNA, 36 bp, Artificial Sequence
  Description of Artificial Sequence: Synthetic oligonucleotide
ccctggcctgatggagctactattaaaaatgacttg

SEQ ID NO: 258515 - DNA, 36 bp, Artificial Sequence
  Description of Artificial Sequence: Synthetic oligonucleotide
cctggcctgatggagctactattaaaaatgacttgg

SEQ ID NO: 258516 - DNA, 37 bp, Artificial Sequence
  Description of Artificial Sequence: Synthetic oligonucleotide
ctggcctgatggagctactattaaaaatgacttggac

SEQ ID NO: 258517 - DNA, 40 bp, Artificial Sequence
  Description of Artificial Sequence: Synthetic oligonucleotide
tggcctgatggagctactattaaaaatgacttggacaaac

SEQ ID NO: 258518 - DNA, 39 bp, Artificial Sequence
  Description of Artificial Sequence: Synthetic oligonucleotide
ggcctgatggagctactattaaaaatgacttggacaaac

SEQ ID NO: 258519 - DNA, 45 bp, Artificial Sequence
  Description of Artificial Sequence: Synthetic oligonucleotide
gcctgatggagctactattaaaaatgacttggacaaactaaaatc

SEQ ID NO: 258520 - DNA, 45 bp, Artificial Sequence
  Description of Artificial Sequence: Synthetic oligonucleotide
cctgatggagctactattaaaaatgacttggacaaactaaaatcc

SEQ ID NO: 258521 - DNA, 46 bp, Artificial Sequence
  Description of Artificial Sequence: Synthetic oligonucleotide
ctgatggagctactattaaaaatgacttggacaaactaaaatccac

SEQ ID NO: 258522 - DNA, 46 bp, Artificial Sequence
  Description of Artificial Sequence: Synthetic oligonucleotide
tgatggagctactattaaaaatgacttggacaaactaaaatccacg

SEQ ID NO: 258523 - DNA, 45 bp, Artificial Sequence
  Description of Artificial Sequence: Synthetic oligonucleotide
gatggagctactattaaaaatgacttggacaaactaaaatccacg

SEQ ID NO: 258524 - DNA, 45 bp, Artificial Sequence
  Description of Artificial Sequence: Synthetic oligonucleotide
atggagctactattaaaaatgacttggacaaactaaaatccacgc

SEQ ID NO: 258525 - DNA, 44 bp, Artificial Sequence
  Description of Artificial Sequence: Synthetic oligonucleotide
tggagctactattaaaaatgacttggacaaactaaaatccacgc

SEQ ID NO: 258526 - DNA, 43 bp, Artificial Sequence
  Description of Artificial Sequence: Synthetic oligonucleotide
ggagctactattaaaaatgacttggacaaactaaaatccacgc

SEQ ID NO: 258527 - DNA, 44 bp, Artificial Sequence
  Description of Artificial Sequence: Synthetic oligonucleotide
gagctactattaaaaatgacttggacaaactaaaatccacgctc

SEQ ID NO: 258528 - DNA, 44 bp, Artificial Sequence
  Description of Artificial Sequence: Synthetic oligonucleotide
agctactattaaaaatgacttggacaaactaaaatccacgctcg

SEQ ID NO: 258529 - DNA, 43 bp, Artificial Sequence
  Description of Artificial Sequence: Synthetic oligonucleotide
gctactattaaaaatgacttggacaaactaaaatccacgctcg

SEQ ID NO: 258530 - DNA, 45 bp, Artificial Sequence
  Description of Artificial Sequence: Synthetic oligonucleotide
ctactattaaaaatgacttggacaaactaaaatccacgctcgtag

SEQ ID NO: 258531 - DNA, 47 bp, Artificial Sequence
  Description of Artificial Sequence: Synthetic oligonucleotide
tactattaaaaatgacttggacaaactaaaatccacgctcgtagatc

SEQ ID NO: 258532 - DNA, 46 bp, Artificial Sequence
  Description of Artificial Sequence: Synthetic oligonucleotide
actattaaaaatgacttggacaaactaaaatccacgctcgtagatc

SEQ ID NO: 258533 - DNA, 45 bp, Artificial Sequence
  Description of Artificial Sequence: Synthetic oligonucleotide
ctattaaaaatgacttggacaaactaaaatccacgctcgtagatc

SEQ ID NO: 258534 - DNA, 45 bp, Artificial Sequence
  Description of Artificial Sequence: Synthetic oligonucleotide
tattaaaaatgacttggacaaactaaaatccacgctcgtagatcc

SEQ ID NO: 258535 - DNA, 44 bp, Artificial Sequence
  Description of Artificial Sequence: Synthetic oligonucleotide
attaaaaatgacttggacaaactaaaatccacgctcgtagatcc

SEQ ID NO: 258536 - DNA, 43 bp, Artificial Sequence
  Description of Artificial Sequence: Synthetic oligonucleotide
ttaaaaatgacttggacaaactaaaatccacgctcgtagatcc

SEQ ID NO: 258537 - DNA, 42 bp, Artificial Sequence
  Description of Artificial Sequence: Synthetic oligonucleotide
taaaaatgacttggacaaactaaaatccacgctcgtagatcc

SEQ ID NO: 258538 - DNA, 41 bp, Artificial Sequence
  Description of Artificial Sequence: Synthetic oligonucleotide
aaaaatgacttggacaaactaaaatccacgctcgtagatcc

SEQ ID NO: 258539 - DNA, 40 bp, Artificial Sequence
  Description of Artificial Sequence: Synthetic oligonucleotide
aaaatgacttggacaaactaaaatccacgctcgtagatcc

SEQ ID NO: 258540 - DNA, 39 bp, Artificial Sequence
  Description of Artificial Sequence: Synthetic oligonucleotide
aaatgacttggacaaactaaaatccacgctcgtagatcc

SEQ ID NO: 258541 - DNA, 38 bp, Artificial Sequence
  Description of Artificial Sequence: Synthetic oligonucleotide
aatgacttggacaaactaaaatccacgctcgtagatcc

SEQ ID NO: 258542 - DNA, 37 bp, Artificial Sequence
  Description of Artificial Sequence: Synthetic oligonucleotide
atgacttggacaaactaaaatccacgctcgtagatcc

SEQ ID NO: 258543 - DNA, 36 bp, Artificial Sequence
  Description of Artificial Sequence: Synthetic oligonucleotide
tgacttggacaaactaaaatccacgctcgtagatcc

SEQ ID NO: 258544 - DNA, 35 bp, Artificial Sequence
  Description of Artificial Sequence: Synthetic oligonucleotide
gacttggacaaactaaaatccacgctcgtagatcc

SEQ ID NO: 258545 - DNA, 35 bp, Artificial Sequence
  Description of Artificial Sequence: Synthetic oligonucleotide
acttggacaaactaaaatccacgctcgtagatccc

SEQ ID NO: 258546 - DNA, 34 bp, Artificial Sequence
  Description of Artificial Sequence: Synthetic oligonucleotide
cttggacaaactaaaatccacgctcgtagatccc

SEQ ID NO: 258547 - DNA, 34 bp, Artificial Sequence
  Description of Artificial Sequence: Synthetic oligonucleotide
ttggacaaactaaaatccacgctcgtagatcccc

SEQ ID NO: 258548 - DNA, 33 bp, Artificial Sequence
  Description of Artificial Sequence: Synthetic oligonucleotide
tggacaaactaaaatccacgctcgtagatcccc

SEQ ID NO: 258549 - DNA, 32 bp, Artificial Sequence
  Description of Artificial Sequence: Synthetic oligonucleotide
ggacaaactaaaatccacgctcgtagatcccc

SEQ ID NO: 258550 - DNA, 35 bp, Artificial Sequence
  Description of Artificial Sequence: Synthetic oligonucleotide
gacaaactaaaatccacgctcgtagatcccctttg

SEQ ID NO: 258551 - DNA, 37 bp, Artificial Sequence
  Description of Artificial Sequence: Synthetic oligonucleotide
acaaactaaaatccacgctcgtagatcccctttgtac

SEQ ID NO: 258552 - DNA, 36 bp, Artificial Sequence
  Description of Artificial Sequence: Synthetic oligonucleotide
caaactaaaatccacgctcgtagatcccctttgtac

SEQ ID NO: 258553 - DNA, 36 bp, Artificial Sequence
  Description of Artificial Sequence: Synthetic oligonucleotide
aaactaaaatccacgctcgtagatcccctttgtacg

SEQ ID NO: 258554 - DNA, 35 bp, Artificial Sequence
  Description of Artificial Sequence: Synthetic oligonucleotide
aactaaaatccacgctcgtagatcccctttgtacg

SEQ ID NO: 258555 - DNA, 34 bp, Artificial Sequence
  Description of Artificial Sequence: Synthetic oligonucleotide
actaaaatccacgctcgtagatcccctttgtacg

SEQ ID NO: 258556 - DNA, 33 bp, Artificial Sequence
  Description of Artificial Sequence: Synthetic oligonucleotide
ctaaaatccacgctcgtagatcccctttgtacg

SEQ ID NO: 258557 - DNA, 36 bp, Artificial Sequence
  Description of Artificial Sequence: Synthetic oligonucleotide
taaaatccacgctcgtagatcccctttgtacgaaag

SEQ ID NO: 258558 - DNA, 35 bp, Artificial Sequence
  Description of Artificial Sequence: Synthetic oligonucleotide
aaaatccacgctcgtagatcccctttgtacgaaag

SEQ ID NO: 258559 - DNA, 34 bp, Artificial Sequence
  Description of Artificial Sequence: Synthetic oligonucleotide
aaatccacgctcgtagatcccctttgtacgaaag

SEQ ID NO: 258560 - DNA, 33 bp, Artificial Sequence
  Description of Artificial Sequence: Synthetic oligonucleotide
aatccacgctcgtagatcccctttgtacgaaag

SEQ ID NO: 258561 - DNA, 32 bp, Artificial Sequence
  Description of Artificial Sequence: Synthetic oligonucleotide
atccacgctcgtagatcccctttgtacgaaag

SEQ ID NO: 258562 - DNA, 31 bp, Artificial Sequence
  Description of Artificial Sequence: Synthetic oligonucleotide
tccacgctcgtagatcccctttgtacgaaag

SEQ ID NO: 258563 - DNA, 30 bp, Artificial Sequence
  Description of Artificial Sequence: Synthetic oligonucleotide
ccacgctcgtagatcccctttgtacgaaag

SEQ ID NO: 258564 - DNA, 30 bp, Artificial Sequence
  Description of Artificial Sequence: Synthetic oligonucleotide
cacgctcgtagatcccctttgtacgaaagg

SEQ ID NO: 258565 - DNA, 32 bp, Artificial Sequence
  Description of Artificial Sequence: Synthetic oligonucleotide
acgctcgtagatcccctttgtacgaaaggttg

SEQ ID NO: 258566 - DNA, 31 bp, Artificial Sequence
  Description of Artificial Sequence: Synthetic oligonucleotide
cgctcgtagatcccctttgtacgaaaggttg

SEQ ID NO: 258567 - DNA, 32 bp, Artificial Sequence
  Description of Artificial Sequence: Synthetic oligonucleotide
gctcgtagatcccctttgtacgaaaggttgag

SEQ ID NO: 258568 - DNA, 32 bp, Artificial Sequence
  Description of Artificial Sequence: Synthetic oligonucleotide
ctcgtagatcccctttgtacgaaaggttgagc

SEQ ID NO: 258569 - DNA, 32 bp, Artificial Sequence
  Description of Artificial Sequence: Synthetic oligonucleotide
tcgtagatcccctttgtacgaaaggttgagcc

SEQ ID NO: 258570 - DNA, 31 bp, Artificial Sequence
  Description of Artificial Sequence: Synthetic oligonucleotide
cgtagatcccctttgtacgaaaggttgagcc

SEQ ID NO: 258571 - DNA, 31 bp, Artificial Sequence
  Description of Artificial Sequence: Synthetic oligonucleotide
gtagatcccctttgtacgaaaggttgagccc

SEQ ID NO: 258572 - DNA, 32 bp, Artificial Sequence
  Description of Artificial Sequence: Synthetic oligonucleotide
tagatcccctttgtacgaaaggttgagccctg

SEQ ID NO: 258573 - DNA, 31 bp, Artificial Sequence
  Description of Artificial Sequence: Synthetic oligonucleotide
agatcccctttgtacgaaaggttgagccctg

SEQ ID NO: 258574 - DNA, 30 bp, Artificial Sequence
  Description of Artificial Sequence: Synthetic oligonucleotide
gatcccctttgtacgaaaggttgagccctg

SEQ ID NO: 258575 - DNA, 30 bp, Artificial Sequence
  Description of Artificial Sequence: Synthetic oligonucleotide
atcccctttgtacgaaaggttgagccctgg

SEQ ID NO: 258576 - DNA, 29 bp, Artificial Sequence
  Description of Artificial Sequence: Synthetic oligonucleotide
tcccctttgtacgaaaggttgagccctgg

SEQ ID NO: 258577 - DNA, 28 bp, Artificial Sequence
  Description of Artificial Sequence: Synthetic oligonucleotide
cccctttgtacgaaaggttgagccctgg

SEQ ID NO: 258578 - DNA, 28 bp, Artificial Sequence
  Description of Artificial Sequence: Synthetic oligonucleotide
ccctttgtacgaaaggttgagccctggc

SEQ ID NO: 258579 - DNA, 29 bp, Artificial Sequence
  Description of Artificial Sequence: Synthetic oligonucleotide
cctttgtacgaaaggttgagccctggcac

SEQ ID NO: 258580 - DNA, 30 bp, Artificial Sequence
  Description of Artificial Sequence: Synthetic oligonucleotide
ctttgtacgaaaggttgagccctggcacac

SEQ ID NO: 258581 - DNA, 30 bp, Artificial Sequence
  Description of Artificial Sequence: Synthetic oligonucleotide
tttgtacgaaaggttgagccctggcacacc

SEQ ID NO: 258582 - DNA, 29 bp, Artificial Sequence
  Description of Artificial Sequence: Synthetic oligonucleotide
ttgtacgaaaggttgagccctggcacacc

SEQ ID NO: 258583 - DNA, 28 bp, Artificial Sequence
  Description of Artificial Sequence: Synthetic oligonucleotide
tgtacgaaaggttgagccctggcacacc

SEQ ID NO: 258584 - DNA, 27 bp, Artificial Sequence
  Description of Artificial Sequence: Synthetic oligonucleotide
gtacgaaaggttgagccctggcacacc

SEQ ID NO: 258585 - DNA, 29 bp, Artificial Sequence
  Description of Artificial Sequence: Synthetic oligonucleotide
tacgaaaggttgagccctggcacaccatc

SEQ ID NO: 258586 - DNA, 28 bp, Artificial Sequence
  Description of Artificial Sequence: Synthetic oligonucleotide
acgaaaggttgagccctggcacaccatc

SEQ ID NO: 258587 - DNA, 27 bp, Artificial Sequence
  Description of Artificial Sequence: Synthetic oligonucleotide
cgaaaggttgagccctggcacaccatc

SEQ ID NO: 258588 - DNA, 29 bp, Artificial Sequence
  Description of Artificial Sequence: Synthetic oligonucleotide
gaaaggttgagccctggcacaccatcttc

SEQ ID NO: 258589 - DNA, 31 bp, Artificial Sequence
  Description of Artificial Sequence: Synthetic oligonucleotide
aaaggttgagccctggcacaccatcttcatc

SEQ ID NO: 258590 - DNA, 30 bp, Artificial Sequence
  Description of Artificial Sequence: Synthetic oligonucleotide
aaggttgagccctggcacaccatcttcatc

SEQ ID NO: 258591 - DNA, 29 bp, Artificial Sequence
  Description of Artificial Sequence: Synthetic oligonucleotide
aggttgagccctggcacaccatcttcatc

SEQ ID NO: 258592 - DNA, 28 bp, Artificial Sequence
  Description of Artificial Sequence: Synthetic oligonucleotide
ggttgagccctggcacaccatcttcatc

SEQ ID NO: 258593 - DNA, 29 bp, Artificial Sequence
  Description of Artificial Sequence: Synthetic oligonucleotide
gttgagccctggcacaccatcttcatcac

SEQ ID NO: 258594 - DNA, 30 bp, Artificial Sequence
  Description of Artificial Sequence: Synthetic oligonucleotide
ttgagccctggcacaccatcttcatcacac

SEQ ID NO: 258595 - DNA, 29 bp, Artificial Sequence
  Description of Artificial Sequence: Synthetic oligonucleotide
tgagccctggcacaccatcttcatcacac

SEQ ID NO: 258596 - DNA, 28 bp, Artificial Sequence
  Description of Artificial Sequence: Synthetic oligonucleotide
gagccctggcacaccatcttcatcacac

SEQ ID NO: 258597 - DNA, 28 bp, Artificial Sequence
  Description of Artificial Sequence: Synthetic oligonucleotide
agccctggcacaccatcttcatcacacc

SEQ ID NO: 258598 - DNA, 27 bp, Artificial Sequence
  Description of Artificial Sequence: Synthetic oligonucleotide
gccctggcacaccatcttcatcacacc

SEQ ID NO: 258599 - DNA, 27 bp, Artificial Sequence
  Description of Artificial Sequence: Synthetic oligonucleotide
ccctggcacaccatcttcatcacaccc

SEQ ID NO: 258600 - DNA, 28 bp, Artificial Sequence
  Description of Artificial Sequence: Synthetic oligonucleotide
cctggcacaccatcttcatcacacccac

SEQ ID NO: 258601 - DNA, 28 bp, Artificial Sequence
  Description of Artificial Sequence: Synthetic oligonucleotide
ctggcacaccatcttcatcacacccacg

SEQ ID NO: 258602 - DNA, 28 bp, Artificial Sequence
  Description of Artificial Sequence: Synthetic oligonucleotide
tggcacaccatcttcatcacacccacgc

SEQ ID NO: 258603 - DNA, 27 bp, Artificial Sequence
  Description of Artificial Sequence: Synthetic oligonucleotide
ggcacaccatcttcatcacacccacgc

SEQ ID NO: 258604 - DNA, 28 bp, Artificial Sequence
  Description of Artificial Sequence: Synthetic oligonucleotide
gcacaccatcttcatcacacccacgctc

SEQ ID NO: 258605 - DNA, 30 bp, Artificial Sequence
  Description of Artificial Sequence: Synthetic oligonucleotide
cacaccatcttcatcacacccacgctcaag

SEQ ID NO: 258606 - DNA, 31 bp, Artificial Sequence
  Description of Artificial Sequence: Synthetic oligonucleotide
acaccatcttcatcacacccacgctcaagac

SEQ ID NO: 258607 - DNA, 30 bp, Artificial Sequence
  Description of Artificial Sequence: Synthetic oligonucleotide
caccatcttcatcacacccacgctcaagac

SEQ ID NO: 258608 - DNA, 30 bp, Artificial Sequence
  Description of Artificial Sequence: Synthetic oligonucleotide
accatcttcatcacacccacgctcaagacc

SEQ ID NO: 258609 - DNA, 29 bp, Artificial Sequence
  Description of Artificial Sequence: Synthetic oligonucleotide
ccatcttcatcacacccacgctcaagacc

SEQ ID NO: 258610 - DNA, 29 bp, Artificial Sequence
  Description of Artificial Sequence: Synthetic oligonucleotide
catcttcatcacacccacgctcaagaccg

SEQ ID NO: 258611 - DNA, 30 bp, Artificial Sequence
  Description of Artificial Sequence: Synthetic oligonucleotide
atcttcatcacacccacgctcaagaccgag

SEQ ID NO: 258612 - DNA, 29 bp, Artificial Sequence
  Description of Artificial Sequence: Synthetic oligonucleotide
tcttcatcacacccacgctcaagaccgag

SEQ ID NO: 258613 - DNA, 28 bp, Artificial Sequence
  Description of Artificial Sequence: Synthetic oligonucleotide
cttcatcacacccacgctcaagaccgag

SEQ ID NO: 258614 - DNA, 28 bp, Artificial Sequence
  Description of Artificial Sequence: Synthetic oligonucleotide
ttcatcacacccacgctcaagaccgagc

SEQ ID NO: 258615 - DNA, 27 bp, Artificial Sequence
  Description of Artificial Sequence: Synthetic oligonucleotide
tcatcacacccacgctcaagaccgagc

SEQ ID NO: 258616 - DNA, 26 bp, Artificial Sequence
  Description of Artificial Sequence: Synthetic oligonucleotide
catcacacccacgctcaagaccgagc

SEQ ID NO: 258617 - DNA, 27 bp, Artificial Sequence
  Description of Artificial Sequence: Synthetic oligonucleotide
atcacacccacgctcaagaccgagcca

SEQ ID NO: 258618 - DNA, 27 bp, Artificial Sequence
  Description of Artificial Sequence: Synthetic oligonucleotide
tcacacccacgctcaagaccgagccat

SEQ ID NO: 258619 - DNA, 27 bp, Artificial Sequence
  Description of Artificial Sequence: Synthetic oligonucleotide
cacacccacgctcaagaccgagccatt

SEQ ID NO: 258620 - DNA, 28 bp, Artificial Sequence
  Description of Artificial Sequence: Synthetic oligonucleotide
acacccacgctcaagaccgagccatttg

SEQ ID NO: 258621 - DNA, 27 bp, Artificial Sequence
  Description of Artificial Sequence: Synthetic oligonucleotide
cacccacgctcaagaccgagccatttg

SEQ ID NO: 258622 - DNA, 27 bp, Artificial Sequence
  Description of Artificial Sequence: Synthetic oligonucleotide
acccacgctcaagaccgagccatttgc

SEQ ID NO: 258623 - DNA, 27 bp, Artificial Sequence
  Description of Artificial Sequence: Synthetic oligonucleotide
cccacgctcaagaccgagccatttgca

SEQ ID NO: 258624 - DNA, 27 bp, Artificial Sequence
  Description of Artificial Sequence: Synthetic oligonucleotide
ccacgctcaagaccgagccatttgcac

SEQ ID NO: 258625 - DNA, 28 bp, Artificial Sequence
  Description of Artificial Sequence: Synthetic oligonucleotide
cacgctcaagaccgagccatttgcactg

SEQ ID NO: 258626 - DNA, 30 bp, Artificial Sequence
  Description of Artificial Sequence: Synthetic oligonucleotide
acgctcaagaccgagccatttgcactgatg

SEQ ID NO: 258627 - DNA, 29 bp, Artificial Sequence
  Description of Artificial Sequence: Synthetic oligonucleotide
cgctcaagaccgagccatttgcactgatg

SEQ ID NO: 258628 - DNA, 29 bp, Artificial Sequence
  Description of Artificial Sequence: Synthetic oligonucleotide
gctcaagaccgagccatttgcactgatgc

SEQ ID NO: 258629 - DNA, 30 bp, Artificial Sequence
  Description of Artificial Sequence: Synthetic oligonucleotide
ctcaagaccgagccatttgcactgatgctg

SEQ ID NO: 258630 - DNA, 32 bp, Artificial Sequence
  Description of Artificial Sequence: Synthetic oligonucleotide
tcaagaccgagccatttgcactgatgctgaag

SEQ ID NO: 258631 - DNA, 31 bp, Artificial Sequence
  Description of Artificial Sequence: Synthetic oligonucleotide
caagaccgagccatttgcactgatgctgaag

SEQ ID NO: 258632 - DNA, 31 bp, Artificial Sequence
  Description of Artificial Sequence: Synthetic oligonucleotide
aagaccgagccatttgcactgatgctgaagg

SEQ ID NO: 258633 - DNA, 30 bp, Artificial Sequence
  Description of Artificial Sequence: Synthetic oligonucleotide
agaccgagccatttgcactgatgctgaagg

SEQ ID NO: 258634 - DNA, 29 bp, Artificial Sequence
  Description of Artificial Sequence: Synthetic oligonucleotide
gaccgagccatttgcactgatgctgaagg

SEQ ID NO: 258635 - DNA, 32 bp, Artificial Sequence
  Description of Artificial Sequence: Synthetic oligonucleotide
accgagccatttgcactgatgctgaaggaaag

SEQ ID NO: 258636 - DNA, 31 bp, Artificial Sequence
  Description of Artificial Sequence: Synthetic oligonucleotide
ccgagccatttgcactgatgctgaaggaaag

SEQ ID NO: 258637 - DNA, 31 bp, Artificial Sequence
  Description of Artificial Sequence: Synthetic oligonucleotide
cgagccatttgcactgatgctgaaggaaagc

SEQ ID NO: 258638 - DNA, 32 bp, Artificial Sequence
  Description of Artificial Sequence: Synthetic oligonucleotide
gagccatttgcactgatgctgaaggaaagcag

SEQ ID NO: 258639 - DNA, 32 bp, Artificial Sequence
  Description of Artificial Sequence: Synthetic oligonucleotide
agccatttgcactgatgctgaaggaaagcagg

SEQ ID NO: 258640 - DNA, 31 bp, Artificial Sequence
  Description of Artificial Sequence: Synthetic oligonucleotide
gccatttgcactgatgctgaaggaaagcagg

SEQ ID NO: 258641 - DNA, 32 bp, Artificial Sequence
  Description of Artificial Sequence: Synthetic oligonucleotide
ccatttgcactgatgctgaaggaaagcaggag

SEQ ID NO: 258642 - DNA, 32 bp, Artificial Sequence
  Description of Artificial Sequence: Synthetic oligonucleotide
catttgcactgatgctgaaggaaagcaggagg

SEQ ID NO: 258643 - DNA, 34 bp, Artificial Sequence
  Description of Artificial Sequence: Synthetic oligonucleotide
atttgcactgatgctgaaggaaagcaggaggaag

SEQ ID NO: 258644 - DNA, 33 bp, Artificial Sequence
  Description of Artificial Sequence: Synthetic oligonucleotide
tttgcactgatgctgaaggaaagcaggaggaag

SEQ ID NO: 258645 - DNA, 32 bp, Artificial Sequence
  Description of Artificial Sequence: Synthetic oligonucleotide
ttgcactgatgctgaaggaaagcaggaggaag

SEQ ID NO: 258646 - DNA, 31 bp, Artificial Sequence
  Description of Artificial Sequence: Synthetic oligonucleotide
tgcactgatgctgaaggaaagcaggaggaag

SEQ ID NO: 258647 - DNA, 30 bp, Artificial Sequence
  Description of Artificial Sequence: Synthetic oligonucleotide
gcactgatgctgaaggaaagcaggaggaag

SEQ ID NO: 258648 - DNA, 30 bp, Artificial Sequence
  Description of Artificial Sequence: Synthetic oligonucleotide
cactgatgctgaaggaaagcaggaggaagc

SEQ ID NO: 258649 - DNA, 31 bp, Artificial Sequence
  Description of Artificial Sequence: Synthetic oligonucleotide
actgatgctgaaggaaagcaggaggaagcag

SEQ ID NO: 258650 - DNA, 30 bp, Artificial Sequence
  Description of Artificial Sequence: Synthetic oligonucleotide
ctgatgctgaaggaaagcaggaggaagcag

SEQ ID NO: 258651 - DNA, 33 bp, Artificial Sequence
  Description of Artificial Sequence: Synthetic oligonucleotide
tgatgctgaaggaaagcaggaggaagcagaaag

SEQ ID NO: 258652 - DNA, 32 bp, Artificial Sequence
  Description of Artificial Sequence: Synthetic oligonucleotide
gatgctgaaggaaagcaggaggaagcagaaag

SEQ ID NO: 258653 - DNA, 33 bp, Artificial Sequence
  Description of Artificial Sequence: Synthetic oligonucleotide
atgctgaaggaaagcaggaggaagcagaaagtc

SEQ ID NO: 258654 - DNA, 32 bp, Artificial Sequence
  Description of Artificial Sequence: Synthetic oligonucleotide
tgctgaaggaaagcaggaggaagcagaaagtc

SEQ ID NO: 258655 - DNA, 31 bp, Artificial Sequence
  Description of Artificial Sequence: Synthetic oligonucleotide
gctgaaggaaagcaggaggaagcagaaagtc

SEQ ID NO: 258656 - DNA, 31 bp, Artificial Sequence
  Description of Artificial Sequence: Synthetic oligonucleotide
ctgaaggaaagcaggaggaagcagaaagtcc

SEQ ID NO: 258657 - DNA, 34 bp, Artificial Sequence
  Description of Artificial Sequence: Synthetic oligonucleotide
tgaaggaaagcaggaggaagcagaaagtccattg

SEQ ID NO: 258658 - DNA, 33 bp, Artificial Sequence
  Description of Artificial Sequence: Synthetic oligonucleotide
gaaggaaagcaggaggaagcagaaagtccattg

SEQ ID NO: 258659 - DNA, 33 bp, Artificial Sequence
  Description of Artificial Sequence: Synthetic oligonucleotide
aaggaaagcaggaggaagcagaaagtccattgg

SEQ ID NO: 258660 - DNA, 32 bp, Artificial Sequence
  Description of Artificial Sequence: Synthetic oligonucleotide
aggaaagcaggaggaagcagaaagtccattgg

SEQ ID NO: 258661 - DNA, 31 bp, Artificial Sequence
  Description of Artificial Sequence: Synthetic oligonucleotide
ggaaagcaggaggaagcagaaagtccattgg

SEQ ID NO: 258662 - DNA, 34 bp, Artificial Sequence
  Description of Artificial Sequence: Synthetic oligonucleotide
gaaagcaggaggaagcagaaagtccattggattc

SEQ ID NO: 258663 - DNA, 35 bp, Artificial Sequence
  Description of Artificial Sequence: Synthetic oligonucleotide
aaagcaggaggaagcagaaagtccattggattctg

SEQ ID NO: 258664 - DNA, 34 bp, Artificial Sequence
  Description of Artificial Sequence: Synthetic oligonucleotide
aagcaggaggaagcagaaagtccattggattctg

SEQ ID NO: 258665 - DNA, 33 bp, Artificial Sequence
  Description of Artificial Sequence: Synthetic oligonucleotide
agcaggaggaagcagaaagtccattggattctg

SEQ ID NO: 258666 - DNA, 32 bp, Artificial Sequence
  Description of Artificial Sequence: Synthetic oligonucleotide
gcaggaggaagcagaaagtccattggattctg

SEQ ID NO: 258667 - DNA, 33 bp, Artificial Sequence
  Description of Artificial Sequence: Synthetic oligonucleotide
caggaggaagcagaaagtccattggattctgtg

SEQ ID NO: 258668 - DNA, 33 bp, Artificial Sequence
  Description of Artificial Sequence: Synthetic oligonucleotide
aggaggaagcagaaagtccattggattctgtgg

SEQ ID NO: 258669 - DNA, 32 bp, Artificial Sequence
  Description of Artificial Sequence: Synthetic oligonucleotide
ggaggaagcagaaagtccattggattctgtgg

SEQ ID NO: 258670 - DNA, 32 bp, Artificial Sequence
  Description of Artificial Sequence: Synthetic oligonucleotide
gaggaagcagaaagtccattggattctgtggc

SEQ ID NO: 258671 - DNA, 33 bp, Artificial Sequence
  Description of Artificial Sequence: Synthetic oligonucleotide
aggaagcagaaagtccattggattctgtggcag

SEQ ID NO: 258672 - DNA, 32 bp, Artificial Sequence
  Description of Artificial Sequence: Synthetic oligonucleotide
ggaagcagaaagtccattggattctgtggcag

SEQ ID NO: 258673 - DNA, 35 bp, Artificial Sequence
  Description of Artificial Sequence: Synthetic oligonucleotide
gaagcagaaagtccattggattctgtggcagaaag

SEQ ID NO: 258674 - DNA, 40 bp, Artificial Sequence
  Description of Artificial Sequence: Synthetic oligonucleotide
aagcagaaagtccattggattctgtggcagaaagattttg

SEQ ID NO: 258675 - DNA, 39 bp, Artificial Sequence
  Description of Artificial Sequence: Synthetic oligonucleotide
agcagaaagtccattggattctgtggcagaaagattttg

SEQ ID NO: 258676 - DNA, 38 bp, Artificial Sequence
  Description of Artificial Sequence: Synthetic oligonucleotide
gcagaaagtccattggattctgtggcagaaagattttg

SEQ ID NO: 258677 - DNA, 38 bp, Artificial Sequence
  Description of Artificial Sequence: Synthetic oligonucleotide
cagaaagtccattggattctgtggcagaaagattttgg

SEQ ID NO: 258678 - DNA, 38 bp, Artificial Sequence
  Description of Artificial Sequence: Synthetic oligonucleotide
agaaagtccattggattctgtggcagaaagattttggg

SEQ ID NO: 258679 - DNA, 37 bp, Artificial Sequence
  Description of Artificial Sequence: Synthetic oligonucleotide
gaaagtccattggattctgtggcagaaagattttggg

SEQ ID NO: 258680 - DNA, 40 bp, Artificial Sequence
  Description of Artificial Sequence: Synthetic oligonucleotide
aaagtccattggattctgtggcagaaagattttgggatac

SEQ ID NO: 258681 - DNA, 39 bp, Artificial Sequence
  Description of Artificial Sequence: Synthetic oligonucleotide
aagtccattggattctgtggcagaaagattttgggatac

SEQ ID NO: 258682 - DNA, 38 bp, Artificial Sequence
  Description of Artificial Sequence: Synthetic oligonucleotide
agtccattggattctgtggcagaaagattttgggatac

SEQ ID NO: 258683 - DNA, 37 bp, Artificial Sequence
  Description of Artificial Sequence: Synthetic oligonucleotide
gtccattggattctgtggcagaaagattttgggatac

SEQ ID NO: 258684 - DNA, 39 bp, Artificial Sequence
  Description of Artificial Sequence: Synthetic oligonucleotide
tccattggattctgtggcagaaagattttgggatactac

SEQ ID NO: 258685 - DNA, 38 bp, Artificial Sequence
  Description of Artificial Sequence: Synthetic oligonucleotide
ccattggattctgtggcagaaagattttgggatactac

SEQ ID NO: 258686 - DNA, 43 bp, Artificial Sequence
  Description of Artificial Sequence: Synthetic oligonucleotide
cattggattctgtggcagaaagattttgggatactactaaaag

SEQ ID NO: 258687 - DNA, 43 bp, Artificial Sequence
  Description of Artificial Sequence: Synthetic oligonucleotide
attggattctgtggcagaaagattttgggatactactaaaagg

SEQ ID NO: 258688 - DNA, 42 bp, Artificial Sequence
  Description of Artificial Sequence: Synthetic oligonucleotide
ttggattctgtggcagaaagattttgggatactactaaaagg

SEQ ID NO: 258689 - DNA, 41 bp, Artificial Sequence
  Description of Artificial Sequence: Synthetic oligonucleotide
tggattctgtggcagaaagattttgggatactactaaaagg

SEQ ID NO: 258690 - DNA, 40 bp, Artificial Sequence
  Description of Artificial Sequence: Synthetic oligonucleotide
ggattctgtggcagaaagattttgggatactactaaaagg

SEQ ID NO: 258691 - DNA, 41 bp, Artificial Sequence
  Description of Artificial Sequence: Synthetic oligonucleotide
gattctgtggcagaaagattttgggatactactaaaaggac

SEQ ID NO: 258692 - DNA, 42 bp, Artificial Sequence
  Description of Artificial Sequence: Synthetic oligonucleotide
attctgtggcagaaagattttgggatactactaaaaggactg

SEQ ID NO: 258693 - DNA, 41 bp, Artificial Sequence
  Description of Artificial Sequence: Synthetic oligonucleotide
ttctgtggcagaaagattttgggatactactaaaaggactg

SEQ ID NO: 258694 - DNA, 40 bp, Artificial Sequence
  Description of Artificial Sequence: Synthetic oligonucleotide
tctgtggcagaaagattttgggatactactaaaaggactg

SEQ ID NO: 258695 - DNA, 39 bp, Artificial Sequence
  Description of Artificial Sequence: Synthetic oligonucleotide
ctgtggcagaaagattttgggatactactaaaaggactg

SEQ ID NO: 258696 - DNA, 41 bp, Artificial Sequence
  Description of Artificial Sequence: Synthetic oligonucleotide
tgtggcagaaagattttgggatactactaaaaggactgatc

SEQ ID NO: 258697 - DNA, 40 bp, Artificial Sequence
  Description of Artificial Sequence: Synthetic oligonucleotide
gtggcagaaagattttgggatactactaaaaggactgatc

SEQ ID NO: 258698 - DNA, 41 bp, Artificial Sequence
  Description of Artificial Sequence: Synthetic oligonucleotide
tggcagaaagattttgggatactactaaaaggactgatcac

SEQ ID NO: 258699 - DNA, 40 bp, Artificial Sequence
  Description of Artificial Sequence: Synthetic oligonucleotide
ggcagaaagattttgggatactactaaaaggactgatcac

SEQ ID NO: 258700 - DNA, 43 bp, Artificial Sequence
  Description of Artificial Sequence: Synthetic oligonucleotide
gcagaaagattttgggatactactaaaaggactgatcactttg

SEQ ID NO: 258701 - DNA, 44 bp, Artificial Sequence
  Description of Artificial Sequence: Synthetic oligonucleotide
cagaaagattttgggatactactaaaaggactgatcactttgac

SEQ ID NO: 258702 - DNA, 49 bp, Artificial Sequence
  Description of Artificial Sequence: Synthetic oligonucleotide
agaaagattttgggatactactaaaaggactgatcactttgacaaaaag

SEQ ID NO: 258703 - DNA, 48 bp, Artificial Sequence
  Description of Artificial Sequence: Synthetic oligonucleotide
gaaagattttgggatactactaaaaggactgatcactttgacaaaaag

SEQ ID NO: 258704 - DNA, 48 bp, Artificial Sequence
  Description of Artificial Sequence: Synthetic oligonucleotide
aaagattttgggatactactaaaaggactgatcactttgacaaaaagg

SEQ ID NO: 258705 - DNA, 47 bp, Artificial Sequence
  Description of Artificial Sequence: Synthetic oligonucleotide
aagattttgggatactactaaaaggactgatcactttgacaaaaagg

SEQ ID NO: 258706 - DNA, 46 bp, Artificial Sequence
  Description of Artificial Sequence: Synthetic oligonucleotide
agattttgggatactactaaaaggactgatcactttgacaaaaagg

SEQ ID NO: 258707 - DNA, 45 bp, Artificial Sequence
  Description of Artificial Sequence: Synthetic oligonucleotide
gattttgggatactactaaaaggactgatcactttgacaaaaagg

SEQ ID NO: 258708 - DNA, 49 bp, Artificial Sequence
  Description of Artificial Sequence: Synthetic oligonucleotide
attttgggatactactaaaaggactgatcactttgacaaaaaggttttg

SEQ ID NO: 258709 - DNA, 48 bp, Artificial Sequence
  Description of Artificial Sequence: Synthetic oligonucleotide
ttttgggatactactaaaaggactgatcactttgacaaaaaggttttg

SEQ ID NO: 258710 - DNA, 47 bp, Artificial Sequence
  Description of Artificial Sequence: Synthetic oligonucleotide
tttgggatactactaaaaggactgatcactttgacaaaaaggttttg

SEQ ID NO: 258711 - DNA, 46 bp, Artificial Sequence
  Description of Artificial Sequence: Synthetic oligonucleotide
ttgggatactactaaaaggactgatcactttgacaaaaaggttttg

SEQ ID NO: 258712 - DNA, 45 bp, Artificial Sequence
  Description of Artificial Sequence: Synthetic oligonucleotide
tgggatactactaaaaggactgatcactttgacaaaaaggttttg

SEQ ID NO: 258713 - DNA, 44 bp, Artificial Sequence
  Description of Artificial Sequence: Synthetic oligonucleotide
gggatactactaaaaggactgatcactttgacaaaaaggttttg

SEQ ID NO: 258714 - DNA, 45 bp, Artificial Sequence
  Description of Artificial Sequence: Synthetic oligonucleotide
ggatactactaaaaggactgatcactttgacaaaaaggttttgtc

SEQ ID NO: 258715 - DNA, 49 bp, Artificial Sequence
  Description of Artificial Sequence: Synthetic oligonucleotide
gatactactaaaaggactgatcactttgacaaaaaggttttgtcatttg

SEQ ID NO: 258716 - DNA, 49 bp, Artificial Sequence
  Description of Artificial Sequence: Synthetic oligonucleotide
atactactaaaaggactgatcactttgacaaaaaggttttgtcatttgc

SEQ ID NO: 258717 - DNA, 48 bp, Artificial Sequence
  Description of Artificial Sequence: Synthetic oligonucleotide
tactactaaaaggactgatcactttgacaaaaaggttttgtcatttgc

SEQ ID NO: 258718 - DNA, 47 bp, Artificial Sequence
  Description of Artificial Sequence: Synthetic oligonucleotide
actactaaaaggactgatcactttgacaaaaaggttttgtcatttgc

SEQ ID NO: 258719 - DNA, 46 bp, Artificial Sequence
  Description of Artificial Sequence: Synthetic oligonucleotide
ctactaaaaggactgatcactttgacaaaaaggttttgtcatttgc

SEQ ID NO: 258720 - DNA, 53 bp, Artificial Sequence
  Description of Artificial Sequence: Synthetic oligonucleotide
tactaaaaggactgatcactttgacaaaaaggttttgtcatttgcatttaaac

SEQ ID NO: 258721 - DNA, 52 bp, Artificial Sequence
  Description of Artificial Sequence: Synthetic oligonucleotide
actaaaaggactgatcactttgacaaaaaggttttgtcatttgcatttaaac

SEQ ID NO: 258722 - DNA, 51 bp, Artificial Sequence
  Description of Artificial Sequence: Synthetic oligonucleotide
ctaaaaggactgatcactttgacaaaaaggttttgtcatttgcatttaaac

SEQ ID NO: 258723 - DNA, 53 bp, Artificial Sequence
  Description of Artificial Sequence: Synthetic oligonucleotide
taaaaggactgatcactttgacaaaaaggttttgtcatttgcatttaaacatg

SEQ ID NO: 258724 - DNA, 52 bp, Artificial Sequence
  Description of Artificial Sequence: Synthetic oligonucleotide
aaaaggactgatcactttgacaaaaaggttttgtcatttgcatttaaacatg

SEQ ID NO: 258725 - DNA, 51 bp, Artificial Sequence
  Description of Artificial Sequence: Synthetic oligonucleotide
aaaggactgatcactttgacaaaaaggttttgtcatttgcatttaaacatg

SEQ ID NO: 258726 - DNA, 50 bp, Artificial Sequence
  Description of Artificial Sequence: Synthetic oligonucleotide
aaggactgatcactttgacaaaaaggttttgtcatttgcatttaaacatg

SEQ ID NO: 258727 - DNA, 49 bp, Artificial Sequence
  Description of Artificial Sequence: Synthetic oligonucleotide
aggactgatcactttgacaaaaaggttttgtcatttgcatttaaacatg

SEQ ID NO: 258728 - DNA, 48 bp, Artificial Sequence
  Description of Artificial Sequence: Synthetic oligonucleotide
ggactgatcactttgacaaaaaggttttgtcatttgcatttaaacatg

SEQ ID NO: 258729 - DNA, 48 bp, Artificial Sequence
  Description of Artificial Sequence: Synthetic oligonucleotide
gactgatcactttgacaaaaaggttttgtcatttgcatttaaacatgc

SEQ ID NO: 258730 - DNA, 52 bp, Artificial Sequence
  Description of Artificial Sequence: Synthetic oligonucleotide
actgatcactttgacaaaaaggttttgtcatttgcatttaaacatgctttag

SEQ ID NO: 258731 - DNA, 51 bp, Artificial Sequence
  Description of Artificial Sequence: Synthetic oligonucleotide
ctgatcactttgacaaaaaggttttgtcatttgcatttaaacatgctttag

SEQ ID NO: 258732 - DNA, 60 bp, Artificial Sequence
  Description of Artificial Sequence: Synthetic oligonucleotide
tgatcactttgacaaaaaggttttgtcatttgcatttaaacatgctttagtaaattaaat

SEQ ID NO: 258733 - DNA, 60 bp, Artificial Sequence
  Description of Artificial Sequence: Synthetic oligonucleotide
gatcactttgacaaaaaggttttgtcatttgcatttaaacatgctttagtaaattaaatg

SEQ ID NO: 258734 - DNA, 60 bp, Artificial Sequence
  Description of Artificial Sequence: Synthetic oligonucleotide
atcactttgacaaaaaggttttgtcatttgcatttaaacatgctttagtaaattaaatgt

SEQ ID NO: 258735 - DNA, 60 bp, Artificial Sequence
  Description of Artificial Sequence: Synthetic oligonucleotide
tcactttgacaaaaaggttttgtcatttgcatttaaacatgctttagtaaattaaatgta

SEQ ID NO: 258736 - DNA, 60 bp, Artificial Sequence
  Description of Artificial Sequence: Synthetic oligonucleotide
cactttgacaaaaaggttttgtcatttgcatttaaacatgctttagtaaattaaatgtat

SEQ ID NO: 258737 - DNA, 60 bp, Artificial Sequence
  Description of Artificial Sequence: Synthetic oligonucleotide
actttgacaaaaaggttttgtcatttgcatttaaacatgctttagtaaattaaatgtatg

SEQ ID NO: 258738 - DNA, 60 bp, Artificial Sequence
  Description of Artificial Sequence: Synthetic oligonucleotide
ctttgacaaaaaggttttgtcatttgcatttaaacatgctttagtaaattaaatgtatgc

SEQ ID NO: 258739 - DNA, 60 bp, Artificial Sequence
  Description of Artificial Sequence: Synthetic oligonucleotide
tttgacaaaaaggttttgtcatttgcatttaaacatgctttagtaaattaaatgtatgcg

SEQ ID NO: 258740 - DNA, 59 bp, Artificial Sequence
  Description of Artificial Sequence: Synthetic oligonucleotide
ttgacaaaaaggttttgtcatttgcatttaaacatgctttagtaaattaaatgtatgcg

SEQ ID NO: 258741 - DNA, 58 bp, Artificial Sequence
  Description of Artificial Sequence: Synthetic oligonucleotide
tgacaaaaaggttttgtcatttgcatttaaacatgctttagtaaattaaatgtatgcg

SEQ ID NO: 258742 - DNA, 57 bp, Artificial Sequence
  Description of Artificial Sequence: Synthetic oligonucleotide
gacaaaaaggttttgtcatttgcatttaaacatgctttagtaaattaaatgtatgcg

SEQ ID NO: 258743 - DNA, 58 bp, Artificial Sequence
  Description of Artificial Sequence: Synthetic oligonucleotide
acaaaaaggttttgtcatttgcatttaaacatgctttagtaaattaaatgtatgcgag

SEQ ID NO: 258744 - DNA, 57 bp, Artificial Sequence
  Description of Artificial Sequence: Synthetic oligonucleotide
caaaaaggttttgtcatttgcatttaaacatgctttagtaaattaaatgtatgcgag

SEQ ID NO: 258745 - DNA, 58 bp, Artificial Sequence
  Description of Artificial Sequence: Synthetic oligonucleotide
aaaaaggttttgtcatttgcatttaaacatgctttagtaaattaaatgtatgcgagag

SEQ ID NO: 258746 - DNA, 57 bp, Artificial Sequence
  Description of Artificial Sequence: Synthetic oligonucleotide
aaaaggttttgtcatttgcatttaaacatgctttagtaaattaaatgtatgcgagag

SEQ ID NO: 258747 - DNA, 56 bp, Artificial Sequence
  Description of Artificial Sequence: Synthetic oligonucleotide
aaaggttttgtcatttgcatttaaacatgctttagtaaattaaatgtatgcgagag

SEQ ID NO: 258748 - DNA, 55 bp, Artificial Sequence
  Description of Artificial Sequence: Synthetic oligonucleotide
aaggttttgtcatttgcatttaaacatgctttagtaaattaaatgtatgcgagag

SEQ ID NO: 258749 - DNA, 54 bp, Artificial Sequence
  Description of Artificial Sequence: Synthetic oligonucleotide
aggttttgtcatttgcatttaaacatgctttagtaaattaaatgtatgcgagag

SEQ ID NO: 258750 - DNA, 53 bp, Artificial Sequence
  Description of Artificial Sequence: Synthetic oligonucleotide
ggttttgtcatttgcatttaaacatgctttagtaaattaaatgtatgcgagag

SEQ ID NO: 258751 - DNA, 53 bp, Artificial Sequence
  Description of Artificial Sequence: Synthetic oligonucleotide
gttttgtcatttgcatttaaacatgctttagtaaattaaatgtatgcgagagg

SEQ ID NO: 258752 - DNA, 53 bp, Artificial Sequence
  Description of Artificial Sequence: Synthetic oligonucleotide
ttttgtcatttgcatttaaacatgctttagtaaattaaatgtatgcgagaggc

SEQ ID NO: 258753 - DNA, 52 bp, Artificial Sequence
  Description of Artificial Sequence: Synthetic oligonucleotide
tttgtcatttgcatttaaacatgctttagtaaattaaatgtatgcgagaggc

SEQ ID NO: 258754 - DNA, 51 bp, Artificial Sequence
  Description of Artificial Sequence: Synthetic oligonucleotide
ttgtcatttgcatttaaacatgctttagtaaattaaatgtatgcgagaggc

SEQ ID NO: 258755 - DNA, 50 bp, Artificial Sequence
  Description of Artificial Sequence: Synthetic oligonucleotide
tgtcatttgcatttaaacatgctttagtaaattaaatgtatgcgagaggc

SEQ ID NO: 258756 - DNA, 49 bp, Artificial Sequence
  Description of Artificial Sequence: Synthetic oligonucleotide
gtcatttgcatttaaacatgctttagtaaattaaatgtatgcgagaggc

SEQ ID NO: 258757 - DNA, 49 bp, Artificial Sequence
  Description of Artificial Sequence: Synthetic oligonucleotide
tcatttgcatttaaacatgctttagtaaattaaatgtatgcgagaggcc

SEQ ID NO: 258758 - DNA, 48 bp, Artificial Sequence
  Description of Artificial Sequence: Synthetic oligonucleotide
catttgcatttaaacatgctttagtaaattaaatgtatgcgagaggcc

SEQ ID NO: 258759 - DNA, 56 bp, Artificial Sequence
  Description of Artificial Sequence: Synthetic oligonucleotide
atttgcatttaaacatgctttagtaaattaaatgtatgcgagaggcctaaaatttg

SEQ ID NO: 258760 - DNA, 55 bp, Artificial Sequence
  Description of Artificial Sequence: Synthetic oligonucleotide
tttgcatttaaacatgctttagtaaattaaatgtatgcgagaggcctaaaatttg

SEQ ID NO: 258761 - DNA, 54 bp, Artificial Sequence
  Description of Artificial Sequence: Synthetic oligonucleotide
ttgcatttaaacatgctttagtaaattaaatgtatgcgagaggcctaaaatttg

SEQ ID NO: 258762 - DNA, 53 bp, Artificial Sequence
  Description of Artificial Sequence: Synthetic oligonucleotide
tgcatttaaacatgctttagtaaattaaatgtatgcgagaggcctaaaatttg

SEQ ID NO: 258763 - DNA, 52 bp, Artificial Sequence
  Description of Artificial Sequence: Synthetic oligonucleotide
gcatttaaacatgctttagtaaattaaatgtatgcgagaggcctaaaatttg

SEQ ID NO: 258764 - DNA, 52 bp, Artificial Sequence
  Description of Artificial Sequence: Synthetic oligonucleotide
catttaaacatgctttagtaaattaaatgtatgcgagaggcctaaaatttgc

SEQ ID NO: 258765 - DNA, 54 bp, Artificial Sequence
  Description of Artificial Sequence: Synthetic oligonucleotide
atttaaacatgctttagtaaattaaatgtatgcgagaggcctaaaatttgcatc

SEQ ID NO: 258766 - DNA, 53 bp, Artificial Sequence
  Description of Artificial Sequence: Synthetic oligonucleotide
tttaaacatgctttagtaaattaaatgtatgcgagaggcctaaaatttgcatc

SEQ ID NO: 258767 - DNA, 52 bp, Artificial Sequence
  Description of Artificial Sequence: Synthetic oligonucleotide
ttaaacatgctttagtaaattaaatgtatgcgagaggcctaaaatttgcatc

SEQ ID NO: 258768 - DNA, 51 bp, Artificial Sequence
  Description of Artificial Sequence: Synthetic oligonucleotide
taaacatgctttagtaaattaaatgtatgcgagaggcctaaaatttgcatc

SEQ ID NO: 258769 - DNA, 50 bp, Artificial Sequence
  Description of Artificial Sequence: Synthetic oligonucleotide
aaacatgctttagtaaattaaatgtatgcgagaggcctaaaatttgcatc

SEQ ID NO: 258770 - DNA, 49 bp, Artificial Sequence
  Description of Artificial Sequence: Synthetic oligonucleotide
aacatgctttagtaaattaaatgtatgcgagaggcctaaaatttgcatc

SEQ ID NO: 258771 - DNA, 48 bp, Artificial Sequence
  Description of Artificial Sequence: Synthetic oligonucleotide
acatgctttagtaaattaaatgtatgcgagaggcctaaaatttgcatc

SEQ ID NO: 258772 - DNA, 47 bp, Artificial Sequence
  Description of Artificial Sequence: Synthetic oligonucleotide
catgctttagtaaattaaatgtatgcgagaggcctaaaatttgcatc

SEQ ID NO: 258773 - DNA, 51 bp, Artificial Sequence
  Description of Artificial Sequence: Synthetic oligonucleotide
atgctttagtaaattaaatgtatgcgagaggcctaaaatttgcatctaaac

SEQ ID NO: 258774 - DNA, 50 bp, Artificial Sequence
  Description of Artificial Sequence: Synthetic oligonucleotide
tgctttagtaaattaaatgtatgcgagaggcctaaaatttgcatctaaac

SEQ ID NO: 258775 - DNA, 49 bp, Artificial Sequence
  Description of Artificial Sequence: Synthetic oligonucleotide
gctttagtaaattaaatgtatgcgagaggcctaaaatttgcatctaaac

SEQ ID NO: 258776 - DNA, 51 bp, Artificial Sequence
  Description of Artificial Sequence: Synthetic oligonucleotide
ctttagtaaattaaatgtatgcgagaggcctaaaatttgcatctaaacttg

SEQ ID NO: 258777 - DNA, 52 bp, Artificial Sequence
  Description of Artificial Sequence: Synthetic oligonucleotide
tttagtaaattaaatgtatgcgagaggcctaaaatttgcatctaaacttgag

SEQ ID NO: 258778 - DNA, 51 bp, Artificial Sequence
  Description of Artificial Sequence: Synthetic oligonucleotide
ttagtaaattaaatgtatgcgagaggcctaaaatttgcatctaaacttgag

SEQ ID NO: 258779 - DNA, 50 bp, Artificial Sequence
  Description of Artificial Sequence: Synthetic oligonucleotide
tagtaaattaaatgtatgcgagaggcctaaaatttgcatctaaacttgag

SEQ ID NO: 258780 - DNA, 49 bp, Artificial Sequence
  Description of Artificial Sequence: Synthetic oligonucleotide
agtaaattaaatgtatgcgagaggcctaaaatttgcatctaaacttgag

SEQ ID NO: 258781 - DNA, 48 bp, Artificial Sequence
  Description of Artificial Sequence: Synthetic oligonucleotide
gtaaattaaatgtatgcgagaggcctaaaatttgcatctaaacttgag

SEQ ID NO: 258782 - DNA, 48 bp, Artificial Sequence
  Description of Artificial Sequence: Synthetic oligonucleotide
taaattaaatgtatgcgagaggcctaaaatttgcatctaaacttgagg

SEQ ID NO: 258783 - DNA, 47 bp, Artificial Sequence
  Description of Artificial Sequence: Synthetic oligonucleotide
aaattaaatgtatgcgagaggcctaaaatttgcatctaaacttgagg

SEQ ID NO: 258784 - DNA, 46 bp, Artificial Sequence
  Description of Artificial Sequence: Synthetic oligonucleotide
aattaaatgtatgcgagaggcctaaaatttgcatctaaacttgagg

SEQ ID NO: 258785 - DNA, 45 bp, Artificial Sequence
  Description of Artificial Sequence: Synthetic oligonucleotide
attaaatgtatgcgagaggcctaaaatttgcatctaaacttgagg

SEQ ID NO: 258786 - DNA, 44 bp, Artificial Sequence
  Description of Artificial Sequence: Synthetic oligonucleotide
ttaaatgtatgcgagaggcctaaaatttgcatctaaacttgagg

SEQ ID NO: 258787 - DNA, 43 bp, Artificial Sequence
  Description of Artificial Sequence: Synthetic oligonucleotide
taaatgtatgcgagaggcctaaaatttgcatctaaacttgagg

SEQ ID NO: 258788 - DNA, 42 bp, Artificial Sequence
  Description of Artificial Sequence: Synthetic oligonucleotide
aaatgtatgcgagaggcctaaaatttgcatctaaacttgagg

SEQ ID NO: 258789 - DNA, 41 bp, Artificial Sequence
  Description of Artificial Sequence: Synthetic oligonucleotide
aatgtatgcgagaggcctaaaatttgcatctaaacttgagg

SEQ ID NO: 258790 - DNA, 40 bp, Artificial Sequence
  Description of Artificial Sequence: Synthetic oligonucleotide
atgtatgcgagaggcctaaaatttgcatctaaacttgagg

SEQ ID NO: 258791 - DNA, 39 bp, Artificial Sequence
  Description of Artificial Sequence: Synthetic oligonucleotide
tgtatgcgagaggcctaaaatttgcatctaaacttgagg

SEQ ID NO: 258792 - DNA, 38 bp, Artificial Sequence
  Description of Artificial Sequence: Synthetic oligonucleotide
gtatgcgagaggcctaaaatttgcatctaaacttgagg

SEQ ID NO: 258793 - DNA, 40 bp, Artificial Sequence
  Description of Artificial Sequence: Synthetic oligonucleotide
tatgcgagaggcctaaaatttgcatctaaacttgaggaag

SEQ ID NO: 258794 - DNA, 39 bp, Artificial Sequence
  Description of Artificial Sequence: Synthetic oligonucleotide
atgcgagaggcctaaaatttgcatctaaacttgaggaag

SEQ ID NO: 258795 - DNA, 38 bp, Artificial Sequence
  Description of Artificial Sequence: Synthetic oligonucleotide
tgcgagaggcctaaaatttgcatctaaacttgaggaag

SEQ ID NO: 258796 - DNA, 37 bp, Artificial Sequence
  Description of Artificial Sequence: Synthetic oligonucleotide
gcgagaggcctaaaatttgcatctaaacttgaggaag

SEQ ID NO: 258797 - DNA, 42 bp, Artificial Sequence
  Description of Artificial Sequence: Synthetic oligonucleotide
cgagaggcctaaaatttgcatctaaacttgaggaagaaaatc

SEQ ID NO: 258798 - DNA, 42 bp, Artificial Sequence
  Description of Artificial Sequence: Synthetic oligonucleotide
gagaggcctaaaatttgcatctaaacttgaggaagaaaatcc

SEQ ID NO: 258799 - DNA, 44 bp, Artificial Sequence
  Description of Artificial Sequence: Synthetic oligonucleotide
agaggcctaaaatttgcatctaaacttgaggaagaaaatccaac

SEQ ID NO: 258800 - DNA, 43 bp, Artificial Sequence
  Description of Artificial Sequence: Synthetic oligonucleotide
gaggcctaaaatttgcatctaaacttgaggaagaaaatccaac

SEQ ID NO: 258801 - DNA, 47 bp, Artificial Sequence
  Description of Artificial Sequence: Synthetic oligonucleotide
aggcctaaaatttgcatctaaacttgaggaagaaaatccaacaaaac

SEQ ID NO: 258802 - DNA, 46 bp, Artificial Sequence
  Description of Artificial Sequence: Synthetic oligonucleotide
ggcctaaaatttgcatctaaacttgaggaagaaaatccaacaaaac

SEQ ID NO: 258803 - DNA, 50 bp, Artificial Sequence
  Description of Artificial Sequence: Synthetic oligonucleotide
gcctaaaatttgcatctaaacttgaggaagaaaatccaacaaaacaaaac

SEQ ID NO: 258804 - DNA, 51 bp, Artificial Sequence
  Description of Artificial Sequence: Synthetic oligonucleotide
cctaaaatttgcatctaaacttgaggaagaaaatccaacaaaacaaaactg

SEQ ID NO: 258805 - DNA, 51 bp, Artificial Sequence
  Description of Artificial Sequence: Synthetic oligonucleotide
ctaaaatttgcatctaaacttgaggaagaaaatccaacaaaacaaaactgg

SEQ ID NO: 258806 - DNA, 58 bp, Artificial Sequence
  Description of Artificial Sequence: Synthetic oligonucleotide
taaaatttgcatctaaacttgaggaagaaaatccaacaaaacaaaactggataaattg

SEQ ID NO: 258807 - DNA, 57 bp, Artificial Sequence
  Description of Artificial Sequence: Synthetic oligonucleotide
aaaatttgcatctaaacttgaggaagaaaatccaacaaaacaaaactggataaattg

SEQ ID NO: 258808 - DNA, 56 bp, Artificial Sequence
  Description of Artificial Sequence: Synthetic oligonucleotide
aaatttgcatctaaacttgaggaagaaaatccaacaaaacaaaactggataaattg

SEQ ID NO: 258809 - DNA, 55 bp, Artificial Sequence
  Description of Artificial Sequence: Synthetic oligonucleotide
aatttgcatctaaacttgaggaagaaaatccaacaaaacaaaactggataaattg

SEQ ID NO: 258810 - DNA, 54 bp, Artificial Sequence
  Description of Artificial Sequence: Synthetic oligonucleotide
atttgcatctaaacttgaggaagaaaatccaacaaaacaaaactggataaattg

SEQ ID NO: 258811 - DNA, 53 bp, Artificial Sequence
  Description of Artificial Sequence: Synthetic oligonucleotide
tttgcatctaaacttgaggaagaaaatccaacaaaacaaaactggataaattg

SEQ ID NO: 258812 - DNA, 52 bp, Artificial Sequence
  Description of Artificial Sequence: Synthetic oligonucleotide
ttgcatctaaacttgaggaagaaaatccaacaaaacaaaactggataaattg

SEQ ID NO: 258813 - DNA, 51 bp, Artificial Sequence
  Description of Artificial Sequence: Synthetic oligonucleotide
tgcatctaaacttgaggaagaaaatccaacaaaacaaaactggataaattg

SEQ ID NO: 258814 - DNA, 50 bp, Artificial Sequence
  Description of Artificial Sequence: Synthetic oligonucleotide
gcatctaaacttgaggaagaaaatccaacaaaacaaaactggataaattg

SEQ ID NO: 258815 - DNA, 54 bp, Artificial Sequence
  Description of Artificial Sequence: Synthetic oligonucleotide
catctaaacttgaggaagaaaatccaacaaaacaaaactggataaattgtatac

SEQ ID NO: 258816 - DNA, 56 bp, Artificial Sequence
  Description of Artificial Sequence: Synthetic oligonucleotide
atctaaacttgaggaagaaaatccaacaaaacaaaactggataaattgtatacaac

SEQ ID NO: 258817 - DNA, 55 bp, Artificial Sequence
  Description of Artificial Sequence: Synthetic oligonucleotide
tctaaacttgaggaagaaaatccaacaaaacaaaactggataaattgtatacaac

SEQ ID NO: 258818 - DNA, 54 bp, Artificial Sequence
  Description of Artificial Sequence: Synthetic oligonucleotide
ctaaacttgaggaagaaaatccaacaaaacaaaactggataaattgtatacaac

SEQ ID NO: 258819 - DNA, 55 bp, Artificial Sequence
  Description of Artificial Sequence: Synthetic oligonucleotide
taaacttgaggaagaaaatccaacaaaacaaaactggataaattgtatacaactg

SEQ ID NO: 258820 - DNA, 54 bp, Artificial Sequence
  Description of Artificial Sequence: Synthetic oligonucleotide
aaacttgaggaagaaaatccaacaaaacaaaactggataaattgtatacaactg

SEQ ID NO: 258821 - DNA, 53 bp, Artificial Sequence
  Description of Artificial Sequence: Synthetic oligonucleotide
aacttgaggaagaaaatccaacaaaacaaaactggataaattgtatacaactg

SEQ ID NO: 258822 - DNA, 52 bp, Artificial Sequence
  Description of Artificial Sequence: Synthetic oligonucleotide
acttgaggaagaaaatccaacaaaacaaaactggataaattgtatacaactg

SEQ ID NO: 258823 - DNA, 51 bp, Artificial Sequence
  Description of Artificial Sequence: Synthetic oligonucleotide
cttgaggaagaaaatccaacaaaacaaaactggataaattgtatacaactg

SEQ ID NO: 258824 - DNA, 53 bp, Artificial Sequence
  Description of Artificial Sequence: Synthetic oligonucleotide
ttgaggaagaaaatccaacaaaacaaaactggataaattgtatacaactgatg

SEQ ID NO: 258825 - DNA, 52 bp, Artificial Sequence
  Description of Artificial Sequence: Synthetic oligonucleotide
tgaggaagaaaatccaacaaaacaaaactggataaattgtatacaactgatg

SEQ ID NO: 258826 - DNA, 51 bp, Artificial Sequence
  Description of Artificial Sequence: Synthetic oligonucleotide
gaggaagaaaatccaacaaaacaaaactggataaattgtatacaactgatg

SEQ ID NO: 258827 - DNA, 53 bp, Artificial Sequence
  Description of Artificial Sequence: Synthetic oligonucleotide
aggaagaaaatccaacaaaacaaaactggataaattgtatacaactgatgtag

SEQ ID NO: 258828 - DNA, 52 bp, Artificial Sequence
  Description of Artificial Sequence: Synthetic oligonucleotide
ggaagaaaatccaacaaaacaaaactggataaattgtatacaactgatgtag

SEQ ID NO: 258829 - DNA, 55 bp, Artificial Sequence
  Description of Artificial Sequence: Synthetic oligonucleotide
gaagaaaatccaacaaaacaaaactggataaattgtatacaactgatgtagttac

SEQ ID NO: 258830 - DNA, 57 bp, Artificial Sequence
  Description of Artificial Sequence: Synthetic oligonucleotide
aagaaaatccaacaaaacaaaactggataaattgtatacaactgatgtagttacttg

SEQ ID NO: 258831 - DNA, 56 bp, Artificial Sequence
  Description of Artificial Sequence: Synthetic oligonucleotide
agaaaatccaacaaaacaaaactggataaattgtatacaactgatgtagttacttg

SEQ ID NO: 258832 - DNA, 55 bp, Artificial Sequence
  Description of Artificial Sequence: Synthetic oligonucleotide
gaaaatccaacaaaacaaaactggataaattgtatacaactgatgtagttacttg

SEQ ID NO: 258833 - DNA, 55 bp, Artificial Sequence
  Description of Artificial Sequence: Synthetic oligonucleotide
aaaatccaacaaaacaaaactggataaattgtatacaactgatgtagttacttgc

SEQ ID NO: 258834 - DNA, 54 bp, Artificial Sequence
  Description of Artificial Sequence: Synthetic oligonucleotide
aaatccaacaaaacaaaactggataaattgtatacaactgatgtagttacttgc

SEQ ID NO: 258835 - DNA, 53 bp, Artificial Sequence
  Description of Artificial Sequence: Synthetic oligonucleotide
aatccaacaaaacaaaactggataaattgtatacaactgatgtagttacttgc

SEQ ID NO: 258836 - DNA, 52 bp, Artificial Sequence
  Description of Artificial Sequence: Synthetic oligonucleotide
atccaacaaaacaaaactggataaattgtatacaactgatgtagttacttgc

SEQ ID NO: 258837 - DNA, 51 bp, Artificial Sequence
  Description of Artificial Sequence: Synthetic oligonucleotide
tccaacaaaacaaaactggataaattgtatacaactgatgtagttacttgc

SEQ ID NO: 258838 - DNA, 50 bp, Artificial Sequence
  Description of Artificial Sequence: Synthetic oligonucleotide
ccaacaaaacaaaactggataaattgtatacaactgatgtagttacttgc

SEQ ID NO: 258839 - DNA, 52 bp, Artificial Sequence
  Description of Artificial Sequence: Synthetic oligonucleotide
caacaaaacaaaactggataaattgtatacaactgatgtagttacttgcatg

SEQ ID NO: 258840 - DNA, 52 bp, Artificial Sequence
  Description of Artificial Sequence: Synthetic oligonucleotide
aacaaaacaaaactggataaattgtatacaactgatgtagttacttgcatgg

SEQ ID NO: 258841 - DNA, 51 bp, Artificial Sequence
  Description of Artificial Sequence: Synthetic oligonucleotide
acaaaacaaaactggataaattgtatacaactgatgtagttacttgcatgg

SEQ ID NO: 258842 - DNA, 50 bp, Artificial Sequence
  Description of Artificial Sequence: Synthetic oligonucleotide
caaaacaaaactggataaattgtatacaactgatgtagttacttgcatgg

SEQ ID NO: 258843 - DNA, 51 bp, Artificial Sequence
  Description of Artificial Sequence: Synthetic oligonucleotide
aaaacaaaactggataaattgtatacaactgatgtagttacttgcatggac

SEQ ID NO: 258844 - DNA, 50 bp, Artificial Sequence
  Description of Artificial Sequence: Synthetic oligonucleotide
aaacaaaactggataaattgtatacaactgatgtagttacttgcatggac

SEQ ID NO: 258845 - DNA, 49 bp, Artificial Sequence
  Description of Artificial Sequence: Synthetic oligonucleotide
aacaaaactggataaattgtatacaactgatgtagttacttgcatggac

SEQ ID NO: 258846 - DNA, 48 bp, Artificial Sequence
  Description of Artificial Sequence: Synthetic oligonucleotide
acaaaactggataaattgtatacaactgatgtagttacttgcatggac

SEQ ID NO: 258847 - DNA, 47 bp, Artificial Sequence
  Description of Artificial Sequence: Synthetic oligonucleotide
caaaactggataaattgtatacaactgatgtagttacttgcatggac

SEQ ID NO: 258848 - DNA, 47 bp, Artificial Sequence
  Description of Artificial Sequence: Synthetic oligonucleotide
aaaactggataaattgtatacaactgatgtagttacttgcatggacc

SEQ ID NO: 258849 - DNA, 46 bp, Artificial Sequence
  Description of Artificial Sequence: Synthetic oligonucleotide
aaactggataaattgtatacaactgatgtagttacttgcatggacc

SEQ ID NO: 258850 - DNA, 45 bp, Artificial Sequence
  Description of Artificial Sequence: Synthetic oligonucleotide
aactggataaattgtatacaactgatgtagttacttgcatggacc

SEQ ID NO: 258851 - DNA, 44 bp, Artificial Sequence
  Description of Artificial Sequence: Synthetic oligonucleotide
actggataaattgtatacaactgatgtagttacttgcatggacc

SEQ ID NO: 258852 - DNA, 43 bp, Artificial Sequence
  Description of Artificial Sequence: Synthetic oligonucleotide
ctggataaattgtatacaactgatgtagttacttgcatggacc

SEQ ID NO: 258853 - DNA, 43 bp, Artificial Sequence
  Description of Artificial Sequence: Synthetic oligonucleotide
tggataaattgtatacaactgatgtagttacttgcatggaccc

SEQ ID NO: 258854 - DNA, 42 bp, Artificial Sequence
  Description of Artificial Sequence: Synthetic oligonucleotide
ggataaattgtatacaactgatgtagttacttgcatggaccc

SEQ ID NO: 258855 - DNA, 45 bp, Artificial Sequence
  Description of Artificial Sequence: Synthetic oligonucleotide
gataaattgtatacaactgatgtagttacttgcatggacccaatg

SEQ ID NO: 258856 - DNA, 46 bp, Artificial Sequence
  Description of Artificial Sequence: Synthetic oligonucleotide
ataaattgtatacaactgatgtagttacttgcatggacccaatgtg

SEQ ID NO: 258857 - DNA, 45 bp, Artificial Sequence
  Description of Artificial Sequence: Synthetic oligonucleotide
taaattgtatacaactgatgtagttacttgcatggacccaatgtg

SEQ ID NO: 258858 - DNA, 44 bp, Artificial Sequence
  Description of Artificial Sequence: Synthetic oligonucleotide
aaattgtatacaactgatgtagttacttgcatggacccaatgtg

SEQ ID NO: 258859 - DNA, 43 bp, Artificial Sequence
  Description of Artificial Sequence: Synthetic oligonucleotide
aattgtatacaactgatgtagttacttgcatggacccaatgtg

SEQ ID NO: 258860 - DNA, 42 bp, Artificial Sequence
  Description of Artificial Sequence: Synthetic oligonucleotide
attgtatacaactgatgtagttacttgcatggacccaatgtg

SEQ ID NO: 258861 - DNA, 41 bp, Artificial Sequence
  Description of Artificial Sequence: Synthetic oligonucleotide
ttgtatacaactgatgtagttacttgcatggacccaatgtg

SEQ ID NO: 258862 - DNA, 40 bp, Artificial Sequence
  Description of Artificial Sequence: Synthetic oligonucleotide
tgtatacaactgatgtagttacttgcatggacccaatgtg

SEQ ID NO: 258863 - DNA, 39 bp, Artificial Sequence
  Description of Artificial Sequence: Synthetic oligonucleotide
gtatacaactgatgtagttacttgcatggacccaatgtg

SEQ ID NO: 258864 - DNA, 39 bp, Artificial Sequence
  Description of Artificial Sequence: Synthetic oligonucleotide
tatacaactgatgtagttacttgcatggacccaatgtgc

SEQ ID NO: 258865 - DNA, 38 bp, Artificial Sequence
  Description of Artificial Sequence: Synthetic oligonucleotide
atacaactgatgtagttacttgcatggacccaatgtgc

SEQ ID NO: 258866 - DNA, 37 bp, Artificial Sequence
  Description of Artificial Sequence: Synthetic oligonucleotide
tacaactgatgtagttacttgcatggacccaatgtgc

SEQ ID NO: 258867 - DNA, 36 bp, Artificial Sequence
  Description of Artificial Sequence: Synthetic oligonucleotide
acaactgatgtagttacttgcatggacccaatgtgc

SEQ ID NO: 258868 - DNA, 35 bp, Artificial Sequence
  Description of Artificial Sequence: Synthetic oligonucleotide
caactgatgtagttacttgcatggacccaatgtgc

SEQ ID NO: 258869 - DNA, 37 bp, Artificial Sequence
  Description of Artificial Sequence: Synthetic oligonucleotide
aactgatgtagttacttgcatggacccaatgtgcatc

SEQ ID NO: 258870 - DNA, 36 bp, Artificial Sequence
  Description of Artificial Sequence: Synthetic oligonucleotide
actgatgtagttacttgcatggacccaatgtgcatc

SEQ ID NO: 258871 - DNA, 35 bp, Artificial Sequence
  Description of Artificial Sequence: Synthetic oligonucleotide
ctgatgtagttacttgcatggacccaatgtgcatc

SEQ ID NO: 258872 - DNA, 40 bp, Artificial Sequence
  Description of Artificial Sequence: Synthetic oligonucleotide
tgatgtagttacttgcatggacccaatgtgcatctattac

SEQ ID NO: 258873 - DNA, 39 bp, Artificial Sequence
  Description of Artificial Sequence: Synthetic oligonucleotide
gatgtagttacttgcatggacccaatgtgcatctattac

SEQ ID NO: 258874 - DNA, 40 bp, Artificial Sequence
  Description of Artificial Sequence: Synthetic oligonucleotide
atgtagttacttgcatggacccaatgtgcatctattactg

SEQ ID NO: 258875 - DNA, 39 bp, Artificial Sequence
  Description of Artificial Sequence: Synthetic oligonucleotide
tgtagttacttgcatggacccaatgtgcatctattactg

SEQ ID NO: 258876 - DNA, 38 bp, Artificial Sequence
  Description of Artificial Sequence: Synthetic oligonucleotide
gtagttacttgcatggacccaatgtgcatctattactg

SEQ ID NO: 258877 - DNA, 42 bp, Artificial Sequence
  Description of Artificial Sequence: Synthetic oligonucleotide
tagttacttgcatggacccaatgtgcatctattactgaaatc

SEQ ID NO: 258878 - DNA, 41 bp, Artificial Sequence
  Description of Artificial Sequence: Synthetic oligonucleotide
agttacttgcatggacccaatgtgcatctattactgaaatc

SEQ ID NO: 258879 - DNA, 40 bp, Artificial Sequence
  Description of Artificial Sequence: Synthetic oligonucleotide
gttacttgcatggacccaatgtgcatctattactgaaatc

SEQ ID NO: 258880 - DNA, 41 bp, Artificial Sequence
  Description of Artificial Sequence: Synthetic oligonucleotide
ttacttgcatggacccaatgtgcatctattactgaaatctg

SEQ ID NO: 258881 - DNA, 40 bp, Artificial Sequence
  Description of Artificial Sequence: Synthetic oligonucleotide
tacttgcatggacccaatgtgcatctattactgaaatctg

SEQ ID NO: 258882 - DNA, 39 bp, Artificial Sequence
  Description of Artificial Sequence: Synthetic oligonucleotide
acttgcatggacccaatgtgcatctattactgaaatctg

SEQ ID NO: 258883 - DNA, 38 bp, Artificial Sequence
  Description of Artificial Sequence: Synthetic oligonucleotide
cttgcatggacccaatgtgcatctattactgaaatctg

SEQ ID NO: 258884 - DNA, 38 bp, Artificial Sequence
  Description of Artificial Sequence: Synthetic oligonucleotide
ttgcatggacccaatgtgcatctattactgaaatctgg

SEQ ID NO: 258885 - DNA, 37 bp, Artificial Sequence
  Description of Artificial Sequence: Synthetic oligonucleotide
tgcatggacccaatgtgcatctattactgaaatctgg

SEQ ID NO: 258886 - DNA, 36 bp, Artificial Sequence
  Description of Artificial Sequence: Synthetic oligonucleotide
gcatggacccaatgtgcatctattactgaaatctgg

SEQ ID NO: 258887 - DNA, 36 bp, Artificial Sequence
  Description of Artificial Sequence: Synthetic oligonucleotide
catggacccaatgtgcatctattactgaaatctggc

SEQ ID NO: 258888 - DNA, 37 bp, Artificial Sequence
  Description of Artificial Sequence: Synthetic oligonucleotide
atggacccaatgtgcatctattactgaaatctggctc

SEQ ID NO: 258889 - DNA, 36 bp, Artificial Sequence
  Description of Artificial Sequence: Synthetic oligonucleotide
tggacccaatgtgcatctattactgaaatctggctc

SEQ ID NO: 258890 - DNA, 35 bp, Artificial Sequence
  Description of Artificial Sequence: Synthetic oligonucleotide
ggacccaatgtgcatctattactgaaatctggctc

SEQ ID NO: 258891 - DNA, 35 bp, Artificial Sequence
  Description of Artificial Sequence: Synthetic oligonucleotide
gacccaatgtgcatctattactgaaatctggctcc

SEQ ID NO: 258892 - DNA, 35 bp, Artificial Sequence
  Description of Artificial Sequence: Synthetic oligonucleotide
acccaatgtgcatctattactgaaatctggctccc

SEQ ID NO: 258893 - DNA, 34 bp, Artificial Sequence
  Description of Artificial Sequence: Synthetic oligonucleotide
cccaatgtgcatctattactgaaatctggctccc

SEQ ID NO: 258894 - DNA, 34 bp, Artificial Sequence
  Description of Artificial Sequence: Synthetic oligonucleotide
ccaatgtgcatctattactgaaatctggctcccg

SEQ ID NO: 258895 - DNA, 36 bp, Artificial Sequence
  Description of Artificial Sequence: Synthetic oligonucleotide
caatgtgcatctattactgaaatctggctcccgatc

SEQ ID NO: 258896 - DNA, 38 bp, Artificial Sequence
  Description of Artificial Sequence: Synthetic oligonucleotide
aatgtgcatctattactgaaatctggctcccgatcatg

SEQ ID NO: 258897 - DNA, 37 bp, Artificial Sequence
  Description of Artificial Sequence: Synthetic oligonucleotide
atgtgcatctattactgaaatctggctcccgatcatg

SEQ ID NO: 258898 - DNA, 36 bp, Artificial Sequence
  Description of Artificial Sequence: Synthetic oligonucleotide
tgtgcatctattactgaaatctggctcccgatcatg

SEQ ID NO: 258899 - DNA, 35 bp, Artificial Sequence
  Description of Artificial Sequence: Synthetic oligonucleotide
gtgcatctattactgaaatctggctcccgatcatg

SEQ ID NO: 258900 - DNA, 38 bp, Artificial Sequence
  Description of Artificial Sequence: Synthetic oligonucleotide
tgcatctattactgaaatctggctcccgatcatgtatg

SEQ ID NO: 258901 - DNA, 37 bp, Artificial Sequence
  Description of Artificial Sequence: Synthetic oligonucleotide
gcatctattactgaaatctggctcccgatcatgtatg

SEQ ID NO: 258902 - DNA, 37 bp, Artificial Sequence
  Description of Artificial Sequence: Synthetic oligonucleotide
catctattactgaaatctggctcccgatcatgtatgc

SEQ ID NO: 258903 - DNA, 38 bp, Artificial Sequence
  Description of Artificial Sequence: Synthetic oligonucleotide
atctattactgaaatctggctcccgatcatgtatgctc

SEQ ID NO: 258904 - DNA, 37 bp, Artificial Sequence
  Description of Artificial Sequence: Synthetic oligonucleotide
tctattactgaaatctggctcccgatcatgtatgctc

SEQ ID NO: 258905 - DNA, 36 bp, Artificial Sequence
  Description of Artificial Sequence: Synthetic oligonucleotide
ctattactgaaatctggctcccgatcatgtatgctc

SEQ ID NO: 258906 - DNA, 36 bp, Artificial Sequence
  Description of Artificial Sequence: Synthetic oligonucleotide
tattactgaaatctggctcccgatcatgtatgctcc

SEQ ID NO: 258907 - DNA, 35 bp, Artificial Sequence
  Description of Artificial Sequence: Synthetic oligonucleotide
attactgaaatctggctcccgatcatgtatgctcc

SEQ ID NO: 258908 - DNA, 34 bp, Artificial Sequence
  Description of Artificial Sequence: Synthetic oligonucleotide
ttactgaaatctggctcccgatcatgtatgctcc

SEQ ID NO: 258909 - DNA, 33 bp, Artificial Sequence
  Description of Artificial Sequence: Synthetic oligonucleotide
tactgaaatctggctcccgatcatgtatgctcc

SEQ ID NO: 258910 - DNA, 32 bp, Artificial Sequence
  Description of Artificial Sequence: Synthetic oligonucleotide
actgaaatctggctcccgatcatgtatgctcc

SEQ ID NO: 258911 - DNA, 31 bp, Artificial Sequence
  Description of Artificial Sequence: Synthetic oligonucleotide
ctgaaatctggctcccgatcatgtatgctcc

SEQ ID NO: 258912 - DNA, 31 bp, Artificial Sequence
  Description of Artificial Sequence: Synthetic oligonucleotide
tgaaatctggctcccgatcatgtatgctccc

SEQ ID NO: 258913 - DNA, 30 bp, Artificial Sequence
  Description of Artificial Sequence: Synthetic oligonucleotide
gaaatctggctcccgatcatgtatgctccc

SEQ ID NO: 258914 - DNA, 30 bp, Artificial Sequence
  Description of Artificial Sequence: Synthetic oligonucleotide
aaatctggctcccgatcatgtatgctcccg

SEQ ID NO: 258915 - DNA, 29 bp, Artificial Sequence
  Description of Artificial Sequence: Synthetic oligonucleotide
aatctggctcccgatcatgtatgctcccg

SEQ ID NO: 258916 - DNA, 28 bp, Artificial Sequence
  Description of Artificial Sequence: Synthetic oligonucleotide
atctggctcccgatcatgtatgctcccg

SEQ ID NO: 258917 - DNA, 27 bp, Artificial Sequence
  Description of Artificial Sequence: Synthetic oligonucleotide
tctggctcccgatcatgtatgctcccg

SEQ ID NO: 258918 - DNA, 27 bp, Artificial Sequence
  Description of Artificial Sequence: Synthetic oligonucleotide
ctggctcccgatcatgtatgctcccga

SEQ ID NO: 258919 - DNA, 32 bp, Artificial Sequence
  Description of Artificial Sequence: Synthetic oligonucleotide
tggctcccgatcatgtatgctcccgatttttg

SEQ ID NO: 258920 - DNA, 31 bp, Artificial Sequence
  Description of Artificial Sequence: Synthetic oligonucleotide
ggctcccgatcatgtatgctcccgatttttg

SEQ ID NO: 258921 - DNA, 31 bp, Artificial Sequence
  Description of Artificial Sequence: Synthetic oligonucleotide
gctcccgatcatgtatgctcccgatttttgc

SEQ ID NO: 258922 - DNA, 31 bp, Artificial Sequence
  Description of Artificial Sequence: Synthetic oligonucleotide
ctcccgatcatgtatgctcccgatttttgcg

SEQ ID NO: 258923 - DNA, 35 bp, Artificial Sequence
  Description of Artificial Sequence: Synthetic oligonucleotide
tcccgatcatgtatgctcccgatttttgcgtattg

SEQ ID NO: 258924 - DNA, 34 bp, Artificial Sequence
  Description of Artificial Sequence: Synthetic oligonucleotide
cccgatcatgtatgctcccgatttttgcgtattg

SEQ ID NO: 258925 - DNA, 30 bp, Artificial Sequence
  Description of Artificial Sequence: Synthetic oligonucleotide
atcagcagctcgcgactgaattgggagaag

SEQ ID NO: 258926 - DNA, 29 bp, Artificial Sequence
  Description of Artificial Sequence: Synthetic oligonucleotide
tcagcagctcgcgactgaattgggagaag

SEQ ID NO: 258927 - DNA, 28 bp, Artificial Sequence
  Description of Artificial Sequence: Synthetic oligonucleotide
cagcagctcgcgactgaattgggagaag

SEQ ID NO: 258928 - DNA, 28 bp, Artificial Sequence
  Description of Artificial Sequence: Synthetic oligonucleotide
agcagctcgcgactgaattgggagaagg

SEQ ID NO: 258929 - DNA, 27 bp, Artificial Sequence
  Description of Artificial Sequence: Synthetic oligonucleotide
gcagctcgcgactgaattgggagaagg

SEQ ID NO: 258930 - DNA, 29 bp, Artificial Sequence
  Description of Artificial Sequence: Synthetic oligonucleotide
cagctcgcgactgaattgggagaaggttg

SEQ ID NO: 258931 - DNA, 29 bp, Artificial Sequence
  Description of Artificial Sequence: Synthetic oligonucleotide
agctcgcgactgaattgggagaaggttgc

SEQ ID NO: 258932 - DNA, 28 bp, Artificial Sequence
  Description of Artificial Sequence: Synthetic oligonucleotide
gctcgcgactgaattgggagaaggttgc

SEQ ID NO: 258933 - DNA, 29 bp, Artificial Sequence
  Description of Artificial Sequence: Synthetic oligonucleotide
ctcgcgactgaattgggagaaggttgctg

SEQ ID NO: 258934 - DNA, 29 bp, Artificial Sequence
  Description of Artificial Sequence: Synthetic oligonucleotide
tcgcgactgaattgggagaaggttgctgc

SEQ ID NO: 258935 - DNA, 28 bp, Artificial Sequence
  Description of Artificial Sequence: Synthetic oligonucleotide
cgcgactgaattgggagaaggttgctgc

SEQ ID NO: 258936 - DNA, 29 bp, Artificial Sequence
  Description of Artificial Sequence: Synthetic oligonucleotide
gcgactgaattgggagaaggttgctgctc

SEQ ID NO: 258937 - DNA, 30 bp, Artificial Sequence
  Description of Artificial Sequence: Synthetic oligonucleotide
cgactgaattgggagaaggttgctgctctg

SEQ ID NO: 258938 - DNA, 33 bp, Artificial Sequence
  Description of Artificial Sequence: Synthetic oligonucleotide
gactgaattgggagaaggttgctgctctgttac

SEQ ID NO: 258939 - DNA, 34 bp, Artificial Sequence
  Description of Artificial Sequence: Synthetic oligonucleotide
actgaattgggagaaggttgctgctctgttacag

SEQ ID NO: 258940 - DNA, 33 bp, Artificial Sequence
  Description of Artificial Sequence: Synthetic oligonucleotide
ctgaattgggagaaggttgctgctctgttacag

SEQ ID NO: 258941 - DNA, 36 bp, Artificial Sequence
  Description of Artificial Sequence: Synthetic oligonucleotide
tgaattgggagaaggttgctgctctgttacagaaac

SEQ ID NO: 258942 - DNA, 35 bp, Artificial Sequence
  Description of Artificial Sequence: Synthetic oligonucleotide
gaattgggagaaggttgctgctctgttacagaaac

SEQ ID NO: 258943 - DNA, 36 bp, Artificial Sequence
  Description of Artificial Sequence: Synthetic oligonucleotide
aattgggagaaggttgctgctctgttacagaaacag

SEQ ID NO: 258944 - DNA, 35 bp, Artificial Sequence
  Description of Artificial Sequence: Synthetic oligonucleotide
attgggagaaggttgctgctctgttacagaaacag

SEQ ID NO: 258945 - DNA, 34 bp, Artificial Sequence
  Description of Artificial Sequence: Synthetic oligonucleotide
ttgggagaaggttgctgctctgttacagaaacag

SEQ ID NO: 258946 - DNA, 33 bp, Artificial Sequence
  Description of Artificial Sequence: Synthetic oligonucleotide
tgggagaaggttgctgctctgttacagaaacag

SEQ ID NO: 258947 - DNA, 32 bp, Artificial Sequence
  Description of Artificial Sequence: Synthetic oligonucleotide
gggagaaggttgctgctctgttacagaaacag

SEQ ID NO: 258948 - DNA, 36 bp, Artificial Sequence
  Description of Artificial Sequence: Synthetic oligonucleotide
ggagaaggttgctgctctgttacagaaacagaattc

SEQ ID NO: 258949 - DNA, 36 bp, Artificial Sequence
  Description of Artificial Sequence: Synthetic oligonucleotide
gagaaggttgctgctctgttacagaaacagaattcc

SEQ ID NO: 258950 - DNA, 36 bp, Artificial Sequence
  Description of Artificial Sequence: Synthetic oligonucleotide
agaaggttgctgctctgttacagaaacagaattccg

SEQ ID NO: 258951 - DNA, 35 bp, Artificial Sequence
  Description of Artificial Sequence: Synthetic oligonucleotide
gaaggttgctgctctgttacagaaacagaattccg

SEQ ID NO: 258952 - DNA, 36 bp, Artificial Sequence
  Description of Artificial Sequence: Synthetic oligonucleotide
aaggttgctgctctgttacagaaacagaattccgag

SEQ ID NO: 258953 - DNA, 35 bp, Artificial Sequence
  Description of Artificial Sequence: Synthetic oligonucleotide
aggttgctgctctgttacagaaacagaattccgag

SEQ ID NO: 258954 - DNA, 34 bp, Artificial Sequence
  Description of Artificial Sequence: Synthetic oligonucleotide
ggttgctgctctgttacagaaacagaattccgag

SEQ ID NO: 258955 - DNA, 34 bp, Artificial Sequence
  Description of Artificial Sequence: Synthetic oligonucleotide
gttgctgctctgttacagaaacagaattccgagc

SEQ ID NO: 258956 - DNA, 34 bp, Artificial Sequence
  Description of Artificial Sequence: Synthetic oligonucleotide
ttgctgctctgttacagaaacagaattccgagcc

SEQ ID NO: 258957 - DNA, 33 bp, Artificial Sequence
  Description of Artificial Sequence: Synthetic oligonucleotide
tgctgctctgttacagaaacagaattccgagcc

SEQ ID NO: 258958 - DNA, 32 bp, Artificial Sequence
  Description of Artificial Sequence: Synthetic oligonucleotide
gctgctctgttacagaaacagaattccgagcc

SEQ ID NO: 258959 - DNA, 32 bp, Artificial Sequence
  Description of Artificial Sequence: Synthetic oligonucleotide
ctgctctgttacagaaacagaattccgagccc

SEQ ID NO: 258960 - DNA, 32 bp, Artificial Sequence
  Description of Artificial Sequence: Synthetic oligonucleotide
tgctctgttacagaaacagaattccgagcccc

SEQ ID NO: 258961 - DNA, 31 bp, Artificial Sequence
  Description of Artificial Sequence: Synthetic oligonucleotide
gctctgttacagaaacagaattccgagcccc

SEQ ID NO: 258962 - DNA, 32 bp, Artificial Sequence
  Description of Artificial Sequence: Synthetic oligonucleotide
ctctgttacagaaacagaattccgagccccag

SEQ ID NO: 258963 - DNA, 34 bp, Artificial Sequence
  Description of Artificial Sequence: Synthetic oligonucleotide
tctgttacagaaacagaattccgagccccagttc

SEQ ID NO: 258964 - DNA, 33 bp, Artificial Sequence
  Description of Artificial Sequence: Synthetic oligonucleotide
ctgttacagaaacagaattccgagccccagttc

SEQ ID NO: 258965 - DNA, 33 bp, Artificial Sequence
  Description of Artificial Sequence: Synthetic oligonucleotide
tgttacagaaacagaattccgagccccagttcc

SEQ ID NO: 258966 - DNA, 32 bp, Artificial Sequence
  Description of Artificial Sequence: Synthetic oligonucleotide
gttacagaaacagaattccgagccccagttcc

SEQ ID NO: 258967 - DNA, 34 bp, Artificial Sequence
  Description of Artificial Sequence: Synthetic oligonucleotide
ttacagaaacagaattccgagccccagttcctac

SEQ ID NO: 258968 - DNA, 33 bp, Artificial Sequence
  Description of Artificial Sequence: Synthetic oligonucleotide
tacagaaacagaattccgagccccagttcctac

SEQ ID NO: 258969 - DNA, 32 bp, Artificial Sequence
  Description of Artificial Sequence: Synthetic oligonucleotide
acagaaacagaattccgagccccagttcctac

SEQ ID NO: 258970 - DNA, 31 bp, Artificial Sequence
  Description of Artificial Sequence: Synthetic oligonucleotide
cagaaacagaattccgagccccagttcctac

SEQ ID NO: 258971 - DNA, 33 bp, Artificial Sequence
  Description of Artificial Sequence: Synthetic oligonucleotide
agaaacagaattccgagccccagttcctacttg

SEQ ID NO: 258972 - DNA, 32 bp, Artificial Sequence
  Description of Artificial Sequence: Synthetic oligonucleotide
gaaacagaattccgagccccagttcctacttg

SEQ ID NO: 258973 - DNA, 32 bp, Artificial Sequence
  Description of Artificial Sequence: Synthetic oligonucleotide
aaacagaattccgagccccagttcctacttgc

SEQ ID NO: 258974 - DNA, 31 bp, Artificial Sequence
  Description of Artificial Sequence: Synthetic oligonucleotide
aacagaattccgagccccagttcctacttgc

SEQ ID NO: 258975 - DNA, 30 bp, Artificial Sequence
  Description of Artificial Sequence: Synthetic oligonucleotide
acagaattccgagccccagttcctacttgc

SEQ ID NO: 258976 - DNA, 29 bp, Artificial Sequence
  Description of Artificial Sequence: Synthetic oligonucleotide
cagaattccgagccccagttcctacttgc

SEQ ID NO: 258977 - DNA, 29 bp, Artificial Sequence
  Description of Artificial Sequence: Synthetic oligonucleotide
agaattccgagccccagttcctacttgcc

SEQ ID NO: 258978 - DNA, 28 bp, Artificial Sequence
  Description of Artificial Sequence: Synthetic oligonucleotide
gaattccgagccccagttcctacttgcc

SEQ ID NO: 258979 - DNA, 28 bp, Artificial Sequence
  Description of Artificial Sequence: Synthetic oligonucleotide
aattccgagccccagttcctacttgccc

SEQ ID NO: 258980 - DNA, 27 bp, Artificial Sequence
  Description of Artificial Sequence: Synthetic oligonucleotide
attccgagccccagttcctacttgccc

SEQ ID NO: 258981 - DNA, 27 bp, Artificial Sequence
  Description of Artificial Sequence: Synthetic oligonucleotide
ttccgagccccagttcctacttgccct

SEQ ID NO: 258982 - DNA, 26 bp, Artificial Sequence
  Description of Artificial Sequence: Synthetic oligonucleotide
tccgagccccagttcctacttgccct

SEQ ID NO: 258983 - DNA, 25 bp, Artificial Sequence
  Description of Artificial Sequence: Synthetic oligonucleotide
ccgagccccagttcctacttgccct

SEQ ID NO: 258984 - DNA, 27 bp, Artificial Sequence
  Description of Artificial Sequence: Synthetic oligonucleotide
cgagccccagttcctacttgccctgaa

SEQ ID NO: 258985 - DNA, 28 bp, Artificial Sequence
  Description of Artificial Sequence: Synthetic oligonucleotide
gagccccagttcctacttgccctgaatg

SEQ ID NO: 258986 - DNA, 29 bp, Artificial Sequence
  Description of Artificial Sequence: Synthetic oligonucleotide
agccccagttcctacttgccctgaatgtc

SEQ ID NO: 258987 - DNA, 28 bp, Artificial Sequence
  Description of Artificial Sequence: Synthetic oligonucleotide
gccccagttcctacttgccctgaatgtc

SEQ ID NO: 258988 - DNA, 28 bp, Artificial Sequence
  Description of Artificial Sequence: Synthetic oligonucleotide
ccccagttcctacttgccctgaatgtcg

SEQ ID NO: 258989 - DNA, 28 bp, Artificial Sequence
  Description of Artificial Sequence: Synthetic oligonucleotide
cccagttcctacttgccctgaatgtcgg

SEQ ID NO: 258990 - DNA, 28 bp, Artificial Sequence
  Description of Artificial Sequence: Synthetic oligonucleotide
ccagttcctacttgccctgaatgtcggc

SEQ ID NO: 258991 - DNA, 29 bp, Artificial Sequence
  Description of Artificial Sequence: Synthetic oligonucleotide
cagttcctacttgccctgaatgtcggcac

SEQ ID NO: 258992 - DNA, 29 bp, Artificial Sequence
  Description of Artificial Sequence: Synthetic oligonucleotide
agttcctacttgccctgaatgtcggcacc

SEQ ID NO: 258993 - DNA, 28 bp, Artificial Sequence
  Description of Artificial Sequence: Synthetic oligonucleotide
gttcctacttgccctgaatgtcggcacc

SEQ ID NO: 258994 - DNA, 29 bp, Artificial Sequence
  Description of Artificial Sequence: Synthetic oligonucleotide
ttcctacttgccctgaatgtcggcaccac

SEQ ID NO: 258995 - DNA, 28 bp, Artificial Sequence
  Description of Artificial Sequence: Synthetic oligonucleotide
tcctacttgccctgaatgtcggcaccac

SEQ ID NO: 258996 - DNA, 27 bp, Artificial Sequence
  Description of Artificial Sequence: Synthetic oligonucleotide
cctacttgccctgaatgtcggcaccac

SEQ ID NO: 258997 - DNA, 27 bp, Artificial Sequence
  Description of Artificial Sequence: Synthetic oligonucleotide
ctacttgccctgaatgtcggcaccacc

SEQ ID NO: 258998 - DNA, 27 bp, Artificial Sequence
  Description of Artificial Sequence: Synthetic oligonucleotide
tacttgccctgaatgtcggcaccaccc

SEQ ID NO: 258999 - DNA, 27 bp, Artificial Sequence
  Description of Artificial Sequence: Synthetic oligonucleotide
acttgccctgaatgtcggcaccaccca

SEQ ID NO: 259000 - DNA, 26 bp, Artificial Sequence
  Description of Artificial Sequence: Synthetic oligonucleotide
cttgccctgaatgtcggcaccaccca

SEQ ID NO: 259001 - DNA, 26 bp, Artificial Sequence
  Description of Artificial Sequence: Synthetic oligonucleotide
ttgccctgaatgtcggcaccacccac

SEQ ID NO: 259002 - DNA, 25 bp, Artificial Sequence
  Description of Artificial Sequence: Synthetic oligonucleotide
tgccctgaatgtcggcaccacccac

SEQ ID NO: 259003 - DNA, 24 bp, Artificial Sequence
  Description of Artificial Sequence: Synthetic oligonucleotide
gccctgaatgtcggcaccacccac

SEQ ID NO: 259004 - DNA, 25 bp, Artificial Sequence
  Description of Artificial Sequence: Synthetic oligonucleotide
ccctgaatgtcggcaccacccacca

SEQ ID NO: 259005 - DNA, 25 bp, Artificial Sequence
  Description of Artificial Sequence: Synthetic oligonucleotide
cctgaatgtcggcaccacccaccac

SEQ ID NO: 259006 - DNA, 26 bp, Artificial Sequence
  Description of Artificial Sequence: Synthetic oligonucleotide
ctgaatgtcggcaccacccaccacct

SEQ ID NO: 259007 - DNA, 26 bp, Artificial Sequence
  Description of Artificial Sequence: Synthetic oligonucleotide
tgaatgtcggcaccacccaccacctg

SEQ ID NO: 259008 - DNA, 25 bp, Artificial Sequence
  Description of Artificial Sequence: Synthetic oligonucleotide
gaatgtcggcaccacccaccacctg

SEQ ID NO: 259009 - DNA, 26 bp, Artificial Sequence
  Description of Artificial Sequence: Synthetic oligonucleotide
aatgtcggcaccacccaccacctgct

SEQ ID NO: 259010 - DNA, 25 bp, Artificial Sequence
  Description of Artificial Sequence: Synthetic oligonucleotide
atgtcggcaccacccaccacctgct

SEQ ID NO: 259011 - DNA, 24 bp, Artificial Sequence
  Description of Artificial Sequence: Synthetic oligonucleotide
tgtcggcaccacccaccacctgct

SEQ ID NO: 259012 - DNA, 23 bp, Artificial Sequence
  Description of Artificial Sequence: Synthetic oligonucleotide
gtcggcaccacccaccacctgct

SEQ ID NO: 259013 - DNA, 23 bp, Artificial Sequence
  Description of Artificial Sequence: Synthetic oligonucleotide
tcggcaccacccaccacctgctg

SEQ ID NO: 259014 - DNA, 22 bp, Artificial Sequence
  Description of Artificial Sequence: Synthetic oligonucleotide
cggcaccacccaccacctgctg

SEQ ID NO: 259015 - DNA, 23 bp, Artificial Sequence
  Description of Artificial Sequence: Synthetic oligonucleotide
ggcaccacccaccacctgctggt

SEQ ID NO: 259016 - DNA, 25 bp, Artificial Sequence
  Description of Artificial Sequence: Synthetic oligonucleotide
gcaccacccaccacctgctggtcat

SEQ ID NO: 259017 - DNA, 26 bp, Artificial Sequence
  Description of Artificial Sequence: Synthetic oligonucleotide
caccacccaccacctgctggtcatct

SEQ ID NO: 259018 - DNA, 27 bp, Artificial Sequence
  Description of Artificial Sequence: Synthetic oligonucleotide
accacccaccacctgctggtcatctgt

SEQ ID NO: 259019 - DNA, 26 bp, Artificial Sequence
  Description of Artificial Sequence: Synthetic oligonucleotide
ccacccaccacctgctggtcatctgt

SEQ ID NO: 259020 - DNA, 27 bp, Artificial Sequence
  Description of Artificial Sequence: Synthetic oligonucleotide
cacccaccacctgctggtcatctgtct

SEQ ID NO: 259021 - DNA, 27 bp, Artificial Sequence
  Description of Artificial Sequence: Synthetic oligonucleotide
acccaccacctgctggtcatctgtctc

SEQ ID NO: 259022 - DNA, 27 bp, Artificial Sequence
  Description of Artificial Sequence: Synthetic oligonucleotide
cccaccacctgctggtcatctgtctca

SEQ ID NO: 259023 - DNA, 28 bp, Artificial Sequence
  Description of Artificial Sequence: Synthetic oligonucleotide
ccaccacctgctggtcatctgtctcaag

SEQ ID NO: 259024 - DNA, 28 bp, Artificial Sequence
  Description of Artificial Sequence: Synthetic oligonucleotide
caccacctgctggtcatctgtctcaagc

SEQ ID NO: 259025 - DNA, 28 bp, Artificial Sequence
  Description of Artificial Sequence: Synthetic oligonucleotide
accacctgctggtcatctgtctcaagcg

SEQ ID NO: 259026 - DNA, 27 bp, Artificial Sequence
  Description of Artificial Sequence: Synthetic oligonucleotide
ccacctgctggtcatctgtctcaagcg

SEQ ID NO: 259027 - DNA, 27 bp, Artificial Sequence
  Description of Artificial Sequence: Synthetic oligonucleotide
cacctgctggtcatctgtctcaagcgg

SEQ ID NO: 259028 - DNA, 27 bp, Artificial Sequence
  Description of Artificial Sequence: Synthetic oligonucleotide
acctgctggtcatctgtctcaagcggg

SEQ ID NO: 259029 - DNA, 26 bp, Artificial Sequence
  Description of Artificial Sequence: Synthetic oligonucleotide
cctgctggtcatctgtctcaagcggg

SEQ ID NO: 259030 - DNA, 26 bp, Artificial Sequence
  Description of Artificial Sequence: Synthetic oligonucleotide
ctgctggtcatctgtctcaagcgggc

SEQ ID NO: 259031 - DNA, 27 bp, Artificial Sequence
  Description of Artificial Sequence: Synthetic oligonucleotide
tgctggtcatctgtctcaagcgggcct

SEQ ID NO: 259032 - DNA, 26 bp, Artificial Sequence
  Description of Artificial Sequence: Synthetic oligonucleotide
gctggtcatctgtctcaagcgggcct

SEQ ID NO: 259033 - DNA, 26 bp, Artificial Sequence
  Description of Artificial Sequence: Synthetic oligonucleotide
ctggtcatctgtctcaagcgggcctc

SEQ ID NO: 259034 - DNA, 26 bp, Artificial Sequence
  Description of Artificial Sequence: Synthetic oligonucleotide
tggtcatctgtctcaagcgggcctcg

SEQ ID NO: 259035 - DNA, 25 bp, Artificial Sequence
  Description of Artificial Sequence: Synthetic oligonucleotide
ggtcatctgtctcaagcgggcctcg

SEQ ID NO: 259036 - DNA, 26 bp, Artificial Sequence
  Description of Artificial Sequence: Synthetic oligonucleotide
gtcatctgtctcaagcgggcctcggt

SEQ ID NO: 259037 - DNA, 26 bp, Artificial Sequence
  Description of Artificial Sequence: Synthetic oligonucleotide
tcatctgtctcaagcgggcctcggtg

SEQ ID NO: 259038 - DNA, 25 bp, Artificial Sequence
  Description of Artificial Sequence: Synthetic oligonucleotide
catctgtctcaagcgggcctcggtg

SEQ ID NO: 259039 - DNA, 26 bp, Artificial Sequence
  Description of Artificial Sequence: Synthetic oligonucleotide
atctgtctcaagcgggcctcggtgca

SEQ ID NO: 259040 - DNA, 25 bp, Artificial Sequence
  Description of Artificial Sequence: Synthetic oligonucleotide
tctgtctcaagcgggcctcggtgca

SEQ ID NO: 259041 - DNA, 24 bp, Artificial Sequence
  Description of Artificial Sequence: Synthetic oligonucleotide
ctgtctcaagcgggcctcggtgca

SEQ ID NO: 259042 - DNA, 24 bp, Artificial Sequence
  Description of Artificial Sequence: Synthetic oligonucleotide
tgtctcaagcgggcctcggtgcag

SEQ ID NO: 259043 - DNA, 23 bp, Artificial Sequence
  Description of Artificial Sequence: Synthetic oligonucleotide
gtctcaagcgggcctcggtgcag

SEQ ID NO: 259044 - DNA, 23 bp, Artificial Sequence
  Description of Artificial Sequence: Synthetic oligonucleotide
tctcaagcgggcctcggtgcagc

SEQ ID NO: 259045 - DNA, 22 bp, Artificial Sequence
  Description of Artificial Sequence: Synthetic oligonucleotide
ctcaagcgggcctcggtgcagc

SEQ ID NO: 259046 - DNA, 22 bp, Artificial Sequence
  Description of Artificial Sequence: Synthetic oligonucleotide
tcaagcgggcctcggtgcagcc

SEQ ID NO: 259047 - DNA, 21 bp, Artificial Sequence
  Description of Artificial Sequence: Synthetic oligonucleotide
caagcgggcctcggtgcagcc

SEQ ID NO: 259048 - DNA, 21 bp, Artificial Sequence
  Description of Artificial Sequence: Synthetic oligonucleotide
aagcgggcctcggtgcagccc

SEQ ID NO: 259049 - DNA, 20 bp, Artificial Sequence
  Description of Artificial Sequence: Synthetic oligonucleotide
agcgggcctcggtgcagccc

SEQ ID NO: 259050 - DNA, 20 bp, Artificial Sequence
  Description of Artificial Sequence: Synthetic oligonucleotide
gcgggcctcggtgcagccct

SEQ ID NO: 259051 - DNA, 20 bp, Artificial Sequence
  Description of Artificial Sequence: Synthetic oligonucleotide
cgggcctcggtgcagcccgt

SEQ ID NO: 259052 - DNA, 20 bp, Artificial Sequence
  Description of Artificial Sequence: Synthetic oligonucleotide
gggcctcggtgcagcccgct

SEQ ID NO: 259053 - DNA, 20 bp, Artificial Sequence
  Description of Artificial Sequence: Synthetic oligonucleotide
ggcctcggtgcagcccgcgt

SEQ ID NO: 259054 - DNA, 20 bp, Artificial Sequence
  Description of Artificial Sequence: Synthetic oligonucleotide
gcctcggtgcagcccgcgca

SEQ ID NO: 259055 - DNA, 20 bp, Artificial Sequence
  Description of Artificial Sequence: Synthetic oligonucleotide
cctcggtgcagcccgcgcag

SEQ ID NO: 259056 - DNA, 22 bp, Artificial Sequence
  Description of Artificial Sequence: Synthetic oligonucleotide
ctcggtgcagcccgcgcagcaa

SEQ ID NO: 259057 - DNA, 23 bp, Artificial Sequence
  Description of Artificial Sequence: Synthetic oligonucleotide
tcggtgcagcccgcgcagcaagt

SEQ ID NO: 259058 - DNA, 22 bp, Artificial Sequence
  Description of Artificial Sequence: Synthetic oligonucleotide
cggtgcagcccgcgcagcaagt

SEQ ID NO: 259059 - DNA, 24 bp, Artificial Sequence
  Description of Artificial Sequence: Synthetic oligonucleotide
ggtgcagcccgcgcagcaagtgtt

SEQ ID NO: 259060 - DNA, 24 bp, Artificial Sequence
  Description of Artificial Sequence: Synthetic oligonucleotide
gtgcagcccgcgcagcaagtgttc

SEQ ID NO: 259061 - DNA, 25 bp, Artificial Sequence
  Description of Artificial Sequence: Synthetic oligonucleotide
tgcagcccgcgcagcaagtgttcca

SEQ ID NO: 259062 - DNA, 24 bp, Artificial Sequence
  Description of Artificial Sequence: Synthetic oligonucleotide
gcagcccgcgcagcaagtgttcca

SEQ ID NO: 259063 - DNA, 24 bp, Artificial Sequence
  Description of Artificial Sequence: Synthetic oligonucleotide
cagcccgcgcagcaagtgttccag

SEQ ID NO: 259064 - DNA, 25 bp, Artificial Sequence
  Description of Artificial Sequence: Synthetic oligonucleotide
agcccgcgcagcaagtgttccagga

SEQ ID NO: 259065 - DNA, 24 bp, Artificial Sequence
  Description of Artificial Sequence: Synthetic oligonucleotide
gcccgcgcagcaagtgttccagga

SEQ ID NO: 259066 - DNA, 24 bp, Artificial Sequence
  Description of Artificial Sequence: Synthetic oligonucleotide
cccgcgcagcaagtgttccaggac

SEQ ID NO: 259067 - DNA, 24 bp, Artificial Sequence
  Description of Artificial Sequence: Synthetic oligonucleotide
ccgcgcagcaagtgttccaggacg

SEQ ID NO: 259068 - DNA, 24 bp, Artificial Sequence
  Description of Artificial Sequence: Synthetic oligonucleotide
cgcgcagcaagtgttccaggacgc

SEQ ID NO: 259069 - DNA, 24 bp, Artificial Sequence
  Description of Artificial Sequence: Synthetic oligonucleotide
gcgcagcaagtgttccaggacgcc

SEQ ID NO: 259070 - DNA, 25 bp, Artificial Sequence
  Description of Artificial Sequence: Synthetic oligonucleotide
cgcagcaagtgttccaggacgccgt

SEQ ID NO: 259071 - DNA, 25 bp, Artificial Sequence
  Description of Artificial Sequence: Synthetic oligonucleotide
gcagcaagtgttccaggacgccgtg

SEQ ID NO: 259072 - DNA, 25 bp, Artificial Sequence
  Description of Artificial Sequence: Synthetic oligonucleotide
cagcaagtgttccaggacgccgtgc

SEQ ID NO: 259073 - DNA, 25 bp, Artificial Sequence
  Description of Artificial Sequence: Synthetic oligonucleotide
agcaagtgttccaggacgccgtgcg

SEQ ID NO: 259074 - DNA, 24 bp, Artificial Sequence
  Description of Artificial Sequence: Synthetic oligonucleotide
gcaagtgttccaggacgccgtgcg

SEQ ID NO: 259075 - DNA, 24 bp, Artificial Sequence
  Description of Artificial Sequence: Synthetic oligonucleotide
caagtgttccaggacgccgtgcgc

SEQ ID NO: 259076 - DNA, 25 bp, Artificial Sequence
  Description of Artificial Sequence: Synthetic oligonucleotide
aagtgttccaggacgccgtgcgcca

SEQ ID NO: 259077 - DNA, 24 bp, Artificial Sequence
  Description of Artificial Sequence: Synthetic oligonucleotide
agtgttccaggacgccgtgcgcca

SEQ ID NO: 259078 - DNA, 23 bp, Artificial Sequence
  Description of Artificial Sequence: Synthetic oligonucleotide
gtgttccaggacgccgtgcgcca

SEQ ID NO: 259079 - DNA, 23 bp, Artificial Sequence
  Description of Artificial Sequence: Synthetic oligonucleotide
tgttccaggacgccgtgcgccag

SEQ ID NO: 259080 - DNA, 22 bp, Artificial Sequence
  Description of Artificial Sequence: Synthetic oligonucleotide
gttccaggacgccgtgcgccag

SEQ ID NO: 259081 - DNA, 23 bp, Artificial Sequence
  Description of Artificial Sequence: Synthetic oligonucleotide
ttccaggacgccgtgcgccagga

SEQ ID NO: 259082 - DNA, 22 bp, Artificial Sequence
  Description of Artificial Sequence: Synthetic oligonucleotide
tccaggacgccgtgcgccagga

SEQ ID NO: 259083 - DNA, 21 bp, Artificial Sequence
  Description of Artificial Sequence: Synthetic oligonucleotide
ccaggacgccgtgcgccagga

SEQ ID NO: 259084 - DNA, 21 bp, Artificial Sequence
  Description of Artificial Sequence: Synthetic oligonucleotide
caggacgccgtgcgccaggag

SEQ ID NO: 259085 - DNA, 21 bp, Artificial Sequence
  Description of Artificial Sequence: Synthetic oligonucleotide
aggacgccgtgcgccaggagg

SEQ ID NO: 259086 - DNA, 20 bp, Artificial Sequence
  Description of Artificial Sequence: Synthetic oligonucleotide
ggacgccgtgcgccaggagg

SEQ ID NO: 259087 - DNA, 20 bp, Artificial Sequence
  Description of Artificial Sequence: Synthetic oligonucleotide
gacgccgtgcgccaggaggg

SEQ ID NO: 259088 - DNA, 22 bp, Artificial Sequence
  Description of Artificial Sequence: Synthetic oligonucleotide
acgccgtgcgccaggaggggaa

SEQ ID NO: 259089 - DNA, 21 bp, Artificial Sequence
  Description of Artificial Sequence: Synthetic oligonucleotide
cgccgtgcgccaggaggggaa

SEQ ID NO: 259090 - DNA, 21 bp, Artificial Sequence
  Description of Artificial Sequence: Synthetic oligonucleotide
gccgtgcgccaggaggggaag

SEQ ID NO: 259091 - DNA, 21 bp, Artificial Sequence
  Description of Artificial Sequence: Synthetic oligonucleotide
ccgtgcgccaggaggggaagc

SEQ ID NO: 259092 - DNA, 24 bp, Artificial Sequence
  Description of Artificial Sequence: Synthetic oligonucleotide
cgtgcgccaggaggggaagccaat

SEQ ID NO: 259093 - DNA, 25 bp, Artificial Sequence
  Description of Artificial Sequence: Synthetic oligonucleotide
gtgcgccaggaggggaagccaatct

SEQ ID NO: 259094 - DNA, 25 bp, Artificial Sequence
  Description of Artificial Sequence: Synthetic oligonucleotide
tgcgccaggaggggaagccaatctc

SEQ ID NO: 259095 - DNA, 24 bp, Artificial Sequence
  Description of Artificial Sequence: Synthetic oligonucleotide
gcgccaggaggggaagccaatctc

SEQ ID NO: 259096 - DNA, 26 bp, Artificial Sequence
  Description of Artificial Sequence: Synthetic oligonucleotide
cgccaggaggggaagccaatctccaa

SEQ ID NO: 259097 - DNA, 26 bp, Artificial Sequence
  Description of Artificial Sequence: Synthetic oligonucleotide
gccaggaggggaagccaatctccaac

SEQ ID NO: 259098 - DNA, 27 bp, Artificial Sequence
  Description of Artificial Sequence: Synthetic oligonucleotide
ccaggaggggaagccaatctccaacca

SEQ ID NO: 259099 - DNA, 27 bp, Artificial Sequence
  Description of Artificial Sequence: Synthetic oligonucleotide
caggaggggaagccaatctccaaccag

SEQ ID NO: 259100 - DNA, 29 bp, Artificial Sequence
  Description of Artificial Sequence: Synthetic oligonucleotide
aggaggggaagccaatctccaaccagatg

SEQ ID NO: 259101 - DNA, 28 bp, Artificial Sequence
  Description of Artificial Sequence: Synthetic oligonucleotide
ggaggggaagccaatctccaaccagatg

SEQ ID NO: 259102 - DNA, 29 bp, Artificial Sequence
  Description of Artificial Sequence: Synthetic oligonucleotide
gaggggaagccaatctccaaccagatgag

SEQ ID NO: 259103 - DNA, 29 bp, Artificial Sequence
  Description of Artificial Sequence: Synthetic oligonucleotide
aggggaagccaatctccaaccagatgagc

SEQ ID NO: 259104 - DNA, 28 bp, Artificial Sequence
  Description of Artificial Sequence: Synthetic oligonucleotide
ggggaagccaatctccaaccagatgagc

SEQ ID NO: 259105 - DNA, 29 bp, Artificial Sequence
  Description of Artificial Sequence: Synthetic oligonucleotide
gggaagccaatctccaaccagatgagctc

SEQ ID NO: 259106 - DNA, 30 bp, Artificial Sequence
  Description of Artificial Sequence: Synthetic oligonucleotide
ggaagccaatctccaaccagatgagctcag

SEQ ID NO: 259107 - DNA, 30 bp, Artificial Sequence
  Description of Artificial Sequence: Synthetic oligonucleotide
gaagccaatctccaaccagatgagctcagg

SEQ ID NO: 259108 - DNA, 30 bp, Artificial Sequence
  Description of Artificial Sequence: Synthetic oligonucleotide
aagccaatctccaaccagatgagctcaggc

SEQ ID NO: 259109 - DNA, 29 bp, Artificial Sequence
  Description of Artificial Sequence: Synthetic oligonucleotide
agccaatctccaaccagatgagctcaggc

SEQ ID NO: 259110 - DNA, 28 bp, Artificial Sequence
  Description of Artificial Sequence: Synthetic oligonucleotide
gccaatctccaaccagatgagctcaggc

SEQ ID NO: 259111 - DNA, 28 bp, Artificial Sequence
  Description of Artificial Sequence: Synthetic oligonucleotide
ccaatctccaaccagatgagctcaggcc

SEQ ID NO: 259112 - DNA, 28 bp, Artificial Sequence
  Description of Artificial Sequence: Synthetic oligonucleotide
caatctccaaccagatgagctcaggccg

SEQ ID NO: 259113 - DNA, 30 bp, Artificial Sequence
  Description of Artificial Sequence: Synthetic oligonucleotide
aatctccaaccagatgagctcaggccgatg

SEQ ID NO: 259114 - DNA, 29 bp, Artificial Sequence
  Description of Artificial Sequence: Synthetic oligonucleotide
atctccaaccagatgagctcaggccgatg

SEQ ID NO: 259115 - DNA, 28 bp, Artificial Sequence
  Description of Artificial Sequence: Synthetic oligonucleotide
tctccaaccagatgagctcaggccgatg

SEQ ID NO: 259116 - DNA, 27 bp, Artificial Sequence
  Description of Artificial Sequence: Synthetic oligonucleotide
ctccaaccagatgagctcaggccgatg

SEQ ID NO: 259117 - DNA, 27 bp, Artificial Sequence
  Description of Artificial Sequence: Synthetic oligonucleotide
tccaaccagatgagctcaggccgatgc

SEQ ID NO: 259118 - DNA, 27 bp, Artificial Sequence
  Description of Artificial Sequence: Synthetic oligonucleotide
ccaaccagatgagctcaggccgatgct

SEQ ID NO: 259119 - DNA, 27 bp, Artificial Sequence
  Description of Artificial Sequence: Synthetic oligonucleotide
caaccagatgagctcaggccgatgctg

SEQ ID NO: 259120 - DNA, 27 bp, Artificial Sequence
  Description of Artificial Sequence: Synthetic oligonucleotide
aaccagatgagctcaggccgatgctgg

SEQ ID NO: 259121 - DNA, 27 bp, Artificial Sequence
  Description of Artificial Sequence: Synthetic oligonucleotide
accagatgagctcaggccgatgctggt

SEQ ID NO: 259122 - DNA, 27 bp, Artificial Sequence
  Description of Artificial Sequence: Synthetic oligonucleotide
ccagatgagctcaggccgatgctggtt

SEQ ID NO: 259123 - DNA, 27 bp, Artificial Sequence
  Description of Artificial Sequence: Synthetic oligonucleotide
cagatgagctcaggccgatgctggttc

SEQ ID NO: 259124 - DNA, 31 bp, Artificial Sequence
  Description of Artificial Sequence: Synthetic oligonucleotide
agatgagctcaggccgatgctggttcttttc

SEQ ID NO: 259125 - DNA, 30 bp, Artificial Sequence
  Description of Artificial Sequence: Synthetic oligonucleotide
gatgagctcaggccgatgctggttcttttc

SEQ ID NO: 259126 - DNA, 32 bp, Artificial Sequence
  Description of Artificial Sequence: Synthetic oligonucleotide
atgagctcaggccgatgctggttcttttcttc

SEQ ID NO: 259127 - DNA, 31 bp, Artificial Sequence
  Description of Artificial Sequence: Synthetic oligonucleotide
tgagctcaggccgatgctggttcttttcttc

SEQ ID NO: 259128 - DNA, 30 bp, Artificial Sequence
  Description of Artificial Sequence: Synthetic oligonucleotide
gagctcaggccgatgctggttcttttcttc

SEQ ID NO: 259129 - DNA, 31 bp, Artificial Sequence
  Description of Artificial Sequence: Synthetic oligonucleotide
agctcaggccgatgctggttcttttcttctc

SEQ ID NO: 259130 - DNA, 30 bp, Artificial Sequence
  Description of Artificial Sequence: Synthetic oligonucleotide
gctcaggccgatgctggttcttttcttctc

SEQ ID NO: 259131 - DNA, 31 bp, Artificial Sequence
  Description of Artificial Sequence: Synthetic oligonucleotide
ctcaggccgatgctggttcttttcttctctg

SEQ ID NO: 259132 - DNA, 34 bp, Artificial Sequence
  Description of Artificial Sequence: Synthetic oligonucleotide
tcaggccgatgctggttcttttcttctctgaatg

SEQ ID NO: 259133 - DNA, 33 bp, Artificial Sequence
  Description of Artificial Sequence: Synthetic oligonucleotide
caggccgatgctggttcttttcttctctgaatg

SEQ ID NO: 259134 - DNA, 37 bp, Artificial Sequence
  Description of Artificial Sequence: Synthetic oligonucleotide
aggccgatgctggttcttttcttctctgaatgtaatg

SEQ ID NO: 259135 - DNA, 36 bp, Artificial Sequence
  Description of Artificial Sequence: Synthetic oligonucleotide
ggccgatgctggttcttttcttctctgaatgtaatg

SEQ ID NO: 259136 - DNA, 37 bp, Artificial Sequence
  Description of Artificial Sequence: Synthetic oligonucleotide
gccgatgctggttcttttcttctctgaatgtaatgag

SEQ ID NO: 259137 - DNA, 37 bp, Artificial Sequence
  Description of Artificial Sequence: Synthetic oligonucleotide
ccgatgctggttcttttcttctctgaatgtaatgagg

SEQ ID NO: 259138 - DNA, 37 bp, Artificial Sequence
  Description of Artificial Sequence: Synthetic oligonucleotide
cgatgctggttcttttcttctctgaatgtaatgaggc

SEQ ID NO: 259139 - DNA, 39 bp, Artificial Sequence
  Description of Artificial Sequence: Synthetic oligonucleotide
gatgctggttcttttcttctctgaatgtaatgaggcttg

SEQ ID NO: 259140 - DNA, 39 bp, Artificial Sequence
  Description of Artificial Sequence: Synthetic oligonucleotide
atgctggttcttttcttctctgaatgtaatgaggcttgc

SEQ ID NO: 259141 - DNA, 38 bp, Artificial Sequence
  Description of Artificial Sequence: Synthetic oligonucleotide
tgctggttcttttcttctctgaatgtaatgaggcttgc

SEQ ID NO: 259142 - DNA, 37 bp, Artificial Sequence
  Description of Artificial Sequence: Synthetic oligonucleotide
gctggttcttttcttctctgaatgtaatgaggcttgc

SEQ ID NO: 259143 - DNA, 40 bp, Artificial Sequence
  Description of Artificial Sequence: Synthetic oligonucleotide
ctggttcttttcttctctgaatgtaatgaggcttgcattc

SEQ ID NO: 259144 - DNA, 42 bp, Artificial Sequence
  Description of Artificial Sequence: Synthetic oligonucleotide
tggttcttttcttctctgaatgtaatgaggcttgcattcatg

SEQ ID NO: 259145 - DNA, 41 bp, Artificial Sequence
  Description of Artificial Sequence: Synthetic oligonucleotide
ggttcttttcttctctgaatgtaatgaggcttgcattcatg

SEQ ID NO: 259146 - DNA, 46 bp, Artificial Sequence
  Description of Artificial Sequence: Synthetic oligonucleotide
gttcttttcttctctgaatgtaatgaggcttgcattcatgataaag

SEQ ID NO: 259147 - DNA, 55 bp, Artificial Sequence
  Description of Artificial Sequence: Synthetic oligonucleotide
ttcttttcttctctgaatgtaatgaggcttgcattcatgataaagttaaaaattg

SEQ ID NO: 259148 - DNA, 54 bp, Artificial Sequence
  Description of Artificial Sequence: Synthetic oligonucleotide
tcttttcttctctgaatgtaatgaggcttgcattcatgataaagttaaaaattg

SEQ ID NO: 259149 - DNA, 53 bp, Artificial Sequence
  Description of Artificial Sequence: Synthetic oligonucleotide
cttttcttctctgaatgtaatgaggcttgcattcatgataaagttaaaaattg

SEQ ID NO: 259150 - DNA, 55 bp, Artificial Sequence
  Description of Artificial Sequence: Synthetic oligonucleotide
ttttcttctctgaatgtaatgaggcttgcattcatgataaagttaaaaattgaag

SEQ ID NO: 259151 - DNA, 54 bp, Artificial Sequence
  Description of Artificial Sequence: Synthetic oligonucleotide
tttcttctctgaatgtaatgaggcttgcattcatgataaagttaaaaattgaag

SEQ ID NO: 259152 - DNA, 53 bp, Artificial Sequence
  Description of Artificial Sequence: Synthetic oligonucleotide
ttcttctctgaatgtaatgaggcttgcattcatgataaagttaaaaattgaag

SEQ ID NO: 259153 - DNA, 52 bp, Artificial Sequence
  Description of Artificial Sequence: Synthetic oligonucleotide
tcttctctgaatgtaatgaggcttgcattcatgataaagttaaaaattgaag

SEQ ID NO: 259154 - DNA, 51 bp, Artificial Sequence
  Description of Artificial Sequence: Synthetic oligonucleotide
cttctctgaatgtaatgaggcttgcattcatgataaagttaaaaattgaag

SEQ ID NO: 259155 - DNA, 56 bp, Artificial Sequence
  Description of Artificial Sequence: Synthetic oligonucleotide
ttctctgaatgtaatgaggcttgcattcatgataaagttaaaaattgaagaaattg

SEQ ID NO: 259156 - DNA, 55 bp, Artificial Sequence
  Description of Artificial Sequence: Synthetic oligonucleotide
tctctgaatgtaatgaggcttgcattcatgataaagttaaaaattgaagaaattg

SEQ ID NO: 259157 - DNA, 54 bp, Artificial Sequence
  Description of Artificial Sequence: Synthetic oligonucleotide
ctctgaatgtaatgaggcttgcattcatgataaagttaaaaattgaagaaattg

SEQ ID NO: 259158 - DNA, 55 bp, Artificial Sequence
  Description of Artificial Sequence: Synthetic oligonucleotide
tctgaatgtaatgaggcttgcattcatgataaagttaaaaattgaagaaattgag

SEQ ID NO: 259159 - DNA, 54 bp, Artificial Sequence
  Description of Artificial Sequence: Synthetic oligonucleotide
ctgaatgtaatgaggcttgcattcatgataaagttaaaaattgaagaaattgag

SEQ ID NO: 259160 - DNA, 58 bp, Artificial Sequence
  Description of Artificial Sequence: Synthetic oligonucleotide
tgaatgtaatgaggcttgcattcatgataaagttaaaaattgaagaaattgagtttac

SEQ ID NO: 259161 - DNA, 57 bp, Artificial Sequence
  Description of Artificial Sequence: Synthetic oligonucleotide
gaatgtaatgaggcttgcattcatgataaagttaaaaattgaagaaattgagtttac

SEQ ID NO: 259162 - DNA, 57 bp, Artificial Sequence
  Description of Artificial Sequence: Synthetic oligonucleotide
aatgtaatgaggcttgcattcatgataaagttaaaaattgaagaaattgagtttacc

SEQ ID NO: 259163 - DNA, 56 bp, Artificial Sequence
  Description of Artificial Sequence: Synthetic oligonucleotide
atgtaatgaggcttgcattcatgataaagttaaaaattgaagaaattgagtttacc

SEQ ID NO: 259164 - DNA, 55 bp, Artificial Sequence
  Description of Artificial Sequence: Synthetic oligonucleotide
tgtaatgaggcttgcattcatgataaagttaaaaattgaagaaattgagtttacc

SEQ ID NO: 259165 - DNA, 54 bp, Artificial Sequence
  Description of Artificial Sequence: Synthetic oligonucleotide
gtaatgaggcttgcattcatgataaagttaaaaattgaagaaattgagtttacc

SEQ ID NO: 259166 - DNA, 54 bp, Artificial Sequence
  Description of Artificial Sequence: Synthetic oligonucleotide
taatgaggcttgcattcatgataaagttaaaaattgaagaaattgagtttaccc

SEQ ID NO: 259167 - DNA, 53 bp, Artificial Sequence
  Description of Artificial Sequence: Synthetic oligonucleotide
aatgaggcttgcattcatgataaagttaaaaattgaagaaattgagtttaccc

SEQ ID NO: 259168 - DNA, 52 bp, Artificial Sequence
  Description of Artificial Sequence: Synthetic oligonucleotide
atgaggcttgcattcatgataaagttaaaaattgaagaaattgagtttaccc

SEQ ID NO: 259169 - DNA, 51 bp, Artificial Sequence
  Description of Artificial Sequence: Synthetic oligonucleotide
tgaggcttgcattcatgataaagttaaaaattgaagaaattgagtttaccc

SEQ ID NO: 259170 - DNA, 50 bp, Artificial Sequence
  Description of Artificial Sequence: Synthetic oligonucleotide
gaggcttgcattcatgataaagttaaaaattgaagaaattgagtttaccc

SEQ ID NO: 259171 - DNA, 53 bp, Artificial Sequence
  Description of Artificial Sequence: Synthetic oligonucleotide
aggcttgcattcatgataaagttaaaaattgaagaaattgagtttacccaatc

SEQ ID NO: 259172 - DNA, 52 bp, Artificial Sequence
  Description of Artificial Sequence: Synthetic oligonucleotide
ggcttgcattcatgataaagttaaaaattgaagaaattgagtttacccaatc

SEQ ID NO: 259173 - DNA, 55 bp, Artificial Sequence
  Description of Artificial Sequence: Synthetic oligonucleotide
gcttgcattcatgataaagttaaaaattgaagaaattgagtttacccaatcttag

SEQ ID NO: 259174 - DNA, 55 bp, Artificial Sequence
  Description of Artificial Sequence: Synthetic oligonucleotide
cttgcattcatgataaagttaaaaattgaagaaattgagtttacccaatcttagc

SEQ ID NO: 259175 - DNA, 56 bp, Artificial Sequence
  Description of Artificial Sequence: Synthetic oligonucleotide
ttgcattcatgataaagttaaaaattgaagaaattgagtttacccaatcttagctg

SEQ ID NO: 259176 - DNA, 55 bp, Artificial Sequence
  Description of Artificial Sequence: Synthetic oligonucleotide
tgcattcatgataaagttaaaaattgaagaaattgagtttacccaatcttagctg

SEQ ID NO: 259177 - DNA, 54 bp, Artificial Sequence
  Description of Artificial Sequence: Synthetic oligonucleotide
gcattcatgataaagttaaaaattgaagaaattgagtttacccaatcttagctg

SEQ ID NO: 259178 - DNA, 60 bp, Artificial Sequence
  Description of Artificial Sequence: Synthetic oligonucleotide
cattcatgataaagttaaaaattgaagaaattgagtttacccaatcttagctgtttttta

SEQ ID NO: 259179 - DNA, 60 bp, Artificial Sequence
  Description of Artificial Sequence: Synthetic oligonucleotide
attcatgataaagttaaaaattgaagaaattgagtttacccaatcttagctgttttttag

SEQ ID NO: 259180 - DNA, 60 bp, Artificial Sequence
  Description of Artificial Sequence: Synthetic oligonucleotide
ttcatgataaagttaaaaattgaagaaattgagtttacccaatcttagctgttttttagg

SEQ ID NO: 259181 - DNA, 59 bp, Artificial Sequence
  Description of Artificial Sequence: Synthetic oligonucleotide
tcatgataaagttaaaaattgaagaaattgagtttacccaatcttagctgttttttagg

SEQ ID NO: 259182 - DNA, 58 bp, Artificial Sequence
  Description of Artificial Sequence: Synthetic oligonucleotide
catgataaagttaaaaattgaagaaattgagtttacccaatcttagctgttttttagg

SEQ ID NO: 259183 - DNA, 58 bp, Artificial Sequence
  Description of Artificial Sequence: Synthetic oligonucleotide
atgataaagttaaaaattgaagaaattgagtttacccaatcttagctgttttttaggg

SEQ ID NO: 259184 - DNA, 57 bp, Artificial Sequence
  Description of Artificial Sequence: Synthetic oligonucleotide
tgataaagttaaaaattgaagaaattgagtttacccaatcttagctgttttttaggg

SEQ ID NO: 259185 - DNA, 56 bp, Artificial Sequence
  Description of Artificial Sequence: Synthetic oligonucleotide
gataaagttaaaaattgaagaaattgagtttacccaatcttagctgttttttaggg

SEQ ID NO: 259186 - DNA, 57 bp, Artificial Sequence
  Description of Artificial Sequence: Synthetic oligonucleotide
ataaagttaaaaattgaagaaattgagtttacccaatcttagctgttttttagggac

SEQ ID NO: 259187 - DNA, 56 bp, Artificial Sequence
  Description of Artificial Sequence: Synthetic oligonucleotide
taaagttaaaaattgaagaaattgagtttacccaatcttagctgttttttagggac

SEQ ID NO: 259188 - DNA, 55 bp, Artificial Sequence
  Description of Artificial Sequence: Synthetic oligonucleotide
aaagttaaaaattgaagaaattgagtttacccaatcttagctgttttttagggac

SEQ ID NO: 259189 - DNA, 54 bp, Artificial Sequence
  Description of Artificial Sequence: Synthetic oligonucleotide
aagttaaaaattgaagaaattgagtttacccaatcttagctgttttttagggac

SEQ ID NO: 259190 - DNA, 53 bp, Artificial Sequence
  Description of Artificial Sequence: Synthetic oligonucleotide
agttaaaaattgaagaaattgagtttacccaatcttagctgttttttagggac

SEQ ID NO: 259191 - DNA, 52 bp, Artificial Sequence
  Description of Artificial Sequence: Synthetic oligonucleotide
gttaaaaattgaagaaattgagtttacccaatcttagctgttttttagggac

SEQ ID NO: 259192 - DNA, 54 bp, Artificial Sequence
  Description of Artificial Sequence: Synthetic oligonucleotide
ttaaaaattgaagaaattgagtttacccaatcttagctgttttttagggacaag

SEQ ID NO: 259193 - DNA, 53 bp, Artificial Sequence
  Description of Artificial Sequence: Synthetic oligonucleotide
taaaaattgaagaaattgagtttacccaatcttagctgttttttagggacaag

SEQ ID NO: 259194 - DNA, 52 bp, Artificial Sequence
  Description of Artificial Sequence: Synthetic oligonucleotide
aaaaattgaagaaattgagtttacccaatcttagctgttttttagggacaag

SEQ ID NO: 259195 - DNA, 51 bp, Artificial Sequence
  Description of Artificial Sequence: Synthetic oligonucleotide
aaaattgaagaaattgagtttacccaatcttagctgttttttagggacaag

SEQ ID NO: 259196 - DNA, 50 bp, Artificial Sequence
  Description of Artificial Sequence: Synthetic oligonucleotide
aaattgaagaaattgagtttacccaatcttagctgttttttagggacaag

SEQ ID NO: 259197 - DNA, 49 bp, Artificial Sequence
  Description of Artificial Sequence: Synthetic oligonucleotide
aattgaagaaattgagtttacccaatcttagctgttttttagggacaag

SEQ ID NO: 259198 - DNA, 48 bp, Artificial Sequence
  Description of Artificial Sequence: Synthetic oligonucleotide
attgaagaaattgagtttacccaatcttagctgttttttagggacaag

SEQ ID NO: 259199 - DNA, 47 bp, Artificial Sequence
  Description of Artificial Sequence: Synthetic oligonucleotide
ttgaagaaattgagtttacccaatcttagctgttttttagggacaag

SEQ ID NO: 259200 - DNA, 46 bp, Artificial Sequence
  Description of Artificial Sequence: Synthetic oligonucleotide
tgaagaaattgagtttacccaatcttagctgttttttagggacaag

SEQ ID NO: 259201 - DNA, 45 bp, Artificial Sequence
  Description of Artificial Sequence: Synthetic oligonucleotide
gaagaaattgagtttacccaatcttagctgttttttagggacaag

SEQ ID NO: 259202 - DNA, 45 bp, Artificial Sequence
  Description of Artificial Sequence: Synthetic oligonucleotide
aagaaattgagtttacccaatcttagctgttttttagggacaagg

SEQ ID NO: 259203 - DNA, 44 bp, Artificial Sequence
  Description of Artificial Sequence: Synthetic oligonucleotide
agaaattgagtttacccaatcttagctgttttttagggacaagg

SEQ ID NO: 259204 - DNA, 43 bp, Artificial Sequence
  Description of Artificial Sequence: Synthetic oligonucleotide
gaaattgagtttacccaatcttagctgttttttagggacaagg

SEQ ID NO: 259205 - DNA, 45 bp, Artificial Sequence
  Description of Artificial Sequence: Synthetic oligonucleotide
aaattgagtttacccaatcttagctgttttttagggacaaggatg

SEQ ID NO: 259206 - DNA, 44 bp, Artificial Sequence
  Description of Artificial Sequence: Synthetic oligonucleotide
aattgagtttacccaatcttagctgttttttagggacaaggatg

SEQ ID NO: 259207 - DNA, 43 bp, Artificial Sequence
  Description of Artificial Sequence: Synthetic oligonucleotide
attgagtttacccaatcttagctgttttttagggacaaggatg

SEQ ID NO: 259208 - DNA, 42 bp, Artificial Sequence
  Description of Artificial Sequence: Synthetic oligonucleotide
ttgagtttacccaatcttagctgttttttagggacaaggatg

SEQ ID NO: 259209 - DNA, 41 bp, Artificial Sequence
  Description of Artificial Sequence: Synthetic oligonucleotide
tgagtttacccaatcttagctgttttttagggacaaggatg

SEQ ID NO: 259210 - DNA, 40 bp, Artificial Sequence
  Description of Artificial Sequence: Synthetic oligonucleotide
gagtttacccaatcttagctgttttttagggacaaggatg

SEQ ID NO: 259211 - DNA, 42 bp, Artificial Sequence
  Description of Artificial Sequence: Synthetic oligonucleotide
agtttacccaatcttagctgttttttagggacaaggatgaac

SEQ ID NO: 259212 - DNA, 41 bp, Artificial Sequence
  Description of Artificial Sequence: Synthetic oligonucleotide
gtttacccaatcttagctgttttttagggacaaggatgaac

SEQ ID NO: 259213 - DNA, 41 bp, Artificial Sequence
  Description of Artificial Sequence: Synthetic oligonucleotide
tttacccaatcttagctgttttttagggacaaggatgaacg

SEQ ID NO: 259214 - DNA, 40 bp, Artificial Sequence
  Description of Artificial Sequence: Synthetic oligonucleotide
ttacccaatcttagctgttttttagggacaaggatgaacg

SEQ ID NO: 259215 - DNA, 39 bp, Artificial Sequence
  Description of Artificial Sequence: Synthetic oligonucleotide
tacccaatcttagctgttttttagggacaaggatgaacg

SEQ ID NO: 259216 - DNA, 38 bp, Artificial Sequence
  Description of Artificial Sequence: Synthetic oligonucleotide
acccaatcttagctgttttttagggacaaggatgaacg

SEQ ID NO: 259217 - DNA, 37 bp, Artificial Sequence
  Description of Artificial Sequence: Synthetic oligonucleotide
cccaatcttagctgttttttagggacaaggatgaacg

SEQ ID NO: 259218 - DNA, 37 bp, Artificial Sequence
  Description of Artificial Sequence: Synthetic oligonucleotide
ccaatcttagctgttttttagggacaaggatgaacgc

SEQ ID NO: 259219 - DNA, 38 bp, Artificial Sequence
  Description of Artificial Sequence: Synthetic oligonucleotide
caatcttagctgttttttagggacaaggatgaacgctg

SEQ ID NO: 259220 - DNA, 44 bp, Artificial Sequence
  Description of Artificial Sequence: Synthetic oligonucleotide
aatcttagctgttttttagggacaaggatgaacgctgatatttc

SEQ ID NO: 259221 - DNA, 43 bp, Artificial Sequence
  Description of Artificial Sequence: Synthetic oligonucleotide
atcttagctgttttttagggacaaggatgaacgctgatatttc

SEQ ID NO: 259222 - DNA, 42 bp, Artificial Sequence
  Description of Artificial Sequence: Synthetic oligonucleotide
tcttagctgttttttagggacaaggatgaacgctgatatttc

SEQ ID NO: 259223 - DNA, 41 bp, Artificial Sequence
  Description of Artificial Sequence: Synthetic oligonucleotide
cttagctgttttttagggacaaggatgaacgctgatatttc

SEQ ID NO: 259224 - DNA, 43 bp, Artificial Sequence
  Description of Artificial Sequence: Synthetic oligonucleotide
ttagctgttttttagggacaaggatgaacgctgatatttcttc

SEQ ID NO: 259225 - DNA, 42 bp, Artificial Sequence
  Description of Artificial Sequence: Synthetic oligonucleotide
tagctgttttttagggacaaggatgaacgctgatatttcttc

SEQ ID NO: 259226 - DNA, 41 bp, Artificial Sequence
  Description of Artificial Sequence: Synthetic oligonucleotide
agctgttttttagggacaaggatgaacgctgatatttcttc

SEQ ID NO: 259227 - DNA, 40 bp, Artificial Sequence
  Description of Artificial Sequence: Synthetic oligonucleotide
gctgttttttagggacaaggatgaacgctgatatttcttc

SEQ ID NO: 259228 - DNA, 42 bp, Artificial Sequence
  Description of Artificial Sequence: Synthetic oligonucleotide
ctgttttttagggacaaggatgaacgctgatatttcttcatg

SEQ ID NO: 259229 - DNA, 43 bp, Artificial Sequence
  Description of Artificial Sequence: Synthetic oligonucleotide
tgttttttagggacaaggatgaacgctgatatttcttcatgag

SEQ ID NO: 259230 - DNA, 42 bp, Artificial Sequence
  Description of Artificial Sequence: Synthetic oligonucleotide
gttttttagggacaaggatgaacgctgatatttcttcatgag

SEQ ID NO: 259231 - DNA, 43 bp, Artificial Sequence
  Description of Artificial Sequence: Synthetic oligonucleotide
ttttttagggacaaggatgaacgctgatatttcttcatgagtg

SEQ ID NO: 259232 - DNA, 42 bp, Artificial Sequence
  Description of Artificial Sequence: Synthetic oligonucleotide
tttttagggacaaggatgaacgctgatatttcttcatgagtg

SEQ ID NO: 259233 - DNA, 41 bp, Artificial Sequence
  Description of Artificial Sequence: Synthetic oligonucleotide
ttttagggacaaggatgaacgctgatatttcttcatgagtg

SEQ ID NO: 259234 - DNA, 40 bp, Artificial Sequence
  Description of Artificial Sequence: Synthetic oligonucleotide
tttagggacaaggatgaacgctgatatttcttcatgagtg

SEQ ID NO: 259235 - DNA, 39 bp, Artificial Sequence
  Description of Artificial Sequence: Synthetic oligonucleotide
ttagggacaaggatgaacgctgatatttcttcatgagtg

SEQ ID NO: 259236 - DNA, 38 bp, Artificial Sequence
  Description of Artificial Sequence: Synthetic oligonucleotide
tagggacaaggatgaacgctgatatttcttcatgagtg

SEQ ID NO: 259237 - DNA, 37 bp, Artificial Sequence
  Description of Artificial Sequence: Synthetic oligonucleotide
agggacaaggatgaacgctgatatttcttcatgagtg

SEQ ID NO: 259238 - DNA, 36 bp, Artificial Sequence
  Description of Artificial Sequence: Synthetic oligonucleotide
gggacaaggatgaacgctgatatttcttcatgagtg

SEQ ID NO: 259239 - DNA, 36 bp, Artificial Sequence
  Description of Artificial Sequence: Synthetic oligonucleotide
ggacaaggatgaacgctgatatttcttcatgagtgc

SEQ ID NO: 259240 - DNA, 40 bp, Artificial Sequence
  Description of Artificial Sequence: Synthetic oligonucleotide
gacaaggatgaacgctgatatttcttcatgagtgcttatg

SEQ ID NO: 259241 - DNA, 41 bp, Artificial Sequence
  Description of Artificial Sequence: Synthetic oligonucleotide
acaaggatgaacgctgatatttcttcatgagtgcttatgtg

SEQ ID NO: 259242 - DNA, 40 bp, Artificial Sequence
  Description of Artificial Sequence: Synthetic oligonucleotide
caaggatgaacgctgatatttcttcatgagtgcttatgtg

SEQ ID NO: 259243 - DNA, 40 bp, Artificial Sequence
  Description of Artificial Sequence: Synthetic oligonucleotide
aaggatgaacgctgatatttcttcatgagtgcttatgtgg

SEQ ID NO: 259244 - DNA, 39 bp, Artificial Sequence
  Description of Artificial Sequence: Synthetic oligonucleotide
aggatgaacgctgatatttcttcatgagtgcttatgtgg

SEQ ID NO: 259245 - DNA, 38 bp, Artificial Sequence
  Description of Artificial Sequence: Synthetic oligonucleotide
ggatgaacgctgatatttcttcatgagtgcttatgtgg

SEQ ID NO: 259246 - DNA, 39 bp, Artificial Sequence
  Description of Artificial Sequence: Synthetic oligonucleotide
gatgaacgctgatatttcttcatgagtgcttatgtggac

SEQ ID NO: 259247 - DNA, 40 bp, Artificial Sequence
  Description of Artificial Sequence: Synthetic oligonucleotide
atgaacgctgatatttcttcatgagtgcttatgtggacac

SEQ ID NO: 259248 - DNA, 39 bp, Artificial Sequence
  Description of Artificial Sequence: Synthetic oligonucleotide
tgaacgctgatatttcttcatgagtgcttatgtggacac

SEQ ID NO: 259249 - DNA, 38 bp, Artificial Sequence
  Description of Artificial Sequence: Synthetic oligonucleotide
gaacgctgatatttcttcatgagtgcttatgtggacac

SEQ ID NO: 259250 - DNA, 39 bp, Artificial Sequence
  Description of Artificial Sequence: Synthetic oligonucleotide
aacgctgatatttcttcatgagtgcttatgtggacactg

SEQ ID NO: 259251 - DNA, 38 bp, Artificial Sequence
  Description of Artificial Sequence: Synthetic oligonucleotide
acgctgatatttcttcatgagtgcttatgtggacactg

SEQ ID NO: 259252 - DNA, 37 bp, Artificial Sequence
  Description of Artificial Sequence: Synthetic oligonucleotide
cgctgatatttcttcatgagtgcttatgtggacactg

SEQ ID NO: 259253 - DNA, 37 bp, Artificial Sequence
  Description of Artificial Sequence: Synthetic oligonucleotide
gctgatatttcttcatgagtgcttatgtggacactgc

SEQ ID NO: 259254 - DNA, 37 bp, Artificial Sequence
  Description of Artificial Sequence: Synthetic oligonucleotide
ctgatatttcttcatgagtgcttatgtggacactgcc

SEQ ID NO: 259255 - DNA, 37 bp, Artificial Sequence
  Description of Artificial Sequence: Synthetic oligonucleotide
tgatatttcttcatgagtgcttatgtggacactgccc

SEQ ID NO: 259256 - DNA, 36 bp, Artificial Sequence
  Description of Artificial Sequence: Synthetic oligonucleotide
gatatttcttcatgagtgcttatgtggacactgccc

SEQ ID NO: 259257 - DNA, 37 bp, Artificial Sequence
  Description of Artificial Sequence: Synthetic oligonucleotide
atatttcttcatgagtgcttatgtggacactgcccag

SEQ ID NO: 259258 - DNA, 36 bp, Artificial Sequence
  Description of Artificial Sequence: Synthetic oligonucleotide
tatttcttcatgagtgcttatgtggacactgcccag

SEQ ID NO: 259259 - DNA, 35 bp, Artificial Sequence
  Description of Artificial Sequence: Synthetic oligonucleotide
atttcttcatgagtgcttatgtggacactgcccag

SEQ ID NO: 259260 - DNA, 34 bp, Artificial Sequence
  Description of Artificial Sequence: Synthetic oligonucleotide
tttcttcatgagtgcttatgtggacactgcccag

SEQ ID NO: 259261 - DNA, 33 bp, Artificial Sequence
  Description of Artificial Sequence: Synthetic oligonucleotide
ttcttcatgagtgcttatgtggacactgcccag

SEQ ID NO: 259262 - DNA, 32 bp, Artificial Sequence
  Description of Artificial Sequence: Synthetic oligonucleotide
tcttcatgagtgcttatgtggacactgcccag

SEQ ID NO: 259263 - DNA, 31 bp, Artificial Sequence
  Description of Artificial Sequence: Synthetic oligonucleotide
cttcatgagtgcttatgtggacactgcccag

SEQ ID NO: 259264 - DNA, 32 bp, Artificial Sequence
  Description of Artificial Sequence: Synthetic oligonucleotide
ttcatgagtgcttatgtggacactgcccagag

SEQ ID NO: 259265 - DNA, 31 bp, Artificial Sequence
  Description of Artificial Sequence: Synthetic oligonucleotide
tcatgagtgcttatgtggacactgcccagag

SEQ ID NO: 259266 - DNA, 30 bp, Artificial Sequence
  Description of Artificial Sequence: Synthetic oligonucleotide
catgagtgcttatgtggacactgcccagag

SEQ ID NO: 259267 - DNA, 33 bp, Artificial Sequence
  Description of Artificial Sequence: Synthetic oligonucleotide
atgagtgcttatgtggacactgcccagagatag

SEQ ID NO: 259268 - DNA, 32 bp, Artificial Sequence
  Description of Artificial Sequence: Synthetic oligonucleotide
tgagtgcttatgtggacactgcccagagatag

SEQ ID NO: 259269 - DNA, 31 bp, Artificial Sequence
  Description of Artificial Sequence: Synthetic oligonucleotide
gagtgcttatgtggacactgcccagagatag

SEQ ID NO: 259270 - DNA, 31 bp, Artificial Sequence
  Description of Artificial Sequence: Synthetic oligonucleotide
agtgcttatgtggacactgcccagagatagg

SEQ ID NO: 259271 - DNA, 30 bp, Artificial Sequence
  Description of Artificial Sequence: Synthetic oligonucleotide
gtgcttatgtggacactgcccagagatagg

SEQ ID NO: 259272 - DNA, 31 bp, Artificial Sequence
  Description of Artificial Sequence: Synthetic oligonucleotide
tgcttatgtggacactgcccagagataggag

SEQ ID NO: 259273 - DNA, 30 bp, Artificial Sequence
  Description of Artificial Sequence: Synthetic oligonucleotide
gcttatgtggacactgcccagagataggag

SEQ ID NO: 259274 - DNA, 30 bp, Artificial Sequence
  Description of Artificial Sequence: Synthetic oligonucleotide
cttatgtggacactgcccagagataggagc

SEQ ID NO: 259275 - DNA, 30 bp, Artificial Sequence
  Description of Artificial Sequence: Synthetic oligonucleotide
ttatgtggacactgcccagagataggagcc

SEQ ID NO: 259276 - DNA, 29 bp, Artificial Sequence
  Description of Artificial Sequence: Synthetic oligonucleotide
tatgtggacactgcccagagataggagcc

SEQ ID NO: 259277 - DNA, 28 bp, Artificial Sequence
  Description of Artificial Sequence: Synthetic oligonucleotide
atgtggacactgcccagagataggagcc

SEQ ID NO: 259278 - DNA, 27 bp, Artificial Sequence
  Description of Artificial Sequence: Synthetic oligonucleotide
tgtggacactgcccagagataggagcc

SEQ ID NO: 259279 - DNA, 27 bp, Artificial Sequence
  Description of Artificial Sequence: Synthetic oligonucleotide
gtggacactgcccagagataggagcct

SEQ ID NO: 259280 - DNA, 27 bp, Artificial Sequence
  Description of Artificial Sequence: Synthetic oligonucleotide
tggacactgcccagagataggagcctg

SEQ ID NO: 259281 - DNA, 27 bp, Artificial Sequence
  Description of Artificial Sequence: Synthetic oligonucleotide
ggacactgcccagagataggagcctgt

SEQ ID NO: 259282 - DNA, 27 bp, Artificial Sequence
  Description of Artificial Sequence: Synthetic oligonucleotide
gacactgcccagagataggagcctgtg

SEQ ID NO: 259283 - DNA, 27 bp, Artificial Sequence
  Description of Artificial Sequence: Synthetic oligonucleotide
acactgcccagagataggagcctgtgg

SEQ ID NO: 259284 - DNA, 27 bp, Artificial Sequence
  Description of Artificial Sequence: Synthetic oligonucleotide
cactgcccagagataggagcctgtgga

SEQ ID NO: 259285 - DNA, 28 bp, Artificial Sequence
  Description of Artificial Sequence: Synthetic oligonucleotide
actgcccagagataggagcctgtggatg

SEQ ID NO: 259286 - DNA, 27 bp, Artificial Sequence
  Description of Artificial Sequence: Synthetic oligonucleotide
ctgcccagagataggagcctgtggatg

SEQ ID NO: 259287 - DNA, 27 bp, Artificial Sequence
  Description of Artificial Sequence: Synthetic oligonucleotide
tgcccagagataggagcctgtggatgg

SEQ ID NO: 259288 - DNA, 26 bp, Artificial Sequence
  Description of Artificial Sequence: Synthetic oligonucleotide
gcccagagataggagcctgtggatgg

SEQ ID NO: 259289 - DNA, 27 bp, Artificial Sequence
  Description of Artificial Sequence: Synthetic oligonucleotide
cccagagataggagcctgtggatggga

SEQ ID NO: 259290 - DNA, 27 bp, Artificial Sequence
  Description of Artificial Sequence: Synthetic oligonucleotide
ccagagataggagcctgtggatgggag

SEQ ID NO: 259291 - DNA, 27 bp, Artificial Sequence
  Description of Artificial Sequence: Synthetic oligonucleotide
cagagataggagcctgtggatgggagc

SEQ ID NO: 259292 - DNA, 27 bp, Artificial Sequence
  Description of Artificial Sequence: Synthetic oligonucleotide
agagataggagcctgtggatgggagcc

SEQ ID NO: 259293 - DNA, 27 bp, Artificial Sequence
  Description of Artificial Sequence: Synthetic oligonucleotide
gagataggagcctgtggatgggagcct

SEQ ID NO: 259294 - DNA, 27 bp, Artificial Sequence
  Description of Artificial Sequence: Synthetic oligonucleotide
agataggagcctgtggatgggagcctg

SEQ ID NO: 259295 - DNA, 26 bp, Artificial Sequence
  Description of Artificial Sequence: Synthetic oligonucleotide
gataggagcctgtggatgggagcctg

SEQ ID NO: 259296 - DNA, 27 bp, Artificial Sequence
  Description of Artificial Sequence: Synthetic oligonucleotide
ataggagcctgtggatgggagcctggt

SEQ ID NO: 259297 - DNA, 26 bp, Artificial Sequence
  Description of Artificial Sequence: Synthetic oligonucleotide
taggagcctgtggatgggagcctggt

SEQ ID NO: 259298 - DNA, 25 bp, Artificial Sequence
  Description of Artificial Sequence: Synthetic oligonucleotide
aggagcctgtggatgggagcctggt

SEQ ID NO: 259299 - DNA, 24 bp, Artificial Sequence
  Description of Artificial Sequence: Synthetic oligonucleotide
ggagcctgtggatgggagcctggt

SEQ ID NO: 259300 - DNA, 24 bp, Artificial Sequence
  Description of Artificial Sequence: Synthetic oligonucleotide
gagcctgtggatgggagcctggtg

SEQ ID NO: 259301 - DNA, 25 bp, Artificial Sequence
  Description of Artificial Sequence: Synthetic oligonucleotide
agcctgtggatgggagcctggtgca

SEQ ID NO: 259302 - DNA, 24 bp, Artificial Sequence
  Description of Artificial Sequence: Synthetic oligonucleotide
gcctgtggatgggagcctggtgca

SEQ ID NO: 259303 - DNA, 27 bp, Artificial Sequence
  Description of Artificial Sequence: Synthetic oligonucleotide
cctgtggatgggagcctggtgcagatt

SEQ ID NO: 259304 - DNA, 29 bp, Artificial Sequence
  Description of Artificial Sequence: Synthetic oligonucleotide
ctgtggatgggagcctggtgcagattttg

SEQ ID NO: 259305 - DNA, 29 bp, Artificial Sequence
  Description of Artificial Sequence: Synthetic oligonucleotide
tgtggatgggagcctggtgcagattttgc

SEQ ID NO: 259306 - DNA, 28 bp, Artificial Sequence
  Description of Artificial Sequence: Synthetic oligonucleotide
gtggatgggagcctggtgcagattttgc

SEQ ID NO: 259307 - DNA, 32 bp, Artificial Sequence
  Description of Artificial Sequence: Synthetic oligonucleotide
tggatgggagcctggtgcagattttgcttaag

SEQ ID NO: 259308 - DNA, 31 bp, Artificial Sequence
  Description of Artificial Sequence: Synthetic oligonucleotide
ggatgggagcctggtgcagattttgcttaag

SEQ ID NO: 259309 - DNA, 33 bp, Artificial Sequence
  Description of Artificial Sequence: Synthetic oligonucleotide
gatgggagcctggtgcagattttgcttaagaac

SEQ ID NO: 259310 - DNA, 33 bp, Artificial Sequence
  Description of Artificial Sequence: Synthetic oligonucleotide
atgggagcctggtgcagattttgcttaagaacc

SEQ ID NO: 259311 - DNA, 32 bp, Artificial Sequence
  Description of Artificial Sequence: Synthetic oligonucleotide
tgggagcctggtgcagattttgcttaagaacc

SEQ ID NO: 259312 - DNA, 31 bp, Artificial Sequence
  Description of Artificial Sequence: Synthetic oligonucleotide
gggagcctggtgcagattttgcttaagaacc

SEQ ID NO: 259313 - DNA, 31 bp, Artificial Sequence
  Description of Artificial Sequence: Synthetic oligonucleotide
ggagcctggtgcagattttgcttaagaaccc

SEQ ID NO: 259314 - DNA, 32 bp, Artificial Sequence
  Description of Artificial Sequence: Synthetic oligonucleotide
gagcctggtgcagattttgcttaagaaccctg

SEQ ID NO: 259315 - DNA, 32 bp, Artificial Sequence
  Description of Artificial Sequence: Synthetic oligonucleotide
agcctggtgcagattttgcttaagaaccctgc

SEQ ID NO: 259316 - DNA, 31 bp, Artificial Sequence
  Description of Artificial Sequence: Synthetic oligonucleotide
gcctggtgcagattttgcttaagaaccctgc

SEQ ID NO: 259317 - DNA, 35 bp, Artificial Sequence
  Description of Artificial Sequence: Synthetic oligonucleotide
cctggtgcagattttgcttaagaaccctgctaatg

SEQ ID NO: 259318 - DNA, 37 bp, Artificial Sequence
  Description of Artificial Sequence: Synthetic oligonucleotide
ctggtgcagattttgcttaagaaccctgctaatgatg

SEQ ID NO: 259319 - DNA, 37 bp, Artificial Sequence
  Description of Artificial Sequence: Synthetic oligonucleotide
tggtgcagattttgcttaagaaccctgctaatgatgg

SEQ ID NO: 259320 - DNA, 36 bp, Artificial Sequence
  Description of Artificial Sequence: Synthetic oligonucleotide
ggtgcagattttgcttaagaaccctgctaatgatgg

SEQ ID NO: 259321 - DNA, 37 bp, Artificial Sequence
  Description of Artificial Sequence: Synthetic oligonucleotide
gtgcagattttgcttaagaaccctgctaatgatggtc

SEQ ID NO: 259322 - DNA, 37 bp, Artificial Sequence
  Description of Artificial Sequence: Synthetic oligonucleotide
tgcagattttgcttaagaaccctgctaatgatggtcg

SEQ ID NO: 259323 - DNA, 36 bp, Artificial Sequence
  Description of Artificial Sequence: Synthetic oligonucleotide
gcagattttgcttaagaaccctgctaatgatggtcg

SEQ ID NO: 259324 - DNA, 36 bp, Artificial Sequence
  Description of Artificial Sequence: Synthetic oligonucleotide
cagattttgcttaagaaccctgctaatgatggtcgc

SEQ ID NO: 259325 - DNA, 36 bp, Artificial Sequence
  Description of Artificial Sequence: Synthetic oligonucleotide
agattttgcttaagaaccctgctaatgatggtcgcc

SEQ ID NO: 259326 - DNA, 35 bp, Artificial Sequence
  Description of Artificial Sequence: Synthetic oligonucleotide
gattttgcttaagaaccctgctaatgatggtcgcc

SEQ ID NO: 259327 - DNA, 38 bp, Artificial Sequence
  Description of Artificial Sequence: Synthetic oligonucleotide
attttgcttaagaaccctgctaatgatggtcgccaatg

SEQ ID NO: 259328 - DNA, 37 bp, Artificial Sequence
  Description of Artificial Sequence: Synthetic oligonucleotide
ttttgcttaagaaccctgctaatgatggtcgccaatg

SEQ ID NO: 259329 - DNA, 36 bp, Artificial Sequence
  Description of Artificial Sequence: Synthetic oligonucleotide
tttgcttaagaaccctgctaatgatggtcgccaatg

SEQ ID NO: 259330 - DNA, 35 bp, Artificial Sequence
  Description of Artificial Sequence: Synthetic oligonucleotide
ttgcttaagaaccctgctaatgatggtcgccaatg

SEQ ID NO: 259331 - DNA, 34 bp, Artificial Sequence
  Description of Artificial Sequence: Synthetic oligonucleotide
tgcttaagaaccctgctaatgatggtcgccaatg

SEQ ID NO: 259332 - DNA, 33 bp, Artificial Sequence
  Description of Artificial Sequence: Synthetic oligonucleotide
gcttaagaaccctgctaatgatggtcgccaatg

SEQ ID NO: 259333 - DNA, 33 bp, Artificial Sequence
  Description of Artificial Sequence: Synthetic oligonucleotide
cttaagaaccctgctaatgatggtcgccaatgg

SEQ ID NO: 259334 - DNA, 33 bp, Artificial Sequence
  Description of Artificial Sequence: Synthetic oligonucleotide
ttaagaaccctgctaatgatggtcgccaatggg

SEQ ID NO: 259335 - DNA, 32 bp, Artificial Sequence
  Description of Artificial Sequence: Synthetic oligonucleotide
taagaaccctgctaatgatggtcgccaatggg

SEQ ID NO: 259336 - DNA, 31 bp, Artificial Sequence
  Description of Artificial Sequence: Synthetic oligonucleotide
aagaaccctgctaatgatggtcgccaatggg

SEQ ID NO: 259337 - DNA, 30 bp, Artificial Sequence
  Description of Artificial Sequence: Synthetic oligonucleotide
agaaccctgctaatgatggtcgccaatggg

SEQ ID NO: 259338 - DNA, 29 bp, Artificial Sequence
  Description of Artificial Sequence: Synthetic oligonucleotide
gaaccctgctaatgatggtcgccaatggg

SEQ ID NO: 259339 - DNA, 33 bp, Artificial Sequence
  Description of Artificial Sequence: Synthetic oligonucleotide
aaccctgctaatgatggtcgccaatgggttatg

SEQ ID NO: 259340 - DNA, 32 bp, Artificial Sequence
  Description of Artificial Sequence: Synthetic oligonucleotide
accctgctaatgatggtcgccaatgggttatg

SEQ ID NO: 259341 - DNA, 31 bp, Artificial Sequence
  Description of Artificial Sequence: Synthetic oligonucleotide
ccctgctaatgatggtcgccaatgggttatg

SEQ ID NO: 259342 - DNA, 31 bp, Artificial Sequence
  Description of Artificial Sequence: Synthetic oligonucleotide
cctgctaatgatggtcgccaatgggttatgc

SEQ ID NO: 259343 - DNA, 33 bp, Artificial Sequence
  Description of Artificial Sequence: Synthetic oligonucleotide
ctgctaatgatggtcgccaatgggttatgcttg

SEQ ID NO: 259344 - DNA, 41 bp, Artificial Sequence
  Description of Artificial Sequence: Synthetic oligonucleotide
tgctaatgatggtcgccaatgggttatgcttgtaaatattg

SEQ ID NO: 259345 - DNA, 40 bp, Artificial Sequence
  Description of Artificial Sequence: Synthetic oligonucleotide
gctaatgatggtcgccaatgggttatgcttgtaaatattg

SEQ ID NO: 259346 - DNA, 42 bp, Artificial Sequence
  Description of Artificial Sequence: Synthetic oligonucleotide
ctaatgatggtcgccaatgggttatgcttgtaaatattgttc

SEQ ID NO: 259347 - DNA, 50 bp, Artificial Sequence
  Description of Artificial Sequence: Synthetic oligonucleotide
taatgatggtcgccaatgggttatgcttgtaaatattgttcaaaaatatg

SEQ ID NO: 259348 - DNA, 49 bp, Artificial Sequence
  Description of Artificial Sequence: Synthetic oligonucleotide
aatgatggtcgccaatgggttatgcttgtaaatattgttcaaaaatatg

SEQ ID NO: 259349 - DNA, 48 bp, Artificial Sequence
  Description of Artificial Sequence: Synthetic oligonucleotide
atgatggtcgccaatgggttatgcttgtaaatattgttcaaaaatatg

SEQ ID NO: 259350 - DNA, 47 bp, Artificial Sequence
  Description of Artificial Sequence: Synthetic oligonucleotide
tgatggtcgccaatgggttatgcttgtaaatattgttcaaaaatatg

SEQ ID NO: 259351 - DNA, 46 bp, Artificial Sequence
  Description of Artificial Sequence: Synthetic oligonucleotide
gatggtcgccaatgggttatgcttgtaaatattgttcaaaaatatg

SEQ ID NO: 259352 - DNA, 46 bp, Artificial Sequence
  Description of Artificial Sequence: Synthetic oligonucleotide
atggtcgccaatgggttatgcttgtaaatattgttcaaaaatatgc

SEQ ID NO: 259353 - DNA, 45 bp, Artificial Sequence
  Description of Artificial Sequence: Synthetic oligonucleotide
tggtcgccaatgggttatgcttgtaaatattgttcaaaaatatgc

SEQ ID NO: 259354 - DNA, 44 bp, Artificial Sequence
  Description of Artificial Sequence: Synthetic oligonucleotide
ggtcgccaatgggttatgcttgtaaatattgttcaaaaatatgc

SEQ ID NO: 259355 - DNA, 45 bp, Artificial Sequence
  Description of Artificial Sequence: Synthetic oligonucleotide
gtcgccaatgggttatgcttgtaaatattgttcaaaaatatgctg

SEQ ID NO: 259356 - DNA, 49 bp, Artificial Sequence
  Description of Artificial Sequence: Synthetic oligonucleotide
tcgccaatgggttatgcttgtaaatattgttcaaaaatatgctgttatc

SEQ ID NO: 259357 - DNA, 48 bp, Artificial Sequence
  Description of Artificial Sequence: Synthetic oligonucleotide
cgccaatgggttatgcttgtaaatattgttcaaaaatatgctgttatc

SEQ ID NO: 259358 - DNA, 48 bp, Artificial Sequence
  Description of Artificial Sequence: Synthetic oligonucleotide
gccaatgggttatgcttgtaaatattgttcaaaaatatgctgttatcc

SEQ ID NO: 259359 - DNA, 48 bp, Artificial Sequence
  Description of Artificial Sequence: Synthetic oligonucleotide
ccaatgggttatgcttgtaaatattgttcaaaaatatgctgttatccc

SEQ ID NO: 259360 - DNA, 51 bp, Artificial Sequence
  Description of Artificial Sequence: Synthetic oligonucleotide
caatgggttatgcttgtaaatattgttcaaaaatatgctgttatcccaaag

SEQ ID NO: 259361 - DNA, 55 bp, Artificial Sequence
  Description of Artificial Sequence: Synthetic oligonucleotide
aatgggttatgcttgtaaatattgttcaaaaatatgctgttatcccaaagaaatg

SEQ ID NO: 259362 - DNA, 54 bp, Artificial Sequence
  Description of Artificial Sequence: Synthetic oligonucleotide
atgggttatgcttgtaaatattgttcaaaaatatgctgttatcccaaagaaatg

SEQ ID NO: 259363 - DNA, 53 bp, Artificial Sequence
  Description of Artificial Sequence: Synthetic oligonucleotide
tgggttatgcttgtaaatattgttcaaaaatatgctgttatcccaaagaaatg

SEQ ID NO: 259364 - DNA, 52 bp, Artificial Sequence
  Description of Artificial Sequence: Synthetic oligonucleotide
gggttatgcttgtaaatattgttcaaaaatatgctgttatcccaaagaaatg

SEQ ID NO: 259365 - DNA, 52 bp, Artificial Sequence
  Description of Artificial Sequence: Synthetic oligonucleotide
ggttatgcttgtaaatattgttcaaaaatatgctgttatcccaaagaaatgc

SEQ ID NO: 259366 - DNA, 54 bp, Artificial Sequence
  Description of Artificial Sequence: Synthetic oligonucleotide
gttatgcttgtaaatattgttcaaaaatatgctgttatcccaaagaaatgcatc

SEQ ID NO: 259367 - DNA, 54 bp, Artificial Sequence
  Description of Artificial Sequence: Synthetic oligonucleotide
ttatgcttgtaaatattgttcaaaaatatgctgttatcccaaagaaatgcatcc

SEQ ID NO: 259368 - DNA, 53 bp, Artificial Sequence
  Description of Artificial Sequence: Synthetic oligonucleotide
tatgcttgtaaatattgttcaaaaatatgctgttatcccaaagaaatgcatcc

SEQ ID NO: 259369 - DNA, 52 bp, Artificial Sequence
  Description of Artificial Sequence: Synthetic oligonucleotide
atgcttgtaaatattgttcaaaaatatgctgttatcccaaagaaatgcatcc

SEQ ID NO: 259370 - DNA, 51 bp, Artificial Sequence
  Description of Artificial Sequence: Synthetic oligonucleotide
tgcttgtaaatattgttcaaaaatatgctgttatcccaaagaaatgcatcc

SEQ ID NO: 259371 - DNA, 50 bp, Artificial Sequence
  Description of Artificial Sequence: Synthetic oligonucleotide
gcttgtaaatattgttcaaaaatatgctgttatcccaaagaaatgcatcc

SEQ ID NO: 259372 - DNA, 50 bp, Artificial Sequence
  Description of Artificial Sequence: Synthetic oligonucleotide
cttgtaaatattgttcaaaaatatgctgttatcccaaagaaatgcatccc

SEQ ID NO: 259373 - DNA, 51 bp, Artificial Sequence
  Description of Artificial Sequence: Synthetic oligonucleotide
ttgtaaatattgttcaaaaatatgctgttatcccaaagaaatgcatccctg

SEQ ID NO: 259374 - DNA, 50 bp, Artificial Sequence
  Description of Artificial Sequence: Synthetic oligonucleotide
tgtaaatattgttcaaaaatatgctgttatcccaaagaaatgcatccctg

SEQ ID NO: 259375 - DNA, 49 bp, Artificial Sequence
  Description of Artificial Sequence: Synthetic oligonucleotide
gtaaatattgttcaaaaatatgctgttatcccaaagaaatgcatccctg

SEQ ID NO: 259376 - DNA, 52 bp, Artificial Sequence
  Description of Artificial Sequence: Synthetic oligonucleotide
taaatattgttcaaaaatatgctgttatcccaaagaaatgcatccctgaatg

SEQ ID NO: 259377 - DNA, 51 bp, Artificial Sequence
  Description of Artificial Sequence: Synthetic oligonucleotide
aaatattgttcaaaaatatgctgttatcccaaagaaatgcatccctgaatg

SEQ ID NO: 259378 - DNA, 50 bp, Artificial Sequence
  Description of Artificial Sequence: Synthetic oligonucleotide
aatattgttcaaaaatatgctgttatcccaaagaaatgcatccctgaatg

SEQ ID NO: 259379 - DNA, 49 bp, Artificial Sequence
  Description of Artificial Sequence: Synthetic oligonucleotide
atattgttcaaaaatatgctgttatcccaaagaaatgcatccctgaatg

SEQ ID NO: 259380 - DNA, 48 bp, Artificial Sequence
  Description of Artificial Sequence: Synthetic oligonucleotide
tattgttcaaaaatatgctgttatcccaaagaaatgcatccctgaatg

SEQ ID NO: 259381 - DNA, 47 bp, Artificial Sequence
  Description of Artificial Sequence: Synthetic oligonucleotide
attgttcaaaaatatgctgttatcccaaagaaatgcatccctgaatg

SEQ ID NO: 259382 - DNA, 46 bp, Artificial Sequence
  Description of Artificial Sequence: Synthetic oligonucleotide
ttgttcaaaaatatgctgttatcccaaagaaatgcatccctgaatg

SEQ ID NO: 259383 - DNA, 45 bp, Artificial Sequence
  Description of Artificial Sequence: Synthetic oligonucleotide
tgttcaaaaatatgctgttatcccaaagaaatgcatccctgaatg

SEQ ID NO: 259384 - DNA, 44 bp, Artificial Sequence
  Description of Artificial Sequence: Synthetic oligonucleotide
gttcaaaaatatgctgttatcccaaagaaatgcatccctgaatg

SEQ ID NO: 259385 - DNA, 49 bp, Artificial Sequence
  Description of Artificial Sequence: Synthetic oligonucleotide
ttcaaaaatatgctgttatcccaaagaaatgcatccctgaatgttatac

SEQ ID NO: 259386 - DNA, 48 bp, Artificial Sequence
  Description of Artificial Sequence: Synthetic oligonucleotide
tcaaaaatatgctgttatcccaaagaaatgcatccctgaatgttatac

SEQ ID NO: 259387 - DNA, 47 bp, Artificial Sequence
  Description of Artificial Sequence: Synthetic oligonucleotide
caaaaatatgctgttatcccaaagaaatgcatccctgaatgttatac

SEQ ID NO: 259388 - DNA, 49 bp, Artificial Sequence
  Description of Artificial Sequence: Synthetic oligonucleotide
aaaaatatgctgttatcccaaagaaatgcatccctgaatgttatacaac

SEQ ID NO: 259389 - DNA, 48 bp, Artificial Sequence
  Description of Artificial Sequence: Synthetic oligonucleotide
aaaatatgctgttatcccaaagaaatgcatccctgaatgttatacaac

SEQ ID NO: 259390 - DNA, 47 bp, Artificial Sequence
  Description of Artificial Sequence: Synthetic oligonucleotide
aaatatgctgttatcccaaagaaatgcatccctgaatgttatacaac

SEQ ID NO: 259391 - DNA, 46 bp, Artificial Sequence
  Description of Artificial Sequence: Synthetic oligonucleotide
aatatgctgttatcccaaagaaatgcatccctgaatgttatacaac

SEQ ID NO: 259392 - DNA, 45 bp, Artificial Sequence
  Description of Artificial Sequence: Synthetic oligonucleotide
atatgctgttatcccaaagaaatgcatccctgaatgttatacaac

SEQ ID NO: 259393 - DNA, 44 bp, Artificial Sequence
  Description of Artificial Sequence: Synthetic oligonucleotide
tatgctgttatcccaaagaaatgcatccctgaatgttatacaac

SEQ ID NO: 259394 - DNA, 43 bp, Artificial Sequence
  Description of Artificial Sequence: Synthetic oligonucleotide
atgctgttatcccaaagaaatgcatccctgaatgttatacaac

SEQ ID NO: 259395 - DNA, 42 bp, Artificial Sequence
  Description of Artificial Sequence: Synthetic oligonucleotide
tgctgttatcccaaagaaatgcatccctgaatgttatacaac

SEQ ID NO: 259396 - DNA, 41 bp, Artificial Sequence
  Description of Artificial Sequence: Synthetic oligonucleotide
gctgttatcccaaagaaatgcatccctgaatgttatacaac

SEQ ID NO: 259397 - DNA, 42 bp, Artificial Sequence
  Description of Artificial Sequence: Synthetic oligonucleotide
ctgttatcccaaagaaatgcatccctgaatgttatacaactg

SEQ ID NO: 259398 - DNA, 43 bp, Artificial Sequence
  Description of Artificial Sequence: Synthetic oligonucleotide
tgttatcccaaagaaatgcatccctgaatgttatacaactgag

SEQ ID NO: 259399 - DNA, 42 bp, Artificial Sequence
  Description of Artificial Sequence: Synthetic oligonucleotide
gttatcccaaagaaatgcatccctgaatgttatacaactgag

SEQ ID NO: 259400 - DNA, 42 bp, Artificial Sequence
  Description of Artificial Sequence: Synthetic oligonucleotide
ttatcccaaagaaatgcatccctgaatgttatacaactgagg

SEQ ID NO: 259401 - DNA, 41 bp, Artificial Sequence
  Description of Artificial Sequence: Synthetic oligonucleotide
tatcccaaagaaatgcatccctgaatgttatacaactgagg

SEQ ID NO: 259402 - DNA, 40 bp, Artificial Sequence
  Description of Artificial Sequence: Synthetic oligonucleotide
atcccaaagaaatgcatccctgaatgttatacaactgagg

SEQ ID NO: 259403 - DNA, 39 bp, Artificial Sequence
  Description of Artificial Sequence: Synthetic oligonucleotide
tcccaaagaaatgcatccctgaatgttatacaactgagg

SEQ ID NO: 259404 - DNA, 38 bp, Artificial Sequence
  Description of Artificial Sequence: Synthetic oligonucleotide
cccaaagaaatgcatccctgaatgttatacaactgagg

SEQ ID NO: 259405 - DNA, 38 bp, Artificial Sequence
  Description of Artificial Sequence: Synthetic oligonucleotide
ccaaagaaatgcatccctgaatgttatacaactgaggc

SEQ ID NO: 259406 - DNA, 40 bp, Artificial Sequence
  Description of Artificial Sequence: Synthetic oligonucleotide
caaagaaatgcatccctgaatgttatacaactgaggcaac

SEQ ID NO: 259407 - DNA, 40 bp, Artificial Sequence
  Description of Artificial Sequence: Synthetic oligonucleotide
aaagaaatgcatccctgaatgttatacaactgaggcaacc

SEQ ID NO: 259408 - DNA, 39 bp, Artificial Sequence
  Description of Artificial Sequence: Synthetic oligonucleotide
aagaaatgcatccctgaatgttatacaactgaggcaacc

SEQ ID NO: 259409 - DNA, 38 bp, Artificial Sequence
  Description of Artificial Sequence: Synthetic oligonucleotide
agaaatgcatccctgaatgttatacaactgaggcaacc

SEQ ID NO: 259410 - DNA, 37 bp, Artificial Sequence
  Description of Artificial Sequence: Synthetic oligonucleotide
gaaatgcatccctgaatgttatacaactgaggcaacc

SEQ ID NO: 259411 - DNA, 38 bp, Artificial Sequence
  Description of Artificial Sequence: Synthetic oligonucleotide
aaatgcatccctgaatgttatacaactgaggcaacctg

SEQ ID NO: 259412 - DNA, 37 bp, Artificial Sequence
  Description of Artificial Sequence: Synthetic oligonucleotide
aatgcatccctgaatgttatacaactgaggcaacctg

SEQ ID NO: 259413 - DNA, 36 bp, Artificial Sequence
  Description of Artificial Sequence: Synthetic oligonucleotide
atgcatccctgaatgttatacaactgaggcaacctg

SEQ ID NO: 259414 - DNA, 35 bp, Artificial Sequence
  Description of Artificial Sequence: Synthetic oligonucleotide
tgcatccctgaatgttatacaactgaggcaacctg

SEQ ID NO: 259415 - DNA, 34 bp, Artificial Sequence
  Description of Artificial Sequence: Synthetic oligonucleotide
gcatccctgaatgttatacaactgaggcaacctg

SEQ ID NO: 259416 - DNA, 36 bp, Artificial Sequence
  Description of Artificial Sequence: Synthetic oligonucleotide
catccctgaatgttatacaactgaggcaacctgaag

SEQ ID NO: 259417 - DNA, 36 bp, Artificial Sequence
  Description of Artificial Sequence: Synthetic oligonucleotide
atccctgaatgttatacaactgaggcaacctgaagg

SEQ ID NO: 259418 - DNA, 35 bp, Artificial Sequence
  Description of Artificial Sequence: Synthetic oligonucleotide
tccctgaatgttatacaactgaggcaacctgaagg

SEQ ID NO: 259419 - DNA, 34 bp, Artificial Sequence
  Description of Artificial Sequence: Synthetic oligonucleotide
ccctgaatgttatacaactgaggcaacctgaagg

SEQ ID NO: 259420 - DNA, 36 bp, Artificial Sequence
  Description of Artificial Sequence: Synthetic oligonucleotide
cctgaatgttatacaactgaggcaacctgaaggatg

SEQ ID NO: 259421 - DNA, 39 bp, Artificial Sequence
  Description of Artificial Sequence: Synthetic oligonucleotide
ctgaatgttatacaactgaggcaacctgaaggatgattg

SEQ ID NO: 259422 - DNA, 44 bp, Artificial Sequence
  Description of Artificial Sequence: Synthetic oligonucleotide
tgaatgttatacaactgaggcaacctgaaggatgattgatattc

SEQ ID NO: 259423 - DNA, 43 bp, Artificial Sequence
  Description of Artificial Sequence: Synthetic oligonucleotide
gaatgttatacaactgaggcaacctgaaggatgattgatattc

SEQ ID NO: 259424 - DNA, 44 bp, Artificial Sequence
  Description of Artificial Sequence: Synthetic oligonucleotide
aatgttatacaactgaggcaacctgaaggatgattgatattctc

SEQ ID NO: 259425 - DNA, 43 bp, Artificial Sequence
  Description of Artificial Sequence: Synthetic oligonucleotide
atgttatacaactgaggcaacctgaaggatgattgatattctc

SEQ ID NO: 259426 - DNA, 42 bp, Artificial Sequence
  Description of Artificial Sequence: Synthetic oligonucleotide
tgttatacaactgaggcaacctgaaggatgattgatattctc

SEQ ID NO: 259427 - DNA, 41 bp, Artificial Sequence
  Description of Artificial Sequence: Synthetic oligonucleotide
gttatacaactgaggcaacctgaaggatgattgatattctc

SEQ ID NO: 259428 - DNA, 44 bp, Artificial Sequence
  Description of Artificial Sequence: Synthetic oligonucleotide
ttatacaactgaggcaacctgaaggatgattgatattctcaatc

SEQ ID NO: 259429 - DNA, 43 bp, Artificial Sequence
  Description of Artificial Sequence: Synthetic oligonucleotide
tatacaactgaggcaacctgaaggatgattgatattctcaatc

SEQ ID NO: 259430 - DNA, 42 bp, Artificial Sequence
  Description of Artificial Sequence: Synthetic oligonucleotide
atacaactgaggcaacctgaaggatgattgatattctcaatc

SEQ ID NO: 259431 - DNA, 41 bp, Artificial Sequence
  Description of Artificial Sequence: Synthetic oligonucleotide
tacaactgaggcaacctgaaggatgattgatattctcaatc

SEQ ID NO: 259432 - DNA, 40 bp, Artificial Sequence
  Description of Artificial Sequence: Synthetic oligonucleotide
acaactgaggcaacctgaaggatgattgatattctcaatc

SEQ ID NO: 259433 - DNA, 39 bp, Artificial Sequence
  Description of Artificial Sequence: Synthetic oligonucleotide
caactgaggcaacctgaaggatgattgatattctcaatc

SEQ ID NO: 259434 - DNA, 40 bp, Artificial Sequence
  Description of Artificial Sequence: Synthetic oligonucleotide
aactgaggcaacctgaaggatgattgatattctcaatcac

SEQ ID NO: 259435 - DNA, 39 bp, Artificial Sequence
  Description of Artificial Sequence: Synthetic oligonucleotide
actgaggcaacctgaaggatgattgatattctcaatcac

SEQ ID NO: 259436 - DNA, 38 bp, Artificial Sequence
  Description of Artificial Sequence: Synthetic oligonucleotide
ctgaggcaacctgaaggatgattgatattctcaatcac

SEQ ID NO: 259437 - DNA, 40 bp, Artificial Sequence
  Description of Artificial Sequence: Synthetic oligonucleotide
tgaggcaacctgaaggatgattgatattctcaatcacaag

SEQ ID NO: 259438 - DNA, 39 bp, Artificial Sequence
  Description of Artificial Sequence: Synthetic oligonucleotide
gaggcaacctgaaggatgattgatattctcaatcacaag

SEQ ID NO: 259439 - DNA, 41 bp, Artificial Sequence
  Description of Artificial Sequence: Synthetic oligonucleotide
aggcaacctgaaggatgattgatattctcaatcacaagttg

SEQ ID NO: 259440 - DNA, 40 bp, Artificial Sequence
  Description of Artificial Sequence: Synthetic oligonucleotide
ggcaacctgaaggatgattgatattctcaatcacaagttg

SEQ ID NO: 259441 - DNA, 41 bp, Artificial Sequence
  Description of Artificial Sequence: Synthetic oligonucleotide
gcaacctgaaggatgattgatattctcaatcacaagttgag

SEQ ID NO: 259442 - DNA, 42 bp, Artificial Sequence
  Description of Artificial Sequence: Synthetic oligonucleotide
caacctgaaggatgattgatattctcaatcacaagttgagag

SEQ ID NO: 259443 - DNA, 46 bp, Artificial Sequence
  Description of Artificial Sequence: Synthetic oligonucleotide
aacctgaaggatgattgatattctcaatcacaagttgagagaatac

SEQ ID NO: 259444 - DNA, 45 bp, Artificial Sequence
  Description of Artificial Sequence: Synthetic oligonucleotide
acctgaaggatgattgatattctcaatcacaagttgagagaatac

SEQ ID NO: 259445 - DNA, 44 bp, Artificial Sequence
  Description of Artificial Sequence: Synthetic oligonucleotide
cctgaaggatgattgatattctcaatcacaagttgagagaatac

SEQ ID NO: 259446 - DNA, 45 bp, Artificial Sequence
  Description of Artificial Sequence: Synthetic oligonucleotide
ctgaaggatgattgatattctcaatcacaagttgagagaatactg

SEQ ID NO: 259447 - DNA, 49 bp, Artificial Sequence
  Description of Artificial Sequence: Synthetic oligonucleotide
tgaaggatgattgatattctcaatcacaagttgagagaatactgtatac

SEQ ID NO: 259448 - DNA, 48 bp, Artificial Sequence
  Description of Artificial Sequence: Synthetic oligonucleotide
gaaggatgattgatattctcaatcacaagttgagagaatactgtatac

SEQ ID NO: 259449 - DNA, 48 bp, Artificial Sequence
  Description of Artificial Sequence: Synthetic oligonucleotide
aaggatgattgatattctcaatcacaagttgagagaatactgtatacg

SEQ ID NO: 259450 - DNA, 47 bp, Artificial Sequence
  Description of Artificial Sequence: Synthetic oligonucleotide
aggatgattgatattctcaatcacaagttgagagaatactgtatacg

SEQ ID NO: 259451 - DNA, 46 bp, Artificial Sequence
  Description of Artificial Sequence: Synthetic oligonucleotide
ggatgattgatattctcaatcacaagttgagagaatactgtatacg

SEQ ID NO: 259452 - DNA, 47 bp, Artificial Sequence
  Description of Artificial Sequence: Synthetic oligonucleotide
gatgattgatattctcaatcacaagttgagagaatactgtatacgtc

SEQ ID NO: 259453 - DNA, 48 bp, Artificial Sequence
  Description of Artificial Sequence: Synthetic oligonucleotide
atgattgatattctcaatcacaagttgagagaatactgtatacgtctg

SEQ ID NO: 259454 - DNA, 47 bp, Artificial Sequence
  Description of Artificial Sequence: Synthetic oligonucleotide
tgattgatattctcaatcacaagttgagagaatactgtatacgtctg

SEQ ID NO: 259455 - DNA, 46 bp, Artificial Sequence
  Description of Artificial Sequence: Synthetic oligonucleotide
gattgatattctcaatcacaagttgagagaatactgtatacgtctg

SEQ ID NO: 259456 - DNA, 46 bp, Artificial Sequence
  Description of Artificial Sequence: Synthetic oligonucleotide
attgatattctcaatcacaagttgagagaatactgtatacgtctgc

SEQ ID NO: 259457 - DNA, 45 bp, Artificial Sequence
  Description of Artificial Sequence: Synthetic oligonucleotide
ttgatattctcaatcacaagttgagagaatactgtatacgtctgc

SEQ ID NO: 259458 - DNA, 44 bp, Artificial Sequence
  Description of Artificial Sequence: Synthetic oligonucleotide
tgatattctcaatcacaagttgagagaatactgtatacgtctgc

SEQ ID NO: 259459 - DNA, 43 bp, Artificial Sequence
  Description of Artificial Sequence: Synthetic oligonucleotide
gatattctcaatcacaagttgagagaatactgtatacgtctgc

SEQ ID NO: 259460 - DNA, 43 bp, Artificial Sequence
  Description of Artificial Sequence: Synthetic oligonucleotide
atattctcaatcacaagttgagagaatactgtatacgtctgcg

SEQ ID NO: 259461 - DNA, 42 bp, Artificial Sequence
  Description of Artificial Sequence: Synthetic oligonucleotide
tattctcaatcacaagttgagagaatactgtatacgtctgcg

SEQ ID NO: 259462 - DNA, 41 bp, Artificial Sequence
  Description of Artificial Sequence: Synthetic oligonucleotide
attctcaatcacaagttgagagaatactgtatacgtctgcg

SEQ ID NO: 259463 - DNA, 40 bp, Artificial Sequence
  Description of Artificial Sequence: Synthetic oligonucleotide
ttctcaatcacaagttgagagaatactgtatacgtctgcg

SEQ ID NO: 259464 - DNA, 39 bp, Artificial Sequence
  Description of Artificial Sequence: Synthetic oligonucleotide
tctcaatcacaagttgagagaatactgtatacgtctgcg

SEQ ID NO: 259465 - DNA, 38 bp, Artificial Sequence
  Description of Artificial Sequence: Synthetic oligonucleotide
ctcaatcacaagttgagagaatactgtatacgtctgcg

SEQ ID NO: 259466 - DNA, 38 bp, Artificial Sequence
  Description of Artificial Sequence: Synthetic oligonucleotide
tcaatcacaagttgagagaatactgtatacgtctgcgg

SEQ ID NO: 259467 - DNA, 37 bp, Artificial Sequence
  Description of Artificial Sequence: Synthetic oligonucleotide
caatcacaagttgagagaatactgtatacgtctgcgg

SEQ ID NO: 259468 - DNA, 39 bp, Artificial Sequence
  Description of Artificial Sequence: Synthetic oligonucleotide
aatcacaagttgagagaatactgtatacgtctgcggaac

SEQ ID NO: 259469 - DNA, 38 bp, Artificial Sequence
  Description of Artificial Sequence: Synthetic oligonucleotide
atcacaagttgagagaatactgtatacgtctgcggaac

SEQ ID NO: 259470 - DNA, 37 bp, Artificial Sequence
  Description of Artificial Sequence: Synthetic oligonucleotide
tcacaagttgagagaatactgtatacgtctgcggaac

SEQ ID NO: 259471 - DNA, 36 bp, Artificial Sequence
  Description of Artificial Sequence: Synthetic oligonucleotide
cacaagttgagagaatactgtatacgtctgcggaac

SEQ ID NO: 259472 - DNA, 36 bp, Artificial Sequence
  Description of Artificial Sequence: Synthetic oligonucleotide
acaagttgagagaatactgtatacgtctgcggaacg

SEQ ID NO: 259473 - DNA, 35 bp, Artificial Sequence
  Description of Artificial Sequence: Synthetic oligonucleotide
caagttgagagaatactgtatacgtctgcggaacg

SEQ ID NO: 259474 - DNA, 36 bp, Artificial Sequence
  Description of Artificial Sequence: Synthetic oligonucleotide
aagttgagagaatactgtatacgtctgcggaacgtg

SEQ ID NO: 259475 - DNA, 35 bp, Artificial Sequence
  Description of Artificial Sequence: Synthetic oligonucleotide
agttgagagaatactgtatacgtctgcggaacgtg

SEQ ID NO: 259476 - DNA, 34 bp, Artificial Sequence
  Description of Artificial Sequence: Synthetic oligonucleotide
gttgagagaatactgtatacgtctgcggaacgtg

SEQ ID NO: 259477 - DNA, 34 bp, Artificial Sequence
  Description of Artificial Sequence: Synthetic oligonucleotide
ttgagagaatactgtatacgtctgcggaacgtgg

SEQ ID NO: 259478 - DNA, 33 bp, Artificial Sequence
  Description of Artificial Sequence: Synthetic oligonucleotide
tgagagaatactgtatacgtctgcggaacgtgg

SEQ ID NO: 259479 - DNA, 32 bp, Artificial Sequence
  Description of Artificial Sequence: Synthetic oligonucleotide
gagagaatactgtatacgtctgcggaacgtgg

SEQ ID NO: 259480 - DNA, 34 bp, Artificial Sequence
  Description of Artificial Sequence: Synthetic oligonucleotide
agagaatactgtatacgtctgcggaacgtggtac

SEQ ID NO: 259481 - DNA, 33 bp, Artificial Sequence
  Description of Artificial Sequence: Synthetic oligonucleotide
gagaatactgtatacgtctgcggaacgtggtac

SEQ ID NO: 259482 - DNA, 34 bp, Artificial Sequence
  Description of Artificial Sequence: Synthetic oligonucleotide
agaatactgtatacgtctgcggaacgtggtacac

SEQ ID NO: 259483 - DNA, 33 bp, Artificial Sequence
  Description of Artificial Sequence: Synthetic oligonucleotide
gaatactgtatacgtctgcggaacgtggtacac

SEQ ID NO: 259484 - DNA, 34 bp, Artificial Sequence
  Description of Artificial Sequence: Synthetic oligonucleotide
aatactgtatacgtctgcggaacgtggtacacac

SEQ ID NO: 259485 - DNA, 33 bp, Artificial Sequence
  Description of Artificial Sequence: Synthetic oligonucleotide
atactgtatacgtctgcggaacgtggtacacac

SEQ ID NO: 259486 - DNA, 32 bp, Artificial Sequence
  Description of Artificial Sequence: Synthetic oligonucleotide
tactgtatacgtctgcggaacgtggtacacac

SEQ ID NO: 259487 - DNA, 31 bp, Artificial Sequence
  Description of Artificial Sequence: Synthetic oligonucleotide
actgtatacgtctgcggaacgtggtacacac

SEQ ID NO: 259488 - DNA, 30 bp, Artificial Sequence
  Description of Artificial Sequence: Synthetic oligonucleotide
ctgtatacgtctgcggaacgtggtacacac

SEQ ID NO: 259489 - DNA, 31 bp, Artificial Sequence
  Description of Artificial Sequence: Synthetic oligonucleotide
tgtatacgtctgcggaacgtggtacacactg

SEQ ID NO: 259490 - DNA, 30 bp, Artificial Sequence
  Description of Artificial Sequence: Synthetic oligonucleotide
gtatacgtctgcggaacgtggtacacactg

SEQ ID NO: 259491 - DNA, 30 bp, Artificial Sequence
  Description of Artificial Sequence: Synthetic oligonucleotide
tatacgtctgcggaacgtggtacacactgg

SEQ ID NO: 259492 - DNA, 29 bp, Artificial Sequence
  Description of Artificial Sequence: Synthetic oligonucleotide
atacgtctgcggaacgtggtacacactgg

SEQ ID NO: 259493 - DNA, 28 bp, Artificial Sequence
  Description of Artificial Sequence: Synthetic oligonucleotide
tacgtctgcggaacgtggtacacactgg

SEQ ID NO: 259494 - DNA, 27 bp, Artificial Sequence
  Description of Artificial Sequence: Synthetic oligonucleotide
acgtctgcggaacgtggtacacactgg

SEQ ID NO: 259495 - DNA, 27 bp, Artificial Sequence
  Description of Artificial Sequence: Synthetic oligonucleotide
cgtctgcggaacgtggtacacactgga

SEQ ID NO: 259496 - DNA, 27 bp, Artificial Sequence
  Description of Artificial Sequence: Synthetic oligonucleotide
gtctgcggaacgtggtacacactggag

SEQ ID NO: 259497 - DNA, 27 bp, Artificial Sequence
  Description of Artificial Sequence: Synthetic oligonucleotide
tctgcggaacgtggtacacactggagc

SEQ ID NO: 259498 - DNA, 27 bp, Artificial Sequence
  Description of Artificial Sequence: Synthetic oligonucleotide
ctgcggaacgtggtacacactggagca

SEQ ID NO: 259499 - DNA, 28 bp, Artificial Sequence
  Description of Artificial Sequence: Synthetic oligonucleotide
tgcggaacgtggtacacactggagcaac

SEQ ID NO: 259500 - DNA, 27 bp, Artificial Sequence
  Description of Artificial Sequence: Synthetic oligonucleotide
gcggaacgtggtacacactggagcaac

SEQ ID NO: 259501 - DNA, 27 bp, Artificial Sequence
  Description of Artificial Sequence: Synthetic oligonucleotide
cggaacgtggtacacactggagcaacg

SEQ ID NO: 259502 - DNA, 30 bp, Artificial Sequence
  Description of Artificial Sequence: Synthetic oligonucleotide
ggaacgtggtacacactggagcaacgaaag

SEQ ID NO: 259503 - DNA, 30 bp, Artificial Sequence
  Description of Artificial Sequence: Synthetic oligonucleotide
gaacgtggtacacactggagcaacgaaagg

SEQ ID NO: 259504 - DNA, 31 bp, Artificial Sequence
  Description of Artificial Sequence: Synthetic oligonucleotide
aacgtggtacacactggagcaacgaaaggag

SEQ ID NO: 259505 - DNA, 30 bp, Artificial Sequence
  Description of Artificial Sequence: Synthetic oligonucleotide
acgtggtacacactggagcaacgaaaggag

SEQ ID NO: 259506 - DNA, 29 bp, Artificial Sequence
  Description of Artificial Sequence: Synthetic oligonucleotide
cgtggtacacactggagcaacgaaaggag

SEQ ID NO: 259507 - DNA, 33 bp, Artificial Sequence
  Description of Artificial Sequence: Synthetic oligonucleotide
gtggtacacactggagcaacgaaaggagaattc

SEQ ID NO: 259508 - DNA, 34 bp, Artificial Sequence
  Description of Artificial Sequence: Synthetic oligonucleotide
tggtacacactggagcaacgaaaggagaattctc

SEQ ID NO: 259509 - DNA, 33 bp, Artificial Sequence
  Description of Artificial Sequence: Synthetic oligonucleotide
ggtacacactggagcaacgaaaggagaattctc

SEQ ID NO: 259510 - DNA, 33 bp, Artificial Sequence
  Description of Artificial Sequence: Synthetic oligonucleotide
gtacacactggagcaacgaaaggagaattctcg

SEQ ID NO: 259511 - DNA, 33 bp, Artificial Sequence
  Description of Artificial Sequence: Synthetic oligonucleotide
tacacactggagcaacgaaaggagaattctcgg

SEQ ID NO: 259512 - DNA, 32 bp, Artificial Sequence
  Description of Artificial Sequence: Synthetic oligonucleotide
acacactggagcaacgaaaggagaattctcgg

SEQ ID NO: 259513 - DNA, 31 bp, Artificial Sequence
  Description of Artificial Sequence: Synthetic oligonucleotide
cacactggagcaacgaaaggagaattctcgg

SEQ ID NO: 259514 - DNA, 31 bp, Artificial Sequence
  Description of Artificial Sequence: Synthetic oligonucleotide
acactggagcaacgaaaggagaattctcggc

SEQ ID NO: 259515 - DNA, 30 bp, Artificial Sequence
  Description of Artificial Sequence: Synthetic oligonucleotide
cactggagcaacgaaaggagaattctcggc

SEQ ID NO: 259516 - DNA, 30 bp, Artificial Sequence
  Description of Artificial Sequence: Synthetic oligonucleotide
actggagcaacgaaaggagaattctcggcc

SEQ ID NO: 259517 - DNA, 29 bp, Artificial Sequence
  Description of Artificial Sequence: Synthetic oligonucleotide
ctggagcaacgaaaggagaattctcggcc

SEQ ID NO: 259518 - DNA, 30 bp, Artificial Sequence
  Description of Artificial Sequence: Synthetic oligonucleotide
tggagcaacgaaaggagaattctcggccag

SEQ ID NO: 259519 - DNA, 29 bp, Artificial Sequence
  Description of Artificial Sequence: Synthetic oligonucleotide
ggagcaacgaaaggagaattctcggccag

SEQ ID NO: 259520 - DNA, 30 bp, Artificial Sequence
  Description of Artificial Sequence: Synthetic oligonucleotide
gagcaacgaaaggagaattctcggccagac

SEQ ID NO: 259521 - DNA, 31 bp, Artificial Sequence
  Description of Artificial Sequence: Synthetic oligonucleotide
agcaacgaaaggagaattctcggccagacag

SEQ ID NO: 259522 - DNA, 30 bp, Artificial Sequence
  Description of Artificial Sequence: Synthetic oligonucleotide
gcaacgaaaggagaattctcggccagacag

SEQ ID NO: 259523 - DNA, 30 bp, Artificial Sequence
  Description of Artificial Sequence: Synthetic oligonucleotide
caacgaaaggagaattctcggccagacagg

SEQ ID NO: 259524 - DNA, 31 bp, Artificial Sequence
  Description of Artificial Sequence: Synthetic oligonucleotide
aacgaaaggagaattctcggccagacaggac

SEQ ID NO: 259525 - DNA, 30 bp, Artificial Sequence
  Description of Artificial Sequence: Synthetic oligonucleotide
acgaaaggagaattctcggccagacaggac

SEQ ID NO: 259526 - DNA, 29 bp, Artificial Sequence
  Description of Artificial Sequence: Synthetic oligonucleotide
cgaaaggagaattctcggccagacaggac

SEQ ID NO: 259527 - DNA, 29 bp, Artificial Sequence
  Description of Artificial Sequence: Synthetic oligonucleotide
gaaaggagaattctcggccagacaggacg

SEQ ID NO: 259528 - DNA, 30 bp, Artificial Sequence
  Description of Artificial Sequence: Synthetic oligonucleotide
aaaggagaattctcggccagacaggacgtg

SEQ ID NO: 259529 - DNA, 29 bp, Artificial Sequence
  Description of Artificial Sequence: Synthetic oligonucleotide
aaggagaattctcggccagacaggacgtg

SEQ ID NO: 259530 - DNA, 28 bp, Artificial Sequence
  Description of Artificial Sequence: Synthetic oligonucleotide
aggagaattctcggccagacaggacgtg

SEQ ID NO: 259531 - DNA, 27 bp, Artificial Sequence
  Description of Artificial Sequence: Synthetic oligonucleotide
ggagaattctcggccagacaggacgtg

SEQ ID NO: 259532 - DNA, 29 bp, Artificial Sequence
  Description of Artificial Sequence: Synthetic oligonucleotide
gagaattctcggccagacaggacgtgatg

SEQ ID NO: 259533 - DNA, 31 bp, Artificial Sequence
  Description of Artificial Sequence: Synthetic oligonucleotide
agaattctcggccagacaggacgtgatgatg

SEQ ID NO: 259534 - DNA, 30 bp, Artificial Sequence
  Description of Artificial Sequence: Synthetic oligonucleotide
gaattctcggccagacaggacgtgatgatg

SEQ ID NO: 259535 - DNA, 30 bp, Artificial Sequence
  Description of Artificial Sequence: Synthetic oligonucleotide
aattctcggccagacaggacgtgatgatgg

SEQ ID NO: 259536 - DNA, 29 bp, Artificial Sequence
  Description of Artificial Sequence: Synthetic oligonucleotide
attctcggccagacaggacgtgatgatgg

SEQ ID NO: 259537 - DNA, 28 bp, Artificial Sequence
  Description of Artificial Sequence: Synthetic oligonucleotide
ttctcggccagacaggacgtgatgatgg

SEQ ID NO: 259538 - DNA, 27 bp, Artificial Sequence
  Description of Artificial Sequence: Synthetic oligonucleotide
tctcggccagacaggacgtgatgatgg

SEQ ID NO: 259539 - DNA, 27 bp, Artificial Sequence
  Description of Artificial Sequence: Synthetic oligonucleotide
ctcggccagacaggacgtgatgatgga

SEQ ID NO: 259540 - DNA, 27 bp, Artificial Sequence
  Description of Artificial Sequence: Synthetic oligonucleotide
tcggccagacaggacgtgatgatggag

SEQ ID NO: 259541 - DNA, 26 bp, Artificial Sequence
  Description of Artificial Sequence: Synthetic oligonucleotide
cggccagacaggacgtgatgatggag

SEQ ID NO: 259542 - DNA, 27 bp, Artificial Sequence
  Description of Artificial Sequence: Synthetic oligonucleotide
ggccagacaggacgtgatgatggagca

SEQ ID NO: 259543 - DNA, 27 bp, Artificial Sequence
  Description of Artificial Sequence: Synthetic oligonucleotide
gccagacaggacgtgatgatggagcag

SEQ ID NO: 259544 - DNA, 32 bp, Artificial Sequence
  Description of Artificial Sequence: Synthetic oligonucleotide
ccagacaggacgtgatgatggagcagatattc

SEQ ID NO: 259545 - DNA, 32 bp, Artificial Sequence
  Description of Artificial Sequence: Synthetic oligonucleotide
cagacaggacgtgatgatggagcagatattcc

SEQ ID NO: 259546 - DNA, 32 bp, Artificial Sequence
  Description of Artificial Sequence: Synthetic oligonucleotide
agacaggacgtgatgatggagcagatattccc

SEQ ID NO: 259547 - DNA, 31 bp, Artificial Sequence
  Description of Artificial Sequence: Synthetic oligonucleotide
gacaggacgtgatgatggagcagatattccc

SEQ ID NO: 259548 - DNA, 32 bp, Artificial Sequence
  Description of Artificial Sequence: Synthetic oligonucleotide
acaggacgtgatgatggagcagatattcccag

SEQ ID NO: 259549 - DNA, 31 bp, Artificial Sequence
  Description of Artificial Sequence: Synthetic oligonucleotide
caggacgtgatgatggagcagatattcccag

SEQ ID NO: 259550 - DNA, 32 bp, Artificial Sequence
  Description of Artificial Sequence: Synthetic oligonucleotide
aggacgtgatgatggagcagatattcccagtg

SEQ ID NO: 259551 - DNA, 31 bp, Artificial Sequence
  Description of Artificial Sequence: Synthetic oligonucleotide
ggacgtgatgatggagcagatattcccagtg

SEQ ID NO: 259552 - DNA, 31 bp, Artificial Sequence
  Description of Artificial Sequence: Synthetic oligonucleotide
gacgtgatgatggagcagatattcccagtgg

SEQ ID NO: 259553 - DNA, 32 bp, Artificial Sequence
  Description of Artificial Sequence: Synthetic oligonucleotide
acgtgatgatggagcagatattcccagtggtg

SEQ ID NO: 259554 - DNA, 31 bp, Artificial Sequence
  Description of Artificial Sequence: Synthetic oligonucleotide
cgtgatgatggagcagatattcccagtggtg

SEQ ID NO: 259555 - DNA, 32 bp, Artificial Sequence
  Description of Artificial Sequence: Synthetic oligonucleotide
gtgatgatggagcagatattcccagtggtgtg

SEQ ID NO: 259556 - DNA, 32 bp, Artificial Sequence
  Description of Artificial Sequence: Synthetic oligonucleotide
tgatgatggagcagatattcccagtggtgtgg

SEQ ID NO: 259557 - DNA, 31 bp, Artificial Sequence
  Description of Artificial Sequence: Synthetic oligonucleotide
gatgatggagcagatattcccagtggtgtgg

SEQ ID NO: 259558 - DNA, 33 bp, Artificial Sequence
  Description of Artificial Sequence: Synthetic oligonucleotide
atgatggagcagatattcccagtggtgtggatc

SEQ ID NO: 259559 - DNA, 32 bp, Artificial Sequence
  Description of Artificial Sequence: Synthetic oligonucleotide
tgatggagcagatattcccagtggtgtggatc

SEQ ID NO: 259560 - DNA, 31 bp, Artificial Sequence
  Description of Artificial Sequence: Synthetic oligonucleotide
gatggagcagatattcccagtggtgtggatc

SEQ ID NO: 259561 - DNA, 32 bp, Artificial Sequence
  Description of Artificial Sequence: Synthetic oligonucleotide
atggagcagatattcccagtggtgtggatctg

SEQ ID NO: 259562 - DNA, 31 bp, Artificial Sequence
  Description of Artificial Sequence: Synthetic oligonucleotide
tggagcagatattcccagtggtgtggatctg

SEQ ID NO: 259563 - DNA, 30 bp, Artificial Sequence
  Description of Artificial Sequence: Synthetic oligonucleotide
ggagcagatattcccagtggtgtggatctg

SEQ ID NO: 259564 - DNA, 33 bp, Artificial Sequence
  Description of Artificial Sequence: Synthetic oligonucleotide
gagcagatattcccagtggtgtggatctgtttg

SEQ ID NO: 259565 - DNA, 33 bp, Artificial Sequence
  Description of Artificial Sequence: Synthetic oligonucleotide
agcagatattcccagtggtgtggatctgtttgc

SEQ ID NO: 259566 - DNA, 32 bp, Artificial Sequence
  Description of Artificial Sequence: Synthetic oligonucleotide
gcagatattcccagtggtgtggatctgtttgc

SEQ ID NO: 259567 - DNA, 32 bp, Artificial Sequence
  Description of Artificial Sequence: Synthetic oligonucleotide
cagatattcccagtggtgtggatctgtttgcg

SEQ ID NO: 259568 - DNA, 36 bp, Artificial Sequence
  Description of Artificial Sequence: Synthetic oligonucleotide
agatattcccagtggtgtggatctgtttgcgtaatc

SEQ ID NO: 259569 - DNA, 35 bp, Artificial Sequence
  Description of Artificial Sequence: Synthetic oligonucleotide
gatattcccagtggtgtggatctgtttgcgtaatc

SEQ ID NO: 259570 - DNA, 35 bp, Artificial Sequence
  Description of Artificial Sequence: Synthetic oligonucleotide
atattcccagtggtgtggatctgtttgcgtaatcc

SEQ ID NO: 259571 - DNA, 34 bp, Artificial Sequence
  Description of Artificial Sequence: Synthetic oligonucleotide
tattcccagtggtgtggatctgtttgcgtaatcc

SEQ ID NO: 259572 - DNA, 33 bp, Artificial Sequence
  Description of Artificial Sequence: Synthetic oligonucleotide
attcccagtggtgtggatctgtttgcgtaatcc

SEQ ID NO: 259573 - DNA, 32 bp, Artificial Sequence
  Description of Artificial Sequence: Synthetic oligonucleotide
ttcccagtggtgtggatctgtttgcgtaatcc

SEQ ID NO: 259574 - DNA, 31 bp, Artificial Sequence
  Description of Artificial Sequence: Synthetic oligonucleotide
tcccagtggtgtggatctgtttgcgtaatcc

SEQ ID NO: 259575 - DNA, 30 bp, Artificial Sequence
  Description of Artificial Sequence: Synthetic oligonucleotide
cccagtggtgtggatctgtttgcgtaatcc

SEQ ID NO: 259576 - DNA, 31 bp, Artificial Sequence
  Description of Artificial Sequence: Synthetic oligonucleotide
ccagtggtgtggatctgtttgcgtaatccac

SEQ ID NO: 259577 - DNA, 31 bp, Artificial Sequence
  Description of Artificial Sequence: Synthetic oligonucleotide
cagtggtgtggatctgtttgcgtaatccacg

SEQ ID NO: 259578 - DNA, 32 bp, Artificial Sequence
  Description of Artificial Sequence: Synthetic oligonucleotide
agtggtgtggatctgtttgcgtaatccacgag

SEQ ID NO: 259579 - DNA, 31 bp, Artificial Sequence
  Description of Artificial Sequence: Synthetic oligonucleotide
gtggtgtggatctgtttgcgtaatccacgag

SEQ ID NO: 259580 - DNA, 32 bp, Artificial Sequence
  Description of Artificial Sequence: Synthetic oligonucleotide
tggtgtggatctgtttgcgtaatccacgagag

SEQ ID NO: 259581 - DNA, 31 bp, Artificial Sequence
  Description of Artificial Sequence: Synthetic oligonucleotide
ggtgtggatctgtttgcgtaatccacgagag

SEQ ID NO: 259582 - DNA, 32 bp, Artificial Sequence
  Description of Artificial Sequence: Synthetic oligonucleotide
gtgtggatctgtttgcgtaatccacgagagac

SEQ ID NO: 259583 - DNA, 35 bp, Artificial Sequence
  Description of Artificial Sequence: Synthetic oligonucleotide
tgtggatctgtttgcgtaatccacgagagacattg

SEQ ID NO: 259584 - DNA, 34 bp, Artificial Sequence
  Description of Artificial Sequence: Synthetic oligonucleotide
gtggatctgtttgcgtaatccacgagagacattg

SEQ ID NO: 259585 - DNA, 35 bp, Artificial Sequence
  Description of Artificial Sequence: Synthetic oligonucleotide
tggatctgtttgcgtaatccacgagagacattgac

SEQ ID NO: 259586 - DNA, 34 bp, Artificial Sequence
  Description of Artificial Sequence: Synthetic oligonucleotide
ggatctgtttgcgtaatccacgagagacattgac

SEQ ID NO: 259587 - DNA, 34 bp, Artificial Sequence
  Description of Artificial Sequence: Synthetic oligonucleotide
gatctgtttgcgtaatccacgagagacattgacc

SEQ ID NO: 259588 - DNA, 35 bp, Artificial Sequence
  Description of Artificial Sequence: Synthetic oligonucleotide
atctgtttgcgtaatccacgagagacattgacctg

SEQ ID NO: 259589 - DNA, 34 bp, Artificial Sequence
  Description of Artificial Sequence: Synthetic oligonucleotide
tctgtttgcgtaatccacgagagacattgacctg

SEQ ID NO: 259590 - DNA, 33 bp, Artificial Sequence
  Description of Artificial Sequence: Synthetic oligonucleotide
ctgtttgcgtaatccacgagagacattgacctg

SEQ ID NO: 259591 - DNA, 33 bp, Artificial Sequence
  Description of Artificial Sequence: Synthetic oligonucleotide
tgtttgcgtaatccacgagagacattgacctgg

SEQ ID NO: 259592 - DNA, 32 bp, Artificial Sequence
  Description of Artificial Sequence: Synthetic oligonucleotide
gtttgcgtaatccacgagagacattgacctgg

SEQ ID NO: 259593 - DNA, 32 bp, Artificial Sequence
  Description of Artificial Sequence: Synthetic oligonucleotide
tttgcgtaatccacgagagacattgacctggg

SEQ ID NO: 259594 - DNA, 31 bp, Artificial Sequence
  Description of Artificial Sequence: Synthetic oligonucleotide
ttgcgtaatccacgagagacattgacctggg

SEQ ID NO: 259595 - DNA, 30 bp, Artificial Sequence
  Description of Artificial Sequence: Synthetic oligonucleotide
tgcgtaatccacgagagacattgacctggg

SEQ ID NO: 259596 - DNA, 29 bp, Artificial Sequence
  Description of Artificial Sequence: Synthetic oligonucleotide
gcgtaatccacgagagacattgacctggg

SEQ ID NO: 259597 - DNA, 34 bp, Artificial Sequence
  Description of Artificial Sequence: Synthetic oligonucleotide
cgtaatccacgagagacattgacctgggaaaatc

SEQ ID NO: 259598 - DNA, 34 bp, Artificial Sequence
  Description of Artificial Sequence: Synthetic oligonucleotide
gtaatccacgagagacattgacctgggaaaatcg

SEQ ID NO: 259599 - DNA, 35 bp, Artificial Sequence
  Description of Artificial Sequence: Synthetic oligonucleotide
taatccacgagagacattgacctgggaaaatcgag

SEQ ID NO: 259600 - DNA, 34 bp, Artificial Sequence
  Description of Artificial Sequence: Synthetic oligonucleotide
aatccacgagagacattgacctgggaaaatcgag

SEQ ID NO: 259601 - DNA, 33 bp, Artificial Sequence
  Description of Artificial Sequence: Synthetic oligonucleotide
atccacgagagacattgacctgggaaaatcgag

SEQ ID NO: 259602 - DNA, 32 bp, Artificial Sequence
  Description of Artificial Sequence: Synthetic oligonucleotide
tccacgagagacattgacctgggaaaatcgag

SEQ ID NO: 259603 - DNA, 31 bp, Artificial Sequence
  Description of Artificial Sequence: Synthetic oligonucleotide
ccacgagagacattgacctgggaaaatcgag

SEQ ID NO: 259604 - DNA, 32 bp, Artificial Sequence
  Description of Artificial Sequence: Synthetic oligonucleotide
cacgagagacattgacctgggaaaatcgagac

SEQ ID NO: 259605 - DNA, 35 bp, Artificial Sequence
  Description of Artificial Sequence: Synthetic oligonucleotide
acgagagacattgacctgggaaaatcgagacatag

SEQ ID NO: 259606 - DNA, 34 bp, Artificial Sequence
  Description of Artificial Sequence: Synthetic oligonucleotide
cgagagacattgacctgggaaaatcgagacatag

SEQ ID NO: 259607 - DNA, 45 bp, Artificial Sequence
  Description of Artificial Sequence: Synthetic oligonucleotide
gagagacattgacctgggaaaatcgagacatagataaaaaatatc

SEQ ID NO: 259608 - DNA, 46 bp, Artificial Sequence
  Description of Artificial Sequence: Synthetic oligonucleotide
agagacattgacctgggaaaatcgagacatagataaaaaatatcag

SEQ ID NO: 259609 - DNA, 45 bp, Artificial Sequence
  Description of Artificial Sequence: Synthetic oligonucleotide
gagacattgacctgggaaaatcgagacatagataaaaaatatcag

SEQ ID NO: 259610 - DNA, 51 bp, Artificial Sequence
  Description of Artificial Sequence: Synthetic oligonucleotide
agacattgacctgggaaaatcgagacatagataaaaaatatcagaaatttg

SEQ ID NO: 259611 - DNA, 50 bp, Artificial Sequence
  Description of Artificial Sequence: Synthetic oligonucleotide
gacattgacctgggaaaatcgagacatagataaaaaatatcagaaatttg

SEQ ID NO: 259612 - DNA, 50 bp, Artificial Sequence
  Description of Artificial Sequence: Synthetic oligonucleotide
acattgacctgggaaaatcgagacatagataaaaaatatcagaaatttgg

SEQ ID NO: 259613 - DNA, 49 bp, Artificial Sequence
  Description of Artificial Sequence: Synthetic oligonucleotide
cattgacctgggaaaatcgagacatagataaaaaatatcagaaatttgg

SEQ ID NO: 259614 - DNA, 49 bp, Artificial Sequence
  Description of Artificial Sequence: Synthetic oligonucleotide
attgacctgggaaaatcgagacatagataaaaaatatcagaaatttggc

SEQ ID NO: 259615 - DNA, 48 bp, Artificial Sequence
  Description of Artificial Sequence: Synthetic oligonucleotide
ttgacctgggaaaatcgagacatagataaaaaatatcagaaatttggc

SEQ ID NO: 259616 - DNA, 47 bp, Artificial Sequence
  Description of Artificial Sequence: Synthetic oligonucleotide
tgacctgggaaaatcgagacatagataaaaaatatcagaaatttggc

SEQ ID NO: 259617 - DNA, 46 bp, Artificial Sequence
  Description of Artificial Sequence: Synthetic oligonucleotide
gacctgggaaaatcgagacatagataaaaaatatcagaaatttggc

SEQ ID NO: 259618 - DNA, 46 bp, Artificial Sequence
  Description of Artificial Sequence: Synthetic oligonucleotide
acctgggaaaatcgagacatagataaaaaatatcagaaatttggcc

SEQ ID NO: 259619 - DNA, 45 bp, Artificial Sequence
  Description of Artificial Sequence: Synthetic oligonucleotide
cctgggaaaatcgagacatagataaaaaatatcagaaatttggcc

SEQ ID NO: 259620 - DNA, 45 bp, Artificial Sequence
  Description of Artificial Sequence: Synthetic oligonucleotide
ctgggaaaatcgagacatagataaaaaatatcagaaatttggccc

SEQ ID NO: 259621 - DNA, 45 bp, Artificial Sequence
  Description of Artificial Sequence: Synthetic oligonucleotide
tgggaaaatcgagacatagataaaaaatatcagaaatttggcccc

SEQ ID NO: 259622 - DNA, 44 bp, Artificial Sequence
  Description of Artificial Sequence: Synthetic oligonucleotide
gggaaaatcgagacatagataaaaaatatcagaaatttggcccc

SEQ ID NO: 259623 - DNA, 48 bp, Artificial Sequence
  Description of Artificial Sequence: Synthetic oligonucleotide
ggaaaatcgagacatagataaaaaatatcagaaatttggccccaaaac

SEQ ID NO: 259624 - DNA, 49 bp, Artificial Sequence
  Description of Artificial Sequence: Synthetic oligonucleotide
gaaaatcgagacatagataaaaaatatcagaaatttggccccaaaacac

SEQ ID NO: 259625 - DNA, 49 bp, Artificial Sequence
  Description of Artificial Sequence: Synthetic oligonucleotide
aaaatcgagacatagataaaaaatatcagaaatttggccccaaaacacc

SEQ ID NO: 259626 - DNA, 48 bp, Artificial Sequence
  Description of Artificial Sequence: Synthetic oligonucleotide
aaatcgagacatagataaaaaatatcagaaatttggccccaaaacacc

SEQ ID NO: 259627 - DNA, 47 bp, Artificial Sequence
  Description of Artificial Sequence: Synthetic oligonucleotide
aatcgagacatagataaaaaatatcagaaatttggccccaaaacacc

SEQ ID NO: 259628 - DNA, 46 bp, Artificial Sequence
  Description of Artificial Sequence: Synthetic oligonucleotide
atcgagacatagataaaaaatatcagaaatttggccccaaaacacc

SEQ ID NO: 259629 - DNA, 45 bp, Artificial Sequence
  Description of Artificial Sequence: Synthetic oligonucleotide
tcgagacatagataaaaaatatcagaaatttggccccaaaacacc

SEQ ID NO: 259630 - DNA, 44 bp, Artificial Sequence
  Description of Artificial Sequence: Synthetic oligonucleotide
cgagacatagataaaaaatatcagaaatttggccccaaaacacc

SEQ ID NO: 259631 - DNA, 44 bp, Artificial Sequence
  Description of Artificial Sequence: Synthetic oligonucleotide
gagacatagataaaaaatatcagaaatttggccccaaaacaccc

SEQ ID NO: 259632 - DNA, 46 bp, Artificial Sequence
  Description of Artificial Sequence: Synthetic oligonucleotide
agacatagataaaaaatatcagaaatttggccccaaaacacccttc

SEQ ID NO: 259633 - DNA, 45 bp, Artificial Sequence
  Description of Artificial Sequence: Synthetic oligonucleotide
gacatagataaaaaatatcagaaatttggccccaaaacacccttc

SEQ ID NO: 259634 - DNA, 45 bp, Artificial Sequence
  Description of Artificial Sequence: Synthetic oligonucleotide
acatagataaaaaatatcagaaatttggccccaaaacacccttcg

SEQ ID NO: 259635 - DNA, 44 bp, Artificial Sequence
  Description of Artificial Sequence: Synthetic oligonucleotide
catagataaaaaatatcagaaatttggccccaaaacacccttcg

SEQ ID NO: 259636 - DNA, 45 bp, Artificial Sequence
  Description of Artificial Sequence: Synthetic oligonucleotide
atagataaaaaatatcagaaatttggccccaaaacacccttcgag

SEQ ID NO: 259637 - DNA, 44 bp, Artificial Sequence
  Description of Artificial Sequence: Synthetic oligonucleotide
tagataaaaaatatcagaaatttggccccaaaacacccttcgag

SEQ ID NO: 259638 - DNA, 43 bp, Artificial Sequence
  Description of Artificial Sequence: Synthetic oligonucleotide
agataaaaaatatcagaaatttggccccaaaacacccttcgag

SEQ ID NO: 259639 - DNA, 42 bp, Artificial Sequence
  Description of Artificial Sequence: Synthetic oligonucleotide
gataaaaaatatcagaaatttggccccaaaacacccttcgag

SEQ ID NO: 259640 - DNA, 47 bp, Artificial Sequence
  Description of Artificial Sequence: Synthetic oligonucleotide
ataaaaaatatcagaaatttggccccaaaacacccttcgagttttac

SEQ ID NO: 259641 - DNA, 46 bp, Artificial Sequence
  Description of Artificial Sequence: Synthetic oligonucleotide
taaaaaatatcagaaatttggccccaaaacacccttcgagttttac

SEQ ID NO: 259642 - DNA, 45 bp, Artificial Sequence
  Description of Artificial Sequence: Synthetic oligonucleotide
aaaaaatatcagaaatttggccccaaaacacccttcgagttttac

SEQ ID NO: 259643 - DNA, 44 bp, Artificial Sequence
  Description of Artificial Sequence: Synthetic oligonucleotide
aaaaatatcagaaatttggccccaaaacacccttcgagttttac

SEQ ID NO: 259644 - DNA, 43 bp, Artificial Sequence
  Description of Artificial Sequence: Synthetic oligonucleotide
aaaatatcagaaatttggccccaaaacacccttcgagttttac

SEQ ID NO: 259645 - DNA, 42 bp, Artificial Sequence
  Description of Artificial Sequence: Synthetic oligonucleotide
aaatatcagaaatttggccccaaaacacccttcgagttttac

SEQ ID NO: 259646 - DNA, 41 bp, Artificial Sequence
  Description of Artificial Sequence: Synthetic oligonucleotide
aatatcagaaatttggccccaaaacacccttcgagttttac

SEQ ID NO: 259647 - DNA, 40 bp, Artificial Sequence
  Description of Artificial Sequence: Synthetic oligonucleotide
atatcagaaatttggccccaaaacacccttcgagttttac

SEQ ID NO: 259648 - DNA, 39 bp, Artificial Sequence
  Description of Artificial Sequence: Synthetic oligonucleotide
tatcagaaatttggccccaaaacacccttcgagttttac

SEQ ID NO: 259649 - DNA, 38 bp, Artificial Sequence
  Description of Artificial Sequence: Synthetic oligonucleotide
atcagaaatttggccccaaaacacccttcgagttttac

SEQ ID NO: 259650 - DNA, 37 bp, Artificial Sequence
  Description of Artificial Sequence: Synthetic oligonucleotide
tcagaaatttggccccaaaacacccttcgagttttac

SEQ ID NO: 259651 - DNA, 36 bp, Artificial Sequence
  Description of Artificial Sequence: Synthetic oligonucleotide
cagaaatttggccccaaaacacccttcgagttttac

SEQ ID NO: 259652 - DNA, 37 bp, Artificial Sequence
  Description of Artificial Sequence: Synthetic oligonucleotide
agaaatttggccccaaaacacccttcgagttttactg

SEQ ID NO: 259653 - DNA, 36 bp, Artificial Sequence
  Description of Artificial Sequence: Synthetic oligonucleotide
gaaatttggccccaaaacacccttcgagttttactg

SEQ ID NO: 259654 - DNA, 36 bp, Artificial Sequence
  Description of Artificial Sequence: Synthetic oligonucleotide
aaatttggccccaaaacacccttcgagttttactgg

SEQ ID NO: 259655 - DNA, 35 bp, Artificial Sequence
  Description of Artificial Sequence: Synthetic oligonucleotide
aatttggccccaaaacacccttcgagttttactgg

SEQ ID NO: 259656 - DNA, 34 bp, Artificial Sequence
  Description of Artificial Sequence: Synthetic oligonucleotide
atttggccccaaaacacccttcgagttttactgg

SEQ ID NO: 259657 - DNA, 33 bp, Artificial Sequence
  Description of Artificial Sequence: Synthetic oligonucleotide
tttggccccaaaacacccttcgagttttactgg

SEQ ID NO: 259658 - DNA, 32 bp, Artificial Sequence
  Description of Artificial Sequence: Synthetic oligonucleotide
ttggccccaaaacacccttcgagttttactgg

SEQ ID NO: 259659 - DNA, 31 bp, Artificial Sequence
  Description of Artificial Sequence: Synthetic oligonucleotide
tggccccaaaacacccttcgagttttactgg

SEQ ID NO: 259660 - DNA, 30 bp, Artificial Sequence
  Description of Artificial Sequence: Synthetic oligonucleotide
ggccccaaaacacccttcgagttttactgg

SEQ ID NO: 259661 - DNA, 30 bp, Artificial Sequence
  Description of Artificial Sequence: Synthetic oligonucleotide
gccccaaaacacccttcgagttttactggg

SEQ ID NO: 259662 - DNA, 32 bp, Artificial Sequence
  Description of Artificial Sequence: Synthetic oligonucleotide
ccccaaaacacccttcgagttttactgggaac

SEQ ID NO: 259663 - DNA, 34 bp, Artificial Sequence
  Description of Artificial Sequence: Synthetic oligonucleotide
cccaaaacacccttcgagttttactgggaacatg

SEQ ID NO: 259664 - DNA, 35 bp, Artificial Sequence
  Description of Artificial Sequence: Synthetic oligonucleotide
ccaaaacacccttcgagttttactgggaacatgac

SEQ ID NO: 259665 - DNA, 37 bp, Artificial Sequence
  Description of Artificial Sequence: Synthetic oligonucleotide
caaaacacccttcgagttttactgggaacatgacaag

SEQ ID NO: 259666 - DNA, 37 bp, Artificial Sequence
  Description of Artificial Sequence: Synthetic oligonucleotide
aaaacacccttcgagttttactgggaacatgacaagc

SEQ ID NO: 259667 - DNA, 36 bp, Artificial Sequence
  Description of Artificial Sequence: Synthetic oligonucleotide
aaacacccttcgagttttactgggaacatgacaagc

SEQ ID NO: 259668 - DNA, 35 bp, Artificial Sequence
  Description of Artificial Sequence: Synthetic oligonucleotide
aacacccttcgagttttactgggaacatgacaagc

SEQ ID NO: 259669 - DNA, 34 bp, Artificial Sequence
  Description of Artificial Sequence: Synthetic oligonucleotide
acacccttcgagttttactgggaacatgacaagc

SEQ ID NO: 259670 - DNA, 33 bp, Artificial Sequence
  Description of Artificial Sequence: Synthetic oligonucleotide
cacccttcgagttttactgggaacatgacaagc

SEQ ID NO: 259671 - DNA, 33 bp, Artificial Sequence
  Description of Artificial Sequence: Synthetic oligonucleotide
acccttcgagttttactgggaacatgacaagcc

SEQ ID NO: 259672 - DNA, 32 bp, Artificial Sequence
  Description of Artificial Sequence: Synthetic oligonucleotide
cccttcgagttttactgggaacatgacaagcc

SEQ ID NO: 259673 - DNA, 33 bp, Artificial Sequence
  Description of Artificial Sequence: Synthetic oligonucleotide
ccttcgagttttactgggaacatgacaagccac

SEQ ID NO: 259674 - DNA, 34 bp, Artificial Sequence
  Description of Artificial Sequence: Synthetic oligonucleotide
cttcgagttttactgggaacatgacaagccactg

SEQ ID NO: 259675 - DNA, 36 bp, Artificial Sequence
  Description of Artificial Sequence: Synthetic oligonucleotide
ttcgagttttactgggaacatgacaagccactgttc

SEQ ID NO: 259676 - DNA, 35 bp, Artificial Sequence
  Description of Artificial Sequence: Synthetic oligonucleotide
tcgagttttactgggaacatgacaagccactgttc

SEQ ID NO: 259677 - DNA, 34 bp, Artificial Sequence
  Description of Artificial Sequence: Synthetic oligonucleotide
cgagttttactgggaacatgacaagccactgttc

SEQ ID NO: 259678 - DNA, 39 bp, Artificial Sequence
  Description of Artificial Sequence: Synthetic oligonucleotide
gagttttactgggaacatgacaagccactgttcaatatg

SEQ ID NO: 259679 - DNA, 39 bp, Artificial Sequence
  Description of Artificial Sequence: Synthetic oligonucleotide
agttttactgggaacatgacaagccactgttcaatatgc

SEQ ID NO: 259680 - DNA, 38 bp, Artificial Sequence
  Description of Artificial Sequence: Synthetic oligonucleotide
gttttactgggaacatgacaagccactgttcaatatgc

SEQ ID NO: 259681 - DNA, 40 bp, Artificial Sequence
  Description of Artificial Sequence: Synthetic oligonucleotide
ttttactgggaacatgacaagccactgttcaatatgcaag

SEQ ID NO: 259682 - DNA, 39 bp, Artificial Sequence
  Description of Artificial Sequence: Synthetic oligonucleotide
tttactgggaacatgacaagccactgttcaatatgcaag

SEQ ID NO: 259683 - DNA, 38 bp, Artificial Sequence
  Description of Artificial Sequence: Synthetic oligonucleotide
ttactgggaacatgacaagccactgttcaatatgcaag

SEQ ID NO: 259684 - DNA, 37 bp, Artificial Sequence
  Description of Artificial Sequence: Synthetic oligonucleotide
tactgggaacatgacaagccactgttcaatatgcaag

SEQ ID NO: 259685 - DNA, 36 bp, Artificial Sequence
  Description of Artificial Sequence: Synthetic oligonucleotide
actgggaacatgacaagccactgttcaatatgcaag

SEQ ID NO: 259686 - DNA, 35 bp, Artificial Sequence
  Description of Artificial Sequence: Synthetic oligonucleotide
ctgggaacatgacaagccactgttcaatatgcaag

SEQ ID NO: 259687 - DNA, 39 bp, Artificial Sequence
  Description of Artificial Sequence: Synthetic oligonucleotide
tgggaacatgacaagccactgttcaatatgcaagataag

SEQ ID NO: 259688 - DNA, 38 bp, Artificial Sequence
  Description of Artificial Sequence: Synthetic oligonucleotide
gggaacatgacaagccactgttcaatatgcaagataag

SEQ ID NO: 259689 - DNA, 42 bp, Artificial Sequence
  Description of Artificial Sequence: Synthetic oligonucleotide
ggaacatgacaagccactgttcaatatgcaagataagaattg

SEQ ID NO: 259690 - DNA, 46 bp, Artificial Sequence
  Description of Artificial Sequence: Synthetic oligonucleotide
gaacatgacaagccactgttcaatatgcaagataagaattgtttag

SEQ ID NO: 259691 - DNA, 47 bp, Artificial Sequence
  Description of Artificial Sequence: Synthetic oligonucleotide
aacatgacaagccactgttcaatatgcaagataagaattgtttagtc

SEQ ID NO: 259692 - DNA, 46 bp, Artificial Sequence
  Description of Artificial Sequence: Synthetic oligonucleotide
acatgacaagccactgttcaatatgcaagataagaattgtttagtc

SEQ ID NO: 259693 - DNA, 45 bp, Artificial Sequence
  Description of Artificial Sequence: Synthetic oligonucleotide
catgacaagccactgttcaatatgcaagataagaattgtttagtc

SEQ ID NO: 259694 - DNA, 48 bp, Artificial Sequence
  Description of Artificial Sequence: Synthetic oligonucleotide
atgacaagccactgttcaatatgcaagataagaattgtttagtcaatg

SEQ ID NO: 259695 - DNA, 47 bp, Artificial Sequence
  Description of Artificial Sequence: Synthetic oligonucleotide
tgacaagccactgttcaatatgcaagataagaattgtttagtcaatg

SEQ ID NO: 259696 - DNA, 46 bp, Artificial Sequence
  Description of Artificial Sequence: Synthetic oligonucleotide
gacaagccactgttcaatatgcaagataagaattgtttagtcaatg

SEQ ID NO: 259697 - DNA, 47 bp, Artificial Sequence
  Description of Artificial Sequence: Synthetic oligonucleotide
acaagccactgttcaatatgcaagataagaattgtttagtcaatgac

SEQ ID NO: 259698 - DNA, 46 bp, Artificial Sequence
  Description of Artificial Sequence: Synthetic oligonucleotide
caagccactgttcaatatgcaagataagaattgtttagtcaatgac

SEQ ID NO: 259699 - DNA, 46 bp, Artificial Sequence
  Description of Artificial Sequence: Synthetic oligonucleotide
aagccactgttcaatatgcaagataagaattgtttagtcaatgacc

SEQ ID NO: 259700 - DNA, 45 bp, Artificial Sequence
  Description of Artificial Sequence: Synthetic oligonucleotide
agccactgttcaatatgcaagataagaattgtttagtcaatgacc

SEQ ID NO: 259701 - DNA, 44 bp, Artificial Sequence
  Description of Artificial Sequence: Synthetic oligonucleotide
gccactgttcaatatgcaagataagaattgtttagtcaatgacc

SEQ ID NO: 259702 - DNA, 44 bp, Artificial Sequence
  Description of Artificial Sequence: Synthetic oligonucleotide
ccactgttcaatatgcaagataagaattgtttagtcaatgaccc

SEQ ID NO: 259703 - DNA, 46 bp, Artificial Sequence
  Description of Artificial Sequence: Synthetic oligonucleotide
cactgttcaatatgcaagataagaattgtttagtcaatgacccttg

SEQ ID NO: 259704 - DNA, 46 bp, Artificial Sequence
  Description of Artificial Sequence: Synthetic oligonucleotide
actgttcaatatgcaagataagaattgtttagtcaatgacccttgg

SEQ ID NO: 259705 - DNA, 45 bp, Artificial Sequence
  Description of Artificial Sequence: Synthetic oligonucleotide
ctgttcaatatgcaagataagaattgtttagtcaatgacccttgg

SEQ ID NO: 259706 - DNA, 45 bp, Artificial Sequence
  Description of Artificial Sequence: Synthetic oligonucleotide
tgttcaatatgcaagataagaattgtttagtcaatgacccttggc

SEQ ID NO: 259707 - DNA, 44 bp, Artificial Sequence
  Description of Artificial Sequence: Synthetic oligonucleotide
gttcaatatgcaagataagaattgtttagtcaatgacccttggc

SEQ ID NO: 259708 - DNA, 44 bp, Artificial Sequence
  Description of Artificial Sequence: Synthetic oligonucleotide
ttcaatatgcaagataagaattgtttagtcaatgacccttggcc

SEQ ID NO: 259709 - DNA, 43 bp, Artificial Sequence
  Description of Artificial Sequence: Synthetic oligonucleotide
tcaatatgcaagataagaattgtttagtcaatgacccttggcc

SEQ ID NO: 259710 - DNA, 42 bp, Artificial Sequence
  Description of Artificial Sequence: Synthetic oligonucleotide
caatatgcaagataagaattgtttagtcaatgacccttggcc

SEQ ID NO: 259711 - DNA, 42 bp, Artificial Sequence
  Description of Artificial Sequence: Synthetic oligonucleotide
aatatgcaagataagaattgtttagtcaatgacccttggccc

SEQ ID NO: 259712 - DNA, 41 bp, Artificial Sequence
  Description of Artificial Sequence: Synthetic oligonucleotide
atatgcaagataagaattgtttagtcaatgacccttggccc

SEQ ID NO: 259713 - DNA, 40 bp, Artificial Sequence
  Description of Artificial Sequence: Synthetic oligonucleotide
tatgcaagataagaattgtttagtcaatgacccttggccc

SEQ ID NO: 259714 - DNA, 39 bp, Artificial Sequence
  Description of Artificial Sequence: Synthetic oligonucleotide
atgcaagataagaattgtttagtcaatgacccttggccc

SEQ ID NO: 259715 - DNA, 38 bp, Artificial Sequence
  Description of Artificial Sequence: Synthetic oligonucleotide
tgcaagataagaattgtttagtcaatgacccttggccc

SEQ ID NO: 259716 - DNA, 37 bp, Artificial Sequence
  Description of Artificial Sequence: Synthetic oligonucleotide
gcaagataagaattgtttagtcaatgacccttggccc

SEQ ID NO: 259717 - DNA, 37 bp, Artificial Sequence
  Description of Artificial Sequence: Synthetic oligonucleotide
caagataagaattgtttagtcaatgacccttggcccc

SEQ ID NO: 259718 - DNA, 38 bp, Artificial Sequence
  Description of Artificial Sequence: Synthetic oligonucleotide
aagataagaattgtttagtcaatgacccttggccccag

SEQ ID NO: 259719 - DNA, 37 bp, Artificial Sequence
  Description of Artificial Sequence: Synthetic oligonucleotide
agataagaattgtttagtcaatgacccttggccccag

SEQ ID NO: 259720 - DNA, 36 bp, Artificial Sequence
  Description of Artificial Sequence: Synthetic oligonucleotide
gataagaattgtttagtcaatgacccttggccccag

SEQ ID NO: 259721 - DNA, 36 bp, Artificial Sequence
  Description of Artificial Sequence: Synthetic oligonucleotide
ataagaattgtttagtcaatgacccttggccccagc

SEQ ID NO: 259722 - DNA, 35 bp, Artificial Sequence
  Description of Artificial Sequence: Synthetic oligonucleotide
taagaattgtttagtcaatgacccttggccccagc

SEQ ID NO: 259723 - DNA, 34 bp, Artificial Sequence
  Description of Artificial Sequence: Synthetic oligonucleotide
aagaattgtttagtcaatgacccttggccccagc

SEQ ID NO: 259724 - DNA, 33 bp, Artificial Sequence
  Description of Artificial Sequence: Synthetic oligonucleotide
agaattgtttagtcaatgacccttggccccagc

SEQ ID NO: 259725 - DNA, 32 bp, Artificial Sequence
  Description of Artificial Sequence: Synthetic oligonucleotide
gaattgtttagtcaatgacccttggccccagc

SEQ ID NO: 259726 - DNA, 33 bp, Artificial Sequence
  Description of Artificial Sequence: Synthetic oligonucleotide
aattgtttagtcaatgacccttggccccagctc

SEQ ID NO: 259727 - DNA, 32 bp, Artificial Sequence
  Description of Artificial Sequence: Synthetic oligonucleotide
attgtttagtcaatgacccttggccccagctc

SEQ ID NO: 259728 - DNA, 31 bp, Artificial Sequence
  Description of Artificial Sequence: Synthetic oligonucleotide
ttgtttagtcaatgacccttggccccagctc

SEQ ID NO: 259729 - DNA, 30 bp, Artificial Sequence
  Description of Artificial Sequence: Synthetic oligonucleotide
tgtttagtcaatgacccttggccccagctc

SEQ ID NO: 259730 - DNA, 29 bp, Artificial Sequence
  Description of Artificial Sequence: Synthetic oligonucleotide
gtttagtcaatgacccttggccccagctc

SEQ ID NO: 259731 - DNA, 31 bp, Artificial Sequence
  Description of Artificial Sequence: Synthetic oligonucleotide
tttagtcaatgacccttggccccagctcaag

SEQ ID NO: 259732 - DNA, 30 bp, Artificial Sequence
  Description of Artificial Sequence: Synthetic oligonucleotide
ttagtcaatgacccttggccccagctcaag

SEQ ID NO: 259733 - DNA, 29 bp, Artificial Sequence
  Description of Artificial Sequence: Synthetic oligonucleotide
tagtcaatgacccttggccccagctcaag

SEQ ID NO: 259734 - DNA, 28 bp, Artificial Sequence
  Description of Artificial Sequence: Synthetic oligonucleotide
agtcaatgacccttggccccagctcaag

SEQ ID NO: 259735 - DNA, 27 bp, Artificial Sequence
  Description of Artificial Sequence: Synthetic oligonucleotide
gtcaatgacccttggccccagctcaag

SEQ ID NO: 259736 - DNA, 29 bp, Artificial Sequence
  Description of Artificial Sequence: Synthetic oligonucleotide
tcaatgacccttggccccagctcaagtac

SEQ ID NO: 259737 - DNA, 28 bp, Artificial Sequence
  Description of Artificial Sequence: Synthetic oligonucleotide
caatgacccttggccccagctcaagtac

SEQ ID NO: 259738 - DNA, 30 bp, Artificial Sequence
  Description of Artificial Sequence: Synthetic oligonucleotide
aatgacccttggccccagctcaagtacaag

SEQ ID NO: 259739 - DNA, 29 bp, Artificial Sequence
  Description of Artificial Sequence: Synthetic oligonucleotide
atgacccttggccccagctcaagtacaag

SEQ ID NO: 259740 - DNA, 28 bp, Artificial Sequence
  Description of Artificial Sequence: Synthetic oligonucleotide
tgacccttggccccagctcaagtacaag

SEQ ID NO: 259741 - DNA, 27 bp, Artificial Sequence
  Description of Artificial Sequence: Synthetic oligonucleotide
gacccttggccccagctcaagtacaag

SEQ ID NO: 259742 - DNA, 30 bp, Artificial Sequence
  Description of Artificial Sequence: Synthetic oligonucleotide
acccttggccccagctcaagtacaagaaac

SEQ ID NO: 259743 - DNA, 29 bp, Artificial Sequence
  Description of Artificial Sequence: Synthetic oligonucleotide
cccttggccccagctcaagtacaagaaac

SEQ ID NO: 259744 - DNA, 33 bp, Artificial Sequence
  Description of Artificial Sequence: Synthetic oligonucleotide
ccttggccccagctcaagtacaagaaactttac

SEQ ID NO: 259745 - DNA, 34 bp, Artificial Sequence
  Description of Artificial Sequence: Synthetic oligonucleotide
cttggccccagctcaagtacaagaaactttactc

SEQ ID NO: 259746 - DNA, 35 bp, Artificial Sequence
  Description of Artificial Sequence: Synthetic oligonucleotide
ttggccccagctcaagtacaagaaactttactcag

SEQ ID NO: 259747 - DNA, 34 bp, Artificial Sequence
  Description of Artificial Sequence: Synthetic oligonucleotide
tggccccagctcaagtacaagaaactttactcag

SEQ ID NO: 259748 - DNA, 33 bp, Artificial Sequence
  Description of Artificial Sequence: Synthetic oligonucleotide
ggccccagctcaagtacaagaaactttactcag

SEQ ID NO: 259749 - DNA, 34 bp, Artificial Sequence
  Description of Artificial Sequence: Synthetic oligonucleotide
gccccagctcaagtacaagaaactttactcagtg

SEQ ID NO: 259750 - DNA, 34 bp, Artificial Sequence
  Description of Artificial Sequence: Synthetic oligonucleotide
ccccagctcaagtacaagaaactttactcagtgg

SEQ ID NO: 259751 - DNA, 38 bp, Artificial Sequence
  Description of Artificial Sequence: Synthetic oligonucleotide
cccagctcaagtacaagaaactttactcagtggaattc

SEQ ID NO: 259752 - DNA, 42 bp, Artificial Sequence
  Description of Artificial Sequence: Synthetic oligonucleotide
ccagctcaagtacaagaaactttactcagtggaattcttaag

SEQ ID NO: 259753 - DNA, 42 bp, Artificial Sequence
  Description of Artificial Sequence: Synthetic oligonucleotide
cagctcaagtacaagaaactttactcagtggaattcttaagc

SEQ ID NO: 259754 - DNA, 47 bp, Artificial Sequence
  Description of Artificial Sequence: Synthetic oligonucleotide
agctcaagtacaagaaactttactcagtggaattcttaagcaaaatg

SEQ ID NO: 259755 - DNA, 46 bp, Artificial Sequence
  Description of Artificial Sequence: Synthetic oligonucleotide
gctcaagtacaagaaactttactcagtggaattcttaagcaaaatg

SEQ ID NO: 259756 - DNA, 46 bp, Artificial Sequence
  Description of Artificial Sequence: Synthetic oligonucleotide
ctcaagtacaagaaactttactcagtggaattcttaagcaaaatgg

SEQ ID NO: 259757 - DNA, 48 bp, Artificial Sequence
  Description of Artificial Sequence: Synthetic oligonucleotide
tcaagtacaagaaactttactcagtggaattcttaagcaaaatggttg

SEQ ID NO: 259758 - DNA, 47 bp, Artificial Sequence
  Description of Artificial Sequence: Synthetic oligonucleotide
caagtacaagaaactttactcagtggaattcttaagcaaaatggttg

SEQ ID NO: 259759 - DNA, 47 bp, Artificial Sequence
  Description of Artificial Sequence: Synthetic oligonucleotide
aagtacaagaaactttactcagtggaattcttaagcaaaatggttgg

SEQ ID NO: 259760 - DNA, 46 bp, Artificial Sequence
  Description of Artificial Sequence: Synthetic oligonucleotide
agtacaagaaactttactcagtggaattcttaagcaaaatggttgg

SEQ ID NO: 259761 - DNA, 45 bp, Artificial Sequence
  Description of Artificial Sequence: Synthetic oligonucleotide
gtacaagaaactttactcagtggaattcttaagcaaaatggttgg

SEQ ID NO: 259762 - DNA, 46 bp, Artificial Sequence
  Description of Artificial Sequence: Synthetic oligonucleotide
tacaagaaactttactcagtggaattcttaagcaaaatggttggac

SEQ ID NO: 259763 - DNA, 45 bp, Artificial Sequence
  Description of Artificial Sequence: Synthetic oligonucleotide
acaagaaactttactcagtggaattcttaagcaaaatggttggac

SEQ ID NO: 259764 - DNA, 44 bp, Artificial Sequence
  Description of Artificial Sequence: Synthetic oligonucleotide
caagaaactttactcagtggaattcttaagcaaaatggttggac

SEQ ID NO: 259765 - DNA, 44 bp, Artificial Sequence
  Description of Artificial Sequence: Synthetic oligonucleotide
aagaaactttactcagtggaattcttaagcaaaatggttggacg

SEQ ID NO: 259766 - DNA, 43 bp, Artificial Sequence
  Description of Artificial Sequence: Synthetic oligonucleotide
agaaactttactcagtggaattcttaagcaaaatggttggacg

SEQ ID NO: 259767 - DNA, 42 bp, Artificial Sequence
  Description of Artificial Sequence: Synthetic oligonucleotide
gaaactttactcagtggaattcttaagcaaaatggttggacg

SEQ ID NO: 259768 - DNA, 42 bp, Artificial Sequence
  Description of Artificial Sequence: Synthetic oligonucleotide
aaactttactcagtggaattcttaagcaaaatggttggacgg

SEQ ID NO: 259769 - DNA, 41 bp, Artificial Sequence
  Description of Artificial Sequence: Synthetic oligonucleotide
aactttactcagtggaattcttaagcaaaatggttggacgg

SEQ ID NO: 259770 - DNA, 40 bp, Artificial Sequence
  Description of Artificial Sequence: Synthetic oligonucleotide
actttactcagtggaattcttaagcaaaatggttggacgg

SEQ ID NO: 259771 - DNA, 39 bp, Artificial Sequence
  Description of Artificial Sequence: Synthetic oligonucleotide
ctttactcagtggaattcttaagcaaaatggttggacgg

SEQ ID NO: 259772 - DNA, 40 bp, Artificial Sequence
  Description of Artificial Sequence: Synthetic oligonucleotide
tttactcagtggaattcttaagcaaaatggttggacggag

SEQ ID NO: 259773 - DNA, 39 bp, Artificial Sequence
  Description of Artificial Sequence: Synthetic oligonucleotide
ttactcagtggaattcttaagcaaaatggttggacggag

SEQ ID NO: 259774 - DNA, 38 bp, Artificial Sequence
  Description of Artificial Sequence: Synthetic oligonucleotide
tactcagtggaattcttaagcaaaatggttggacggag

SEQ ID NO: 259775 - DNA, 37 bp, Artificial Sequence
  Description of Artificial Sequence: Synthetic oligonucleotide
actcagtggaattcttaagcaaaatggttggacggag

SEQ ID NO: 259776 - DNA, 36 bp, Artificial Sequence
  Description of Artificial Sequence: Synthetic oligonucleotide
ctcagtggaattcttaagcaaaatggttggacggag

SEQ ID NO: 259777 - DNA, 41 bp, Artificial Sequence
  Description of Artificial Sequence: Synthetic oligonucleotide
tcagtggaattcttaagcaaaatggttggacggagaaaaag

SEQ ID NO: 259778 - DNA, 40 bp, Artificial Sequence
  Description of Artificial Sequence: Synthetic oligonucleotide
cagtggaattcttaagcaaaatggttggacggagaaaaag

SEQ ID NO: 259779 - DNA, 41 bp, Artificial Sequence
  Description of Artificial Sequence: Synthetic oligonucleotide
agtggaattcttaagcaaaatggttggacggagaaaaagtc

SEQ ID NO: 259780 - DNA, 40 bp, Artificial Sequence
  Description of Artificial Sequence: Synthetic oligonucleotide
gtggaattcttaagcaaaatggttggacggagaaaaagtc

SEQ ID NO: 259781 - DNA, 44 bp, Artificial Sequence
  Description of Artificial Sequence: Synthetic oligonucleotide
tggaattcttaagcaaaatggttggacggagaaaaagtctatac

SEQ ID NO: 259782 - DNA, 43 bp, Artificial Sequence
  Description of Artificial Sequence: Synthetic oligonucleotide
ggaattcttaagcaaaatggttggacggagaaaaagtctatac

SEQ ID NO: 259783 - DNA, 45 bp, Artificial Sequence
  Description of Artificial Sequence: Synthetic oligonucleotide
gaattcttaagcaaaatggttggacggagaaaaagtctatacaag

SEQ ID NO: 259784 - DNA, 47 bp, Artificial Sequence
  Description of Artificial Sequence: Synthetic oligonucleotide
aattcttaagcaaaatggttggacggagaaaaagtctatacaagaac

SEQ ID NO: 259785 - DNA, 46 bp, Artificial Sequence
  Description of Artificial Sequence: Synthetic oligonucleotide
attcttaagcaaaatggttggacggagaaaaagtctatacaagaac

SEQ ID NO: 259786 - DNA, 45 bp, Artificial Sequence
  Description of Artificial Sequence: Synthetic oligonucleotide
ttcttaagcaaaatggttggacggagaaaaagtctatacaagaac

SEQ ID NO: 259787 - DNA, 44 bp, Artificial Sequence
  Description of Artificial Sequence: Synthetic oligonucleotide
tcttaagcaaaatggttggacggagaaaaagtctatacaagaac

SEQ ID NO: 259788 - DNA, 43 bp, Artificial Sequence
  Description of Artificial Sequence: Synthetic oligonucleotide
cttaagcaaaatggttggacggagaaaaagtctatacaagaac

SEQ ID NO: 259789 - DNA, 43 bp, Artificial Sequence
  Description of Artificial Sequence: Synthetic oligonucleotide
ttaagcaaaatggttggacggagaaaaagtctatacaagaacc

SEQ ID NO: 259790 - DNA, 42 bp, Artificial Sequence
  Description of Artificial Sequence: Synthetic oligonucleotide
taagcaaaatggttggacggagaaaaagtctatacaagaacc

SEQ ID NO: 259791 - DNA, 41 bp, Artificial Sequence
  Description of Artificial Sequence: Synthetic oligonucleotide
aagcaaaatggttggacggagaaaaagtctatacaagaacc

SEQ ID NO: 259792 - DNA, 40 bp, Artificial Sequence
  Description of Artificial Sequence: Synthetic oligonucleotide
agcaaaatggttggacggagaaaaagtctatacaagaacc

SEQ ID NO: 259793 - DNA, 39 bp, Artificial Sequence
  Description of Artificial Sequence: Synthetic oligonucleotide
gcaaaatggttggacggagaaaaagtctatacaagaacc

SEQ ID NO: 259794 - DNA, 40 bp, Artificial Sequence
  Description of Artificial Sequence: Synthetic oligonucleotide
caaaatggttggacggagaaaaagtctatacaagaaccag

SEQ ID NO: 259795 - DNA, 40 bp, Artificial Sequence
  Description of Artificial Sequence: Synthetic oligonucleotide
aaaatggttggacggagaaaaagtctatacaagaaccagc

SEQ ID NO: 259796 - DNA, 39 bp, Artificial Sequence
  Description of Artificial Sequence: Synthetic oligonucleotide
aaatggttggacggagaaaaagtctatacaagaaccagc

SEQ ID NO: 259797 - DNA, 38 bp, Artificial Sequence
  Description of Artificial Sequence: Synthetic oligonucleotide
aatggttggacggagaaaaagtctatacaagaaccagc

SEQ ID NO: 259798 - DNA, 37 bp, Artificial Sequence
  Description of Artificial Sequence: Synthetic oligonucleotide
atggttggacggagaaaaagtctatacaagaaccagc

SEQ ID NO: 259799 - DNA, 36 bp, Artificial Sequence
  Description of Artificial Sequence: Synthetic oligonucleotide
tggttggacggagaaaaagtctatacaagaaccagc

SEQ ID NO: 259800 - DNA, 35 bp, Artificial Sequence
  Description of Artificial Sequence: Synthetic oligonucleotide
ggttggacggagaaaaagtctatacaagaaccagc

SEQ ID NO: 259801 - DNA, 35 bp, Artificial Sequence
  Description of Artificial Sequence: Synthetic oligonucleotide
gttggacggagaaaaagtctatacaagaaccagcc

SEQ ID NO: 259802 - DNA, 35 bp, Artificial Sequence
  Description of Artificial Sequence: Synthetic oligonucleotide
ttggacggagaaaaagtctatacaagaaccagccc

SEQ ID NO: 259803 - DNA, 34 bp, Artificial Sequence
  Description of Artificial Sequence: Synthetic oligonucleotide
tggacggagaaaaagtctatacaagaaccagccc

SEQ ID NO: 259804 - DNA, 33 bp, Artificial Sequence
  Description of Artificial Sequence: Synthetic oligonucleotide
ggacggagaaaaagtctatacaagaaccagccc

SEQ ID NO: 259805 - DNA, 36 bp, Artificial Sequence
  Description of Artificial Sequence: Synthetic oligonucleotide
gacggagaaaaagtctatacaagaaccagccctttg

SEQ ID NO: 259806 - DNA, 37 bp, Artificial Sequence
  Description of Artificial Sequence: Synthetic oligonucleotide
acggagaaaaagtctatacaagaaccagccctttgac

SEQ ID NO: 259807 - DNA, 36 bp, Artificial Sequence
  Description of Artificial Sequence: Synthetic oligonucleotide
cggagaaaaagtctatacaagaaccagccctttgac

SEQ ID NO: 259808 - DNA, 38 bp, Artificial Sequence
  Description of Artificial Sequence: Synthetic oligonucleotide
ggagaaaaagtctatacaagaaccagccctttgacttc

SEQ ID NO: 259809 - DNA, 38 bp, Artificial Sequence
  Description of Artificial Sequence: Synthetic oligonucleotide
gagaaaaagtctatacaagaaccagccctttgacttcc

SEQ ID NO: 259810 - DNA, 39 bp, Artificial Sequence
  Description of Artificial Sequence: Synthetic oligonucleotide
agaaaaagtctatacaagaaccagccctttgacttccag

SEQ ID NO: 259811 - DNA, 38 bp, Artificial Sequence
  Description of Artificial Sequence: Synthetic oligonucleotide
gaaaaagtctatacaagaaccagccctttgacttccag

SEQ ID NO: 259812 - DNA, 43 bp, Artificial Sequence
  Description of Artificial Sequence: Synthetic oligonucleotide
aaaaagtctatacaagaaccagccctttgacttccagaaaaag

SEQ ID NO: 259813 - DNA, 42 bp, Artificial Sequence
  Description of Artificial Sequence: Synthetic oligonucleotide
aaaagtctatacaagaaccagccctttgacttccagaaaaag

SEQ ID NO: 259814 - DNA, 41 bp, Artificial Sequence
  Description of Artificial Sequence: Synthetic oligonucleotide
aaagtctatacaagaaccagccctttgacttccagaaaaag

SEQ ID NO: 259815 - DNA, 40 bp, Artificial Sequence
  Description of Artificial Sequence: Synthetic oligonucleotide
aagtctatacaagaaccagccctttgacttccagaaaaag

SEQ ID NO: 259816 - DNA, 39 bp, Artificial Sequence
  Description of Artificial Sequence: Synthetic oligonucleotide
agtctatacaagaaccagccctttgacttccagaaaaag

SEQ ID NO: 259817 - DNA, 38 bp, Artificial Sequence
  Description of Artificial Sequence: Synthetic oligonucleotide
gtctatacaagaaccagccctttgacttccagaaaaag

SEQ ID NO: 259818 - DNA, 40 bp, Artificial Sequence
  Description of Artificial Sequence: Synthetic oligonucleotide
tctatacaagaaccagccctttgacttccagaaaaagatc

SEQ ID NO: 259819 - DNA, 39 bp, Artificial Sequence
  Description of Artificial Sequence: Synthetic oligonucleotide
ctatacaagaaccagccctttgacttccagaaaaagatc

SEQ ID NO: 259820 - DNA, 39 bp, Artificial Sequence
  Description of Artificial Sequence: Synthetic oligonucleotide
tatacaagaaccagccctttgacttccagaaaaagatcg

SEQ ID NO: 259821 - DNA, 38 bp, Artificial Sequence
  Description of Artificial Sequence: Synthetic oligonucleotide
atacaagaaccagccctttgacttccagaaaaagatcg

SEQ ID NO: 259822 - DNA, 37 bp, Artificial Sequence
  Description of Artificial Sequence: Synthetic oligonucleotide
tacaagaaccagccctttgacttccagaaaaagatcg

SEQ ID NO: 259823 - DNA, 36 bp, Artificial Sequence
  Description of Artificial Sequence: Synthetic oligonucleotide
acaagaaccagccctttgacttccagaaaaagatcg

SEQ ID NO: 259824 - DNA, 35 bp, Artificial Sequence
  Description of Artificial Sequence: Synthetic oligonucleotide
caagaaccagccctttgacttccagaaaaagatcg

SEQ ID NO: 259825 - DNA, 37 bp, Artificial Sequence
  Description of Artificial Sequence: Synthetic oligonucleotide
aagaaccagccctttgacttccagaaaaagatcgttg

SEQ ID NO: 259826 - DNA, 36 bp, Artificial Sequence
  Description of Artificial Sequence: Synthetic oligonucleotide
agaaccagccctttgacttccagaaaaagatcgttg

SEQ ID NO: 259827 - DNA, 35 bp, Artificial Sequence
  Description of Artificial Sequence: Synthetic oligonucleotide
gaaccagccctttgacttccagaaaaagatcgttg

SEQ ID NO: 259828 - DNA, 35 bp, Artificial Sequence
  Description of Artificial Sequence: Synthetic oligonucleotide
aaccagccctttgacttccagaaaaagatcgttgc

SEQ ID NO: 259829 - DNA, 34 bp, Artificial Sequence
  Description of Artificial Sequence: Synthetic oligonucleotide
accagccctttgacttccagaaaaagatcgttgc

SEQ ID NO: 259830 - DNA, 33 bp, Artificial Sequence
  Description of Artificial Sequence: Synthetic oligonucleotide
ccagccctttgacttccagaaaaagatcgttgc

SEQ ID NO: 259831 - DNA, 34 bp, Artificial Sequence
  Description of Artificial Sequence: Synthetic oligonucleotide
cagccctttgacttccagaaaaagatcgttgctg

SEQ ID NO: 259832 - DNA, 34 bp, Artificial Sequence
  Description of Artificial Sequence: Synthetic oligonucleotide
agccctttgacttccagaaaaagatcgttgctgc

SEQ ID NO: 259833 - DNA, 33 bp, Artificial Sequence
  Description of Artificial Sequence: Synthetic oligonucleotide
gccctttgacttccagaaaaagatcgttgctgc

SEQ ID NO: 259834 - DNA, 33 bp, Artificial Sequence
  Description of Artificial Sequence: Synthetic oligonucleotide
ccctttgacttccagaaaaagatcgttgctgcc

SEQ ID NO: 259835 - DNA, 34 bp, Artificial Sequence
  Description of Artificial Sequence: Synthetic oligonucleotide
cctttgacttccagaaaaagatcgttgctgccac

SEQ ID NO: 259836 - DNA, 34 bp, Artificial Sequence
  Description of Artificial Sequence: Synthetic oligonucleotide
ctttgacttccagaaaaagatcgttgctgccacc

SEQ ID NO: 259837 - DNA, 36 bp, Artificial Sequence
  Description of Artificial Sequence: Synthetic oligonucleotide
tttgacttccagaaaaagatcgttgctgccaccatc

SEQ ID NO: 259838 - DNA, 35 bp, Artificial Sequence
  Description of Artificial Sequence: Synthetic oligonucleotide
ttgacttccagaaaaagatcgttgctgccaccatc

SEQ ID NO: 259839 - DNA, 34 bp, Artificial Sequence
  Description of Artificial Sequence: Synthetic oligonucleotide
tgacttccagaaaaagatcgttgctgccaccatc

SEQ ID NO: 259840 - DNA, 33 bp, Artificial Sequence
  Description of Artificial Sequence: Synthetic oligonucleotide
gacttccagaaaaagatcgttgctgccaccatc

SEQ ID NO: 259841 - DNA, 36 bp, Artificial Sequence
  Description of Artificial Sequence: Synthetic oligonucleotide
acttccagaaaaagatcgttgctgccaccatcaaag

SEQ ID NO: 259842 - DNA, 35 bp, Artificial Sequence
  Description of Artificial Sequence: Synthetic oligonucleotide
cttccagaaaaagatcgttgctgccaccatcaaag

SEQ ID NO: 259843 - DNA, 37 bp, Artificial Sequence
  Description of Artificial Sequence: Synthetic oligonucleotide
ttccagaaaaagatcgttgctgccaccatcaaagttg

SEQ ID NO: 259844 - DNA, 36 bp, Artificial Sequence
  Description of Artificial Sequence: Synthetic oligonucleotide
tccagaaaaagatcgttgctgccaccatcaaagttg

SEQ ID NO: 259845 - DNA, 35 bp, Artificial Sequence
  Description of Artificial Sequence: Synthetic oligonucleotide
ccagaaaaagatcgttgctgccaccatcaaagttg

SEQ ID NO: 259846 - DNA, 35 bp, Artificial Sequence
  Description of Artificial Sequence: Synthetic oligonucleotide
cagaaaaagatcgttgctgccaccatcaaagttgg

SEQ ID NO: 259847 - DNA, 36 bp, Artificial Sequence
  Description of Artificial Sequence: Synthetic oligonucleotide
agaaaaagatcgttgctgccaccatcaaagttggag

SEQ ID NO: 259848 - DNA, 35 bp, Artificial Sequence
  Description of Artificial Sequence: Synthetic oligonucleotide
gaaaaagatcgttgctgccaccatcaaagttggag

SEQ ID NO: 259849 - DNA, 36 bp, Artificial Sequence
  Description of Artificial Sequence: Synthetic oligonucleotide
aaaaagatcgttgctgccaccatcaaagttggagag

SEQ ID NO: 259850 - DNA, 35 bp, Artificial Sequence
  Description of Artificial Sequence: Synthetic oligonucleotide
aaaagatcgttgctgccaccatcaaagttggagag

SEQ ID NO: 259851 - DNA, 34 bp, Artificial Sequence
  Description of Artificial Sequence: Synthetic oligonucleotide
aaagatcgttgctgccaccatcaaagttggagag

SEQ ID NO: 259852 - DNA, 33 bp, Artificial Sequence
  Description of Artificial Sequence: Synthetic oligonucleotide
aagatcgttgctgccaccatcaaagttggagag

SEQ ID NO: 259853 - DNA, 32 bp, Artificial Sequence
  Description of Artificial Sequence: Synthetic oligonucleotide
agatcgttgctgccaccatcaaagttggagag

SEQ ID NO: 259854 - DNA, 31 bp, Artificial Sequence
  Description of Artificial Sequence: Synthetic oligonucleotide
gatcgttgctgccaccatcaaagttggagag

SEQ ID NO: 259855 - DNA, 31 bp, Artificial Sequence
  Description of Artificial Sequence: Synthetic oligonucleotide
atcgttgctgccaccatcaaagttggagagg

SEQ ID NO: 259856 - DNA, 30 bp, Artificial Sequence
  Description of Artificial Sequence: Synthetic oligonucleotide
tcgttgctgccaccatcaaagttggagagg

SEQ ID NO: 259857 - DNA, 29 bp, Artificial Sequence
  Description of Artificial Sequence: Synthetic oligonucleotide
cgttgctgccaccatcaaagttggagagg

SEQ ID NO: 259858 - DNA, 29 bp, Artificial Sequence
  Description of Artificial Sequence: Synthetic oligonucleotide
gttgctgccaccatcaaagttggagaggc

SEQ ID NO: 259859 - DNA, 30 bp, Artificial Sequence
  Description of Artificial Sequence: Synthetic oligonucleotide
ttgctgccaccatcaaagttggagaggcag

SEQ ID NO: 259860 - DNA, 29 bp, Artificial Sequence
  Description of Artificial Sequence: Synthetic oligonucleotide
tgctgccaccatcaaagttggagaggcag

SEQ ID NO: 259861 - DNA, 28 bp, Artificial Sequence
  Description of Artificial Sequence: Synthetic oligonucleotide
gctgccaccatcaaagttggagaggcag

SEQ ID NO: 259862 - DNA, 29 bp, Artificial Sequence
  Description of Artificial Sequence: Synthetic oligonucleotide
ctgccaccatcaaagttggagaggcagtg

SEQ ID NO: 259863 - DNA, 30 bp, Artificial Sequence
  Description of Artificial Sequence: Synthetic oligonucleotide
tgccaccatcaaagttggagaggcagtgtg

SEQ ID NO: 259864 - DNA, 29 bp, Artificial Sequence
  Description of Artificial Sequence: Synthetic oligonucleotide
gccaccatcaaagttggagaggcagtgtg

SEQ ID NO: 259865 - DNA, 29 bp, Artificial Sequence
  Description of Artificial Sequence: Synthetic oligonucleotide
ccaccatcaaagttggagaggcagtgtgg

SEQ ID NO: 259866 - DNA, 32 bp, Artificial Sequence
  Description of Artificial Sequence: Synthetic oligonucleotide
caccatcaaagttggagaggcagtgtggtttc

SEQ ID NO: 259867 - DNA, 32 bp, Artificial Sequence
  Description of Artificial Sequence: Synthetic oligonucleotide
accatcaaagttggagaggcagtgtggtttcg

SEQ ID NO: 259868 - DNA, 31 bp, Artificial Sequence
  Description of Artificial Sequence: Synthetic oligonucleotide
ccatcaaagttggagaggcagtgtggtttcg

SEQ ID NO: 259869 - DNA, 31 bp, Artificial Sequence
  Description of Artificial Sequence: Synthetic oligonucleotide
catcaaagttggagaggcagtgtggtttcgc

SEQ ID NO: 259870 - DNA, 32 bp, Artificial Sequence
  Description of Artificial Sequence: Synthetic oligonucleotide
atcaaagttggagaggcagtgtggtttcgctg

SEQ ID NO: 259871 - DNA, 31 bp, Artificial Sequence
  Description of Artificial Sequence: Synthetic oligonucleotide
tcaaagttggagaggcagtgtggtttcgctg

SEQ ID NO: 259872 - DNA, 30 bp, Artificial Sequence
  Description of Artificial Sequence: Synthetic oligonucleotide
caaagttggagaggcagtgtggtttcgctg

SEQ ID NO: 259873 - DNA, 31 bp, Artificial Sequence
  Description of Artificial Sequence: Synthetic oligonucleotide
aaagttggagaggcagtgtggtttcgctgtg

SEQ ID NO: 259874 - DNA, 30 bp, Artificial Sequence
  Description of Artificial Sequence: Synthetic oligonucleotide
aagttggagaggcagtgtggtttcgctgtg

SEQ ID NO: 259875 - DNA, 29 bp, Artificial Sequence
  Description of Artificial Sequence: Synthetic oligonucleotide
agttggagaggcagtgtggtttcgctgtg

SEQ ID NO: 259876 - DNA, 28 bp, Artificial Sequence
  Description of Artificial Sequence: Synthetic oligonucleotide
gttggagaggcagtgtggtttcgctgtg

SEQ ID NO: 259877 - DNA, 30 bp, Artificial Sequence
  Description of Artificial Sequence: Synthetic oligonucleotide
ttggagaggcagtgtggtttcgctgtgatg

SEQ ID NO: 259878 - DNA, 29 bp, Artificial Sequence
  Description of Artificial Sequence: Synthetic oligonucleotide
tggagaggcagtgtggtttcgctgtgatg

SEQ ID NO: 259879 - DNA, 28 bp, Artificial Sequence
  Description of Artificial Sequence: Synthetic oligonucleotide
ggagaggcagtgtggtttcgctgtgatg

SEQ ID NO: 259880 - DNA, 30 bp, Artificial Sequence
  Description of Artificial Sequence: Synthetic oligonucleotide
gagaggcagtgtggtttcgctgtgatgatg

SEQ ID NO: 259881 - DNA, 30 bp, Artificial Sequence
  Description of Artificial Sequence: Synthetic oligonucleotide
agaggcagtgtggtttcgctgtgatgatgg

SEQ ID NO: 259882 - DNA, 29 bp, Artificial Sequence
  Description of Artificial Sequence: Synthetic oligonucleotide
gaggcagtgtggtttcgctgtgatgatgg

SEQ ID NO: 259883 - DNA, 33 bp, Artificial Sequence
  Description of Artificial Sequence: Synthetic oligonucleotide
aggcagtgtggtttcgctgtgatgatggaaaac

SEQ ID NO: 259884 - DNA, 32 bp, Artificial Sequence
  Description of Artificial Sequence: Synthetic oligonucleotide
ggcagtgtggtttcgctgtgatgatggaaaac

SEQ ID NO: 259885 - DNA, 33 bp, Artificial Sequence
  Description of Artificial Sequence: Synthetic oligonucleotide
gcagtgtggtttcgctgtgatgatggaaaacag

SEQ ID NO: 259886 - DNA, 35 bp, Artificial Sequence
  Description of Artificial Sequence: Synthetic oligonucleotide
cagtgtggtttcgctgtgatgatggaaaacagttc

SEQ ID NO: 259887 - DNA, 39 bp, Artificial Sequence
  Description of Artificial Sequence: Synthetic oligonucleotide
agtgtggtttcgctgtgatgatggaaaacagttcaatag

SEQ ID NO: 259888 - DNA, 38 bp, Artificial Sequence
  Description of Artificial Sequence: Synthetic oligonucleotide
gtgtggtttcgctgtgatgatggaaaacagttcaatag

SEQ ID NO: 259889 - DNA, 38 bp, Artificial Sequence
  Description of Artificial Sequence: Synthetic oligonucleotide
tgtggtttcgctgtgatgatggaaaacagttcaatagc

SEQ ID NO: 259890 - DNA, 37 bp, Artificial Sequence
  Description of Artificial Sequence: Synthetic oligonucleotide
gtggtttcgctgtgatgatggaaaacagttcaatagc

SEQ ID NO: 259891 - DNA, 39 bp, Artificial Sequence
  Description of Artificial Sequence: Synthetic oligonucleotide
tggtttcgctgtgatgatggaaaacagttcaatagctag

SEQ ID NO: 259892 - DNA, 38 bp, Artificial Sequence
  Description of Artificial Sequence: Synthetic oligonucleotide
ggtttcgctgtgatgatggaaaacagttcaatagctag

SEQ ID NO: 259893 - DNA, 38 bp, Artificial Sequence
  Description of Artificial Sequence: Synthetic oligonucleotide
gtttcgctgtgatgatggaaaacagttcaatagctagc

SEQ ID NO: 259894 - DNA, 39 bp, Artificial Sequence
  Description of Artificial Sequence: Synthetic oligonucleotide
tttcgctgtgatgatggaaaacagttcaatagctagctg

SEQ ID NO: 259895 - DNA, 38 bp, Artificial Sequence
  Description of Artificial Sequence: Synthetic oligonucleotide
ttcgctgtgatgatggaaaacagttcaatagctagctg

SEQ ID NO: 259896 - DNA, 37 bp, Artificial Sequence
  Description of Artificial Sequence: Synthetic oligonucleotide
tcgctgtgatgatggaaaacagttcaatagctagctg

SEQ ID NO: 259897 - DNA, 36 bp, Artificial Sequence
  Description of Artificial Sequence: Synthetic oligonucleotide
cgctgtgatgatggaaaacagttcaatagctagctg

SEQ ID NO: 259898 - DNA, 36 bp, Artificial Sequence
  Description of Artificial Sequence: Synthetic oligonucleotide
gctgtgatgatggaaaacagttcaatagctagctgg

SEQ ID NO: 259899 - DNA, 36 bp, Artificial Sequence
  Description of Artificial Sequence: Synthetic oligonucleotide
ctgtgatgatggaaaacagttcaatagctagctggg

SEQ ID NO: 259900 - DNA, 36 bp, Artificial Sequence
  Description of Artificial Sequence: Synthetic oligonucleotide
tgtgatgatggaaaacagttcaatagctagctgggc

SEQ ID NO: 259901 - DNA, 35 bp, Artificial Sequence
  Description of Artificial Sequence: Synthetic oligonucleotide
gtgatgatggaaaacagttcaatagctagctgggc

SEQ ID NO: 259902 - DNA, 35 bp, Artificial Sequence
  Description of Artificial Sequence: Synthetic oligonucleotide
tgatgatggaaaacagttcaatagctagctgggcc

SEQ ID NO: 259903 - DNA, 34 bp, Artificial Sequence
  Description of Artificial Sequence: Synthetic oligonucleotide
gatgatggaaaacagttcaatagctagctgggcc

SEQ ID NO: 259904 - DNA, 35 bp, Artificial Sequence
  Description of Artificial Sequence: Synthetic oligonucleotide
atgatggaaaacagttcaatagctagctgggccac

SEQ ID NO: 259905 - DNA, 34 bp, Artificial Sequence
  Description of Artificial Sequence: Synthetic oligonucleotide
tgatggaaaacagttcaatagctagctgggccac

SEQ ID NO: 259906 - DNA, 33 bp, Artificial Sequence
  Description of Artificial Sequence: Synthetic oligonucleotide
gatggaaaacagttcaatagctagctgggccac

SEQ ID NO: 259907 - DNA, 34 bp, Artificial Sequence
  Description of Artificial Sequence: Synthetic oligonucleotide
atggaaaacagttcaatagctagctgggccacag

SEQ ID NO: 259908 - DNA, 33 bp, Artificial Sequence
  Description of Artificial Sequence: Synthetic oligonucleotide
tggaaaacagttcaatagctagctgggccacag

SEQ ID NO: 259909 - DNA, 32 bp, Artificial Sequence
  Description of Artificial Sequence: Synthetic oligonucleotide
ggaaaacagttcaatagctagctgggccacag

SEQ ID NO: 259910 - DNA, 33 bp, Artificial Sequence
  Description of Artificial Sequence: Synthetic oligonucleotide
gaaaacagttcaatagctagctgggccacagtg

SEQ ID NO: 259911 - DNA, 34 bp, Artificial Sequence
  Description of Artificial Sequence: Synthetic oligonucleotide
aaaacagttcaatagctagctgggccacagtgac

SEQ ID NO: 259912 - DNA, 33 bp, Artificial Sequence
  Description of Artificial Sequence: Synthetic oligonucleotide
aaacagttcaatagctagctgggccacagtgac

SEQ ID NO: 259913 - DNA, 32 bp, Artificial Sequence
  Description of Artificial Sequence: Synthetic oligonucleotide
aacagttcaatagctagctgggccacagtgac

SEQ ID NO: 259914 - DNA, 31 bp, Artificial Sequence
  Description of Artificial Sequence: Synthetic oligonucleotide
acagttcaatagctagctgggccacagtgac

SEQ ID NO: 259915 - DNA, 30 bp, Artificial Sequence
  Description of Artificial Sequence: Synthetic oligonucleotide
cagttcaatagctagctgggccacagtgac

SEQ ID NO: 259916 - DNA, 32 bp, Artificial Sequence
  Description of Artificial Sequence: Synthetic oligonucleotide
agttcaatagctagctgggccacagtgacatc

SEQ ID NO: 259917 - DNA, 31 bp, Artificial Sequence
  Description of Artificial Sequence: Synthetic oligonucleotide
gttcaatagctagctgggccacagtgacatc

SEQ ID NO: 259918 - DNA, 34 bp, Artificial Sequence
  Description of Artificial Sequence: Synthetic oligonucleotide
ttcaatagctagctgggccacagtgacatcaatc

SEQ ID NO: 259919 - DNA, 33 bp, Artificial Sequence
  Description of Artificial Sequence: Synthetic oligonucleotide
tcaatagctagctgggccacagtgacatcaatc

SEQ ID NO: 259920 - DNA, 32 bp, Artificial Sequence
  Description of Artificial Sequence: Synthetic oligonucleotide
caatagctagctgggccacagtgacatcaatc

SEQ ID NO: 259921 - DNA, 33 bp, Artificial Sequence
  Description of Artificial Sequence: Synthetic oligonucleotide
aatagctagctgggccacagtgacatcaatctc

SEQ ID NO: 259922 - DNA, 32 bp, Artificial Sequence
  Description of Artificial Sequence: Synthetic oligonucleotide
atagctagctgggccacagtgacatcaatctc

SEQ ID NO: 259923 - DNA, 31 bp, Artificial Sequence
  Description of Artificial Sequence: Synthetic oligonucleotide
tagctagctgggccacagtgacatcaatctc

SEQ ID NO: 259924 - DNA, 30 bp, Artificial Sequence
  Description of Artificial Sequence: Synthetic oligonucleotide
agctagctgggccacagtgacatcaatctc

SEQ ID NO: 259925 - DNA, 29 bp, Artificial Sequence
  Description of Artificial Sequence: Synthetic oligonucleotide
gctagctgggccacagtgacatcaatctc

SEQ ID NO: 259926 - DNA, 32 bp, Artificial Sequence
  Description of Artificial Sequence: Synthetic oligonucleotide
ctagctgggccacagtgacatcaatctctatc

SEQ ID NO: 259927 - DNA, 33 bp, Artificial Sequence
  Description of Artificial Sequence: Synthetic oligonucleotide
tagctgggccacagtgacatcaatctctatcac

SEQ ID NO: 259928 - DNA, 32 bp, Artificial Sequence
  Description of Artificial Sequence: Synthetic oligonucleotide
agctgggccacagtgacatcaatctctatcac

SEQ ID NO: 259929 - DNA, 31 bp, Artificial Sequence
  Description of Artificial Sequence: Synthetic oligonucleotide
gctgggccacagtgacatcaatctctatcac

SEQ ID NO: 259930 - DNA, 31 bp, Artificial Sequence
  Description of Artificial Sequence: Synthetic oligonucleotide
ctgggccacagtgacatcaatctctatcacc

SEQ ID NO: 259931 - DNA, 33 bp, Artificial Sequence
  Description of Artificial Sequence: Synthetic oligonucleotide
tgggccacagtgacatcaatctctatcaccatg

SEQ ID NO: 259932 - DNA, 32 bp, Artificial Sequence
  Description of Artificial Sequence: Synthetic oligonucleotide
gggccacagtgacatcaatctctatcaccatg

SEQ ID NO: 259933 - DNA, 33 bp, Artificial Sequence
  Description of Artificial Sequence: Synthetic oligonucleotide
ggccacagtgacatcaatctctatcaccatgag

SEQ ID NO: 259934 - DNA, 36 bp, Artificial Sequence
  Description of Artificial Sequence: Synthetic oligonucleotide
gccacagtgacatcaatctctatcaccatgagtaag

SEQ ID NO: 259935 - DNA, 37 bp, Artificial Sequence
  Description of Artificial Sequence: Synthetic oligonucleotide
ccacagtgacatcaatctctatcaccatgagtaagtg

SEQ ID NO: 259936 - DNA, 40 bp, Artificial Sequence
  Description of Artificial Sequence: Synthetic oligonucleotide
cacagtgacatcaatctctatcaccatgagtaagtgtttg

SEQ ID NO: 259937 - DNA, 40 bp, Artificial Sequence
  Description of Artificial Sequence: Synthetic oligonucleotide
acagtgacatcaatctctatcaccatgagtaagtgtttgg

SEQ ID NO: 259938 - DNA, 39 bp, Artificial Sequence
  Description of Artificial Sequence: Synthetic oligonucleotide
cagtgacatcaatctctatcaccatgagtaagtgtttgg

SEQ ID NO: 259939 - DNA, 40 bp, Artificial Sequence
  Description of Artificial Sequence: Synthetic oligonucleotide
agtgacatcaatctctatcaccatgagtaagtgtttggag

SEQ ID NO: 259940 - DNA, 39 bp, Artificial Sequence
  Description of Artificial Sequence: Synthetic oligonucleotide
gtgacatcaatctctatcaccatgagtaagtgtttggag

SEQ ID NO: 259941 - DNA, 40 bp, Artificial Sequence
  Description of Artificial Sequence: Synthetic oligonucleotide
tgacatcaatctctatcaccatgagtaagtgtttggagtc

SEQ ID NO: 259942 - DNA, 39 bp, Artificial Sequence
  Description of Artificial Sequence: Synthetic oligonucleotide
gacatcaatctctatcaccatgagtaagtgtttggagtc

SEQ ID NO: 259943 - DNA, 40 bp, Artificial Sequence
  Description of Artificial Sequence: Synthetic oligonucleotide
acatcaatctctatcaccatgagtaagtgtttggagtctc

SEQ ID NO: 259944 - DNA, 39 bp, Artificial Sequence
  Description of Artificial Sequence: Synthetic oligonucleotide
catcaatctctatcaccatgagtaagtgtttggagtctc

SEQ ID NO: 259945 - DNA, 39 bp, Artificial Sequence
  Description of Artificial Sequence: Synthetic oligonucleotide
atcaatctctatcaccatgagtaagtgtttggagtctcc

SEQ ID NO: 259946 - DNA, 38 bp, Artificial Sequence
  Description of Artificial Sequence: Synthetic oligonucleotide
tcaatctctatcaccatgagtaagtgtttggagtctcc

SEQ ID NO: 259947 - DNA, 37 bp, Artificial Sequence
  Description of Artificial Sequence: Synthetic oligonucleotide
caatctctatcaccatgagtaagtgtttggagtctcc

SEQ ID NO: 259948 - DNA, 39 bp, Artificial Sequence
  Description of Artificial Sequence: Synthetic oligonucleotide
aatctctatcaccatgagtaagtgtttggagtctccttg

SEQ ID NO: 259949 - DNA, 38 bp, Artificial Sequence
  Description of Artificial Sequence: Synthetic oligonucleotide
atctctatcaccatgagtaagtgtttggagtctccttg

SEQ ID NO: 259950 - DNA, 37 bp, Artificial Sequence
  Description of Artificial Sequence: Synthetic oligonucleotide
tctctatcaccatgagtaagtgtttggagtctccttg

SEQ ID NO: 259951 - DNA, 36 bp, Artificial Sequence
  Description of Artificial Sequence: Synthetic oligonucleotide
ctctatcaccatgagtaagtgtttggagtctccttg

SEQ ID NO: 259952 - DNA, 38 bp, Artificial Sequence
  Description of Artificial Sequence: Synthetic oligonucleotide
tctatcaccatgagtaagtgtttggagtctccttgtag

SEQ ID NO: 259953 - DNA, 37 bp, Artificial Sequence
  Description of Artificial Sequence: Synthetic oligonucleotide
ctatcaccatgagtaagtgtttggagtctccttgtag

SEQ ID NO: 259954 - DNA, 39 bp, Artificial Sequence
  Description of Artificial Sequence: Synthetic oligonucleotide
tatcaccatgagtaagtgtttggagtctccttgtagaac

SEQ ID NO: 259955 - DNA, 38 bp, Artificial Sequence
  Description of Artificial Sequence: Synthetic oligonucleotide
atcaccatgagtaagtgtttggagtctccttgtagaac

SEQ ID NO: 259956 - DNA, 37 bp, Artificial Sequence
  Description of Artificial Sequence: Synthetic oligonucleotide
tcaccatgagtaagtgtttggagtctccttgtagaac

SEQ ID NO: 259957 - DNA, 36 bp, Artificial Sequence
  Description of Artificial Sequence: Synthetic oligonucleotide
caccatgagtaagtgtttggagtctccttgtagaac

SEQ ID NO: 259958 - DNA, 38 bp, Artificial Sequence
  Description of Artificial Sequence: Synthetic oligonucleotide
accatgagtaagtgtttggagtctccttgtagaacatg

SEQ ID NO: 259959 - DNA, 37 bp, Artificial Sequence
  Description of Artificial Sequence: Synthetic oligonucleotide
ccatgagtaagtgtttggagtctccttgtagaacatg

SEQ ID NO: 259960 - DNA, 43 bp, Artificial Sequence
  Description of Artificial Sequence: Synthetic oligonucleotide
catgagtaagtgtttggagtctccttgtagaacatgattaaag

SEQ ID NO: 259961 - DNA, 43 bp, Artificial Sequence
  Description of Artificial Sequence: Synthetic oligonucleotide
atgagtaagtgtttggagtctccttgtagaacatgattaaagc

SEQ ID NO: 259962 - DNA, 42 bp, Artificial Sequence
  Description of Artificial Sequence: Synthetic oligonucleotide
tgagtaagtgtttggagtctccttgtagaacatgattaaagc

SEQ ID NO: 259963 - DNA, 41 bp, Artificial Sequence
  Description of Artificial Sequence: Synthetic oligonucleotide
gagtaagtgtttggagtctccttgtagaacatgattaaagc

SEQ ID NO: 259964 - DNA, 41 bp, Artificial Sequence
  Description of Artificial Sequence: Synthetic oligonucleotide
agtaagtgtttggagtctccttgtagaacatgattaaagcg

SEQ ID NO: 259965 - DNA, 40 bp, Artificial Sequence
  Description of Artificial Sequence: Synthetic oligonucleotide
gtaagtgtttggagtctccttgtagaacatgattaaagcg

SEQ ID NO: 259966 - DNA, 40 bp, Artificial Sequence
  Description of Artificial Sequence: Synthetic oligonucleotide
taagtgtttggagtctccttgtagaacatgattaaagcgg

SEQ ID NO: 259967 - DNA, 39 bp, Artificial Sequence
  Description of Artificial Sequence: Synthetic oligonucleotide
aagtgtttggagtctccttgtagaacatgattaaagcgg

SEQ ID NO: 259968 - DNA, 38 bp, Artificial Sequence
  Description of Artificial Sequence: Synthetic oligonucleotide
agtgtttggagtctccttgtagaacatgattaaagcgg

SEQ ID NO: 259969 - DNA, 37 bp, Artificial Sequence
  Description of Artificial Sequence: Synthetic oligonucleotide
gtgtttggagtctccttgtagaacatgattaaagcgg

SEQ ID NO: 259970 - DNA, 38 bp, Artificial Sequence
  Description of Artificial Sequence: Synthetic oligonucleotide
tgtttggagtctccttgtagaacatgattaaagcggac

SEQ ID NO: 259971 - DNA, 37 bp, Artificial Sequence
  Description of Artificial Sequence: Synthetic oligonucleotide
gtttggagtctccttgtagaacatgattaaagcggac

SEQ ID NO: 259972 - DNA, 38 bp, Artificial Sequence
  Description of Artificial Sequence: Synthetic oligonucleotide
tttggagtctccttgtagaacatgattaaagcggacag

SEQ ID NO: 259973 - DNA, 37 bp, Artificial Sequence
  Description of Artificial Sequence: Synthetic oligonucleotide
ttggagtctccttgtagaacatgattaaagcggacag

SEQ ID NO: 259974 - DNA, 36 bp, Artificial Sequence
  Description of Artificial Sequence: Synthetic oligonucleotide
tggagtctccttgtagaacatgattaaagcggacag

SEQ ID NO: 259975 - DNA, 35 bp, Artificial Sequence
  Description of Artificial Sequence: Synthetic oligonucleotide
ggagtctccttgtagaacatgattaaagcggacag

SEQ ID NO: 259976 - DNA, 35 bp, Artificial Sequence
  Description of Artificial Sequence: Synthetic oligonucleotide
gagtctccttgtagaacatgattaaagcggacagg

SEQ ID NO: 259977 - DNA, 35 bp, Artificial Sequence
  Description of Artificial Sequence: Synthetic oligonucleotide
agtctccttgtagaacatgattaaagcggacaggc

SEQ ID NO: 259978 - DNA, 34 bp, Artificial Sequence
  Description of Artificial Sequence: Synthetic oligonucleotide
gtctccttgtagaacatgattaaagcggacaggc

SEQ ID NO: 259979 - DNA, 35 bp, Artificial Sequence
  Description of Artificial Sequence: Synthetic oligonucleotide
tctccttgtagaacatgattaaagcggacaggctg

SEQ ID NO: 259980 - DNA, 34 bp, Artificial Sequence
  Description of Artificial Sequence: Synthetic oligonucleotide
ctccttgtagaacatgattaaagcggacaggctg

SEQ ID NO: 259981 - DNA, 35 bp, Artificial Sequence
  Description of Artificial Sequence: Synthetic oligonucleotide
tccttgtagaacatgattaaagcggacaggctgac

SEQ ID NO: 259982 - DNA, 34 bp, Artificial Sequence
  Description of Artificial Sequence: Synthetic oligonucleotide
ccttgtagaacatgattaaagcggacaggctgac

SEQ ID NO: 259983 - DNA, 38 bp, Artificial Sequence
  Description of Artificial Sequence: Synthetic oligonucleotide
cttgtagaacatgattaaagcggacaggctgactattg

SEQ ID NO: 259984 - DNA, 38 bp, Artificial Sequence
  Description of Artificial Sequence: Synthetic oligonucleotide
ttgtagaacatgattaaagcggacaggctgactattgg

SEQ ID NO: 259985 - DNA, 37 bp, Artificial Sequence
  Description of Artificial Sequence: Synthetic oligonucleotide
tgtagaacatgattaaagcggacaggctgactattgg

SEQ ID NO: 259986 - DNA, 36 bp, Artificial Sequence
  Description of Artificial Sequence: Synthetic oligonucleotide
gtagaacatgattaaagcggacaggctgactattgg

SEQ ID NO: 259987 - DNA, 37 bp, Artificial Sequence
  Description of Artificial Sequence: Synthetic oligonucleotide
tagaacatgattaaagcggacaggctgactattggtg

SEQ ID NO: 259988 - DNA, 36 bp, Artificial Sequence
  Description of Artificial Sequence: Synthetic oligonucleotide
agaacatgattaaagcggacaggctgactattggtg

SEQ ID NO: 259989 - DNA, 35 bp, Artificial Sequence
  Description of Artificial Sequence: Synthetic oligonucleotide
gaacatgattaaagcggacaggctgactattggtg

SEQ ID NO: 259990 - DNA, 36 bp, Artificial Sequence
  Description of Artificial Sequence: Synthetic oligonucleotide
aacatgattaaagcggacaggctgactattggtgag

SEQ ID NO: 259991 - DNA, 35 bp, Artificial Sequence
  Description of Artificial Sequence: Synthetic oligonucleotide
acatgattaaagcggacaggctgactattggtgag

SEQ ID NO: 259992 - DNA, 34 bp, Artificial Sequence
  Description of Artificial Sequence: Synthetic oligonucleotide
catgattaaagcggacaggctgactattggtgag

SEQ ID NO: 259993 - DNA, 35 bp, Artificial Sequence
  Description of Artificial Sequence: Synthetic oligonucleotide
atgattaaagcggacaggctgactattggtgagtg

SEQ ID NO: 259994 - DNA, 34 bp, Artificial Sequence
  Description of Artificial Sequence: Synthetic oligonucleotide
tgattaaagcggacaggctgactattggtgagtg

SEQ ID NO: 259995 - DNA, 33 bp, Artificial Sequence
  Description of Artificial Sequence: Synthetic oligonucleotide
gattaaagcggacaggctgactattggtgagtg

SEQ ID NO: 259996 - DNA, 34 bp, Artificial Sequence
  Description of Artificial Sequence: Synthetic oligonucleotide
attaaagcggacaggctgactattggtgagtgac

SEQ ID NO: 259997 - DNA, 33 bp, Artificial Sequence
  Description of Artificial Sequence: Synthetic oligonucleotide
ttaaagcggacaggctgactattggtgagtgac

SEQ ID NO: 259998 - DNA, 32 bp, Artificial Sequence
  Description of Artificial Sequence: Synthetic oligonucleotide
taaagcggacaggctgactattggtgagtgac

SEQ ID NO: 259999 - DNA, 31 bp, Artificial Sequence
  Description of Artificial Sequence: Synthetic oligonucleotide
aaagcggacaggctgactattggtgagtgac

SEQ ID NO: 260000 - DNA, 30 bp, Artificial Sequence
  Description of Artificial Sequence: Synthetic oligonucleotide
aagcggacaggctgactattggtgagtgac

SEQ ID NO: 260001 - DNA, 29 bp, Artificial Sequence
  Description of Artificial Sequence: Synthetic oligonucleotide
agcggacaggctgactattggtgagtgac

SEQ ID NO: 260002 - DNA, 28 bp, Artificial Sequence
  Description of Artificial Sequence: Synthetic oligonucleotide
gcggacaggctgactattggtgagtgac

SEQ ID NO: 260003 - DNA, 32 bp, Artificial Sequence
  Description of Artificial Sequence: Synthetic oligonucleotide
cggacaggctgactattggtgagtgacttatg

SEQ ID NO: 260004 - DNA, 33 bp, Artificial Sequence
  Description of Artificial Sequence: Synthetic oligonucleotide
ggacaggctgactattggtgagtgacttatgac

SEQ ID NO: 260005 - DNA, 33 bp, Artificial Sequence
  Description of Artificial Sequence: Synthetic oligonucleotide
gacaggctgactattggtgagtgacttatgacg

SEQ ID NO: 260006 - DNA, 33 bp, Artificial Sequence
  Description of Artificial Sequence: Synthetic oligonucleotide
acaggctgactattggtgagtgacttatgacgc

SEQ ID NO: 260007 - DNA, 32 bp, Artificial Sequence
  Description of Artificial Sequence: Synthetic oligonucleotide
caggctgactattggtgagtgacttatgacgc

SEQ ID NO: 260008 - DNA, 33 bp, Artificial Sequence
  Description of Artificial Sequence: Synthetic oligonucleotide
aggctgactattggtgagtgacttatgacgcac

SEQ ID NO: 260009 - DNA, 32 bp, Artificial Sequence
  Description of Artificial Sequence: Synthetic oligonucleotide
ggctgactattggtgagtgacttatgacgcac

SEQ ID NO: 260010 - DNA, 32 bp, Artificial Sequence
  Description of Artificial Sequence: Synthetic oligonucleotide
gctgactattggtgagtgacttatgacgcacg

SEQ ID NO: 260011 - DNA, 32 bp, Artificial Sequence
  Description of Artificial Sequence: Synthetic oligonucleotide
ctgactattggtgagtgacttatgacgcacgc

SEQ ID NO: 260012 - DNA, 32 bp, Artificial Sequence
  Description of Artificial Sequence: Synthetic oligonucleotide
tgactattggtgagtgacttatgacgcacgcc

SEQ ID NO: 260013 - DNA, 31 bp, Artificial Sequence
  Description of Artificial Sequence: Synthetic oligonucleotide
gactattggtgagtgacttatgacgcacgcc

SEQ ID NO: 260014 - DNA, 33 bp, Artificial Sequence
  Description of Artificial Sequence: Synthetic oligonucleotide
actattggtgagtgacttatgacgcacgccatg

SEQ ID NO: 260015 - DNA, 32 bp, Artificial Sequence
  Description of Artificial Sequence: Synthetic oligonucleotide
ctattggtgagtgacttatgacgcacgccatg

SEQ ID NO: 260016 - DNA, 33 bp, Artificial Sequence
  Description of Artificial Sequence: Synthetic oligonucleotide
tattggtgagtgacttatgacgcacgccatgtc

SEQ ID NO: 260017 - DNA, 32 bp, Artificial Sequence
  Description of Artificial Sequence: Synthetic oligonucleotide
attggtgagtgacttatgacgcacgccatgtc

SEQ ID NO: 260018 - DNA, 31 bp, Artificial Sequence
  Description of Artificial Sequence: Synthetic oligonucleotide
ttggtgagtgacttatgacgcacgccatgtc

SEQ ID NO: 260019 - DNA, 30 bp, Artificial Sequence
  Description of Artificial Sequence: Synthetic oligonucleotide
tggtgagtgacttatgacgcacgccatgtc

SEQ ID NO: 260020 - DNA, 29 bp, Artificial Sequence
  Description of Artificial Sequence: Synthetic oligonucleotide
ggtgagtgacttatgacgcacgccatgtc

SEQ ID NO: 260021 - DNA, 29 bp, Artificial Sequence
  Description of Artificial Sequence: Synthetic oligonucleotide
gtgagtgacttatgacgcacgccatgtcc

SEQ ID NO: 260022 - DNA, 31 bp, Artificial Sequence
  Description of Artificial Sequence: Synthetic oligonucleotide
tgagtgacttatgacgcacgccatgtccttc

SEQ ID NO: 260023 - DNA, 30 bp, Artificial Sequence
  Description of Artificial Sequence: Synthetic oligonucleotide
gagtgacttatgacgcacgccatgtccttc

SEQ ID NO: 260024 - DNA, 31 bp, Artificial Sequence
  Description of Artificial Sequence: Synthetic oligonucleotide
agtgacttatgacgcacgccatgtccttcac

SEQ ID NO: 260025 - DNA, 30 bp, Artificial Sequence
  Description of Artificial Sequence: Synthetic oligonucleotide
gtgacttatgacgcacgccatgtccttcac

SEQ ID NO: 260026 - DNA, 31 bp, Artificial Sequence
  Description of Artificial Sequence: Synthetic oligonucleotide
tgacttatgacgcacgccatgtccttcactg

SEQ ID NO: 260027 - DNA, 30 bp, Artificial Sequence
  Description of Artificial Sequence: Synthetic oligonucleotide
gacttatgacgcacgccatgtccttcactg

SEQ ID NO: 260028 - DNA, 30 bp, Artificial Sequence
  Description of Artificial Sequence: Synthetic oligonucleotide
acttatgacgcacgccatgtccttcactgg

SEQ ID NO: 260029 - DNA, 29 bp, Artificial Sequence
  Description of Artificial Sequence: Synthetic oligonucleotide
cttatgacgcacgccatgtccttcactgg

SEQ ID NO: 260030 - DNA, 30 bp, Artificial Sequence
  Description of Artificial Sequence: Synthetic oligonucleotide
ttatgacgcacgccatgtccttcactggtg

SEQ ID NO: 260031 - DNA, 29 bp, Artificial Sequence
  Description of Artificial Sequence: Synthetic oligonucleotide
tatgacgcacgccatgtccttcactggtg

SEQ ID NO: 260032 - DNA, 28 bp, Artificial Sequence
  Description of Artificial Sequence: Synthetic oligonucleotide
atgacgcacgccatgtccttcactggtg

SEQ ID NO: 260033 - DNA, 27 bp, Artificial Sequence
  Description of Artificial Sequence: Synthetic oligonucleotide
tgacgcacgccatgtccttcactggtg

SEQ ID NO: 260034 - DNA, 27 bp, Artificial Sequence
  Description of Artificial Sequence: Synthetic oligonucleotide
gacgcacgccatgtccttcactggtgt

SEQ ID NO: 260035 - DNA, 27 bp, Artificial Sequence
  Description of Artificial Sequence: Synthetic oligonucleotide
acgcacgccatgtccttcactggtgtc

SEQ ID NO: 260036 - DNA, 27 bp, Artificial Sequence
  Description of Artificial Sequence: Synthetic oligonucleotide
cgcacgccatgtccttcactggtgtct

SEQ ID NO: 260037 - DNA, 27 bp, Artificial Sequence
  Description of Artificial Sequence: Synthetic oligonucleotide
gcacgccatgtccttcactggtgtctc

SEQ ID NO: 260038 - DNA, 28 bp, Artificial Sequence
  Description of Artificial Sequence: Synthetic oligonucleotide
cacgccatgtccttcactggtgtctcag

SEQ ID NO: 260039 - DNA, 29 bp, Artificial Sequence
  Description of Artificial Sequence: Synthetic oligonucleotide
acgccatgtccttcactggtgtctcagac

SEQ ID NO: 260040 - DNA, 28 bp, Artificial Sequence
  Description of Artificial Sequence: Synthetic oligonucleotide
cgccatgtccttcactggtgtctcagac

SEQ ID NO: 260041 - DNA, 30 bp, Artificial Sequence
  Description of Artificial Sequence: Synthetic oligonucleotide
gccatgtccttcactggtgtctcagacaag

SEQ ID NO: 260042 - DNA, 30 bp, Artificial Sequence
  Description of Artificial Sequence: Synthetic oligonucleotide
ccatgtccttcactggtgtctcagacaagg

SEQ ID NO: 260043 - DNA, 32 bp, Artificial Sequence
  Description of Artificial Sequence: Synthetic oligonucleotide
catgtccttcactggtgtctcagacaaggatg

SEQ ID NO: 260044 - DNA, 34 bp, Artificial Sequence
  Description of Artificial Sequence: Synthetic oligonucleotide
atgtccttcactggtgtctcagacaaggatgatg

SEQ ID NO: 260045 - DNA, 33 bp, Artificial Sequence
  Description of Artificial Sequence: Synthetic oligonucleotide
tgtccttcactggtgtctcagacaaggatgatg

SEQ ID NO: 260046 - DNA, 32 bp, Artificial Sequence
  Description of Artificial Sequence: Synthetic oligonucleotide
gtccttcactggtgtctcagacaaggatgatg

SEQ ID NO: 260047 - DNA, 33 bp, Artificial Sequence
  Description of Artificial Sequence: Synthetic oligonucleotide
tccttcactggtgtctcagacaaggatgatgag

SEQ ID NO: 260048 - DNA, 32 bp, Artificial Sequence
  Description of Artificial Sequence: Synthetic oligonucleotide
ccttcactggtgtctcagacaaggatgatgag

SEQ ID NO: 260049 - DNA, 32 bp, Artificial Sequence
  Description of Artificial Sequence: Synthetic oligonucleotide
cttcactggtgtctcagacaaggatgatgagg

SEQ ID NO: 260050 - DNA, 34 bp, Artificial Sequence
  Description of Artificial Sequence: Synthetic oligonucleotide
ttcactggtgtctcagacaaggatgatgaggatg

SEQ ID NO: 260051 - DNA, 33 bp, Artificial Sequence
  Description of Artificial Sequence: Synthetic oligonucleotide
tcactggtgtctcagacaaggatgatgaggatg

SEQ ID NO: 260052 - DNA, 32 bp, Artificial Sequence
  Description of Artificial Sequence: Synthetic oligonucleotide
cactggtgtctcagacaaggatgatgaggatg

SEQ ID NO: 260053 - DNA, 32 bp, Artificial Sequence
  Description of Artificial Sequence: Synthetic oligonucleotide
actggtgtctcagacaaggatgatgaggatgg

SEQ ID NO: 260054 - DNA, 31 bp, Artificial Sequence
  Description of Artificial Sequence: Synthetic oligonucleotide
ctggtgtctcagacaaggatgatgaggatgg

SEQ ID NO: 260055 - DNA, 32 bp, Artificial Sequence
  Description of Artificial Sequence: Synthetic oligonucleotide
tggtgtctcagacaaggatgatgaggatggtg

SEQ ID NO: 260056 - DNA, 31 bp, Artificial Sequence
  Description of Artificial Sequence: Synthetic oligonucleotide
ggtgtctcagacaaggatgatgaggatggtg

SEQ ID NO: 260057 - DNA, 31 bp, Artificial Sequence
  Description of Artificial Sequence: Synthetic oligonucleotide
gtgtctcagacaaggatgatgaggatggtgg

SEQ ID NO: 260058 - DNA, 34 bp, Artificial Sequence
  Description of Artificial Sequence: Synthetic oligonucleotide
tgtctcagacaaggatgatgaggatggtggtttc

SEQ ID NO: 260059 - DNA, 33 bp, Artificial Sequence
  Description of Artificial Sequence: Synthetic oligonucleotide
gtctcagacaaggatgatgaggatggtggtttc

SEQ ID NO: 260060 - DNA, 34 bp, Artificial Sequence
  Description of Artificial Sequence: Synthetic oligonucleotide
tctcagacaaggatgatgaggatggtggtttcac

SEQ ID NO: 260061 - DNA, 33 bp, Artificial Sequence
  Description of Artificial Sequence: Synthetic oligonucleotide
ctcagacaaggatgatgaggatggtggtttcac

SEQ ID NO: 260062 - DNA, 38 bp, Artificial Sequence
  Description of Artificial Sequence: Synthetic oligonucleotide
tcagacaaggatgatgaggatggtggtttcacaaattg

SEQ ID NO: 260063 - DNA, 37 bp, Artificial Sequence
  Description of Artificial Sequence: Synthetic oligonucleotide
cagacaaggatgatgaggatggtggtttcacaaattg

SEQ ID NO: 260064 - DNA, 37 bp, Artificial Sequence
  Description of Artificial Sequence: Synthetic oligonucleotide
agacaaggatgatgaggatggtggtttcacaaattgg

SEQ ID NO: 260065 - DNA, 36 bp, Artificial Sequence
  Description of Artificial Sequence: Synthetic oligonucleotide
gacaaggatgatgaggatggtggtttcacaaattgg

SEQ ID NO: 260066 - DNA, 37 bp, Artificial Sequence
  Description of Artificial Sequence: Synthetic oligonucleotide
acaaggatgatgaggatggtggtttcacaaattggag

SEQ ID NO: 260067 - DNA, 36 bp, Artificial Sequence
  Description of Artificial Sequence: Synthetic oligonucleotide
caaggatgatgaggatggtggtttcacaaattggag

SEQ ID NO: 260068 - DNA, 37 bp, Artificial Sequence
  Description of Artificial Sequence: Synthetic oligonucleotide
aaggatgatgaggatggtggtttcacaaattggagag

SEQ ID NO: 260069 - DNA, 36 bp, Artificial Sequence
  Description of Artificial Sequence: Synthetic oligonucleotide
aggatgatgaggatggtggtttcacaaattggagag

SEQ ID NO: 260070 - DNA, 35 bp, Artificial Sequence
  Description of Artificial Sequence: Synthetic oligonucleotide
ggatgatgaggatggtggtttcacaaattggagag

SEQ ID NO: 260071 - DNA, 36 bp, Artificial Sequence
  Description of Artificial Sequence: Synthetic oligonucleotide
gatgatgaggatggtggtttcacaaattggagagtg

SEQ ID NO: 260072 - DNA, 36 bp, Artificial Sequence
  Description of Artificial Sequence: Synthetic oligonucleotide
atgatgaggatggtggtttcacaaattggagagtgc

SEQ ID NO: 260073 - DNA, 35 bp, Artificial Sequence
  Description of Artificial Sequence: Synthetic oligonucleotide
tgatgaggatggtggtttcacaaattggagagtgc

SEQ ID NO: 260074 - DNA, 34 bp, Artificial Sequence
  Description of Artificial Sequence: Synthetic oligonucleotide
gatgaggatggtggtttcacaaattggagagtgc

SEQ ID NO: 260075 - DNA, 35 bp, Artificial Sequence
  Description of Artificial Sequence: Synthetic oligonucleotide
atgaggatggtggtttcacaaattggagagtgcag

SEQ ID NO: 260076 - DNA, 34 bp, Artificial Sequence
  Description of Artificial Sequence: Synthetic oligonucleotide
tgaggatggtggtttcacaaattggagagtgcag

SEQ ID NO: 260077 - DNA, 33 bp, Artificial Sequence
  Description of Artificial Sequence: Synthetic oligonucleotide
gaggatggtggtttcacaaattggagagtgcag

SEQ ID NO: 260078 - DNA, 37 bp, Artificial Sequence
  Description of Artificial Sequence: Synthetic oligonucleotide
aggatggtggtttcacaaattggagagtgcagaattc

SEQ ID NO: 260079 - DNA, 36 bp, Artificial Sequence
  Description of Artificial Sequence: Synthetic oligonucleotide
ggatggtggtttcacaaattggagagtgcagaattc

SEQ ID NO: 260080 - DNA, 38 bp, Artificial Sequence
  Description of Artificial Sequence: Synthetic oligonucleotide
gatggtggtttcacaaattggagagtgcagaattcatc

SEQ ID NO: 260081 - DNA, 38 bp, Artificial Sequence
  Description of Artificial Sequence: Synthetic oligonucleotide
atggtggtttcacaaattggagagtgcagaattcatcg

SEQ ID NO: 260082 - DNA, 37 bp, Artificial Sequence
  Description of Artificial Sequence: Synthetic oligonucleotide
tggtggtttcacaaattggagagtgcagaattcatcg

SEQ ID NO: 260083 - DNA, 36 bp, Artificial Sequence
  Description of Artificial Sequence: Synthetic oligonucleotide
ggtggtttcacaaattggagagtgcagaattcatcg

SEQ ID NO: 260084 - DNA, 36 bp, Artificial Sequence
  Description of Artificial Sequence: Synthetic oligonucleotide
gtggtttcacaaattggagagtgcagaattcatcgg

SEQ ID NO: 260085 - DNA, 36 bp, Artificial Sequence
  Description of Artificial Sequence: Synthetic oligonucleotide
tggtttcacaaattggagagtgcagaattcatcggg

SEQ ID NO: 260086 - DNA, 35 bp, Artificial Sequence
  Description of Artificial Sequence: Synthetic oligonucleotide
ggtttcacaaattggagagtgcagaattcatcggg

SEQ ID NO: 260087 - DNA, 36 bp, Artificial Sequence
  Description of Artificial Sequence: Synthetic oligonucleotide
gtttcacaaattggagagtgcagaattcatcgggtg

SEQ ID NO: 260088 - DNA, 38 bp, Artificial Sequence
  Description of Artificial Sequence: Synthetic oligonucleotide
tttcacaaattggagagtgcagaattcatcgggtgaag

SEQ ID NO: 260089 - DNA, 37 bp, Artificial Sequence
  Description of Artificial Sequence: Synthetic oligonucleotide
ttcacaaattggagagtgcagaattcatcgggtgaag

SEQ ID NO: 260090 - DNA, 36 bp, Artificial Sequence
  Description of Artificial Sequence: Synthetic oligonucleotide
tcacaaattggagagtgcagaattcatcgggtgaag

SEQ ID NO: 260091 - DNA, 35 bp, Artificial Sequence
  Description of Artificial Sequence: Synthetic oligonucleotide
cacaaattggagagtgcagaattcatcgggtgaag

SEQ ID NO: 260092 - DNA, 36 bp, Artificial Sequence
  Description of Artificial Sequence: Synthetic oligonucleotide
acaaattggagagtgcagaattcatcgggtgaagag

SEQ ID NO: 260093 - DNA, 35 bp, Artificial Sequence
  Description of Artificial Sequence: Synthetic oligonucleotide
caaattggagagtgcagaattcatcgggtgaagag

SEQ ID NO: 260094 - DNA, 35 bp, Artificial Sequence
  Description of Artificial Sequence: Synthetic oligonucleotide
aaattggagagtgcagaattcatcgggtgaagagc

SEQ ID NO: 260095 - DNA, 34 bp, Artificial Sequence
  Description of Artificial Sequence: Synthetic oligonucleotide
aattggagagtgcagaattcatcgggtgaagagc

SEQ ID NO: 260096 - DNA, 33 bp, Artificial Sequence
  Description of Artificial Sequence: Synthetic oligonucleotide
attggagagtgcagaattcatcgggtgaagagc

SEQ ID NO: 260097 - DNA, 32 bp, Artificial Sequence
  Description of Artificial Sequence: Synthetic oligonucleotide
ttggagagtgcagaattcatcgggtgaagagc

SEQ ID NO: 260098 - DNA, 31 bp, Artificial Sequence
  Description of Artificial Sequence: Synthetic oligonucleotide
tggagagtgcagaattcatcgggtgaagagc

SEQ ID NO: 260099 - DNA, 30 bp, Artificial Sequence
  Description of Artificial Sequence: Synthetic oligonucleotide
ggagagtgcagaattcatcgggtgaagagc

SEQ ID NO: 260100 - DNA, 32 bp, Artificial Sequence
  Description of Artificial Sequence: Synthetic oligonucleotide
gagagtgcagaattcatcgggtgaagagcatg

SEQ ID NO: 260101 - DNA, 32 bp, Artificial Sequence
  Description of Artificial Sequence: Synthetic oligonucleotide
agagtgcagaattcatcgggtgaagagcatgg

SEQ ID NO: 260102 - DNA, 31 bp, Artificial Sequence
  Description of Artificial Sequence: Synthetic oligonucleotide
gagtgcagaattcatcgggtgaagagcatgg

SEQ ID NO: 260103 - DNA, 31 bp, Artificial Sequence
  Description of Artificial Sequence: Synthetic oligonucleotide
agtgcagaattcatcgggtgaagagcatggc

SEQ ID NO: 260104 - DNA, 30 bp, Artificial Sequence
  Description of Artificial Sequence: Synthetic oligonucleotide
gtgcagaattcatcgggtgaagagcatggc

SEQ ID NO: 260105 - DNA, 30 bp, Artificial Sequence
  Description of Artificial Sequence: Synthetic oligonucleotide
tgcagaattcatcgggtgaagagcatggcc

SEQ ID NO: 260106 - DNA, 29 bp, Artificial Sequence
  Description of Artificial Sequence: Synthetic oligonucleotide
gcagaattcatcgggtgaagagcatggcc

SEQ ID NO: 260107 - DNA, 30 bp, Artificial Sequence
  Description of Artificial Sequence: Synthetic oligonucleotide
cagaattcatcgggtgaagagcatggccac

SEQ ID NO: 260108 - DNA, 33 bp, Artificial Sequence
  Description of Artificial Sequence: Synthetic oligonucleotide
agaattcatcgggtgaagagcatggccactaag

SEQ ID NO: 260109 - DNA, 32 bp, Artificial Sequence
  Description of Artificial Sequence: Synthetic oligonucleotide
gaattcatcgggtgaagagcatggccactaag

SEQ ID NO: 260110 - DNA, 32 bp, Artificial Sequence
  Description of Artificial Sequence: Synthetic oligonucleotide
aattcatcgggtgaagagcatggccactaagg

SEQ ID NO: 260111 - DNA, 31 bp, Artificial Sequence
  Description of Artificial Sequence: Synthetic oligonucleotide
attcatcgggtgaagagcatggccactaagg

SEQ ID NO: 260112 - DNA, 30 bp, Artificial Sequence
  Description of Artificial Sequence: Synthetic oligonucleotide
ttcatcgggtgaagagcatggccactaagg

SEQ ID NO: 260113 - DNA, 29 bp, Artificial Sequence
  Description of Artificial Sequence: Synthetic oligonucleotide
tcatcgggtgaagagcatggccactaagg

SEQ ID NO: 260114 - DNA, 28 bp, Artificial Sequence
  Description of Artificial Sequence: Synthetic oligonucleotide
catcgggtgaagagcatggccactaagg

SEQ ID NO: 260115 - DNA, 31 bp, Artificial Sequence
  Description of Artificial Sequence: Synthetic oligonucleotide
atcgggtgaagagcatggccactaaggttac

SEQ ID NO: 260116 - DNA, 30 bp, Artificial Sequence
  Description of Artificial Sequence: Synthetic oligonucleotide
tcgggtgaagagcatggccactaaggttac

SEQ ID NO: 260117 - DNA, 29 bp, Artificial Sequence
  Description of Artificial Sequence: Synthetic oligonucleotide
cgggtgaagagcatggccactaaggttac

SEQ ID NO: 260118 - DNA, 29 bp, Artificial Sequence
  Description of Artificial Sequence: Synthetic oligonucleotide
gggtgaagagcatggccactaaggttacc

SEQ ID NO: 260119 - DNA, 30 bp, Artificial Sequence
  Description of Artificial Sequence: Synthetic oligonucleotide
ggtgaagagcatggccactaaggttaccag

SEQ ID NO: 260120 - DNA, 31 bp, Artificial Sequence
  Description of Artificial Sequence: Synthetic oligonucleotide
gtgaagagcatggccactaaggttaccagtg

SEQ ID NO: 260121 - DNA, 31 bp, Artificial Sequence
  Description of Artificial Sequence: Synthetic oligonucleotide
tgaagagcatggccactaaggttaccagtgc

SEQ ID NO: 260122 - DNA, 30 bp, Artificial Sequence
  Description of Artificial Sequence: Synthetic oligonucleotide
gaagagcatggccactaaggttaccagtgc

SEQ ID NO: 260123 - DNA, 32 bp, Artificial Sequence
  Description of Artificial Sequence: Synthetic oligonucleotide
aagagcatggccactaaggttaccagtgcatg

SEQ ID NO: 260124 - DNA, 31 bp, Artificial Sequence
  Description of Artificial Sequence: Synthetic oligonucleotide
agagcatggccactaaggttaccagtgcatg

SEQ ID NO: 260125 - DNA, 30 bp, Artificial Sequence
  Description of Artificial Sequence: Synthetic oligonucleotide
gagcatggccactaaggttaccagtgcatg

SEQ ID NO: 260126 - DNA, 31 bp, Artificial Sequence
  Description of Artificial Sequence: Synthetic oligonucleotide
agcatggccactaaggttaccagtgcatgac

SEQ ID NO: 260127 - DNA, 30 bp, Artificial Sequence
  Description of Artificial Sequence: Synthetic oligonucleotide
gcatggccactaaggttaccagtgcatgac

SEQ ID NO: 260128 - DNA, 31 bp, Artificial Sequence
  Description of Artificial Sequence: Synthetic oligonucleotide
catggccactaaggttaccagtgcatgactg

SEQ ID NO: 260129 - DNA, 33 bp, Artificial Sequence
  Description of Artificial Sequence: Synthetic oligonucleotide
atggccactaaggttaccagtgcatgactgatg

SEQ ID NO: 260130 - DNA, 32 bp, Artificial Sequence
  Description of Artificial Sequence: Synthetic oligonucleotide
tggccactaaggttaccagtgcatgactgatg

SEQ ID NO: 260131 - DNA, 31 bp, Artificial Sequence
  Description of Artificial Sequence: Synthetic oligonucleotide
ggccactaaggttaccagtgcatgactgatg

SEQ ID NO: 260132 - DNA, 32 bp, Artificial Sequence
  Description of Artificial Sequence: Synthetic oligonucleotide
gccactaaggttaccagtgcatgactgatgag

SEQ ID NO: 260133 - DNA, 33 bp, Artificial Sequence
  Description of Artificial Sequence: Synthetic oligonucleotide
ccactaaggttaccagtgcatgactgatgagtg

SEQ ID NO: 260134 - DNA, 33 bp, Artificial Sequence
  Description of Artificial Sequence: Synthetic oligonucleotide
cactaaggttaccagtgcatgactgatgagtgg

SEQ ID NO: 260135 - DNA, 35 bp, Artificial Sequence
  Description of Artificial Sequence: Synthetic oligonucleotide
actaaggttaccagtgcatgactgatgagtggatc

SEQ ID NO: 260136 - DNA, 34 bp, Artificial Sequence
  Description of Artificial Sequence: Synthetic oligonucleotide
ctaaggttaccagtgcatgactgatgagtggatc

SEQ ID NO: 260137 - DNA, 35 bp, Artificial Sequence
  Description of Artificial Sequence: Synthetic oligonucleotide
taaggttaccagtgcatgactgatgagtggatctc

SEQ ID NO: 260138 - DNA, 34 bp, Artificial Sequence
  Description of Artificial Sequence: Synthetic oligonucleotide
aaggttaccagtgcatgactgatgagtggatctc

SEQ ID NO: 260139 - DNA, 33 bp, Artificial Sequence
  Description of Artificial Sequence: Synthetic oligonucleotide
aggttaccagtgcatgactgatgagtggatctc

SEQ ID NO: 260140 - DNA, 32 bp, Artificial Sequence
  Description of Artificial Sequence: Synthetic oligonucleotide
ggttaccagtgcatgactgatgagtggatctc

SEQ ID NO: 260141 - DNA, 33 bp, Artificial Sequence
  Description of Artificial Sequence: Synthetic oligonucleotide
gttaccagtgcatgactgatgagtggatctctg

SEQ ID NO: 260142 - DNA, 34 bp, Artificial Sequence
  Description of Artificial Sequence: Synthetic oligonucleotide
ttaccagtgcatgactgatgagtggatctctgag

SEQ ID NO: 260143 - DNA, 33 bp, Artificial Sequence
  Description of Artificial Sequence: Synthetic oligonucleotide
taccagtgcatgactgatgagtggatctctgag

SEQ ID NO: 260144 - DNA, 32 bp, Artificial Sequence
  Description of Artificial Sequence: Synthetic oligonucleotide
accagtgcatgactgatgagtggatctctgag

SEQ ID NO: 260145 - DNA, 31 bp, Artificial Sequence
  Description of Artificial Sequence: Synthetic oligonucleotide
ccagtgcatgactgatgagtggatctctgag

SEQ ID NO: 260146 - DNA, 34 bp, Artificial Sequence
  Description of Artificial Sequence: Synthetic oligonucleotide
cagtgcatgactgatgagtggatctctgagtttg

SEQ ID NO: 260147 - DNA, 35 bp, Artificial Sequence
  Description of Artificial Sequence: Synthetic oligonucleotide
agtgcatgactgatgagtggatctctgagtttgtc

SEQ ID NO: 260148 - DNA, 34 bp, Artificial Sequence
  Description of Artificial Sequence: Synthetic oligonucleotide
gtgcatgactgatgagtggatctctgagtttgtc

SEQ ID NO: 260149 - DNA, 36 bp, Artificial Sequence
  Description of Artificial Sequence: Synthetic oligonucleotide
tgcatgactgatgagtggatctctgagtttgtctac

SEQ ID NO: 260150 - DNA, 35 bp, Artificial Sequence
  Description of Artificial Sequence: Synthetic oligonucleotide
gcatgactgatgagtggatctctgagtttgtctac

SEQ ID NO: 260151 - DNA, 35 bp, Artificial Sequence
  Description of Artificial Sequence: Synthetic oligonucleotide
catgactgatgagtggatctctgagtttgtctacg

SEQ ID NO: 260152 - DNA, 37 bp, Artificial Sequence
  Description of Artificial Sequence: Synthetic oligonucleotide
atgactgatgagtggatctctgagtttgtctacgatg

SEQ ID NO: 260153 - DNA, 36 bp, Artificial Sequence
  Description of Artificial Sequence: Synthetic oligonucleotide
tgactgatgagtggatctctgagtttgtctacgatg

SEQ ID NO: 260154 - DNA, 35 bp, Artificial Sequence
  Description of Artificial Sequence: Synthetic oligonucleotide
gactgatgagtggatctctgagtttgtctacgatg

SEQ ID NO: 260155 - DNA, 36 bp, Artificial Sequence
  Description of Artificial Sequence: Synthetic oligonucleotide
actgatgagtggatctctgagtttgtctacgatgtg

SEQ ID NO: 260156 - DNA, 35 bp, Artificial Sequence
  Description of Artificial Sequence: Synthetic oligonucleotide
ctgatgagtggatctctgagtttgtctacgatgtg

SEQ ID NO: 260157 - DNA, 35 bp, Artificial Sequence
  Description of Artificial Sequence: Synthetic oligonucleotide
tgatgagtggatctctgagtttgtctacgatgtgg

SEQ ID NO: 260158 - DNA, 34 bp, Artificial Sequence
  Description of Artificial Sequence: Synthetic oligonucleotide
gatgagtggatctctgagtttgtctacgatgtgg

SEQ ID NO: 260159 - DNA, 35 bp, Artificial Sequence
  Description of Artificial Sequence: Synthetic oligonucleotide
atgagtggatctctgagtttgtctacgatgtggtg

SEQ ID NO: 260160 - DNA, 34 bp, Artificial Sequence
  Description of Artificial Sequence: Synthetic oligonucleotide
tgagtggatctctgagtttgtctacgatgtggtg

SEQ ID NO: 260161 - DNA, 33 bp, Artificial Sequence
  Description of Artificial Sequence: Synthetic oligonucleotide
gagtggatctctgagtttgtctacgatgtggtg

SEQ ID NO: 260162 - DNA, 33 bp, Artificial Sequence
  Description of Artificial Sequence: Synthetic oligonucleotide
agtggatctctgagtttgtctacgatgtggtgg

SEQ ID NO: 260163 - DNA, 32 bp, Artificial Sequence
  Description of Artificial Sequence: Synthetic oligonucleotide
gtggatctctgagtttgtctacgatgtggtgg

SEQ ID NO: 260164 - DNA, 33 bp, Artificial Sequence
  Description of Artificial Sequence: Synthetic oligonucleotide
tggatctctgagtttgtctacgatgtggtggtg

SEQ ID NO: 260165 - DNA, 32 bp, Artificial Sequence
  Description of Artificial Sequence: Synthetic oligonucleotide
ggatctctgagtttgtctacgatgtggtggtg

SEQ ID NO: 260166 - DNA, 32 bp, Artificial Sequence
  Description of Artificial Sequence: Synthetic oligonucleotide
gatctctgagtttgtctacgatgtggtggtgc

SEQ ID NO: 260167 - DNA, 33 bp, Artificial Sequence
  Description of Artificial Sequence: Synthetic oligonucleotide
atctctgagtttgtctacgatgtggtggtgcac

SEQ ID NO: 260168 - DNA, 32 bp, Artificial Sequence
  Description of Artificial Sequence: Synthetic oligonucleotide
tctctgagtttgtctacgatgtggtggtgcac

SEQ ID NO: 260169 - DNA, 31 bp, Artificial Sequence
  Description of Artificial Sequence: Synthetic oligonucleotide
ctctgagtttgtctacgatgtggtggtgcac

SEQ ID NO: 260170 - DNA, 32 bp, Artificial Sequence
  Description of Artificial Sequence: Synthetic oligonucleotide
tctgagtttgtctacgatgtggtggtgcacag

SEQ ID NO: 260171 - DNA, 31 bp, Artificial Sequence
  Description of Artificial Sequence: Synthetic oligonucleotide
ctgagtttgtctacgatgtggtggtgcacag

SEQ ID NO: 260172 - DNA, 31 bp, Artificial Sequence
  Description of Artificial Sequence: Synthetic oligonucleotide
tgagtttgtctacgatgtggtggtgcacagg

SEQ ID NO: 260173 - DNA, 30 bp, Artificial Sequence
  Description of Artificial Sequence: Synthetic oligonucleotide
gagtttgtctacgatgtggtggtgcacagg

SEQ ID NO: 260174 - DNA, 32 bp, Artificial Sequence
  Description of Artificial Sequence: Synthetic oligonucleotide
agtttgtctacgatgtggtggtgcacaggaag

SEQ ID NO: 260175 - DNA, 31 bp, Artificial Sequence
  Description of Artificial Sequence: Synthetic oligonucleotide
gtttgtctacgatgtggtggtgcacaggaag

SEQ ID NO: 260176 - DNA, 31 bp, Artificial Sequence
  Description of Artificial Sequence: Synthetic oligonucleotide
tttgtctacgatgtggtggtgcacaggaagc

SEQ ID NO: 260177 - DNA, 30 bp, Artificial Sequence
  Description of Artificial Sequence: Synthetic oligonucleotide
ttgtctacgatgtggtggtgcacaggaagc

SEQ ID NO: 260178 - DNA, 29 bp, Artificial Sequence
  Description of Artificial Sequence: Synthetic oligonucleotide
tgtctacgatgtggtggtgcacaggaagc

SEQ ID NO: 260179 - DNA, 28 bp, Artificial Sequence
  Description of Artificial Sequence: Synthetic oligonucleotide
gtctacgatgtggtggtgcacaggaagc

SEQ ID NO: 260180 - DNA, 30 bp, Artificial Sequence
  Description of Artificial Sequence: Synthetic oligonucleotide
tctacgatgtggtggtgcacaggaagcttg

SEQ ID NO: 260181 - DNA, 29 bp, Artificial Sequence
  Description of Artificial Sequence: Synthetic oligonucleotide
ctacgatgtggtggtgcacaggaagcttg

SEQ ID NO: 260182 - DNA, 30 bp, Artificial Sequence
  Description of Artificial Sequence: Synthetic oligonucleotide
tacgatgtggtggtgcacaggaagcttgtc

SEQ ID NO: 260183 - DNA, 29 bp, Artificial Sequence
  Description of Artificial Sequence: Synthetic oligonucleotide
acgatgtggtggtgcacaggaagcttgtc

SEQ ID NO: 260184 - DNA, 28 bp, Artificial Sequence
  Description of Artificial Sequence: Synthetic oligonucleotide
cgatgtggtggtgcacaggaagcttgtc

SEQ ID NO: 260185 - DNA, 28 bp, Artificial Sequence
  Description of Artificial Sequence: Synthetic oligonucleotide
gatgtggtggtgcacaggaagcttgtcc

SEQ ID NO: 260186 - DNA, 28 bp, Artificial Sequence
  Description of Artificial Sequence: Synthetic oligonucleotide
atgtggtggtgcacaggaagcttgtccc

SEQ ID NO: 260187 - DNA, 27 bp, Artificial Sequence
  Description of Artificial Sequence: Synthetic oligonucleotide
tgtggtggtgcacaggaagcttgtccc

SEQ ID NO: 260188 - DNA, 27 bp, Artificial Sequence
  Description of Artificial Sequence: Synthetic oligonucleotide
gtggtggtgcacaggaagcttgtccct

SEQ ID NO: 260189 - DNA, 27 bp, Artificial Sequence
  Description of Artificial Sequence: Synthetic oligonucleotide
tggtggtgcacaggaagcttgtccctg

SEQ ID NO: 260190 - DNA, 27 bp, Artificial Sequence
  Description of Artificial Sequence: Synthetic oligonucleotide
ggtggtgcacaggaagcttgtccctga

SEQ ID NO: 260191 - DNA, 28 bp, Artificial Sequence
  Description of Artificial Sequence: Synthetic oligonucleotide
gtggtgcacaggaagcttgtccctgatg

SEQ ID NO: 260192 - DNA, 29 bp, Artificial Sequence
  Description of Artificial Sequence: Synthetic oligonucleotide
tggtgcacaggaagcttgtccctgatgag

SEQ ID NO: 260193 - DNA, 28 bp, Artificial Sequence
  Description of Artificial Sequence: Synthetic oligonucleotide
ggtgcacaggaagcttgtccctgatgag

SEQ ID NO: 260194 - DNA, 28 bp, Artificial Sequence
  Description of Artificial Sequence: Synthetic oligonucleotide
gtgcacaggaagcttgtccctgatgagg

SEQ ID NO: 260195 - DNA, 29 bp, Artificial Sequence
  Description of Artificial Sequence: Synthetic oligonucleotide
tgcacaggaagcttgtccctgatgaggtg

SEQ ID NO: 260196 - DNA, 28 bp, Artificial Sequence
  Description of Artificial Sequence: Synthetic oligonucleotide
gcacaggaagcttgtccctgatgaggtg

SEQ ID NO: 260197 - DNA, 28 bp, Artificial Sequence
  Description of Artificial Sequence: Synthetic oligonucleotide
cacaggaagcttgtccctgatgaggtgc

SEQ ID NO: 260198 - DNA, 30 bp, Artificial Sequence
  Description of Artificial Sequence: Synthetic oligonucleotide
acaggaagcttgtccctgatgaggtgctac

SEQ ID NO: 260199 - DNA, 29 bp, Artificial Sequence
  Description of Artificial Sequence: Synthetic oligonucleotide
caggaagcttgtccctgatgaggtgctac

SEQ ID NO: 260200 - DNA, 29 bp, Artificial Sequence
  Description of Artificial Sequence: Synthetic oligonucleotide
aggaagcttgtccctgatgaggtgctacc

SEQ ID NO: 260201 - DNA, 28 bp, Artificial Sequence
  Description of Artificial Sequence: Synthetic oligonucleotide
ggaagcttgtccctgatgaggtgctacc

SEQ ID NO: 260202 - DNA, 29 bp, Artificial Sequence
  Description of Artificial Sequence: Synthetic oligonucleotide
gaagcttgtccctgatgaggtgctacctg

SEQ ID NO: 260203 - DNA, 30 bp, Artificial Sequence
  Description of Artificial Sequence: Synthetic oligonucleotide
aagcttgtccctgatgaggtgctacctgtg

SEQ ID NO: 260204 - DNA, 29 bp, Artificial Sequence
  Description of Artificial Sequence: Synthetic oligonucleotide
agcttgtccctgatgaggtgctacctgtg

SEQ ID NO: 260205 - DNA, 28 bp, Artificial Sequence
  Description of Artificial Sequence: Synthetic oligonucleotide
gcttgtccctgatgaggtgctacctgtg

SEQ ID NO: 260206 - DNA, 31 bp, Artificial Sequence
  Description of Artificial Sequence: Synthetic oligonucleotide
cttgtccctgatgaggtgctacctgtgttag

SEQ ID NO: 260207 - DNA, 32 bp, Artificial Sequence
  Description of Artificial Sequence: Synthetic oligonucleotide
ttgtccctgatgaggtgctacctgtgttagtg

SEQ ID NO: 260208 - DNA, 31 bp, Artificial Sequence
  Description of Artificial Sequence: Synthetic oligonucleotide
tgtccctgatgaggtgctacctgtgttagtg

SEQ ID NO: 260209 - DNA, 30 bp, Artificial Sequence
  Description of Artificial Sequence: Synthetic oligonucleotide
gtccctgatgaggtgctacctgtgttagtg

SEQ ID NO: 260210 - DNA, 30 bp, Artificial Sequence
  Description of Artificial Sequence: Synthetic oligonucleotide
tccctgatgaggtgctacctgtgttagtgc

SEQ ID NO: 260211 - DNA, 29 bp, Artificial Sequence
  Description of Artificial Sequence: Synthetic oligonucleotide
ccctgatgaggtgctacctgtgttagtgc

SEQ ID NO: 260212 - DNA, 30 bp, Artificial Sequence
  Description of Artificial Sequence: Synthetic oligonucleotide
cctgatgaggtgctacctgtgttagtgcag

SEQ ID NO: 260213 - DNA, 30 bp, Artificial Sequence
  Description of Artificial Sequence: Synthetic oligonucleotide
ctgatgaggtgctacctgtgttagtgcagg

SEQ ID NO: 260214 - DNA, 32 bp, Artificial Sequence
  Description of Artificial Sequence: Synthetic oligonucleotide
tgatgaggtgctacctgtgttagtgcaggaac

SEQ ID NO: 260215 - DNA, 31 bp, Artificial Sequence
  Description of Artificial Sequence: Synthetic oligonucleotide
gatgaggtgctacctgtgttagtgcaggaac

SEQ ID NO: 260216 - DNA, 31 bp, Artificial Sequence
  Description of Artificial Sequence: Synthetic oligonucleotide
atgaggtgctacctgtgttagtgcaggaacc

SEQ ID NO: 260217 - DNA, 30 bp, Artificial Sequence
  Description of Artificial Sequence: Synthetic oligonucleotide
tgaggtgctacctgtgttagtgcaggaacc

SEQ ID NO: 260218 - DNA, 29 bp, Artificial Sequence
  Description of Artificial Sequence: Synthetic oligonucleotide
gaggtgctacctgtgttagtgcaggaacc

SEQ ID NO: 260219 - DNA, 29 bp, Artificial Sequence
  Description of Artificial Sequence: Synthetic oligonucleotide
aggtgctacctgtgttagtgcaggaaccg

SEQ ID NO: 260220 - DNA, 28 bp, Artificial Sequence
  Description of Artificial Sequence: Synthetic oligonucleotide
ggtgctacctgtgttagtgcaggaaccg

SEQ ID NO: 260221 - DNA, 33 bp, Artificial Sequence
  Description of Artificial Sequence: Synthetic oligonucleotide
gtgctacctgtgttagtgcaggaaccgattatc

SEQ ID NO: 260222 - DNA, 33 bp, Artificial Sequence
  Description of Artificial Sequence: Synthetic oligonucleotide
tgctacctgtgttagtgcaggaaccgattatcc

SEQ ID NO: 260223 - DNA, 32 bp, Artificial Sequence
  Description of Artificial Sequence: Synthetic oligonucleotide
gctacctgtgttagtgcaggaaccgattatcc

SEQ ID NO: 260224 - DNA, 33 bp, Artificial Sequence
  Description of Artificial Sequence: Synthetic oligonucleotide
ctacctgtgttagtgcaggaaccgattatcctg

SEQ ID NO: 260225 - DNA, 33 bp, Artificial Sequence
  Description of Artificial Sequence: Synthetic oligonucleotide
tacctgtgttagtgcaggaaccgattatcctgg

SEQ ID NO: 260226 - DNA, 32 bp, Artificial Sequence
  Description of Artificial Sequence: Synthetic oligonucleotide
acctgtgttagtgcaggaaccgattatcctgg

SEQ ID NO: 260227 - DNA, 31 bp, Artificial Sequence
  Description of Artificial Sequence: Synthetic oligonucleotide
cctgtgttagtgcaggaaccgattatcctgg

SEQ ID NO: 260228 - DNA, 31 bp, Artificial Sequence
  Description of Artificial Sequence: Synthetic oligonucleotide
ctgtgttagtgcaggaaccgattatcctggc

SEQ ID NO: 260229 - DNA, 32 bp, Artificial Sequence
  Description of Artificial Sequence: Synthetic oligonucleotide
tgtgttagtgcaggaaccgattatcctggcag

SEQ ID NO: 260230 - DNA, 31 bp, Artificial Sequence
  Description of Artificial Sequence: Synthetic oligonucleotide
gtgttagtgcaggaaccgattatcctggcag

SEQ ID NO: 260231 - DNA, 31 bp, Artificial Sequence
  Description of Artificial Sequence: Synthetic oligonucleotide
tgttagtgcaggaaccgattatcctggcagc

SEQ ID NO: 260232 - DNA, 30 bp, Artificial Sequence
  Description of Artificial Sequence: Synthetic oligonucleotide
gttagtgcaggaaccgattatcctggcagc

SEQ ID NO: 260233 - DNA, 32 bp, Artificial Sequence
  Description of Artificial Sequence: Synthetic oligonucleotide
ttagtgcaggaaccgattatcctggcagcatg

SEQ ID NO: 260234 - DNA, 31 bp, Artificial Sequence
  Description of Artificial Sequence: Synthetic oligonucleotide
tagtgcaggaaccgattatcctggcagcatg

SEQ ID NO: 260235 - DNA, 30 bp, Artificial Sequence
  Description of Artificial Sequence: Synthetic oligonucleotide
agtgcaggaaccgattatcctggcagcatg

SEQ ID NO: 260236 - DNA, 29 bp, Artificial Sequence
  Description of Artificial Sequence: Synthetic oligonucleotide
gtgcaggaaccgattatcctggcagcatg

SEQ ID NO: 260237 - DNA, 29 bp, Artificial Sequence
  Description of Artificial Sequence: Synthetic oligonucleotide
tgcaggaaccgattatcctggcagcatgg

SEQ ID NO: 260238 - DNA, 28 bp, Artificial Sequence
  Description of Artificial Sequence: Synthetic oligonucleotide
gcaggaaccgattatcctggcagcatgg

SEQ ID NO: 260239 - DNA, 28 bp, Artificial Sequence
  Description of Artificial Sequence: Synthetic oligonucleotide
caggaaccgattatcctggcagcatggg

SEQ ID NO: 260240 - DNA, 29 bp, Artificial Sequence
  Description of Artificial Sequence: Synthetic oligonucleotide
aggaaccgattatcctggcagcatgggtc

SEQ ID NO: 260241 - DNA, 28 bp, Artificial Sequence
  Description of Artificial Sequence: Synthetic oligonucleotide
ggaaccgattatcctggcagcatgggtc

SEQ ID NO: 260242 - DNA, 28 bp, Artificial Sequence
  Description of Artificial Sequence: Synthetic oligonucleotide
gaaccgattatcctggcagcatgggtcc

SEQ ID NO: 260243 - DNA, 28 bp, Artificial Sequence
  Description of Artificial Sequence: Synthetic oligonucleotide
aaccgattatcctggcagcatgggtccc

SEQ ID NO: 260244 - DNA, 27 bp, Artificial Sequence
  Description of Artificial Sequence: Synthetic oligonucleotide
accgattatcctggcagcatgggtccc

SEQ ID NO: 260245 - DNA, 26 bp, Artificial Sequence
  Description of Artificial Sequence: Synthetic oligonucleotide
ccgattatcctggcagcatgggtccc

SEQ ID NO: 260246 - DNA, 27 bp, Artificial Sequence
  Description of Artificial Sequence: Synthetic oligonucleotide
cgattatcctggcagcatgggtcccca

SEQ ID NO: 260247 - DNA, 28 bp, Artificial Sequence
  Description of Artificial Sequence: Synthetic oligonucleotide
gattatcctggcagcatgggtccccatg

SEQ ID NO: 260248 - DNA, 28 bp, Artificial Sequence
  Description of Artificial Sequence: Synthetic oligonucleotide
attatcctggcagcatgggtccccatgg

SEQ ID NO: 260249 - DNA, 27 bp, Artificial Sequence
  Description of Artificial Sequence: Synthetic oligonucleotide
ttatcctggcagcatgggtccccatgg

SEQ ID NO: 260250 - DNA, 26 bp, Artificial Sequence
  Description of Artificial Sequence: Synthetic oligonucleotide
tatcctggcagcatgggtccccatgg

SEQ ID NO: 260251 - DNA, 25 bp, Artificial Sequence
  Description of Artificial Sequence: Synthetic oligonucleotide
atcctggcagcatgggtccccatgg

SEQ ID NO: 260252 - DNA, 24 bp, Artificial Sequence
  Description of Artificial Sequence: Synthetic oligonucleotide
tcctggcagcatgggtccccatgg

SEQ ID NO: 260253 - DNA, 23 bp, Artificial Sequence
  Description of Artificial Sequence: Synthetic oligonucleotide
cctggcagcatgggtccccatgg

SEQ ID NO: 260254 - DNA, 24 bp, Artificial Sequence
  Description of Artificial Sequence: Synthetic oligonucleotide
ctggcagcatgggtccccatgggt

SEQ ID NO: 260255 - DNA, 24 bp, Artificial Sequence
  Description of Artificial Sequence: Synthetic oligonucleotide
tggcagcatgggtccccatgggtg

SEQ ID NO: 260256 - DNA, 23 bp, Artificial Sequence
  Description of Artificial Sequence: Synthetic oligonucleotide
ggcagcatgggtccccatgggtg

SEQ ID NO: 260257 - DNA, 26 bp, Artificial Sequence
  Description of Artificial Sequence: Synthetic oligonucleotide
gcagcatgggtccccatgggtgcttt

SEQ ID NO: 260258 - DNA, 26 bp, Artificial Sequence
  Description of Artificial Sequence: Synthetic oligonucleotide
cagcatgggtccccatgggtgctttg

SEQ ID NO: 260259 - DNA, 26 bp, Artificial Sequence
  Description of Artificial Sequence: Synthetic oligonucleotide
agcatgggtccccatgggtgctttgg

SEQ ID NO: 260260 - DNA, 25 bp, Artificial Sequence
  Description of Artificial Sequence: Synthetic oligonucleotide
gcatgggtccccatgggtgctttgg

SEQ ID NO: 260261 - DNA, 26 bp, Artificial Sequence
  Description of Artificial Sequence: Synthetic oligonucleotide
catgggtccccatgggtgctttggct

SEQ ID NO: 260262 - DNA, 27 bp, Artificial Sequence
  Description of Artificial Sequence: Synthetic oligonucleotide
atgggtccccatgggtgctttggctca

SEQ ID NO: 260263 - DNA, 26 bp, Artificial Sequence
  Description of Artificial Sequence: Synthetic oligonucleotide
tgggtccccatgggtgctttggctca

SEQ ID NO: 260264 - DNA, 25 bp, Artificial Sequence
  Description of Artificial Sequence: Synthetic oligonucleotide
gggtccccatgggtgctttggctca

SEQ ID NO: 260265 - DNA, 26 bp, Artificial Sequence
  Description of Artificial Sequence: Synthetic oligonucleotide
ggtccccatgggtgctttggctcagt

SEQ ID NO: 260266 - DNA, 27 bp, Artificial Sequence
  Description of Artificial Sequence: Synthetic oligonucleotide
gtccccatgggtgctttggctcagtga

SEQ ID NO: 260267 - DNA, 27 bp, Artificial Sequence
  Description of Artificial Sequence: Synthetic oligonucleotide
atgttctagctgcctctaccggctgcg

SEQ ID NO: 260268 - DNA, 26 bp, Artificial Sequence
  Description of Artificial Sequence: Synthetic oligonucleotide
tgttctagctgcctctaccggctgcg

SEQ ID NO: 260269 - DNA, 25 bp, Artificial Sequence
  Description of Artificial Sequence: Synthetic oligonucleotide
gttctagctgcctctaccggctgcg

SEQ ID NO: 260270 - DNA, 25 bp, Artificial Sequence
  Description of Artificial Sequence: Synthetic oligonucleotide
ttctagctgcctctaccggctgcgc

SEQ ID NO: 260271 - DNA, 24 bp, Artificial Sequence
  Description of Artificial Sequence: Synthetic oligonucleotide
tctagctgcctctaccggctgcgc

SEQ ID NO: 260272 - DNA, 23 bp, Artificial Sequence
  Description of Artificial Sequence: Synthetic oligonucleotide
ctagctgcctctaccggctgcgc

SEQ ID NO: 260273 - DNA, 23 bp, Artificial Sequence
  Description of Artificial Sequence: Synthetic oligonucleotide
tagctgcctctaccggctgcgcg

SEQ ID NO: 260274 - DNA, 22 bp, Artificial Sequence
  Description of Artificial Sequence: Synthetic oligonucleotide
agctgcctctaccggctgcgcg

SEQ ID NO: 260275 - DNA, 21 bp, Artificial Sequence
  Description of Artificial Sequence: Synthetic oligonucleotide
gctgcctctaccggctgcgcg

SEQ ID NO: 260276 - DNA, 21 bp, Artificial Sequence
  Description of Artificial Sequence: Synthetic oligonucleotide
ctgcctctaccggctgcgcgg

SEQ ID NO: 260277 - DNA, 21 bp, Artificial Sequence
  Description of Artificial Sequence: Synthetic oligonucleotide
tgcctctaccggctgcgcggc

SEQ ID NO: 260278 - DNA, 20 bp, Artificial Sequence
  Description of Artificial Sequence: Synthetic oligonucleotide
gcctctaccggctgcgcggc

SEQ ID NO: 260279 - DNA, 21 bp, Artificial Sequence
  Description of Artificial Sequence: Synthetic oligonucleotide
cctctaccggctgcgcggcga

SEQ ID NO: 260280 - DNA, 23 bp, Artificial Sequence
  Description of Artificial Sequence: Synthetic oligonucleotide
ctctaccggctgcgcggcgagta

SEQ ID NO: 260281 - DNA, 24 bp, Artificial Sequence
  Description of Artificial Sequence: Synthetic oligonucleotide
tctaccggctgcgcggcgagtaga

SEQ ID NO: 260282 - DNA, 23 bp, Artificial Sequence
  Description of Artificial Sequence: Synthetic oligonucleotide
ctaccggctgcgcggcgagtaga

SEQ ID NO: 260283 - DNA, 23 bp, Artificial Sequence
  Description of Artificial Sequence: Synthetic oligonucleotide
taccggctgcgcggcgagtagac

SEQ ID NO: 260284 - DNA, 22 bp, Artificial Sequence
  Description of Artificial Sequence: Synthetic oligonucleotide
accggctgcgcggcgagtagac

SEQ ID NO: 260285 - DNA, 21 bp, Artificial Sequence
  Description of Artificial Sequence: Synthetic oligonucleotide
ccggctgcgcggcgagtagac

SEQ ID NO: 260286 - DNA, 22 bp, Artificial Sequence
  Description of Artificial Sequence: Synthetic oligonucleotide
cggctgcgcggcgagtagacgt

SEQ ID NO: 260287 - DNA, 22 bp, Artificial Sequence
  Description of Artificial Sequence: Synthetic oligonucleotide
ggctgcgcggcgagtagacgtc

SEQ ID NO: 260288 - DNA, 22 bp, Artificial Sequence
  Description of Artificial Sequence: Synthetic oligonucleotide
gctgcgcggcgagtagacgtcc

SEQ ID NO: 260289 - DNA, 23 bp, Artificial Sequence
  Description of Artificial Sequence: Synthetic oligonucleotide
ctgcgcggcgagtagacgtccga

SEQ ID NO: 260290 - DNA, 23 bp, Artificial Sequence
  Description of Artificial Sequence: Synthetic oligonucleotide
tgcgcggcgagtagacgtccgac

SEQ ID NO: 260291 - DNA, 22 bp, Artificial Sequence
  Description of Artificial Sequence: Synthetic oligonucleotide
gcgcggcgagtagacgtccgac

SEQ ID NO: 260292 - DNA, 23 bp, Artificial Sequence
  Description of Artificial Sequence: Synthetic oligonucleotide
cgcggcgagtagacgtccgacga

SEQ ID NO: 260293 - DNA, 24 bp, Artificial Sequence
  Description of Artificial Sequence: Synthetic oligonucleotide
gcggcgagtagacgtccgacgact

SEQ ID NO: 260294 - DNA, 24 bp, Artificial Sequence
  Description of Artificial Sequence: Synthetic oligonucleotide
cggcgagtagacgtccgacgactg

SEQ ID NO: 260295 - DNA, 24 bp, Artificial Sequence
  Description of Artificial Sequence: Synthetic oligonucleotide
ggcgagtagacgtccgacgactgg

SEQ ID NO: 260296 - DNA, 24 bp, Artificial Sequence
  Description of Artificial Sequence: Synthetic oligonucleotide
gcgagtagacgtccgacgactggc

SEQ ID NO: 260297 - DNA, 24 bp, Artificial Sequence
  Description of Artificial Sequence: Synthetic oligonucleotide
cgagtagacgtccgacgactggcc

SEQ ID NO: 260298 - DNA, 25 bp, Artificial Sequence
  Description of Artificial Sequence: Synthetic oligonucleotide
gagtagacgtccgacgactggccgt

SEQ ID NO: 260299 - DNA, 26 bp, Artificial Sequence
  Description of Artificial Sequence: Synthetic oligonucleotide
agtagacgtccgacgactggccgtgt

SEQ ID NO: 260300 - DNA, 25 bp, Artificial Sequence
  Description of Artificial Sequence: Synthetic oligonucleotide
gtagacgtccgacgactggccgtgt

SEQ ID NO: 260301 - DNA, 26 bp, Artificial Sequence
  Description of Artificial Sequence: Synthetic oligonucleotide
tagacgtccgacgactggccgtgtga

SEQ ID NO: 260302 - DNA, 25 bp, Artificial Sequence
  Description of Artificial Sequence: Synthetic oligonucleotide
agacgtccgacgactggccgtgtga

SEQ ID NO: 260303 - DNA, 24 bp, Artificial Sequence
  Description of Artificial Sequence: Synthetic oligonucleotide
gacgtccgacgactggccgtgtga

SEQ ID NO: 260304 - DNA, 24 bp, Artificial Sequence
  Description of Artificial Sequence: Synthetic oligonucleotide
acgtccgacgactggccgtgtgac

SEQ ID NO: 260305 - DNA, 23 bp, Artificial Sequence
  Description of Artificial Sequence: Synthetic oligonucleotide
cgtccgacgactggccgtgtgac

SEQ ID NO: 260306 - DNA, 26 bp, Artificial Sequence
  Description of Artificial Sequence: Synthetic oligonucleotide
gtccgacgactggccgtgtgacgttt

SEQ ID NO: 260307 - DNA, 26 bp, Artificial Sequence
  Description of Artificial Sequence: Synthetic oligonucleotide
tccgacgactggccgtgtgacgtttc

SEQ ID NO: 260308 - DNA, 25 bp, Artificial Sequence
  Description of Artificial Sequence: Synthetic oligonucleotide
ccgacgactggccgtgtgacgtttc

SEQ ID NO: 260309 - DNA, 25 bp, Artificial Sequence
  Description of Artificial Sequence: Synthetic oligonucleotide
cgacgactggccgtgtgacgtttcg

SEQ ID NO: 260310 - DNA, 25 bp, Artificial Sequence
  Description of Artificial Sequence: Synthetic oligonucleotide
gacgactggccgtgtgacgtttcgc

SEQ ID NO: 260311 - DNA, 26 bp, Artificial Sequence
  Description of Artificial Sequence: Synthetic oligonucleotide
acgactggccgtgtgacgtttcgcga

SEQ ID NO: 260312 - DNA, 25 bp, Artificial Sequence
  Description of Artificial Sequence: Synthetic oligonucleotide
cgactggccgtgtgacgtttcgcga

SEQ ID NO: 260313 - DNA, 25 bp, Artificial Sequence
  Description of Artificial Sequence: Synthetic oligonucleotide
gactggccgtgtgacgtttcgcgag

SEQ ID NO: 260314 - DNA, 25 bp, Artificial Sequence
  Description of Artificial Sequence: Synthetic oligonucleotide
actggccgtgtgacgtttcgcgagc

SEQ ID NO: 260315 - DNA, 24 bp, Artificial Sequence
  Description of Artificial Sequence: Synthetic oligonucleotide
ctggccgtgtgacgtttcgcgagc

SEQ ID NO: 260316 - DNA, 24 bp, Artificial Sequence
  Description of Artificial Sequence: Synthetic oligonucleotide
tggccgtgtgacgtttcgcgagcc

SEQ ID NO: 260317 - DNA, 23 bp, Artificial Sequence
  Description of Artificial Sequence: Synthetic oligonucleotide
ggccgtgtgacgtttcgcgagcc

SEQ ID NO: 260318 - DNA, 23 bp, Artificial Sequence
  Description of Artificial Sequence: Synthetic oligonucleotide
gccgtgtgacgtttcgcgagccg

SEQ ID NO: 260319 - DNA, 24 bp, Artificial Sequence
  Description of Artificial Sequence: Synthetic oligonucleotide
ccgtgtgacgtttcgcgagccgga

SEQ ID NO: 260320 - DNA, 25 bp, Artificial Sequence
  Description of Artificial Sequence: Synthetic oligonucleotide
cgtgtgacgtttcgcgagccggaga

SEQ ID NO: 260321 - DNA, 26 bp, Artificial Sequence
  Description of Artificial Sequence: Synthetic oligonucleotide
gtgtgacgtttcgcgagccggagact

SEQ ID NO: 260322 - DNA, 27 bp, Artificial Sequence
  Description of Artificial Sequence: Synthetic oligonucleotide
tgtgacgtttcgcgagccggagactct

SEQ ID NO: 260323 - DNA, 26 bp, Artificial Sequence
  Description of Artificial Sequence: Synthetic oligonucleotide
gtgacgtttcgcgagccggagactct

SEQ ID NO: 260324 - DNA, 26 bp, Artificial Sequence
  Description of Artificial Sequence: Synthetic oligonucleotide
tgacgtttcgcgagccggagactctc

SEQ ID NO: 260325 - DNA, 25 bp, Artificial Sequence
  Description of Artificial Sequence: Synthetic oligonucleotide
gacgtttcgcgagccggagactctc

SEQ ID NO: 260326 - DNA, 26 bp, Artificial Sequence
  Description of Artificial Sequence: Synthetic oligonucleotide
acgtttcgcgagccggagactctcca

SEQ ID NO: 260327 - DNA, 25 bp, Artificial Sequence
  Description of Artificial Sequence: Synthetic oligonucleotide
cgtttcgcgagccggagactctcca

SEQ ID NO: 260328 - DNA, 25 bp, Artificial Sequence
  Description of Artificial Sequence: Synthetic oligonucleotide
gtttcgcgagccggagactctccac

SEQ ID NO: 260329 - DNA, 25 bp, Artificial Sequence
  Description of Artificial Sequence: Synthetic oligonucleotide
tttcgcgagccggagactctccacc

SEQ ID NO: 260330 - DNA, 24 bp, Artificial Sequence
  Description of Artificial Sequence: Synthetic oligonucleotide
ttcgcgagccggagactctccacc

SEQ ID NO: 260331 - DNA, 23 bp, Artificial Sequence
  Description of Artificial Sequence: Synthetic oligonucleotide
tcgcgagccggagactctccacc

SEQ ID NO: 260332 - DNA, 22 bp, Artificial Sequence
  Description of Artificial Sequence: Synthetic oligonucleotide
cgcgagccggagactctccacc

SEQ ID NO: 260333 - DNA, 22 bp, Artificial Sequence
  Description of Artificial Sequence: Synthetic oligonucleotide
gcgagccggagactctccaccc

SEQ ID NO: 260334 - DNA, 23 bp, Artificial Sequence
  Description of Artificial Sequence: Synthetic oligonucleotide
cgagccggagactctccacccca

SEQ ID NO: 260335 - DNA, 24 bp, Artificial Sequence
  Description of Artificial Sequence: Synthetic oligonucleotide
gagccggagactctccaccccaga

SEQ ID NO: 260336 - DNA, 26 bp, Artificial Sequence
  Description of Artificial Sequence: Synthetic oligonucleotide
agccggagactctccaccccagacat

SEQ ID NO: 260337 - DNA, 25 bp, Artificial Sequence
  Description of Artificial Sequence: Synthetic oligonucleotide
gccggagactctccaccccagacat

SEQ ID NO: 260338 - DNA, 26 bp, Artificial Sequence
  Description of Artificial Sequence: Synthetic oligonucleotide
ccggagactctccaccccagacatga

SEQ ID NO: 260339 - DNA, 26 bp, Artificial Sequence
  Description of Artificial Sequence: Synthetic oligonucleotide
cggagactctccaccccagacatgag

SEQ ID NO: 260340 - DNA, 27 bp, Artificial Sequence
  Description of Artificial Sequence: Synthetic oligonucleotide
ggagactctccaccccagacatgagga

SEQ ID NO: 260341 - DNA, 28 bp, Artificial Sequence
  Description of Artificial Sequence: Synthetic oligonucleotide
gagactctccaccccagacatgaggaag

SEQ ID NO: 260342 - DNA, 28 bp, Artificial Sequence
  Description of Artificial Sequence: Synthetic oligonucleotide
agactctccaccccagacatgaggaagg

SEQ ID NO: 260343 - DNA, 27 bp, Artificial Sequence
  Description of Artificial Sequence: Synthetic oligonucleotide
gactctccaccccagacatgaggaagg

SEQ ID NO: 260344 - DNA, 27 bp, Artificial Sequence
  Description of Artificial Sequence: Synthetic oligonucleotide
actctccaccccagacatgaggaaggg

SEQ ID NO: 260345 - DNA, 26 bp, Artificial Sequence
  Description of Artificial Sequence: Synthetic oligonucleotide
ctctccaccccagacatgaggaaggg

SEQ ID NO: 260346 - DNA, 26 bp, Artificial Sequence
  Description of Artificial Sequence: Synthetic oligonucleotide
tctccaccccagacatgaggaagggc

SEQ ID NO: 260347 - DNA, 25 bp, Artificial Sequence
  Description of Artificial Sequence: Synthetic oligonucleotide
ctccaccccagacatgaggaagggc

SEQ ID NO: 260348 - DNA, 27 bp, Artificial Sequence
  Description of Artificial Sequence: Synthetic oligonucleotide
tccaccccagacatgaggaagggccta

SEQ ID NO: 260349 - DNA, 26 bp, Artificial Sequence
  Description of Artificial Sequence: Synthetic oligonucleotide
ccaccccagacatgaggaagggccta

SEQ ID NO: 260350 - DNA, 27 bp, Artificial Sequence
  Description of Artificial Sequence: Synthetic oligonucleotide
caccccagacatgaggaagggcctagt

SEQ ID NO: 260351 - DNA, 31 bp, Artificial Sequence
  Description of Artificial Sequence: Synthetic oligonucleotide
accccagacatgaggaagggcctagttttag

SEQ ID NO: 260352 - DNA, 30 bp, Artificial Sequence
  Description of Artificial Sequence: Synthetic oligonucleotide
ccccagacatgaggaagggcctagttttag

SEQ ID NO: 260353 - DNA, 30 bp, Artificial Sequence
  Description of Artificial Sequence: Synthetic oligonucleotide
cccagacatgaggaagggcctagttttagg

SEQ ID NO: 260354 - DNA, 33 bp, Artificial Sequence
  Description of Artificial Sequence: Synthetic oligonucleotide
ccagacatgaggaagggcctagttttaggattc

SEQ ID NO: 260355 - DNA, 37 bp, Artificial Sequence
  Description of Artificial Sequence: Synthetic oligonucleotide
cagacatgaggaagggcctagttttaggattctattc

SEQ ID NO: 260356 - DNA, 37 bp, Artificial Sequence
  Description of Artificial Sequence: Synthetic oligonucleotide
agacatgaggaagggcctagttttaggattctattcc

SEQ ID NO: 260357 - DNA, 36 bp, Artificial Sequence
  Description of Artificial Sequence: Synthetic oligonucleotide
gacatgaggaagggcctagttttaggattctattcc

SEQ ID NO: 260358 - DNA, 39 bp, Artificial Sequence
  Description of Artificial Sequence: Synthetic oligonucleotide
acatgaggaagggcctagttttaggattctattccatag

SEQ ID NO: 260359 - DNA, 38 bp, Artificial Sequence
  Description of Artificial Sequence: Synthetic oligonucleotide
catgaggaagggcctagttttaggattctattccatag

SEQ ID NO: 260360 - DNA, 43 bp, Artificial Sequence
  Description of Artificial Sequence: Synthetic oligonucleotide
atgaggaagggcctagttttaggattctattccatagaaaaag

SEQ ID NO: 260361 - DNA, 42 bp, Artificial Sequence
  Description of Artificial Sequence: Synthetic oligonucleotide
tgaggaagggcctagttttaggattctattccatagaaaaag

SEQ ID NO: 260362 - DNA, 41 bp, Artificial Sequence
  Description of Artificial Sequence: Synthetic oligonucleotide
gaggaagggcctagttttaggattctattccatagaaaaag

SEQ ID NO: 260363 - DNA, 43 bp, Artificial Sequence
  Description of Artificial Sequence: Synthetic oligonucleotide
aggaagggcctagttttaggattctattccatagaaaaagatg

SEQ ID NO: 260364 - DNA, 42 bp, Artificial Sequence
  Description of Artificial Sequence: Synthetic oligonucleotide
ggaagggcctagttttaggattctattccatagaaaaagatg

SEQ ID NO: 260365 - DNA, 44 bp, Artificial Sequence
  Description of Artificial Sequence: Synthetic oligonucleotide
gaagggcctagttttaggattctattccatagaaaaagatgatg

SEQ ID NO: 260366 - DNA, 46 bp, Artificial Sequence
  Description of Artificial Sequence: Synthetic oligonucleotide
aagggcctagttttaggattctattccatagaaaaagatgatgatg

SEQ ID NO: 260367 - DNA, 45 bp, Artificial Sequence
  Description of Artificial Sequence: Synthetic oligonucleotide
agggcctagttttaggattctattccatagaaaaagatgatgatg

SEQ ID NO: 260368 - DNA, 44 bp, Artificial Sequence
  Description of Artificial Sequence: Synthetic oligonucleotide
gggcctagttttaggattctattccatagaaaaagatgatgatg

SEQ ID NO: 260369 - DNA, 45 bp, Artificial Sequence
  Description of Artificial Sequence: Synthetic oligonucleotide
ggcctagttttaggattctattccatagaaaaagatgatgatgtg

SEQ ID NO: 260370 - DNA, 45 bp, Artificial Sequence
  Description of Artificial Sequence: Synthetic oligonucleotide
gcctagttttaggattctattccatagaaaaagatgatgatgtgg

SEQ ID NO: 260371 - DNA, 45 bp, Artificial Sequence
  Description of Artificial Sequence: Synthetic oligonucleotide
cctagttttaggattctattccatagaaaaagatgatgatgtggc

SEQ ID NO: 260372 - DNA, 46 bp, Artificial Sequence
  Description of Artificial Sequence: Synthetic oligonucleotide
ctagttttaggattctattccatagaaaaagatgatgatgtggcac

SEQ ID NO: 260373 - DNA, 47 bp, Artificial Sequence
  Description of Artificial Sequence: Synthetic oligonucleotide
tagttttaggattctattccatagaaaaagatgatgatgtggcacag

SEQ ID NO: 260374 - DNA, 46 bp, Artificial Sequence
  Description of Artificial Sequence: Synthetic oligonucleotide
agttttaggattctattccatagaaaaagatgatgatgtggcacag

SEQ ID NO: 260375 - DNA, 45 bp, Artificial Sequence
  Description of Artificial Sequence: Synthetic oligonucleotide
gttttaggattctattccatagaaaaagatgatgatgtggcacag

SEQ ID NO: 260376 - DNA, 47 bp, Artificial Sequence
  Description of Artificial Sequence: Synthetic oligonucleotide
ttttaggattctattccatagaaaaagatgatgatgtggcacagttc

SEQ ID NO: 260377 - DNA, 46 bp, Artificial Sequence
  Description of Artificial Sequence: Synthetic oligonucleotide
tttaggattctattccatagaaaaagatgatgatgtggcacagttc

SEQ ID NO: 260378 - DNA, 45 bp, Artificial Sequence
  Description of Artificial Sequence: Synthetic oligonucleotide
ttaggattctattccatagaaaaagatgatgatgtggcacagttc

SEQ ID NO: 260379 - DNA, 44 bp, Artificial Sequence
  Description of Artificial Sequence: Synthetic oligonucleotide
taggattctattccatagaaaaagatgatgatgtggcacagttc

SEQ ID NO: 260380 - DNA, 43 bp, Artificial Sequence
  Description of Artificial Sequence: Synthetic oligonucleotide
aggattctattccatagaaaaagatgatgatgtggcacagttc

SEQ ID NO: 260381 - DNA, 42 bp, Artificial Sequence
  Description of Artificial Sequence: Synthetic oligonucleotide
ggattctattccatagaaaaagatgatgatgtggcacagttc

SEQ ID NO: 260382 - DNA, 43 bp, Artificial Sequence
  Description of Artificial Sequence: Synthetic oligonucleotide
gattctattccatagaaaaagatgatgatgtggcacagttcag

SEQ ID NO: 260383 - DNA, 45 bp, Artificial Sequence
  Description of Artificial Sequence: Synthetic oligonucleotide
attctattccatagaaaaagatgatgatgtggcacagttcagaag

SEQ ID NO: 260384 - DNA, 44 bp, Artificial Sequence
  Description of Artificial Sequence: Synthetic oligonucleotide
ttctattccatagaaaaagatgatgatgtggcacagttcagaag

SEQ ID NO: 260385 - DNA, 43 bp, Artificial Sequence
  Description of Artificial Sequence: Synthetic oligonucleotide
tctattccatagaaaaagatgatgatgtggcacagttcagaag

SEQ ID NO: 260386 - DNA, 42 bp, Artificial Sequence
  Description of Artificial Sequence: Synthetic oligonucleotide
ctattccatagaaaaagatgatgatgtggcacagttcagaag

SEQ ID NO: 260387 - DNA, 43 bp, Artificial Sequence
  Description of Artificial Sequence: Synthetic oligonucleotide
tattccatagaaaaagatgatgatgtggcacagttcagaagtg

SEQ ID NO: 260388 - DNA, 42 bp, Artificial Sequence
  Description of Artificial Sequence: Synthetic oligonucleotide
attccatagaaaaagatgatgatgtggcacagttcagaagtg

SEQ ID NO: 260389 - DNA, 41 bp, Artificial Sequence
  Description of Artificial Sequence: Synthetic oligonucleotide
ttccatagaaaaagatgatgatgtggcacagttcagaagtg

SEQ ID NO: 260390 - DNA, 40 bp, Artificial Sequence
  Description of Artificial Sequence: Synthetic oligonucleotide
tccatagaaaaagatgatgatgtggcacagttcagaagtg

SEQ ID NO: 260391 - DNA, 39 bp, Artificial Sequence
  Description of Artificial Sequence: Synthetic oligonucleotide
ccatagaaaaagatgatgatgtggcacagttcagaagtg

SEQ ID NO: 260392 - DNA, 39 bp, Artificial Sequence
  Description of Artificial Sequence: Synthetic oligonucleotide
catagaaaaagatgatgatgtggcacagttcagaagtgc

SEQ ID NO: 260393 - DNA, 40 bp, Artificial Sequence
  Description of Artificial Sequence: Synthetic oligonucleotide
atagaaaaagatgatgatgtggcacagttcagaagtgcag

SEQ ID NO: 260394 - DNA, 39 bp, Artificial Sequence
  Description of Artificial Sequence: Synthetic oligonucleotide
tagaaaaagatgatgatgtggcacagttcagaagtgcag

SEQ ID NO: 260395 - DNA, 38 bp, Artificial Sequence
  Description of Artificial Sequence: Synthetic oligonucleotide
agaaaaagatgatgatgtggcacagttcagaagtgcag

SEQ ID NO: 260396 - DNA, 37 bp, Artificial Sequence
  Description of Artificial Sequence: Synthetic oligonucleotide
gaaaaagatgatgatgtggcacagttcagaagtgcag

SEQ ID NO: 260397 - DNA, 37 bp, Artificial Sequence
  Description of Artificial Sequence: Synthetic oligonucleotide
aaaaagatgatgatgtggcacagttcagaagtgcagg

SEQ ID NO: 260398 - DNA, 36 bp, Artificial Sequence
  Description of Artificial Sequence: Synthetic oligonucleotide
aaaagatgatgatgtggcacagttcagaagtgcagg

SEQ ID NO: 260399 - DNA, 35 bp, Artificial Sequence
  Description of Artificial Sequence: Synthetic oligonucleotide
aaagatgatgatgtggcacagttcagaagtgcagg

SEQ ID NO: 260400 - DNA, 34 bp, Artificial Sequence
  Description of Artificial Sequence: Synthetic oligonucleotide
aagatgatgatgtggcacagttcagaagtgcagg

SEQ ID NO: 260401 - DNA, 33 bp, Artificial Sequence
  Description of Artificial Sequence: Synthetic oligonucleotide
agatgatgatgtggcacagttcagaagtgcagg

SEQ ID NO: 260402 - DNA, 32 bp, Artificial Sequence
  Description of Artificial Sequence: Synthetic oligonucleotide
gatgatgatgtggcacagttcagaagtgcagg

SEQ ID NO: 260403 - DNA, 33 bp, Artificial Sequence
  Description of Artificial Sequence: Synthetic oligonucleotide
atgatgatgtggcacagttcagaagtgcaggtg

SEQ ID NO: 260404 - DNA, 32 bp, Artificial Sequence
  Description of Artificial Sequence: Synthetic oligonucleotide
tgatgatgtggcacagttcagaagtgcaggtg

SEQ ID NO: 260405 - DNA, 31 bp, Artificial Sequence
  Description of Artificial Sequence: Synthetic oligonucleotide
gatgatgtggcacagttcagaagtgcaggtg

SEQ ID NO: 260406 - DNA, 32 bp, Artificial Sequence
  Description of Artificial Sequence: Synthetic oligonucleotide
atgatgtggcacagttcagaagtgcaggtgag

SEQ ID NO: 260407 - DNA, 31 bp, Artificial Sequence
  Description of Artificial Sequence: Synthetic oligonucleotide
tgatgtggcacagttcagaagtgcaggtgag

SEQ ID NO: 260408 - DNA, 30 bp, Artificial Sequence
  Description of Artificial Sequence: Synthetic oligonucleotide
gatgtggcacagttcagaagtgcaggtgag

SEQ ID NO: 260409 - DNA, 36 bp, Artificial Sequence
  Description of Artificial Sequence: Synthetic oligonucleotide
atgtggcacagttcagaagtgcaggtgagaattttc

SEQ ID NO: 260410 - DNA, 35 bp, Artificial Sequence
  Description of Artificial Sequence: Synthetic oligonucleotide
tgtggcacagttcagaagtgcaggtgagaattttc

SEQ ID NO: 260411 - DNA, 34 bp, Artificial Sequence
  Description of Artificial Sequence: Synthetic oligonucleotide
gtggcacagttcagaagtgcaggtgagaattttc

SEQ ID NO: 260412 - DNA, 41 bp, Artificial Sequence
  Description of Artificial Sequence: Synthetic oligonucleotide
tggcacagttcagaagtgcaggtgagaattttcataaattg

SEQ ID NO: 260413 - DNA, 40 bp, Artificial Sequence
  Description of Artificial Sequence: Synthetic oligonucleotide
ggcacagttcagaagtgcaggtgagaattttcataaattg

SEQ ID NO: 260414 - DNA, 43 bp, Artificial Sequence
  Description of Artificial Sequence: Synthetic oligonucleotide
gcacagttcagaagtgcaggtgagaattttcataaattgtaag

SEQ ID NO: 260415 - DNA, 43 bp, Artificial Sequence
  Description of Artificial Sequence: Synthetic oligonucleotide
cacagttcagaagtgcaggtgagaattttcataaattgtaagc

SEQ ID NO: 260416 - DNA, 44 bp, Artificial Sequence
  Description of Artificial Sequence: Synthetic oligonucleotide
acagttcagaagtgcaggtgagaattttcataaattgtaagctg

SEQ ID NO: 260417 - DNA, 43 bp, Artificial Sequence
  Description of Artificial Sequence: Synthetic oligonucleotide
cagttcagaagtgcaggtgagaattttcataaattgtaagctg

SEQ ID NO: 260418 - DNA, 43 bp, Artificial Sequence
  Description of Artificial Sequence: Synthetic oligonucleotide
agttcagaagtgcaggtgagaattttcataaattgtaagctgg

SEQ ID NO: 260419 - DNA, 42 bp, Artificial Sequence
  Description of Artificial Sequence: Synthetic oligonucleotide
gttcagaagtgcaggtgagaattttcataaattgtaagctgg

SEQ ID NO: 260420 - DNA, 45 bp, Artificial Sequence
  Description of Artificial Sequence: Synthetic oligonucleotide
ttcagaagtgcaggtgagaattttcataaattgtaagctggaaac

SEQ ID NO: 260421 - DNA, 44 bp, Artificial Sequence
  Description of Artificial Sequence: Synthetic oligonucleotide
tcagaagtgcaggtgagaattttcataaattgtaagctggaaac

SEQ ID NO: 260422 - DNA, 43 bp, Artificial Sequence
  Description of Artificial Sequence: Synthetic oligonucleotide
cagaagtgcaggtgagaattttcataaattgtaagctggaaac

SEQ ID NO: 260423 - DNA, 43 bp, Artificial Sequence
  Description of Artificial Sequence: Synthetic oligonucleotide
agaagtgcaggtgagaattttcataaattgtaagctggaaacc

SEQ ID NO: 260424 - DNA, 42 bp, Artificial Sequence
  Description of Artificial Sequence: Synthetic oligonucleotide
gaagtgcaggtgagaattttcataaattgtaagctggaaacc

SEQ ID NO: 260425 - DNA, 43 bp, Artificial Sequence
  Description of Artificial Sequence: Synthetic oligonucleotide
aagtgcaggtgagaattttcataaattgtaagctggaaacctg

SEQ ID NO: 260426 - DNA, 42 bp, Artificial Sequence
  Description of Artificial Sequence: Synthetic oligonucleotide
agtgcaggtgagaattttcataaattgtaagctggaaacctg

SEQ ID NO: 260427 - DNA, 41 bp, Artificial Sequence
  Description of Artificial Sequence: Synthetic oligonucleotide
gtgcaggtgagaattttcataaattgtaagctggaaacctg

SEQ ID NO: 260428 - DNA, 42 bp, Artificial Sequence
  Description of Artificial Sequence: Synthetic oligonucleotide
tgcaggtgagaattttcataaattgtaagctggaaacctgag

SEQ ID NO: 260429 - DNA, 41 bp, Artificial Sequence
  Description of Artificial Sequence: Synthetic oligonucleotide
gcaggtgagaattttcataaattgtaagctggaaacctgag

SEQ ID NO: 260430 - DNA, 42 bp, Artificial Sequence
  Description of Artificial Sequence: Synthetic oligonucleotide
caggtgagaattttcataaattgtaagctggaaacctgagag

SEQ ID NO: 260431 - DNA, 43 bp, Artificial Sequence
  Description of Artificial Sequence: Synthetic oligonucleotide
aggtgagaattttcataaattgtaagctggaaacctgagagag

SEQ ID NO: 260432 - DNA, 42 bp, Artificial Sequence
  Description of Artificial Sequence: Synthetic oligonucleotide
ggtgagaattttcataaattgtaagctggaaacctgagagag

SEQ ID NO: 260433 - DNA, 43 bp, Artificial Sequence
  Description of Artificial Sequence: Synthetic oligonucleotide
gtgagaattttcataaattgtaagctggaaacctgagagagtc

SEQ ID NO: 260434 - DNA, 46 bp, Artificial Sequence
  Description of Artificial Sequence: Synthetic oligonucleotide
tgagaattttcataaattgtaagctggaaacctgagagagtctttg

SEQ ID NO: 260435 - DNA, 45 bp, Artificial Sequence
  Description of Artificial Sequence: Synthetic oligonucleotide
gagaattttcataaattgtaagctggaaacctgagagagtctttg

SEQ ID NO: 260436 - DNA, 47 bp, Artificial Sequence
  Description of Artificial Sequence: Synthetic oligonucleotide
agaattttcataaattgtaagctggaaacctgagagagtctttgaac

SEQ ID NO: 260437 - DNA, 46 bp, Artificial Sequence
  Description of Artificial Sequence: Synthetic oligonucleotide
gaattttcataaattgtaagctggaaacctgagagagtctttgaac

SEQ ID NO: 260438 - DNA, 50 bp, Artificial Sequence
  Description of Artificial Sequence: Synthetic oligonucleotide
aattttcataaattgtaagctggaaacctgagagagtctttgaacaaatc

SEQ ID NO: 260439 - DNA, 49 bp, Artificial Sequence
  Description of Artificial Sequence: Synthetic oligonucleotide
attttcataaattgtaagctggaaacctgagagagtctttgaacaaatc

SEQ ID NO: 260440 - DNA, 48 bp, Artificial Sequence
  Description of Artificial Sequence: Synthetic oligonucleotide
ttttcataaattgtaagctggaaacctgagagagtctttgaacaaatc

SEQ ID NO: 260441 - DNA, 47 bp, Artificial Sequence
  Description of Artificial Sequence: Synthetic oligonucleotide
tttcataaattgtaagctggaaacctgagagagtctttgaacaaatc

SEQ ID NO: 260442 - DNA, 46 bp, Artificial Sequence
  Description of Artificial Sequence: Synthetic oligonucleotide
ttcataaattgtaagctggaaacctgagagagtctttgaacaaatc

SEQ ID NO: 260443 - DNA, 45 bp, Artificial Sequence
  Description of Artificial Sequence: Synthetic oligonucleotide
tcataaattgtaagctggaaacctgagagagtctttgaacaaatc

SEQ ID NO: 260444 - DNA, 44 bp, Artificial Sequence
  Description of Artificial Sequence: Synthetic oligonucleotide
cataaattgtaagctggaaacctgagagagtctttgaacaaatc

SEQ ID NO: 260445 - DNA, 45 bp, Artificial Sequence
  Description of Artificial Sequence: Synthetic oligonucleotide
ataaattgtaagctggaaacctgagagagtctttgaacaaatctg

SEQ ID NO: 260446 - DNA, 44 bp, Artificial Sequence
  Description of Artificial Sequence: Synthetic oligonucleotide
taaattgtaagctggaaacctgagagagtctttgaacaaatctg

SEQ ID NO: 260447 - DNA, 43 bp, Artificial Sequence
  Description of Artificial Sequence: Synthetic oligonucleotide
aaattgtaagctggaaacctgagagagtctttgaacaaatctg

SEQ ID NO: 260448 - DNA, 42 bp, Artificial Sequence
  Description of Artificial Sequence: Synthetic oligonucleotide
aattgtaagctggaaacctgagagagtctttgaacaaatctg

SEQ ID NO: 260449 - DNA, 41 bp, Artificial Sequence
  Description of Artificial Sequence: Synthetic oligonucleotide
attgtaagctggaaacctgagagagtctttgaacaaatctg

SEQ ID NO: 260450 - DNA, 40 bp, Artificial Sequence
  Description of Artificial Sequence: Synthetic oligonucleotide
ttgtaagctggaaacctgagagagtctttgaacaaatctg

SEQ ID NO: 260451 - DNA, 39 bp, Artificial Sequence
  Description of Artificial Sequence: Synthetic oligonucleotide
tgtaagctggaaacctgagagagtctttgaacaaatctg

SEQ ID NO: 260452 - DNA, 38 bp, Artificial Sequence
  Description of Artificial Sequence: Synthetic oligonucleotide
gtaagctggaaacctgagagagtctttgaacaaatctg

SEQ ID NO: 260453 - DNA, 38 bp, Artificial Sequence
  Description of Artificial Sequence: Synthetic oligonucleotide
taagctggaaacctgagagagtctttgaacaaatctgg

SEQ ID NO: 260454 - DNA, 37 bp, Artificial Sequence
  Description of Artificial Sequence: Synthetic oligonucleotide
aagctggaaacctgagagagtctttgaacaaatctgg

SEQ ID NO: 260455 - DNA, 36 bp, Artificial Sequence
  Description of Artificial Sequence: Synthetic oligonucleotide
agctggaaacctgagagagtctttgaacaaatctgg

SEQ ID NO: 260456 - DNA, 35 bp, Artificial Sequence
  Description of Artificial Sequence: Synthetic oligonucleotide
gctggaaacctgagagagtctttgaacaaatctgg

SEQ ID NO: 260457 - DNA, 36 bp, Artificial Sequence
  Description of Artificial Sequence: Synthetic oligonucleotide
ctggaaacctgagagagtctttgaacaaatctggac

SEQ ID NO: 260458 - DNA, 36 bp, Artificial Sequence
  Description of Artificial Sequence: Synthetic oligonucleotide
tggaaacctgagagagtctttgaacaaatctggacc

SEQ ID NO: 260459 - DNA, 35 bp, Artificial Sequence
  Description of Artificial Sequence: Synthetic oligonucleotide
ggaaacctgagagagtctttgaacaaatctggacc

SEQ ID NO: 260460 - DNA, 36 bp, Artificial Sequence
  Description of Artificial Sequence: Synthetic oligonucleotide
gaaacctgagagagtctttgaacaaatctggacctc

SEQ ID NO: 260461 - DNA, 36 bp, Artificial Sequence
  Description of Artificial Sequence: Synthetic oligonucleotide
aaacctgagagagtctttgaacaaatctggacctcc

SEQ ID NO: 260462 - DNA, 35 bp, Artificial Sequence
  Description of Artificial Sequence: Synthetic oligonucleotide
aacctgagagagtctttgaacaaatctggacctcc

SEQ ID NO: 260463 - DNA, 34 bp, Artificial Sequence
  Description of Artificial Sequence: Synthetic oligonucleotide
acctgagagagtctttgaacaaatctggacctcc

SEQ ID NO: 260464 - DNA, 33 bp, Artificial Sequence
  Description of Artificial Sequence: Synthetic oligonucleotide
cctgagagagtctttgaacaaatctggacctcc

SEQ ID NO: 260465 - DNA, 34 bp, Artificial Sequence
  Description of Artificial Sequence: Synthetic oligonucleotide
ctgagagagtctttgaacaaatctggacctcctc

SEQ ID NO: 260466 - DNA, 35 bp, Artificial Sequence
  Description of Artificial Sequence: Synthetic oligonucleotide
tgagagagtctttgaacaaatctggacctcctctg

SEQ ID NO: 260467 - DNA, 34 bp, Artificial Sequence
  Description of Artificial Sequence: Synthetic oligonucleotide
gagagagtctttgaacaaatctggacctcctctg

SEQ ID NO: 260468 - DNA, 36 bp, Artificial Sequence
  Description of Artificial Sequence: Synthetic oligonucleotide
agagagtctttgaacaaatctggacctcctctgaag

SEQ ID NO: 260469 - DNA, 35 bp, Artificial Sequence
  Description of Artificial Sequence: Synthetic oligonucleotide
gagagtctttgaacaaatctggacctcctctgaag

SEQ ID NO: 260470 - DNA, 35 bp, Artificial Sequence
  Description of Artificial Sequence: Synthetic oligonucleotide
agagtctttgaacaaatctggacctcctctgaagc

SEQ ID NO: 260471 - DNA, 34 bp, Artificial Sequence
  Description of Artificial Sequence: Synthetic oligonucleotide
gagtctttgaacaaatctggacctcctctgaagc

SEQ ID NO: 260472 - DNA, 34 bp, Artificial Sequence
  Description of Artificial Sequence: Synthetic oligonucleotide
agtctttgaacaaatctggacctcctctgaagcc

SEQ ID NO: 260473 - DNA, 33 bp, Artificial Sequence
  Description of Artificial Sequence: Synthetic oligonucleotide
gtctttgaacaaatctggacctcctctgaagcc

SEQ ID NO: 260474 - DNA, 34 bp, Artificial Sequence
  Description of Artificial Sequence: Synthetic oligonucleotide
tctttgaacaaatctggacctcctctgaagccag

SEQ ID NO: 260475 - DNA, 33 bp, Artificial Sequence
  Description of Artificial Sequence: Synthetic oligonucleotide
ctttgaacaaatctggacctcctctgaagccag

SEQ ID NO: 260476 - DNA, 33 bp, Artificial Sequence
  Description of Artificial Sequence: Synthetic oligonucleotide
tttgaacaaatctggacctcctctgaagccagg

SEQ ID NO: 260477 - DNA, 32 bp, Artificial Sequence
  Description of Artificial Sequence: Synthetic oligonucleotide
ttgaacaaatctggacctcctctgaagccagg

SEQ ID NO: 260478 - DNA, 31 bp, Artificial Sequence
  Description of Artificial Sequence: Synthetic oligonucleotide
tgaacaaatctggacctcctctgaagccagg

SEQ ID NO: 260479 - DNA, 30 bp, Artificial Sequence
  Description of Artificial Sequence: Synthetic oligonucleotide
gaacaaatctggacctcctctgaagccagg

SEQ ID NO: 260480 - DNA, 30 bp, Artificial Sequence
  Description of Artificial Sequence: Synthetic oligonucleotide
aacaaatctggacctcctctgaagccaggg

SEQ ID NO: 260481 - DNA, 29 bp, Artificial Sequence
  Description of Artificial Sequence: Synthetic oligonucleotide
acaaatctggacctcctctgaagccaggg

SEQ ID NO: 260482 - DNA, 28 bp, Artificial Sequence
  Description of Artificial Sequence: Synthetic oligonucleotide
caaatctggacctcctctgaagccaggg

SEQ ID NO: 260483 - DNA, 30 bp, Artificial Sequence
  Description of Artificial Sequence: Synthetic oligonucleotide
aaatctggacctcctctgaagccagggaag

SEQ ID NO: 260484 - DNA, 29 bp, Artificial Sequence
  Description of Artificial Sequence: Synthetic oligonucleotide
aatctggacctcctctgaagccagggaag

SEQ ID NO: 260485 - DNA, 28 bp, Artificial Sequence
  Description of Artificial Sequence: Synthetic oligonucleotide
atctggacctcctctgaagccagggaag

SEQ ID NO: 260486 - DNA, 27 bp, Artificial Sequence
  Description of Artificial Sequence: Synthetic oligonucleotide
tctggacctcctctgaagccagggaag

SEQ ID NO: 260487 - DNA, 27 bp, Artificial Sequence
  Description of Artificial Sequence: Synthetic oligonucleotide
ctggacctcctctgaagccagggaaga

SEQ ID NO: 260488 - DNA, 27 bp, Artificial Sequence
  Description of Artificial Sequence: Synthetic oligonucleotide
tggacctcctctgaagccagggaagag

SEQ ID NO: 260489 - DNA, 27 bp, Artificial Sequence
  Description of Artificial Sequence: Synthetic oligonucleotide
ggacctcctctgaagccagggaagagt

SEQ ID NO: 260490 - DNA, 27 bp, Artificial Sequence
  Description of Artificial Sequence: Synthetic oligonucleotide
gacctcctctgaagccagggaagagtc

SEQ ID NO: 260491 - DNA, 27 bp, Artificial Sequence
  Description of Artificial Sequence: Synthetic oligonucleotide
acctcctctgaagccagggaagagtcg

SEQ ID NO: 260492 - DNA, 27 bp, Artificial Sequence
  Description of Artificial Sequence: Synthetic oligonucleotide
cctcctctgaagccagggaagagtcga

SEQ ID NO: 260493 - DNA, 28 bp, Artificial Sequence
  Description of Artificial Sequence: Synthetic oligonucleotide
ctcctctgaagccagggaagagtcgaac

SEQ ID NO: 260494 - DNA, 28 bp, Artificial Sequence
  Description of Artificial Sequence: Synthetic oligonucleotide
tcctctgaagccagggaagagtcgaacc

SEQ ID NO: 260495 - DNA, 27 bp, Artificial Sequence
  Description of Artificial Sequence: Synthetic oligonucleotide
cctctgaagccagggaagagtcgaacc

SEQ ID NO: 260496 - DNA, 33 bp, Artificial Sequence
  Description of Artificial Sequence: Synthetic oligonucleotide
ctctgaagccagggaagagtcgaaccttatatg

SEQ ID NO: 260497 - DNA, 33 bp, Artificial Sequence
  Description of Artificial Sequence: Synthetic oligonucleotide
tctgaagccagggaagagtcgaaccttatatgg

SEQ ID NO: 260498 - DNA, 32 bp, Artificial Sequence
  Description of Artificial Sequence: Synthetic oligonucleotide
ctgaagccagggaagagtcgaaccttatatgg

SEQ ID NO: 260499 - DNA, 33 bp, Artificial Sequence
  Description of Artificial Sequence: Synthetic oligonucleotide
tgaagccagggaagagtcgaaccttatatggtc

SEQ ID NO: 260500 - DNA, 32 bp, Artificial Sequence
  Description of Artificial Sequence: Synthetic oligonucleotide
gaagccagggaagagtcgaaccttatatggtc

SEQ ID NO: 260501 - DNA, 33 bp, Artificial Sequence
  Description of Artificial Sequence: Synthetic oligonucleotide
aagccagggaagagtcgaaccttatatggtctg

SEQ ID NO: 260502 - DNA, 32 bp, Artificial Sequence
  Description of Artificial Sequence: Synthetic oligonucleotide
agccagggaagagtcgaaccttatatggtctg

SEQ ID NO: 260503 - DNA, 31 bp, Artificial Sequence
  Description of Artificial Sequence: Synthetic oligonucleotide
gccagggaagagtcgaaccttatatggtctg

SEQ ID NO: 260504 - DNA, 31 bp, Artificial Sequence
  Description of Artificial Sequence: Synthetic oligonucleotide
ccagggaagagtcgaaccttatatggtctgg

SEQ ID NO: 260505 - DNA, 33 bp, Artificial Sequence
  Description of Artificial Sequence: Synthetic oligonucleotide
cagggaagagtcgaaccttatatggtctggatc

SEQ ID NO: 260506 - DNA, 34 bp, Artificial Sequence
  Description of Artificial Sequence: Synthetic oligonucleotide
agggaagagtcgaaccttatatggtctggatcag

SEQ ID NO: 260507 - DNA, 33 bp, Artificial Sequence
  Description of Artificial Sequence: Synthetic oligonucleotide
gggaagagtcgaaccttatatggtctggatcag

SEQ ID NO: 260508 - DNA, 33 bp, Artificial Sequence
  Description of Artificial Sequence: Synthetic oligonucleotide
ggaagagtcgaaccttatatggtctggatcagg

SEQ ID NO: 260509 - DNA, 34 bp, Artificial Sequence
  Description of Artificial Sequence: Synthetic oligonucleotide
gaagagtcgaaccttatatggtctggatcaggac

SEQ ID NO: 260510 - DNA, 36 bp, Artificial Sequence
  Description of Artificial Sequence: Synthetic oligonucleotide
aagagtcgaaccttatatggtctggatcaggactac

SEQ ID NO: 260511 - DNA, 35 bp, Artificial Sequence
  Description of Artificial Sequence: Synthetic oligonucleotide
agagtcgaaccttatatggtctggatcaggactac

SEQ ID NO: 260512 - DNA, 34 bp, Artificial Sequence
  Description of Artificial Sequence: Synthetic oligonucleotide
gagtcgaaccttatatggtctggatcaggactac

SEQ ID NO: 260513 - DNA, 34 bp, Artificial Sequence
  Description of Artificial Sequence: Synthetic oligonucleotide
agtcgaaccttatatggtctggatcaggactacc

SEQ ID NO: 260514 - DNA, 33 bp, Artificial Sequence
  Description of Artificial Sequence: Synthetic oligonucleotide
gtcgaaccttatatggtctggatcaggactacc

SEQ ID NO: 260515 - DNA, 33 bp, Artificial Sequence
  Description of Artificial Sequence: Synthetic oligonucleotide
tcgaaccttatatggtctggatcaggactaccc

SEQ ID NO: 260516 - DNA, 32 bp, Artificial Sequence
  Description of Artificial Sequence: Synthetic oligonucleotide
cgaaccttatatggtctggatcaggactaccc

SEQ ID NO: 260517 - DNA, 32 bp, Artificial Sequence
  Description of Artificial Sequence: Synthetic oligonucleotide
gaaccttatatggtctggatcaggactacccc

SEQ ID NO: 260518 - DNA, 33 bp, Artificial Sequence
  Description of Artificial Sequence: Synthetic oligonucleotide
aaccttatatggtctggatcaggactaccccag

SEQ ID NO: 260519 - DNA, 32 bp, Artificial Sequence
  Description of Artificial Sequence: Synthetic oligonucleotide
accttatatggtctggatcaggactaccccag

SEQ ID NO: 260520 - DNA, 31 bp, Artificial Sequence
  Description of Artificial Sequence: Synthetic oligonucleotide
ccttatatggtctggatcaggactaccccag

SEQ ID NO: 260521 - DNA, 31 bp, Artificial Sequence
  Description of Artificial Sequence: Synthetic oligonucleotide
cttatatggtctggatcaggactaccccagc

SEQ ID NO: 260522 - DNA, 31 bp, Artificial Sequence
  Description of Artificial Sequence: Synthetic oligonucleotide
ttatatggtctggatcaggactaccccagcg

SEQ ID NO: 260523 - DNA, 30 bp, Artificial Sequence
  Description of Artificial Sequence: Synthetic oligonucleotide
tatatggtctggatcaggactaccccagcg

SEQ ID NO: 260524 - DNA, 29 bp, Artificial Sequence
  Description of Artificial Sequence: Synthetic oligonucleotide
atatggtctggatcaggactaccccagcg

SEQ ID NO: 260525 - DNA, 28 bp, Artificial Sequence
  Description of Artificial Sequence: Synthetic oligonucleotide
tatggtctggatcaggactaccccagcg

SEQ ID NO: 260526 - DNA, 27 bp, Artificial Sequence
  Description of Artificial Sequence: Synthetic oligonucleotide
atggtctggatcaggactaccccagcg

SEQ ID NO: 260527 - DNA, 27 bp, Artificial Sequence
  Description of Artificial Sequence: Synthetic oligonucleotide
tggtctggatcaggactaccccagcgt

SEQ ID NO: 260528 - DNA, 26 bp, Artificial Sequence
  Description of Artificial Sequence: Synthetic oligonucleotide
ggtctggatcaggactaccccagcgt

SEQ ID NO: 260529 - DNA, 26 bp, Artificial Sequence
  Description of Artificial Sequence: Synthetic oligonucleotide
gtctggatcaggactaccccagcgtc

SEQ ID NO: 260530 - DNA, 27 bp, Artificial Sequence
  Description of Artificial Sequence: Synthetic oligonucleotide
tctggatcaggactaccccagcgtcgt

SEQ ID NO: 260531 - DNA, 26 bp, Artificial Sequence
  Description of Artificial Sequence: Synthetic oligonucleotide
ctggatcaggactaccccagcgtcgt

SEQ ID NO: 260532 - DNA, 26 bp, Artificial Sequence
  Description of Artificial Sequence: Synthetic oligonucleotide
tggatcaggactaccccagcgtcgtg

SEQ ID NO: 260533 - DNA, 25 bp, Artificial Sequence
  Description of Artificial Sequence: Synthetic oligonucleotide
ggatcaggactaccccagcgtcgtg

SEQ ID NO: 260534 - DNA, 27 bp, Artificial Sequence
  Description of Artificial Sequence: Synthetic oligonucleotide
gatcaggactaccccagcgtcgtgcta

SEQ ID NO: 260535 - DNA, 27 bp, Artificial Sequence
  Description of Artificial Sequence: Synthetic oligonucleotide
atcaggactaccccagcgtcgtgctag

SEQ ID NO: 260536 - DNA, 27 bp, Artificial Sequence
  Description of Artificial Sequence: Synthetic oligonucleotide
tcaggactaccccagcgtcgtgctagt

SEQ ID NO: 260537 - DNA, 27 bp, Artificial Sequence
  Description of Artificial Sequence: Synthetic oligonucleotide
caggactaccccagcgtcgtgctagtt

SEQ ID NO: 260538 - DNA, 27 bp, Artificial Sequence
  Description of Artificial Sequence: Synthetic oligonucleotide
aggactaccccagcgtcgtgctagttc

SEQ ID NO: 260539 - DNA, 26 bp, Artificial Sequence
  Description of Artificial Sequence: Synthetic oligonucleotide
ggactaccccagcgtcgtgctagttc

SEQ ID NO: 260540 - DNA, 26 bp, Artificial Sequence
  Description of Artificial Sequence: Synthetic oligonucleotide
gactaccccagcgtcgtgctagttcg

SEQ ID NO: 260541 - DNA, 26 bp, Artificial Sequence
  Description of Artificial Sequence: Synthetic oligonucleotide
actaccccagcgtcgtgctagttcgc

SEQ ID NO: 260542 - DNA, 25 bp, Artificial Sequence
  Description of Artificial Sequence: Synthetic oligonucleotide
ctaccccagcgtcgtgctagttcgc

SEQ ID NO: 260543 - DNA, 26 bp, Artificial Sequence
  Description of Artificial Sequence: Synthetic oligonucleotide
taccccagcgtcgtgctagttcgcct

SEQ ID NO: 260544 - DNA, 25 bp, Artificial Sequence
  Description of Artificial Sequence: Synthetic oligonucleotide
accccagcgtcgtgctagttcgcct

SEQ ID NO: 260545 - DNA, 24 bp, Artificial Sequence
  Description of Artificial Sequence: Synthetic oligonucleotide
ccccagcgtcgtgctagttcgcct

SEQ ID NO: 260546 - DNA, 24 bp, Artificial Sequence
  Description of Artificial Sequence: Synthetic oligonucleotide
cccagcgtcgtgctagttcgcctc

SEQ ID NO: 260547 - DNA, 24 bp, Artificial Sequence
  Description of Artificial Sequence: Synthetic oligonucleotide
ccagcgtcgtgctagttcgcctcg

SEQ ID NO: 260548 - DNA, 24 bp, Artificial Sequence
  Description of Artificial Sequence: Synthetic oligonucleotide
cagcgtcgtgctagttcgcctcgg

SEQ ID NO: 260549 - DNA, 27 bp, Artificial Sequence
  Description of Artificial Sequence: Synthetic oligonucleotide
agcgtcgtgctagttcgcctcggcata

SEQ ID NO: 260550 - DNA, 27 bp, Artificial Sequence
  Description of Artificial Sequence: Synthetic oligonucleotide
gcgtcgtgctagttcgcctcggcataa

SEQ ID NO: 260551 - DNA, 28 bp, Artificial Sequence
  Description of Artificial Sequence: Synthetic oligonucleotide
cgtcgtgctagttcgcctcggcataaag

SEQ ID NO: 260552 - DNA, 28 bp, Artificial Sequence
  Description of Artificial Sequence: Synthetic oligonucleotide
gtcgtgctagttcgcctcggcataaagg

SEQ ID NO: 260553 - DNA, 28 bp, Artificial Sequence
  Description of Artificial Sequence: Synthetic oligonucleotide
tcgtgctagttcgcctcggcataaaggc

SEQ ID NO: 260554 - DNA, 27 bp, Artificial Sequence
  Description of Artificial Sequence: Synthetic oligonucleotide
cgtgctagttcgcctcggcataaaggc

SEQ ID NO: 260555 - DNA, 28 bp, Artificial Sequence
  Description of Artificial Sequence: Synthetic oligonucleotide
gtgctagttcgcctcggcataaaggcag

SEQ ID NO: 260556 - DNA, 28 bp, Artificial Sequence
  Description of Artificial Sequence: Synthetic oligonucleotide
tgctagttcgcctcggcataaaggcagc

SEQ ID NO: 260557 - DNA, 27 bp, Artificial Sequence
  Description of Artificial Sequence: Synthetic oligonucleotide
gctagttcgcctcggcataaaggcagc

SEQ ID NO: 260558 - DNA, 28 bp, Artificial Sequence
  Description of Artificial Sequence: Synthetic oligonucleotide
ctagttcgcctcggcataaaggcagcag

SEQ ID NO: 260559 - DNA, 28 bp, Artificial Sequence
  Description of Artificial Sequence: Synthetic oligonucleotide
tagttcgcctcggcataaaggcagcagg

SEQ ID NO: 260560 - DNA, 27 bp, Artificial Sequence
  Description of Artificial Sequence: Synthetic oligonucleotide
agttcgcctcggcataaaggcagcagg

SEQ ID NO: 260561 - DNA, 27 bp, Artificial Sequence
  Description of Artificial Sequence: Synthetic oligonucleotide
gttcgcctcggcataaaggcagcagga

SEQ ID NO: 260562 - DNA, 29 bp, Artificial Sequence
  Description of Artificial Sequence: Synthetic oligonucleotide
ttcgcctcggcataaaggcagcaggaatc

SEQ ID NO: 260563 - DNA, 28 bp, Artificial Sequence
  Description of Artificial Sequence: Synthetic oligonucleotide
tcgcctcggcataaaggcagcaggaatc

SEQ ID NO: 260564 - DNA, 27 bp, Artificial Sequence
  Description of Artificial Sequence: Synthetic oligonucleotide
cgcctcggcataaaggcagcaggaatc

SEQ ID NO: 260565 - DNA, 27 bp, Artificial Sequence
  Description of Artificial Sequence: Synthetic oligonucleotide
gcctcggcataaaggcagcaggaatcg

SEQ ID NO: 260566 - DNA, 28 bp, Artificial Sequence
  Description of Artificial Sequence: Synthetic oligonucleotide
cctcggcataaaggcagcaggaatcgac

SEQ ID NO: 260567 - DNA, 28 bp, Artificial Sequence
  Description of Artificial Sequence: Synthetic oligonucleotide
ctcggcataaaggcagcaggaatcgacc

SEQ ID NO: 260568 - DNA, 30 bp, Artificial Sequence
  Description of Artificial Sequence: Synthetic oligonucleotide
tcggcataaaggcagcaggaatcgaccaac

SEQ ID NO: 260569 - DNA, 29 bp, Artificial Sequence
  Description of Artificial Sequence: Synthetic oligonucleotide
cggcataaaggcagcaggaatcgaccaac

SEQ ID NO: 260570 - DNA, 30 bp, Artificial Sequence
  Description of Artificial Sequence: Synthetic oligonucleotide
ggcataaaggcagcaggaatcgaccaacag

SEQ ID NO: 260571 - DNA, 30 bp, Artificial Sequence
  Description of Artificial Sequence: Synthetic oligonucleotide
gcataaaggcagcaggaatcgaccaacagg

SEQ ID NO: 260572 - DNA, 34 bp, Artificial Sequence
  Description of Artificial Sequence: Synthetic oligonucleotide
cataaaggcagcaggaatcgaccaacaggaaatc

SEQ ID NO: 260573 - DNA, 35 bp, Artificial Sequence
  Description of Artificial Sequence: Synthetic oligonucleotide
ataaaggcagcaggaatcgaccaacaggaaatctg

SEQ ID NO: 260574 - DNA, 34 bp, Artificial Sequence
  Description of Artificial Sequence: Synthetic oligonucleotide
taaaggcagcaggaatcgaccaacaggaaatctg

SEQ ID NO: 260575 - DNA, 33 bp, Artificial Sequence
  Description of Artificial Sequence: Synthetic oligonucleotide
aaaggcagcaggaatcgaccaacaggaaatctg

SEQ ID NO: 260576 - DNA, 32 bp, Artificial Sequence
  Description of Artificial Sequence: Synthetic oligonucleotide
aaggcagcaggaatcgaccaacaggaaatctg

SEQ ID NO: 260577 - DNA, 31 bp, Artificial Sequence
  Description of Artificial Sequence: Synthetic oligonucleotide
aggcagcaggaatcgaccaacaggaaatctg

SEQ ID NO: 260578 - DNA, 30 bp, Artificial Sequence
  Description of Artificial Sequence: Synthetic oligonucleotide
ggcagcaggaatcgaccaacaggaaatctg

SEQ ID NO: 260579 - DNA, 30 bp, Artificial Sequence
  Description of Artificial Sequence: Synthetic oligonucleotide
gcagcaggaatcgaccaacaggaaatctgg

SEQ ID NO: 260580 - DNA, 30 bp, Artificial Sequence
  Description of Artificial Sequence: Synthetic oligonucleotide
cagcaggaatcgaccaacaggaaatctggc

SEQ ID NO: 260581 - DNA, 32 bp, Artificial Sequence
  Description of Artificial Sequence: Synthetic oligonucleotide
agcaggaatcgaccaacaggaaatctggcatg

SEQ ID NO: 260582 - DNA, 31 bp, Artificial Sequence
  Description of Artificial Sequence: Synthetic oligonucleotide
gcaggaatcgaccaacaggaaatctggcatg

SEQ ID NO: 260583 - DNA, 33 bp, Artificial Sequence
  Description of Artificial Sequence: Synthetic oligonucleotide
caggaatcgaccaacaggaaatctggcatgatg

SEQ ID NO: 260584 - DNA, 33 bp, Artificial Sequence
  Description of Artificial Sequence: Synthetic oligonucleotide
aggaatcgaccaacaggaaatctggcatgatgg

SEQ ID NO: 260585 - DNA, 32 bp, Artificial Sequence
  Description of Artificial Sequence: Synthetic oligonucleotide
ggaatcgaccaacaggaaatctggcatgatgg

SEQ ID NO: 260586 - DNA, 32 bp, Artificial Sequence
  Description of Artificial Sequence: Synthetic oligonucleotide
gaatcgaccaacaggaaatctggcatgatggc

SEQ ID NO: 260587 - DNA, 35 bp, Artificial Sequence
  Description of Artificial Sequence: Synthetic oligonucleotide
aatcgaccaacaggaaatctggcatgatggcaaag

SEQ ID NO: 260588 - DNA, 34 bp, Artificial Sequence
  Description of Artificial Sequence: Synthetic oligonucleotide
atcgaccaacaggaaatctggcatgatggcaaag

SEQ ID NO: 260589 - DNA, 33 bp, Artificial Sequence
  Description of Artificial Sequence: Synthetic oligonucleotide
tcgaccaacaggaaatctggcatgatggcaaag

SEQ ID NO: 260590 - DNA, 32 bp, Artificial Sequence
  Description of Artificial Sequence: Synthetic oligonucleotide
cgaccaacaggaaatctggcatgatggcaaag

SEQ ID NO: 260591 - DNA, 36 bp, Artificial Sequence
  Description of Artificial Sequence: Synthetic oligonucleotide
gaccaacaggaaatctggcatgatggcaaagaatac

SEQ ID NO: 260592 - DNA, 38 bp, Artificial Sequence
  Description of Artificial Sequence: Synthetic oligonucleotide
accaacaggaaatctggcatgatggcaaagaatacatc

SEQ ID NO: 260593 - DNA, 37 bp, Artificial Sequence
  Description of Artificial Sequence: Synthetic oligonucleotide
ccaacaggaaatctggcatgatggcaaagaatacatc

SEQ ID NO: 260594 - DNA, 38 bp, Artificial Sequence
  Description of Artificial Sequence: Synthetic oligonucleotide
caacaggaaatctggcatgatggcaaagaatacatcag

SEQ ID NO: 260595 - DNA, 39 bp, Artificial Sequence
  Description of Artificial Sequence: Synthetic oligonucleotide
aacaggaaatctggcatgatggcaaagaatacatcagag

SEQ ID NO: 260596 - DNA, 38 bp, Artificial Sequence
  Description of Artificial Sequence: Synthetic oligonucleotide
acaggaaatctggcatgatggcaaagaatacatcagag

SEQ ID NO: 260597 - DNA, 37 bp, Artificial Sequence
  Description of Artificial Sequence: Synthetic oligonucleotide
caggaaatctggcatgatggcaaagaatacatcagag

SEQ ID NO: 260598 - DNA, 37 bp, Artificial Sequence
  Description of Artificial Sequence: Synthetic oligonucleotide
aggaaatctggcatgatggcaaagaatacatcagagg

SEQ ID NO: 260599 - DNA, 36 bp, Artificial Sequence
  Description of Artificial Sequence: Synthetic oligonucleotide
ggaaatctggcatgatggcaaagaatacatcagagg

SEQ ID NO: 260600 - DNA, 37 bp, Artificial Sequence
  Description of Artificial Sequence: Synthetic oligonucleotide
gaaatctggcatgatggcaaagaatacatcagaggtg

SEQ ID NO: 260601 - DNA, 37 bp, Artificial Sequence
  Description of Artificial Sequence: Synthetic oligonucleotide
aaatctggcatgatggcaaagaatacatcagaggtgc

SEQ ID NO: 260602 - DNA, 36 bp, Artificial Sequence
  Description of Artificial Sequence: Synthetic oligonucleotide
aatctggcatgatggcaaagaatacatcagaggtgc

SEQ ID NO: 260603 - DNA, 35 bp, Artificial Sequence
  Description of Artificial Sequence: Synthetic oligonucleotide
atctggcatgatggcaaagaatacatcagaggtgc

SEQ ID NO: 260604 - DNA, 34 bp, Artificial Sequence
  Description of Artificial Sequence: Synthetic oligonucleotide
tctggcatgatggcaaagaatacatcagaggtgc

SEQ ID NO: 260605 - DNA, 33 bp, Artificial Sequence
  Description of Artificial Sequence: Synthetic oligonucleotide
ctggcatgatggcaaagaatacatcagaggtgc

SEQ ID NO: 260606 - DNA, 34 bp, Artificial Sequence
  Description of Artificial Sequence: Synthetic oligonucleotide
tggcatgatggcaaagaatacatcagaggtgctg

SEQ ID NO: 260607 - DNA, 33 bp, Artificial Sequence
  Description of Artificial Sequence: Synthetic oligonucleotide
ggcatgatggcaaagaatacatcagaggtgctg

SEQ ID NO: 260608 - DNA, 35 bp, Artificial Sequence
  Description of Artificial Sequence: Synthetic oligonucleotide
gcatgatggcaaagaatacatcagaggtgctgttg

SEQ ID NO: 260609 - DNA, 35 bp, Artificial Sequence
  Description of Artificial Sequence: Synthetic oligonucleotide
catgatggcaaagaatacatcagaggtgctgttgc

SEQ ID NO: 260610 - DNA, 36 bp, Artificial Sequence
  Description of Artificial Sequence: Synthetic oligonucleotide
atgatggcaaagaatacatcagaggtgctgttgctg

SEQ ID NO: 260611 - DNA, 35 bp, Artificial Sequence
  Description of Artificial Sequence: Synthetic oligonucleotide
tgatggcaaagaatacatcagaggtgctgttgctg

SEQ ID NO: 260612 - DNA, 34 bp, Artificial Sequence
  Description of Artificial Sequence: Synthetic oligonucleotide
gatggcaaagaatacatcagaggtgctgttgctg

SEQ ID NO: 260613 - DNA, 34 bp, Artificial Sequence
  Description of Artificial Sequence: Synthetic oligonucleotide
atggcaaagaatacatcagaggtgctgttgctgc

SEQ ID NO: 260614 - DNA, 33 bp, Artificial Sequence
  Description of Artificial Sequence: Synthetic oligonucleotide
tggcaaagaatacatcagaggtgctgttgctgc

SEQ ID NO: 260615 - DNA, 32 bp, Artificial Sequence
  Description of Artificial Sequence: Synthetic oligonucleotide
ggcaaagaatacatcagaggtgctgttgctgc

SEQ ID NO: 260616 - DNA, 32 bp, Artificial Sequence
  Description of Artificial Sequence: Synthetic oligonucleotide
gcaaagaatacatcagaggtgctgttgctgcg

SEQ ID NO: 260617 - DNA, 32 bp, Artificial Sequence
  Description of Artificial Sequence: Synthetic oligonucleotide
caaagaatacatcagaggtgctgttgctgcgg

SEQ ID NO: 260618 - DNA, 32 bp, Artificial Sequence
  Description of Artificial Sequence: Synthetic oligonucleotide
aaagaatacatcagaggtgctgttgctgcggg

SEQ ID NO: 260619 - DNA, 31 bp, Artificial Sequence
  Description of Artificial Sequence: Synthetic oligonucleotide
aagaatacatcagaggtgctgttgctgcggg

SEQ ID NO: 260620 - DNA, 30 bp, Artificial Sequence
  Description of Artificial Sequence: Synthetic oligonucleotide
agaatacatcagaggtgctgttgctgcggg

SEQ ID NO: 260621 - DNA, 29 bp, Artificial Sequence
  Description of Artificial Sequence: Synthetic oligonucleotide
gaatacatcagaggtgctgttgctgcggg

SEQ ID NO: 260622 - DNA, 29 bp, Artificial Sequence
  Description of Artificial Sequence: Synthetic oligonucleotide
aatacatcagaggtgctgttgctgcgggg

SEQ ID NO: 260623 - DNA, 28 bp, Artificial Sequence
  Description of Artificial Sequence: Synthetic oligonucleotide
atacatcagaggtgctgttgctgcgggg

SEQ ID NO: 260624 - DNA, 27 bp, Artificial Sequence
  Description of Artificial Sequence: Synthetic oligonucleotide
tacatcagaggtgctgttgctgcgggg

SEQ ID NO: 260625 - DNA, 27 bp, Artificial Sequence
  Description of Artificial Sequence: Synthetic oligonucleotide
acatcagaggtgctgttgctgcggggt

SEQ ID NO: 260626 - DNA, 26 bp, Artificial Sequence
  Description of Artificial Sequence: Synthetic oligonucleotide
catcagaggtgctgttgctgcggggt

SEQ ID NO: 260627 - DNA, 26 bp, Artificial Sequence
  Description of Artificial Sequence: Synthetic oligonucleotide
atcagaggtgctgttgctgcggggtg

SEQ ID NO: 260628 - DNA, 25 bp, Artificial Sequence
  Description of Artificial Sequence: Synthetic oligonucleotide
tcagaggtgctgttgctgcggggtg

SEQ ID NO: 260629 - DNA, 24 bp, Artificial Sequence
  Description of Artificial Sequence: Synthetic oligonucleotide
cagaggtgctgttgctgcggggtg

SEQ ID NO: 260630 - DNA, 25 bp, Artificial Sequence
  Description of Artificial Sequence: Synthetic oligonucleotide
agaggtgctgttgctgcggggtgct

SEQ ID NO: 260631 - DNA, 24 bp, Artificial Sequence
  Description of Artificial Sequence: Synthetic oligonucleotide
gaggtgctgttgctgcggggtgct

SEQ ID NO: 260632 - DNA, 24 bp, Artificial Sequence
  Description of Artificial Sequence: Synthetic oligonucleotide
aggtgctgttgctgcggggtgctg

SEQ ID NO: 260633 - DNA, 23 bp, Artificial Sequence
  Description of Artificial Sequence: Synthetic oligonucleotide
ggtgctgttgctgcggggtgctg

SEQ ID NO: 260634 - DNA, 23 bp, Artificial Sequence
  Description of Artificial Sequence: Synthetic oligonucleotide
gtgctgttgctgcggggtgctgg

SEQ ID NO: 260635 - DNA, 24 bp, Artificial Sequence
  Description of Artificial Sequence: Synthetic oligonucleotide
tgctgttgctgcggggtgctggca

SEQ ID NO: 260636 - DNA, 23 bp, Artificial Sequence
  Description of Artificial Sequence: Synthetic oligonucleotide
gctgttgctgcggggtgctggca

SEQ ID NO: 260637 - DNA, 26 bp, Artificial Sequence
  Description of Artificial Sequence: Synthetic oligonucleotide
ctgttgctgcggggtgctggcagatt

SEQ ID NO: 260638 - DNA, 27 bp, Artificial Sequence
  Description of Artificial Sequence: Synthetic oligonucleotide
tgttgctgcggggtgctggcagattct

SEQ ID NO: 260639 - DNA, 27 bp, Artificial Sequence
  Description of Artificial Sequence: Synthetic oligonucleotide
gttgctgcggggtgctggcagattcta

SEQ ID NO: 260640 - DNA, 27 bp, Artificial Sequence
  Description of Artificial Sequence: Synthetic oligonucleotide
ttgctgcggggtgctggcagattctag

SEQ ID NO: 260641 - DNA, 27 bp, Artificial Sequence
  Description of Artificial Sequence: Synthetic oligonucleotide
tgctgcggggtgctggcagattctaga

SEQ ID NO: 260642 - DNA, 26 bp, Artificial Sequence
  Description of Artificial Sequence: Synthetic oligonucleotide
gctgcggggtgctggcagattctaga

SEQ ID NO: 260643 - DNA, 26 bp, Artificial Sequence
  Description of Artificial Sequence: Synthetic oligonucleotide
ctgcggggtgctggcagattctagac

SEQ ID NO: 260644 - DNA, 27 bp, Artificial Sequence
  Description of Artificial Sequence: Synthetic oligonucleotide
tgcggggtgctggcagattctagacct

SEQ ID NO: 260645 - DNA, 26 bp, Artificial Sequence
  Description of Artificial Sequence: Synthetic oligonucleotide
gcggggtgctggcagattctagacct

SEQ ID NO: 260646 - DNA, 26 bp, Artificial Sequence
  Description of Artificial Sequence: Synthetic oligonucleotide
cggggtgctggcagattctagacctg

SEQ ID NO: 260647 - DNA, 27 bp, Artificial Sequence
  Description of Artificial Sequence: Synthetic oligonucleotide
ggggtgctggcagattctagacctgga

SEQ ID NO: 260648 - DNA, 27 bp, Artificial Sequence
  Description of Artificial Sequence: Synthetic oligonucleotide
gggtgctggcagattctagacctggac

SEQ ID NO: 260649 - DNA, 27 bp, Artificial Sequence
  Description of Artificial Sequence: Synthetic oligonucleotide
ggtgctggcagattctagacctggacc

SEQ ID NO: 260650 - DNA, 28 bp, Artificial Sequence
  Description of Artificial Sequence: Synthetic oligonucleotide
gtgctggcagattctagacctggacctc

SEQ ID NO: 260651 - DNA, 29 bp, Artificial Sequence
  Description of Artificial Sequence: Synthetic oligonucleotide
tgctggcagattctagacctggacctctc

SEQ ID NO: 260652 - DNA, 28 bp, Artificial Sequence
  Description of Artificial Sequence: Synthetic oligonucleotide
gctggcagattctagacctggacctctc

SEQ ID NO: 260653 - DNA, 28 bp, Artificial Sequence
  Description of Artificial Sequence: Synthetic oligonucleotide
ctggcagattctagacctggacctctcg

SEQ ID NO: 260654 - DNA, 29 bp, Artificial Sequence
  Description of Artificial Sequence: Synthetic oligonucleotide
tggcagattctagacctggacctctcgtc

SEQ ID NO: 260655 - DNA, 28 bp, Artificial Sequence
  Description of Artificial Sequence: Synthetic oligonucleotide
ggcagattctagacctggacctctcgtc

SEQ ID NO: 260656 - DNA, 29 bp, Artificial Sequence
  Description of Artificial Sequence: Synthetic oligonucleotide
gcagattctagacctggacctctcgtctc

SEQ ID NO: 260657 - DNA, 30 bp, Artificial Sequence
  Description of Artificial Sequence: Synthetic oligonucleotide
cagattctagacctggacctctcgtctctg

SEQ ID NO: 260658 - DNA, 30 bp, Artificial Sequence
  Description of Artificial Sequence: Synthetic oligonucleotide
agattctagacctggacctctcgtctctgg

SEQ ID NO: 260659 - DNA, 29 bp, Artificial Sequence
  Description of Artificial Sequence: Synthetic oligonucleotide
gattctagacctggacctctcgtctctgg

SEQ ID NO: 260660 - DNA, 30 bp, Artificial Sequence
  Description of Artificial Sequence: Synthetic oligonucleotide
attctagacctggacctctcgtctctggag

SEQ ID NO: 260661 - DNA, 29 bp, Artificial Sequence
  Description of Artificial Sequence: Synthetic oligonucleotide
ttctagacctggacctctcgtctctggag

SEQ ID NO: 260662 - DNA, 28 bp, Artificial Sequence
  Description of Artificial Sequence: Synthetic oligonucleotide
tctagacctggacctctcgtctctggag

SEQ ID NO: 260663 - DNA, 27 bp, Artificial Sequence
  Description of Artificial Sequence: Synthetic oligonucleotide
ctagacctggacctctcgtctctggag

SEQ ID NO: 260664 - DNA, 27 bp, Artificial Sequence
  Description of Artificial Sequence: Synthetic oligonucleotide
tagacctggacctctcgtctctggagg

SEQ ID NO: 260665 - DNA, 27 bp, Artificial Sequence
  Description of Artificial Sequence: Synthetic oligonucleotide
agacctggacctctcgtctctggaggt

SEQ ID NO: 260666 - DNA, 26 bp, Artificial Sequence
  Description of Artificial Sequence: Synthetic oligonucleotide
gacctggacctctcgtctctggaggt

SEQ ID NO: 260667 - DNA, 26 bp, Artificial Sequence
  Description of Artificial Sequence: Synthetic oligonucleotide
acctggacctctcgtctctggaggtg

SEQ ID NO: 260668 - DNA, 25 bp, Artificial Sequence
  Description of Artificial Sequence: Synthetic oligonucleotide
cctggacctctcgtctctggaggtg

SEQ ID NO: 260669 - DNA, 27 bp, Artificial Sequence
  Description of Artificial Sequence: Synthetic oligonucleotide
ctggacctctcgtctctggaggtggtt

SEQ ID NO: 260670 - DNA, 27 bp, Artificial Sequence
  Description of Artificial Sequence: Synthetic oligonucleotide
tggacctctcgtctctggaggtggttc

SEQ ID NO: 260671 - DNA, 26 bp, Artificial Sequence
  Description of Artificial Sequence: Synthetic oligonucleotide
ggacctctcgtctctggaggtggttc

SEQ ID NO: 260672 - DNA, 26 bp, Artificial Sequence
  Description of Artificial Sequence: Synthetic oligonucleotide
gacctctcgtctctggaggtggttcc

SEQ ID NO: 260673 - DNA, 27 bp, Artificial Sequence
  Description of Artificial Sequence: Synthetic oligonucleotide
acctctcgtctctggaggtggttccct

SEQ ID NO: 260674 - DNA, 26 bp, Artificial Sequence
  Description of Artificial Sequence: Synthetic oligonucleotide
cctctcgtctctggaggtggttccct

SEQ ID NO: 260675 - DNA, 27 bp, Artificial Sequence
  Description of Artificial Sequence: Synthetic oligonucleotide
ctctcgtctctggaggtggttccctgt

SEQ ID NO: 260676 - DNA, 27 bp, Artificial Sequence
  Description of Artificial Sequence: Synthetic oligonucleotide
tctcgtctctggaggtggttccctgtg

SEQ ID NO: 260677 - DNA, 26 bp, Artificial Sequence
  Description of Artificial Sequence: Synthetic oligonucleotide
ctcgtctctggaggtggttccctgtg

SEQ ID NO: 260678 - DNA, 27 bp, Artificial Sequence
  Description of Artificial Sequence: Synthetic oligonucleotide
tcgtctctggaggtggttccctgtggt

SEQ ID NO: 260679 - DNA, 26 bp, Artificial Sequence
  Description of Artificial Sequence: Synthetic oligonucleotide
cgtctctggaggtggttccctgtggt

SEQ ID NO: 260680 - DNA, 27 bp, Artificial Sequence
  Description of Artificial Sequence: Synthetic oligonucleotide
gtctctggaggtggttccctgtggtga

SEQ ID NO: 260681 - DNA, 27 bp, Artificial Sequence
  Description of Artificial Sequence: Synthetic oligonucleotide
tctctggaggtggttccctgtggtgac

SEQ ID NO: 260682 - DNA, 26 bp, Artificial Sequence
  Description of Artificial Sequence: Synthetic oligonucleotide
ctctggaggtggttccctgtggtgac

SEQ ID NO: 260683 - DNA, 26 bp, Artificial Sequence
  Description of Artificial Sequence: Synthetic oligonucleotide
tctggaggtggttccctgtggtgacg

SEQ ID NO: 260684 - DNA, 25 bp, Artificial Sequence
  Description of Artificial Sequence: Synthetic oligonucleotide
ctggaggtggttccctgtggtgacg

SEQ ID NO: 260685 - DNA, 26 bp, Artificial Sequence
  Description of Artificial Sequence: Synthetic oligonucleotide
tggaggtggttccctgtggtgacgct

SEQ ID NO: 260686 - DNA, 25 bp, Artificial Sequence
  Description of Artificial Sequence: Synthetic oligonucleotide
ggaggtggttccctgtggtgacgct

SEQ ID NO: 260687 - DNA, 26 bp, Artificial Sequence
  Description of Artificial Sequence: Synthetic oligonucleotide
gaggtggttccctgtggtgacgctca

SEQ ID NO: 260688 - DNA, 26 bp, Artificial Sequence
  Description of Artificial Sequence: Synthetic oligonucleotide
aggtggttccctgtggtgacgctcag

SEQ ID NO: 260689 - DNA, 25 bp, Artificial Sequence
  Description of Artificial Sequence: Synthetic oligonucleotide
ggtggttccctgtggtgacgctcag

SEQ ID NO: 260690 - DNA, 25 bp, Artificial Sequence
  Description of Artificial Sequence: Synthetic oligonucleotide
gtggttccctgtggtgacgctcagc

SEQ ID NO: 260691 - DNA, 26 bp, Artificial Sequence
  Description of Artificial Sequence: Synthetic oligonucleotide
tggttccctgtggtgacgctcagcct

SEQ ID NO: 260692 - DNA, 25 bp, Artificial Sequence
  Description of Artificial Sequence: Synthetic oligonucleotide
ggttccctgtggtgacgctcagcct

SEQ ID NO: 260693 - DNA, 25 bp, Artificial Sequence
  Description of Artificial Sequence: Synthetic oligonucleotide
gttccctgtggtgacgctcagcctg

SEQ ID NO: 260694 - DNA, 26 bp, Artificial Sequence
  Description of Artificial Sequence: Synthetic oligonucleotide
ttccctgtggtgacgctcagcctgct

SEQ ID NO: 260695 - DNA, 25 bp, Artificial Sequence
  Description of Artificial Sequence: Synthetic oligonucleotide
tccctgtggtgacgctcagcctgct

SEQ ID NO: 260696 - DNA, 24 bp, Artificial Sequence
  Description of Artificial Sequence: Synthetic oligonucleotide
ccctgtggtgacgctcagcctgct

SEQ ID NO: 260697 - DNA, 24 bp, Artificial Sequence
  Description of Artificial Sequence: Synthetic oligonucleotide
cctgtggtgacgctcagcctgctg

SEQ ID NO: 260698 - DNA, 24 bp, Artificial Sequence
  Description of Artificial Sequence: Synthetic oligonucleotide
ctgtggtgacgctcagcctgctgc

SEQ ID NO: 260699 - DNA, 24 bp, Artificial Sequence
  Description of Artificial Sequence: Synthetic oligonucleotide
tgtggtgacgctcagcctgctgcg

SEQ ID NO: 260700 - DNA, 23 bp, Artificial Sequence
  Description of Artificial Sequence: Synthetic oligonucleotide
gtggtgacgctcagcctgctgcg

SEQ ID NO: 260701 - DNA, 24 bp, Artificial Sequence
  Description of Artificial Sequence: Synthetic oligonucleotide
tggtgacgctcagcctgctgcggt

SEQ ID NO: 260702 - DNA, 23 bp, Artificial Sequence
  Description of Artificial Sequence: Synthetic oligonucleotide
ggtgacgctcagcctgctgcggt

SEQ ID NO: 260703 - DNA, 23 bp, Artificial Sequence
  Description of Artificial Sequence: Synthetic oligonucleotide
gtgacgctcagcctgctgcggtg

SEQ ID NO: 260704 - DNA, 23 bp, Artificial Sequence
  Description of Artificial Sequence: Synthetic oligonucleotide
tgacgctcagcctgctgcggtgg

SEQ ID NO: 260705 - DNA, 22 bp, Artificial Sequence
  Description of Artificial Sequence: Synthetic oligonucleotide
gacgctcagcctgctgcggtgg

SEQ ID NO: 260706 - DNA, 23 bp, Artificial Sequence
  Description of Artificial Sequence: Synthetic oligonucleotide
acgctcagcctgctgcggtggga

SEQ ID NO: 260707 - DNA, 22 bp, Artificial Sequence
  Description of Artificial Sequence: Synthetic oligonucleotide
cgctcagcctgctgcggtggga

SEQ ID NO: 260708 - DNA, 22 bp, Artificial Sequence
  Description of Artificial Sequence: Synthetic oligonucleotide
gctcagcctgctgcggtgggag

SEQ ID NO: 260709 - DNA, 22 bp, Artificial Sequence
  Description of Artificial Sequence: Synthetic oligonucleotide
ctcagcctgctgcggtgggagc

SEQ ID NO: 260710 - DNA, 22 bp, Artificial Sequence
  Description of Artificial Sequence: Synthetic oligonucleotide
tcagcctgctgcggtgggagcg

SEQ ID NO: 260711 - DNA, 21 bp, Artificial Sequence
  Description of Artificial Sequence: Synthetic oligonucleotide
cagcctgctgcggtgggagcg

SEQ ID NO: 260712 - DNA, 22 bp, Artificial Sequence
  Description of Artificial Sequence: Synthetic oligonucleotide
agcctgctgcggtgggagcggt

SEQ ID NO: 260713 - DNA, 21 bp, Artificial Sequence
  Description of Artificial Sequence: Synthetic oligonucleotide
gcctgctgcggtgggagcggt

SEQ ID NO: 260714 - DNA, 21 bp, Artificial Sequence
  Description of Artificial Sequence: Synthetic oligonucleotide
cctgctgcggtgggagcggtc

SEQ ID NO: 260715 - DNA, 23 bp, Artificial Sequence
  Description of Artificial Sequence: Synthetic oligonucleotide
ctgctgcggtgggagcggtcctt

SEQ ID NO: 260716 - DNA, 23 bp, Artificial Sequence
  Description of Artificial Sequence: Synthetic oligonucleotide
tgctgcggtgggagcggtccttg

SEQ ID NO: 260717 - DNA, 22 bp, Artificial Sequence
  Description of Artificial Sequence: Synthetic oligonucleotide
gctgcggtgggagcggtccttg

SEQ ID NO: 260718 - DNA, 23 bp, Artificial Sequence
  Description of Artificial Sequence: Synthetic oligonucleotide
ctgcggtgggagcggtccttggt

SEQ ID NO: 260719 - DNA, 24 bp, Artificial Sequence
  Description of Artificial Sequence: Synthetic oligonucleotide
tgcggtgggagcggtccttggtct

SEQ ID NO: 260720 - DNA, 23 bp, Artificial Sequence
  Description of Artificial Sequence: Synthetic oligonucleotide
gcggtgggagcggtccttggtct

SEQ ID NO: 260721 - DNA, 26 bp, Artificial Sequence
  Description of Artificial Sequence: Synthetic oligonucleotide
cggtgggagcggtccttggtctcaat

SEQ ID NO: 260722 - DNA, 27 bp, Artificial Sequence
  Description of Artificial Sequence: Synthetic oligonucleotide
ggtgggagcggtccttggtctcaatga

SEQ ID NO: 260723 - DNA, 30 bp, Artificial Sequence
  Description of Artificial Sequence: Synthetic oligonucleotide
gtgggagcggtccttggtctcaatgaatac

SEQ ID NO: 260724 - DNA, 30 bp, Artificial Sequence
  Description of Artificial Sequence: Synthetic oligonucleotide
tgggagcggtccttggtctcaatgaatacg

SEQ ID NO: 260725 - DNA, 29 bp, Artificial Sequence
  Description of Artificial Sequence: Synthetic oligonucleotide
gggagcggtccttggtctcaatgaatacg

SEQ ID NO: 260726 - DNA, 31 bp, Artificial Sequence
  Description of Artificial Sequence: Synthetic oligonucleotide
ggagcggtccttggtctcaatgaatacgttg

SEQ ID NO: 260727 - DNA, 32 bp, Artificial Sequence
  Description of Artificial Sequence: Synthetic oligonucleotide
gagcggtccttggtctcaatgaatacgttgac

SEQ ID NO: 260728 - DNA, 32 bp, Artificial Sequence
  Description of Artificial Sequence: Synthetic oligonucleotide
agcggtccttggtctcaatgaatacgttgacc

SEQ ID NO: 260729 - DNA, 31 bp, Artificial Sequence
  Description of Artificial Sequence: Synthetic oligonucleotide
gcggtccttggtctcaatgaatacgttgacc

SEQ ID NO: 260730 - DNA, 35 bp, Artificial Sequence
  Description of Artificial Sequence: Synthetic oligonucleotide
cggtccttggtctcaatgaatacgttgacctaaac

SEQ ID NO: 260731 - DNA, 35 bp, Artificial Sequence
  Description of Artificial Sequence: Synthetic oligonucleotide
ggtccttggtctcaatgaatacgttgacctaaacc

SEQ ID NO: 260732 - DNA, 42 bp, Artificial Sequence
  Description of Artificial Sequence: Synthetic oligonucleotide
gtccttggtctcaatgaatacgttgacctaaaccaaaaaaag

SEQ ID NO: 260733 - DNA, 44 bp, Artificial Sequence
  Description of Artificial Sequence: Synthetic oligonucleotide
tccttggtctcaatgaatacgttgacctaaaccaaaaaaagtag

SEQ ID NO: 260734 - DNA, 43 bp, Artificial Sequence
  Description of Artificial Sequence: Synthetic oligonucleotide
ccttggtctcaatgaatacgttgacctaaaccaaaaaaagtag

SEQ ID NO: 260735 - DNA, 45 bp, Artificial Sequence
  Description of Artificial Sequence: Synthetic oligonucleotide
cttggtctcaatgaatacgttgacctaaaccaaaaaaagtagatg

SEQ ID NO: 260736 - DNA, 45 bp, Artificial Sequence
  Description of Artificial Sequence: Synthetic oligonucleotide
ttggtctcaatgaatacgttgacctaaaccaaaaaaagtagatgg

SEQ ID NO: 260737 - DNA, 44 bp, Artificial Sequence
  Description of Artificial Sequence: Synthetic oligonucleotide
tggtctcaatgaatacgttgacctaaaccaaaaaaagtagatgg

SEQ ID NO: 260738 - DNA, 43 bp, Artificial Sequence
  Description of Artificial Sequence: Synthetic oligonucleotide
ggtctcaatgaatacgttgacctaaaccaaaaaaagtagatgg

SEQ ID NO: 260739 - DNA, 43 bp, Artificial Sequence
  Description of Artificial Sequence: Synthetic oligonucleotide
gtctcaatgaatacgttgacctaaaccaaaaaaagtagatggc

SEQ ID NO: 260740 - DNA, 44 bp, Artificial Sequence
  Description of Artificial Sequence: Synthetic oligonucleotide
tctcaatgaatacgttgacctaaaccaaaaaaagtagatggctg

SEQ ID NO: 260741 - DNA, 43 bp, Artificial Sequence
  Description of Artificial Sequence: Synthetic oligonucleotide
ctcaatgaatacgttgacctaaaccaaaaaaagtagatggctg

SEQ ID NO: 260742 - DNA, 44 bp, Artificial Sequence
  Description of Artificial Sequence: Synthetic oligonucleotide
tcaatgaatacgttgacctaaaccaaaaaaagtagatggctgag

SEQ ID NO: 260743 - DNA, 43 bp, Artificial Sequence
  Description of Artificial Sequence: Synthetic oligonucleotide
caatgaatacgttgacctaaaccaaaaaaagtagatggctgag

SEQ ID NO: 260744 - DNA, 44 bp, Artificial Sequence
  Description of Artificial Sequence: Synthetic oligonucleotide
aatgaatacgttgacctaaaccaaaaaaagtagatggctgagtc

SEQ ID NO: 260745 - DNA, 43 bp, Artificial Sequence
  Description of Artificial Sequence: Synthetic oligonucleotide
atgaatacgttgacctaaaccaaaaaaagtagatggctgagtc

SEQ ID NO: 260746 - DNA, 42 bp, Artificial Sequence
  Description of Artificial Sequence: Synthetic oligonucleotide
tgaatacgttgacctaaaccaaaaaaagtagatggctgagtc

SEQ ID NO: 260747 - DNA, 41 bp, Artificial Sequence
  Description of Artificial Sequence: Synthetic oligonucleotide
gaatacgttgacctaaaccaaaaaaagtagatggctgagtc

SEQ ID NO: 260748 - DNA, 41 bp, Artificial Sequence
  Description of Artificial Sequence: Synthetic oligonucleotide
aatacgttgacctaaaccaaaaaaagtagatggctgagtcg

SEQ ID NO: 260749 - DNA, 40 bp, Artificial Sequence
  Description of Artificial Sequence: Synthetic oligonucleotide
atacgttgacctaaaccaaaaaaagtagatggctgagtcg

SEQ ID NO: 260750 - DNA, 39 bp, Artificial Sequence
  Description of Artificial Sequence: Synthetic oligonucleotide
tacgttgacctaaaccaaaaaaagtagatggctgagtcg

SEQ ID NO: 260751 - DNA, 38 bp, Artificial Sequence
  Description of Artificial Sequence: Synthetic oligonucleotide
acgttgacctaaaccaaaaaaagtagatggctgagtcg

SEQ ID NO: 260752 - DNA, 37 bp, Artificial Sequence
  Description of Artificial Sequence: Synthetic oligonucleotide
cgttgacctaaaccaaaaaaagtagatggctgagtcg

SEQ ID NO: 260753 - DNA, 37 bp, Artificial Sequence
  Description of Artificial Sequence: Synthetic oligonucleotide
gttgacctaaaccaaaaaaagtagatggctgagtcgg

SEQ ID NO: 260754 - DNA, 37 bp, Artificial Sequence
  Description of Artificial Sequence: Synthetic oligonucleotide
ttgacctaaaccaaaaaaagtagatggctgagtcggc

SEQ ID NO: 260755 - DNA, 36 bp, Artificial Sequence
  Description of Artificial Sequence: Synthetic oligonucleotide
tgacctaaaccaaaaaaagtagatggctgagtcggc

SEQ ID NO: 260756 - DNA, 35 bp, Artificial Sequence
  Description of Artificial Sequence: Synthetic oligonucleotide
gacctaaaccaaaaaaagtagatggctgagtcggc

SEQ ID NO: 260757 - DNA, 38 bp, Artificial Sequence
  Description of Artificial Sequence: Synthetic oligonucleotide
acctaaaccaaaaaaagtagatggctgagtcggcaaac

SEQ ID NO: 260758 - DNA, 37 bp, Artificial Sequence
  Description of Artificial Sequence: Synthetic oligonucleotide
cctaaaccaaaaaaagtagatggctgagtcggcaaac

SEQ ID NO: 260759 - DNA, 37 bp, Artificial Sequence
  Description of Artificial Sequence: Synthetic oligonucleotide
ctaaaccaaaaaaagtagatggctgagtcggcaaacc

SEQ ID NO: 260760 - DNA, 38 bp, Artificial Sequence
  Description of Artificial Sequence: Synthetic oligonucleotide
taaaccaaaaaaagtagatggctgagtcggcaaacctc

SEQ ID NO: 260761 - DNA, 37 bp, Artificial Sequence
  Description of Artificial Sequence: Synthetic oligonucleotide
aaaccaaaaaaagtagatggctgagtcggcaaacctc

SEQ ID NO: 260762 - DNA, 36 bp, Artificial Sequence
  Description of Artificial Sequence: Synthetic oligonucleotide
aaccaaaaaaagtagatggctgagtcggcaaacctc

SEQ ID NO: 260763 - DNA, 35 bp, Artificial Sequence
  Description of Artificial Sequence: Synthetic oligonucleotide
accaaaaaaagtagatggctgagtcggcaaacctc

SEQ ID NO: 260764 - DNA, 34 bp, Artificial Sequence
  Description of Artificial Sequence: Synthetic oligonucleotide
ccaaaaaaagtagatggctgagtcggcaaacctc

SEQ ID NO: 260765 - DNA, 37 bp, Artificial Sequence
  Description of Artificial Sequence: Synthetic oligonucleotide
caaaaaaagtagatggctgagtcggcaaacctctatg

SEQ ID NO: 260766 - DNA, 37 bp, Artificial Sequence
  Description of Artificial Sequence: Synthetic oligonucleotide
aaaaaaagtagatggctgagtcggcaaacctctatgg

SEQ ID NO: 260767 - DNA, 36 bp, Artificial Sequence
  Description of Artificial Sequence: Synthetic oligonucleotide
aaaaaagtagatggctgagtcggcaaacctctatgg

SEQ ID NO: 260768 - DNA, 35 bp, Artificial Sequence
  Description of Artificial Sequence: Synthetic oligonucleotide
aaaaagtagatggctgagtcggcaaacctctatgg

SEQ ID NO: 260769 - DNA, 34 bp, Artificial Sequence
  Description of Artificial Sequence: Synthetic oligonucleotide
aaaagtagatggctgagtcggcaaacctctatgg

SEQ ID NO: 260770 - DNA, 33 bp, Artificial Sequence
  Description of Artificial Sequence: Synthetic oligonucleotide
aaagtagatggctgagtcggcaaacctctatgg

SEQ ID NO: 260771 - DNA, 32 bp, Artificial Sequence
  Description of Artificial Sequence: Synthetic oligonucleotide
aagtagatggctgagtcggcaaacctctatgg

SEQ ID NO: 260772 - DNA, 31 bp, Artificial Sequence
  Description of Artificial Sequence: Synthetic oligonucleotide
agtagatggctgagtcggcaaacctctatgg

SEQ ID NO: 260773 - DNA, 30 bp, Artificial Sequence
  Description of Artificial Sequence: Synthetic oligonucleotide
gtagatggctgagtcggcaaacctctatgg

SEQ ID NO: 260774 - DNA, 32 bp, Artificial Sequence
  Description of Artificial Sequence: Synthetic oligonucleotide
tagatggctgagtcggcaaacctctatggatg

SEQ ID NO: 260775 - DNA, 31 bp, Artificial Sequence
  Description of Artificial Sequence: Synthetic oligonucleotide
agatggctgagtcggcaaacctctatggatg

SEQ ID NO: 260776 - DNA, 30 bp, Artificial Sequence
  Description of Artificial Sequence: Synthetic oligonucleotide
gatggctgagtcggcaaacctctatggatg

SEQ ID NO: 260777 - DNA, 31 bp, Artificial Sequence
  Description of Artificial Sequence: Synthetic oligonucleotide
atggctgagtcggcaaacctctatggatgtg

SEQ ID NO: 260778 - DNA, 30 bp, Artificial Sequence
  Description of Artificial Sequence: Synthetic oligonucleotide
tggctgagtcggcaaacctctatggatgtg

SEQ ID NO: 260779 - DNA, 29 bp, Artificial Sequence
  Description of Artificial Sequence: Synthetic oligonucleotide
ggctgagtcggcaaacctctatggatgtg

SEQ ID NO: 260780 - DNA, 29 bp, Artificial Sequence
  Description of Artificial Sequence: Synthetic oligonucleotide
gctgagtcggcaaacctctatggatgtgg

SEQ ID NO: 260781 - DNA, 29 bp, Artificial Sequence
  Description of Artificial Sequence: Synthetic oligonucleotide
ctgagtcggcaaacctctatggatgtggg

SEQ ID NO: 260782 - DNA, 29 bp, Artificial Sequence
  Description of Artificial Sequence: Synthetic oligonucleotide
tgagtcggcaaacctctatggatgtgggg

SEQ ID NO: 260783 - DNA, 28 bp, Artificial Sequence
  Description of Artificial Sequence: Synthetic oligonucleotide
gagtcggcaaacctctatggatgtgggg

SEQ ID NO: 260784 - DNA, 30 bp, Artificial Sequence
  Description of Artificial Sequence: Synthetic oligonucleotide
agtcggcaaacctctatggatgtggggatc

SEQ ID NO: 260785 - DNA, 29 bp, Artificial Sequence
  Description of Artificial Sequence: Synthetic oligonucleotide
gtcggcaaacctctatggatgtggggatc

SEQ ID NO: 260786 - DNA, 30 bp, Artificial Sequence
  Description of Artificial Sequence: Synthetic oligonucleotide
tcggcaaacctctatggatgtggggatctg

SEQ ID NO: 260787 - DNA, 29 bp, Artificial Sequence
  Description of Artificial Sequence: Synthetic oligonucleotide
cggcaaacctctatggatgtggggatctg

SEQ ID NO: 260788 - DNA, 29 bp, Artificial Sequence
  Description of Artificial Sequence: Synthetic oligonucleotide
ggcaaacctctatggatgtggggatctgg

SEQ ID NO: 260789 - DNA, 30 bp, Artificial Sequence
  Description of Artificial Sequence: Synthetic oligonucleotide
gcaaacctctatggatgtggggatctggag

SEQ ID NO: 260790 - DNA, 30 bp, Artificial Sequence
  Description of Artificial Sequence: Synthetic oligonucleotide
caaacctctatggatgtggggatctggagg

SEQ ID NO: 260791 - DNA, 30 bp, Artificial Sequence
  Description of Artificial Sequence: Synthetic oligonucleotide
aaacctctatggatgtggggatctggaggc

SEQ ID NO: 260792 - DNA, 29 bp, Artificial Sequence
  Description of Artificial Sequence: Synthetic oligonucleotide
aacctctatggatgtggggatctggaggc

SEQ ID NO: 260793 - DNA, 28 bp, Artificial Sequence
  Description of Artificial Sequence: Synthetic oligonucleotide
acctctatggatgtggggatctggaggc

SEQ ID NO: 260794 - DNA, 27 bp, Artificial Sequence
  Description of Artificial Sequence: Synthetic oligonucleotide
cctctatggatgtggggatctggaggc

SEQ ID NO: 260795 - DNA, 27 bp, Artificial Sequence
  Description of Artificial Sequence: Synthetic oligonucleotide
ctctatggatgtggggatctggaggcc

SEQ ID NO: 260796 - DNA, 28 bp, Artificial Sequence
  Description of Artificial Sequence: Synthetic oligonucleotide
tctatggatgtggggatctggaggcctg

SEQ ID NO: 260797 - DNA, 27 bp, Artificial Sequence
  Description of Artificial Sequence: Synthetic oligonucleotide
ctatggatgtggggatctggaggcctg

SEQ ID NO: 260798 - DNA, 27 bp, Artificial Sequence
  Description of Artificial Sequence: Synthetic oligonucleotide
tatggatgtggggatctggaggcctgc

SEQ ID NO: 260799 - DNA, 26 bp, Artificial Sequence
  Description of Artificial Sequence: Synthetic oligonucleotide
atggatgtggggatctggaggcctgc

SEQ ID NO: 260800 - DNA, 25 bp, Artificial Sequence
  Description of Artificial Sequence: Synthetic oligonucleotide
tggatgtggggatctggaggcctgc

SEQ ID NO: 260801 - DNA, 24 bp, Artificial Sequence
  Description of Artificial Sequence: Synthetic oligonucleotide
ggatgtggggatctggaggcctgc

SEQ ID NO: 260802 - DNA, 25 bp, Artificial Sequence
  Description of Artificial Sequence: Synthetic oligonucleotide
gatgtggggatctggaggcctgcca

SEQ ID NO: 260803 - DNA, 27 bp, Artificial Sequence
  Description of Artificial Sequence: Synthetic oligonucleotide
atgtggggatctggaggcctgccagaa

SEQ ID NO: 260804 - DNA, 27 bp, Artificial Sequence
  Description of Artificial Sequence: Synthetic oligonucleotide
tgtggggatctggaggcctgccagaaa

SEQ ID NO: 260805 - DNA, 26 bp, Artificial Sequence
  Description of Artificial Sequence: Synthetic oligonucleotide
gtggggatctggaggcctgccagaaa

SEQ ID NO: 260806 - DNA, 26 bp, Artificial Sequence
  Description of Artificial Sequence: Synthetic oligonucleotide
tggggatctggaggcctgccagaaag

SEQ ID NO: 260807 - DNA, 25 bp, Artificial Sequence
  Description of Artificial Sequence: Synthetic oligonucleotide
ggggatctggaggcctgccagaaag

SEQ ID NO: 260808 - DNA, 26 bp, Artificial Sequence
  Description of Artificial Sequence: Synthetic oligonucleotide
gggatctggaggcctgccagaaagga

SEQ ID NO: 260809 - DNA, 27 bp, Artificial Sequence
  Description of Artificial Sequence: Synthetic oligonucleotide
ggatctggaggcctgccagaaaggact

SEQ ID NO: 260810 - DNA, 27 bp, Artificial Sequence
  Description of Artificial Sequence: Synthetic oligonucleotide
gatctggaggcctgccagaaaggactc

SEQ ID NO: 260811 - DNA, 27 bp, Artificial Sequence
  Description of Artificial Sequence: Synthetic oligonucleotide
atctggaggcctgccagaaaggactcc

SEQ ID NO: 260812 - DNA, 27 bp, Artificial Sequence
  Description of Artificial Sequence: Synthetic oligonucleotide
tctggaggcctgccagaaaggactcct

SEQ ID NO: 260813 - DNA, 26 bp, Artificial Sequence
  Description of Artificial Sequence: Synthetic oligonucleotide
ctggaggcctgccagaaaggactcct

SEQ ID NO: 260814 - DNA, 27 bp, Artificial Sequence
  Description of Artificial Sequence: Synthetic oligonucleotide
tggaggcctgccagaaaggactcctgt

SEQ ID NO: 260815 - DNA, 27 bp, Artificial Sequence
  Description of Artificial Sequence: Synthetic oligonucleotide
ggaggcctgccagaaaggactcctgtt

SEQ ID NO: 260816 - DNA, 28 bp, Artificial Sequence
  Description of Artificial Sequence: Synthetic oligonucleotide
gaggcctgccagaaaggactcctgtttg

SEQ ID NO: 260817 - DNA, 28 bp, Artificial Sequence
  Description of Artificial Sequence: Synthetic oligonucleotide
aggcctgccagaaaggactcctgtttgg

SEQ ID NO: 260818 - DNA, 27 bp, Artificial Sequence
  Description of Artificial Sequence: Synthetic oligonucleotide
ggcctgccagaaaggactcctgtttgg

SEQ ID NO: 260819 - DNA, 29 bp, Artificial Sequence
  Description of Artificial Sequence: Synthetic oligonucleotide
gcctgccagaaaggactcctgtttggttc

SEQ ID NO: 260820 - DNA, 30 bp, Artificial Sequence
  Description of Artificial Sequence: Synthetic oligonucleotide
cctgccagaaaggactcctgtttggttctg

SEQ ID NO: 260821 - DNA, 30 bp, Artificial Sequence
  Description of Artificial Sequence: Synthetic oligonucleotide
ctgccagaaaggactcctgtttggttctgg

SEQ ID NO: 260822 - DNA, 30 bp, Artificial Sequence
  Description of Artificial Sequence: Synthetic oligonucleotide
tgccagaaaggactcctgtttggttctggg

SEQ ID NO: 260823 - DNA, 29 bp, Artificial Sequence
  Description of Artificial Sequence: Synthetic oligonucleotide
gccagaaaggactcctgtttggttctggg

SEQ ID NO: 260824 - DNA, 29 bp, Artificial Sequence
  Description of Artificial Sequence: Synthetic oligonucleotide
ccagaaaggactcctgtttggttctgggc

SEQ ID NO: 260825 - DNA, 30 bp, Artificial Sequence
  Description of Artificial Sequence: Synthetic oligonucleotide
cagaaaggactcctgtttggttctgggcac

SEQ ID NO: 260826 - DNA, 32 bp, Artificial Sequence
  Description of Artificial Sequence: Synthetic oligonucleotide
agaaaggactcctgtttggttctgggcacaac

SEQ ID NO: 260827 - DNA, 31 bp, Artificial Sequence
  Description of Artificial Sequence: Synthetic oligonucleotide
gaaaggactcctgtttggttctgggcacaac

SEQ ID NO: 260828 - DNA, 33 bp, Artificial Sequence
  Description of Artificial Sequence: Synthetic oligonucleotide
aaaggactcctgtttggttctgggcacaacttg

SEQ ID NO: 260829 - DNA, 32 bp, Artificial Sequence
  Description of Artificial Sequence: Synthetic oligonucleotide
aaggactcctgtttggttctgggcacaacttg

SEQ ID NO: 260830 - DNA, 31 bp, Artificial Sequence
  Description of Artificial Sequence: Synthetic oligonucleotide
aggactcctgtttggttctgggcacaacttg

SEQ ID NO: 260831 - DNA, 30 bp, Artificial Sequence
  Description of Artificial Sequence: Synthetic oligonucleotide
ggactcctgtttggttctgggcacaacttg

SEQ ID NO: 260832 - DNA, 30 bp, Artificial Sequence
  Description of Artificial Sequence: Synthetic oligonucleotide
gactcctgtttggttctgggcacaacttgg

SEQ ID NO: 260833 - DNA, 30 bp, Artificial Sequence
  Description of Artificial Sequence: Synthetic oligonucleotide
actcctgtttggttctgggcacaacttggc

SEQ ID NO: 260834 - DNA, 29 bp, Artificial Sequence
  Description of Artificial Sequence: Synthetic oligonucleotide
ctcctgtttggttctgggcacaacttggc

SEQ ID NO: 260835 - DNA, 30 bp, Artificial Sequence
  Description of Artificial Sequence: Synthetic oligonucleotide
tcctgtttggttctgggcacaacttggcag

SEQ ID NO: 260836 - DNA, 29 bp, Artificial Sequence
  Description of Artificial Sequence: Synthetic oligonucleotide
cctgtttggttctgggcacaacttggcag

SEQ ID NO: 260837 - DNA, 29 bp, Artificial Sequence
  Description of Artificial Sequence: Synthetic oligonucleotide
ctgtttggttctgggcacaacttggcagg

SEQ ID NO: 260838 - DNA, 29 bp, Artificial Sequence
  Description of Artificial Sequence: Synthetic oligonucleotide
tgtttggttctgggcacaacttggcaggc

SEQ ID NO: 260839 - DNA, 28 bp, Artificial Sequence
  Description of Artificial Sequence: Synthetic oligonucleotide
gtttggttctgggcacaacttggcaggc

SEQ ID NO: 260840 - DNA, 28 bp, Artificial Sequence
  Description of Artificial Sequence: Synthetic oligonucleotide
tttggttctgggcacaacttggcaggcc

SEQ ID NO: 260841 - DNA, 27 bp, Artificial Sequence
  Description of Artificial Sequence: Synthetic oligonucleotide
ttggttctgggcacaacttggcaggcc

SEQ ID NO: 260842 - DNA, 27 bp, Artificial Sequence
  Description of Artificial Sequence: Synthetic oligonucleotide
tggttctgggcacaacttggcaggcca

SEQ ID NO: 260843 - DNA, 27 bp, Artificial Sequence
  Description of Artificial Sequence: Synthetic oligonucleotide
ggttctgggcacaacttggcaggccaa

SEQ ID NO: 260844 - DNA, 29 bp, Artificial Sequence
  Description of Artificial Sequence: Synthetic oligonucleotide
gttctgggcacaacttggcaggccaattg

SEQ ID NO: 260845 - DNA, 31 bp, Artificial Sequence
  Description of Artificial Sequence: Synthetic oligonucleotide
ttctgggcacaacttggcaggccaattgaag

SEQ ID NO: 260846 - DNA, 30 bp, Artificial Sequence
  Description of Artificial Sequence: Synthetic oligonucleotide
tctgggcacaacttggcaggccaattgaag

SEQ ID NO: 260847 - DNA, 29 bp, Artificial Sequence
  Description of Artificial Sequence: Synthetic oligonucleotide
ctgggcacaacttggcaggccaattgaag

SEQ ID NO: 260848 - DNA, 29 bp, Artificial Sequence
  Description of Artificial Sequence: Synthetic oligonucleotide
tgggcacaacttggcaggccaattgaagg

SEQ ID NO: 260849 - DNA, 28 bp, Artificial Sequence
  Description of Artificial Sequence: Synthetic oligonucleotide
gggcacaacttggcaggccaattgaagg

SEQ ID NO: 260850 - DNA, 29 bp, Artificial Sequence
  Description of Artificial Sequence: Synthetic oligonucleotide
ggcacaacttggcaggccaattgaaggag

SEQ ID NO: 260851 - DNA, 30 bp, Artificial Sequence
  Description of Artificial Sequence: Synthetic oligonucleotide
gcacaacttggcaggccaattgaaggagac

SEQ ID NO: 260852 - DNA, 30 bp, Artificial Sequence
  Description of Artificial Sequence: Synthetic oligonucleotide
cacaacttggcaggccaattgaaggagacg

SEQ ID NO: 260853 - DNA, 30 bp, Artificial Sequence
  Description of Artificial Sequence: Synthetic oligonucleotide
acaacttggcaggccaattgaaggagacgc

SEQ ID NO: 260854 - DNA, 29 bp, Artificial Sequence
  Description of Artificial Sequence: Synthetic oligonucleotide
caacttggcaggccaattgaaggagacgc

SEQ ID NO: 260855 - DNA, 29 bp, Artificial Sequence
  Description of Artificial Sequence: Synthetic oligonucleotide
aacttggcaggccaattgaaggagacgcc

SEQ ID NO: 260856 - DNA, 28 bp, Artificial Sequence
  Description of Artificial Sequence: Synthetic oligonucleotide
acttggcaggccaattgaaggagacgcc

SEQ ID NO: 260857 - DNA, 27 bp, Artificial Sequence
  Description of Artificial Sequence: Synthetic oligonucleotide
cttggcaggccaattgaaggagacgcc

SEQ ID NO: 260858 - DNA, 28 bp, Artificial Sequence
  Description of Artificial Sequence: Synthetic oligonucleotide
ttggcaggccaattgaaggagacgcctg

SEQ ID NO: 260859 - DNA, 27 bp, Artificial Sequence
  Description of Artificial Sequence: Synthetic oligonucleotide
tggcaggccaattgaaggagacgcctg

SEQ ID NO: 260860 - DNA, 26 bp, Artificial Sequence
  Description of Artificial Sequence: Synthetic oligonucleotide
ggcaggccaattgaaggagacgcctg

SEQ ID NO: 260861 - DNA, 26 bp, Artificial Sequence
  Description of Artificial Sequence: Synthetic oligonucleotide
gcaggccaattgaaggagacgcctgc

SEQ ID NO: 260862 - DNA, 27 bp, Artificial Sequence
  Description of Artificial Sequence: Synthetic oligonucleotide
caggccaattgaaggagacgcctgcca

SEQ ID NO: 260863 - DNA, 29 bp, Artificial Sequence
  Description of Artificial Sequence: Synthetic oligonucleotide
aggccaattgaaggagacgcctgccaatg

SEQ ID NO: 260864 - DNA, 28 bp, Artificial Sequence
  Description of Artificial Sequence: Synthetic oligonucleotide
ggccaattgaaggagacgcctgccaatg

SEQ ID NO: 260865 - DNA, 29 bp, Artificial Sequence
  Description of Artificial Sequence: Synthetic oligonucleotide
gccaattgaaggagacgcctgccaatgag

SEQ ID NO: 260866 - DNA, 31 bp, Artificial Sequence
  Description of Artificial Sequence: Synthetic oligonucleotide
ccaattgaaggagacgcctgccaatgagttg

SEQ ID NO: 260867 - DNA, 32 bp, Artificial Sequence
  Description of Artificial Sequence: Synthetic oligonucleotide
caattgaaggagacgcctgccaatgagttgac

SEQ ID NO: 260868 - DNA, 32 bp, Artificial Sequence
  Description of Artificial Sequence: Synthetic oligonucleotide
aattgaaggagacgcctgccaatgagttgacg

SEQ ID NO: 260869 - DNA, 31 bp, Artificial Sequence
  Description of Artificial Sequence: Synthetic oligonucleotide
attgaaggagacgcctgccaatgagttgacg

SEQ ID NO: 260870 - DNA, 30 bp, Artificial Sequence
  Description of Artificial Sequence: Synthetic oligonucleotide
ttgaaggagacgcctgccaatgagttgacg

SEQ ID NO: 260871 - DNA, 29 bp, Artificial Sequence
  Description of Artificial Sequence: Synthetic oligonucleotide
tgaaggagacgcctgccaatgagttgacg

SEQ ID NO: 260872 - DNA, 28 bp, Artificial Sequence
  Description of Artificial Sequence: Synthetic oligonucleotide
gaaggagacgcctgccaatgagttgacg

SEQ ID NO: 260873 - DNA, 28 bp, Artificial Sequence
  Description of Artificial Sequence: Synthetic oligonucleotide
aaggagacgcctgccaatgagttgacgc

SEQ ID NO: 260874 - DNA, 27 bp, Artificial Sequence
  Description of Artificial Sequence: Synthetic oligonucleotide
aggagacgcctgccaatgagttgacgc

SEQ ID NO: 260875 - DNA, 26 bp, Artificial Sequence
  Description of Artificial Sequence: Synthetic oligonucleotide
ggagacgcctgccaatgagttgacgc

SEQ ID NO: 260876 - DNA, 27 bp, Artificial Sequence
  Description of Artificial Sequence: Synthetic oligonucleotide
gagacgcctgccaatgagttgacgcca

SEQ ID NO: 260877 - DNA, 28 bp, Artificial Sequence
  Description of Artificial Sequence: Synthetic oligonucleotide
agacgcctgccaatgagttgacgccaag

SEQ ID NO: 260878 - DNA, 27 bp, Artificial Sequence
  Description of Artificial Sequence: Synthetic oligonucleotide
gacgcctgccaatgagttgacgccaag

SEQ ID NO: 260879 - DNA, 27 bp, Artificial Sequence
  Description of Artificial Sequence: Synthetic oligonucleotide
acgcctgccaatgagttgacgccaagc

SEQ ID NO: 260880 - DNA, 27 bp, Artificial Sequence
  Description of Artificial Sequence: Synthetic oligonucleotide
cgcctgccaatgagttgacgccaagca

SEQ ID NO: 260881 - DNA, 27 bp, Artificial Sequence
  Description of Artificial Sequence: Synthetic oligonucleotide
gcctgccaatgagttgacgccaagcag

SEQ ID NO: 260882 - DNA, 31 bp, Artificial Sequence
  Description of Artificial Sequence: Synthetic oligonucleotide
cctgccaatgagttgacgccaagcagatttg

SEQ ID NO: 260883 - DNA, 31 bp, Artificial Sequence
  Description of Artificial Sequence: Synthetic oligonucleotide
ctgccaatgagttgacgccaagcagatttgc

SEQ ID NO: 260884 - DNA, 32 bp, Artificial Sequence
  Description of Artificial Sequence: Synthetic oligonucleotide
tgccaatgagttgacgccaagcagatttgcag

SEQ ID NO: 260885 - DNA, 31 bp, Artificial Sequence
  Description of Artificial Sequence: Synthetic oligonucleotide
gccaatgagttgacgccaagcagatttgcag

SEQ ID NO: 260886 - DNA, 39 bp, Artificial Sequence
  Description of Artificial Sequence: Synthetic oligonucleotide
ccaatgagttgacgccaagcagatttgcagaaattattc

SEQ ID NO: 260887 - DNA, 40 bp, Artificial Sequence
  Description of Artificial Sequence: Synthetic oligonucleotide
caatgagttgacgccaagcagatttgcagaaattattcag

SEQ ID NO: 260888 - DNA, 42 bp, Artificial Sequence
  Description of Artificial Sequence: Synthetic oligonucleotide
aatgagttgacgccaagcagatttgcagaaattattcagaag

SEQ ID NO: 260889 - DNA, 41 bp, Artificial Sequence
  Description of Artificial Sequence: Synthetic oligonucleotide
atgagttgacgccaagcagatttgcagaaattattcagaag

SEQ ID NO: 260890 - DNA, 40 bp, Artificial Sequence
  Description of Artificial Sequence: Synthetic oligonucleotide
tgagttgacgccaagcagatttgcagaaattattcagaag

SEQ ID NO: 260891 - DNA, 39 bp, Artificial Sequence
  Description of Artificial Sequence: Synthetic oligonucleotide
gagttgacgccaagcagatttgcagaaattattcagaag

SEQ ID NO: 260892 - DNA, 42 bp, Artificial Sequence
  Description of Artificial Sequence: Synthetic oligonucleotide
agttgacgccaagcagatttgcagaaattattcagaagaatc

SEQ ID NO: 260893 - DNA, 41 bp, Artificial Sequence
  Description of Artificial Sequence: Synthetic oligonucleotide
gttgacgccaagcagatttgcagaaattattcagaagaatc

SEQ ID NO: 260894 - DNA, 42 bp, Artificial Sequence
  Description of Artificial Sequence: Synthetic oligonucleotide
ttgacgccaagcagatttgcagaaattattcagaagaatcac

SEQ ID NO: 260895 - DNA, 41 bp, Artificial Sequence
  Description of Artificial Sequence: Synthetic oligonucleotide
tgacgccaagcagatttgcagaaattattcagaagaatcac

SEQ ID NO: 260896 - DNA, 40 bp, Artificial Sequence
  Description of Artificial Sequence: Synthetic oligonucleotide
gacgccaagcagatttgcagaaattattcagaagaatcac

SEQ ID NO: 260897 - DNA, 44 bp, Artificial Sequence
  Description of Artificial Sequence: Synthetic oligonucleotide
acgccaagcagatttgcagaaattattcagaagaatcacaaaag

SEQ ID NO: 260898 - DNA, 43 bp, Artificial Sequence
  Description of Artificial Sequence: Synthetic oligonucleotide
cgccaagcagatttgcagaaattattcagaagaatcacaaaag

SEQ ID NO: 260899 - DNA, 44 bp, Artificial Sequence
  Description of Artificial Sequence: Synthetic oligonucleotide
gccaagcagatttgcagaaattattcagaagaatcacaaaagtg

SEQ ID NO: 260900 - DNA, 44 bp, Artificial Sequence
  Description of Artificial Sequence: Synthetic oligonucleotide
ccaagcagatttgcagaaattattcagaagaatcacaaaagtgc

SEQ ID NO: 260901 - DNA, 46 bp, Artificial Sequence
  Description of Artificial Sequence: Synthetic oligonucleotide
caagcagatttgcagaaattattcagaagaatcacaaaagtgcaag

SEQ ID NO: 260902 - DNA, 48 bp, Artificial Sequence
  Description of Artificial Sequence: Synthetic oligonucleotide
aagcagatttgcagaaattattcagaagaatcacaaaagtgcaagtag

SEQ ID NO: 260903 - DNA, 47 bp, Artificial Sequence
  Description of Artificial Sequence: Synthetic oligonucleotide
agcagatttgcagaaattattcagaagaatcacaaaagtgcaagtag

SEQ ID NO: 260904 - DNA, 46 bp, Artificial Sequence
  Description of Artificial Sequence: Synthetic oligonucleotide
gcagatttgcagaaattattcagaagaatcacaaaagtgcaagtag

SEQ ID NO: 260905 - DNA, 51 bp, Artificial Sequence
  Description of Artificial Sequence: Synthetic oligonucleotide
cagatttgcagaaattattcagaagaatcacaaaagtgcaagtagtaaatc

SEQ ID NO: 260906 - DNA, 51 bp, Artificial Sequence
  Description of Artificial Sequence: Synthetic oligonucleotide
agatttgcagaaattattcagaagaatcacaaaagtgcaagtagtaaatcc

SEQ ID NO: 260907 - DNA, 50 bp, Artificial Sequence
  Description of Artificial Sequence: Synthetic oligonucleotide
gatttgcagaaattattcagaagaatcacaaaagtgcaagtagtaaatcc

SEQ ID NO: 260908 - DNA, 50 bp, Artificial Sequence
  Description of Artificial Sequence: Synthetic oligonucleotide
atttgcagaaattattcagaagaatcacaaaagtgcaagtagtaaatccg

SEQ ID NO: 260909 - DNA, 49 bp, Artificial Sequence
  Description of Artificial Sequence: Synthetic oligonucleotide
tttgcagaaattattcagaagaatcacaaaagtgcaagtagtaaatccg

SEQ ID NO: 260910 - DNA, 48 bp, Artificial Sequence
  Description of Artificial Sequence: Synthetic oligonucleotide
ttgcagaaattattcagaagaatcacaaaagtgcaagtagtaaatccg

SEQ ID NO: 260911 - DNA, 47 bp, Artificial Sequence
  Description of Artificial Sequence: Synthetic oligonucleotide
tgcagaaattattcagaagaatcacaaaagtgcaagtagtaaatccg

SEQ ID NO: 260912 - DNA, 46 bp, Artificial Sequence
  Description of Artificial Sequence: Synthetic oligonucleotide
gcagaaattattcagaagaatcacaaaagtgcaagtagtaaatccg

SEQ ID NO: 260913 - DNA, 47 bp, Artificial Sequence
  Description of Artificial Sequence: Synthetic oligonucleotide
cagaaattattcagaagaatcacaaaagtgcaagtagtaaatccgag

SEQ ID NO: 260914 - DNA, 47 bp, Artificial Sequence
  Description of Artificial Sequence: Synthetic oligonucleotide
agaaattattcagaagaatcacaaaagtgcaagtagtaaatccgagg

SEQ ID NO: 260915 - DNA, 46 bp, Artificial Sequence
  Description of Artificial Sequence: Synthetic oligonucleotide
gaaattattcagaagaatcacaaaagtgcaagtagtaaatccgagg

SEQ ID NO: 260916 - DNA, 47 bp, Artificial Sequence
  Description of Artificial Sequence: Synthetic oligonucleotide
aaattattcagaagaatcacaaaagtgcaagtagtaaatccgaggtc

SEQ ID NO: 260917 - DNA, 46 bp, Artificial Sequence
  Description of Artificial Sequence: Synthetic oligonucleotide
aattattcagaagaatcacaaaagtgcaagtagtaaatccgaggtc

SEQ ID NO: 260918 - DNA, 45 bp, Artificial Sequence
  Description of Artificial Sequence: Synthetic oligonucleotide
attattcagaagaatcacaaaagtgcaagtagtaaatccgaggtc

SEQ ID NO: 260919 - DNA, 44 bp, Artificial Sequence
  Description of Artificial Sequence: Synthetic oligonucleotide
ttattcagaagaatcacaaaagtgcaagtagtaaatccgaggtc

SEQ ID NO: 260920 - DNA, 43 bp, Artificial Sequence
  Description of Artificial Sequence: Synthetic oligonucleotide
tattcagaagaatcacaaaagtgcaagtagtaaatccgaggtc

SEQ ID NO: 260921 - DNA, 42 bp, Artificial Sequence
  Description of Artificial Sequence: Synthetic oligonucleotide
attcagaagaatcacaaaagtgcaagtagtaaatccgaggtc

SEQ ID NO: 260922 - DNA, 41 bp, Artificial Sequence
  Description of Artificial Sequence: Synthetic oligonucleotide
ttcagaagaatcacaaaagtgcaagtagtaaatccgaggtc

SEQ ID NO: 260923 - DNA, 40 bp, Artificial Sequence
  Description of Artificial Sequence: Synthetic oligonucleotide
tcagaagaatcacaaaagtgcaagtagtaaatccgaggtc

SEQ ID NO: 260924 - DNA, 39 bp, Artificial Sequence
  Description of Artificial Sequence: Synthetic oligonucleotide
cagaagaatcacaaaagtgcaagtagtaaatccgaggtc

SEQ ID NO: 260925 - DNA, 39 bp, Artificial Sequence
  Description of Artificial Sequence: Synthetic oligonucleotide
agaagaatcacaaaagtgcaagtagtaaatccgaggtcc

SEQ ID NO: 260926 - DNA, 38 bp, Artificial Sequence
  Description of Artificial Sequence: Synthetic oligonucleotide
gaagaatcacaaaagtgcaagtagtaaatccgaggtcc

SEQ ID NO: 260927 - DNA, 42 bp, Artificial Sequence
  Description of Artificial Sequence: Synthetic oligonucleotide
aagaatcacaaaagtgcaagtagtaaatccgaggtccttatc

SEQ ID NO: 260928 - DNA, 41 bp, Artificial Sequence
  Description of Artificial Sequence: Synthetic oligonucleotide
agaatcacaaaagtgcaagtagtaaatccgaggtccttatc

SEQ ID NO: 260929 - DNA, 40 bp, Artificial Sequence
  Description of Artificial Sequence: Synthetic oligonucleotide
gaatcacaaaagtgcaagtagtaaatccgaggtccttatc

SEQ ID NO: 260930 - DNA, 41 bp, Artificial Sequence
  Description of Artificial Sequence: Synthetic oligonucleotide
aatcacaaaagtgcaagtagtaaatccgaggtccttatcag

SEQ ID NO: 260931 - DNA, 40 bp, Artificial Sequence
  Description of Artificial Sequence: Synthetic oligonucleotide
atcacaaaagtgcaagtagtaaatccgaggtccttatcag

SEQ ID NO: 260932 - DNA, 39 bp, Artificial Sequence
  Description of Artificial Sequence: Synthetic oligonucleotide
tcacaaaagtgcaagtagtaaatccgaggtccttatcag

SEQ ID NO: 260933 - DNA, 38 bp, Artificial Sequence
  Description of Artificial Sequence: Synthetic oligonucleotide
cacaaaagtgcaagtagtaaatccgaggtccttatcag

SEQ ID NO: 260934 - DNA, 39 bp, Artificial Sequence
  Description of Artificial Sequence: Synthetic oligonucleotide
acaaaagtgcaagtagtaaatccgaggtccttatcagac

SEQ ID NO: 260935 - DNA, 38 bp, Artificial Sequence
  Description of Artificial Sequence: Synthetic oligonucleotide
caaaagtgcaagtagtaaatccgaggtccttatcagac

SEQ ID NO: 260936 - DNA, 38 bp, Artificial Sequence
  Description of Artificial Sequence: Synthetic oligonucleotide
aaaagtgcaagtagtaaatccgaggtccttatcagacc

SEQ ID NO: 260937 - DNA, 37 bp, Artificial Sequence
  Description of Artificial Sequence: Synthetic oligonucleotide
aaagtgcaagtagtaaatccgaggtccttatcagacc

SEQ ID NO: 260938 - DNA, 36 bp, Artificial Sequence
  Description of Artificial Sequence: Synthetic oligonucleotide
aagtgcaagtagtaaatccgaggtccttatcagacc

SEQ ID NO: 260939 - DNA, 35 bp, Artificial Sequence
  Description of Artificial Sequence: Synthetic oligonucleotide
agtgcaagtagtaaatccgaggtccttatcagacc

SEQ ID NO: 260940 - DNA, 34 bp, Artificial Sequence
  Description of Artificial Sequence: Synthetic oligonucleotide
gtgcaagtagtaaatccgaggtccttatcagacc

SEQ ID NO: 260941 - DNA, 34 bp, Artificial Sequence
  Description of Artificial Sequence: Synthetic oligonucleotide
tgcaagtagtaaatccgaggtccttatcagaccg

SEQ ID NO: 260942 - DNA, 33 bp, Artificial Sequence
  Description of Artificial Sequence: Synthetic oligonucleotide
gcaagtagtaaatccgaggtccttatcagaccg

SEQ ID NO: 260943 - DNA, 35 bp, Artificial Sequence
  Description of Artificial Sequence: Synthetic oligonucleotide
caagtagtaaatccgaggtccttatcagaccgaag

SEQ ID NO: 260944 - DNA, 36 bp, Artificial Sequence
  Description of Artificial Sequence: Synthetic oligonucleotide
aagtagtaaatccgaggtccttatcagaccgaagtc

SEQ ID NO: 260945 - DNA, 35 bp, Artificial Sequence
  Description of Artificial Sequence: Synthetic oligonucleotide
agtagtaaatccgaggtccttatcagaccgaagtc

SEQ ID NO: 260946 - DNA, 34 bp, Artificial Sequence
  Description of Artificial Sequence: Synthetic oligonucleotide
gtagtaaatccgaggtccttatcagaccgaagtc

SEQ ID NO: 260947 - DNA, 36 bp, Artificial Sequence
  Description of Artificial Sequence: Synthetic oligonucleotide
tagtaaatccgaggtccttatcagaccgaagtcttg

SEQ ID NO: 260948 - DNA, 35 bp, Artificial Sequence
  Description of Artificial Sequence: Synthetic oligonucleotide
agtaaatccgaggtccttatcagaccgaagtcttg

SEQ ID NO: 260949 - DNA, 34 bp, Artificial Sequence
  Description of Artificial Sequence: Synthetic oligonucleotide
gtaaatccgaggtccttatcagaccgaagtcttg

SEQ ID NO: 260950 - DNA, 34 bp, Artificial Sequence
  Description of Artificial Sequence: Synthetic oligonucleotide
taaatccgaggtccttatcagaccgaagtcttgg

SEQ ID NO: 260951 - DNA, 33 bp, Artificial Sequence
  Description of Artificial Sequence: Synthetic oligonucleotide
aaatccgaggtccttatcagaccgaagtcttgg

SEQ ID NO: 260952 - DNA, 32 bp, Artificial Sequence
  Description of Artificial Sequence: Synthetic oligonucleotide
aatccgaggtccttatcagaccgaagtcttgg

SEQ ID NO: 260953 - DNA, 31 bp, Artificial Sequence
  Description of Artificial Sequence: Synthetic oligonucleotide
atccgaggtccttatcagaccgaagtcttgg

SEQ ID NO: 260954 - DNA, 30 bp, Artificial Sequence
  Description of Artificial Sequence: Synthetic oligonucleotide
tccgaggtccttatcagaccgaagtcttgg

SEQ ID NO: 260955 - DNA, 29 bp, Artificial Sequence
  Description of Artificial Sequence: Synthetic oligonucleotide
ccgaggtccttatcagaccgaagtcttgg

SEQ ID NO: 260956 - DNA, 32 bp, Artificial Sequence
  Description of Artificial Sequence: Synthetic oligonucleotide
cgaggtccttatcagaccgaagtcttggtttg

SEQ ID NO: 260957 - DNA, 33 bp, Artificial Sequence
  Description of Artificial Sequence: Synthetic oligonucleotide
gaggtccttatcagaccgaagtcttggtttgag

SEQ ID NO: 260958 - DNA, 33 bp, Artificial Sequence
  Description of Artificial Sequence: Synthetic oligonucleotide
aggtccttatcagaccgaagtcttggtttgagg

SEQ ID NO: 260959 - DNA, 32 bp, Artificial Sequence
  Description of Artificial Sequence: Synthetic oligonucleotide
ggtccttatcagaccgaagtcttggtttgagg

SEQ ID NO: 260960 - DNA, 34 bp, Artificial Sequence
  Description of Artificial Sequence: Synthetic oligonucleotide
gtccttatcagaccgaagtcttggtttgaggaac

SEQ ID NO: 260961 - DNA, 35 bp, Artificial Sequence
  Description of Artificial Sequence: Synthetic oligonucleotide
tccttatcagaccgaagtcttggtttgaggaactg

SEQ ID NO: 260962 - DNA, 34 bp, Artificial Sequence
  Description of Artificial Sequence: Synthetic oligonucleotide
ccttatcagaccgaagtcttggtttgaggaactg

SEQ ID NO: 260963 - DNA, 34 bp, Artificial Sequence
  Description of Artificial Sequence: Synthetic oligonucleotide
cttatcagaccgaagtcttggtttgaggaactgg

SEQ ID NO: 260964 - DNA, 34 bp, Artificial Sequence
  Description of Artificial Sequence: Synthetic oligonucleotide
ttatcagaccgaagtcttggtttgaggaactggc

SEQ ID NO: 260965 - DNA, 33 bp, Artificial Sequence
  Description of Artificial Sequence: Synthetic oligonucleotide
tatcagaccgaagtcttggtttgaggaactggc

SEQ ID NO: 260966 - DNA, 32 bp, Artificial Sequence
  Description of Artificial Sequence: Synthetic oligonucleotide
atcagaccgaagtcttggtttgaggaactggc

SEQ ID NO: 260967 - DNA, 31 bp, Artificial Sequence
  Description of Artificial Sequence: Synthetic oligonucleotide
tcagaccgaagtcttggtttgaggaactggc

SEQ ID NO: 260968 - DNA, 30 bp, Artificial Sequence
  Description of Artificial Sequence: Synthetic oligonucleotide
cagaccgaagtcttggtttgaggaactggc

SEQ ID NO: 260969 - DNA, 33 bp, Artificial Sequence
  Description of Artificial Sequence: Synthetic oligonucleotide
agaccgaagtcttggtttgaggaactggcaatg

SEQ ID NO: 260970 - DNA, 32 bp, Artificial Sequence
  Description of Artificial Sequence: Synthetic oligonucleotide
gaccgaagtcttggtttgaggaactggcaatg

SEQ ID NO: 260971 - DNA, 32 bp, Artificial Sequence
  Description of Artificial Sequence: Synthetic oligonucleotide
accgaagtcttggtttgaggaactggcaatgg

SEQ ID NO: 260972 - DNA, 31 bp, Artificial Sequence
  Description of Artificial Sequence: Synthetic oligonucleotide
ccgaagtcttggtttgaggaactggcaatgg

SEQ ID NO: 260973 - DNA, 31 bp, Artificial Sequence
  Description of Artificial Sequence: Synthetic oligonucleotide
cgaagtcttggtttgaggaactggcaatggg

SEQ ID NO: 260974 - DNA, 33 bp, Artificial Sequence
  Description of Artificial Sequence: Synthetic oligonucleotide
gaagtcttggtttgaggaactggcaatgggttc

SEQ ID NO: 260975 - DNA, 36 bp, Artificial Sequence
  Description of Artificial Sequence: Synthetic oligonucleotide
aagtcttggtttgaggaactggcaatgggttcattc

SEQ ID NO: 260976 - DNA, 35 bp, Artificial Sequence
  Description of Artificial Sequence: Synthetic oligonucleotide
agtcttggtttgaggaactggcaatgggttcattc

SEQ ID NO: 260977 - DNA, 34 bp, Artificial Sequence
  Description of Artificial Sequence: Synthetic oligonucleotide
gtcttggtttgaggaactggcaatgggttcattc

SEQ ID NO: 260978 - DNA, 34 bp, Artificial Sequence
  Description of Artificial Sequence: Synthetic oligonucleotide
tcttggtttgaggaactggcaatgggttcattcc

SEQ ID NO: 260979 - DNA, 33 bp, Artificial Sequence
  Description of Artificial Sequence: Synthetic oligonucleotide
cttggtttgaggaactggcaatgggttcattcc

SEQ ID NO: 260980 - DNA, 34 bp, Artificial Sequence
  Description of Artificial Sequence: Synthetic oligonucleotide
ttggtttgaggaactggcaatgggttcattcctc

SEQ ID NO: 260981 - DNA, 33 bp, Artificial Sequence
  Description of Artificial Sequence: Synthetic oligonucleotide
tggtttgaggaactggcaatgggttcattcctc

SEQ ID NO: 260982 - DNA, 32 bp, Artificial Sequence
  Description of Artificial Sequence: Synthetic oligonucleotide
ggtttgaggaactggcaatgggttcattcctc

SEQ ID NO: 260983 - DNA, 33 bp, Artificial Sequence
  Description of Artificial Sequence: Synthetic oligonucleotide
gtttgaggaactggcaatgggttcattcctctg

SEQ ID NO: 260984 - DNA, 34 bp, Artificial Sequence
  Description of Artificial Sequence: Synthetic oligonucleotide
tttgaggaactggcaatgggttcattcctctgtg

SEQ ID NO: 260985 - DNA, 33 bp, Artificial Sequence
  Description of Artificial Sequence: Synthetic oligonucleotide
ttgaggaactggcaatgggttcattcctctgtg

SEQ ID NO: 260986 - DNA, 32 bp, Artificial Sequence
  Description of Artificial Sequence: Synthetic oligonucleotide
tgaggaactggcaatgggttcattcctctgtg

SEQ ID NO: 260987 - DNA, 31 bp, Artificial Sequence
  Description of Artificial Sequence: Synthetic oligonucleotide
gaggaactggcaatgggttcattcctctgtg

SEQ ID NO: 260988 - DNA, 32 bp, Artificial Sequence
  Description of Artificial Sequence: Synthetic oligonucleotide
aggaactggcaatgggttcattcctctgtgtg

SEQ ID NO: 260989 - DNA, 31 bp, Artificial Sequence
  Description of Artificial Sequence: Synthetic oligonucleotide
ggaactggcaatgggttcattcctctgtgtg

SEQ ID NO: 260990 - DNA, 31 bp, Artificial Sequence
  Description of Artificial Sequence: Synthetic oligonucleotide
gaactggcaatgggttcattcctctgtgtgg

SEQ ID NO: 260991 - DNA, 31 bp, Artificial Sequence
  Description of Artificial Sequence: Synthetic oligonucleotide
aactggcaatgggttcattcctctgtgtggc

SEQ ID NO: 260992 - DNA, 30 bp, Artificial Sequence
  Description of Artificial Sequence: Synthetic oligonucleotide
actggcaatgggttcattcctctgtgtggc

SEQ ID NO: 260993 - DNA, 29 bp, Artificial Sequence
  Description of Artificial Sequence: Synthetic oligonucleotide
ctggcaatgggttcattcctctgtgtggc

SEQ ID NO: 260994 - DNA, 29 bp, Artificial Sequence
  Description of Artificial Sequence: Synthetic oligonucleotide
tggcaatgggttcattcctctgtgtggcc

SEQ ID NO: 260995 - DNA, 28 bp, Artificial Sequence
  Description of Artificial Sequence: Synthetic oligonucleotide
ggcaatgggttcattcctctgtgtggcc

SEQ ID NO: 260996 - DNA, 31 bp, Artificial Sequence
  Description of Artificial Sequence: Synthetic oligonucleotide
gcaatgggttcattcctctgtgtggccatag

SEQ ID NO: 260997 - DNA, 31 bp, Artificial Sequence
  Description of Artificial Sequence: Synthetic oligonucleotide
caatgggttcattcctctgtgtggccatagg

SEQ ID NO: 260998 - DNA, 33 bp, Artificial Sequence
  Description of Artificial Sequence: Synthetic oligonucleotide
aatgggttcattcctctgtgtggccataggatc

SEQ ID NO: 260999 - DNA, 32 bp, Artificial Sequence
  Description of Artificial Sequence: Synthetic oligonucleotide
atgggttcattcctctgtgtggccataggatc

SEQ ID NO: 261000 - DNA, 31 bp, Artificial Sequence
  Description of Artificial Sequence: Synthetic oligonucleotide
tgggttcattcctctgtgtggccataggatc

SEQ ID NO: 261001 - DNA, 30 bp, Artificial Sequence
  Description of Artificial Sequence: Synthetic oligonucleotide
gggttcattcctctgtgtggccataggatc

SEQ ID NO: 261002 - DNA, 31 bp, Artificial Sequence
  Description of Artificial Sequence: Synthetic oligonucleotide
ggttcattcctctgtgtggccataggatctg

SEQ ID NO: 261003 - DNA, 32 bp, Artificial Sequence
  Description of Artificial Sequence: Synthetic oligonucleotide
gttcattcctctgtgtggccataggatctgag

SEQ ID NO: 261004 - DNA, 32 bp, Artificial Sequence
  Description of Artificial Sequence: Synthetic oligonucleotide
ttcattcctctgtgtggccataggatctgagg

SEQ ID NO: 261005 - DNA, 31 bp, Artificial Sequence
  Description of Artificial Sequence: Synthetic oligonucleotide
tcattcctctgtgtggccataggatctgagg

SEQ ID NO: 261006 - DNA, 30 bp, Artificial Sequence
  Description of Artificial Sequence: Synthetic oligonucleotide
cattcctctgtgtggccataggatctgagg

SEQ ID NO: 261007 - DNA, 31 bp, Artificial Sequence
  Description of Artificial Sequence: Synthetic oligonucleotide
attcctctgtgtggccataggatctgaggag

SEQ ID NO: 261008 - DNA, 30 bp, Artificial Sequence
  Description of Artificial Sequence: Synthetic oligonucleotide
ttcctctgtgtggccataggatctgaggag

SEQ ID NO: 261009 - DNA, 29 bp, Artificial Sequence
  Description of Artificial Sequence: Synthetic oligonucleotide
tcctctgtgtggccataggatctgaggag

SEQ ID NO: 261010 - DNA, 28 bp, Artificial Sequence
  Description of Artificial Sequence: Synthetic oligonucleotide
cctctgtgtggccataggatctgaggag

SEQ ID NO: 261011 - DNA, 28 bp, Artificial Sequence
  Description of Artificial Sequence: Synthetic oligonucleotide
ctctgtgtggccataggatctgaggagc

SEQ ID NO: 261012 - DNA, 28 bp, Artificial Sequence
  Description of Artificial Sequence: Synthetic oligonucleotide
tctgtgtggccataggatctgaggagcc

SEQ ID NO: 261013 - DNA, 27 bp, Artificial Sequence
  Description of Artificial Sequence: Synthetic oligonucleotide
ctgtgtggccataggatctgaggagcc

SEQ ID NO: 261014 - DNA, 27 bp, Artificial Sequence
  Description of Artificial Sequence: Synthetic oligonucleotide
tgtgtggccataggatctgaggagccc

SEQ ID NO: 261015 - DNA, 26 bp, Artificial Sequence
  Description of Artificial Sequence: Synthetic oligonucleotide
gtgtggccataggatctgaggagccc

SEQ ID NO: 261016 - DNA, 26 bp, Artificial Sequence
  Description of Artificial Sequence: Synthetic oligonucleotide
tgtggccataggatctgaggagcccc

SEQ ID NO: 261017 - DNA, 25 bp, Artificial Sequence
  Description of Artificial Sequence: Synthetic oligonucleotide
gtggccataggatctgaggagcccc

SEQ ID NO: 261018 - DNA, 26 bp, Artificial Sequence
  Description of Artificial Sequence: Synthetic oligonucleotide
tggccataggatctgaggagccccca

SEQ ID NO: 261019 - DNA, 25 bp, Artificial Sequence
  Description of Artificial Sequence: Synthetic oligonucleotide
ggccataggatctgaggagccccca

SEQ ID NO: 261020 - DNA, 26 bp, Artificial Sequence
  Description of Artificial Sequence: Synthetic oligonucleotide
gccataggatctgaggagcccccact

SEQ ID NO: 261021 - DNA, 27 bp, Artificial Sequence
  Description of Artificial Sequence: Synthetic oligonucleotide
ccataggatctgaggagcccccactct

SEQ ID NO: 261022 - DNA, 28 bp, Artificial Sequence
  Description of Artificial Sequence: Synthetic oligonucleotide
cataggatctgaggagcccccactcttc

SEQ ID NO: 261023 - DNA, 30 bp, Artificial Sequence
  Description of Artificial Sequence: Synthetic oligonucleotide
ataggatctgaggagcccccactcttcttg

SEQ ID NO: 261024 - DNA, 29 bp, Artificial Sequence
  Description of Artificial Sequence: Synthetic oligonucleotide
taggatctgaggagcccccactcttcttg

SEQ ID NO: 261025 - DNA, 28 bp, Artificial Sequence
  Description of Artificial Sequence: Synthetic oligonucleotide
aggatctgaggagcccccactcttcttg

SEQ ID NO: 261026 - DNA, 27 bp, Artificial Sequence
  Description of Artificial Sequence: Synthetic oligonucleotide
ggatctgaggagcccccactcttcttg

SEQ ID NO: 261027 - DNA, 27 bp, Artificial Sequence
  Description of Artificial Sequence: Synthetic oligonucleotide
gatctgaggagcccccactcttcttgg

SEQ ID NO: 261028 - DNA, 32 bp, Artificial Sequence
  Description of Artificial Sequence: Synthetic oligonucleotide
atctgaggagcccccactcttcttggtaattc

SEQ ID NO: 261029 - DNA, 31 bp, Artificial Sequence
  Description of Artificial Sequence: Synthetic oligonucleotide
tctgaggagcccccactcttcttggtaattc

SEQ ID NO: 261030 - DNA, 30 bp, Artificial Sequence
  Description of Artificial Sequence: Synthetic oligonucleotide
ctgaggagcccccactcttcttggtaattc

SEQ ID NO: 261031 - DNA, 31 bp, Artificial Sequence
  Description of Artificial Sequence: Synthetic oligonucleotide
tgaggagcccccactcttcttggtaattcac

SEQ ID NO: 261032 - DNA, 30 bp, Artificial Sequence
  Description of Artificial Sequence: Synthetic oligonucleotide
gaggagcccccactcttcttggtaattcac

SEQ ID NO: 261033 - DNA, 32 bp, Artificial Sequence
  Description of Artificial Sequence: Synthetic oligonucleotide
aggagcccccactcttcttggtaattcactag

SEQ ID NO: 261034 - DNA, 31 bp, Artificial Sequence
  Description of Artificial Sequence: Synthetic oligonucleotide
ggagcccccactcttcttggtaattcactag

SEQ ID NO: 261035 - DNA, 34 bp, Artificial Sequence
  Description of Artificial Sequence: Synthetic oligonucleotide
gagcccccactcttcttggtaattcactagaaag

SEQ ID NO: 261036 - DNA, 34 bp, Artificial Sequence
  Description of Artificial Sequence: Synthetic oligonucleotide
agcccccactcttcttggtaattcactagaaagg

SEQ ID NO: 261037 - DNA, 33 bp, Artificial Sequence
  Description of Artificial Sequence: Synthetic oligonucleotide
gcccccactcttcttggtaattcactagaaagg

SEQ ID NO: 261038 - DNA, 33 bp, Artificial Sequence
  Description of Artificial Sequence: Synthetic oligonucleotide
cccccactcttcttggtaattcactagaaaggc

SEQ ID NO: 261039 - DNA, 34 bp, Artificial Sequence
  Description of Artificial Sequence: Synthetic oligonucleotide
ccccactcttcttggtaattcactagaaaggcag

SEQ ID NO: 261040 - DNA, 34 bp, Artificial Sequence
  Description of Artificial Sequence: Synthetic oligonucleotide
cccactcttcttggtaattcactagaaaggcagc

SEQ ID NO: 261041 - DNA, 34 bp, Artificial Sequence
  Description of Artificial Sequence: Synthetic oligonucleotide
ccactcttcttggtaattcactagaaaggcagcg

SEQ ID NO: 261042 - DNA, 34 bp, Artificial Sequence
  Description of Artificial Sequence: Synthetic oligonucleotide
cactcttcttggtaattcactagaaaggcagcgc

SEQ ID NO: 261043 - DNA, 34 bp, Artificial Sequence
  Description of Artificial Sequence: Synthetic oligonucleotide
actcttcttggtaattcactagaaaggcagcgcc

SEQ ID NO: 261044 - DNA, 33 bp, Artificial Sequence
  Description of Artificial Sequence: Synthetic oligonucleotide
ctcttcttggtaattcactagaaaggcagcgcc

SEQ ID NO: 261045 - DNA, 36 bp, Artificial Sequence
  Description of Artificial Sequence: Synthetic oligonucleotide
tcttcttggtaattcactagaaaggcagcgccaatg

SEQ ID NO: 261046 - DNA, 35 bp, Artificial Sequence
  Description of Artificial Sequence: Synthetic oligonucleotide
cttcttggtaattcactagaaaggcagcgccaatg

SEQ ID NO: 261047 - DNA, 35 bp, Artificial Sequence
  Description of Artificial Sequence: Synthetic oligonucleotide
ttcttggtaattcactagaaaggcagcgccaatgc

SEQ ID NO: 261048 - DNA, 34 bp, Artificial Sequence
  Description of Artificial Sequence: Synthetic oligonucleotide
tcttggtaattcactagaaaggcagcgccaatgc

SEQ ID NO: 261049 - DNA, 33 bp, Artificial Sequence
  Description of Artificial Sequence: Synthetic oligonucleotide
cttggtaattcactagaaaggcagcgccaatgc

SEQ ID NO: 261050 - DNA, 36 bp, Artificial Sequence
  Description of Artificial Sequence: Synthetic oligonucleotide
ttggtaattcactagaaaggcagcgccaatgcaatc

SEQ ID NO: 261051 - DNA, 35 bp, Artificial Sequence
  Description of Artificial Sequence: Synthetic oligonucleotide
tggtaattcactagaaaggcagcgccaatgcaatc

SEQ ID NO: 261052 - DNA, 34 bp, Artificial Sequence
  Description of Artificial Sequence: Synthetic oligonucleotide
ggtaattcactagaaaggcagcgccaatgcaatc

SEQ ID NO: 261053 - DNA, 34 bp, Artificial Sequence
  Description of Artificial Sequence: Synthetic oligonucleotide
gtaattcactagaaaggcagcgccaatgcaatcg

SEQ ID NO: 261054 - DNA, 36 bp, Artificial Sequence
  Description of Artificial Sequence: Synthetic oligonucleotide
taattcactagaaaggcagcgccaatgcaatcgaac

SEQ ID NO: 261055 - DNA, 35 bp, Artificial Sequence
  Description of Artificial Sequence: Synthetic oligonucleotide
aattcactagaaaggcagcgccaatgcaatcgaac

SEQ ID NO: 261056 - DNA, 34 bp, Artificial Sequence
  Description of Artificial Sequence: Synthetic oligonucleotide
attcactagaaaggcagcgccaatgcaatcgaac

SEQ ID NO: 261057 - DNA, 33 bp, Artificial Sequence
  Description of Artificial Sequence: Synthetic oligonucleotide
ttcactagaaaggcagcgccaatgcaatcgaac

SEQ ID NO: 261058 - DNA, 32 bp, Artificial Sequence
  Description of Artificial Sequence: Synthetic oligonucleotide
tcactagaaaggcagcgccaatgcaatcgaac

SEQ ID NO: 261059 - DNA, 31 bp, Artificial Sequence
  Description of Artificial Sequence: Synthetic oligonucleotide
cactagaaaggcagcgccaatgcaatcgaac

SEQ ID NO: 261060 - DNA, 31 bp, Artificial Sequence
  Description of Artificial Sequence: Synthetic oligonucleotide
actagaaaggcagcgccaatgcaatcgaacc

SEQ ID NO: 261061 - DNA, 30 bp, Artificial Sequence
  Description of Artificial Sequence: Synthetic oligonucleotide
ctagaaaggcagcgccaatgcaatcgaacc

SEQ ID NO: 261062 - DNA, 31 bp, Artificial Sequence
  Description of Artificial Sequence: Synthetic oligonucleotide
tagaaaggcagcgccaatgcaatcgaaccac

SEQ ID NO: 261063 - DNA, 30 bp, Artificial Sequence
  Description of Artificial Sequence: Synthetic oligonucleotide
agaaaggcagcgccaatgcaatcgaaccac

SEQ ID NO: 261064 - DNA, 29 bp, Artificial Sequence
  Description of Artificial Sequence: Synthetic oligonucleotide
gaaaggcagcgccaatgcaatcgaaccac

SEQ ID NO: 261065 - DNA, 29 bp, Artificial Sequence
  Description of Artificial Sequence: Synthetic oligonucleotide
aaaggcagcgccaatgcaatcgaaccacc

SEQ ID NO: 261066 - DNA, 28 bp, Artificial Sequence
  Description of Artificial Sequence: Synthetic oligonucleotide
aaggcagcgccaatgcaatcgaaccacc

SEQ ID NO: 261067 - DNA, 27 bp, Artificial Sequence
  Description of Artificial Sequence: Synthetic oligonucleotide
aggcagcgccaatgcaatcgaaccacc

SEQ ID NO: 261068 - DNA, 26 bp, Artificial Sequence
  Description of Artificial Sequence: Synthetic oligonucleotide
ggcagcgccaatgcaatcgaaccacc

SEQ ID NO: 261069 - DNA, 26 bp, Artificial Sequence
  Description of Artificial Sequence: Synthetic oligonucleotide
gcagcgccaatgcaatcgaaccaccg

SEQ ID NO: 261070 - DNA, 27 bp, Artificial Sequence
  Description of Artificial Sequence: Synthetic oligonucleotide
cagcgccaatgcaatcgaaccaccgct

SEQ ID NO: 261071 - DNA, 27 bp, Artificial Sequence
  Description of Artificial Sequence: Synthetic oligonucleotide
agcgccaatgcaatcgaaccaccgctg

SEQ ID NO: 261072 - DNA, 26 bp, Artificial Sequence
  Description of Artificial Sequence: Synthetic oligonucleotide
gcgccaatgcaatcgaaccaccgctg

SEQ ID NO: 261073 - DNA, 27 bp, Artificial Sequence
  Description of Artificial Sequence: Synthetic oligonucleotide
cgccaatgcaatcgaaccaccgctggt

SEQ ID NO: 261074 - DNA, 27 bp, Artificial Sequence
  Description of Artificial Sequence: Synthetic oligonucleotide
gccaatgcaatcgaaccaccgctggtg

SEQ ID NO: 261075 - DNA, 30 bp, Artificial Sequence
  Description of Artificial Sequence: Synthetic oligonucleotide
ccaatgcaatcgaaccaccgctggtgtttc

SEQ ID NO: 261076 - DNA, 32 bp, Artificial Sequence
  Description of Artificial Sequence: Synthetic oligonucleotide
caatgcaatcgaaccaccgctggtgtttcttg

SEQ ID NO: 261077 - DNA, 32 bp, Artificial Sequence
  Description of Artificial Sequence: Synthetic oligonucleotide
aatgcaatcgaaccaccgctggtgtttcttgg

SEQ ID NO: 261078 - DNA, 31 bp, Artificial Sequence
  Description of Artificial Sequence: Synthetic oligonucleotide
atgcaatcgaaccaccgctggtgtttcttgg

SEQ ID NO: 261079 - DNA, 30 bp, Artificial Sequence
  Description of Artificial Sequence: Synthetic oligonucleotide
tgcaatcgaaccaccgctggtgtttcttgg

SEQ ID NO: 261080 - DNA, 29 bp, Artificial Sequence
  Description of Artificial Sequence: Synthetic oligonucleotide
gcaatcgaaccaccgctggtgtttcttgg

SEQ ID NO: 261081 - DNA, 29 bp, Artificial Sequence
  Description of Artificial Sequence: Synthetic oligonucleotide
caatcgaaccaccgctggtgtttcttggg

SEQ ID NO: 261082 - DNA, 32 bp, Artificial Sequence
  Description of Artificial Sequence: Synthetic oligonucleotide
aatcgaaccaccgctggtgtttcttgggaaag

SEQ ID NO: 261083 - DNA, 31 bp, Artificial Sequence
  Description of Artificial Sequence: Synthetic oligonucleotide
atcgaaccaccgctggtgtttcttgggaaag

SEQ ID NO: 261084 - DNA, 30 bp, Artificial Sequence
  Description of Artificial Sequence: Synthetic oligonucleotide
tcgaaccaccgctggtgtttcttgggaaag

SEQ ID NO: 261085 - DNA, 29 bp, Artificial Sequence
  Description of Artificial Sequence: Synthetic oligonucleotide
cgaaccaccgctggtgtttcttgggaaag

SEQ ID NO: 261086 - DNA, 29 bp, Artificial Sequence
  Description of Artificial Sequence: Synthetic oligonucleotide
gaaccaccgctggtgtttcttgggaaagc

SEQ ID NO: 261087 - DNA, 34 bp, Artificial Sequence
  Description of Artificial Sequence: Synthetic oligonucleotide
aaccaccgctggtgtttcttgggaaagcaattac

SEQ ID NO: 261088 - DNA, 33 bp, Artificial Sequence
  Description of Artificial Sequence: Synthetic oligonucleotide
accaccgctggtgtttcttgggaaagcaattac

SEQ ID NO: 261089 - DNA, 32 bp, Artificial Sequence
  Description of Artificial Sequence: Synthetic oligonucleotide
ccaccgctggtgtttcttgggaaagcaattac

SEQ ID NO: 261090 - DNA, 32 bp, Artificial Sequence
  Description of Artificial Sequence: Synthetic oligonucleotide
caccgctggtgtttcttgggaaagcaattacc

SEQ ID NO: 261091 - DNA, 35 bp, Artificial Sequence
  Description of Artificial Sequence: Synthetic oligonucleotide
accgctggtgtttcttgggaaagcaattaccttag

SEQ ID NO: 261092 - DNA, 34 bp, Artificial Sequence
  Description of Artificial Sequence: Synthetic oligonucleotide
ccgctggtgtttcttgggaaagcaattaccttag

SEQ ID NO: 261093 - DNA, 35 bp, Artificial Sequence
  Description of Artificial Sequence: Synthetic oligonucleotide
cgctggtgtttcttgggaaagcaattaccttagac

SEQ ID NO: 261094 - DNA, 36 bp, Artificial Sequence
  Description of Artificial Sequence: Synthetic oligonucleotide
gctggtgtttcttgggaaagcaattaccttagacag

SEQ ID NO: 261095 - DNA, 37 bp, Artificial Sequence
  Description of Artificial Sequence: Synthetic oligonucleotide
ctggtgtttcttgggaaagcaattaccttagacagtg

SEQ ID NO: 261096 - DNA, 37 bp, Artificial Sequence
  Description of Artificial Sequence: Synthetic oligonucleotide
tggtgtttcttgggaaagcaattaccttagacagtgg

SEQ ID NO: 261097 - DNA, 36 bp, Artificial Sequence
  Description of Artificial Sequence: Synthetic oligonucleotide
ggtgtttcttgggaaagcaattaccttagacagtgg

SEQ ID NO: 261098 - DNA, 37 bp, Artificial Sequence
  Description of Artificial Sequence: Synthetic oligonucleotide
gtgtttcttgggaaagcaattaccttagacagtggtc

SEQ ID NO: 261099 - DNA, 37 bp, Artificial Sequence
  Description of Artificial Sequence: Synthetic oligonucleotide
tgtttcttgggaaagcaattaccttagacagtggtcg

SEQ ID NO: 261100 - DNA, 36 bp, Artificial Sequence
  Description of Artificial Sequence: Synthetic oligonucleotide
gtttcttgggaaagcaattaccttagacagtggtcg

SEQ ID NO: 261101 - DNA, 39 bp, Artificial Sequence
  Description of Artificial Sequence: Synthetic oligonucleotide
tttcttgggaaagcaattaccttagacagtggtcgtatc

SEQ ID NO: 261102 - DNA, 38 bp, Artificial Sequence
  Description of Artificial Sequence: Synthetic oligonucleotide
ttcttgggaaagcaattaccttagacagtggtcgtatc

SEQ ID NO: 261103 - DNA, 37 bp, Artificial Sequence
  Description of Artificial Sequence: Synthetic oligonucleotide
tcttgggaaagcaattaccttagacagtggtcgtatc

SEQ ID NO: 261104 - DNA, 36 bp, Artificial Sequence
  Description of Artificial Sequence: Synthetic oligonucleotide
cttgggaaagcaattaccttagacagtggtcgtatc

SEQ ID NO: 261105 - DNA, 37 bp, Artificial Sequence
  Description of Artificial Sequence: Synthetic oligonucleotide
ttgggaaagcaattaccttagacagtggtcgtatctc

SEQ ID NO: 261106 - DNA, 36 bp, Artificial Sequence
  Description of Artificial Sequence: Synthetic oligonucleotide
tgggaaagcaattaccttagacagtggtcgtatctc

SEQ ID NO: 261107 - DNA, 35 bp, Artificial Sequence
  Description of Artificial Sequence: Synthetic oligonucleotide
gggaaagcaattaccttagacagtggtcgtatctc

SEQ ID NO: 261108 - DNA, 35 bp, Artificial Sequence
  Description of Artificial Sequence: Synthetic oligonucleotide
ggaaagcaattaccttagacagtggtcgtatctcc

SEQ ID NO: 261109 - DNA, 37 bp, Artificial Sequence
  Description of Artificial Sequence: Synthetic oligonucleotide
gaaagcaattaccttagacagtggtcgtatctccaac

SEQ ID NO: 261110 - DNA, 39 bp, Artificial Sequence
  Description of Artificial Sequence: Synthetic oligonucleotide
aaagcaattaccttagacagtggtcgtatctccaacaag

SEQ ID NO: 261111 - DNA, 38 bp, Artificial Sequence
  Description of Artificial Sequence: Synthetic oligonucleotide
aagcaattaccttagacagtggtcgtatctccaacaag

SEQ ID NO: 261112 - DNA, 37 bp, Artificial Sequence
  Description of Artificial Sequence: Synthetic oligonucleotide
agcaattaccttagacagtggtcgtatctccaacaag

SEQ ID NO: 261113 - DNA, 36 bp, Artificial Sequence
  Description of Artificial Sequence: Synthetic oligonucleotide
gcaattaccttagacagtggtcgtatctccaacaag

SEQ ID NO: 261114 - DNA, 36 bp, Artificial Sequence
  Description of Artificial Sequence: Synthetic oligonucleotide
caattaccttagacagtggtcgtatctccaacaagg

SEQ ID NO: 261115 - DNA, 36 bp, Artificial Sequence
  Description of Artificial Sequence: Synthetic oligonucleotide
aattaccttagacagtggtcgtatctccaacaaggc

SEQ ID NO: 261116 - DNA, 35 bp, Artificial Sequence
  Description of Artificial Sequence: Synthetic oligonucleotide
attaccttagacagtggtcgtatctccaacaaggc

SEQ ID NO: 261117 - DNA, 34 bp, Artificial Sequence
  Description of Artificial Sequence: Synthetic oligonucleotide
ttaccttagacagtggtcgtatctccaacaaggc

SEQ ID NO: 261118 - DNA, 33 bp, Artificial Sequence
  Description of Artificial Sequence: Synthetic oligonucleotide
taccttagacagtggtcgtatctccaacaaggc

SEQ ID NO: 261119 - DNA, 32 bp, Artificial Sequence
  Description of Artificial Sequence: Synthetic oligonucleotide
accttagacagtggtcgtatctccaacaaggc

SEQ ID NO: 261120 - DNA, 31 bp, Artificial Sequence
  Description of Artificial Sequence: Synthetic oligonucleotide
ccttagacagtggtcgtatctccaacaaggc

SEQ ID NO: 261121 - DNA, 33 bp, Artificial Sequence
  Description of Artificial Sequence: Synthetic oligonucleotide
cttagacagtggtcgtatctccaacaaggcttc

SEQ ID NO: 261122 - DNA, 34 bp, Artificial Sequence
  Description of Artificial Sequence: Synthetic oligonucleotide
ttagacagtggtcgtatctccaacaaggcttcag

SEQ ID NO: 261123 - DNA, 33 bp, Artificial Sequence
  Description of Artificial Sequence: Synthetic oligonucleotide
tagacagtggtcgtatctccaacaaggcttcag

SEQ ID NO: 261124 - DNA, 32 bp, Artificial Sequence
  Description of Artificial Sequence: Synthetic oligonucleotide
agacagtggtcgtatctccaacaaggcttcag

SEQ ID NO: 261125 - DNA, 31 bp, Artificial Sequence
  Description of Artificial Sequence: Synthetic oligonucleotide
gacagtggtcgtatctccaacaaggcttcag

SEQ ID NO: 261126 - DNA, 31 bp, Artificial Sequence
  Description of Artificial Sequence: Synthetic oligonucleotide
acagtggtcgtatctccaacaaggcttcagc

SEQ ID NO: 261127 - DNA, 30 bp, Artificial Sequence
  Description of Artificial Sequence: Synthetic oligonucleotide
cagtggtcgtatctccaacaaggcttcagc

SEQ ID NO: 261128 - DNA, 36 bp, Artificial Sequence
  Description of Artificial Sequence: Synthetic oligonucleotide
agtggtcgtatctccaacaaggcttcagcaaatatg

SEQ ID NO: 261129 - DNA, 35 bp, Artificial Sequence
  Description of Artificial Sequence: Synthetic oligonucleotide
gtggtcgtatctccaacaaggcttcagcaaatatg

SEQ ID NO: 261130 - DNA, 35 bp, Artificial Sequence
  Description of Artificial Sequence: Synthetic oligonucleotide
tggtcgtatctccaacaaggcttcagcaaatatgc

SEQ ID NO: 261131 - DNA, 34 bp, Artificial Sequence
  Description of Artificial Sequence: Synthetic oligonucleotide
ggtcgtatctccaacaaggcttcagcaaatatgc

SEQ ID NO: 261132 - DNA, 35 bp, Artificial Sequence
  Description of Artificial Sequence: Synthetic oligonucleotide
gtcgtatctccaacaaggcttcagcaaatatgcac

SEQ ID NO: 261133 - DNA, 35 bp, Artificial Sequence
  Description of Artificial Sequence: Synthetic oligonucleotide
tcgtatctccaacaaggcttcagcaaatatgcacc

SEQ ID NO: 261134 - DNA, 34 bp, Artificial Sequence
  Description of Artificial Sequence: Synthetic oligonucleotide
cgtatctccaacaaggcttcagcaaatatgcacc

SEQ ID NO: 261135 - DNA, 35 bp, Artificial Sequence
  Description of Artificial Sequence: Synthetic oligonucleotide
gtatctccaacaaggcttcagcaaatatgcacctc

SEQ ID NO: 261136 - DNA, 37 bp, Artificial Sequence
  Description of Artificial Sequence: Synthetic oligonucleotide
tatctccaacaaggcttcagcaaatatgcacctcatg

SEQ ID NO: 261137 - DNA, 36 bp, Artificial Sequence
  Description of Artificial Sequence: Synthetic oligonucleotide
atctccaacaaggcttcagcaaatatgcacctcatg

SEQ ID NO: 261138 - DNA, 35 bp, Artificial Sequence
  Description of Artificial Sequence: Synthetic oligonucleotide
tctccaacaaggcttcagcaaatatgcacctcatg

SEQ ID NO: 261139 - DNA, 34 bp, Artificial Sequence
  Description of Artificial Sequence: Synthetic oligonucleotide
ctccaacaaggcttcagcaaatatgcacctcatg

SEQ ID NO: 261140 - DNA, 35 bp, Artificial Sequence
  Description of Artificial Sequence: Synthetic oligonucleotide
tccaacaaggcttcagcaaatatgcacctcatgac

SEQ ID NO: 261141 - DNA, 34 bp, Artificial Sequence
  Description of Artificial Sequence: Synthetic oligonucleotide
ccaacaaggcttcagcaaatatgcacctcatgac

SEQ ID NO: 261142 - DNA, 34 bp, Artificial Sequence
  Description of Artificial Sequence: Synthetic oligonucleotide
caacaaggcttcagcaaatatgcacctcatgacg

SEQ ID NO: 261143 - DNA, 34 bp, Artificial Sequence
  Description of Artificial Sequence: Synthetic oligonucleotide
aacaaggcttcagcaaatatgcacctcatgacgg

SEQ ID NO: 261144 - DNA, 33 bp, Artificial Sequence
  Description of Artificial Sequence: Synthetic oligonucleotide
acaaggcttcagcaaatatgcacctcatgacgg

SEQ ID NO: 261145 - DNA, 32 bp, Artificial Sequence
  Description of Artificial Sequence: Synthetic oligonucleotide
caaggcttcagcaaatatgcacctcatgacgg

SEQ ID NO: 261146 - DNA, 32 bp, Artificial Sequence
  Description of Artificial Sequence: Synthetic oligonucleotide
aaggcttcagcaaatatgcacctcatgacggc

SEQ ID NO: 261147 - DNA, 31 bp, Artificial Sequence
  Description of Artificial Sequence: Synthetic oligonucleotide
aggcttcagcaaatatgcacctcatgacggc

SEQ ID NO: 261148 - DNA, 30 bp, Artificial Sequence
  Description of Artificial Sequence: Synthetic oligonucleotide
ggcttcagcaaatatgcacctcatgacggc

SEQ ID NO: 261149 - DNA, 31 bp, Artificial Sequence
  Description of Artificial Sequence: Synthetic oligonucleotide
gcttcagcaaatatgcacctcatgacggctg

SEQ ID NO: 261150 - DNA, 32 bp, Artificial Sequence
  Description of Artificial Sequence: Synthetic oligonucleotide
cttcagcaaatatgcacctcatgacggctgac

SEQ ID NO: 261151 - DNA, 34 bp, Artificial Sequence
  Description of Artificial Sequence: Synthetic oligonucleotide
ttcagcaaatatgcacctcatgacggctgacatc

SEQ ID NO: 261152 - DNA, 33 bp, Artificial Sequence
  Description of Artificial Sequence: Synthetic oligonucleotide
tcagcaaatatgcacctcatgacggctgacatc

SEQ ID NO: 261153 - DNA, 32 bp, Artificial Sequence
  Description of Artificial Sequence: Synthetic oligonucleotide
cagcaaatatgcacctcatgacggctgacatc

SEQ ID NO: 261154 - DNA, 32 bp, Artificial Sequence
  Description of Artificial Sequence: Synthetic oligonucleotide
agcaaatatgcacctcatgacggctgacatcg

SEQ ID NO: 261155 - DNA, 31 bp, Artificial Sequence
  Description of Artificial Sequence: Synthetic oligonucleotide
gcaaatatgcacctcatgacggctgacatcg

SEQ ID NO: 261156 - DNA, 31 bp, Artificial Sequence
  Description of Artificial Sequence: Synthetic oligonucleotide
caaatatgcacctcatgacggctgacatcgg

SEQ ID NO: 261157 - DNA, 32 bp, Artificial Sequence
  Description of Artificial Sequence: Synthetic oligonucleotide
aaatatgcacctcatgacggctgacatcggag

SEQ ID NO: 261158 - DNA, 31 bp, Artificial Sequence
  Description of Artificial Sequence: Synthetic oligonucleotide
aatatgcacctcatgacggctgacatcggag

SEQ ID NO: 261159 - DNA, 30 bp, Artificial Sequence
  Description of Artificial Sequence: Synthetic oligonucleotide
atatgcacctcatgacggctgacatcggag

SEQ ID NO: 261160 - DNA, 29 bp, Artificial Sequence
  Description of Artificial Sequence: Synthetic oligonucleotide
tatgcacctcatgacggctgacatcggag

SEQ ID NO: 261161 - DNA, 28 bp, Artificial Sequence
  Description of Artificial Sequence: Synthetic oligonucleotide
atgcacctcatgacggctgacatcggag

SEQ ID NO: 261162 - DNA, 27 bp, Artificial Sequence
  Description of Artificial Sequence: Synthetic oligonucleotide
tgcacctcatgacggctgacatcggag

SEQ ID NO: 261163 - DNA, 26 bp, Artificial Sequence
  Description of Artificial Sequence: Synthetic oligonucleotide
gcacctcatgacggctgacatcggag

SEQ ID NO: 261164 - DNA, 27 bp, Artificial Sequence
  Description of Artificial Sequence: Synthetic oligonucleotide
cacctcatgacggctgacatcggagga

SEQ ID NO: 261165 - DNA, 27 bp, Artificial Sequence
  Description of Artificial Sequence: Synthetic oligonucleotide
acctcatgacggctgacatcggaggag

SEQ ID NO: 261166 - DNA, 26 bp, Artificial Sequence
  Description of Artificial Sequence: Synthetic oligonucleotide
cctcatgacggctgacatcggaggag

SEQ ID NO: 261167 - DNA, 27 bp, Artificial Sequence
  Description of Artificial Sequence: Synthetic oligonucleotide
ctcatgacggctgacatcggaggagct

SEQ ID NO: 261168 - DNA, 27 bp, Artificial Sequence
  Description of Artificial Sequence: Synthetic oligonucleotide
tcatgacggctgacatcggaggagctc

SEQ ID NO: 261169 - DNA, 26 bp, Artificial Sequence
  Description of Artificial Sequence: Synthetic oligonucleotide
catgacggctgacatcggaggagctc

SEQ ID NO: 261170 - DNA, 27 bp, Artificial Sequence
  Description of Artificial Sequence: Synthetic oligonucleotide
atgacggctgacatcggaggagctcca

SEQ ID NO: 261171 - DNA, 27 bp, Artificial Sequence
  Description of Artificial Sequence: Synthetic oligonucleotide
tgacggctgacatcggaggagctccaa

SEQ ID NO: 261172 - DNA, 26 bp, Artificial Sequence
  Description of Artificial Sequence: Synthetic oligonucleotide
gacggctgacatcggaggagctccaa

SEQ ID NO: 261173 - DNA, 27 bp, Artificial Sequence
  Description of Artificial Sequence: Synthetic oligonucleotide
acggctgacatcggaggagctccaact

SEQ ID NO: 261174 - DNA, 27 bp, Artificial Sequence
  Description of Artificial Sequence: Synthetic oligonucleotide
cggctgacatcggaggagctccaacta

SEQ ID NO: 261175 - DNA, 30 bp, Artificial Sequence
  Description of Artificial Sequence: Synthetic oligonucleotide
ggctgacatcggaggagctccaactatatc

SEQ ID NO: 261176 - DNA, 30 bp, Artificial Sequence
  Description of Artificial Sequence: Synthetic oligonucleotide
gctgacatcggaggagctccaactatatcc

SEQ ID NO: 261177 - DNA, 31 bp, Artificial Sequence
  Description of Artificial Sequence: Synthetic oligonucleotide
ctgacatcggaggagctccaactatatcctc

SEQ ID NO: 261178 - DNA, 32 bp, Artificial Sequence
  Description of Artificial Sequence: Synthetic oligonucleotide
tgacatcggaggagctccaactatatcctcag

SEQ ID NO: 261179 - DNA, 31 bp, Artificial Sequence
  Description of Artificial Sequence: Synthetic oligonucleotide
gacatcggaggagctccaactatatcctcag

SEQ ID NO: 261180 - DNA, 31 bp, Artificial Sequence
  Description of Artificial Sequence: Synthetic oligonucleotide
acatcggaggagctccaactatatcctcagc

SEQ ID NO: 261181 - DNA, 30 bp, Artificial Sequence
  Description of Artificial Sequence: Synthetic oligonucleotide
catcggaggagctccaactatatcctcagc

SEQ ID NO: 261182 - DNA, 30 bp, Artificial Sequence
  Description of Artificial Sequence: Synthetic oligonucleotide
atcggaggagctccaactatatcctcagcc

SEQ ID NO: 261183 - DNA, 29 bp, Artificial Sequence
  Description of Artificial Sequence: Synthetic oligonucleotide
tcggaggagctccaactatatcctcagcc

SEQ ID NO: 261184 - DNA, 28 bp, Artificial Sequence
  Description of Artificial Sequence: Synthetic oligonucleotide
cggaggagctccaactatatcctcagcc

SEQ ID NO: 261185 - DNA, 30 bp, Artificial Sequence
  Description of Artificial Sequence: Synthetic oligonucleotide
ggaggagctccaactatatcctcagccatg

SEQ ID NO: 261186 - DNA, 30 bp, Artificial Sequence
  Description of Artificial Sequence: Synthetic oligonucleotide
gaggagctccaactatatcctcagccatgg

SEQ ID NO: 261187 - DNA, 31 bp, Artificial Sequence
  Description of Artificial Sequence: Synthetic oligonucleotide
aggagctccaactatatcctcagccatggtg

SEQ ID NO: 261188 - DNA, 30 bp, Artificial Sequence
  Description of Artificial Sequence: Synthetic oligonucleotide
ggagctccaactatatcctcagccatggtg

SEQ ID NO: 261189 - DNA, 31 bp, Artificial Sequence
  Description of Artificial Sequence: Synthetic oligonucleotide
gagctccaactatatcctcagccatggtgtc

SEQ ID NO: 261190 - DNA, 32 bp, Artificial Sequence
  Description of Artificial Sequence: Synthetic oligonucleotide
agctccaactatatcctcagccatggtgtctg

SEQ ID NO: 261191 - DNA, 31 bp, Artificial Sequence
  Description of Artificial Sequence: Synthetic oligonucleotide
gctccaactatatcctcagccatggtgtctg

SEQ ID NO: 261192 - DNA, 31 bp, Artificial Sequence
  Description of Artificial Sequence: Synthetic oligonucleotide
ctccaactatatcctcagccatggtgtctgc

SEQ ID NO: 261193 - DNA, 32 bp, Artificial Sequence
  Description of Artificial Sequence: Synthetic oligonucleotide
tccaactatatcctcagccatggtgtctgctc

SEQ ID NO: 261194 - DNA, 31 bp, Artificial Sequence
  Description of Artificial Sequence: Synthetic oligonucleotide
ccaactatatcctcagccatggtgtctgctc

SEQ ID NO: 261195 - DNA, 31 bp, Artificial Sequence
  Description of Artificial Sequence: Synthetic oligonucleotide
caactatatcctcagccatggtgtctgctcc

SEQ ID NO: 261196 - DNA, 34 bp, Artificial Sequence
  Description of Artificial Sequence: Synthetic oligonucleotide
aactatatcctcagccatggtgtctgctccaaag

SEQ ID NO: 261197 - DNA, 33 bp, Artificial Sequence
  Description of Artificial Sequence: Synthetic oligonucleotide
actatatcctcagccatggtgtctgctccaaag

SEQ ID NO: 261198 - DNA, 32 bp, Artificial Sequence
  Description of Artificial Sequence: Synthetic oligonucleotide
ctatatcctcagccatggtgtctgctccaaag

SEQ ID NO: 261199 - DNA, 32 bp, Artificial Sequence
  Description of Artificial Sequence: Synthetic oligonucleotide
tatatcctcagccatggtgtctgctccaaagc

SEQ ID NO: 261200 - DNA, 31 bp, Artificial Sequence
  Description of Artificial Sequence: Synthetic oligonucleotide
atatcctcagccatggtgtctgctccaaagc

SEQ ID NO: 261201 - DNA, 30 bp, Artificial Sequence
  Description of Artificial Sequence: Synthetic oligonucleotide
tatcctcagccatggtgtctgctccaaagc

SEQ ID NO: 261202 - DNA, 29 bp, Artificial Sequence
  Description of Artificial Sequence: Synthetic oligonucleotide
atcctcagccatggtgtctgctccaaagc

SEQ ID NO: 261203 - DNA, 28 bp, Artificial Sequence
  Description of Artificial Sequence: Synthetic oligonucleotide
tcctcagccatggtgtctgctccaaagc

SEQ ID NO: 261204 - DNA, 27 bp, Artificial Sequence
  Description of Artificial Sequence: Synthetic oligonucleotide
cctcagccatggtgtctgctccaaagc

SEQ ID NO: 261205 - DNA, 34 bp, Artificial Sequence
  Description of Artificial Sequence: Synthetic oligonucleotide
ctcagccatggtgtctgctccaaagcttattttg

SEQ ID NO: 261206 - DNA, 34 bp, Artificial Sequence
  Description of Artificial Sequence: Synthetic oligonucleotide
tcagccatggtgtctgctccaaagcttattttgc

SEQ ID NO: 261207 - DNA, 33 bp, Artificial Sequence
  Description of Artificial Sequence: Synthetic oligonucleotide
cagccatggtgtctgctccaaagcttattttgc

SEQ ID NO: 261208 - DNA, 33 bp, Artificial Sequence
  Description of Artificial Sequence: Synthetic oligonucleotide
agccatggtgtctgctccaaagcttattttgcc

SEQ ID NO: 261209 - DNA, 32 bp, Artificial Sequence
  Description of Artificial Sequence: Synthetic oligonucleotide
gccatggtgtctgctccaaagcttattttgcc

SEQ ID NO: 261210 - DNA, 32 bp, Artificial Sequence
  Description of Artificial Sequence: Synthetic oligonucleotide
ccatggtgtctgctccaaagcttattttgccc

SEQ ID NO: 261211 - DNA, 44 bp, Artificial Sequence
  Description of Artificial Sequence: Synthetic oligonucleotide
catggtgtctgctccaaagcttattttgcccataaatattatac

SEQ ID NO: 261212 - DNA, 44 bp, Artificial Sequence
  Description of Artificial Sequence: Synthetic oligonucleotide
atggtgtctgctccaaagcttattttgcccataaatattatacg

SEQ ID NO: 261213 - DNA, 43 bp, Artificial Sequence
  Description of Artificial Sequence: Synthetic oligonucleotide
tggtgtctgctccaaagcttattttgcccataaatattatacg

SEQ ID NO: 261214 - DNA, 42 bp, Artificial Sequence
  Description of Artificial Sequence: Synthetic oligonucleotide
ggtgtctgctccaaagcttattttgcccataaatattatacg

SEQ ID NO: 261215 - DNA, 43 bp, Artificial Sequence
  Description of Artificial Sequence: Synthetic oligonucleotide
gtgtctgctccaaagcttattttgcccataaatattatacgtc

SEQ ID NO: 261216 - DNA, 44 bp, Artificial Sequence
  Description of Artificial Sequence: Synthetic oligonucleotide
tgtctgctccaaagcttattttgcccataaatattatacgtctg

SEQ ID NO: 261217 - DNA, 43 bp, Artificial Sequence
  Description of Artificial Sequence: Synthetic oligonucleotide
gtctgctccaaagcttattttgcccataaatattatacgtctg

SEQ ID NO: 261218 - DNA, 43 bp, Artificial Sequence
  Description of Artificial Sequence: Synthetic oligonucleotide
tctgctccaaagcttattttgcccataaatattatacgtctgg

SEQ ID NO: 261219 - DNA, 42 bp, Artificial Sequence
  Description of Artificial Sequence: Synthetic oligonucleotide
ctgctccaaagcttattttgcccataaatattatacgtctgg

SEQ ID NO: 261220 - DNA, 42 bp, Artificial Sequence
  Description of Artificial Sequence: Synthetic oligonucleotide
tgctccaaagcttattttgcccataaatattatacgtctggc

SEQ ID NO: 261221 - DNA, 41 bp, Artificial Sequence
  Description of Artificial Sequence: Synthetic oligonucleotide
gctccaaagcttattttgcccataaatattatacgtctggc

SEQ ID NO: 261222 - DNA, 41 bp, Artificial Sequence
  Description of Artificial Sequence: Synthetic oligonucleotide
ctccaaagcttattttgcccataaatattatacgtctggcc

SEQ ID NO: 261223 - DNA, 41 bp, Artificial Sequence
  Description of Artificial Sequence: Synthetic oligonucleotide
tccaaagcttattttgcccataaatattatacgtctggccc

SEQ ID NO: 261224 - DNA, 40 bp, Artificial Sequence
  Description of Artificial Sequence: Synthetic oligonucleotide
ccaaagcttattttgcccataaatattatacgtctggccc

SEQ ID NO: 261225 - DNA, 40 bp, Artificial Sequence
  Description of Artificial Sequence: Synthetic oligonucleotide
caaagcttattttgcccataaatattatacgtctggcccg

SEQ ID NO: 261226 - DNA, 41 bp, Artificial Sequence
  Description of Artificial Sequence: Synthetic oligonucleotide
aaagcttattttgcccataaatattatacgtctggcccgtc

SEQ ID NO: 261227 - DNA, 40 bp, Artificial Sequence
  Description of Artificial Sequence: Synthetic oligonucleotide
aagcttattttgcccataaatattatacgtctggcccgtc

SEQ ID NO: 261228 - DNA, 39 bp, Artificial Sequence
  Description of Artificial Sequence: Synthetic oligonucleotide
agcttattttgcccataaatattatacgtctggcccgtc

SEQ ID NO: 261229 - DNA, 38 bp, Artificial Sequence
  Description of Artificial Sequence: Synthetic oligonucleotide
gcttattttgcccataaatattatacgtctggcccgtc

SEQ ID NO: 261230 - DNA, 41 bp, Artificial Sequence
  Description of Artificial Sequence: Synthetic oligonucleotide
cttattttgcccataaatattatacgtctggcccgtctttg

SEQ ID NO: 261231 - DNA, 42 bp, Artificial Sequence
  Description of Artificial Sequence: Synthetic oligonucleotide
ttattttgcccataaatattatacgtctggcccgtctttgtg

SEQ ID NO: 261232 - DNA, 41 bp, Artificial Sequence
  Description of Artificial Sequence: Synthetic oligonucleotide
tattttgcccataaatattatacgtctggcccgtctttgtg

SEQ ID NO: 261233 - DNA, 40 bp, Artificial Sequence
  Description of Artificial Sequence: Synthetic oligonucleotide
attttgcccataaatattatacgtctggcccgtctttgtg

SEQ ID NO: 261234 - DNA, 39 bp, Artificial Sequence
  Description of Artificial Sequence: Synthetic oligonucleotide
ttttgcccataaatattatacgtctggcccgtctttgtg

SEQ ID NO: 261235 - DNA, 38 bp, Artificial Sequence
  Description of Artificial Sequence: Synthetic oligonucleotide
tttgcccataaatattatacgtctggcccgtctttgtg

SEQ ID NO: 261236 - DNA, 37 bp, Artificial Sequence
  Description of Artificial Sequence: Synthetic oligonucleotide
ttgcccataaatattatacgtctggcccgtctttgtg

SEQ ID NO: 261237 - DNA, 36 bp, Artificial Sequence
  Description of Artificial Sequence: Synthetic oligonucleotide
tgcccataaatattatacgtctggcccgtctttgtg

SEQ ID NO: 261238 - DNA, 35 bp, Artificial Sequence
  Description of Artificial Sequence: Synthetic oligonucleotide
gcccataaatattatacgtctggcccgtctttgtg

SEQ ID NO: 261239 - DNA, 42 bp, Artificial Sequence
  Description of Artificial Sequence: Synthetic oligonucleotide
cccataaatattatacgtctggcccgtctttgtgataatatg

SEQ ID NO: 261240 - DNA, 42 bp, Artificial Sequence
  Description of Artificial Sequence: Synthetic oligonucleotide
ccataaatattatacgtctggcccgtctttgtgataatatgc

SEQ ID NO: 261241 - DNA, 42 bp, Artificial Sequence
  Description of Artificial Sequence: Synthetic oligonucleotide
cataaatattatacgtctggcccgtctttgtgataatatgcc

SEQ ID NO: 261242 - DNA, 42 bp, Artificial Sequence
  Description of Artificial Sequence: Synthetic oligonucleotide
ataaatattatacgtctggcccgtctttgtgataatatgccc

SEQ ID NO: 261243 - DNA, 41 bp, Artificial Sequence
  Description of Artificial Sequence: Synthetic oligonucleotide
taaatattatacgtctggcccgtctttgtgataatatgccc

SEQ ID NO: 261244 - DNA, 40 bp, Artificial Sequence
  Description of Artificial Sequence: Synthetic oligonucleotide
aaatattatacgtctggcccgtctttgtgataatatgccc

SEQ ID NO: 261245 - DNA, 39 bp, Artificial Sequence
  Description of Artificial Sequence: Synthetic oligonucleotide
aatattatacgtctggcccgtctttgtgataatatgccc

SEQ ID NO: 261246 - DNA, 38 bp, Artificial Sequence
  Description of Artificial Sequence: Synthetic oligonucleotide
atattatacgtctggcccgtctttgtgataatatgccc

SEQ ID NO: 261247 - DNA, 37 bp, Artificial Sequence
  Description of Artificial Sequence: Synthetic oligonucleotide
tattatacgtctggcccgtctttgtgataatatgccc

SEQ ID NO: 261248 - DNA, 36 bp, Artificial Sequence
  Description of Artificial Sequence: Synthetic oligonucleotide
attatacgtctggcccgtctttgtgataatatgccc

SEQ ID NO: 261249 - DNA, 35 bp, Artificial Sequence
  Description of Artificial Sequence: Synthetic oligonucleotide
ttatacgtctggcccgtctttgtgataatatgccc

SEQ ID NO: 261250 - DNA, 34 bp, Artificial Sequence
  Description of Artificial Sequence: Synthetic oligonucleotide
tatacgtctggcccgtctttgtgataatatgccc

SEQ ID NO: 261251 - DNA, 33 bp, Artificial Sequence
  Description of Artificial Sequence: Synthetic oligonucleotide
atacgtctggcccgtctttgtgataatatgccc

SEQ ID NO: 261252 - DNA, 32 bp, Artificial Sequence
  Description of Artificial Sequence: Synthetic oligonucleotide
tacgtctggcccgtctttgtgataatatgccc

SEQ ID NO: 261253 - DNA, 31 bp, Artificial Sequence
  Description of Artificial Sequence: Synthetic oligonucleotide
acgtctggcccgtctttgtgataatatgccc

SEQ ID NO: 261254 - DNA, 30 bp, Artificial Sequence
  Description of Artificial Sequence: Synthetic oligonucleotide
cgtctggcccgtctttgtgataatatgccc

SEQ ID NO: 261255 - DNA, 31 bp, Artificial Sequence
  Description of Artificial Sequence: Synthetic oligonucleotide
gtctggcccgtctttgtgataatatgccctg

SEQ ID NO: 261256 - DNA, 31 bp, Artificial Sequence
  Description of Artificial Sequence: Synthetic oligonucleotide
tctggcccgtctttgtgataatatgccctgc

SEQ ID NO: 261257 - DNA, 30 bp, Artificial Sequence
  Description of Artificial Sequence: Synthetic oligonucleotide
ctggcccgtctttgtgataatatgccctgc

SEQ ID NO: 261258 - DNA, 30 bp, Artificial Sequence
  Description of Artificial Sequence: Synthetic oligonucleotide
tggcccgtctttgtgataatatgccctgcg

SEQ ID NO: 261259 - DNA, 29 bp, Artificial Sequence
  Description of Artificial Sequence: Synthetic oligonucleotide
ggcccgtctttgtgataatatgccctgcg

SEQ ID NO: 261260 - DNA, 29 bp, Artificial Sequence
  Description of Artificial Sequence: Synthetic oligonucleotide
gcccgtctttgtgataatatgccctgcgg

SEQ ID NO: 261261 - DNA, 29 bp, Artificial Sequence
  Description of Artificial Sequence: Synthetic oligonucleotide
cccgtctttgtgataatatgccctgcggc

SEQ ID NO: 261262 - DNA, 31 bp, Artificial Sequence
  Description of Artificial Sequence: Synthetic oligonucleotide
ccgtctttgtgataatatgccctgcggcaag

SEQ ID NO: 261263 - DNA, 31 bp, Artificial Sequence
  Description of Artificial Sequence: Synthetic oligonucleotide
cgtctttgtgataatatgccctgcggcaagg

SEQ ID NO: 261264 - DNA, 31 bp, Artificial Sequence
  Description of Artificial Sequence: Synthetic oligonucleotide
gtctttgtgataatatgccctgcggcaaggg

SEQ ID NO: 261265 - DNA, 31 bp, Artificial Sequence
  Description of Artificial Sequence: Synthetic oligonucleotide
tctttgtgataatatgccctgcggcaagggc

SEQ ID NO: 261266 - DNA, 30 bp, Artificial Sequence
  Description of Artificial Sequence: Synthetic oligonucleotide
ctttgtgataatatgccctgcggcaagggc

SEQ ID NO: 261267 - DNA, 32 bp, Artificial Sequence
  Description of Artificial Sequence: Synthetic oligonucleotide
tttgtgataatatgccctgcggcaagggcaac

SEQ ID NO: 261268 - DNA, 31 bp, Artificial Sequence
  Description of Artificial Sequence: Synthetic oligonucleotide
ttgtgataatatgccctgcggcaagggcaac

SEQ ID NO: 261269 - DNA, 30 bp, Artificial Sequence
  Description of Artificial Sequence: Synthetic oligonucleotide
tgtgataatatgccctgcggcaagggcaac

SEQ ID NO: 261270 - DNA, 29 bp, Artificial Sequence
  Description of Artificial Sequence: Synthetic oligonucleotide
gtgataatatgccctgcggcaagggcaac

SEQ ID NO: 261271 - DNA, 31 bp, Artificial Sequence
  Description of Artificial Sequence: Synthetic oligonucleotide
tgataatatgccctgcggcaagggcaacaag

SEQ ID NO: 261272 - DNA, 30 bp, Artificial Sequence
  Description of Artificial Sequence: Synthetic oligonucleotide
gataatatgccctgcggcaagggcaacaag

SEQ ID NO: 261273 - DNA, 30 bp, Artificial Sequence
  Description of Artificial Sequence: Synthetic oligonucleotide
ataatatgccctgcggcaagggcaacaagc

SEQ ID NO: 261274 - DNA, 29 bp, Artificial Sequence
  Description of Artificial Sequence: Synthetic oligonucleotide
taatatgccctgcggcaagggcaacaagc

SEQ ID NO: 261275 - DNA, 28 bp, Artificial Sequence
  Description of Artificial Sequence: Synthetic oligonucleotide
aatatgccctgcggcaagggcaacaagc

SEQ ID NO: 261276 - DNA, 27 bp, Artificial Sequence
  Description of Artificial Sequence: Synthetic oligonucleotide
atatgccctgcggcaagggcaacaagc

SEQ ID NO: 261277 - DNA, 26 bp, Artificial Sequence
  Description of Artificial Sequence: Synthetic oligonucleotide
tatgccctgcggcaagggcaacaagc

SEQ ID NO: 261278 - DNA, 25 bp, Artificial Sequence
  Description of Artificial Sequence: Synthetic oligonucleotide
atgccctgcggcaagggcaacaagc

SEQ ID NO: 261279 - DNA, 24 bp, Artificial Sequence
  Description of Artificial Sequence: Synthetic oligonucleotide
tgccctgcggcaagggcaacaagc

SEQ ID NO: 261280 - DNA, 23 bp, Artificial Sequence
  Description of Artificial Sequence: Synthetic oligonucleotide
gccctgcggcaagggcaacaagc

SEQ ID NO: 261281 - DNA, 23 bp, Artificial Sequence
  Description of Artificial Sequence: Synthetic oligonucleotide
ccctgcggcaagggcaacaagcc

SEQ ID NO: 261282 - DNA, 23 bp, Artificial Sequence
  Description of Artificial Sequence: Synthetic oligonucleotide
cctgcggcaagggcaacaagccc

SEQ ID NO: 261283 - DNA, 23 bp, Artificial Sequence
  Description of Artificial Sequence: Synthetic oligonucleotide
ctgcggcaagggcaacaagcccg

SEQ ID NO: 261284 - DNA, 23 bp, Artificial Sequence
  Description of Artificial Sequence: Synthetic oligonucleotide
tgcggcaagggcaacaagcccgg

SEQ ID NO: 261285 - DNA, 22 bp, Artificial Sequence
  Description of Artificial Sequence: Synthetic oligonucleotide
gcggcaagggcaacaagcccgg

SEQ ID NO: 261286 - DNA, 22 bp, Artificial Sequence
  Description of Artificial Sequence: Synthetic oligonucleotide
cggcaagggcaacaagcccggg

SEQ ID NO: 261287 - DNA, 24 bp, Artificial Sequence
  Description of Artificial Sequence: Synthetic oligonucleotide
ggcaagggcaacaagcccggggat

SEQ ID NO: 261288 - DNA, 26 bp, Artificial Sequence
  Description of Artificial Sequence: Synthetic oligonucleotide
gcaagggcaacaagcccggggatgtt

SEQ ID NO: 261289 - DNA, 27 bp, Artificial Sequence
  Description of Artificial Sequence: Synthetic oligonucleotide
caagggcaacaagcccggggatgttct

SEQ ID NO: 261290 - DNA, 29 bp, Artificial Sequence
  Description of Artificial Sequence: Synthetic oligonucleotide
aagggcaacaagcccggggatgttcttag

SEQ ID NO: 261291 - DNA, 28 bp, Artificial Sequence
  Description of Artificial Sequence: Synthetic oligonucleotide
agggcaacaagcccggggatgttcttag

SEQ ID NO: 261292 - DNA, 27 bp, Artificial Sequence
  Description of Artificial Sequence: Synthetic oligonucleotide
gggcaacaagcccggggatgttcttag

SEQ ID NO: 261293 - DNA, 28 bp, Artificial Sequence
  Description of Artificial Sequence: Synthetic oligonucleotide
ggcaacaagcccggggatgttcttagag

SEQ ID NO: 261294 - DNA, 28 bp, Artificial Sequence
  Description of Artificial Sequence: Synthetic oligonucleotide
gcaacaagcccggggatgttcttagagc

SEQ ID NO: 261295 - DNA, 28 bp, Artificial Sequence
  Description of Artificial Sequence: Synthetic oligonucleotide
caacaagcccggggatgttcttagagcc

SEQ ID NO: 261296 - DNA, 33 bp, Artificial Sequence
  Description of Artificial Sequence: Synthetic oligonucleotide
aacaagcccggggatgttcttagagccataaac

SEQ ID NO: 261297 - DNA, 32 bp, Artificial Sequence
  Description of Artificial Sequence: Synthetic oligonucleotide
acaagcccggggatgttcttagagccataaac

SEQ ID NO: 261298 - DNA, 31 bp, Artificial Sequence
  Description of Artificial Sequence: Synthetic oligonucleotide
caagcccggggatgttcttagagccataaac

SEQ ID NO: 261299 - DNA, 31 bp, Artificial Sequence
  Description of Artificial Sequence: Synthetic oligonucleotide
aagcccggggatgttcttagagccataaacg

SEQ ID NO: 261300 - DNA, 30 bp, Artificial Sequence
  Description of Artificial Sequence: Synthetic oligonucleotide
agcccggggatgttcttagagccataaacg

SEQ ID NO: 261301 - DNA, 29 bp, Artificial Sequence
  Description of Artificial Sequence: Synthetic oligonucleotide
gcccggggatgttcttagagccataaacg

SEQ ID NO: 261302 - DNA, 29 bp, Artificial Sequence
  Description of Artificial Sequence: Synthetic oligonucleotide
cccggggatgttcttagagccataaacgg

SEQ ID NO: 261303 - DNA, 29 bp, Artificial Sequence
  Description of Artificial Sequence: Synthetic oligonucleotide
ccggggatgttcttagagccataaacggg

SEQ ID NO: 261304 - DNA, 31 bp, Artificial Sequence
  Description of Artificial Sequence: Synthetic oligonucleotide
cggggatgttcttagagccataaacgggaac

SEQ ID NO: 261305 - DNA, 32 bp, Artificial Sequence
  Description of Artificial Sequence: Synthetic oligonucleotide
ggggatgttcttagagccataaacgggaacac

SEQ ID NO: 261306 - DNA, 32 bp, Artificial Sequence
  Description of Artificial Sequence: Synthetic oligonucleotide
gggatgttcttagagccataaacgggaacacc

SEQ ID NO: 261307 - DNA, 34 bp, Artificial Sequence
  Description of Artificial Sequence: Synthetic oligonucleotide
ggatgttcttagagccataaacgggaacaccatc

SEQ ID NO: 261308 - DNA, 34 bp, Artificial Sequence
  Description of Artificial Sequence: Synthetic oligonucleotide
gatgttcttagagccataaacgggaacaccatcc

SEQ ID NO: 261309 - DNA, 35 bp, Artificial Sequence
  Description of Artificial Sequence: Synthetic oligonucleotide
atgttcttagagccataaacgggaacaccatccag

SEQ ID NO: 261310 - DNA, 34 bp, Artificial Sequence
  Description of Artificial Sequence: Synthetic oligonucleotide
tgttcttagagccataaacgggaacaccatccag

SEQ ID NO: 261311 - DNA, 33 bp, Artificial Sequence
  Description of Artificial Sequence: Synthetic oligonucleotide
gttcttagagccataaacgggaacaccatccag

SEQ ID NO: 261312 - DNA, 33 bp, Artificial Sequence
  Description of Artificial Sequence: Synthetic oligonucleotide
ttcttagagccataaacgggaacaccatccagc

SEQ ID NO: 261313 - DNA, 32 bp, Artificial Sequence
  Description of Artificial Sequence: Synthetic oligonucleotide
tcttagagccataaacgggaacaccatccagc

SEQ ID NO: 261314 - DNA, 31 bp, Artificial Sequence
  Description of Artificial Sequence: Synthetic oligonucleotide
cttagagccataaacgggaacaccatccagc

SEQ ID NO: 261315 - DNA, 33 bp, Artificial Sequence
  Description of Artificial Sequence: Synthetic oligonucleotide
ttagagccataaacgggaacaccatccagcttg

SEQ ID NO: 261316 - DNA, 32 bp, Artificial Sequence
  Description of Artificial Sequence: Synthetic oligonucleotide
tagagccataaacgggaacaccatccagcttg

SEQ ID NO: 261317 - DNA, 31 bp, Artificial Sequence
  Description of Artificial Sequence: Synthetic oligonucleotide
agagccataaacgggaacaccatccagcttg

SEQ ID NO: 261318 - DNA, 30 bp, Artificial Sequence
  Description of Artificial Sequence: Synthetic oligonucleotide
gagccataaacgggaacaccatccagcttg

SEQ ID NO: 261319 - DNA, 34 bp, Artificial Sequence
  Description of Artificial Sequence: Synthetic oligonucleotide
agccataaacgggaacaccatccagcttgataac

SEQ ID NO: 261320 - DNA, 33 bp, Artificial Sequence
  Description of Artificial Sequence: Synthetic oligonucleotide
gccataaacgggaacaccatccagcttgataac

SEQ ID NO: 261321 - DNA, 34 bp, Artificial Sequence
  Description of Artificial Sequence: Synthetic oligonucleotide
ccataaacgggaacaccatccagcttgataacag

SEQ ID NO: 261322 - DNA, 35 bp, Artificial Sequence
  Description of Artificial Sequence: Synthetic oligonucleotide
cataaacgggaacaccatccagcttgataacagtg

SEQ ID NO: 261323 - DNA, 37 bp, Artificial Sequence
  Description of Artificial Sequence: Synthetic oligonucleotide
ataaacgggaacaccatccagcttgataacagtgatg

SEQ ID NO: 261324 - DNA, 36 bp, Artificial Sequence
  Description of Artificial Sequence: Synthetic oligonucleotide
taaacgggaacaccatccagcttgataacagtgatg

SEQ ID NO: 261325 - DNA, 35 bp, Artificial Sequence
  Description of Artificial Sequence: Synthetic oligonucleotide
aaacgggaacaccatccagcttgataacagtgatg

SEQ ID NO: 261326 - DNA, 34 bp, Artificial Sequence
  Description of Artificial Sequence: Synthetic oligonucleotide
aacgggaacaccatccagcttgataacagtgatg

SEQ ID NO: 261327 - DNA, 33 bp, Artificial Sequence
  Description of Artificial Sequence: Synthetic oligonucleotide
acgggaacaccatccagcttgataacagtgatg

SEQ ID NO: 261328 - DNA, 32 bp, Artificial Sequence
  Description of Artificial Sequence: Synthetic oligonucleotide
cgggaacaccatccagcttgataacagtgatg

SEQ ID NO: 261329 - DNA, 32 bp, Artificial Sequence
  Description of Artificial Sequence: Synthetic oligonucleotide
gggaacaccatccagcttgataacagtgatgc

SEQ ID NO: 261330 - DNA, 33 bp, Artificial Sequence
  Description of Artificial Sequence: Synthetic oligonucleotide
ggaacaccatccagcttgataacagtgatgctg

SEQ ID NO: 261331 - DNA, 34 bp, Artificial Sequence
  Description of Artificial Sequence: Synthetic oligonucleotide
gaacaccatccagcttgataacagtgatgctgac

SEQ ID NO: 261332 - DNA, 34 bp, Artificial Sequence
  Description of Artificial Sequence: Synthetic oligonucleotide
aacaccatccagcttgataacagtgatgctgacg

SEQ ID NO: 261333 - DNA, 33 bp, Artificial Sequence
  Description of Artificial Sequence: Synthetic oligonucleotide
acaccatccagcttgataacagtgatgctgacg

SEQ ID NO: 261334 - DNA, 32 bp, Artificial Sequence
  Description of Artificial Sequence: Synthetic oligonucleotide
caccatccagcttgataacagtgatgctgacg

SEQ ID NO: 261335 - DNA, 32 bp, Artificial Sequence
  Description of Artificial Sequence: Synthetic oligonucleotide
accatccagcttgataacagtgatgctgacgg

SEQ ID NO: 261336 - DNA, 31 bp, Artificial Sequence
  Description of Artificial Sequence: Synthetic oligonucleotide
ccatccagcttgataacagtgatgctgacgg

SEQ ID NO: 261337 - DNA, 31 bp, Artificial Sequence
  Description of Artificial Sequence: Synthetic oligonucleotide
catccagcttgataacagtgatgctgacggg

SEQ ID NO: 261338 - DNA, 32 bp, Artificial Sequence
  Description of Artificial Sequence: Synthetic oligonucleotide
atccagcttgataacagtgatgctgacgggag

SEQ ID NO: 261339 - DNA, 31 bp, Artificial Sequence
  Description of Artificial Sequence: Synthetic oligonucleotide
tccagcttgataacagtgatgctgacgggag

SEQ ID NO: 261340 - DNA, 30 bp, Artificial Sequence
  Description of Artificial Sequence: Synthetic oligonucleotide
ccagcttgataacagtgatgctgacgggag

SEQ ID NO: 261341 - DNA, 30 bp, Artificial Sequence
  Description of Artificial Sequence: Synthetic oligonucleotide
cagcttgataacagtgatgctgacgggagg

SEQ ID NO: 261342 - DNA, 30 bp, Artificial Sequence
  Description of Artificial Sequence: Synthetic oligonucleotide
agcttgataacagtgatgctgacgggaggc

SEQ ID NO: 261343 - DNA, 29 bp, Artificial Sequence
  Description of Artificial Sequence: Synthetic oligonucleotide
gcttgataacagtgatgctgacgggaggc

SEQ ID NO: 261344 - DNA, 30 bp, Artificial Sequence
  Description of Artificial Sequence: Synthetic oligonucleotide
cttgataacagtgatgctgacgggaggctc

SEQ ID NO: 261345 - DNA, 33 bp, Artificial Sequence
  Description of Artificial Sequence: Synthetic oligonucleotide
ttgataacagtgatgctgacgggaggctcttac

SEQ ID NO: 261346 - DNA, 32 bp, Artificial Sequence
  Description of Artificial Sequence: Synthetic oligonucleotide
tgataacagtgatgctgacgggaggctcttac

SEQ ID NO: 261347 - DNA, 31 bp, Artificial Sequence
  Description of Artificial Sequence: Synthetic oligonucleotide
gataacagtgatgctgacgggaggctcttac

SEQ ID NO: 261348 - DNA, 32 bp, Artificial Sequence
  Description of Artificial Sequence: Synthetic oligonucleotide
ataacagtgatgctgacgggaggctcttactg

SEQ ID NO: 261349 - DNA, 31 bp, Artificial Sequence
  Description of Artificial Sequence: Synthetic oligonucleotide
taacagtgatgctgacgggaggctcttactg

SEQ ID NO: 261350 - DNA, 30 bp, Artificial Sequence
  Description of Artificial Sequence: Synthetic oligonucleotide
aacagtgatgctgacgggaggctcttactg

SEQ ID NO: 261351 - DNA, 29 bp, Artificial Sequence
  Description of Artificial Sequence: Synthetic oligonucleotide
acagtgatgctgacgggaggctcttactg

SEQ ID NO: 261352 - DNA, 28 bp, Artificial Sequence
  Description of Artificial Sequence: Synthetic oligonucleotide
cagtgatgctgacgggaggctcttactg

SEQ ID NO: 261353 - DNA, 28 bp, Artificial Sequence
  Description of Artificial Sequence: Synthetic oligonucleotide
agtgatgctgacgggaggctcttactgg

SEQ ID NO: 261354 - DNA, 27 bp, Artificial Sequence
  Description of Artificial Sequence: Synthetic oligonucleotide
gtgatgctgacgggaggctcttactgg

SEQ ID NO: 261355 - DNA, 27 bp, Artificial Sequence
  Description of Artificial Sequence: Synthetic oligonucleotide
tgatgctgacgggaggctcttactggc

SEQ ID NO: 261356 - DNA, 27 bp, Artificial Sequence
  Description of Artificial Sequence: Synthetic oligonucleotide
gatgctgacgggaggctcttactggct

SEQ ID NO: 261357 - DNA, 27 bp, Artificial Sequence
  Description of Artificial Sequence: Synthetic oligonucleotide
atgctgacgggaggctcttactggctg

SEQ ID NO: 261358 - DNA, 27 bp, Artificial Sequence
  Description of Artificial Sequence: Synthetic oligonucleotide
tgctgacgggaggctcttactggctgt

SEQ ID NO: 261359 - DNA, 27 bp, Artificial Sequence
  Description of Artificial Sequence: Synthetic oligonucleotide
gctgacgggaggctcttactggctgtt

SEQ ID NO: 261360 - DNA, 27 bp, Artificial Sequence
  Description of Artificial Sequence: Synthetic oligonucleotide
ctgacgggaggctcttactggctgttg

SEQ ID NO: 261361 - DNA, 27 bp, Artificial Sequence
  Description of Artificial Sequence: Synthetic oligonucleotide
tgacgggaggctcttactggctgttgc

SEQ ID NO: 261362 - DNA, 26 bp, Artificial Sequence
  Description of Artificial Sequence: Synthetic oligonucleotide
gacgggaggctcttactggctgttgc

SEQ ID NO: 261363 - DNA, 26 bp, Artificial Sequence
  Description of Artificial Sequence: Synthetic oligonucleotide
acgggaggctcttactggctgttgcg

SEQ ID NO: 261364 - DNA, 25 bp, Artificial Sequence
  Description of Artificial Sequence: Synthetic oligonucleotide
cgggaggctcttactggctgttgcg

SEQ ID NO: 261365 - DNA, 26 bp, Artificial Sequence
  Description of Artificial Sequence: Synthetic oligonucleotide
gggaggctcttactggctgttgcgct

SEQ ID NO: 261366 - DNA, 27 bp, Artificial Sequence
  Description of Artificial Sequence: Synthetic oligonucleotide
ggaggctcttactggctgttgcgctct

SEQ ID NO: 261367 - DNA, 27 bp, Artificial Sequence
  Description of Artificial Sequence: Synthetic oligonucleotide
gaggctcttactggctgttgcgctctg

SEQ ID NO: 261368 - DNA, 30 bp, Artificial Sequence
  Description of Artificial Sequence: Synthetic oligonucleotide
aggctcttactggctgttgcgctctgatac

SEQ ID NO: 261369 - DNA, 29 bp, Artificial Sequence
  Description of Artificial Sequence: Synthetic oligonucleotide
ggctcttactggctgttgcgctctgatac

SEQ ID NO: 261370 - DNA, 29 bp, Artificial Sequence
  Description of Artificial Sequence: Synthetic oligonucleotide
gctcttactggctgttgcgctctgatacg

SEQ ID NO: 261371 - DNA, 29 bp, Artificial Sequence
  Description of Artificial Sequence: Synthetic oligonucleotide
ctcttactggctgttgcgctctgatacgc

SEQ ID NO: 261372 - DNA, 30 bp, Artificial Sequence
  Description of Artificial Sequence: Synthetic oligonucleotide
tcttactggctgttgcgctctgatacgcac

SEQ ID NO: 261373 - DNA, 29 bp, Artificial Sequence
  Description of Artificial Sequence: Synthetic oligonucleotide
cttactggctgttgcgctctgatacgcac

SEQ ID NO: 261374 - DNA, 30 bp, Artificial Sequence
  Description of Artificial Sequence: Synthetic oligonucleotide
ttactggctgttgcgctctgatacgcacac

SEQ ID NO: 261375 - DNA, 29 bp, Artificial Sequence
  Description of Artificial Sequence: Synthetic oligonucleotide
tactggctgttgcgctctgatacgcacac

SEQ ID NO: 261376 - DNA, 28 bp, Artificial Sequence
  Description of Artificial Sequence: Synthetic oligonucleotide
actggctgttgcgctctgatacgcacac

SEQ ID NO: 261377 - DNA, 27 bp, Artificial Sequence
  Description of Artificial Sequence: Synthetic oligonucleotide
ctggctgttgcgctctgatacgcacac

SEQ ID NO: 261378 - DNA, 28 bp, Artificial Sequence
  Description of Artificial Sequence: Synthetic oligonucleotide
tggctgttgcgctctgatacgcacactc

SEQ ID NO: 261379 - DNA, 27 bp, Artificial Sequence
  Description of Artificial Sequence: Synthetic oligonucleotide
ggctgttgcgctctgatacgcacactc

SEQ ID NO: 261380 - DNA, 27 bp, Artificial Sequence
  Description of Artificial Sequence: Synthetic oligonucleotide
gctgttgcgctctgatacgcacactcg

SEQ ID NO: 261381 - DNA, 32 bp, Artificial Sequence
  Description of Artificial Sequence: Synthetic oligonucleotide
ctgttgcgctctgatacgcacactcgtttaac

SEQ ID NO: 261382 - DNA, 32 bp, Artificial Sequence
  Description of Artificial Sequence: Synthetic oligonucleotide
tgttgcgctctgatacgcacactcgtttaacc

SEQ ID NO: 261383 - DNA, 31 bp, Artificial Sequence
  Description of Artificial Sequence: Synthetic oligonucleotide
gttgcgctctgatacgcacactcgtttaacc

SEQ ID NO: 261384 - DNA, 31 bp, Artificial Sequence
  Description of Artificial Sequence: Synthetic oligonucleotide
ttgcgctctgatacgcacactcgtttaaccg

SEQ ID NO: 261385 - DNA, 30 bp, Artificial Sequence
  Description of Artificial Sequence: Synthetic oligonucleotide
tgcgctctgatacgcacactcgtttaaccg

SEQ ID NO: 261386 - DNA, 29 bp, Artificial Sequence
  Description of Artificial Sequence: Synthetic oligonucleotide
gcgctctgatacgcacactcgtttaaccg

SEQ ID NO: 261387 - DNA, 29 bp, Artificial Sequence
  Description of Artificial Sequence: Synthetic oligonucleotide
cgctctgatacgcacactcgtttaaccgg

SEQ ID NO: 261388 - DNA, 31 bp, Artificial Sequence
  Description of Artificial Sequence: Synthetic oligonucleotide
gctctgatacgcacactcgtttaaccggaag

SEQ ID NO: 261389 - DNA, 31 bp, Artificial Sequence
  Description of Artificial Sequence: Synthetic oligonucleotide
ctctgatacgcacactcgtttaaccggaagg

SEQ ID NO: 261390 - DNA, 32 bp, Artificial Sequence
  Description of Artificial Sequence: Synthetic oligonucleotide
tctgatacgcacactcgtttaaccggaaggtc

SEQ ID NO: 261391 - DNA, 31 bp, Artificial Sequence
  Description of Artificial Sequence: Synthetic oligonucleotide
ctgatacgcacactcgtttaaccggaaggtc

SEQ ID NO: 261392 - DNA, 33 bp, Artificial Sequence
  Description of Artificial Sequence: Synthetic oligonucleotide
tgatacgcacactcgtttaaccggaaggtcatg

SEQ ID NO: 261393 - DNA, 32 bp, Artificial Sequence
  Description of Artificial Sequence: Synthetic oligonucleotide
gatacgcacactcgtttaaccggaaggtcatg

SEQ ID NO: 261394 - DNA, 32 bp, Artificial Sequence
  Description of Artificial Sequence: Synthetic oligonucleotide
atacgcacactcgtttaaccggaaggtcatgc

SEQ ID NO: 261395 - DNA, 31 bp, Artificial Sequence
  Description of Artificial Sequence: Synthetic oligonucleotide
tacgcacactcgtttaaccggaaggtcatgc

SEQ ID NO: 261396 - DNA, 30 bp, Artificial Sequence
  Description of Artificial Sequence: Synthetic oligonucleotide
acgcacactcgtttaaccggaaggtcatgc

SEQ ID NO: 261397 - DNA, 29 bp, Artificial Sequence
  Description of Artificial Sequence: Synthetic oligonucleotide
cgcacactcgtttaaccggaaggtcatgc

SEQ ID NO: 261398 - DNA, 30 bp, Artificial Sequence
  Description of Artificial Sequence: Synthetic oligonucleotide
gcacactcgtttaaccggaaggtcatgctc

SEQ ID NO: 261399 - DNA, 33 bp, Artificial Sequence
  Description of Artificial Sequence: Synthetic oligonucleotide
cacactcgtttaaccggaaggtcatgctcaatg

SEQ ID NO: 261400 - DNA, 33 bp, Artificial Sequence
  Description of Artificial Sequence: Synthetic oligonucleotide
acactcgtttaaccggaaggtcatgctcaatgc

SEQ ID NO: 261401 - DNA, 32 bp, Artificial Sequence
  Description of Artificial Sequence: Synthetic oligonucleotide
cactcgtttaaccggaaggtcatgctcaatgc

SEQ ID NO: 261402 - DNA, 32 bp, Artificial Sequence
  Description of Artificial Sequence: Synthetic oligonucleotide
actcgtttaaccggaaggtcatgctcaatgcc

SEQ ID NO: 261403 - DNA, 31 bp, Artificial Sequence
  Description of Artificial Sequence: Synthetic oligonucleotide
ctcgtttaaccggaaggtcatgctcaatgcc

SEQ ID NO: 261404 - DNA, 31 bp, Artificial Sequence
  Description of Artificial Sequence: Synthetic oligonucleotide
tcgtttaaccggaaggtcatgctcaatgccc

SEQ ID NO: 261405 - DNA, 30 bp, Artificial Sequence
  Description of Artificial Sequence: Synthetic oligonucleotide
cgtttaaccggaaggtcatgctcaatgccc

SEQ ID NO: 261406 - DNA, 30 bp, Artificial Sequence
  Description of Artificial Sequence: Synthetic oligonucleotide
gtttaaccggaaggtcatgctcaatgcccc

SEQ ID NO: 261407 - DNA, 30 bp, Artificial Sequence
  Description of Artificial Sequence: Synthetic oligonucleotide
tttaaccggaaggtcatgctcaatgccccc

SEQ ID NO: 261408 - DNA, 29 bp, Artificial Sequence
  Description of Artificial Sequence: Synthetic oligonucleotide
ttaaccggaaggtcatgctcaatgccccc

SEQ ID NO: 261409 - DNA, 28 bp, Artificial Sequence
  Description of Artificial Sequence: Synthetic oligonucleotide
taaccggaaggtcatgctcaatgccccc

SEQ ID NO: 261410 - DNA, 27 bp, Artificial Sequence
  Description of Artificial Sequence: Synthetic oligonucleotide
aaccggaaggtcatgctcaatgccccc

SEQ ID NO: 261411 - DNA, 27 bp, Artificial Sequence
  Description of Artificial Sequence: Synthetic oligonucleotide
accggaaggtcatgctcaatgccccca

SEQ ID NO: 261412 - DNA, 26 bp, Artificial Sequence
  Description of Artificial Sequence: Synthetic oligonucleotide
ccggaaggtcatgctcaatgccccca

SEQ ID NO: 261413 - DNA, 26 bp, Artificial Sequence
  Description of Artificial Sequence: Synthetic oligonucleotide
cggaaggtcatgctcaatgcccccac

SEQ ID NO: 261414 - DNA, 27 bp, Artificial Sequence
  Description of Artificial Sequence: Synthetic oligonucleotide
ggaaggtcatgctcaatgcccccacct

SEQ ID NO: 261415 - DNA, 30 bp, Artificial Sequence
  Description of Artificial Sequence: Synthetic oligonucleotide
gaaggtcatgctcaatgcccccaccttaag

SEQ ID NO: 261416 - DNA, 31 bp, Artificial Sequence
  Description of Artificial Sequence: Synthetic oligonucleotide
aaggtcatgctcaatgcccccaccttaagag

SEQ ID NO: 261417 - DNA, 30 bp, Artificial Sequence
  Description of Artificial Sequence: Synthetic oligonucleotide
aggtcatgctcaatgcccccaccttaagag

SEQ ID NO: 261418 - DNA, 29 bp, Artificial Sequence
  Description of Artificial Sequence: Synthetic oligonucleotide
ggtcatgctcaatgcccccaccttaagag

SEQ ID NO: 261419 - DNA, 29 bp, Artificial Sequence
  Description of Artificial Sequence: Synthetic oligonucleotide
gtcatgctcaatgcccccaccttaagagg

SEQ ID NO: 261420 - DNA, 30 bp, Artificial Sequence
  Description of Artificial Sequence: Synthetic oligonucleotide
tcatgctcaatgcccccaccttaagaggtg

SEQ ID NO: 261421 - DNA, 29 bp, Artificial Sequence
  Description of Artificial Sequence: Synthetic oligonucleotide
catgctcaatgcccccaccttaagaggtg

SEQ ID NO: 261422 - DNA, 29 bp, Artificial Sequence
  Description of Artificial Sequence: Synthetic oligonucleotide
atgctcaatgcccccaccttaagaggtgc

SEQ ID NO: 261423 - DNA, 28 bp, Artificial Sequence
  Description of Artificial Sequence: Synthetic oligonucleotide
tgctcaatgcccccaccttaagaggtgc

SEQ ID NO: 261424 - DNA, 27 bp, Artificial Sequence
  Description of Artificial Sequence: Synthetic oligonucleotide
gctcaatgcccccaccttaagaggtgc

SEQ ID NO: 261425 - DNA, 27 bp, Artificial Sequence
  Description of Artificial Sequence: Synthetic oligonucleotide
ctcaatgcccccaccttaagaggtgcc

SEQ ID NO: 261426 - DNA, 29 bp, Artificial Sequence
  Description of Artificial Sequence: Synthetic oligonucleotide
tcaatgcccccaccttaagaggtgccatc

SEQ ID NO: 261427 - DNA, 28 bp, Artificial Sequence
  Description of Artificial Sequence: Synthetic oligonucleotide
caatgcccccaccttaagaggtgccatc

SEQ ID NO: 261428 - DNA, 28 bp, Artificial Sequence
  Description of Artificial Sequence: Synthetic oligonucleotide
aatgcccccaccttaagaggtgccatcg

SEQ ID NO: 261429 - DNA, 27 bp, Artificial Sequence
  Description of Artificial Sequence: Synthetic oligonucleotide
atgcccccaccttaagaggtgccatcg

SEQ ID NO: 261430 - DNA, 27 bp, Artificial Sequence
  Description of Artificial Sequence: Synthetic oligonucleotide
tgcccccaccttaagaggtgccatcga

SEQ ID NO: 261431 - DNA, 27 bp, Artificial Sequence
  Description of Artificial Sequence: Synthetic oligonucleotide
gcccccaccttaagaggtgccatcgat

SEQ ID NO: 261432 - DNA, 27 bp, Artificial Sequence
  Description of Artificial Sequence: Synthetic oligonucleotide
cccccaccttaagaggtgccatcgatg

SEQ ID NO: 261433 - DNA, 29 bp, Artificial Sequence
  Description of Artificial Sequence: Synthetic oligonucleotide
ccccaccttaagaggtgccatcgatgtag

SEQ ID NO: 261434 - DNA, 29 bp, Artificial Sequence
  Description of Artificial Sequence: Synthetic oligonucleotide
cccaccttaagaggtgccatcgatgtagc

SEQ ID NO: 261435 - DNA, 32 bp, Artificial Sequence
  Description of Artificial Sequence: Synthetic oligonucleotide
ccaccttaagaggtgccatcgatgtagctatg

SEQ ID NO: 261436 - DNA, 32 bp, Artificial Sequence
  Description of Artificial Sequence: Synthetic oligonucleotide
caccttaagaggtgccatcgatgtagctatgg

SEQ ID NO: 261437 - DNA, 32 bp, Artificial Sequence
  Description of Artificial Sequence: Synthetic oligonucleotide
accttaagaggtgccatcgatgtagctatggg

SEQ ID NO: 261438 - DNA, 31 bp, Artificial Sequence
  Description of Artificial Sequence: Synthetic oligonucleotide
ccttaagaggtgccatcgatgtagctatggg

SEQ ID NO: 261439 - DNA, 33 bp, Artificial Sequence
  Description of Artificial Sequence: Synthetic oligonucleotide
cttaagaggtgccatcgatgtagctatgggatc

SEQ ID NO: 261440 - DNA, 34 bp, Artificial Sequence
  Description of Artificial Sequence: Synthetic oligonucleotide
ttaagaggtgccatcgatgtagctatgggatcag

SEQ ID NO: 261441 - DNA, 33 bp, Artificial Sequence
  Description of Artificial Sequence: Synthetic oligonucleotide
taagaggtgccatcgatgtagctatgggatcag

SEQ ID NO: 261442 - DNA, 32 bp, Artificial Sequence
  Description of Artificial Sequence: Synthetic oligonucleotide
aagaggtgccatcgatgtagctatgggatcag

SEQ ID NO: 261443 - DNA, 31 bp, Artificial Sequence
  Description of Artificial Sequence: Synthetic oligonucleotide
agaggtgccatcgatgtagctatgggatcag

SEQ ID NO: 261444 - DNA, 30 bp, Artificial Sequence
  Description of Artificial Sequence: Synthetic oligonucleotide
gaggtgccatcgatgtagctatgggatcag

SEQ ID NO: 261445 - DNA, 30 bp, Artificial Sequence
  Description of Artificial Sequence: Synthetic oligonucleotide
aggtgccatcgatgtagctatgggatcagc

SEQ ID NO: 261446 - DNA, 29 bp, Artificial Sequence
  Description of Artificial Sequence: Synthetic oligonucleotide
ggtgccatcgatgtagctatgggatcagc

SEQ ID NO: 261447 - DNA, 30 bp, Artificial Sequence
  Description of Artificial Sequence: Synthetic oligonucleotide
gtgccatcgatgtagctatgggatcagctg

SEQ ID NO: 261448 - DNA, 30 bp, Artificial Sequence
  Description of Artificial Sequence: Synthetic oligonucleotide
tgccatcgatgtagctatgggatcagctgc

SEQ ID NO: 261449 - DNA, 29 bp, Artificial Sequence
  Description of Artificial Sequence: Synthetic oligonucleotide
gccatcgatgtagctatgggatcagctgc

SEQ ID NO: 261450 - DNA, 29 bp, Artificial Sequence
  Description of Artificial Sequence: Synthetic oligonucleotide
ccatcgatgtagctatgggatcagctgcc

SEQ ID NO: 261451 - DNA, 30 bp, Artificial Sequence
  Description of Artificial Sequence: Synthetic oligonucleotide
catcgatgtagctatgggatcagctgccac

SEQ ID NO: 261452 - DNA, 31 bp, Artificial Sequence
  Description of Artificial Sequence: Synthetic oligonucleotide
atcgatgtagctatgggatcagctgccactg

SEQ ID NO: 261453 - DNA, 30 bp, Artificial Sequence
  Description of Artificial Sequence: Synthetic oligonucleotide
tcgatgtagctatgggatcagctgccactg

SEQ ID NO: 261454 - DNA, 29 bp, Artificial Sequence
  Description of Artificial Sequence: Synthetic oligonucleotide
cgatgtagctatgggatcagctgccactg

SEQ ID NO: 261455 - DNA, 29 bp, Artificial Sequence
  Description of Artificial Sequence: Synthetic oligonucleotide
gatgtagctatgggatcagctgccactgg

SEQ ID NO: 261456 - DNA, 29 bp, Artificial Sequence
  Description of Artificial Sequence: Synthetic oligonucleotide
atgtagctatgggatcagctgccactggc

SEQ ID NO: 261457 - DNA, 28 bp, Artificial Sequence
  Description of Artificial Sequence: Synthetic oligonucleotide
tgtagctatgggatcagctgccactggc

SEQ ID NO: 261458 - DNA, 27 bp, Artificial Sequence
  Description of Artificial Sequence: Synthetic oligonucleotide
gtagctatgggatcagctgccactggc

SEQ ID NO: 261459 - DNA, 27 bp, Artificial Sequence
  Description of Artificial Sequence: Synthetic oligonucleotide
tagctatgggatcagctgccactggcg

SEQ ID NO: 261460 - DNA, 27 bp, Artificial Sequence
  Description of Artificial Sequence: Synthetic oligonucleotide
agctatgggatcagctgccactggcgt

SEQ ID NO: 261461 - DNA, 26 bp, Artificial Sequence
  Description of Artificial Sequence: Synthetic oligonucleotide
gctatgggatcagctgccactggcgt

SEQ ID NO: 261462 - DNA, 27 bp, Artificial Sequence
  Description of Artificial Sequence: Synthetic oligonucleotide
ctatgggatcagctgccactggcgtct

SEQ ID NO: 261463 - DNA, 30 bp, Artificial Sequence
  Description of Artificial Sequence: Synthetic oligonucleotide
tatgggatcagctgccactggcgtctttac

SEQ ID NO: 261464 - DNA, 29 bp, Artificial Sequence
  Description of Artificial Sequence: Synthetic oligonucleotide
atgggatcagctgccactggcgtctttac

SEQ ID NO: 261465 - DNA, 28 bp, Artificial Sequence
  Description of Artificial Sequence: Synthetic oligonucleotide
tgggatcagctgccactggcgtctttac

SEQ ID NO: 261466 - DNA, 27 bp, Artificial Sequence
  Description of Artificial Sequence: Synthetic oligonucleotide
gggatcagctgccactggcgtctttac

SEQ ID NO: 261467 - DNA, 27 bp, Artificial Sequence
  Description of Artificial Sequence: Synthetic oligonucleotide
ggatcagctgccactggcgtctttacc

SEQ ID NO: 261468 - DNA, 31 bp, Artificial Sequence
  Description of Artificial Sequence: Synthetic oligonucleotide
gatcagctgccactggcgtctttacctattc

SEQ ID NO: 261469 - DNA, 33 bp, Artificial Sequence
  Description of Artificial Sequence: Synthetic oligonucleotide
atcagctgccactggcgtctttacctattcatc

SEQ ID NO: 261470 - DNA, 32 bp, Artificial Sequence
  Description of Artificial Sequence: Synthetic oligonucleotide
tcagctgccactggcgtctttacctattcatc

SEQ ID NO: 261471 - DNA, 31 bp, Artificial Sequence
  Description of Artificial Sequence: Synthetic oligonucleotide
cagctgccactggcgtctttacctattcatc

SEQ ID NO: 261472 - DNA, 31 bp, Artificial Sequence
  Description of Artificial Sequence: Synthetic oligonucleotide
agctgccactggcgtctttacctattcatcc

SEQ ID NO: 261473 - DNA, 30 bp, Artificial Sequence
  Description of Artificial Sequence: Synthetic oligonucleotide
gctgccactggcgtctttacctattcatcc

SEQ ID NO: 261474 - DNA, 31 bp, Artificial Sequence
  Description of Artificial Sequence: Synthetic oligonucleotide
ctgccactggcgtctttacctattcatcctc

SEQ ID NO: 261475 - DNA, 31 bp, Artificial Sequence
  Description of Artificial Sequence: Synthetic oligonucleotide
tgccactggcgtctttacctattcatcctcg

SEQ ID NO: 261476 - DNA, 30 bp, Artificial Sequence
  Description of Artificial Sequence: Synthetic oligonucleotide
gccactggcgtctttacctattcatcctcg

SEQ ID NO: 261477 - DNA, 30 bp, Artificial Sequence
  Description of Artificial Sequence: Synthetic oligonucleotide
ccactggcgtctttacctattcatcctcgc

SEQ ID NO: 261478 - DNA, 31 bp, Artificial Sequence
  Description of Artificial Sequence: Synthetic oligonucleotide
cactggcgtctttacctattcatcctcgctc

SEQ ID NO: 261479 - DNA, 32 bp, Artificial Sequence
  Description of Artificial Sequence: Synthetic oligonucleotide
actggcgtctttacctattcatcctcgctctg

SEQ ID NO: 261480 - DNA, 31 bp, Artificial Sequence
  Description of Artificial Sequence: Synthetic oligonucleotide
ctggcgtctttacctattcatcctcgctctg

SEQ ID NO: 261481 - DNA, 31 bp, Artificial Sequence
  Description of Artificial Sequence: Synthetic oligonucleotide
tggcgtctttacctattcatcctcgctctgg

SEQ ID NO: 261482 - DNA, 30 bp, Artificial Sequence
  Description of Artificial Sequence: Synthetic oligonucleotide
ggcgtctttacctattcatcctcgctctgg

SEQ ID NO: 261483 - DNA, 32 bp, Artificial Sequence
  Description of Artificial Sequence: Synthetic oligonucleotide
gcgtctttacctattcatcctcgctctggaag

SEQ ID NO: 261484 - DNA, 35 bp, Artificial Sequence
  Description of Artificial Sequence: Synthetic oligonucleotide
cgtctttacctattcatcctcgctctggaagaaac

SEQ ID NO: 261485 - DNA, 36 bp, Artificial Sequence
  Description of Artificial Sequence: Synthetic oligonucleotide
gtctttacctattcatcctcgctctggaagaaactc

SEQ ID NO: 261486 - DNA, 38 bp, Artificial Sequence
  Description of Artificial Sequence: Synthetic oligonucleotide
tctttacctattcatcctcgctctggaagaaactcttc

SEQ ID NO: 261487 - DNA, 37 bp, Artificial Sequence
  Description of Artificial Sequence: Synthetic oligonucleotide
ctttacctattcatcctcgctctggaagaaactcttc

SEQ ID NO: 261488 - DNA, 37 bp, Artificial Sequence
  Description of Artificial Sequence: Synthetic oligonucleotide
tttacctattcatcctcgctctggaagaaactcttcc

SEQ ID NO: 261489 - DNA, 36 bp, Artificial Sequence
  Description of Artificial Sequence: Synthetic oligonucleotide
ttacctattcatcctcgctctggaagaaactcttcc

SEQ ID NO: 261490 - DNA, 35 bp, Artificial Sequence
  Description of Artificial Sequence: Synthetic oligonucleotide
tacctattcatcctcgctctggaagaaactcttcc

SEQ ID NO: 261491 - DNA, 34 bp, Artificial Sequence
  Description of Artificial Sequence: Synthetic oligonucleotide
acctattcatcctcgctctggaagaaactcttcc

SEQ ID NO: 261492 - DNA, 33 bp, Artificial Sequence
  Description of Artificial Sequence: Synthetic oligonucleotide
cctattcatcctcgctctggaagaaactcttcc

SEQ ID NO: 261493 - DNA, 34 bp, Artificial Sequence
  Description of Artificial Sequence: Synthetic oligonucleotide
ctattcatcctcgctctggaagaaactcttccag

SEQ ID NO: 261494 - DNA, 34 bp, Artificial Sequence
  Description of Artificial Sequence: Synthetic oligonucleotide
tattcatcctcgctctggaagaaactcttccagg

SEQ ID NO: 261495 - DNA, 33 bp, Artificial Sequence
  Description of Artificial Sequence: Synthetic oligonucleotide
attcatcctcgctctggaagaaactcttccagg

SEQ ID NO: 261496 - DNA, 32 bp, Artificial Sequence
  Description of Artificial Sequence: Synthetic oligonucleotide
ttcatcctcgctctggaagaaactcttccagg

SEQ ID NO: 261497 - DNA, 31 bp, Artificial Sequence
  Description of Artificial Sequence: Synthetic oligonucleotide
tcatcctcgctctggaagaaactcttccagg

SEQ ID NO: 261498 - DNA, 30 bp, Artificial Sequence
  Description of Artificial Sequence: Synthetic oligonucleotide
catcctcgctctggaagaaactcttccagg

SEQ ID NO: 261499 - DNA, 30 bp, Artificial Sequence
  Description of Artificial Sequence: Synthetic oligonucleotide
atcctcgctctggaagaaactcttccaggc

SEQ ID NO: 261500 - DNA, 29 bp, Artificial Sequence
  Description of Artificial Sequence: Synthetic oligonucleotide
tcctcgctctggaagaaactcttccaggc

SEQ ID NO: 261501 - DNA, 28 bp, Artificial Sequence
  Description of Artificial Sequence: Synthetic oligonucleotide
cctcgctctggaagaaactcttccaggc

SEQ ID NO: 261502 - DNA, 28 bp, Artificial Sequence
  Description of Artificial Sequence: Synthetic oligonucleotide
ctcgctctggaagaaactcttccaggcc

SEQ ID NO: 261503 - DNA, 29 bp, Artificial Sequence
  Description of Artificial Sequence: Synthetic oligonucleotide
tcgctctggaagaaactcttccaggccag

SEQ ID NO: 261504 - DNA, 28 bp, Artificial Sequence
  Description of Artificial Sequence: Synthetic oligonucleotide
cgctctggaagaaactcttccaggccag

SEQ ID NO: 261505 - DNA, 28 bp, Artificial Sequence
  Description of Artificial Sequence: Synthetic oligonucleotide
gctctggaagaaactcttccaggccagc

SEQ ID NO: 261506 - DNA, 31 bp, Artificial Sequence
  Description of Artificial Sequence: Synthetic oligonucleotide
ctctggaagaaactcttccaggccagcaatg

SEQ ID NO: 261507 - DNA, 34 bp, Artificial Sequence
  Description of Artificial Sequence: Synthetic oligonucleotide
tctggaagaaactcttccaggccagcaatgaaac

SEQ ID NO: 261508 - DNA, 33 bp, Artificial Sequence
  Description of Artificial Sequence: Synthetic oligonucleotide
ctggaagaaactcttccaggccagcaatgaaac

SEQ ID NO: 261509 - DNA, 34 bp, Artificial Sequence
  Description of Artificial Sequence: Synthetic oligonucleotide
tggaagaaactcttccaggccagcaatgaaacag

SEQ ID NO: 261510 - DNA, 33 bp, Artificial Sequence
  Description of Artificial Sequence: Synthetic oligonucleotide
ggaagaaactcttccaggccagcaatgaaacag

SEQ ID NO: 261511 - DNA, 33 bp, Artificial Sequence
  Description of Artificial Sequence: Synthetic oligonucleotide
gaagaaactcttccaggccagcaatgaaacagg

SEQ ID NO: 261512 - DNA, 33 bp, Artificial Sequence
  Description of Artificial Sequence: Synthetic oligonucleotide
aagaaactcttccaggccagcaatgaaacaggc

SEQ ID NO: 261513 - DNA, 32 bp, Artificial Sequence
  Description of Artificial Sequence: Synthetic oligonucleotide
agaaactcttccaggccagcaatgaaacaggc

SEQ ID NO: 261514 - DNA, 31 bp, Artificial Sequence
  Description of Artificial Sequence: Synthetic oligonucleotide
gaaactcttccaggccagcaatgaaacaggc

SEQ ID NO: 261515 - DNA, 31 bp, Artificial Sequence
  Description of Artificial Sequence: Synthetic oligonucleotide
aaactcttccaggccagcaatgaaacaggcg

SEQ ID NO: 261516 - DNA, 30 bp, Artificial Sequence
  Description of Artificial Sequence: Synthetic oligonucleotide
aactcttccaggccagcaatgaaacaggcg

SEQ ID NO: 261517 - DNA, 29 bp, Artificial Sequence
  Description of Artificial Sequence: Synthetic oligonucleotide
actcttccaggccagcaatgaaacaggcg

SEQ ID NO: 261518 - DNA, 28 bp, Artificial Sequence
  Description of Artificial Sequence: Synthetic oligonucleotide
ctcttccaggccagcaatgaaacaggcg

SEQ ID NO: 261519 - DNA, 29 bp, Artificial Sequence
  Description of Artificial Sequence: Synthetic oligonucleotide
tcttccaggccagcaatgaaacaggcgac

SEQ ID NO: 261520 - DNA, 28 bp, Artificial Sequence
  Description of Artificial Sequence: Synthetic oligonucleotide
cttccaggccagcaatgaaacaggcgac

SEQ ID NO: 261521 - DNA, 28 bp, Artificial Sequence
  Description of Artificial Sequence: Synthetic oligonucleotide
ttccaggccagcaatgaaacaggcgacc

SEQ ID NO: 261522 - DNA, 27 bp, Artificial Sequence
  Description of Artificial Sequence: Synthetic oligonucleotide
tccaggccagcaatgaaacaggcgacc

SEQ ID NO: 261523 - DNA, 26 bp, Artificial Sequence
  Description of Artificial Sequence: Synthetic oligonucleotide
ccaggccagcaatgaaacaggcgacc

SEQ ID NO: 261524 - DNA, 27 bp, Artificial Sequence
  Description of Artificial Sequence: Synthetic oligonucleotide
caggccagcaatgaaacaggcgaccgt

SEQ ID NO: 261525 - DNA, 27 bp, Artificial Sequence
  Description of Artificial Sequence: Synthetic oligonucleotide
aggccagcaatgaaacaggcgaccgtg

SEQ ID NO: 261526 - DNA, 27 bp, Artificial Sequence
  Description of Artificial Sequence: Synthetic oligonucleotide
ggccagcaatgaaacaggcgaccgtgt

SEQ ID NO: 261527 - DNA, 27 bp, Artificial Sequence
  Description of Artificial Sequence: Synthetic oligonucleotide
gccagcaatgaaacaggcgaccgtgtc

SEQ ID NO: 261528 - DNA, 28 bp, Artificial Sequence
  Description of Artificial Sequence: Synthetic oligonucleotide
ccagcaatgaaacaggcgaccgtgtcag

SEQ ID NO: 261529 - DNA, 28 bp, Artificial Sequence
  Description of Artificial Sequence: Synthetic oligonucleotide
cagcaatgaaacaggcgaccgtgtcagg

SEQ ID NO: 261530 - DNA, 29 bp, Artificial Sequence
  Description of Artificial Sequence: Synthetic oligonucleotide
agcaatgaaacaggcgaccgtgtcaggag

SEQ ID NO: 261531 - DNA, 28 bp, Artificial Sequence
  Description of Artificial Sequence: Synthetic oligonucleotide
gcaatgaaacaggcgaccgtgtcaggag

SEQ ID NO: 261532 - DNA, 28 bp, Artificial Sequence
  Description of Artificial Sequence: Synthetic oligonucleotide
caatgaaacaggcgaccgtgtcaggagg

SEQ ID NO: 261533 - DNA, 30 bp, Artificial Sequence
  Description of Artificial Sequence: Synthetic oligonucleotide
aatgaaacaggcgaccgtgtcaggaggatg

SEQ ID NO: 261534 - DNA, 29 bp, Artificial Sequence
  Description of Artificial Sequence: Synthetic oligonucleotide
atgaaacaggcgaccgtgtcaggaggatg

SEQ ID NO: 261535 - DNA, 28 bp, Artificial Sequence
  Description of Artificial Sequence: Synthetic oligonucleotide
tgaaacaggcgaccgtgtcaggaggatg

SEQ ID NO: 261536 - DNA, 27 bp, Artificial Sequence
  Description of Artificial Sequence: Synthetic oligonucleotide
gaaacaggcgaccgtgtcaggaggatg

SEQ ID NO: 261537 - DNA, 27 bp, Artificial Sequence
  Description of Artificial Sequence: Synthetic oligonucleotide
aaacaggcgaccgtgtcaggaggatgc

SEQ ID NO: 261538 - DNA, 26 bp, Artificial Sequence
  Description of Artificial Sequence: Synthetic oligonucleotide
aacaggcgaccgtgtcaggaggatgc

SEQ ID NO: 261539 - DNA, 25 bp, Artificial Sequence
  Description of Artificial Sequence: Synthetic oligonucleotide
acaggcgaccgtgtcaggaggatgc

SEQ ID NO: 261540 - DNA, 24 bp, Artificial Sequence
  Description of Artificial Sequence: Synthetic oligonucleotide
caggcgaccgtgtcaggaggatgc

SEQ ID NO: 261541 - DNA, 25 bp, Artificial Sequence
  Description of Artificial Sequence: Synthetic oligonucleotide
aggcgaccgtgtcaggaggatgcgt

SEQ ID NO: 261542 - DNA, 24 bp, Artificial Sequence
  Description of Artificial Sequence: Synthetic oligonucleotide
ggcgaccgtgtcaggaggatgcgt

SEQ ID NO: 261543 - DNA, 25 bp, Artificial Sequence
  Description of Artificial Sequence: Synthetic oligonucleotide
gcgaccgtgtcaggaggatgcgtct

SEQ ID NO: 261544 - DNA, 27 bp, Artificial Sequence
  Description of Artificial Sequence: Synthetic oligonucleotide
cgaccgtgtcaggaggatgcgtctctt

SEQ ID NO: 261545 - DNA, 27 bp, Artificial Sequence
  Description of Artificial Sequence: Synthetic oligonucleotide
gaccgtgtcaggaggatgcgtctcttc

SEQ ID NO: 261546 - DNA, 27 bp, Artificial Sequence
  Description of Artificial Sequence: Synthetic oligonucleotide
accgtgtcaggaggatgcgtctcttcg

SEQ ID NO: 261547 - DNA, 27 bp, Artificial Sequence
  Description of Artificial Sequence: Synthetic oligonucleotide
ccgtgtcaggaggatgcgtctcttcga

SEQ ID NO: 261548 - DNA, 28 bp, Artificial Sequence
  Description of Artificial Sequence: Synthetic oligonucleotide
cgtgtcaggaggatgcgtctcttcgatc

SEQ ID NO: 261549 - DNA, 34 bp, Artificial Sequence
  Description of Artificial Sequence: Synthetic oligonucleotide
gtgtcaggaggatgcgtctcttcgatcattatac

SEQ ID NO: 261550 - DNA, 36 bp, Artificial Sequence
  Description of Artificial Sequence: Synthetic oligonucleotide
tgtcaggaggatgcgtctcttcgatcattatacatg

SEQ ID NO: 261551 - DNA, 35 bp, Artificial Sequence
  Description of Artificial Sequence: Synthetic oligonucleotide
gtcaggaggatgcgtctcttcgatcattatacatg

SEQ ID NO: 261552 - DNA, 36 bp, Artificial Sequence
  Description of Artificial Sequence: Synthetic oligonucleotide
tcaggaggatgcgtctcttcgatcattatacatgac

SEQ ID NO: 261553 - DNA, 35 bp, Artificial Sequence
  Description of Artificial Sequence: Synthetic oligonucleotide
caggaggatgcgtctcttcgatcattatacatgac

SEQ ID NO: 261554 - DNA, 36 bp, Artificial Sequence
  Description of Artificial Sequence: Synthetic oligonucleotide
aggaggatgcgtctcttcgatcattatacatgacag

SEQ ID NO: 261555 - DNA, 35 bp, Artificial Sequence
  Description of Artificial Sequence: Synthetic oligonucleotide
ggaggatgcgtctcttcgatcattatacatgacag

SEQ ID NO: 261556 - DNA, 35 bp, Artificial Sequence
  Description of Artificial Sequence: Synthetic oligonucleotide
gaggatgcgtctcttcgatcattatacatgacagg

SEQ ID NO: 261557 - DNA, 37 bp, Artificial Sequence
  Description of Artificial Sequence: Synthetic oligonucleotide
aggatgcgtctcttcgatcattatacatgacaggttg

SEQ ID NO: 261558 - DNA, 36 bp, Artificial Sequence
  Description of Artificial Sequence: Synthetic oligonucleotide
ggatgcgtctcttcgatcattatacatgacaggttg

SEQ ID NO: 261559 - DNA, 38 bp, Artificial Sequence
  Description of Artificial Sequence: Synthetic oligonucleotide
gatgcgtctcttcgatcattatacatgacaggttgaag

SEQ ID NO: 261560 - DNA, 41 bp, Artificial Sequence
  Description of Artificial Sequence: Synthetic oligonucleotide
atgcgtctcttcgatcattatacatgacaggttgaagattg

SEQ ID NO: 261561 - DNA, 40 bp, Artificial Sequence
  Description of Artificial Sequence: Synthetic oligonucleotide
tgcgtctcttcgatcattatacatgacaggttgaagattg

SEQ ID NO: 261562 - DNA, 39 bp, Artificial Sequence
  Description of Artificial Sequence: Synthetic oligonucleotide
gcgtctcttcgatcattatacatgacaggttgaagattg

SEQ ID NO: 261563 - DNA, 39 bp, Artificial Sequence
  Description of Artificial Sequence: Synthetic oligonucleotide
cgtctcttcgatcattatacatgacaggttgaagattgc

SEQ ID NO: 261564 - DNA, 39 bp, Artificial Sequence
  Description of Artificial Sequence: Synthetic oligonucleotide
gtctcttcgatcattatacatgacaggttgaagattgcc

SEQ ID NO: 261565 - DNA, 40 bp, Artificial Sequence
  Description of Artificial Sequence: Synthetic oligonucleotide
tctcttcgatcattatacatgacaggttgaagattgccac

SEQ ID NO: 261566 - DNA, 39 bp, Artificial Sequence
  Description of Artificial Sequence: Synthetic oligonucleotide
ctcttcgatcattatacatgacaggttgaagattgccac

SEQ ID NO: 261567 - DNA, 39 bp, Artificial Sequence
  Description of Artificial Sequence: Synthetic oligonucleotide
tcttcgatcattatacatgacaggttgaagattgccacc

SEQ ID NO: 261568 - DNA, 38 bp, Artificial Sequence
  Description of Artificial Sequence: Synthetic oligonucleotide
cttcgatcattatacatgacaggttgaagattgccacc

SEQ ID NO: 261569 - DNA, 40 bp, Artificial Sequence
  Description of Artificial Sequence: Synthetic oligonucleotide
ttcgatcattatacatgacaggttgaagattgccaccttg

SEQ ID NO: 261570 - DNA, 39 bp, Artificial Sequence
  Description of Artificial Sequence: Synthetic oligonucleotide
tcgatcattatacatgacaggttgaagattgccaccttg

SEQ ID NO: 261571 - DNA, 38 bp, Artificial Sequence
  Description of Artificial Sequence: Synthetic oligonucleotide
cgatcattatacatgacaggttgaagattgccaccttg

SEQ ID NO: 261572 - DNA, 38 bp, Artificial Sequence
  Description of Artificial Sequence: Synthetic oligonucleotide
gatcattatacatgacaggttgaagattgccaccttgc

SEQ ID NO: 261573 - DNA, 39 bp, Artificial Sequence
  Description of Artificial Sequence: Synthetic oligonucleotide
atcattatacatgacaggttgaagattgccaccttgctg

SEQ ID NO: 261574 - DNA, 38 bp, Artificial Sequence
  Description of Artificial Sequence: Synthetic oligonucleotide
tcattatacatgacaggttgaagattgccaccttgctg

SEQ ID NO: 261575 - DNA, 37 bp, Artificial Sequence
  Description of Artificial Sequence: Synthetic oligonucleotide
cattatacatgacaggttgaagattgccaccttgctg

SEQ ID NO: 261576 - DNA, 39 bp, Artificial Sequence
  Description of Artificial Sequence: Synthetic oligonucleotide
attatacatgacaggttgaagattgccaccttgctgatc

SEQ ID NO: 261577 - DNA, 38 bp, Artificial Sequence
  Description of Artificial Sequence: Synthetic oligonucleotide
ttatacatgacaggttgaagattgccaccttgctgatc

SEQ ID NO: 261578 - DNA, 37 bp, Artificial Sequence
  Description of Artificial Sequence: Synthetic oligonucleotide
tatacatgacaggttgaagattgccaccttgctgatc

SEQ ID NO: 261579 - DNA, 36 bp, Artificial Sequence
  Description of Artificial Sequence: Synthetic oligonucleotide
atacatgacaggttgaagattgccaccttgctgatc

SEQ ID NO: 261580 - DNA, 35 bp, Artificial Sequence
  Description of Artificial Sequence: Synthetic oligonucleotide
tacatgacaggttgaagattgccaccttgctgatc

SEQ ID NO: 261581 - DNA, 34 bp, Artificial Sequence
  Description of Artificial Sequence: Synthetic oligonucleotide
acatgacaggttgaagattgccaccttgctgatc

SEQ ID NO: 261582 - DNA, 33 bp, Artificial Sequence
  Description of Artificial Sequence: Synthetic oligonucleotide
catgacaggttgaagattgccaccttgctgatc

SEQ ID NO: 261583 - DNA, 37 bp, Artificial Sequence
  Description of Artificial Sequence: Synthetic oligonucleotide
atgacaggttgaagattgccaccttgctgatcttaac

SEQ ID NO: 261584 - DNA, 36 bp, Artificial Sequence
  Description of Artificial Sequence: Synthetic oligonucleotide
tgacaggttgaagattgccaccttgctgatcttaac

SEQ ID NO: 261585 - DNA, 35 bp, Artificial Sequence
  Description of Artificial Sequence: Synthetic oligonucleotide
gacaggttgaagattgccaccttgctgatcttaac

SEQ ID NO: 261586 - DNA, 37 bp, Artificial Sequence
  Description of Artificial Sequence: Synthetic oligonucleotide
acaggttgaagattgccaccttgctgatcttaacaac

SEQ ID NO: 261587 - DNA, 36 bp, Artificial Sequence
  Description of Artificial Sequence: Synthetic oligonucleotide
caggttgaagattgccaccttgctgatcttaacaac

SEQ ID NO: 261588 - DNA, 39 bp, Artificial Sequence
  Description of Artificial Sequence: Synthetic oligonucleotide
aggttgaagattgccaccttgctgatcttaacaacaatg

SEQ ID NO: 261589 - DNA, 38 bp, Artificial Sequence
  Description of Artificial Sequence: Synthetic oligonucleotide
ggttgaagattgccaccttgctgatcttaacaacaatg

SEQ ID NO: 261590 - DNA, 38 bp, Artificial Sequence
  Description of Artificial Sequence: Synthetic oligonucleotide
gttgaagattgccaccttgctgatcttaacaacaatgg

SEQ ID NO: 261591 - DNA, 44 bp, Artificial Sequence
  Description of Artificial Sequence: Synthetic oligonucleotide
ttgaagattgccaccttgctgatcttaacaacaatggaaaatag

SEQ ID NO: 261592 - DNA, 43 bp, Artificial Sequence
  Description of Artificial Sequence: Synthetic oligonucleotide
tgaagattgccaccttgctgatcttaacaacaatggaaaatag

SEQ ID NO: 261593 - DNA, 42 bp, Artificial Sequence
  Description of Artificial Sequence: Synthetic oligonucleotide
gaagattgccaccttgctgatcttaacaacaatggaaaatag

SEQ ID NO: 261594 - DNA, 43 bp, Artificial Sequence
  Description of Artificial Sequence: Synthetic oligonucleotide
aagattgccaccttgctgatcttaacaacaatggaaaatagag

SEQ ID NO: 261595 - DNA, 42 bp, Artificial Sequence
  Description of Artificial Sequence: Synthetic oligonucleotide
agattgccaccttgctgatcttaacaacaatggaaaatagag

SEQ ID NO: 261596 - DNA, 41 bp, Artificial Sequence
  Description of Artificial Sequence: Synthetic oligonucleotide
gattgccaccttgctgatcttaacaacaatggaaaatagag

SEQ ID NO: 261597 - DNA, 43 bp, Artificial Sequence
  Description of Artificial Sequence: Synthetic oligonucleotide
attgccaccttgctgatcttaacaacaatggaaaatagagatc

SEQ ID NO: 261598 - DNA, 42 bp, Artificial Sequence
  Description of Artificial Sequence: Synthetic oligonucleotide
ttgccaccttgctgatcttaacaacaatggaaaatagagatc

SEQ ID NO: 261599 - DNA, 41 bp, Artificial Sequence
  Description of Artificial Sequence: Synthetic oligonucleotide
tgccaccttgctgatcttaacaacaatggaaaatagagatc

SEQ ID NO: 261600 - DNA, 40 bp, Artificial Sequence
  Description of Artificial Sequence: Synthetic oligonucleotide
gccaccttgctgatcttaacaacaatggaaaatagagatc

SEQ ID NO: 261601 - DNA, 41 bp, Artificial Sequence
  Description of Artificial Sequence: Synthetic oligonucleotide
ccaccttgctgatcttaacaacaatggaaaatagagatctg

SEQ ID NO: 261602 - DNA, 41 bp, Artificial Sequence
  Description of Artificial Sequence: Synthetic oligonucleotide
caccttgctgatcttaacaacaatggaaaatagagatctgc

SEQ ID NO: 261603 - DNA, 42 bp, Artificial Sequence
  Description of Artificial Sequence: Synthetic oligonucleotide
accttgctgatcttaacaacaatggaaaatagagatctgcac

SEQ ID NO: 261604 - DNA, 41 bp, Artificial Sequence
  Description of Artificial Sequence: Synthetic oligonucleotide
ccttgctgatcttaacaacaatggaaaatagagatctgcac

SEQ ID NO: 261605 - DNA, 41 bp, Artificial Sequence
  Description of Artificial Sequence: Synthetic oligonucleotide
cttgctgatcttaacaacaatggaaaatagagatctgcacg

SEQ ID NO: 261606 - DNA, 42 bp, Artificial Sequence
  Description of Artificial Sequence: Synthetic oligonucleotide
ttgctgatcttaacaacaatggaaaatagagatctgcacgag

SEQ ID NO: 261607 - DNA, 41 bp, Artificial Sequence
  Description of Artificial Sequence: Synthetic oligonucleotide
tgctgatcttaacaacaatggaaaatagagatctgcacgag

SEQ ID NO: 261608 - DNA, 40 bp, Artificial Sequence
  Description of Artificial Sequence: Synthetic oligonucleotide
gctgatcttaacaacaatggaaaatagagatctgcacgag

SEQ ID NO: 261609 - DNA, 40 bp, Artificial Sequence
  Description of Artificial Sequence: Synthetic oligonucleotide
ctgatcttaacaacaatggaaaatagagatctgcacgagc

SEQ ID NO: 261610 - DNA, 42 bp, Artificial Sequence
  Description of Artificial Sequence: Synthetic oligonucleotide
tgatcttaacaacaatggaaaatagagatctgcacgagcatg

SEQ ID NO: 261611 - DNA, 41 bp, Artificial Sequence
  Description of Artificial Sequence: Synthetic oligonucleotide
gatcttaacaacaatggaaaatagagatctgcacgagcatg

SEQ ID NO: 261612 - DNA, 43 bp, Artificial Sequence
  Description of Artificial Sequence: Synthetic oligonucleotide
atcttaacaacaatggaaaatagagatctgcacgagcatgtag

SEQ ID NO: 261613 - DNA, 42 bp, Artificial Sequence
  Description of Artificial Sequence: Synthetic oligonucleotide
tcttaacaacaatggaaaatagagatctgcacgagcatgtag

SEQ ID NO: 261614 - DNA, 41 bp, Artificial Sequence
  Description of Artificial Sequence: Synthetic oligonucleotide
cttaacaacaatggaaaatagagatctgcacgagcatgtag

SEQ ID NO: 261615 - DNA, 42 bp, Artificial Sequence
  Description of Artificial Sequence: Synthetic oligonucleotide
ttaacaacaatggaaaatagagatctgcacgagcatgtagag

SEQ ID NO: 261616 - DNA, 41 bp, Artificial Sequence
  Description of Artificial Sequence: Synthetic oligonucleotide
taacaacaatggaaaatagagatctgcacgagcatgtagag

SEQ ID NO: 261617 - DNA, 40 bp, Artificial Sequence
  Description of Artificial Sequence: Synthetic oligonucleotide
aacaacaatggaaaatagagatctgcacgagcatgtagag

SEQ ID NO: 261618 - DNA, 39 bp, Artificial Sequence
  Description of Artificial Sequence: Synthetic oligonucleotide
acaacaatggaaaatagagatctgcacgagcatgtagag

SEQ ID NO: 261619 - DNA, 38 bp, Artificial Sequence
  Description of Artificial Sequence: Synthetic oligonucleotide
caacaatggaaaatagagatctgcacgagcatgtagag

SEQ ID NO: 261620 - DNA, 38 bp, Artificial Sequence
  Description of Artificial Sequence: Synthetic oligonucleotide
aacaatggaaaatagagatctgcacgagcatgtagagc

SEQ ID NO: 261621 - DNA, 37 bp, Artificial Sequence
  Description of Artificial Sequence: Synthetic oligonucleotide
acaatggaaaatagagatctgcacgagcatgtagagc

SEQ ID NO: 261622 - DNA, 36 bp, Artificial Sequence
  Description of Artificial Sequence: Synthetic oligonucleotide
caatggaaaatagagatctgcacgagcatgtagagc

SEQ ID NO: 261623 - DNA, 37 bp, Artificial Sequence
  Description of Artificial Sequence: Synthetic oligonucleotide
aatggaaaatagagatctgcacgagcatgtagagctg

SEQ ID NO: 261624 - DNA, 36 bp, Artificial Sequence
  Description of Artificial Sequence: Synthetic oligonucleotide
atggaaaatagagatctgcacgagcatgtagagctg

SEQ ID NO: 261625 - DNA, 35 bp, Artificial Sequence
  Description of Artificial Sequence: Synthetic oligonucleotide
tggaaaatagagatctgcacgagcatgtagagctg

SEQ ID NO: 261626 - DNA, 34 bp, Artificial Sequence
  Description of Artificial Sequence: Synthetic oligonucleotide
ggaaaatagagatctgcacgagcatgtagagctg

SEQ ID NO: 261627 - DNA, 34 bp, Artificial Sequence
  Description of Artificial Sequence: Synthetic oligonucleotide
gaaaatagagatctgcacgagcatgtagagctgc

SEQ ID NO: 261628 - DNA, 35 bp, Artificial Sequence
  Description of Artificial Sequence: Synthetic oligonucleotide
aaaatagagatctgcacgagcatgtagagctgcag

SEQ ID NO: 261629 - DNA, 34 bp, Artificial Sequence
  Description of Artificial Sequence: Synthetic oligonucleotide
aaatagagatctgcacgagcatgtagagctgcag

SEQ ID NO: 261630 - DNA, 33 bp, Artificial Sequence
  Description of Artificial Sequence: Synthetic oligonucleotide
aatagagatctgcacgagcatgtagagctgcag

SEQ ID NO: 261631 - DNA, 32 bp, Artificial Sequence
  Description of Artificial Sequence: Synthetic oligonucleotide
atagagatctgcacgagcatgtagagctgcag

SEQ ID NO: 261632 - DNA, 31 bp, Artificial Sequence
  Description of Artificial Sequence: Synthetic oligonucleotide
tagagatctgcacgagcatgtagagctgcag

SEQ ID NO: 261633 - DNA, 30 bp, Artificial Sequence
  Description of Artificial Sequence: Synthetic oligonucleotide
agagatctgcacgagcatgtagagctgcag

SEQ ID NO: 261634 - DNA, 29 bp, Artificial Sequence
  Description of Artificial Sequence: Synthetic oligonucleotide
gagatctgcacgagcatgtagagctgcag

SEQ ID NO: 261635 - DNA, 29 bp, Artificial Sequence
  Description of Artificial Sequence: Synthetic oligonucleotide
agatctgcacgagcatgtagagctgcagc

SEQ ID NO: 261636 - DNA, 28 bp, Artificial Sequence
  Description of Artificial Sequence: Synthetic oligonucleotide
gatctgcacgagcatgtagagctgcagc

SEQ ID NO: 261637 - DNA, 31 bp, Artificial Sequence
  Description of Artificial Sequence: Synthetic oligonucleotide
atctgcacgagcatgtagagctgcagctttc

SEQ ID NO: 261638 - DNA, 30 bp, Artificial Sequence
  Description of Artificial Sequence: Synthetic oligonucleotide
tctgcacgagcatgtagagctgcagctttc

SEQ ID NO: 261639 - DNA, 29 bp, Artificial Sequence
  Description of Artificial Sequence: Synthetic oligonucleotide
ctgcacgagcatgtagagctgcagctttc

SEQ ID NO: 261640 - DNA, 29 bp, Artificial Sequence
  Description of Artificial Sequence: Synthetic oligonucleotide
tgcacgagcatgtagagctgcagctttcc

SEQ ID NO: 261641 - DNA, 28 bp, Artificial Sequence
  Description of Artificial Sequence: Synthetic oligonucleotide
gcacgagcatgtagagctgcagctttcc

SEQ ID NO: 261642 - DNA, 29 bp, Artificial Sequence
  Description of Artificial Sequence: Synthetic oligonucleotide
cacgagcatgtagagctgcagctttcctg

SEQ ID NO: 261643 - DNA, 32 bp, Artificial Sequence
  Description of Artificial Sequence: Synthetic oligonucleotide
acgagcatgtagagctgcagctttcctgaaac

SEQ ID NO: 261644 - DNA, 31 bp, Artificial Sequence
  Description of Artificial Sequence: Synthetic oligonucleotide
cgagcatgtagagctgcagctttcctgaaac

SEQ ID NO: 261645 - DNA, 35 bp, Artificial Sequence
  Description of Artificial Sequence: Synthetic oligonucleotide
gagcatgtagagctgcagctttcctgaaacaattc

SEQ ID NO: 261646 - DNA, 35 bp, Artificial Sequence
  Description of Artificial Sequence: Synthetic oligonucleotide
agcatgtagagctgcagctttcctgaaacaattcg

SEQ ID NO: 261647 - DNA, 34 bp, Artificial Sequence
  Description of Artificial Sequence: Synthetic oligonucleotide
gcatgtagagctgcagctttcctgaaacaattcg

SEQ ID NO: 261648 - DNA, 37 bp, Artificial Sequence
  Description of Artificial Sequence: Synthetic oligonucleotide
catgtagagctgcagctttcctgaaacaattcgtaag

SEQ ID NO: 261649 - DNA, 38 bp, Artificial Sequence
  Description of Artificial Sequence: Synthetic oligonucleotide
atgtagagctgcagctttcctgaaacaattcgtaagtc

SEQ ID NO: 261650 - DNA, 37 bp, Artificial Sequence
  Description of Artificial Sequence: Synthetic oligonucleotide
tgtagagctgcagctttcctgaaacaattcgtaagtc

SEQ ID NO: 261651 - DNA, 36 bp, Artificial Sequence
  Description of Artificial Sequence: Synthetic oligonucleotide
gtagagctgcagctttcctgaaacaattcgtaagtc

SEQ ID NO: 261652 - DNA, 38 bp, Artificial Sequence
  Description of Artificial Sequence: Synthetic oligonucleotide
tagagctgcagctttcctgaaacaattcgtaagtcatc

SEQ ID NO: 261653 - DNA, 37 bp, Artificial Sequence
  Description of Artificial Sequence: Synthetic oligonucleotide
agagctgcagctttcctgaaacaattcgtaagtcatc

SEQ ID NO: 261654 - DNA, 36 bp, Artificial Sequence
  Description of Artificial Sequence: Synthetic oligonucleotide
gagctgcagctttcctgaaacaattcgtaagtcatc

SEQ ID NO: 261655 - DNA, 36 bp, Artificial Sequence
  Description of Artificial Sequence: Synthetic oligonucleotide
agctgcagctttcctgaaacaattcgtaagtcatcc

SEQ ID NO: 261656 - DNA, 35 bp, Artificial Sequence
  Description of Artificial Sequence: Synthetic oligonucleotide
gctgcagctttcctgaaacaattcgtaagtcatcc

SEQ ID NO: 261657 - DNA, 38 bp, Artificial Sequence
  Description of Artificial Sequence: Synthetic oligonucleotide
ctgcagctttcctgaaacaattcgtaagtcatcctaac

SEQ ID NO: 261658 - DNA, 39 bp, Artificial Sequence
  Description of Artificial Sequence: Synthetic oligonucleotide
tgcagctttcctgaaacaattcgtaagtcatcctaactg

SEQ ID NO: 261659 - DNA, 38 bp, Artificial Sequence
  Description of Artificial Sequence: Synthetic oligonucleotide
gcagctttcctgaaacaattcgtaagtcatcctaactg

SEQ ID NO: 261660 - DNA, 38 bp, Artificial Sequence
  Description of Artificial Sequence: Synthetic oligonucleotide
cagctttcctgaaacaattcgtaagtcatcctaactgg

SEQ ID NO: 261661 - DNA, 38 bp, Artificial Sequence
  Description of Artificial Sequence: Synthetic oligonucleotide
agctttcctgaaacaattcgtaagtcatcctaactggg

SEQ ID NO: 261662 - DNA, 37 bp, Artificial Sequence
  Description of Artificial Sequence: Synthetic oligonucleotide
gctttcctgaaacaattcgtaagtcatcctaactggg

SEQ ID NO: 261663 - DNA, 37 bp, Artificial Sequence
  Description of Artificial Sequence: Synthetic oligonucleotide
ctttcctgaaacaattcgtaagtcatcctaactgggc

SEQ ID NO: 261664 - DNA, 38 bp, Artificial Sequence
  Description of Artificial Sequence: Synthetic oligonucleotide
tttcctgaaacaattcgtaagtcatcctaactgggcac

SEQ ID NO: 261665 - DNA, 37 bp, Artificial Sequence
  Description of Artificial Sequence: Synthetic oligonucleotide
ttcctgaaacaattcgtaagtcatcctaactgggcac

SEQ ID NO: 261666 - DNA, 36 bp, Artificial Sequence
  Description of Artificial Sequence: Synthetic oligonucleotide
tcctgaaacaattcgtaagtcatcctaactgggcac

SEQ ID NO: 261667 - DNA, 35 bp, Artificial Sequence
  Description of Artificial Sequence: Synthetic oligonucleotide
cctgaaacaattcgtaagtcatcctaactgggcac

SEQ ID NO: 261668 - DNA, 40 bp, Artificial Sequence
  Description of Artificial Sequence: Synthetic oligonucleotide
ctgaaacaattcgtaagtcatcctaactgggcacatatag

SEQ ID NO: 261669 - DNA, 41 bp, Artificial Sequence
  Description of Artificial Sequence: Synthetic oligonucleotide
tgaaacaattcgtaagtcatcctaactgggcacatatagac

SEQ ID NO: 261670 - DNA, 40 bp, Artificial Sequence
  Description of Artificial Sequence: Synthetic oligonucleotide
gaaacaattcgtaagtcatcctaactgggcacatatagac

SEQ ID NO: 261671 - DNA, 43 bp, Artificial Sequence
  Description of Artificial Sequence: Synthetic oligonucleotide
aaacaattcgtaagtcatcctaactgggcacatatagacatag

SEQ ID NO: 261672 - DNA, 42 bp, Artificial Sequence
  Description of Artificial Sequence: Synthetic oligonucleotide
aacaattcgtaagtcatcctaactgggcacatatagacatag

SEQ ID NO: 261673 - DNA, 41 bp, Artificial Sequence
  Description of Artificial Sequence: Synthetic oligonucleotide
acaattcgtaagtcatcctaactgggcacatatagacatag

SEQ ID NO: 261674 - DNA, 40 bp, Artificial Sequence
  Description of Artificial Sequence: Synthetic oligonucleotide
caattcgtaagtcatcctaactgggcacatatagacatag

SEQ ID NO: 261675 - DNA, 40 bp, Artificial Sequence
  Description of Artificial Sequence: Synthetic oligonucleotide
aattcgtaagtcatcctaactgggcacatatagacatagg

SEQ ID NO: 261676 - DNA, 39 bp, Artificial Sequence
  Description of Artificial Sequence: Synthetic oligonucleotide
attcgtaagtcatcctaactgggcacatatagacatagg

SEQ ID NO: 261677 - DNA, 38 bp, Artificial Sequence
  Description of Artificial Sequence: Synthetic oligonucleotide
ttcgtaagtcatcctaactgggcacatatagacatagg

SEQ ID NO: 261678 - DNA, 37 bp, Artificial Sequence
  Description of Artificial Sequence: Synthetic oligonucleotide
tcgtaagtcatcctaactgggcacatatagacatagg

SEQ ID NO: 261679 - DNA, 36 bp, Artificial Sequence
  Description of Artificial Sequence: Synthetic oligonucleotide
cgtaagtcatcctaactgggcacatatagacatagg

SEQ ID NO: 261680 - DNA, 37 bp, Artificial Sequence
  Description of Artificial Sequence: Synthetic oligonucleotide
gtaagtcatcctaactgggcacatatagacataggag

SEQ ID NO: 261681 - DNA, 37 bp, Artificial Sequence
  Description of Artificial Sequence: Synthetic oligonucleotide
taagtcatcctaactgggcacatatagacataggagg

SEQ ID NO: 261682 - DNA, 36 bp, Artificial Sequence
  Description of Artificial Sequence: Synthetic oligonucleotide
aagtcatcctaactgggcacatatagacataggagg

SEQ ID NO: 261683 - DNA, 35 bp, Artificial Sequence
  Description of Artificial Sequence: Synthetic oligonucleotide
agtcatcctaactgggcacatatagacataggagg

SEQ ID NO: 261684 - DNA, 34 bp, Artificial Sequence
  Description of Artificial Sequence: Synthetic oligonucleotide
gtcatcctaactgggcacatatagacataggagg

SEQ ID NO: 261685 - DNA, 34 bp, Artificial Sequence
  Description of Artificial Sequence: Synthetic oligonucleotide
tcatcctaactgggcacatatagacataggaggc

SEQ ID NO: 261686 - DNA, 33 bp, Artificial Sequence
  Description of Artificial Sequence: Synthetic oligonucleotide
catcctaactgggcacatatagacataggaggc

SEQ ID NO: 261687 - DNA, 33 bp, Artificial Sequence
  Description of Artificial Sequence: Synthetic oligonucleotide
atcctaactgggcacatatagacataggaggcg

SEQ ID NO: 261688 - DNA, 32 bp, Artificial Sequence
  Description of Artificial Sequence: Synthetic oligonucleotide
tcctaactgggcacatatagacataggaggcg

SEQ ID NO: 261689 - DNA, 31 bp, Artificial Sequence
  Description of Artificial Sequence: Synthetic oligonucleotide
cctaactgggcacatatagacataggaggcg

SEQ ID NO: 261690 - DNA, 32 bp, Artificial Sequence
  Description of Artificial Sequence: Synthetic oligonucleotide
ctaactgggcacatatagacataggaggcgtg

SEQ ID NO: 261691 - DNA, 34 bp, Artificial Sequence
  Description of Artificial Sequence: Synthetic oligonucleotide
taactgggcacatatagacataggaggcgtgatc

SEQ ID NO: 261692 - DNA, 33 bp, Artificial Sequence
  Description of Artificial Sequence: Synthetic oligonucleotide
aactgggcacatatagacataggaggcgtgatc

SEQ ID NO: 261693 - DNA, 32 bp, Artificial Sequence
  Description of Artificial Sequence: Synthetic oligonucleotide
actgggcacatatagacataggaggcgtgatc

SEQ ID NO: 261694 - DNA, 31 bp, Artificial Sequence
  Description of Artificial Sequence: Synthetic oligonucleotide
ctgggcacatatagacataggaggcgtgatc

SEQ ID NO: 261695 - DNA, 32 bp, Artificial Sequence
  Description of Artificial Sequence: Synthetic oligonucleotide
tgggcacatatagacataggaggcgtgatcac

SEQ ID NO: 261696 - DNA, 31 bp, Artificial Sequence
  Description of Artificial Sequence: Synthetic oligonucleotide
gggcacatatagacataggaggcgtgatcac

SEQ ID NO: 261697 - DNA, 31 bp, Artificial Sequence
  Description of Artificial Sequence: Synthetic oligonucleotide
ggcacatatagacataggaggcgtgatcacc

SEQ ID NO: 261698 - DNA, 33 bp, Artificial Sequence
  Description of Artificial Sequence: Synthetic oligonucleotide
gcacatatagacataggaggcgtgatcaccaac

SEQ ID NO: 261699 - DNA, 36 bp, Artificial Sequence
  Description of Artificial Sequence: Synthetic oligonucleotide
cacatatagacataggaggcgtgatcaccaacaaac

SEQ ID NO: 261700 - DNA, 38 bp, Artificial Sequence
  Description of Artificial Sequence: Synthetic oligonucleotide
acatatagacataggaggcgtgatcaccaacaaacatg

SEQ ID NO: 261701 - DNA, 37 bp, Artificial Sequence
  Description of Artificial Sequence: Synthetic oligonucleotide
catatagacataggaggcgtgatcaccaacaaacatg

SEQ ID NO: 261702 - DNA, 39 bp, Artificial Sequence
  Description of Artificial Sequence: Synthetic oligonucleotide
atatagacataggaggcgtgatcaccaacaaacatgaag

SEQ ID NO: 261703 - DNA, 38 bp, Artificial Sequence
  Description of Artificial Sequence: Synthetic oligonucleotide
tatagacataggaggcgtgatcaccaacaaacatgaag

SEQ ID NO: 261704 - DNA, 37 bp, Artificial Sequence
  Description of Artificial Sequence: Synthetic oligonucleotide
atagacataggaggcgtgatcaccaacaaacatgaag

SEQ ID NO: 261705 - DNA, 36 bp, Artificial Sequence
  Description of Artificial Sequence: Synthetic oligonucleotide
tagacataggaggcgtgatcaccaacaaacatgaag

SEQ ID NO: 261706 - DNA, 35 bp, Artificial Sequence
  Description of Artificial Sequence: Synthetic oligonucleotide
agacataggaggcgtgatcaccaacaaacatgaag

SEQ ID NO: 261707 - DNA, 34 bp, Artificial Sequence
  Description of Artificial Sequence: Synthetic oligonucleotide
gacataggaggcgtgatcaccaacaaacatgaag

SEQ ID NO: 261708 - DNA, 36 bp, Artificial Sequence
  Description of Artificial Sequence: Synthetic oligonucleotide
acataggaggcgtgatcaccaacaaacatgaagttc

SEQ ID NO: 261709 - DNA, 35 bp, Artificial Sequence
  Description of Artificial Sequence: Synthetic oligonucleotide
cataggaggcgtgatcaccaacaaacatgaagttc

SEQ ID NO: 261710 - DNA, 35 bp, Artificial Sequence
  Description of Artificial Sequence: Synthetic oligonucleotide
ataggaggcgtgatcaccaacaaacatgaagttcg

SEQ ID NO: 261711 - DNA, 34 bp, Artificial Sequence
  Description of Artificial Sequence: Synthetic oligonucleotide
taggaggcgtgatcaccaacaaacatgaagttcg

SEQ ID NO: 261712 - DNA, 33 bp, Artificial Sequence
  Description of Artificial Sequence: Synthetic oligonucleotide
aggaggcgtgatcaccaacaaacatgaagttcg

SEQ ID NO: 261713 - DNA, 32 bp, Artificial Sequence
  Description of Artificial Sequence: Synthetic oligonucleotide
ggaggcgtgatcaccaacaaacatgaagttcg

SEQ ID NO: 261714 - DNA, 32 bp, Artificial Sequence
  Description of Artificial Sequence: Synthetic oligonucleotide
gaggcgtgatcaccaacaaacatgaagttcgc

SEQ ID NO: 261715 - DNA, 35 bp, Artificial Sequence
  Description of Artificial Sequence: Synthetic oligonucleotide
aggcgtgatcaccaacaaacatgaagttcgctatc

SEQ ID NO: 261716 - DNA, 34 bp, Artificial Sequence
  Description of Artificial Sequence: Synthetic oligonucleotide
ggcgtgatcaccaacaaacatgaagttcgctatc

SEQ ID NO: 261717 - DNA, 36 bp, Artificial Sequence
  Description of Artificial Sequence: Synthetic oligonucleotide
gcgtgatcaccaacaaacatgaagttcgctatctac

SEQ ID NO: 261718 - DNA, 36 bp, Artificial Sequence
  Description of Artificial Sequence: Synthetic oligonucleotide
cgtgatcaccaacaaacatgaagttcgctatctacg

SEQ ID NO: 261719 - DNA, 36 bp, Artificial Sequence
  Description of Artificial Sequence: Synthetic oligonucleotide
gtgatcaccaacaaacatgaagttcgctatctacgc

SEQ ID NO: 261720 - DNA, 39 bp, Artificial Sequence
  Description of Artificial Sequence: Synthetic oligonucleotide
tgatcaccaacaaacatgaagttcgctatctacgcaaag

SEQ ID NO: 261721 - DNA, 38 bp, Artificial Sequence
  Description of Artificial Sequence: Synthetic oligonucleotide
gatcaccaacaaacatgaagttcgctatctacgcaaag

SEQ ID NO: 261722 - DNA, 38 bp, Artificial Sequence
  Description of Artificial Sequence: Synthetic oligonucleotide
atcaccaacaaacatgaagttcgctatctacgcaaagg

SEQ ID NO: 261723 - DNA, 37 bp, Artificial Sequence
  Description of Artificial Sequence: Synthetic oligonucleotide
tcaccaacaaacatgaagttcgctatctacgcaaagg

SEQ ID NO: 261724 - DNA, 36 bp, Artificial Sequence
  Description of Artificial Sequence: Synthetic oligonucleotide
caccaacaaacatgaagttcgctatctacgcaaagg

SEQ ID NO: 261725 - DNA, 36 bp, Artificial Sequence
  Description of Artificial Sequence: Synthetic oligonucleotide
accaacaaacatgaagttcgctatctacgcaaaggc

SEQ ID NO: 261726 - DNA, 35 bp, Artificial Sequence
  Description of Artificial Sequence: Synthetic oligonucleotide
ccaacaaacatgaagttcgctatctacgcaaaggc

SEQ ID NO: 261727 - DNA, 37 bp, Artificial Sequence
  Description of Artificial Sequence: Synthetic oligonucleotide
caacaaacatgaagttcgctatctacgcaaaggcatg

SEQ ID NO: 261728 - DNA, 38 bp, Artificial Sequence
  Description of Artificial Sequence: Synthetic oligonucleotide
aacaaacatgaagttcgctatctacgcaaaggcatgtc

SEQ ID NO: 261729 - DNA, 37 bp, Artificial Sequence
  Description of Artificial Sequence: Synthetic oligonucleotide
acaaacatgaagttcgctatctacgcaaaggcatgtc

SEQ ID NO: 261730 - DNA, 36 bp, Artificial Sequence
  Description of Artificial Sequence: Synthetic oligonucleotide
caaacatgaagttcgctatctacgcaaaggcatgtc

SEQ ID NO: 261731 - DNA, 37 bp, Artificial Sequence
  Description of Artificial Sequence: Synthetic oligonucleotide
aaacatgaagttcgctatctacgcaaaggcatgtctg

SEQ ID NO: 261732 - DNA, 36 bp, Artificial Sequence
  Description of Artificial Sequence: Synthetic oligonucleotide
aacatgaagttcgctatctacgcaaaggcatgtctg

SEQ ID NO: 261733 - DNA, 35 bp, Artificial Sequence
  Description of Artificial Sequence: Synthetic oligonucleotide
acatgaagttcgctatctacgcaaaggcatgtctg

SEQ ID NO: 261734 - DNA, 34 bp, Artificial Sequence
  Description of Artificial Sequence: Synthetic oligonucleotide
catgaagttcgctatctacgcaaaggcatgtctg

SEQ ID NO: 261735 - DNA, 34 bp, Artificial Sequence
  Description of Artificial Sequence: Synthetic oligonucleotide
atgaagttcgctatctacgcaaaggcatgtctgg

SEQ ID NO: 261736 - DNA, 33 bp, Artificial Sequence
  Description of Artificial Sequence: Synthetic oligonucleotide
tgaagttcgctatctacgcaaaggcatgtctgg

SEQ ID NO: 261737 - DNA, 32 bp, Artificial Sequence
  Description of Artificial Sequence: Synthetic oligonucleotide
gaagttcgctatctacgcaaaggcatgtctgg

SEQ ID NO: 261738 - DNA, 32 bp, Artificial Sequence
  Description of Artificial Sequence: Synthetic oligonucleotide
aagttcgctatctacgcaaaggcatgtctggg

SEQ ID NO: 261739 - DNA, 31 bp, Artificial Sequence
  Description of Artificial Sequence: Synthetic oligonucleotide
agttcgctatctacgcaaaggcatgtctggg

SEQ ID NO: 261740 - DNA, 30 bp, Artificial Sequence
  Description of Artificial Sequence: Synthetic oligonucleotide
gttcgctatctacgcaaaggcatgtctggg

SEQ ID NO: 261741 - DNA, 31 bp, Artificial Sequence
  Description of Artificial Sequence: Synthetic oligonucleotide
ttcgctatctacgcaaaggcatgtctgggag

SEQ ID NO: 261742 - DNA, 30 bp, Artificial Sequence
  Description of Artificial Sequence: Synthetic oligonucleotide
tcgctatctacgcaaaggcatgtctgggag

SEQ ID NO: 261743 - DNA, 29 bp, Artificial Sequence
  Description of Artificial Sequence: Synthetic oligonucleotide
cgctatctacgcaaaggcatgtctgggag

SEQ ID NO: 261744 - DNA, 29 bp, Artificial Sequence
  Description of Artificial Sequence: Synthetic oligonucleotide
gctatctacgcaaaggcatgtctgggagg

SEQ ID NO: 261745 - DNA, 29 bp, Artificial Sequence
  Description of Artificial Sequence: Synthetic oligonucleotide
ctatctacgcaaaggcatgtctgggaggc

SEQ ID NO: 261746 - DNA, 29 bp, Artificial Sequence
  Description of Artificial Sequence: Synthetic oligonucleotide
tatctacgcaaaggcatgtctgggaggcg

SEQ ID NO: 261747 - DNA, 28 bp, Artificial Sequence
  Description of Artificial Sequence: Synthetic oligonucleotide
atctacgcaaaggcatgtctgggaggcg

SEQ ID NO: 261748 - DNA, 27 bp, Artificial Sequence
  Description of Artificial Sequence: Synthetic oligonucleotide
tctacgcaaaggcatgtctgggaggcg

SEQ ID NO: 261749 - DNA, 26 bp, Artificial Sequence
  Description of Artificial Sequence: Synthetic oligonucleotide
ctacgcaaaggcatgtctgggaggcg

SEQ ID NO: 261750 - DNA, 27 bp, Artificial Sequence
  Description of Artificial Sequence: Synthetic oligonucleotide
tacgcaaaggcatgtctgggaggcgca

SEQ ID NO: 261751 - DNA, 26 bp, Artificial Sequence
  Description of Artificial Sequence: Synthetic oligonucleotide
acgcaaaggcatgtctgggaggcgca

SEQ ID NO: 261752 - DNA, 25 bp, Artificial Sequence
  Description of Artificial Sequence: Synthetic oligonucleotide
cgcaaaggcatgtctgggaggcgca

SEQ ID NO: 261753 - DNA, 27 bp, Artificial Sequence
  Description of Artificial Sequence: Synthetic oligonucleotide
gcaaaggcatgtctgggaggcgcacaa

SEQ ID NO: 261754 - DNA, 27 bp, Artificial Sequence
  Description of Artificial Sequence: Synthetic oligonucleotide
caaaggcatgtctgggaggcgcacaag

SEQ ID NO: 261755 - DNA, 27 bp, Artificial Sequence
  Description of Artificial Sequence: Synthetic oligonucleotide
aaaggcatgtctgggaggcgcacaagg

SEQ ID NO: 261756 - DNA, 27 bp, Artificial Sequence
  Description of Artificial Sequence: Synthetic oligonucleotide
aaggcatgtctgggaggcgcacaagga

SEQ ID NO: 261757 - DNA, 26 bp, Artificial Sequence
  Description of Artificial Sequence: Synthetic oligonucleotide
aggcatgtctgggaggcgcacaagga

SEQ ID NO: 261758 - DNA, 25 bp, Artificial Sequence
  Description of Artificial Sequence: Synthetic oligonucleotide
ggcatgtctgggaggcgcacaagga

SEQ ID NO: 261759 - DNA, 26 bp, Artificial Sequence
  Description of Artificial Sequence: Synthetic oligonucleotide
gcatgtctgggaggcgcacaaggaca

SEQ ID NO: 261760 - DNA, 27 bp, Artificial Sequence
  Description of Artificial Sequence: Synthetic oligonucleotide
catgtctgggaggcgcacaaggacact

SEQ ID NO: 261761 - DNA, 27 bp, Artificial Sequence
  Description of Artificial Sequence: Synthetic oligonucleotide
atgtctgggaggcgcacaaggacactc

SEQ ID NO: 261762 - DNA, 27 bp, Artificial Sequence
  Description of Artificial Sequence: Synthetic oligonucleotide
tgtctgggaggcgcacaaggacactca

SEQ ID NO: 261763 - DNA, 27 bp, Artificial Sequence
  Description of Artificial Sequence: Synthetic oligonucleotide
gtctgggaggcgcacaaggacactcat

SEQ ID NO: 261764 - DNA, 28 bp, Artificial Sequence
  Description of Artificial Sequence: Synthetic oligonucleotide
tctgggaggcgcacaaggacactcattg

SEQ ID NO: 261765 - DNA, 27 bp, Artificial Sequence
  Description of Artificial Sequence: Synthetic oligonucleotide
ctgggaggcgcacaaggacactcattg

SEQ ID NO: 261766 - DNA, 28 bp, Artificial Sequence
  Description of Artificial Sequence: Synthetic oligonucleotide
tgggaggcgcacaaggacactcattgag

SEQ ID NO: 261767 - DNA, 27 bp, Artificial Sequence
  Description of Artificial Sequence: Synthetic oligonucleotide
gggaggcgcacaaggacactcattgag

SEQ ID NO: 261768 - DNA, 29 bp, Artificial Sequence
  Description of Artificial Sequence: Synthetic oligonucleotide
ggaggcgcacaaggacactcattgagatc

SEQ ID NO: 261769 - DNA, 32 bp, Artificial Sequence
  Description of Artificial Sequence: Synthetic oligonucleotide
gaggcgcacaaggacactcattgagatcttac

SEQ ID NO: 261770 - DNA, 34 bp, Artificial Sequence
  Description of Artificial Sequence: Synthetic oligonucleotide
aggcgcacaaggacactcattgagatcttacttc

SEQ ID NO: 261771 - DNA, 33 bp, Artificial Sequence
  Description of Artificial Sequence: Synthetic oligonucleotide
ggcgcacaaggacactcattgagatcttacttc

SEQ ID NO: 261772 - DNA, 33 bp, Artificial Sequence
  Description of Artificial Sequence: Synthetic oligonucleotide
gcgcacaaggacactcattgagatcttacttcc

SEQ ID NO: 261773 - DNA, 36 bp, Artificial Sequence
  Description of Artificial Sequence: Synthetic oligonucleotide
cgcacaaggacactcattgagatcttacttcctttc

SEQ ID NO: 261774 - DNA, 37 bp, Artificial Sequence
  Description of Artificial Sequence: Synthetic oligonucleotide
gcacaaggacactcattgagatcttacttcctttcag

SEQ ID NO: 261775 - DNA, 38 bp, Artificial Sequence
  Description of Artificial Sequence: Synthetic oligonucleotide
cacaaggacactcattgagatcttacttcctttcagtc

SEQ ID NO: 261776 - DNA, 40 bp, Artificial Sequence
  Description of Artificial Sequence: Synthetic oligonucleotide
acaaggacactcattgagatcttacttcctttcagtcatg

SEQ ID NO: 261777 - DNA, 39 bp, Artificial Sequence
  Description of Artificial Sequence: Synthetic oligonucleotide
caaggacactcattgagatcttacttcctttcagtcatg

SEQ ID NO: 261778 - DNA, 40 bp, Artificial Sequence
  Description of Artificial Sequence: Synthetic oligonucleotide
aaggacactcattgagatcttacttcctttcagtcatgac

SEQ ID NO: 261779 - DNA, 39 bp, Artificial Sequence
  Description of Artificial Sequence: Synthetic oligonucleotide
aggacactcattgagatcttacttcctttcagtcatgac

SEQ ID NO: 261780 - DNA, 38 bp, Artificial Sequence
  Description of Artificial Sequence: Synthetic oligonucleotide
ggacactcattgagatcttacttcctttcagtcatgac

SEQ ID NO: 261781 - DNA, 41 bp, Artificial Sequence
  Description of Artificial Sequence: Synthetic oligonucleotide
gacactcattgagatcttacttcctttcagtcatgacaatg

SEQ ID NO: 261782 - DNA, 41 bp, Artificial Sequence
  Description of Artificial Sequence: Synthetic oligonucleotide
acactcattgagatcttacttcctttcagtcatgacaatgc

SEQ ID NO: 261783 - DNA, 40 bp, Artificial Sequence
  Description of Artificial Sequence: Synthetic oligonucleotide
cactcattgagatcttacttcctttcagtcatgacaatgc

SEQ ID NO: 261784 - DNA, 43 bp, Artificial Sequence
  Description of Artificial Sequence: Synthetic oligonucleotide
actcattgagatcttacttcctttcagtcatgacaatgctaag

SEQ ID NO: 261785 - DNA, 37 bp, Artificial Sequence
  Description of Artificial Sequence: Synthetic oligonucleotide
aagcagctcaggaaggtgaagattcgaaatctgtatg

SEQ ID NO: 261786 - DNA, 36 bp, Artificial Sequence
  Description of Artificial Sequence: Synthetic oligonucleotide
agcagctcaggaaggtgaagattcgaaatctgtatg

SEQ ID NO: 261787 - DNA, 35 bp, Artificial Sequence
  Description of Artificial Sequence: Synthetic oligonucleotide
gcagctcaggaaggtgaagattcgaaatctgtatg

SEQ ID NO: 261788 - DNA, 36 bp, Artificial Sequence
  Description of Artificial Sequence: Synthetic oligonucleotide
cagctcaggaaggtgaagattcgaaatctgtatgac

SEQ ID NO: 261789 - DNA, 39 bp, Artificial Sequence
  Description of Artificial Sequence: Synthetic oligonucleotide
agctcaggaaggtgaagattcgaaatctgtatgacaaag

SEQ ID NO: 261790 - DNA, 38 bp, Artificial Sequence
  Description of Artificial Sequence: Synthetic oligonucleotide
gctcaggaaggtgaagattcgaaatctgtatgacaaag

SEQ ID NO: 261791 - DNA, 40 bp, Artificial Sequence
  Description of Artificial Sequence: Synthetic oligonucleotide
ctcaggaaggtgaagattcgaaatctgtatgacaaagatg

SEQ ID NO: 261792 - DNA, 41 bp, Artificial Sequence
  Description of Artificial Sequence: Synthetic oligonucleotide
tcaggaaggtgaagattcgaaatctgtatgacaaagatgtc

SEQ ID NO: 261793 - DNA, 40 bp, Artificial Sequence
  Description of Artificial Sequence: Synthetic oligonucleotide
caggaaggtgaagattcgaaatctgtatgacaaagatgtc

SEQ ID NO: 261794 - DNA, 41 bp, Artificial Sequence
  Description of Artificial Sequence: Synthetic oligonucleotide
aggaaggtgaagattcgaaatctgtatgacaaagatgtcac

SEQ ID NO: 261795 - DNA, 40 bp, Artificial Sequence
  Description of Artificial Sequence: Synthetic oligonucleotide
ggaaggtgaagattcgaaatctgtatgacaaagatgtcac

SEQ ID NO: 261796 - DNA, 41 bp, Artificial Sequence
  Description of Artificial Sequence: Synthetic oligonucleotide
gaaggtgaagattcgaaatctgtatgacaaagatgtcactc

SEQ ID NO: 261797 - DNA, 44 bp, Artificial Sequence
  Description of Artificial Sequence: Synthetic oligonucleotide
aaggtgaagattcgaaatctgtatgacaaagatgtcactctttg

SEQ ID NO: 261798 - DNA, 43 bp, Artificial Sequence
  Description of Artificial Sequence: Synthetic oligonucleotide
aggtgaagattcgaaatctgtatgacaaagatgtcactctttg

SEQ ID NO: 261799 - DNA, 42 bp, Artificial Sequence
  Description of Artificial Sequence: Synthetic oligonucleotide
ggtgaagattcgaaatctgtatgacaaagatgtcactctttg

SEQ ID NO: 261800 - DNA, 42 bp, Artificial Sequence
  Description of Artificial Sequence: Synthetic oligonucleotide
gtgaagattcgaaatctgtatgacaaagatgtcactctttgg

SEQ ID NO: 261801 - DNA, 43 bp, Artificial Sequence
  Description of Artificial Sequence: Synthetic oligonucleotide
tgaagattcgaaatctgtatgacaaagatgtcactctttggag

SEQ ID NO: 261802 - DNA, 42 bp, Artificial Sequence
  Description of Artificial Sequence: Synthetic oligonucleotide
gaagattcgaaatctgtatgacaaagatgtcactctttggag

SEQ ID NO: 261803 - DNA, 42 bp, Artificial Sequence
  Description of Artificial Sequence: Synthetic oligonucleotide
aagattcgaaatctgtatgacaaagatgtcactctttggagc

SEQ ID NO: 261804 - DNA, 41 bp, Artificial Sequence
  Description of Artificial Sequence: Synthetic oligonucleotide
agattcgaaatctgtatgacaaagatgtcactctttggagc

SEQ ID NO: 261805 - DNA, 40 bp, Artificial Sequence
  Description of Artificial Sequence: Synthetic oligonucleotide
gattcgaaatctgtatgacaaagatgtcactctttggagc

SEQ ID NO: 261806 - DNA, 40 bp, Artificial Sequence
  Description of Artificial Sequence: Synthetic oligonucleotide
attcgaaatctgtatgacaaagatgtcactctttggagcc

SEQ ID NO: 261807 - DNA, 39 bp, Artificial Sequence
  Description of Artificial Sequence: Synthetic oligonucleotide
ttcgaaatctgtatgacaaagatgtcactctttggagcc

SEQ ID NO: 261808 - DNA, 38 bp, Artificial Sequence
  Description of Artificial Sequence: Synthetic oligonucleotide
tcgaaatctgtatgacaaagatgtcactctttggagcc

SEQ ID NO: 261809 - DNA, 37 bp, Artificial Sequence
  Description of Artificial Sequence: Synthetic oligonucleotide
cgaaatctgtatgacaaagatgtcactctttggagcc

SEQ ID NO: 261810 - DNA, 37 bp, Artificial Sequence
  Description of Artificial Sequence: Synthetic oligonucleotide
gaaatctgtatgacaaagatgtcactctttggagccg

SEQ ID NO: 261811 - DNA, 37 bp, Artificial Sequence
  Description of Artificial Sequence: Synthetic oligonucleotide
aaatctgtatgacaaagatgtcactctttggagccgc

SEQ ID NO: 261812 - DNA, 36 bp, Artificial Sequence
  Description of Artificial Sequence: Synthetic oligonucleotide
aatctgtatgacaaagatgtcactctttggagccgc

SEQ ID NO: 261813 - DNA, 35 bp, Artificial Sequence
  Description of Artificial Sequence: Synthetic oligonucleotide
atctgtatgacaaagatgtcactctttggagccgc

SEQ ID NO: 261814 - DNA, 34 bp, Artificial Sequence
  Description of Artificial Sequence: Synthetic oligonucleotide
tctgtatgacaaagatgtcactctttggagccgc

SEQ ID NO: 261815 - DNA, 33 bp, Artificial Sequence
  Description of Artificial Sequence: Synthetic oligonucleotide
ctgtatgacaaagatgtcactctttggagccgc

SEQ ID NO: 261816 - DNA, 33 bp, Artificial Sequence
  Description of Artificial Sequence: Synthetic oligonucleotide
tgtatgacaaagatgtcactctttggagccgcc

SEQ ID NO: 261817 - DNA, 32 bp, Artificial Sequence
  Description of Artificial Sequence: Synthetic oligonucleotide
gtatgacaaagatgtcactctttggagccgcc

SEQ ID NO: 261818 - DNA, 33 bp, Artificial Sequence
  Description of Artificial Sequence: Synthetic oligonucleotide
tatgacaaagatgtcactctttggagccgccag

SEQ ID NO: 261819 - DNA, 32 bp, Artificial Sequence
  Description of Artificial Sequence: Synthetic oligonucleotide
atgacaaagatgtcactctttggagccgccag

SEQ ID NO: 261820 - DNA, 31 bp, Artificial Sequence
  Description of Artificial Sequence: Synthetic oligonucleotide
tgacaaagatgtcactctttggagccgccag

SEQ ID NO: 261821 - DNA, 30 bp, Artificial Sequence
  Description of Artificial Sequence: Synthetic oligonucleotide
gacaaagatgtcactctttggagccgccag

SEQ ID NO: 261822 - DNA, 30 bp, Artificial Sequence
  Description of Artificial Sequence: Synthetic oligonucleotide
acaaagatgtcactctttggagccgccagg

SEQ ID NO: 261823 - DNA, 29 bp, Artificial Sequence
  Description of Artificial Sequence: Synthetic oligonucleotide
caaagatgtcactctttggagccgccagg

SEQ ID NO: 261824 - DNA, 29 bp, Artificial Sequence
  Description of Artificial Sequence: Synthetic oligonucleotide
aaagatgtcactctttggagccgccaggg

SEQ ID NO: 261825 - DNA, 28 bp, Artificial Sequence
  Description of Artificial Sequence: Synthetic oligonucleotide
aagatgtcactctttggagccgccaggg

SEQ ID NO: 261826 - DNA, 27 bp, Artificial Sequence
  Description of Artificial Sequence: Synthetic oligonucleotide
agatgtcactctttggagccgccaggg

SEQ ID NO: 261827 - DNA, 26 bp, Artificial Sequence
  Description of Artificial Sequence: Synthetic oligonucleotide
gatgtcactctttggagccgccaggg

SEQ ID NO: 261828 - DNA, 27 bp, Artificial Sequence
  Description of Artificial Sequence: Synthetic oligonucleotide
atgtcactctttggagccgccagggca

SEQ ID NO: 261829 - DNA, 26 bp, Artificial Sequence
  Description of Artificial Sequence: Synthetic oligonucleotide
tgtcactctttggagccgccagggca

SEQ ID NO: 261830 - DNA, 25 bp, Artificial Sequence
  Description of Artificial Sequence: Synthetic oligonucleotide
gtcactctttggagccgccagggca

SEQ ID NO: 261831 - DNA, 25 bp, Artificial Sequence
  Description of Artificial Sequence: Synthetic oligonucleotide
tcactctttggagccgccagggcag

SEQ ID NO: 261832 - DNA, 24 bp, Artificial Sequence
  Description of Artificial Sequence: Synthetic oligonucleotide
cactctttggagccgccagggcag

SEQ ID NO: 261833 - DNA, 27 bp, Artificial Sequence
  Description of Artificial Sequence: Synthetic oligonucleotide
actctttggagccgccagggcagcatt

SEQ ID NO: 261834 - DNA, 26 bp, Artificial Sequence
  Description of Artificial Sequence: Synthetic oligonucleotide
ctctttggagccgccagggcagcatt

SEQ ID NO: 261835 - DNA, 27 bp, Artificial Sequence
  Description of Artificial Sequence: Synthetic oligonucleotide
tctttggagccgccagggcagcattca

SEQ ID NO: 261836 - DNA, 27 bp, Artificial Sequence
  Description of Artificial Sequence: Synthetic oligonucleotide
ctttggagccgccagggcagcattcat

SEQ ID NO: 261837 - DNA, 27 bp, Artificial Sequence
  Description of Artificial Sequence: Synthetic oligonucleotide
tttggagccgccagggcagcattcatc

SEQ ID NO: 261838 - DNA, 27 bp, Artificial Sequence
  Description of Artificial Sequence: Synthetic oligonucleotide
ttggagccgccagggcagcattcatca

SEQ ID NO: 261839 - DNA, 27 bp, Artificial Sequence
  Description of Artificial Sequence: Synthetic oligonucleotide
tggagccgccagggcagcattcatcaa

SEQ ID NO: 261840 - DNA, 27 bp, Artificial Sequence
  Description of Artificial Sequence: Synthetic oligonucleotide
ggagccgccagggcagcattcatcaat

SEQ ID NO: 261841 - DNA, 29 bp, Artificial Sequence
  Description of Artificial Sequence: Synthetic oligonucleotide
gagccgccagggcagcattcatcaatttg

SEQ ID NO: 261842 - DNA, 34 bp, Artificial Sequence
  Description of Artificial Sequence: Synthetic oligonucleotide
agccgccagggcagcattcatcaatttgaatatg

SEQ ID NO: 261843 - DNA, 33 bp, Artificial Sequence
  Description of Artificial Sequence: Synthetic oligonucleotide
gccgccagggcagcattcatcaatttgaatatg

SEQ ID NO: 261844 - DNA, 33 bp, Artificial Sequence
  Description of Artificial Sequence: Synthetic oligonucleotide
ccgccagggcagcattcatcaatttgaatatgg

SEQ ID NO: 261845 - DNA, 36 bp, Artificial Sequence
  Description of Artificial Sequence: Synthetic oligonucleotide
cgccagggcagcattcatcaatttgaatatggaatg

SEQ ID NO: 261846 - DNA, 36 bp, Artificial Sequence
  Description of Artificial Sequence: Synthetic oligonucleotide
gccagggcagcattcatcaatttgaatatggaatgg

SEQ ID NO: 261847 - DNA, 38 bp, Artificial Sequence
  Description of Artificial Sequence: Synthetic oligonucleotide
ccagggcagcattcatcaatttgaatatggaatggaag

SEQ ID NO: 261848 - DNA, 38 bp, Artificial Sequence
  Description of Artificial Sequence: Synthetic oligonucleotide
cagggcagcattcatcaatttgaatatggaatggaagc

SEQ ID NO: 261849 - DNA, 39 bp, Artificial Sequence
  Description of Artificial Sequence: Synthetic oligonucleotide
agggcagcattcatcaatttgaatatggaatggaagcag

SEQ ID NO: 261850 - DNA, 38 bp, Artificial Sequence
  Description of Artificial Sequence: Synthetic oligonucleotide
gggcagcattcatcaatttgaatatggaatggaagcag

SEQ ID NO: 261851 - DNA, 43 bp, Artificial Sequence
  Description of Artificial Sequence: Synthetic oligonucleotide
ggcagcattcatcaatttgaatatggaatggaagcagttaaac

SEQ ID NO: 261852 - DNA, 45 bp, Artificial Sequence
  Description of Artificial Sequence: Synthetic oligonucleotide
gcagcattcatcaatttgaatatggaatggaagcagttaaacaac

SEQ ID NO: 261853 - DNA, 45 bp, Artificial Sequence
  Description of Artificial Sequence: Synthetic oligonucleotide
cagcattcatcaatttgaatatggaatggaagcagttaaacaacg

SEQ ID NO: 261854 - DNA, 47 bp, Artificial Sequence
  Description of Artificial Sequence: Synthetic oligonucleotide
agcattcatcaatttgaatatggaatggaagcagttaaacaacgttc

SEQ ID NO: 261855 - DNA, 46 bp, Artificial Sequence
  Description of Artificial Sequence: Synthetic oligonucleotide
gcattcatcaatttgaatatggaatggaagcagttaaacaacgttc

SEQ ID NO: 261856 - DNA, 47 bp, Artificial Sequence
  Description of Artificial Sequence: Synthetic oligonucleotide
cattcatcaatttgaatatggaatggaagcagttaaacaacgttcag

SEQ ID NO: 261857 - DNA, 47 bp, Artificial Sequence
  Description of Artificial Sequence: Synthetic oligonucleotide
attcatcaatttgaatatggaatggaagcagttaaacaacgttcagc

SEQ ID NO: 261858 - DNA, 46 bp, Artificial Sequence
  Description of Artificial Sequence: Synthetic oligonucleotide
ttcatcaatttgaatatggaatggaagcagttaaacaacgttcagc

SEQ ID NO: 261859 - DNA, 45 bp, Artificial Sequence
  Description of Artificial Sequence: Synthetic oligonucleotide
tcatcaatttgaatatggaatggaagcagttaaacaacgttcagc

SEQ ID NO: 261860 - DNA, 44 bp, Artificial Sequence
  Description of Artificial Sequence: Synthetic oligonucleotide
catcaatttgaatatggaatggaagcagttaaacaacgttcagc

SEQ ID NO: 261861 - DNA, 44 bp, Artificial Sequence
  Description of Artificial Sequence: Synthetic oligonucleotide
atcaatttgaatatggaatggaagcagttaaacaacgttcagcc

SEQ ID NO: 261862 - DNA, 43 bp, Artificial Sequence
  Description of Artificial Sequence: Synthetic oligonucleotide
tcaatttgaatatggaatggaagcagttaaacaacgttcagcc

SEQ ID NO: 261863 - DNA, 42 bp, Artificial Sequence
  Description of Artificial Sequence: Synthetic oligonucleotide
caatttgaatatggaatggaagcagttaaacaacgttcagcc

SEQ ID NO: 261864 - DNA, 43 bp, Artificial Sequence
  Description of Artificial Sequence: Synthetic oligonucleotide
aatttgaatatggaatggaagcagttaaacaacgttcagccag

SEQ ID NO: 261865 - DNA, 42 bp, Artificial Sequence
  Description of Artificial Sequence: Synthetic oligonucleotide
atttgaatatggaatggaagcagttaaacaacgttcagccag

SEQ ID NO: 261866 - DNA, 41 bp, Artificial Sequence
  Description of Artificial Sequence: Synthetic oligonucleotide
tttgaatatggaatggaagcagttaaacaacgttcagccag

SEQ ID NO: 261867 - DNA, 40 bp, Artificial Sequence
  Description of Artificial Sequence: Synthetic oligonucleotide
ttgaatatggaatggaagcagttaaacaacgttcagccag

SEQ ID NO: 261868 - DNA, 39 bp, Artificial Sequence
  Description of Artificial Sequence: Synthetic oligonucleotide
tgaatatggaatggaagcagttaaacaacgttcagccag

SEQ ID NO: 261869 - DNA, 38 bp, Artificial Sequence
  Description of Artificial Sequence: Synthetic oligonucleotide
gaatatggaatggaagcagttaaacaacgttcagccag

SEQ ID NO: 261870 - DNA, 39 bp, Artificial Sequence
  Description of Artificial Sequence: Synthetic oligonucleotide
aatatggaatggaagcagttaaacaacgttcagccagag

SEQ ID NO: 261871 - DNA, 38 bp, Artificial Sequence
  Description of Artificial Sequence: Synthetic oligonucleotide
atatggaatggaagcagttaaacaacgttcagccagag

SEQ ID NO: 261872 - DNA, 37 bp, Artificial Sequence
  Description of Artificial Sequence: Synthetic oligonucleotide
tatggaatggaagcagttaaacaacgttcagccagag

SEQ ID NO: 261873 - DNA, 36 bp, Artificial Sequence
  Description of Artificial Sequence: Synthetic oligonucleotide
atggaatggaagcagttaaacaacgttcagccagag

SEQ ID NO: 261874 - DNA, 35 bp, Artificial Sequence
  Description of Artificial Sequence: Synthetic oligonucleotide
tggaatggaagcagttaaacaacgttcagccagag

SEQ ID NO: 261875 - DNA, 34 bp, Artificial Sequence
  Description of Artificial Sequence: Synthetic oligonucleotide
ggaatggaagcagttaaacaacgttcagccagag

SEQ ID NO: 261876 - DNA, 36 bp, Artificial Sequence
  Description of Artificial Sequence: Synthetic oligonucleotide
gaatggaagcagttaaacaacgttcagccagagttg

SEQ ID NO: 261877 - DNA, 36 bp, Artificial Sequence
  Description of Artificial Sequence: Synthetic oligonucleotide
aatggaagcagttaaacaacgttcagccagagttgg

SEQ ID NO: 261878 - DNA, 35 bp, Artificial Sequence
  Description of Artificial Sequence: Synthetic oligonucleotide
atggaagcagttaaacaacgttcagccagagttgg

SEQ ID NO: 261879 - DNA, 34 bp, Artificial Sequence
  Description of Artificial Sequence: Synthetic oligonucleotide
tggaagcagttaaacaacgttcagccagagttgg

SEQ ID NO: 261880 - DNA, 33 bp, Artificial Sequence
  Description of Artificial Sequence: Synthetic oligonucleotide
ggaagcagttaaacaacgttcagccagagttgg

SEQ ID NO: 261881 - DNA, 34 bp, Artificial Sequence
  Description of Artificial Sequence: Synthetic oligonucleotide
gaagcagttaaacaacgttcagccagagttggtc

SEQ ID NO: 261882 - DNA, 35 bp, Artificial Sequence
  Description of Artificial Sequence: Synthetic oligonucleotide
aagcagttaaacaacgttcagccagagttggtctc

SEQ ID NO: 261883 - DNA, 34 bp, Artificial Sequence
  Description of Artificial Sequence: Synthetic oligonucleotide
agcagttaaacaacgttcagccagagttggtctc

SEQ ID NO: 261884 - DNA, 33 bp, Artificial Sequence
  Description of Artificial Sequence: Synthetic oligonucleotide
gcagttaaacaacgttcagccagagttggtctc

SEQ ID NO: 261885 - DNA, 37 bp, Artificial Sequence
  Description of Artificial Sequence: Synthetic oligonucleotide
cagttaaacaacgttcagccagagttggtctcaaatc

SEQ ID NO: 261886 - DNA, 42 bp, Artificial Sequence
  Description of Artificial Sequence: Synthetic oligonucleotide
agttaaacaacgttcagccagagttggtctcaaatcaaaatc

SEQ ID NO: 261887 - DNA, 41 bp, Artificial Sequence
  Description of Artificial Sequence: Synthetic oligonucleotide
gttaaacaacgttcagccagagttggtctcaaatcaaaatc

SEQ ID NO: 261888 - DNA, 42 bp, Artificial Sequence
  Description of Artificial Sequence: Synthetic oligonucleotide
ttaaacaacgttcagccagagttggtctcaaatcaaaatctc

SEQ ID NO: 261889 - DNA, 41 bp, Artificial Sequence
  Description of Artificial Sequence: Synthetic oligonucleotide
taaacaacgttcagccagagttggtctcaaatcaaaatctc

SEQ ID NO: 261890 - DNA, 40 bp, Artificial Sequence
  Description of Artificial Sequence: Synthetic oligonucleotide
aaacaacgttcagccagagttggtctcaaatcaaaatctc

SEQ ID NO: 261891 - DNA, 39 bp, Artificial Sequence
  Description of Artificial Sequence: Synthetic oligonucleotide
aacaacgttcagccagagttggtctcaaatcaaaatctc

SEQ ID NO: 261892 - DNA, 38 bp, Artificial Sequence
  Description of Artificial Sequence: Synthetic oligonucleotide
acaacgttcagccagagttggtctcaaatcaaaatctc

SEQ ID NO: 261893 - DNA, 37 bp, Artificial Sequence
  Description of Artificial Sequence: Synthetic oligonucleotide
caacgttcagccagagttggtctcaaatcaaaatctc

SEQ ID NO: 261894 - DNA, 39 bp, Artificial Sequence
  Description of Artificial Sequence: Synthetic oligonucleotide
aacgttcagccagagttggtctcaaatcaaaatctcatg

SEQ ID NO: 261895 - DNA, 38 bp, Artificial Sequence
  Description of Artificial Sequence: Synthetic oligonucleotide
acgttcagccagagttggtctcaaatcaaaatctcatg

SEQ ID NO: 261896 - DNA, 37 bp, Artificial Sequence
  Description of Artificial Sequence: Synthetic oligonucleotide
cgttcagccagagttggtctcaaatcaaaatctcatg

SEQ ID NO: 261897 - DNA, 37 bp, Artificial Sequence
  Description of Artificial Sequence: Synthetic oligonucleotide
gttcagccagagttggtctcaaatcaaaatctcatgc

SEQ ID NO: 261898 - DNA, 38 bp, Artificial Sequence
  Description of Artificial Sequence: Synthetic oligonucleotide
ttcagccagagttggtctcaaatcaaaatctcatgcag

SEQ ID NO: 261899 - DNA, 37 bp, Artificial Sequence
  Description of Artificial Sequence: Synthetic oligonucleotide
tcagccagagttggtctcaaatcaaaatctcatgcag

SEQ ID NO: 261900 - DNA, 36 bp, Artificial Sequence
  Description of Artificial Sequence: Synthetic oligonucleotide
cagccagagttggtctcaaatcaaaatctcatgcag

SEQ ID NO: 261901 - DNA, 40 bp, Artificial Sequence
  Description of Artificial Sequence: Synthetic oligonucleotide
agccagagttggtctcaaatcaaaatctcatgcagatttg

SEQ ID NO: 261902 - DNA, 39 bp, Artificial Sequence
  Description of Artificial Sequence: Synthetic oligonucleotide
gccagagttggtctcaaatcaaaatctcatgcagatttg

SEQ ID NO: 261903 - DNA, 39 bp, Artificial Sequence
  Description of Artificial Sequence: Synthetic oligonucleotide
ccagagttggtctcaaatcaaaatctcatgcagatttgg

SEQ ID NO: 261904 - DNA, 41 bp, Artificial Sequence
  Description of Artificial Sequence: Synthetic oligonucleotide
cagagttggtctcaaatcaaaatctcatgcagatttggttg

SEQ ID NO: 261905 - DNA, 41 bp, Artificial Sequence
  Description of Artificial Sequence: Synthetic oligonucleotide
agagttggtctcaaatcaaaatctcatgcagatttggttgc

SEQ ID NO: 261906 - DNA, 40 bp, Artificial Sequence
  Description of Artificial Sequence: Synthetic oligonucleotide
gagttggtctcaaatcaaaatctcatgcagatttggttgc

SEQ ID NO: 261907 - DNA, 43 bp, Artificial Sequence
  Description of Artificial Sequence: Synthetic oligonucleotide
agttggtctcaaatcaaaatctcatgcagatttggttgctttg

SEQ ID NO: 261908 - DNA, 42 bp, Artificial Sequence
  Description of Artificial Sequence: Synthetic oligonucleotide
gttggtctcaaatcaaaatctcatgcagatttggttgctttg

SEQ ID NO: 261909 - DNA, 46 bp, Artificial Sequence
  Description of Artificial Sequence: Synthetic oligonucleotide
ttggtctcaaatcaaaatctcatgcagatttggttgctttgaaaag

SEQ ID NO: 261910 - DNA, 45 bp, Artificial Sequence
  Description of Artificial Sequence: Synthetic oligonucleotide
tggtctcaaatcaaaatctcatgcagatttggttgctttgaaaag

SEQ ID NO: 261911 - DNA, 44 bp, Artificial Sequence
  Description of Artificial Sequence: Synthetic oligonucleotide
ggtctcaaatcaaaatctcatgcagatttggttgctttgaaaag

SEQ ID NO: 261912 - DNA, 44 bp, Artificial Sequence
  Description of Artificial Sequence: Synthetic oligonucleotide
gtctcaaatcaaaatctcatgcagatttggttgctttgaaaagg

SEQ ID NO: 261913 - DNA, 44 bp, Artificial Sequence
  Description of Artificial Sequence: Synthetic oligonucleotide
tctcaaatcaaaatctcatgcagatttggttgctttgaaaaggc

SEQ ID NO: 261914 - DNA, 43 bp, Artificial Sequence
  Description of Artificial Sequence: Synthetic oligonucleotide
ctcaaatcaaaatctcatgcagatttggttgctttgaaaaggc

SEQ ID NO: 261915 - DNA, 43 bp, Artificial Sequence
  Description of Artificial Sequence: Synthetic oligonucleotide
tcaaatcaaaatctcatgcagatttggttgctttgaaaaggcc

SEQ ID NO: 261916 - DNA, 42 bp, Artificial Sequence
  Description of Artificial Sequence: Synthetic oligonucleotide
caaatcaaaatctcatgcagatttggttgctttgaaaaggcc

SEQ ID NO: 261917 - DNA, 42 bp, Artificial Sequence
  Description of Artificial Sequence: Synthetic oligonucleotide
aaatcaaaatctcatgcagatttggttgctttgaaaaggccg

SEQ ID NO: 261918 - DNA, 41 bp, Artificial Sequence
  Description of Artificial Sequence: Synthetic oligonucleotide
aatcaaaatctcatgcagatttggttgctttgaaaaggccg

SEQ ID NO: 261919 - DNA, 40 bp, Artificial Sequence
  Description of Artificial Sequence: Synthetic oligonucleotide
atcaaaatctcatgcagatttggttgctttgaaaaggccg

SEQ ID NO: 261920 - DNA, 39 bp, Artificial Sequence
  Description of Artificial Sequence: Synthetic oligonucleotide
tcaaaatctcatgcagatttggttgctttgaaaaggccg

SEQ ID NO: 261921 - DNA, 38 bp, Artificial Sequence
  Description of Artificial Sequence: Synthetic oligonucleotide
caaaatctcatgcagatttggttgctttgaaaaggccg

SEQ ID NO: 261922 - DNA, 38 bp, Artificial Sequence
  Description of Artificial Sequence: Synthetic oligonucleotide
aaaatctcatgcagatttggttgctttgaaaaggccgc

SEQ ID NO: 261923 - DNA, 37 bp, Artificial Sequence
  Description of Artificial Sequence: Synthetic oligonucleotide
aaatctcatgcagatttggttgctttgaaaaggccgc

SEQ ID NO: 261924 - DNA, 36 bp, Artificial Sequence
  Description of Artificial Sequence: Synthetic oligonucleotide
aatctcatgcagatttggttgctttgaaaaggccgc

SEQ ID NO: 261925 - DNA, 35 bp, Artificial Sequence
  Description of Artificial Sequence: Synthetic oligonucleotide
atctcatgcagatttggttgctttgaaaaggccgc

SEQ ID NO: 261926 - DNA, 34 bp, Artificial Sequence
  Description of Artificial Sequence: Synthetic oligonucleotide
tctcatgcagatttggttgctttgaaaaggccgc

SEQ ID NO: 261927 - DNA, 33 bp, Artificial Sequence
  Description of Artificial Sequence: Synthetic oligonucleotide
ctcatgcagatttggttgctttgaaaaggccgc

SEQ ID NO: 261928 - DNA, 36 bp, Artificial Sequence
  Description of Artificial Sequence: Synthetic oligonucleotide
tcatgcagatttggttgctttgaaaaggccgcaatc

SEQ ID NO: 261929 - DNA, 35 bp, Artificial Sequence
  Description of Artificial Sequence: Synthetic oligonucleotide
catgcagatttggttgctttgaaaaggccgcaatc

SEQ ID NO: 261930 - DNA, 36 bp, Artificial Sequence
  Description of Artificial Sequence: Synthetic oligonucleotide
atgcagatttggttgctttgaaaaggccgcaatcag

SEQ ID NO: 261931 - DNA, 35 bp, Artificial Sequence
  Description of Artificial Sequence: Synthetic oligonucleotide
tgcagatttggttgctttgaaaaggccgcaatcag

SEQ ID NO: 261932 - DNA, 34 bp, Artificial Sequence
  Description of Artificial Sequence: Synthetic oligonucleotide
gcagatttggttgctttgaaaaggccgcaatcag

SEQ ID NO: 261933 - DNA, 35 bp, Artificial Sequence
  Description of Artificial Sequence: Synthetic oligonucleotide
cagatttggttgctttgaaaaggccgcaatcagtg

SEQ ID NO: 261934 - DNA, 35 bp, Artificial Sequence
  Description of Artificial Sequence: Synthetic oligonucleotide
agatttggttgctttgaaaaggccgcaatcagtgc

SEQ ID NO: 261935 - DNA, 34 bp, Artificial Sequence
  Description of Artificial Sequence: Synthetic oligonucleotide
gatttggttgctttgaaaaggccgcaatcagtgc

SEQ ID NO: 261936 - DNA, 36 bp, Artificial Sequence
  Description of Artificial Sequence: Synthetic oligonucleotide
atttggttgctttgaaaaggccgcaatcagtgcttg

SEQ ID NO: 261937 - DNA, 35 bp, Artificial Sequence
  Description of Artificial Sequence: Synthetic oligonucleotide
tttggttgctttgaaaaggccgcaatcagtgcttg

SEQ ID NO: 261938 - DNA, 34 bp, Artificial Sequence
  Description of Artificial Sequence: Synthetic oligonucleotide
ttggttgctttgaaaaggccgcaatcagtgcttg

SEQ ID NO: 261939 - DNA, 33 bp, Artificial Sequence
  Description of Artificial Sequence: Synthetic oligonucleotide
tggttgctttgaaaaggccgcaatcagtgcttg

SEQ ID NO: 261940 - DNA, 32 bp, Artificial Sequence
  Description of Artificial Sequence: Synthetic oligonucleotide
ggttgctttgaaaaggccgcaatcagtgcttg

SEQ ID NO: 261941 - DNA, 32 bp, Artificial Sequence
  Description of Artificial Sequence: Synthetic oligonucleotide
gttgctttgaaaaggccgcaatcagtgcttgc

SEQ ID NO: 261942 - DNA, 33 bp, Artificial Sequence
  Description of Artificial Sequence: Synthetic oligonucleotide
ttgctttgaaaaggccgcaatcagtgcttgcag

SEQ ID NO: 261943 - DNA, 32 bp, Artificial Sequence
  Description of Artificial Sequence: Synthetic oligonucleotide
tgctttgaaaaggccgcaatcagtgcttgcag

SEQ ID NO: 261944 - DNA, 31 bp, Artificial Sequence
  Description of Artificial Sequence: Synthetic oligonucleotide
gctttgaaaaggccgcaatcagtgcttgcag

SEQ ID NO: 261945 - DNA, 31 bp, Artificial Sequence
  Description of Artificial Sequence: Synthetic oligonucleotide
ctttgaaaaggccgcaatcagtgcttgcagc

SEQ ID NO: 261946 - DNA, 32 bp, Artificial Sequence
  Description of Artificial Sequence: Synthetic oligonucleotide
tttgaaaaggccgcaatcagtgcttgcagcac

SEQ ID NO: 261947 - DNA, 31 bp, Artificial Sequence
  Description of Artificial Sequence: Synthetic oligonucleotide
ttgaaaaggccgcaatcagtgcttgcagcac

SEQ ID NO: 261948 - DNA, 30 bp, Artificial Sequence
  Description of Artificial Sequence: Synthetic oligonucleotide
tgaaaaggccgcaatcagtgcttgcagcac

SEQ ID NO: 261949 - DNA, 29 bp, Artificial Sequence
  Description of Artificial Sequence: Synthetic oligonucleotide
gaaaaggccgcaatcagtgcttgcagcac

SEQ ID NO: 261950 - DNA, 31 bp, Artificial Sequence
  Description of Artificial Sequence: Synthetic oligonucleotide
aaaaggccgcaatcagtgcttgcagcacatc

SEQ ID NO: 261951 - DNA, 30 bp, Artificial Sequence
  Description of Artificial Sequence: Synthetic oligonucleotide
aaaggccgcaatcagtgcttgcagcacatc

SEQ ID NO: 261952 - DNA, 29 bp, Artificial Sequence
  Description of Artificial Sequence: Synthetic oligonucleotide
aaggccgcaatcagtgcttgcagcacatc

SEQ ID NO: 261953 - DNA, 28 bp, Artificial Sequence
  Description of Artificial Sequence: Synthetic oligonucleotide
aggccgcaatcagtgcttgcagcacatc

SEQ ID NO: 261954 - DNA, 27 bp, Artificial Sequence
  Description of Artificial Sequence: Synthetic oligonucleotide
ggccgcaatcagtgcttgcagcacatc

SEQ ID NO: 261955 - DNA, 28 bp, Artificial Sequence
  Description of Artificial Sequence: Synthetic oligonucleotide
gccgcaatcagtgcttgcagcacatcag

SEQ ID NO: 261956 - DNA, 37 bp, Artificial Sequence
  Description of Artificial Sequence: Synthetic oligonucleotide
ccgcaatcagtgcttgcagcacatcagaaataaattc

SEQ ID NO: 261957 - DNA, 38 bp, Artificial Sequence
  Description of Artificial Sequence: Synthetic oligonucleotide
cgcaatcagtgcttgcagcacatcagaaataaattctc

SEQ ID NO: 261958 - DNA, 38 bp, Artificial Sequence
  Description of Artificial Sequence: Synthetic oligonucleotide
gcaatcagtgcttgcagcacatcagaaataaattctcc

SEQ ID NO: 261959 - DNA, 40 bp, Artificial Sequence
  Description of Artificial Sequence: Synthetic oligonucleotide
caatcagtgcttgcagcacatcagaaataaattctccttg

SEQ ID NO: 261960 - DNA, 42 bp, Artificial Sequence
  Description of Artificial Sequence: Synthetic oligonucleotide
aatcagtgcttgcagcacatcagaaataaattctccttgttg

SEQ ID NO: 261961 - DNA, 41 bp, Artificial Sequence
  Description of Artificial Sequence: Synthetic oligonucleotide
atcagtgcttgcagcacatcagaaataaattctccttgttg

SEQ ID NO: 261962 - DNA, 40 bp, Artificial Sequence
  Description of Artificial Sequence: Synthetic oligonucleotide
tcagtgcttgcagcacatcagaaataaattctccttgttg

SEQ ID NO: 261963 - DNA, 39 bp, Artificial Sequence
  Description of Artificial Sequence: Synthetic oligonucleotide
cagtgcttgcagcacatcagaaataaattctccttgttg

SEQ ID NO: 261964 - DNA, 40 bp, Artificial Sequence
  Description of Artificial Sequence: Synthetic oligonucleotide
agtgcttgcagcacatcagaaataaattctccttgttgac

SEQ ID NO: 261965 - DNA, 39 bp, Artificial Sequence
  Description of Artificial Sequence: Synthetic oligonucleotide
gtgcttgcagcacatcagaaataaattctccttgttgac

SEQ ID NO: 261966 - DNA, 41 bp, Artificial Sequence
  Description of Artificial Sequence: Synthetic oligonucleotide
tgcttgcagcacatcagaaataaattctccttgttgacaag

SEQ ID NO: 261967 - DNA, 40 bp, Artificial Sequence
  Description of Artificial Sequence: Synthetic oligonucleotide
gcttgcagcacatcagaaataaattctccttgttgacaag

SEQ ID NO: 261968 - DNA, 40 bp, Artificial Sequence
  Description of Artificial Sequence: Synthetic oligonucleotide
cttgcagcacatcagaaataaattctccttgttgacaagc

SEQ ID NO: 261969 - DNA, 45 bp, Artificial Sequence
  Description of Artificial Sequence: Synthetic oligonucleotide
ttgcagcacatcagaaataaattctccttgttgacaagcatattg

SEQ ID NO: 261970 - DNA, 44 bp, Artificial Sequence
  Description of Artificial Sequence: Synthetic oligonucleotide
tgcagcacatcagaaataaattctccttgttgacaagcatattg

SEQ ID NO: 261971 - DNA, 43 bp, Artificial Sequence
  Description of Artificial Sequence: Synthetic oligonucleotide
gcagcacatcagaaataaattctccttgttgacaagcatattg

SEQ ID NO: 261972 - DNA, 43 bp, Artificial Sequence
  Description of Artificial Sequence: Synthetic oligonucleotide
cagcacatcagaaataaattctccttgttgacaagcatattgg

SEQ ID NO: 261973 - DNA, 46 bp, Artificial Sequence
  Description of Artificial Sequence: Synthetic oligonucleotide
agcacatcagaaataaattctccttgttgacaagcatattggtttc

SEQ ID NO: 261974 - DNA, 45 bp, Artificial Sequence
  Description of Artificial Sequence: Synthetic oligonucleotide
gcacatcagaaataaattctccttgttgacaagcatattggtttc

SEQ ID NO: 261975 - DNA, 46 bp, Artificial Sequence
  Description of Artificial Sequence: Synthetic oligonucleotide
cacatcagaaataaattctccttgttgacaagcatattggtttctc

SEQ ID NO: 261976 - DNA, 50 bp, Artificial Sequence
  Description of Artificial Sequence: Synthetic oligonucleotide
acatcagaaataaattctccttgttgacaagcatattggtttctcaattg

SEQ ID NO: 261977 - DNA, 49 bp, Artificial Sequence
  Description of Artificial Sequence: Synthetic oligonucleotide
catcagaaataaattctccttgttgacaagcatattggtttctcaattg

SEQ ID NO: 261978 - DNA, 49 bp, Artificial Sequence
  Description of Artificial Sequence: Synthetic oligonucleotide
atcagaaataaattctccttgttgacaagcatattggtttctcaattgg

SEQ ID NO: 261979 - DNA, 48 bp, Artificial Sequence
  Description of Artificial Sequence: Synthetic oligonucleotide
tcagaaataaattctccttgttgacaagcatattggtttctcaattgg

SEQ ID NO: 261980 - DNA, 47 bp, Artificial Sequence
  Description of Artificial Sequence: Synthetic oligonucleotide
cagaaataaattctccttgttgacaagcatattggtttctcaattgg

SEQ ID NO: 261981 - DNA, 47 bp, Artificial Sequence
  Description of Artificial Sequence: Synthetic oligonucleotide
agaaataaattctccttgttgacaagcatattggtttctcaattggg

SEQ ID NO: 261982 - DNA, 46 bp, Artificial Sequence
  Description of Artificial Sequence: Synthetic oligonucleotide
gaaataaattctccttgttgacaagcatattggtttctcaattggg

SEQ ID NO: 261983 - DNA, 46 bp, Artificial Sequence
  Description of Artificial Sequence: Synthetic oligonucleotide
aaataaattctccttgttgacaagcatattggtttctcaattgggg

SEQ ID NO: 261984 - DNA, 45 bp, Artificial Sequence
  Description of Artificial Sequence: Synthetic oligonucleotide
aataaattctccttgttgacaagcatattggtttctcaattgggg

SEQ ID NO: 261985 - DNA, 44 bp, Artificial Sequence
  Description of Artificial Sequence: Synthetic oligonucleotide
ataaattctccttgttgacaagcatattggtttctcaattgggg

SEQ ID NO: 261986 - DNA, 43 bp, Artificial Sequence
  Description of Artificial Sequence: Synthetic oligonucleotide
taaattctccttgttgacaagcatattggtttctcaattgggg

SEQ ID NO: 261987 - DNA, 42 bp, Artificial Sequence
  Description of Artificial Sequence: Synthetic oligonucleotide
aaattctccttgttgacaagcatattggtttctcaattgggg

SEQ ID NO: 261988 - DNA, 41 bp, Artificial Sequence
  Description of Artificial Sequence: Synthetic oligonucleotide
aattctccttgttgacaagcatattggtttctcaattgggg

SEQ ID NO: 261989 - DNA, 40 bp, Artificial Sequence
  Description of Artificial Sequence: Synthetic oligonucleotide
attctccttgttgacaagcatattggtttctcaattgggg

SEQ ID NO: 261990 - DNA, 39 bp, Artificial Sequence
  Description of Artificial Sequence: Synthetic oligonucleotide
ttctccttgttgacaagcatattggtttctcaattgggg

SEQ ID NO: 261991 - DNA, 38 bp, Artificial Sequence
  Description of Artificial Sequence: Synthetic oligonucleotide
tctccttgttgacaagcatattggtttctcaattgggg

SEQ ID NO: 261992 - DNA, 37 bp, Artificial Sequence
  Description of Artificial Sequence: Synthetic oligonucleotide
ctccttgttgacaagcatattggtttctcaattgggg

SEQ ID NO: 261993 - DNA, 37 bp, Artificial Sequence
  Description of Artificial Sequence: Synthetic oligonucleotide
tccttgttgacaagcatattggtttctcaattggggg

SEQ ID NO: 261994 - DNA, 36 bp, Artificial Sequence
  Description of Artificial Sequence: Synthetic oligonucleotide
ccttgttgacaagcatattggtttctcaattggggg

SEQ ID NO: 261995 - DNA, 36 bp, Artificial Sequence
  Description of Artificial Sequence: Synthetic oligonucleotide
cttgttgacaagcatattggtttctcaattgggggg

SEQ ID NO: 261996 - DNA, 36 bp, Artificial Sequence
  Description of Artificial Sequence: Synthetic oligonucleotide
ttgttgacaagcatattggtttctcaattggggggc

SEQ ID NO: 261997 - DNA, 35 bp, Artificial Sequence
  Description of Artificial Sequence: Synthetic oligonucleotide
tgttgacaagcatattggtttctcaattggggggc

SEQ ID NO: 261998 - DNA, 34 bp, Artificial Sequence
  Description of Artificial Sequence: Synthetic oligonucleotide
gttgacaagcatattggtttctcaattggggggc

SEQ ID NO: 261999 - DNA, 37 bp, Artificial Sequence
  Description of Artificial Sequence: Synthetic oligonucleotide
ttgacaagcatattggtttctcaattggggggcttac

SEQ ID NO: 262000 - DNA, 36 bp, Artificial Sequence
  Description of Artificial Sequence: Synthetic oligonucleotide
tgacaagcatattggtttctcaattggggggcttac

SEQ ID NO: 262001 - DNA, 35 bp, Artificial Sequence
  Description of Artificial Sequence: Synthetic oligonucleotide
gacaagcatattggtttctcaattggggggcttac

SEQ ID NO: 262002 - DNA, 36 bp, Artificial Sequence
  Description of Artificial Sequence: Synthetic oligonucleotide
acaagcatattggtttctcaattggggggcttacag

SEQ ID NO: 262003 - DNA, 35 bp, Artificial Sequence
  Description of Artificial Sequence: Synthetic oligonucleotide
caagcatattggtttctcaattggggggcttacag

SEQ ID NO: 262004 - DNA, 35 bp, Artificial Sequence
  Description of Artificial Sequence: Synthetic oligonucleotide
aagcatattggtttctcaattggggggcttacagc

SEQ ID NO: 262005 - DNA, 34 bp, Artificial Sequence
  Description of Artificial Sequence: Synthetic oligonucleotide
agcatattggtttctcaattggggggcttacagc

SEQ ID NO: 262006 - DNA, 33 bp, Artificial Sequence
  Description of Artificial Sequence: Synthetic oligonucleotide
gcatattggtttctcaattggggggcttacagc

SEQ ID NO: 262007 - DNA, 34 bp, Artificial Sequence
  Description of Artificial Sequence: Synthetic oligonucleotide
catattggtttctcaattggggggcttacagctg

SEQ ID NO: 262008 - DNA, 36 bp, Artificial Sequence
  Description of Artificial Sequence: Synthetic oligonucleotide
atattggtttctcaattggggggcttacagctgatg

SEQ ID NO: 262009 - DNA, 35 bp, Artificial Sequence
  Description of Artificial Sequence: Synthetic oligonucleotide
tattggtttctcaattggggggcttacagctgatg

SEQ ID NO: 262010 - DNA, 34 bp, Artificial Sequence
  Description of Artificial Sequence: Synthetic oligonucleotide
attggtttctcaattggggggcttacagctgatg

SEQ ID NO: 262011 - DNA, 33 bp, Artificial Sequence
  Description of Artificial Sequence: Synthetic oligonucleotide
ttggtttctcaattggggggcttacagctgatg

SEQ ID NO: 262012 - DNA, 32 bp, Artificial Sequence
  Description of Artificial Sequence: Synthetic oligonucleotide
tggtttctcaattggggggcttacagctgatg

SEQ ID NO: 262013 - DNA, 31 bp, Artificial Sequence
  Description of Artificial Sequence: Synthetic oligonucleotide
ggtttctcaattggggggcttacagctgatg

SEQ ID NO: 262014 - DNA, 31 bp, Artificial Sequence
  Description of Artificial Sequence: Synthetic oligonucleotide
gtttctcaattggggggcttacagctgatgc

SEQ ID NO: 262015 - DNA, 33 bp, Artificial Sequence
  Description of Artificial Sequence: Synthetic oligonucleotide
tttctcaattggggggcttacagctgatgcttg

SEQ ID NO: 262016 - DNA, 32 bp, Artificial Sequence
  Description of Artificial Sequence: Synthetic oligonucleotide
ttctcaattggggggcttacagctgatgcttg

SEQ ID NO: 262017 - DNA, 31 bp, Artificial Sequence
  Description of Artificial Sequence: Synthetic oligonucleotide
tctcaattggggggcttacagctgatgcttg

SEQ ID NO: 262018 - DNA, 30 bp, Artificial Sequence
  Description of Artificial Sequence: Synthetic oligonucleotide
ctcaattggggggcttacagctgatgcttg

SEQ ID NO: 262019 - DNA, 31 bp, Artificial Sequence
  Description of Artificial Sequence: Synthetic oligonucleotide
tcaattggggggcttacagctgatgcttgac

SEQ ID NO: 262020 - DNA, 30 bp, Artificial Sequence
  Description of Artificial Sequence: Synthetic oligonucleotide
caattggggggcttacagctgatgcttgac

SEQ ID NO: 262021 - DNA, 31 bp, Artificial Sequence
  Description of Artificial Sequence: Synthetic oligonucleotide
aattggggggcttacagctgatgcttgactg

SEQ ID NO: 262022 - DNA, 30 bp, Artificial Sequence
  Description of Artificial Sequence: Synthetic oligonucleotide
attggggggcttacagctgatgcttgactg

SEQ ID NO: 262023 - DNA, 29 bp, Artificial Sequence
  Description of Artificial Sequence: Synthetic oligonucleotide
ttggggggcttacagctgatgcttgactg

SEQ ID NO: 262024 - DNA, 28 bp, Artificial Sequence
  Description of Artificial Sequence: Synthetic oligonucleotide
tggggggcttacagctgatgcttgactg

SEQ ID NO: 262025 - DNA, 27 bp, Artificial Sequence
  Description of Artificial Sequence: Synthetic oligonucleotide
ggggggcttacagctgatgcttgactg

SEQ ID NO: 262026 - DNA, 31 bp, Artificial Sequence
  Description of Artificial Sequence: Synthetic oligonucleotide
gggggcttacagctgatgcttgactgttatc

SEQ ID NO: 262027 - DNA, 40 bp, Artificial Sequence
  Description of Artificial Sequence: Synthetic oligonucleotide
ggggcttacagctgatgcttgactgttatctaattttatc

SEQ ID NO: 262028 - DNA, 40 bp, Artificial Sequence
  Description of Artificial Sequence: Synthetic oligonucleotide
gggcttacagctgatgcttgactgttatctaattttatcc

SEQ ID NO: 262029 - DNA, 40 bp, Artificial Sequence
  Description of Artificial Sequence: Synthetic oligonucleotide
ggcttacagctgatgcttgactgttatctaattttatccg

SEQ ID NO: 262030 - DNA, 41 bp, Artificial Sequence
  Description of Artificial Sequence: Synthetic oligonucleotide
gcttacagctgatgcttgactgttatctaattttatccgtc

SEQ ID NO: 262031 - DNA, 42 bp, Artificial Sequence
  Description of Artificial Sequence: Synthetic oligonucleotide
cttacagctgatgcttgactgttatctaattttatccgtcag

SEQ ID NO: 262032 - DNA, 42 bp, Artificial Sequence
  Description of Artificial Sequence: Synthetic oligonucleotide
ttacagctgatgcttgactgttatctaattttatccgtcagg

SEQ ID NO: 262033 - DNA, 41 bp, Artificial Sequence
  Description of Artificial Sequence: Synthetic oligonucleotide
tacagctgatgcttgactgttatctaattttatccgtcagg

SEQ ID NO: 262034 - DNA, 40 bp, Artificial Sequence
  Description of Artificial Sequence: Synthetic oligonucleotide
acagctgatgcttgactgttatctaattttatccgtcagg

SEQ ID NO: 262035 - DNA, 39 bp, Artificial Sequence
  Description of Artificial Sequence: Synthetic oligonucleotide
cagctgatgcttgactgttatctaattttatccgtcagg

SEQ ID NO: 262036 - DNA, 40 bp, Artificial Sequence
  Description of Artificial Sequence: Synthetic oligonucleotide
agctgatgcttgactgttatctaattttatccgtcaggag

SEQ ID NO: 262037 - DNA, 39 bp, Artificial Sequence
  Description of Artificial Sequence: Synthetic oligonucleotide
gctgatgcttgactgttatctaattttatccgtcaggag

SEQ ID NO: 262038 - DNA, 40 bp, Artificial Sequence
  Description of Artificial Sequence: Synthetic oligonucleotide
ctgatgcttgactgttatctaattttatccgtcaggagag

SEQ ID NO: 262039 - DNA, 43 bp, Artificial Sequence
  Description of Artificial Sequence: Synthetic oligonucleotide
tgatgcttgactgttatctaattttatccgtcaggagagtttg

SEQ ID NO: 262040 - DNA, 42 bp, Artificial Sequence
  Description of Artificial Sequence: Synthetic oligonucleotide
gatgcttgactgttatctaattttatccgtcaggagagtttg

SEQ ID NO: 262041 - DNA, 42 bp, Artificial Sequence
  Description of Artificial Sequence: Synthetic oligonucleotide
atgcttgactgttatctaattttatccgtcaggagagtttgg

SEQ ID NO: 262042 - DNA, 41 bp, Artificial Sequence
  Description of Artificial Sequence: Synthetic oligonucleotide
tgcttgactgttatctaattttatccgtcaggagagtttgg

SEQ ID NO: 262043 - DNA, 40 bp, Artificial Sequence
  Description of Artificial Sequence: Synthetic oligonucleotide
gcttgactgttatctaattttatccgtcaggagagtttgg

SEQ ID NO: 262044 - DNA, 43 bp, Artificial Sequence
  Description of Artificial Sequence: Synthetic oligonucleotide
cttgactgttatctaattttatccgtcaggagagtttggattg

SEQ ID NO: 262045 - DNA, 43 bp, Artificial Sequence
  Description of Artificial Sequence: Synthetic oligonucleotide
ttgactgttatctaattttatccgtcaggagagtttggattgc

SEQ ID NO: 262046 - DNA, 42 bp, Artificial Sequence
  Description of Artificial Sequence: Synthetic oligonucleotide
tgactgttatctaattttatccgtcaggagagtttggattgc

SEQ ID NO: 262047 - DNA, 41 bp, Artificial Sequence
  Description of Artificial Sequence: Synthetic oligonucleotide
gactgttatctaattttatccgtcaggagagtttggattgc

SEQ ID NO: 262048 - DNA, 42 bp, Artificial Sequence
  Description of Artificial Sequence: Synthetic oligonucleotide
actgttatctaattttatccgtcaggagagtttggattgcag

SEQ ID NO: 262049 - DNA, 41 bp, Artificial Sequence
  Description of Artificial Sequence: Synthetic oligonucleotide
ctgttatctaattttatccgtcaggagagtttggattgcag

SEQ ID NO: 262050 - DNA, 45 bp, Artificial Sequence
  Description of Artificial Sequence: Synthetic oligonucleotide
tgttatctaattttatccgtcaggagagtttggattgcagatttg

SEQ ID NO: 262051 - DNA, 44 bp, Artificial Sequence
  Description of Artificial Sequence: Synthetic oligonucleotide
gttatctaattttatccgtcaggagagtttggattgcagatttg

SEQ ID NO: 262052 - DNA, 48 bp, Artificial Sequence
  Description of Artificial Sequence: Synthetic oligonucleotide
ttatctaattttatccgtcaggagagtttggattgcagatttgttttc

SEQ ID NO: 262053 - DNA, 47 bp, Artificial Sequence
  Description of Artificial Sequence: Synthetic oligonucleotide
tatctaattttatccgtcaggagagtttggattgcagatttgttttc

SEQ ID NO: 262054 - DNA, 46 bp, Artificial Sequence
  Description of Artificial Sequence: Synthetic oligonucleotide
atctaattttatccgtcaggagagtttggattgcagatttgttttc

SEQ ID NO: 262055 - DNA, 45 bp, Artificial Sequence
  Description of Artificial Sequence: Synthetic oligonucleotide
tctaattttatccgtcaggagagtttggattgcagatttgttttc

SEQ ID NO: 262056 - DNA, 44 bp, Artificial Sequence
  Description of Artificial Sequence: Synthetic oligonucleotide
ctaattttatccgtcaggagagtttggattgcagatttgttttc

SEQ ID NO: 262057 - DNA, 44 bp, Artificial Sequence
  Description of Artificial Sequence: Synthetic oligonucleotide
taattttatccgtcaggagagtttggattgcagatttgttttcg

SEQ ID NO: 262058 - DNA, 43 bp, Artificial Sequence
  Description of Artificial Sequence: Synthetic oligonucleotide
aattttatccgtcaggagagtttggattgcagatttgttttcg

SEQ ID NO: 262059 - DNA, 42 bp, Artificial Sequence
  Description of Artificial Sequence: Synthetic oligonucleotide
attttatccgtcaggagagtttggattgcagatttgttttcg

SEQ ID NO: 262060 - DNA, 41 bp, Artificial Sequence
  Description of Artificial Sequence: Synthetic oligonucleotide
ttttatccgtcaggagagtttggattgcagatttgttttcg

SEQ ID NO: 262061 - DNA, 40 bp, Artificial Sequence
  Description of Artificial Sequence: Synthetic oligonucleotide
tttatccgtcaggagagtttggattgcagatttgttttcg

SEQ ID NO: 262062 - DNA, 39 bp, Artificial Sequence
  Description of Artificial Sequence: Synthetic oligonucleotide
ttatccgtcaggagagtttggattgcagatttgttttcg

SEQ ID NO: 262063 - DNA, 38 bp, Artificial Sequence
  Description of Artificial Sequence: Synthetic oligonucleotide
tatccgtcaggagagtttggattgcagatttgttttcg

SEQ ID NO: 262064 - DNA, 37 bp, Artificial Sequence
  Description of Artificial Sequence: Synthetic oligonucleotide
atccgtcaggagagtttggattgcagatttgttttcg

SEQ ID NO: 262065 - DNA, 36 bp, Artificial Sequence
  Description of Artificial Sequence: Synthetic oligonucleotide
tccgtcaggagagtttggattgcagatttgttttcg

SEQ ID NO: 262066 - DNA, 35 bp, Artificial Sequence
  Description of Artificial Sequence: Synthetic oligonucleotide
ccgtcaggagagtttggattgcagatttgttttcg

SEQ ID NO: 262067 - DNA, 38 bp, Artificial Sequence
  Description of Artificial Sequence: Synthetic oligonucleotide
cgtcaggagagtttggattgcagatttgttttcgatag

SEQ ID NO: 262068 - DNA, 39 bp, Artificial Sequence
  Description of Artificial Sequence: Synthetic oligonucleotide
gtcaggagagtttggattgcagatttgttttcgatagag

SEQ ID NO: 262069 - DNA, 39 bp, Artificial Sequence
  Description of Artificial Sequence: Synthetic oligonucleotide
tcaggagagtttggattgcagatttgttttcgatagagc

SEQ ID NO: 262070 - DNA, 38 bp, Artificial Sequence
  Description of Artificial Sequence: Synthetic oligonucleotide
caggagagtttggattgcagatttgttttcgatagagc

SEQ ID NO: 262071 - DNA, 39 bp, Artificial Sequence
  Description of Artificial Sequence: Synthetic oligonucleotide
aggagagtttggattgcagatttgttttcgatagagcac

SEQ ID NO: 262072 - DNA, 38 bp, Artificial Sequence
  Description of Artificial Sequence: Synthetic oligonucleotide
ggagagtttggattgcagatttgttttcgatagagcac

SEQ ID NO: 262073 - DNA, 39 bp, Artificial Sequence
  Description of Artificial Sequence: Synthetic oligonucleotide
gagagtttggattgcagatttgttttcgatagagcactg

SEQ ID NO: 262074 - DNA, 39 bp, Artificial Sequence
  Description of Artificial Sequence: Synthetic oligonucleotide
agagtttggattgcagatttgttttcgatagagcactgc

SEQ ID NO: 262075 - DNA, 38 bp, Artificial Sequence
  Description of Artificial Sequence: Synthetic oligonucleotide
gagtttggattgcagatttgttttcgatagagcactgc

SEQ ID NO: 262076 - DNA, 38 bp, Artificial Sequence
  Description of Artificial Sequence: Synthetic oligonucleotide
agtttggattgcagatttgttttcgatagagcactgcc

SEQ ID NO: 262077 - DNA, 37 bp, Artificial Sequence
  Description of Artificial Sequence: Synthetic oligonucleotide
gtttggattgcagatttgttttcgatagagcactgcc

SEQ ID NO: 262078 - DNA, 38 bp, Artificial Sequence
  Description of Artificial Sequence: Synthetic oligonucleotide
tttggattgcagatttgttttcgatagagcactgcctg

SEQ ID NO: 262079 - DNA, 37 bp, Artificial Sequence
  Description of Artificial Sequence: Synthetic oligonucleotide
ttggattgcagatttgttttcgatagagcactgcctg

SEQ ID NO: 262080 - DNA, 36 bp, Artificial Sequence
  Description of Artificial Sequence: Synthetic oligonucleotide
tggattgcagatttgttttcgatagagcactgcctg

SEQ ID NO: 262081 - DNA, 35 bp, Artificial Sequence
  Description of Artificial Sequence: Synthetic oligonucleotide
ggattgcagatttgttttcgatagagcactgcctg

SEQ ID NO: 262082 - DNA, 36 bp, Artificial Sequence
  Description of Artificial Sequence: Synthetic oligonucleotide
gattgcagatttgttttcgatagagcactgcctgag

SEQ ID NO: 262083 - DNA, 37 bp, Artificial Sequence
  Description of Artificial Sequence: Synthetic oligonucleotide
attgcagatttgttttcgatagagcactgcctgagtc

SEQ ID NO: 262084 - DNA, 36 bp, Artificial Sequence
  Description of Artificial Sequence: Synthetic oligonucleotide
ttgcagatttgttttcgatagagcactgcctgagtc

SEQ ID NO: 262085 - DNA, 35 bp, Artificial Sequence
  Description of Artificial Sequence: Synthetic oligonucleotide
tgcagatttgttttcgatagagcactgcctgagtc

SEQ ID NO: 262086 - DNA, 34 bp, Artificial Sequence
  Description of Artificial Sequence: Synthetic oligonucleotide
gcagatttgttttcgatagagcactgcctgagtc

SEQ ID NO: 262087 - DNA, 35 bp, Artificial Sequence
  Description of Artificial Sequence: Synthetic oligonucleotide
cagatttgttttcgatagagcactgcctgagtctc

SEQ ID NO: 262088 - DNA, 35 bp, Artificial Sequence
  Description of Artificial Sequence: Synthetic oligonucleotide
agatttgttttcgatagagcactgcctgagtctcg

SEQ ID NO: 262089 - DNA, 34 bp, Artificial Sequence
  Description of Artificial Sequence: Synthetic oligonucleotide
gatttgttttcgatagagcactgcctgagtctcg

SEQ ID NO: 262090 - DNA, 35 bp, Artificial Sequence
  Description of Artificial Sequence: Synthetic oligonucleotide
atttgttttcgatagagcactgcctgagtctcgtc

SEQ ID NO: 262091 - DNA, 34 bp, Artificial Sequence
  Description of Artificial Sequence: Synthetic oligonucleotide
tttgttttcgatagagcactgcctgagtctcgtc

SEQ ID NO: 262092 - DNA, 33 bp, Artificial Sequence
  Description of Artificial Sequence: Synthetic oligonucleotide
ttgttttcgatagagcactgcctgagtctcgtc

SEQ ID NO: 262093 - DNA, 32 bp, Artificial Sequence
  Description of Artificial Sequence: Synthetic oligonucleotide
tgttttcgatagagcactgcctgagtctcgtc

SEQ ID NO: 262094 - DNA, 31 bp, Artificial Sequence
  Description of Artificial Sequence: Synthetic oligonucleotide
gttttcgatagagcactgcctgagtctcgtc

SEQ ID NO: 262095 - DNA, 33 bp, Artificial Sequence
  Description of Artificial Sequence: Synthetic oligonucleotide
ttttcgatagagcactgcctgagtctcgtctag

SEQ ID NO: 262096 - DNA, 32 bp, Artificial Sequence
  Description of Artificial Sequence: Synthetic oligonucleotide
tttcgatagagcactgcctgagtctcgtctag

SEQ ID NO: 262097 - DNA, 31 bp, Artificial Sequence
  Description of Artificial Sequence: Synthetic oligonucleotide
ttcgatagagcactgcctgagtctcgtctag

SEQ ID NO: 262098 - DNA, 30 bp, Artificial Sequence
  Description of Artificial Sequence: Synthetic oligonucleotide
tcgatagagcactgcctgagtctcgtctag

SEQ ID NO: 262099 - DNA, 29 bp, Artificial Sequence
  Description of Artificial Sequence: Synthetic oligonucleotide
cgatagagcactgcctgagtctcgtctag

SEQ ID NO: 262100 - DNA, 32 bp, Artificial Sequence
  Description of Artificial Sequence: Synthetic oligonucleotide
gatagagcactgcctgagtctcgtctagtatc

SEQ ID NO: 262101 - DNA, 33 bp, Artificial Sequence
  Description of Artificial Sequence: Synthetic oligonucleotide
atagagcactgcctgagtctcgtctagtatctc

SEQ ID NO: 262102 - DNA, 32 bp, Artificial Sequence
  Description of Artificial Sequence: Synthetic oligonucleotide
tagagcactgcctgagtctcgtctagtatctc

SEQ ID NO: 262103 - DNA, 31 bp, Artificial Sequence
  Description of Artificial Sequence: Synthetic oligonucleotide
agagcactgcctgagtctcgtctagtatctc

SEQ ID NO: 262104 - DNA, 30 bp, Artificial Sequence
  Description of Artificial Sequence: Synthetic oligonucleotide
gagcactgcctgagtctcgtctagtatctc

SEQ ID NO: 262105 - DNA, 35 bp, Artificial Sequence
  Description of Artificial Sequence: Synthetic oligonucleotide
agcactgcctgagtctcgtctagtatctctatttg

SEQ ID NO: 262106 - DNA, 34 bp, Artificial Sequence
  Description of Artificial Sequence: Synthetic oligonucleotide
gcactgcctgagtctcgtctagtatctctatttg

SEQ ID NO: 262107 - DNA, 34 bp, Artificial Sequence
  Description of Artificial Sequence: Synthetic oligonucleotide
cactgcctgagtctcgtctagtatctctatttgg

SEQ ID NO: 262108 - DNA, 36 bp, Artificial Sequence
  Description of Artificial Sequence: Synthetic oligonucleotide
actgcctgagtctcgtctagtatctctatttggaag

SEQ ID NO: 262109 - DNA, 35 bp, Artificial Sequence
  Description of Artificial Sequence: Synthetic oligonucleotide
ctgcctgagtctcgtctagtatctctatttggaag

SEQ ID NO: 262110 - DNA, 35 bp, Artificial Sequence
  Description of Artificial Sequence: Synthetic oligonucleotide
tgcctgagtctcgtctagtatctctatttggaagc

SEQ ID NO: 262111 - DNA, 34 bp, Artificial Sequence
  Description of Artificial Sequence: Synthetic oligonucleotide
gcctgagtctcgtctagtatctctatttggaagc

SEQ ID NO: 262112 - DNA, 36 bp, Artificial Sequence
  Description of Artificial Sequence: Synthetic oligonucleotide
cctgagtctcgtctagtatctctatttggaagctag

SEQ ID NO: 262113 - DNA, 37 bp, Artificial Sequence
  Description of Artificial Sequence: Synthetic oligonucleotide
ctgagtctcgtctagtatctctatttggaagctagac

SEQ ID NO: 262114 - DNA, 37 bp, Artificial Sequence
  Description of Artificial Sequence: Synthetic oligonucleotide
tgagtctcgtctagtatctctatttggaagctagacc

SEQ ID NO: 262115 - DNA, 36 bp, Artificial Sequence
  Description of Artificial Sequence: Synthetic oligonucleotide
gagtctcgtctagtatctctatttggaagctagacc

SEQ ID NO: 262116 - DNA, 36 bp, Artificial Sequence
  Description of Artificial Sequence: Synthetic oligonucleotide
agtctcgtctagtatctctatttggaagctagaccc

SEQ ID NO: 262117 - DNA, 35 bp, Artificial Sequence
  Description of Artificial Sequence: Synthetic oligonucleotide
gtctcgtctagtatctctatttggaagctagaccc

SEQ ID NO: 262118 - DNA, 36 bp, Artificial Sequence
  Description of Artificial Sequence: Synthetic oligonucleotide
tctcgtctagtatctctatttggaagctagacccag

SEQ ID NO: 262119 - DNA, 35 bp, Artificial Sequence
  Description of Artificial Sequence: Synthetic oligonucleotide
ctcgtctagtatctctatttggaagctagacccag

SEQ ID NO: 262120 - DNA, 38 bp, Artificial Sequence
  Description of Artificial Sequence: Synthetic oligonucleotide
tcgtctagtatctctatttggaagctagacccagattc

SEQ ID NO: 262121 - DNA, 37 bp, Artificial Sequence
  Description of Artificial Sequence: Synthetic oligonucleotide
cgtctagtatctctatttggaagctagacccagattc

SEQ ID NO: 262122 - DNA, 37 bp, Artificial Sequence
  Description of Artificial Sequence: Synthetic oligonucleotide
gtctagtatctctatttggaagctagacccagattcc

SEQ ID NO: 262123 - DNA, 39 bp, Artificial Sequence
  Description of Artificial Sequence: Synthetic oligonucleotide
tctagtatctctatttggaagctagacccagattccaac

SEQ ID NO: 262124 - DNA, 38 bp, Artificial Sequence
  Description of Artificial Sequence: Synthetic oligonucleotide
ctagtatctctatttggaagctagacccagattccaac

SEQ ID NO: 262125 - DNA, 39 bp, Artificial Sequence
  Description of Artificial Sequence: Synthetic oligonucleotide
tagtatctctatttggaagctagacccagattccaacac

SEQ ID NO: 262126 - DNA, 38 bp, Artificial Sequence
  Description of Artificial Sequence: Synthetic oligonucleotide
agtatctctatttggaagctagacccagattccaacac

SEQ ID NO: 262127 - DNA, 37 bp, Artificial Sequence
  Description of Artificial Sequence: Synthetic oligonucleotide
gtatctctatttggaagctagacccagattccaacac

SEQ ID NO: 262128 - DNA, 39 bp, Artificial Sequence
  Description of Artificial Sequence: Synthetic oligonucleotide
tatctctatttggaagctagacccagattccaacacaag

SEQ ID NO: 262129 - DNA, 38 bp, Artificial Sequence
  Description of Artificial Sequence: Synthetic oligonucleotide
atctctatttggaagctagacccagattccaacacaag

SEQ ID NO: 262130 - DNA, 37 bp, Artificial Sequence
  Description of Artificial Sequence: Synthetic oligonucleotide
tctctatttggaagctagacccagattccaacacaag

SEQ ID NO: 262131 - DNA, 36 bp, Artificial Sequence
  Description of Artificial Sequence: Synthetic oligonucleotide
ctctatttggaagctagacccagattccaacacaag

SEQ ID NO: 262132 - DNA, 36 bp, Artificial Sequence
  Description of Artificial Sequence: Synthetic oligonucleotide
tctatttggaagctagacccagattccaacacaagg

SEQ ID NO: 262133 - DNA, 35 bp, Artificial Sequence
  Description of Artificial Sequence: Synthetic oligonucleotide
ctatttggaagctagacccagattccaacacaagg

SEQ ID NO: 262134 - DNA, 39 bp, Artificial Sequence
  Description of Artificial Sequence: Synthetic oligonucleotide
tatttggaagctagacccagattccaacacaaggatatg

SEQ ID NO: 262135 - DNA, 38 bp, Artificial Sequence
  Description of Artificial Sequence: Synthetic oligonucleotide
atttggaagctagacccagattccaacacaaggatatg

SEQ ID NO: 262136 - DNA, 37 bp, Artificial Sequence
  Description of Artificial Sequence: Synthetic oligonucleotide
tttggaagctagacccagattccaacacaaggatatg

SEQ ID NO: 262137 - DNA, 36 bp, Artificial Sequence
  Description of Artificial Sequence: Synthetic oligonucleotide
ttggaagctagacccagattccaacacaaggatatg

SEQ ID NO: 262138 - DNA, 35 bp, Artificial Sequence
  Description of Artificial Sequence: Synthetic oligonucleotide
tggaagctagacccagattccaacacaaggatatg

SEQ ID NO: 262139 - DNA, 34 bp, Artificial Sequence
  Description of Artificial Sequence: Synthetic oligonucleotide
ggaagctagacccagattccaacacaaggatatg

SEQ ID NO: 262140 - DNA, 34 bp, Artificial Sequence
  Description of Artificial Sequence: Synthetic oligonucleotide
gaagctagacccagattccaacacaaggatatgg

SEQ ID NO: 262141 - DNA, 34 bp, Artificial Sequence
  Description of Artificial Sequence: Synthetic oligonucleotide
aagctagacccagattccaacacaaggatatggc

SEQ ID NO: 262142 - DNA, 33 bp, Artificial Sequence
  Description of Artificial Sequence: Synthetic oligonucleotide
agctagacccagattccaacacaaggatatggc

SEQ ID NO: 262143 - DNA, 32 bp, Artificial Sequence
  Description of Artificial Sequence: Synthetic oligonucleotide
gctagacccagattccaacacaaggatatggc

SEQ ID NO: 262144 - DNA, 32 bp, Artificial Sequence
  Description of Artificial Sequence: Synthetic oligonucleotide
ctagacccagattccaacacaaggatatggcc

SEQ ID NO: 262145 - DNA, 32 bp, Artificial Sequence
  Description of Artificial Sequence: Synthetic oligonucleotide
tagacccagattccaacacaaggatatggccc

SEQ ID NO: 262146 - DNA, 31 bp, Artificial Sequence
  Description of Artificial Sequence: Synthetic oligonucleotide
agacccagattccaacacaaggatatggccc

SEQ ID NO: 262147 - DNA, 30 bp, Artificial Sequence
  Description of Artificial Sequence: Synthetic oligonucleotide
gacccagattccaacacaaggatatggccc

SEQ ID NO: 262148 - DNA, 30 bp, Artificial Sequence
  Description of Artificial Sequence: Synthetic oligonucleotide
acccagattccaacacaaggatatggcccg

SEQ ID NO: 262149 - DNA, 29 bp, Artificial Sequence
  Description of Artificial Sequence: Synthetic oligonucleotide
cccagattccaacacaaggatatggcccg

SEQ ID NO: 262150 - DNA, 30 bp, Artificial Sequence
  Description of Artificial Sequence: Synthetic oligonucleotide
ccagattccaacacaaggatatggcccgag

SEQ ID NO: 262151 - DNA, 31 bp, Artificial Sequence
  Description of Artificial Sequence: Synthetic oligonucleotide
cagattccaacacaaggatatggcccgagac

SEQ ID NO: 262152 - DNA, 31 bp, Artificial Sequence
  Description of Artificial Sequence: Synthetic oligonucleotide
agattccaacacaaggatatggcccgagacc

SEQ ID NO: 262153 - DNA, 30 bp, Artificial Sequence
  Description of Artificial Sequence: Synthetic oligonucleotide
gattccaacacaaggatatggcccgagacc

SEQ ID NO: 262154 - DNA, 34 bp, Artificial Sequence
  Description of Artificial Sequence: Synthetic oligonucleotide
attccaacacaaggatatggcccgagaccataag

SEQ ID NO: 262155 - DNA, 33 bp, Artificial Sequence
  Description of Artificial Sequence: Synthetic oligonucleotide
ttccaacacaaggatatggcccgagaccataag

SEQ ID NO: 262156 - DNA, 32 bp, Artificial Sequence
  Description of Artificial Sequence: Synthetic oligonucleotide
tccaacacaaggatatggcccgagaccataag

SEQ ID NO: 262157 - DNA, 31 bp, Artificial Sequence
  Description of Artificial Sequence: Synthetic oligonucleotide
ccaacacaaggatatggcccgagaccataag

SEQ ID NO: 262158 - DNA, 31 bp, Artificial Sequence
  Description of Artificial Sequence: Synthetic oligonucleotide
caacacaaggatatggcccgagaccataagg

SEQ ID NO: 262159 - DNA, 32 bp, Artificial Sequence
  Description of Artificial Sequence: Synthetic oligonucleotide
aacacaaggatatggcccgagaccataaggtg

SEQ ID NO: 262160 - DNA, 31 bp, Artificial Sequence
  Description of Artificial Sequence: Synthetic oligonucleotide
acacaaggatatggcccgagaccataaggtg

SEQ ID NO: 262161 - DNA, 30 bp, Artificial Sequence
  Description of Artificial Sequence: Synthetic oligonucleotide
cacaaggatatggcccgagaccataaggtg

SEQ ID NO: 262162 - DNA, 32 bp, Artificial Sequence
  Description of Artificial Sequence: Synthetic oligonucleotide
acaaggatatggcccgagaccataaggtgttg

SEQ ID NO: 262163 - DNA, 31 bp, Artificial Sequence
  Description of Artificial Sequence: Synthetic oligonucleotide
caaggatatggcccgagaccataaggtgttg

SEQ ID NO: 262164 - DNA, 31 bp, Artificial Sequence
  Description of Artificial Sequence: Synthetic oligonucleotide
aaggatatggcccgagaccataaggtgttgg

SEQ ID NO: 262165 - DNA, 30 bp, Artificial Sequence
  Description of Artificial Sequence: Synthetic oligonucleotide
aggatatggcccgagaccataaggtgttgg

SEQ ID NO: 262166 - DNA, 29 bp, Artificial Sequence
  Description of Artificial Sequence: Synthetic oligonucleotide
ggatatggcccgagaccataaggtgttgg

SEQ ID NO: 262167 - DNA, 30 bp, Artificial Sequence
  Description of Artificial Sequence: Synthetic oligonucleotide
gatatggcccgagaccataaggtgttggtg

SEQ ID NO: 262168 - DNA, 31 bp, Artificial Sequence
  Description of Artificial Sequence: Synthetic oligonucleotide
atatggcccgagaccataaggtgttggtgtc

SEQ ID NO: 262169 - DNA, 30 bp, Artificial Sequence
  Description of Artificial Sequence: Synthetic oligonucleotide
tatggcccgagaccataaggtgttggtgtc

SEQ ID NO: 262170 - DNA, 29 bp, Artificial Sequence
  Description of Artificial Sequence: Synthetic oligonucleotide
atggcccgagaccataaggtgttggtgtc

SEQ ID NO: 262171 - DNA, 28 bp, Artificial Sequence
  Description of Artificial Sequence: Synthetic oligonucleotide
tggcccgagaccataaggtgttggtgtc

SEQ ID NO: 262172 - DNA, 27 bp, Artificial Sequence
  Description of Artificial Sequence: Synthetic oligonucleotide
ggcccgagaccataaggtgttggtgtc

SEQ ID NO: 262173 - DNA, 27 bp, Artificial Sequence
  Description of Artificial Sequence: Synthetic oligonucleotide
gcccgagaccataaggtgttggtgtcc

SEQ ID NO: 262174 - DNA, 32 bp, Artificial Sequence
  Description of Artificial Sequence: Synthetic oligonucleotide
cccgagaccataaggtgttggtgtccttatag

SEQ ID NO: 262175 - DNA, 32 bp, Artificial Sequence
  Description of Artificial Sequence: Synthetic oligonucleotide
ccgagaccataaggtgttggtgtccttatagc

SEQ ID NO: 262176 - DNA, 33 bp, Artificial Sequence
  Description of Artificial Sequence: Synthetic oligonucleotide
cgagaccataaggtgttggtgtccttatagctg

SEQ ID NO: 262177 - DNA, 33 bp, Artificial Sequence
  Description of Artificial Sequence: Synthetic oligonucleotide
gagaccataaggtgttggtgtccttatagctgg

SEQ ID NO: 262178 - DNA, 37 bp, Artificial Sequence
  Description of Artificial Sequence: Synthetic oligonucleotide
agaccataaggtgttggtgtccttatagctggttatg

SEQ ID NO: 262179 - DNA, 36 bp, Artificial Sequence
  Description of Artificial Sequence: Synthetic oligonucleotide
gaccataaggtgttggtgtccttatagctggttatg

SEQ ID NO: 262180 - DNA, 38 bp, Artificial Sequence
  Description of Artificial Sequence: Synthetic oligonucleotide
accataaggtgttggtgtccttatagctggttatgaag

SEQ ID NO: 262181 - DNA, 37 bp, Artificial Sequence
  Description of Artificial Sequence: Synthetic oligonucleotide
ccataaggtgttggtgtccttatagctggttatgaag

SEQ ID NO: 262182 - DNA, 41 bp, Artificial Sequence
  Description of Artificial Sequence: Synthetic oligonucleotide
cataaggtgttggtgtccttatagctggttatgaagatatg

SEQ ID NO: 262183 - DNA, 41 bp, Artificial Sequence
  Description of Artificial Sequence: Synthetic oligonucleotide
ataaggtgttggtgtccttatagctggttatgaagatatgg

SEQ ID NO: 262184 - DNA, 40 bp, Artificial Sequence
  Description of Artificial Sequence: Synthetic oligonucleotide
taaggtgttggtgtccttatagctggttatgaagatatgg

SEQ ID NO: 262185 - DNA, 39 bp, Artificial Sequence
  Description of Artificial Sequence: Synthetic oligonucleotide
aaggtgttggtgtccttatagctggttatgaagatatgg

SEQ ID NO: 262186 - DNA, 38 bp, Artificial Sequence
  Description of Artificial Sequence: Synthetic oligonucleotide
aggtgttggtgtccttatagctggttatgaagatatgg

SEQ ID NO: 262187 - DNA, 37 bp, Artificial Sequence
  Description of Artificial Sequence: Synthetic oligonucleotide
ggtgttggtgtccttatagctggttatgaagatatgg

SEQ ID NO: 262188 - DNA, 37 bp, Artificial Sequence
  Description of Artificial Sequence: Synthetic oligonucleotide
gtgttggtgtccttatagctggttatgaagatatggg

SEQ ID NO: 262189 - DNA, 37 bp, Artificial Sequence
  Description of Artificial Sequence: Synthetic oligonucleotide
tgttggtgtccttatagctggttatgaagatatgggg

SEQ ID NO: 262190 - DNA, 36 bp, Artificial Sequence
  Description of Artificial Sequence: Synthetic oligonucleotide
gttggtgtccttatagctggttatgaagatatgggg

SEQ ID NO: 262191 - DNA, 36 bp, Artificial Sequence
  Description of Artificial Sequence: Synthetic oligonucleotide
ttggtgtccttatagctggttatgaagatatggggc

SEQ ID NO: 262192 - DNA, 35 bp, Artificial Sequence
  Description of Artificial Sequence: Synthetic oligonucleotide
tggtgtccttatagctggttatgaagatatggggc

SEQ ID NO: 262193 - DNA, 34 bp, Artificial Sequence
  Description of Artificial Sequence: Synthetic oligonucleotide
ggtgtccttatagctggttatgaagatatggggc

SEQ ID NO: 262194 - DNA, 34 bp, Artificial Sequence
  Description of Artificial Sequence: Synthetic oligonucleotide
gtgtccttatagctggttatgaagatatggggcc

SEQ ID NO: 262195 - DNA, 35 bp, Artificial Sequence
  Description of Artificial Sequence: Synthetic oligonucleotide
tgtccttatagctggttatgaagatatggggcctc

SEQ ID NO: 262196 - DNA, 34 bp, Artificial Sequence
  Description of Artificial Sequence: Synthetic oligonucleotide
gtccttatagctggttatgaagatatggggcctc

SEQ ID NO: 262197 - DNA, 35 bp, Artificial Sequence
  Description of Artificial Sequence: Synthetic oligonucleotide
tccttatagctggttatgaagatatggggcctcac

SEQ ID NO: 262198 - DNA, 34 bp, Artificial Sequence
  Description of Artificial Sequence: Synthetic oligonucleotide
ccttatagctggttatgaagatatggggcctcac

SEQ ID NO: 262199 - DNA, 39 bp, Artificial Sequence
  Description of Artificial Sequence: Synthetic oligonucleotide
cttatagctggttatgaagatatggggcctcacatttac

SEQ ID NO: 262200 - DNA, 39 bp, Artificial Sequence
  Description of Artificial Sequence: Synthetic oligonucleotide
ttatagctggttatgaagatatggggcctcacatttacc

SEQ ID NO: 262201 - DNA, 38 bp, Artificial Sequence
  Description of Artificial Sequence: Synthetic oligonucleotide
tatagctggttatgaagatatggggcctcacatttacc

SEQ ID NO: 262202 - DNA, 37 bp, Artificial Sequence
  Description of Artificial Sequence: Synthetic oligonucleotide
atagctggttatgaagatatggggcctcacatttacc

SEQ ID NO: 262203 - DNA, 36 bp, Artificial Sequence
  Description of Artificial Sequence: Synthetic oligonucleotide
tagctggttatgaagatatggggcctcacatttacc

SEQ ID NO: 262204 - DNA, 35 bp, Artificial Sequence
  Description of Artificial Sequence: Synthetic oligonucleotide
agctggttatgaagatatggggcctcacatttacc

SEQ ID NO: 262205 - DNA, 34 bp, Artificial Sequence
  Description of Artificial Sequence: Synthetic oligonucleotide
gctggttatgaagatatggggcctcacatttacc

SEQ ID NO: 262206 - DNA, 37 bp, Artificial Sequence
  Description of Artificial Sequence: Synthetic oligonucleotide
ctggttatgaagatatggggcctcacatttaccaaac

SEQ ID NO: 262207 - DNA, 37 bp, Artificial Sequence
  Description of Artificial Sequence: Synthetic oligonucleotide
tggttatgaagatatggggcctcacatttaccaaacc

SEQ ID NO: 262208 - DNA, 36 bp, Artificial Sequence
  Description of Artificial Sequence: Synthetic oligonucleotide
ggttatgaagatatggggcctcacatttaccaaacc

SEQ ID NO: 262209 - DNA, 37 bp, Artificial Sequence
  Description of Artificial Sequence: Synthetic oligonucleotide
gttatgaagatatggggcctcacatttaccaaacctg

SEQ ID NO: 262210 - DNA, 38 bp, Artificial Sequence
  Description of Artificial Sequence: Synthetic oligonucleotide
ttatgaagatatggggcctcacatttaccaaacctgac

SEQ ID NO: 262211 - DNA, 37 bp, Artificial Sequence
  Description of Artificial Sequence: Synthetic oligonucleotide
tatgaagatatggggcctcacatttaccaaacctgac

SEQ ID NO: 262212 - DNA, 36 bp, Artificial Sequence
  Description of Artificial Sequence: Synthetic oligonucleotide
atgaagatatggggcctcacatttaccaaacctgac

SEQ ID NO: 262213 - DNA, 35 bp, Artificial Sequence
  Description of Artificial Sequence: Synthetic oligonucleotide
tgaagatatggggcctcacatttaccaaacctgac

SEQ ID NO: 262214 - DNA, 34 bp, Artificial Sequence
  Description of Artificial Sequence: Synthetic oligonucleotide
gaagatatggggcctcacatttaccaaacctgac

SEQ ID NO: 262215 - DNA, 34 bp, Artificial Sequence
  Description of Artificial Sequence: Synthetic oligonucleotide
aagatatggggcctcacatttaccaaacctgacc

SEQ ID NO: 262216 - DNA, 33 bp, Artificial Sequence
  Description of Artificial Sequence: Synthetic oligonucleotide
agatatggggcctcacatttaccaaacctgacc

SEQ ID NO: 262217 - DNA, 32 bp, Artificial Sequence
  Description of Artificial Sequence: Synthetic oligonucleotide
gatatggggcctcacatttaccaaacctgacc

SEQ ID NO: 262218 - DNA, 34 bp, Artificial Sequence
  Description of Artificial Sequence: Synthetic oligonucleotide
atatggggcctcacatttaccaaacctgaccatc

SEQ ID NO: 262219 - DNA, 33 bp, Artificial Sequence
  Description of Artificial Sequence: Synthetic oligonucleotide
tatggggcctcacatttaccaaacctgaccatc

SEQ ID NO: 262220 - DNA, 32 bp, Artificial Sequence
  Description of Artificial Sequence: Synthetic oligonucleotide
atggggcctcacatttaccaaacctgaccatc

SEQ ID NO: 262221 - DNA, 31 bp, Artificial Sequence
  Description of Artificial Sequence: Synthetic oligonucleotide
tggggcctcacatttaccaaacctgaccatc

SEQ ID NO: 262222 - DNA, 30 bp, Artificial Sequence
  Description of Artificial Sequence: Synthetic oligonucleotide
ggggcctcacatttaccaaacctgaccatc

SEQ ID NO: 262223 - DNA, 31 bp, Artificial Sequence
  Description of Artificial Sequence: Synthetic oligonucleotide
gggcctcacatttaccaaacctgaccatctg

SEQ ID NO: 262224 - DNA, 31 bp, Artificial Sequence
  Description of Artificial Sequence: Synthetic oligonucleotide
ggcctcacatttaccaaacctgaccatctgc

SEQ ID NO: 262225 - DNA, 34 bp, Artificial Sequence
  Description of Artificial Sequence: Synthetic oligonucleotide
gcctcacatttaccaaacctgaccatctgcttac

SEQ ID NO: 262226 - DNA, 40 bp, Artificial Sequence
  Description of Artificial Sequence: Synthetic oligonucleotide
cctcacatttaccaaacctgaccatctgcttactattttg

SEQ ID NO: 262227 - DNA, 41 bp, Artificial Sequence
  Description of Artificial Sequence: Synthetic oligonucleotide
ctcacatttaccaaacctgaccatctgcttactattttgtc

SEQ ID NO: 262228 - DNA, 42 bp, Artificial Sequence
  Description of Artificial Sequence: Synthetic oligonucleotide
tcacatttaccaaacctgaccatctgcttactattttgtctg

SEQ ID NO: 262229 - DNA, 41 bp, Artificial Sequence
  Description of Artificial Sequence: Synthetic oligonucleotide
cacatttaccaaacctgaccatctgcttactattttgtctg

SEQ ID NO: 262230 - DNA, 41 bp, Artificial Sequence
  Description of Artificial Sequence: Synthetic oligonucleotide
acatttaccaaacctgaccatctgcttactattttgtctgc

SEQ ID NO: 262231 - DNA, 40 bp, Artificial Sequence
  Description of Artificial Sequence: Synthetic oligonucleotide
catttaccaaacctgaccatctgcttactattttgtctgc

SEQ ID NO: 262232 - DNA, 41 bp, Artificial Sequence
  Description of Artificial Sequence: Synthetic oligonucleotide
atttaccaaacctgaccatctgcttactattttgtctgcag

SEQ ID NO: 262233 - DNA, 40 bp, Artificial Sequence
  Description of Artificial Sequence: Synthetic oligonucleotide
tttaccaaacctgaccatctgcttactattttgtctgcag

SEQ ID NO: 262234 - DNA, 39 bp, Artificial Sequence
  Description of Artificial Sequence: Synthetic oligonucleotide
ttaccaaacctgaccatctgcttactattttgtctgcag

SEQ ID NO: 262235 - DNA, 38 bp, Artificial Sequence
  Description of Artificial Sequence: Synthetic oligonucleotide
taccaaacctgaccatctgcttactattttgtctgcag

SEQ ID NO: 262236 - DNA, 37 bp, Artificial Sequence
  Description of Artificial Sequence: Synthetic oligonucleotide
accaaacctgaccatctgcttactattttgtctgcag

SEQ ID NO: 262237 - DNA, 36 bp, Artificial Sequence
  Description of Artificial Sequence: Synthetic oligonucleotide
ccaaacctgaccatctgcttactattttgtctgcag

SEQ ID NO: 262238 - DNA, 37 bp, Artificial Sequence
  Description of Artificial Sequence: Synthetic oligonucleotide
caaacctgaccatctgcttactattttgtctgcagag

SEQ ID NO: 262239 - DNA, 37 bp, Artificial Sequence
  Description of Artificial Sequence: Synthetic oligonucleotide
aaacctgaccatctgcttactattttgtctgcagagc

SEQ ID NO: 262240 - DNA, 36 bp, Artificial Sequence
  Description of Artificial Sequence: Synthetic oligonucleotide
aacctgaccatctgcttactattttgtctgcagagc

SEQ ID NO: 262241 - DNA, 35 bp, Artificial Sequence
  Description of Artificial Sequence: Synthetic oligonucleotide
acctgaccatctgcttactattttgtctgcagagc

SEQ ID NO: 262242 - DNA, 34 bp, Artificial Sequence
  Description of Artificial Sequence: Synthetic oligonucleotide
cctgaccatctgcttactattttgtctgcagagc

SEQ ID NO: 262243 - DNA, 34 bp, Artificial Sequence
  Description of Artificial Sequence: Synthetic oligonucleotide
ctgaccatctgcttactattttgtctgcagagcg

SEQ ID NO: 262244 - DNA, 36 bp, Artificial Sequence
  Description of Artificial Sequence: Synthetic oligonucleotide
tgaccatctgcttactattttgtctgcagagcgatg

SEQ ID NO: 262245 - DNA, 35 bp, Artificial Sequence
  Description of Artificial Sequence: Synthetic oligonucleotide
gaccatctgcttactattttgtctgcagagcgatg

SEQ ID NO: 262246 - DNA, 36 bp, Artificial Sequence
  Description of Artificial Sequence: Synthetic oligonucleotide
accatctgcttactattttgtctgcagagcgatgtc

SEQ ID NO: 262247 - DNA, 35 bp, Artificial Sequence
  Description of Artificial Sequence: Synthetic oligonucleotide
ccatctgcttactattttgtctgcagagcgatgtc

SEQ ID NO: 262248 - DNA, 35 bp, Artificial Sequence
  Description of Artificial Sequence: Synthetic oligonucleotide
catctgcttactattttgtctgcagagcgatgtcc

SEQ ID NO: 262249 - DNA, 38 bp, Artificial Sequence
  Description of Artificial Sequence: Synthetic oligonucleotide
atctgcttactattttgtctgcagagcgatgtccattg

SEQ ID NO: 262250 - DNA, 37 bp, Artificial Sequence
  Description of Artificial Sequence: Synthetic oligonucleotide
tctgcttactattttgtctgcagagcgatgtccattg

SEQ ID NO: 262251 - DNA, 36 bp, Artificial Sequence
  Description of Artificial Sequence: Synthetic oligonucleotide
ctgcttactattttgtctgcagagcgatgtccattg

SEQ ID NO: 262252 - DNA, 36 bp, Artificial Sequence
  Description of Artificial Sequence: Synthetic oligonucleotide
tgcttactattttgtctgcagagcgatgtccattgg

SEQ ID NO: 262253 - DNA, 35 bp, Artificial Sequence
  Description of Artificial Sequence: Synthetic oligonucleotide
gcttactattttgtctgcagagcgatgtccattgg

SEQ ID NO: 262254 - DNA, 36 bp, Artificial Sequence
  Description of Artificial Sequence: Synthetic oligonucleotide
cttactattttgtctgcagagcgatgtccattggtg

SEQ ID NO: 262255 - DNA, 36 bp, Artificial Sequence
  Description of Artificial Sequence: Synthetic oligonucleotide
ttactattttgtctgcagagcgatgtccattggtgc

SEQ ID NO: 262256 - DNA, 35 bp, Artificial Sequence
  Description of Artificial Sequence: Synthetic oligonucleotide
tactattttgtctgcagagcgatgtccattggtgc

SEQ ID NO: 262257 - DNA, 34 bp, Artificial Sequence
  Description of Artificial Sequence: Synthetic oligonucleotide
actattttgtctgcagagcgatgtccattggtgc

SEQ ID NO: 262258 - DNA, 33 bp, Artificial Sequence
  Description of Artificial Sequence: Synthetic oligonucleotide
ctattttgtctgcagagcgatgtccattggtgc

SEQ ID NO: 262259 - DNA, 33 bp, Artificial Sequence
  Description of Artificial Sequence: Synthetic oligonucleotide
tattttgtctgcagagcgatgtccattggtgcc

SEQ ID NO: 262260 - DNA, 32 bp, Artificial Sequence
  Description of Artificial Sequence: Synthetic oligonucleotide
attttgtctgcagagcgatgtccattggtgcc

SEQ ID NO: 262261 - DNA, 31 bp, Artificial Sequence
  Description of Artificial Sequence: Synthetic oligonucleotide
ttttgtctgcagagcgatgtccattggtgcc

SEQ ID NO: 262262 - DNA, 30 bp, Artificial Sequence
  Description of Artificial Sequence: Synthetic oligonucleotide
tttgtctgcagagcgatgtccattggtgcc

SEQ ID NO: 262263 - DNA, 29 bp, Artificial Sequence
  Description of Artificial Sequence: Synthetic oligonucleotide
ttgtctgcagagcgatgtccattggtgcc

SEQ ID NO: 262264 - DNA, 28 bp, Artificial Sequence
  Description of Artificial Sequence: Synthetic oligonucleotide
tgtctgcagagcgatgtccattggtgcc

SEQ ID NO: 262265 - DNA, 27 bp, Artificial Sequence
  Description of Artificial Sequence: Synthetic oligonucleotide
gtctgcagagcgatgtccattggtgcc

SEQ ID NO: 262266 - DNA, 27 bp, Artificial Sequence
  Description of Artificial Sequence: Synthetic oligonucleotide
tctgcagagcgatgtccattggtgccc

SEQ ID NO: 262267 - DNA, 26 bp, Artificial Sequence
  Description of Artificial Sequence: Synthetic oligonucleotide
ctgcagagcgatgtccattggtgccc

SEQ ID NO: 262268 - DNA, 27 bp, Artificial Sequence
  Description of Artificial Sequence: Synthetic oligonucleotide
tgcagagcgatgtccattggtgcccgt

SEQ ID NO: 262269 - DNA, 27 bp, Artificial Sequence
  Description of Artificial Sequence: Synthetic oligonucleotide
gcagagcgatgtccattggtgcccgtt

SEQ ID NO: 262270 - DNA, 27 bp, Artificial Sequence
  Description of Artificial Sequence: Synthetic oligonucleotide
cagagcgatgtccattggtgcccgttc

SEQ ID NO: 262271 - DNA, 27 bp, Artificial Sequence
  Description of Artificial Sequence: Synthetic oligonucleotide
agagcgatgtccattggtgcccgttcc

SEQ ID NO: 262272 - DNA, 26 bp, Artificial Sequence
  Description of Artificial Sequence: Synthetic oligonucleotide
gagcgatgtccattggtgcccgttcc

SEQ ID NO: 262273 - DNA, 27 bp, Artificial Sequence
  Description of Artificial Sequence: Synthetic oligonucleotide
agcgatgtccattggtgcccgttccca

SEQ ID NO: 262274 - DNA, 27 bp, Artificial Sequence
  Description of Artificial Sequence: Synthetic oligonucleotide
gcgatgtccattggtgcccgttcccaa

SEQ ID NO: 262275 - DNA, 28 bp, Artificial Sequence
  Description of Artificial Sequence: Synthetic oligonucleotide
cgatgtccattggtgcccgttcccaaac

SEQ ID NO: 262276 - DNA, 29 bp, Artificial Sequence
  Description of Artificial Sequence: Synthetic oligonucleotide
gatgtccattggtgcccgttcccaaacag

SEQ ID NO: 262277 - DNA, 29 bp, Artificial Sequence
  Description of Artificial Sequence: Synthetic oligonucleotide
atgtccattggtgcccgttcccaaacagc

SEQ ID NO: 262278 - DNA, 28 bp, Artificial Sequence
  Description of Artificial Sequence: Synthetic oligonucleotide
tgtccattggtgcccgttcccaaacagc

SEQ ID NO: 262279 - DNA, 27 bp, Artificial Sequence
  Description of Artificial Sequence: Synthetic oligonucleotide
gtccattggtgcccgttcccaaacagc

SEQ ID NO: 262280 - DNA, 28 bp, Artificial Sequence
  Description of Artificial Sequence: Synthetic oligonucleotide
tccattggtgcccgttcccaaacagcac

SEQ ID NO: 262281 - DNA, 27 bp, Artificial Sequence
  Description of Artificial Sequence: Synthetic oligonucleotide
ccattggtgcccgttcccaaacagcac

SEQ ID NO: 262282 - DNA, 27 bp, Artificial Sequence
  Description of Artificial Sequence: Synthetic oligonucleotide
cattggtgcccgttcccaaacagcacg

SEQ ID NO: 262283 - DNA, 29 bp, Artificial Sequence
  Description of Artificial Sequence: Synthetic oligonucleotide
attggtgcccgttcccaaacagcacgtac

SEQ ID NO: 262284 - DNA, 28 bp, Artificial Sequence
  Description of Artificial Sequence: Synthetic oligonucleotide
ttggtgcccgttcccaaacagcacgtac

SEQ ID NO: 262285 - DNA, 27 bp, Artificial Sequence
  Description of Artificial Sequence: Synthetic oligonucleotide
tggtgcccgttcccaaacagcacgtac

SEQ ID NO: 262286 - DNA, 27 bp, Artificial Sequence
  Description of Artificial Sequence: Synthetic oligonucleotide
ggtgcccgttcccaaacagcacgtact

SEQ ID NO: 262287 - DNA, 29 bp, Artificial Sequence
  Description of Artificial Sequence: Synthetic oligonucleotide
gtgcccgttcccaaacagcacgtacttac

SEQ ID NO: 262288 - DNA, 31 bp, Artificial Sequence
  Description of Artificial Sequence: Synthetic oligonucleotide
tgcccgttcccaaacagcacgtacttacatg

SEQ ID NO: 262289 - DNA, 30 bp, Artificial Sequence
  Description of Artificial Sequence: Synthetic oligonucleotide
gcccgttcccaaacagcacgtacttacatg

SEQ ID NO: 262290 - DNA, 30 bp, Artificial Sequence
  Description of Artificial Sequence: Synthetic oligonucleotide
cccgttcccaaacagcacgtacttacatgg

SEQ ID NO: 262291 - DNA, 31 bp, Artificial Sequence
  Description of Artificial Sequence: Synthetic oligonucleotide
ccgttcccaaacagcacgtacttacatggag

SEQ ID NO: 262292 - DNA, 32 bp, Artificial Sequence
  Description of Artificial Sequence: Synthetic oligonucleotide
cgttcccaaacagcacgtacttacatggagac

SEQ ID NO: 262293 - DNA, 32 bp, Artificial Sequence
  Description of Artificial Sequence: Synthetic oligonucleotide
gttcccaaacagcacgtacttacatggagacg

SEQ ID NO: 262294 - DNA, 33 bp, Artificial Sequence
  Description of Artificial Sequence: Synthetic oligonucleotide
ttcccaaacagcacgtacttacatggagacgag

SEQ ID NO: 262295 - DNA, 32 bp, Artificial Sequence
  Description of Artificial Sequence: Synthetic oligonucleotide
tcccaaacagcacgtacttacatggagacgag

SEQ ID NO: 262296 - DNA, 31 bp, Artificial Sequence
  Description of Artificial Sequence: Synthetic oligonucleotide
cccaaacagcacgtacttacatggagacgag

SEQ ID NO: 262297 - DNA, 35 bp, Artificial Sequence
  Description of Artificial Sequence: Synthetic oligonucleotide
ccaaacagcacgtacttacatggagacgagatatg

SEQ ID NO: 262298 - DNA, 36 bp, Artificial Sequence
  Description of Artificial Sequence: Synthetic oligonucleotide
caaacagcacgtacttacatggagacgagatatgtc

SEQ ID NO: 262299 - DNA, 37 bp, Artificial Sequence
  Description of Artificial Sequence: Synthetic oligonucleotide
aaacagcacgtacttacatggagacgagatatgtctg

SEQ ID NO: 262300 - DNA, 36 bp, Artificial Sequence
  Description of Artificial Sequence: Synthetic oligonucleotide
aacagcacgtacttacatggagacgagatatgtctg

SEQ ID NO: 262301 - DNA, 35 bp, Artificial Sequence
  Description of Artificial Sequence: Synthetic oligonucleotide
acagcacgtacttacatggagacgagatatgtctg

SEQ ID NO: 262302 - DNA, 34 bp, Artificial Sequence
  Description of Artificial Sequence: Synthetic oligonucleotide
cagcacgtacttacatggagacgagatatgtctg

SEQ ID NO: 262303 - DNA, 41 bp, Artificial Sequence
  Description of Artificial Sequence: Synthetic oligonucleotide
agcacgtacttacatggagacgagatatgtctgtatttatg

SEQ ID NO: 262304 - DNA, 40 bp, Artificial Sequence
  Description of Artificial Sequence: Synthetic oligonucleotide
gcacgtacttacatggagacgagatatgtctgtatttatg

SEQ ID NO: 262305 - DNA, 40 bp, Artificial Sequence
  Description of Artificial Sequence: Synthetic oligonucleotide
cacgtacttacatggagacgagatatgtctgtatttatgg

SEQ ID NO: 262306 - DNA, 41 bp, Artificial Sequence
  Description of Artificial Sequence: Synthetic oligonucleotide
acgtacttacatggagacgagatatgtctgtatttatggtg

SEQ ID NO: 262307 - DNA, 40 bp, Artificial Sequence
  Description of Artificial Sequence: Synthetic oligonucleotide
cgtacttacatggagacgagatatgtctgtatttatggtg

SEQ ID NO: 262308 - DNA, 41 bp, Artificial Sequence
  Description of Artificial Sequence: Synthetic oligonucleotide
gtacttacatggagacgagatatgtctgtatttatggtgtg

SEQ ID NO: 262309 - DNA, 51 bp, Artificial Sequence
  Description of Artificial Sequence: Synthetic oligonucleotide
tacttacatggagacgagatatgtctgtatttatggtgtgtaatttatatg

SEQ ID NO: 262310 - DNA, 50 bp, Artificial Sequence
  Description of Artificial Sequence: Synthetic oligonucleotide
acttacatggagacgagatatgtctgtatttatggtgtgtaatttatatg

SEQ ID NO: 262311 - DNA, 49 bp, Artificial Sequence
  Description of Artificial Sequence: Synthetic oligonucleotide
cttacatggagacgagatatgtctgtatttatggtgtgtaatttatatg

SEQ ID NO: 262312 - DNA, 51 bp, Artificial Sequence
  Description of Artificial Sequence: Synthetic oligonucleotide
ttacatggagacgagatatgtctgtatttatggtgtgtaatttatatgaac

SEQ ID NO: 262313 - DNA, 50 bp, Artificial Sequence
  Description of Artificial Sequence: Synthetic oligonucleotide
tacatggagacgagatatgtctgtatttatggtgtgtaatttatatgaac

SEQ ID NO: 262314 - DNA, 49 bp, Artificial Sequence
  Description of Artificial Sequence: Synthetic oligonucleotide
acatggagacgagatatgtctgtatttatggtgtgtaatttatatgaac

SEQ ID NO: 262315 - DNA, 48 bp, Artificial Sequence
  Description of Artificial Sequence: Synthetic oligonucleotide
catggagacgagatatgtctgtatttatggtgtgtaatttatatgaac

SEQ ID NO: 262316 - DNA, 50 bp, Artificial Sequence
  Description of Artificial Sequence: Synthetic oligonucleotide
atggagacgagatatgtctgtatttatggtgtgtaatttatatgaactag

SEQ ID NO: 262317 - DNA, 49 bp, Artificial Sequence
  Description of Artificial Sequence: Synthetic oligonucleotide
tggagacgagatatgtctgtatttatggtgtgtaatttatatgaactag

SEQ ID NO: 262318 - DNA, 48 bp, Artificial Sequence
  Description of Artificial Sequence: Synthetic oligonucleotide
ggagacgagatatgtctgtatttatggtgtgtaatttatatgaactag

SEQ ID NO: 262319 - DNA, 53 bp, Artificial Sequence
  Description of Artificial Sequence: Synthetic oligonucleotide
gagacgagatatgtctgtatttatggtgtgtaatttatatgaactagtaaaac

SEQ ID NO: 262320 - DNA, 55 bp, Artificial Sequence
  Description of Artificial Sequence: Synthetic oligonucleotide
agacgagatatgtctgtatttatggtgtgtaatttatatgaactagtaaaacatg

SEQ ID NO: 262321 - DNA, 54 bp, Artificial Sequence
  Description of Artificial Sequence: Synthetic oligonucleotide
gacgagatatgtctgtatttatggtgtgtaatttatatgaactagtaaaacatg

SEQ ID NO: 262322 - DNA, 54 bp, Artificial Sequence
  Description of Artificial Sequence: Synthetic oligonucleotide
acgagatatgtctgtatttatggtgtgtaatttatatgaactagtaaaacatgg

SEQ ID NO: 262323 - DNA, 53 bp, Artificial Sequence
  Description of Artificial Sequence: Synthetic oligonucleotide
cgagatatgtctgtatttatggtgtgtaatttatatgaactagtaaaacatgg

SEQ ID NO: 262324 - DNA, 54 bp, Artificial Sequence
  Description of Artificial Sequence: Synthetic oligonucleotide
gagatatgtctgtatttatggtgtgtaatttatatgaactagtaaaacatggac

SEQ ID NO: 262325 - DNA, 55 bp, Artificial Sequence
  Description of Artificial Sequence: Synthetic oligonucleotide
agatatgtctgtatttatggtgtgtaatttatatgaactagtaaaacatggactg

SEQ ID NO: 262326 - DNA, 54 bp, Artificial Sequence
  Description of Artificial Sequence: Synthetic oligonucleotide
gatatgtctgtatttatggtgtgtaatttatatgaactagtaaaacatggactg

SEQ ID NO: 262327 - DNA, 54 bp, Artificial Sequence
  Description of Artificial Sequence: Synthetic oligonucleotide
atatgtctgtatttatggtgtgtaatttatatgaactagtaaaacatggactgc

SEQ ID NO: 262328 - DNA, 53 bp, Artificial Sequence
  Description of Artificial Sequence: Synthetic oligonucleotide
tatgtctgtatttatggtgtgtaatttatatgaactagtaaaacatggactgc

SEQ ID NO: 262329 - DNA, 52 bp, Artificial Sequence
  Description of Artificial Sequence: Synthetic oligonucleotide
atgtctgtatttatggtgtgtaatttatatgaactagtaaaacatggactgc

SEQ ID NO: 262330 - DNA, 51 bp, Artificial Sequence
  Description of Artificial Sequence: Synthetic oligonucleotide
tgtctgtatttatggtgtgtaatttatatgaactagtaaaacatggactgc

SEQ ID NO: 262331 - DNA, 50 bp, Artificial Sequence
  Description of Artificial Sequence: Synthetic oligonucleotide
gtctgtatttatggtgtgtaatttatatgaactagtaaaacatggactgc

SEQ ID NO: 262332 - DNA, 50 bp, Artificial Sequence
  Description of Artificial Sequence: Synthetic oligonucleotide
tctgtatttatggtgtgtaatttatatgaactagtaaaacatggactgcg

SEQ ID NO: 262333 - DNA, 49 bp, Artificial Sequence
  Description of Artificial Sequence: Synthetic oligonucleotide
ctgtatttatggtgtgtaatttatatgaactagtaaaacatggactgcg

SEQ ID NO: 262334 - DNA, 50 bp, Artificial Sequence
  Description of Artificial Sequence: Synthetic oligonucleotide
tgtatttatggtgtgtaatttatatgaactagtaaaacatggactgcgtg

SEQ ID NO: 262335 - DNA, 49 bp, Artificial Sequence
  Description of Artificial Sequence: Synthetic oligonucleotide
gtatttatggtgtgtaatttatatgaactagtaaaacatggactgcgtg

SEQ ID NO: 262336 - DNA, 49 bp, Artificial Sequence
  Description of Artificial Sequence: Synthetic oligonucleotide
tatttatggtgtgtaatttatatgaactagtaaaacatggactgcgtgc

SEQ ID NO: 262337 - DNA, 48 bp, Artificial Sequence
  Description of Artificial Sequence: Synthetic oligonucleotide
atttatggtgtgtaatttatatgaactagtaaaacatggactgcgtgc

SEQ ID NO: 262338 - DNA, 47 bp, Artificial Sequence
  Description of Artificial Sequence: Synthetic oligonucleotide
tttatggtgtgtaatttatatgaactagtaaaacatggactgcgtgc

SEQ ID NO: 262339 - DNA, 46 bp, Artificial Sequence
  Description of Artificial Sequence: Synthetic oligonucleotide
ttatggtgtgtaatttatatgaactagtaaaacatggactgcgtgc

SEQ ID NO: 262340 - DNA, 45 bp, Artificial Sequence
  Description of Artificial Sequence: Synthetic oligonucleotide
tatggtgtgtaatttatatgaactagtaaaacatggactgcgtgc

SEQ ID NO: 262341 - DNA, 44 bp, Artificial Sequence
  Description of Artificial Sequence: Synthetic oligonucleotide
atggtgtgtaatttatatgaactagtaaaacatggactgcgtgc

SEQ ID NO: 262342 - DNA, 43 bp, Artificial Sequence
  Description of Artificial Sequence: Synthetic oligonucleotide
tggtgtgtaatttatatgaactagtaaaacatggactgcgtgc

SEQ ID NO: 262343 - DNA, 42 bp, Artificial Sequence
  Description of Artificial Sequence: Synthetic oligonucleotide
ggtgtgtaatttatatgaactagtaaaacatggactgcgtgc

SEQ ID NO: 262344 - DNA, 42 bp, Artificial Sequence
  Description of Artificial Sequence: Synthetic oligonucleotide
gtgtgtaatttatatgaactagtaaaacatggactgcgtgcc

SEQ ID NO: 262345 - DNA, 46 bp, Artificial Sequence
  Description of Artificial Sequence: Synthetic oligonucleotide
tgtgtaatttatatgaactagtaaaacatggactgcgtgccataag

SEQ ID NO: 262346 - DNA, 45 bp, Artificial Sequence
  Description of Artificial Sequence: Synthetic oligonucleotide
gtgtaatttatatgaactagtaaaacatggactgcgtgccataag

SEQ ID NO: 262347 - DNA, 46 bp, Artificial Sequence
  Description of Artificial Sequence: Synthetic oligonucleotide
tgtaatttatatgaactagtaaaacatggactgcgtgccataagag

SEQ ID NO: 262348 - DNA, 45 bp, Artificial Sequence
  Description of Artificial Sequence: Synthetic oligonucleotide
gtaatttatatgaactagtaaaacatggactgcgtgccataagag

SEQ ID NO: 262349 - DNA, 46 bp, Artificial Sequence
  Description of Artificial Sequence: Synthetic oligonucleotide
taatttatatgaactagtaaaacatggactgcgtgccataagagag

SEQ ID NO: 262350 - DNA, 45 bp, Artificial Sequence
  Description of Artificial Sequence: Synthetic oligonucleotide
aatttatatgaactagtaaaacatggactgcgtgccataagagag

SEQ ID NO: 262351 - DNA, 44 bp, Artificial Sequence
  Description of Artificial Sequence: Synthetic oligonucleotide
atttatatgaactagtaaaacatggactgcgtgccataagagag

SEQ ID NO: 262352 - DNA, 43 bp, Artificial Sequence
  Description of Artificial Sequence: Synthetic oligonucleotide
tttatatgaactagtaaaacatggactgcgtgccataagagag

SEQ ID NO: 262353 - DNA, 42 bp, Artificial Sequence
  Description of Artificial Sequence: Synthetic oligonucleotide
ttatatgaactagtaaaacatggactgcgtgccataagagag

SEQ ID NO: 262354 - DNA, 41 bp, Artificial Sequence
  Description of Artificial Sequence: Synthetic oligonucleotide
tatatgaactagtaaaacatggactgcgtgccataagagag

SEQ ID NO: 262355 - DNA, 40 bp, Artificial Sequence
  Description of Artificial Sequence: Synthetic oligonucleotide
atatgaactagtaaaacatggactgcgtgccataagagag

SEQ ID NO: 262356 - DNA, 39 bp, Artificial Sequence
  Description of Artificial Sequence: Synthetic oligonucleotide
tatgaactagtaaaacatggactgcgtgccataagagag

SEQ ID NO: 262357 - DNA, 38 bp, Artificial Sequence
  Description of Artificial Sequence: Synthetic oligonucleotide
atgaactagtaaaacatggactgcgtgccataagagag

SEQ ID NO: 262358 - DNA, 37 bp, Artificial Sequence
  Description of Artificial Sequence: Synthetic oligonucleotide
tgaactagtaaaacatggactgcgtgccataagagag

SEQ ID NO: 262359 - DNA, 36 bp, Artificial Sequence
  Description of Artificial Sequence: Synthetic oligonucleotide
gaactagtaaaacatggactgcgtgccataagagag

SEQ ID NO: 262360 - DNA, 37 bp, Artificial Sequence
  Description of Artificial Sequence: Synthetic oligonucleotide
aactagtaaaacatggactgcgtgccataagagagag

SEQ ID NO: 262361 - DNA, 36 bp, Artificial Sequence
  Description of Artificial Sequence: Synthetic oligonucleotide
actagtaaaacatggactgcgtgccataagagagag

SEQ ID NO: 262362 - DNA, 35 bp, Artificial Sequence
  Description of Artificial Sequence: Synthetic oligonucleotide
ctagtaaaacatggactgcgtgccataagagagag

SEQ ID NO: 262363 - DNA, 35 bp, Artificial Sequence
  Description of Artificial Sequence: Synthetic oligonucleotide
tagtaaaacatggactgcgtgccataagagagagg

SEQ ID NO: 262364 - DNA, 34 bp, Artificial Sequence
  Description of Artificial Sequence: Synthetic oligonucleotide
agtaaaacatggactgcgtgccataagagagagg

SEQ ID NO: 262365 - DNA, 33 bp, Artificial Sequence
  Description of Artificial Sequence: Synthetic oligonucleotide
gtaaaacatggactgcgtgccataagagagagg

SEQ ID NO: 262366 - DNA, 33 bp, Artificial Sequence
  Description of Artificial Sequence: Synthetic oligonucleotide
taaaacatggactgcgtgccataagagagaggc

SEQ ID NO: 262367 - DNA, 32 bp, Artificial Sequence
  Description of Artificial Sequence: Synthetic oligonucleotide
aaaacatggactgcgtgccataagagagaggc

SEQ ID NO: 262368 - DNA, 31 bp, Artificial Sequence
  Description of Artificial Sequence: Synthetic oligonucleotide
aaacatggactgcgtgccataagagagaggc

SEQ ID NO: 262369 - DNA, 30 bp, Artificial Sequence
  Description of Artificial Sequence: Synthetic oligonucleotide
aacatggactgcgtgccataagagagaggc

SEQ ID NO: 262370 - DNA, 29 bp, Artificial Sequence
  Description of Artificial Sequence: Synthetic oligonucleotide
acatggactgcgtgccataagagagaggc

SEQ ID NO: 262371 - DNA, 28 bp, Artificial Sequence
  Description of Artificial Sequence: Synthetic oligonucleotide
catggactgcgtgccataagagagaggc

SEQ ID NO: 262372 - DNA, 30 bp, Artificial Sequence
  Description of Artificial Sequence: Synthetic oligonucleotide
atggactgcgtgccataagagagaggcttc

SEQ ID NO: 262373 - DNA, 29 bp, Artificial Sequence
  Description of Artificial Sequence: Synthetic oligonucleotide
tggactgcgtgccataagagagaggcttc

SEQ ID NO: 262374 - DNA, 28 bp, Artificial Sequence
  Description of Artificial Sequence: Synthetic oligonucleotide
ggactgcgtgccataagagagaggcttc

SEQ ID NO: 262375 - DNA, 28 bp, Artificial Sequence
  Description of Artificial Sequence: Synthetic oligonucleotide
gactgcgtgccataagagagaggcttcc

SEQ ID NO: 262376 - DNA, 29 bp, Artificial Sequence
  Description of Artificial Sequence: Synthetic oligonucleotide
actgcgtgccataagagagaggcttcctg

SEQ ID NO: 262377 - DNA, 28 bp, Artificial Sequence
  Description of Artificial Sequence: Synthetic oligonucleotide
ctgcgtgccataagagagaggcttcctg

SEQ ID NO: 262378 - DNA, 28 bp, Artificial Sequence
  Description of Artificial Sequence: Synthetic oligonucleotide
tgcgtgccataagagagaggcttcctgc

SEQ ID NO: 262379 - DNA, 27 bp, Artificial Sequence
  Description of Artificial Sequence: Synthetic oligonucleotide
gcgtgccataagagagaggcttcctgc

SEQ ID NO: 262380 - DNA, 28 bp, Artificial Sequence
  Description of Artificial Sequence: Synthetic oligonucleotide
cgtgccataagagagaggcttcctgctg

SEQ ID NO: 262381 - DNA, 30 bp, Artificial Sequence
  Description of Artificial Sequence: Synthetic oligonucleotide
gtgccataagagagaggcttcctgctgaac

SEQ ID NO: 262382 - DNA, 31 bp, Artificial Sequence
  Description of Artificial Sequence: Synthetic oligonucleotide
tgccataagagagaggcttcctgctgaacag

SEQ ID NO: 262383 - DNA, 30 bp, Artificial Sequence
  Description of Artificial Sequence: Synthetic oligonucleotide
gccataagagagaggcttcctgctgaacag

SEQ ID NO: 262384 - DNA, 30 bp, Artificial Sequence
  Description of Artificial Sequence: Synthetic oligonucleotide
ccataagagagaggcttcctgctgaacagg

SEQ ID NO: 262385 - DNA, 31 bp, Artificial Sequence
  Description of Artificial Sequence: Synthetic oligonucleotide
cataagagagaggcttcctgctgaacaggac

SEQ ID NO: 262386 - DNA, 31 bp, Artificial Sequence
  Description of Artificial Sequence: Synthetic oligonucleotide
ataagagagaggcttcctgctgaacaggacg

SEQ ID NO: 262387 - DNA, 30 bp, Artificial Sequence
  Description of Artificial Sequence: Synthetic oligonucleotide
taagagagaggcttcctgctgaacaggacg

SEQ ID NO: 262388 - DNA, 29 bp, Artificial Sequence
  Description of Artificial Sequence: Synthetic oligonucleotide
aagagagaggcttcctgctgaacaggacg

SEQ ID NO: 262389 - DNA, 28 bp, Artificial Sequence
  Description of Artificial Sequence: Synthetic oligonucleotide
agagagaggcttcctgctgaacaggacg

SEQ ID NO: 262390 - DNA, 27 bp, Artificial Sequence
  Description of Artificial Sequence: Synthetic oligonucleotide
gagagaggcttcctgctgaacaggacg

SEQ ID NO: 262391 - DNA, 28 bp, Artificial Sequence
  Description of Artificial Sequence: Synthetic oligonucleotide
agagaggcttcctgctgaacaggacgtg

SEQ ID NO: 262392 - DNA, 27 bp, Artificial Sequence
  Description of Artificial Sequence: Synthetic oligonucleotide
gagaggcttcctgctgaacaggacgtg

SEQ ID NO: 262393 - DNA, 28 bp, Artificial Sequence
  Description of Artificial Sequence: Synthetic oligonucleotide
agaggcttcctgctgaacaggacgtgac

SEQ ID NO: 262394 - DNA, 27 bp, Artificial Sequence
  Description of Artificial Sequence: Synthetic oligonucleotide
gaggcttcctgctgaacaggacgtgac

SEQ ID NO: 262395 - DNA, 29 bp, Artificial Sequence
  Description of Artificial Sequence: Synthetic oligonucleotide
aggcttcctgctgaacaggacgtgactac

SEQ ID NO: 262396 - DNA, 28 bp, Artificial Sequence
  Description of Artificial Sequence: Synthetic oligonucleotide
ggcttcctgctgaacaggacgtgactac

SEQ ID NO: 262397 - DNA, 31 bp, Artificial Sequence
  Description of Artificial Sequence: Synthetic oligonucleotide
gcttcctgctgaacaggacgtgactacaaag

SEQ ID NO: 262398 - DNA, 34 bp, Artificial Sequence
  Description of Artificial Sequence: Synthetic oligonucleotide
cttcctgctgaacaggacgtgactacaaagtatg

SEQ ID NO: 262399 - DNA, 37 bp, Artificial Sequence
  Description of Artificial Sequence: Synthetic oligonucleotide
ttcctgctgaacaggacgtgactacaaagtatgtttc

SEQ ID NO: 262400 - DNA, 36 bp, Artificial Sequence
  Description of Artificial Sequence: Synthetic oligonucleotide
tcctgctgaacaggacgtgactacaaagtatgtttc

SEQ ID NO: 262401 - DNA, 35 bp, Artificial Sequence
  Description of Artificial Sequence: Synthetic oligonucleotide
cctgctgaacaggacgtgactacaaagtatgtttc

SEQ ID NO: 262402 - DNA, 35 bp, Artificial Sequence
  Description of Artificial Sequence: Synthetic oligonucleotide
ctgctgaacaggacgtgactacaaagtatgtttcc

SEQ ID NO: 262403 - DNA, 38 bp, Artificial Sequence
  Description of Artificial Sequence: Synthetic oligonucleotide
tgctgaacaggacgtgactacaaagtatgtttcctttg

SEQ ID NO: 262404 - DNA, 37 bp, Artificial Sequence
  Description of Artificial Sequence: Synthetic oligonucleotide
gctgaacaggacgtgactacaaagtatgtttcctttg

SEQ ID NO: 262405 - DNA, 37 bp, Artificial Sequence
  Description of Artificial Sequence: Synthetic oligonucleotide
ctgaacaggacgtgactacaaagtatgtttcctttgg

SEQ ID NO: 262406 - DNA, 41 bp, Artificial Sequence
  Description of Artificial Sequence: Synthetic oligonucleotide
tgaacaggacgtgactacaaagtatgtttcctttggaattg

SEQ ID NO: 262407 - DNA, 40 bp, Artificial Sequence
  Description of Artificial Sequence: Synthetic oligonucleotide
gaacaggacgtgactacaaagtatgtttcctttggaattg

SEQ ID NO: 262408 - DNA, 42 bp, Artificial Sequence
  Description of Artificial Sequence: Synthetic oligonucleotide
aacaggacgtgactacaaagtatgtttcctttggaattgatg

SEQ ID NO: 262409 - DNA, 41 bp, Artificial Sequence
  Description of Artificial Sequence: Synthetic oligonucleotide
acaggacgtgactacaaagtatgtttcctttggaattgatg

SEQ ID NO: 262410 - DNA, 40 bp, Artificial Sequence
  Description of Artificial Sequence: Synthetic oligonucleotide
caggacgtgactacaaagtatgtttcctttggaattgatg

SEQ ID NO: 262411 - DNA, 40 bp, Artificial Sequence
  Description of Artificial Sequence: Synthetic oligonucleotide
aggacgtgactacaaagtatgtttcctttggaattgatgg

SEQ ID NO: 262412 - DNA, 39 bp, Artificial Sequence
  Description of Artificial Sequence: Synthetic oligonucleotide
ggacgtgactacaaagtatgtttcctttggaattgatgg

SEQ ID NO: 262413 - DNA, 43 bp, Artificial Sequence
  Description of Artificial Sequence: Synthetic oligonucleotide
gacgtgactacaaagtatgtttcctttggaattgatggtaaag

SEQ ID NO: 262414 - DNA, 44 bp, Artificial Sequence
  Description of Artificial Sequence: Synthetic oligonucleotide
acgtgactacaaagtatgtttcctttggaattgatggtaaagtc

SEQ ID NO: 262415 - DNA, 43 bp, Artificial Sequence
  Description of Artificial Sequence: Synthetic oligonucleotide
cgtgactacaaagtatgtttcctttggaattgatggtaaagtc

SEQ ID NO: 262416 - DNA, 45 bp, Artificial Sequence
  Description of Artificial Sequence: Synthetic oligonucleotide
gtgactacaaagtatgtttcctttggaattgatggtaaagtcttg

SEQ ID NO: 262417 - DNA, 45 bp, Artificial Sequence
  Description of Artificial Sequence: Synthetic oligonucleotide
tgactacaaagtatgtttcctttggaattgatggtaaagtcttgg

SEQ ID NO: 262418 - DNA, 44 bp, Artificial Sequence
  Description of Artificial Sequence: Synthetic oligonucleotide
gactacaaagtatgtttcctttggaattgatggtaaagtcttgg

SEQ ID NO: 262419 - DNA, 45 bp, Artificial Sequence
  Description of Artificial Sequence: Synthetic oligonucleotide
actacaaagtatgtttcctttggaattgatggtaaagtcttggag

SEQ ID NO: 262420 - DNA, 44 bp, Artificial Sequence
  Description of Artificial Sequence: Synthetic oligonucleotide
ctacaaagtatgtttcctttggaattgatggtaaagtcttggag

SEQ ID NO: 262421 - DNA, 48 bp, Artificial Sequence
  Description of Artificial Sequence: Synthetic oligonucleotide
tacaaagtatgtttcctttggaattgatggtaaagtcttggagttaac

SEQ ID NO: 262422 - DNA, 47 bp, Artificial Sequence
  Description of Artificial Sequence: Synthetic oligonucleotide
acaaagtatgtttcctttggaattgatggtaaagtcttggagttaac

SEQ ID NO: 262423 - DNA, 46 bp, Artificial Sequence
  Description of Artificial Sequence: Synthetic oligonucleotide
caaagtatgtttcctttggaattgatggtaaagtcttggagttaac

SEQ ID NO: 262424 - DNA, 49 bp, Artificial Sequence
  Description of Artificial Sequence: Synthetic oligonucleotide
aaagtatgtttcctttggaattgatggtaaagtcttggagttaacaatc

SEQ ID NO: 262425 - DNA, 48 bp, Artificial Sequence
  Description of Artificial Sequence: Synthetic oligonucleotide
aagtatgtttcctttggaattgatggtaaagtcttggagttaacaatc

SEQ ID NO: 262426 - DNA, 47 bp, Artificial Sequence
  Description of Artificial Sequence: Synthetic oligonucleotide
agtatgtttcctttggaattgatggtaaagtcttggagttaacaatc

SEQ ID NO: 262427 - DNA, 46 bp, Artificial Sequence
  Description of Artificial Sequence: Synthetic oligonucleotide
gtatgtttcctttggaattgatggtaaagtcttggagttaacaatc

SEQ ID NO: 262428 - DNA, 49 bp, Artificial Sequence
  Description of Artificial Sequence: Synthetic oligonucleotide
tatgtttcctttggaattgatggtaaagtcttggagttaacaatctatc

SEQ ID NO: 262429 - DNA, 48 bp, Artificial Sequence
  Description of Artificial Sequence: Synthetic oligonucleotide
atgtttcctttggaattgatggtaaagtcttggagttaacaatctatc

SEQ ID NO: 262430 - DNA, 47 bp, Artificial Sequence
  Description of Artificial Sequence: Synthetic oligonucleotide
tgtttcctttggaattgatggtaaagtcttggagttaacaatctatc

SEQ ID NO: 262431 - DNA, 46 bp, Artificial Sequence
  Description of Artificial Sequence: Synthetic oligonucleotide
gtttcctttggaattgatggtaaagtcttggagttaacaatctatc

SEQ ID NO: 262432 - DNA, 48 bp, Artificial Sequence
  Description of Artificial Sequence: Synthetic oligonucleotide
tttcctttggaattgatggtaaagtcttggagttaacaatctatcatg

SEQ ID NO: 262433 - DNA, 47 bp, Artificial Sequence
  Description of Artificial Sequence: Synthetic oligonucleotide
ttcctttggaattgatggtaaagtcttggagttaacaatctatcatg

SEQ ID NO: 262434 - DNA, 46 bp, Artificial Sequence
  Description of Artificial Sequence: Synthetic oligonucleotide
tcctttggaattgatggtaaagtcttggagttaacaatctatcatg

SEQ ID NO: 262435 - DNA, 45 bp, Artificial Sequence
  Description of Artificial Sequence: Synthetic oligonucleotide
cctttggaattgatggtaaagtcttggagttaacaatctatcatg

SEQ ID NO: 262436 - DNA, 47 bp, Artificial Sequence
  Description of Artificial Sequence: Synthetic oligonucleotide
ctttggaattgatggtaaagtcttggagttaacaatctatcatgatg

SEQ ID NO: 262437 - DNA, 49 bp, Artificial Sequence
  Description of Artificial Sequence: Synthetic oligonucleotide
tttggaattgatggtaaagtcttggagttaacaatctatcatgatgatg

SEQ ID NO: 262438 - DNA, 48 bp, Artificial Sequence
  Description of Artificial Sequence: Synthetic oligonucleotide
ttggaattgatggtaaagtcttggagttaacaatctatcatgatgatg

SEQ ID NO: 262439 - DNA, 47 bp, Artificial Sequence
  Description of Artificial Sequence: Synthetic oligonucleotide
tggaattgatggtaaagtcttggagttaacaatctatcatgatgatg

SEQ ID NO: 262440 - DNA, 46 bp, Artificial Sequence
  Description of Artificial Sequence: Synthetic oligonucleotide
ggaattgatggtaaagtcttggagttaacaatctatcatgatgatg

SEQ ID NO: 262441 - DNA, 48 bp, Artificial Sequence
  Description of Artificial Sequence: Synthetic oligonucleotide
gaattgatggtaaagtcttggagttaacaatctatcatgatgatgttg

SEQ ID NO: 262442 - DNA, 49 bp, Artificial Sequence
  Description of Artificial Sequence: Synthetic oligonucleotide
aattgatggtaaagtcttggagttaacaatctatcatgatgatgttgtg

SEQ ID NO: 262443 - DNA, 48 bp, Artificial Sequence
  Description of Artificial Sequence: Synthetic oligonucleotide
attgatggtaaagtcttggagttaacaatctatcatgatgatgttgtg

SEQ ID NO: 262444 - DNA, 47 bp, Artificial Sequence
  Description of Artificial Sequence: Synthetic oligonucleotide
ttgatggtaaagtcttggagttaacaatctatcatgatgatgttgtg

SEQ ID NO: 262445 - DNA, 46 bp, Artificial Sequence
  Description of Artificial Sequence: Synthetic oligonucleotide
tgatggtaaagtcttggagttaacaatctatcatgatgatgttgtg

SEQ ID NO: 262446 - DNA, 45 bp, Artificial Sequence
  Description of Artificial Sequence: Synthetic oligonucleotide
gatggtaaagtcttggagttaacaatctatcatgatgatgttgtg

SEQ ID NO: 262447 - DNA, 46 bp, Artificial Sequence
  Description of Artificial Sequence: Synthetic oligonucleotide
atggtaaagtcttggagttaacaatctatcatgatgatgttgtgtc

SEQ ID NO: 262448 - DNA, 45 bp, Artificial Sequence
  Description of Artificial Sequence: Synthetic oligonucleotide
tggtaaagtcttggagttaacaatctatcatgatgatgttgtgtc

SEQ ID NO: 262449 - DNA, 44 bp, Artificial Sequence
  Description of Artificial Sequence: Synthetic oligonucleotide
ggtaaagtcttggagttaacaatctatcatgatgatgttgtgtc

SEQ ID NO: 262450 - DNA, 45 bp, Artificial Sequence
  Description of Artificial Sequence: Synthetic oligonucleotide
gtaaagtcttggagttaacaatctatcatgatgatgttgtgtctc

SEQ ID NO: 262451 - DNA, 45 bp, Artificial Sequence
  Description of Artificial Sequence: Synthetic oligonucleotide
taaagtcttggagttaacaatctatcatgatgatgttgtgtctcc

SEQ ID NO: 262452 - DNA, 44 bp, Artificial Sequence
  Description of Artificial Sequence: Synthetic oligonucleotide
aaagtcttggagttaacaatctatcatgatgatgttgtgtctcc

SEQ ID NO: 262453 - DNA, 43 bp, Artificial Sequence
  Description of Artificial Sequence: Synthetic oligonucleotide
aagtcttggagttaacaatctatcatgatgatgttgtgtctcc

SEQ ID NO: 262454 - DNA, 42 bp, Artificial Sequence
  Description of Artificial Sequence: Synthetic oligonucleotide
agtcttggagttaacaatctatcatgatgatgttgtgtctcc

SEQ ID NO: 262455 - DNA, 41 bp, Artificial Sequence
  Description of Artificial Sequence: Synthetic oligonucleotide
gtcttggagttaacaatctatcatgatgatgttgtgtctcc

SEQ ID NO: 262456 - DNA, 44 bp, Artificial Sequence
  Description of Artificial Sequence: Synthetic oligonucleotide
tcttggagttaacaatctatcatgatgatgttgtgtctcctttc

SEQ ID NO: 262457 - DNA, 43 bp, Artificial Sequence
  Description of Artificial Sequence: Synthetic oligonucleotide
cttggagttaacaatctatcatgatgatgttgtgtctcctttc

SEQ ID NO: 262458 - DNA, 43 bp, Artificial Sequence
  Description of Artificial Sequence: Synthetic oligonucleotide
ttggagttaacaatctatcatgatgatgttgtgtctcctttcc

SEQ ID NO: 262459 - DNA, 42 bp, Artificial Sequence
  Description of Artificial Sequence: Synthetic oligonucleotide
tggagttaacaatctatcatgatgatgttgtgtctcctttcc

SEQ ID NO: 262460 - DNA, 41 bp, Artificial Sequence
  Description of Artificial Sequence: Synthetic oligonucleotide
ggagttaacaatctatcatgatgatgttgtgtctcctttcc

SEQ ID NO: 262461 - DNA, 42 bp, Artificial Sequence
  Description of Artificial Sequence: Synthetic oligonucleotide
gagttaacaatctatcatgatgatgttgtgtctcctttcctg

SEQ ID NO: 262462 - DNA, 42 bp, Artificial Sequence
  Description of Artificial Sequence: Synthetic oligonucleotide
agttaacaatctatcatgatgatgttgtgtctcctttcctgg

SEQ ID NO: 262463 - DNA, 41 bp, Artificial Sequence
  Description of Artificial Sequence: Synthetic oligonucleotide
gttaacaatctatcatgatgatgttgtgtctcctttcctgg

SEQ ID NO: 262464 - DNA, 43 bp, Artificial Sequence
  Description of Artificial Sequence: Synthetic oligonucleotide
ttaacaatctatcatgatgatgttgtgtctcctttcctggaac

SEQ ID NO: 262465 - DNA, 42 bp, Artificial Sequence
  Description of Artificial Sequence: Synthetic oligonucleotide
taacaatctatcatgatgatgttgtgtctcctttcctggaac

SEQ ID NO: 262466 - DNA, 41 bp, Artificial Sequence
  Description of Artificial Sequence: Synthetic oligonucleotide
aacaatctatcatgatgatgttgtgtctcctttcctggaac

SEQ ID NO: 262467 - DNA, 40 bp, Artificial Sequence
  Description of Artificial Sequence: Synthetic oligonucleotide
acaatctatcatgatgatgttgtgtctcctttcctggaac

SEQ ID NO: 262468 - DNA, 39 bp, Artificial Sequence
  Description of Artificial Sequence: Synthetic oligonucleotide
caatctatcatgatgatgttgtgtctcctttcctggaac

SEQ ID NO: 262469 - DNA, 39 bp, Artificial Sequence
  Description of Artificial Sequence: Synthetic oligonucleotide
aatctatcatgatgatgttgtgtctcctttcctggaacg

SEQ ID NO: 262470 - DNA, 38 bp, Artificial Sequence
  Description of Artificial Sequence: Synthetic oligonucleotide
atctatcatgatgatgttgtgtctcctttcctggaacg

SEQ ID NO: 262471 - DNA, 37 bp, Artificial Sequence
  Description of Artificial Sequence: Synthetic oligonucleotide
tctatcatgatgatgttgtgtctcctttcctggaacg

SEQ ID NO: 262472 - DNA, 36 bp, Artificial Sequence
  Description of Artificial Sequence: Synthetic oligonucleotide
ctatcatgatgatgttgtgtctcctttcctggaacg

SEQ ID NO: 262473 - DNA, 37 bp, Artificial Sequence
  Description of Artificial Sequence: Synthetic oligonucleotide
tatcatgatgatgttgtgtctcctttcctggaacgtc

SEQ ID NO: 262474 - DNA, 36 bp, Artificial Sequence
  Description of Artificial Sequence: Synthetic oligonucleotide
atcatgatgatgttgtgtctcctttcctggaacgtc

SEQ ID NO: 262475 - DNA, 35 bp, Artificial Sequence
  Description of Artificial Sequence: Synthetic oligonucleotide
tcatgatgatgttgtgtctcctttcctggaacgtc

SEQ ID NO: 262476 - DNA, 34 bp, Artificial Sequence
  Description of Artificial Sequence: Synthetic oligonucleotide
catgatgatgttgtgtctcctttcctggaacgtc

SEQ ID NO: 262477 - DNA, 36 bp, Artificial Sequence
  Description of Artificial Sequence: Synthetic oligonucleotide
atgatgatgttgtgtctcctttcctggaacgtcttg

SEQ ID NO: 262478 - DNA, 35 bp, Artificial Sequence
  Description of Artificial Sequence: Synthetic oligonucleotide
tgatgatgttgtgtctcctttcctggaacgtcttg

SEQ ID NO: 262479 - DNA, 34 bp, Artificial Sequence
  Description of Artificial Sequence: Synthetic oligonucleotide
gatgatgttgtgtctcctttcctggaacgtcttg

SEQ ID NO: 262480 - DNA, 36 bp, Artificial Sequence
  Description of Artificial Sequence: Synthetic oligonucleotide
atgatgttgtgtctcctttcctggaacgtcttgaag

SEQ ID NO: 262481 - DNA, 35 bp, Artificial Sequence
  Description of Artificial Sequence: Synthetic oligonucleotide
tgatgttgtgtctcctttcctggaacgtcttgaag

SEQ ID NO: 262482 - DNA, 34 bp, Artificial Sequence
  Description of Artificial Sequence: Synthetic oligonucleotide
gatgttgtgtctcctttcctggaacgtcttgaag

SEQ ID NO: 262483 - DNA, 37 bp, Artificial Sequence
  Description of Artificial Sequence: Synthetic oligonucleotide
atgttgtgtctcctttcctggaacgtcttgaagtaag

SEQ ID NO: 262484 - DNA, 36 bp, Artificial Sequence
  Description of Artificial Sequence: Synthetic oligonucleotide
tgttgtgtctcctttcctggaacgtcttgaagtaag

SEQ ID NO: 262485 - DNA, 35 bp, Artificial Sequence
  Description of Artificial Sequence: Synthetic oligonucleotide
gttgtgtctcctttcctggaacgtcttgaagtaag

SEQ ID NO: 262486 - DNA, 36 bp, Artificial Sequence
  Description of Artificial Sequence: Synthetic oligonucleotide
ttgtgtctcctttcctggaacgtcttgaagtaagac

SEQ ID NO: 262487 - DNA, 35 bp, Artificial Sequence
  Description of Artificial Sequence: Synthetic oligonucleotide
tgtgtctcctttcctggaacgtcttgaagtaagac

SEQ ID NO: 262488 - DNA, 34 bp, Artificial Sequence
  Description of Artificial Sequence: Synthetic oligonucleotide
gtgtctcctttcctggaacgtcttgaagtaagac

SEQ ID NO: 262489 - DNA, 34 bp, Artificial Sequence
  Description of Artificial Sequence: Synthetic oligonucleotide
tgtctcctttcctggaacgtcttgaagtaagacc

SEQ ID NO: 262490 - DNA, 33 bp, Artificial Sequence
  Description of Artificial Sequence: Synthetic oligonucleotide
gtctcctttcctggaacgtcttgaagtaagacc

SEQ ID NO: 262491 - DNA, 34 bp, Artificial Sequence
  Description of Artificial Sequence: Synthetic oligonucleotide
tctcctttcctggaacgtcttgaagtaagaccac

SEQ ID NO: 262492 - DNA, 33 bp, Artificial Sequence
  Description of Artificial Sequence: Synthetic oligonucleotide
ctcctttcctggaacgtcttgaagtaagaccac

SEQ ID NO: 262493 - DNA, 34 bp, Artificial Sequence
  Description of Artificial Sequence: Synthetic oligonucleotide
tcctttcctggaacgtcttgaagtaagaccacac

SEQ ID NO: 262494 - DNA, 33 bp, Artificial Sequence
  Description of Artificial Sequence: Synthetic oligonucleotide
cctttcctggaacgtcttgaagtaagaccacac

SEQ ID NO: 262495 - DNA, 34 bp, Artificial Sequence
  Description of Artificial Sequence: Synthetic oligonucleotide
ctttcctggaacgtcttgaagtaagaccacacag

SEQ ID NO: 262496 - DNA, 37 bp, Artificial Sequence
  Description of Artificial Sequence: Synthetic oligonucleotide
tttcctggaacgtcttgaagtaagaccacacagaaag

SEQ ID NO: 262497 - DNA, 36 bp, Artificial Sequence
  Description of Artificial Sequence: Synthetic oligonucleotide
ttcctggaacgtcttgaagtaagaccacacagaaag

SEQ ID NO: 262498 - DNA, 35 bp, Artificial Sequence
  Description of Artificial Sequence: Synthetic oligonucleotide
tcctggaacgtcttgaagtaagaccacacagaaag

SEQ ID NO: 262499 - DNA, 34 bp, Artificial Sequence
  Description of Artificial Sequence: Synthetic oligonucleotide
cctggaacgtcttgaagtaagaccacacagaaag

SEQ ID NO: 262500 - DNA, 34 bp, Artificial Sequence
  Description of Artificial Sequence: Synthetic oligonucleotide
ctggaacgtcttgaagtaagaccacacagaaagg

SEQ ID NO: 262501 - DNA, 34 bp, Artificial Sequence
  Description of Artificial Sequence: Synthetic oligonucleotide
tggaacgtcttgaagtaagaccacacagaaaggc

SEQ ID NO: 262502 - DNA, 33 bp, Artificial Sequence
  Description of Artificial Sequence: Synthetic oligonucleotide
ggaacgtcttgaagtaagaccacacagaaaggc

SEQ ID NO: 262503 - DNA, 34 bp, Artificial Sequence
  Description of Artificial Sequence: Synthetic oligonucleotide
gaacgtcttgaagtaagaccacacagaaaggcag

SEQ ID NO: 262504 - DNA, 35 bp, Artificial Sequence
  Description of Artificial Sequence: Synthetic oligonucleotide
aacgtcttgaagtaagaccacacagaaaggcagag

SEQ ID NO: 262505 - DNA, 34 bp, Artificial Sequence
  Description of Artificial Sequence: Synthetic oligonucleotide
acgtcttgaagtaagaccacacagaaaggcagag

SEQ ID NO: 262506 - DNA, 33 bp, Artificial Sequence
  Description of Artificial Sequence: Synthetic oligonucleotide
cgtcttgaagtaagaccacacagaaaggcagag

SEQ ID NO: 262507 - DNA, 33 bp, Artificial Sequence
  Description of Artificial Sequence: Synthetic oligonucleotide
gtcttgaagtaagaccacacagaaaggcagagc

SEQ ID NO: 262508 - DNA, 33 bp, Artificial Sequence
  Description of Artificial Sequence: Synthetic oligonucleotide
tcttgaagtaagaccacacagaaaggcagagcc

SEQ ID NO: 262509 - DNA, 32 bp, Artificial Sequence
  Description of Artificial Sequence: Synthetic oligonucleotide
cttgaagtaagaccacacagaaaggcagagcc

SEQ ID NO: 262510 - DNA, 33 bp, Artificial Sequence
  Description of Artificial Sequence: Synthetic oligonucleotide
ttgaagtaagaccacacagaaaggcagagcctg

SEQ ID NO: 262511 - DNA, 32 bp, Artificial Sequence
  Description of Artificial Sequence: Synthetic oligonucleotide
tgaagtaagaccacacagaaaggcagagcctg

SEQ ID NO: 262512 - DNA, 31 bp, Artificial Sequence
  Description of Artificial Sequence: Synthetic oligonucleotide
gaagtaagaccacacagaaaggcagagcctg

SEQ ID NO: 262513 - DNA, 31 bp, Artificial Sequence
  Description of Artificial Sequence: Synthetic oligonucleotide
aagtaagaccacacagaaaggcagagcctgc

SEQ ID NO: 262514 - DNA, 30 bp, Artificial Sequence
  Description of Artificial Sequence: Synthetic oligonucleotide
agtaagaccacacagaaaggcagagcctgc

SEQ ID NO: 262515 - DNA, 29 bp, Artificial Sequence
  Description of Artificial Sequence: Synthetic oligonucleotide
gtaagaccacacagaaaggcagagcctgc

SEQ ID NO: 262516 - DNA, 30 bp, Artificial Sequence
  Description of Artificial Sequence: Synthetic oligonucleotide
taagaccacacagaaaggcagagcctgctc

SEQ ID NO: 262517 - DNA, 29 bp, Artificial Sequence
  Description of Artificial Sequence: Synthetic oligonucleotide
aagaccacacagaaaggcagagcctgctc

SEQ ID NO: 262518 - DNA, 28 bp, Artificial Sequence
  Description of Artificial Sequence: Synthetic oligonucleotide
agaccacacagaaaggcagagcctgctc

SEQ ID NO: 262519 - DNA, 27 bp, Artificial Sequence
  Description of Artificial Sequence: Synthetic oligonucleotide
gaccacacagaaaggcagagcctgctc

SEQ ID NO: 262520 - DNA, 29 bp, Artificial Sequence
  Description of Artificial Sequence: Synthetic oligonucleotide
accacacagaaaggcagagcctgctctac

SEQ ID NO: 262521 - DNA, 28 bp, Artificial Sequence
  Description of Artificial Sequence: Synthetic oligonucleotide
ccacacagaaaggcagagcctgctctac

SEQ ID NO: 262522 - DNA, 28 bp, Artificial Sequence
  Description of Artificial Sequence: Synthetic oligonucleotide
cacacagaaaggcagagcctgctctacc

SEQ ID NO: 262523 - DNA, 29 bp, Artificial Sequence
  Description of Artificial Sequence: Synthetic oligonucleotide
acacagaaaggcagagcctgctctacctg

SEQ ID NO: 262524 - DNA, 28 bp, Artificial Sequence
  Description of Artificial Sequence: Synthetic oligonucleotide
cacagaaaggcagagcctgctctacctg

SEQ ID NO: 262525 - DNA, 28 bp, Artificial Sequence
  Description of Artificial Sequence: Synthetic oligonucleotide
acagaaaggcagagcctgctctacctgc

SEQ ID NO: 262526 - DNA, 27 bp, Artificial Sequence
  Description of Artificial Sequence: Synthetic oligonucleotide
cagaaaggcagagcctgctctacctgc

SEQ ID NO: 262527 - DNA, 28 bp, Artificial Sequence
  Description of Artificial Sequence: Synthetic oligonucleotide
agaaaggcagagcctgctctacctgctg

SEQ ID NO: 262528 - DNA, 27 bp, Artificial Sequence
  Description of Artificial Sequence: Synthetic oligonucleotide
gaaaggcagagcctgctctacctgctg

SEQ ID NO: 262529 - DNA, 29 bp, Artificial Sequence
  Description of Artificial Sequence: Synthetic oligonucleotide
aaaggcagagcctgctctacctgctgaag

SEQ ID NO: 262530 - DNA, 28 bp, Artificial Sequence
  Description of Artificial Sequence: Synthetic oligonucleotide
aaggcagagcctgctctacctgctgaag

SEQ ID NO: 262531 - DNA, 27 bp, Artificial Sequence
  Description of Artificial Sequence: Synthetic oligonucleotide
aggcagagcctgctctacctgctgaag

SEQ ID NO: 262532 - DNA, 27 bp, Artificial Sequence
  Description of Artificial Sequence: Synthetic oligonucleotide
ggcagagcctgctctacctgctgaaga

SEQ ID NO: 262533 - DNA, 28 bp, Artificial Sequence
  Description of Artificial Sequence: Synthetic oligonucleotide
gcagagcctgctctacctgctgaagaac

SEQ ID NO: 262534 - DNA, 28 bp, Artificial Sequence
  Description of Artificial Sequence: Synthetic oligonucleotide
cagagcctgctctacctgctgaagaacc

SEQ ID NO: 262535 - DNA, 29 bp, Artificial Sequence
  Description of Artificial Sequence: Synthetic oligonucleotide
agagcctgctctacctgctgaagaacctg

SEQ ID NO: 262536 - DNA, 28 bp, Artificial Sequence
  Description of Artificial Sequence: Synthetic oligonucleotide
gagcctgctctacctgctgaagaacctg

SEQ ID NO: 262537 - DNA, 28 bp, Artificial Sequence
  Description of Artificial Sequence: Synthetic oligonucleotide
agcctgctctacctgctgaagaacctgc

SEQ ID NO: 262538 - DNA, 27 bp, Artificial Sequence
  Description of Artificial Sequence: Synthetic oligonucleotide
gcctgctctacctgctgaagaacctgc

SEQ ID NO: 262539 - DNA, 28 bp, Artificial Sequence
  Description of Artificial Sequence: Synthetic oligonucleotide
cctgctctacctgctgaagaacctgcac

SEQ ID NO: 262540 - DNA, 32 bp, Artificial Sequence
  Description of Artificial Sequence: Synthetic oligonucleotide
ctgctctacctgctgaagaacctgcacaaaag

SEQ ID NO: 262541 - DNA, 32 bp, Artificial Sequence
  Description of Artificial Sequence: Synthetic oligonucleotide
tgctctacctgctgaagaacctgcacaaaagg

SEQ ID NO: 262542 - DNA, 31 bp, Artificial Sequence
  Description of Artificial Sequence: Synthetic oligonucleotide
gctctacctgctgaagaacctgcacaaaagg

SEQ ID NO: 262543 - DNA, 31 bp, Artificial Sequence
  Description of Artificial Sequence: Synthetic oligonucleotide
ctctacctgctgaagaacctgcacaaaaggc

SEQ ID NO: 262544 - DNA, 32 bp, Artificial Sequence
  Description of Artificial Sequence: Synthetic oligonucleotide
tctacctgctgaagaacctgcacaaaaggctg

SEQ ID NO: 262545 - DNA, 31 bp, Artificial Sequence
  Description of Artificial Sequence: Synthetic oligonucleotide
ctacctgctgaagaacctgcacaaaaggctg

SEQ ID NO: 262546 - DNA, 33 bp, Artificial Sequence
  Description of Artificial Sequence: Synthetic oligonucleotide
tacctgctgaagaacctgcacaaaaggctgttg

SEQ ID NO: 262547 - DNA, 32 bp, Artificial Sequence
  Description of Artificial Sequence: Synthetic oligonucleotide
acctgctgaagaacctgcacaaaaggctgttg

SEQ ID NO: 262548 - DNA, 31 bp, Artificial Sequence
  Description of Artificial Sequence: Synthetic oligonucleotide
cctgctgaagaacctgcacaaaaggctgttg

SEQ ID NO: 262549 - DNA, 33 bp, Artificial Sequence
  Description of Artificial Sequence: Synthetic oligonucleotide
ctgctgaagaacctgcacaaaaggctgttgaac

SEQ ID NO: 262550 - DNA, 33 bp, Artificial Sequence
  Description of Artificial Sequence: Synthetic oligonucleotide
tgctgaagaacctgcacaaaaggctgttgaacc

SEQ ID NO: 262551 - DNA, 32 bp, Artificial Sequence
  Description of Artificial Sequence: Synthetic oligonucleotide
gctgaagaacctgcacaaaaggctgttgaacc

SEQ ID NO: 262552 - DNA, 35 bp, Artificial Sequence
  Description of Artificial Sequence: Synthetic oligonucleotide
ctgaagaacctgcacaaaaggctgttgaaccaatc

SEQ ID NO: 262553 - DNA, 35 bp, Artificial Sequence
  Description of Artificial Sequence: Synthetic oligonucleotide
tgaagaacctgcacaaaaggctgttgaaccaatcg

SEQ ID NO: 262554 - DNA, 34 bp, Artificial Sequence
  Description of Artificial Sequence: Synthetic oligonucleotide
gaagaacctgcacaaaaggctgttgaaccaatcg

SEQ ID NO: 262555 - DNA, 36 bp, Artificial Sequence
  Description of Artificial Sequence: Synthetic oligonucleotide
aagaacctgcacaaaaggctgttgaaccaatcgaac

SEQ ID NO: 262556 - DNA, 35 bp, Artificial Sequence
  Description of Artificial Sequence: Synthetic oligonucleotide
agaacctgcacaaaaggctgttgaaccaatcgaac

SEQ ID NO: 262557 - DNA, 34 bp, Artificial Sequence
  Description of Artificial Sequence: Synthetic oligonucleotide
gaacctgcacaaaaggctgttgaaccaatcgaac

SEQ ID NO: 262558 - DNA, 26 bp, Artificial Sequence
  Description of Artificial Sequence: Synthetic oligonucleotide
aaggcggagcgggggtacagcatttc

SEQ ID NO: 262559 - DNA, 25 bp, Artificial Sequence
  Description of Artificial Sequence: Synthetic oligonucleotide
aggcggagcgggggtacagcatttc

SEQ ID NO: 262560 - DNA, 24 bp, Artificial Sequence
  Description of Artificial Sequence: Synthetic oligonucleotide
ggcggagcgggggtacagcatttc

SEQ ID NO: 262561 - DNA, 24 bp, Artificial Sequence
  Description of Artificial Sequence: Synthetic oligonucleotide
gcggagcgggggtacagcatttcg

SEQ ID NO: 262562 - DNA, 25 bp, Artificial Sequence
  Description of Artificial Sequence: Synthetic oligonucleotide
cggagcgggggtacagcatttcgct

SEQ ID NO: 262563 - DNA, 26 bp, Artificial Sequence
  Description of Artificial Sequence: Synthetic oligonucleotide
ggagcgggggtacagcatttcgctga

SEQ ID NO: 262564 - DNA, 27 bp, Artificial Sequence
  Description of Artificial Sequence: Synthetic oligonucleotide
gagcgggggtacagcatttcgctgagt

SEQ ID NO: 262565 - DNA, 28 bp, Artificial Sequence
  Description of Artificial Sequence: Synthetic oligonucleotide
agcgggggtacagcatttcgctgagtac

SEQ ID NO: 262566 - DNA, 27 bp, Artificial Sequence
  Description of Artificial Sequence: Synthetic oligonucleotide
gcgggggtacagcatttcgctgagtac

SEQ ID NO: 262567 - DNA, 30 bp, Artificial Sequence
  Description of Artificial Sequence: Synthetic oligonucleotide
cgggggtacagcatttcgctgagtacattc

SEQ ID NO: 262568 - DNA, 31 bp, Artificial Sequence
  Description of Artificial Sequence: Synthetic oligonucleotide
gggggtacagcatttcgctgagtacattcag

SEQ ID NO: 262569 - DNA, 31 bp, Artificial Sequence
  Description of Artificial Sequence: Synthetic oligonucleotide
ggggtacagcatttcgctgagtacattcagg

SEQ ID NO: 262570 - DNA, 31 bp, Artificial Sequence
  Description of Artificial Sequence: Synthetic oligonucleotide
gggtacagcatttcgctgagtacattcaggc

SEQ ID NO: 262571 - DNA, 31 bp, Artificial Sequence
  Description of Artificial Sequence: Synthetic oligonucleotide
ggtacagcatttcgctgagtacattcaggcc

SEQ ID NO: 262572 - DNA, 31 bp, Artificial Sequence
  Description of Artificial Sequence: Synthetic oligonucleotide
gtacagcatttcgctgagtacattcaggccg

SEQ ID NO: 262573 - DNA, 32 bp, Artificial Sequence
  Description of Artificial Sequence: Synthetic oligonucleotide
tacagcatttcgctgagtacattcaggccgtc

SEQ ID NO: 262574 - DNA, 31 bp, Artificial Sequence
  Description of Artificial Sequence: Synthetic oligonucleotide
acagcatttcgctgagtacattcaggccgtc

SEQ ID NO: 262575 - DNA, 30 bp, Artificial Sequence
  Description of Artificial Sequence: Synthetic oligonucleotide
cagcatttcgctgagtacattcaggccgtc

SEQ ID NO: 262576 - DNA, 31 bp, Artificial Sequence
  Description of Artificial Sequence: Synthetic oligonucleotide
agcatttcgctgagtacattcaggccgtctg

SEQ ID NO: 262577 - DNA, 30 bp, Artificial Sequence
  Description of Artificial Sequence: Synthetic oligonucleotide
gcatttcgctgagtacattcaggccgtctg

SEQ ID NO: 262578 - DNA, 30 bp, Artificial Sequence
  Description of Artificial Sequence: Synthetic oligonucleotide
catttcgctgagtacattcaggccgtctgg

SEQ ID NO: 262579 - DNA, 34 bp, Artificial Sequence
  Description of Artificial Sequence: Synthetic oligonucleotide
atttcgctgagtacattcaggccgtctggttaac

SEQ ID NO: 262580 - DNA, 33 bp, Artificial Sequence
  Description of Artificial Sequence: Synthetic oligonucleotide
tttcgctgagtacattcaggccgtctggttaac

SEQ ID NO: 262581 - DNA, 32 bp, Artificial Sequence
  Description of Artificial Sequence: Synthetic oligonucleotide
ttcgctgagtacattcaggccgtctggttaac

SEQ ID NO: 262582 - DNA, 31 bp, Artificial Sequence
  Description of Artificial Sequence: Synthetic oligonucleotide
tcgctgagtacattcaggccgtctggttaac

SEQ ID NO: 262583 - DNA, 30 bp, Artificial Sequence
  Description of Artificial Sequence: Synthetic oligonucleotide
cgctgagtacattcaggccgtctggttaac

SEQ ID NO: 262584 - DNA, 32 bp, Artificial Sequence
  Description of Artificial Sequence: Synthetic oligonucleotide
gctgagtacattcaggccgtctggttaacttg

SEQ ID NO: 262585 - DNA, 33 bp, Artificial Sequence
  Description of Artificial Sequence: Synthetic oligonucleotide
ctgagtacattcaggccgtctggttaacttgtc

SEQ ID NO: 262586 - DNA, 33 bp, Artificial Sequence
  Description of Artificial Sequence: Synthetic oligonucleotide
tgagtacattcaggccgtctggttaacttgtcc

SEQ ID NO: 262587 - DNA, 32 bp, Artificial Sequence
  Description of Artificial Sequence: Synthetic oligonucleotide
gagtacattcaggccgtctggttaacttgtcc

SEQ ID NO: 262588 - DNA, 33 bp, Artificial Sequence
  Description of Artificial Sequence: Synthetic oligonucleotide
agtacattcaggccgtctggttaacttgtcctg

SEQ ID NO: 262589 - DNA, 32 bp, Artificial Sequence
  Description of Artificial Sequence: Synthetic oligonucleotide
gtacattcaggccgtctggttaacttgtcctg

SEQ ID NO: 262590 - DNA, 35 bp, Artificial Sequence
  Description of Artificial Sequence: Synthetic oligonucleotide
tacattcaggccgtctggttaacttgtcctgattg

SEQ ID NO: 262591 - DNA, 34 bp, Artificial Sequence
  Description of Artificial Sequence: Synthetic oligonucleotide
acattcaggccgtctggttaacttgtcctgattg

SEQ ID NO: 262592 - DNA, 33 bp, Artificial Sequence
  Description of Artificial Sequence: Synthetic oligonucleotide
cattcaggccgtctggttaacttgtcctgattg

SEQ ID NO: 262593 - DNA, 38 bp, Artificial Sequence
  Description of Artificial Sequence: Synthetic oligonucleotide
attcaggccgtctggttaacttgtcctgattgaataag

SEQ ID NO: 262594 - DNA, 37 bp, Artificial Sequence
  Description of Artificial Sequence: Synthetic oligonucleotide
ttcaggccgtctggttaacttgtcctgattgaataag

SEQ ID NO: 262595 - DNA, 36 bp, Artificial Sequence
  Description of Artificial Sequence: Synthetic oligonucleotide
tcaggccgtctggttaacttgtcctgattgaataag

SEQ ID NO: 262596 - DNA, 35 bp, Artificial Sequence
  Description of Artificial Sequence: Synthetic oligonucleotide
caggccgtctggttaacttgtcctgattgaataag

SEQ ID NO: 262597 - DNA, 35 bp, Artificial Sequence
  Description of Artificial Sequence: Synthetic oligonucleotide
aggccgtctggttaacttgtcctgattgaataagc

SEQ ID NO: 262598 - DNA, 34 bp, Artificial Sequence
  Description of Artificial Sequence: Synthetic oligonucleotide
ggccgtctggttaacttgtcctgattgaataagc

SEQ ID NO: 262599 - DNA, 37 bp, Artificial Sequence
  Description of Artificial Sequence: Synthetic oligonucleotide
gccgtctggttaacttgtcctgattgaataagctttg

SEQ ID NO: 262600 - DNA, 37 bp, Artificial Sequence
  Description of Artificial Sequence: Synthetic oligonucleotide
ccgtctggttaacttgtcctgattgaataagctttgg

SEQ ID NO: 262601 - DNA, 37 bp, Artificial Sequence
  Description of Artificial Sequence: Synthetic oligonucleotide
cgtctggttaacttgtcctgattgaataagctttggc

SEQ ID NO: 262602 - DNA, 38 bp, Artificial Sequence
  Description of Artificial Sequence: Synthetic oligonucleotide
gtctggttaacttgtcctgattgaataagctttggctc

SEQ ID NO: 262603 - DNA, 38 bp, Artificial Sequence
  Description of Artificial Sequence: Synthetic oligonucleotide
tctggttaacttgtcctgattgaataagctttggctcc

SEQ ID NO: 262604 - DNA, 37 bp, Artificial Sequence
  Description of Artificial Sequence: Synthetic oligonucleotide
ctggttaacttgtcctgattgaataagctttggctcc

SEQ ID NO: 262605 - DNA, 38 bp, Artificial Sequence
  Description of Artificial Sequence: Synthetic oligonucleotide
tggttaacttgtcctgattgaataagctttggctcctg

SEQ ID NO: 262606 - DNA, 37 bp, Artificial Sequence
  Description of Artificial Sequence: Synthetic oligonucleotide
ggttaacttgtcctgattgaataagctttggctcctg

SEQ ID NO: 262607 - DNA, 39 bp, Artificial Sequence
  Description of Artificial Sequence: Synthetic oligonucleotide
gttaacttgtcctgattgaataagctttggctcctgtag

SEQ ID NO: 262608 - DNA, 39 bp, Artificial Sequence
  Description of Artificial Sequence: Synthetic oligonucleotide
ttaacttgtcctgattgaataagctttggctcctgtagc

SEQ ID NO: 262609 - DNA, 38 bp, Artificial Sequence
  Description of Artificial Sequence: Synthetic oligonucleotide
taacttgtcctgattgaataagctttggctcctgtagc

SEQ ID NO: 262610 - DNA, 37 bp, Artificial Sequence
  Description of Artificial Sequence: Synthetic oligonucleotide
aacttgtcctgattgaataagctttggctcctgtagc

SEQ ID NO: 262611 - DNA, 36 bp, Artificial Sequence
  Description of Artificial Sequence: Synthetic oligonucleotide
acttgtcctgattgaataagctttggctcctgtagc

SEQ ID NO: 262612 - DNA, 35 bp, Artificial Sequence
  Description of Artificial Sequence: Synthetic oligonucleotide
cttgtcctgattgaataagctttggctcctgtagc

SEQ ID NO: 262613 - DNA, 36 bp, Artificial Sequence
  Description of Artificial Sequence: Synthetic oligonucleotide
ttgtcctgattgaataagctttggctcctgtagctg

SEQ ID NO: 262614 - DNA, 35 bp, Artificial Sequence
  Description of Artificial Sequence: Synthetic oligonucleotide
tgtcctgattgaataagctttggctcctgtagctg

SEQ ID NO: 262615 - DNA, 34 bp, Artificial Sequence
  Description of Artificial Sequence: Synthetic oligonucleotide
gtcctgattgaataagctttggctcctgtagctg

SEQ ID NO: 262616 - DNA, 34 bp, Artificial Sequence
  Description of Artificial Sequence: Synthetic oligonucleotide
tcctgattgaataagctttggctcctgtagctgc

SEQ ID NO: 262617 - DNA, 33 bp, Artificial Sequence
  Description of Artificial Sequence: Synthetic oligonucleotide
cctgattgaataagctttggctcctgtagctgc

SEQ ID NO: 262618 - DNA, 34 bp, Artificial Sequence
  Description of Artificial Sequence: Synthetic oligonucleotide
ctgattgaataagctttggctcctgtagctgcag

SEQ ID NO: 262619 - DNA, 34 bp, Artificial Sequence
  Description of Artificial Sequence: Synthetic oligonucleotide
tgattgaataagctttggctcctgtagctgcagg

SEQ ID NO: 262620 - DNA, 33 bp, Artificial Sequence
  Description of Artificial Sequence: Synthetic oligonucleotide
gattgaataagctttggctcctgtagctgcagg

SEQ ID NO: 262621 - DNA, 34 bp, Artificial Sequence
  Description of Artificial Sequence: Synthetic oligonucleotide
attgaataagctttggctcctgtagctgcaggag

SEQ ID NO: 262622 - DNA, 33 bp, Artificial Sequence
  Description of Artificial Sequence: Synthetic oligonucleotide
ttgaataagctttggctcctgtagctgcaggag

SEQ ID NO: 262623 - DNA, 32 bp, Artificial Sequence
  Description of Artificial Sequence: Synthetic oligonucleotide
tgaataagctttggctcctgtagctgcaggag

SEQ ID NO: 262624 - DNA, 31 bp, Artificial Sequence
  Description of Artificial Sequence: Synthetic oligonucleotide
gaataagctttggctcctgtagctgcaggag

SEQ ID NO: 262625 - DNA, 31 bp, Artificial Sequence
  Description of Artificial Sequence: Synthetic oligonucleotide
aataagctttggctcctgtagctgcaggagc

SEQ ID NO: 262626 - DNA, 30 bp, Artificial Sequence
  Description of Artificial Sequence: Synthetic oligonucleotide
ataagctttggctcctgtagctgcaggagc

SEQ ID NO: 262627 - DNA, 29 bp, Artificial Sequence
  Description of Artificial Sequence: Synthetic oligonucleotide
taagctttggctcctgtagctgcaggagc

SEQ ID NO: 262628 - DNA, 28 bp, Artificial Sequence
  Description of Artificial Sequence: Synthetic oligonucleotide
aagctttggctcctgtagctgcaggagc

SEQ ID NO: 262629 - DNA, 27 bp, Artificial Sequence
  Description of Artificial Sequence: Synthetic oligonucleotide
agctttggctcctgtagctgcaggagc

SEQ ID NO: 262630 - DNA, 26 bp, Artificial Sequence
  Description of Artificial Sequence: Synthetic oligonucleotide
gctttggctcctgtagctgcaggagc

SEQ ID NO: 262631 - DNA, 26 bp, Artificial Sequence
  Description of Artificial Sequence: Synthetic oligonucleotide
ctttggctcctgtagctgcaggagcc

SEQ ID NO: 262632 - DNA, 26 bp, Artificial Sequence
  Description of Artificial Sequence: Synthetic oligonucleotide
tttggctcctgtagctgcaggagccc

SEQ ID NO: 262633 - DNA, 25 bp, Artificial Sequence
  Description of Artificial Sequence: Synthetic oligonucleotide
ttggctcctgtagctgcaggagccc

SEQ ID NO: 262634 - DNA, 24 bp, Artificial Sequence
  Description of Artificial Sequence: Synthetic oligonucleotide
tggctcctgtagctgcaggagccc

SEQ ID NO: 262635 - DNA, 23 bp, Artificial Sequence
  Description of Artificial Sequence: Synthetic oligonucleotide
ggctcctgtagctgcaggagccc

SEQ ID NO: 262636 - DNA, 23 bp, Artificial Sequence
  Description of Artificial Sequence: Synthetic oligonucleotide
gctcctgtagctgcaggagcccc

SEQ ID NO: 262637 - DNA, 24 bp, Artificial Sequence
  Description of Artificial Sequence: Synthetic oligonucleotide
ctcctgtagctgcaggagccccct

SEQ ID NO: 262638 - DNA, 24 bp, Artificial Sequence
  Description of Artificial Sequence: Synthetic oligonucleotide
tcctgtagctgcaggagccccctc

SEQ ID NO: 262639 - DNA, 23 bp, Artificial Sequence
  Description of Artificial Sequence: Synthetic oligonucleotide
cctgtagctgcaggagccccctc

SEQ ID NO: 262640 - DNA, 23 bp, Artificial Sequence
  Description of Artificial Sequence: Synthetic oligonucleotide
ctgtagctgcaggagccccctcc

SEQ ID NO: 262641 - DNA, 24 bp, Artificial Sequence
  Description of Artificial Sequence: Synthetic oligonucleotide
tgtagctgcaggagccccctccgt

SEQ ID NO: 262642 - DNA, 23 bp, Artificial Sequence
  Description of Artificial Sequence: Synthetic oligonucleotide
gtagctgcaggagccccctccgt

SEQ ID NO: 262643 - DNA, 23 bp, Artificial Sequence
  Description of Artificial Sequence: Synthetic oligonucleotide
tagctgcaggagccccctccgtg

SEQ ID NO: 262644 - DNA, 22 bp, Artificial Sequence
  Description of Artificial Sequence: Synthetic oligonucleotide
agctgcaggagccccctccgtg

SEQ ID NO: 262645 - DNA, 21 bp, Artificial Sequence
  Description of Artificial Sequence: Synthetic oligonucleotide
gctgcaggagccccctccgtg

SEQ ID NO: 262646 - DNA, 21 bp, Artificial Sequence
  Description of Artificial Sequence: Synthetic oligonucleotide
ctgcaggagccccctccgtgg

SEQ ID NO: 262647 - DNA, 27 bp, Artificial Sequence
  Description of Artificial Sequence: Synthetic oligonucleotide
tgcaggagccccctccgtgggatttaa

SEQ ID NO: 262648 - DNA, 27 bp, Artificial Sequence
  Description of Artificial Sequence: Synthetic oligonucleotide
gcaggagccccctccgtgggatttaaa

SEQ ID NO: 262649 - DNA, 27 bp, Artificial Sequence
  Description of Artificial Sequence: Synthetic oligonucleotide
caggagccccctccgtgggatttaaag

SEQ ID NO: 262650 - DNA, 27 bp, Artificial Sequence
  Description of Artificial Sequence: Synthetic oligonucleotide
aggagccccctccgtgggatttaaagc

SEQ ID NO: 262651 - DNA, 27 bp, Artificial Sequence
  Description of Artificial Sequence: Synthetic oligonucleotide
ggagccccctccgtgggatttaaagct

SEQ ID NO: 262652 - DNA, 27 bp, Artificial Sequence
  Description of Artificial Sequence: Synthetic oligonucleotide
gagccccctccgtgggatttaaagctg

SEQ ID NO: 262653 - DNA, 27 bp, Artificial Sequence
  Description of Artificial Sequence: Synthetic oligonucleotide
agccccctccgtgggatttaaagctgg

SEQ ID NO: 262654 - DNA, 27 bp, Artificial Sequence
  Description of Artificial Sequence: Synthetic oligonucleotide
gccccctccgtgggatttaaagctgga

SEQ ID NO: 262655 - DNA, 30 bp, Artificial Sequence
  Description of Artificial Sequence: Synthetic oligonucleotide
ccccctccgtgggatttaaagctggaaatg

SEQ ID NO: 262656 - DNA, 30 bp, Artificial Sequence
  Description of Artificial Sequence: Synthetic oligonucleotide
cccctccgtgggatttaaagctggaaatgg

SEQ ID NO: 262657 - DNA, 31 bp, Artificial Sequence
  Description of Artificial Sequence: Synthetic oligonucleotide
ccctccgtgggatttaaagctggaaatggtg

SEQ ID NO: 262658 - DNA, 32 bp, Artificial Sequence
  Description of Artificial Sequence: Synthetic oligonucleotide
cctccgtgggatttaaagctggaaatggtgtc

SEQ ID NO: 262659 - DNA, 32 bp, Artificial Sequence
  Description of Artificial Sequence: Synthetic oligonucleotide
ctccgtgggatttaaagctggaaatggtgtcg

SEQ ID NO: 262660 - DNA, 37 bp, Artificial Sequence
  Description of Artificial Sequence: Synthetic oligonucleotide
tccgtgggatttaaagctggaaatggtgtcgtattag

SEQ ID NO: 262661 - DNA, 36 bp, Artificial Sequence
  Description of Artificial Sequence: Synthetic oligonucleotide
ccgtgggatttaaagctggaaatggtgtcgtattag

SEQ ID NO: 262662 - DNA, 36 bp, Artificial Sequence
  Description of Artificial Sequence: Synthetic oligonucleotide
cgtgggatttaaagctggaaatggtgtcgtattagc

SEQ ID NO: 262663 - DNA, 38 bp, Artificial Sequence
  Description of Artificial Sequence: Synthetic oligonucleotide
gtgggatttaaagctggaaatggtgtcgtattagcatc

SEQ ID NO: 262664 - DNA, 39 bp, Artificial Sequence
  Description of Artificial Sequence: Synthetic oligonucleotide
tgggatttaaagctggaaatggtgtcgtattagcatctg

SEQ ID NO: 262665 - DNA, 38 bp, Artificial Sequence
  Description of Artificial Sequence: Synthetic oligonucleotide
gggatttaaagctggaaatggtgtcgtattagcatctg

SEQ ID NO: 262666 - DNA, 39 bp, Artificial Sequence
  Description of Artificial Sequence: Synthetic oligonucleotide
ggatttaaagctggaaatggtgtcgtattagcatctgag

SEQ ID NO: 262667 - DNA, 45 bp, Artificial Sequence
  Description of Artificial Sequence: Synthetic oligonucleotide
gatttaaagctggaaatggtgtcgtattagcatctgagaaaatac

SEQ ID NO: 262668 - DNA, 46 bp, Artificial Sequence
  Description of Artificial Sequence: Synthetic oligonucleotide
atttaaagctggaaatggtgtcgtattagcatctgagaaaatacag

SEQ ID NO: 262669 - DNA, 45 bp, Artificial Sequence
  Description of Artificial Sequence: Synthetic oligonucleotide
tttaaagctggaaatggtgtcgtattagcatctgagaaaatacag

SEQ ID NO: 262670 - DNA, 44 bp, Artificial Sequence
  Description of Artificial Sequence: Synthetic oligonucleotide
ttaaagctggaaatggtgtcgtattagcatctgagaaaatacag

SEQ ID NO: 262671 - DNA, 43 bp, Artificial Sequence
  Description of Artificial Sequence: Synthetic oligonucleotide
taaagctggaaatggtgtcgtattagcatctgagaaaatacag

SEQ ID NO: 262672 - DNA, 42 bp, Artificial Sequence
  Description of Artificial Sequence: Synthetic oligonucleotide
aaagctggaaatggtgtcgtattagcatctgagaaaatacag

SEQ ID NO: 262673 - DNA, 41 bp, Artificial Sequence
  Description of Artificial Sequence: Synthetic oligonucleotide
aagctggaaatggtgtcgtattagcatctgagaaaatacag

SEQ ID NO: 262674 - DNA, 40 bp, Artificial Sequence
  Description of Artificial Sequence: Synthetic oligonucleotide
agctggaaatggtgtcgtattagcatctgagaaaatacag

SEQ ID NO: 262675 - DNA, 39 bp, Artificial Sequence
  Description of Artificial Sequence: Synthetic oligonucleotide
gctggaaatggtgtcgtattagcatctgagaaaatacag

SEQ ID NO: 262676 - DNA, 43 bp, Artificial Sequence
  Description of Artificial Sequence: Synthetic oligonucleotide
ctggaaatggtgtcgtattagcatctgagaaaatacagaaatc

SEQ ID NO: 262677 - DNA, 43 bp, Artificial Sequence
  Description of Artificial Sequence: Synthetic oligonucleotide
tggaaatggtgtcgtattagcatctgagaaaatacagaaatcg

SEQ ID NO: 262678 - DNA, 42 bp, Artificial Sequence
  Description of Artificial Sequence: Synthetic oligonucleotide
ggaaatggtgtcgtattagcatctgagaaaatacagaaatcg

SEQ ID NO: 262679 - DNA, 45 bp, Artificial Sequence
  Description of Artificial Sequence: Synthetic oligonucleotide
gaaatggtgtcgtattagcatctgagaaaatacagaaatcgattc

SEQ ID NO: 262680 - DNA, 46 bp, Artificial Sequence
  Description of Artificial Sequence: Synthetic oligonucleotide
aaatggtgtcgtattagcatctgagaaaatacagaaatcgattctg

SEQ ID NO: 262681 - DNA, 45 bp, Artificial Sequence
  Description of Artificial Sequence: Synthetic oligonucleotide
aatggtgtcgtattagcatctgagaaaatacagaaatcgattctg

SEQ ID NO: 262682 - DNA, 44 bp, Artificial Sequence
  Description of Artificial Sequence: Synthetic oligonucleotide
atggtgtcgtattagcatctgagaaaatacagaaatcgattctg

SEQ ID NO: 262683 - DNA, 43 bp, Artificial Sequence
  Description of Artificial Sequence: Synthetic oligonucleotide
tggtgtcgtattagcatctgagaaaatacagaaatcgattctg

SEQ ID NO: 262684 - DNA, 42 bp, Artificial Sequence
  Description of Artificial Sequence: Synthetic oligonucleotide
ggtgtcgtattagcatctgagaaaatacagaaatcgattctg

SEQ ID NO: 262685 - DNA, 45 bp, Artificial Sequence
  Description of Artificial Sequence: Synthetic oligonucleotide
gtgtcgtattagcatctgagaaaatacagaaatcgattctgtatc

SEQ ID NO: 262686 - DNA, 47 bp, Artificial Sequence
  Description of Artificial Sequence: Synthetic oligonucleotide
tgtcgtattagcatctgagaaaatacagaaatcgattctgtatcatg

SEQ ID NO: 262687 - DNA, 46 bp, Artificial Sequence
  Description of Artificial Sequence: Synthetic oligonucleotide
gtcgtattagcatctgagaaaatacagaaatcgattctgtatcatg

SEQ ID NO: 262688 - DNA, 47 bp, Artificial Sequence
  Description of Artificial Sequence: Synthetic oligonucleotide
tcgtattagcatctgagaaaatacagaaatcgattctgtatcatgag

SEQ ID NO: 262689 - DNA, 46 bp, Artificial Sequence
  Description of Artificial Sequence: Synthetic oligonucleotide
cgtattagcatctgagaaaatacagaaatcgattctgtatcatgag

SEQ ID NO: 262690 - DNA, 46 bp, Artificial Sequence
  Description of Artificial Sequence: Synthetic oligonucleotide
gtattagcatctgagaaaatacagaaatcgattctgtatcatgagc

SEQ ID NO: 262691 - DNA, 46 bp, Artificial Sequence
  Description of Artificial Sequence: Synthetic oligonucleotide
tattagcatctgagaaaatacagaaatcgattctgtatcatgagcg

SEQ ID NO: 262692 - DNA, 45 bp, Artificial Sequence
  Description of Artificial Sequence: Synthetic oligonucleotide
attagcatctgagaaaatacagaaatcgattctgtatcatgagcg

SEQ ID NO: 262693 - DNA, 44 bp, Artificial Sequence
  Description of Artificial Sequence: Synthetic oligonucleotide
ttagcatctgagaaaatacagaaatcgattctgtatcatgagcg

SEQ ID NO: 262694 - DNA, 43 bp, Artificial Sequence
  Description of Artificial Sequence: Synthetic oligonucleotide
tagcatctgagaaaatacagaaatcgattctgtatcatgagcg

SEQ ID NO: 262695 - DNA, 42 bp, Artificial Sequence
  Description of Artificial Sequence: Synthetic oligonucleotide
agcatctgagaaaatacagaaatcgattctgtatcatgagcg

SEQ ID NO: 262696 - DNA, 41 bp, Artificial Sequence
  Description of Artificial Sequence: Synthetic oligonucleotide
gcatctgagaaaatacagaaatcgattctgtatcatgagcg

SEQ ID NO: 262697 - DNA, 43 bp, Artificial Sequence
  Description of Artificial Sequence: Synthetic oligonucleotide
catctgagaaaatacagaaatcgattctgtatcatgagcgaac

SEQ ID NO: 262698 - DNA, 44 bp, Artificial Sequence
  Description of Artificial Sequence: Synthetic oligonucleotide
atctgagaaaatacagaaatcgattctgtatcatgagcgaactg

SEQ ID NO: 262699 - DNA, 43 bp, Artificial Sequence
  Description of Artificial Sequence: Synthetic oligonucleotide
tctgagaaaatacagaaatcgattctgtatcatgagcgaactg

SEQ ID NO: 262700 - DNA, 42 bp, Artificial Sequence
  Description of Artificial Sequence: Synthetic oligonucleotide
ctgagaaaatacagaaatcgattctgtatcatgagcgaactg

SEQ ID NO: 262701 - DNA, 44 bp, Artificial Sequence
  Description of Artificial Sequence: Synthetic oligonucleotide
tgagaaaatacagaaatcgattctgtatcatgagcgaactgtac

SEQ ID NO: 262702 - DNA, 43 bp, Artificial Sequence
  Description of Artificial Sequence: Synthetic oligonucleotide
gagaaaatacagaaatcgattctgtatcatgagcgaactgtac

SEQ ID NO: 262703 - DNA, 44 bp, Artificial Sequence
  Description of Artificial Sequence: Synthetic oligonucleotide
agaaaatacagaaatcgattctgtatcatgagcgaactgtacac

SEQ ID NO: 262704 - DNA, 43 bp, Artificial Sequence
  Description of Artificial Sequence: Synthetic oligonucleotide
gaaaatacagaaatcgattctgtatcatgagcgaactgtacac

SEQ ID NO: 262705 - DNA, 46 bp, Artificial Sequence
  Description of Artificial Sequence: Synthetic oligonucleotide
aaaatacagaaatcgattctgtatcatgagcgaactgtacacaatg

SEQ ID NO: 262706 - DNA, 45 bp, Artificial Sequence
  Description of Artificial Sequence: Synthetic oligonucleotide
aaatacagaaatcgattctgtatcatgagcgaactgtacacaatg

SEQ ID NO: 262707 - DNA, 44 bp, Artificial Sequence
  Description of Artificial Sequence: Synthetic oligonucleotide
aatacagaaatcgattctgtatcatgagcgaactgtacacaatg

SEQ ID NO: 262708 - DNA, 43 bp, Artificial Sequence
  Description of Artificial Sequence: Synthetic oligonucleotide
atacagaaatcgattctgtatcatgagcgaactgtacacaatg

SEQ ID NO: 262709 - DNA, 42 bp, Artificial Sequence
  Description of Artificial Sequence: Synthetic oligonucleotide
tacagaaatcgattctgtatcatgagcgaactgtacacaatg

SEQ ID NO: 262710 - DNA, 41 bp, Artificial Sequence
  Description of Artificial Sequence: Synthetic oligonucleotide
acagaaatcgattctgtatcatgagcgaactgtacacaatg

SEQ ID NO: 262711 - DNA, 40 bp, Artificial Sequence
  Description of Artificial Sequence: Synthetic oligonucleotide
cagaaatcgattctgtatcatgagcgaactgtacacaatg

SEQ ID NO: 262712 - DNA, 42 bp, Artificial Sequence
  Description of Artificial Sequence: Synthetic oligonucleotide
agaaatcgattctgtatcatgagcgaactgtacacaatgtag

SEQ ID NO: 262713 - DNA, 41 bp, Artificial Sequence
  Description of Artificial Sequence: Synthetic oligonucleotide
gaaatcgattctgtatcatgagcgaactgtacacaatgtag

SEQ ID NO: 262714 - DNA, 43 bp, Artificial Sequence
  Description of Artificial Sequence: Synthetic oligonucleotide
aaatcgattctgtatcatgagcgaactgtacacaatgtagaac

SEQ ID NO: 262715 - DNA, 42 bp, Artificial Sequence
  Description of Artificial Sequence: Synthetic oligonucleotide
aatcgattctgtatcatgagcgaactgtacacaatgtagaac

SEQ ID NO: 262716 - DNA, 41 bp, Artificial Sequence
  Description of Artificial Sequence: Synthetic oligonucleotide
atcgattctgtatcatgagcgaactgtacacaatgtagaac

SEQ ID NO: 262717 - DNA, 40 bp, Artificial Sequence
  Description of Artificial Sequence: Synthetic oligonucleotide
tcgattctgtatcatgagcgaactgtacacaatgtagaac

SEQ ID NO: 262718 - DNA, 39 bp, Artificial Sequence
  Description of Artificial Sequence: Synthetic oligonucleotide
cgattctgtatcatgagcgaactgtacacaatgtagaac

SEQ ID NO: 262719 - DNA, 39 bp, Artificial Sequence
  Description of Artificial Sequence: Synthetic oligonucleotide
gattctgtatcatgagcgaactgtacacaatgtagaacc

SEQ ID NO: 262720 - DNA, 44 bp, Artificial Sequence
  Description of Artificial Sequence: Synthetic oligonucleotide
attctgtatcatgagcgaactgtacacaatgtagaaccatttac

SEQ ID NO: 262721 - DNA, 43 bp, Artificial Sequence
  Description of Artificial Sequence: Synthetic oligonucleotide
ttctgtatcatgagcgaactgtacacaatgtagaaccatttac

SEQ ID NO: 262722 - DNA, 42 bp, Artificial Sequence
  Description of Artificial Sequence: Synthetic oligonucleotide
tctgtatcatgagcgaactgtacacaatgtagaaccatttac

SEQ ID NO: 262723 - DNA, 41 bp, Artificial Sequence
  Description of Artificial Sequence: Synthetic oligonucleotide
ctgtatcatgagcgaactgtacacaatgtagaaccatttac

SEQ ID NO: 262724 - DNA, 41 bp, Artificial Sequence
  Description of Artificial Sequence: Synthetic oligonucleotide
tgtatcatgagcgaactgtacacaatgtagaaccatttacc

SEQ ID NO: 262725 - DNA, 40 bp, Artificial Sequence
  Description of Artificial Sequence: Synthetic oligonucleotide
gtatcatgagcgaactgtacacaatgtagaaccatttacc

SEQ ID NO: 262726 - DNA, 42 bp, Artificial Sequence
  Description of Artificial Sequence: Synthetic oligonucleotide
tatcatgagcgaactgtacacaatgtagaaccatttaccaag

SEQ ID NO: 262727 - DNA, 41 bp, Artificial Sequence
  Description of Artificial Sequence: Synthetic oligonucleotide
atcatgagcgaactgtacacaatgtagaaccatttaccaag

SEQ ID NO: 262728 - DNA, 40 bp, Artificial Sequence
  Description of Artificial Sequence: Synthetic oligonucleotide
tcatgagcgaactgtacacaatgtagaaccatttaccaag

SEQ ID NO: 262729 - DNA, 39 bp, Artificial Sequence
  Description of Artificial Sequence: Synthetic oligonucleotide
catgagcgaactgtacacaatgtagaaccatttaccaag

SEQ ID NO: 262730 - DNA, 39 bp, Artificial Sequence
  Description of Artificial Sequence: Synthetic oligonucleotide
atgagcgaactgtacacaatgtagaaccatttaccaagc

SEQ ID NO: 262731 - DNA, 38 bp, Artificial Sequence
  Description of Artificial Sequence: Synthetic oligonucleotide
tgagcgaactgtacacaatgtagaaccatttaccaagc

SEQ ID NO: 262732 - DNA, 37 bp, Artificial Sequence
  Description of Artificial Sequence: Synthetic oligonucleotide
gagcgaactgtacacaatgtagaaccatttaccaagc

SEQ ID NO: 262733 - DNA, 42 bp, Artificial Sequence
  Description of Artificial Sequence: Synthetic oligonucleotide
agcgaactgtacacaatgtagaaccatttaccaagcttatag

SEQ ID NO: 262734 - DNA, 41 bp, Artificial Sequence
  Description of Artificial Sequence: Synthetic oligonucleotide
gcgaactgtacacaatgtagaaccatttaccaagcttatag

SEQ ID NO: 262735 - DNA, 41 bp, Artificial Sequence
  Description of Artificial Sequence: Synthetic oligonucleotide
cgaactgtacacaatgtagaaccatttaccaagcttatagg

SEQ ID NO: 262736 - DNA, 44 bp, Artificial Sequence
  Description of Artificial Sequence: Synthetic oligonucleotide
gaactgtacacaatgtagaaccatttaccaagcttataggtttc

SEQ ID NO: 262737 - DNA, 44 bp, Artificial Sequence
  Description of Artificial Sequence: Synthetic oligonucleotide
aactgtacacaatgtagaaccatttaccaagcttataggtttcg

SEQ ID NO: 262738 - DNA, 43 bp, Artificial Sequence
  Description of Artificial Sequence: Synthetic oligonucleotide
actgtacacaatgtagaaccatttaccaagcttataggtttcg

SEQ ID NO: 262739 - DNA, 42 bp, Artificial Sequence
  Description of Artificial Sequence: Synthetic oligonucleotide
ctgtacacaatgtagaaccatttaccaagcttataggtttcg

SEQ ID NO: 262740 - DNA, 43 bp, Artificial Sequence
  Description of Artificial Sequence: Synthetic oligonucleotide
tgtacacaatgtagaaccatttaccaagcttataggtttcgtg

SEQ ID NO: 262741 - DNA, 42 bp, Artificial Sequence
  Description of Artificial Sequence: Synthetic oligonucleotide
gtacacaatgtagaaccatttaccaagcttataggtttcgtg

SEQ ID NO: 262742 - DNA, 44 bp, Artificial Sequence
  Description of Artificial Sequence: Synthetic oligonucleotide
tacacaatgtagaaccatttaccaagcttataggtttcgtgtac

SEQ ID NO: 262743 - DNA, 43 bp, Artificial Sequence
  Description of Artificial Sequence: Synthetic oligonucleotide
acacaatgtagaaccatttaccaagcttataggtttcgtgtac

SEQ ID NO: 262744 - DNA, 42 bp, Artificial Sequence
  Description of Artificial Sequence: Synthetic oligonucleotide
cacaatgtagaaccatttaccaagcttataggtttcgtgtac

SEQ ID NO: 262745 - DNA, 43 bp, Artificial Sequence
  Description of Artificial Sequence: Synthetic oligonucleotide
acaatgtagaaccatttaccaagcttataggtttcgtgtacag

SEQ ID NO: 262746 - DNA, 42 bp, Artificial Sequence
  Description of Artificial Sequence: Synthetic oligonucleotide
caatgtagaaccatttaccaagcttataggtttcgtgtacag

SEQ ID NO: 262747 - DNA, 43 bp, Artificial Sequence
  Description of Artificial Sequence: Synthetic oligonucleotide
aatgtagaaccatttaccaagcttataggtttcgtgtacagtc

SEQ ID NO: 262748 - DNA, 42 bp, Artificial Sequence
  Description of Artificial Sequence: Synthetic oligonucleotide
atgtagaaccatttaccaagcttataggtttcgtgtacagtc

SEQ ID NO: 262749 - DNA, 41 bp, Artificial Sequence
  Description of Artificial Sequence: Synthetic oligonucleotide
tgtagaaccatttaccaagcttataggtttcgtgtacagtc

SEQ ID NO: 262750 - DNA, 40 bp, Artificial Sequence
  Description of Artificial Sequence: Synthetic oligonucleotide
gtagaaccatttaccaagcttataggtttcgtgtacagtc

SEQ ID NO: 262751 - DNA, 40 bp, Artificial Sequence
  Description of Artificial Sequence: Synthetic oligonucleotide
tagaaccatttaccaagcttataggtttcgtgtacagtcg

SEQ ID NO: 262752 - DNA, 39 bp, Artificial Sequence
  Description of Artificial Sequence: Synthetic oligonucleotide
agaaccatttaccaagcttataggtttcgtgtacagtcg

SEQ ID NO: 262753 - DNA, 38 bp, Artificial Sequence
  Description of Artificial Sequence: Synthetic oligonucleotide
gaaccatttaccaagcttataggtttcgtgtacagtcg

SEQ ID NO: 262754 - DNA, 38 bp, Artificial Sequence
  Description of Artificial Sequence: Synthetic oligonucleotide
aaccatttaccaagcttataggtttcgtgtacagtcgc

SEQ ID NO: 262755 - DNA, 37 bp, Artificial Sequence
  Description of Artificial Sequence: Synthetic oligonucleotide
accatttaccaagcttataggtttcgtgtacagtcgc

SEQ ID NO: 262756 - DNA, 36 bp, Artificial Sequence
  Description of Artificial Sequence: Synthetic oligonucleotide
ccatttaccaagcttataggtttcgtgtacagtcgc

SEQ ID NO: 262757 - DNA, 38 bp, Artificial Sequence
  Description of Artificial Sequence: Synthetic oligonucleotide
catttaccaagcttataggtttcgtgtacagtcgcatg

SEQ ID NO: 262758 - DNA, 38 bp, Artificial Sequence
  Description of Artificial Sequence: Synthetic oligonucleotide
atttaccaagcttataggtttcgtgtacagtcgcatgg

SEQ ID NO: 262759 - DNA, 37 bp, Artificial Sequence
  Description of Artificial Sequence: Synthetic oligonucleotide
tttaccaagcttataggtttcgtgtacagtcgcatgg

SEQ ID NO: 262760 - DNA, 36 bp, Artificial Sequence
  Description of Artificial Sequence: Synthetic oligonucleotide
ttaccaagcttataggtttcgtgtacagtcgcatgg

SEQ ID NO: 262761 - DNA, 35 bp, Artificial Sequence
  Description of Artificial Sequence: Synthetic oligonucleotide
taccaagcttataggtttcgtgtacagtcgcatgg

SEQ ID NO: 262762 - DNA, 34 bp, Artificial Sequence
  Description of Artificial Sequence: Synthetic oligonucleotide
accaagcttataggtttcgtgtacagtcgcatgg

SEQ ID NO: 262763 - DNA, 33 bp, Artificial Sequence
  Description of Artificial Sequence: Synthetic oligonucleotide
ccaagcttataggtttcgtgtacagtcgcatgg

SEQ ID NO: 262764 - DNA, 33 bp, Artificial Sequence
  Description of Artificial Sequence: Synthetic oligonucleotide
caagcttataggtttcgtgtacagtcgcatggg

SEQ ID NO: 262765 - DNA, 33 bp, Artificial Sequence
  Description of Artificial Sequence: Synthetic oligonucleotide
aagcttataggtttcgtgtacagtcgcatgggc

SEQ ID NO: 262766 - DNA, 32 bp, Artificial Sequence
  Description of Artificial Sequence: Synthetic oligonucleotide
agcttataggtttcgtgtacagtcgcatgggc

SEQ ID NO: 262767 - DNA, 31 bp, Artificial Sequence
  Description of Artificial Sequence: Synthetic oligonucleotide
gcttataggtttcgtgtacagtcgcatgggc

SEQ ID NO: 262768 - DNA, 31 bp, Artificial Sequence
  Description of Artificial Sequence: Synthetic oligonucleotide
cttataggtttcgtgtacagtcgcatgggcc

SEQ ID NO: 262769 - DNA, 31 bp, Artificial Sequence
  Description of Artificial Sequence: Synthetic oligonucleotide
ttataggtttcgtgtacagtcgcatgggccg

SEQ ID NO: 262770 - DNA, 30 bp, Artificial Sequence
  Description of Artificial Sequence: Synthetic oligonucleotide
tataggtttcgtgtacagtcgcatgggccg

SEQ ID NO: 262771 - DNA, 29 bp, Artificial Sequence
  Description of Artificial Sequence: Synthetic oligonucleotide
ataggtttcgtgtacagtcgcatgggccg

SEQ ID NO: 262772 - DNA, 28 bp, Artificial Sequence
  Description of Artificial Sequence: Synthetic oligonucleotide
taggtttcgtgtacagtcgcatgggccg

SEQ ID NO: 262773 - DNA, 27 bp, Artificial Sequence
  Description of Artificial Sequence: Synthetic oligonucleotide
aggtttcgtgtacagtcgcatgggccg

SEQ ID NO: 262774 - DNA, 26 bp, Artificial Sequence
  Description of Artificial Sequence: Synthetic oligonucleotide
ggtttcgtgtacagtcgcatgggccg

SEQ ID NO: 262775 - DNA, 26 bp, Artificial Sequence
  Description of Artificial Sequence: Synthetic oligonucleotide
gtttcgtgtacagtcgcatgggccgc

SEQ ID NO: 262776 - DNA, 27 bp, Artificial Sequence
  Description of Artificial Sequence: Synthetic oligonucleotide
tttcgtgtacagtcgcatgggccgcga

SEQ ID NO: 262777 - DNA, 27 bp, Artificial Sequence
  Description of Artificial Sequence: Synthetic oligonucleotide
ttcgtgtacagtcgcatgggccgcgat

SEQ ID NO: 262778 - DNA, 27 bp, Artificial Sequence
  Description of Artificial Sequence: Synthetic oligonucleotide
tcgtgtacagtcgcatgggccgcgatt

SEQ ID NO: 262779 - DNA, 27 bp, Artificial Sequence
  Description of Artificial Sequence: Synthetic oligonucleotide
cgtgtacagtcgcatgggccgcgatta

SEQ ID NO: 262780 - DNA, 27 bp, Artificial Sequence
  Description of Artificial Sequence: Synthetic oligonucleotide
gtgtacagtcgcatgggccgcgattac

SEQ ID NO: 262781 - DNA, 28 bp, Artificial Sequence
  Description of Artificial Sequence: Synthetic oligonucleotide
tgtacagtcgcatgggccgcgattacag

SEQ ID NO: 262782 - DNA, 27 bp, Artificial Sequence
  Description of Artificial Sequence: Synthetic oligonucleotide
gtacagtcgcatgggccgcgattacag

SEQ ID NO: 262783 - DNA, 28 bp, Artificial Sequence
  Description of Artificial Sequence: Synthetic oligonucleotide
tacagtcgcatgggccgcgattacagtg

SEQ ID NO: 262784 - DNA, 27 bp, Artificial Sequence
  Description of Artificial Sequence: Synthetic oligonucleotide
acagtcgcatgggccgcgattacagtg

SEQ ID NO: 262785 - DNA, 27 bp, Artificial Sequence
  Description of Artificial Sequence: Synthetic oligonucleotide
cagtcgcatgggccgcgattacagtgt

SEQ ID NO: 262786 - DNA, 27 bp, Artificial Sequence
  Description of Artificial Sequence: Synthetic oligonucleotide
agtcgcatgggccgcgattacagtgtg

SEQ ID NO: 262787 - DNA, 26 bp, Artificial Sequence
  Description of Artificial Sequence: Synthetic oligonucleotide
gtcgcatgggccgcgattacagtgtg

SEQ ID NO: 262788 - DNA, 27 bp, Artificial Sequence
  Description of Artificial Sequence: Synthetic oligonucleotide
tcgcatgggccgcgattacagtgtgct

SEQ ID NO: 262789 - DNA, 27 bp, Artificial Sequence
  Description of Artificial Sequence: Synthetic oligonucleotide
cgcatgggccgcgattacagtgtgctt

SEQ ID NO: 262790 - DNA, 27 bp, Artificial Sequence
  Description of Artificial Sequence: Synthetic oligonucleotide
gcatgggccgcgattacagtgtgcttg

SEQ ID NO: 262791 - DNA, 28 bp, Artificial Sequence
  Description of Artificial Sequence: Synthetic oligonucleotide
catgggccgcgattacagtgtgcttgtg

SEQ ID NO: 262792 - DNA, 28 bp, Artificial Sequence
  Description of Artificial Sequence: Synthetic oligonucleotide
atgggccgcgattacagtgtgcttgtgg

SEQ ID NO: 262793 - DNA, 27 bp, Artificial Sequence
  Description of Artificial Sequence: Synthetic oligonucleotide
tgggccgcgattacagtgtgcttgtgg

SEQ ID NO: 262794 - DNA, 27 bp, Artificial Sequence
  Description of Artificial Sequence: Synthetic oligonucleotide
gggccgcgattacagtgtgcttgtgga

SEQ ID NO: 262795 - DNA, 27 bp, Artificial Sequence
  Description of Artificial Sequence: Synthetic oligonucleotide
ggccgcgattacagtgtgcttgtggac

SEQ ID NO: 262796 - DNA, 28 bp, Artificial Sequence
  Description of Artificial Sequence: Synthetic oligonucleotide
gccgcgattacagtgtgcttgtggacag

SEQ ID NO: 262797 - DNA, 29 bp, Artificial Sequence
  Description of Artificial Sequence: Synthetic oligonucleotide
ccgcgattacagtgtgcttgtggacagag

SEQ ID NO: 262798 - DNA, 29 bp, Artificial Sequence
  Description of Artificial Sequence: Synthetic oligonucleotide
cgcgattacagtgtgcttgtggacagagc

SEQ ID NO: 262799 - DNA, 30 bp, Artificial Sequence
  Description of Artificial Sequence: Synthetic oligonucleotide
gcgattacagtgtgcttgtggacagagctc

SEQ ID NO: 262800 - DNA, 30 bp, Artificial Sequence
  Description of Artificial Sequence: Synthetic oligonucleotide
cgattacagtgtgcttgtggacagagctcc

SEQ ID NO: 262801 - DNA, 34 bp, Artificial Sequence
  Description of Artificial Sequence: Synthetic oligonucleotide
gattacagtgtgcttgtggacagagctccaaaac

SEQ ID NO: 262802 - DNA, 36 bp, Artificial Sequence
  Description of Artificial Sequence: Synthetic oligonucleotide
attacagtgtgcttgtggacagagctccaaaactag

SEQ ID NO: 262803 - DNA, 35 bp, Artificial Sequence
  Description of Artificial Sequence: Synthetic oligonucleotide
ttacagtgtgcttgtggacagagctccaaaactag

SEQ ID NO: 262804 - DNA, 34 bp, Artificial Sequence
  Description of Artificial Sequence: Synthetic oligonucleotide
tacagtgtgcttgtggacagagctccaaaactag

SEQ ID NO: 262805 - DNA, 33 bp, Artificial Sequence
  Description of Artificial Sequence: Synthetic oligonucleotide
acagtgtgcttgtggacagagctccaaaactag

SEQ ID NO: 262806 - DNA, 32 bp, Artificial Sequence
  Description of Artificial Sequence: Synthetic oligonucleotide
cagtgtgcttgtggacagagctccaaaactag

SEQ ID NO: 262807 - DNA, 32 bp, Artificial Sequence
  Description of Artificial Sequence: Synthetic oligonucleotide
agtgtgcttgtggacagagctccaaaactagc

SEQ ID NO: 262808 - DNA, 31 bp, Artificial Sequence
  Description of Artificial Sequence: Synthetic oligonucleotide
gtgtgcttgtggacagagctccaaaactagc

SEQ ID NO: 262809 - DNA, 32 bp, Artificial Sequence
  Description of Artificial Sequence: Synthetic oligonucleotide
tgtgcttgtggacagagctccaaaactagcac

SEQ ID NO: 262810 - DNA, 31 bp, Artificial Sequence
  Description of Artificial Sequence: Synthetic oligonucleotide
gtgcttgtggacagagctccaaaactagcac

SEQ ID NO: 262811 - DNA, 33 bp, Artificial Sequence
  Description of Artificial Sequence: Synthetic oligonucleotide
tgcttgtggacagagctccaaaactagcacaac

SEQ ID NO: 262812 - DNA, 32 bp, Artificial Sequence
  Description of Artificial Sequence: Synthetic oligonucleotide
gcttgtggacagagctccaaaactagcacaac

SEQ ID NO: 262813 - DNA, 36 bp, Artificial Sequence
  Description of Artificial Sequence: Synthetic oligonucleotide
cttgtggacagagctccaaaactagcacaacaatac

SEQ ID NO: 262814 - DNA, 39 bp, Artificial Sequence
  Description of Artificial Sequence: Synthetic oligonucleotide
ttgtggacagagctccaaaactagcacaacaatacaatc

SEQ ID NO: 262815 - DNA, 38 bp, Artificial Sequence
  Description of Artificial Sequence: Synthetic oligonucleotide
tgtggacagagctccaaaactagcacaacaatacaatc

SEQ ID NO: 262816 - DNA, 37 bp, Artificial Sequence
  Description of Artificial Sequence: Synthetic oligonucleotide
gtggacagagctccaaaactagcacaacaatacaatc

SEQ ID NO: 262817 - DNA, 39 bp, Artificial Sequence
  Description of Artificial Sequence: Synthetic oligonucleotide
tggacagagctccaaaactagcacaacaatacaatcttg

SEQ ID NO: 262818 - DNA, 38 bp, Artificial Sequence
  Description of Artificial Sequence: Synthetic oligonucleotide
ggacagagctccaaaactagcacaacaatacaatcttg

SEQ ID NO: 262819 - DNA, 39 bp, Artificial Sequence
  Description of Artificial Sequence: Synthetic oligonucleotide
gacagagctccaaaactagcacaacaatacaatcttgtg

SEQ ID NO: 262820 - DNA, 41 bp, Artificial Sequence
  Description of Artificial Sequence: Synthetic oligonucleotide
acagagctccaaaactagcacaacaatacaatcttgtgttc

SEQ ID NO: 262821 - DNA, 40 bp, Artificial Sequence
  Description of Artificial Sequence: Synthetic oligonucleotide
cagagctccaaaactagcacaacaatacaatcttgtgttc

SEQ ID NO: 262822 - DNA, 40 bp, Artificial Sequence
  Description of Artificial Sequence: Synthetic oligonucleotide
agagctccaaaactagcacaacaatacaatcttgtgttcc

SEQ ID NO: 262823 - DNA, 39 bp, Artificial Sequence
  Description of Artificial Sequence: Synthetic oligonucleotide
gagctccaaaactagcacaacaatacaatcttgtgttcc

SEQ ID NO: 262824 - DNA, 41 bp, Artificial Sequence
  Description of Artificial Sequence: Synthetic oligonucleotide
agctccaaaactagcacaacaatacaatcttgtgttccaag

SEQ ID NO: 262825 - DNA, 40 bp, Artificial Sequence
  Description of Artificial Sequence: Synthetic oligonucleotide
gctccaaaactagcacaacaatacaatcttgtgttccaag

SEQ ID NO: 262826 - DNA, 42 bp, Artificial Sequence
  Description of Artificial Sequence: Synthetic oligonucleotide
ctccaaaactagcacaacaatacaatcttgtgttccaagaac

SEQ ID NO: 262827 - DNA, 42 bp, Artificial Sequence
  Description of Artificial Sequence: Synthetic oligonucleotide
tccaaaactagcacaacaatacaatcttgtgttccaagaacc

SEQ ID NO: 262828 - DNA, 41 bp, Artificial Sequence
  Description of Artificial Sequence: Synthetic oligonucleotide
ccaaaactagcacaacaatacaatcttgtgttccaagaacc

SEQ ID NO: 262829 - DNA, 41 bp, Artificial Sequence
  Description of Artificial Sequence: Synthetic oligonucleotide
caaaactagcacaacaatacaatcttgtgttccaagaaccg

SEQ ID NO: 262830 - DNA, 44 bp, Artificial Sequence
  Description of Artificial Sequence: Synthetic oligonucleotide
aaaactagcacaacaatacaatcttgtgttccaagaaccgattc

SEQ ID NO: 262831 - DNA, 43 bp, Artificial Sequence
  Description of Artificial Sequence: Synthetic oligonucleotide
aaactagcacaacaatacaatcttgtgttccaagaaccgattc

SEQ ID NO: 262832 - DNA, 42 bp, Artificial Sequence
  Description of Artificial Sequence: Synthetic oligonucleotide
aactagcacaacaatacaatcttgtgttccaagaaccgattc

SEQ ID NO: 262833 - DNA, 41 bp, Artificial Sequence
  Description of Artificial Sequence: Synthetic oligonucleotide
actagcacaacaatacaatcttgtgttccaagaaccgattc

SEQ ID NO: 262834 - DNA, 40 bp, Artificial Sequence
  Description of Artificial Sequence: Synthetic oligonucleotide
ctagcacaacaatacaatcttgtgttccaagaaccgattc

SEQ ID NO: 262835 - DNA, 40 bp, Artificial Sequence
  Description of Artificial Sequence: Synthetic oligonucleotide
tagcacaacaatacaatcttgtgttccaagaaccgattcc

SEQ ID NO: 262836 - DNA, 39 bp, Artificial Sequence
  Description of Artificial Sequence: Synthetic oligonucleotide
agcacaacaatacaatcttgtgttccaagaaccgattcc

SEQ ID NO: 262837 - DNA, 38 bp, Artificial Sequence
  Description of Artificial Sequence: Synthetic oligonucleotide
gcacaacaatacaatcttgtgttccaagaaccgattcc

SEQ ID NO: 262838 - DNA, 40 bp, Artificial Sequence
  Description of Artificial Sequence: Synthetic oligonucleotide
cacaacaatacaatcttgtgttccaagaaccgattcctac

SEQ ID NO: 262839 - DNA, 41 bp, Artificial Sequence
  Description of Artificial Sequence: Synthetic oligonucleotide
acaacaatacaatcttgtgttccaagaaccgattcctacac

SEQ ID NO: 262840 - DNA, 40 bp, Artificial Sequence
  Description of Artificial Sequence: Synthetic oligonucleotide
caacaatacaatcttgtgttccaagaaccgattcctacac

SEQ ID NO: 262841 - DNA, 40 bp, Artificial Sequence
  Description of Artificial Sequence: Synthetic oligonucleotide
aacaatacaatcttgtgttccaagaaccgattcctacacc

SEQ ID NO: 262842 - DNA, 39 bp, Artificial Sequence
  Description of Artificial Sequence: Synthetic oligonucleotide
acaatacaatcttgtgttccaagaaccgattcctacacc

SEQ ID NO: 262843 - DNA, 38 bp, Artificial Sequence
  Description of Artificial Sequence: Synthetic oligonucleotide
caatacaatcttgtgttccaagaaccgattcctacacc

SEQ ID NO: 262844 - DNA, 39 bp, Artificial Sequence
  Description of Artificial Sequence: Synthetic oligonucleotide
aatacaatcttgtgttccaagaaccgattcctacacctc

SEQ ID NO: 262845 - DNA, 38 bp, Artificial Sequence
  Description of Artificial Sequence: Synthetic oligonucleotide
atacaatcttgtgttccaagaaccgattcctacacctc

SEQ ID NO: 262846 - DNA, 37 bp, Artificial Sequence
  Description of Artificial Sequence: Synthetic oligonucleotide
tacaatcttgtgttccaagaaccgattcctacacctc

SEQ ID NO: 262847 - DNA, 36 bp, Artificial Sequence
  Description of Artificial Sequence: Synthetic oligonucleotide
acaatcttgtgttccaagaaccgattcctacacctc

SEQ ID NO: 262848 - DNA, 35 bp, Artificial Sequence
  Description of Artificial Sequence: Synthetic oligonucleotide
caatcttgtgttccaagaaccgattcctacacctc

SEQ ID NO: 262849 - DNA, 36 bp, Artificial Sequence
  Description of Artificial Sequence: Synthetic oligonucleotide
aatcttgtgttccaagaaccgattcctacacctcag

SEQ ID NO: 262850 - DNA, 35 bp, Artificial Sequence
  Description of Artificial Sequence: Synthetic oligonucleotide
atcttgtgttccaagaaccgattcctacacctcag

SEQ ID NO: 262851 - DNA, 34 bp, Artificial Sequence
  Description of Artificial Sequence: Synthetic oligonucleotide
tcttgtgttccaagaaccgattcctacacctcag

SEQ ID NO: 262852 - DNA, 33 bp, Artificial Sequence
  Description of Artificial Sequence: Synthetic oligonucleotide
cttgtgttccaagaaccgattcctacacctcag

SEQ ID NO: 262853 - DNA, 33 bp, Artificial Sequence
  Description of Artificial Sequence: Synthetic oligonucleotide
ttgtgttccaagaaccgattcctacacctcagc

SEQ ID NO: 262854 - DNA, 32 bp, Artificial Sequence
  Description of Artificial Sequence: Synthetic oligonucleotide
tgtgttccaagaaccgattcctacacctcagc

SEQ ID NO: 262855 - DNA, 31 bp, Artificial Sequence
  Description of Artificial Sequence: Synthetic oligonucleotide
gtgttccaagaaccgattcctacacctcagc

SEQ ID NO: 262856 - DNA, 32 bp, Artificial Sequence
  Description of Artificial Sequence: Synthetic oligonucleotide
tgttccaagaaccgattcctacacctcagctg

SEQ ID NO: 262857 - DNA, 31 bp, Artificial Sequence
  Description of Artificial Sequence: Synthetic oligonucleotide
gttccaagaaccgattcctacacctcagctg

SEQ ID NO: 262858 - DNA, 31 bp, Artificial Sequence
  Description of Artificial Sequence: Synthetic oligonucleotide
ttccaagaaccgattcctacacctcagctgg

SEQ ID NO: 262859 - DNA, 30 bp, Artificial Sequence
  Description of Artificial Sequence: Synthetic oligonucleotide
tccaagaaccgattcctacacctcagctgg

SEQ ID NO: 262860 - DNA, 29 bp, Artificial Sequence
  Description of Artificial Sequence: Synthetic oligonucleotide
ccaagaaccgattcctacacctcagctgg

SEQ ID NO: 262861 - DNA, 31 bp, Artificial Sequence
  Description of Artificial Sequence: Synthetic oligonucleotide
caagaaccgattcctacacctcagctggaac

SEQ ID NO: 262862 - DNA, 32 bp, Artificial Sequence
  Description of Artificial Sequence: Synthetic oligonucleotide
aagaaccgattcctacacctcagctggaacag

SEQ ID NO: 262863 - DNA, 31 bp, Artificial Sequence
  Description of Artificial Sequence: Synthetic oligonucleotide
agaaccgattcctacacctcagctggaacag

SEQ ID NO: 262864 - DNA, 30 bp, Artificial Sequence
  Description of Artificial Sequence: Synthetic oligonucleotide
gaaccgattcctacacctcagctggaacag

SEQ ID NO: 262865 - DNA, 31 bp, Artificial Sequence
  Description of Artificial Sequence: Synthetic oligonucleotide
aaccgattcctacacctcagctggaacagag

SEQ ID NO: 262866 - DNA, 30 bp, Artificial Sequence
  Description of Artificial Sequence: Synthetic oligonucleotide
accgattcctacacctcagctggaacagag

SEQ ID NO: 262867 - DNA, 29 bp, Artificial Sequence
  Description of Artificial Sequence: Synthetic oligonucleotide
ccgattcctacacctcagctggaacagag

SEQ ID NO: 262868 - DNA, 30 bp, Artificial Sequence
  Description of Artificial Sequence: Synthetic oligonucleotide
cgattcctacacctcagctggaacagagag

SEQ ID NO: 262869 - DNA, 32 bp, Artificial Sequence
  Description of Artificial Sequence: Synthetic oligonucleotide
gattcctacacctcagctggaacagagagttg

SEQ ID NO: 262870 - DNA, 32 bp, Artificial Sequence
  Description of Artificial Sequence: Synthetic oligonucleotide
attcctacacctcagctggaacagagagttgc

SEQ ID NO: 262871 - DNA, 31 bp, Artificial Sequence
  Description of Artificial Sequence: Synthetic oligonucleotide
ttcctacacctcagctggaacagagagttgc

SEQ ID NO: 262872 - DNA, 30 bp, Artificial Sequence
  Description of Artificial Sequence: Synthetic oligonucleotide
tcctacacctcagctggaacagagagttgc

SEQ ID NO: 262873 - DNA, 29 bp, Artificial Sequence
  Description of Artificial Sequence: Synthetic oligonucleotide
cctacacctcagctggaacagagagttgc

SEQ ID NO: 262874 - DNA, 31 bp, Artificial Sequence
  Description of Artificial Sequence: Synthetic oligonucleotide
ctacacctcagctggaacagagagttgcttc

SEQ ID NO: 262875 - DNA, 32 bp, Artificial Sequence
  Description of Artificial Sequence: Synthetic oligonucleotide
tacacctcagctggaacagagagttgcttctg

SEQ ID NO: 262876 - DNA, 31 bp, Artificial Sequence
  Description of Artificial Sequence: Synthetic oligonucleotide
acacctcagctggaacagagagttgcttctg

SEQ ID NO: 262877 - DNA, 30 bp, Artificial Sequence
  Description of Artificial Sequence: Synthetic oligonucleotide
cacctcagctggaacagagagttgcttctg

SEQ ID NO: 262878 - DNA, 31 bp, Artificial Sequence
  Description of Artificial Sequence: Synthetic oligonucleotide
acctcagctggaacagagagttgcttctgtg

SEQ ID NO: 262879 - DNA, 30 bp, Artificial Sequence
  Description of Artificial Sequence: Synthetic oligonucleotide
cctcagctggaacagagagttgcttctgtg

SEQ ID NO: 262880 - DNA, 32 bp, Artificial Sequence
  Description of Artificial Sequence: Synthetic oligonucleotide
ctcagctggaacagagagttgcttctgtgttg

SEQ ID NO: 262881 - DNA, 32 bp, Artificial Sequence
  Description of Artificial Sequence: Synthetic oligonucleotide
tcagctggaacagagagttgcttctgtgttgc

SEQ ID NO: 262882 - DNA, 31 bp, Artificial Sequence
  Description of Artificial Sequence: Synthetic oligonucleotide
cagctggaacagagagttgcttctgtgttgc

SEQ ID NO: 262883 - DNA, 33 bp, Artificial Sequence
  Description of Artificial Sequence: Synthetic oligonucleotide
agctggaacagagagttgcttctgtgttgcaag

SEQ ID NO: 262884 - DNA, 32 bp, Artificial Sequence
  Description of Artificial Sequence: Synthetic oligonucleotide
gctggaacagagagttgcttctgtgttgcaag

SEQ ID NO: 262885 - DNA, 38 bp, Artificial Sequence
  Description of Artificial Sequence: Synthetic oligonucleotide
ctggaacagagagttgcttctgtgttgcaagaatttac

SEQ ID NO: 262886 - DNA, 39 bp, Artificial Sequence
  Description of Artificial Sequence: Synthetic oligonucleotide
tggaacagagagttgcttctgtgttgcaagaatttactc

SEQ ID NO: 262887 - DNA, 38 bp, Artificial Sequence
  Description of Artificial Sequence: Synthetic oligonucleotide
ggaacagagagttgcttctgtgttgcaagaatttactc

SEQ ID NO: 262888 - DNA, 39 bp, Artificial Sequence
  Description of Artificial Sequence: Synthetic oligonucleotide
gaacagagagttgcttctgtgttgcaagaatttactcag

SEQ ID NO: 262889 - DNA, 40 bp, Artificial Sequence
  Description of Artificial Sequence: Synthetic oligonucleotide
aacagagagttgcttctgtgttgcaagaatttactcagtc

SEQ ID NO: 262890 - DNA, 39 bp, Artificial Sequence
  Description of Artificial Sequence: Synthetic oligonucleotide
acagagagttgcttctgtgttgcaagaatttactcagtc

SEQ ID NO: 262891 - DNA, 38 bp, Artificial Sequence
  Description of Artificial Sequence: Synthetic oligonucleotide
cagagagttgcttctgtgttgcaagaatttactcagtc

SEQ ID NO: 262892 - DNA, 39 bp, Artificial Sequence
  Description of Artificial Sequence: Synthetic oligonucleotide
agagagttgcttctgtgttgcaagaatttactcagtctg

SEQ ID NO: 262893 - DNA, 38 bp, Artificial Sequence
  Description of Artificial Sequence: Synthetic oligonucleotide
gagagttgcttctgtgttgcaagaatttactcagtctg

SEQ ID NO: 262894 - DNA, 38 bp, Artificial Sequence
  Description of Artificial Sequence: Synthetic oligonucleotide
agagttgcttctgtgttgcaagaatttactcagtctgg

SEQ ID NO: 262895 - DNA, 37 bp, Artificial Sequence
  Description of Artificial Sequence: Synthetic oligonucleotide
gagttgcttctgtgttgcaagaatttactcagtctgg

SEQ ID NO: 262896 - DNA, 38 bp, Artificial Sequence
  Description of Artificial Sequence: Synthetic oligonucleotide
agttgcttctgtgttgcaagaatttactcagtctggtg

SEQ ID NO: 262897 - DNA, 37 bp, Artificial Sequence
  Description of Artificial Sequence: Synthetic oligonucleotide
gttgcttctgtgttgcaagaatttactcagtctggtg

SEQ ID NO: 262898 - DNA, 37 bp, Artificial Sequence
  Description of Artificial Sequence: Synthetic oligonucleotide
ttgcttctgtgttgcaagaatttactcagtctggtgg

SEQ ID NO: 262899 - DNA, 36 bp, Artificial Sequence
  Description of Artificial Sequence: Synthetic oligonucleotide
tgcttctgtgttgcaagaatttactcagtctggtgg

SEQ ID NO: 262900 - DNA, 35 bp, Artificial Sequence
  Description of Artificial Sequence: Synthetic oligonucleotide
gcttctgtgttgcaagaatttactcagtctggtgg

SEQ ID NO: 262901 - DNA, 36 bp, Artificial Sequence
  Description of Artificial Sequence: Synthetic oligonucleotide
cttctgtgttgcaagaatttactcagtctggtggtg

SEQ ID NO: 262902 - DNA, 38 bp, Artificial Sequence
  Description of Artificial Sequence: Synthetic oligonucleotide
ttctgtgttgcaagaatttactcagtctggtggtgttg

SEQ ID NO: 262903 - DNA, 37 bp, Artificial Sequence
  Description of Artificial Sequence: Synthetic oligonucleotide
tctgtgttgcaagaatttactcagtctggtggtgttg

SEQ ID NO: 262904 - DNA, 36 bp, Artificial Sequence
  Description of Artificial Sequence: Synthetic oligonucleotide
ctgtgttgcaagaatttactcagtctggtggtgttg

SEQ ID NO: 262905 - DNA, 36 bp, Artificial Sequence
  Description of Artificial Sequence: Synthetic oligonucleotide
tgtgttgcaagaatttactcagtctggtggtgttgg

SEQ ID NO: 262906 - DNA, 35 bp, Artificial Sequence
  Description of Artificial Sequence: Synthetic oligonucleotide
gtgttgcaagaatttactcagtctggtggtgttgg

SEQ ID NO: 262907 - DNA, 36 bp, Artificial Sequence
  Description of Artificial Sequence: Synthetic oligonucleotide
tgttgcaagaatttactcagtctggtggtgttggtc

SEQ ID NO: 262908 - DNA, 35 bp, Artificial Sequence
  Description of Artificial Sequence: Synthetic oligonucleotide
gttgcaagaatttactcagtctggtggtgttggtc

SEQ ID NO: 262909 - DNA, 35 bp, Artificial Sequence
  Description of Artificial Sequence: Synthetic oligonucleotide
ttgcaagaatttactcagtctggtggtgttggtcc

SEQ ID NO: 262910 - DNA, 34 bp, Artificial Sequence
  Description of Artificial Sequence: Synthetic oligonucleotide
tgcaagaatttactcagtctggtggtgttggtcc

SEQ ID NO: 262911 - DNA, 33 bp, Artificial Sequence
  Description of Artificial Sequence: Synthetic oligonucleotide
gcaagaatttactcagtctggtggtgttggtcc

SEQ ID NO: 262912 - DNA, 37 bp, Artificial Sequence
  Description of Artificial Sequence: Synthetic oligonucleotide
caagaatttactcagtctggtggtgttggtccatttg

SEQ ID NO: 262913 - DNA, 37 bp, Artificial Sequence
  Description of Artificial Sequence: Synthetic oligonucleotide
aagaatttactcagtctggtggtgttggtccatttgc

SEQ ID NO: 262914 - DNA, 36 bp, Artificial Sequence
  Description of Artificial Sequence: Synthetic oligonucleotide
agaatttactcagtctggtggtgttggtccatttgc

SEQ ID NO: 262915 - DNA, 35 bp, Artificial Sequence
  Description of Artificial Sequence: Synthetic oligonucleotide
gaatttactcagtctggtggtgttggtccatttgc

SEQ ID NO: 262916 - DNA, 36 bp, Artificial Sequence
  Description of Artificial Sequence: Synthetic oligonucleotide
aatttactcagtctggtggtgttggtccatttgcag

SEQ ID NO: 262917 - DNA, 35 bp, Artificial Sequence
  Description of Artificial Sequence: Synthetic oligonucleotide
atttactcagtctggtggtgttggtccatttgcag

SEQ ID NO: 262918 - DNA, 34 bp, Artificial Sequence
  Description of Artificial Sequence: Synthetic oligonucleotide
tttactcagtctggtggtgttggtccatttgcag

SEQ ID NO: 262919 - DNA, 33 bp, Artificial Sequence
  Description of Artificial Sequence: Synthetic oligonucleotide
ttactcagtctggtggtgttggtccatttgcag

SEQ ID NO: 262920 - DNA, 32 bp, Artificial Sequence
  Description of Artificial Sequence: Synthetic oligonucleotide
tactcagtctggtggtgttggtccatttgcag

SEQ ID NO: 262921 - DNA, 31 bp, Artificial Sequence
  Description of Artificial Sequence: Synthetic oligonucleotide
actcagtctggtggtgttggtccatttgcag

SEQ ID NO: 262922 - DNA, 30 bp, Artificial Sequence
  Description of Artificial Sequence: Synthetic oligonucleotide
ctcagtctggtggtgttggtccatttgcag

SEQ ID NO: 262923 - DNA, 33 bp, Artificial Sequence
  Description of Artificial Sequence: Synthetic oligonucleotide
tcagtctggtggtgttggtccatttgcagtttc

SEQ ID NO: 262924 - DNA, 32 bp, Artificial Sequence
  Description of Artificial Sequence: Synthetic oligonucleotide
cagtctggtggtgttggtccatttgcagtttc

SEQ ID NO: 262925 - DNA, 36 bp, Artificial Sequence
  Description of Artificial Sequence: Synthetic oligonucleotide
agtctggtggtgttggtccatttgcagtttcttttc

SEQ ID NO: 262926 - DNA, 35 bp, Artificial Sequence
  Description of Artificial Sequence: Synthetic oligonucleotide
gtctggtggtgttggtccatttgcagtttcttttc

SEQ ID NO: 262927 - DNA, 41 bp, Artificial Sequence
  Description of Artificial Sequence: Synthetic oligonucleotide
tctggtggtgttggtccatttgcagtttcttttcttatttg

SEQ ID NO: 262928 - DNA, 40 bp, Artificial Sequence
  Description of Artificial Sequence: Synthetic oligonucleotide
ctggtggtgttggtccatttgcagtttcttttcttatttg

SEQ ID NO: 262929 - DNA, 41 bp, Artificial Sequence
  Description of Artificial Sequence: Synthetic oligonucleotide
tggtggtgttggtccatttgcagtttcttttcttatttgtc

SEQ ID NO: 262930 - DNA, 40 bp, Artificial Sequence
  Description of Artificial Sequence: Synthetic oligonucleotide
ggtggtgttggtccatttgcagtttcttttcttatttgtc

SEQ ID NO: 262931 - DNA, 40 bp, Artificial Sequence
  Description of Artificial Sequence: Synthetic oligonucleotide
gtggtgttggtccatttgcagtttcttttcttatttgtcg

SEQ ID NO: 262932 - DNA, 42 bp, Artificial Sequence
  Description of Artificial Sequence: Synthetic oligonucleotide
tggtgttggtccatttgcagtttcttttcttatttgtcgttg

SEQ ID NO: 262933 - DNA, 41 bp, Artificial Sequence
  Description of Artificial Sequence: Synthetic oligonucleotide
ggtgttggtccatttgcagtttcttttcttatttgtcgttg

SEQ ID NO: 262934 - DNA, 41 bp, Artificial Sequence
  Description of Artificial Sequence: Synthetic oligonucleotide
gtgttggtccatttgcagtttcttttcttatttgtcgttgg

SEQ ID NO: 262935 - DNA, 44 bp, Artificial Sequence
  Description of Artificial Sequence: Synthetic oligonucleotide
tgttggtccatttgcagtttcttttcttatttgtcgttggaatg

SEQ ID NO: 262936 - DNA, 43 bp, Artificial Sequence
  Description of Artificial Sequence: Synthetic oligonucleotide
gttggtccatttgcagtttcttttcttatttgtcgttggaatg

SEQ ID NO: 262937 - DNA, 44 bp, Artificial Sequence
  Description of Artificial Sequence: Synthetic oligonucleotide
ttggtccatttgcagtttcttttcttatttgtcgttggaatgtg

SEQ ID NO: 262938 - DNA, 43 bp, Artificial Sequence
  Description of Artificial Sequence: Synthetic oligonucleotide
tggtccatttgcagtttcttttcttatttgtcgttggaatgtg

SEQ ID NO: 262939 - DNA, 42 bp, Artificial Sequence
  Description of Artificial Sequence: Synthetic oligonucleotide
ggtccatttgcagtttcttttcttatttgtcgttggaatgtg

SEQ ID NO: 262940 - DNA, 42 bp, Artificial Sequence
  Description of Artificial Sequence: Synthetic oligonucleotide
gtccatttgcagtttcttttcttatttgtcgttggaatgtgg

SEQ ID NO: 262941 - DNA, 42 bp, Artificial Sequence
  Description of Artificial Sequence: Synthetic oligonucleotide
tccatttgcagtttcttttcttatttgtcgttggaatgtggg

SEQ ID NO: 262942 - DNA, 41 bp, Artificial Sequence
  Description of Artificial Sequence: Synthetic oligonucleotide
ccatttgcagtttcttttcttatttgtcgttggaatgtggg

SEQ ID NO: 262943 - DNA, 42 bp, Artificial Sequence
  Description of Artificial Sequence: Synthetic oligonucleotide
catttgcagtttcttttcttatttgtcgttggaatgtgggac

SEQ ID NO: 262944 - DNA, 42 bp, Artificial Sequence
  Description of Artificial Sequence: Synthetic oligonucleotide
atttgcagtttcttttcttatttgtcgttggaatgtgggacg

SEQ ID NO: 262945 - DNA, 41 bp, Artificial Sequence
  Description of Artificial Sequence: Synthetic oligonucleotide
tttgcagtttcttttcttatttgtcgttggaatgtgggacg

SEQ ID NO: 262946 - DNA, 40 bp, Artificial Sequence
  Description of Artificial Sequence: Synthetic oligonucleotide
ttgcagtttcttttcttatttgtcgttggaatgtgggacg

SEQ ID NO: 262947 - DNA, 39 bp, Artificial Sequence
  Description of Artificial Sequence: Synthetic oligonucleotide
tgcagtttcttttcttatttgtcgttggaatgtgggacg

SEQ ID NO: 262948 - DNA, 38 bp, Artificial Sequence
  Description of Artificial Sequence: Synthetic oligonucleotide
gcagtttcttttcttatttgtcgttggaatgtgggacg

SEQ ID NO: 262949 - DNA, 39 bp, Artificial Sequence
  Description of Artificial Sequence: Synthetic oligonucleotide
cagtttcttttcttatttgtcgttggaatgtgggacgac

SEQ ID NO: 262950 - DNA, 39 bp, Artificial Sequence
  Description of Artificial Sequence: Synthetic oligonucleotide
agtttcttttcttatttgtcgttggaatgtgggacgacc

SEQ ID NO: 262951 - DNA, 38 bp, Artificial Sequence
  Description of Artificial Sequence: Synthetic oligonucleotide
gtttcttttcttatttgtcgttggaatgtgggacgacc

SEQ ID NO: 262952 - DNA, 48 bp, Artificial Sequence
  Description of Artificial Sequence: Synthetic oligonucleotide
tttcttttcttatttgtcgttggaatgtgggacgaccttatttatttg

SEQ ID NO: 262953 - DNA, 47 bp, Artificial Sequence
  Description of Artificial Sequence: Synthetic oligonucleotide
ttcttttcttatttgtcgttggaatgtgggacgaccttatttatttg

SEQ ID NO: 262954 - DNA, 46 bp, Artificial Sequence
  Description of Artificial Sequence: Synthetic oligonucleotide
tcttttcttatttgtcgttggaatgtgggacgaccttatttatttg

SEQ ID NO: 262955 - DNA, 45 bp, Artificial Sequence
  Description of Artificial Sequence: Synthetic oligonucleotide
cttttcttatttgtcgttggaatgtgggacgaccttatttatttg

SEQ ID NO: 262956 - DNA, 46 bp, Artificial Sequence
  Description of Artificial Sequence: Synthetic oligonucleotide
ttttcttatttgtcgttggaatgtgggacgaccttatttatttgag

SEQ ID NO: 262957 - DNA, 45 bp, Artificial Sequence
  Description of Artificial Sequence: Synthetic oligonucleotide
tttcttatttgtcgttggaatgtgggacgaccttatttatttgag

SEQ ID NO: 262958 - DNA, 44 bp, Artificial Sequence
  Description of Artificial Sequence: Synthetic oligonucleotide
ttcttatttgtcgttggaatgtgggacgaccttatttatttgag

SEQ ID NO: 262959 - DNA, 43 bp, Artificial Sequence
  Description of Artificial Sequence: Synthetic oligonucleotide
tcttatttgtcgttggaatgtgggacgaccttatttatttgag

SEQ ID NO: 262960 - DNA, 42 bp, Artificial Sequence
  Description of Artificial Sequence: Synthetic oligonucleotide
cttatttgtcgttggaatgtgggacgaccttatttatttgag

SEQ ID NO: 262961 - DNA, 43 bp, Artificial Sequence
  Description of Artificial Sequence: Synthetic oligonucleotide
ttatttgtcgttggaatgtgggacgaccttatttatttgagtc

SEQ ID NO: 262962 - DNA, 42 bp, Artificial Sequence
  Description of Artificial Sequence: Synthetic oligonucleotide
tatttgtcgttggaatgtgggacgaccttatttatttgagtc

SEQ ID NO: 262963 - DNA, 41 bp, Artificial Sequence
  Description of Artificial Sequence: Synthetic oligonucleotide
atttgtcgttggaatgtgggacgaccttatttatttgagtc

SEQ ID NO: 262964 - DNA, 40 bp, Artificial Sequence
  Description of Artificial Sequence: Synthetic oligonucleotide
tttgtcgttggaatgtgggacgaccttatttatttgagtc

SEQ ID NO: 262965 - DNA, 39 bp, Artificial Sequence
  Description of Artificial Sequence: Synthetic oligonucleotide
ttgtcgttggaatgtgggacgaccttatttatttgagtc

SEQ ID NO: 262966 - DNA, 38 bp, Artificial Sequence
  Description of Artificial Sequence: Synthetic oligonucleotide
tgtcgttggaatgtgggacgaccttatttatttgagtc

SEQ ID NO: 262967 - DNA, 37 bp, Artificial Sequence
  Description of Artificial Sequence: Synthetic oligonucleotide
gtcgttggaatgtgggacgaccttatttatttgagtc

SEQ ID NO: 262968 - DNA, 38 bp, Artificial Sequence
  Description of Artificial Sequence: Synthetic oligonucleotide
tcgttggaatgtgggacgaccttatttatttgagtcag

SEQ ID NO: 262969 - DNA, 37 bp, Artificial Sequence
  Description of Artificial Sequence: Synthetic oligonucleotide
cgttggaatgtgggacgaccttatttatttgagtcag

SEQ ID NO: 262970 - DNA, 39 bp, Artificial Sequence
  Description of Artificial Sequence: Synthetic oligonucleotide
gttggaatgtgggacgaccttatttatttgagtcagatc

SEQ ID NO: 262971 - DNA, 39 bp, Artificial Sequence
  Description of Artificial Sequence: Synthetic oligonucleotide
ttggaatgtgggacgaccttatttatttgagtcagatcg

SEQ ID NO: 262972 - DNA, 38 bp, Artificial Sequence
  Description of Artificial Sequence: Synthetic oligonucleotide
tggaatgtgggacgaccttatttatttgagtcagatcg

SEQ ID NO: 262973 - DNA, 37 bp, Artificial Sequence
  Description of Artificial Sequence: Synthetic oligonucleotide
ggaatgtgggacgaccttatttatttgagtcagatcg

SEQ ID NO: 262974 - DNA, 39 bp, Artificial Sequence
  Description of Artificial Sequence: Synthetic oligonucleotide
gaatgtgggacgaccttatttatttgagtcagatcgatc

SEQ ID NO: 262975 - DNA, 40 bp, Artificial Sequence
  Description of Artificial Sequence: Synthetic oligonucleotide
aatgtgggacgaccttatttatttgagtcagatcgatctg

SEQ ID NO: 262976 - DNA, 39 bp, Artificial Sequence
  Description of Artificial Sequence: Synthetic oligonucleotide
atgtgggacgaccttatttatttgagtcagatcgatctg

SEQ ID NO: 262977 - DNA, 38 bp, Artificial Sequence
  Description of Artificial Sequence: Synthetic oligonucleotide
tgtgggacgaccttatttatttgagtcagatcgatctg

SEQ ID NO: 262978 - DNA, 37 bp, Artificial Sequence
  Description of Artificial Sequence: Synthetic oligonucleotide
gtgggacgaccttatttatttgagtcagatcgatctg

SEQ ID NO: 262979 - DNA, 37 bp, Artificial Sequence
  Description of Artificial Sequence: Synthetic oligonucleotide
tgggacgaccttatttatttgagtcagatcgatctgg

SEQ ID NO: 262980 - DNA, 36 bp, Artificial Sequence
  Description of Artificial Sequence: Synthetic oligonucleotide
gggacgaccttatttatttgagtcagatcgatctgg

SEQ ID NO: 262981 - DNA, 37 bp, Artificial Sequence
  Description of Artificial Sequence: Synthetic oligonucleotide
ggacgaccttatttatttgagtcagatcgatctggag

SEQ ID NO: 262982 - DNA, 37 bp, Artificial Sequence
  Description of Artificial Sequence: Synthetic oligonucleotide
gacgaccttatttatttgagtcagatcgatctggagc

SEQ ID NO: 262983 - DNA, 40 bp, Artificial Sequence
  Description of Artificial Sequence: Synthetic oligonucleotide
acgaccttatttatttgagtcagatcgatctggagcatac

SEQ ID NO: 262984 - DNA, 39 bp, Artificial Sequence
  Description of Artificial Sequence: Synthetic oligonucleotide
cgaccttatttatttgagtcagatcgatctggagcatac

SEQ ID NO: 262985 - DNA, 42 bp, Artificial Sequence
  Description of Artificial Sequence: Synthetic oligonucleotide
gaccttatttatttgagtcagatcgatctggagcatactttg

SEQ ID NO: 262986 - DNA, 42 bp, Artificial Sequence
  Description of Artificial Sequence: Synthetic oligonucleotide
accttatttatttgagtcagatcgatctggagcatactttgc

SEQ ID NO: 262987 - DNA, 41 bp, Artificial Sequence
  Description of Artificial Sequence: Synthetic oligonucleotide
ccttatttatttgagtcagatcgatctggagcatactttgc

SEQ ID NO: 262988 - DNA, 41 bp, Artificial Sequence
  Description of Artificial Sequence: Synthetic oligonucleotide
cttatttatttgagtcagatcgatctggagcatactttgcc

SEQ ID NO: 262989 - DNA, 42 bp, Artificial Sequence
  Description of Artificial Sequence: Synthetic oligonucleotide
ttatttatttgagtcagatcgatctggagcatactttgccag

SEQ ID NO: 262990 - DNA, 41 bp, Artificial Sequence
  Description of Artificial Sequence: Synthetic oligonucleotide
tatttatttgagtcagatcgatctggagcatactttgccag

SEQ ID NO: 262991 - DNA, 40 bp, Artificial Sequence
  Description of Artificial Sequence: Synthetic oligonucleotide
atttatttgagtcagatcgatctggagcatactttgccag

SEQ ID NO: 262992 - DNA, 39 bp, Artificial Sequence
  Description of Artificial Sequence: Synthetic oligonucleotide
tttatttgagtcagatcgatctggagcatactttgccag

SEQ ID NO: 262993 - DNA, 38 bp, Artificial Sequence
  Description of Artificial Sequence: Synthetic oligonucleotide
ttatttgagtcagatcgatctggagcatactttgccag

SEQ ID NO: 262994 - DNA, 37 bp, Artificial Sequence
  Description of Artificial Sequence: Synthetic oligonucleotide
tatttgagtcagatcgatctggagcatactttgccag

SEQ ID NO: 262995 - DNA, 36 bp, Artificial Sequence
  Description of Artificial Sequence: Synthetic oligonucleotide
atttgagtcagatcgatctggagcatactttgccag

SEQ ID NO: 262996 - DNA, 35 bp, Artificial Sequence
  Description of Artificial Sequence: Synthetic oligonucleotide
tttgagtcagatcgatctggagcatactttgccag

SEQ ID NO: 262997 - DNA, 34 bp, Artificial Sequence
  Description of Artificial Sequence: Synthetic oligonucleotide
ttgagtcagatcgatctggagcatactttgccag

SEQ ID NO: 262998 - DNA, 33 bp, Artificial Sequence
  Description of Artificial Sequence: Synthetic oligonucleotide
tgagtcagatcgatctggagcatactttgccag

SEQ ID NO: 262999 - DNA, 32 bp, Artificial Sequence
  Description of Artificial Sequence: Synthetic oligonucleotide
gagtcagatcgatctggagcatactttgccag

SEQ ID NO: 263000 - DNA, 32 bp, Artificial Sequence
  Description of Artificial Sequence: Synthetic oligonucleotide
agtcagatcgatctggagcatactttgccagg

SEQ ID NO: 263001 - DNA, 31 bp, Artificial Sequence
  Description of Artificial Sequence: Synthetic oligonucleotide
gtcagatcgatctggagcatactttgccagg

SEQ ID NO: 263002 - DNA, 34 bp, Artificial Sequence
  Description of Artificial Sequence: Synthetic oligonucleotide
tcagatcgatctggagcatactttgccaggaaag

SEQ ID NO: 263003 - DNA, 33 bp, Artificial Sequence
  Description of Artificial Sequence: Synthetic oligonucleotide
cagatcgatctggagcatactttgccaggaaag

SEQ ID NO: 263004 - DNA, 33 bp, Artificial Sequence
  Description of Artificial Sequence: Synthetic oligonucleotide
agatcgatctggagcatactttgccaggaaagc

SEQ ID NO: 263005 - DNA, 32 bp, Artificial Sequence
  Description of Artificial Sequence: Synthetic oligonucleotide
gatcgatctggagcatactttgccaggaaagc

SEQ ID NO: 263006 - DNA, 34 bp, Artificial Sequence
  Description of Artificial Sequence: Synthetic oligonucleotide
atcgatctggagcatactttgccaggaaagctag

SEQ ID NO: 263007 - DNA, 33 bp, Artificial Sequence
  Description of Artificial Sequence: Synthetic oligonucleotide
tcgatctggagcatactttgccaggaaagctag

SEQ ID NO: 263008 - DNA, 32 bp, Artificial Sequence
  Description of Artificial Sequence: Synthetic oligonucleotide
cgatctggagcatactttgccaggaaagctag

SEQ ID NO: 263009 - DNA, 33 bp, Artificial Sequence
  Description of Artificial Sequence: Synthetic oligonucleotide
gatctggagcatactttgccaggaaagctagag

SEQ ID NO: 263010 - DNA, 33 bp, Artificial Sequence
  Description of Artificial Sequence: Synthetic oligonucleotide
atctggagcatactttgccaggaaagctagagc

SEQ ID NO: 263011 - DNA, 32 bp, Artificial Sequence
  Description of Artificial Sequence: Synthetic oligonucleotide
tctggagcatactttgccaggaaagctagagc

SEQ ID NO: 263012 - DNA, 31 bp, Artificial Sequence
  Description of Artificial Sequence: Synthetic oligonucleotide
ctggagcatactttgccaggaaagctagagc

SEQ ID NO: 263013 - DNA, 34 bp, Artificial Sequence
  Description of Artificial Sequence: Synthetic oligonucleotide
tggagcatactttgccaggaaagctagagcaatg

SEQ ID NO: 263014 - DNA, 33 bp, Artificial Sequence
  Description of Artificial Sequence: Synthetic oligonucleotide
ggagcatactttgccaggaaagctagagcaatg

SEQ ID NO: 263015 - DNA, 33 bp, Artificial Sequence
  Description of Artificial Sequence: Synthetic oligonucleotide
gagcatactttgccaggaaagctagagcaatgg

SEQ ID NO: 263016 - DNA, 33 bp, Artificial Sequence
  Description of Artificial Sequence: Synthetic oligonucleotide
agcatactttgccaggaaagctagagcaatggg

SEQ ID NO: 263017 - DNA, 32 bp, Artificial Sequence
  Description of Artificial Sequence: Synthetic oligonucleotide
gcatactttgccaggaaagctagagcaatggg

SEQ ID NO: 263018 - DNA, 35 bp, Artificial Sequence
  Description of Artificial Sequence: Synthetic oligonucleotide
catactttgccaggaaagctagagcaatgggtaag

SEQ ID NO: 263019 - DNA, 37 bp, Artificial Sequence
  Description of Artificial Sequence: Synthetic oligonucleotide
atactttgccaggaaagctagagcaatgggtaagaac

SEQ ID NO: 263020 - DNA, 36 bp, Artificial Sequence
  Description of Artificial Sequence: Synthetic oligonucleotide
tactttgccaggaaagctagagcaatgggtaagaac

SEQ ID NO: 263021 - DNA, 35 bp, Artificial Sequence
  Description of Artificial Sequence: Synthetic oligonucleotide
actttgccaggaaagctagagcaatgggtaagaac

SEQ ID NO: 263022 - DNA, 34 bp, Artificial Sequence
  Description of Artificial Sequence: Synthetic oligonucleotide
ctttgccaggaaagctagagcaatgggtaagaac

SEQ ID NO: 263023 - DNA, 37 bp, Artificial Sequence
  Description of Artificial Sequence: Synthetic oligonucleotide
tttgccaggaaagctagagcaatgggtaagaactatc

SEQ ID NO: 263024 - DNA, 36 bp, Artificial Sequence
  Description of Artificial Sequence: Synthetic oligonucleotide
ttgccaggaaagctagagcaatgggtaagaactatc

SEQ ID NO: 263025 - DNA, 35 bp, Artificial Sequence
  Description of Artificial Sequence: Synthetic oligonucleotide
tgccaggaaagctagagcaatgggtaagaactatc

SEQ ID NO: 263026 - DNA, 34 bp, Artificial Sequence
  Description of Artificial Sequence: Synthetic oligonucleotide
gccaggaaagctagagcaatgggtaagaactatc

SEQ ID NO: 263027 - DNA, 35 bp, Artificial Sequence
  Description of Artificial Sequence: Synthetic oligonucleotide
ccaggaaagctagagcaatgggtaagaactatctg

SEQ ID NO: 263028 - DNA, 38 bp, Artificial Sequence
  Description of Artificial Sequence: Synthetic oligonucleotide
caggaaagctagagcaatgggtaagaactatctgaatg

SEQ ID NO: 263029 - DNA, 38 bp, Artificial Sequence
  Description of Artificial Sequence: Synthetic oligonucleotide
aggaaagctagagcaatgggtaagaactatctgaatgg

SEQ ID NO: 263030 - DNA, 37 bp, Artificial Sequence
  Description of Artificial Sequence: Synthetic oligonucleotide
ggaaagctagagcaatgggtaagaactatctgaatgg

SEQ ID NO: 263031 - DNA, 37 bp, Artificial Sequence
  Description of Artificial Sequence: Synthetic oligonucleotide
gaaagctagagcaatgggtaagaactatctgaatggg

SEQ ID NO: 263032 - DNA, 39 bp, Artificial Sequence
  Description of Artificial Sequence: Synthetic oligonucleotide
aaagctagagcaatgggtaagaactatctgaatgggatg

SEQ ID NO: 263033 - DNA, 38 bp, Artificial Sequence
  Description of Artificial Sequence: Synthetic oligonucleotide
aagctagagcaatgggtaagaactatctgaatgggatg

SEQ ID NO: 263034 - DNA, 37 bp, Artificial Sequence
  Description of Artificial Sequence: Synthetic oligonucleotide
agctagagcaatgggtaagaactatctgaatgggatg

SEQ ID NO: 263035 - DNA, 36 bp, Artificial Sequence
  Description of Artificial Sequence: Synthetic oligonucleotide
gctagagcaatgggtaagaactatctgaatgggatg

SEQ ID NO: 263036 - DNA, 37 bp, Artificial Sequence
  Description of Artificial Sequence: Synthetic oligonucleotide
ctagagcaatgggtaagaactatctgaatgggatgac

SEQ ID NO: 263037 - DNA, 40 bp, Artificial Sequence
  Description of Artificial Sequence: Synthetic oligonucleotide
tagagcaatgggtaagaactatctgaatgggatgactttc

SEQ ID NO: 263038 - DNA, 39 bp, Artificial Sequence
  Description of Artificial Sequence: Synthetic oligonucleotide
agagcaatgggtaagaactatctgaatgggatgactttc

SEQ ID NO: 263039 - DNA, 38 bp, Artificial Sequence
  Description of Artificial Sequence: Synthetic oligonucleotide
gagcaatgggtaagaactatctgaatgggatgactttc

SEQ ID NO: 263040 - DNA, 38 bp, Artificial Sequence
  Description of Artificial Sequence: Synthetic oligonucleotide
agcaatgggtaagaactatctgaatgggatgactttcc

SEQ ID NO: 263041 - DNA, 37 bp, Artificial Sequence
  Description of Artificial Sequence: Synthetic oligonucleotide
gcaatgggtaagaactatctgaatgggatgactttcc

SEQ ID NO: 263042 - DNA, 39 bp, Artificial Sequence
  Description of Artificial Sequence: Synthetic oligonucleotide
caatgggtaagaactatctgaatgggatgactttcctag

SEQ ID NO: 263043 - DNA, 40 bp, Artificial Sequence
  Description of Artificial Sequence: Synthetic oligonucleotide
aatgggtaagaactatctgaatgggatgactttcctagag

SEQ ID NO: 263044 - DNA, 39 bp, Artificial Sequence
  Description of Artificial Sequence: Synthetic oligonucleotide
atgggtaagaactatctgaatgggatgactttcctagag

SEQ ID NO: 263045 - DNA, 38 bp, Artificial Sequence
  Description of Artificial Sequence: Synthetic oligonucleotide
tgggtaagaactatctgaatgggatgactttcctagag

SEQ ID NO: 263046 - DNA, 37 bp, Artificial Sequence
  Description of Artificial Sequence: Synthetic oligonucleotide
gggtaagaactatctgaatgggatgactttcctagag

SEQ ID NO: 263047 - DNA, 41 bp, Artificial Sequence
  Description of Artificial Sequence: Synthetic oligonucleotide
ggtaagaactatctgaatgggatgactttcctagagaaaag

SEQ ID NO: 263048 - DNA, 48 bp, Artificial Sequence
  Description of Artificial Sequence: Synthetic oligonucleotide
gtaagaactatctgaatgggatgactttcctagagaaaagaaataatg

SEQ ID NO: 263049 - DNA, 50 bp, Artificial Sequence
  Description of Artificial Sequence: Synthetic oligonucleotide
taagaactatctgaatgggatgactttcctagagaaaagaaataatgaag

SEQ ID NO: 263050 - DNA, 49 bp, Artificial Sequence
  Description of Artificial Sequence: Synthetic oligonucleotide
aagaactatctgaatgggatgactttcctagagaaaagaaataatgaag

SEQ ID NO: 263051 - DNA, 48 bp, Artificial Sequence
  Description of Artificial Sequence: Synthetic oligonucleotide
agaactatctgaatgggatgactttcctagagaaaagaaataatgaag

SEQ ID NO: 263052 - DNA, 47 bp, Artificial Sequence
  Description of Artificial Sequence: Synthetic oligonucleotide
gaactatctgaatgggatgactttcctagagaaaagaaataatgaag

SEQ ID NO: 263053 - DNA, 49 bp, Artificial Sequence
  Description of Artificial Sequence: Synthetic oligonucleotide
aactatctgaatgggatgactttcctagagaaaagaaataatgaagttc

SEQ ID NO: 263054 - DNA, 48 bp, Artificial Sequence
  Description of Artificial Sequence: Synthetic oligonucleotide
actatctgaatgggatgactttcctagagaaaagaaataatgaagttc

SEQ ID NO: 263055 - DNA, 47 bp, Artificial Sequence
  Description of Artificial Sequence: Synthetic oligonucleotide
ctatctgaatgggatgactttcctagagaaaagaaataatgaagttc

SEQ ID NO: 263056 - DNA, 48 bp, Artificial Sequence
  Description of Artificial Sequence: Synthetic oligonucleotide
tatctgaatgggatgactttcctagagaaaagaaataatgaagttctg

SEQ ID NO: 263057 - DNA, 47 bp, Artificial Sequence
  Description of Artificial Sequence: Synthetic oligonucleotide
atctgaatgggatgactttcctagagaaaagaaataatgaagttctg

SEQ ID NO: 263058 - DNA, 46 bp, Artificial Sequence
  Description of Artificial Sequence: Synthetic oligonucleotide
tctgaatgggatgactttcctagagaaaagaaataatgaagttctg

SEQ ID NO: 263059 - DNA, 45 bp, Artificial Sequence
  Description of Artificial Sequence: Synthetic oligonucleotide
ctgaatgggatgactttcctagagaaaagaaataatgaagttctg

SEQ ID NO: 263060 - DNA, 45 bp, Artificial Sequence
  Description of Artificial Sequence: Synthetic oligonucleotide
tgaatgggatgactttcctagagaaaagaaataatgaagttctgg

SEQ ID NO: 263061 - DNA, 44 bp, Artificial Sequence
  Description of Artificial Sequence: Synthetic oligonucleotide
gaatgggatgactttcctagagaaaagaaataatgaagttctgg

SEQ ID NO: 263062 - DNA, 46 bp, Artificial Sequence
  Description of Artificial Sequence: Synthetic oligonucleotide
aatgggatgactttcctagagaaaagaaataatgaagttctggaac

SEQ ID NO: 263063 - DNA, 45 bp, Artificial Sequence
  Description of Artificial Sequence: Synthetic oligonucleotide
atgggatgactttcctagagaaaagaaataatgaagttctggaac

SEQ ID NO: 263064 - DNA, 44 bp, Artificial Sequence
  Description of Artificial Sequence: Synthetic oligonucleotide
tgggatgactttcctagagaaaagaaataatgaagttctggaac

SEQ ID NO: 263065 - DNA, 43 bp, Artificial Sequence
  Description of Artificial Sequence: Synthetic oligonucleotide
gggatgactttcctagagaaaagaaataatgaagttctggaac

SEQ ID NO: 263066 - DNA, 45 bp, Artificial Sequence
  Description of Artificial Sequence: Synthetic oligonucleotide
ggatgactttcctagagaaaagaaataatgaagttctggaactag

SEQ ID NO: 263067 - DNA, 47 bp, Artificial Sequence
  Description of Artificial Sequence: Synthetic oligonucleotide
gatgactttcctagagaaaagaaataatgaagttctggaactagaag

SEQ ID NO: 263068 - DNA, 49 bp, Artificial Sequence
  Description of Artificial Sequence: Synthetic oligonucleotide
atgactttcctagagaaaagaaataatgaagttctggaactagaagatg

SEQ ID NO: 263069 - DNA, 48 bp, Artificial Sequence
  Description of Artificial Sequence: Synthetic oligonucleotide
tgactttcctagagaaaagaaataatgaagttctggaactagaagatg

SEQ ID NO: 263070 - DNA, 47 bp, Artificial Sequence
  Description of Artificial Sequence: Synthetic oligonucleotide
gactttcctagagaaaagaaataatgaagttctggaactagaagatg

SEQ ID NO: 263071 - DNA, 47 bp, Artificial Sequence
  Description of Artificial Sequence: Synthetic oligonucleotide
actttcctagagaaaagaaataatgaagttctggaactagaagatgc

SEQ ID NO: 263072 - DNA, 46 bp, Artificial Sequence
  Description of Artificial Sequence: Synthetic oligonucleotide
ctttcctagagaaaagaaataatgaagttctggaactagaagatgc

SEQ ID NO: 263073 - DNA, 46 bp, Artificial Sequence
  Description of Artificial Sequence: Synthetic oligonucleotide
tttcctagagaaaagaaataatgaagttctggaactagaagatgcc

SEQ ID NO: 263074 - DNA, 45 bp, Artificial Sequence
  Description of Artificial Sequence: Synthetic oligonucleotide
ttcctagagaaaagaaataatgaagttctggaactagaagatgcc

SEQ ID NO: 263075 - DNA, 44 bp, Artificial Sequence
  Description of Artificial Sequence: Synthetic oligonucleotide
tcctagagaaaagaaataatgaagttctggaactagaagatgcc

SEQ ID NO: 263076 - DNA, 43 bp, Artificial Sequence
  Description of Artificial Sequence: Synthetic oligonucleotide
cctagagaaaagaaataatgaagttctggaactagaagatgcc

SEQ ID NO: 263077 - DNA, 46 bp, Artificial Sequence
  Description of Artificial Sequence: Synthetic oligonucleotide
ctagagaaaagaaataatgaagttctggaactagaagatgcctttc

SEQ ID NO: 263078 - DNA, 49 bp, Artificial Sequence
  Description of Artificial Sequence: Synthetic oligonucleotide
tagagaaaagaaataatgaagttctggaactagaagatgcctttcatac

SEQ ID NO: 263079 - DNA, 48 bp, Artificial Sequence
  Description of Artificial Sequence: Synthetic oligonucleotide
agagaaaagaaataatgaagttctggaactagaagatgcctttcatac

SEQ ID NO: 263080 - DNA, 47 bp, Artificial Sequence
  Description of Artificial Sequence: Synthetic oligonucleotide
gagaaaagaaataatgaagttctggaactagaagatgcctttcatac

SEQ ID NO: 263081 - DNA, 48 bp, Artificial Sequence
  Description of Artificial Sequence: Synthetic oligonucleotide
agaaaagaaataatgaagttctggaactagaagatgcctttcatacag

SEQ ID NO: 263082 - DNA, 47 bp, Artificial Sequence
  Description of Artificial Sequence: Synthetic oligonucleotide
gaaaagaaataatgaagttctggaactagaagatgcctttcatacag

SEQ ID NO: 263083 - DNA, 47 bp, Artificial Sequence
  Description of Artificial Sequence: Synthetic oligonucleotide
aaaagaaataatgaagttctggaactagaagatgcctttcatacagg

SEQ ID NO: 263084 - DNA, 46 bp, Artificial Sequence
  Description of Artificial Sequence: Synthetic oligonucleotide
aaagaaataatgaagttctggaactagaagatgcctttcatacagg

SEQ ID NO: 263085 - DNA, 45 bp, Artificial Sequence
  Description of Artificial Sequence: Synthetic oligonucleotide
aagaaataatgaagttctggaactagaagatgcctttcatacagg

SEQ ID NO: 263086 - DNA, 44 bp, Artificial Sequence
  Description of Artificial Sequence: Synthetic oligonucleotide
agaaataatgaagttctggaactagaagatgcctttcatacagg

SEQ ID NO: 263087 - DNA, 43 bp, Artificial Sequence
  Description of Artificial Sequence: Synthetic oligonucleotide
gaaataatgaagttctggaactagaagatgcctttcatacagg

SEQ ID NO: 263088 - DNA, 43 bp, Artificial Sequence
  Description of Artificial Sequence: Synthetic oligonucleotide
aaataatgaagttctggaactagaagatgcctttcatacaggc

SEQ ID NO: 263089 - DNA, 42 bp, Artificial Sequence
  Description of Artificial Sequence: Synthetic oligonucleotide
aataatgaagttctggaactagaagatgcctttcatacaggc

SEQ ID NO: 263090 - DNA, 41 bp, Artificial Sequence
  Description of Artificial Sequence: Synthetic oligonucleotide
ataatgaagttctggaactagaagatgcctttcatacaggc

SEQ ID NO: 263091 - DNA, 40 bp, Artificial Sequence
  Description of Artificial Sequence: Synthetic oligonucleotide
taatgaagttctggaactagaagatgcctttcatacaggc

SEQ ID NO: 263092 - DNA, 39 bp, Artificial Sequence
  Description of Artificial Sequence: Synthetic oligonucleotide
aatgaagttctggaactagaagatgcctttcatacaggc

SEQ ID NO: 263093 - DNA, 38 bp, Artificial Sequence
  Description of Artificial Sequence: Synthetic oligonucleotide
atgaagttctggaactagaagatgcctttcatacaggc

SEQ ID NO: 263094 - DNA, 37 bp, Artificial Sequence
  Description of Artificial Sequence: Synthetic oligonucleotide
tgaagttctggaactagaagatgcctttcatacaggc

SEQ ID NO: 263095 - DNA, 36 bp, Artificial Sequence
  Description of Artificial Sequence: Synthetic oligonucleotide
gaagttctggaactagaagatgcctttcatacaggc

SEQ ID NO: 263096 - DNA, 38 bp, Artificial Sequence
  Description of Artificial Sequence: Synthetic oligonucleotide
aagttctggaactagaagatgcctttcatacaggcatc

SEQ ID NO: 263097 - DNA, 37 bp, Artificial Sequence
  Description of Artificial Sequence: Synthetic oligonucleotide
agttctggaactagaagatgcctttcatacaggcatc

SEQ ID NO: 263098 - DNA, 36 bp, Artificial Sequence
  Description of Artificial Sequence: Synthetic oligonucleotide
gttctggaactagaagatgcctttcatacaggcatc

SEQ ID NO: 263099 - DNA, 40 bp, Artificial Sequence
  Description of Artificial Sequence: Synthetic oligonucleotide
ttctggaactagaagatgcctttcatacaggcatcttaac

SEQ ID NO: 263100 - DNA, 39 bp, Artificial Sequence
  Description of Artificial Sequence: Synthetic oligonucleotide
tctggaactagaagatgcctttcatacaggcatcttaac

SEQ ID NO: 263101 - DNA, 38 bp, Artificial Sequence
  Description of Artificial Sequence: Synthetic oligonucleotide
ctggaactagaagatgcctttcatacaggcatcttaac

SEQ ID NO: 263102 - DNA, 38 bp, Artificial Sequence
  Description of Artificial Sequence: Synthetic oligonucleotide
tggaactagaagatgcctttcatacaggcatcttaacg

SEQ ID NO: 263103 - DNA, 37 bp, Artificial Sequence
  Description of Artificial Sequence: Synthetic oligonucleotide
ggaactagaagatgcctttcatacaggcatcttaacg

SEQ ID NO: 263104 - DNA, 37 bp, Artificial Sequence
  Description of Artificial Sequence: Synthetic oligonucleotide
gaactagaagatgcctttcatacaggcatcttaacgc

SEQ ID NO: 263105 - DNA, 41 bp, Artificial Sequence
  Description of Artificial Sequence: Synthetic oligonucleotide
aactagaagatgcctttcatacaggcatcttaacgctaaag

SEQ ID NO: 263106 - DNA, 40 bp, Artificial Sequence
  Description of Artificial Sequence: Synthetic oligonucleotide
actagaagatgcctttcatacaggcatcttaacgctaaag

SEQ ID NO: 263107 - DNA, 39 bp, Artificial Sequence
  Description of Artificial Sequence: Synthetic oligonucleotide
ctagaagatgcctttcatacaggcatcttaacgctaaag

SEQ ID NO: 263108 - DNA, 39 bp, Artificial Sequence
  Description of Artificial Sequence: Synthetic oligonucleotide
tagaagatgcctttcatacaggcatcttaacgctaaagg

SEQ ID NO: 263109 - DNA, 38 bp, Artificial Sequence
  Description of Artificial Sequence: Synthetic oligonucleotide
agaagatgcctttcatacaggcatcttaacgctaaagg

SEQ ID NO: 263110 - DNA, 37 bp, Artificial Sequence
  Description of Artificial Sequence: Synthetic oligonucleotide
gaagatgcctttcatacaggcatcttaacgctaaagg

SEQ ID NO: 263111 - DNA, 40 bp, Artificial Sequence
  Description of Artificial Sequence: Synthetic oligonucleotide
aagatgcctttcatacaggcatcttaacgctaaaggaatg

SEQ ID NO: 263112 - DNA, 39 bp, Artificial Sequence
  Description of Artificial Sequence: Synthetic oligonucleotide
agatgcctttcatacaggcatcttaacgctaaaggaatg

SEQ ID NO: 263113 - DNA, 38 bp, Artificial Sequence
  Description of Artificial Sequence: Synthetic oligonucleotide
gatgcctttcatacaggcatcttaacgctaaaggaatg

SEQ ID NO: 263114 - DNA, 38 bp, Artificial Sequence
  Description of Artificial Sequence: Synthetic oligonucleotide
atgcctttcatacaggcatcttaacgctaaaggaatgc

SEQ ID NO: 263115 - DNA, 37 bp, Artificial Sequence
  Description of Artificial Sequence: Synthetic oligonucleotide
tgcctttcatacaggcatcttaacgctaaaggaatgc

SEQ ID NO: 263116 - DNA, 36 bp, Artificial Sequence
  Description of Artificial Sequence: Synthetic oligonucleotide
gcctttcatacaggcatcttaacgctaaaggaatgc

SEQ ID NO: 263117 - DNA, 39 bp, Artificial Sequence
  Description of Artificial Sequence: Synthetic oligonucleotide
cctttcatacaggcatcttaacgctaaaggaatgctttg

SEQ ID NO: 263118 - DNA, 41 bp, Artificial Sequence
  Description of Artificial Sequence: Synthetic oligonucleotide
ctttcatacaggcatcttaacgctaaaggaatgctttgaag

SEQ ID NO: 263119 - DNA, 41 bp, Artificial Sequence
  Description of Artificial Sequence: Synthetic oligonucleotide
tttcatacaggcatcttaacgctaaaggaatgctttgaagc

SEQ ID NO: 263120 - DNA, 40 bp, Artificial Sequence
  Description of Artificial Sequence: Synthetic oligonucleotide
ttcatacaggcatcttaacgctaaaggaatgctttgaagc

SEQ ID NO: 263121 - DNA, 39 bp, Artificial Sequence
  Description of Artificial Sequence: Synthetic oligonucleotide
tcatacaggcatcttaacgctaaaggaatgctttgaagc

SEQ ID NO: 263122 - DNA, 38 bp, Artificial Sequence
  Description of Artificial Sequence: Synthetic oligonucleotide
catacaggcatcttaacgctaaaggaatgctttgaagc

SEQ ID NO: 263123 - DNA, 38 bp, Artificial Sequence
  Description of Artificial Sequence: Synthetic oligonucleotide
atacaggcatcttaacgctaaaggaatgctttgaagcg

SEQ ID NO: 263124 - DNA, 37 bp, Artificial Sequence
  Description of Artificial Sequence: Synthetic oligonucleotide
tacaggcatcttaacgctaaaggaatgctttgaagcg

SEQ ID NO: 263125 - DNA, 36 bp, Artificial Sequence
  Description of Artificial Sequence: Synthetic oligonucleotide
acaggcatcttaacgctaaaggaatgctttgaagcg

SEQ ID NO: 263126 - DNA, 35 bp, Artificial Sequence
  Description of Artificial Sequence: Synthetic oligonucleotide
caggcatcttaacgctaaaggaatgctttgaagcg

SEQ ID NO: 263127 - DNA, 35 bp, Artificial Sequence
  Description of Artificial Sequence: Synthetic oligonucleotide
aggcatcttaacgctaaaggaatgctttgaagcgc

SEQ ID NO: 263128 - DNA, 34 bp, Artificial Sequence
  Description of Artificial Sequence: Synthetic oligonucleotide
ggcatcttaacgctaaaggaatgctttgaagcgc

SEQ ID NO: 263129 - DNA, 38 bp, Artificial Sequence
  Description of Artificial Sequence: Synthetic oligonucleotide
gcatcttaacgctaaaggaatgctttgaagcgcaaatg

SEQ ID NO: 263130 - DNA, 39 bp, Artificial Sequence
  Description of Artificial Sequence: Synthetic oligonucleotide
catcttaacgctaaaggaatgctttgaagcgcaaatgac

SEQ ID NO: 263131 - DNA, 40 bp, Artificial Sequence
  Description of Artificial Sequence: Synthetic oligonucleotide
atcttaacgctaaaggaatgctttgaagcgcaaatgactg

SEQ ID NO: 263132 - DNA, 39 bp, Artificial Sequence
  Description of Artificial Sequence: Synthetic oligonucleotide
tcttaacgctaaaggaatgctttgaagcgcaaatgactg

SEQ ID NO: 263133 - DNA, 38 bp, Artificial Sequence
  Description of Artificial Sequence: Synthetic oligonucleotide
cttaacgctaaaggaatgctttgaagcgcaaatgactg

SEQ ID NO: 263134 - DNA, 39 bp, Artificial Sequence
  Description of Artificial Sequence: Synthetic oligonucleotide
ttaacgctaaaggaatgctttgaagcgcaaatgactgag

SEQ ID NO: 263135 - DNA, 38 bp, Artificial Sequence
  Description of Artificial Sequence: Synthetic oligonucleotide
taacgctaaaggaatgctttgaagcgcaaatgactgag

SEQ ID NO: 263136 - DNA, 37 bp, Artificial Sequence
  Description of Artificial Sequence: Synthetic oligonucleotide
aacgctaaaggaatgctttgaagcgcaaatgactgag

SEQ ID NO: 263137 - DNA, 36 bp, Artificial Sequence
  Description of Artificial Sequence: Synthetic oligonucleotide
acgctaaaggaatgctttgaagcgcaaatgactgag

SEQ ID NO: 263138 - DNA, 35 bp, Artificial Sequence
  Description of Artificial Sequence: Synthetic oligonucleotide
cgctaaaggaatgctttgaagcgcaaatgactgag

SEQ ID NO: 263139 - DNA, 35 bp, Artificial Sequence
  Description of Artificial Sequence: Synthetic oligonucleotide
gctaaaggaatgctttgaagcgcaaatgactgagg

SEQ ID NO: 263140 - DNA, 39 bp, Artificial Sequence
  Description of Artificial Sequence: Synthetic oligonucleotide
ctaaaggaatgctttgaagcgcaaatgactgaggataac

SEQ ID NO: 263141 - DNA, 42 bp, Artificial Sequence
  Description of Artificial Sequence: Synthetic oligonucleotide
taaaggaatgctttgaagcgcaaatgactgaggataacttag

SEQ ID NO: 263142 - DNA, 41 bp, Artificial Sequence
  Description of Artificial Sequence: Synthetic oligonucleotide
aaaggaatgctttgaagcgcaaatgactgaggataacttag

SEQ ID NO: 263143 - DNA, 40 bp, Artificial Sequence
  Description of Artificial Sequence: Synthetic oligonucleotide
aaggaatgctttgaagcgcaaatgactgaggataacttag

SEQ ID NO: 263144 - DNA, 39 bp, Artificial Sequence
  Description of Artificial Sequence: Synthetic oligonucleotide
aggaatgctttgaagcgcaaatgactgaggataacttag

SEQ ID NO: 263145 - DNA, 38 bp, Artificial Sequence
  Description of Artificial Sequence: Synthetic oligonucleotide
ggaatgctttgaagcgcaaatgactgaggataacttag

SEQ ID NO: 263146 - DNA, 40 bp, Artificial Sequence
  Description of Artificial Sequence: Synthetic oligonucleotide
gaatgctttgaagcgcaaatgactgaggataacttagaag

SEQ ID NO: 263147 - DNA, 42 bp, Artificial Sequence
  Description of Artificial Sequence: Synthetic oligonucleotide
aatgctttgaagcgcaaatgactgaggataacttagaagttg

SEQ ID NO: 263148 - DNA, 41 bp, Artificial Sequence
  Description of Artificial Sequence: Synthetic oligonucleotide
atgctttgaagcgcaaatgactgaggataacttagaagttg

SEQ ID NO: 263149 - DNA, 40 bp, Artificial Sequence
  Description of Artificial Sequence: Synthetic oligonucleotide
tgctttgaagcgcaaatgactgaggataacttagaagttg

SEQ ID NO: 263150 - DNA, 39 bp, Artificial Sequence
  Description of Artificial Sequence: Synthetic oligonucleotide
gctttgaagcgcaaatgactgaggataacttagaagttg

SEQ ID NO: 263151 - DNA, 39 bp, Artificial Sequence
  Description of Artificial Sequence: Synthetic oligonucleotide
ctttgaagcgcaaatgactgaggataacttagaagttgc

SEQ ID NO: 263152 - DNA, 42 bp, Artificial Sequence
  Description of Artificial Sequence: Synthetic oligonucleotide
tttgaagcgcaaatgactgaggataacttagaagttgcaatc

SEQ ID NO: 263153 - DNA, 41 bp, Artificial Sequence
  Description of Artificial Sequence: Synthetic oligonucleotide
ttgaagcgcaaatgactgaggataacttagaagttgcaatc

SEQ ID NO: 263154 - DNA, 40 bp, Artificial Sequence
  Description of Artificial Sequence: Synthetic oligonucleotide
tgaagcgcaaatgactgaggataacttagaagttgcaatc

SEQ ID NO: 263155 - DNA, 39 bp, Artificial Sequence
  Description of Artificial Sequence: Synthetic oligonucleotide
gaagcgcaaatgactgaggataacttagaagttgcaatc

SEQ ID NO: 263156 - DNA, 40 bp, Artificial Sequence
  Description of Artificial Sequence: Synthetic oligonucleotide
aagcgcaaatgactgaggataacttagaagttgcaatctg

SEQ ID NO: 263157 - DNA, 39 bp, Artificial Sequence
  Description of Artificial Sequence: Synthetic oligonucleotide
agcgcaaatgactgaggataacttagaagttgcaatctg

SEQ ID NO: 263158 - DNA, 38 bp, Artificial Sequence
  Description of Artificial Sequence: Synthetic oligonucleotide
gcgcaaatgactgaggataacttagaagttgcaatctg

SEQ ID NO: 263159 - DNA, 38 bp, Artificial Sequence
  Description of Artificial Sequence: Synthetic oligonucleotide
cgcaaatgactgaggataacttagaagttgcaatctgc

SEQ ID NO: 263160 - DNA, 41 bp, Artificial Sequence
  Description of Artificial Sequence: Synthetic oligonucleotide
gcaaatgactgaggataacttagaagttgcaatctgcaaag

SEQ ID NO: 263161 - DNA, 43 bp, Artificial Sequence
  Description of Artificial Sequence: Synthetic oligonucleotide
caaatgactgaggataacttagaagttgcaatctgcaaagaag

SEQ ID NO: 263162 - DNA, 43 bp, Artificial Sequence
  Description of Artificial Sequence: Synthetic oligonucleotide
aaatgactgaggataacttagaagttgcaatctgcaaagaagc

SEQ ID NO: 263163 - DNA, 42 bp, Artificial Sequence
  Description of Artificial Sequence: Synthetic oligonucleotide
aatgactgaggataacttagaagttgcaatctgcaaagaagc

SEQ ID NO: 263164 - DNA, 41 bp, Artificial Sequence
  Description of Artificial Sequence: Synthetic oligonucleotide
atgactgaggataacttagaagttgcaatctgcaaagaagc

SEQ ID NO: 263165 - DNA, 40 bp, Artificial Sequence
  Description of Artificial Sequence: Synthetic oligonucleotide
tgactgaggataacttagaagttgcaatctgcaaagaagc

SEQ ID NO: 263166 - DNA, 39 bp, Artificial Sequence
  Description of Artificial Sequence: Synthetic oligonucleotide
gactgaggataacttagaagttgcaatctgcaaagaagc

SEQ ID NO: 263167 - DNA, 40 bp, Artificial Sequence
  Description of Artificial Sequence: Synthetic oligonucleotide
actgaggataacttagaagttgcaatctgcaaagaagctg

SEQ ID NO: 263168 - DNA, 39 bp, Artificial Sequence
  Description of Artificial Sequence: Synthetic oligonucleotide
ctgaggataacttagaagttgcaatctgcaaagaagctg

SEQ ID NO: 263169 - DNA, 39 bp, Artificial Sequence
  Description of Artificial Sequence: Synthetic oligonucleotide
tgaggataacttagaagttgcaatctgcaaagaagctgg

SEQ ID NO: 263170 - DNA, 38 bp, Artificial Sequence
  Description of Artificial Sequence: Synthetic oligonucleotide
gaggataacttagaagttgcaatctgcaaagaagctgg

SEQ ID NO: 263171 - DNA, 43 bp, Artificial Sequence
  Description of Artificial Sequence: Synthetic oligonucleotide
aggataacttagaagttgcaatctgcaaagaagctggaattag

SEQ ID NO: 263172 - DNA, 42 bp, Artificial Sequence
  Description of Artificial Sequence: Synthetic oligonucleotide
ggataacttagaagttgcaatctgcaaagaagctggaattag

SEQ ID NO: 263173 - DNA, 42 bp, Artificial Sequence
  Description of Artificial Sequence: Synthetic oligonucleotide
gataacttagaagttgcaatctgcaaagaagctggaattagg

SEQ ID NO: 263174 - DNA, 43 bp, Artificial Sequence
  Description of Artificial Sequence: Synthetic oligonucleotide
ataacttagaagttgcaatctgcaaagaagctggaattaggag

SEQ ID NO: 263175 - DNA, 42 bp, Artificial Sequence
  Description of Artificial Sequence: Synthetic oligonucleotide
taacttagaagttgcaatctgcaaagaagctggaattaggag

SEQ ID NO: 263176 - DNA, 41 bp, Artificial Sequence
  Description of Artificial Sequence: Synthetic oligonucleotide
aacttagaagttgcaatctgcaaagaagctggaattaggag

SEQ ID NO: 263177 - DNA, 40 bp, Artificial Sequence
  Description of Artificial Sequence: Synthetic oligonucleotide
acttagaagttgcaatctgcaaagaagctggaattaggag

SEQ ID NO: 263178 - DNA, 39 bp, Artificial Sequence
  Description of Artificial Sequence: Synthetic oligonucleotide
cttagaagttgcaatctgcaaagaagctggaattaggag

SEQ ID NO: 263179 - DNA, 39 bp, Artificial Sequence
  Description of Artificial Sequence: Synthetic oligonucleotide
ttagaagttgcaatctgcaaagaagctggaattaggagg

SEQ ID NO: 263180 - DNA, 38 bp, Artificial Sequence
  Description of Artificial Sequence: Synthetic oligonucleotide
tagaagttgcaatctgcaaagaagctggaattaggagg

SEQ ID NO: 263181 - DNA, 37 bp, Artificial Sequence
  Description of Artificial Sequence: Synthetic oligonucleotide
agaagttgcaatctgcaaagaagctggaattaggagg

SEQ ID NO: 263182 - DNA, 36 bp, Artificial Sequence
  Description of Artificial Sequence: Synthetic oligonucleotide
gaagttgcaatctgcaaagaagctggaattaggagg

SEQ ID NO: 263183 - DNA, 36 bp, Artificial Sequence
  Description of Artificial Sequence: Synthetic oligonucleotide
aagttgcaatctgcaaagaagctggaattaggaggc

SEQ ID NO: 263184 - DNA, 35 bp, Artificial Sequence
  Description of Artificial Sequence: Synthetic oligonucleotide
agttgcaatctgcaaagaagctggaattaggaggc

SEQ ID NO: 263185 - DNA, 34 bp, Artificial Sequence
  Description of Artificial Sequence: Synthetic oligonucleotide
gttgcaatctgcaaagaagctggaattaggaggc

SEQ ID NO: 263186 - DNA, 37 bp, Artificial Sequence
  Description of Artificial Sequence: Synthetic oligonucleotide
ttgcaatctgcaaagaagctggaattaggaggcatac

SEQ ID NO: 263187 - DNA, 36 bp, Artificial Sequence
  Description of Artificial Sequence: Synthetic oligonucleotide
tgcaatctgcaaagaagctggaattaggaggcatac

SEQ ID NO: 263188 - DNA, 35 bp, Artificial Sequence
  Description of Artificial Sequence: Synthetic oligonucleotide
gcaatctgcaaagaagctggaattaggaggcatac

SEQ ID NO: 263189 - DNA, 36 bp, Artificial Sequence
  Description of Artificial Sequence: Synthetic oligonucleotide
caatctgcaaagaagctggaattaggaggcatactc

SEQ ID NO: 263190 - DNA, 36 bp, Artificial Sequence
  Description of Artificial Sequence: Synthetic oligonucleotide
aatctgcaaagaagctggaattaggaggcatactcc

SEQ ID NO: 263191 - DNA, 35 bp, Artificial Sequence
  Description of Artificial Sequence: Synthetic oligonucleotide
atctgcaaagaagctggaattaggaggcatactcc

SEQ ID NO: 263192 - DNA, 34 bp, Artificial Sequence
  Description of Artificial Sequence: Synthetic oligonucleotide
tctgcaaagaagctggaattaggaggcatactcc

SEQ ID NO: 263193 - DNA, 33 bp, Artificial Sequence
  Description of Artificial Sequence: Synthetic oligonucleotide
ctgcaaagaagctggaattaggaggcatactcc

SEQ ID NO: 263194 - DNA, 35 bp, Artificial Sequence
  Description of Artificial Sequence: Synthetic oligonucleotide
tgcaaagaagctggaattaggaggcatactccaac

SEQ ID NO: 263195 - DNA, 34 bp, Artificial Sequence
  Description of Artificial Sequence: Synthetic oligonucleotide
gcaaagaagctggaattaggaggcatactccaac

SEQ ID NO: 263196 - DNA, 35 bp, Artificial Sequence
  Description of Artificial Sequence: Synthetic oligonucleotide
caaagaagctggaattaggaggcatactccaacag

SEQ ID NO: 263197 - DNA, 37 bp, Artificial Sequence
  Description of Artificial Sequence: Synthetic oligonucleotide
aaagaagctggaattaggaggcatactccaacagaag

SEQ ID NO: 263198 - DNA, 36 bp, Artificial Sequence
  Description of Artificial Sequence: Synthetic oligonucleotide
aagaagctggaattaggaggcatactccaacagaag

SEQ ID NO: 263199 - DNA, 35 bp, Artificial Sequence
  Description of Artificial Sequence: Synthetic oligonucleotide
agaagctggaattaggaggcatactccaacagaag

SEQ ID NO: 263200 - DNA, 34 bp, Artificial Sequence
  Description of Artificial Sequence: Synthetic oligonucleotide
gaagctggaattaggaggcatactccaacagaag

SEQ ID NO: 263201 - DNA, 38 bp, Artificial Sequence
  Description of Artificial Sequence: Synthetic oligonucleotide
aagctggaattaggaggcatactccaacagaagttaag

SEQ ID NO: 263202 - DNA, 37 bp, Artificial Sequence
  Description of Artificial Sequence: Synthetic oligonucleotide
agctggaattaggaggcatactccaacagaagttaag

SEQ ID NO: 263203 - DNA, 36 bp, Artificial Sequence
  Description of Artificial Sequence: Synthetic oligonucleotide
gctggaattaggaggcatactccaacagaagttaag

SEQ ID NO: 263204 - DNA, 36 bp, Artificial Sequence
  Description of Artificial Sequence: Synthetic oligonucleotide
ctggaattaggaggcatactccaacagaagttaagc

SEQ ID NO: 263205 - DNA, 40 bp, Artificial Sequence
  Description of Artificial Sequence: Synthetic oligonucleotide
tggaattaggaggcatactccaacagaagttaagcattac

SEQ ID NO: 263206 - DNA, 39 bp, Artificial Sequence
  Description of Artificial Sequence: Synthetic oligonucleotide
ggaattaggaggcatactccaacagaagttaagcattac

SEQ ID NO: 263207 - DNA, 41 bp, Artificial Sequence
  Description of Artificial Sequence: Synthetic oligonucleotide
gaattaggaggcatactccaacagaagttaagcattacttg

SEQ ID NO: 263208 - DNA, 41 bp, Artificial Sequence
  Description of Artificial Sequence: Synthetic oligonucleotide
aattaggaggcatactccaacagaagttaagcattacttgg

SEQ ID NO: 263209 - DNA, 40 bp, Artificial Sequence
  Description of Artificial Sequence: Synthetic oligonucleotide
attaggaggcatactccaacagaagttaagcattacttgg

SEQ ID NO: 263210 - DNA, 39 bp, Artificial Sequence
  Description of Artificial Sequence: Synthetic oligonucleotide
ttaggaggcatactccaacagaagttaagcattacttgg

SEQ ID NO: 263211 - DNA, 38 bp, Artificial Sequence
  Description of Artificial Sequence: Synthetic oligonucleotide
taggaggcatactccaacagaagttaagcattacttgg

SEQ ID NO: 263212 - DNA, 37 bp, Artificial Sequence
  Description of Artificial Sequence: Synthetic oligonucleotide
aggaggcatactccaacagaagttaagcattacttgg

SEQ ID NO: 263213 - DNA, 36 bp, Artificial Sequence
  Description of Artificial Sequence: Synthetic oligonucleotide
ggaggcatactccaacagaagttaagcattacttgg

SEQ ID NO: 263214 - DNA, 36 bp, Artificial Sequence
  Description of Artificial Sequence: Synthetic oligonucleotide
gaggcatactccaacagaagttaagcattacttggg

SEQ ID NO: 263215 - DNA, 37 bp, Artificial Sequence
  Description of Artificial Sequence: Synthetic oligonucleotide
aggcatactccaacagaagttaagcattacttgggtg

SEQ ID NO: 263216 - DNA, 36 bp, Artificial Sequence
  Description of Artificial Sequence: Synthetic oligonucleotide
ggcatactccaacagaagttaagcattacttgggtg

SEQ ID NO: 263217 - DNA, 36 bp, Artificial Sequence
  Description of Artificial Sequence: Synthetic oligonucleotide
gcatactccaacagaagttaagcattacttgggtgc

SEQ ID NO: 263218 - DNA, 36 bp, Artificial Sequence
  Description of Artificial Sequence: Synthetic oligonucleotide
catactccaacagaagttaagcattacttgggtgcc

SEQ ID NO: 263219 - DNA, 39 bp, Artificial Sequence
  Description of Artificial Sequence: Synthetic oligonucleotide
atactccaacagaagttaagcattacttgggtgccatag

SEQ ID NO: 263220 - DNA, 38 bp, Artificial Sequence
  Description of Artificial Sequence: Synthetic oligonucleotide
tactccaacagaagttaagcattacttgggtgccatag

SEQ ID NO: 263221 - DNA, 37 bp, Artificial Sequence
  Description of Artificial Sequence: Synthetic oligonucleotide
actccaacagaagttaagcattacttgggtgccatag

SEQ ID NO: 263222 - DNA, 36 bp, Artificial Sequence
  Description of Artificial Sequence: Synthetic oligonucleotide
ctccaacagaagttaagcattacttgggtgccatag

SEQ ID NO: 263223 - DNA, 36 bp, Artificial Sequence
  Description of Artificial Sequence: Synthetic oligonucleotide
tccaacagaagttaagcattacttgggtgccatagc

SEQ ID NO: 263224 - DNA, 35 bp, Artificial Sequence
  Description of Artificial Sequence: Synthetic oligonucleotide
ccaacagaagttaagcattacttgggtgccatagc

SEQ ID NO: 263225 - DNA, 30 bp, Artificial Sequence
  Description of Artificial Sequence: Synthetic oligonucleotide
atgtgctcaatcgccactgggtaagacctg

SEQ ID NO: 263226 - DNA, 29 bp, Artificial Sequence
  Description of Artificial Sequence: Synthetic oligonucleotide
tgtgctcaatcgccactgggtaagacctg

SEQ ID NO: 263227 - DNA, 28 bp, Artificial Sequence
  Description of Artificial Sequence: Synthetic oligonucleotide
gtgctcaatcgccactgggtaagacctg

SEQ ID NO: 263228 - DNA, 29 bp, Artificial Sequence
  Description of Artificial Sequence: Synthetic oligonucleotide
tgctcaatcgccactgggtaagacctgtc

SEQ ID NO: 263229 - DNA, 28 bp, Artificial Sequence
  Description of Artificial Sequence: Synthetic oligonucleotide
gctcaatcgccactgggtaagacctgtc

SEQ ID NO: 263230 - DNA, 29 bp, Artificial Sequence
  Description of Artificial Sequence: Synthetic oligonucleotide
ctcaatcgccactgggtaagacctgtcac

SEQ ID NO: 263231 - DNA, 29 bp, Artificial Sequence
  Description of Artificial Sequence: Synthetic oligonucleotide
tcaatcgccactgggtaagacctgtcacc

SEQ ID NO: 263232 - DNA, 28 bp, Artificial Sequence
  Description of Artificial Sequence: Synthetic oligonucleotide
caatcgccactgggtaagacctgtcacc

SEQ ID NO: 263233 - DNA, 28 bp, Artificial Sequence
  Description of Artificial Sequence: Synthetic oligonucleotide
aatcgccactgggtaagacctgtcaccc

SEQ ID NO: 263234 - DNA, 27 bp, Artificial Sequence
  Description of Artificial Sequence: Synthetic oligonucleotide
atcgccactgggtaagacctgtcaccc

SEQ ID NO: 263235 - DNA, 27 bp, Artificial Sequence
  Description of Artificial Sequence: Synthetic oligonucleotide
tcgccactgggtaagacctgtcaccct

SEQ ID NO: 263236 - DNA, 26 bp, Artificial Sequence
  Description of Artificial Sequence: Synthetic oligonucleotide
cgccactgggtaagacctgtcaccct

SEQ ID NO: 263237 - DNA, 27 bp, Artificial Sequence
  Description of Artificial Sequence: Synthetic oligonucleotide
gccactgggtaagacctgtcaccctct

SEQ ID NO: 263238 - DNA, 28 bp, Artificial Sequence
  Description of Artificial Sequence: Synthetic oligonucleotide
ccactgggtaagacctgtcaccctctac

SEQ ID NO: 263239 - DNA, 31 bp, Artificial Sequence
  Description of Artificial Sequence: Synthetic oligonucleotide
cactgggtaagacctgtcaccctctacatac

SEQ ID NO: 263240 - DNA, 32 bp, Artificial Sequence
  Description of Artificial Sequence: Synthetic oligonucleotide
actgggtaagacctgtcaccctctacatactc

SEQ ID NO: 263241 - DNA, 31 bp, Artificial Sequence
  Description of Artificial Sequence: Synthetic oligonucleotide
ctgggtaagacctgtcaccctctacatactc

SEQ ID NO: 263242 - DNA, 32 bp, Artificial Sequence
  Description of Artificial Sequence: Synthetic oligonucleotide
tgggtaagacctgtcaccctctacatactctc

SEQ ID NO: 263243 - DNA, 31 bp, Artificial Sequence
  Description of Artificial Sequence: Synthetic oligonucleotide
gggtaagacctgtcaccctctacatactctc

SEQ ID NO: 263244 - DNA, 31 bp, Artificial Sequence
  Description of Artificial Sequence: Synthetic oligonucleotide
ggtaagacctgtcaccctctacatactctcc

SEQ ID NO: 263245 - DNA, 32 bp, Artificial Sequence
  Description of Artificial Sequence: Synthetic oligonucleotide
gtaagacctgtcaccctctacatactctcctg

SEQ ID NO: 263246 - DNA, 33 bp, Artificial Sequence
  Description of Artificial Sequence: Synthetic oligonucleotide
taagacctgtcaccctctacatactctcctgag

SEQ ID NO: 263247 - DNA, 32 bp, Artificial Sequence
  Description of Artificial Sequence: Synthetic oligonucleotide
aagacctgtcaccctctacatactctcctgag

SEQ ID NO: 263248 - DNA, 31 bp, Artificial Sequence
  Description of Artificial Sequence: Synthetic oligonucleotide
agacctgtcaccctctacatactctcctgag

SEQ ID NO: 263249 - DNA, 30 bp, Artificial Sequence
  Description of Artificial Sequence: Synthetic oligonucleotide
gacctgtcaccctctacatactctcctgag

SEQ ID NO: 263250 - DNA, 30 bp, Artificial Sequence
  Description of Artificial Sequence: Synthetic oligonucleotide
acctgtcaccctctacatactctcctgagg

SEQ ID NO: 263251 - DNA, 29 bp, Artificial Sequence
  Description of Artificial Sequence: Synthetic oligonucleotide
cctgtcaccctctacatactctcctgagg

SEQ ID NO: 263252 - DNA, 29 bp, Artificial Sequence
  Description of Artificial Sequence: Synthetic oligonucleotide
ctgtcaccctctacatactctcctgaggg

SEQ ID NO: 263253 - DNA, 31 bp, Artificial Sequence
  Description of Artificial Sequence: Synthetic oligonucleotide
tgtcaccctctacatactctcctgagggaag

SEQ ID NO: 263254 - DNA, 30 bp, Artificial Sequence
  Description of Artificial Sequence: Synthetic oligonucleotide
gtcaccctctacatactctcctgagggaag

SEQ ID NO: 263255 - DNA, 31 bp, Artificial Sequence
  Description of Artificial Sequence: Synthetic oligonucleotide
tcaccctctacatactctcctgagggaagag

SEQ ID NO: 263256 - DNA, 30 bp, Artificial Sequence
  Description of Artificial Sequence: Synthetic oligonucleotide
caccctctacatactctcctgagggaagag

SEQ ID NO: 263257 - DNA, 35 bp, Artificial Sequence
  Description of Artificial Sequence: Synthetic oligonucleotide
accctctacatactctcctgagggaagagttattc

SEQ ID NO: 263258 - DNA, 34 bp, Artificial Sequence
  Description of Artificial Sequence: Synthetic oligonucleotide
ccctctacatactctcctgagggaagagttattc

SEQ ID NO: 263259 - DNA, 36 bp, Artificial Sequence
  Description of Artificial Sequence: Synthetic oligonucleotide
cctctacatactctcctgagggaagagttattcaag

SEQ ID NO: 263260 - DNA, 38 bp, Artificial Sequence
  Description of Artificial Sequence: Synthetic oligonucleotide
ctctacatactctcctgagggaagagttattcaagttg

SEQ ID NO: 263261 - DNA, 43 bp, Artificial Sequence
  Description of Artificial Sequence: Synthetic oligonucleotide
tctacatactctcctgagggaagagttattcaagttgtatatg

SEQ ID NO: 263262 - DNA, 42 bp, Artificial Sequence
  Description of Artificial Sequence: Synthetic oligonucleotide
ctacatactctcctgagggaagagttattcaagttgtatatg

SEQ ID NO: 263263 - DNA, 42 bp, Artificial Sequence
  Description of Artificial Sequence: Synthetic oligonucleotide
tacatactctcctgagggaagagttattcaagttgtatatgc

SEQ ID NO: 263264 - DNA, 41 bp, Artificial Sequence
  Description of Artificial Sequence: Synthetic oligonucleotide
acatactctcctgagggaagagttattcaagttgtatatgc

SEQ ID NO: 263265 - DNA, 40 bp, Artificial Sequence
  Description of Artificial Sequence: Synthetic oligonucleotide
catactctcctgagggaagagttattcaagttgtatatgc

SEQ ID NO: 263266 - DNA, 43 bp, Artificial Sequence
  Description of Artificial Sequence: Synthetic oligonucleotide
atactctcctgagggaagagttattcaagttgtatatgctatc

SEQ ID NO: 263267 - DNA, 42 bp, Artificial Sequence
  Description of Artificial Sequence: Synthetic oligonucleotide
tactctcctgagggaagagttattcaagttgtatatgctatc

SEQ ID NO: 263268 - DNA, 41 bp, Artificial Sequence
  Description of Artificial Sequence: Synthetic oligonucleotide
actctcctgagggaagagttattcaagttgtatatgctatc

SEQ ID NO: 263269 - DNA, 40 bp, Artificial Sequence
  Description of Artificial Sequence: Synthetic oligonucleotide
ctctcctgagggaagagttattcaagttgtatatgctatc

SEQ ID NO: 263270 - DNA, 42 bp, Artificial Sequence
  Description of Artificial Sequence: Synthetic oligonucleotide
tctcctgagggaagagttattcaagttgtatatgctatcaag

SEQ ID NO: 263271 - DNA, 41 bp, Artificial Sequence
  Description of Artificial Sequence: Synthetic oligonucleotide
ctcctgagggaagagttattcaagttgtatatgctatcaag

SEQ ID NO: 263272 - DNA, 41 bp, Artificial Sequence
  Description of Artificial Sequence: Synthetic oligonucleotide
tcctgagggaagagttattcaagttgtatatgctatcaagg

SEQ ID NO: 263273 - DNA, 40 bp, Artificial Sequence
  Description of Artificial Sequence: Synthetic oligonucleotide
cctgagggaagagttattcaagttgtatatgctatcaagg

SEQ ID NO: 263274 - DNA, 40 bp, Artificial Sequence
  Description of Artificial Sequence: Synthetic oligonucleotide
ctgagggaagagttattcaagttgtatatgctatcaaggc

SEQ ID NO: 263275 - DNA, 41 bp, Artificial Sequence
  Description of Artificial Sequence: Synthetic oligonucleotide
tgagggaagagttattcaagttgtatatgctatcaaggctg

SEQ ID NO: 263276 - DNA, 40 bp, Artificial Sequence
  Description of Artificial Sequence: Synthetic oligonucleotide
gagggaagagttattcaagttgtatatgctatcaaggctg

SEQ ID NO: 263277 - DNA, 41 bp, Artificial Sequence
  Description of Artificial Sequence: Synthetic oligonucleotide
agggaagagttattcaagttgtatatgctatcaaggctgtg

SEQ ID NO: 263278 - DNA, 40 bp, Artificial Sequence
  Description of Artificial Sequence: Synthetic oligonucleotide
gggaagagttattcaagttgtatatgctatcaaggctgtg

SEQ ID NO: 263279 - DNA, 40 bp, Artificial Sequence
  Description of Artificial Sequence: Synthetic oligonucleotide
ggaagagttattcaagttgtatatgctatcaaggctgtgc

SEQ ID NO: 263280 - DNA, 46 bp, Artificial Sequence
  Description of Artificial Sequence: Synthetic oligonucleotide
gaagagttattcaagttgtatatgctatcaaggctgtgcaaaatag

SEQ ID NO: 263281 - DNA, 48 bp, Artificial Sequence
  Description of Artificial Sequence: Synthetic oligonucleotide
aagagttattcaagttgtatatgctatcaaggctgtgcaaaatagtac

SEQ ID NO: 263282 - DNA, 47 bp, Artificial Sequence
  Description of Artificial Sequence: Synthetic oligonucleotide
agagttattcaagttgtatatgctatcaaggctgtgcaaaatagtac

SEQ ID NO: 263283 - DNA, 46 bp, Artificial Sequence
  Description of Artificial Sequence: Synthetic oligonucleotide
gagttattcaagttgtatatgctatcaaggctgtgcaaaatagtac

SEQ ID NO: 263284 - DNA, 48 bp, Artificial Sequence
  Description of Artificial Sequence: Synthetic oligonucleotide
agttattcaagttgtatatgctatcaaggctgtgcaaaatagtactac

SEQ ID NO: 263285 - DNA, 47 bp, Artificial Sequence
  Description of Artificial Sequence: Synthetic oligonucleotide
gttattcaagttgtatatgctatcaaggctgtgcaaaatagtactac

SEQ ID NO: 263286 - DNA, 48 bp, Artificial Sequence
  Description of Artificial Sequence: Synthetic oligonucleotide
ttattcaagttgtatatgctatcaaggctgtgcaaaatagtactacag

SEQ ID NO: 263287 - DNA, 47 bp, Artificial Sequence
  Description of Artificial Sequence: Synthetic oligonucleotide
tattcaagttgtatatgctatcaaggctgtgcaaaatagtactacag

SEQ ID NO: 263288 - DNA, 46 bp, Artificial Sequence
  Description of Artificial Sequence: Synthetic oligonucleotide
attcaagttgtatatgctatcaaggctgtgcaaaatagtactacag

SEQ ID NO: 263289 - DNA, 45 bp, Artificial Sequence
  Description of Artificial Sequence: Synthetic oligonucleotide
ttcaagttgtatatgctatcaaggctgtgcaaaatagtactacag

SEQ ID NO: 263290 - DNA, 44 bp, Artificial Sequence
  Description of Artificial Sequence: Synthetic oligonucleotide
tcaagttgtatatgctatcaaggctgtgcaaaatagtactacag

SEQ ID NO: 263291 - DNA, 43 bp, Artificial Sequence
  Description of Artificial Sequence: Synthetic oligonucleotide
caagttgtatatgctatcaaggctgtgcaaaatagtactacag

SEQ ID NO: 263292 - DNA, 43 bp, Artificial Sequence
  Description of Artificial Sequence: Synthetic oligonucleotide
aagttgtatatgctatcaaggctgtgcaaaatagtactacagc

SEQ ID NO: 263293 - DNA, 42 bp, Artificial Sequence
  Description of Artificial Sequence: Synthetic oligonucleotide
agttgtatatgctatcaaggctgtgcaaaatagtactacagc

SEQ ID NO: 263294 - DNA, 41 bp, Artificial Sequence
  Description of Artificial Sequence: Synthetic oligonucleotide
gttgtatatgctatcaaggctgtgcaaaatagtactacagc

SEQ ID NO: 263295 - DNA, 45 bp, Artificial Sequence
  Description of Artificial Sequence: Synthetic oligonucleotide
ttgtatatgctatcaaggctgtgcaaaatagtactacagctatag

SEQ ID NO: 263296 - DNA, 44 bp, Artificial Sequence
  Description of Artificial Sequence: Synthetic oligonucleotide
tgtatatgctatcaaggctgtgcaaaatagtactacagctatag

SEQ ID NO: 263297 - DNA, 43 bp, Artificial Sequence
  Description of Artificial Sequence: Synthetic oligonucleotide
gtatatgctatcaaggctgtgcaaaatagtactacagctatag

SEQ ID NO: 263298 - DNA, 43 bp, Artificial Sequence
  Description of Artificial Sequence: Synthetic oligonucleotide
tatatgctatcaaggctgtgcaaaatagtactacagctatagg

SEQ ID NO: 263299 - DNA, 42 bp, Artificial Sequence
  Description of Artificial Sequence: Synthetic oligonucleotide
atatgctatcaaggctgtgcaaaatagtactacagctatagg

SEQ ID NO: 263300 - DNA, 41 bp, Artificial Sequence
  Description of Artificial Sequence: Synthetic oligonucleotide
tatgctatcaaggctgtgcaaaatagtactacagctatagg

SEQ ID NO: 263301 - DNA, 40 bp, Artificial Sequence
  Description of Artificial Sequence: Synthetic oligonucleotide
atgctatcaaggctgtgcaaaatagtactacagctatagg

SEQ ID NO: 263302 - DNA, 39 bp, Artificial Sequence
  Description of Artificial Sequence: Synthetic oligonucleotide
tgctatcaaggctgtgcaaaatagtactacagctatagg

SEQ ID NO: 263303 - DNA, 38 bp, Artificial Sequence
  Description of Artificial Sequence: Synthetic oligonucleotide
gctatcaaggctgtgcaaaatagtactacagctatagg

SEQ ID NO: 263304 - DNA, 41 bp, Artificial Sequence
  Description of Artificial Sequence: Synthetic oligonucleotide
ctatcaaggctgtgcaaaatagtactacagctataggaatc

SEQ ID NO: 263305 - DNA, 42 bp, Artificial Sequence
  Description of Artificial Sequence: Synthetic oligonucleotide
tatcaaggctgtgcaaaatagtactacagctataggaatcag

SEQ ID NO: 263306 - DNA, 41 bp, Artificial Sequence
  Description of Artificial Sequence: Synthetic oligonucleotide
atcaaggctgtgcaaaatagtactacagctataggaatcag

SEQ ID NO: 263307 - DNA, 40 bp, Artificial Sequence
  Description of Artificial Sequence: Synthetic oligonucleotide
tcaaggctgtgcaaaatagtactacagctataggaatcag

SEQ ID NO: 263308 - DNA, 39 bp, Artificial Sequence
  Description of Artificial Sequence: Synthetic oligonucleotide
caaggctgtgcaaaatagtactacagctataggaatcag

SEQ ID NO: 263309 - DNA, 41 bp, Artificial Sequence
  Description of Artificial Sequence: Synthetic oligonucleotide
aaggctgtgcaaaatagtactacagctataggaatcagaag

SEQ ID NO: 263310 - DNA, 40 bp, Artificial Sequence
  Description of Artificial Sequence: Synthetic oligonucleotide
aggctgtgcaaaatagtactacagctataggaatcagaag

SEQ ID NO: 263311 - DNA, 39 bp, Artificial Sequence
  Description of Artificial Sequence: Synthetic oligonucleotide
ggctgtgcaaaatagtactacagctataggaatcagaag

SEQ ID NO: 263312 - DNA, 39 bp, Artificial Sequence
  Description of Artificial Sequence: Synthetic oligonucleotide
gctgtgcaaaatagtactacagctataggaatcagaagc

SEQ ID NO: 263313 - DNA, 42 bp, Artificial Sequence
  Description of Artificial Sequence: Synthetic oligonucleotide
ctgtgcaaaatagtactacagctataggaatcagaagcaaag

SEQ ID NO: 263314 - DNA, 44 bp, Artificial Sequence
  Description of Artificial Sequence: Synthetic oligonucleotide
tgtgcaaaatagtactacagctataggaatcagaagcaaagatg

SEQ ID NO: 263315 - DNA, 43 bp, Artificial Sequence
  Description of Artificial Sequence: Synthetic oligonucleotide
gtgcaaaatagtactacagctataggaatcagaagcaaagatg

SEQ ID NO: 263316 - DNA, 43 bp, Artificial Sequence
  Description of Artificial Sequence: Synthetic oligonucleotide
tgcaaaatagtactacagctataggaatcagaagcaaagatgc

SEQ ID NO: 263317 - DNA, 42 bp, Artificial Sequence
  Description of Artificial Sequence: Synthetic oligonucleotide
gcaaaatagtactacagctataggaatcagaagcaaagatgc

SEQ ID NO: 263318 - DNA, 43 bp, Artificial Sequence
  Description of Artificial Sequence: Synthetic oligonucleotide
caaaatagtactacagctataggaatcagaagcaaagatgctg

SEQ ID NO: 263319 - DNA, 45 bp, Artificial Sequence
  Description of Artificial Sequence: Synthetic oligonucleotide
aaaatagtactacagctataggaatcagaagcaaagatgctgttg

SEQ ID NO: 263320 - DNA, 44 bp, Artificial Sequence
  Description of Artificial Sequence: Synthetic oligonucleotide
aaatagtactacagctataggaatcagaagcaaagatgctgttg

SEQ ID NO: 263321 - DNA, 43 bp, Artificial Sequence
  Description of Artificial Sequence: Synthetic oligonucleotide
aatagtactacagctataggaatcagaagcaaagatgctgttg

SEQ ID NO: 263322 - DNA, 42 bp, Artificial Sequence
  Description of Artificial Sequence: Synthetic oligonucleotide
atagtactacagctataggaatcagaagcaaagatgctgttg

SEQ ID NO: 263323 - DNA, 41 bp, Artificial Sequence
  Description of Artificial Sequence: Synthetic oligonucleotide
tagtactacagctataggaatcagaagcaaagatgctgttg

SEQ ID NO: 263324 - DNA, 40 bp, Artificial Sequence
  Description of Artificial Sequence: Synthetic oligonucleotide
agtactacagctataggaatcagaagcaaagatgctgttg

SEQ ID NO: 263325 - DNA, 39 bp, Artificial Sequence
  Description of Artificial Sequence: Synthetic oligonucleotide
gtactacagctataggaatcagaagcaaagatgctgttg

SEQ ID NO: 263326 - DNA, 40 bp, Artificial Sequence
  Description of Artificial Sequence: Synthetic oligonucleotide
tactacagctataggaatcagaagcaaagatgctgttgtc

SEQ ID NO: 263327 - DNA, 39 bp, Artificial Sequence
  Description of Artificial Sequence: Synthetic oligonucleotide
actacagctataggaatcagaagcaaagatgctgttgtc

SEQ ID NO: 263328 - DNA, 38 bp, Artificial Sequence
  Description of Artificial Sequence: Synthetic oligonucleotide
ctacagctataggaatcagaagcaaagatgctgttgtc

SEQ ID NO: 263329 - DNA, 41 bp, Artificial Sequence
  Description of Artificial Sequence: Synthetic oligonucleotide
tacagctataggaatcagaagcaaagatgctgttgtcttag

SEQ ID NO: 263330 - DNA, 40 bp, Artificial Sequence
  Description of Artificial Sequence: Synthetic oligonucleotide
acagctataggaatcagaagcaaagatgctgttgtcttag

SEQ ID NO: 263331 - DNA, 39 bp, Artificial Sequence
  Description of Artificial Sequence: Synthetic oligonucleotide
cagctataggaatcagaagcaaagatgctgttgtcttag

SEQ ID NO: 263332 - DNA, 39 bp, Artificial Sequence
  Description of Artificial Sequence: Synthetic oligonucleotide
agctataggaatcagaagcaaagatgctgttgtcttagg

SEQ ID NO: 263333 - DNA, 38 bp, Artificial Sequence
  Description of Artificial Sequence: Synthetic oligonucleotide
gctataggaatcagaagcaaagatgctgttgtcttagg

SEQ ID NO: 263334 - DNA, 38 bp, Artificial Sequence
  Description of Artificial Sequence: Synthetic oligonucleotide
ctataggaatcagaagcaaagatgctgttgtcttaggg

SEQ ID NO: 263335 - DNA, 38 bp, Artificial Sequence
  Description of Artificial Sequence: Synthetic oligonucleotide
tataggaatcagaagcaaagatgctgttgtcttagggg

SEQ ID NO: 263336 - DNA, 37 bp, Artificial Sequence
  Description of Artificial Sequence: Synthetic oligonucleotide
ataggaatcagaagcaaagatgctgttgtcttagggg

SEQ ID NO: 263337 - DNA, 36 bp, Artificial Sequence
  Description of Artificial Sequence: Synthetic oligonucleotide
taggaatcagaagcaaagatgctgttgtcttagggg

SEQ ID NO: 263338 - DNA, 35 bp, Artificial Sequence
  Description of Artificial Sequence: Synthetic oligonucleotide
aggaatcagaagcaaagatgctgttgtcttagggg

SEQ ID NO: 263339 - DNA, 34 bp, Artificial Sequence
  Description of Artificial Sequence: Synthetic oligonucleotide
ggaatcagaagcaaagatgctgttgtcttagggg

SEQ ID NO: 263340 - DNA, 36 bp, Artificial Sequence
  Description of Artificial Sequence: Synthetic oligonucleotide
gaatcagaagcaaagatgctgttgtcttaggggtag

SEQ ID NO: 263341 - DNA, 44 bp, Artificial Sequence
  Description of Artificial Sequence: Synthetic oligonucleotide
aatcagaagcaaagatgctgttgtcttaggggtagaataattag

SEQ ID NO: 263342 - DNA, 43 bp, Artificial Sequence
  Description of Artificial Sequence: Synthetic oligonucleotide
atcagaagcaaagatgctgttgtcttaggggtagaataattag

SEQ ID NO: 263343 - DNA, 42 bp, Artificial Sequence
  Description of Artificial Sequence: Synthetic oligonucleotide
tcagaagcaaagatgctgttgtcttaggggtagaataattag

SEQ ID NO: 263344 - DNA, 41 bp, Artificial Sequence
  Description of Artificial Sequence: Synthetic oligonucleotide
cagaagcaaagatgctgttgtcttaggggtagaataattag

SEQ ID NO: 263345 - DNA, 42 bp, Artificial Sequence
  Description of Artificial Sequence: Synthetic oligonucleotide
agaagcaaagatgctgttgtcttaggggtagaataattagtc

SEQ ID NO: 263346 - DNA, 41 bp, Artificial Sequence
  Description of Artificial Sequence: Synthetic oligonucleotide
gaagcaaagatgctgttgtcttaggggtagaataattagtc

SEQ ID NO: 263347 - DNA, 41 bp, Artificial Sequence
  Description of Artificial Sequence: Synthetic oligonucleotide
aagcaaagatgctgttgtcttaggggtagaataattagtcc

SEQ ID NO: 263348 - DNA, 40 bp, Artificial Sequence
  Description of Artificial Sequence: Synthetic oligonucleotide
agcaaagatgctgttgtcttaggggtagaataattagtcc

SEQ ID NO: 263349 - DNA, 39 bp, Artificial Sequence
  Description of Artificial Sequence: Synthetic oligonucleotide
gcaaagatgctgttgtcttaggggtagaataattagtcc

SEQ ID NO: 263350 - DNA, 42 bp, Artificial Sequence
  Description of Artificial Sequence: Synthetic oligonucleotide
caaagatgctgttgtcttaggggtagaataattagtccattc

SEQ ID NO: 263351 - DNA, 46 bp, Artificial Sequence
  Description of Artificial Sequence: Synthetic oligonucleotide
aaagatgctgttgtcttaggggtagaataattagtccattctaaac

SEQ ID NO: 263352 - DNA, 45 bp, Artificial Sequence
  Description of Artificial Sequence: Synthetic oligonucleotide
aagatgctgttgtcttaggggtagaataattagtccattctaaac

SEQ ID NO: 263353 - DNA, 44 bp, Artificial Sequence
  Description of Artificial Sequence: Synthetic oligonucleotide
agatgctgttgtcttaggggtagaataattagtccattctaaac

SEQ ID NO: 263354 - DNA, 43 bp, Artificial Sequence
  Description of Artificial Sequence: Synthetic oligonucleotide
gatgctgttgtcttaggggtagaataattagtccattctaaac

SEQ ID NO: 263355 - DNA, 48 bp, Artificial Sequence
  Description of Artificial Sequence: Synthetic oligonucleotide
atgctgttgtcttaggggtagaataattagtccattctaaactatatg

SEQ ID NO: 263356 - DNA, 47 bp, Artificial Sequence
  Description of Artificial Sequence: Synthetic oligonucleotide
tgctgttgtcttaggggtagaataattagtccattctaaactatatg

SEQ ID NO: 263357 - DNA, 46 bp, Artificial Sequence
  Description of Artificial Sequence: Synthetic oligonucleotide
gctgttgtcttaggggtagaataattagtccattctaaactatatg

SEQ ID NO: 263358 - DNA, 48 bp, Artificial Sequence
  Description of Artificial Sequence: Synthetic oligonucleotide
ctgttgtcttaggggtagaataattagtccattctaaactatatgaag

SEQ ID NO: 263359 - DNA, 50 bp, Artificial Sequence
  Description of Artificial Sequence: Synthetic oligonucleotide
tgttgtcttaggggtagaataattagtccattctaaactatatgaagaac

SEQ ID NO: 263360 - DNA, 49 bp, Artificial Sequence
  Description of Artificial Sequence: Synthetic oligonucleotide
gttgtcttaggggtagaataattagtccattctaaactatatgaagaac

SEQ ID NO: 263361 - DNA, 49 bp, Artificial Sequence
  Description of Artificial Sequence: Synthetic oligonucleotide
ttgtcttaggggtagaataattagtccattctaaactatatgaagaacg

SEQ ID NO: 263362 - DNA, 48 bp, Artificial Sequence
  Description of Artificial Sequence: Synthetic oligonucleotide
tgtcttaggggtagaataattagtccattctaaactatatgaagaacg

SEQ ID NO: 263363 - DNA, 47 bp, Artificial Sequence
  Description of Artificial Sequence: Synthetic oligonucleotide
gtcttaggggtagaataattagtccattctaaactatatgaagaacg

SEQ ID NO: 263364 - DNA, 49 bp, Artificial Sequence
  Description of Artificial Sequence: Synthetic oligonucleotide
tcttaggggtagaataattagtccattctaaactatatgaagaacgttc

SEQ ID NO: 263365 - DNA, 48 bp, Artificial Sequence
  Description of Artificial Sequence: Synthetic oligonucleotide
cttaggggtagaataattagtccattctaaactatatgaagaacgttc

SEQ ID NO: 263366 - DNA, 48 bp, Artificial Sequence
  Description of Artificial Sequence: Synthetic oligonucleotide
ttaggggtagaataattagtccattctaaactatatgaagaacgttcc

SEQ ID NO: 263367 - DNA, 47 bp, Artificial Sequence
  Description of Artificial Sequence: Synthetic oligonucleotide
taggggtagaataattagtccattctaaactatatgaagaacgttcc

SEQ ID NO: 263368 - DNA, 46 bp, Artificial Sequence
  Description of Artificial Sequence: Synthetic oligonucleotide
aggggtagaataattagtccattctaaactatatgaagaacgttcc

SEQ ID NO: 263369 - DNA, 45 bp, Artificial Sequence
  Description of Artificial Sequence: Synthetic oligonucleotide
ggggtagaataattagtccattctaaactatatgaagaacgttcc

SEQ ID NO: 263370 - DNA, 47 bp, Artificial Sequence
  Description of Artificial Sequence: Synthetic oligonucleotide
gggtagaataattagtccattctaaactatatgaagaacgttccaac

SEQ ID NO: 263371 - DNA, 51 bp, Artificial Sequence
  Description of Artificial Sequence: Synthetic oligonucleotide
ggtagaataattagtccattctaaactatatgaagaacgttccaacataag

SEQ ID NO: 263372 - DNA, 52 bp, Artificial Sequence
  Description of Artificial Sequence: Synthetic oligonucleotide
gtagaataattagtccattctaaactatatgaagaacgttccaacataagac

SEQ ID NO: 263373 - DNA, 60 bp, Artificial Sequence
  Description of Artificial Sequence: Synthetic oligonucleotide
tagaataattagtccattctaaactatatgaagaacgttccaacataagacttttaaatg

SEQ ID NO: 263374 - DNA, 59 bp, Artificial Sequence
  Description of Artificial Sequence: Synthetic oligonucleotide
agaataattagtccattctaaactatatgaagaacgttccaacataagacttttaaatg

SEQ ID NO: 263375 - DNA, 58 bp, Artificial Sequence
  Description of Artificial Sequence: Synthetic oligonucleotide
gaataattagtccattctaaactatatgaagaacgttccaacataagacttttaaatg

SEQ ID NO: 263376 - DNA, 60 bp, Artificial Sequence
  Description of Artificial Sequence: Synthetic oligonucleotide
aataattagtccattctaaactatatgaagaacgttccaacataagacttttaaatgttg

SEQ ID NO: 263377 - DNA, 59 bp, Artificial Sequence
  Description of Artificial Sequence: Synthetic oligonucleotide
ataattagtccattctaaactatatgaagaacgttccaacataagacttttaaatgttg

SEQ ID NO: 263378 - DNA, 58 bp, Artificial Sequence
  Description of Artificial Sequence: Synthetic oligonucleotide
taattagtccattctaaactatatgaagaacgttccaacataagacttttaaatgttg

SEQ ID NO: 263379 - DNA, 57 bp, Artificial Sequence
  Description of Artificial Sequence: Synthetic oligonucleotide
aattagtccattctaaactatatgaagaacgttccaacataagacttttaaatgttg

SEQ ID NO: 263380 - DNA, 56 bp, Artificial Sequence
  Description of Artificial Sequence: Synthetic oligonucleotide
attagtccattctaaactatatgaagaacgttccaacataagacttttaaatgttg

SEQ ID NO: 263381 - DNA, 55 bp, Artificial Sequence
  Description of Artificial Sequence: Synthetic oligonucleotide
ttagtccattctaaactatatgaagaacgttccaacataagacttttaaatgttg

SEQ ID NO: 263382 - DNA, 54 bp, Artificial Sequence
  Description of Artificial Sequence: Synthetic oligonucleotide
tagtccattctaaactatatgaagaacgttccaacataagacttttaaatgttg

SEQ ID NO: 263383 - DNA, 53 bp, Artificial Sequence
  Description of Artificial Sequence: Synthetic oligonucleotide
agtccattctaaactatatgaagaacgttccaacataagacttttaaatgttg

SEQ ID NO: 263384 - DNA, 52 bp, Artificial Sequence
  Description of Artificial Sequence: Synthetic oligonucleotide
gtccattctaaactatatgaagaacgttccaacataagacttttaaatgttg

SEQ ID NO: 263385 - DNA, 54 bp, Artificial Sequence
  Description of Artificial Sequence: Synthetic oligonucleotide
tccattctaaactatatgaagaacgttccaacataagacttttaaatgttgatg

SEQ ID NO: 263386 - DNA, 53 bp, Artificial Sequence
  Description of Artificial Sequence: Synthetic oligonucleotide
ccattctaaactatatgaagaacgttccaacataagacttttaaatgttgatg

SEQ ID NO: 263387 - DNA, 53 bp, Artificial Sequence
  Description of Artificial Sequence: Synthetic oligonucleotide
cattctaaactatatgaagaacgttccaacataagacttttaaatgttgatgg

SEQ ID NO: 263388 - DNA, 53 bp, Artificial Sequence
  Description of Artificial Sequence: Synthetic oligonucleotide
attctaaactatatgaagaacgttccaacataagacttttaaatgttgatggg

SEQ ID NO: 263389 - DNA, 52 bp, Artificial Sequence
  Description of Artificial Sequence: Synthetic oligonucleotide
ttctaaactatatgaagaacgttccaacataagacttttaaatgttgatggg

SEQ ID NO: 263390 - DNA, 51 bp, Artificial Sequence
  Description of Artificial Sequence: Synthetic oligonucleotide
tctaaactatatgaagaacgttccaacataagacttttaaatgttgatggg

SEQ ID NO: 263391 - DNA, 50 bp, Artificial Sequence
  Description of Artificial Sequence: Synthetic oligonucleotide
ctaaactatatgaagaacgttccaacataagacttttaaatgttgatggg

SEQ ID NO: 263392 - DNA, 50 bp, Artificial Sequence
  Description of Artificial Sequence: Synthetic oligonucleotide
taaactatatgaagaacgttccaacataagacttttaaatgttgatgggc

SEQ ID NO: 263393 - DNA, 49 bp, Artificial Sequence
  Description of Artificial Sequence: Synthetic oligonucleotide
aaactatatgaagaacgttccaacataagacttttaaatgttgatgggc

SEQ ID NO: 263394 - DNA, 48 bp, Artificial Sequence
  Description of Artificial Sequence: Synthetic oligonucleotide
aactatatgaagaacgttccaacataagacttttaaatgttgatgggc

SEQ ID NO: 263395 - DNA, 47 bp, Artificial Sequence
  Description of Artificial Sequence: Synthetic oligonucleotide
actatatgaagaacgttccaacataagacttttaaatgttgatgggc

SEQ ID NO: 263396 - DNA, 46 bp, Artificial Sequence
  Description of Artificial Sequence: Synthetic oligonucleotide
ctatatgaagaacgttccaacataagacttttaaatgttgatgggc

SEQ ID NO: 263397 - DNA, 48 bp, Artificial Sequence
  Description of Artificial Sequence: Synthetic oligonucleotide
tatatgaagaacgttccaacataagacttttaaatgttgatgggcatg

SEQ ID NO: 263398 - DNA, 47 bp, Artificial Sequence
  Description of Artificial Sequence: Synthetic oligonucleotide
atatgaagaacgttccaacataagacttttaaatgttgatgggcatg

SEQ ID NO: 263399 - DNA, 46 bp, Artificial Sequence
  Description of Artificial Sequence: Synthetic oligonucleotide
tatgaagaacgttccaacataagacttttaaatgttgatgggcatg

SEQ ID NO: 263400 - DNA, 45 bp, Artificial Sequence
  Description of Artificial Sequence: Synthetic oligonucleotide
atgaagaacgttccaacataagacttttaaatgttgatgggcatg

SEQ ID NO: 263401 - DNA, 44 bp, Artificial Sequence
  Description of Artificial Sequence: Synthetic oligonucleotide
tgaagaacgttccaacataagacttttaaatgttgatgggcatg

SEQ ID NO: 263402 - DNA, 43 bp, Artificial Sequence
  Description of Artificial Sequence: Synthetic oligonucleotide
gaagaacgttccaacataagacttttaaatgttgatgggcatg

SEQ ID NO: 263403 - DNA, 45 bp, Artificial Sequence
  Description of Artificial Sequence: Synthetic oligonucleotide
aagaacgttccaacataagacttttaaatgttgatgggcatgttg

SEQ ID NO: 263404 - DNA, 44 bp, Artificial Sequence
  Description of Artificial Sequence: Synthetic oligonucleotide
agaacgttccaacataagacttttaaatgttgatgggcatgttg

SEQ ID NO: 263405 - DNA, 43 bp, Artificial Sequence
  Description of Artificial Sequence: Synthetic oligonucleotide
gaacgttccaacataagacttttaaatgttgatgggcatgttg

SEQ ID NO: 263406 - DNA, 43 bp, Artificial Sequence
  Description of Artificial Sequence: Synthetic oligonucleotide
aacgttccaacataagacttttaaatgttgatgggcatgttgc

SEQ ID NO: 263407 - DNA, 42 bp, Artificial Sequence
  Description of Artificial Sequence: Synthetic oligonucleotide
acgttccaacataagacttttaaatgttgatgggcatgttgc

SEQ ID NO: 263408 - DNA, 41 bp, Artificial Sequence
  Description of Artificial Sequence: Synthetic oligonucleotide
cgttccaacataagacttttaaatgttgatgggcatgttgc

SEQ ID NO: 263409 - DNA, 44 bp, Artificial Sequence
  Description of Artificial Sequence: Synthetic oligonucleotide
gttccaacataagacttttaaatgttgatgggcatgttgcaatg

SEQ ID NO: 263410 - DNA, 44 bp, Artificial Sequence
  Description of Artificial Sequence: Synthetic oligonucleotide
ttccaacataagacttttaaatgttgatgggcatgttgcaatgg

SEQ ID NO: 263411 - DNA, 43 bp, Artificial Sequence
  Description of Artificial Sequence: Synthetic oligonucleotide
tccaacataagacttttaaatgttgatgggcatgttgcaatgg

SEQ ID NO: 263412 - DNA, 42 bp, Artificial Sequence
  Description of Artificial Sequence: Synthetic oligonucleotide
ccaacataagacttttaaatgttgatgggcatgttgcaatgg

SEQ ID NO: 263413 - DNA, 42 bp, Artificial Sequence
  Description of Artificial Sequence: Synthetic oligonucleotide
caacataagacttttaaatgttgatgggcatgttgcaatggc

SEQ ID NO: 263414 - DNA, 43 bp, Artificial Sequence
  Description of Artificial Sequence: Synthetic oligonucleotide
aacataagacttttaaatgttgatgggcatgttgcaatggcag

SEQ ID NO: 263415 - DNA, 42 bp, Artificial Sequence
  Description of Artificial Sequence: Synthetic oligonucleotide
acataagacttttaaatgttgatgggcatgttgcaatggcag

SEQ ID NO: 263416 - DNA, 41 bp, Artificial Sequence
  Description of Artificial Sequence: Synthetic oligonucleotide
cataagacttttaaatgttgatgggcatgttgcaatggcag

SEQ ID NO: 263417 - DNA, 43 bp, Artificial Sequence
  Description of Artificial Sequence: Synthetic oligonucleotide
ataagacttttaaatgttgatgggcatgttgcaatggcagttg

SEQ ID NO: 263418 - DNA, 42 bp, Artificial Sequence
  Description of Artificial Sequence: Synthetic oligonucleotide
taagacttttaaatgttgatgggcatgttgcaatggcagttg

SEQ ID NO: 263419 - DNA, 41 bp, Artificial Sequence
  Description of Artificial Sequence: Synthetic oligonucleotide
aagacttttaaatgttgatgggcatgttgcaatggcagttg

SEQ ID NO: 263420 - DNA, 40 bp, Artificial Sequence
  Description of Artificial Sequence: Synthetic oligonucleotide
agacttttaaatgttgatgggcatgttgcaatggcagttg

SEQ ID NO: 263421 - DNA, 39 bp, Artificial Sequence
  Description of Artificial Sequence: Synthetic oligonucleotide
gacttttaaatgttgatgggcatgttgcaatggcagttg

SEQ ID NO: 263422 - DNA, 39 bp, Artificial Sequence
  Description of Artificial Sequence: Synthetic oligonucleotide
acttttaaatgttgatgggcatgttgcaatggcagttgc

SEQ ID NO: 263423 - DNA, 38 bp, Artificial Sequence
  Description of Artificial Sequence: Synthetic oligonucleotide
cttttaaatgttgatgggcatgttgcaatggcagttgc

SEQ ID NO: 263424 - DNA, 39 bp, Artificial Sequence
  Description of Artificial Sequence: Synthetic oligonucleotide
ttttaaatgttgatgggcatgttgcaatggcagttgcag

SEQ ID NO: 263425 - DNA, 38 bp, Artificial Sequence
  Description of Artificial Sequence: Synthetic oligonucleotide
tttaaatgttgatgggcatgttgcaatggcagttgcag

SEQ ID NO: 263426 - DNA, 37 bp, Artificial Sequence
  Description of Artificial Sequence: Synthetic oligonucleotide
ttaaatgttgatgggcatgttgcaatggcagttgcag

SEQ ID NO: 263427 - DNA, 36 bp, Artificial Sequence
  Description of Artificial Sequence: Synthetic oligonucleotide
taaatgttgatgggcatgttgcaatggcagttgcag

SEQ ID NO: 263428 - DNA, 35 bp, Artificial Sequence
  Description of Artificial Sequence: Synthetic oligonucleotide
aaatgttgatgggcatgttgcaatggcagttgcag

SEQ ID NO: 263429 - DNA, 34 bp, Artificial Sequence
  Description of Artificial Sequence: Synthetic oligonucleotide
aatgttgatgggcatgttgcaatggcagttgcag

SEQ ID NO: 263430 - DNA, 33 bp, Artificial Sequence
  Description of Artificial Sequence: Synthetic oligonucleotide
atgttgatgggcatgttgcaatggcagttgcag

SEQ ID NO: 263431 - DNA, 32 bp, Artificial Sequence
  Description of Artificial Sequence: Synthetic oligonucleotide
tgttgatgggcatgttgcaatggcagttgcag

SEQ ID NO: 263432 - DNA, 31 bp, Artificial Sequence
  Description of Artificial Sequence: Synthetic oligonucleotide
gttgatgggcatgttgcaatggcagttgcag

SEQ ID NO: 263433 - DNA, 31 bp, Artificial Sequence
  Description of Artificial Sequence: Synthetic oligonucleotide
ttgatgggcatgttgcaatggcagttgcagg

SEQ ID NO: 263434 - DNA, 30 bp, Artificial Sequence
  Description of Artificial Sequence: Synthetic oligonucleotide
tgatgggcatgttgcaatggcagttgcagg

SEQ ID NO: 263435 - DNA, 29 bp, Artificial Sequence
  Description of Artificial Sequence: Synthetic oligonucleotide
gatgggcatgttgcaatggcagttgcagg

SEQ ID NO: 263436 - DNA, 32 bp, Artificial Sequence
  Description of Artificial Sequence: Synthetic oligonucleotide
atgggcatgttgcaatggcagttgcaggtttg

SEQ ID NO: 263437 - DNA, 31 bp, Artificial Sequence
  Description of Artificial Sequence: Synthetic oligonucleotide
tgggcatgttgcaatggcagttgcaggtttg

SEQ ID NO: 263438 - DNA, 30 bp, Artificial Sequence
  Description of Artificial Sequence: Synthetic oligonucleotide
gggcatgttgcaatggcagttgcaggtttg

SEQ ID NO: 263439 - DNA, 32 bp, Artificial Sequence
  Description of Artificial Sequence: Synthetic oligonucleotide
ggcatgttgcaatggcagttgcaggtttgatg

SEQ ID NO: 263440 - DNA, 32 bp, Artificial Sequence
  Description of Artificial Sequence: Synthetic oligonucleotide
gcatgttgcaatggcagttgcaggtttgatgg

SEQ ID NO: 263441 - DNA, 32 bp, Artificial Sequence
  Description of Artificial Sequence: Synthetic oligonucleotide
catgttgcaatggcagttgcaggtttgatggc

SEQ ID NO: 263442 - DNA, 33 bp, Artificial Sequence
  Description of Artificial Sequence: Synthetic oligonucleotide
atgttgcaatggcagttgcaggtttgatggcag

SEQ ID NO: 263443 - DNA, 32 bp, Artificial Sequence
  Description of Artificial Sequence: Synthetic oligonucleotide
tgttgcaatggcagttgcaggtttgatggcag

SEQ ID NO: 263444 - DNA, 31 bp, Artificial Sequence
  Description of Artificial Sequence: Synthetic oligonucleotide
gttgcaatggcagttgcaggtttgatggcag

SEQ ID NO: 263445 - DNA, 33 bp, Artificial Sequence
  Description of Artificial Sequence: Synthetic oligonucleotide
ttgcaatggcagttgcaggtttgatggcagatg

SEQ ID NO: 263446 - DNA, 32 bp, Artificial Sequence
  Description of Artificial Sequence: Synthetic oligonucleotide
tgcaatggcagttgcaggtttgatggcagatg

SEQ ID NO: 263447 - DNA, 31 bp, Artificial Sequence
  Description of Artificial Sequence: Synthetic oligonucleotide
gcaatggcagttgcaggtttgatggcagatg

SEQ ID NO: 263448 - DNA, 31 bp, Artificial Sequence
  Description of Artificial Sequence: Synthetic oligonucleotide
caatggcagttgcaggtttgatggcagatgg

SEQ ID NO: 263449 - DNA, 32 bp, Artificial Sequence
  Description of Artificial Sequence: Synthetic oligonucleotide
aatggcagttgcaggtttgatggcagatggtc

SEQ ID NO: 263450 - DNA, 31 bp, Artificial Sequence
  Description of Artificial Sequence: Synthetic oligonucleotide
atggcagttgcaggtttgatggcagatggtc

SEQ ID NO: 263451 - DNA, 30 bp, Artificial Sequence
  Description of Artificial Sequence: Synthetic oligonucleotide
tggcagttgcaggtttgatggcagatggtc

SEQ ID NO: 263452 - DNA, 29 bp, Artificial Sequence
  Description of Artificial Sequence: Synthetic oligonucleotide
ggcagttgcaggtttgatggcagatggtc

SEQ ID NO: 263453 - DNA, 29 bp, Artificial Sequence
  Description of Artificial Sequence: Synthetic oligonucleotide
gcagttgcaggtttgatggcagatggtcg

SEQ ID NO: 263454 - DNA, 31 bp, Artificial Sequence
  Description of Artificial Sequence: Synthetic oligonucleotide
cagttgcaggtttgatggcagatggtcgttc

SEQ ID NO: 263455 - DNA, 35 bp, Artificial Sequence
  Description of Artificial Sequence: Synthetic oligonucleotide
agttgcaggtttgatggcagatggtcgttcttttg

SEQ ID NO: 263456 - DNA, 34 bp, Artificial Sequence
  Description of Artificial Sequence: Synthetic oligonucleotide
gttgcaggtttgatggcagatggtcgttcttttg

SEQ ID NO: 263457 - DNA, 34 bp, Artificial Sequence
  Description of Artificial Sequence: Synthetic oligonucleotide
ttgcaggtttgatggcagatggtcgttcttttgc

SEQ ID NO: 263458 - DNA, 33 bp, Artificial Sequence
  Description of Artificial Sequence: Synthetic oligonucleotide
tgcaggtttgatggcagatggtcgttcttttgc

SEQ ID NO: 263459 - DNA, 32 bp, Artificial Sequence
  Description of Artificial Sequence: Synthetic oligonucleotide
gcaggtttgatggcagatggtcgttcttttgc

SEQ ID NO: 263460 - DNA, 33 bp, Artificial Sequence
  Description of Artificial Sequence: Synthetic oligonucleotide
caggtttgatggcagatggtcgttcttttgcag

SEQ ID NO: 263461 - DNA, 34 bp, Artificial Sequence
  Description of Artificial Sequence: Synthetic oligonucleotide
aggtttgatggcagatggtcgttcttttgcagac

SEQ ID NO: 263462 - DNA, 33 bp, Artificial Sequence
  Description of Artificial Sequence: Synthetic oligonucleotide
ggtttgatggcagatggtcgttcttttgcagac

SEQ ID NO: 263463 - DNA, 36 bp, Artificial Sequence
  Description of Artificial Sequence: Synthetic oligonucleotide
gtttgatggcagatggtcgttcttttgcagacatac

SEQ ID NO: 263464 - DNA, 36 bp, Artificial Sequence
  Description of Artificial Sequence: Synthetic oligonucleotide
tttgatggcagatggtcgttcttttgcagacatacc

SEQ ID NO: 263465 - DNA, 35 bp, Artificial Sequence
  Description of Artificial Sequence: Synthetic oligonucleotide
ttgatggcagatggtcgttcttttgcagacatacc

SEQ ID NO: 263466 - DNA, 34 bp, Artificial Sequence
  Description of Artificial Sequence: Synthetic oligonucleotide
tgatggcagatggtcgttcttttgcagacatacc

SEQ ID NO: 263467 - DNA, 33 bp, Artificial Sequence
  Description of Artificial Sequence: Synthetic oligonucleotide
gatggcagatggtcgttcttttgcagacatacc

SEQ ID NO: 263468 - DNA, 35 bp, Artificial Sequence
  Description of Artificial Sequence: Synthetic oligonucleotide
atggcagatggtcgttcttttgcagacataccaag

SEQ ID NO: 263469 - DNA, 34 bp, Artificial Sequence
  Description of Artificial Sequence: Synthetic oligonucleotide
tggcagatggtcgttcttttgcagacataccaag

SEQ ID NO: 263470 - DNA, 33 bp, Artificial Sequence
  Description of Artificial Sequence: Synthetic oligonucleotide
ggcagatggtcgttcttttgcagacataccaag

SEQ ID NO: 263471 - DNA, 34 bp, Artificial Sequence
  Description of Artificial Sequence: Synthetic oligonucleotide
gcagatggtcgttcttttgcagacataccaagag

SEQ ID NO: 263472 - DNA, 36 bp, Artificial Sequence
  Description of Artificial Sequence: Synthetic oligonucleotide
cagatggtcgttcttttgcagacataccaagagaag

SEQ ID NO: 263473 - DNA, 38 bp, Artificial Sequence
  Description of Artificial Sequence: Synthetic oligonucleotide
agatggtcgttcttttgcagacataccaagagaagtag

SEQ ID NO: 263474 - DNA, 37 bp, Artificial Sequence
  Description of Artificial Sequence: Synthetic oligonucleotide
gatggtcgttcttttgcagacataccaagagaagtag

SEQ ID NO: 263475 - DNA, 37 bp, Artificial Sequence
  Description of Artificial Sequence: Synthetic oligonucleotide
atggtcgttcttttgcagacataccaagagaagtagc

SEQ ID NO: 263476 - DNA, 36 bp, Artificial Sequence
  Description of Artificial Sequence: Synthetic oligonucleotide
tggtcgttcttttgcagacataccaagagaagtagc

SEQ ID NO: 263477 - DNA, 35 bp, Artificial Sequence
  Description of Artificial Sequence: Synthetic oligonucleotide
ggtcgttcttttgcagacataccaagagaagtagc

SEQ ID NO: 263478 - DNA, 37 bp, Artificial Sequence
  Description of Artificial Sequence: Synthetic oligonucleotide
gtcgttcttttgcagacataccaagagaagtagcttc

SEQ ID NO: 263479 - DNA, 37 bp, Artificial Sequence
  Description of Artificial Sequence: Synthetic oligonucleotide
tcgttcttttgcagacataccaagagaagtagcttcc

SEQ ID NO: 263480 - DNA, 36 bp, Artificial Sequence
  Description of Artificial Sequence: Synthetic oligonucleotide
cgttcttttgcagacataccaagagaagtagcttcc

SEQ ID NO: 263481 - DNA, 38 bp, Artificial Sequence
  Description of Artificial Sequence: Synthetic oligonucleotide
gttcttttgcagacataccaagagaagtagcttccaag

SEQ ID NO: 263482 - DNA, 40 bp, Artificial Sequence
  Description of Artificial Sequence: Synthetic oligonucleotide
ttcttttgcagacataccaagagaagtagcttccaagttc

SEQ ID NO: 263483 - DNA, 39 bp, Artificial Sequence
  Description of Artificial Sequence: Synthetic oligonucleotide
tcttttgcagacataccaagagaagtagcttccaagttc

SEQ ID NO: 263484 - DNA, 38 bp, Artificial Sequence
  Description of Artificial Sequence: Synthetic oligonucleotide
cttttgcagacataccaagagaagtagcttccaagttc

SEQ ID NO: 263485 - DNA, 39 bp, Artificial Sequence
  Description of Artificial Sequence: Synthetic oligonucleotide
ttttgcagacataccaagagaagtagcttccaagttcag

SEQ ID NO: 263486 - DNA, 38 bp, Artificial Sequence
  Description of Artificial Sequence: Synthetic oligonucleotide
tttgcagacataccaagagaagtagcttccaagttcag

SEQ ID NO: 263487 - DNA, 37 bp, Artificial Sequence
  Description of Artificial Sequence: Synthetic oligonucleotide
ttgcagacataccaagagaagtagcttccaagttcag

SEQ ID NO: 263488 - DNA, 36 bp, Artificial Sequence
  Description of Artificial Sequence: Synthetic oligonucleotide
tgcagacataccaagagaagtagcttccaagttcag

SEQ ID NO: 263489 - DNA, 35 bp, Artificial Sequence
  Description of Artificial Sequence: Synthetic oligonucleotide
gcagacataccaagagaagtagcttccaagttcag

SEQ ID NO: 263490 - DNA, 37 bp, Artificial Sequence
  Description of Artificial Sequence: Synthetic oligonucleotide
cagacataccaagagaagtagcttccaagttcagatc

SEQ ID NO: 263491 - DNA, 40 bp, Artificial Sequence
  Description of Artificial Sequence: Synthetic oligonucleotide
agacataccaagagaagtagcttccaagttcagatcttac

SEQ ID NO: 263492 - DNA, 39 bp, Artificial Sequence
  Description of Artificial Sequence: Synthetic oligonucleotide
gacataccaagagaagtagcttccaagttcagatcttac

SEQ ID NO: 263493 - DNA, 42 bp, Artificial Sequence
  Description of Artificial Sequence: Synthetic oligonucleotide
acataccaagagaagtagcttccaagttcagatcttactttg

SEQ ID NO: 263494 - DNA, 41 bp, Artificial Sequence
  Description of Artificial Sequence: Synthetic oligonucleotide
cataccaagagaagtagcttccaagttcagatcttactttg

SEQ ID NO: 263495 - DNA, 41 bp, Artificial Sequence
  Description of Artificial Sequence: Synthetic oligonucleotide
ataccaagagaagtagcttccaagttcagatcttactttgg

SEQ ID NO: 263496 - DNA, 40 bp, Artificial Sequence
  Description of Artificial Sequence: Synthetic oligonucleotide
taccaagagaagtagcttccaagttcagatcttactttgg

SEQ ID NO: 263497 - DNA, 39 bp, Artificial Sequence
  Description of Artificial Sequence: Synthetic oligonucleotide
accaagagaagtagcttccaagttcagatcttactttgg

SEQ ID NO: 263498 - DNA, 38 bp, Artificial Sequence
  Description of Artificial Sequence: Synthetic oligonucleotide
ccaagagaagtagcttccaagttcagatcttactttgg

SEQ ID NO: 263499 - DNA, 38 bp, Artificial Sequence
  Description of Artificial Sequence: Synthetic oligonucleotide
caagagaagtagcttccaagttcagatcttactttggc

SEQ ID NO: 263500 - DNA, 40 bp, Artificial Sequence
  Description of Artificial Sequence: Synthetic oligonucleotide
aagagaagtagcttccaagttcagatcttactttggcttc

SEQ ID NO: 263501 - DNA, 39 bp, Artificial Sequence
  Description of Artificial Sequence: Synthetic oligonucleotide
agagaagtagcttccaagttcagatcttactttggcttc

SEQ ID NO: 263502 - DNA, 38 bp, Artificial Sequence
  Description of Artificial Sequence: Synthetic oligonucleotide
gagaagtagcttccaagttcagatcttactttggcttc

SEQ ID NO: 263503 - DNA, 40 bp, Artificial Sequence
  Description of Artificial Sequence: Synthetic oligonucleotide
agaagtagcttccaagttcagatcttactttggcttcaac

SEQ ID NO: 263504 - DNA, 39 bp, Artificial Sequence
  Description of Artificial Sequence: Synthetic oligonucleotide
gaagtagcttccaagttcagatcttactttggcttcaac

SEQ ID NO: 263505 - DNA, 42 bp, Artificial Sequence
  Description of Artificial Sequence: Synthetic oligonucleotide
aagtagcttccaagttcagatcttactttggcttcaacattc

SEQ ID NO: 263506 - DNA, 41 bp, Artificial Sequence
  Description of Artificial Sequence: Synthetic oligonucleotide
agtagcttccaagttcagatcttactttggcttcaacattc

SEQ ID NO: 263507 - DNA, 40 bp, Artificial Sequence
  Description of Artificial Sequence: Synthetic oligonucleotide
gtagcttccaagttcagatcttactttggcttcaacattc

SEQ ID NO: 263508 - DNA, 40 bp, Artificial Sequence
  Description of Artificial Sequence: Synthetic oligonucleotide
tagcttccaagttcagatcttactttggcttcaacattcc

SEQ ID NO: 263509 - DNA, 39 bp, Artificial Sequence
  Description of Artificial Sequence: Synthetic oligonucleotide
agcttccaagttcagatcttactttggcttcaacattcc

SEQ ID NO: 263510 - DNA, 38 bp, Artificial Sequence
  Description of Artificial Sequence: Synthetic oligonucleotide
gcttccaagttcagatcttactttggcttcaacattcc

SEQ ID NO: 263511 - DNA, 39 bp, Artificial Sequence
  Description of Artificial Sequence: Synthetic oligonucleotide
cttccaagttcagatcttactttggcttcaacattcctc

SEQ ID NO: 263512 - DNA, 44 bp, Artificial Sequence
  Description of Artificial Sequence: Synthetic oligonucleotide
ttccaagttcagatcttactttggcttcaacattcctctaaaac

SEQ ID NO: 263513 - DNA, 43 bp, Artificial Sequence
  Description of Artificial Sequence: Synthetic oligonucleotide
tccaagttcagatcttactttggcttcaacattcctctaaaac

SEQ ID NO: 263514 - DNA, 42 bp, Artificial Sequence
  Description of Artificial Sequence: Synthetic oligonucleotide
ccaagttcagatcttactttggcttcaacattcctctaaaac

SEQ ID NO: 263515 - DNA, 44 bp, Artificial Sequence
  Description of Artificial Sequence: Synthetic oligonucleotide
caagttcagatcttactttggcttcaacattcctctaaaacatg

SEQ ID NO: 263516 - DNA, 46 bp, Artificial Sequence
  Description of Artificial Sequence: Synthetic oligonucleotide
aagttcagatcttactttggcttcaacattcctctaaaacatgttg

SEQ ID NO: 263517 - DNA, 45 bp, Artificial Sequence
  Description of Artificial Sequence: Synthetic oligonucleotide
agttcagatcttactttggcttcaacattcctctaaaacatgttg

SEQ ID NO: 263518 - DNA, 44 bp, Artificial Sequence
  Description of Artificial Sequence: Synthetic oligonucleotide
gttcagatcttactttggcttcaacattcctctaaaacatgttg

SEQ ID NO: 263519 - DNA, 44 bp, Artificial Sequence
  Description of Artificial Sequence: Synthetic oligonucleotide
ttcagatcttactttggcttcaacattcctctaaaacatgttgc

SEQ ID NO: 263520 - DNA, 43 bp, Artificial Sequence
  Description of Artificial Sequence: Synthetic oligonucleotide
tcagatcttactttggcttcaacattcctctaaaacatgttgc

SEQ ID NO: 263521 - DNA, 42 bp, Artificial Sequence
  Description of Artificial Sequence: Synthetic oligonucleotide
cagatcttactttggcttcaacattcctctaaaacatgttgc

SEQ ID NO: 263522 - DNA, 43 bp, Artificial Sequence
  Description of Artificial Sequence: Synthetic oligonucleotide
agatcttactttggcttcaacattcctctaaaacatgttgcag

SEQ ID NO: 263523 - DNA, 42 bp, Artificial Sequence
  Description of Artificial Sequence: Synthetic oligonucleotide
gatcttactttggcttcaacattcctctaaaacatgttgcag

SEQ ID NO: 263524 - DNA, 43 bp, Artificial Sequence
  Description of Artificial Sequence: Synthetic oligonucleotide
atcttactttggcttcaacattcctctaaaacatgttgcagac

SEQ ID NO: 263525 - DNA, 42 bp, Artificial Sequence
  Description of Artificial Sequence: Synthetic oligonucleotide
tcttactttggcttcaacattcctctaaaacatgttgcagac

SEQ ID NO: 263526 - DNA, 41 bp, Artificial Sequence
  Description of Artificial Sequence: Synthetic oligonucleotide
cttactttggcttcaacattcctctaaaacatgttgcagac

SEQ ID NO: 263527 - DNA, 42 bp, Artificial Sequence
  Description of Artificial Sequence: Synthetic oligonucleotide
ttactttggcttcaacattcctctaaaacatgttgcagacac

SEQ ID NO: 263528 - DNA, 41 bp, Artificial Sequence
  Description of Artificial Sequence: Synthetic oligonucleotide
tactttggcttcaacattcctctaaaacatgttgcagacac

SEQ ID NO: 263529 - DNA, 40 bp, Artificial Sequence
  Description of Artificial Sequence: Synthetic oligonucleotide
actttggcttcaacattcctctaaaacatgttgcagacac

SEQ ID NO: 263530 - DNA, 39 bp, Artificial Sequence
  Description of Artificial Sequence: Synthetic oligonucleotide
ctttggcttcaacattcctctaaaacatgttgcagacac

SEQ ID NO: 263531 - DNA, 40 bp, Artificial Sequence
  Description of Artificial Sequence: Synthetic oligonucleotide
tttggcttcaacattcctctaaaacatgttgcagacacag

SEQ ID NO: 263532 - DNA, 39 bp, Artificial Sequence
  Description of Artificial Sequence: Synthetic oligonucleotide
ttggcttcaacattcctctaaaacatgttgcagacacag

SEQ ID NO: 263533 - DNA, 38 bp, Artificial Sequence
  Description of Artificial Sequence: Synthetic oligonucleotide
tggcttcaacattcctctaaaacatgttgcagacacag

SEQ ID NO: 263534 - DNA, 37 bp, Artificial Sequence
  Description of Artificial Sequence: Synthetic oligonucleotide
ggcttcaacattcctctaaaacatgttgcagacacag

SEQ ID NO: 263535 - DNA, 38 bp, Artificial Sequence
  Description of Artificial Sequence: Synthetic oligonucleotide
gcttcaacattcctctaaaacatgttgcagacacagtg

SEQ ID NO: 263536 - DNA, 38 bp, Artificial Sequence
  Description of Artificial Sequence: Synthetic oligonucleotide
cttcaacattcctctaaaacatgttgcagacacagtgg

SEQ ID NO: 263537 - DNA, 38 bp, Artificial Sequence
  Description of Artificial Sequence: Synthetic oligonucleotide
ttcaacattcctctaaaacatgttgcagacacagtggc

SEQ ID NO: 263538 - DNA, 37 bp, Artificial Sequence
  Description of Artificial Sequence: Synthetic oligonucleotide
tcaacattcctctaaaacatgttgcagacacagtggc

SEQ ID NO: 263539 - DNA, 36 bp, Artificial Sequence
  Description of Artificial Sequence: Synthetic oligonucleotide
caacattcctctaaaacatgttgcagacacagtggc

SEQ ID NO: 263540 - DNA, 36 bp, Artificial Sequence
  Description of Artificial Sequence: Synthetic oligonucleotide
aacattcctctaaaacatgttgcagacacagtggcc

SEQ ID NO: 263541 - DNA, 35 bp, Artificial Sequence
  Description of Artificial Sequence: Synthetic oligonucleotide
acattcctctaaaacatgttgcagacacagtggcc

SEQ ID NO: 263542 - DNA, 34 bp, Artificial Sequence
  Description of Artificial Sequence: Synthetic oligonucleotide
cattcctctaaaacatgttgcagacacagtggcc

SEQ ID NO: 263543 - DNA, 36 bp, Artificial Sequence
  Description of Artificial Sequence: Synthetic oligonucleotide
attcctctaaaacatgttgcagacacagtggccatc

SEQ ID NO: 263544 - DNA, 35 bp, Artificial Sequence
  Description of Artificial Sequence: Synthetic oligonucleotide
ttcctctaaaacatgttgcagacacagtggccatc

SEQ ID NO: 263545 - DNA, 34 bp, Artificial Sequence
  Description of Artificial Sequence: Synthetic oligonucleotide
tcctctaaaacatgttgcagacacagtggccatc

SEQ ID NO: 263546 - DNA, 33 bp, Artificial Sequence
  Description of Artificial Sequence: Synthetic oligonucleotide
cctctaaaacatgttgcagacacagtggccatc

SEQ ID NO: 263547 - DNA, 36 bp, Artificial Sequence
  Description of Artificial Sequence: Synthetic oligonucleotide
ctctaaaacatgttgcagacacagtggccatctatg

SEQ ID NO: 263548 - DNA, 37 bp, Artificial Sequence
  Description of Artificial Sequence: Synthetic oligonucleotide
tctaaaacatgttgcagacacagtggccatctatgtg

SEQ ID NO: 263549 - DNA, 36 bp, Artificial Sequence
  Description of Artificial Sequence: Synthetic oligonucleotide
ctaaaacatgttgcagacacagtggccatctatgtg

SEQ ID NO: 263550 - DNA, 36 bp, Artificial Sequence
  Description of Artificial Sequence: Synthetic oligonucleotide
taaaacatgttgcagacacagtggccatctatgtgc

SEQ ID NO: 263551 - DNA, 35 bp, Artificial Sequence
  Description of Artificial Sequence: Synthetic oligonucleotide
aaaacatgttgcagacacagtggccatctatgtgc

SEQ ID NO: 263552 - DNA, 34 bp, Artificial Sequence
  Description of Artificial Sequence: Synthetic oligonucleotide
aaacatgttgcagacacagtggccatctatgtgc

SEQ ID NO: 263553 - DNA, 33 bp, Artificial Sequence
  Description of Artificial Sequence: Synthetic oligonucleotide
aacatgttgcagacacagtggccatctatgtgc

SEQ ID NO: 263554 - DNA, 32 bp, Artificial Sequence
  Description of Artificial Sequence: Synthetic oligonucleotide
acatgttgcagacacagtggccatctatgtgc

SEQ ID NO: 263555 - DNA, 31 bp, Artificial Sequence
  Description of Artificial Sequence: Synthetic oligonucleotide
catgttgcagacacagtggccatctatgtgc

SEQ ID NO: 263556 - DNA, 33 bp, Artificial Sequence
  Description of Artificial Sequence: Synthetic oligonucleotide
atgttgcagacacagtggccatctatgtgcatc

SEQ ID NO: 263557 - DNA, 32 bp, Artificial Sequence
  Description of Artificial Sequence: Synthetic oligonucleotide
tgttgcagacacagtggccatctatgtgcatc

SEQ ID NO: 263558 - DNA, 31 bp, Artificial Sequence
  Description of Artificial Sequence: Synthetic oligonucleotide
gttgcagacacagtggccatctatgtgcatc

SEQ ID NO: 263559 - DNA, 31 bp, Artificial Sequence
  Description of Artificial Sequence: Synthetic oligonucleotide
ttgcagacacagtggccatctatgtgcatcc

SEQ ID NO: 263560 - DNA, 30 bp, Artificial Sequence
  Description of Artificial Sequence: Synthetic oligonucleotide
tgcagacacagtggccatctatgtgcatcc

SEQ ID NO: 263561 - DNA, 29 bp, Artificial Sequence
  Description of Artificial Sequence: Synthetic oligonucleotide
gcagacacagtggccatctatgtgcatcc

SEQ ID NO: 263562 - DNA, 34 bp, Artificial Sequence
  Description of Artificial Sequence: Synthetic oligonucleotide
cagacacagtggccatctatgtgcatccatatac

SEQ ID NO: 263563 - DNA, 35 bp, Artificial Sequence
  Description of Artificial Sequence: Synthetic oligonucleotide
agacacagtggccatctatgtgcatccatatacac

SEQ ID NO: 263564 - DNA, 34 bp, Artificial Sequence
  Description of Artificial Sequence: Synthetic oligonucleotide
gacacagtggccatctatgtgcatccatatacac

SEQ ID NO: 263565 - DNA, 35 bp, Artificial Sequence
  Description of Artificial Sequence: Synthetic oligonucleotide
acacagtggccatctatgtgcatccatatacacac

SEQ ID NO: 263566 - DNA, 34 bp, Artificial Sequence
  Description of Artificial Sequence: Synthetic oligonucleotide
cacagtggccatctatgtgcatccatatacacac

SEQ ID NO: 263567 - DNA, 36 bp, Artificial Sequence
  Description of Artificial Sequence: Synthetic oligonucleotide
acagtggccatctatgtgcatccatatacacactac

SEQ ID NO: 263568 - DNA, 35 bp, Artificial Sequence
  Description of Artificial Sequence: Synthetic oligonucleotide
cagtggccatctatgtgcatccatatacacactac

SEQ ID NO: 263569 - DNA, 36 bp, Artificial Sequence
  Description of Artificial Sequence: Synthetic oligonucleotide
agtggccatctatgtgcatccatatacacactacag

SEQ ID NO: 263570 - DNA, 35 bp, Artificial Sequence
  Description of Artificial Sequence: Synthetic oligonucleotide
gtggccatctatgtgcatccatatacacactacag

SEQ ID NO: 263571 - DNA, 36 bp, Artificial Sequence
  Description of Artificial Sequence: Synthetic oligonucleotide
tggccatctatgtgcatccatatacacactacagtg

SEQ ID NO: 263572 - DNA, 35 bp, Artificial Sequence
  Description of Artificial Sequence: Synthetic oligonucleotide
ggccatctatgtgcatccatatacacactacagtg

SEQ ID NO: 263573 - DNA, 35 bp, Artificial Sequence
  Description of Artificial Sequence: Synthetic oligonucleotide
gccatctatgtgcatccatatacacactacagtgc

SEQ ID NO: 263574 - DNA, 36 bp, Artificial Sequence
  Description of Artificial Sequence: Synthetic oligonucleotide
ccatctatgtgcatccatatacacactacagtgcag

SEQ ID NO: 263575 - DNA, 39 bp, Artificial Sequence
  Description of Artificial Sequence: Synthetic oligonucleotide
catctatgtgcatccatatacacactacagtgcagttag

SEQ ID NO: 263576 - DNA, 40 bp, Artificial Sequence
  Description of Artificial Sequence: Synthetic oligonucleotide
atctatgtgcatccatatacacactacagtgcagttagac

SEQ ID NO: 263577 - DNA, 39 bp, Artificial Sequence
  Description of Artificial Sequence: Synthetic oligonucleotide
tctatgtgcatccatatacacactacagtgcagttagac

SEQ ID NO: 263578 - DNA, 38 bp, Artificial Sequence
  Description of Artificial Sequence: Synthetic oligonucleotide
ctatgtgcatccatatacacactacagtgcagttagac

SEQ ID NO: 263579 - DNA, 38 bp, Artificial Sequence
  Description of Artificial Sequence: Synthetic oligonucleotide
tatgtgcatccatatacacactacagtgcagttagacc

SEQ ID NO: 263580 - DNA, 37 bp, Artificial Sequence
  Description of Artificial Sequence: Synthetic oligonucleotide
atgtgcatccatatacacactacagtgcagttagacc

SEQ ID NO: 263581 - DNA, 36 bp, Artificial Sequence
  Description of Artificial Sequence: Synthetic oligonucleotide
tgtgcatccatatacacactacagtgcagttagacc

SEQ ID NO: 263582 - DNA, 35 bp, Artificial Sequence
  Description of Artificial Sequence: Synthetic oligonucleotide
gtgcatccatatacacactacagtgcagttagacc

SEQ ID NO: 263583 - DNA, 39 bp, Artificial Sequence
  Description of Artificial Sequence: Synthetic oligonucleotide
tgcatccatatacacactacagtgcagttagacctattg

SEQ ID NO: 263584 - DNA, 38 bp, Artificial Sequence
  Description of Artificial Sequence: Synthetic oligonucleotide
gcatccatatacacactacagtgcagttagacctattg

SEQ ID NO: 263585 - DNA, 38 bp, Artificial Sequence
  Description of Artificial Sequence: Synthetic oligonucleotide
catccatatacacactacagtgcagttagacctattgg

SEQ ID NO: 263586 - DNA, 38 bp, Artificial Sequence
  Description of Artificial Sequence: Synthetic oligonucleotide
atccatatacacactacagtgcagttagacctattggc

SEQ ID NO: 263587 - DNA, 37 bp, Artificial Sequence
  Description of Artificial Sequence: Synthetic oligonucleotide
tccatatacacactacagtgcagttagacctattggc

SEQ ID NO: 263588 - DNA, 36 bp, Artificial Sequence
  Description of Artificial Sequence: Synthetic oligonucleotide
ccatatacacactacagtgcagttagacctattggc

SEQ ID NO: 263589 - DNA, 37 bp, Artificial Sequence
  Description of Artificial Sequence: Synthetic oligonucleotide
catatacacactacagtgcagttagacctattggctg

SEQ ID NO: 263590 - DNA, 37 bp, Artificial Sequence
  Description of Artificial Sequence: Synthetic oligonucleotide
atatacacactacagtgcagttagacctattggctgc

SEQ ID NO: 263591 - DNA, 36 bp, Artificial Sequence
  Description of Artificial Sequence: Synthetic oligonucleotide
tatacacactacagtgcagttagacctattggctgc

SEQ ID NO: 263592 - DNA, 35 bp, Artificial Sequence
  Description of Artificial Sequence: Synthetic oligonucleotide
atacacactacagtgcagttagacctattggctgc

SEQ ID NO: 263593 - DNA, 34 bp, Artificial Sequence
  Description of Artificial Sequence: Synthetic oligonucleotide
tacacactacagtgcagttagacctattggctgc

SEQ ID NO: 263594 - DNA, 33 bp, Artificial Sequence
  Description of Artificial Sequence: Synthetic oligonucleotide
acacactacagtgcagttagacctattggctgc

SEQ ID NO: 263595 - DNA, 32 bp, Artificial Sequence
  Description of Artificial Sequence: Synthetic oligonucleotide
cacactacagtgcagttagacctattggctgc

SEQ ID NO: 263596 - DNA, 33 bp, Artificial Sequence
  Description of Artificial Sequence: Synthetic oligonucleotide
acactacagtgcagttagacctattggctgcac

SEQ ID NO: 263597 - DNA, 32 bp, Artificial Sequence
  Description of Artificial Sequence: Synthetic oligonucleotide
cactacagtgcagttagacctattggctgcac

SEQ ID NO: 263598 - DNA, 35 bp, Artificial Sequence
  Description of Artificial Sequence: Synthetic oligonucleotide
actacagtgcagttagacctattggctgcactttc

SEQ ID NO: 263599 - DNA, 34 bp, Artificial Sequence
  Description of Artificial Sequence: Synthetic oligonucleotide
ctacagtgcagttagacctattggctgcactttc

SEQ ID NO: 263600 - DNA, 36 bp, Artificial Sequence
  Description of Artificial Sequence: Synthetic oligonucleotide
tacagtgcagttagacctattggctgcactttcatg

SEQ ID NO: 263601 - DNA, 35 bp, Artificial Sequence
  Description of Artificial Sequence: Synthetic oligonucleotide
acagtgcagttagacctattggctgcactttcatg

SEQ ID NO: 263602 - DNA, 34 bp, Artificial Sequence
  Description of Artificial Sequence: Synthetic oligonucleotide
cagtgcagttagacctattggctgcactttcatg

SEQ ID NO: 263603 - DNA, 37 bp, Artificial Sequence
  Description of Artificial Sequence: Synthetic oligonucleotide
agtgcagttagacctattggctgcactttcatgtttg

SEQ ID NO: 263604 - DNA, 36 bp, Artificial Sequence
  Description of Artificial Sequence: Synthetic oligonucleotide
gtgcagttagacctattggctgcactttcatgtttg

SEQ ID NO: 263605 - DNA, 36 bp, Artificial Sequence
  Description of Artificial Sequence: Synthetic oligonucleotide
tgcagttagacctattggctgcactttcatgtttgg

SEQ ID NO: 263606 - DNA, 35 bp, Artificial Sequence
  Description of Artificial Sequence: Synthetic oligonucleotide
gcagttagacctattggctgcactttcatgtttgg

SEQ ID NO: 263607 - DNA, 35 bp, Artificial Sequence
  Description of Artificial Sequence: Synthetic oligonucleotide
cagttagacctattggctgcactttcatgtttggg

SEQ ID NO: 263608 - DNA, 36 bp, Artificial Sequence
  Description of Artificial Sequence: Synthetic oligonucleotide
agttagacctattggctgcactttcatgtttgggtc

SEQ ID NO: 263609 - DNA, 35 bp, Artificial Sequence
  Description of Artificial Sequence: Synthetic oligonucleotide
gttagacctattggctgcactttcatgtttgggtc

SEQ ID NO: 263610 - DNA, 38 bp, Artificial Sequence
  Description of Artificial Sequence: Synthetic oligonucleotide
ttagacctattggctgcactttcatgtttgggtcttac

SEQ ID NO: 263611 - DNA, 37 bp, Artificial Sequence
  Description of Artificial Sequence: Synthetic oligonucleotide
tagacctattggctgcactttcatgtttgggtcttac

SEQ ID NO: 263612 - DNA, 36 bp, Artificial Sequence
  Description of Artificial Sequence: Synthetic oligonucleotide
agacctattggctgcactttcatgtttgggtcttac

SEQ ID NO: 263613 - DNA, 35 bp, Artificial Sequence
  Description of Artificial Sequence: Synthetic oligonucleotide
gacctattggctgcactttcatgtttgggtcttac

SEQ ID NO: 263614 - DNA, 36 bp, Artificial Sequence
  Description of Artificial Sequence: Synthetic oligonucleotide
acctattggctgcactttcatgtttgggtcttactg

SEQ ID NO: 263615 - DNA, 35 bp, Artificial Sequence
  Description of Artificial Sequence: Synthetic oligonucleotide
cctattggctgcactttcatgtttgggtcttactg

SEQ ID NO: 263616 - DNA, 36 bp, Artificial Sequence
  Description of Artificial Sequence: Synthetic oligonucleotide
ctattggctgcactttcatgtttgggtcttactgtg

SEQ ID NO: 263617 - DNA, 37 bp, Artificial Sequence
  Description of Artificial Sequence: Synthetic oligonucleotide
tattggctgcactttcatgtttgggtcttactgtgtg

SEQ ID NO: 263618 - DNA, 36 bp, Artificial Sequence
  Description of Artificial Sequence: Synthetic oligonucleotide
attggctgcactttcatgtttgggtcttactgtgtg

SEQ ID NO: 263619 - DNA, 35 bp, Artificial Sequence
  Description of Artificial Sequence: Synthetic oligonucleotide
ttggctgcactttcatgtttgggtcttactgtgtg

SEQ ID NO: 263620 - DNA, 34 bp, Artificial Sequence
  Description of Artificial Sequence: Synthetic oligonucleotide
tggctgcactttcatgtttgggtcttactgtgtg

SEQ ID NO: 263621 - DNA, 33 bp, Artificial Sequence
  Description of Artificial Sequence: Synthetic oligonucleotide
ggctgcactttcatgtttgggtcttactgtgtg

SEQ ID NO: 263622 - DNA, 36 bp, Artificial Sequence
  Description of Artificial Sequence: Synthetic oligonucleotide
gctgcactttcatgtttgggtcttactgtgtgaatg

SEQ ID NO: 263623 - DNA, 37 bp, Artificial Sequence
  Description of Artificial Sequence: Synthetic oligonucleotide
ctgcactttcatgtttgggtcttactgtgtgaatgtc

SEQ ID NO: 263624 - DNA, 37 bp, Artificial Sequence
  Description of Artificial Sequence: Synthetic oligonucleotide
tgcactttcatgtttgggtcttactgtgtgaatgtcg

SEQ ID NO: 263625 - DNA, 36 bp, Artificial Sequence
  Description of Artificial Sequence: Synthetic oligonucleotide
gcactttcatgtttgggtcttactgtgtgaatgtcg

SEQ ID NO: 263626 - DNA, 36 bp, Artificial Sequence
  Description of Artificial Sequence: Synthetic oligonucleotide
cactttcatgtttgggtcttactgtgtgaatgtcgg

SEQ ID NO: 263627 - DNA, 37 bp, Artificial Sequence
  Description of Artificial Sequence: Synthetic oligonucleotide
actttcatgtttgggtcttactgtgtgaatgtcggtg

SEQ ID NO: 263628 - DNA, 36 bp, Artificial Sequence
  Description of Artificial Sequence: Synthetic oligonucleotide
ctttcatgtttgggtcttactgtgtgaatgtcggtg

SEQ ID NO: 263629 - DNA, 36 bp, Artificial Sequence
  Description of Artificial Sequence: Synthetic oligonucleotide
tttcatgtttgggtcttactgtgtgaatgtcggtgc

SEQ ID NO: 263630 - DNA, 35 bp, Artificial Sequence
  Description of Artificial Sequence: Synthetic oligonucleotide
ttcatgtttgggtcttactgtgtgaatgtcggtgc

SEQ ID NO: 263631 - DNA, 34 bp, Artificial Sequence
  Description of Artificial Sequence: Synthetic oligonucleotide
tcatgtttgggtcttactgtgtgaatgtcggtgc

SEQ ID NO: 263632 - DNA, 33 bp, Artificial Sequence
  Description of Artificial Sequence: Synthetic oligonucleotide
catgtttgggtcttactgtgtgaatgtcggtgc

SEQ ID NO: 263633 - DNA, 33 bp, Artificial Sequence
  Description of Artificial Sequence: Synthetic oligonucleotide
atgtttgggtcttactgtgtgaatgtcggtgcg

SEQ ID NO: 263634 - DNA, 32 bp, Artificial Sequence
  Description of Artificial Sequence: Synthetic oligonucleotide
tgtttgggtcttactgtgtgaatgtcggtgcg

SEQ ID NO: 263635 - DNA, 31 bp, Artificial Sequence
  Description of Artificial Sequence: Synthetic oligonucleotide
gtttgggtcttactgtgtgaatgtcggtgcg

SEQ ID NO: 263636 - DNA, 31 bp, Artificial Sequence
  Description of Artificial Sequence: Synthetic oligonucleotide
tttgggtcttactgtgtgaatgtcggtgcgc

SEQ ID NO: 263637 - DNA, 30 bp, Artificial Sequence
  Description of Artificial Sequence: Synthetic oligonucleotide
ttgggtcttactgtgtgaatgtcggtgcgc

SEQ ID NO: 263638 - DNA, 29 bp, Artificial Sequence
  Description of Artificial Sequence: Synthetic oligonucleotide
tgggtcttactgtgtgaatgtcggtgcgc

SEQ ID NO: 263639 - DNA, 28 bp, Artificial Sequence
  Description of Artificial Sequence: Synthetic oligonucleotide
gggtcttactgtgtgaatgtcggtgcgc

SEQ ID NO: 263640 - DNA, 30 bp, Artificial Sequence
  Description of Artificial Sequence: Synthetic oligonucleotide
ggtcttactgtgtgaatgtcggtgcgcatc

SEQ ID NO: 263641 - DNA, 31 bp, Artificial Sequence
  Description of Artificial Sequence: Synthetic oligonucleotide
gtcttactgtgtgaatgtcggtgcgcatctc

SEQ ID NO: 263642 - DNA, 33 bp, Artificial Sequence
  Description of Artificial Sequence: Synthetic oligonucleotide
tcttactgtgtgaatgtcggtgcgcatctctac

SEQ ID NO: 263643 - DNA, 32 bp, Artificial Sequence
  Description of Artificial Sequence: Synthetic oligonucleotide
cttactgtgtgaatgtcggtgcgcatctctac

SEQ ID NO: 263644 - DNA, 34 bp, Artificial Sequence
  Description of Artificial Sequence: Synthetic oligonucleotide
ttactgtgtgaatgtcggtgcgcatctctacatg

SEQ ID NO: 263645 - DNA, 33 bp, Artificial Sequence
  Description of Artificial Sequence: Synthetic oligonucleotide
tactgtgtgaatgtcggtgcgcatctctacatg

SEQ ID NO: 263646 - DNA, 32 bp, Artificial Sequence
  Description of Artificial Sequence: Synthetic oligonucleotide
actgtgtgaatgtcggtgcgcatctctacatg

SEQ ID NO: 263647 - DNA, 31 bp, Artificial Sequence
  Description of Artificial Sequence: Synthetic oligonucleotide
ctgtgtgaatgtcggtgcgcatctctacatg

SEQ ID NO: 263648 - DNA, 34 bp, Artificial Sequence
  Description of Artificial Sequence: Synthetic oligonucleotide
tgtgtgaatgtcggtgcgcatctctacatgtttg

SEQ ID NO: 263649 - DNA, 33 bp, Artificial Sequence
  Description of Artificial Sequence: Synthetic oligonucleotide
gtgtgaatgtcggtgcgcatctctacatgtttg

SEQ ID NO: 263650 - DNA, 34 bp, Artificial Sequence
  Description of Artificial Sequence: Synthetic oligonucleotide
tgtgaatgtcggtgcgcatctctacatgtttgac

SEQ ID NO: 263651 - DNA, 33 bp, Artificial Sequence
  Description of Artificial Sequence: Synthetic oligonucleotide
gtgaatgtcggtgcgcatctctacatgtttgac

SEQ ID NO: 263652 - DNA, 33 bp, Artificial Sequence
  Description of Artificial Sequence: Synthetic oligonucleotide
tgaatgtcggtgcgcatctctacatgtttgacc

SEQ ID NO: 263653 - DNA, 32 bp, Artificial Sequence
  Description of Artificial Sequence: Synthetic oligonucleotide
gaatgtcggtgcgcatctctacatgtttgacc

SEQ ID NO: 263654 - DNA, 32 bp, Artificial Sequence
  Description of Artificial Sequence: Synthetic oligonucleotide
aatgtcggtgcgcatctctacatgtttgaccc

SEQ ID NO: 263655 - DNA, 31 bp, Artificial Sequence
  Description of Artificial Sequence: Synthetic oligonucleotide
atgtcggtgcgcatctctacatgtttgaccc

SEQ ID NO: 263656 - DNA, 30 bp, Artificial Sequence
  Description of Artificial Sequence: Synthetic oligonucleotide
tgtcggtgcgcatctctacatgtttgaccc

SEQ ID NO: 263657 - DNA, 29 bp, Artificial Sequence
  Description of Artificial Sequence: Synthetic oligonucleotide
gtcggtgcgcatctctacatgtttgaccc

SEQ ID NO: 263658 - DNA, 31 bp, Artificial Sequence
  Description of Artificial Sequence: Synthetic oligonucleotide
tcggtgcgcatctctacatgtttgacccatg

SEQ ID NO: 263659 - DNA, 30 bp, Artificial Sequence
  Description of Artificial Sequence: Synthetic oligonucleotide
cggtgcgcatctctacatgtttgacccatg

SEQ ID NO: 263660 - DNA, 31 bp, Artificial Sequence
  Description of Artificial Sequence: Synthetic oligonucleotide
ggtgcgcatctctacatgtttgacccatgag

SEQ ID NO: 263661 - DNA, 31 bp, Artificial Sequence
  Description of Artificial Sequence: Synthetic oligonucleotide
gtgcgcatctctacatgtttgacccatgagg

SEQ ID NO: 263662 - DNA, 32 bp, Artificial Sequence
  Description of Artificial Sequence: Synthetic oligonucleotide
tgcgcatctctacatgtttgacccatgaggtg

SEQ ID NO: 263663 - DNA, 31 bp, Artificial Sequence
  Description of Artificial Sequence: Synthetic oligonucleotide
gcgcatctctacatgtttgacccatgaggtg

SEQ ID NO: 263664 - DNA, 34 bp, Artificial Sequence
  Description of Artificial Sequence: Synthetic oligonucleotide
cgcatctctacatgtttgacccatgaggtgtttc

SEQ ID NO: 263665 - DNA, 37 bp, Artificial Sequence
  Description of Artificial Sequence: Synthetic oligonucleotide
gcatctctacatgtttgacccatgaggtgtttcttac

SEQ ID NO: 263666 - DNA, 37 bp, Artificial Sequence
  Description of Artificial Sequence: Synthetic oligonucleotide
catctctacatgtttgacccatgaggtgtttcttacg

SEQ ID NO: 263667 - DNA, 37 bp, Artificial Sequence
  Description of Artificial Sequence: Synthetic oligonucleotide
atctctacatgtttgacccatgaggtgtttcttacgg

SEQ ID NO: 263668 - DNA, 36 bp, Artificial Sequence
  Description of Artificial Sequence: Synthetic oligonucleotide
tctctacatgtttgacccatgaggtgtttcttacgg

SEQ ID NO: 263669 - DNA, 35 bp, Artificial Sequence
  Description of Artificial Sequence: Synthetic oligonucleotide
ctctacatgtttgacccatgaggtgtttcttacgg

SEQ ID NO: 263670 - DNA, 40 bp, Artificial Sequence
  Description of Artificial Sequence: Synthetic oligonucleotide
tctacatgtttgacccatgaggtgtttcttacggttatag

SEQ ID NO: 263671 - DNA, 39 bp, Artificial Sequence
  Description of Artificial Sequence: Synthetic oligonucleotide
ctacatgtttgacccatgaggtgtttcttacggttatag

SEQ ID NO: 263672 - DNA, 39 bp, Artificial Sequence
  Description of Artificial Sequence: Synthetic oligonucleotide
tacatgtttgacccatgaggtgtttcttacggttatagg

SEQ ID NO: 263673 - DNA, 38 bp, Artificial Sequence
  Description of Artificial Sequence: Synthetic oligonucleotide
acatgtttgacccatgaggtgtttcttacggttatagg

SEQ ID NO: 263674 - DNA, 37 bp, Artificial Sequence
  Description of Artificial Sequence: Synthetic oligonucleotide
catgtttgacccatgaggtgtttcttacggttatagg

SEQ ID NO: 263675 - DNA, 37 bp, Artificial Sequence
  Description of Artificial Sequence: Synthetic oligonucleotide
atgtttgacccatgaggtgtttcttacggttataggg

SEQ ID NO: 263676 - DNA, 36 bp, Artificial Sequence
  Description of Artificial Sequence: Synthetic oligonucleotide
tgtttgacccatgaggtgtttcttacggttataggg

SEQ ID NO: 263677 - DNA, 35 bp, Artificial Sequence
  Description of Artificial Sequence: Synthetic oligonucleotide
gtttgacccatgaggtgtttcttacggttataggg

SEQ ID NO: 263678 - DNA, 35 bp, Artificial Sequence
  Description of Artificial Sequence: Synthetic oligonucleotide
tttgacccatgaggtgtttcttacggttatagggg

SEQ ID NO: 263679 - DNA, 34 bp, Artificial Sequence
  Description of Artificial Sequence: Synthetic oligonucleotide
ttgacccatgaggtgtttcttacggttatagggg

SEQ ID NO: 263680 - DNA, 33 bp, Artificial Sequence
  Description of Artificial Sequence: Synthetic oligonucleotide
tgacccatgaggtgtttcttacggttatagggg

SEQ ID NO: 263681 - DNA, 32 bp, Artificial Sequence
  Description of Artificial Sequence: Synthetic oligonucleotide
gacccatgaggtgtttcttacggttatagggg

SEQ ID NO: 263682 - DNA, 32 bp, Artificial Sequence
  Description of Artificial Sequence: Synthetic oligonucleotide
acccatgaggtgtttcttacggttataggggc

SEQ ID NO: 263683 - DNA, 31 bp, Artificial Sequence
  Description of Artificial Sequence: Synthetic oligonucleotide
cccatgaggtgtttcttacggttataggggc

SEQ ID NO: 263684 - DNA, 32 bp, Artificial Sequence
  Description of Artificial Sequence: Synthetic oligonucleotide
ccatgaggtgtttcttacggttataggggctg

SEQ ID NO: 263685 - DNA, 33 bp, Artificial Sequence
  Description of Artificial Sequence: Synthetic oligonucleotide
catgaggtgtttcttacggttataggggctgtg

SEQ ID NO: 263686 - DNA, 33 bp, Artificial Sequence
  Description of Artificial Sequence: Synthetic oligonucleotide
atgaggtgtttcttacggttataggggctgtgg

SEQ ID NO: 263687 - DNA, 32 bp, Artificial Sequence
  Description of Artificial Sequence: Synthetic oligonucleotide
tgaggtgtttcttacggttataggggctgtgg

SEQ ID NO: 263688 - DNA, 31 bp, Artificial Sequence
  Description of Artificial Sequence: Synthetic oligonucleotide
gaggtgtttcttacggttataggggctgtgg

SEQ ID NO: 263689 - DNA, 31 bp, Artificial Sequence
  Description of Artificial Sequence: Synthetic oligonucleotide
aggtgtttcttacggttataggggctgtggc

SEQ ID NO: 263690 - DNA, 30 bp, Artificial Sequence
  Description of Artificial Sequence: Synthetic oligonucleotide
ggtgtttcttacggttataggggctgtggc

SEQ ID NO: 263691 - DNA, 32 bp, Artificial Sequence
  Description of Artificial Sequence: Synthetic oligonucleotide
gtgtttcttacggttataggggctgtggcatc

SEQ ID NO: 263692 - DNA, 32 bp, Artificial Sequence
  Description of Artificial Sequence: Synthetic oligonucleotide
tgtttcttacggttataggggctgtggcatcg

SEQ ID NO: 263693 - DNA, 31 bp, Artificial Sequence
  Description of Artificial Sequence: Synthetic oligonucleotide
gtttcttacggttataggggctgtggcatcg

SEQ ID NO: 263694 - DNA, 31 bp, Artificial Sequence
  Description of Artificial Sequence: Synthetic oligonucleotide
tttcttacggttataggggctgtggcatcgg

SEQ ID NO: 263695 - DNA, 30 bp, Artificial Sequence
  Description of Artificial Sequence: Synthetic oligonucleotide
ttcttacggttataggggctgtggcatcgg

SEQ ID NO: 263696 - DNA, 29 bp, Artificial Sequence
  Description of Artificial Sequence: Synthetic oligonucleotide
tcttacggttataggggctgtggcatcgg

SEQ ID NO: 263697 - DNA, 28 bp, Artificial Sequence
  Description of Artificial Sequence: Synthetic oligonucleotide
cttacggttataggggctgtggcatcgg

SEQ ID NO: 263698 - DNA, 28 bp, Artificial Sequence
  Description of Artificial Sequence: Synthetic oligonucleotide
ttacggttataggggctgtggcatcggc

SEQ ID NO: 263699 - DNA, 27 bp, Artificial Sequence
  Description of Artificial Sequence: Synthetic oligonucleotide
tacggttataggggctgtggcatcggc

SEQ ID NO: 263700 - DNA, 27 bp, Artificial Sequence
  Description of Artificial Sequence: Synthetic oligonucleotide
acggttataggggctgtggcatcggca

SEQ ID NO: 263701 - DNA, 27 bp, Artificial Sequence
  Description of Artificial Sequence: Synthetic oligonucleotide
cggttataggggctgtggcatcggcaa

SEQ ID NO: 263702 - DNA, 28 bp, Artificial Sequence
  Description of Artificial Sequence: Synthetic oligonucleotide
ggttataggggctgtggcatcggcaatg

SEQ ID NO: 263703 - DNA, 28 bp, Artificial Sequence
  Description of Artificial Sequence: Synthetic oligonucleotide
gttataggggctgtggcatcggcaatgc

SEQ ID NO: 263704 - DNA, 28 bp, Artificial Sequence
  Description of Artificial Sequence: Synthetic oligonucleotide
ttataggggctgtggcatcggcaatgcc

SEQ ID NO: 263705 - DNA, 27 bp, Artificial Sequence
  Description of Artificial Sequence: Synthetic oligonucleotide
tataggggctgtggcatcggcaatgcc

SEQ ID NO: 263706 - DNA, 27 bp, Artificial Sequence
  Description of Artificial Sequence: Synthetic oligonucleotide
ataggggctgtggcatcggcaatgcca

SEQ ID NO: 263707 - DNA, 26 bp, Artificial Sequence
  Description of Artificial Sequence: Synthetic oligonucleotide
taggggctgtggcatcggcaatgcca

SEQ ID NO: 263708 - DNA, 25 bp, Artificial Sequence
  Description of Artificial Sequence: Synthetic oligonucleotide
aggggctgtggcatcggcaatgcca

SEQ ID NO: 263709 - DNA, 24 bp, Artificial Sequence
  Description of Artificial Sequence: Synthetic oligonucleotide
ggggctgtggcatcggcaatgcca

SEQ ID NO: 263710 - DNA, 24 bp, Artificial Sequence
  Description of Artificial Sequence: Synthetic oligonucleotide
gggctgtggcatcggcaatgccag

SEQ ID NO: 263711 - DNA, 24 bp, Artificial Sequence
  Description of Artificial Sequence: Synthetic oligonucleotide
ggctgtggcatcggcaatgccagg

SEQ ID NO: 263712 - DNA, 26 bp, Artificial Sequence
  Description of Artificial Sequence: Synthetic oligonucleotide
gctgtggcatcggcaatgccaggcaa

SEQ ID NO: 263713 - DNA, 26 bp, Artificial Sequence
  Description of Artificial Sequence: Synthetic oligonucleotide
ctgtggcatcggcaatgccaggcaac

SEQ ID NO: 263714 - DNA, 27 bp, Artificial Sequence
  Description of Artificial Sequence: Synthetic oligonucleotide
tgtggcatcggcaatgccaggcaacct

SEQ ID NO: 263715 - DNA, 26 bp, Artificial Sequence
  Description of Artificial Sequence: Synthetic oligonucleotide
gtggcatcggcaatgccaggcaacct

SEQ ID NO: 263716 - DNA, 26 bp, Artificial Sequence
  Description of Artificial Sequence: Synthetic oligonucleotide
tggcatcggcaatgccaggcaacctg

SEQ ID NO: 263717 - DNA, 25 bp, Artificial Sequence
  Description of Artificial Sequence: Synthetic oligonucleotide
ggcatcggcaatgccaggcaacctg

SEQ ID NO: 263718 - DNA, 27 bp, Artificial Sequence
  Description of Artificial Sequence: Synthetic oligonucleotide
gcatcggcaatgccaggcaacctgcaa

SEQ ID NO: 263719 - DNA, 28 bp, Artificial Sequence
  Description of Artificial Sequence: Synthetic oligonucleotide
catcggcaatgccaggcaacctgcaaag

SEQ ID NO: 263720 - DNA, 29 bp, Artificial Sequence
  Description of Artificial Sequence: Synthetic oligonucleotide
atcggcaatgccaggcaacctgcaaagag

SEQ ID NO: 263721 - DNA, 28 bp, Artificial Sequence
  Description of Artificial Sequence: Synthetic oligonucleotide
tcggcaatgccaggcaacctgcaaagag

SEQ ID NO: 263722 - DNA, 27 bp, Artificial Sequence
  Description of Artificial Sequence: Synthetic oligonucleotide
cggcaatgccaggcaacctgcaaagag

SEQ ID NO: 263723 - DNA, 27 bp, Artificial Sequence
  Description of Artificial Sequence: Synthetic oligonucleotide
ggcaatgccaggcaacctgcaaagagg

SEQ ID NO: 263724 - DNA, 27 bp, Artificial Sequence
  Description of Artificial Sequence: Synthetic oligonucleotide
gcaatgccaggcaacctgcaaagaggg

SEQ ID NO: 263725 - DNA, 32 bp, Artificial Sequence
  Description of Artificial Sequence: Synthetic oligonucleotide
caatgccaggcaacctgcaaagagggaaatag

SEQ ID NO: 263726 - DNA, 33 bp, Artificial Sequence
  Description of Artificial Sequence: Synthetic oligonucleotide
aatgccaggcaacctgcaaagagggaaatagac

SEQ ID NO: 263727 - DNA, 32 bp, Artificial Sequence
  Description of Artificial Sequence: Synthetic oligonucleotide
atgccaggcaacctgcaaagagggaaatagac

SEQ ID NO: 263728 - DNA, 31 bp, Artificial Sequence
  Description of Artificial Sequence: Synthetic oligonucleotide
tgccaggcaacctgcaaagagggaaatagac

SEQ ID NO: 263729 - DNA, 30 bp, Artificial Sequence
  Description of Artificial Sequence: Synthetic oligonucleotide
gccaggcaacctgcaaagagggaaatagac

SEQ ID NO: 263730 - DNA, 32 bp, Artificial Sequence
  Description of Artificial Sequence: Synthetic oligonucleotide
ccaggcaacctgcaaagagggaaatagacaag

SEQ ID NO: 263731 - DNA, 32 bp, Artificial Sequence
  Description of Artificial Sequence: Synthetic oligonucleotide
caggcaacctgcaaagagggaaatagacaagc

SEQ ID NO: 263732 - DNA, 34 bp, Artificial Sequence
  Description of Artificial Sequence: Synthetic oligonucleotide
aggcaacctgcaaagagggaaatagacaagcttc

SEQ ID NO: 263733 - DNA, 33 bp, Artificial Sequence
  Description of Artificial Sequence: Synthetic oligonucleotide
ggcaacctgcaaagagggaaatagacaagcttc

SEQ ID NO: 263734 - DNA, 34 bp, Artificial Sequence
  Description of Artificial Sequence: Synthetic oligonucleotide
gcaacctgcaaagagggaaatagacaagcttcag

SEQ ID NO: 263735 - DNA, 36 bp, Artificial Sequence
  Description of Artificial Sequence: Synthetic oligonucleotide
caacctgcaaagagggaaatagacaagcttcagttg

SEQ ID NO: 263736 - DNA, 39 bp, Artificial Sequence
  Description of Artificial Sequence: Synthetic oligonucleotide
aacctgcaaagagggaaatagacaagcttcagttgaaag

SEQ ID NO: 263737 - DNA, 38 bp, Artificial Sequence
  Description of Artificial Sequence: Synthetic oligonucleotide
acctgcaaagagggaaatagacaagcttcagttgaaag

SEQ ID NO: 263738 - DNA, 37 bp, Artificial Sequence
  Description of Artificial Sequence: Synthetic oligonucleotide
cctgcaaagagggaaatagacaagcttcagttgaaag

SEQ ID NO: 263739 - DNA, 41 bp, Artificial Sequence
  Description of Artificial Sequence: Synthetic oligonucleotide
ctgcaaagagggaaatagacaagcttcagttgaaagaaaag

SEQ ID NO: 263740 - DNA, 42 bp, Artificial Sequence
  Description of Artificial Sequence: Synthetic oligonucleotide
tgcaaagagggaaatagacaagcttcagttgaaagaaaagac

SEQ ID NO: 263741 - DNA, 41 bp, Artificial Sequence
  Description of Artificial Sequence: Synthetic oligonucleotide
gcaaagagggaaatagacaagcttcagttgaaagaaaagac

SEQ ID NO: 263742 - DNA, 41 bp, Artificial Sequence
  Description of Artificial Sequence: Synthetic oligonucleotide
caaagagggaaatagacaagcttcagttgaaagaaaagacc

SEQ ID NO: 263743 - DNA, 42 bp, Artificial Sequence
  Description of Artificial Sequence: Synthetic oligonucleotide
aaagagggaaatagacaagcttcagttgaaagaaaagacctg

SEQ ID NO: 263744 - DNA, 41 bp, Artificial Sequence
  Description of Artificial Sequence: Synthetic oligonucleotide
aagagggaaatagacaagcttcagttgaaagaaaagacctg

SEQ ID NO: 263745 - DNA, 40 bp, Artificial Sequence
  Description of Artificial Sequence: Synthetic oligonucleotide
agagggaaatagacaagcttcagttgaaagaaaagacctg

SEQ ID NO: 263746 - DNA, 39 bp, Artificial Sequence
  Description of Artificial Sequence: Synthetic oligonucleotide
gagggaaatagacaagcttcagttgaaagaaaagacctg

SEQ ID NO: 263747 - DNA, 39 bp, Artificial Sequence
  Description of Artificial Sequence: Synthetic oligonucleotide
agggaaatagacaagcttcagttgaaagaaaagacctgc

SEQ ID NO: 263748 - DNA, 38 bp, Artificial Sequence
  Description of Artificial Sequence: Synthetic oligonucleotide
gggaaatagacaagcttcagttgaaagaaaagacctgc

SEQ ID NO: 263749 - DNA, 38 bp, Artificial Sequence
  Description of Artificial Sequence: Synthetic oligonucleotide
ggaaatagacaagcttcagttgaaagaaaagacctgcc

SEQ ID NO: 263750 - DNA, 38 bp, Artificial Sequence
  Description of Artificial Sequence: Synthetic oligonucleotide
gaaatagacaagcttcagttgaaagaaaagacctgccg

SEQ ID NO: 263751 - DNA, 39 bp, Artificial Sequence
  Description of Artificial Sequence: Synthetic oligonucleotide
aaatagacaagcttcagttgaaagaaaagacctgccgag

SEQ ID NO: 263752 - DNA, 38 bp, Artificial Sequence
  Description of Artificial Sequence: Synthetic oligonucleotide
aatagacaagcttcagttgaaagaaaagacctgccgag

SEQ ID NO: 263753 - DNA, 37 bp, Artificial Sequence
  Description of Artificial Sequence: Synthetic oligonucleotide
atagacaagcttcagttgaaagaaaagacctgccgag

SEQ ID NO: 263754 - DNA, 36 bp, Artificial Sequence
  Description of Artificial Sequence: Synthetic oligonucleotide
tagacaagcttcagttgaaagaaaagacctgccgag

SEQ ID NO: 263755 - DNA, 35 bp, Artificial Sequence
  Description of Artificial Sequence: Synthetic oligonucleotide
agacaagcttcagttgaaagaaaagacctgccgag

SEQ ID NO: 263756 - DNA, 34 bp, Artificial Sequence
  Description of Artificial Sequence: Synthetic oligonucleotide
gacaagcttcagttgaaagaaaagacctgccgag

SEQ ID NO: 263757 - DNA, 38 bp, Artificial Sequence
  Description of Artificial Sequence: Synthetic oligonucleotide
acaagcttcagttgaaagaaaagacctgccgagatatc

SEQ ID NO: 263758 - DNA, 37 bp, Artificial Sequence
  Description of Artificial Sequence: Synthetic oligonucleotide
caagcttcagttgaaagaaaagacctgccgagatatc

SEQ ID NO: 263759 - DNA, 37 bp, Artificial Sequence
  Description of Artificial Sequence: Synthetic oligonucleotide
aagcttcagttgaaagaaaagacctgccgagatatcg

SEQ ID NO: 263760 - DNA, 36 bp, Artificial Sequence
  Description of Artificial Sequence: Synthetic oligonucleotide
agcttcagttgaaagaaaagacctgccgagatatcg

SEQ ID NO: 263761 - DNA, 35 bp, Artificial Sequence
  Description of Artificial Sequence: Synthetic oligonucleotide
gcttcagttgaaagaaaagacctgccgagatatcg

SEQ ID NO: 263762 - DNA, 40 bp, Artificial Sequence
  Description of Artificial Sequence: Synthetic oligonucleotide
cttcagttgaaagaaaagacctgccgagatatcgtttaag

SEQ ID NO: 263763 - DNA, 42 bp, Artificial Sequence
  Description of Artificial Sequence: Synthetic oligonucleotide
ttcagttgaaagaaaagacctgccgagatatcgtttaagaag

SEQ ID NO: 263764 - DNA, 41 bp, Artificial Sequence
  Description of Artificial Sequence: Synthetic oligonucleotide
tcagttgaaagaaaagacctgccgagatatcgtttaagaag

SEQ ID NO: 263765 - DNA, 40 bp, Artificial Sequence
  Description of Artificial Sequence: Synthetic oligonucleotide
cagttgaaagaaaagacctgccgagatatcgtttaagaag

SEQ ID NO: 263766 - DNA, 42 bp, Artificial Sequence
  Description of Artificial Sequence: Synthetic oligonucleotide
agttgaaagaaaagacctgccgagatatcgtttaagaagttg

SEQ ID NO: 263767 - DNA, 41 bp, Artificial Sequence
  Description of Artificial Sequence: Synthetic oligonucleotide
gttgaaagaaaagacctgccgagatatcgtttaagaagttg

SEQ ID NO: 263768 - DNA, 41 bp, Artificial Sequence
  Description of Artificial Sequence: Synthetic oligonucleotide
ttgaaagaaaagacctgccgagatatcgtttaagaagttgg

SEQ ID NO: 263769 - DNA, 40 bp, Artificial Sequence
  Description of Artificial Sequence: Synthetic oligonucleotide
tgaaagaaaagacctgccgagatatcgtttaagaagttgg

SEQ ID NO: 263770 - DNA, 39 bp, Artificial Sequence
  Description of Artificial Sequence: Synthetic oligonucleotide
gaaagaaaagacctgccgagatatcgtttaagaagttgg

SEQ ID NO: 263771 - DNA, 51 bp, Artificial Sequence
  Description of Artificial Sequence: Synthetic oligonucleotide
aaagaaaagacctgccgagatatcgtttaagaagttggaaaaataatatac

SEQ ID NO: 263772 - DNA, 50 bp, Artificial Sequence
  Description of Artificial Sequence: Synthetic oligonucleotide
aagaaaagacctgccgagatatcgtttaagaagttggaaaaataatatac

SEQ ID NO: 263773 - DNA, 49 bp, Artificial Sequence
  Description of Artificial Sequence: Synthetic oligonucleotide
agaaaagacctgccgagatatcgtttaagaagttggaaaaataatatac

SEQ ID NO: 263774 - DNA, 48 bp, Artificial Sequence
  Description of Artificial Sequence: Synthetic oligonucleotide
gaaaagacctgccgagatatcgtttaagaagttggaaaaataatatac

SEQ ID NO: 263775 - DNA, 51 bp, Artificial Sequence
  Description of Artificial Sequence: Synthetic oligonucleotide
aaaagacctgccgagatatcgtttaagaagttggaaaaataatatacatag

SEQ ID NO: 263776 - DNA, 50 bp, Artificial Sequence
  Description of Artificial Sequence: Synthetic oligonucleotide
aaagacctgccgagatatcgtttaagaagttggaaaaataatatacatag

SEQ ID NO: 263777 - DNA, 49 bp, Artificial Sequence
  Description of Artificial Sequence: Synthetic oligonucleotide
aagacctgccgagatatcgtttaagaagttggaaaaataatatacatag

SEQ ID NO: 263778 - DNA, 48 bp, Artificial Sequence
  Description of Artificial Sequence: Synthetic oligonucleotide
agacctgccgagatatcgtttaagaagttggaaaaataatatacatag

SEQ ID NO: 263779 - DNA, 47 bp, Artificial Sequence
  Description of Artificial Sequence: Synthetic oligonucleotide
gacctgccgagatatcgtttaagaagttggaaaaataatatacatag

SEQ ID NO: 263780 - DNA, 49 bp, Artificial Sequence
  Description of Artificial Sequence: Synthetic oligonucleotide
acctgccgagatatcgtttaagaagttggaaaaataatatacatagtag

SEQ ID NO: 263781 - DNA, 48 bp, Artificial Sequence
  Description of Artificial Sequence: Synthetic oligonucleotide
cctgccgagatatcgtttaagaagttggaaaaataatatacatagtag

SEQ ID NO: 263782 - DNA, 50 bp, Artificial Sequence
  Description of Artificial Sequence: Synthetic oligonucleotide
ctgccgagatatcgtttaagaagttggaaaaataatatacatagtagatg

SEQ ID NO: 263783 - DNA, 51 bp, Artificial Sequence
  Description of Artificial Sequence: Synthetic oligonucleotide
tgccgagatatcgtttaagaagttggaaaaataatatacatagtagatgac

SEQ ID NO: 263784 - DNA, 50 bp, Artificial Sequence
  Description of Artificial Sequence: Synthetic oligonucleotide
gccgagatatcgtttaagaagttggaaaaataatatacatagtagatgac

SEQ ID NO: 263785 - DNA, 50 bp, Artificial Sequence
  Description of Artificial Sequence: Synthetic oligonucleotide
ccgagatatcgtttaagaagttggaaaaataatatacatagtagatgacg

SEQ ID NO: 263786 - DNA, 52 bp, Artificial Sequence
  Description of Artificial Sequence: Synthetic oligonucleotide
cgagatatcgtttaagaagttggaaaaataatatacatagtagatgacgaag

SEQ ID NO: 263787 - DNA, 56 bp, Artificial Sequence
  Description of Artificial Sequence: Synthetic oligonucleotide
gagatatcgtttaagaagttggaaaaataatatacatagtagatgacgaagataag

SEQ ID NO: 263788 - DNA, 56 bp, Artificial Sequence
  Description of Artificial Sequence: Synthetic oligonucleotide
agatatcgtttaagaagttggaaaaataatatacatagtagatgacgaagataagg

SEQ ID NO: 263789 - DNA, 55 bp, Artificial Sequence
  Description of Artificial Sequence: Synthetic oligonucleotide
gatatcgtttaagaagttggaaaaataatatacatagtagatgacgaagataagg

SEQ ID NO: 263790 - DNA, 60 bp, Artificial Sequence
  Description of Artificial Sequence: Synthetic oligonucleotide
atatcgtttaagaagttggaaaaataatatacatagtagatgacgaagataaggataatg

SEQ ID NO: 263791 - DNA, 59 bp, Artificial Sequence
  Description of Artificial Sequence: Synthetic oligonucleotide
tatcgtttaagaagttggaaaaataatatacatagtagatgacgaagataaggataatg

SEQ ID NO: 263792 - DNA, 58 bp, Artificial Sequence
  Description of Artificial Sequence: Synthetic oligonucleotide
atcgtttaagaagttggaaaaataatatacatagtagatgacgaagataaggataatg

SEQ ID NO: 263793 - DNA, 57 bp, Artificial Sequence
  Description of Artificial Sequence: Synthetic oligonucleotide
tcgtttaagaagttggaaaaataatatacatagtagatgacgaagataaggataatg

SEQ ID NO: 263794 - DNA, 56 bp, Artificial Sequence
  Description of Artificial Sequence: Synthetic oligonucleotide
cgtttaagaagttggaaaaataatatacatagtagatgacgaagataaggataatg

SEQ ID NO: 263795 - DNA, 56 bp, Artificial Sequence
  Description of Artificial Sequence: Synthetic oligonucleotide
gtttaagaagttggaaaaataatatacatagtagatgacgaagataaggataatgc

SEQ ID NO: 263796 - DNA, 60 bp, Artificial Sequence
  Description of Artificial Sequence: Synthetic oligonucleotide
tttaagaagttggaaaaataatatacatagtagatgacgaagataaggataatgcttttg

SEQ ID NO: 263797 - DNA, 59 bp, Artificial Sequence
  Description of Artificial Sequence: Synthetic oligonucleotide
ttaagaagttggaaaaataatatacatagtagatgacgaagataaggataatgcttttg

SEQ ID NO: 263798 - DNA, 58 bp, Artificial Sequence
  Description of Artificial Sequence: Synthetic oligonucleotide
taagaagttggaaaaataatatacatagtagatgacgaagataaggataatgcttttg

SEQ ID NO: 263799 - DNA, 57 bp, Artificial Sequence
  Description of Artificial Sequence: Synthetic oligonucleotide
aagaagttggaaaaataatatacatagtagatgacgaagataaggataatgcttttg

SEQ ID NO: 263800 - DNA, 56 bp, Artificial Sequence
  Description of Artificial Sequence: Synthetic oligonucleotide
agaagttggaaaaataatatacatagtagatgacgaagataaggataatgcttttg

SEQ ID NO: 263801 - DNA, 55 bp, Artificial Sequence
  Description of Artificial Sequence: Synthetic oligonucleotide
gaagttggaaaaataatatacatagtagatgacgaagataaggataatgcttttg

SEQ ID NO: 263802 - DNA, 57 bp, Artificial Sequence
  Description of Artificial Sequence: Synthetic oligonucleotide
aagttggaaaaataatatacatagtagatgacgaagataaggataatgcttttgaag

SEQ ID NO: 263803 - DNA, 56 bp, Artificial Sequence
  Description of Artificial Sequence: Synthetic oligonucleotide
agttggaaaaataatatacatagtagatgacgaagataaggataatgcttttgaag

SEQ ID NO: 263804 - DNA, 55 bp, Artificial Sequence
  Description of Artificial Sequence: Synthetic oligonucleotide
gttggaaaaataatatacatagtagatgacgaagataaggataatgcttttgaag

SEQ ID NO: 263805 - DNA, 57 bp, Artificial Sequence
  Description of Artificial Sequence: Synthetic oligonucleotide
ttggaaaaataatatacatagtagatgacgaagataaggataatgcttttgaagtag

SEQ ID NO: 263806 - DNA, 56 bp, Artificial Sequence
  Description of Artificial Sequence: Synthetic oligonucleotide
tggaaaaataatatacatagtagatgacgaagataaggataatgcttttgaagtag

SEQ ID NO: 263807 - DNA, 55 bp, Artificial Sequence
  Description of Artificial Sequence: Synthetic oligonucleotide
ggaaaaataatatacatagtagatgacgaagataaggataatgcttttgaagtag

SEQ ID NO: 263808 - DNA, 57 bp, Artificial Sequence
  Description of Artificial Sequence: Synthetic oligonucleotide
gaaaaataatatacatagtagatgacgaagataaggataatgcttttgaagtagaac

SEQ ID NO: 263809 - DNA, 58 bp, Artificial Sequence
  Description of Artificial Sequence: Synthetic oligonucleotide
aaaaataatatacatagtagatgacgaagataaggataatgcttttgaagtagaactc

SEQ ID NO: 263810 - DNA, 57 bp, Artificial Sequence
  Description of Artificial Sequence: Synthetic oligonucleotide
aaaataatatacatagtagatgacgaagataaggataatgcttttgaagtagaactc

SEQ ID NO: 263811 - DNA, 56 bp, Artificial Sequence
  Description of Artificial Sequence: Synthetic oligonucleotide
aaataatatacatagtagatgacgaagataaggataatgcttttgaagtagaactc

SEQ ID NO: 263812 - DNA, 55 bp, Artificial Sequence
  Description of Artificial Sequence: Synthetic oligonucleotide
aataatatacatagtagatgacgaagataaggataatgcttttgaagtagaactc

SEQ ID NO: 263813 - DNA, 54 bp, Artificial Sequence
  Description of Artificial Sequence: Synthetic oligonucleotide
ataatatacatagtagatgacgaagataaggataatgcttttgaagtagaactc

SEQ ID NO: 263814 - DNA, 53 bp, Artificial Sequence
  Description of Artificial Sequence: Synthetic oligonucleotide
taatatacatagtagatgacgaagataaggataatgcttttgaagtagaactc

SEQ ID NO: 263815 - DNA, 52 bp, Artificial Sequence
  Description of Artificial Sequence: Synthetic oligonucleotide
aatatacatagtagatgacgaagataaggataatgcttttgaagtagaactc

SEQ ID NO: 263816 - DNA, 51 bp, Artificial Sequence
  Description of Artificial Sequence: Synthetic oligonucleotide
atatacatagtagatgacgaagataaggataatgcttttgaagtagaactc

SEQ ID NO: 263817 - DNA, 50 bp, Artificial Sequence
  Description of Artificial Sequence: Synthetic oligonucleotide
tatacatagtagatgacgaagataaggataatgcttttgaagtagaactc

SEQ ID NO: 263818 - DNA, 49 bp, Artificial Sequence
  Description of Artificial Sequence: Synthetic oligonucleotide
atacatagtagatgacgaagataaggataatgcttttgaagtagaactc

SEQ ID NO: 263819 - DNA, 48 bp, Artificial Sequence
  Description of Artificial Sequence: Synthetic oligonucleotide
tacatagtagatgacgaagataaggataatgcttttgaagtagaactc

SEQ ID NO: 263820 - DNA, 47 bp, Artificial Sequence
  Description of Artificial Sequence: Synthetic oligonucleotide
acatagtagatgacgaagataaggataatgcttttgaagtagaactc

SEQ ID NO: 263821 - DNA, 46 bp, Artificial Sequence
  Description of Artificial Sequence: Synthetic oligonucleotide
catagtagatgacgaagataaggataatgcttttgaagtagaactc

SEQ ID NO: 263822 - DNA, 47 bp, Artificial Sequence
  Description of Artificial Sequence: Synthetic oligonucleotide
atagtagatgacgaagataaggataatgcttttgaagtagaactcac

SEQ ID NO: 263823 - DNA, 46 bp, Artificial Sequence
  Description of Artificial Sequence: Synthetic oligonucleotide
tagtagatgacgaagataaggataatgcttttgaagtagaactcac

SEQ ID NO: 263824 - DNA, 45 bp, Artificial Sequence
  Description of Artificial Sequence: Synthetic oligonucleotide
agtagatgacgaagataaggataatgcttttgaagtagaactcac

SEQ ID NO: 263825 - DNA, 44 bp, Artificial Sequence
  Description of Artificial Sequence: Synthetic oligonucleotide
gtagatgacgaagataaggataatgcttttgaagtagaactcac

SEQ ID NO: 263826 - DNA, 44 bp, Artificial Sequence
  Description of Artificial Sequence: Synthetic oligonucleotide
tagatgacgaagataaggataatgcttttgaagtagaactcacc

SEQ ID NO: 263827 - DNA, 43 bp, Artificial Sequence
  Description of Artificial Sequence: Synthetic oligonucleotide
agatgacgaagataaggataatgcttttgaagtagaactcacc

SEQ ID NO: 263828 - DNA, 42 bp, Artificial Sequence
  Description of Artificial Sequence: Synthetic oligonucleotide
gatgacgaagataaggataatgcttttgaagtagaactcacc

SEQ ID NO: 263829 - DNA, 43 bp, Artificial Sequence
  Description of Artificial Sequence: Synthetic oligonucleotide
atgacgaagataaggataatgcttttgaagtagaactcacctg

SEQ ID NO: 263830 - DNA, 42 bp, Artificial Sequence
  Description of Artificial Sequence: Synthetic oligonucleotide
tgacgaagataaggataatgcttttgaagtagaactcacctg

SEQ ID NO: 263831 - DNA, 41 bp, Artificial Sequence
  Description of Artificial Sequence: Synthetic oligonucleotide
gacgaagataaggataatgcttttgaagtagaactcacctg

SEQ ID NO: 263832 - DNA, 41 bp, Artificial Sequence
  Description of Artificial Sequence: Synthetic oligonucleotide
acgaagataaggataatgcttttgaagtagaactcacctgg

SEQ ID NO: 263833 - DNA, 40 bp, Artificial Sequence
  Description of Artificial Sequence: Synthetic oligonucleotide
cgaagataaggataatgcttttgaagtagaactcacctgg

SEQ ID NO: 263834 - DNA, 40 bp, Artificial Sequence
  Description of Artificial Sequence: Synthetic oligonucleotide
gaagataaggataatgcttttgaagtagaactcacctggg

SEQ ID NO: 263835 - DNA, 42 bp, Artificial Sequence
  Description of Artificial Sequence: Synthetic oligonucleotide
aagataaggataatgcttttgaagtagaactcacctgggttg

SEQ ID NO: 263836 - DNA, 41 bp, Artificial Sequence
  Description of Artificial Sequence: Synthetic oligonucleotide
agataaggataatgcttttgaagtagaactcacctgggttg

SEQ ID NO: 263837 - DNA, 40 bp, Artificial Sequence
  Description of Artificial Sequence: Synthetic oligonucleotide
gataaggataatgcttttgaagtagaactcacctgggttg

SEQ ID NO: 263838 - DNA, 40 bp, Artificial Sequence
  Description of Artificial Sequence: Synthetic oligonucleotide
ataaggataatgcttttgaagtagaactcacctgggttgg

SEQ ID NO: 263839 - DNA, 39 bp, Artificial Sequence
  Description of Artificial Sequence: Synthetic oligonucleotide
taaggataatgcttttgaagtagaactcacctgggttgg

SEQ ID NO: 263840 - DNA, 38 bp, Artificial Sequence
  Description of Artificial Sequence: Synthetic oligonucleotide
aaggataatgcttttgaagtagaactcacctgggttgg

SEQ ID NO: 263841 - DNA, 37 bp, Artificial Sequence
  Description of Artificial Sequence: Synthetic oligonucleotide
aggataatgcttttgaagtagaactcacctgggttgg

SEQ ID NO: 263842 - DNA, 36 bp, Artificial Sequence
  Description of Artificial Sequence: Synthetic oligonucleotide
ggataatgcttttgaagtagaactcacctgggttgg

SEQ ID NO: 263843 - DNA, 37 bp, Artificial Sequence
  Description of Artificial Sequence: Synthetic oligonucleotide
gataatgcttttgaagtagaactcacctgggttggag

SEQ ID NO: 263844 - DNA, 43 bp, Artificial Sequence
  Description of Artificial Sequence: Synthetic oligonucleotide
ataatgcttttgaagtagaactcacctgggttggagaattaac

SEQ ID NO: 263845 - DNA, 42 bp, Artificial Sequence
  Description of Artificial Sequence: Synthetic oligonucleotide
taatgcttttgaagtagaactcacctgggttggagaattaac

SEQ ID NO: 263846 - DNA, 41 bp, Artificial Sequence
  Description of Artificial Sequence: Synthetic oligonucleotide
aatgcttttgaagtagaactcacctgggttggagaattaac

SEQ ID NO: 263847 - DNA, 40 bp, Artificial Sequence
  Description of Artificial Sequence: Synthetic oligonucleotide
atgcttttgaagtagaactcacctgggttggagaattaac

SEQ ID NO: 263848 - DNA, 39 bp, Artificial Sequence
  Description of Artificial Sequence: Synthetic oligonucleotide
tgcttttgaagtagaactcacctgggttggagaattaac

SEQ ID NO: 263849 - DNA, 38 bp, Artificial Sequence
  Description of Artificial Sequence: Synthetic oligonucleotide
gcttttgaagtagaactcacctgggttggagaattaac

SEQ ID NO: 263850 - DNA, 42 bp, Artificial Sequence
  Description of Artificial Sequence: Synthetic oligonucleotide
cttttgaagtagaactcacctgggttggagaattaacttatg

SEQ ID NO: 263851 - DNA, 42 bp, Artificial Sequence
  Description of Artificial Sequence: Synthetic oligonucleotide
ttttgaagtagaactcacctgggttggagaattaacttatgg

SEQ ID NO: 263852 - DNA, 41 bp, Artificial Sequence
  Description of Artificial Sequence: Synthetic oligonucleotide
tttgaagtagaactcacctgggttggagaattaacttatgg

SEQ ID NO: 263853 - DNA, 40 bp, Artificial Sequence
  Description of Artificial Sequence: Synthetic oligonucleotide
ttgaagtagaactcacctgggttggagaattaacttatgg

SEQ ID NO: 263854 - DNA, 39 bp, Artificial Sequence
  Description of Artificial Sequence: Synthetic oligonucleotide
tgaagtagaactcacctgggttggagaattaacttatgg

SEQ ID NO: 263855 - DNA, 38 bp, Artificial Sequence
  Description of Artificial Sequence: Synthetic oligonucleotide
gaagtagaactcacctgggttggagaattaacttatgg

SEQ ID NO: 263856 - DNA, 40 bp, Artificial Sequence
  Description of Artificial Sequence: Synthetic oligonucleotide
aagtagaactcacctgggttggagaattaacttatggaag

SEQ ID NO: 263857 - DNA, 39 bp, Artificial Sequence
  Description of Artificial Sequence: Synthetic oligonucleotide
agtagaactcacctgggttggagaattaacttatggaag

SEQ ID NO: 263858 - DNA, 38 bp, Artificial Sequence
  Description of Artificial Sequence: Synthetic oligonucleotide
gtagaactcacctgggttggagaattaacttatggaag

SEQ ID NO: 263859 - DNA, 39 bp, Artificial Sequence
  Description of Artificial Sequence: Synthetic oligonucleotide
tagaactcacctgggttggagaattaacttatggaagac

SEQ ID NO: 263860 - DNA, 38 bp, Artificial Sequence
  Description of Artificial Sequence: Synthetic oligonucleotide
agaactcacctgggttggagaattaacttatggaagac

SEQ ID NO: 263861 - DNA, 37 bp, Artificial Sequence
  Description of Artificial Sequence: Synthetic oligonucleotide
gaactcacctgggttggagaattaacttatggaagac

SEQ ID NO: 263862 - DNA, 39 bp, Artificial Sequence
  Description of Artificial Sequence: Synthetic oligonucleotide
aactcacctgggttggagaattaacttatggaagacttg

SEQ ID NO: 263863 - DNA, 38 bp, Artificial Sequence
  Description of Artificial Sequence: Synthetic oligonucleotide
actcacctgggttggagaattaacttatggaagacttg

SEQ ID NO: 263864 - DNA, 37 bp, Artificial Sequence
  Description of Artificial Sequence: Synthetic oligonucleotide
ctcacctgggttggagaattaacttatggaagacttg

SEQ ID NO: 263865 - DNA, 42 bp, Artificial Sequence
  Description of Artificial Sequence: Synthetic oligonucleotide
tcacctgggttggagaattaacttatggaagacttgaaattg

SEQ ID NO: 263866 - DNA, 41 bp, Artificial Sequence
  Description of Artificial Sequence: Synthetic oligonucleotide
cacctgggttggagaattaacttatggaagacttgaaattg

SEQ ID NO: 263867 - DNA, 43 bp, Artificial Sequence
  Description of Artificial Sequence: Synthetic oligonucleotide
acctgggttggagaattaacttatggaagacttgaaattgtac

SEQ ID NO: 263868 - DNA, 42 bp, Artificial Sequence
  Description of Artificial Sequence: Synthetic oligonucleotide
cctgggttggagaattaacttatggaagacttgaaattgtac

SEQ ID NO: 263869 - DNA, 42 bp, Artificial Sequence
  Description of Artificial Sequence: Synthetic oligonucleotide
ctgggttggagaattaacttatggaagacttgaaattgtacc

SEQ ID NO: 263870 - DNA, 46 bp, Artificial Sequence
  Description of Artificial Sequence: Synthetic oligonucleotide
tgggttggagaattaacttatggaagacttgaaattgtaccaaaag

SEQ ID NO: 263871 - DNA, 45 bp, Artificial Sequence
  Description of Artificial Sequence: Synthetic oligonucleotide
gggttggagaattaacttatggaagacttgaaattgtaccaaaag

SEQ ID NO: 263872 - DNA, 51 bp, Artificial Sequence
  Description of Artificial Sequence: Synthetic oligonucleotide
ggttggagaattaacttatggaagacttgaaattgtaccaaaagatttaag

SEQ ID NO: 263873 - DNA, 52 bp, Artificial Sequence
  Description of Artificial Sequence: Synthetic oligonucleotide
gttggagaattaacttatggaagacttgaaattgtaccaaaagatttaagag

SEQ ID NO: 263874 - DNA, 54 bp, Artificial Sequence
  Description of Artificial Sequence: Synthetic oligonucleotide
ttggagaattaacttatggaagacttgaaattgtaccaaaagatttaagagaag

SEQ ID NO: 263875 - DNA, 53 bp, Artificial Sequence
  Description of Artificial Sequence: Synthetic oligonucleotide
tggagaattaacttatggaagacttgaaattgtaccaaaagatttaagagaag

SEQ ID NO: 263876 - DNA, 52 bp, Artificial Sequence
  Description of Artificial Sequence: Synthetic oligonucleotide
ggagaattaacttatggaagacttgaaattgtaccaaaagatttaagagaag

SEQ ID NO: 263877 - DNA, 54 bp, Artificial Sequence
  Description of Artificial Sequence: Synthetic oligonucleotide
gagaattaacttatggaagacttgaaattgtaccaaaagatttaagagaagtag

SEQ ID NO: 263878 - DNA, 54 bp, Artificial Sequence
  Description of Artificial Sequence: Synthetic oligonucleotide
agaattaacttatggaagacttgaaattgtaccaaaagatttaagagaagtagc

SEQ ID NO: 263879 - DNA, 53 bp, Artificial Sequence
  Description of Artificial Sequence: Synthetic oligonucleotide
gaattaacttatggaagacttgaaattgtaccaaaagatttaagagaagtagc

SEQ ID NO: 263880 - DNA, 54 bp, Artificial Sequence
  Description of Artificial Sequence: Synthetic oligonucleotide
aattaacttatggaagacttgaaattgtaccaaaagatttaagagaagtagcag

SEQ ID NO: 263881 - DNA, 53 bp, Artificial Sequence
  Description of Artificial Sequence: Synthetic oligonucleotide
attaacttatggaagacttgaaattgtaccaaaagatttaagagaagtagcag

SEQ ID NO: 263882 - DNA, 52 bp, Artificial Sequence
  Description of Artificial Sequence: Synthetic oligonucleotide
ttaacttatggaagacttgaaattgtaccaaaagatttaagagaagtagcag

SEQ ID NO: 263883 - DNA, 51 bp, Artificial Sequence
  Description of Artificial Sequence: Synthetic oligonucleotide
taacttatggaagacttgaaattgtaccaaaagatttaagagaagtagcag

SEQ ID NO: 263884 - DNA, 50 bp, Artificial Sequence
  Description of Artificial Sequence: Synthetic oligonucleotide
aacttatggaagacttgaaattgtaccaaaagatttaagagaagtagcag

SEQ ID NO: 263885 - DNA, 49 bp, Artificial Sequence
  Description of Artificial Sequence: Synthetic oligonucleotide
acttatggaagacttgaaattgtaccaaaagatttaagagaagtagcag

SEQ ID NO: 263886 - DNA, 48 bp, Artificial Sequence
  Description of Artificial Sequence: Synthetic oligonucleotide
cttatggaagacttgaaattgtaccaaaagatttaagagaagtagcag

SEQ ID NO: 263887 - DNA, 49 bp, Artificial Sequence
  Description of Artificial Sequence: Synthetic oligonucleotide
ttatggaagacttgaaattgtaccaaaagatttaagagaagtagcagag

SEQ ID NO: 263888 - DNA, 48 bp, Artificial Sequence
  Description of Artificial Sequence: Synthetic oligonucleotide
tatggaagacttgaaattgtaccaaaagatttaagagaagtagcagag

SEQ ID NO: 263889 - DNA, 47 bp, Artificial Sequence
  Description of Artificial Sequence: Synthetic oligonucleotide
atggaagacttgaaattgtaccaaaagatttaagagaagtagcagag

SEQ ID NO: 263890 - DNA, 46 bp, Artificial Sequence
  Description of Artificial Sequence: Synthetic oligonucleotide
tggaagacttgaaattgtaccaaaagatttaagagaagtagcagag

SEQ ID NO: 263891 - DNA, 45 bp, Artificial Sequence
  Description of Artificial Sequence: Synthetic oligonucleotide
ggaagacttgaaattgtaccaaaagatttaagagaagtagcagag

SEQ ID NO: 263892 - DNA, 51 bp, Artificial Sequence
  Description of Artificial Sequence: Synthetic oligonucleotide
gaagacttgaaattgtaccaaaagatttaagagaagtagcagagaattatg

SEQ ID NO: 263893 - DNA, 51 bp, Artificial Sequence
  Description of Artificial Sequence: Synthetic oligonucleotide
aagacttgaaattgtaccaaaagatttaagagaagtagcagagaattatgc

SEQ ID NO: 263894 - DNA, 50 bp, Artificial Sequence
  Description of Artificial Sequence: Synthetic oligonucleotide
agacttgaaattgtaccaaaagatttaagagaagtagcagagaattatgc

SEQ ID NO: 263895 - DNA, 49 bp, Artificial Sequence
  Description of Artificial Sequence: Synthetic oligonucleotide
gacttgaaattgtaccaaaagatttaagagaagtagcagagaattatgc

SEQ ID NO: 263896 - DNA, 52 bp, Artificial Sequence
  Description of Artificial Sequence: Synthetic oligonucleotide
acttgaaattgtaccaaaagatttaagagaagtagcagagaattatgctaag

SEQ ID NO: 263897 - DNA, 51 bp, Artificial Sequence
  Description of Artificial Sequence: Synthetic oligonucleotide
cttgaaattgtaccaaaagatttaagagaagtagcagagaattatgctaag

SEQ ID NO: 263898 - DNA, 51 bp, Artificial Sequence
  Description of Artificial Sequence: Synthetic oligonucleotide
ttgaaattgtaccaaaagatttaagagaagtagcagagaattatgctaagc

SEQ ID NO: 263899 - DNA, 50 bp, Artificial Sequence
  Description of Artificial Sequence: Synthetic oligonucleotide
tgaaattgtaccaaaagatttaagagaagtagcagagaattatgctaagc

SEQ ID NO: 263900 - DNA, 49 bp, Artificial Sequence
  Description of Artificial Sequence: Synthetic oligonucleotide
gaaattgtaccaaaagatttaagagaagtagcagagaattatgctaagc

SEQ ID NO: 263901 - DNA, 52 bp, Artificial Sequence
  Description of Artificial Sequence: Synthetic oligonucleotide
aaattgtaccaaaagatttaagagaagtagcagagaattatgctaagcaatc

SEQ ID NO: 263902 - DNA, 51 bp, Artificial Sequence
  Description of Artificial Sequence: Synthetic oligonucleotide
aattgtaccaaaagatttaagagaagtagcagagaattatgctaagcaatc

SEQ ID NO: 263903 - DNA, 50 bp, Artificial Sequence
  Description of Artificial Sequence: Synthetic oligonucleotide
attgtaccaaaagatttaagagaagtagcagagaattatgctaagcaatc

SEQ ID NO: 263904 - DNA, 49 bp, Artificial Sequence
  Description of Artificial Sequence: Synthetic oligonucleotide
ttgtaccaaaagatttaagagaagtagcagagaattatgctaagcaatc

SEQ ID NO: 263905 - DNA, 48 bp, Artificial Sequence
  Description of Artificial Sequence: Synthetic oligonucleotide
tgtaccaaaagatttaagagaagtagcagagaattatgctaagcaatc

SEQ ID NO: 263906 - DNA, 47 bp, Artificial Sequence
  Description of Artificial Sequence: Synthetic oligonucleotide
gtaccaaaagatttaagagaagtagcagagaattatgctaagcaatc

SEQ ID NO: 263907 - DNA, 48 bp, Artificial Sequence
  Description of Artificial Sequence: Synthetic oligonucleotide
taccaaaagatttaagagaagtagcagagaattatgctaagcaatctc

SEQ ID NO: 263908 - DNA, 47 bp, Artificial Sequence
  Description of Artificial Sequence: Synthetic oligonucleotide
accaaaagatttaagagaagtagcagagaattatgctaagcaatctc

SEQ ID NO: 263909 - DNA, 46 bp, Artificial Sequence
  Description of Artificial Sequence: Synthetic oligonucleotide
ccaaaagatttaagagaagtagcagagaattatgctaagcaatctc

SEQ ID NO: 263910 - DNA, 47 bp, Artificial Sequence
  Description of Artificial Sequence: Synthetic oligonucleotide
caaaagatttaagagaagtagcagagaattatgctaagcaatctctg

SEQ ID NO: 263911 - DNA, 49 bp, Artificial Sequence
  Description of Artificial Sequence: Synthetic oligonucleotide
aaaagatttaagagaagtagcagagaattatgctaagcaatctctgatg

SEQ ID NO: 263912 - DNA, 48 bp, Artificial Sequence
  Description of Artificial Sequence: Synthetic oligonucleotide
aaagatttaagagaagtagcagagaattatgctaagcaatctctgatg

SEQ ID NO: 263913 - DNA, 47 bp, Artificial Sequence
  Description of Artificial Sequence: Synthetic oligonucleotide
aagatttaagagaagtagcagagaattatgctaagcaatctctgatg

SEQ ID NO: 263914 - DNA, 46 bp, Artificial Sequence
  Description of Artificial Sequence: Synthetic oligonucleotide
agatttaagagaagtagcagagaattatgctaagcaatctctgatg

SEQ ID NO: 263915 - DNA, 45 bp, Artificial Sequence
  Description of Artificial Sequence: Synthetic oligonucleotide
gatttaagagaagtagcagagaattatgctaagcaatctctgatg

SEQ ID NO: 263916 - DNA, 45 bp, Artificial Sequence
  Description of Artificial Sequence: Synthetic oligonucleotide
atttaagagaagtagcagagaattatgctaagcaatctctgatgg

SEQ ID NO: 263917 - DNA, 44 bp, Artificial Sequence
  Description of Artificial Sequence: Synthetic oligonucleotide
tttaagagaagtagcagagaattatgctaagcaatctctgatgg

SEQ ID NO: 263918 - DNA, 43 bp, Artificial Sequence
  Description of Artificial Sequence: Synthetic oligonucleotide
ttaagagaagtagcagagaattatgctaagcaatctctgatgg

SEQ ID NO: 263919 - DNA, 42 bp, Artificial Sequence
  Description of Artificial Sequence: Synthetic oligonucleotide
taagagaagtagcagagaattatgctaagcaatctctgatgg

SEQ ID NO: 263920 - DNA, 41 bp, Artificial Sequence
  Description of Artificial Sequence: Synthetic oligonucleotide
aagagaagtagcagagaattatgctaagcaatctctgatgg

SEQ ID NO: 263921 - DNA, 40 bp, Artificial Sequence
  Description of Artificial Sequence: Synthetic oligonucleotide
agagaagtagcagagaattatgctaagcaatctctgatgg

SEQ ID NO: 263922 - DNA, 39 bp, Artificial Sequence
  Description of Artificial Sequence: Synthetic oligonucleotide
gagaagtagcagagaattatgctaagcaatctctgatgg

SEQ ID NO: 263923 - DNA, 41 bp, Artificial Sequence
  Description of Artificial Sequence: Synthetic oligonucleotide
agaagtagcagagaattatgctaagcaatctctgatggaag

SEQ ID NO: 263924 - DNA, 40 bp, Artificial Sequence
  Description of Artificial Sequence: Synthetic oligonucleotide
gaagtagcagagaattatgctaagcaatctctgatggaag

SEQ ID NO: 263925 - DNA, 42 bp, Artificial Sequence
  Description of Artificial Sequence: Synthetic oligonucleotide
aagtagcagagaattatgctaagcaatctctgatggaagaag

SEQ ID NO: 263926 - DNA, 41 bp, Artificial Sequence
  Description of Artificial Sequence: Synthetic oligonucleotide
agtagcagagaattatgctaagcaatctctgatggaagaag

SEQ ID NO: 263927 - DNA, 40 bp, Artificial Sequence
  Description of Artificial Sequence: Synthetic oligonucleotide
gtagcagagaattatgctaagcaatctctgatggaagaag

SEQ ID NO: 263928 - DNA, 42 bp, Artificial Sequence
  Description of Artificial Sequence: Synthetic oligonucleotide
tagcagagaattatgctaagcaatctctgatggaagaagaag

SEQ ID NO: 263929 - DNA, 41 bp, Artificial Sequence
  Description of Artificial Sequence: Synthetic oligonucleotide
agcagagaattatgctaagcaatctctgatggaagaagaag

SEQ ID NO: 263930 - DNA, 40 bp, Artificial Sequence
  Description of Artificial Sequence: Synthetic oligonucleotide
gcagagaattatgctaagcaatctctgatggaagaagaag

SEQ ID NO: 263931 - DNA, 43 bp, Artificial Sequence
  Description of Artificial Sequence: Synthetic oligonucleotide
cagagaattatgctaagcaatctctgatggaagaagaagaatc

SEQ ID NO: 263932 - DNA, 44 bp, Artificial Sequence
  Description of Artificial Sequence: Synthetic oligonucleotide
agagaattatgctaagcaatctctgatggaagaagaagaatcag

SEQ ID NO: 263933 - DNA, 43 bp, Artificial Sequence
  Description of Artificial Sequence: Synthetic oligonucleotide
gagaattatgctaagcaatctctgatggaagaagaagaatcag

SEQ ID NO: 263934 - DNA, 45 bp, Artificial Sequence
  Description of Artificial Sequence: Synthetic oligonucleotide
agaattatgctaagcaatctctgatggaagaagaagaatcagatc

SEQ ID NO: 263935 - DNA, 44 bp, Artificial Sequence
  Description of Artificial Sequence: Synthetic oligonucleotide
gaattatgctaagcaatctctgatggaagaagaagaatcagatc

SEQ ID NO: 263936 - DNA, 46 bp, Artificial Sequence
  Description of Artificial Sequence: Synthetic oligonucleotide
aattatgctaagcaatctctgatggaagaagaagaatcagatcatg

SEQ ID NO: 263937 - DNA, 45 bp, Artificial Sequence
  Description of Artificial Sequence: Synthetic oligonucleotide
attatgctaagcaatctctgatggaagaagaagaatcagatcatg

SEQ ID NO: 263938 - DNA, 44 bp, Artificial Sequence
  Description of Artificial Sequence: Synthetic oligonucleotide
ttatgctaagcaatctctgatggaagaagaagaatcagatcatg

SEQ ID NO: 263939 - DNA, 43 bp, Artificial Sequence
  Description of Artificial Sequence: Synthetic oligonucleotide
tatgctaagcaatctctgatggaagaagaagaatcagatcatg

SEQ ID NO: 263940 - DNA, 42 bp, Artificial Sequence
  Description of Artificial Sequence: Synthetic oligonucleotide
atgctaagcaatctctgatggaagaagaagaatcagatcatg

SEQ ID NO: 263941 - DNA, 41 bp, Artificial Sequence
  Description of Artificial Sequence: Synthetic oligonucleotide
tgctaagcaatctctgatggaagaagaagaatcagatcatg

SEQ ID NO: 263942 - DNA, 40 bp, Artificial Sequence
  Description of Artificial Sequence: Synthetic oligonucleotide
gctaagcaatctctgatggaagaagaagaatcagatcatg

SEQ ID NO: 263943 - DNA, 47 bp, Artificial Sequence
  Description of Artificial Sequence: Synthetic oligonucleotide
ctaagcaatctctgatggaagaagaagaatcagatcatgataataag

SEQ ID NO: 263944 - DNA, 40 bp, Artificial Sequence
  Description of Artificial Sequence: Synthetic oligonucleotide
aagtctcgaagttatgactcctggaccactaaattttctc

SEQ ID NO: 263945 - DNA, 39 bp, Artificial Sequence
  Description of Artificial Sequence: Synthetic oligonucleotide
agtctcgaagttatgactcctggaccactaaattttctc

SEQ ID NO: 263946 - DNA, 38 bp, Artificial Sequence
  Description of Artificial Sequence: Synthetic oligonucleotide
gtctcgaagttatgactcctggaccactaaattttctc

SEQ ID NO: 263947 - DNA, 38 bp, Artificial Sequence
  Description of Artificial Sequence: Synthetic oligonucleotide
tctcgaagttatgactcctggaccactaaattttctcc

SEQ ID NO: 263948 - DNA, 37 bp, Artificial Sequence
  Description of Artificial Sequence: Synthetic oligonucleotide
ctcgaagttatgactcctggaccactaaattttctcc

SEQ ID NO: 263949 - DNA, 38 bp, Artificial Sequence
  Description of Artificial Sequence: Synthetic oligonucleotide
tcgaagttatgactcctggaccactaaattttctcctg

SEQ ID NO: 263950 - DNA, 37 bp, Artificial Sequence
  Description of Artificial Sequence: Synthetic oligonucleotide
cgaagttatgactcctggaccactaaattttctcctg

SEQ ID NO: 263951 - DNA, 39 bp, Artificial Sequence
  Description of Artificial Sequence: Synthetic oligonucleotide
gaagttatgactcctggaccactaaattttctcctgaag

SEQ ID NO: 263952 - DNA, 39 bp, Artificial Sequence
  Description of Artificial Sequence: Synthetic oligonucleotide
aagttatgactcctggaccactaaattttctcctgaagg

SEQ ID NO: 263953 - DNA, 38 bp, Artificial Sequence
  Description of Artificial Sequence: Synthetic oligonucleotide
agttatgactcctggaccactaaattttctcctgaagg

SEQ ID NO: 263954 - DNA, 37 bp, Artificial Sequence
  Description of Artificial Sequence: Synthetic oligonucleotide
gttatgactcctggaccactaaattttctcctgaagg

SEQ ID NO: 263955 - DNA, 38 bp, Artificial Sequence
  Description of Artificial Sequence: Synthetic oligonucleotide
ttatgactcctggaccactaaattttctcctgaaggtc

SEQ ID NO: 263956 - DNA, 37 bp, Artificial Sequence
  Description of Artificial Sequence: Synthetic oligonucleotide
tatgactcctggaccactaaattttctcctgaaggtc

SEQ ID NO: 263957 - DNA, 36 bp, Artificial Sequence
  Description of Artificial Sequence: Synthetic oligonucleotide
atgactcctggaccactaaattttctcctgaaggtc

SEQ ID NO: 263958 - DNA, 35 bp, Artificial Sequence
  Description of Artificial Sequence: Synthetic oligonucleotide
tgactcctggaccactaaattttctcctgaaggtc

SEQ ID NO: 263959 - DNA, 34 bp, Artificial Sequence
  Description of Artificial Sequence: Synthetic oligonucleotide
gactcctggaccactaaattttctcctgaaggtc

SEQ ID NO: 263960 - DNA, 34 bp, Artificial Sequence
  Description of Artificial Sequence: Synthetic oligonucleotide
actcctggaccactaaattttctcctgaaggtcg

SEQ ID NO: 263961 - DNA, 33 bp, Artificial Sequence
  Description of Artificial Sequence: Synthetic oligonucleotide
ctcctggaccactaaattttctcctgaaggtcg

SEQ ID NO: 263962 - DNA, 33 bp, Artificial Sequence
  Description of Artificial Sequence: Synthetic oligonucleotide
tcctggaccactaaattttctcctgaaggtcgc

SEQ ID NO: 263963 - DNA, 32 bp, Artificial Sequence
  Description of Artificial Sequence: Synthetic oligonucleotide
cctggaccactaaattttctcctgaaggtcgc

SEQ ID NO: 263964 - DNA, 37 bp, Artificial Sequence
  Description of Artificial Sequence: Synthetic oligonucleotide
ctggaccactaaattttctcctgaaggtcgcatatac

SEQ ID NO: 263965 - DNA, 37 bp, Artificial Sequence
  Description of Artificial Sequence: Synthetic oligonucleotide
tggaccactaaattttctcctgaaggtcgcatatacc

SEQ ID NO: 263966 - DNA, 36 bp, Artificial Sequence
  Description of Artificial Sequence: Synthetic oligonucleotide
ggaccactaaattttctcctgaaggtcgcatatacc

SEQ ID NO: 263967 - DNA, 38 bp, Artificial Sequence
  Description of Artificial Sequence: Synthetic oligonucleotide
gaccactaaattttctcctgaaggtcgcatataccaag

SEQ ID NO: 263968 - DNA, 40 bp, Artificial Sequence
  Description of Artificial Sequence: Synthetic oligonucleotide
accactaaattttctcctgaaggtcgcatataccaagatg

SEQ ID NO: 263969 - DNA, 39 bp, Artificial Sequence
  Description of Artificial Sequence: Synthetic oligonucleotide
ccactaaattttctcctgaaggtcgcatataccaagatg

SEQ ID NO: 263970 - DNA, 44 bp, Artificial Sequence
  Description of Artificial Sequence: Synthetic oligonucleotide
cactaaattttctcctgaaggtcgcatataccaagatgaatatg

SEQ ID NO: 263971 - DNA, 44 bp, Artificial Sequence
  Description of Artificial Sequence: Synthetic oligonucleotide
actaaattttctcctgaaggtcgcatataccaagatgaatatgc

SEQ ID NO: 263972 - DNA, 43 bp, Artificial Sequence
  Description of Artificial Sequence: Synthetic oligonucleotide
ctaaattttctcctgaaggtcgcatataccaagatgaatatgc

SEQ ID NO: 263973 - DNA, 43 bp, Artificial Sequence
  Description of Artificial Sequence: Synthetic oligonucleotide
taaattttctcctgaaggtcgcatataccaagatgaatatgcg

SEQ ID NO: 263974 - DNA, 42 bp, Artificial Sequence
  Description of Artificial Sequence: Synthetic oligonucleotide
aaattttctcctgaaggtcgcatataccaagatgaatatgcg

SEQ ID NO: 263975 - DNA, 41 bp, Artificial Sequence
  Description of Artificial Sequence: Synthetic oligonucleotide
aattttctcctgaaggtcgcatataccaagatgaatatgcg

SEQ ID NO: 263976 - DNA, 40 bp, Artificial Sequence
  Description of Artificial Sequence: Synthetic oligonucleotide
attttctcctgaaggtcgcatataccaagatgaatatgcg

SEQ ID NO: 263977 - DNA, 39 bp, Artificial Sequence
  Description of Artificial Sequence: Synthetic oligonucleotide
ttttctcctgaaggtcgcatataccaagatgaatatgcg

SEQ ID NO: 263978 - DNA, 38 bp, Artificial Sequence
  Description of Artificial Sequence: Synthetic oligonucleotide
tttctcctgaaggtcgcatataccaagatgaatatgcg

SEQ ID NO: 263979 - DNA, 37 bp, Artificial Sequence
  Description of Artificial Sequence: Synthetic oligonucleotide
ttctcctgaaggtcgcatataccaagatgaatatgcg

SEQ ID NO: 263980 - DNA, 36 bp, Artificial Sequence
  Description of Artificial Sequence: Synthetic oligonucleotide
tctcctgaaggtcgcatataccaagatgaatatgcg

SEQ ID NO: 263981 - DNA, 35 bp, Artificial Sequence
  Description of Artificial Sequence: Synthetic oligonucleotide
ctcctgaaggtcgcatataccaagatgaatatgcg

SEQ ID NO: 263982 - DNA, 37 bp, Artificial Sequence
  Description of Artificial Sequence: Synthetic oligonucleotide
tcctgaaggtcgcatataccaagatgaatatgcgatg

SEQ ID NO: 263983 - DNA, 36 bp, Artificial Sequence
  Description of Artificial Sequence: Synthetic oligonucleotide
cctgaaggtcgcatataccaagatgaatatgcgatg

SEQ ID NO: 263984 - DNA, 36 bp, Artificial Sequence
  Description of Artificial Sequence: Synthetic oligonucleotide
ctgaaggtcgcatataccaagatgaatatgcgatgg

SEQ ID NO: 263985 - DNA, 38 bp, Artificial Sequence
  Description of Artificial Sequence: Synthetic oligonucleotide
tgaaggtcgcatataccaagatgaatatgcgatggaag

SEQ ID NO: 263986 - DNA, 37 bp, Artificial Sequence
  Description of Artificial Sequence: Synthetic oligonucleotide
gaaggtcgcatataccaagatgaatatgcgatggaag

SEQ ID NO: 263987 - DNA, 37 bp, Artificial Sequence
  Description of Artificial Sequence: Synthetic oligonucleotide
aaggtcgcatataccaagatgaatatgcgatggaagc

SEQ ID NO: 263988 - DNA, 36 bp, Artificial Sequence
  Description of Artificial Sequence: Synthetic oligonucleotide
aggtcgcatataccaagatgaatatgcgatggaagc

SEQ ID NO: 263989 - DNA, 35 bp, Artificial Sequence
  Description of Artificial Sequence: Synthetic oligonucleotide
ggtcgcatataccaagatgaatatgcgatggaagc

SEQ ID NO: 263990 - DNA, 39 bp, Artificial Sequence
  Description of Artificial Sequence: Synthetic oligonucleotide
gtcgcatataccaagatgaatatgcgatggaagcttttg

SEQ ID NO: 263991 - DNA, 39 bp, Artificial Sequence
  Description of Artificial Sequence: Synthetic oligonucleotide
tcgcatataccaagatgaatatgcgatggaagcttttgg

SEQ ID NO: 263992 - DNA, 38 bp, Artificial Sequence
  Description of Artificial Sequence: Synthetic oligonucleotide
cgcatataccaagatgaatatgcgatggaagcttttgg

SEQ ID NO: 263993 - DNA, 39 bp, Artificial Sequence
  Description of Artificial Sequence: Synthetic oligonucleotide
gcatataccaagatgaatatgcgatggaagcttttggac

SEQ ID NO: 263994 - DNA, 41 bp, Artificial Sequence
  Description of Artificial Sequence: Synthetic oligonucleotide
catataccaagatgaatatgcgatggaagcttttggacatg

SEQ ID NO: 263995 - DNA, 41 bp, Artificial Sequence
  Description of Artificial Sequence: Synthetic oligonucleotide
atataccaagatgaatatgcgatggaagcttttggacatgg

SEQ ID NO: 263996 - DNA, 40 bp, Artificial Sequence
  Description of Artificial Sequence: Synthetic oligonucleotide
tataccaagatgaatatgcgatggaagcttttggacatgg

SEQ ID NO: 263997 - DNA, 39 bp, Artificial Sequence
  Description of Artificial Sequence: Synthetic oligonucleotide
ataccaagatgaatatgcgatggaagcttttggacatgg

SEQ ID NO: 263998 - DNA, 38 bp, Artificial Sequence
  Description of Artificial Sequence: Synthetic oligonucleotide
taccaagatgaatatgcgatggaagcttttggacatgg

SEQ ID NO: 263999 - DNA, 37 bp, Artificial Sequence
  Description of Artificial Sequence: Synthetic oligonucleotide
accaagatgaatatgcgatggaagcttttggacatgg

SEQ ID NO: 264000 - DNA, 36 bp, Artificial Sequence
  Description of Artificial Sequence: Synthetic oligonucleotide
ccaagatgaatatgcgatggaagcttttggacatgg

SEQ ID NO: 264001 - DNA, 37 bp, Artificial Sequence
  Description of Artificial Sequence: Synthetic oligonucleotide
caagatgaatatgcgatggaagcttttggacatggag

SEQ ID NO: 264002 - DNA, 37 bp, Artificial Sequence
  Description of Artificial Sequence: Synthetic oligonucleotide
aagatgaatatgcgatggaagcttttggacatggagg

SEQ ID NO: 264003 - DNA, 36 bp, Artificial Sequence
  Description of Artificial Sequence: Synthetic oligonucleotide
agatgaatatgcgatggaagcttttggacatggagg

SEQ ID NO: 264004 - DNA, 35 bp, Artificial Sequence
  Description of Artificial Sequence: Synthetic oligonucleotide
gatgaatatgcgatggaagcttttggacatggagg

SEQ ID NO: 264005 - DNA, 35 bp, Artificial Sequence
  Description of Artificial Sequence: Synthetic oligonucleotide
atgaatatgcgatggaagcttttggacatggaggc

SEQ ID NO: 264006 - DNA, 34 bp, Artificial Sequence
  Description of Artificial Sequence: Synthetic oligonucleotide
tgaatatgcgatggaagcttttggacatggaggc

SEQ ID NO: 264007 - DNA, 33 bp, Artificial Sequence
  Description of Artificial Sequence: Synthetic oligonucleotide
gaatatgcgatggaagcttttggacatggaggc

SEQ ID NO: 264008 - DNA, 34 bp, Artificial Sequence
  Description of Artificial Sequence: Synthetic oligonucleotide
aatatgcgatggaagcttttggacatggaggcac

SEQ ID NO: 264009 - DNA, 33 bp, Artificial Sequence
  Description of Artificial Sequence: Synthetic oligonucleotide
atatgcgatggaagcttttggacatggaggcac

SEQ ID NO: 264010 - DNA, 32 bp, Artificial Sequence
  Description of Artificial Sequence: Synthetic oligonucleotide
tatgcgatggaagcttttggacatggaggcac

SEQ ID NO: 264011 - DNA, 31 bp, Artificial Sequence
  Description of Artificial Sequence: Synthetic oligonucleotide
atgcgatggaagcttttggacatggaggcac

SEQ ID NO: 264012 - DNA, 30 bp, Artificial Sequence
  Description of Artificial Sequence: Synthetic oligonucleotide
tgcgatggaagcttttggacatggaggcac

SEQ ID NO: 264013 - DNA, 29 bp, Artificial Sequence
  Description of Artificial Sequence: Synthetic oligonucleotide
gcgatggaagcttttggacatggaggcac

SEQ ID NO: 264014 - DNA, 29 bp, Artificial Sequence
  Description of Artificial Sequence: Synthetic oligonucleotide
cgatggaagcttttggacatggaggcacc

SEQ ID NO: 264015 - DNA, 30 bp, Artificial Sequence
  Description of Artificial Sequence: Synthetic oligonucleotide
gatggaagcttttggacatggaggcacctg

SEQ ID NO: 264016 - DNA, 33 bp, Artificial Sequence
  Description of Artificial Sequence: Synthetic oligonucleotide
atggaagcttttggacatggaggcacctgattg

SEQ ID NO: 264017 - DNA, 32 bp, Artificial Sequence
  Description of Artificial Sequence: Synthetic oligonucleotide
tggaagcttttggacatggaggcacctgattg

SEQ ID NO: 264018 - DNA, 31 bp, Artificial Sequence
  Description of Artificial Sequence: Synthetic oligonucleotide
ggaagcttttggacatggaggcacctgattg

SEQ ID NO: 264019 - DNA, 31 bp, Artificial Sequence
  Description of Artificial Sequence: Synthetic oligonucleotide
gaagcttttggacatggaggcacctgattgg

SEQ ID NO: 264020 - DNA, 31 bp, Artificial Sequence
  Description of Artificial Sequence: Synthetic oligonucleotide
aagcttttggacatggaggcacctgattggg

SEQ ID NO: 264021 - DNA, 30 bp, Artificial Sequence
  Description of Artificial Sequence: Synthetic oligonucleotide
agcttttggacatggaggcacctgattggg

SEQ ID NO: 264022 - DNA, 29 bp, Artificial Sequence
  Description of Artificial Sequence: Synthetic oligonucleotide
gcttttggacatggaggcacctgattggg

SEQ ID NO: 264023 - DNA, 36 bp, Artificial Sequence
  Description of Artificial Sequence: Synthetic oligonucleotide
cttttggacatggaggcacctgattgggaattatag

SEQ ID NO: 264024 - DNA, 36 bp, Artificial Sequence
  Description of Artificial Sequence: Synthetic oligonucleotide
ttttggacatggaggcacctgattgggaattatagc

SEQ ID NO: 264025 - DNA, 35 bp, Artificial Sequence
  Description of Artificial Sequence: Synthetic oligonucleotide
tttggacatggaggcacctgattgggaattatagc

SEQ ID NO: 264026 - DNA, 34 bp, Artificial Sequence
  Description of Artificial Sequence: Synthetic oligonucleotide
ttggacatggaggcacctgattgggaattatagc

SEQ ID NO: 264027 - DNA, 33 bp, Artificial Sequence
  Description of Artificial Sequence: Synthetic oligonucleotide
tggacatggaggcacctgattgggaattatagc

SEQ ID NO: 264028 - DNA, 32 bp, Artificial Sequence
  Description of Artificial Sequence: Synthetic oligonucleotide
ggacatggaggcacctgattgggaattatagc

SEQ ID NO: 264029 - DNA, 36 bp, Artificial Sequence
  Description of Artificial Sequence: Synthetic oligonucleotide
gacatggaggcacctgattgggaattatagcaaatg

SEQ ID NO: 264030 - DNA, 38 bp, Artificial Sequence
  Description of Artificial Sequence: Synthetic oligonucleotide
acatggaggcacctgattgggaattatagcaaatgttg

SEQ ID NO: 264031 - DNA, 37 bp, Artificial Sequence
  Description of Artificial Sequence: Synthetic oligonucleotide
catggaggcacctgattgggaattatagcaaatgttg

SEQ ID NO: 264032 - DNA, 37 bp, Artificial Sequence
  Description of Artificial Sequence: Synthetic oligonucleotide
atggaggcacctgattgggaattatagcaaatgttgg

SEQ ID NO: 264033 - DNA, 36 bp, Artificial Sequence
  Description of Artificial Sequence: Synthetic oligonucleotide
tggaggcacctgattgggaattatagcaaatgttgg

SEQ ID NO: 264034 - DNA, 35 bp, Artificial Sequence
  Description of Artificial Sequence: Synthetic oligonucleotide
ggaggcacctgattgggaattatagcaaatgttgg

SEQ ID NO: 264035 - DNA, 36 bp, Artificial Sequence
  Description of Artificial Sequence: Synthetic oligonucleotide
gaggcacctgattgggaattatagcaaatgttggtg

SEQ ID NO: 264036 - DNA, 40 bp, Artificial Sequence
  Description of Artificial Sequence: Synthetic oligonucleotide
aggcacctgattgggaattatagcaaatgttggtgttttc

SEQ ID NO: 264037 - DNA, 39 bp, Artificial Sequence
  Description of Artificial Sequence: Synthetic oligonucleotide
ggcacctgattgggaattatagcaaatgttggtgttttc

SEQ ID NO: 264038 - DNA, 39 bp, Artificial Sequence
  Description of Artificial Sequence: Synthetic oligonucleotide
gcacctgattgggaattatagcaaatgttggtgttttcc

SEQ ID NO: 264039 - DNA, 41 bp, Artificial Sequence
  Description of Artificial Sequence: Synthetic oligonucleotide
cacctgattgggaattatagcaaatgttggtgttttccttg

SEQ ID NO: 264040 - DNA, 41 bp, Artificial Sequence
  Description of Artificial Sequence: Synthetic oligonucleotide
acctgattgggaattatagcaaatgttggtgttttccttgc

SEQ ID NO: 264041 - DNA, 40 bp, Artificial Sequence
  Description of Artificial Sequence: Synthetic oligonucleotide
cctgattgggaattatagcaaatgttggtgttttccttgc

SEQ ID NO: 264042 - DNA, 41 bp, Artificial Sequence
  Description of Artificial Sequence: Synthetic oligonucleotide
ctgattgggaattatagcaaatgttggtgttttccttgcag

SEQ ID NO: 264043 - DNA, 41 bp, Artificial Sequence
  Description of Artificial Sequence: Synthetic oligonucleotide
tgattgggaattatagcaaatgttggtgttttccttgcagc

SEQ ID NO: 264044 - DNA, 40 bp, Artificial Sequence
  Description of Artificial Sequence: Synthetic oligonucleotide
gattgggaattatagcaaatgttggtgttttccttgcagc

SEQ ID NO: 264045 - DNA, 41 bp, Artificial Sequence
  Description of Artificial Sequence: Synthetic oligonucleotide
attgggaattatagcaaatgttggtgttttccttgcagcac

SEQ ID NO: 264046 - DNA, 40 bp, Artificial Sequence
  Description of Artificial Sequence: Synthetic oligonucleotide
ttgggaattatagcaaatgttggtgttttccttgcagcac

SEQ ID NO: 264047 - DNA, 39 bp, Artificial Sequence
  Description of Artificial Sequence: Synthetic oligonucleotide
tgggaattatagcaaatgttggtgttttccttgcagcac

SEQ ID NO: 264048 - DNA, 38 bp, Artificial Sequence
  Description of Artificial Sequence: Synthetic oligonucleotide
gggaattatagcaaatgttggtgttttccttgcagcac

SEQ ID NO: 264049 - DNA, 39 bp, Artificial Sequence
  Description of Artificial Sequence: Synthetic oligonucleotide
ggaattatagcaaatgttggtgttttccttgcagcacag

SEQ ID NO: 264050 - DNA, 40 bp, Artificial Sequence
  Description of Artificial Sequence: Synthetic oligonucleotide
gaattatagcaaatgttggtgttttccttgcagcacagag

SEQ ID NO: 264051 - DNA, 41 bp, Artificial Sequence
  Description of Artificial Sequence: Synthetic oligonucleotide
aattatagcaaatgttggtgttttccttgcagcacagagac

SEQ ID NO: 264052 - DNA, 40 bp, Artificial Sequence
  Description of Artificial Sequence: Synthetic oligonucleotide
attatagcaaatgttggtgttttccttgcagcacagagac

SEQ ID NO: 264053 - DNA, 39 bp, Artificial Sequence
  Description of Artificial Sequence: Synthetic oligonucleotide
ttatagcaaatgttggtgttttccttgcagcacagagac

SEQ ID NO: 264054 - DNA, 38 bp, Artificial Sequence
  Description of Artificial Sequence: Synthetic oligonucleotide
tatagcaaatgttggtgttttccttgcagcacagagac

SEQ ID NO: 264055 - DNA, 37 bp, Artificial Sequence
  Description of Artificial Sequence: Synthetic oligonucleotide
atagcaaatgttggtgttttccttgcagcacagagac

SEQ ID NO: 264056 - DNA, 36 bp, Artificial Sequence
  Description of Artificial Sequence: Synthetic oligonucleotide
tagcaaatgttggtgttttccttgcagcacagagac

SEQ ID NO: 264057 - DNA, 35 bp, Artificial Sequence
  Description of Artificial Sequence: Synthetic oligonucleotide
agcaaatgttggtgttttccttgcagcacagagac

SEQ ID NO: 264058 - DNA, 34 bp, Artificial Sequence
  Description of Artificial Sequence: Synthetic oligonucleotide
gcaaatgttggtgttttccttgcagcacagagac

SEQ ID NO: 264059 - DNA, 34 bp, Artificial Sequence
  Description of Artificial Sequence: Synthetic oligonucleotide
caaatgttggtgttttccttgcagcacagagacg

SEQ ID NO: 264060 - DNA, 34 bp, Artificial Sequence
  Description of Artificial Sequence: Synthetic oligonucleotide
aaatgttggtgttttccttgcagcacagagacgc

SEQ ID NO: 264061 - DNA, 33 bp, Artificial Sequence
  Description of Artificial Sequence: Synthetic oligonucleotide
aatgttggtgttttccttgcagcacagagacgc

SEQ ID NO: 264062 - DNA, 32 bp, Artificial Sequence
  Description of Artificial Sequence: Synthetic oligonucleotide
atgttggtgttttccttgcagcacagagacgc

SEQ ID NO: 264063 - DNA, 31 bp, Artificial Sequence
  Description of Artificial Sequence: Synthetic oligonucleotide
tgttggtgttttccttgcagcacagagacgc

SEQ ID NO: 264064 - DNA, 30 bp, Artificial Sequence
  Description of Artificial Sequence: Synthetic oligonucleotide
gttggtgttttccttgcagcacagagacgc

SEQ ID NO: 264065 - DNA, 32 bp, Artificial Sequence
  Description of Artificial Sequence: Synthetic oligonucleotide
ttggtgttttccttgcagcacagagacgcatc

SEQ ID NO: 264066 - DNA, 31 bp, Artificial Sequence
  Description of Artificial Sequence: Synthetic oligonucleotide
tggtgttttccttgcagcacagagacgcatc

SEQ ID NO: 264067 - DNA, 30 bp, Artificial Sequence
  Description of Artificial Sequence: Synthetic oligonucleotide
ggtgttttccttgcagcacagagacgcatc

SEQ ID NO: 264068 - DNA, 32 bp, Artificial Sequence
  Description of Artificial Sequence: Synthetic oligonucleotide
gtgttttccttgcagcacagagacgcatcatc

SEQ ID NO: 264069 - DNA, 32 bp, Artificial Sequence
  Description of Artificial Sequence: Synthetic oligonucleotide
tgttttccttgcagcacagagacgcatcatcc

SEQ ID NO: 264070 - DNA, 31 bp, Artificial Sequence
  Description of Artificial Sequence: Synthetic oligonucleotide
gttttccttgcagcacagagacgcatcatcc

SEQ ID NO: 264071 - DNA, 32 bp, Artificial Sequence
  Description of Artificial Sequence: Synthetic oligonucleotide
ttttccttgcagcacagagacgcatcatccac

SEQ ID NO: 264072 - DNA, 31 bp, Artificial Sequence
  Description of Artificial Sequence: Synthetic oligonucleotide
tttccttgcagcacagagacgcatcatccac

SEQ ID NO: 264073 - DNA, 30 bp, Artificial Sequence
  Description of Artificial Sequence: Synthetic oligonucleotide
ttccttgcagcacagagacgcatcatccac

SEQ ID NO: 264074 - DNA, 29 bp, Artificial Sequence
  Description of Artificial Sequence: Synthetic oligonucleotide
tccttgcagcacagagacgcatcatccac

SEQ ID NO: 264075 - DNA, 28 bp, Artificial Sequence
  Description of Artificial Sequence: Synthetic oligonucleotide
ccttgcagcacagagacgcatcatccac

SEQ ID NO: 264076 - DNA, 30 bp, Artificial Sequence
  Description of Artificial Sequence: Synthetic oligonucleotide
cttgcagcacagagacgcatcatccacaac

SEQ ID NO: 264077 - DNA, 30 bp, Artificial Sequence
  Description of Artificial Sequence: Synthetic oligonucleotide
ttgcagcacagagacgcatcatccacaacc

SEQ ID NO: 264078 - DNA, 29 bp, Artificial Sequence
  Description of Artificial Sequence: Synthetic oligonucleotide
tgcagcacagagacgcatcatccacaacc

SEQ ID NO: 264079 - DNA, 28 bp, Artificial Sequence
  Description of Artificial Sequence: Synthetic oligonucleotide
gcagcacagagacgcatcatccacaacc

SEQ ID NO: 264080 - DNA, 30 bp, Artificial Sequence
  Description of Artificial Sequence: Synthetic oligonucleotide
cagcacagagacgcatcatccacaaccttc

SEQ ID NO: 264081 - DNA, 32 bp, Artificial Sequence
  Description of Artificial Sequence: Synthetic oligonucleotide
agcacagagacgcatcatccacaaccttcttg

SEQ ID NO: 264082 - DNA, 31 bp, Artificial Sequence
  Description of Artificial Sequence: Synthetic oligonucleotide
gcacagagacgcatcatccacaaccttcttg

SEQ ID NO: 264083 - DNA, 33 bp, Artificial Sequence
  Description of Artificial Sequence: Synthetic oligonucleotide
cacagagacgcatcatccacaaccttcttgatc

SEQ ID NO: 264084 - DNA, 35 bp, Artificial Sequence
  Description of Artificial Sequence: Synthetic oligonucleotide
acagagacgcatcatccacaaccttcttgatcaag

SEQ ID NO: 264085 - DNA, 34 bp, Artificial Sequence
  Description of Artificial Sequence: Synthetic oligonucleotide
cagagacgcatcatccacaaccttcttgatcaag

SEQ ID NO: 264086 - DNA, 35 bp, Artificial Sequence
  Description of Artificial Sequence: Synthetic oligonucleotide
agagacgcatcatccacaaccttcttgatcaagtc

SEQ ID NO: 264087 - DNA, 34 bp, Artificial Sequence
  Description of Artificial Sequence: Synthetic oligonucleotide
gagacgcatcatccacaaccttcttgatcaagtc

SEQ ID NO: 264088 - DNA, 41 bp, Artificial Sequence
  Description of Artificial Sequence: Synthetic oligonucleotide
agacgcatcatccacaaccttcttgatcaagtcttttattc

SEQ ID NO: 264089 - DNA, 40 bp, Artificial Sequence
  Description of Artificial Sequence: Synthetic oligonucleotide
gacgcatcatccacaaccttcttgatcaagtcttttattc

SEQ ID NO: 264090 - DNA, 41 bp, Artificial Sequence
  Description of Artificial Sequence: Synthetic oligonucleotide
acgcatcatccacaaccttcttgatcaagtcttttattctg

SEQ ID NO: 264091 - DNA, 40 bp, Artificial Sequence
  Description of Artificial Sequence: Synthetic oligonucleotide
cgcatcatccacaaccttcttgatcaagtcttttattctg

SEQ ID NO: 264092 - DNA, 54 bp, Artificial Sequence
  Description of Artificial Sequence: Synthetic oligonucleotide
gcatcatccacaaccttcttgatcaagtcttttattctgaaaatatttataaag

SEQ ID NO: 264093 - DNA, 55 bp, Artificial Sequence
  Description of Artificial Sequence: Synthetic oligonucleotide
catcatccacaaccttcttgatcaagtcttttattctgaaaatatttataaagtc

SEQ ID NO: 264094 - DNA, 58 bp, Artificial Sequence
  Description of Artificial Sequence: Synthetic oligonucleotide
atcatccacaaccttcttgatcaagtcttttattctgaaaatatttataaagtcaatg

SEQ ID NO: 264095 - DNA, 57 bp, Artificial Sequence
  Description of Artificial Sequence: Synthetic oligonucleotide
tcatccacaaccttcttgatcaagtcttttattctgaaaatatttataaagtcaatg

SEQ ID NO: 264096 - DNA, 56 bp, Artificial Sequence
  Description of Artificial Sequence: Synthetic oligonucleotide
catccacaaccttcttgatcaagtcttttattctgaaaatatttataaagtcaatg

SEQ ID NO: 264097 - DNA, 57 bp, Artificial Sequence
  Description of Artificial Sequence: Synthetic oligonucleotide
atccacaaccttcttgatcaagtcttttattctgaaaatatttataaagtcaatgag

SEQ ID NO: 264098 - DNA, 56 bp, Artificial Sequence
  Description of Artificial Sequence: Synthetic oligonucleotide
tccacaaccttcttgatcaagtcttttattctgaaaatatttataaagtcaatgag

SEQ ID NO: 264099 - DNA, 55 bp, Artificial Sequence
  Description of Artificial Sequence: Synthetic oligonucleotide
ccacaaccttcttgatcaagtcttttattctgaaaatatttataaagtcaatgag

SEQ ID NO: 264100 - DNA, 55 bp, Artificial Sequence
  Description of Artificial Sequence: Synthetic oligonucleotide
cacaaccttcttgatcaagtcttttattctgaaaatatttataaagtcaatgagg

SEQ ID NO: 264101 - DNA, 56 bp, Artificial Sequence
  Description of Artificial Sequence: Synthetic oligonucleotide
acaaccttcttgatcaagtcttttattctgaaaatatttataaagtcaatgaggtc

SEQ ID NO: 264102 - DNA, 55 bp, Artificial Sequence
  Description of Artificial Sequence: Synthetic oligonucleotide
caaccttcttgatcaagtcttttattctgaaaatatttataaagtcaatgaggtc

SEQ ID NO: 264103 - DNA, 57 bp, Artificial Sequence
  Description of Artificial Sequence: Synthetic oligonucleotide
aaccttcttgatcaagtcttttattctgaaaatatttataaagtcaatgaggtcatg

SEQ ID NO: 264104 - DNA, 56 bp, Artificial Sequence
  Description of Artificial Sequence: Synthetic oligonucleotide
accttcttgatcaagtcttttattctgaaaatatttataaagtcaatgaggtcatg

SEQ ID NO: 264105 - DNA, 55 bp, Artificial Sequence
  Description of Artificial Sequence: Synthetic oligonucleotide
ccttcttgatcaagtcttttattctgaaaatatttataaagtcaatgaggtcatg

SEQ ID NO: 264106 - DNA, 55 bp, Artificial Sequence
  Description of Artificial Sequence: Synthetic oligonucleotide
cttcttgatcaagtcttttattctgaaaatatttataaagtcaatgaggtcatgg

SEQ ID NO: 264107 - DNA, 55 bp, Artificial Sequence
  Description of Artificial Sequence: Synthetic oligonucleotide
ttcttgatcaagtcttttattctgaaaatatttataaagtcaatgaggtcatggc

SEQ ID NO: 264108 - DNA, 54 bp, Artificial Sequence
  Description of Artificial Sequence: Synthetic oligonucleotide
tcttgatcaagtcttttattctgaaaatatttataaagtcaatgaggtcatggc

SEQ ID NO: 264109 - DNA, 53 bp, Artificial Sequence
  Description of Artificial Sequence: Synthetic oligonucleotide
cttgatcaagtcttttattctgaaaatatttataaagtcaatgaggtcatggc

SEQ ID NO: 264110 - DNA, 55 bp, Artificial Sequence
  Description of Artificial Sequence: Synthetic oligonucleotide
ttgatcaagtcttttattctgaaaatatttataaagtcaatgaggtcatggcttg

SEQ ID NO: 264111 - DNA, 54 bp, Artificial Sequence
  Description of Artificial Sequence: Synthetic oligonucleotide
tgatcaagtcttttattctgaaaatatttataaagtcaatgaggtcatggcttg

SEQ ID NO: 264112 - DNA, 53 bp, Artificial Sequence
  Description of Artificial Sequence: Synthetic oligonucleotide
gatcaagtcttttattctgaaaatatttataaagtcaatgaggtcatggcttg

SEQ ID NO: 264113 - DNA, 53 bp, Artificial Sequence
  Description of Artificial Sequence: Synthetic oligonucleotide
atcaagtcttttattctgaaaatatttataaagtcaatgaggtcatggcttgg

SEQ ID NO: 264114 - DNA, 52 bp, Artificial Sequence
  Description of Artificial Sequence: Synthetic oligonucleotide
tcaagtcttttattctgaaaatatttataaagtcaatgaggtcatggcttgg

SEQ ID NO: 264115 - DNA, 51 bp, Artificial Sequence
  Description of Artificial Sequence: Synthetic oligonucleotide
caagtcttttattctgaaaatatttataaagtcaatgaggtcatggcttgg

SEQ ID NO: 264116 - DNA, 52 bp, Artificial Sequence
  Description of Artificial Sequence: Synthetic oligonucleotide
aagtcttttattctgaaaatatttataaagtcaatgaggtcatggcttggag

SEQ ID NO: 264117 - DNA, 51 bp, Artificial Sequence
  Description of Artificial Sequence: Synthetic oligonucleotide
agtcttttattctgaaaatatttataaagtcaatgaggtcatggcttggag

SEQ ID NO: 264118 - DNA, 50 bp, Artificial Sequence
  Description of Artificial Sequence: Synthetic oligonucleotide
gtcttttattctgaaaatatttataaagtcaatgaggtcatggcttggag

SEQ ID NO: 264119 - DNA, 51 bp, Artificial Sequence
  Description of Artificial Sequence: Synthetic oligonucleotide
tcttttattctgaaaatatttataaagtcaatgaggtcatggcttggagtg

SEQ ID NO: 264120 - DNA, 50 bp, Artificial Sequence
  Description of Artificial Sequence: Synthetic oligonucleotide
cttttattctgaaaatatttataaagtcaatgaggtcatggcttggagtg

SEQ ID NO: 264121 - DNA, 51 bp, Artificial Sequence
  Description of Artificial Sequence: Synthetic oligonucleotide
ttttattctgaaaatatttataaagtcaatgaggtcatggcttggagtgtg

SEQ ID NO: 264122 - DNA, 50 bp, Artificial Sequence
  Description of Artificial Sequence: Synthetic oligonucleotide
tttattctgaaaatatttataaagtcaatgaggtcatggcttggagtgtg

SEQ ID NO: 264123 - DNA, 49 bp, Artificial Sequence
  Description of Artificial Sequence: Synthetic oligonucleotide
ttattctgaaaatatttataaagtcaatgaggtcatggcttggagtgtg

SEQ ID NO: 264124 - DNA, 48 bp, Artificial Sequence
  Description of Artificial Sequence: Synthetic oligonucleotide
tattctgaaaatatttataaagtcaatgaggtcatggcttggagtgtg

SEQ ID NO: 264125 - DNA, 47 bp, Artificial Sequence
  Description of Artificial Sequence: Synthetic oligonucleotide
attctgaaaatatttataaagtcaatgaggtcatggcttggagtgtg

SEQ ID NO: 264126 - DNA, 46 bp, Artificial Sequence
  Description of Artificial Sequence: Synthetic oligonucleotide
ttctgaaaatatttataaagtcaatgaggtcatggcttggagtgtg

SEQ ID NO: 264127 - DNA, 45 bp, Artificial Sequence
  Description of Artificial Sequence: Synthetic oligonucleotide
tctgaaaatatttataaagtcaatgaggtcatggcttggagtgtg

SEQ ID NO: 264128 - DNA, 44 bp, Artificial Sequence
  Description of Artificial Sequence: Synthetic oligonucleotide
ctgaaaatatttataaagtcaatgaggtcatggcttggagtgtg

SEQ ID NO: 264129 - DNA, 44 bp, Artificial Sequence
  Description of Artificial Sequence: Synthetic oligonucleotide
tgaaaatatttataaagtcaatgaggtcatggcttggagtgtgg

SEQ ID NO: 264130 - DNA, 43 bp, Artificial Sequence
  Description of Artificial Sequence: Synthetic oligonucleotide
gaaaatatttataaagtcaatgaggtcatggcttggagtgtgg

SEQ ID NO: 264131 - DNA, 43 bp, Artificial Sequence
  Description of Artificial Sequence: Synthetic oligonucleotide
aaaatatttataaagtcaatgaggtcatggcttggagtgtggc

SEQ ID NO: 264132 - DNA, 42 bp, Artificial Sequence
  Description of Artificial Sequence: Synthetic oligonucleotide
aaatatttataaagtcaatgaggtcatggcttggagtgtggc

SEQ ID NO: 264133 - DNA, 41 bp, Artificial Sequence
  Description of Artificial Sequence: Synthetic oligonucleotide
aatatttataaagtcaatgaggtcatggcttggagtgtggc

SEQ ID NO: 264134 - DNA, 40 bp, Artificial Sequence
  Description of Artificial Sequence: Synthetic oligonucleotide
atatttataaagtcaatgaggtcatggcttggagtgtggc

SEQ ID NO: 264135 - DNA, 39 bp, Artificial Sequence
  Description of Artificial Sequence: Synthetic oligonucleotide
tatttataaagtcaatgaggtcatggcttggagtgtggc

SEQ ID NO: 264136 - DNA, 38 bp, Artificial Sequence
  Description of Artificial Sequence: Synthetic oligonucleotide
atttataaagtcaatgaggtcatggcttggagtgtggc

SEQ ID NO: 264137 - DNA, 37 bp, Artificial Sequence
  Description of Artificial Sequence: Synthetic oligonucleotide
tttataaagtcaatgaggtcatggcttggagtgtggc

SEQ ID NO: 264138 - DNA, 36 bp, Artificial Sequence
  Description of Artificial Sequence: Synthetic oligonucleotide
ttataaagtcaatgaggtcatggcttggagtgtggc

SEQ ID NO: 264139 - DNA, 35 bp, Artificial Sequence
  Description of Artificial Sequence: Synthetic oligonucleotide
tataaagtcaatgaggtcatggcttggagtgtggc

SEQ ID NO: 264140 - DNA, 34 bp, Artificial Sequence
  Description of Artificial Sequence: Synthetic oligonucleotide
ataaagtcaatgaggtcatggcttggagtgtggc

SEQ ID NO: 264141 - DNA, 33 bp, Artificial Sequence
  Description of Artificial Sequence: Synthetic oligonucleotide
taaagtcaatgaggtcatggcttggagtgtggc

SEQ ID NO: 264142 - DNA, 32 bp, Artificial Sequence
  Description of Artificial Sequence: Synthetic oligonucleotide
aaagtcaatgaggtcatggcttggagtgtggc

SEQ ID NO: 264143 - DNA, 31 bp, Artificial Sequence
  Description of Artificial Sequence: Synthetic oligonucleotide
aagtcaatgaggtcatggcttggagtgtggc

SEQ ID NO: 264144 - DNA, 30 bp, Artificial Sequence
  Description of Artificial Sequence: Synthetic oligonucleotide
agtcaatgaggtcatggcttggagtgtggc

SEQ ID NO: 264145 - DNA, 29 bp, Artificial Sequence
  Description of Artificial Sequence: Synthetic oligonucleotide
gtcaatgaggtcatggcttggagtgtggc

SEQ ID NO: 264146 - DNA, 30 bp, Artificial Sequence
  Description of Artificial Sequence: Synthetic oligonucleotide
tcaatgaggtcatggcttggagtgtggcac

SEQ ID NO: 264147 - DNA, 29 bp, Artificial Sequence
  Description of Artificial Sequence: Synthetic oligonucleotide
caatgaggtcatggcttggagtgtggcac

SEQ ID NO: 264148 - DNA, 29 bp, Artificial Sequence
  Description of Artificial Sequence: Synthetic oligonucleotide
aatgaggtcatggcttggagtgtggcacg

SEQ ID NO: 264149 - DNA, 28 bp, Artificial Sequence
  Description of Artificial Sequence: Synthetic oligonucleotide
atgaggtcatggcttggagtgtggcacg

SEQ ID NO: 264150 - DNA, 27 bp, Artificial Sequence
  Description of Artificial Sequence: Synthetic oligonucleotide
tgaggtcatggcttggagtgtggcacg

SEQ ID NO: 264151 - DNA, 26 bp, Artificial Sequence
  Description of Artificial Sequence: Synthetic oligonucleotide
gaggtcatggcttggagtgtggcacg

SEQ ID NO: 264152 - DNA, 27 bp, Artificial Sequence
  Description of Artificial Sequence: Synthetic oligonucleotide
aggtcatggcttggagtgtggcacgca

SEQ ID NO: 264153 - DNA, 27 bp, Artificial Sequence
  Description of Artificial Sequence: Synthetic oligonucleotide
ggtcatggcttggagtgtggcacgcat

SEQ ID NO: 264154 - DNA, 29 bp, Artificial Sequence
  Description of Artificial Sequence: Synthetic oligonucleotide
gtcatggcttggagtgtggcacgcataac

SEQ ID NO: 264155 - DNA, 31 bp, Artificial Sequence
  Description of Artificial Sequence: Synthetic oligonucleotide
tcatggcttggagtgtggcacgcataacttg

SEQ ID NO: 264156 - DNA, 30 bp, Artificial Sequence
  Description of Artificial Sequence: Synthetic oligonucleotide
catggcttggagtgtggcacgcataacttg

SEQ ID NO: 264157 - DNA, 31 bp, Artificial Sequence
  Description of Artificial Sequence: Synthetic oligonucleotide
atggcttggagtgtggcacgcataacttgtg

SEQ ID NO: 264158 - DNA, 30 bp, Artificial Sequence
  Description of Artificial Sequence: Synthetic oligonucleotide
tggcttggagtgtggcacgcataacttgtg

SEQ ID NO: 264159 - DNA, 29 bp, Artificial Sequence
  Description of Artificial Sequence: Synthetic oligonucleotide
ggcttggagtgtggcacgcataacttgtg

SEQ ID NO: 264160 - DNA, 31 bp, Artificial Sequence
  Description of Artificial Sequence: Synthetic oligonucleotide
gcttggagtgtggcacgcataacttgtgatg

SEQ ID NO: 264161 - DNA, 31 bp, Artificial Sequence
  Description of Artificial Sequence: Synthetic oligonucleotide
cttggagtgtggcacgcataacttgtgatgc

SEQ ID NO: 264162 - DNA, 35 bp, Artificial Sequence
  Description of Artificial Sequence: Synthetic oligonucleotide
ttggagtgtggcacgcataacttgtgatgctaaag

SEQ ID NO: 264163 - DNA, 34 bp, Artificial Sequence
  Description of Artificial Sequence: Synthetic oligonucleotide
tggagtgtggcacgcataacttgtgatgctaaag

SEQ ID NO: 264164 - DNA, 33 bp, Artificial Sequence
  Description of Artificial Sequence: Synthetic oligonucleotide
ggagtgtggcacgcataacttgtgatgctaaag

SEQ ID NO: 264165 - DNA, 35 bp, Artificial Sequence
  Description of Artificial Sequence: Synthetic oligonucleotide
gagtgtggcacgcataacttgtgatgctaaagttc

SEQ ID NO: 264166 - DNA, 36 bp, Artificial Sequence
  Description of Artificial Sequence: Synthetic oligonucleotide
agtgtggcacgcataacttgtgatgctaaagttctg

SEQ ID NO: 264167 - DNA, 35 bp, Artificial Sequence
  Description of Artificial Sequence: Synthetic oligonucleotide
gtgtggcacgcataacttgtgatgctaaagttctg

SEQ ID NO: 264168 - DNA, 36 bp, Artificial Sequence
  Description of Artificial Sequence: Synthetic oligonucleotide
tgtggcacgcataacttgtgatgctaaagttctgac

SEQ ID NO: 264169 - DNA, 35 bp, Artificial Sequence
  Description of Artificial Sequence: Synthetic oligonucleotide
gtggcacgcataacttgtgatgctaaagttctgac

SEQ ID NO: 264170 - DNA, 39 bp, Artificial Sequence
  Description of Artificial Sequence: Synthetic oligonucleotide
tggcacgcataacttgtgatgctaaagttctgacttatg

SEQ ID NO: 264171 - DNA, 38 bp, Artificial Sequence
  Description of Artificial Sequence: Synthetic oligonucleotide
ggcacgcataacttgtgatgctaaagttctgacttatg

SEQ ID NO: 264172 - DNA, 40 bp, Artificial Sequence
  Description of Artificial Sequence: Synthetic oligonucleotide
gcacgcataacttgtgatgctaaagttctgacttatgaac

SEQ ID NO: 264173 - DNA, 43 bp, Artificial Sequence
  Description of Artificial Sequence: Synthetic oligonucleotide
cacgcataacttgtgatgctaaagttctgacttatgaactaac

SEQ ID NO: 264174 - DNA, 43 bp, Artificial Sequence
  Description of Artificial Sequence: Synthetic oligonucleotide
acgcataacttgtgatgctaaagttctgacttatgaactaacg

SEQ ID NO: 264175 - DNA, 42 bp, Artificial Sequence
  Description of Artificial Sequence: Synthetic oligonucleotide
cgcataacttgtgatgctaaagttctgacttatgaactaacg

SEQ ID NO: 264176 - DNA, 42 bp, Artificial Sequence
  Description of Artificial Sequence: Synthetic oligonucleotide
gcataacttgtgatgctaaagttctgacttatgaactaacgc

SEQ ID NO: 264177 - DNA, 43 bp, Artificial Sequence
  Description of Artificial Sequence: Synthetic oligonucleotide
cataacttgtgatgctaaagttctgacttatgaactaacgctc

SEQ ID NO: 264178 - DNA, 46 bp, Artificial Sequence
  Description of Artificial Sequence: Synthetic oligonucleotide
ataacttgtgatgctaaagttctgacttatgaactaacgctcattg

SEQ ID NO: 264179 - DNA, 45 bp, Artificial Sequence
  Description of Artificial Sequence: Synthetic oligonucleotide
taacttgtgatgctaaagttctgacttatgaactaacgctcattg

SEQ ID NO: 264180 - DNA, 44 bp, Artificial Sequence
  Description of Artificial Sequence: Synthetic oligonucleotide
aacttgtgatgctaaagttctgacttatgaactaacgctcattg

SEQ ID NO: 264181 - DNA, 43 bp, Artificial Sequence
  Description of Artificial Sequence: Synthetic oligonucleotide
acttgtgatgctaaagttctgacttatgaactaacgctcattg

SEQ ID NO: 264182 - DNA, 42 bp, Artificial Sequence
  Description of Artificial Sequence: Synthetic oligonucleotide
cttgtgatgctaaagttctgacttatgaactaacgctcattg

SEQ ID NO: 264183 - DNA, 42 bp, Artificial Sequence
  Description of Artificial Sequence: Synthetic oligonucleotide
ttgtgatgctaaagttctgacttatgaactaacgctcattgc

SEQ ID NO: 264184 - DNA, 41 bp, Artificial Sequence
  Description of Artificial Sequence: Synthetic oligonucleotide
tgtgatgctaaagttctgacttatgaactaacgctcattgc

SEQ ID NO: 264185 - DNA, 40 bp, Artificial Sequence
  Description of Artificial Sequence: Synthetic oligonucleotide
gtgatgctaaagttctgacttatgaactaacgctcattgc

SEQ ID NO: 264186 - DNA, 41 bp, Artificial Sequence
  Description of Artificial Sequence: Synthetic oligonucleotide
tgatgctaaagttctgacttatgaactaacgctcattgcac

SEQ ID NO: 264187 - DNA, 40 bp, Artificial Sequence
  Description of Artificial Sequence: Synthetic oligonucleotide
gatgctaaagttctgacttatgaactaacgctcattgcac

SEQ ID NO: 264188 - DNA, 43 bp, Artificial Sequence
  Description of Artificial Sequence: Synthetic oligonucleotide
atgctaaagttctgacttatgaactaacgctcattgcacaaag

SEQ ID NO: 264189 - DNA, 42 bp, Artificial Sequence
  Description of Artificial Sequence: Synthetic oligonucleotide
tgctaaagttctgacttatgaactaacgctcattgcacaaag

SEQ ID NO: 264190 - DNA, 41 bp, Artificial Sequence
  Description of Artificial Sequence: Synthetic oligonucleotide
gctaaagttctgacttatgaactaacgctcattgcacaaag

SEQ ID NO: 264191 - DNA, 41 bp, Artificial Sequence
  Description of Artificial Sequence: Synthetic oligonucleotide
ctaaagttctgacttatgaactaacgctcattgcacaaagg

SEQ ID NO: 264192 - DNA, 50 bp, Artificial Sequence
  Description of Artificial Sequence: Synthetic oligonucleotide
taaagttctgacttatgaactaacgctcattgcacaaaggtatatattac

SEQ ID NO: 264193 - DNA, 49 bp, Artificial Sequence
  Description of Artificial Sequence: Synthetic oligonucleotide
aaagttctgacttatgaactaacgctcattgcacaaaggtatatattac

SEQ ID NO: 264194 - DNA, 48 bp, Artificial Sequence
  Description of Artificial Sequence: Synthetic oligonucleotide
aagttctgacttatgaactaacgctcattgcacaaaggtatatattac

SEQ ID NO: 264195 - DNA, 47 bp, Artificial Sequence
  Description of Artificial Sequence: Synthetic oligonucleotide
agttctgacttatgaactaacgctcattgcacaaaggtatatattac

SEQ ID NO: 264196 - DNA, 46 bp, Artificial Sequence
  Description of Artificial Sequence: Synthetic oligonucleotide
gttctgacttatgaactaacgctcattgcacaaaggtatatattac

SEQ ID NO: 264197 - DNA, 47 bp, Artificial Sequence
  Description of Artificial Sequence: Synthetic oligonucleotide
ttctgacttatgaactaacgctcattgcacaaaggtatatattacag

SEQ ID NO: 264198 - DNA, 46 bp, Artificial Sequence
  Description of Artificial Sequence: Synthetic oligonucleotide
tctgacttatgaactaacgctcattgcacaaaggtatatattacag

SEQ ID NO: 264199 - DNA, 45 bp, Artificial Sequence
  Description of Artificial Sequence: Synthetic oligonucleotide
ctgacttatgaactaacgctcattgcacaaaggtatatattacag

SEQ ID NO: 264200 - DNA, 48 bp, Artificial Sequence
  Description of Artificial Sequence: Synthetic oligonucleotide
tgacttatgaactaacgctcattgcacaaaggtatatattacagtttc

SEQ ID NO: 264201 - DNA, 47 bp, Artificial Sequence
  Description of Artificial Sequence: Synthetic oligonucleotide
gacttatgaactaacgctcattgcacaaaggtatatattacagtttc

SEQ ID NO: 264202 - DNA, 48 bp, Artificial Sequence
  Description of Artificial Sequence: Synthetic oligonucleotide
acttatgaactaacgctcattgcacaaaggtatatattacagtttcag

SEQ ID NO: 264203 - DNA, 47 bp, Artificial Sequence
  Description of Artificial Sequence: Synthetic oligonucleotide
cttatgaactaacgctcattgcacaaaggtatatattacagtttcag

SEQ ID NO: 264204 - DNA, 47 bp, Artificial Sequence
  Description of Artificial Sequence: Synthetic oligonucleotide
ttatgaactaacgctcattgcacaaaggtatatattacagtttcagg

SEQ ID NO: 264205 - DNA, 46 bp, Artificial Sequence
  Description of Artificial Sequence: Synthetic oligonucleotide
tatgaactaacgctcattgcacaaaggtatatattacagtttcagg

SEQ ID NO: 264206 - DNA, 45 bp, Artificial Sequence
  Description of Artificial Sequence: Synthetic oligonucleotide
atgaactaacgctcattgcacaaaggtatatattacagtttcagg

SEQ ID NO: 264207 - DNA, 44 bp, Artificial Sequence
  Description of Artificial Sequence: Synthetic oligonucleotide
tgaactaacgctcattgcacaaaggtatatattacagtttcagg

SEQ ID NO: 264208 - DNA, 43 bp, Artificial Sequence
  Description of Artificial Sequence: Synthetic oligonucleotide
gaactaacgctcattgcacaaaggtatatattacagtttcagg

SEQ ID NO: 264209 - DNA, 44 bp, Artificial Sequence
  Description of Artificial Sequence: Synthetic oligonucleotide
aactaacgctcattgcacaaaggtatatattacagtttcaggag

SEQ ID NO: 264210 - DNA, 43 bp, Artificial Sequence
  Description of Artificial Sequence: Synthetic oligonucleotide
actaacgctcattgcacaaaggtatatattacagtttcaggag

SEQ ID NO: 264211 - DNA, 42 bp, Artificial Sequence
  Description of Artificial Sequence: Synthetic oligonucleotide
ctaacgctcattgcacaaaggtatatattacagtttcaggag

SEQ ID NO: 264212 - DNA, 42 bp, Artificial Sequence
  Description of Artificial Sequence: Synthetic oligonucleotide
taacgctcattgcacaaaggtatatattacagtttcaggagc

SEQ ID NO: 264213 - DNA, 41 bp, Artificial Sequence
  Description of Artificial Sequence: Synthetic oligonucleotide
aacgctcattgcacaaaggtatatattacagtttcaggagc

SEQ ID NO: 264214 - DNA, 40 bp, Artificial Sequence
  Description of Artificial Sequence: Synthetic oligonucleotide
acgctcattgcacaaaggtatatattacagtttcaggagc

SEQ ID NO: 264215 - DNA, 39 bp, Artificial Sequence
  Description of Artificial Sequence: Synthetic oligonucleotide
cgctcattgcacaaaggtatatattacagtttcaggagc

SEQ ID NO: 264216 - DNA, 39 bp, Artificial Sequence
  Description of Artificial Sequence: Synthetic oligonucleotide
gctcattgcacaaaggtatatattacagtttcaggagcc

SEQ ID NO: 264217 - DNA, 43 bp, Artificial Sequence
  Description of Artificial Sequence: Synthetic oligonucleotide
ctcattgcacaaaggtatatattacagtttcaggagcctatac

SEQ ID NO: 264218 - DNA, 43 bp, Artificial Sequence
  Description of Artificial Sequence: Synthetic oligonucleotide
tcattgcacaaaggtatatattacagtttcaggagcctatacc

SEQ ID NO: 264219 - DNA, 42 bp, Artificial Sequence
  Description of Artificial Sequence: Synthetic oligonucleotide
cattgcacaaaggtatatattacagtttcaggagcctatacc

SEQ ID NO: 264220 - DNA, 44 bp, Artificial Sequence
  Description of Artificial Sequence: Synthetic oligonucleotide
attgcacaaaggtatatattacagtttcaggagcctataccttg

SEQ ID NO: 264221 - DNA, 43 bp, Artificial Sequence
  Description of Artificial Sequence: Synthetic oligonucleotide
ttgcacaaaggtatatattacagtttcaggagcctataccttg

SEQ ID NO: 264222 - DNA, 42 bp, Artificial Sequence
  Description of Artificial Sequence: Synthetic oligonucleotide
tgcacaaaggtatatattacagtttcaggagcctataccttg

SEQ ID NO: 264223 - DNA, 41 bp, Artificial Sequence
  Description of Artificial Sequence: Synthetic oligonucleotide
gcacaaaggtatatattacagtttcaggagcctataccttg

SEQ ID NO: 264224 - DNA, 42 bp, Artificial Sequence
  Description of Artificial Sequence: Synthetic oligonucleotide
cacaaaggtatatattacagtttcaggagcctataccttgtc

SEQ ID NO: 264225 - DNA, 43 bp, Artificial Sequence
  Description of Artificial Sequence: Synthetic oligonucleotide
acaaaggtatatattacagtttcaggagcctataccttgtcag

SEQ ID NO: 264226 - DNA, 42 bp, Artificial Sequence
  Description of Artificial Sequence: Synthetic oligonucleotide
caaaggtatatattacagtttcaggagcctataccttgtcag

SEQ ID NO: 264227 - DNA, 42 bp, Artificial Sequence
  Description of Artificial Sequence: Synthetic oligonucleotide
aaaggtatatattacagtttcaggagcctataccttgtcagc

SEQ ID NO: 264228 - DNA, 41 bp, Artificial Sequence
  Description of Artificial Sequence: Synthetic oligonucleotide
aaggtatatattacagtttcaggagcctataccttgtcagc

SEQ ID NO: 264229 - DNA, 40 bp, Artificial Sequence
  Description of Artificial Sequence: Synthetic oligonucleotide
aggtatatattacagtttcaggagcctataccttgtcagc

SEQ ID NO: 264230 - DNA, 39 bp, Artificial Sequence
  Description of Artificial Sequence: Synthetic oligonucleotide
ggtatatattacagtttcaggagcctataccttgtcagc

SEQ ID NO: 264231 - DNA, 40 bp, Artificial Sequence
  Description of Artificial Sequence: Synthetic oligonucleotide
gtatatattacagtttcaggagcctataccttgtcagcag

SEQ ID NO: 264232 - DNA, 42 bp, Artificial Sequence
  Description of Artificial Sequence: Synthetic oligonucleotide
tatatattacagtttcaggagcctataccttgtcagcagttg

SEQ ID NO: 264233 - DNA, 41 bp, Artificial Sequence
  Description of Artificial Sequence: Synthetic oligonucleotide
atatattacagtttcaggagcctataccttgtcagcagttg

SEQ ID NO: 264234 - DNA, 40 bp, Artificial Sequence
  Description of Artificial Sequence: Synthetic oligonucleotide
tatattacagtttcaggagcctataccttgtcagcagttg

SEQ ID NO: 264235 - DNA, 39 bp, Artificial Sequence
  Description of Artificial Sequence: Synthetic oligonucleotide
atattacagtttcaggagcctataccttgtcagcagttg

SEQ ID NO: 264236 - DNA, 38 bp, Artificial Sequence
  Description of Artificial Sequence: Synthetic oligonucleotide
tattacagtttcaggagcctataccttgtcagcagttg

SEQ ID NO: 264237 - DNA, 37 bp, Artificial Sequence
  Description of Artificial Sequence: Synthetic oligonucleotide
attacagtttcaggagcctataccttgtcagcagttg

SEQ ID NO: 264238 - DNA, 36 bp, Artificial Sequence
  Description of Artificial Sequence: Synthetic oligonucleotide
ttacagtttcaggagcctataccttgtcagcagttg

SEQ ID NO: 264239 - DNA, 35 bp, Artificial Sequence
  Description of Artificial Sequence: Synthetic oligonucleotide
tacagtttcaggagcctataccttgtcagcagttg

SEQ ID NO: 264240 - DNA, 34 bp, Artificial Sequence
  Description of Artificial Sequence: Synthetic oligonucleotide
acagtttcaggagcctataccttgtcagcagttg

SEQ ID NO: 264241 - DNA, 33 bp, Artificial Sequence
  Description of Artificial Sequence: Synthetic oligonucleotide
cagtttcaggagcctataccttgtcagcagttg

SEQ ID NO: 264242 - DNA, 33 bp, Artificial Sequence
  Description of Artificial Sequence: Synthetic oligonucleotide
agtttcaggagcctataccttgtcagcagttgg

SEQ ID NO: 264243 - DNA, 32 bp, Artificial Sequence
  Description of Artificial Sequence: Synthetic oligonucleotide
gtttcaggagcctataccttgtcagcagttgg

SEQ ID NO: 264244 - DNA, 35 bp, Artificial Sequence
  Description of Artificial Sequence: Synthetic oligonucleotide
tttcaggagcctataccttgtcagcagttggatac

SEQ ID NO: 264245 - DNA, 34 bp, Artificial Sequence
  Description of Artificial Sequence: Synthetic oligonucleotide
ttcaggagcctataccttgtcagcagttggatac

SEQ ID NO: 264246 - DNA, 33 bp, Artificial Sequence
  Description of Artificial Sequence: Synthetic oligonucleotide
tcaggagcctataccttgtcagcagttggatac

SEQ ID NO: 264247 - DNA, 32 bp, Artificial Sequence
  Description of Artificial Sequence: Synthetic oligonucleotide
caggagcctataccttgtcagcagttggatac

SEQ ID NO: 264248 - DNA, 33 bp, Artificial Sequence
  Description of Artificial Sequence: Synthetic oligonucleotide
aggagcctataccttgtcagcagttggatacag

SEQ ID NO: 264249 - DNA, 32 bp, Artificial Sequence
  Description of Artificial Sequence: Synthetic oligonucleotide
ggagcctataccttgtcagcagttggatacag

SEQ ID NO: 264250 - DNA, 32 bp, Artificial Sequence
  Description of Artificial Sequence: Synthetic oligonucleotide
gagcctataccttgtcagcagttggatacagc

SEQ ID NO: 264251 - DNA, 32 bp, Artificial Sequence
  Description of Artificial Sequence: Synthetic oligonucleotide
agcctataccttgtcagcagttggatacagcg

SEQ ID NO: 264252 - DNA, 31 bp, Artificial Sequence
  Description of Artificial Sequence: Synthetic oligonucleotide
gcctataccttgtcagcagttggatacagcg

SEQ ID NO: 264253 - DNA, 31 bp, Artificial Sequence
  Description of Artificial Sequence: Synthetic oligonucleotide
cctataccttgtcagcagttggatacagcgc

SEQ ID NO: 264254 - DNA, 32 bp, Artificial Sequence
  Description of Artificial Sequence: Synthetic oligonucleotide
ctataccttgtcagcagttggatacagcgctc

SEQ ID NO: 264255 - DNA, 33 bp, Artificial Sequence
  Description of Artificial Sequence: Synthetic oligonucleotide
tataccttgtcagcagttggatacagcgctctg

SEQ ID NO: 264256 - DNA, 32 bp, Artificial Sequence
  Description of Artificial Sequence: Synthetic oligonucleotide
ataccttgtcagcagttggatacagcgctctg

SEQ ID NO: 264257 - DNA, 31 bp, Artificial Sequence
  Description of Artificial Sequence: Synthetic oligonucleotide
taccttgtcagcagttggatacagcgctctg

SEQ ID NO: 264258 - DNA, 30 bp, Artificial Sequence
  Description of Artificial Sequence: Synthetic oligonucleotide
accttgtcagcagttggatacagcgctctg

SEQ ID NO: 264259 - DNA, 29 bp, Artificial Sequence
  Description of Artificial Sequence: Synthetic oligonucleotide
ccttgtcagcagttggatacagcgctctg

SEQ ID NO: 264260 - DNA, 30 bp, Artificial Sequence
  Description of Artificial Sequence: Synthetic oligonucleotide
cttgtcagcagttggatacagcgctctgtg

SEQ ID NO: 264261 - DNA, 34 bp, Artificial Sequence
  Description of Artificial Sequence: Synthetic oligonucleotide
ttgtcagcagttggatacagcgctctgtgatatc

SEQ ID NO: 264262 - DNA, 33 bp, Artificial Sequence
  Description of Artificial Sequence: Synthetic oligonucleotide
tgtcagcagttggatacagcgctctgtgatatc

SEQ ID NO: 264263 - DNA, 32 bp, Artificial Sequence
  Description of Artificial Sequence: Synthetic oligonucleotide
gtcagcagttggatacagcgctctgtgatatc

SEQ ID NO: 264264 - DNA, 35 bp, Artificial Sequence
  Description of Artificial Sequence: Synthetic oligonucleotide
tcagcagttggatacagcgctctgtgatatctaac

SEQ ID NO: 264265 - DNA, 34 bp, Artificial Sequence
  Description of Artificial Sequence: Synthetic oligonucleotide
cagcagttggatacagcgctctgtgatatctaac

SEQ ID NO: 264266 - DNA, 36 bp, Artificial Sequence
  Description of Artificial Sequence: Synthetic oligonucleotide
agcagttggatacagcgctctgtgatatctaacaag

SEQ ID NO: 264267 - DNA, 35 bp, Artificial Sequence
  Description of Artificial Sequence: Synthetic oligonucleotide
gcagttggatacagcgctctgtgatatctaacaag

SEQ ID NO: 264268 - DNA, 35 bp, Artificial Sequence
  Description of Artificial Sequence: Synthetic oligonucleotide
cagttggatacagcgctctgtgatatctaacaagc

SEQ ID NO: 264269 - DNA, 40 bp, Artificial Sequence
  Description of Artificial Sequence: Synthetic oligonucleotide
agttggatacagcgctctgtgatatctaacaagcttttac

SEQ ID NO: 264270 - DNA, 39 bp, Artificial Sequence
  Description of Artificial Sequence: Synthetic oligonucleotide
gttggatacagcgctctgtgatatctaacaagcttttac

SEQ ID NO: 264271 - DNA, 40 bp, Artificial Sequence
  Description of Artificial Sequence: Synthetic oligonucleotide
ttggatacagcgctctgtgatatctaacaagcttttacac

SEQ ID NO: 264272 - DNA, 39 bp, Artificial Sequence
  Description of Artificial Sequence: Synthetic oligonucleotide
tggatacagcgctctgtgatatctaacaagcttttacac

SEQ ID NO: 264273 - DNA, 38 bp, Artificial Sequence
  Description of Artificial Sequence: Synthetic oligonucleotide
ggatacagcgctctgtgatatctaacaagcttttacac

SEQ ID NO: 264274 - DNA, 43 bp, Artificial Sequence
  Description of Artificial Sequence: Synthetic oligonucleotide
gatacagcgctctgtgatatctaacaagcttttacacaattag

SEQ ID NO: 264275 - DNA, 43 bp, Artificial Sequence
  Description of Artificial Sequence: Synthetic oligonucleotide
atacagcgctctgtgatatctaacaagcttttacacaattagg

SEQ ID NO: 264276 - DNA, 42 bp, Artificial Sequence
  Description of Artificial Sequence: Synthetic oligonucleotide
tacagcgctctgtgatatctaacaagcttttacacaattagg

SEQ ID NO: 264277 - DNA, 41 bp, Artificial Sequence
  Description of Artificial Sequence: Synthetic oligonucleotide
acagcgctctgtgatatctaacaagcttttacacaattagg

SEQ ID NO: 264278 - DNA, 40 bp, Artificial Sequence
  Description of Artificial Sequence: Synthetic oligonucleotide
cagcgctctgtgatatctaacaagcttttacacaattagg

SEQ ID NO: 264279 - DNA, 41 bp, Artificial Sequence
  Description of Artificial Sequence: Synthetic oligonucleotide
agcgctctgtgatatctaacaagcttttacacaattaggag

SEQ ID NO: 264280 - DNA, 40 bp, Artificial Sequence
  Description of Artificial Sequence: Synthetic oligonucleotide
gcgctctgtgatatctaacaagcttttacacaattaggag

SEQ ID NO: 264281 - DNA, 40 bp, Artificial Sequence
  Description of Artificial Sequence: Synthetic oligonucleotide
cgctctgtgatatctaacaagcttttacacaattaggagg

SEQ ID NO: 264282 - DNA, 44 bp, Artificial Sequence
  Description of Artificial Sequence: Synthetic oligonucleotide
gctctgtgatatctaacaagcttttacacaattaggaggaaaag

SEQ ID NO: 264283 - DNA, 44 bp, Artificial Sequence
  Description of Artificial Sequence: Synthetic oligonucleotide
ctctgtgatatctaacaagcttttacacaattaggaggaaaagg

SEQ ID NO: 264284 - DNA, 45 bp, Artificial Sequence
  Description of Artificial Sequence: Synthetic oligonucleotide
tctgtgatatctaacaagcttttacacaattaggaggaaaaggtc

SEQ ID NO: 264285 - DNA, 44 bp, Artificial Sequence
  Description of Artificial Sequence: Synthetic oligonucleotide
ctgtgatatctaacaagcttttacacaattaggaggaaaaggtc

SEQ ID NO: 264286 - DNA, 44 bp, Artificial Sequence
  Description of Artificial Sequence: Synthetic oligonucleotide
tgtgatatctaacaagcttttacacaattaggaggaaaaggtcc

SEQ ID NO: 264287 - DNA, 43 bp, Artificial Sequence
  Description of Artificial Sequence: Synthetic oligonucleotide
gtgatatctaacaagcttttacacaattaggaggaaaaggtcc

SEQ ID NO: 264288 - DNA, 43 bp, Artificial Sequence
  Description of Artificial Sequence: Synthetic oligonucleotide
tgatatctaacaagcttttacacaattaggaggaaaaggtccc

SEQ ID NO: 264289 - DNA, 42 bp, Artificial Sequence
  Description of Artificial Sequence: Synthetic oligonucleotide
gatatctaacaagcttttacacaattaggaggaaaaggtccc

SEQ ID NO: 264290 - DNA, 45 bp, Artificial Sequence
  Description of Artificial Sequence: Synthetic oligonucleotide
atatctaacaagcttttacacaattaggaggaaaaggtccctttg

SEQ ID NO: 264291 - DNA, 44 bp, Artificial Sequence
  Description of Artificial Sequence: Synthetic oligonucleotide
tatctaacaagcttttacacaattaggaggaaaaggtccctttg

SEQ ID NO: 264292 - DNA, 43 bp, Artificial Sequence
  Description of Artificial Sequence: Synthetic oligonucleotide
atctaacaagcttttacacaattaggaggaaaaggtccctttg

SEQ ID NO: 264293 - DNA, 42 bp, Artificial Sequence
  Description of Artificial Sequence: Synthetic oligonucleotide
tctaacaagcttttacacaattaggaggaaaaggtccctttg

SEQ ID NO: 264294 - DNA, 41 bp, Artificial Sequence
  Description of Artificial Sequence: Synthetic oligonucleotide
ctaacaagcttttacacaattaggaggaaaaggtccctttg

SEQ ID NO: 264295 - DNA, 41 bp, Artificial Sequence
  Description of Artificial Sequence: Synthetic oligonucleotide
taacaagcttttacacaattaggaggaaaaggtccctttgc

SEQ ID NO: 264296 - DNA, 40 bp, Artificial Sequence
  Description of Artificial Sequence: Synthetic oligonucleotide
aacaagcttttacacaattaggaggaaaaggtccctttgc

SEQ ID NO: 264297 - DNA, 39 bp, Artificial Sequence
  Description of Artificial Sequence: Synthetic oligonucleotide
acaagcttttacacaattaggaggaaaaggtccctttgc

SEQ ID NO: 264298 - DNA, 38 bp, Artificial Sequence
  Description of Artificial Sequence: Synthetic oligonucleotide
caagcttttacacaattaggaggaaaaggtccctttgc

SEQ ID NO: 264299 - DNA, 39 bp, Artificial Sequence
  Description of Artificial Sequence: Synthetic oligonucleotide
aagcttttacacaattaggaggaaaaggtccctttgctg

SEQ ID NO: 264300 - DNA, 38 bp, Artificial Sequence
  Description of Artificial Sequence: Synthetic oligonucleotide
agcttttacacaattaggaggaaaaggtccctttgctg

SEQ ID NO: 264301 - DNA, 37 bp, Artificial Sequence
  Description of Artificial Sequence: Synthetic oligonucleotide
gcttttacacaattaggaggaaaaggtccctttgctg

SEQ ID NO: 264302 - DNA, 40 bp, Artificial Sequence
  Description of Artificial Sequence: Synthetic oligonucleotide
cttttacacaattaggaggaaaaggtccctttgctgtttc

SEQ ID NO: 264303 - DNA, 43 bp, Artificial Sequence
  Description of Artificial Sequence: Synthetic oligonucleotide
ttttacacaattaggaggaaaaggtccctttgctgtttcattc

SEQ ID NO: 264304 - DNA, 42 bp, Artificial Sequence
  Description of Artificial Sequence: Synthetic oligonucleotide
tttacacaattaggaggaaaaggtccctttgctgtttcattc

SEQ ID NO: 264305 - DNA, 41 bp, Artificial Sequence
  Description of Artificial Sequence: Synthetic oligonucleotide
ttacacaattaggaggaaaaggtccctttgctgtttcattc

SEQ ID NO: 264306 - DNA, 40 bp, Artificial Sequence
  Description of Artificial Sequence: Synthetic oligonucleotide
tacacaattaggaggaaaaggtccctttgctgtttcattc

SEQ ID NO: 264307 - DNA, 39 bp, Artificial Sequence
  Description of Artificial Sequence: Synthetic oligonucleotide
acacaattaggaggaaaaggtccctttgctgtttcattc

SEQ ID NO: 264308 - DNA, 38 bp, Artificial Sequence
  Description of Artificial Sequence: Synthetic oligonucleotide
cacaattaggaggaaaaggtccctttgctgtttcattc

SEQ ID NO: 264309 - DNA, 38 bp, Artificial Sequence
  Description of Artificial Sequence: Synthetic oligonucleotide
acaattaggaggaaaaggtccctttgctgtttcattcc

SEQ ID NO: 264310 - DNA, 37 bp, Artificial Sequence
  Description of Artificial Sequence: Synthetic oligonucleotide
caattaggaggaaaaggtccctttgctgtttcattcc

SEQ ID NO: 264311 - DNA, 38 bp, Artificial Sequence
  Description of Artificial Sequence: Synthetic oligonucleotide
aattaggaggaaaaggtccctttgctgtttcattcctg

SEQ ID NO: 264312 - DNA, 37 bp, Artificial Sequence
  Description of Artificial Sequence: Synthetic oligonucleotide
attaggaggaaaaggtccctttgctgtttcattcctg

SEQ ID NO: 264313 - DNA, 36 bp, Artificial Sequence
  Description of Artificial Sequence: Synthetic oligonucleotide
ttaggaggaaaaggtccctttgctgtttcattcctg

SEQ ID NO: 264314 - DNA, 35 bp, Artificial Sequence
  Description of Artificial Sequence: Synthetic oligonucleotide
taggaggaaaaggtccctttgctgtttcattcctg

SEQ ID NO: 264315 - DNA, 34 bp, Artificial Sequence
  Description of Artificial Sequence: Synthetic oligonucleotide
aggaggaaaaggtccctttgctgtttcattcctg

SEQ ID NO: 264316 - DNA, 33 bp, Artificial Sequence
  Description of Artificial Sequence: Synthetic oligonucleotide
ggaggaaaaggtccctttgctgtttcattcctg

SEQ ID NO: 264317 - DNA, 35 bp, Artificial Sequence
  Description of Artificial Sequence: Synthetic oligonucleotide
gaggaaaaggtccctttgctgtttcattcctgtac

SEQ ID NO: 264318 - DNA, 38 bp, Artificial Sequence
  Description of Artificial Sequence: Synthetic oligonucleotide
aggaaaaggtccctttgctgtttcattcctgtacattc

SEQ ID NO: 264319 - DNA, 37 bp, Artificial Sequence
  Description of Artificial Sequence: Synthetic oligonucleotide
ggaaaaggtccctttgctgtttcattcctgtacattc

SEQ ID NO: 264320 - DNA, 37 bp, Artificial Sequence
  Description of Artificial Sequence: Synthetic oligonucleotide
gaaaaggtccctttgctgtttcattcctgtacattcg

SEQ ID NO: 264321 - DNA, 37 bp, Artificial Sequence
  Description of Artificial Sequence: Synthetic oligonucleotide
aaaaggtccctttgctgtttcattcctgtacattcgc

SEQ ID NO: 264322 - DNA, 36 bp, Artificial Sequence
  Description of Artificial Sequence: Synthetic oligonucleotide
aaaggtccctttgctgtttcattcctgtacattcgc

SEQ ID NO: 264323 - DNA, 35 bp, Artificial Sequence
  Description of Artificial Sequence: Synthetic oligonucleotide
aaggtccctttgctgtttcattcctgtacattcgc

SEQ ID NO: 264324 - DNA, 34 bp, Artificial Sequence
  Description of Artificial Sequence: Synthetic oligonucleotide
aggtccctttgctgtttcattcctgtacattcgc

SEQ ID NO: 264325 - DNA, 33 bp, Artificial Sequence
  Description of Artificial Sequence: Synthetic oligonucleotide
ggtccctttgctgtttcattcctgtacattcgc

SEQ ID NO: 264326 - DNA, 34 bp, Artificial Sequence
  Description of Artificial Sequence: Synthetic oligonucleotide
gtccctttgctgtttcattcctgtacattcgctg

SEQ ID NO: 264327 - DNA, 34 bp, Artificial Sequence
  Description of Artificial Sequence: Synthetic oligonucleotide
tccctttgctgtttcattcctgtacattcgctgg

SEQ ID NO: 264328 - DNA, 33 bp, Artificial Sequence
  Description of Artificial Sequence: Synthetic oligonucleotide
ccctttgctgtttcattcctgtacattcgctgg

SEQ ID NO: 264329 - DNA, 33 bp, Artificial Sequence
  Description of Artificial Sequence: Synthetic oligonucleotide
cctttgctgtttcattcctgtacattcgctggg

SEQ ID NO: 264330 - DNA, 37 bp, Artificial Sequence
  Description of Artificial Sequence: Synthetic oligonucleotide
ctttgctgtttcattcctgtacattcgctgggatatg

SEQ ID NO: 264331 - DNA, 37 bp, Artificial Sequence
  Description of Artificial Sequence: Synthetic oligonucleotide
tttgctgtttcattcctgtacattcgctgggatatgc

SEQ ID NO: 264332 - DNA, 36 bp, Artificial Sequence
  Description of Artificial Sequence: Synthetic oligonucleotide
ttgctgtttcattcctgtacattcgctgggatatgc

SEQ ID NO: 264333 - DNA, 35 bp, Artificial Sequence
  Description of Artificial Sequence: Synthetic oligonucleotide
tgctgtttcattcctgtacattcgctgggatatgc

SEQ ID NO: 264334 - DNA, 34 bp, Artificial Sequence
  Description of Artificial Sequence: Synthetic oligonucleotide
gctgtttcattcctgtacattcgctgggatatgc

SEQ ID NO: 264335 - DNA, 35 bp, Artificial Sequence
  Description of Artificial Sequence: Synthetic oligonucleotide
ctgtttcattcctgtacattcgctgggatatgcac

SEQ ID NO: 264336 - DNA, 38 bp, Artificial Sequence
  Description of Artificial Sequence: Synthetic oligonucleotide
tgtttcattcctgtacattcgctgggatatgcactatg

SEQ ID NO: 264337 - DNA, 37 bp, Artificial Sequence
  Description of Artificial Sequence: Synthetic oligonucleotide
gtttcattcctgtacattcgctgggatatgcactatg

SEQ ID NO: 264338 - DNA, 37 bp, Artificial Sequence
  Description of Artificial Sequence: Synthetic oligonucleotide
tttcattcctgtacattcgctgggatatgcactatgg

SEQ ID NO: 264339 - DNA, 36 bp, Artificial Sequence
  Description of Artificial Sequence: Synthetic oligonucleotide
ttcattcctgtacattcgctgggatatgcactatgg

SEQ ID NO: 264340 - DNA, 35 bp, Artificial Sequence
  Description of Artificial Sequence: Synthetic oligonucleotide
tcattcctgtacattcgctgggatatgcactatgg

SEQ ID NO: 264341 - DNA, 34 bp, Artificial Sequence
  Description of Artificial Sequence: Synthetic oligonucleotide
cattcctgtacattcgctgggatatgcactatgg

SEQ ID NO: 264342 - DNA, 34 bp, Artificial Sequence
  Description of Artificial Sequence: Synthetic oligonucleotide
attcctgtacattcgctgggatatgcactatggg

SEQ ID NO: 264343 - DNA, 33 bp, Artificial Sequence
  Description of Artificial Sequence: Synthetic oligonucleotide
ttcctgtacattcgctgggatatgcactatggg

SEQ ID NO: 264344 - DNA, 32 bp, Artificial Sequence
  Description of Artificial Sequence: Synthetic oligonucleotide
tcctgtacattcgctgggatatgcactatggg

SEQ ID NO: 264345 - DNA, 31 bp, Artificial Sequence
  Description of Artificial Sequence: Synthetic oligonucleotide
cctgtacattcgctgggatatgcactatggg

SEQ ID NO: 264346 - DNA, 34 bp, Artificial Sequence
  Description of Artificial Sequence: Synthetic oligonucleotide
ctgtacattcgctgggatatgcactatgggtttc

SEQ ID NO: 264347 - DNA, 35 bp, Artificial Sequence
  Description of Artificial Sequence: Synthetic oligonucleotide
tgtacattcgctgggatatgcactatgggtttcag

SEQ ID NO: 264348 - DNA, 34 bp, Artificial Sequence
  Description of Artificial Sequence: Synthetic oligonucleotide
gtacattcgctgggatatgcactatgggtttcag

SEQ ID NO: 264349 - DNA, 34 bp, Artificial Sequence
  Description of Artificial Sequence: Synthetic oligonucleotide
tacattcgctgggatatgcactatgggtttcagc

SEQ ID NO: 264350 - DNA, 33 bp, Artificial Sequence
  Description of Artificial Sequence: Synthetic oligonucleotide
acattcgctgggatatgcactatgggtttcagc

SEQ ID NO: 264351 - DNA, 32 bp, Artificial Sequence
  Description of Artificial Sequence: Synthetic oligonucleotide
cattcgctgggatatgcactatgggtttcagc

SEQ ID NO: 264352 - DNA, 33 bp, Artificial Sequence
  Description of Artificial Sequence: Synthetic oligonucleotide
attcgctgggatatgcactatgggtttcagctc

SEQ ID NO: 264353 - DNA, 32 bp, Artificial Sequence
  Description of Artificial Sequence: Synthetic oligonucleotide
ttcgctgggatatgcactatgggtttcagctc

SEQ ID NO: 264354 - DNA, 31 bp, Artificial Sequence
  Description of Artificial Sequence: Synthetic oligonucleotide
tcgctgggatatgcactatgggtttcagctc

SEQ ID NO: 264355 - DNA, 30 bp, Artificial Sequence
  Description of Artificial Sequence: Synthetic oligonucleotide
cgctgggatatgcactatgggtttcagctc

SEQ ID NO: 264356 - DNA, 33 bp, Artificial Sequence
  Description of Artificial Sequence: Synthetic oligonucleotide
gctgggatatgcactatgggtttcagctcaatc

SEQ ID NO: 264357 - DNA, 34 bp, Artificial Sequence
  Description of Artificial Sequence: Synthetic oligonucleotide
ctgggatatgcactatgggtttcagctcaatcag

SEQ ID NO: 264358 - DNA, 35 bp, Artificial Sequence
  Description of Artificial Sequence: Synthetic oligonucleotide
tgggatatgcactatgggtttcagctcaatcagag

SEQ ID NO: 264359 - DNA, 34 bp, Artificial Sequence
  Description of Artificial Sequence: Synthetic oligonucleotide
gggatatgcactatgggtttcagctcaatcagag

SEQ ID NO: 264360 - DNA, 35 bp, Artificial Sequence
  Description of Artificial Sequence: Synthetic oligonucleotide
ggatatgcactatgggtttcagctcaatcagagtg

SEQ ID NO: 264361 - DNA, 36 bp, Artificial Sequence
  Description of Artificial Sequence: Synthetic oligonucleotide
gatatgcactatgggtttcagctcaatcagagtgtc

SEQ ID NO: 264362 - DNA, 36 bp, Artificial Sequence
  Description of Artificial Sequence: Synthetic oligonucleotide
atatgcactatgggtttcagctcaatcagagtgtcc

SEQ ID NO: 264363 - DNA, 35 bp, Artificial Sequence
  Description of Artificial Sequence: Synthetic oligonucleotide
tatgcactatgggtttcagctcaatcagagtgtcc

SEQ ID NO: 264364 - DNA, 34 bp, Artificial Sequence
  Description of Artificial Sequence: Synthetic oligonucleotide
atgcactatgggtttcagctcaatcagagtgtcc

SEQ ID NO: 264365 - DNA, 33 bp, Artificial Sequence
  Description of Artificial Sequence: Synthetic oligonucleotide
tgcactatgggtttcagctcaatcagagtgtcc

SEQ ID NO: 264366 - DNA, 32 bp, Artificial Sequence
  Description of Artificial Sequence: Synthetic oligonucleotide
gcactatgggtttcagctcaatcagagtgtcc

SEQ ID NO: 264367 - DNA, 32 bp, Artificial Sequence
  Description of Artificial Sequence: Synthetic oligonucleotide
cactatgggtttcagctcaatcagagtgtccc

SEQ ID NO: 264368 - DNA, 34 bp, Artificial Sequence
  Description of Artificial Sequence: Synthetic oligonucleotide
actatgggtttcagctcaatcagagtgtccctag

SEQ ID NO: 264369 - DNA, 33 bp, Artificial Sequence
  Description of Artificial Sequence: Synthetic oligonucleotide
ctatgggtttcagctcaatcagagtgtccctag

SEQ ID NO: 264370 - DNA, 34 bp, Artificial Sequence
  Description of Artificial Sequence: Synthetic oligonucleotide
tatgggtttcagctcaatcagagtgtccctagtg

SEQ ID NO: 264371 - DNA, 33 bp, Artificial Sequence
  Description of Artificial Sequence: Synthetic oligonucleotide
atgggtttcagctcaatcagagtgtccctagtg

SEQ ID NO: 264372 - DNA, 32 bp, Artificial Sequence
  Description of Artificial Sequence: Synthetic oligonucleotide
tgggtttcagctcaatcagagtgtccctagtg

SEQ ID NO: 264373 - DNA, 31 bp, Artificial Sequence
  Description of Artificial Sequence: Synthetic oligonucleotide
gggtttcagctcaatcagagtgtccctagtg

SEQ ID NO: 264374 - DNA, 31 bp, Artificial Sequence
  Description of Artificial Sequence: Synthetic oligonucleotide
ggtttcagctcaatcagagtgtccctagtgg

SEQ ID NO: 264375 - DNA, 37 bp, Artificial Sequence
  Description of Artificial Sequence: Synthetic oligonucleotide
gtttcagctcaatcagagtgtccctagtggtaattac

SEQ ID NO: 264376 - DNA, 37 bp, Artificial Sequence
  Description of Artificial Sequence: Synthetic oligonucleotide
tttcagctcaatcagagtgtccctagtggtaattacg

SEQ ID NO: 264377 - DNA, 36 bp, Artificial Sequence
  Description of Artificial Sequence: Synthetic oligonucleotide
ttcagctcaatcagagtgtccctagtggtaattacg

SEQ ID NO: 264378 - DNA, 35 bp, Artificial Sequence
  Description of Artificial Sequence: Synthetic oligonucleotide
tcagctcaatcagagtgtccctagtggtaattacg

SEQ ID NO: 264379 - DNA, 34 bp, Artificial Sequence
  Description of Artificial Sequence: Synthetic oligonucleotide
cagctcaatcagagtgtccctagtggtaattacg

SEQ ID NO: 264380 - DNA, 34 bp, Artificial Sequence
  Description of Artificial Sequence: Synthetic oligonucleotide
agctcaatcagagtgtccctagtggtaattacgg

SEQ ID NO: 264381 - DNA, 33 bp, Artificial Sequence
  Description of Artificial Sequence: Synthetic oligonucleotide
gctcaatcagagtgtccctagtggtaattacgg

SEQ ID NO: 264382 - DNA, 33 bp, Artificial Sequence
  Description of Artificial Sequence: Synthetic oligonucleotide
ctcaatcagagtgtccctagtggtaattacggg

SEQ ID NO: 264383 - DNA, 33 bp, Artificial Sequence
  Description of Artificial Sequence: Synthetic oligonucleotide
tcaatcagagtgtccctagtggtaattacgggc

SEQ ID NO: 264384 - DNA, 32 bp, Artificial Sequence
  Description of Artificial Sequence: Synthetic oligonucleotide
caatcagagtgtccctagtggtaattacgggc

SEQ ID NO: 264385 - DNA, 32 bp, Artificial Sequence
  Description of Artificial Sequence: Synthetic oligonucleotide
aatcagagtgtccctagtggtaattacgggcg

SEQ ID NO: 264386 - DNA, 31 bp, Artificial Sequence
  Description of Artificial Sequence: Synthetic oligonucleotide
atcagagtgtccctagtggtaattacgggcg

SEQ ID NO: 264387 - DNA, 30 bp, Artificial Sequence
  Description of Artificial Sequence: Synthetic oligonucleotide
tcagagtgtccctagtggtaattacgggcg

SEQ ID NO: 264388 - DNA, 29 bp, Artificial Sequence
  Description of Artificial Sequence: Synthetic oligonucleotide
cagagtgtccctagtggtaattacgggcg

SEQ ID NO: 264389 - DNA, 31 bp, Artificial Sequence
  Description of Artificial Sequence: Synthetic oligonucleotide
agagtgtccctagtggtaattacgggcgatg

SEQ ID NO: 264390 - DNA, 30 bp, Artificial Sequence
  Description of Artificial Sequence: Synthetic oligonucleotide
gagtgtccctagtggtaattacgggcgatg

SEQ ID NO: 264391 - DNA, 30 bp, Artificial Sequence
  Description of Artificial Sequence: Synthetic oligonucleotide
agtgtccctagtggtaattacgggcgatgg

SEQ ID NO: 264392 - DNA, 29 bp, Artificial Sequence
  Description of Artificial Sequence: Synthetic oligonucleotide
gtgtccctagtggtaattacgggcgatgg

SEQ ID NO: 264393 - DNA, 31 bp, Artificial Sequence
  Description of Artificial Sequence: Synthetic oligonucleotide
tgtccctagtggtaattacgggcgatggaag

SEQ ID NO: 264394 - DNA, 30 bp, Artificial Sequence
  Description of Artificial Sequence: Synthetic oligonucleotide
gtccctagtggtaattacgggcgatggaag

SEQ ID NO: 264395 - DNA, 30 bp, Artificial Sequence
  Description of Artificial Sequence: Synthetic oligonucleotide
tccctagtggtaattacgggcgatggaagg

SEQ ID NO: 264396 - DNA, 29 bp, Artificial Sequence
  Description of Artificial Sequence: Synthetic oligonucleotide
ccctagtggtaattacgggcgatggaagg

SEQ ID NO: 264397 - DNA, 29 bp, Artificial Sequence
  Description of Artificial Sequence: Synthetic oligonucleotide
cctagtggtaattacgggcgatggaaggg

SEQ ID NO: 264398 - DNA, 29 bp, Artificial Sequence
  Description of Artificial Sequence: Synthetic oligonucleotide
ctagtggtaattacgggcgatggaagggc

SEQ ID NO: 264399 - DNA, 30 bp, Artificial Sequence
  Description of Artificial Sequence: Synthetic oligonucleotide
tagtggtaattacgggcgatggaagggcac

SEQ ID NO: 264400 - DNA, 29 bp, Artificial Sequence
  Description of Artificial Sequence: Synthetic oligonucleotide
agtggtaattacgggcgatggaagggcac

SEQ ID NO: 264401 - DNA, 28 bp, Artificial Sequence
  Description of Artificial Sequence: Synthetic oligonucleotide
gtggtaattacgggcgatggaagggcac

SEQ ID NO: 264402 - DNA, 30 bp, Artificial Sequence
  Description of Artificial Sequence: Synthetic oligonucleotide
tggtaattacgggcgatggaagggcacatg

SEQ ID NO: 264403 - DNA, 29 bp, Artificial Sequence
  Description of Artificial Sequence: Synthetic oligonucleotide
ggtaattacgggcgatggaagggcacatg

SEQ ID NO: 264404 - DNA, 29 bp, Artificial Sequence
  Description of Artificial Sequence: Synthetic oligonucleotide
gtaattacgggcgatggaagggcacatgc

SEQ ID NO: 264405 - DNA, 32 bp, Artificial Sequence
  Description of Artificial Sequence: Synthetic oligonucleotide
taattacgggcgatggaagggcacatgcatag

SEQ ID NO: 264406 - DNA, 31 bp, Artificial Sequence
  Description of Artificial Sequence: Synthetic oligonucleotide
aattacgggcgatggaagggcacatgcatag

SEQ ID NO: 264407 - DNA, 30 bp, Artificial Sequence
  Description of Artificial Sequence: Synthetic oligonucleotide
attacgggcgatggaagggcacatgcatag

SEQ ID NO: 264408 - DNA, 29 bp, Artificial Sequence
  Description of Artificial Sequence: Synthetic oligonucleotide
ttacgggcgatggaagggcacatgcatag

SEQ ID NO: 264409 - DNA, 28 bp, Artificial Sequence
  Description of Artificial Sequence: Synthetic oligonucleotide
tacgggcgatggaagggcacatgcatag

SEQ ID NO: 264410 - DNA, 27 bp, Artificial Sequence
  Description of Artificial Sequence: Synthetic oligonucleotide
acgggcgatggaagggcacatgcatag

SEQ ID NO: 264411 - DNA, 26 bp, Artificial Sequence
  Description of Artificial Sequence: Synthetic oligonucleotide
cgggcgatggaagggcacatgcatag

SEQ ID NO: 264412 - DNA, 27 bp, Artificial Sequence
  Description of Artificial Sequence: Synthetic oligonucleotide
gggcgatggaagggcacatgcatagga

SEQ ID NO: 264413 - DNA, 34 bp, Artificial Sequence
  Description of Artificial Sequence: Synthetic oligonucleotide
ggcgatggaagggcacatgcataggaaataattg

SEQ ID NO: 264414 - DNA, 34 bp, Artificial Sequence
  Description of Artificial Sequence: Synthetic oligonucleotide
gcgatggaagggcacatgcataggaaataattgc

SEQ ID NO: 264415 - DNA, 34 bp, Artificial Sequence
  Description of Artificial Sequence: Synthetic oligonucleotide
cgatggaagggcacatgcataggaaataattgcg

SEQ ID NO: 264416 - DNA, 34 bp, Artificial Sequence
  Description of Artificial Sequence: Synthetic oligonucleotide
gatggaagggcacatgcataggaaataattgcgc

SEQ ID NO: 264417 - DNA, 35 bp, Artificial Sequence
  Description of Artificial Sequence: Synthetic oligonucleotide
atggaagggcacatgcataggaaataattgcgctg

SEQ ID NO: 264418 - DNA, 34 bp, Artificial Sequence
  Description of Artificial Sequence: Synthetic oligonucleotide
tggaagggcacatgcataggaaataattgcgctg

SEQ ID NO: 264419 - DNA, 33 bp, Artificial Sequence
  Description of Artificial Sequence: Synthetic oligonucleotide
ggaagggcacatgcataggaaataattgcgctg

SEQ ID NO: 264420 - DNA, 33 bp, Artificial Sequence
  Description of Artificial Sequence: Synthetic oligonucleotide
gaagggcacatgcataggaaataattgcgctgc

SEQ ID NO: 264421 - DNA, 34 bp, Artificial Sequence
  Description of Artificial Sequence: Synthetic oligonucleotide
aagggcacatgcataggaaataattgcgctgcag

SEQ ID NO: 264422 - DNA, 33 bp, Artificial Sequence
  Description of Artificial Sequence: Synthetic oligonucleotide
agggcacatgcataggaaataattgcgctgcag

SEQ ID NO: 264423 - DNA, 32 bp, Artificial Sequence
  Description of Artificial Sequence: Synthetic oligonucleotide
gggcacatgcataggaaataattgcgctgcag

SEQ ID NO: 264424 - DNA, 32 bp, Artificial Sequence
  Description of Artificial Sequence: Synthetic oligonucleotide
ggcacatgcataggaaataattgcgctgcagg

SEQ ID NO: 264425 - DNA, 33 bp, Artificial Sequence
  Description of Artificial Sequence: Synthetic oligonucleotide
gcacatgcataggaaataattgcgctgcaggtg

SEQ ID NO: 264426 - DNA, 34 bp, Artificial Sequence
  Description of Artificial Sequence: Synthetic oligonucleotide
cacatgcataggaaataattgcgctgcaggtgtg

SEQ ID NO: 264427 - DNA, 35 bp, Artificial Sequence
  Description of Artificial Sequence: Synthetic oligonucleotide
acatgcataggaaataattgcgctgcaggtgtgtc

SEQ ID NO: 264428 - DNA, 34 bp, Artificial Sequence
  Description of Artificial Sequence: Synthetic oligonucleotide
catgcataggaaataattgcgctgcaggtgtgtc

SEQ ID NO: 264429 - DNA, 37 bp, Artificial Sequence
  Description of Artificial Sequence: Synthetic oligonucleotide
atgcataggaaataattgcgctgcaggtgtgtcaatc

SEQ ID NO: 264430 - DNA, 36 bp, Artificial Sequence
  Description of Artificial Sequence: Synthetic oligonucleotide
tgcataggaaataattgcgctgcaggtgtgtcaatc

SEQ ID NO: 264431 - DNA, 35 bp, Artificial Sequence
  Description of Artificial Sequence: Synthetic oligonucleotide
gcataggaaataattgcgctgcaggtgtgtcaatc

SEQ ID NO: 264432 - DNA, 37 bp, Artificial Sequence
  Description of Artificial Sequence: Synthetic oligonucleotide
cataggaaataattgcgctgcaggtgtgtcaatcttg

SEQ ID NO: 264433 - DNA, 40 bp, Artificial Sequence
  Description of Artificial Sequence: Synthetic oligonucleotide
ataggaaataattgcgctgcaggtgtgtcaatcttgaaac

SEQ ID NO: 264434 - DNA, 39 bp, Artificial Sequence
  Description of Artificial Sequence: Synthetic oligonucleotide
taggaaataattgcgctgcaggtgtgtcaatcttgaaac

SEQ ID NO: 264435 - DNA, 38 bp, Artificial Sequence
  Description of Artificial Sequence: Synthetic oligonucleotide
aggaaataattgcgctgcaggtgtgtcaatcttgaaac

SEQ ID NO: 264436 - DNA, 37 bp, Artificial Sequence
  Description of Artificial Sequence: Synthetic oligonucleotide
ggaaataattgcgctgcaggtgtgtcaatcttgaaac

SEQ ID NO: 264437 - DNA, 39 bp, Artificial Sequence
  Description of Artificial Sequence: Synthetic oligonucleotide
gaaataattgcgctgcaggtgtgtcaatcttgaaacaac

SEQ ID NO: 264438 - DNA, 40 bp, Artificial Sequence
  Description of Artificial Sequence: Synthetic oligonucleotide
aaataattgcgctgcaggtgtgtcaatcttgaaacaacac

SEQ ID NO: 264439 - DNA, 39 bp, Artificial Sequence
  Description of Artificial Sequence: Synthetic oligonucleotide
aataattgcgctgcaggtgtgtcaatcttgaaacaacac

SEQ ID NO: 264440 - DNA, 38 bp, Artificial Sequence
  Description of Artificial Sequence: Synthetic oligonucleotide
ataattgcgctgcaggtgtgtcaatcttgaaacaacac

SEQ ID NO: 264441 - DNA, 37 bp, Artificial Sequence
  Description of Artificial Sequence: Synthetic oligonucleotide
taattgcgctgcaggtgtgtcaatcttgaaacaacac

SEQ ID NO: 264442 - DNA, 36 bp, Artificial Sequence
  Description of Artificial Sequence: Synthetic oligonucleotide
aattgcgctgcaggtgtgtcaatcttgaaacaacac

SEQ ID NO: 264443 - DNA, 35 bp, Artificial Sequence
  Description of Artificial Sequence: Synthetic oligonucleotide
attgcgctgcaggtgtgtcaatcttgaaacaacac

SEQ ID NO: 264444 - DNA, 34 bp, Artificial Sequence
  Description of Artificial Sequence: Synthetic oligonucleotide
ttgcgctgcaggtgtgtcaatcttgaaacaacac

SEQ ID NO: 264445 - DNA, 33 bp, Artificial Sequence
  Description of Artificial Sequence: Synthetic oligonucleotide
tgcgctgcaggtgtgtcaatcttgaaacaacac

SEQ ID NO: 264446 - DNA, 32 bp, Artificial Sequence
  Description of Artificial Sequence: Synthetic oligonucleotide
gcgctgcaggtgtgtcaatcttgaaacaacac

SEQ ID NO: 264447 - DNA, 38 bp, Artificial Sequence
  Description of Artificial Sequence: Synthetic oligonucleotide
cgctgcaggtgtgtcaatcttgaaacaacactataaag

SEQ ID NO: 264448 - DNA, 40 bp, Artificial Sequence
  Description of Artificial Sequence: Synthetic oligonucleotide
gctgcaggtgtgtcaatcttgaaacaacactataaagtag

SEQ ID NO: 264449 - DNA, 40 bp, Artificial Sequence
  Description of Artificial Sequence: Synthetic oligonucleotide
ctgcaggtgtgtcaatcttgaaacaacactataaagtagg

SEQ ID NO: 264450 - DNA, 41 bp, Artificial Sequence
  Description of Artificial Sequence: Synthetic oligonucleotide
tgcaggtgtgtcaatcttgaaacaacactataaagtaggag

SEQ ID NO: 264451 - DNA, 40 bp, Artificial Sequence
  Description of Artificial Sequence: Synthetic oligonucleotide
gcaggtgtgtcaatcttgaaacaacactataaagtaggag

SEQ ID NO: 264452 - DNA, 44 bp, Artificial Sequence
  Description of Artificial Sequence: Synthetic oligonucleotide
caggtgtgtcaatcttgaaacaacactataaagtaggagaaatc

SEQ ID NO: 264453 - DNA, 45 bp, Artificial Sequence
  Description of Artificial Sequence: Synthetic oligonucleotide
aggtgtgtcaatcttgaaacaacactataaagtaggagaaatcac

SEQ ID NO: 264454 - DNA, 44 bp, Artificial Sequence
  Description of Artificial Sequence: Synthetic oligonucleotide
ggtgtgtcaatcttgaaacaacactataaagtaggagaaatcac

SEQ ID NO: 264455 - DNA, 44 bp, Artificial Sequence
  Description of Artificial Sequence: Synthetic oligonucleotide
gtgtgtcaatcttgaaacaacactataaagtaggagaaatcacc

SEQ ID NO: 264456 - DNA, 46 bp, Artificial Sequence
  Description of Artificial Sequence: Synthetic oligonucleotide
tgtgtcaatcttgaaacaacactataaagtaggagaaatcaccttg

SEQ ID NO: 264457 - DNA, 45 bp, Artificial Sequence
  Description of Artificial Sequence: Synthetic oligonucleotide
gtgtcaatcttgaaacaacactataaagtaggagaaatcaccttg

SEQ ID NO: 264458 - DNA, 47 bp, Artificial Sequence
  Description of Artificial Sequence: Synthetic oligonucleotide
tgtcaatcttgaaacaacactataaagtaggagaaatcaccttgaag

SEQ ID NO: 264459 - DNA, 46 bp, Artificial Sequence
  Description of Artificial Sequence: Synthetic oligonucleotide
gtcaatcttgaaacaacactataaagtaggagaaatcaccttgaag

SEQ ID NO: 264460 - DNA, 47 bp, Artificial Sequence
  Description of Artificial Sequence: Synthetic oligonucleotide
tcaatcttgaaacaacactataaagtaggagaaatcaccttgaagac

SEQ ID NO: 264461 - DNA, 46 bp, Artificial Sequence
  Description of Artificial Sequence: Synthetic oligonucleotide
caatcttgaaacaacactataaagtaggagaaatcaccttgaagac

SEQ ID NO: 264462 - DNA, 47 bp, Artificial Sequence
  Description of Artificial Sequence: Synthetic oligonucleotide
aatcttgaaacaacactataaagtaggagaaatcaccttgaagacag

SEQ ID NO: 264463 - DNA, 46 bp, Artificial Sequence
  Description of Artificial Sequence: Synthetic oligonucleotide
atcttgaaacaacactataaagtaggagaaatcaccttgaagacag

SEQ ID NO: 264464 - DNA, 45 bp, Artificial Sequence
  Description of Artificial Sequence: Synthetic oligonucleotide
tcttgaaacaacactataaagtaggagaaatcaccttgaagacag

SEQ ID NO: 264465 - DNA, 44 bp, Artificial Sequence
  Description of Artificial Sequence: Synthetic oligonucleotide
cttgaaacaacactataaagtaggagaaatcaccttgaagacag

SEQ ID NO: 264466 - DNA, 44 bp, Artificial Sequence
  Description of Artificial Sequence: Synthetic oligonucleotide
ttgaaacaacactataaagtaggagaaatcaccttgaagacagc

SEQ ID NO: 264467 - DNA, 43 bp, Artificial Sequence
  Description of Artificial Sequence: Synthetic oligonucleotide
tgaaacaacactataaagtaggagaaatcaccttgaagacagc

SEQ ID NO: 264468 - DNA, 42 bp, Artificial Sequence
  Description of Artificial Sequence: Synthetic oligonucleotide
gaaacaacactataaagtaggagaaatcaccttgaagacagc

SEQ ID NO: 264469 - DNA, 43 bp, Artificial Sequence
  Description of Artificial Sequence: Synthetic oligonucleotide
aaacaacactataaagtaggagaaatcaccttgaagacagcac

SEQ ID NO: 264470 - DNA, 42 bp, Artificial Sequence
  Description of Artificial Sequence: Synthetic oligonucleotide
aacaacactataaagtaggagaaatcaccttgaagacagcac

SEQ ID NO: 264471 - DNA, 41 bp, Artificial Sequence
  Description of Artificial Sequence: Synthetic oligonucleotide
acaacactataaagtaggagaaatcaccttgaagacagcac

SEQ ID NO: 264472 - DNA, 40 bp, Artificial Sequence
  Description of Artificial Sequence: Synthetic oligonucleotide
caacactataaagtaggagaaatcaccttgaagacagcac

SEQ ID NO: 264473 - DNA, 42 bp, Artificial Sequence
  Description of Artificial Sequence: Synthetic oligonucleotide
aacactataaagtaggagaaatcaccttgaagacagcacttg

SEQ ID NO: 264474 - DNA, 41 bp, Artificial Sequence
  Description of Artificial Sequence: Synthetic oligonucleotide
acactataaagtaggagaaatcaccttgaagacagcacttg

SEQ ID NO: 264475 - DNA, 40 bp, Artificial Sequence
  Description of Artificial Sequence: Synthetic oligonucleotide
cactataaagtaggagaaatcaccttgaagacagcacttg

SEQ ID NO: 264476 - DNA, 40 bp, Artificial Sequence
  Description of Artificial Sequence: Synthetic oligonucleotide
actataaagtaggagaaatcaccttgaagacagcacttgg

SEQ ID NO: 264477 - DNA, 39 bp, Artificial Sequence
  Description of Artificial Sequence: Synthetic oligonucleotide
ctataaagtaggagaaatcaccttgaagacagcacttgg

SEQ ID NO: 264478 - DNA, 43 bp, Artificial Sequence
  Description of Artificial Sequence: Synthetic oligonucleotide
tataaagtaggagaaatcaccttgaagacagcacttggtttag

SEQ ID NO: 264479 - DNA, 42 bp, Artificial Sequence
  Description of Artificial Sequence: Synthetic oligonucleotide
ataaagtaggagaaatcaccttgaagacagcacttggtttag

SEQ ID NO: 264480 - DNA, 41 bp, Artificial Sequence
  Description of Artificial Sequence: Synthetic oligonucleotide
taaagtaggagaaatcaccttgaagacagcacttggtttag

SEQ ID NO: 264481 - DNA, 40 bp, Artificial Sequence
  Description of Artificial Sequence: Synthetic oligonucleotide
aaagtaggagaaatcaccttgaagacagcacttggtttag

SEQ ID NO: 264482 - DNA, 39 bp, Artificial Sequence
  Description of Artificial Sequence: Synthetic oligonucleotide
aagtaggagaaatcaccttgaagacagcacttggtttag

SEQ ID NO: 264483 - DNA, 38 bp, Artificial Sequence
  Description of Artificial Sequence: Synthetic oligonucleotide
agtaggagaaatcaccttgaagacagcacttggtttag

SEQ ID NO: 264484 - DNA, 37 bp, Artificial Sequence
  Description of Artificial Sequence: Synthetic oligonucleotide
gtaggagaaatcaccttgaagacagcacttggtttag

SEQ ID NO: 264485 - DNA, 37 bp, Artificial Sequence
  Description of Artificial Sequence: Synthetic oligonucleotide
taggagaaatcaccttgaagacagcacttggtttagc

SEQ ID NO: 264486 - DNA, 36 bp, Artificial Sequence
  Description of Artificial Sequence: Synthetic oligonucleotide
aggagaaatcaccttgaagacagcacttggtttagc

SEQ ID NO: 264487 - DNA, 35 bp, Artificial Sequence
  Description of Artificial Sequence: Synthetic oligonucleotide
ggagaaatcaccttgaagacagcacttggtttagc

SEQ ID NO: 264488 - DNA, 38 bp, Artificial Sequence
  Description of Artificial Sequence: Synthetic oligonucleotide
gagaaatcaccttgaagacagcacttggtttagctatg

SEQ ID NO: 264489 - DNA, 41 bp, Artificial Sequence
  Description of Artificial Sequence: Synthetic oligonucleotide
agaaatcaccttgaagacagcacttggtttagctatgaaag

SEQ ID NO: 264490 - DNA, 40 bp, Artificial Sequence
  Description of Artificial Sequence: Synthetic oligonucleotide
gaaatcaccttgaagacagcacttggtttagctatgaaag

SEQ ID NO: 264491 - DNA, 42 bp, Artificial Sequence
  Description of Artificial Sequence: Synthetic oligonucleotide
aaatcaccttgaagacagcacttggtttagctatgaaagtac

SEQ ID NO: 264492 - DNA, 41 bp, Artificial Sequence
  Description of Artificial Sequence: Synthetic oligonucleotide
aatcaccttgaagacagcacttggtttagctatgaaagtac

SEQ ID NO: 264493 - DNA, 40 bp, Artificial Sequence
  Description of Artificial Sequence: Synthetic oligonucleotide
atcaccttgaagacagcacttggtttagctatgaaagtac

SEQ ID NO: 264494 - DNA, 39 bp, Artificial Sequence
  Description of Artificial Sequence: Synthetic oligonucleotide
tcaccttgaagacagcacttggtttagctatgaaagtac

SEQ ID NO: 264495 - DNA, 38 bp, Artificial Sequence
  Description of Artificial Sequence: Synthetic oligonucleotide
caccttgaagacagcacttggtttagctatgaaagtac

SEQ ID NO: 264496 - DNA, 45 bp, Artificial Sequence
  Description of Artificial Sequence: Synthetic oligonucleotide
accttgaagacagcacttggtttagctatgaaagtactatataag

SEQ ID NO: 264497 - DNA, 44 bp, Artificial Sequence
  Description of Artificial Sequence: Synthetic oligonucleotide
ccttgaagacagcacttggtttagctatgaaagtactatataag

SEQ ID NO: 264498 - DNA, 45 bp, Artificial Sequence
  Description of Artificial Sequence: Synthetic oligonucleotide
cttgaagacagcacttggtttagctatgaaagtactatataagac

SEQ ID NO: 264499 - DNA, 45 bp, Artificial Sequence
  Description of Artificial Sequence: Synthetic oligonucleotide
ttgaagacagcacttggtttagctatgaaagtactatataagacc

SEQ ID NO: 264500 - DNA, 44 bp, Artificial Sequence
  Description of Artificial Sequence: Synthetic oligonucleotide
tgaagacagcacttggtttagctatgaaagtactatataagacc

SEQ ID NO: 264501 - DNA, 43 bp, Artificial Sequence
  Description of Artificial Sequence: Synthetic oligonucleotide
gaagacagcacttggtttagctatgaaagtactatataagacc

SEQ ID NO: 264502 - DNA, 45 bp, Artificial Sequence
  Description of Artificial Sequence: Synthetic oligonucleotide
aagacagcacttggtttagctatgaaagtactatataagaccaag

SEQ ID NO: 264503 - DNA, 44 bp, Artificial Sequence
  Description of Artificial Sequence: Synthetic oligonucleotide
agacagcacttggtttagctatgaaagtactatataagaccaag

SEQ ID NO: 264504 - DNA, 43 bp, Artificial Sequence
  Description of Artificial Sequence: Synthetic oligonucleotide
gacagcacttggtttagctatgaaagtactatataagaccaag

SEQ ID NO: 264505 - DNA, 43 bp, Artificial Sequence
  Description of Artificial Sequence: Synthetic oligonucleotide
acagcacttggtttagctatgaaagtactatataagaccaagg

SEQ ID NO: 264506 - DNA, 42 bp, Artificial Sequence
  Description of Artificial Sequence: Synthetic oligonucleotide
cagcacttggtttagctatgaaagtactatataagaccaagg

SEQ ID NO: 264507 - DNA, 44 bp, Artificial Sequence
  Description of Artificial Sequence: Synthetic oligonucleotide
agcacttggtttagctatgaaagtactatataagaccaaggatg

SEQ ID NO: 264508 - DNA, 43 bp, Artificial Sequence
  Description of Artificial Sequence: Synthetic oligonucleotide
gcacttggtttagctatgaaagtactatataagaccaaggatg

SEQ ID NO: 264509 - DNA, 46 bp, Artificial Sequence
  Description of Artificial Sequence: Synthetic oligonucleotide
cacttggtttagctatgaaagtactatataagaccaaggatgttag

SEQ ID NO: 264510 - DNA, 50 bp, Artificial Sequence
  Description of Artificial Sequence: Synthetic oligonucleotide
acttggtttagctatgaaagtactatataagaccaaggatgttagaaaac

SEQ ID NO: 264511 - DNA, 49 bp, Artificial Sequence
  Description of Artificial Sequence: Synthetic oligonucleotide
cttggtttagctatgaaagtactatataagaccaaggatgttagaaaac

SEQ ID NO: 264512 - DNA, 50 bp, Artificial Sequence
  Description of Artificial Sequence: Synthetic oligonucleotide
ttggtttagctatgaaagtactatataagaccaaggatgttagaaaactc

SEQ ID NO: 264513 - DNA, 49 bp, Artificial Sequence
  Description of Artificial Sequence: Synthetic oligonucleotide
tggtttagctatgaaagtactatataagaccaaggatgttagaaaactc

SEQ ID NO: 264514 - DNA, 48 bp, Artificial Sequence
  Description of Artificial Sequence: Synthetic oligonucleotide
ggtttagctatgaaagtactatataagaccaaggatgttagaaaactc

SEQ ID NO: 264515 - DNA, 49 bp, Artificial Sequence
  Description of Artificial Sequence: Synthetic oligonucleotide
gtttagctatgaaagtactatataagaccaaggatgttagaaaactctc

SEQ ID NO: 264516 - DNA, 50 bp, Artificial Sequence
  Description of Artificial Sequence: Synthetic oligonucleotide
tttagctatgaaagtactatataagaccaaggatgttagaaaactctctc

SEQ ID NO: 264517 - DNA, 49 bp, Artificial Sequence
  Description of Artificial Sequence: Synthetic oligonucleotide
ttagctatgaaagtactatataagaccaaggatgttagaaaactctctc

SEQ ID NO: 264518 - DNA, 48 bp, Artificial Sequence
  Description of Artificial Sequence: Synthetic oligonucleotide
tagctatgaaagtactatataagaccaaggatgttagaaaactctctc

SEQ ID NO: 264519 - DNA, 47 bp, Artificial Sequence
  Description of Artificial Sequence: Synthetic oligonucleotide
agctatgaaagtactatataagaccaaggatgttagaaaactctctc

SEQ ID NO: 264520 - DNA, 46 bp, Artificial Sequence
  Description of Artificial Sequence: Synthetic oligonucleotide
gctatgaaagtactatataagaccaaggatgttagaaaactctctc

SEQ ID NO: 264521 - DNA, 46 bp, Artificial Sequence
  Description of Artificial Sequence: Synthetic oligonucleotide
ctatgaaagtactatataagaccaaggatgttagaaaactctctcc

SEQ ID NO: 264522 - DNA, 47 bp, Artificial Sequence
  Description of Artificial Sequence: Synthetic oligonucleotide
tatgaaagtactatataagaccaaggatgttagaaaactctctcctg

SEQ ID NO: 264523 - DNA, 46 bp, Artificial Sequence
  Description of Artificial Sequence: Synthetic oligonucleotide
atgaaagtactatataagaccaaggatgttagaaaactctctcctg

SEQ ID NO: 264524 - DNA, 45 bp, Artificial Sequence
  Description of Artificial Sequence: Synthetic oligonucleotide
tgaaagtactatataagaccaaggatgttagaaaactctctcctg

SEQ ID NO: 264525 - DNA, 44 bp, Artificial Sequence
  Description of Artificial Sequence: Synthetic oligonucleotide
gaaagtactatataagaccaaggatgttagaaaactctctcctg

SEQ ID NO: 264526 - DNA, 49 bp, Artificial Sequence
  Description of Artificial Sequence: Synthetic oligonucleotide
aaagtactatataagaccaaggatgttagaaaactctctcctgaaaaag

SEQ ID NO: 264527 - DNA, 48 bp, Artificial Sequence
  Description of Artificial Sequence: Synthetic oligonucleotide
aagtactatataagaccaaggatgttagaaaactctctcctgaaaaag

SEQ ID NO: 264528 - DNA, 47 bp, Artificial Sequence
  Description of Artificial Sequence: Synthetic oligonucleotide
agtactatataagaccaaggatgttagaaaactctctcctgaaaaag

SEQ ID NO: 264529 - DNA, 46 bp, Artificial Sequence
  Description of Artificial Sequence: Synthetic oligonucleotide
gtactatataagaccaaggatgttagaaaactctctcctgaaaaag

SEQ ID NO: 264530 - DNA, 47 bp, Artificial Sequence
  Description of Artificial Sequence: Synthetic oligonucleotide
tactatataagaccaaggatgttagaaaactctctcctgaaaaagag

SEQ ID NO: 264531 - DNA, 46 bp, Artificial Sequence
  Description of Artificial Sequence: Synthetic oligonucleotide
actatataagaccaaggatgttagaaaactctctcctgaaaaagag

SEQ ID NO: 264532 - DNA, 45 bp, Artificial Sequence
  Description of Artificial Sequence: Synthetic oligonucleotide
ctatataagaccaaggatgttagaaaactctctcctgaaaaagag

SEQ ID NO: 264533 - DNA, 45 bp, Artificial Sequence
  Description of Artificial Sequence: Synthetic oligonucleotide
tatataagaccaaggatgttagaaaactctctcctgaaaaagagg

SEQ ID NO: 264534 - DNA, 44 bp, Artificial Sequence
  Description of Artificial Sequence: Synthetic oligonucleotide
atataagaccaaggatgttagaaaactctctcctgaaaaagagg

SEQ ID NO: 264535 - DNA, 43 bp, Artificial Sequence
  Description of Artificial Sequence: Synthetic oligonucleotide
tataagaccaaggatgttagaaaactctctcctgaaaaagagg

SEQ ID NO: 264536 - DNA, 42 bp, Artificial Sequence
  Description of Artificial Sequence: Synthetic oligonucleotide
ataagaccaaggatgttagaaaactctctcctgaaaaagagg

SEQ ID NO: 264537 - DNA, 41 bp, Artificial Sequence
  Description of Artificial Sequence: Synthetic oligonucleotide
taagaccaaggatgttagaaaactctctcctgaaaaagagg

SEQ ID NO: 264538 - DNA, 40 bp, Artificial Sequence
  Description of Artificial Sequence: Synthetic oligonucleotide
aagaccaaggatgttagaaaactctctcctgaaaaagagg

SEQ ID NO: 264539 - DNA, 39 bp, Artificial Sequence
  Description of Artificial Sequence: Synthetic oligonucleotide
agaccaaggatgttagaaaactctctcctgaaaaagagg

SEQ ID NO: 264540 - DNA, 38 bp, Artificial Sequence
  Description of Artificial Sequence: Synthetic oligonucleotide
gaccaaggatgttagaaaactctctcctgaaaaagagg

SEQ ID NO: 264541 - DNA, 43 bp, Artificial Sequence
  Description of Artificial Sequence: Synthetic oligonucleotide
accaaggatgttagaaaactctctcctgaaaaagaggaaattg

SEQ ID NO: 264542 - DNA, 42 bp, Artificial Sequence
  Description of Artificial Sequence: Synthetic oligonucleotide
ccaaggatgttagaaaactctctcctgaaaaagaggaaattg

SEQ ID NO: 264543 - DNA, 42 bp, Artificial Sequence
  Description of Artificial Sequence: Synthetic oligonucleotide
caaggatgttagaaaactctctcctgaaaaagaggaaattgc

SEQ ID NO: 264544 - DNA, 44 bp, Artificial Sequence
  Description of Artificial Sequence: Synthetic oligonucleotide
aaggatgttagaaaactctctcctgaaaaagaggaaattgctac

SEQ ID NO: 264545 - DNA, 43 bp, Artificial Sequence
  Description of Artificial Sequence: Synthetic oligonucleotide
aggatgttagaaaactctctcctgaaaaagaggaaattgctac

SEQ ID NO: 264546 - DNA, 42 bp, Artificial Sequence
  Description of Artificial Sequence: Synthetic oligonucleotide
ggatgttagaaaactctctcctgaaaaagaggaaattgctac

SEQ ID NO: 264547 - DNA, 43 bp, Artificial Sequence
  Description of Artificial Sequence: Synthetic oligonucleotide
gatgttagaaaactctctcctgaaaaagaggaaattgctacac

SEQ ID NO: 264548 - DNA, 46 bp, Artificial Sequence
  Description of Artificial Sequence: Synthetic oligonucleotide
atgttagaaaactctctcctgaaaaagaggaaattgctacactaac

SEQ ID NO: 264549 - DNA, 45 bp, Artificial Sequence
  Description of Artificial Sequence: Synthetic oligonucleotide
tgttagaaaactctctcctgaaaaagaggaaattgctacactaac

SEQ ID NO: 264550 - DNA, 44 bp, Artificial Sequence
  Description of Artificial Sequence: Synthetic oligonucleotide
gttagaaaactctctcctgaaaaagaggaaattgctacactaac

SEQ ID NO: 264551 - DNA, 46 bp, Artificial Sequence
  Description of Artificial Sequence: Synthetic oligonucleotide
ttagaaaactctctcctgaaaaagaggaaattgctacactaacatg

SEQ ID NO: 264552 - DNA, 45 bp, Artificial Sequence
  Description of Artificial Sequence: Synthetic oligonucleotide
tagaaaactctctcctgaaaaagaggaaattgctacactaacatg

SEQ ID NO: 264553 - DNA, 44 bp, Artificial Sequence
  Description of Artificial Sequence: Synthetic oligonucleotide
agaaaactctctcctgaaaaagaggaaattgctacactaacatg

SEQ ID NO: 264554 - DNA, 43 bp, Artificial Sequence
  Description of Artificial Sequence: Synthetic oligonucleotide
gaaaactctctcctgaaaaagaggaaattgctacactaacatg

SEQ ID NO: 264555 - DNA, 44 bp, Artificial Sequence
  Description of Artificial Sequence: Synthetic oligonucleotide
aaaactctctcctgaaaaagaggaaattgctacactaacatgag

SEQ ID NO: 264556 - DNA, 43 bp, Artificial Sequence
  Description of Artificial Sequence: Synthetic oligonucleotide
aaactctctcctgaaaaagaggaaattgctacactaacatgag

SEQ ID NO: 264557 - DNA, 42 bp, Artificial Sequence
  Description of Artificial Sequence: Synthetic oligonucleotide
aactctctcctgaaaaagaggaaattgctacactaacatgag

SEQ ID NO: 264558 - DNA, 41 bp, Artificial Sequence
  Description of Artificial Sequence: Synthetic oligonucleotide
actctctcctgaaaaagaggaaattgctacactaacatgag

SEQ ID NO: 264559 - DNA, 40 bp, Artificial Sequence
  Description of Artificial Sequence: Synthetic oligonucleotide
ctctctcctgaaaaagaggaaattgctacactaacatgag

SEQ ID NO: 264560 - DNA, 41 bp, Artificial Sequence
  Description of Artificial Sequence: Synthetic oligonucleotide
tctctcctgaaaaagaggaaattgctacactaacatgagag

SEQ ID NO: 264561 - DNA, 40 bp, Artificial Sequence
  Description of Artificial Sequence: Synthetic oligonucleotide
ctctcctgaaaaagaggaaattgctacactaacatgagag

SEQ ID NO: 264562 - DNA, 43 bp, Artificial Sequence
  Description of Artificial Sequence: Synthetic oligonucleotide
tctcctgaaaaagaggaaattgctacactaacatgagagaatg

SEQ ID NO: 264563 - DNA, 42 bp, Artificial Sequence
  Description of Artificial Sequence: Synthetic oligonucleotide
ctcctgaaaaagaggaaattgctacactaacatgagagaatg

SEQ ID NO: 264564 - DNA, 42 bp, Artificial Sequence
  Description of Artificial Sequence: Synthetic oligonucleotide
tcctgaaaaagaggaaattgctacactaacatgagagaatgc

SEQ ID NO: 264565 - DNA, 41 bp, Artificial Sequence
  Description of Artificial Sequence: Synthetic oligonucleotide
cctgaaaaagaggaaattgctacactaacatgagagaatgc

SEQ ID NO: 264566 - DNA, 44 bp, Artificial Sequence
  Description of Artificial Sequence: Synthetic oligonucleotide
ctgaaaaagaggaaattgctacactaacatgagagaatgcaaag

SEQ ID NO: 264567 - DNA, 45 bp, Artificial Sequence
  Description of Artificial Sequence: Synthetic oligonucleotide
tgaaaaagaggaaattgctacactaacatgagagaatgcaaagac

SEQ ID NO: 264568 - DNA, 44 bp, Artificial Sequence
  Description of Artificial Sequence: Synthetic oligonucleotide
gaaaaagaggaaattgctacactaacatgagagaatgcaaagac

SEQ ID NO: 264569 - DNA, 45 bp, Artificial Sequence
  Description of Artificial Sequence: Synthetic oligonucleotide
aaaaagaggaaattgctacactaacatgagagaatgcaaagacag

SEQ ID NO: 264570 - DNA, 44 bp, Artificial Sequence
  Description of Artificial Sequence: Synthetic oligonucleotide
aaaagaggaaattgctacactaacatgagagaatgcaaagacag

SEQ ID NO: 264571 - DNA, 43 bp, Artificial Sequence
  Description of Artificial Sequence: Synthetic oligonucleotide
aaagaggaaattgctacactaacatgagagaatgcaaagacag

SEQ ID NO: 264572 - DNA, 42 bp, Artificial Sequence
  Description of Artificial Sequence: Synthetic oligonucleotide
aagaggaaattgctacactaacatgagagaatgcaaagacag

SEQ ID NO: 264573 - DNA, 41 bp, Artificial Sequence
  Description of Artificial Sequence: Synthetic oligonucleotide
agaggaaattgctacactaacatgagagaatgcaaagacag

SEQ ID NO: 264574 - DNA, 40 bp, Artificial Sequence
  Description of Artificial Sequence: Synthetic oligonucleotide
gaggaaattgctacactaacatgagagaatgcaaagacag

SEQ ID NO: 264575 - DNA, 44 bp, Artificial Sequence
  Description of Artificial Sequence: Synthetic oligonucleotide
aggaaattgctacactaacatgagagaatgcaaagacagttatc

SEQ ID NO: 264576 - DNA, 43 bp, Artificial Sequence
  Description of Artificial Sequence: Synthetic oligonucleotide
ggaaattgctacactaacatgagagaatgcaaagacagttatc

SEQ ID NO: 264577 - DNA, 44 bp, Artificial Sequence
  Description of Artificial Sequence: Synthetic oligonucleotide
gaaattgctacactaacatgagagaatgcaaagacagttatcag

SEQ ID NO: 264578 - DNA, 45 bp, Artificial Sequence
  Description of Artificial Sequence: Synthetic oligonucleotide
aaattgctacactaacatgagagaatgcaaagacagttatcagag

SEQ ID NO: 264579 - DNA, 44 bp, Artificial Sequence
  Description of Artificial Sequence: Synthetic oligonucleotide
aattgctacactaacatgagagaatgcaaagacagttatcagag

SEQ ID NO: 264580 - DNA, 43 bp, Artificial Sequence
  Description of Artificial Sequence: Synthetic oligonucleotide
attgctacactaacatgagagaatgcaaagacagttatcagag

SEQ ID NO: 264581 - DNA, 42 bp, Artificial Sequence
  Description of Artificial Sequence: Synthetic oligonucleotide
ttgctacactaacatgagagaatgcaaagacagttatcagag

SEQ ID NO: 264582 - DNA, 41 bp, Artificial Sequence
  Description of Artificial Sequence: Synthetic oligonucleotide
tgctacactaacatgagagaatgcaaagacagttatcagag

SEQ ID NO: 264583 - DNA, 40 bp, Artificial Sequence
  Description of Artificial Sequence: Synthetic oligonucleotide
gctacactaacatgagagaatgcaaagacagttatcagag

SEQ ID NO: 264584 - DNA, 42 bp, Artificial Sequence
  Description of Artificial Sequence: Synthetic oligonucleotide
ctacactaacatgagagaatgcaaagacagttatcagagttg

SEQ ID NO: 264585 - DNA, 43 bp, Artificial Sequence
  Description of Artificial Sequence: Synthetic oligonucleotide
tacactaacatgagagaatgcaaagacagttatcagagttgtc

SEQ ID NO: 264586 - DNA, 42 bp, Artificial Sequence
  Description of Artificial Sequence: Synthetic oligonucleotide
acactaacatgagagaatgcaaagacagttatcagagttgtc

SEQ ID NO: 264587 - DNA, 41 bp, Artificial Sequence
  Description of Artificial Sequence: Synthetic oligonucleotide
cactaacatgagagaatgcaaagacagttatcagagttgtc

SEQ ID NO: 264588 - DNA, 44 bp, Artificial Sequence
  Description of Artificial Sequence: Synthetic oligonucleotide
actaacatgagagaatgcaaagacagttatcagagttgtcaaac

SEQ ID NO: 264589 - DNA, 43 bp, Artificial Sequence
  Description of Artificial Sequence: Synthetic oligonucleotide
ctaacatgagagaatgcaaagacagttatcagagttgtcaaac

SEQ ID NO: 264590 - DNA, 48 bp, Artificial Sequence
  Description of Artificial Sequence: Synthetic oligonucleotide
taacatgagagaatgcaaagacagttatcagagttgtcaaacaaatag

SEQ ID NO: 264591 - DNA, 47 bp, Artificial Sequence
  Description of Artificial Sequence: Synthetic oligonucleotide
aacatgagagaatgcaaagacagttatcagagttgtcaaacaaatag

SEQ ID NO: 264592 - DNA, 46 bp, Artificial Sequence
  Description of Artificial Sequence: Synthetic oligonucleotide
acatgagagaatgcaaagacagttatcagagttgtcaaacaaatag

SEQ ID NO: 264593 - DNA, 45 bp, Artificial Sequence
  Description of Artificial Sequence: Synthetic oligonucleotide
catgagagaatgcaaagacagttatcagagttgtcaaacaaatag

SEQ ID NO: 264594 - DNA, 47 bp, Artificial Sequence
  Description of Artificial Sequence: Synthetic oligonucleotide
atgagagaatgcaaagacagttatcagagttgtcaaacaaatagaag

SEQ ID NO: 264595 - DNA, 46 bp, Artificial Sequence
  Description of Artificial Sequence: Synthetic oligonucleotide
tgagagaatgcaaagacagttatcagagttgtcaaacaaatagaag

SEQ ID NO: 264596 - DNA, 45 bp, Artificial Sequence
  Description of Artificial Sequence: Synthetic oligonucleotide
gagagaatgcaaagacagttatcagagttgtcaaacaaatagaag

SEQ ID NO: 264597 - DNA, 46 bp, Artificial Sequence
  Description of Artificial Sequence: Synthetic oligonucleotide
agagaatgcaaagacagttatcagagttgtcaaacaaatagaagtg

SEQ ID NO: 264598 - DNA, 45 bp, Artificial Sequence
  Description of Artificial Sequence: Synthetic oligonucleotide
gagaatgcaaagacagttatcagagttgtcaaacaaatagaagtg

SEQ ID NO: 264599 - DNA, 45 bp, Artificial Sequence
  Description of Artificial Sequence: Synthetic oligonucleotide
agaatgcaaagacagttatcagagttgtcaaacaaatagaagtgg

SEQ ID NO: 264600 - DNA, 44 bp, Artificial Sequence
  Description of Artificial Sequence: Synthetic oligonucleotide
gaatgcaaagacagttatcagagttgtcaaacaaatagaagtgg

SEQ ID NO: 264601 - DNA, 45 bp, Artificial Sequence
  Description of Artificial Sequence: Synthetic oligonucleotide
aatgcaaagacagttatcagagttgtcaaacaaatagaagtggac

SEQ ID NO: 264602 - DNA, 44 bp, Artificial Sequence
  Description of Artificial Sequence: Synthetic oligonucleotide
atgcaaagacagttatcagagttgtcaaacaaatagaagtggac

SEQ ID NO: 264603 - DNA, 43 bp, Artificial Sequence
  Description of Artificial Sequence: Synthetic oligonucleotide
tgcaaagacagttatcagagttgtcaaacaaatagaagtggac

SEQ ID NO: 264604 - DNA, 42 bp, Artificial Sequence
  Description of Artificial Sequence: Synthetic oligonucleotide
gcaaagacagttatcagagttgtcaaacaaatagaagtggac

SEQ ID NO: 264605 - DNA, 42 bp, Artificial Sequence
  Description of Artificial Sequence: Synthetic oligonucleotide
caaagacagttatcagagttgtcaaacaaatagaagtggacc

SEQ ID NO: 264606 - DNA, 43 bp, Artificial Sequence
  Description of Artificial Sequence: Synthetic oligonucleotide
aaagacagttatcagagttgtcaaacaaatagaagtggaccag

SEQ ID NO: 264607 - DNA, 42 bp, Artificial Sequence
  Description of Artificial Sequence: Synthetic oligonucleotide
aagacagttatcagagttgtcaaacaaatagaagtggaccag

SEQ ID NO: 264608 - DNA, 41 bp, Artificial Sequence
  Description of Artificial Sequence: Synthetic oligonucleotide
agacagttatcagagttgtcaaacaaatagaagtggaccag

SEQ ID NO: 264609 - DNA, 40 bp, Artificial Sequence
  Description of Artificial Sequence: Synthetic oligonucleotide
gacagttatcagagttgtcaaacaaatagaagtggaccag

SEQ ID NO: 264610 - DNA, 42 bp, Artificial Sequence
  Description of Artificial Sequence: Synthetic oligonucleotide
acagttatcagagttgtcaaacaaatagaagtggaccagttg

SEQ ID NO: 264611 - DNA, 41 bp, Artificial Sequence
  Description of Artificial Sequence: Synthetic oligonucleotide
cagttatcagagttgtcaaacaaatagaagtggaccagttg

SEQ ID NO: 264612 - DNA, 43 bp, Artificial Sequence
  Description of Artificial Sequence: Synthetic oligonucleotide
agttatcagagttgtcaaacaaatagaagtggaccagttgatc

SEQ ID NO: 264613 - DNA, 42 bp, Artificial Sequence
  Description of Artificial Sequence: Synthetic oligonucleotide
gttatcagagttgtcaaacaaatagaagtggaccagttgatc

SEQ ID NO: 264614 - DNA, 48 bp, Artificial Sequence
  Description of Artificial Sequence: Synthetic oligonucleotide
ttatcagagttgtcaaacaaatagaagtggaccagttgatctaaaaac

SEQ ID NO: 264615 - DNA, 47 bp, Artificial Sequence
  Description of Artificial Sequence: Synthetic oligonucleotide
tatcagagttgtcaaacaaatagaagtggaccagttgatctaaaaac

SEQ ID NO: 264616 - DNA, 46 bp, Artificial Sequence
  Description of Artificial Sequence: Synthetic oligonucleotide
atcagagttgtcaaacaaatagaagtggaccagttgatctaaaaac

SEQ ID NO: 264617 - DNA, 45 bp, Artificial Sequence
  Description of Artificial Sequence: Synthetic oligonucleotide
tcagagttgtcaaacaaatagaagtggaccagttgatctaaaaac

SEQ ID NO: 264618 - DNA, 44 bp, Artificial Sequence
  Description of Artificial Sequence: Synthetic oligonucleotide
cagagttgtcaaacaaatagaagtggaccagttgatctaaaaac

SEQ ID NO: 264619 - DNA, 46 bp, Artificial Sequence
  Description of Artificial Sequence: Synthetic oligonucleotide
agagttgtcaaacaaatagaagtggaccagttgatctaaaaacatg

SEQ ID NO: 264620 - DNA, 45 bp, Artificial Sequence
  Description of Artificial Sequence: Synthetic oligonucleotide
gagttgtcaaacaaatagaagtggaccagttgatctaaaaacatg

SEQ ID NO: 264621 - DNA, 46 bp, Artificial Sequence
  Description of Artificial Sequence: Synthetic oligonucleotide
agttgtcaaacaaatagaagtggaccagttgatctaaaaacatgtg

SEQ ID NO: 264622 - DNA, 45 bp, Artificial Sequence
  Description of Artificial Sequence: Synthetic oligonucleotide
gttgtcaaacaaatagaagtggaccagttgatctaaaaacatgtg

SEQ ID NO: 264623 - DNA, 45 bp, Artificial Sequence
  Description of Artificial Sequence: Synthetic oligonucleotide
ttgtcaaacaaatagaagtggaccagttgatctaaaaacatgtgg

SEQ ID NO: 264624 - DNA, 44 bp, Artificial Sequence
  Description of Artificial Sequence: Synthetic oligonucleotide
tgtcaaacaaatagaagtggaccagttgatctaaaaacatgtgg

SEQ ID NO: 264625 - DNA, 43 bp, Artificial Sequence
  Description of Artificial Sequence: Synthetic oligonucleotide
gtcaaacaaatagaagtggaccagttgatctaaaaacatgtgg

SEQ ID NO: 264626 - DNA, 45 bp, Artificial Sequence
  Description of Artificial Sequence: Synthetic oligonucleotide
tcaaacaaatagaagtggaccagttgatctaaaaacatgtggaag

SEQ ID NO: 264627 - DNA, 44 bp, Artificial Sequence
  Description of Artificial Sequence: Synthetic oligonucleotide
caaacaaatagaagtggaccagttgatctaaaaacatgtggaag

SEQ ID NO: 264628 - DNA, 46 bp, Artificial Sequence
  Description of Artificial Sequence: Synthetic oligonucleotide
aaacaaatagaagtggaccagttgatctaaaaacatgtggaagaag

SEQ ID NO: 264629 - DNA, 45 bp, Artificial Sequence
  Description of Artificial Sequence: Synthetic oligonucleotide
aacaaatagaagtggaccagttgatctaaaaacatgtggaagaag

SEQ ID NO: 264630 - DNA, 44 bp, Artificial Sequence
  Description of Artificial Sequence: Synthetic oligonucleotide
acaaatagaagtggaccagttgatctaaaaacatgtggaagaag

SEQ ID NO: 264631 - DNA, 43 bp, Artificial Sequence
  Description of Artificial Sequence: Synthetic oligonucleotide
caaatagaagtggaccagttgatctaaaaacatgtggaagaag

SEQ ID NO: 264632 - DNA, 45 bp, Artificial Sequence
  Description of Artificial Sequence: Synthetic oligonucleotide
aaatagaagtggaccagttgatctaaaaacatgtggaagaagatg

SEQ ID NO: 264633 - DNA, 44 bp, Artificial Sequence
  Description of Artificial Sequence: Synthetic oligonucleotide
aatagaagtggaccagttgatctaaaaacatgtggaagaagatg

SEQ ID NO: 264634 - DNA, 43 bp, Artificial Sequence
  Description of Artificial Sequence: Synthetic oligonucleotide
atagaagtggaccagttgatctaaaaacatgtggaagaagatg

SEQ ID NO: 264635 - DNA, 42 bp, Artificial Sequence
  Description of Artificial Sequence: Synthetic oligonucleotide
tagaagtggaccagttgatctaaaaacatgtggaagaagatg

SEQ ID NO: 264636 - DNA, 41 bp, Artificial Sequence
  Description of Artificial Sequence: Synthetic oligonucleotide
agaagtggaccagttgatctaaaaacatgtggaagaagatg

SEQ ID NO: 264637 - DNA, 40 bp, Artificial Sequence
  Description of Artificial Sequence: Synthetic oligonucleotide
gaagtggaccagttgatctaaaaacatgtggaagaagatg

SEQ ID NO: 264638 - DNA, 40 bp, Artificial Sequence
  Description of Artificial Sequence: Synthetic oligonucleotide
aagtggaccagttgatctaaaaacatgtggaagaagatgc

SEQ ID NO: 264639 - DNA, 39 bp, Artificial Sequence
  Description of Artificial Sequence: Synthetic oligonucleotide
agtggaccagttgatctaaaaacatgtggaagaagatgc

SEQ ID NO: 264640 - DNA, 38 bp, Artificial Sequence
  Description of Artificial Sequence: Synthetic oligonucleotide
gtggaccagttgatctaaaaacatgtggaagaagatgc

SEQ ID NO: 264641 - DNA, 38 bp, Artificial Sequence
  Description of Artificial Sequence: Synthetic oligonucleotide
tggaccagttgatctaaaaacatgtggaagaagatgcc

SEQ ID NO: 264642 - DNA, 37 bp, Artificial Sequence
  Description of Artificial Sequence: Synthetic oligonucleotide
ggaccagttgatctaaaaacatgtggaagaagatgcc

SEQ ID NO: 264643 - DNA, 40 bp, Artificial Sequence
  Description of Artificial Sequence: Synthetic oligonucleotide
gaccagttgatctaaaaacatgtggaagaagatgccaaag

SEQ ID NO: 264644 - DNA, 40 bp, Artificial Sequence
  Description of Artificial Sequence: Synthetic oligonucleotide
accagttgatctaaaaacatgtggaagaagatgccaaagc

SEQ ID NO: 264645 - DNA, 39 bp, Artificial Sequence
  Description of Artificial Sequence: Synthetic oligonucleotide
ccagttgatctaaaaacatgtggaagaagatgccaaagc

SEQ ID NO: 264646 - DNA, 40 bp, Artificial Sequence
  Description of Artificial Sequence: Synthetic oligonucleotide
cagttgatctaaaaacatgtggaagaagatgccaaagctc

SEQ ID NO: 264647 - DNA, 41 bp, Artificial Sequence
  Description of Artificial Sequence: Synthetic oligonucleotide
agttgatctaaaaacatgtggaagaagatgccaaagctcag

SEQ ID NO: 264648 - DNA, 40 bp, Artificial Sequence
  Description of Artificial Sequence: Synthetic oligonucleotide
gttgatctaaaaacatgtggaagaagatgccaaagctcag

SEQ ID NO: 264649 - DNA, 40 bp, Artificial Sequence
  Description of Artificial Sequence: Synthetic oligonucleotide
ttgatctaaaaacatgtggaagaagatgccaaagctcagc

SEQ ID NO: 264650 - DNA, 39 bp, Artificial Sequence
  Description of Artificial Sequence: Synthetic oligonucleotide
tgatctaaaaacatgtggaagaagatgccaaagctcagc

SEQ ID NO: 264651 - DNA, 38 bp, Artificial Sequence
  Description of Artificial Sequence: Synthetic oligonucleotide
gatctaaaaacatgtggaagaagatgccaaagctcagc

SEQ ID NO: 264652 - DNA, 38 bp, Artificial Sequence
  Description of Artificial Sequence: Synthetic oligonucleotide
atctaaaaacatgtggaagaagatgccaaagctcagcg

SEQ ID NO: 264653 - DNA, 37 bp, Artificial Sequence
  Description of Artificial Sequence: Synthetic oligonucleotide
tctaaaaacatgtggaagaagatgccaaagctcagcg

SEQ ID NO: 264654 - DNA, 36 bp, Artificial Sequence
  Description of Artificial Sequence: Synthetic oligonucleotide
ctaaaaacatgtggaagaagatgccaaagctcagcg

SEQ ID NO: 264655 - DNA, 37 bp, Artificial Sequence
  Description of Artificial Sequence: Synthetic oligonucleotide
taaaaacatgtggaagaagatgccaaagctcagcgtg

SEQ ID NO: 264656 - DNA, 36 bp, Artificial Sequence
  Description of Artificial Sequence: Synthetic oligonucleotide
aaaaacatgtggaagaagatgccaaagctcagcgtg

SEQ ID NO: 264657 - DNA, 35 bp, Artificial Sequence
  Description of Artificial Sequence: Synthetic oligonucleotide
aaaacatgtggaagaagatgccaaagctcagcgtg

SEQ ID NO: 264658 - DNA, 34 bp, Artificial Sequence
  Description of Artificial Sequence: Synthetic oligonucleotide
aaacatgtggaagaagatgccaaagctcagcgtg

SEQ ID NO: 264659 - DNA, 33 bp, Artificial Sequence
  Description of Artificial Sequence: Synthetic oligonucleotide
aacatgtggaagaagatgccaaagctcagcgtg

SEQ ID NO: 264660 - DNA, 32 bp, Artificial Sequence
  Description of Artificial Sequence: Synthetic oligonucleotide
acatgtggaagaagatgccaaagctcagcgtg

SEQ ID NO: 264661 - DNA, 31 bp, Artificial Sequence
  Description of Artificial Sequence: Synthetic oligonucleotide
catgtggaagaagatgccaaagctcagcgtg

SEQ ID NO: 264662 - DNA, 32 bp, Artificial Sequence
  Description of Artificial Sequence: Synthetic oligonucleotide
atgtggaagaagatgccaaagctcagcgtgag

SEQ ID NO: 264663 - DNA, 31 bp, Artificial Sequence
  Description of Artificial Sequence: Synthetic oligonucleotide
tgtggaagaagatgccaaagctcagcgtgag

SEQ ID NO: 264664 - DNA, 30 bp, Artificial Sequence
  Description of Artificial Sequence: Synthetic oligonucleotide
gtggaagaagatgccaaagctcagcgtgag

SEQ ID NO: 264665 - DNA, 32 bp, Artificial Sequence
  Description of Artificial Sequence: Synthetic oligonucleotide
tggaagaagatgccaaagctcagcgtgagatg

SEQ ID NO: 264666 - DNA, 31 bp, Artificial Sequence
  Description of Artificial Sequence: Synthetic oligonucleotide
ggaagaagatgccaaagctcagcgtgagatg

SEQ ID NO: 264667 - DNA, 34 bp, Artificial Sequence
  Description of Artificial Sequence: Synthetic oligonucleotide
gaagaagatgccaaagctcagcgtgagatgaaag

SEQ ID NO: 264668 - DNA, 39 bp, Artificial Sequence
  Description of Artificial Sequence: Synthetic oligonucleotide
aagaagatgccaaagctcagcgtgagatgaaagaaaatg

SEQ ID NO: 264669 - DNA, 38 bp, Artificial Sequence
  Description of Artificial Sequence: Synthetic oligonucleotide
agaagatgccaaagctcagcgtgagatgaaagaaaatg

SEQ ID NO: 264670 - DNA, 37 bp, Artificial Sequence
  Description of Artificial Sequence: Synthetic oligonucleotide
gaagatgccaaagctcagcgtgagatgaaagaaaatg

SEQ ID NO: 264671 - DNA, 39 bp, Artificial Sequence
  Description of Artificial Sequence: Synthetic oligonucleotide
aagatgccaaagctcagcgtgagatgaaagaaaatgaac

SEQ ID NO: 264672 - DNA, 38 bp, Artificial Sequence
  Description of Artificial Sequence: Synthetic oligonucleotide
agatgccaaagctcagcgtgagatgaaagaaaatgaac

SEQ ID NO: 264673 - DNA, 37 bp, Artificial Sequence
  Description of Artificial Sequence: Synthetic oligonucleotide
gatgccaaagctcagcgtgagatgaaagaaaatgaac

SEQ ID NO: 264674 - DNA, 38 bp, Artificial Sequence
  Description of Artificial Sequence: Synthetic oligonucleotide
atgccaaagctcagcgtgagatgaaagaaaatgaacag

SEQ ID NO: 264675 - DNA, 37 bp, Artificial Sequence
  Description of Artificial Sequence: Synthetic oligonucleotide
tgccaaagctcagcgtgagatgaaagaaaatgaacag

SEQ ID NO: 264676 - DNA, 36 bp, Artificial Sequence
  Description of Artificial Sequence: Synthetic oligonucleotide
gccaaagctcagcgtgagatgaaagaaaatgaacag

SEQ ID NO: 264677 - DNA, 39 bp, Artificial Sequence
  Description of Artificial Sequence: Synthetic oligonucleotide
ccaaagctcagcgtgagatgaaagaaaatgaacagaaac

SEQ ID NO: 264678 - DNA, 43 bp, Artificial Sequence
  Description of Artificial Sequence: Synthetic oligonucleotide
caaagctcagcgtgagatgaaagaaaatgaacagaaacaaaag

SEQ ID NO: 264679 - DNA, 43 bp, Artificial Sequence
  Description of Artificial Sequence: Synthetic oligonucleotide
aaagctcagcgtgagatgaaagaaaatgaacagaaacaaaagg

SEQ ID NO: 264680 - DNA, 42 bp, Artificial Sequence
  Description of Artificial Sequence: Synthetic oligonucleotide
aagctcagcgtgagatgaaagaaaatgaacagaaacaaaagg

SEQ ID NO: 264681 - DNA, 41 bp, Artificial Sequence
  Description of Artificial Sequence: Synthetic oligonucleotide
agctcagcgtgagatgaaagaaaatgaacagaaacaaaagg

SEQ ID NO: 264682 - DNA, 40 bp, Artificial Sequence
  Description of Artificial Sequence: Synthetic oligonucleotide
gctcagcgtgagatgaaagaaaatgaacagaaacaaaagg

SEQ ID NO: 264683 - DNA, 47 bp, Artificial Sequence
  Description of Artificial Sequence: Synthetic oligonucleotide
ctcagcgtgagatgaaagaaaatgaacagaaacaaaaggatatatag

SEQ ID NO: 264684 - DNA, 31 bp, Artificial Sequence
  Description of Artificial Sequence: Synthetic oligonucleotide
atgtatcttacccgctctgagtaccacaggg

SEQ ID NO: 264685 - DNA, 30 bp, Artificial Sequence
  Description of Artificial Sequence: Synthetic oligonucleotide
tgtatcttacccgctctgagtaccacaggg

SEQ ID NO: 264686 - DNA, 29 bp, Artificial Sequence
  Description of Artificial Sequence: Synthetic oligonucleotide
gtatcttacccgctctgagtaccacaggg

SEQ ID NO: 264687 - DNA, 29 bp, Artificial Sequence
  Description of Artificial Sequence: Synthetic oligonucleotide
tatcttacccgctctgagtaccacagggg

SEQ ID NO: 264688 - DNA, 28 bp, Artificial Sequence
  Description of Artificial Sequence: Synthetic oligonucleotide
atcttacccgctctgagtaccacagggg

SEQ ID NO: 264689 - DNA, 27 bp, Artificial Sequence
  Description of Artificial Sequence: Synthetic oligonucleotide
tcttacccgctctgagtaccacagggg

SEQ ID NO: 264690 - DNA, 26 bp, Artificial Sequence
  Description of Artificial Sequence: Synthetic oligonucleotide
cttacccgctctgagtaccacagggg

SEQ ID NO: 264691 - DNA, 26 bp, Artificial Sequence
  Description of Artificial Sequence: Synthetic oligonucleotide
ttacccgctctgagtaccacaggggc

SEQ ID NO: 264692 - DNA, 25 bp, Artificial Sequence
  Description of Artificial Sequence: Synthetic oligonucleotide
tacccgctctgagtaccacaggggc

SEQ ID NO: 264693 - DNA, 24 bp, Artificial Sequence
  Description of Artificial Sequence: Synthetic oligonucleotide
acccgctctgagtaccacaggggc

SEQ ID NO: 264694 - DNA, 23 bp, Artificial Sequence
  Description of Artificial Sequence: Synthetic oligonucleotide
cccgctctgagtaccacaggggc

SEQ ID NO: 264695 - DNA, 24 bp, Artificial Sequence
  Description of Artificial Sequence: Synthetic oligonucleotide
ccgctctgagtaccacaggggcga

SEQ ID NO: 264696 - DNA, 27 bp, Artificial Sequence
  Description of Artificial Sequence: Synthetic oligonucleotide
cgctctgagtaccacaggggcgagaat

SEQ ID NO: 264697 - DNA, 28 bp, Artificial Sequence
  Description of Artificial Sequence: Synthetic oligonucleotide
gctctgagtaccacaggggcgagaatac

SEQ ID NO: 264698 - DNA, 33 bp, Artificial Sequence
  Description of Artificial Sequence: Synthetic oligonucleotide
ctctgagtaccacaggggcgagaatactttatc

SEQ ID NO: 264699 - DNA, 34 bp, Artificial Sequence
  Description of Artificial Sequence: Synthetic oligonucleotide
tctgagtaccacaggggcgagaatactttatctc

SEQ ID NO: 264700 - DNA, 33 bp, Artificial Sequence
  Description of Artificial Sequence: Synthetic oligonucleotide
ctgagtaccacaggggcgagaatactttatctc

SEQ ID NO: 264701 - DNA, 33 bp, Artificial Sequence
  Description of Artificial Sequence: Synthetic oligonucleotide
tgagtaccacaggggcgagaatactttatctcc

SEQ ID NO: 264702 - DNA, 32 bp, Artificial Sequence
  Description of Artificial Sequence: Synthetic oligonucleotide
gagtaccacaggggcgagaatactttatctcc

SEQ ID NO: 264703 - DNA, 32 bp, Artificial Sequence
  Description of Artificial Sequence: Synthetic oligonucleotide
agtaccacaggggcgagaatactttatctccc

SEQ ID NO: 264704 - DNA, 31 bp, Artificial Sequence
  Description of Artificial Sequence: Synthetic oligonucleotide
gtaccacaggggcgagaatactttatctccc

SEQ ID NO: 264705 - DNA, 31 bp, Artificial Sequence
  Description of Artificial Sequence: Synthetic oligonucleotide
taccacaggggcgagaatactttatctcccg

SEQ ID NO: 264706 - DNA, 30 bp, Artificial Sequence
  Description of Artificial Sequence: Synthetic oligonucleotide
accacaggggcgagaatactttatctcccg

SEQ ID NO: 264707 - DNA, 29 bp, Artificial Sequence
  Description of Artificial Sequence: Synthetic oligonucleotide
ccacaggggcgagaatactttatctcccg

SEQ ID NO: 264708 - DNA, 31 bp, Artificial Sequence
  Description of Artificial Sequence: Synthetic oligonucleotide
cacaggggcgagaatactttatctcccgaac

SEQ ID NO: 264709 - DNA, 31 bp, Artificial Sequence
  Description of Artificial Sequence: Synthetic oligonucleotide
acaggggcgagaatactttatctcccgaacg

SEQ ID NO: 264710 - DNA, 30 bp, Artificial Sequence
  Description of Artificial Sequence: Synthetic oligonucleotide
caggggcgagaatactttatctcccgaacg

SEQ ID NO: 264711 - DNA, 32 bp, Artificial Sequence
  Description of Artificial Sequence: Synthetic oligonucleotide
aggggcgagaatactttatctcccgaacgaag

SEQ ID NO: 264712 - DNA, 31 bp, Artificial Sequence
  Description of Artificial Sequence: Synthetic oligonucleotide
ggggcgagaatactttatctcccgaacgaag

SEQ ID NO: 264713 - DNA, 38 bp, Artificial Sequence
  Description of Artificial Sequence: Synthetic oligonucleotide
gggcgagaatactttatctcccgaacgaagattatatc

SEQ ID NO: 264714 - DNA, 40 bp, Artificial Sequence
  Description of Artificial Sequence: Synthetic oligonucleotide
ggcgagaatactttatctcccgaacgaagattatatcaag

SEQ ID NO: 264715 - DNA, 41 bp, Artificial Sequence
  Description of Artificial Sequence: Synthetic oligonucleotide
gcgagaatactttatctcccgaacgaagattatatcaagtg

SEQ ID NO: 264716 - DNA, 41 bp, Artificial Sequence
  Description of Artificial Sequence: Synthetic oligonucleotide
cgagaatactttatctcccgaacgaagattatatcaagtgg

SEQ ID NO: 264717 - DNA, 46 bp, Artificial Sequence
  Description of Artificial Sequence: Synthetic oligonucleotide
gagaatactttatctcccgaacgaagattatatcaagtggattatg

SEQ ID NO: 264718 - DNA, 46 bp, Artificial Sequence
  Description of Artificial Sequence: Synthetic oligonucleotide
agaatactttatctcccgaacgaagattatatcaagtggattatgc

SEQ ID NO: 264719 - DNA, 45 bp, Artificial Sequence
  Description of Artificial Sequence: Synthetic oligonucleotide
gaatactttatctcccgaacgaagattatatcaagtggattatgc

SEQ ID NO: 264720 - DNA, 45 bp, Artificial Sequence
  Description of Artificial Sequence: Synthetic oligonucleotide
aatactttatctcccgaacgaagattatatcaagtggattatgcc

SEQ ID NO: 264721 - DNA, 44 bp, Artificial Sequence
  Description of Artificial Sequence: Synthetic oligonucleotide
atactttatctcccgaacgaagattatatcaagtggattatgcc

SEQ ID NO: 264722 - DNA, 43 bp, Artificial Sequence
  Description of Artificial Sequence: Synthetic oligonucleotide
tactttatctcccgaacgaagattatatcaagtggattatgcc

SEQ ID NO: 264723 - DNA, 42 bp, Artificial Sequence
  Description of Artificial Sequence: Synthetic oligonucleotide
actttatctcccgaacgaagattatatcaagtggattatgcc

SEQ ID NO: 264724 - DNA, 41 bp, Artificial Sequence
  Description of Artificial Sequence: Synthetic oligonucleotide
ctttatctcccgaacgaagattatatcaagtggattatgcc

SEQ ID NO: 264725 - DNA, 44 bp, Artificial Sequence
  Description of Artificial Sequence: Synthetic oligonucleotide
tttatctcccgaacgaagattatatcaagtggattatgccattc

SEQ ID NO: 264726 - DNA, 43 bp, Artificial Sequence
  Description of Artificial Sequence: Synthetic oligonucleotide
ttatctcccgaacgaagattatatcaagtggattatgccattc

SEQ ID NO: 264727 - DNA, 42 bp, Artificial Sequence
  Description of Artificial Sequence: Synthetic oligonucleotide
tatctcccgaacgaagattatatcaagtggattatgccattc

SEQ ID NO: 264728 - DNA, 41 bp, Artificial Sequence
  Description of Artificial Sequence: Synthetic oligonucleotide
atctcccgaacgaagattatatcaagtggattatgccattc

SEQ ID NO: 264729 - DNA, 40 bp, Artificial Sequence
  Description of Artificial Sequence: Synthetic oligonucleotide
tctcccgaacgaagattatatcaagtggattatgccattc

SEQ ID NO: 264730 - DNA, 39 bp, Artificial Sequence
  Description of Artificial Sequence: Synthetic oligonucleotide
ctcccgaacgaagattatatcaagtggattatgccattc

SEQ ID NO: 264731 - DNA, 40 bp, Artificial Sequence
  Description of Artificial Sequence: Synthetic oligonucleotide
tcccgaacgaagattatatcaagtggattatgccattcag

SEQ ID NO: 264732 - DNA, 39 bp, Artificial Sequence
  Description of Artificial Sequence: Synthetic oligonucleotide
cccgaacgaagattatatcaagtggattatgccattcag

SEQ ID NO: 264733 - DNA, 39 bp, Artificial Sequence
  Description of Artificial Sequence: Synthetic oligonucleotide
ccgaacgaagattatatcaagtggattatgccattcagg

SEQ ID NO: 264734 - DNA, 39 bp, Artificial Sequence
  Description of Artificial Sequence: Synthetic oligonucleotide
cgaacgaagattatatcaagtggattatgccattcaggc

SEQ ID NO: 264735 - DNA, 42 bp, Artificial Sequence
  Description of Artificial Sequence: Synthetic oligonucleotide
gaacgaagattatatcaagtggattatgccattcaggctatc

SEQ ID NO: 264736 - DNA, 44 bp, Artificial Sequence
  Description of Artificial Sequence: Synthetic oligonucleotide
aacgaagattatatcaagtggattatgccattcaggctatcatg

SEQ ID NO: 264737 - DNA, 43 bp, Artificial Sequence
  Description of Artificial Sequence: Synthetic oligonucleotide
acgaagattatatcaagtggattatgccattcaggctatcatg

SEQ ID NO: 264738 - DNA, 42 bp, Artificial Sequence
  Description of Artificial Sequence: Synthetic oligonucleotide
cgaagattatatcaagtggattatgccattcaggctatcatg

SEQ ID NO: 264739 - DNA, 42 bp, Artificial Sequence
  Description of Artificial Sequence: Synthetic oligonucleotide
gaagattatatcaagtggattatgccattcaggctatcatgc

SEQ ID NO: 264740 - DNA, 44 bp, Artificial Sequence
  Description of Artificial Sequence: Synthetic oligonucleotide
aagattatatcaagtggattatgccattcaggctatcatgcttg

SEQ ID NO: 264741 - DNA, 43 bp, Artificial Sequence
  Description of Artificial Sequence: Synthetic oligonucleotide
agattatatcaagtggattatgccattcaggctatcatgcttg

SEQ ID NO: 264742 - DNA, 42 bp, Artificial Sequence
  Description of Artificial Sequence: Synthetic oligonucleotide
gattatatcaagtggattatgccattcaggctatcatgcttg

SEQ ID NO: 264743 - DNA, 42 bp, Artificial Sequence
  Description of Artificial Sequence: Synthetic oligonucleotide
attatatcaagtggattatgccattcaggctatcatgcttgg

SEQ ID NO: 264744 - DNA, 41 bp, Artificial Sequence
  Description of Artificial Sequence: Synthetic oligonucleotide
ttatatcaagtggattatgccattcaggctatcatgcttgg

SEQ ID NO: 264745 - DNA, 40 bp, Artificial Sequence
  Description of Artificial Sequence: Synthetic oligonucleotide
tatatcaagtggattatgccattcaggctatcatgcttgg

SEQ ID NO: 264746 - DNA, 39 bp, Artificial Sequence
  Description of Artificial Sequence: Synthetic oligonucleotide
atatcaagtggattatgccattcaggctatcatgcttgg

SEQ ID NO: 264747 - DNA, 38 bp, Artificial Sequence
  Description of Artificial Sequence: Synthetic oligonucleotide
tatcaagtggattatgccattcaggctatcatgcttgg

SEQ ID NO: 264748 - DNA, 37 bp, Artificial Sequence
  Description of Artificial Sequence: Synthetic oligonucleotide
atcaagtggattatgccattcaggctatcatgcttgg

SEQ ID NO: 264749 - DNA, 36 bp, Artificial Sequence
  Description of Artificial Sequence: Synthetic oligonucleotide
tcaagtggattatgccattcaggctatcatgcttgg

SEQ ID NO: 264750 - DNA, 35 bp, Artificial Sequence
  Description of Artificial Sequence: Synthetic oligonucleotide
caagtggattatgccattcaggctatcatgcttgg

SEQ ID NO: 264751 - DNA, 37 bp, Artificial Sequence
  Description of Artificial Sequence: Synthetic oligonucleotide
aagtggattatgccattcaggctatcatgcttggttc

SEQ ID NO: 264752 - DNA, 36 bp, Artificial Sequence
  Description of Artificial Sequence: Synthetic oligonucleotide
agtggattatgccattcaggctatcatgcttggttc

SEQ ID NO: 264753 - DNA, 35 bp, Artificial Sequence
  Description of Artificial Sequence: Synthetic oligonucleotide
gtggattatgccattcaggctatcatgcttggttc

SEQ ID NO: 264754 - DNA, 37 bp, Artificial Sequence
  Description of Artificial Sequence: Synthetic oligonucleotide
tggattatgccattcaggctatcatgcttggttcaac

SEQ ID NO: 264755 - DNA, 36 bp, Artificial Sequence
  Description of Artificial Sequence: Synthetic oligonucleotide
ggattatgccattcaggctatcatgcttggttcaac

SEQ ID NO: 264756 - DNA, 37 bp, Artificial Sequence
  Description of Artificial Sequence: Synthetic oligonucleotide
gattatgccattcaggctatcatgcttggttcaacag

SEQ ID NO: 264757 - DNA, 37 bp, Artificial Sequence
  Description of Artificial Sequence: Synthetic oligonucleotide
attatgccattcaggctatcatgcttggttcaacagc

SEQ ID NO: 264758 - DNA, 36 bp, Artificial Sequence
  Description of Artificial Sequence: Synthetic oligonucleotide
ttatgccattcaggctatcatgcttggttcaacagc

SEQ ID NO: 264759 - DNA, 35 bp, Artificial Sequence
  Description of Artificial Sequence: Synthetic oligonucleotide
tatgccattcaggctatcatgcttggttcaacagc

SEQ ID NO: 264760 - DNA, 34 bp, Artificial Sequence
  Description of Artificial Sequence: Synthetic oligonucleotide
atgccattcaggctatcatgcttggttcaacagc

SEQ ID NO: 264761 - DNA, 33 bp, Artificial Sequence
  Description of Artificial Sequence: Synthetic oligonucleotide
tgccattcaggctatcatgcttggttcaacagc

SEQ ID NO: 264762 - DNA, 32 bp, Artificial Sequence
  Description of Artificial Sequence: Synthetic oligonucleotide
gccattcaggctatcatgcttggttcaacagc

SEQ ID NO: 264763 - DNA, 32 bp, Artificial Sequence
  Description of Artificial Sequence: Synthetic oligonucleotide
ccattcaggctatcatgcttggttcaacagcc

SEQ ID NO: 264764 - DNA, 35 bp, Artificial Sequence
  Description of Artificial Sequence: Synthetic oligonucleotide
cattcaggctatcatgcttggttcaacagccattc

SEQ ID NO: 264765 - DNA, 35 bp, Artificial Sequence
  Description of Artificial Sequence: Synthetic oligonucleotide
attcaggctatcatgcttggttcaacagccattcg

SEQ ID NO: 264766 - DNA, 34 bp, Artificial Sequence
  Description of Artificial Sequence: Synthetic oligonucleotide
ttcaggctatcatgcttggttcaacagccattcg

SEQ ID NO: 264767 - DNA, 33 bp, Artificial Sequence
  Description of Artificial Sequence: Synthetic oligonucleotide
tcaggctatcatgcttggttcaacagccattcg

SEQ ID NO: 264768 - DNA, 32 bp, Artificial Sequence
  Description of Artificial Sequence: Synthetic oligonucleotide
caggctatcatgcttggttcaacagccattcg

SEQ ID NO: 264769 - DNA, 32 bp, Artificial Sequence
  Description of Artificial Sequence: Synthetic oligonucleotide
aggctatcatgcttggttcaacagccattcgg

SEQ ID NO: 264770 - DNA, 31 bp, Artificial Sequence
  Description of Artificial Sequence: Synthetic oligonucleotide
ggctatcatgcttggttcaacagccattcgg

SEQ ID NO: 264771 - DNA, 33 bp, Artificial Sequence
  Description of Artificial Sequence: Synthetic oligonucleotide
gctatcatgcttggttcaacagccattcggatc

SEQ ID NO: 264772 - DNA, 33 bp, Artificial Sequence
  Description of Artificial Sequence: Synthetic oligonucleotide
ctatcatgcttggttcaacagccattcggatcc

SEQ ID NO: 264773 - DNA, 34 bp, Artificial Sequence
  Description of Artificial Sequence: Synthetic oligonucleotide
tatcatgcttggttcaacagccattcggatccag

SEQ ID NO: 264774 - DNA, 33 bp, Artificial Sequence
  Description of Artificial Sequence: Synthetic oligonucleotide
atcatgcttggttcaacagccattcggatccag

SEQ ID NO: 264775 - DNA, 32 bp, Artificial Sequence
  Description of Artificial Sequence: Synthetic oligonucleotide
tcatgcttggttcaacagccattcggatccag

SEQ ID NO: 264776 - DNA, 31 bp, Artificial Sequence
  Description of Artificial Sequence: Synthetic oligonucleotide
catgcttggttcaacagccattcggatccag

SEQ ID NO: 264777 - DNA, 32 bp, Artificial Sequence
  Description of Artificial Sequence: Synthetic oligonucleotide
atgcttggttcaacagccattcggatccagag

SEQ ID NO: 264778 - DNA, 31 bp, Artificial Sequence
  Description of Artificial Sequence: Synthetic oligonucleotide
tgcttggttcaacagccattcggatccagag

SEQ ID NO: 264779 - DNA, 30 bp, Artificial Sequence
  Description of Artificial Sequence: Synthetic oligonucleotide
gcttggttcaacagccattcggatccagag

SEQ ID NO: 264780 - DNA, 32 bp, Artificial Sequence
  Description of Artificial Sequence: Synthetic oligonucleotide
cttggttcaacagccattcggatccagagatc

SEQ ID NO: 264781 - DNA, 33 bp, Artificial Sequence
  Description of Artificial Sequence: Synthetic oligonucleotide
ttggttcaacagccattcggatccagagatcag

SEQ ID NO: 264782 - DNA, 32 bp, Artificial Sequence
  Description of Artificial Sequence: Synthetic oligonucleotide
tggttcaacagccattcggatccagagatcag

SEQ ID NO: 264783 - DNA, 31 bp, Artificial Sequence
  Description of Artificial Sequence: Synthetic oligonucleotide
ggttcaacagccattcggatccagagatcag

SEQ ID NO: 264784 - DNA, 32 bp, Artificial Sequence
  Description of Artificial Sequence: Synthetic oligonucleotide
gttcaacagccattcggatccagagatcagag

SEQ ID NO: 264785 - DNA, 32 bp, Artificial Sequence
  Description of Artificial Sequence: Synthetic oligonucleotide
ttcaacagccattcggatccagagatcagagg

SEQ ID NO: 264786 - DNA, 31 bp, Artificial Sequence
  Description of Artificial Sequence: Synthetic oligonucleotide
tcaacagccattcggatccagagatcagagg

SEQ ID NO: 264787 - DNA, 30 bp, Artificial Sequence
  Description of Artificial Sequence: Synthetic oligonucleotide
caacagccattcggatccagagatcagagg

SEQ ID NO: 264788 - DNA, 30 bp, Artificial Sequence
  Description of Artificial Sequence: Synthetic oligonucleotide
aacagccattcggatccagagatcagaggg

SEQ ID NO: 264789 - DNA, 29 bp, Artificial Sequence
  Description of Artificial Sequence: Synthetic oligonucleotide
acagccattcggatccagagatcagaggg

SEQ ID NO: 264790 - DNA, 28 bp, Artificial Sequence
  Description of Artificial Sequence: Synthetic oligonucleotide
cagccattcggatccagagatcagaggg

SEQ ID NO: 264791 - DNA, 29 bp, Artificial Sequence
  Description of Artificial Sequence: Synthetic oligonucleotide
agccattcggatccagagatcagagggag

SEQ ID NO: 264792 - DNA, 28 bp, Artificial Sequence
  Description of Artificial Sequence: Synthetic oligonucleotide
gccattcggatccagagatcagagggag

SEQ ID NO: 264793 - DNA, 29 bp, Artificial Sequence
  Description of Artificial Sequence: Synthetic oligonucleotide
ccattcggatccagagatcagagggagtg

SEQ ID NO: 264794 - DNA, 30 bp, Artificial Sequence
  Description of Artificial Sequence: Synthetic oligonucleotide
cattcggatccagagatcagagggagtgtg

SEQ ID NO: 264795 - DNA, 30 bp, Artificial Sequence
  Description of Artificial Sequence: Synthetic oligonucleotide
attcggatccagagatcagagggagtgtgc

SEQ ID NO: 264796 - DNA, 29 bp, Artificial Sequence
  Description of Artificial Sequence: Synthetic oligonucleotide
ttcggatccagagatcagagggagtgtgc

SEQ ID NO: 264797 - DNA, 28 bp, Artificial Sequence
  Description of Artificial Sequence: Synthetic oligonucleotide
tcggatccagagatcagagggagtgtgc

SEQ ID NO: 264798 - DNA, 27 bp, Artificial Sequence
  Description of Artificial Sequence: Synthetic oligonucleotide
cggatccagagatcagagggagtgtgc

SEQ ID NO: 264799 - DNA, 27 bp, Artificial Sequence
  Description of Artificial Sequence: Synthetic oligonucleotide
ggatccagagatcagagggagtgtgcc

SEQ ID NO: 264800 - DNA, 29 bp, Artificial Sequence
  Description of Artificial Sequence: Synthetic oligonucleotide
gatccagagatcagagggagtgtgcctac

SEQ ID NO: 264801 - DNA, 29 bp, Artificial Sequence
  Description of Artificial Sequence: Synthetic oligonucleotide
atccagagatcagagggagtgtgcctacc

SEQ ID NO: 264802 - DNA, 28 bp, Artificial Sequence
  Description of Artificial Sequence: Synthetic oligonucleotide
tccagagatcagagggagtgtgcctacc

SEQ ID NO: 264803 - DNA, 27 bp, Artificial Sequence
  Description of Artificial Sequence: Synthetic oligonucleotide
ccagagatcagagggagtgtgcctacc

SEQ ID NO: 264804 - DNA, 28 bp, Artificial Sequence
  Description of Artificial Sequence: Synthetic oligonucleotide
cagagatcagagggagtgtgcctacctg

SEQ ID NO: 264805 - DNA, 29 bp, Artificial Sequence
  Description of Artificial Sequence: Synthetic oligonucleotide
agagatcagagggagtgtgcctacctgtg

SEQ ID NO: 264806 - DNA, 28 bp, Artificial Sequence
  Description of Artificial Sequence: Synthetic oligonucleotide
gagatcagagggagtgtgcctacctgtg

SEQ ID NO: 264807 - DNA, 28 bp, Artificial Sequence
  Description of Artificial Sequence: Synthetic oligonucleotide
agatcagagggagtgtgcctacctgtgg

SEQ ID NO: 264808 - DNA, 27 bp, Artificial Sequence
  Description of Artificial Sequence: Synthetic oligonucleotide
gatcagagggagtgtgcctacctgtgg

SEQ ID NO: 264809 - DNA, 28 bp, Artificial Sequence
  Description of Artificial Sequence: Synthetic oligonucleotide
atcagagggagtgtgcctacctgtggag

SEQ ID NO: 264810 - DNA, 27 bp, Artificial Sequence
  Description of Artificial Sequence: Synthetic oligonucleotide
tcagagggagtgtgcctacctgtggag

SEQ ID NO: 264811 - DNA, 27 bp, Artificial Sequence
  Description of Artificial Sequence: Synthetic oligonucleotide
cagagggagtgtgcctacctgtggaga

SEQ ID NO: 264812 - DNA, 28 bp, Artificial Sequence
  Description of Artificial Sequence: Synthetic oligonucleotide
agagggagtgtgcctacctgtggagatg

SEQ ID NO: 264813 - DNA, 27 bp, Artificial Sequence
  Description of Artificial Sequence: Synthetic oligonucleotide
gagggagtgtgcctacctgtggagatg

SEQ ID NO: 264814 - DNA, 28 bp, Artificial Sequence
  Description of Artificial Sequence: Synthetic oligonucleotide
agggagtgtgcctacctgtggagatgag

SEQ ID NO: 264815 - DNA, 27 bp, Artificial Sequence
  Description of Artificial Sequence: Synthetic oligonucleotide
gggagtgtgcctacctgtggagatgag

SEQ ID NO: 264816 - DNA, 32 bp, Artificial Sequence
  Description of Artificial Sequence: Synthetic oligonucleotide
ggagtgtgcctacctgtggagatgagaattac

SEQ ID NO: 264817 - DNA, 34 bp, Artificial Sequence
  Description of Artificial Sequence: Synthetic oligonucleotide
gagtgtgcctacctgtggagatgagaattacatc

SEQ ID NO: 264818 - DNA, 34 bp, Artificial Sequence
  Description of Artificial Sequence: Synthetic oligonucleotide
agtgtgcctacctgtggagatgagaattacatcc

SEQ ID NO: 264819 - DNA, 33 bp, Artificial Sequence
  Description of Artificial Sequence: Synthetic oligonucleotide
gtgtgcctacctgtggagatgagaattacatcc

SEQ ID NO: 264820 - DNA, 33 bp, Artificial Sequence
  Description of Artificial Sequence: Synthetic oligonucleotide
tgtgcctacctgtggagatgagaattacatccc

SEQ ID NO: 264821 - DNA, 32 bp, Artificial Sequence
  Description of Artificial Sequence: Synthetic oligonucleotide
gtgcctacctgtggagatgagaattacatccc

SEQ ID NO: 264822 - DNA, 32 bp, Artificial Sequence
  Description of Artificial Sequence: Synthetic oligonucleotide
tgcctacctgtggagatgagaattacatcccc

SEQ ID NO: 264823 - DNA, 31 bp, Artificial Sequence
  Description of Artificial Sequence: Synthetic oligonucleotide
gcctacctgtggagatgagaattacatcccc

SEQ ID NO: 264824 - DNA, 32 bp, Artificial Sequence
  Description of Artificial Sequence: Synthetic oligonucleotide
cctacctgtggagatgagaattacatccccac

SEQ ID NO: 264825 - DNA, 33 bp, Artificial Sequence
  Description of Artificial Sequence: Synthetic oligonucleotide
ctacctgtggagatgagaattacatccccactg

SEQ ID NO: 264826 - DNA, 35 bp, Artificial Sequence
  Description of Artificial Sequence: Synthetic oligonucleotide
tacctgtggagatgagaattacatccccactgttg

SEQ ID NO: 264827 - DNA, 34 bp, Artificial Sequence
  Description of Artificial Sequence: Synthetic oligonucleotide
acctgtggagatgagaattacatccccactgttg

SEQ ID NO: 264828 - DNA, 33 bp, Artificial Sequence
  Description of Artificial Sequence: Synthetic oligonucleotide
cctgtggagatgagaattacatccccactgttg

SEQ ID NO: 264829 - DNA, 33 bp, Artificial Sequence
  Description of Artificial Sequence: Synthetic oligonucleotide
ctgtggagatgagaattacatccccactgttgg

SEQ ID NO: 264830 - DNA, 34 bp, Artificial Sequence
  Description of Artificial Sequence: Synthetic oligonucleotide
tgtggagatgagaattacatccccactgttggag

SEQ ID NO: 264831 - DNA, 33 bp, Artificial Sequence
  Description of Artificial Sequence: Synthetic oligonucleotide
gtggagatgagaattacatccccactgttggag

SEQ ID NO: 264832 - DNA, 33 bp, Artificial Sequence
  Description of Artificial Sequence: Synthetic oligonucleotide
tggagatgagaattacatccccactgttggagc

SEQ ID NO: 264833 - DNA, 32 bp, Artificial Sequence
  Description of Artificial Sequence: Synthetic oligonucleotide
ggagatgagaattacatccccactgttggagc

SEQ ID NO: 264834 - DNA, 32 bp, Artificial Sequence
  Description of Artificial Sequence: Synthetic oligonucleotide
gagatgagaattacatccccactgttggagcc

SEQ ID NO: 264835 - DNA, 32 bp, Artificial Sequence
  Description of Artificial Sequence: Synthetic oligonucleotide
agatgagaattacatccccactgttggagccc

SEQ ID NO: 264836 - DNA, 31 bp, Artificial Sequence
  Description of Artificial Sequence: Synthetic oligonucleotide
gatgagaattacatccccactgttggagccc

SEQ ID NO: 264837 - DNA, 32 bp, Artificial Sequence
  Description of Artificial Sequence: Synthetic oligonucleotide
atgagaattacatccccactgttggagcccac

SEQ ID NO: 264838 - DNA, 31 bp, Artificial Sequence
  Description of Artificial Sequence: Synthetic oligonucleotide
tgagaattacatccccactgttggagcccac

SEQ ID NO: 264839 - DNA, 30 bp, Artificial Sequence
  Description of Artificial Sequence: Synthetic oligonucleotide
gagaattacatccccactgttggagcccac

SEQ ID NO: 264840 - DNA, 30 bp, Artificial Sequence
  Description of Artificial Sequence: Synthetic oligonucleotide
agaattacatccccactgttggagcccacc

SEQ ID NO: 264841 - DNA, 29 bp, Artificial Sequence
  Description of Artificial Sequence: Synthetic oligonucleotide
gaattacatccccactgttggagcccacc

SEQ ID NO: 264842 - DNA, 30 bp, Artificial Sequence
  Description of Artificial Sequence: Synthetic oligonucleotide
aattacatccccactgttggagcccaccag

SEQ ID NO: 264843 - DNA, 29 bp, Artificial Sequence
  Description of Artificial Sequence: Synthetic oligonucleotide
attacatccccactgttggagcccaccag

SEQ ID NO: 264844 - DNA, 28 bp, Artificial Sequence
  Description of Artificial Sequence: Synthetic oligonucleotide
ttacatccccactgttggagcccaccag

SEQ ID NO: 264845 - DNA, 27 bp, Artificial Sequence
  Description of Artificial Sequence: Synthetic oligonucleotide
tacatccccactgttggagcccaccag

SEQ ID NO: 264846 - DNA, 26 bp, Artificial Sequence
  Description of Artificial Sequence: Synthetic oligonucleotide
acatccccactgttggagcccaccag

SEQ ID NO: 264847 - DNA, 25 bp, Artificial Sequence
  Description of Artificial Sequence: Synthetic oligonucleotide
catccccactgttggagcccaccag

SEQ ID NO: 264848 - DNA, 27 bp, Artificial Sequence
  Description of Artificial Sequence: Synthetic oligonucleotide
atccccactgttggagcccaccagcat

SEQ ID NO: 264849 - DNA, 27 bp, Artificial Sequence
  Description of Artificial Sequence: Synthetic oligonucleotide
tccccactgttggagcccaccagcatt

SEQ ID NO: 264850 - DNA, 26 bp, Artificial Sequence
  Description of Artificial Sequence: Synthetic oligonucleotide
ccccactgttggagcccaccagcatt

SEQ ID NO: 264851 - DNA, 27 bp, Artificial Sequence
  Description of Artificial Sequence: Synthetic oligonucleotide
cccactgttggagcccaccagcattga

SEQ ID NO: 264852 - DNA, 27 bp, Artificial Sequence
  Description of Artificial Sequence: Synthetic oligonucleotide
ccactgttggagcccaccagcattgac

SEQ ID NO: 264853 - DNA, 33 bp, Artificial Sequence
  Description of Artificial Sequence: Synthetic oligonucleotide
cactgttggagcccaccagcattgacaaaattg

SEQ ID NO: 264854 - DNA, 35 bp, Artificial Sequence
  Description of Artificial Sequence: Synthetic oligonucleotide
actgttggagcccaccagcattgacaaaattgtac

SEQ ID NO: 264855 - DNA, 34 bp, Artificial Sequence
  Description of Artificial Sequence: Synthetic oligonucleotide
ctgttggagcccaccagcattgacaaaattgtac

SEQ ID NO: 264856 - DNA, 35 bp, Artificial Sequence
  Description of Artificial Sequence: Synthetic oligonucleotide
tgttggagcccaccagcattgacaaaattgtacag

SEQ ID NO: 264857 - DNA, 34 bp, Artificial Sequence
  Description of Artificial Sequence: Synthetic oligonucleotide
gttggagcccaccagcattgacaaaattgtacag

SEQ ID NO: 264858 - DNA, 37 bp, Artificial Sequence
  Description of Artificial Sequence: Synthetic oligonucleotide
ttggagcccaccagcattgacaaaattgtacagattg

SEQ ID NO: 264859 - DNA, 36 bp, Artificial Sequence
  Description of Artificial Sequence: Synthetic oligonucleotide
tggagcccaccagcattgacaaaattgtacagattg

SEQ ID NO: 264860 - DNA, 35 bp, Artificial Sequence
  Description of Artificial Sequence: Synthetic oligonucleotide
ggagcccaccagcattgacaaaattgtacagattg

SEQ ID NO: 264861 - DNA, 37 bp, Artificial Sequence
  Description of Artificial Sequence: Synthetic oligonucleotide
gagcccaccagcattgacaaaattgtacagattgatg

SEQ ID NO: 264862 - DNA, 37 bp, Artificial Sequence
  Description of Artificial Sequence: Synthetic oligonucleotide
agcccaccagcattgacaaaattgtacagattgatgg

SEQ ID NO: 264863 - DNA, 36 bp, Artificial Sequence
  Description of Artificial Sequence: Synthetic oligonucleotide
gcccaccagcattgacaaaattgtacagattgatgg

SEQ ID NO: 264864 - DNA, 37 bp, Artificial Sequence
  Description of Artificial Sequence: Synthetic oligonucleotide
cccaccagcattgacaaaattgtacagattgatggtc

SEQ ID NO: 264865 - DNA, 38 bp, Artificial Sequence
  Description of Artificial Sequence: Synthetic oligonucleotide
ccaccagcattgacaaaattgtacagattgatggtcac

SEQ ID NO: 264866 - DNA, 41 bp, Artificial Sequence
  Description of Artificial Sequence: Synthetic oligonucleotide
caccagcattgacaaaattgtacagattgatggtcacatag

SEQ ID NO: 264867 - DNA, 41 bp, Artificial Sequence
  Description of Artificial Sequence: Synthetic oligonucleotide
accagcattgacaaaattgtacagattgatggtcacatagg

SEQ ID NO: 264868 - DNA, 40 bp, Artificial Sequence
  Description of Artificial Sequence: Synthetic oligonucleotide
ccagcattgacaaaattgtacagattgatggtcacatagg

SEQ ID NO: 264869 - DNA, 42 bp, Artificial Sequence
  Description of Artificial Sequence: Synthetic oligonucleotide
cagcattgacaaaattgtacagattgatggtcacataggatg

SEQ ID NO: 264870 - DNA, 43 bp, Artificial Sequence
  Description of Artificial Sequence: Synthetic oligonucleotide
agcattgacaaaattgtacagattgatggtcacataggatgtg

SEQ ID NO: 264871 - DNA, 42 bp, Artificial Sequence
  Description of Artificial Sequence: Synthetic oligonucleotide
gcattgacaaaattgtacagattgatggtcacataggatgtg

SEQ ID NO: 264872 - DNA, 42 bp, Artificial Sequence
  Description of Artificial Sequence: Synthetic oligonucleotide
cattgacaaaattgtacagattgatggtcacataggatgtgc

SEQ ID NO: 264873 - DNA, 42 bp, Artificial Sequence
  Description of Artificial Sequence: Synthetic oligonucleotide
attgacaaaattgtacagattgatggtcacataggatgtgcc

SEQ ID NO: 264874 - DNA, 41 bp, Artificial Sequence
  Description of Artificial Sequence: Synthetic oligonucleotide
ttgacaaaattgtacagattgatggtcacataggatgtgcc

SEQ ID NO: 264875 - DNA, 40 bp, Artificial Sequence
  Description of Artificial Sequence: Synthetic oligonucleotide
tgacaaaattgtacagattgatggtcacataggatgtgcc

SEQ ID NO: 264876 - DNA, 39 bp, Artificial Sequence
  Description of Artificial Sequence: Synthetic oligonucleotide
gacaaaattgtacagattgatggtcacataggatgtgcc

SEQ ID NO: 264877 - DNA, 41 bp, Artificial Sequence
  Description of Artificial Sequence: Synthetic oligonucleotide
acaaaattgtacagattgatggtcacataggatgtgccatg

SEQ ID NO: 264878 - DNA, 40 bp, Artificial Sequence
  Description of Artificial Sequence: Synthetic oligonucleotide
caaaattgtacagattgatggtcacataggatgtgccatg

SEQ ID NO: 264879 - DNA, 41 bp, Artificial Sequence
  Description of Artificial Sequence: Synthetic oligonucleotide
aaaattgtacagattgatggtcacataggatgtgccatgtg

SEQ ID NO: 264880 - DNA, 40 bp, Artificial Sequence
  Description of Artificial Sequence: Synthetic oligonucleotide
aaattgtacagattgatggtcacataggatgtgccatgtg

SEQ ID NO: 264881 - DNA, 39 bp, Artificial Sequence
  Description of Artificial Sequence: Synthetic oligonucleotide
aattgtacagattgatggtcacataggatgtgccatgtg

SEQ ID NO: 264882 - DNA, 38 bp, Artificial Sequence
  Description of Artificial Sequence: Synthetic oligonucleotide
attgtacagattgatggtcacataggatgtgccatgtg

SEQ ID NO: 264883 - DNA, 37 bp, Artificial Sequence
  Description of Artificial Sequence: Synthetic oligonucleotide
ttgtacagattgatggtcacataggatgtgccatgtg

SEQ ID NO: 264884 - DNA, 36 bp, Artificial Sequence
  Description of Artificial Sequence: Synthetic oligonucleotide
tgtacagattgatggtcacataggatgtgccatgtg

SEQ ID NO: 264885 - DNA, 35 bp, Artificial Sequence
  Description of Artificial Sequence: Synthetic oligonucleotide
gtacagattgatggtcacataggatgtgccatgtg

SEQ ID NO: 264886 - DNA, 36 bp, Artificial Sequence
  Description of Artificial Sequence: Synthetic oligonucleotide
tacagattgatggtcacataggatgtgccatgtgtg

SEQ ID NO: 264887 - DNA, 35 bp, Artificial Sequence
  Description of Artificial Sequence: Synthetic oligonucleotide
acagattgatggtcacataggatgtgccatgtgtg

SEQ ID NO: 264888 - DNA, 34 bp, Artificial Sequence
  Description of Artificial Sequence: Synthetic oligonucleotide
cagattgatggtcacataggatgtgccatgtgtg

SEQ ID NO: 264889 - DNA, 34 bp, Artificial Sequence
  Description of Artificial Sequence: Synthetic oligonucleotide
agattgatggtcacataggatgtgccatgtgtgg

SEQ ID NO: 264890 - DNA, 33 bp, Artificial Sequence
  Description of Artificial Sequence: Synthetic oligonucleotide
gattgatggtcacataggatgtgccatgtgtgg

SEQ ID NO: 264891 - DNA, 33 bp, Artificial Sequence
  Description of Artificial Sequence: Synthetic oligonucleotide
attgatggtcacataggatgtgccatgtgtggg

SEQ ID NO: 264892 - DNA, 32 bp, Artificial Sequence
  Description of Artificial Sequence: Synthetic oligonucleotide
ttgatggtcacataggatgtgccatgtgtggg

SEQ ID NO: 264893 - DNA, 31 bp, Artificial Sequence
  Description of Artificial Sequence: Synthetic oligonucleotide
tgatggtcacataggatgtgccatgtgtggg

SEQ ID NO: 264894 - DNA, 30 bp, Artificial Sequence
  Description of Artificial Sequence: Synthetic oligonucleotide
gatggtcacataggatgtgccatgtgtggg

SEQ ID NO: 264895 - DNA, 30 bp, Artificial Sequence
  Description of Artificial Sequence: Synthetic oligonucleotide
atggtcacataggatgtgccatgtgtgggc

SEQ ID NO: 264896 - DNA, 29 bp, Artificial Sequence
  Description of Artificial Sequence: Synthetic oligonucleotide
tggtcacataggatgtgccatgtgtgggc

SEQ ID NO: 264897 - DNA, 28 bp, Artificial Sequence
  Description of Artificial Sequence: Synthetic oligonucleotide
ggtcacataggatgtgccatgtgtgggc

SEQ ID NO: 264898 - DNA, 33 bp, Artificial Sequence
  Description of Artificial Sequence: Synthetic oligonucleotide
gtcacataggatgtgccatgtgtgggctaaatg

SEQ ID NO: 264899 - DNA, 33 bp, Artificial Sequence
  Description of Artificial Sequence: Synthetic oligonucleotide
tcacataggatgtgccatgtgtgggctaaatgc

SEQ ID NO: 264900 - DNA, 32 bp, Artificial Sequence
  Description of Artificial Sequence: Synthetic oligonucleotide
cacataggatgtgccatgtgtgggctaaatgc

SEQ ID NO: 264901 - DNA, 33 bp, Artificial Sequence
  Description of Artificial Sequence: Synthetic oligonucleotide
acataggatgtgccatgtgtgggctaaatgctg

SEQ ID NO: 264902 - DNA, 32 bp, Artificial Sequence
  Description of Artificial Sequence: Synthetic oligonucleotide
cataggatgtgccatgtgtgggctaaatgctg

SEQ ID NO: 264903 - DNA, 34 bp, Artificial Sequence
  Description of Artificial Sequence: Synthetic oligonucleotide
ataggatgtgccatgtgtgggctaaatgctgatg

SEQ ID NO: 264904 - DNA, 33 bp, Artificial Sequence
  Description of Artificial Sequence: Synthetic oligonucleotide
taggatgtgccatgtgtgggctaaatgctgatg

SEQ ID NO: 264905 - DNA, 32 bp, Artificial Sequence
  Description of Artificial Sequence: Synthetic oligonucleotide
aggatgtgccatgtgtgggctaaatgctgatg

SEQ ID NO: 264906 - DNA, 31 bp, Artificial Sequence
  Description of Artificial Sequence: Synthetic oligonucleotide
ggatgtgccatgtgtgggctaaatgctgatg

SEQ ID NO: 264907 - DNA, 31 bp, Artificial Sequence
  Description of Artificial Sequence: Synthetic oligonucleotide
gatgtgccatgtgtgggctaaatgctgatgc

SEQ ID NO: 264908 - DNA, 34 bp, Artificial Sequence
  Description of Artificial Sequence: Synthetic oligonucleotide
atgtgccatgtgtgggctaaatgctgatgcaaag

SEQ ID NO: 264909 - DNA, 33 bp, Artificial Sequence
  Description of Artificial Sequence: Synthetic oligonucleotide
tgtgccatgtgtgggctaaatgctgatgcaaag

SEQ ID NO: 264910 - DNA, 32 bp, Artificial Sequence
  Description of Artificial Sequence: Synthetic oligonucleotide
gtgccatgtgtgggctaaatgctgatgcaaag

SEQ ID NO: 264911 - DNA, 33 bp, Artificial Sequence
  Description of Artificial Sequence: Synthetic oligonucleotide
tgccatgtgtgggctaaatgctgatgcaaagac

SEQ ID NO: 264912 - DNA, 32 bp, Artificial Sequence
  Description of Artificial Sequence: Synthetic oligonucleotide
gccatgtgtgggctaaatgctgatgcaaagac

SEQ ID NO: 264913 - DNA, 39 bp, Artificial Sequence
  Description of Artificial Sequence: Synthetic oligonucleotide
ccatgtgtgggctaaatgctgatgcaaagactttatttg

SEQ ID NO: 264914 - DNA, 44 bp, Artificial Sequence
  Description of Artificial Sequence: Synthetic oligonucleotide
catgtgtgggctaaatgctgatgcaaagactttatttgataaag

SEQ ID NO: 264915 - DNA, 44 bp, Artificial Sequence
  Description of Artificial Sequence: Synthetic oligonucleotide
atgtgtgggctaaatgctgatgcaaagactttatttgataaagg

SEQ ID NO: 264916 - DNA, 43 bp, Artificial Sequence
  Description of Artificial Sequence: Synthetic oligonucleotide
tgtgtgggctaaatgctgatgcaaagactttatttgataaagg

SEQ ID NO: 264917 - DNA, 42 bp, Artificial Sequence
  Description of Artificial Sequence: Synthetic oligonucleotide
gtgtgggctaaatgctgatgcaaagactttatttgataaagg

SEQ ID NO: 264918 - DNA, 42 bp, Artificial Sequence
  Description of Artificial Sequence: Synthetic oligonucleotide
tgtgggctaaatgctgatgcaaagactttatttgataaaggc

SEQ ID NO: 264919 - DNA, 41 bp, Artificial Sequence
  Description of Artificial Sequence: Synthetic oligonucleotide
gtgggctaaatgctgatgcaaagactttatttgataaaggc

SEQ ID NO: 264920 - DNA, 42 bp, Artificial Sequence
  Description of Artificial Sequence: Synthetic oligonucleotide
tgggctaaatgctgatgcaaagactttatttgataaaggcag

SEQ ID NO: 264921 - DNA, 41 bp, Artificial Sequence
  Description of Artificial Sequence: Synthetic oligonucleotide
gggctaaatgctgatgcaaagactttatttgataaaggcag

SEQ ID NO: 264922 - DNA, 42 bp, Artificial Sequence
  Description of Artificial Sequence: Synthetic oligonucleotide
ggctaaatgctgatgcaaagactttatttgataaaggcagag

SEQ ID NO: 264923 - DNA, 43 bp, Artificial Sequence
  Description of Artificial Sequence: Synthetic oligonucleotide
gctaaatgctgatgcaaagactttatttgataaaggcagagtg

SEQ ID NO: 264924 - DNA, 43 bp, Artificial Sequence
  Description of Artificial Sequence: Synthetic oligonucleotide
ctaaatgctgatgcaaagactttatttgataaaggcagagtgg

SEQ ID NO: 264925 - DNA, 44 bp, Artificial Sequence
  Description of Artificial Sequence: Synthetic oligonucleotide
taaatgctgatgcaaagactttatttgataaaggcagagtggac

SEQ ID NO: 264926 - DNA, 43 bp, Artificial Sequence
  Description of Artificial Sequence: Synthetic oligonucleotide
aaatgctgatgcaaagactttatttgataaaggcagagtggac

SEQ ID NO: 264927 - DNA, 42 bp, Artificial Sequence
  Description of Artificial Sequence: Synthetic oligonucleotide
aatgctgatgcaaagactttatttgataaaggcagagtggac

SEQ ID NO: 264928 - DNA, 41 bp, Artificial Sequence
  Description of Artificial Sequence: Synthetic oligonucleotide
atgctgatgcaaagactttatttgataaaggcagagtggac

SEQ ID NO: 264929 - DNA, 40 bp, Artificial Sequence
  Description of Artificial Sequence: Synthetic oligonucleotide
tgctgatgcaaagactttatttgataaaggcagagtggac

SEQ ID NO: 264930 - DNA, 39 bp, Artificial Sequence
  Description of Artificial Sequence: Synthetic oligonucleotide
gctgatgcaaagactttatttgataaaggcagagtggac

SEQ ID NO: 264931 - DNA, 40 bp, Artificial Sequence
  Description of Artificial Sequence: Synthetic oligonucleotide
ctgatgcaaagactttatttgataaaggcagagtggacac

SEQ ID NO: 264932 - DNA, 41 bp, Artificial Sequence
  Description of Artificial Sequence: Synthetic oligonucleotide
tgatgcaaagactttatttgataaaggcagagtggacacac

SEQ ID NO: 264933 - DNA, 40 bp, Artificial Sequence
  Description of Artificial Sequence: Synthetic oligonucleotide
gatgcaaagactttatttgataaaggcagagtggacacac

SEQ ID NO: 264934 - DNA, 41 bp, Artificial Sequence
  Description of Artificial Sequence: Synthetic oligonucleotide
atgcaaagactttatttgataaaggcagagtggacacacag

SEQ ID NO: 264935 - DNA, 40 bp, Artificial Sequence
  Description of Artificial Sequence: Synthetic oligonucleotide
tgcaaagactttatttgataaaggcagagtggacacacag

SEQ ID NO: 264936 - DNA, 39 bp, Artificial Sequence
  Description of Artificial Sequence: Synthetic oligonucleotide
gcaaagactttatttgataaaggcagagtggacacacag

SEQ ID NO: 264937 - DNA, 41 bp, Artificial Sequence
  Description of Artificial Sequence: Synthetic oligonucleotide
caaagactttatttgataaaggcagagtggacacacagaac

SEQ ID NO: 264938 - DNA, 41 bp, Artificial Sequence
  Description of Artificial Sequence: Synthetic oligonucleotide
aaagactttatttgataaaggcagagtggacacacagaacg

SEQ ID NO: 264939 - DNA, 40 bp, Artificial Sequence
  Description of Artificial Sequence: Synthetic oligonucleotide
aagactttatttgataaaggcagagtggacacacagaacg

SEQ ID NO: 264940 - DNA, 39 bp, Artificial Sequence
  Description of Artificial Sequence: Synthetic oligonucleotide
agactttatttgataaaggcagagtggacacacagaacg

SEQ ID NO: 264941 - DNA, 38 bp, Artificial Sequence
  Description of Artificial Sequence: Synthetic oligonucleotide
gactttatttgataaaggcagagtggacacacagaacg

SEQ ID NO: 264942 - DNA, 39 bp, Artificial Sequence
  Description of Artificial Sequence: Synthetic oligonucleotide
actttatttgataaaggcagagtggacacacagaacgac

SEQ ID NO: 264943 - DNA, 38 bp, Artificial Sequence
  Description of Artificial Sequence: Synthetic oligonucleotide
ctttatttgataaaggcagagtggacacacagaacgac

SEQ ID NO: 264944 - DNA, 39 bp, Artificial Sequence
  Description of Artificial Sequence: Synthetic oligonucleotide
tttatttgataaaggcagagtggacacacagaacgactg

SEQ ID NO: 264945 - DNA, 38 bp, Artificial Sequence
  Description of Artificial Sequence: Synthetic oligonucleotide
ttatttgataaaggcagagtggacacacagaacgactg

SEQ ID NO: 264946 - DNA, 37 bp, Artificial Sequence
  Description of Artificial Sequence: Synthetic oligonucleotide
tatttgataaaggcagagtggacacacagaacgactg

SEQ ID NO: 264947 - DNA, 36 bp, Artificial Sequence
  Description of Artificial Sequence: Synthetic oligonucleotide
atttgataaaggcagagtggacacacagaacgactg

SEQ ID NO: 264948 - DNA, 35 bp, Artificial Sequence
  Description of Artificial Sequence: Synthetic oligonucleotide
tttgataaaggcagagtggacacacagaacgactg

SEQ ID NO: 264949 - DNA, 34 bp, Artificial Sequence
  Description of Artificial Sequence: Synthetic oligonucleotide
ttgataaaggcagagtggacacacagaacgactg

SEQ ID NO: 264950 - DNA, 33 bp, Artificial Sequence
  Description of Artificial Sequence: Synthetic oligonucleotide
tgataaaggcagagtggacacacagaacgactg

SEQ ID NO: 264951 - DNA, 32 bp, Artificial Sequence
  Description of Artificial Sequence: Synthetic oligonucleotide
gataaaggcagagtggacacacagaacgactg

SEQ ID NO: 264952 - DNA, 32 bp, Artificial Sequence
  Description of Artificial Sequence: Synthetic oligonucleotide
ataaaggcagagtggacacacagaacgactgg

SEQ ID NO: 264953 - DNA, 31 bp, Artificial Sequence
  Description of Artificial Sequence: Synthetic oligonucleotide
taaaggcagagtggacacacagaacgactgg

SEQ ID NO: 264954 - DNA, 30 bp, Artificial Sequence
  Description of Artificial Sequence: Synthetic oligonucleotide
aaaggcagagtggacacacagaacgactgg

SEQ ID NO: 264955 - DNA, 29 bp, Artificial Sequence
  Description of Artificial Sequence: Synthetic oligonucleotide
aaggcagagtggacacacagaacgactgg

SEQ ID NO: 264956 - DNA, 28 bp, Artificial Sequence
  Description of Artificial Sequence: Synthetic oligonucleotide
aggcagagtggacacacagaacgactgg

SEQ ID NO: 264957 - DNA, 27 bp, Artificial Sequence
  Description of Artificial Sequence: Synthetic oligonucleotide
ggcagagtggacacacagaacgactgg

SEQ ID NO: 264958 - DNA, 29 bp, Artificial Sequence
  Description of Artificial Sequence: Synthetic oligonucleotide
gcagagtggacacacagaacgactggttc

SEQ ID NO: 264959 - DNA, 30 bp, Artificial Sequence
  Description of Artificial Sequence: Synthetic oligonucleotide
cagagtggacacacagaacgactggttcag

SEQ ID NO: 264960 - DNA, 30 bp, Artificial Sequence
  Description of Artificial Sequence: Synthetic oligonucleotide
agagtggacacacagaacgactggttcagc

SEQ ID NO: 264961 - DNA, 29 bp, Artificial Sequence
  Description of Artificial Sequence: Synthetic oligonucleotide
gagtggacacacagaacgactggttcagc

SEQ ID NO: 264962 - DNA, 31 bp, Artificial Sequence
  Description of Artificial Sequence: Synthetic oligonucleotide
agtggacacacagaacgactggttcagctac

SEQ ID NO: 264963 - DNA, 30 bp, Artificial Sequence
  Description of Artificial Sequence: Synthetic oligonucleotide
gtggacacacagaacgactggttcagctac

SEQ ID NO: 264964 - DNA, 33 bp, Artificial Sequence
  Description of Artificial Sequence: Synthetic oligonucleotide
tggacacacagaacgactggttcagctacaatg

SEQ ID NO: 264965 - DNA, 32 bp, Artificial Sequence
  Description of Artificial Sequence: Synthetic oligonucleotide
ggacacacagaacgactggttcagctacaatg

SEQ ID NO: 264966 - DNA, 33 bp, Artificial Sequence
  Description of Artificial Sequence: Synthetic oligonucleotide
gacacacagaacgactggttcagctacaatgac

SEQ ID NO: 264967 - DNA, 34 bp, Artificial Sequence
  Description of Artificial Sequence: Synthetic oligonucleotide
acacacagaacgactggttcagctacaatgacac

SEQ ID NO: 264968 - DNA, 33 bp, Artificial Sequence
  Description of Artificial Sequence: Synthetic oligonucleotide
cacacagaacgactggttcagctacaatgacac

SEQ ID NO: 264969 - DNA, 36 bp, Artificial Sequence
  Description of Artificial Sequence: Synthetic oligonucleotide
acacagaacgactggttcagctacaatgacacaatg

SEQ ID NO: 264970 - DNA, 35 bp, Artificial Sequence
  Description of Artificial Sequence: Synthetic oligonucleotide
cacagaacgactggttcagctacaatgacacaatg

SEQ ID NO: 264971 - DNA, 36 bp, Artificial Sequence
  Description of Artificial Sequence: Synthetic oligonucleotide
acagaacgactggttcagctacaatgacacaatgac

SEQ ID NO: 264972 - DNA, 35 bp, Artificial Sequence
  Description of Artificial Sequence: Synthetic oligonucleotide
cagaacgactggttcagctacaatgacacaatgac

SEQ ID NO: 264973 - DNA, 36 bp, Artificial Sequence
  Description of Artificial Sequence: Synthetic oligonucleotide
agaacgactggttcagctacaatgacacaatgacac

SEQ ID NO: 264974 - DNA, 35 bp, Artificial Sequence
  Description of Artificial Sequence: Synthetic oligonucleotide
gaacgactggttcagctacaatgacacaatgacac

SEQ ID NO: 264975 - DNA, 36 bp, Artificial Sequence
  Description of Artificial Sequence: Synthetic oligonucleotide
aacgactggttcagctacaatgacacaatgacactg

SEQ ID NO: 264976 - DNA, 35 bp, Artificial Sequence
  Description of Artificial Sequence: Synthetic oligonucleotide
acgactggttcagctacaatgacacaatgacactg

SEQ ID NO: 264977 - DNA, 34 bp, Artificial Sequence
  Description of Artificial Sequence: Synthetic oligonucleotide
cgactggttcagctacaatgacacaatgacactg

SEQ ID NO: 264978 - DNA, 34 bp, Artificial Sequence
  Description of Artificial Sequence: Synthetic oligonucleotide
gactggttcagctacaatgacacaatgacactgg

SEQ ID NO: 264979 - DNA, 35 bp, Artificial Sequence
  Description of Artificial Sequence: Synthetic oligonucleotide
actggttcagctacaatgacacaatgacactggag

SEQ ID NO: 264980 - DNA, 34 bp, Artificial Sequence
  Description of Artificial Sequence: Synthetic oligonucleotide
ctggttcagctacaatgacacaatgacactggag

SEQ ID NO: 264981 - DNA, 35 bp, Artificial Sequence
  Description of Artificial Sequence: Synthetic oligonucleotide
tggttcagctacaatgacacaatgacactggagag

SEQ ID NO: 264982 - DNA, 34 bp, Artificial Sequence
  Description of Artificial Sequence: Synthetic oligonucleotide
ggttcagctacaatgacacaatgacactggagag

SEQ ID NO: 264983 - DNA, 35 bp, Artificial Sequence
  Description of Artificial Sequence: Synthetic oligonucleotide
gttcagctacaatgacacaatgacactggagagtg

SEQ ID NO: 264984 - DNA, 36 bp, Artificial Sequence
  Description of Artificial Sequence: Synthetic oligonucleotide
ttcagctacaatgacacaatgacactggagagtgag

SEQ ID NO: 264985 - DNA, 35 bp, Artificial Sequence
  Description of Artificial Sequence: Synthetic oligonucleotide
tcagctacaatgacacaatgacactggagagtgag

SEQ ID NO: 264986 - DNA, 34 bp, Artificial Sequence
  Description of Artificial Sequence: Synthetic oligonucleotide
cagctacaatgacacaatgacactggagagtgag

SEQ ID NO: 264987 - DNA, 35 bp, Artificial Sequence
  Description of Artificial Sequence: Synthetic oligonucleotide
agctacaatgacacaatgacactggagagtgagac

SEQ ID NO: 264988 - DNA, 34 bp, Artificial Sequence
  Description of Artificial Sequence: Synthetic oligonucleotide
gctacaatgacacaatgacactggagagtgagac

SEQ ID NO: 264989 - DNA, 34 bp, Artificial Sequence
  Description of Artificial Sequence: Synthetic oligonucleotide
ctacaatgacacaatgacactggagagtgagacc

SEQ ID NO: 264990 - DNA, 34 bp, Artificial Sequence
  Description of Artificial Sequence: Synthetic oligonucleotide
tacaatgacacaatgacactggagagtgagaccc

SEQ ID NO: 264991 - DNA, 33 bp, Artificial Sequence
  Description of Artificial Sequence: Synthetic oligonucleotide
acaatgacacaatgacactggagagtgagaccc

SEQ ID NO: 264992 - DNA, 32 bp, Artificial Sequence
  Description of Artificial Sequence: Synthetic oligonucleotide
caatgacacaatgacactggagagtgagaccc

SEQ ID NO: 264993 - DNA, 34 bp, Artificial Sequence
  Description of Artificial Sequence: Synthetic oligonucleotide
aatgacacaatgacactggagagtgagacccaag

SEQ ID NO: 264994 - DNA, 33 bp, Artificial Sequence
  Description of Artificial Sequence: Synthetic oligonucleotide
atgacacaatgacactggagagtgagacccaag

SEQ ID NO: 264995 - DNA, 32 bp, Artificial Sequence
  Description of Artificial Sequence: Synthetic oligonucleotide
tgacacaatgacactggagagtgagacccaag

SEQ ID NO: 264996 - DNA, 31 bp, Artificial Sequence
  Description of Artificial Sequence: Synthetic oligonucleotide
gacacaatgacactggagagtgagacccaag

SEQ ID NO: 264997 - DNA, 31 bp, Artificial Sequence
  Description of Artificial Sequence: Synthetic oligonucleotide
acacaatgacactggagagtgagacccaagc

SEQ ID NO: 264998 - DNA, 30 bp, Artificial Sequence
  Description of Artificial Sequence: Synthetic oligonucleotide
cacaatgacactggagagtgagacccaagc

SEQ ID NO: 264999 - DNA, 31 bp, Artificial Sequence
  Description of Artificial Sequence: Synthetic oligonucleotide
acaatgacactggagagtgagacccaagcag

SEQ ID NO: 265000 - DNA, 30 bp, Artificial Sequence
  Description of Artificial Sequence: Synthetic oligonucleotide
caatgacactggagagtgagacccaagcag

SEQ ID NO: 265001 - DNA, 31 bp, Artificial Sequence
  Description of Artificial Sequence: Synthetic oligonucleotide
aatgacactggagagtgagacccaagcagtg

SEQ ID NO: 265002 - DNA, 30 bp, Artificial Sequence
  Description of Artificial Sequence: Synthetic oligonucleotide
atgacactggagagtgagacccaagcagtg

SEQ ID NO: 265003 - DNA, 29 bp, Artificial Sequence
  Description of Artificial Sequence: Synthetic oligonucleotide
tgacactggagagtgagacccaagcagtg

SEQ ID NO: 265004 - DNA, 28 bp, Artificial Sequence
  Description of Artificial Sequence: Synthetic oligonucleotide
gacactggagagtgagacccaagcagtg

SEQ ID NO: 265005 - DNA, 29 bp, Artificial Sequence
  Description of Artificial Sequence: Synthetic oligonucleotide
acactggagagtgagacccaagcagtgtc

SEQ ID NO: 265006 - DNA, 28 bp, Artificial Sequence
  Description of Artificial Sequence: Synthetic oligonucleotide
cactggagagtgagacccaagcagtgtc

SEQ ID NO: 265007 - DNA, 28 bp, Artificial Sequence
  Description of Artificial Sequence: Synthetic oligonucleotide
actggagagtgagacccaagcagtgtcc

SEQ ID NO: 265008 - DNA, 27 bp, Artificial Sequence
  Description of Artificial Sequence: Synthetic oligonucleotide
ctggagagtgagacccaagcagtgtcc

SEQ ID NO: 265009 - DNA, 30 bp, Artificial Sequence
  Description of Artificial Sequence: Synthetic oligonucleotide
tggagagtgagacccaagcagtgtccaatg

SEQ ID NO: 265010 - DNA, 29 bp, Artificial Sequence
  Description of Artificial Sequence: Synthetic oligonucleotide
ggagagtgagacccaagcagtgtccaatg

SEQ ID NO: 265011 - DNA, 30 bp, Artificial Sequence
  Description of Artificial Sequence: Synthetic oligonucleotide
gagagtgagacccaagcagtgtccaatgtg

SEQ ID NO: 265012 - DNA, 30 bp, Artificial Sequence
  Description of Artificial Sequence: Synthetic oligonucleotide
agagtgagacccaagcagtgtccaatgtgg

SEQ ID NO: 265013 - DNA, 29 bp, Artificial Sequence
  Description of Artificial Sequence: Synthetic oligonucleotide
gagtgagacccaagcagtgtccaatgtgg

SEQ ID NO: 265014 - DNA, 29 bp, Artificial Sequence
  Description of Artificial Sequence: Synthetic oligonucleotide
agtgagacccaagcagtgtccaatgtggc

SEQ ID NO: 265015 - DNA, 28 bp, Artificial Sequence
  Description of Artificial Sequence: Synthetic oligonucleotide
gtgagacccaagcagtgtccaatgtggc

SEQ ID NO: 265016 - DNA, 31 bp, Artificial Sequence
  Description of Artificial Sequence: Synthetic oligonucleotide
tgagacccaagcagtgtccaatgtggctttg

SEQ ID NO: 265017 - DNA, 30 bp, Artificial Sequence
  Description of Artificial Sequence: Synthetic oligonucleotide
gagacccaagcagtgtccaatgtggctttg

SEQ ID NO: 265018 - DNA, 30 bp, Artificial Sequence
  Description of Artificial Sequence: Synthetic oligonucleotide
agacccaagcagtgtccaatgtggctttgc

SEQ ID NO: 265019 - DNA, 29 bp, Artificial Sequence
  Description of Artificial Sequence: Synthetic oligonucleotide
gacccaagcagtgtccaatgtggctttgc

SEQ ID NO: 265020 - DNA, 30 bp, Artificial Sequence
  Description of Artificial Sequence: Synthetic oligonucleotide
acccaagcagtgtccaatgtggctttgctg

SEQ ID NO: 265021 - DNA, 29 bp, Artificial Sequence
  Description of Artificial Sequence: Synthetic oligonucleotide
cccaagcagtgtccaatgtggctttgctg

SEQ ID NO: 265022 - DNA, 32 bp, Artificial Sequence
  Description of Artificial Sequence: Synthetic oligonucleotide
ccaagcagtgtccaatgtggctttgctgtttg

SEQ ID NO: 265023 - DNA, 32 bp, Artificial Sequence
  Description of Artificial Sequence: Synthetic oligonucleotide
caagcagtgtccaatgtggctttgctgtttgg

SEQ ID NO: 265024 - DNA, 33 bp, Artificial Sequence
  Description of Artificial Sequence: Synthetic oligonucleotide
aagcagtgtccaatgtggctttgctgtttggag

SEQ ID NO: 265025 - DNA, 32 bp, Artificial Sequence
  Description of Artificial Sequence: Synthetic oligonucleotide
agcagtgtccaatgtggctttgctgtttggag

SEQ ID NO: 265026 - DNA, 31 bp, Artificial Sequence
  Description of Artificial Sequence: Synthetic oligonucleotide
gcagtgtccaatgtggctttgctgtttggag

SEQ ID NO: 265027 - DNA, 33 bp, Artificial Sequence
  Description of Artificial Sequence: Synthetic oligonucleotide
cagtgtccaatgtggctttgctgtttggagatg

SEQ ID NO: 265028 - DNA, 35 bp, Artificial Sequence
  Description of Artificial Sequence: Synthetic oligonucleotide
agtgtccaatgtggctttgctgtttggagatgaag

SEQ ID NO: 265029 - DNA, 34 bp, Artificial Sequence
  Description of Artificial Sequence: Synthetic oligonucleotide
gtgtccaatgtggctttgctgtttggagatgaag

SEQ ID NO: 265030 - DNA, 36 bp, Artificial Sequence
  Description of Artificial Sequence: Synthetic oligonucleotide
tgtccaatgtggctttgctgtttggagatgaagatg

SEQ ID NO: 265031 - DNA, 35 bp, Artificial Sequence
  Description of Artificial Sequence: Synthetic oligonucleotide
gtccaatgtggctttgctgtttggagatgaagatg

SEQ ID NO: 265032 - DNA, 35 bp, Artificial Sequence
  Description of Artificial Sequence: Synthetic oligonucleotide
tccaatgtggctttgctgtttggagatgaagatgc

SEQ ID NO: 265033 - DNA, 34 bp, Artificial Sequence
  Description of Artificial Sequence: Synthetic oligonucleotide
ccaatgtggctttgctgtttggagatgaagatgc

SEQ ID NO: 265034 - DNA, 35 bp, Artificial Sequence
  Description of Artificial Sequence: Synthetic oligonucleotide
caatgtggctttgctgtttggagatgaagatgcac

SEQ ID NO: 265035 - DNA, 37 bp, Artificial Sequence
  Description of Artificial Sequence: Synthetic oligonucleotide
aatgtggctttgctgtttggagatgaagatgcacatc

SEQ ID NO: 265036 - DNA, 36 bp, Artificial Sequence
  Description of Artificial Sequence: Synthetic oligonucleotide
atgtggctttgctgtttggagatgaagatgcacatc

SEQ ID NO: 265037 - DNA, 35 bp, Artificial Sequence
  Description of Artificial Sequence: Synthetic oligonucleotide
tgtggctttgctgtttggagatgaagatgcacatc

SEQ ID NO: 265038 - DNA, 34 bp, Artificial Sequence
  Description of Artificial Sequence: Synthetic oligonucleotide
gtggctttgctgtttggagatgaagatgcacatc

SEQ ID NO: 265039 - DNA, 34 bp, Artificial Sequence
  Description of Artificial Sequence: Synthetic oligonucleotide
tggctttgctgtttggagatgaagatgcacatcc

SEQ ID NO: 265040 - DNA, 33 bp, Artificial Sequence
  Description of Artificial Sequence: Synthetic oligonucleotide
ggctttgctgtttggagatgaagatgcacatcc

SEQ ID NO: 265041 - DNA, 34 bp, Artificial Sequence
  Description of Artificial Sequence: Synthetic oligonucleotide
gctttgctgtttggagatgaagatgcacatccag

SEQ ID NO: 265042 - DNA, 34 bp, Artificial Sequence
  Description of Artificial Sequence: Synthetic oligonucleotide
ctttgctgtttggagatgaagatgcacatccagg

SEQ ID NO: 265043 - DNA, 35 bp, Artificial Sequence
  Description of Artificial Sequence: Synthetic oligonucleotide
tttgctgtttggagatgaagatgcacatccaggtg

SEQ ID NO: 265044 - DNA, 34 bp, Artificial Sequence
  Description of Artificial Sequence: Synthetic oligonucleotide
ttgctgtttggagatgaagatgcacatccaggtg

SEQ ID NO: 265045 - DNA, 33 bp, Artificial Sequence
  Description of Artificial Sequence: Synthetic oligonucleotide
tgctgtttggagatgaagatgcacatccaggtg

SEQ ID NO: 265046 - DNA, 32 bp, Artificial Sequence
  Description of Artificial Sequence: Synthetic oligonucleotide
gctgtttggagatgaagatgcacatccaggtg

SEQ ID NO: 265047 - DNA, 32 bp, Artificial Sequence
  Description of Artificial Sequence: Synthetic oligonucleotide
ctgtttggagatgaagatgcacatccaggtgg

SEQ ID NO: 265048 - DNA, 32 bp, Artificial Sequence
  Description of Artificial Sequence: Synthetic oligonucleotide
tgtttggagatgaagatgcacatccaggtggc

SEQ ID NO: 265049 - DNA, 31 bp, Artificial Sequence
  Description of Artificial Sequence: Synthetic oligonucleotide
gtttggagatgaagatgcacatccaggtggc

SEQ ID NO: 265050 - DNA, 33 bp, Artificial Sequence
  Description of Artificial Sequence: Synthetic oligonucleotide
tttggagatgaagatgcacatccaggtggcatg

SEQ ID NO: 265051 - DNA, 32 bp, Artificial Sequence
  Description of Artificial Sequence: Synthetic oligonucleotide
ttggagatgaagatgcacatccaggtggcatg

SEQ ID NO: 265052 - DNA, 31 bp, Artificial Sequence
  Description of Artificial Sequence: Synthetic oligonucleotide
tggagatgaagatgcacatccaggtggcatg

SEQ ID NO: 265053 - DNA, 30 bp, Artificial Sequence
  Description of Artificial Sequence: Synthetic oligonucleotide
ggagatgaagatgcacatccaggtggcatg

SEQ ID NO: 265054 - DNA, 31 bp, Artificial Sequence
  Description of Artificial Sequence: Synthetic oligonucleotide
gagatgaagatgcacatccaggtggcatgtc

SEQ ID NO: 265055 - DNA, 32 bp, Artificial Sequence
  Description of Artificial Sequence: Synthetic oligonucleotide
agatgaagatgcacatccaggtggcatgtctc

SEQ ID NO: 265056 - DNA, 31 bp, Artificial Sequence
  Description of Artificial Sequence: Synthetic oligonucleotide
gatgaagatgcacatccaggtggcatgtctc

SEQ ID NO: 265057 - DNA, 31 bp, Artificial Sequence
  Description of Artificial Sequence: Synthetic oligonucleotide
atgaagatgcacatccaggtggcatgtctcg

SEQ ID NO: 265058 - DNA, 30 bp, Artificial Sequence
  Description of Artificial Sequence: Synthetic oligonucleotide
tgaagatgcacatccaggtggcatgtctcg

SEQ ID NO: 265059 - DNA, 29 bp, Artificial Sequence
  Description of Artificial Sequence: Synthetic oligonucleotide
gaagatgcacatccaggtggcatgtctcg

SEQ ID NO: 265060 - DNA, 30 bp, Artificial Sequence
  Description of Artificial Sequence: Synthetic oligonucleotide
aagatgcacatccaggtggcatgtctcgac

SEQ ID NO: 265061 - DNA, 29 bp, Artificial Sequence
  Description of Artificial Sequence: Synthetic oligonucleotide
agatgcacatccaggtggcatgtctcgac

SEQ ID NO: 265062 - DNA, 28 bp, Artificial Sequence
  Description of Artificial Sequence: Synthetic oligonucleotide
gatgcacatccaggtggcatgtctcgac

SEQ ID NO: 265063 - DNA, 28 bp, Artificial Sequence
  Description of Artificial Sequence: Synthetic oligonucleotide
atgcacatccaggtggcatgtctcgacc

SEQ ID NO: 265064 - DNA, 27 bp, Artificial Sequence
  Description of Artificial Sequence: Synthetic oligonucleotide
tgcacatccaggtggcatgtctcgacc

SEQ ID NO: 265065 - DNA, 26 bp, Artificial Sequence
  Description of Artificial Sequence: Synthetic oligonucleotide
gcacatccaggtggcatgtctcgacc

SEQ ID NO: 265066 - DNA, 27 bp, Artificial Sequence
  Description of Artificial Sequence: Synthetic oligonucleotide
cacatccaggtggcatgtctcgaccct

SEQ ID NO: 265067 - DNA, 29 bp, Artificial Sequence
  Description of Artificial Sequence: Synthetic oligonucleotide
acatccaggtggcatgtctcgaccctttg

SEQ ID NO: 265068 - DNA, 28 bp, Artificial Sequence
  Description of Artificial Sequence: Synthetic oligonucleotide
catccaggtggcatgtctcgaccctttg

SEQ ID NO: 265069 - DNA, 28 bp, Artificial Sequence
  Description of Artificial Sequence: Synthetic oligonucleotide
atccaggtggcatgtctcgaccctttgg

SEQ ID NO: 265070 - DNA, 27 bp, Artificial Sequence
  Description of Artificial Sequence: Synthetic oligonucleotide
tccaggtggcatgtctcgaccctttgg

SEQ ID NO: 265071 - DNA, 27 bp, Artificial Sequence
  Description of Artificial Sequence: Synthetic oligonucleotide
ccaggtggcatgtctcgaccctttgga

SEQ ID NO: 265072 - DNA, 27 bp, Artificial Sequence
  Description of Artificial Sequence: Synthetic oligonucleotide
caggtggcatgtctcgaccctttggac

SEQ ID NO: 265073 - DNA, 29 bp, Artificial Sequence
  Description of Artificial Sequence: Synthetic oligonucleotide
aggtggcatgtctcgaccctttggactag

SEQ ID NO: 265074 - DNA, 28 bp, Artificial Sequence
  Description of Artificial Sequence: Synthetic oligonucleotide
ggtggcatgtctcgaccctttggactag

SEQ ID NO: 265075 - DNA, 28 bp, Artificial Sequence
  Description of Artificial Sequence: Synthetic oligonucleotide
gtggcatgtctcgaccctttggactagc

SEQ ID NO: 265076 - DNA, 38 bp, Artificial Sequence
  Description of Artificial Sequence: Synthetic oligonucleotide
tggcatgtctcgaccctttggactagcattataatttg

SEQ ID NO: 265077 - DNA, 37 bp, Artificial Sequence
  Description of Artificial Sequence: Synthetic oligonucleotide
ggcatgtctcgaccctttggactagcattataatttg

SEQ ID NO: 265078 - DNA, 37 bp, Artificial Sequence
  Description of Artificial Sequence: Synthetic oligonucleotide
gcatgtctcgaccctttggactagcattataatttgg

SEQ ID NO: 265079 - DNA, 38 bp, Artificial Sequence
  Description of Artificial Sequence: Synthetic oligonucleotide
catgtctcgaccctttggactagcattataatttggag

SEQ ID NO: 265080 - DNA, 38 bp, Artificial Sequence
  Description of Artificial Sequence: Synthetic oligonucleotide
atgtctcgaccctttggactagcattataatttggagg

SEQ ID NO: 265081 - DNA, 37 bp, Artificial Sequence
  Description of Artificial Sequence: Synthetic oligonucleotide
tgtctcgaccctttggactagcattataatttggagg

SEQ ID NO: 265082 - DNA, 36 bp, Artificial Sequence
  Description of Artificial Sequence: Synthetic oligonucleotide
gtctcgaccctttggactagcattataatttggagg

SEQ ID NO: 265083 - DNA, 37 bp, Artificial Sequence
  Description of Artificial Sequence: Synthetic oligonucleotide
tctcgaccctttggactagcattataatttggaggtg

SEQ ID NO: 265084 - DNA, 36 bp, Artificial Sequence
  Description of Artificial Sequence: Synthetic oligonucleotide
ctcgaccctttggactagcattataatttggaggtg

SEQ ID NO: 265085 - DNA, 38 bp, Artificial Sequence
  Description of Artificial Sequence: Synthetic oligonucleotide
tcgaccctttggactagcattataatttggaggtgttg

SEQ ID NO: 265086 - DNA, 37 bp, Artificial Sequence
  Description of Artificial Sequence: Synthetic oligonucleotide
cgaccctttggactagcattataatttggaggtgttg

SEQ ID NO: 265087 - DNA, 39 bp, Artificial Sequence
  Description of Artificial Sequence: Synthetic oligonucleotide
gaccctttggactagcattataatttggaggtgttgatg

SEQ ID NO: 265088 - DNA, 40 bp, Artificial Sequence
  Description of Artificial Sequence: Synthetic oligonucleotide
accctttggactagcattataatttggaggtgttgatgag

SEQ ID NO: 265089 - DNA, 39 bp, Artificial Sequence
  Description of Artificial Sequence: Synthetic oligonucleotide
ccctttggactagcattataatttggaggtgttgatgag

SEQ ID NO: 265090 - DNA, 42 bp, Artificial Sequence
  Description of Artificial Sequence: Synthetic oligonucleotide
cctttggactagcattataatttggaggtgttgatgagtaag

SEQ ID NO: 265091 - DNA, 42 bp, Artificial Sequence
  Description of Artificial Sequence: Synthetic oligonucleotide
ctttggactagcattataatttggaggtgttgatgagtaagg

SEQ ID NO: 265092 - DNA, 43 bp, Artificial Sequence
  Description of Artificial Sequence: Synthetic oligonucleotide
tttggactagcattataatttggaggtgttgatgagtaaggac

SEQ ID NO: 265093 - DNA, 42 bp, Artificial Sequence
  Description of Artificial Sequence: Synthetic oligonucleotide
ttggactagcattataatttggaggtgttgatgagtaaggac

SEQ ID NO: 265094 - DNA, 41 bp, Artificial Sequence
  Description of Artificial Sequence: Synthetic oligonucleotide
tggactagcattataatttggaggtgttgatgagtaaggac

SEQ ID NO: 265095 - DNA, 40 bp, Artificial Sequence
  Description of Artificial Sequence: Synthetic oligonucleotide
ggactagcattataatttggaggtgttgatgagtaaggac

SEQ ID NO: 265096 - DNA, 40 bp, Artificial Sequence
  Description of Artificial Sequence: Synthetic oligonucleotide
gactagcattataatttggaggtgttgatgagtaaggacc

SEQ ID NO: 265097 - DNA, 40 bp, Artificial Sequence
  Description of Artificial Sequence: Synthetic oligonucleotide
actagcattataatttggaggtgttgatgagtaaggaccc

SEQ ID NO: 265098 - DNA, 39 bp, Artificial Sequence
  Description of Artificial Sequence: Synthetic oligonucleotide
ctagcattataatttggaggtgttgatgagtaaggaccc

SEQ ID NO: 265099 - DNA, 39 bp, Artificial Sequence
  Description of Artificial Sequence: Synthetic oligonucleotide
tagcattataatttggaggtgttgatgagtaaggacccc

SEQ ID NO: 265100 - DNA, 38 bp, Artificial Sequence
  Description of Artificial Sequence: Synthetic oligonucleotide
agcattataatttggaggtgttgatgagtaaggacccc

SEQ ID NO: 265101 - DNA, 37 bp, Artificial Sequence
  Description of Artificial Sequence: Synthetic oligonucleotide
gcattataatttggaggtgttgatgagtaaggacccc

SEQ ID NO: 265102 - DNA, 38 bp, Artificial Sequence
  Description of Artificial Sequence: Synthetic oligonucleotide
cattataatttggaggtgttgatgagtaaggacccctg

SEQ ID NO: 265103 - DNA, 38 bp, Artificial Sequence
  Description of Artificial Sequence: Synthetic oligonucleotide
attataatttggaggtgttgatgagtaaggacccctgc

SEQ ID NO: 265104 - DNA, 37 bp, Artificial Sequence
  Description of Artificial Sequence: Synthetic oligonucleotide
ttataatttggaggtgttgatgagtaaggacccctgc

SEQ ID NO: 265105 - DNA, 36 bp, Artificial Sequence
  Description of Artificial Sequence: Synthetic oligonucleotide
tataatttggaggtgttgatgagtaaggacccctgc

SEQ ID NO: 265106 - DNA, 35 bp, Artificial Sequence
  Description of Artificial Sequence: Synthetic oligonucleotide
ataatttggaggtgttgatgagtaaggacccctgc

SEQ ID NO: 265107 - DNA, 34 bp, Artificial Sequence
  Description of Artificial Sequence: Synthetic oligonucleotide
taatttggaggtgttgatgagtaaggacccctgc

SEQ ID NO: 265108 - DNA, 33 bp, Artificial Sequence
  Description of Artificial Sequence: Synthetic oligonucleotide
aatttggaggtgttgatgagtaaggacccctgc

SEQ ID NO: 265109 - DNA, 32 bp, Artificial Sequence
  Description of Artificial Sequence: Synthetic oligonucleotide
atttggaggtgttgatgagtaaggacccctgc

SEQ ID NO: 265110 - DNA, 31 bp, Artificial Sequence
  Description of Artificial Sequence: Synthetic oligonucleotide
tttggaggtgttgatgagtaaggacccctgc

SEQ ID NO: 265111 - DNA, 30 bp, Artificial Sequence
  Description of Artificial Sequence: Synthetic oligonucleotide
ttggaggtgttgatgagtaaggacccctgc

SEQ ID NO: 265112 - DNA, 29 bp, Artificial Sequence
  Description of Artificial Sequence: Synthetic oligonucleotide
tggaggtgttgatgagtaaggacccctgc

SEQ ID NO: 265113 - DNA, 28 bp, Artificial Sequence
  Description of Artificial Sequence: Synthetic oligonucleotide
ggaggtgttgatgagtaaggacccctgc

SEQ ID NO: 265114 - DNA, 29 bp, Artificial Sequence
  Description of Artificial Sequence: Synthetic oligonucleotide
gaggtgttgatgagtaaggacccctgctg

SEQ ID NO: 265115 - DNA, 32 bp, Artificial Sequence
  Description of Artificial Sequence: Synthetic oligonucleotide
aggtgttgatgagtaaggacccctgctgtttc

SEQ ID NO: 265116 - DNA, 31 bp, Artificial Sequence
  Description of Artificial Sequence: Synthetic oligonucleotide
ggtgttgatgagtaaggacccctgctgtttc

SEQ ID NO: 265117 - DNA, 35 bp, Artificial Sequence
  Description of Artificial Sequence: Synthetic oligonucleotide
gtgttgatgagtaaggacccctgctgtttcaaatg

SEQ ID NO: 265118 - DNA, 35 bp, Artificial Sequence
  Description of Artificial Sequence: Synthetic oligonucleotide
tgttgatgagtaaggacccctgctgtttcaaatgg

SEQ ID NO: 265119 - DNA, 34 bp, Artificial Sequence
  Description of Artificial Sequence: Synthetic oligonucleotide
gttgatgagtaaggacccctgctgtttcaaatgg

SEQ ID NO: 265120 - DNA, 35 bp, Artificial Sequence
  Description of Artificial Sequence: Synthetic oligonucleotide
ttgatgagtaaggacccctgctgtttcaaatggac

SEQ ID NO: 265121 - DNA, 34 bp, Artificial Sequence
  Description of Artificial Sequence: Synthetic oligonucleotide
tgatgagtaaggacccctgctgtttcaaatggac

SEQ ID NO: 265122 - DNA, 33 bp, Artificial Sequence
  Description of Artificial Sequence: Synthetic oligonucleotide
gatgagtaaggacccctgctgtttcaaatggac

SEQ ID NO: 265123 - DNA, 33 bp, Artificial Sequence
  Description of Artificial Sequence: Synthetic oligonucleotide
atgagtaaggacccctgctgtttcaaatggacc

SEQ ID NO: 265124 - DNA, 32 bp, Artificial Sequence
  Description of Artificial Sequence: Synthetic oligonucleotide
tgagtaaggacccctgctgtttcaaatggacc

SEQ ID NO: 265125 - DNA, 31 bp, Artificial Sequence
  Description of Artificial Sequence: Synthetic oligonucleotide
gagtaaggacccctgctgtttcaaatggacc

SEQ ID NO: 265126 - DNA, 31 bp, Artificial Sequence
  Description of Artificial Sequence: Synthetic oligonucleotide
agtaaggacccctgctgtttcaaatggaccc

SEQ ID NO: 265127 - DNA, 30 bp, Artificial Sequence
  Description of Artificial Sequence: Synthetic oligonucleotide
gtaaggacccctgctgtttcaaatggaccc

SEQ ID NO: 265128 - DNA, 32 bp, Artificial Sequence
  Description of Artificial Sequence: Synthetic oligonucleotide
taaggacccctgctgtttcaaatggacccaac

SEQ ID NO: 265129 - DNA, 31 bp, Artificial Sequence
  Description of Artificial Sequence: Synthetic oligonucleotide
aaggacccctgctgtttcaaatggacccaac

SEQ ID NO: 265130 - DNA, 30 bp, Artificial Sequence
  Description of Artificial Sequence: Synthetic oligonucleotide
aggacccctgctgtttcaaatggacccaac

SEQ ID NO: 265131 - DNA, 29 bp, Artificial Sequence
  Description of Artificial Sequence: Synthetic oligonucleotide
ggacccctgctgtttcaaatggacccaac

SEQ ID NO: 265132 - DNA, 30 bp, Artificial Sequence
  Description of Artificial Sequence: Synthetic oligonucleotide
gacccctgctgtttcaaatggacccaactg

SEQ ID NO: 265133 - DNA, 30 bp, Artificial Sequence
  Description of Artificial Sequence: Synthetic oligonucleotide
acccctgctgtttcaaatggacccaactgg

SEQ ID NO: 265134 - DNA, 29 bp, Artificial Sequence
  Description of Artificial Sequence: Synthetic oligonucleotide
cccctgctgtttcaaatggacccaactgg

SEQ ID NO: 265135 - DNA, 29 bp, Artificial Sequence
  Description of Artificial Sequence: Synthetic oligonucleotide
ccctgctgtttcaaatggacccaactggg

SEQ ID NO: 265136 - DNA, 30 bp, Artificial Sequence
  Description of Artificial Sequence: Synthetic oligonucleotide
cctgctgtttcaaatggacccaactgggac

SEQ ID NO: 265137 - DNA, 30 bp, Artificial Sequence
  Description of Artificial Sequence: Synthetic oligonucleotide
ctgctgtttcaaatggacccaactgggacc

SEQ ID NO: 265138 - DNA, 33 bp, Artificial Sequence
  Description of Artificial Sequence: Synthetic oligonucleotide
tgctgtttcaaatggacccaactgggacctatg

SEQ ID NO: 265139 - DNA, 32 bp, Artificial Sequence
  Description of Artificial Sequence: Synthetic oligonucleotide
gctgtttcaaatggacccaactgggacctatg

SEQ ID NO: 265140 - DNA, 34 bp, Artificial Sequence
  Description of Artificial Sequence: Synthetic oligonucleotide
ctgtttcaaatggacccaactgggacctatgtac

SEQ ID NO: 265141 - DNA, 35 bp, Artificial Sequence
  Description of Artificial Sequence: Synthetic oligonucleotide
tgtttcaaatggacccaactgggacctatgtacag

SEQ ID NO: 265142 - DNA, 34 bp, Artificial Sequence
  Description of Artificial Sequence: Synthetic oligonucleotide
gtttcaaatggacccaactgggacctatgtacag

SEQ ID NO: 265143 - DNA, 35 bp, Artificial Sequence
  Description of Artificial Sequence: Synthetic oligonucleotide
tttcaaatggacccaactgggacctatgtacagtg

SEQ ID NO: 265144 - DNA, 34 bp, Artificial Sequence
  Description of Artificial Sequence: Synthetic oligonucleotide
ttcaaatggacccaactgggacctatgtacagtg

SEQ ID NO: 265145 - DNA, 33 bp, Artificial Sequence
  Description of Artificial Sequence: Synthetic oligonucleotide
tcaaatggacccaactgggacctatgtacagtg

SEQ ID NO: 265146 - DNA, 32 bp, Artificial Sequence
  Description of Artificial Sequence: Synthetic oligonucleotide
caaatggacccaactgggacctatgtacagtg

SEQ ID NO: 265147 - DNA, 33 bp, Artificial Sequence
  Description of Artificial Sequence: Synthetic oligonucleotide
aaatggacccaactgggacctatgtacagtgag

SEQ ID NO: 265148 - DNA, 32 bp, Artificial Sequence
  Description of Artificial Sequence: Synthetic oligonucleotide
aatggacccaactgggacctatgtacagtgag

SEQ ID NO: 265149 - DNA, 31 bp, Artificial Sequence
  Description of Artificial Sequence: Synthetic oligonucleotide
atggacccaactgggacctatgtacagtgag

SEQ ID NO: 265150 - DNA, 30 bp, Artificial Sequence
  Description of Artificial Sequence: Synthetic oligonucleotide
tggacccaactgggacctatgtacagtgag

SEQ ID NO: 265151 - DNA, 29 bp, Artificial Sequence
  Description of Artificial Sequence: Synthetic oligonucleotide
ggacccaactgggacctatgtacagtgag

SEQ ID NO: 265152 - DNA, 31 bp, Artificial Sequence
  Description of Artificial Sequence: Synthetic oligonucleotide
gacccaactgggacctatgtacagtgagatg

SEQ ID NO: 265153 - DNA, 31 bp, Artificial Sequence
  Description of Artificial Sequence: Synthetic oligonucleotide
acccaactgggacctatgtacagtgagatgc

SEQ ID NO: 265154 - DNA, 30 bp, Artificial Sequence
  Description of Artificial Sequence: Synthetic oligonucleotide
cccaactgggacctatgtacagtgagatgc

SEQ ID NO: 265155 - DNA, 31 bp, Artificial Sequence
  Description of Artificial Sequence: Synthetic oligonucleotide
ccaactgggacctatgtacagtgagatgctc

SEQ ID NO: 265156 - DNA, 31 bp, Artificial Sequence
  Description of Artificial Sequence: Synthetic oligonucleotide
caactgggacctatgtacagtgagatgctcg

SEQ ID NO: 265157 - DNA, 32 bp, Artificial Sequence
  Description of Artificial Sequence: Synthetic oligonucleotide
aactgggacctatgtacagtgagatgctcgac

SEQ ID NO: 265158 - DNA, 31 bp, Artificial Sequence
  Description of Artificial Sequence: Synthetic oligonucleotide
actgggacctatgtacagtgagatgctcgac

SEQ ID NO: 265159 - DNA, 30 bp, Artificial Sequence
  Description of Artificial Sequence: Synthetic oligonucleotide
ctgggacctatgtacagtgagatgctcgac

SEQ ID NO: 265160 - DNA, 30 bp, Artificial Sequence
  Description of Artificial Sequence: Synthetic oligonucleotide
tgggacctatgtacagtgagatgctcgacc

SEQ ID NO: 265161 - DNA, 29 bp, Artificial Sequence
  Description of Artificial Sequence: Synthetic oligonucleotide
gggacctatgtacagtgagatgctcgacc

SEQ ID NO: 265162 - DNA, 33 bp, Artificial Sequence
  Description of Artificial Sequence: Synthetic oligonucleotide
ggacctatgtacagtgagatgctcgaccaattg

SEQ ID NO: 265163 - DNA, 33 bp, Artificial Sequence
  Description of Artificial Sequence: Synthetic oligonucleotide
gacctatgtacagtgagatgctcgaccaattgg

SEQ ID NO: 265164 - DNA, 33 bp, Artificial Sequence
  Description of Artificial Sequence: Synthetic oligonucleotide
acctatgtacagtgagatgctcgaccaattggc

SEQ ID NO: 265165 - DNA, 32 bp, Artificial Sequence
  Description of Artificial Sequence: Synthetic oligonucleotide
cctatgtacagtgagatgctcgaccaattggc

SEQ ID NO: 265166 - DNA, 33 bp, Artificial Sequence
  Description of Artificial Sequence: Synthetic oligonucleotide
ctatgtacagtgagatgctcgaccaattggctg

SEQ ID NO: 265167 - DNA, 34 bp, Artificial Sequence
  Description of Artificial Sequence: Synthetic oligonucleotide
tatgtacagtgagatgctcgaccaattggctgtg

SEQ ID NO: 265168 - DNA, 33 bp, Artificial Sequence
  Description of Artificial Sequence: Synthetic oligonucleotide
atgtacagtgagatgctcgaccaattggctgtg

SEQ ID NO: 265169 - DNA, 32 bp, Artificial Sequence
  Description of Artificial Sequence: Synthetic oligonucleotide
tgtacagtgagatgctcgaccaattggctgtg

SEQ ID NO: 265170 - DNA, 31 bp, Artificial Sequence
  Description of Artificial Sequence: Synthetic oligonucleotide
gtacagtgagatgctcgaccaattggctgtg

SEQ ID NO: 265171 - DNA, 31 bp, Artificial Sequence
  Description of Artificial Sequence: Synthetic oligonucleotide
tacagtgagatgctcgaccaattggctgtgc

SEQ ID NO: 265172 - DNA, 30 bp, Artificial Sequence
  Description of Artificial Sequence: Synthetic oligonucleotide
acagtgagatgctcgaccaattggctgtgc

SEQ ID NO: 265173 - DNA, 29 bp, Artificial Sequence
  Description of Artificial Sequence: Synthetic oligonucleotide
cagtgagatgctcgaccaattggctgtgc

SEQ ID NO: 265174 - DNA, 31 bp, Artificial Sequence
  Description of Artificial Sequence: Synthetic oligonucleotide
agtgagatgctcgaccaattggctgtgcttc

SEQ ID NO: 265175 - DNA, 30 bp, Artificial Sequence
  Description of Artificial Sequence: Synthetic oligonucleotide
gtgagatgctcgaccaattggctgtgcttc

SEQ ID NO: 265176 - DNA, 31 bp, Artificial Sequence
  Description of Artificial Sequence: Synthetic oligonucleotide
tgagatgctcgaccaattggctgtgcttcag

SEQ ID NO: 265177 - DNA, 30 bp, Artificial Sequence
  Description of Artificial Sequence: Synthetic oligonucleotide
gagatgctcgaccaattggctgtgcttcag

SEQ ID NO: 265178 - DNA, 31 bp, Artificial Sequence
  Description of Artificial Sequence: Synthetic oligonucleotide
agatgctcgaccaattggctgtgcttcagac

SEQ ID NO: 265179 - DNA, 30 bp, Artificial Sequence
  Description of Artificial Sequence: Synthetic oligonucleotide
gatgctcgaccaattggctgtgcttcagac

SEQ ID NO: 265180 - DNA, 30 bp, Artificial Sequence
  Description of Artificial Sequence: Synthetic oligonucleotide
atgctcgaccaattggctgtgcttcagacg

SEQ ID NO: 265181 - DNA, 29 bp, Artificial Sequence
  Description of Artificial Sequence: Synthetic oligonucleotide
tgctcgaccaattggctgtgcttcagacg

SEQ ID NO: 265182 - DNA, 28 bp, Artificial Sequence
  Description of Artificial Sequence: Synthetic oligonucleotide
gctcgaccaattggctgtgcttcagacg

SEQ ID NO: 265183 - DNA, 28 bp, Artificial Sequence
  Description of Artificial Sequence: Synthetic oligonucleotide
ctcgaccaattggctgtgcttcagacgg

SEQ ID NO: 265184 - DNA, 29 bp, Artificial Sequence
  Description of Artificial Sequence: Synthetic oligonucleotide
tcgaccaattggctgtgcttcagacggtg

SEQ ID NO: 265185 - DNA, 28 bp, Artificial Sequence
  Description of Artificial Sequence: Synthetic oligonucleotide
cgaccaattggctgtgcttcagacggtg

SEQ ID NO: 265186 - DNA, 28 bp, Artificial Sequence
  Description of Artificial Sequence: Synthetic oligonucleotide
gaccaattggctgtgcttcagacggtgc

SEQ ID NO: 265187 - DNA, 28 bp, Artificial Sequence
  Description of Artificial Sequence: Synthetic oligonucleotide
accaattggctgtgcttcagacggtgcc

SEQ ID NO: 265188 - DNA, 27 bp, Artificial Sequence
  Description of Artificial Sequence: Synthetic oligonucleotide
ccaattggctgtgcttcagacggtgcc

SEQ ID NO: 265189 - DNA, 27 bp, Artificial Sequence
  Description of Artificial Sequence: Synthetic oligonucleotide
caattggctgtgcttcagacggtgccc

SEQ ID NO: 265190 - DNA, 28 bp, Artificial Sequence
  Description of Artificial Sequence: Synthetic oligonucleotide
aattggctgtgcttcagacggtgcccag

SEQ ID NO: 265191 - DNA, 27 bp, Artificial Sequence
  Description of Artificial Sequence: Synthetic oligonucleotide
attggctgtgcttcagacggtgcccag

SEQ ID NO: 265192 - DNA, 27 bp, Artificial Sequence
  Description of Artificial Sequence: Synthetic oligonucleotide
ttggctgtgcttcagacggtgcccagt

SEQ ID NO: 265193 - DNA, 26 bp, Artificial Sequence
  Description of Artificial Sequence: Synthetic oligonucleotide
tggctgtgcttcagacggtgcccagt

SEQ ID NO: 265194 - DNA, 25 bp, Artificial Sequence
  Description of Artificial Sequence: Synthetic oligonucleotide
ggctgtgcttcagacggtgcccagt

SEQ ID NO: 265195 - DNA, 25 bp, Artificial Sequence
  Description of Artificial Sequence: Synthetic oligonucleotide
gctgtgcttcagacggtgcccagtg

SEQ ID NO: 265196 - DNA, 26 bp, Artificial Sequence
  Description of Artificial Sequence: Synthetic oligonucleotide
ctgtgcttcagacggtgcccagtgct

SEQ ID NO: 265197 - DNA, 26 bp, Artificial Sequence
  Description of Artificial Sequence: Synthetic oligonucleotide
tgtgcttcagacggtgcccagtgctc

SEQ ID NO: 265198 - DNA, 25 bp, Artificial Sequence
  Description of Artificial Sequence: Synthetic oligonucleotide
gtgcttcagacggtgcccagtgctc

SEQ ID NO: 265199 - DNA, 27 bp, Artificial Sequence
  Description of Artificial Sequence: Synthetic oligonucleotide
tgcttcagacggtgcccagtgctcctt

SEQ ID NO: 265200 - DNA, 26 bp, Artificial Sequence
  Description of Artificial Sequence: Synthetic oligonucleotide
gcttcagacggtgcccagtgctcctt

SEQ ID NO: 265201 - DNA, 26 bp, Artificial Sequence
  Description of Artificial Sequence: Synthetic oligonucleotide
cttcagacggtgcccagtgctccttg

SEQ ID NO: 265202 - DNA, 27 bp, Artificial Sequence
  Description of Artificial Sequence: Synthetic oligonucleotide
ttcagacggtgcccagtgctccttgct

SEQ ID NO: 265203 - DNA, 27 bp, Artificial Sequence
  Description of Artificial Sequence: Synthetic oligonucleotide
tcagacggtgcccagtgctccttgcta

SEQ ID NO: 265204 - DNA, 26 bp, Artificial Sequence
  Description of Artificial Sequence: Synthetic oligonucleotide
cagacggtgcccagtgctccttgcta

SEQ ID NO: 265205 - DNA, 27 bp, Artificial Sequence
  Description of Artificial Sequence: Synthetic oligonucleotide
agacggtgcccagtgctccttgctaga

SEQ ID NO: 265206 - DNA, 27 bp, Artificial Sequence
  Description of Artificial Sequence: Synthetic oligonucleotide
gacggtgcccagtgctccttgctagaa

SEQ ID NO: 265207 - DNA, 27 bp, Artificial Sequence
  Description of Artificial Sequence: Synthetic oligonucleotide
acggtgcccagtgctccttgctagaag

SEQ ID NO: 265208 - DNA, 27 bp, Artificial Sequence
  Description of Artificial Sequence: Synthetic oligonucleotide
cggtgcccagtgctccttgctagaagt

SEQ ID NO: 265209 - DNA, 30 bp, Artificial Sequence
  Description of Artificial Sequence: Synthetic oligonucleotide
ggtgcccagtgctccttgctagaagtttag

SEQ ID NO: 265210 - DNA, 30 bp, Artificial Sequence
  Description of Artificial Sequence: Synthetic oligonucleotide
gtgcccagtgctccttgctagaagtttagc

SEQ ID NO: 265211 - DNA, 31 bp, Artificial Sequence
  Description of Artificial Sequence: Synthetic oligonucleotide
tgcccagtgctccttgctagaagtttagcac

SEQ ID NO: 265212 - DNA, 30 bp, Artificial Sequence
  Description of Artificial Sequence: Synthetic oligonucleotide
gcccagtgctccttgctagaagtttagcac

SEQ ID NO: 265213 - DNA, 32 bp, Artificial Sequence
  Description of Artificial Sequence: Synthetic oligonucleotide
cccagtgctccttgctagaagtttagcacaag

SEQ ID NO: 265214 - DNA, 33 bp, Artificial Sequence
  Description of Artificial Sequence: Synthetic oligonucleotide
ccagtgctccttgctagaagtttagcacaagtc

SEQ ID NO: 265215 - DNA, 36 bp, Artificial Sequence
  Description of Artificial Sequence: Synthetic oligonucleotide
cagtgctccttgctagaagtttagcacaagtctttg

SEQ ID NO: 265216 - DNA, 37 bp, Artificial Sequence
  Description of Artificial Sequence: Synthetic oligonucleotide
agtgctccttgctagaagtttagcacaagtctttgac

SEQ ID NO: 265217 - DNA, 36 bp, Artificial Sequence
  Description of Artificial Sequence: Synthetic oligonucleotide
gtgctccttgctagaagtttagcacaagtctttgac

SEQ ID NO: 265218 - DNA, 39 bp, Artificial Sequence
  Description of Artificial Sequence: Synthetic oligonucleotide
tgctccttgctagaagtttagcacaagtctttgactttg

SEQ ID NO: 265219 - DNA, 38 bp, Artificial Sequence
  Description of Artificial Sequence: Synthetic oligonucleotide
gctccttgctagaagtttagcacaagtctttgactttg

SEQ ID NO: 265220 - DNA, 41 bp, Artificial Sequence
  Description of Artificial Sequence: Synthetic oligonucleotide
ctccttgctagaagtttagcacaagtctttgactttgatag

SEQ ID NO: 265221 - DNA, 43 bp, Artificial Sequence
  Description of Artificial Sequence: Synthetic oligonucleotide
tccttgctagaagtttagcacaagtctttgactttgatagaag

SEQ ID NO: 265222 - DNA, 42 bp, Artificial Sequence
  Description of Artificial Sequence: Synthetic oligonucleotide
ccttgctagaagtttagcacaagtctttgactttgatagaag

SEQ ID NO: 265223 - DNA, 42 bp, Artificial Sequence
  Description of Artificial Sequence: Synthetic oligonucleotide
cttgctagaagtttagcacaagtctttgactttgatagaagc

SEQ ID NO: 265224 - DNA, 42 bp, Artificial Sequence
  Description of Artificial Sequence: Synthetic oligonucleotide
ttgctagaagtttagcacaagtctttgactttgatagaagcc

SEQ ID NO: 265225 - DNA, 41 bp, Artificial Sequence
  Description of Artificial Sequence: Synthetic oligonucleotide
tgctagaagtttagcacaagtctttgactttgatagaagcc

SEQ ID NO: 265226 - DNA, 40 bp, Artificial Sequence
  Description of Artificial Sequence: Synthetic oligonucleotide
gctagaagtttagcacaagtctttgactttgatagaagcc

SEQ ID NO: 265227 - DNA, 42 bp, Artificial Sequence
  Description of Artificial Sequence: Synthetic oligonucleotide
ctagaagtttagcacaagtctttgactttgatagaagccatg

SEQ ID NO: 265228 - DNA, 44 bp, Artificial Sequence
  Description of Artificial Sequence: Synthetic oligonucleotide
tagaagtttagcacaagtctttgactttgatagaagccatgaag

SEQ ID NO: 265229 - DNA, 43 bp, Artificial Sequence
  Description of Artificial Sequence: Synthetic oligonucleotide
agaagtttagcacaagtctttgactttgatagaagccatgaag

SEQ ID NO: 265230 - DNA, 42 bp, Artificial Sequence
  Description of Artificial Sequence: Synthetic oligonucleotide
gaagtttagcacaagtctttgactttgatagaagccatgaag

SEQ ID NO: 265231 - DNA, 43 bp, Artificial Sequence
  Description of Artificial Sequence: Synthetic oligonucleotide
aagtttagcacaagtctttgactttgatagaagccatgaagtc

SEQ ID NO: 265232 - DNA, 42 bp, Artificial Sequence
  Description of Artificial Sequence: Synthetic oligonucleotide
agtttagcacaagtctttgactttgatagaagccatgaagtc

SEQ ID NO: 265233 - DNA, 41 bp, Artificial Sequence
  Description of Artificial Sequence: Synthetic oligonucleotide
gtttagcacaagtctttgactttgatagaagccatgaagtc

SEQ ID NO: 265234 - DNA, 43 bp, Artificial Sequence
  Description of Artificial Sequence: Synthetic oligonucleotide
tttagcacaagtctttgactttgatagaagccatgaagtcttc

SEQ ID NO: 265235 - DNA, 42 bp, Artificial Sequence
  Description of Artificial Sequence: Synthetic oligonucleotide
ttagcacaagtctttgactttgatagaagccatgaagtcttc

SEQ ID NO: 265236 - DNA, 41 bp, Artificial Sequence
  Description of Artificial Sequence: Synthetic oligonucleotide
tagcacaagtctttgactttgatagaagccatgaagtcttc

SEQ ID NO: 265237 - DNA, 40 bp, Artificial Sequence
  Description of Artificial Sequence: Synthetic oligonucleotide
agcacaagtctttgactttgatagaagccatgaagtcttc

SEQ ID NO: 265238 - DNA, 39 bp, Artificial Sequence
  Description of Artificial Sequence: Synthetic oligonucleotide
gcacaagtctttgactttgatagaagccatgaagtcttc

SEQ ID NO: 265239 - DNA, 40 bp, Artificial Sequence
  Description of Artificial Sequence: Synthetic oligonucleotide
cacaagtctttgactttgatagaagccatgaagtcttcag

SEQ ID NO: 265240 - DNA, 41 bp, Artificial Sequence
  Description of Artificial Sequence: Synthetic oligonucleotide
acaagtctttgactttgatagaagccatgaagtcttcagtc

SEQ ID NO: 265241 - DNA, 40 bp, Artificial Sequence
  Description of Artificial Sequence: Synthetic oligonucleotide
caagtctttgactttgatagaagccatgaagtcttcagtc

SEQ ID NO: 265242 - DNA, 42 bp, Artificial Sequence
  Description of Artificial Sequence: Synthetic oligonucleotide
aagtctttgactttgatagaagccatgaagtcttcagtcatc

SEQ ID NO: 265243 - DNA, 41 bp, Artificial Sequence
  Description of Artificial Sequence: Synthetic oligonucleotide
agtctttgactttgatagaagccatgaagtcttcagtcatc

SEQ ID NO: 265244 - DNA, 40 bp, Artificial Sequence
  Description of Artificial Sequence: Synthetic oligonucleotide
gtctttgactttgatagaagccatgaagtcttcagtcatc

SEQ ID NO: 265245 - DNA, 42 bp, Artificial Sequence
  Description of Artificial Sequence: Synthetic oligonucleotide
tctttgactttgatagaagccatgaagtcttcagtcatcatc

SEQ ID NO: 265246 - DNA, 41 bp, Artificial Sequence
  Description of Artificial Sequence: Synthetic oligonucleotide
ctttgactttgatagaagccatgaagtcttcagtcatcatc

SEQ ID NO: 265247 - DNA, 41 bp, Artificial Sequence
  Description of Artificial Sequence: Synthetic oligonucleotide
tttgactttgatagaagccatgaagtcttcagtcatcatcc

SEQ ID NO: 265248 - DNA, 40 bp, Artificial Sequence
  Description of Artificial Sequence: Synthetic oligonucleotide
ttgactttgatagaagccatgaagtcttcagtcatcatcc

SEQ ID NO: 265249 - DNA, 39 bp, Artificial Sequence
  Description of Artificial Sequence: Synthetic oligonucleotide
tgactttgatagaagccatgaagtcttcagtcatcatcc

SEQ ID NO: 265250 - DNA, 38 bp, Artificial Sequence
  Description of Artificial Sequence: Synthetic oligonucleotide
gactttgatagaagccatgaagtcttcagtcatcatcc

SEQ ID NO: 265251 - DNA, 39 bp, Artificial Sequence
  Description of Artificial Sequence: Synthetic oligonucleotide
actttgatagaagccatgaagtcttcagtcatcatccac

SEQ ID NO: 265252 - DNA, 38 bp, Artificial Sequence
  Description of Artificial Sequence: Synthetic oligonucleotide
ctttgatagaagccatgaagtcttcagtcatcatccac

SEQ ID NO: 265253 - DNA, 41 bp, Artificial Sequence
  Description of Artificial Sequence: Synthetic oligonucleotide
tttgatagaagccatgaagtcttcagtcatcatccacaaac

SEQ ID NO: 265254 - DNA, 40 bp, Artificial Sequence
  Description of Artificial Sequence: Synthetic oligonucleotide
ttgatagaagccatgaagtcttcagtcatcatccacaaac

SEQ ID NO: 265255 - DNA, 39 bp, Artificial Sequence
  Description of Artificial Sequence: Synthetic oligonucleotide
tgatagaagccatgaagtcttcagtcatcatccacaaac

SEQ ID NO: 265256 - DNA, 38 bp, Artificial Sequence
  Description of Artificial Sequence: Synthetic oligonucleotide
gatagaagccatgaagtcttcagtcatcatccacaaac

SEQ ID NO: 265257 - DNA, 40 bp, Artificial Sequence
  Description of Artificial Sequence: Synthetic oligonucleotide
atagaagccatgaagtcttcagtcatcatccacaaacaag

SEQ ID NO: 265258 - DNA, 39 bp, Artificial Sequence
  Description of Artificial Sequence: Synthetic oligonucleotide
tagaagccatgaagtcttcagtcatcatccacaaacaag

SEQ ID NO: 265259 - DNA, 38 bp, Artificial Sequence
  Description of Artificial Sequence: Synthetic oligonucleotide
agaagccatgaagtcttcagtcatcatccacaaacaag

SEQ ID NO: 265260 - DNA, 37 bp, Artificial Sequence
  Description of Artificial Sequence: Synthetic oligonucleotide
gaagccatgaagtcttcagtcatcatccacaaacaag

SEQ ID NO: 265261 - DNA, 41 bp, Artificial Sequence
  Description of Artificial Sequence: Synthetic oligonucleotide
aagccatgaagtcttcagtcatcatccacaaacaagttatg
